United States Patent 7,250,496 (BIOINFORMATICALLY DETECTABLE GROUP OF NOVEL REGULATORY GENES AND USES THEREOF) - sequence listing, part 12

SEQ ID NO: 468698 - RNA, 18 nt, Human
cggacaaggugaccuuaa

SEQ ID NO: 468699 - RNA, 18 nt, Human
cggccccuccccuuaucc

SEQ ID NO: 468700 - RNA, 24 nt, Human
cgggacaacguggaccccugcugg

SEQ ID NO: 468701 - RNA, 24 nt, Human
cgucccgcagcugcaggcggaggc

SEQ ID NO: 468702 - RNA, 23 nt, Human
cguugagaccuugaagacuaucc

SEQ ID NO: 468703 - RNA, 21 nt, Human
cucaagcuccagcucauucuc

SEQ ID NO: 468704 - RNA, 20 nt, Human
cucaucauccagguccugcu

SEQ ID NO: 468705 - RNA, 18 nt, Human
cuccagcugggccucccc

SEQ ID NO: 468706 - RNA, 21 nt, Human
cuccaggcaccccagcugugc

SEQ ID NO: 468707 - RNA, 18 nt, Human
cuccaguagcgcccucug

SEQ ID NO: 468708 - RNA, 19 nt, Human
cuccccaggcuccaguucc

SEQ ID NO: 468709 - RNA, 21 nt, Human
cuccccaggcuccaguuccug

SEQ ID NO: 468710 - RNA, 23 nt, Human
cuccgccagagauggcccucucc

SEQ ID NO: 468711 - RNA, 25 nt, Human
cuccuccccaccucaucccggcuca

SEQ ID NO: 468712 - RNA, 18 nt, Human
cuccucugaccaggcucc

SEQ ID NO: 468713 - RNA, 21 nt, Human
cucuggcucagcagggagggg

SEQ ID NO: 468714 - RNA, 19 nt, Human
cuggcucagcagggagggg

SEQ ID NO: 468715 - RNA, 20 nt, Human
cugugguacccucucccagc

SEQ ID NO: 468716 - RNA, 20 nt, Human
cuuggucccggcgcggguug

SEQ ID NO: 468717 - RNA, 23 nt, Human
gaacccaucuuugguagaacugg

SEQ ID NO: 468718 - RNA, 23 nt, Human
gaagguaggguuaaaccccgccg

SEQ ID NO: 468719 - RNA, 18 nt, Human
gaucauacuccccugugg

SEQ ID NO: 468720 - RNA, 21 nt, Human
gauccauguccuccuccccac

SEQ ID NO: 468721 - RNA, 18 nt, Human
gcagccccaggcgcagcg

SEQ ID NO: 468722 - RNA, 22 nt, Human
gccccaaaguccuccucugacc

SEQ ID NO: 468723 - RNA, 23 nt, Human
gccccaaaguccuccucugacca

SEQ ID NO: 468724 - RNA, 22 nt, Human
gccgggacaacguggaccccug

SEQ ID NO: 468725 - RNA, 22 nt, Human
gcucaccgacgucucgcccucc

SEQ ID NO: 468726 - RNA, 25 nt, Human
ggaaccaaaugccuuggccaacgcc

SEQ ID NO: 468727 - RNA, 19 nt, Human
ggaaccuucucuggccccc

SEQ ID NO: 468728 - RNA, 19 nt, Human
ggaccaggcugcccagcag

SEQ ID NO: 468729 - RNA, 22 nt, Human
ggccagggcuucucuggcucag

SEQ ID NO: 468730 - RNA, 23 nt, Human
ggcuucucuggcucagcagggag

SEQ ID NO: 468731 - RNA, 18 nt, Human
gggaagagcuccacgaag

SEQ ID NO: 468732 - RNA, 18 nt, Human
gggcaccgagcggggggg

SEQ ID NO: 468733 - RNA, 23 nt, Human
ggggguagcauuggagggggcag

SEQ ID NO: 468734 - RNA, 21 nt, Human
ggguccaugcggagucacugc

SEQ ID NO: 468735 - RNA, 18 nt, Human
gucucgcccuccugcccc

SEQ ID NO: 468736 - RNA, 19 nt, Human
gugagccgggacaacgugg

SEQ ID NO: 468737 - RNA, 21 nt, Human
uaagggcgaaggggcgagcca

SEQ ID NO: 468738 - RNA, 20 nt, Human
uacuucaggucaagcuccac

SEQ ID NO: 468739 - RNA, 27 nt, Human
uagcauuggagggggcaggggagugcu

SEQ ID NO: 468740 - RNA, 23 nt, Human
uaucccggagccccgcgccgggg

SEQ ID NO: 468741 - RNA, 21 nt, Human
ucagcugcucguuccauucgg

SEQ ID NO: 468742 - RNA, 19 nt, Human
ucauccagguccugcucca

SEQ ID NO: 468743 - RNA, 20 nt, Human
uccauguccuccuccccacc

SEQ ID NO: 468744 - RNA, 25 nt, Human
uccauguccuccuccccaccucauc

SEQ ID NO: 468745 - RNA, 22 nt, Human
uccauucgggcgccgccgccuc

SEQ ID NO: 468746 - RNA, 19 nt, Human
uccccaccucaucccggcu

SEQ ID NO: 468747 - RNA, 25 nt, Human
uccccaccucaucccggcucacuuc

SEQ ID NO: 468748 - RNA, 20 nt, Human
uccccaggcuccaguuccug

SEQ ID NO: 468749 - RNA, 25 nt, Human
uccccaggcuccaguuccuggaagc

SEQ ID NO: 468750 - RNA, 21 nt, Human
uccccgcgcgcccucacggac

SEQ ID NO: 468751 - RNA, 24 nt, Human
uccucagggaaccuucucuggccc

SEQ ID NO: 468752 - RNA, 21 nt, Human
uccuggaagcccacauugggg

SEQ ID NO: 468753 - RNA, 22 nt, Human
ucguuccauucgggcgccgccg

SEQ ID NO: 468754 - RNA, 20 nt, Human
ucucgcccuccugccccagg

SEQ ID NO: 468755 - RNA, 21 nt, Human
ucucgcccuccugccccagga

SEQ ID NO: 468756 - RNA, 21 nt, Human
ucuggcucagcagggaggggc

SEQ ID NO: 468757 - RNA, 18 nt, Human
ugagccgggacaacgugg

SEQ ID NO: 468758 - RNA, 22 nt, Human
ugcauggacacagccagcagaa

SEQ ID NO: 468759 - RNA, 19 nt, Human
ugccaagaguucagccucc

SEQ ID NO: 468760 - RNA, 23 nt, Human
ugccccaggaaagacacccgcac

SEQ ID NO: 468761 - RNA, 21 nt, Human
ugcccuggggccggggguagc

SEQ ID NO: 468762 - RNA, 21 nt, Human
ugcuccagcucaagcuccagc

SEQ ID NO: 468763 - RNA, 19 nt, Human
uggaacauucucuccuccc

SEQ ID NO: 468764 - RNA, 19 nt, Human
uggacuuuugcauaugccu

SEQ ID NO: 468765 - RNA, 20 nt, Human
uggccagggcuucucuggcu

SEQ ID NO: 468766 - RNA, 27 nt, Human
uggcccccaaguagaucauacuccuuu

SEQ ID NO: 468767 - RNA, 19 nt, Human
uggccuagacuucgagcua

SEQ ID NO: 468768 - RNA, 21 nt, Human
uggccucucggcgggcacccc

SEQ ID NO: 468769 - RNA, 19 nt, Human
uggggaugauuaacucgaa

SEQ ID NO: 468770 - RNA, 21 nt, Human
uguauagggguccaugcggag

SEQ ID NO: 468771 - RNA, 19 nt, Human
uguccgaacagugcccugg

SEQ ID NO: 468772 - RNA, 21 nt, Human
uguccgaacagugcccugggg

SEQ ID NO: 468773 - RNA, 19 nt, Human
uuggucccggcgcgggugu

SEQ ID NO: 468774 - RNA, 31 nt, Human
uuuccagcuccaucucacuccaggcaccccc

SEQ ID NO: 468775 - RNA, 21 nt, Human
uuuuuuuuuuuuuuuuucggg

SEQ ID NO: 468776 - RNA, 22 nt, Human
uuuuuuuuuuuuuuuuucgggu

SEQ ID NO: 468777 - RNA, 22 nt, Human
aaugacacuccacucugccccu

SEQ ID NO: 468778 - RNA, 19 nt, Human
acacacccacugguggcua

SEQ ID NO: 468779 - RNA, 18 nt, Human
accaaggcccgucaauag

SEQ ID NO: 468780 - RNA, 20 nt, Human
acccccacagccacugcccc

SEQ ID NO: 468781 - RNA, 19 nt, Human
acuccacucugccccuccc

SEQ ID NO: 468782 - RNA, 20 nt, Human
agcaaccacccaugagccuc

SEQ ID NO: 468783 - RNA, 21 nt, Human
agcaaccacccaugagccucc

SEQ ID NO: 468784 - RNA, 25 nt, Human
agcgcccaccaacuccgcuugcggc

SEQ ID NO: 468785 - RNA, 24 nt, Human
cacagaguagccaagcacuacaaa

SEQ ID NO: 468786 - RNA, 26 nt, Human
caccaagauucuguucuucauucagc

SEQ ID NO: 468787 - RNA, 21 nt, Human
cacggcaguucauacugggac

SEQ ID NO: 468788 - RNA, 18 nt, Human
cagcagccagacaggcug

SEQ ID NO: 468789 - RNA, 19 nt, Human
cagcaggccauuguuggga

SEQ ID NO: 468790 - RNA, 20 nt, Human
cauacugggaccucagacca

SEQ ID NO: 468791 - RNA, 23 nt, Human
cauccacucacccaggccuggug

SEQ ID NO: 468792 - RNA, 20 nt, Human
ccacccaugagccuccugcu

SEQ ID NO: 468793 - RNA, 22 nt, Human
ccacgaagggcugcuaggcagc

SEQ ID NO: 468794 - RNA, 27 nt, Human
cccacagccacugccccacacacccac

SEQ ID NO: 468795 - RNA, 24 nt, Human
cccacugguggcuaccaaggcccg

SEQ ID NO: 468796 - RNA, 27 nt, Human
ccccacagccacugccccacacaccca

SEQ ID NO: 468797 - RNA, 19 nt, Human
ccccucccucccuccuucc

SEQ ID NO: 468798 - RNA, 19 nt, Human
ccccucccucccuccuucc

SEQ ID NO: 468799 - RNA, 21 nt, Human
ccucagaccacugaaggcaga

SEQ ID NO: 468800 - RNA, 26 nt, Human
ccuccaugacccugggggguugcugg

SEQ ID NO: 468801 - RNA, 18 nt, Human
ccucccucccuccuuccu

SEQ ID NO: 468802 - RNA, 23 nt, Human
ccuccugccaucacagaguagcc

SEQ ID NO: 468803 - RNA, 23 nt, Human
ccugccaucacagaguagccaag

SEQ ID NO: 468804 - RNA, 25 nt, Human
ccuuccuugcucaggguccauguga

SEQ ID NO: 468805 - RNA, 19 nt, Human
cuccaugacccuggggggu

SEQ ID NO: 468806 - RNA, 23 nt, Human
cuccaugacccugggggguugcu

SEQ ID NO: 468807 - RNA, 23 nt, Human
cuccugcuuuauuccaaucgcau

SEQ ID NO: 468808 - RNA, 21 nt, Human
cucugccccucccucccuccu

SEQ ID NO: 468809 - RNA, 20 nt, Human
cugccccacacacccacugg

SEQ ID NO: 468810 - RNA, 19 nt, Human
cugcuuuauuccaaucgca

SEQ ID NO: 468811 - RNA, 24 nt, Human
cuggucccccaucuugguucuuga

SEQ ID NO: 468812 - RNA, 21 nt, Human
cugguguccagguccagcagc

SEQ ID NO: 468813 - RNA, 19 nt, Human
gaacagcaggccauuguug

SEQ ID NO: 468814 - RNA, 21 nt, Human
gaguggccacgaagggcugcu

SEQ ID NO: 468815 - RNA, 18 nt, Human
gcauccacucacccaggc

SEQ ID NO: 468816 - RNA, 22 nt, Human
gccugaaaaccucucucccuuc

SEQ ID NO: 468817 - RNA, 22 nt, Human
ggaggugugugugccugcccca

SEQ ID NO: 468818 - RNA, 20 nt, Human
gguccagcagccagacaggc

SEQ ID NO: 468819 - RNA, 18 nt, Human
uacaggugucaagguugg

SEQ ID NO: 468820 - RNA, 20 nt, Human
uccuggguccuccaugaccc

SEQ ID NO: 468821 - RNA, 21 nt, Human
ugaacagcaggccauuguugg

SEQ ID NO: 468822 - RNA, 21 nt, Human
ugacccugggggguugcuggu

SEQ ID NO: 468823 - RNA, 22 nt, Human
ugagaggaaugcuggaaugaca

SEQ ID NO: 468824 - RNA, 24 nt, Human
ugaguaaagaguggccacgaaggg

SEQ ID NO: 468825 - RNA, 20 nt, Human
ugcagucauucuuacacccc

SEQ ID NO: 468826 - RNA, 22 nt, Human
ugccccacagauggcuguggug

SEQ ID NO: 468827 - RNA, 20 nt, Human
uggaggguccuggguccucc

SEQ ID NO: 468828 - RNA, 18 nt, Human
uggccagauuccugacgg

SEQ ID NO: 468829 - RNA, 22 nt, Human
uggguccuccaugacccugggg

SEQ ID NO: 468830 - RNA, 20 nt, Human
ugugaacagcaggccauugu

SEQ ID NO: 468831 - RNA, 21 nt, Human
uguugcagucauucuuacacc

SEQ ID NO: 468832 - RNA, 19 nt, Human
uuacagggcagauccuguc

SEQ ID NO: 468833 - RNA, 21 nt, Human
uuacaggugucaagguuggag

SEQ ID NO: 468834 - RNA, 18 nt, Human
uugagcccuuaaugaaca

SEQ ID NO: 468835 - RNA, 21 nt, Human
uugggaagugccuguugcagu

SEQ ID NO: 468836 - RNA, 21 nt, Human
uuuuuuuuuuuuuuuuucauu

SEQ ID NO: 468837 - RNA, 21 nt, Human
aaaacaucauuauguagugca

SEQ ID NO: 468838 - RNA, 19 nt, Human
aaacagaagagcauacaac

SEQ ID NO: 468839 - RNA, 23 nt, Human
aaacagaagagcauacaaccuaa

SEQ ID NO: 468840 - RNA, 21 nt, Human
aaacaggcuacaaaccuguac

SEQ ID NO: 468841 - RNA, 22 nt, Human
aaacaggcuacaaaccuguaca

SEQ ID NO: 468842 - RNA, 20 nt, Human
aaaccaggagucugaacacg

SEQ ID NO: 468843 - RNA, 22 nt, Human
aaagacaacaaaggugacaaag

SEQ ID NO: 468844 - RNA, 24 nt, Human
aaauaggauuuugaucacaaaaau

SEQ ID NO: 468845 - RNA, 18 nt, Human
aagaaaggcaauuaggga

SEQ ID NO: 468846 - RNA, 18 nt, Human
aagccuggaagaaaccag

SEQ ID NO: 468847 - RNA, 24 nt, Human
aagccuggaagaaaccaggagucu

SEQ ID NO: 468848 - RNA, 21 nt, Human
aauaccugguauauacaugac

SEQ ID NO: 468849 - RNA, 21 nt, Human
aggaagcugaugauguccacu

SEQ ID NO: 468850 - RNA, 22 nt, Human
aguaguuuuauuuuuucuaaau

SEQ ID NO: 468851 - RNA, 24 nt, Human
aucauguuacugcacugaauacug

SEQ ID NO: 468852 - RNA, 18 nt, Human
caaagacaacaaagguga

SEQ ID NO: 468853 - RNA, 27 nt, Human
caaagacaacaaaggugacaaaggagg

SEQ ID NO: 468854 - RNA, 21 nt, Human
caacaaaggugacaaagucag

SEQ ID NO: 468855 - RNA, 19 nt, Human
ccuaagaaaaaugcaaaac

SEQ ID NO: 468856 - RNA, 20 nt, Human
cgccucggcucucccauugg

SEQ ID NO: 468857 - RNA, 24 nt, Human
ggugacaaagucagguaaaagaaa

SEQ ID NO: 468858 - RNA, 23 nt, Human
guaaaauaauaugcagccuaaag

SEQ ID NO: 468859 - RNA, 22 nt, Human
uaaaacagaagagcauacaacc

SEQ ID NO: 468860 - RNA, 23 nt, Human
uaaaauugugcaaaacaaacccc

SEQ ID NO: 468861 - RNA, 18 nt, Human
uaagccuggaagaaacca

SEQ ID NO: 468862 - RNA, 24 nt, Human
uacaaccuaagaaaaaugcaaaac

SEQ ID NO: 468863 - RNA, 22 nt, Human
uacaguauuauaaucuuaugag

SEQ ID NO: 468864 - RNA, 20 nt, Human
uaggcaacuguaacauaaug

SEQ ID NO: 468865 - RNA, 22 nt, Human
uauauacaugacaaaacaaagc

SEQ ID NO: 468866 - RNA, 27 nt, Human
uauauacaugacaaaacaaagcaugua

SEQ ID NO: 468867 - RNA, 24 nt, Human
ucaaagacaacaaaggugacaaag

SEQ ID NO: 468868 - RNA, 21 nt, Human
uccacuguaagccuggaagaa

SEQ ID NO: 468869 - RNA, 22 nt, Human
uccacuguaagccuggaagaaa

SEQ ID NO: 468870 - RNA, 21 nt, Human
ucuaaacacagaaaagguaua

SEQ ID NO: 468871 - RNA, 21 nt, Human
ucugucauugaccaaaacauc

SEQ ID NO: 468872 - RNA, 22 nt, Human
ugacaaagucagguaaaagaaa

SEQ ID NO: 468873 - RNA, 20 nt, Human
ugauguccacuguaagccug

SEQ ID NO: 468874 - RNA, 18 nt, Human
uggaagaaaccaggaguc

SEQ ID NO: 468875 - RNA, 27 nt, Human
uuaaagcaggaagcugaugauguccac

SEQ ID NO: 468876 - RNA, 19 nt, Human
uucaaagacaacaaaggug

SEQ ID NO: 468877 - RNA, 18 nt, Human
aaacccccaaaagcucag

SEQ ID NO: 468878 - RNA, 22 nt, Human
aaccaacuucaguuaaaaaccc

SEQ ID NO: 468879 - RNA, 19 nt, Human
aagcaaacacacauacucc

SEQ ID NO: 468880 - RNA, 21 nt, Human
aagcaaacacacauacuccac

SEQ ID NO: 468881 - RNA, 22 nt, Human
aagcaaacacacauacuccaca

SEQ ID NO: 468882 - RNA, 21 nt, Human
aagcucagguucugaaaugcc

SEQ ID NO: 468883 - RNA, 24 nt, Human
acaaccaacuucaguuaaaaaccc

SEQ ID NO: 468884 - RNA, 19 nt, Human
acaagaaagauaaaacaac

SEQ ID NO: 468885 - RNA, 31 nt, Human
acacacauacuccacacauacacauaugugg

SEQ ID NO: 468886 - RNA, 22 nt, Human
acacagucccgcucacccacca

SEQ ID NO: 468887 - RNA, 25 nt, Human
aguaauugcaggagaggaauuaccc

SEQ ID NO: 468888 - RNA, 23 nt, Human
auccacuuaaacugguuaacaaa

SEQ ID NO: 468889 - RNA, 18 nt, Human
auuucauccacggagaag

SEQ ID NO: 468890 - RNA, 30 nt, Human
caaacacacauacuccacacauacacauag

SEQ ID NO: 468891 - RNA, 23 nt, Human
cacaaugaggaguuucuauuuca

SEQ ID NO: 468892 - RNA, 22 nt, Human
cacacagucccgcucacccacc

SEQ ID NO: 468893 - RNA, 18 nt, Human
cacacauacuccacacau

SEQ ID NO: 468894 - RNA, 21 nt, Human
cacacauacuccacacauaca

SEQ ID NO: 468895 - RNA, 18 nt, Human
cagcagcacuugugucuc

SEQ ID NO: 468896 - RNA, 18 nt, Human
ccaguaauacgcuucuuu

SEQ ID NO: 468897 - RNA, 19 nt, Human
ccauucuuuguuaaagaaa

SEQ ID NO: 468898 - RNA, 21 nt, Human
ccccauauaagggaugagaac

SEQ ID NO: 468899 - RNA, 26 nt, Human
ccucugagacgcuucacacucagccu

SEQ ID NO: 468900 - RNA, 22 nt, Human
cgcacacacucacacacagucc

SEQ ID NO: 468901 - RNA, 20 nt, Human
cgcgcacacacucacacaca

SEQ ID NO: 468902 - RNA, 21 nt, Human
cucacacacagucccgcucac

SEQ ID NO: 468903 - RNA, 18 nt, Human
cuccacacauacacauau

SEQ ID NO: 468904 - RNA, 22 nt, Human
cuggucacacaaugaggaguuu

SEQ ID NO: 468905 - RNA, 19 nt, Human
cuguauguucucuuuacau

SEQ ID NO: 468906 - RNA, 21 nt, Human
gagaaaggggcauacuuccau

SEQ ID NO: 468907 - RNA, 22 nt, Human
gcucacccaccaaaggcccgcg

SEQ ID NO: 468908 - RNA, 25 nt, Human
ggagaagcaaacacacauacuccac

SEQ ID NO: 468909 - RNA, 19 nt, Human
guuaaaaacccccaaaagc

SEQ ID NO: 468910 - RNA, 19 nt, Human
uaaaaacccccaaaagcuc

SEQ ID NO: 468911 - RNA, 19 nt, Human
uaaaaacccccaaaagcuc

SEQ ID NO: 468912 - RNA, 21 nt, Human
uaaaaacccccaaaagcucag

SEQ ID NO: 468913 - RNA, 22 nt, Human
uaaaaacccccaaaagcucagg

SEQ ID NO: 468914 - RNA, 22 nt, Human
uaaaacaagaaagauaaaacaa

SEQ ID NO: 468915 - RNA, 24 nt, Human
uaaacaguuaaagcacacauuuug

SEQ ID NO: 468916 - RNA, 25 nt, Human
uaccacugucaagucauuuaaacaa

SEQ ID NO: 468917 - RNA, 21 nt, Human
uacccaguaauacgcuucuuu

SEQ ID NO: 468918 - RNA, 23 nt, Human
uacccaguaauacgcuucuuuua

SEQ ID NO: 468919 - RNA, 27 nt, Human
uacgcgcacacacucacacacaguccc

SEQ ID NO: 468920 - RNA, 21 nt, Human
uauaaaacaagaaagauaaaa

SEQ ID NO: 468921 - RNA, 25 nt, Human
uaugugcgcacauacgcgcacacag

SEQ ID NO: 468922 - RNA, 22 nt, Human
uauuuaaaaagguucugacauu

SEQ ID NO: 468923 - RNA, 24 nt, Human
uauuuuugugccuuuaucuuaaaa

SEQ ID NO: 468924 - RNA, 18 nt, Human
ucacccaccaaaggcccg

SEQ ID NO: 468925 - RNA, 22 nt, Human
ucugaaaugccucugagacgcu

SEQ ID NO: 468926 - RNA, 22 nt, Human
ucuucaguucugacauaucaca

SEQ ID NO: 468927 - RNA, 19 nt, Human
ugacauaucacaucagcga

SEQ ID NO: 468928 - RNA, 20 nt, Human
ugccccauauaagggaugag

SEQ ID NO: 468929 - RNA, 21 nt, Human
uggagcacuaccacugucaag

SEQ ID NO: 468930 - RNA, 27 nt, Human
ugugcgcacauacgcgcacacacucac

SEQ ID NO: 468931 - RNA, 19 nt, Human
uguuaaagaaaaaugcccc

SEQ ID NO: 468932 - RNA, 23 nt, Human
uguucucuuuacauauucuuuca

SEQ ID NO: 468933 - RNA, 21 nt, Human
uuaaaaagguucugacauuaa

SEQ ID NO: 468934 - RNA, 25 nt, Human
uuaacaaauaaaaacacuuuauuac

SEQ ID NO: 468935 - RNA, 26 nt, Human
uucccauaaacuuugcuuucuuauuu

SEQ ID NO: 468936 - RNA, 21 nt, Human
uuuaaccauuccuggucacac

SEQ ID NO: 468937 - RNA, 20 nt, Human
uuucacugaaaccauucuuu

SEQ ID NO: 468938 - RNA, 25 nt, Human
uuuuuuuuuuuuuuuuuuuccaagg

SEQ ID NO: 468939 - RNA, 24 nt, Human
aagcaugacauccuugccuugacc

SEQ ID NO: 468940 - RNA, 20 nt, Human
aagggcuguggacuguugcu

SEQ ID NO: 468941 - RNA, 22 nt, Human
acaaggaacagaagccaccaag

SEQ ID NO: 468942 - RNA, 21 nt, Human
acagcuccuggcgcagggcca

SEQ ID NO: 468943 - RNA, 22 nt, Human
accuugggggaggaucaaaggg

SEQ ID NO: 468944 - RNA, 20 nt, Human
agagggcccuggaaacaucu

SEQ ID NO: 468945 - RNA, 20 nt, Human
agauacaacauccaugaagc

SEQ ID NO: 468946 - RNA, 19 nt, Human
agcacaguggggcccgugc

SEQ ID NO: 468947 - RNA, 21 nt, Human
agccucugguccuuaguucag

SEQ ID NO: 468948 - RNA, 21 nt, Human
aggauucccucaguggccucc

SEQ ID NO: 468949 - RNA, 20 nt, Human
aggggaaggaaaggaaaagg

SEQ ID NO: 468950 - RNA, 23 nt, Human
aguggggcccgugcugcuguggg

SEQ ID NO: 468951 - RNA, 18 nt, Human
aucuagggguuggguccu

SEQ ID NO: 468952 - RNA, 22 nt, Human
auuugggcuagccagggaaggc

SEQ ID NO: 468953 - RNA, 18 nt, Human
cacagcagcugccccugc

SEQ ID NO: 468954 - RNA, 18 nt, Human
cacagcagcugccccugc

SEQ ID NO: 468955 - RNA, 21 nt, Human
cacaguggggcccgugcugcu

SEQ ID NO: 468956 - RNA, 18 nt, Human
cacaguugcugaggcugg

SEQ ID NO: 468957 - RNA, 21 nt, Human
cagcugguggcuccuucucag

SEQ ID NO: 468958 - RNA, 22 nt, Human
caggcccugcagcuggcugccc

SEQ ID NO: 468959 - RNA, 22 nt, Human
caggcccugcagcuggcugucc

SEQ ID NO: 468960 - RNA, 23 nt, Human
ccagaaacaucuggcagccucug

SEQ ID NO: 468961 - RNA, 20 nt, Human
ccagacacugauuugcugac

SEQ ID NO: 468962 - RNA, 21 nt, Human
ccagcaggcucccccagaguc

SEQ ID NO: 468963 - RNA, 19 nt, Human
ccagcucccggccaucaag

SEQ ID NO: 468964 - RNA, 20 nt, Human
ccagcugugacagcuccugg

SEQ ID NO: 468965 - RNA, 18 nt, Human
ccaugcucaggcccugca

SEQ ID NO: 468966 - RNA, 20 nt, Human
cccccagagucggugcagcc

SEQ ID NO: 468967 - RNA, 24 nt, Human
cccgcaggucacacucacucugga

SEQ ID NO: 468968 - RNA, 20 nt, Human
cccuggaaacaucuuagggg

SEQ ID NO: 468969 - RNA, 24 nt, Human
ccggcuggcggccugacccuccuc

SEQ ID NO: 468970 - RNA, 19 nt, Human
ccuaguccugauggcugcg

SEQ ID NO: 468971 - RNA, 21 nt, Human
ccuccggcuggcggccugacc

SEQ ID NO: 468972 - RNA, 20 nt, Human
ccugcagcuggcugcccagc

SEQ ID NO: 468973 - RNA, 22 nt, Human
ccugcagcuggcuguccagaca

SEQ ID NO: 468974 - RNA, 19 nt, Human
ccuggccuucaagcaugac

SEQ ID NO: 468975 - RNA, 21 nt, Human
ccuugggggaggaucaaaggg

SEQ ID NO: 468976 - RNA, 25 nt, Human
ccuuuugugaacaucuugggagggu

SEQ ID NO: 468977 - RNA, 23 nt, Human
cucaccuugggggaggaucaaag

SEQ ID NO: 468978 - RNA, 19 nt, Human
cucucaagucuacccuggc

SEQ ID NO: 468979 - RNA, 21 nt, Human
cugaggcuggugcugacugcc

SEQ ID NO: 468980 - RNA, 19 nt, Human
cugcagcacugugcauggg

SEQ ID NO: 468981 - RNA, 23 nt, Human
cugcagcacugugcauggguuuu

SEQ ID NO: 468982 - RNA, 26 nt, Human
cugcagcacugugcauggguuuuggu

SEQ ID NO: 468983 - RNA, 19 nt, Human
cugccccugccagccaugc

SEQ ID NO: 468984 - RNA, 21 nt, Human
cugccccugccagccaugcuc

SEQ ID NO: 468985 - RNA, 19 nt, Human
cuggcggccugacccuccu

SEQ ID NO: 468986 - RNA, 27 nt, Human
cugggcucuggggugauguuccccgag

SEQ ID NO: 468987 - RNA, 20 nt, Human
cuggggugauguuccccgag

SEQ ID NO: 468988 - RNA, 19 nt, Human
cuuaggggaaggaaaggaa

SEQ ID NO: 468989 - RNA, 21 nt, Human
cuugcagcuucugcucaaagc

SEQ ID NO: 468990 - RNA, 22 nt, Human
gaaacugaggcugggagccuca

SEQ ID NO: 468991 - RNA, 18 nt, Human
gaacaugcauuuucaagu

SEQ ID NO: 468992 - RNA, 19 nt, Human
gaacaugcauuuucaaguu

SEQ ID NO: 468993 - RNA, 24 nt, Human
gaaccaaaggcagggcugugggga

SEQ ID NO: 468994 - RNA, 19 nt, Human
gaagccgaggggacaagga

SEQ ID NO: 468995 - RNA, 22 nt, Human
gacaggccacuggcugugggcc

SEQ ID NO: 468996 - RNA, 25 nt, Human
gauuccguucuuuccugggguucua

SEQ ID NO: 468997 - RNA, 18 nt, Human
gcagcugccccugccaga

SEQ ID NO: 468998 - RNA, 18 nt, Human
gcccugcagcuggcugcc

SEQ ID NO: 468999 - RNA, 24 nt, Human
gcucuggggugauguuccccgagu

SEQ ID NO: 469000 - RNA, 21 nt, Human
gcucuggugcagccuccggcu

SEQ ID NO: 469001 - RNA, 20 nt, Human
gcugcuggauaaggcugggc

SEQ ID NO: 469002 - RNA, 24 nt, Human
gcuuggagccccuuuccuccagcu

SEQ ID NO: 469003 - RNA, 23 nt, Human
ggacacgugaggagccagaaaca

SEQ ID NO: 469004 - RNA, 22 nt, Human
ggaccugaagagcagcacagug

SEQ ID NO: 469005 - RNA, 23 nt, Human
ggcugcgaagagaagccgagggg

SEQ ID NO: 469006 - RNA, 25 nt, Human
ggcuggaaggcgcugcuccgccgac

SEQ ID NO: 469007 - RNA, 22 nt, Human
gggaauaaagagaacucuuggc

SEQ ID NO: 469008 - RNA, 24 nt, Human
gggcaccagagggcccuggaaaca

SEQ ID NO: 469009 - RNA, 22 nt, Human
gggcauugaucaaggcuaguug

SEQ ID NO: 469010 - RNA, 19 nt, Human
gggguuggguccuggccag

SEQ ID NO: 469011 - RNA, 23 nt, Human
guugcuugugggcacagggcaau

SEQ ID NO: 469012 - RNA, 20 nt, Human
uaagcccucaccuuggggga

SEQ ID NO: 469013 - RNA, 21 nt, Human
uacauacggacacugaucaag

SEQ ID NO: 469014 - RNA, 21 nt, Human
uacggacacugaucaaggcca

SEQ ID NO: 469015 - RNA, 19 nt, Human
ucaagcaugacauccuugc

SEQ ID NO: 469016 - RNA, 19 nt, Human
ucacacucacucuggacgc

SEQ ID NO: 469017 - RNA, 23 nt, Human
ucaccuugggggaggaucaaagg

SEQ ID NO: 469018 - RNA, 18 nt, Human
ucagauacaacauccaug

SEQ ID NO: 469019 - RNA, 18 nt, Human
ucaggcccugcagcuggc

SEQ ID NO: 469020 - RNA, 22 nt, Human
ucagggccuggccucauucagg

SEQ ID NO: 469021 - RNA, 20 nt, Human
ucaguggccuccuuagugcc

SEQ ID NO: 469022 - RNA, 18 nt, Human
ucccucaguggccuccuu

SEQ ID NO: 469023 - RNA, 18 nt, Human
ucuaaacagauugccugg

SEQ ID NO: 469024 - RNA, 19 nt, Human
ucucugggaacugcauagg

SEQ ID NO: 469025 - RNA, 22 nt, Human
ugaagagcagcacaguggggcc

SEQ ID NO: 469026 - RNA, 21 nt, Human
ugccagacacgcucaggcccu

SEQ ID NO: 469027 - RNA, 22 nt, Human
ugccaggugugaggagaguucc

SEQ ID NO: 469028 - RNA, 18 nt, Human
ugccccugccagacacgc

SEQ ID NO: 469029 - RNA, 18 nt, Human
ugccuaagcccucaccuu

SEQ ID NO: 469030 - RNA, 23 nt, Human
ugcugugggggaaacugaggcug

SEQ ID NO: 469031 - RNA, 27 nt, Human
ugcugugggggaaacugaggcugggag

SEQ ID NO: 469032 - RNA, 20 nt, Human
uggaaggaagaggacagugg

SEQ ID NO: 469033 - RNA, 21 nt, Human
ugggccuguaggucucugcac

SEQ ID NO: 469034 - RNA, 20 nt, Human
ugggggaaacugaggcuggg

SEQ ID NO: 469035 - RNA, 22 nt, Human
ugggggaaacugaggcugggag

SEQ ID NO: 469036 - RNA, 22 nt, Human
ugguggcugggacagccacgug

SEQ ID NO: 469037 - RNA, 18 nt, Human
ugugacagcuccuggcgc

SEQ ID NO: 469038 - RNA, 20 nt, Human
uuccuccagcugguggcucc

SEQ ID NO: 469039 - RNA, 25 nt, Human
uucuacagcugccuaagcccucacc

SEQ ID NO: 469040 - RNA, 21 nt, Human
aaacuuuuauuuuggaaugau

SEQ ID NO: 469041 - RNA, 22 nt, Human
aacagcugaccuuagcuccaug

SEQ ID NO: 469042 - RNA, 24 nt, Human
aauaaacuuuuauuuuggaaugau

SEQ ID NO: 469043 - RNA, 21 nt, Human
aauucuauuacuggucaccuc

SEQ ID NO: 469044 - RNA, 22 nt, Human
accaagcaauuccagccaacag

SEQ ID NO: 469045 - RNA, 21 nt, Human
acccagccuaccccaagguca

SEQ ID NO: 469046 - RNA, 19 nt, Human
acucuguucccuuucccca

SEQ ID NO: 469047 - RNA, 21 nt, Human
acuguccuagucccaguucca

SEQ ID NO: 469048 - RNA, 26 nt, Human
agagaaugcaccccugcuaucccuuc

SEQ ID NO: 469049 - RNA, 19 nt, Human
agagacucacuuccugccc

SEQ ID NO: 469050 - RNA, 20 nt, Human
agaguuccuguauacccuuc

SEQ ID NO: 469051 - RNA, 24 nt, Human
agcuuuguuugcagcuagaggugc

SEQ ID NO: 469052 - RNA, 24 nt, Human
aggccgcguagcgguggcagcccc

SEQ ID NO: 469053 - RNA, 20 nt, Human
aggcugcuacugcaagucug

SEQ ID NO: 469054 - RNA, 21 nt, Human
agucccaguuccaggccaaga

SEQ ID NO: 469055 - RNA, 21 nt, Human
aguuuuauugcaggaggcagu

SEQ ID NO: 469056 - RNA, 25 nt, Human
auaguacaaagaguuccuguauacc

SEQ ID NO: 469057 - RNA, 19 nt, Human
augcaccccugcuaucccu

SEQ ID NO: 469058 - RNA, 25 nt, Human
auggagagacucacuuccugcccca

SEQ ID NO: 469059 - RNA, 23 nt, Human
caacuuucccggggaaagagaau

SEQ ID NO: 469060 - RNA, 23 nt, Human
caauucuguucccugcugucuua

SEQ ID NO: 469061 - RNA, 19 nt, Human
caccucagucaacuuuccc

SEQ ID NO: 469062 - RNA, 19 nt, Human
caccucuuccccuagaccc

SEQ ID NO: 469063 - RNA, 22 nt, Human
cacuguacagugaguccaaggc

SEQ ID NO: 469064 - RNA, 19 nt, Human
cagagagaaagggggaaga

SEQ ID NO: 469065 - RNA, 19 nt, Human
cagcaaaagcuaacuggua

SEQ ID NO: 469066 - RNA, 23 nt, Human
cagcagugcagacaaggaggcac

SEQ ID NO: 469067 - RNA, 21 nt, Human
cagcccccaaaggaguagaag

SEQ ID NO: 469068 - RNA, 22 nt, Human
cagccuaccccaaggucaacau

SEQ ID NO: 469069 - RNA, 20 nt, Human
cagcugagguaacagcugac

SEQ ID NO: 469070 - RNA, 23 nt, Human
cagugcagacaaggaggcacucc

SEQ ID NO: 469071 - RNA, 19 nt, Human
ccaaaggaguagaaguagu

SEQ ID NO: 469072 - RNA, 23 nt, Human
ccaaaggaguagaaguagucacc

SEQ ID NO: 469073 - RNA, 23 nt, Human
ccagcccaaauugccaacccaua

SEQ ID NO: 469074 - RNA, 24 nt, Human
ccagcccaaauugccaacccauag

SEQ ID NO: 469075 - RNA, 24 nt, Human
ccaggcaagugaguaaggcuaucc

SEQ ID NO: 469076 - RNA, 20 nt, Human
ccaggugugucuucugggcu

SEQ ID NO: 469077 - RNA, 24 nt, Human
cccaaaggaguagaaguagucacc

SEQ ID NO: 469078 - RNA, 21 nt, Human
cccaacaccucuuccccuaga

SEQ ID NO: 469079 - RNA, 24 nt, Human
cccaacaccucuuccccuagaccc

SEQ ID NO: 469080 - RNA, 22 nt, Human
cccagagucagacccucucgcc

SEQ ID NO: 469081 - RNA, 25 nt, Human
cccauaccagcagugcagacaagga

SEQ ID NO: 469082 - RNA, 19 nt, Human
ccccaacaccucuuccccu

SEQ ID NO: 469083 - RNA, 24 nt, Human
ccccaacaccucuuccccuagacc

SEQ ID NO: 469084 - RNA, 23 nt, Human
ccccagggacucuugguuuucag

SEQ ID NO: 469085 - RNA, 21 nt, Human
ccccccgacccgcgccggccc

SEQ ID NO: 469086 - RNA, 21 nt, Human
ccccuagacccugagggccag

SEQ ID NO: 469087 - RNA, 21 nt, Human
ccccucgggcgccccccgacc

SEQ ID NO: 469088 - RNA, 18 nt, Human
cccuagacccugagggcc

SEQ ID NO: 469089 - RNA, 22 nt, Human
cccucuggaauguccuaccugg

SEQ ID NO: 469090 - RNA, 18 nt, Human
cccugcccagcguuccuc

SEQ ID NO: 469091 - RNA, 19 nt, Human
cccugcgcgccgccgcucg

SEQ ID NO: 469092 - RNA, 23 nt, Human
cccugcgcgccgccgcucggccc

SEQ ID NO: 469093 - RNA, 19 nt, Human
ccgcccugcgcgccgccgc

SEQ ID NO: 469094 - RNA, 20 nt, Human
ccgcccugcgcgccgccgcu

SEQ ID NO: 469095 - RNA, 24 nt, Human
ccucuggaauguccuaccuggccu

SEQ ID NO: 469096 - RNA, 22 nt, Human
ccugcugucuuagcuuuguuug

SEQ ID NO: 469097 - RNA, 22 nt, Human
ccuggccuaaccccauaccagc

SEQ ID NO: 469098 - RNA, 21 nt, Human
cggcagcggccggaugagcac

SEQ ID NO: 469099 - RNA, 18 nt, Human
cggcccgggccccucggg

SEQ ID NO: 469100 - RNA, 19 nt, Human
cggcccgggccccucgggc

SEQ ID NO: 469101 - RNA, 22 nt, Human
cgggcgccccccgacccgcgcc

SEQ ID NO: 469102 - RNA, 21 nt, Human
cguuccuccugcacgcagccc

SEQ ID NO: 469103 - RNA, 23 nt, Human
cuaccuggccuaaccccauacca

SEQ ID NO: 469104 - RNA, 19 nt, Human
cuagacccugagggccagg

SEQ ID NO: 469105 - RNA, 20 nt, Human
cuaucccuucugcauggccc

SEQ ID NO: 469106 - RNA, 21 nt, Human
cucacuuccugccccaacacc

SEQ ID NO: 469107 - RNA, 19 nt, Human
cucggcccgggccccucgg

SEQ ID NO: 469108 - RNA, 19 nt, Human
cugaggcuuaaaagugccg

SEQ ID NO: 469109 - RNA, 19 nt, Human
cugggccccuuugauccag

SEQ ID NO: 469110 - RNA, 19 nt, Human
cuggggcucccacacugua

SEQ ID NO: 469111 - RNA, 20 nt, Human
gaccauccaggcccagcuga

SEQ ID NO: 469112 - RNA, 22 nt, Human
gacccgcgccggcccugcccag

SEQ ID NO: 469113 - RNA, 23 nt, Human
gagcagcagaacugcccuguuga

SEQ ID NO: 469114 - RNA, 23 nt, Human
gaugccacauugcacugaagaca

SEQ ID NO: 469115 - RNA, 18 nt, Human
gcauggcccagccugcug

SEQ ID NO: 469116 - RNA, 22 nt, Human
gccacaagcucuuugugguucc

SEQ ID NO: 469117 - RNA, 19 nt, Human
gccacauggaggagaacca

SEQ ID NO: 469118 - RNA, 27 nt, Human
gccccaacaccucuuccccuagacccu

SEQ ID NO: 469119 - RNA, 19 nt, Human
gccgcccugcgcgccgccg

SEQ ID NO: 469120 - RNA, 23 nt, Human
gcuuggcggggauggucucucgc

SEQ ID NO: 469121 - RNA, 23 nt, Human
ggcccagccugcuggaggccagg

SEQ ID NO: 469122 - RNA, 23 nt, Human
ggggcacgcugucuggguccucc

SEQ ID NO: 469123 - RNA, 23 nt, Human
guccuaccuggccuaaccccaua

SEQ ID NO: 469124 - RNA, 19 nt, Human
uaaaagugccgagugacca

SEQ ID NO: 469125 - RNA, 18 nt, Human
uacagugaguccaaggcc

SEQ ID NO: 469126 - RNA, 26 nt, Human
uacagugaguccaaggccuuguagcu

SEQ ID NO: 469127 - RNA, 19 nt, Human
uacaguggguccagcccau

SEQ ID NO: 469128 - RNA, 23 nt, Human
uaucccuucugcauggcccagcc

SEQ ID NO: 469129 - RNA, 19 nt, Human
ucacucucuuuggaauccu

SEQ ID NO: 469130 - RNA, 24 nt, Human
uccaaggccuuguagcuggugaga

SEQ ID NO: 469131 - RNA, 23 nt, Human
ucccaguuccaggccaagaacuc

SEQ ID NO: 469132 - RNA, 19 nt, Human
uccccagggacucuugguu

SEQ ID NO: 469133 - RNA, 22 nt, Human
ucccuuagagggcagugagaac

SEQ ID NO: 469134 - RNA, 19 nt, Human
uccuagaccauccaggccc

SEQ ID NO: 469135 - RNA, 24 nt, Human
uccuauugucacagaggugggaac

SEQ ID NO: 469136 - RNA, 21 nt, Human
uccuccugcacgcagccccau

SEQ ID NO: 469137 - RNA, 21 nt, Human
ucucucgcugcaguugcuggu

SEQ ID NO: 469138 - RNA, 22 nt, Human
ucucuugguaaugggaucccag

SEQ ID NO: 469139 - RNA, 25 nt, Human
ucugaccaaaagaacuuagcagaag

SEQ ID NO: 469140 - RNA, 19 nt, Human
ucuuacaucaccaugguac

SEQ ID NO: 469141 - RNA, 20 nt, Human
ugaagguggcagcaggugcc

SEQ ID NO: 469142 - RNA, 22 nt, Human
ugaauaagccugagcuagccug

SEQ ID NO: 469143 - RNA, 24 nt, Human
ugaccuuagcuccaugagggaucc

SEQ ID NO: 469144 - RNA, 24 nt, Human
ugaccuuagcuccaugagggaucc

SEQ ID NO: 469145 - RNA, 20 nt, Human
ugagaacaaggccugccuua

SEQ ID NO: 469146 - RNA, 25 nt, Human
ugagcccagcccaaauugccaaccc

SEQ ID NO: 469147 - RNA, 22 nt, Human
ugauuugcucugaccaaaagaa

SEQ ID NO: 469148 - RNA, 23 nt, Human
ugcaagucugguguggaugcucc

SEQ ID NO: 469149 - RNA, 21 nt, Human
ugcacugaagacacucucccu

SEQ ID NO: 469150 - RNA, 23 nt, Human
ugccgagugaccaaguucccuua

SEQ ID NO: 469151 - RNA, 25 nt, Human
ugcugguaggccgcguagcgguggc

SEQ ID NO: 469152 - RNA, 18 nt, Human
uggaauccugaagccauc

SEQ ID NO: 469153 - RNA, 26 nt, Human
uggaauguccuaccuggccuaacccc

SEQ ID NO: 469154 - RNA, 18 nt, Human
uggacuggacaagcuugg

SEQ ID NO: 469155 - RNA, 18 nt, Human
uggcagagugaggcccca

SEQ ID NO: 469156 - RNA, 25 nt, Human
ugggcucuugaagguggcagcaggu

SEQ ID NO: 469157 - RNA, 24 nt, Human
uggguccagcccauggagagacuc

SEQ ID NO: 469158 - RNA, 20 nt, Human
ugguacaucugucaaaacca

SEQ ID NO: 469159 - RNA, 20 nt, Human
ugguguggaugcucccaggu

SEQ ID NO: 469160 - RNA, 18 nt, Human
uguagcuggugagagggg

SEQ ID NO: 469161 - RNA, 23 nt, Human
uguauacccuucacccagccuac

SEQ ID NO: 469162 - RNA, 22 nt, Human
ugugauaggugaaaaauggcca

SEQ ID NO: 469163 - RNA, 19 nt, Human
uguuacacagcaaaagcua

SEQ ID NO: 469164 - RNA, 18 nt, Human
uuccugccccaacaccuc

SEQ ID NO: 469165 - RNA, 20 nt, Human
uugcacugaagacacucucc

SEQ ID NO: 469166 - RNA, 26 nt, Human
uugcagagauaguacaaagaguuccu

SEQ ID NO: 469167 - RNA, 23 nt, Human
uuuacagagaaguugcagagaua

SEQ ID NO: 469168 - RNA, 24 nt, Human
uuugauccagaggacaucgauggg

SEQ ID NO: 469169 - RNA, 18 nt, Human
uuuuauugcaggaggcag

SEQ ID NO: 469170 - RNA, 25 nt, Human
agagcccuuccacaugcggcccuuc

SEQ ID NO: 469171 - RNA, 27 nt, Human
augaaggaggacacagcucagagcccu

SEQ ID NO: 469172 - RNA, 21 nt, Human
augaggcagcggaagagggaa

SEQ ID NO: 469173 - RNA, 23 nt, Human
caacccugccccacggagaccgg

SEQ ID NO: 469174 - RNA, 26 nt, Human
cccaacccugccccacggagaccggc

SEQ ID NO: 469175 - RNA, 21 nt, Human
cggcccaacccugccccacgg

SEQ ID NO: 469176 - RNA, 21 nt, Human
cuuuuuuuuuuuuuuuuuuuu

SEQ ID NO: 469177 - RNA, 21 nt, Human
gacgaccaaggcuaggaagga

SEQ ID NO: 469178 - RNA, 25 nt, Human
gcucagagcccuuccacaugcggcc

SEQ ID NO: 469179 - RNA, 23 nt, Human
ggaaugaggcagcggaagaggga

SEQ ID NO: 469180 - RNA, 21 nt, Human
uaggaaggaaaggaaugaggc

SEQ ID NO: 469181 - RNA, 18 nt, Human
ucuuuuuuuuuuuuuuuu

SEQ ID NO: 469182 - RNA, 18 nt, Human
ucuuuuuuuuuuuuuuuu

SEQ ID NO: 469183 - RNA, 20 nt, Human
ugacacgagacauaaaaacu

SEQ ID NO: 469184 - RNA, 19 nt, Human
ugccccacggagaccggcc

SEQ ID NO: 469185 - RNA, 18 nt, Human
uuccacaugcggcccaac

SEQ ID NO: 469186 - RNA, 32 nt, Human; identical to SEQ ID NO: 423254

SEQ ID NO: 469187 - RNA, 18 nt, Human
uuuuuuuuuuuuuuuuug

SEQ ID NO: 469188 - RNA, 23 nt, Human
uuuuuuuuuuuuuuuuugacacg

SEQ ID NO: 469189 - RNA, 20 nt, Human
aaacagccagaugaagauac

SEQ ID NO: 469190 - RNA, 19 nt, Human
aagcauaaggucuaaaccc

SEQ ID NO: 469191 - RNA, 21 nt, Human
acagacagagauuccguuuuc

SEQ ID NO: 469192 - RNA, 22 nt, Human
acgagucaagucagacccaaaa

SEQ ID NO: 469193 - RNA, 23 nt, Human
aggcauggcugaagcauggcagc

SEQ ID NO: 469194 - RNA, 21 nt, Human
ccacauguucagcucuucaga

SEQ ID NO: 469195 - RNA, 23 nt, Human
ccagcaaggccugucuguccaga

SEQ ID NO: 469196 - RNA, 22 nt, Human
ccccgggcccccacccgagccc

SEQ ID NO: 469197 - RNA, 23 nt, Human
ccccgggcccccacccgagcccc

SEQ ID NO: 469198 - RNA, 21 nt, Human
ccccggggccccgggccccca

SEQ ID NO: 469199 - RNA, 24 nt, Human
ccccggggccccgggcccccaccc

SEQ ID NO: 469200 - RNA, 26 nt, Human
cccggggccccgggcccccacccgag

SEQ ID NO: 469201 - RNA, 23 nt, Human
ccggcugguggcggagccgggag

SEQ ID NO: 469202 - RNA, 22 nt, Human
ccuccuuccggguauggggcag

SEQ ID NO: 469203 - RNA, 24 nt, Human
ccugggcaaaugcuggagcuucug

SEQ ID NO: 469204 - RNA, 23 nt, Human
cgccaagguagugagugggugcc

SEQ ID NO: 469205 - RNA, 23 nt, Human
cggguccugggcaaaugcuggag

SEQ ID NO: 469206 - RNA, 20 nt, Human
cucccguguuccugggccuu

SEQ ID NO: 469207 - RNA, 21 nt, Human
cugugcagcguuccuccuucc

SEQ ID NO: 469208 - RNA, 21 nt, Human
cuucagaagcucccguguucc

SEQ ID NO: 469209 - RNA, 20 nt, Human
gacguagcacccgcucggca

SEQ ID NO: 469210 - RNA, 20 nt, Human
gagucaagucagacccaaaa

SEQ ID NO: 469211 - RNA, 21 nt, Human
gagugggugccuuaaugugau

SEQ ID NO: 469212 - RNA, 19 nt, Human
gcccccacccgagccccgg

SEQ ID NO: 469213 - RNA, 21 nt, Human
gccccgggcccccacccgagc

SEQ ID NO: 469214 - RNA, 19 nt, Human
gccccggggccccgggccc

SEQ ID NO: 469215 - RNA, 22 nt, Human
gcugguggcggagccgggagaa

SEQ ID NO: 469216 - RNA, 20 nt, Human
gucaagucagacccaaaaaa

SEQ ID NO: 469217 - RNA, 18 nt, Human
gugggggugcgccacccu

SEQ ID NO: 469218 - RNA, 24 nt, Human
guguugagaugaaacuggacaaaa

SEQ ID NO: 469219 - RNA, 22 nt, Human
guucucguuccccucccuccac

SEQ ID NO: 469220 - RNA, 21 nt, Human
uaagaggaaggucuucucugg

SEQ ID NO: 469221 - RNA, 18 nt, Human
uagcacccgcucggcauc

SEQ ID NO: 469222 - RNA, 23 nt, Human
ucagacccaaaaaacgacgccaa

SEQ ID NO: 469223 - RNA, 19 nt, Human
uccagaugcuucuuggccu

SEQ ID NO: 469224 - RNA, 23 nt, Human
ugaaauggggcaggagaagguca

SEQ ID NO: 469225 - RNA, 20 nt, Human
ugaagauacacacaggguga

SEQ ID NO: 469226 - RNA, 21 nt, Human
ugaugccucuuguucccuaag

SEQ ID NO: 469227 - RNA, 20 nt, Human
ugcgccacccucuuggcaca

SEQ ID NO: 469228 - RNA, 20 nt, Human
uggaaugagggucuuaugag

SEQ ID NO: 469229 - RNA, 20 nt, Human
uggcugaagcauggcagcug

SEQ ID NO: 469230 - RNA, 19 nt, Human
ugggagagaccagcaguug

SEQ ID NO: 469231 - RNA, 21 nt, Human
ugggagagaccagcaguugac

SEQ ID NO: 469232 - RNA, 19 nt, Human
ugggugccuuaaugugaug

SEQ ID NO: 469233 - RNA, 23 nt, Human
uuccggguauggggcagcacccu

SEQ ID NO: 469234 - RNA, 19 nt, Human
uuugcaaguuuccaacgac

SEQ ID NO: 469235 - RNA, 22 nt, Human
uuuuuuuuuuuuuuuuauguuu

SEQ ID NO: 469236 - RNA, 21 nt, Human
aaaaggauuauaagggugaga

SEQ ID NO: 469237 - RNA, 19 nt, Human
aacccuccucaccuccucc

SEQ ID NO: 469238 - RNA, 21 nt, Human
acccuccucaccuccuccgcu

SEQ ID NO: 469239 - RNA, 23 nt, Human
agaagggugagcucagagugggg

SEQ ID NO: 469240 - RNA, 22 nt, Human
agacagaagggugagcucagag

SEQ ID NO: 469241 - RNA, 19 nt, Human
agaguggggaauuaggcuc

SEQ ID NO: 469242 - RNA, 20 nt, Human
agcaaacccuccucaccucc

SEQ ID NO: 469243 - RNA, 22 nt, Human
cacccagcaaacccuccucacc

SEQ ID NO: 469244 - RNA, 21 nt, Human
ccacccagcaaacccuccuca

SEQ ID NO: 469245 - RNA, 23 nt, Human
ccagcaaacccuccucaccuccu

SEQ ID NO: 469246 - RNA, 19 nt, Human
cccagcaaacccuccucac

SEQ ID NO: 469247 - RNA, 21 nt, Human
cccagcaaacccuccucaccu

SEQ ID NO: 469248 - RNA, 25 nt, Human
cccagcaaacccuccucaccuccuc

SEQ ID NO: 469249 - RNA, 21 nt, Human
cccauacccacccagcaaacc

SEQ ID NO: 469250 - RNA, 26 nt, Human
cccauacccacccagcaaacccuccu

SEQ ID NO: 469251 - RNA, 26 nt, Human
ccccucccccauacccacccagcaaa

SEQ ID NO: 469252 - RNA, 23 nt, Human
ccugcagagucucccccuccccc

SEQ ID NO: 469253 - RNA, 22 nt, Human
cgggaagaccuagugcugaaaa

SEQ ID NO: 469254 - RNA, 18 nt, Human
gaaggacacugaguugug

SEQ ID NO: 469255 - RNA, 20 nt, Human
gggaagggguagggcccggg

SEQ ID NO: 469256 - RNA, 25 nt, Human
uccugcagagucucccccuccccca

SEQ ID NO: 469257 - RNA, 20 nt, Human
ucucccccucccccauaccc

SEQ ID NO: 469258 - RNA, 18 nt, Human
ugaguuguggggaggggc

SEQ ID NO: 469259 - RNA, 18 nt, Human
ugcagagucucccccucc

SEQ ID NO: 469260 - RNA, 21 nt, Human
uuugaagaaggguggucauug

SEQ ID NO: 469261 - RNA, 24 nt, Human
uuugaaggacacugaguugugggg

SEQ ID NO: 469262 - RNA, 22 nt, Human
uuuuuuuuuuuugaagaagggu

SEQ ID NO: 469263 - RNA, 26 nt, Human
uuuuuuuuuuuugaagaagggugguc

SEQ ID NO: 469264 - RNA, 24 nt, Human
uuuuuuuuuuuuuuugaagaaggg

SEQ ID NO: 469265 - RNA, 21 nt, Human
aaaacugccugguacacuuuc

SEQ ID NO: 469266 - RNA, 21 nt, Human
aaaagacccagacuccaaaug

SEQ ID NO: 469267 - RNA, 23 nt, Human
aaacaaccuacaugugccagagu

SEQ ID NO: 469268 - RNA, 24 nt, Human
aaagugccaggauuauagguguga

SEQ ID NO: 469269 - RNA, 19 nt, Human
aaagugcuaggauuacagg

SEQ ID NO: 469270 - RNA, 24 nt, Human
aaagugcuaggauuacagguguga

SEQ ID NO: 469271 - RNA, 19 nt, Human
aacauggagaaaccccauc

SEQ ID NO: 469272 - RNA, 20 nt, Human
aacauggagaaaccccaucu

SEQ ID NO: 469273 - RNA, 21 nt, Human
aacauggagaaaccccaucuc

SEQ ID NO: 469274 - RNA, 19 nt, Human
aaccgacacuuuucaacau

SEQ ID NO: 469275 - RNA, 19 nt, Human
aagaggcaagggggcuaag

SEQ ID NO: 469276 - RNA, 19 nt, Human
aaggaagaggcaagggggc

SEQ ID NO: 469277 - RNA, 25 nt, Human
aagugauccucccaucucagccucc

SEQ ID NO: 469278 - RNA, 24 nt, Human
aagugccuaacugggaaugguggu

SEQ ID NO: 469279 - RNA, 21 nt, Human
aauagaaaacauggacagaaa

SEQ ID NO: 469280 - RNA, 18 nt, Human
acaaacccucaaaacaac

SEQ ID NO: 469281 - RNA, 20 nt, Human
acaaacccucaaaacaaccu

SEQ ID NO: 469282 - RNA, 19 nt, Human
acaaagaacaaaugucaca

SEQ ID NO: 469283 - RNA, 20 nt, Human
acagacgaugaaaacgaggu

SEQ ID NO: 469284 - RNA, 22 nt, Human
acagaugcccccagagccuggg

SEQ ID NO: 469285 - RNA, 18 nt, Human
accaacaaacccucaaaa

SEQ ID NO: 469286 - RNA, 21 nt, Human
accaaccaaccaaucaaccag

SEQ ID NO: 469287 - RNA, 24 nt, Human
accccaucucuacuaaaaauacaa

SEQ ID NO: 469288 - RNA, 24 nt, Human
accugcggucaggaguuugagacc

SEQ ID NO: 469289 - RNA, 21 nt, Human
acgggguuuuaucauguuggc

SEQ ID NO: 469290 - RNA, 22 nt, Human
acgggguuuuaucauguuggcu

SEQ ID NO: 469291 - RNA, 23 nt, Human
acgggguuuuaucauguuggcua

SEQ ID NO: 469292 - RNA, 24 nt, Human
acgggguuuuaucauguuggcuag

SEQ ID NO: 469293 - RNA, 24 nt, Human
acuaaaaauacaaaauuagccugg

SEQ ID NO: 469294 - RNA, 25 nt, Human
acuauguugcccaggcuggucucaa

SEQ ID NO: 469295 - RNA, 27 nt, Human
acucacuccccagacuucagcaccacc

SEQ ID NO: 469296 - RNA, 25 nt, Human
acucugucgcucaggcuggagugca

SEQ ID NO: 469297 - RNA, 22 nt, Human
agaaaacagccccaugaggugg

SEQ ID NO: 469298 - RNA, 19 nt, Human
agaagaggggauaucuuau

SEQ ID NO: 469299 - RNA, 20 nt, Human
agaggggcaucaaggcggcc

SEQ ID NO: 469300 - RNA, 22 nt, Human
agagggucacaucuuaccaacg

SEQ ID NO: 469301 - RNA, 19 nt, Human
agaugcccccagagccugg

SEQ ID NO: 469302 - RNA, 24 nt, Human
agcaaaggccacagaaugacaaag

SEQ ID NO: 469303 - RNA, 24 nt, Human
agcacuuugggaggccgaggcagg

SEQ ID NO: 469304 - RNA, 23 nt, Human
agccugguguggugacgcaugcc

SEQ ID NO: 469305 - RNA, 23 nt, Human
agcgauucuccugccccagccuc

SEQ ID NO: 469306 - RNA, 22 nt, Human
aggaguguuccagauaaagguc

SEQ ID NO: 469307 - RNA, 20 nt, Human
aggaguuugagaccagccug

SEQ ID NO: 469308 - RNA, 21 nt, Human
aggauuauaggugugagccac

SEQ ID NO: 469309 - RNA, 19 nt, Human
aggcaaaauaagcauggca

SEQ ID NO: 469310 - RNA, 18 nt, Human
aggcagguggaucaccug

SEQ ID NO: 469311 - RNA, 22 nt, Human
aggcagguggaucaccugcggu

SEQ ID NO: 469312 - RNA, 26 nt, Human
aggcagguggaucaccugcggucagg

SEQ ID NO: 469313 - RNA, 21 nt, Human
aggccgaggcagguggaucac

SEQ ID NO: 469314 - RNA, 18 nt, Human
aggcuggagugcaguggc

SEQ ID NO: 469315 - RNA, 19 nt, Human
aggugugagccacuacacc

SEQ ID NO: 469316 - RNA, 19 nt, Human
aggugugagccacuacacc

SEQ ID NO: 469317 - RNA, 23 nt, Human
aguagcugggauuacaggcgugu

SEQ ID NO: 469318 - RNA, 18 nt, Human
agugcaguggcgugaucc

SEQ ID NO: 469319 - RNA, 21 nt, Human
agugcaguggcgugauccuag

SEQ ID NO: 469320 - RNA, 23 nt, Human
agugcaguggcgugauccuagcu

SEQ ID NO: 469321 - RNA, 24 nt, Human
agugcaguggcgugauccuagcuc

SEQ ID NO: 469322 - RNA, 19 nt, Human
agugcugagcccgcaucag

SEQ ID NO: 469323 - RNA, 22 nt, Human
auaaaggucaagucuuaccagg

SEQ ID NO: 469324 - RNA, 18 nt, Human
aucaccugcggucaggag

SEQ ID NO: 469325 - RNA, 24 nt, Human
aucaccugcggucaggaguuugag

SEQ ID NO: 469326 - RNA, 19 nt, Human
augccuguaaucccagcac

SEQ ID NO: 469327 - RNA, 22 nt, Human
augguggugcuugcaacacugg

SEQ ID NO: 469328 - RNA, 24 nt, Human
auugacacuuuccacauacaguua

SEQ ID NO: 469329 - RNA, 19 nt, Human
caaaaacuguaaaggauuc

SEQ ID NO: 469330 - RNA, 18 nt, Human
caaaauauauucguuucu

SEQ ID NO: 469331 - RNA, 24 nt, Human
caaagugccaggauuauaggugug

SEQ ID NO: 469332 - RNA, 24 nt, Human
caaagugcuaggauuacaggugug

SEQ ID NO: 469333 - RNA, 22 nt, Human
caacaaagaacaaaugucacag

SEQ ID NO: 469334 - RNA, 22 nt, Human
caaccagagaguguccuucagg

SEQ ID NO: 469335 - RNA, 18 nt, Human
caaccagccaaccaacca

SEQ ID NO: 469336 - RNA, 20 nt, Human
caagcgauucuccugcccca

SEQ ID NO: 469337 - RNA, 27 nt, Human
caagugauccucccaucucagccuccc

SEQ ID NO: 469338 - RNA, 19 nt, Human
cacacagcuaucaggagug

SEQ ID NO: 469339 - RNA, 22 nt, Human
cacacuguucagucuauaccac

SEQ ID NO: 469340 - RNA, 19 nt, Human
cacagccaugccacccuuc

SEQ ID NO: 469341 - RNA, 18 nt, Human
cacaguucuuaucaaaaa

SEQ ID NO: 469342 - RNA, 24 nt, Human
caccacaccuggcuaauuuuugua

SEQ ID NO: 469343 - RNA, 19 nt, Human
caccauuucucuucaucuc

SEQ ID NO: 469344 - RNA, 24 nt, Human
caccucagccucccaaagugccag

SEQ ID NO: 469345 - RNA, 19 nt, Human
cacuauguugcccaggcug

SEQ ID NO: 469346 - RNA, 24 nt, Human
cacuauguugcccaggcuggucuc

SEQ ID NO: 469347 - RNA, 27 nt, Human
cacuauguugcccaggcuggucucaaa

SEQ ID NO: 469348 - RNA, 22 nt, Human
cacucugucgcucaggcuggag

SEQ ID NO: 469349 - RNA, 21 nt, Human
cacugcaaccucugccuccug

SEQ ID NO: 469350 - RNA, 23 nt, Human
cacugcaaccucugccuccuggg

SEQ ID NO: 469351 - RNA, 18 nt, Human
cacuucauggaugaaaca

SEQ ID NO: 469352 - RNA, 20 nt, Human
cagaaaaaaaguaaucuuau

SEQ ID NO: 469353 - RNA, 19 nt, Human
cagacuucagcaccacccc

SEQ ID NO: 469354 - RNA, 23 nt, Human
cagcacaugacccugaagcacac

SEQ ID NO: 469355 - RNA, 24 nt, Human
cagcacuuugggaggccgaggcag

SEQ ID NO: 469356 - RNA, 26 nt, Human
cagcacuuugggaggccgaggcaggu

SEQ ID NO: 469357 - RNA, 24 nt, Human
cagccugaccaacauggagaaacc

SEQ ID NO: 469358 - RNA, 22 nt, Human
caggauuauaggugugagccac

SEQ ID NO: 469359 - RNA, 24 nt, Human
cagggucucacuauguugcccagg

SEQ ID NO: 469360 - RNA, 22 nt, Human
cagguacagaugcccugggcca

SEQ ID NO: 469361 - RNA, 24 nt, Human
cagguggaucaccugcggucagga

SEQ ID NO: 469362 - RNA, 20 nt, Human
cagguuggcuuuuugccauc

SEQ ID NO: 469363 - RNA, 26 nt, Human
cauaacaaguacauuaguguucuaaa

SEQ ID NO: 469364 - RNA, 18 nt, Human
cauccucaaccacuuaag

SEQ ID NO: 469365 - RNA, 24 nt, Human
caucucagccucccaaagugcuag

SEQ ID NO: 469366 - RNA, 26 nt, Human
caucuuaccaacgccuccaaagcacc

SEQ ID NO: 469367 - RNA, 20 nt, Human
caugccuguaaucccagcac

SEQ ID NO: 469368 - RNA, 24 nt, Human
caugccuguaaucccagcacuuug

SEQ ID NO: 469369 - RNA, 24 nt, Human
cauuaguguucuaaaccaaccaac

SEQ ID NO: 469370 - RNA, 21 nt, Human
ccaaagugccaggauuauagg

SEQ ID NO: 469371 - RNA, 24 nt, Human
ccaaagugccaggauuauaggugu

SEQ ID NO: 469372 - RNA, 21 nt, Human
ccaaagugcuaggauuacagg

SEQ ID NO: 469373 - RNA, 24 nt, Human
ccaaagugcuaggauuacaggugu

SEQ ID NO: 469374 - RNA, 21 nt, Human
ccaaccaacaaacccucaaaa

SEQ ID NO: 469375 - RNA, 24 nt, Human
ccaaccaacaaacccucaaaacaa

SEQ ID NO: 469376 - RNA, 27 nt, Human
ccaaccaaccaacaaacccucaaaaca

SEQ ID NO: 469377 - RNA, 23 nt, Human
ccaaccaaccaaccaacaaaccc

SEQ ID NO: 469378 - RNA, 23 nt, Human
ccaacgccuccaaagcaccaugg

SEQ ID NO: 469379 - RNA, 18 nt, Human
ccacuacaccuggcccag

SEQ ID NO: 469380 - RNA, 27 nt, Human
ccaguaauccucccaccucagccuccc

SEQ ID NO: 469381 - RNA, 20 nt, Human
cccaaccucaagugauccuc

SEQ ID NO: 469382 - RNA, 23 nt, Human
cccgaguagcugggauuacaggc

SEQ ID NO: 469383 - RNA, 24 nt, Human
cccgaguagcugggauuacaggcg

SEQ ID NO: 469384 - RNA, 22 nt, Human
ccgaguagcugggauuacaggc

SEQ ID NO: 469385 - RNA, 24 nt, Human
ccgaguagcugggauuacaggcgu

SEQ ID NO: 469386 - RNA, 19 nt, Human
ccuccaacuugaugggaua

SEQ ID NO: 469387 - RNA, 26 nt, Human
ccucccaccucagccucccaaagugc

SEQ ID NO: 469388 - RNA, 24 nt, Human
ccuccuggguucaagcgauucucc

SEQ ID NO: 469389 - RNA, 19 nt, Human
ccucugccuccuggguuca

SEQ ID NO: 469390 - RNA, 24 nt, Human
ccugaccaacauggagaaacccca

SEQ ID NO: 469391 - RNA, 23 nt, Human
ccugccccagccucccgaguagc

SEQ ID NO: 469392 - RNA, 24 nt, Human
ccugccccagccucccgaguagcu

SEQ ID NO: 469393 - RNA, 22 nt, Human
ccugcggucaggaguuugagac

SEQ ID NO: 469394 - RNA, 23 nt, Human
ccuggguucaagcgauucuccug

SEQ ID NO: 469395 - RNA, 22 nt, Human
ccuguaaucccagcacuuuggg

SEQ ID NO: 469396 - RNA, 21 nt, Human
ccuguaaucccagcuacucgg

SEQ ID NO: 469397 - RNA, 20 nt, Human
cgaggcagguggaucaccug

SEQ ID NO: 469398 - RNA, 26 nt, Human
cgaggcagguggaucaccugcgguca

SEQ ID NO: 469399 - RNA, 24 nt, Human
cgcucaggcuggagugcaguggcg

SEQ ID NO: 469400 - RNA, 24 nt, Human
cuaaaccaaccaaccaaucaacca

SEQ ID NO: 469401 - RNA, 23 nt, Human
cuaauuuuuguauuuuuagucga

SEQ ID NO: 469402 - RNA, 19 nt, Human
cuacuccauggccacuccc

SEQ ID NO: 469403 - RNA, 20 nt, Human
cuagaggagucagaaaguuc

SEQ ID NO: 469404 - RNA, 24 nt, Human
cuagaggagucagaaaguucuaaa

SEQ ID NO: 469405 - RNA, 20 nt, Human
cucaaaauagaacagaaaaa

SEQ ID NO: 469406 - RNA, 23 nt, Human
cucaaacuccugggauccaguaa

SEQ ID NO: 469407 - RNA, 24 nt, Human
cucaagugauccucccaucucagc

SEQ ID NO: 469408 - RNA, 24 nt, Human
cucacucugucgcucaggcuggag

SEQ ID NO: 469409 - RNA, 24 nt, Human
cucacugcaaccucugccuccugg

SEQ ID NO: 469410 - RNA, 24 nt, Human
cucaugccuguaaucccagcacuu

SEQ ID NO: 469411 - RNA, 21 nt, Human
cuccccagacuucagcaccac

SEQ ID NO: 469412 - RNA, 21 nt, Human
cuccuggguucaagcgauucu

SEQ ID NO: 469413 - RNA, 24 nt, Human
cugagccgggcgcgguggcucaug

SEQ ID NO: 469414 - RNA, 19 nt, Human
cugcaaccucugccuccug

SEQ ID NO: 469415 - RNA, 23 nt, Human
cugcaaccucugccuccuggguu

SEQ ID NO: 469416 - RNA, 24 nt, Human
cugcaaccucugccuccuggguuc

SEQ ID NO: 469417 - RNA, 19 nt, Human
cugucgcucaggcuggagu

SEQ ID NO: 469418 - RNA, 19 nt, Human
gaacuucuggggucacccu

SEQ ID NO: 469419 - RNA, 21 nt, Human
gacgcaugccuguaaucccag

SEQ ID NO: 469420 - RNA, 18 nt, Human
gagacgggguuuuaucau

SEQ ID NO: 469421 - RNA, 24 nt, Human
gagacgggguuuuaucauguuggc

SEQ ID NO: 469422 - RNA, 25 nt, Human
gaguagcugggauuacaggcgugua

SEQ ID NO: 469423 - RNA, 24 nt, Human
gaucaccugcggucaggaguuuga

SEQ ID NO: 469424 - RNA, 18 nt, Human
gauuacaggugugagcca

SEQ ID NO: 469425 - RNA, 21 nt, Human
gauuacaggugugagccacca

SEQ ID NO: 469426 - RNA, 24 nt, Human
gauuacaggugugagccaccaugc

SEQ ID NO: 469427 - RNA, 18 nt, Human
gauuauaggugugagcca

SEQ ID NO: 469428 - RNA, 19 nt, Human
gauuauaggugugagccac

SEQ ID NO: 469429 - RNA, 21 nt, Human
gauuauaggugugagccacua

SEQ ID NO: 469430 - RNA, 20 nt, Human
gcucaggcuggagugcagug

SEQ ID NO: 469431 - RNA, 24 nt, Human
gcucaggcuggagugcaguggcgu

SEQ ID NO: 469432 - RNA, 25 nt, Human
gcuggagugcaguggcgugauccua

SEQ ID NO: 469433 - RNA, 22 nt, Human
ggauuacaggugugagccacca

SEQ ID NO: 469434 - RNA, 24 nt, Human
ggauuacaggugugagccaccaug

SEQ ID NO: 469435 - RNA, 22 nt, Human
ggauuauaggugugagccacua

SEQ ID NO: 469436 - RNA, 22 nt, Human
ggcuggagugcaguggcgugau

SEQ ID NO: 469437 - RNA, 23 nt, Human
ggcuuaaggagacagucugggag

SEQ ID NO: 469438 - RNA, 24 nt, Human
gggcgcgguggcucaugccuguaa

SEQ ID NO: 469439 - RNA, 23 nt, Human
gggguuuuaucauguuggcuagg

SEQ ID NO: 469440 - RNA, 22 nt, Human
ggguuuuaucauguuggcuagg

SEQ ID NO: 469441 - RNA, 19 nt, Human
ggucaggaguuugagacca

SEQ ID NO: 469442 - RNA, 24 nt, Human
ggugacgcaugccuguaaucccag

SEQ ID NO: 469443 - RNA, 23 nt, Human
gguggcucaugccuguaauccca

SEQ ID NO: 469444 - RNA, 24 nt, Human
gguggcucaugccuguaaucccag

SEQ ID NO: 469445 - RNA, 21 nt, Human
gguguggugacgcaugccugu

SEQ ID NO: 469446 - RNA, 18 nt, Human
guagcugggauuacaggc

SEQ ID NO: 469447 - RNA, 24 nt, Human
gugauccucccaucucagccuccc

SEQ ID NO: 469448 - RNA, 24 nt, Human
guggaacugugccuuuguggaugg

SEQ ID NO: 469449 - RNA, 19 nt, Human
uaaaaauacaaaauuagcc

SEQ ID NO: 469450 - RNA, 20 nt, Human
uaaaaauacaaaauuagccu

SEQ ID NO: 469451 - RNA, 21 nt, Human
uaaaaauacaaaauuagccug

SEQ ID NO: 469452 - RNA, 21 nt, Human
uaaaagauuuuacaccgaaga

SEQ ID NO: 469453 - RNA, 22 nt, Human
uaaaagggccuguuuugguggc

SEQ ID NO: 469454 - RNA, 22 nt, Human
uaaaccaaccaaccaaucaacc

SEQ ID NO: 469455 - RNA, 23 nt, Human
uaacaaaagacccagacuccaaa

SEQ ID NO: 469456 - RNA, 25 nt, Human
uaacaaaagacccagacuccaaaug

SEQ ID NO: 469457 - RNA, 21 nt, Human
uaacugggaaugguggugcuu

SEQ ID NO: 469458 - RNA, 24 nt, Human
uaauuuuuguauuuuuagucgaga

SEQ ID NO: 469459 - RNA, 22 nt, Human
uacaaaauuagccugguguggu

SEQ ID NO: 469460 - RNA, 21 nt, Human
uacaaccagagaguguccuuc

SEQ ID NO: 469461 - RNA, 22 nt, Human
uacaggcguguaccaccacacc

SEQ ID NO: 469462 - RNA, 22 nt, Human
uacaggugugagccaccaugcc

SEQ ID NO: 469463 - RNA, 22 nt, Human
uacaggugugagccaccaugcc

SEQ ID NO: 469464 - RNA, 23 nt, Human
uacaggugugagccaccaugccu

SEQ ID NO: 469465 - RNA, 22 nt, Human
uaccaccacaccuggcuaauuu

SEQ ID NO: 469466 - RNA, 24 nt, Human
uaccagggacaaaaagugccuaac

SEQ ID NO: 469467 - RNA, 18 nt, Human
uacucaagaaaaaggagg

SEQ ID NO: 469468 - RNA, 21 nt, Human
uacuccauggccacucccacc

SEQ ID NO: 469469 - RNA, 18 nt, Human
uagaaaacauggacagaa

SEQ ID NO: 469470 - RNA, 23 nt, Human
uagcucacugcaaccucugccuc

SEQ ID NO: 469471 - RNA, 24 nt, Human
uaggaauagaaagcaugcucccaa

SEQ ID NO: 469472 - RNA, 18 nt, Human
uaggauuacaggugugag

SEQ ID NO: 469473 - RNA, 22 nt, Human
uaggauuacaggugugagccac

SEQ ID NO: 469474 - RNA, 24 nt, Human
uaggauuacaggugugagccacca

SEQ ID NO: 469475 - RNA, 25 nt, Human
uaggauuacaggugugagccaccau

SEQ ID NO: 469476 - RNA, 24 nt, Human
uagucgagacgggguuuuaucaug

SEQ ID NO: 469477 - RNA, 23 nt, Human
uauaggugugagccacuacaccu

SEQ ID NO: 469478 - RNA, 22 nt, Human
uaucaaaaacuguaaaggauuc

SEQ ID NO: 469479 - RNA, 23 nt, Human
uaucaacaaagaacaaaugucac

SEQ ID NO: 469480 - RNA, 23 nt, Human
uauguugcccaggcuggucucaa

SEQ ID NO: 469481 - RNA, 24 nt, Human
uauguugcccaggcuggucucaaa

SEQ ID NO: 469482 - RNA, 20 nt, Human
ucaaaaacuguaaaggauuc

SEQ ID NO: 469483 - RNA, 23 nt, Human
ucacagaugcccccagagccugg

SEQ ID NO: 469484 - RNA, 24 nt, Human
ucacagcaaaggccacagaaugac

SEQ ID NO: 469485 - RNA, 24 nt, Human
ucacugcaaccucugccuccuggg

SEQ ID NO: 469486 - RNA, 25 nt, Human
ucacugcaaccucugccuccugggu

SEQ ID NO: 469487 - RNA, 27 nt, Human
ucacugcaaccucugccuccuggguuc

SEQ ID NO: 469488 - RNA, 24 nt, Human
ucagcaccacccaccaaaacugcc

SEQ ID NO: 469489 - RNA, 22 nt, Human
ucaugccuguaaucccagcacu

SEQ ID NO: 469490 - RNA, 23 nt, Human
uccaguaauccucccaccucagc

SEQ ID NO: 469491 - RNA, 21 nt, Human
uccaguaauccucccaccucc

SEQ ID NO: 469492 - RNA, 23 nt, Human
ucccaaagugccaggauuauagg

SEQ ID NO: 469493 - RNA, 23 nt, Human
ucccaaagugcuaggauuacagg

SEQ ID NO: 469494 - RNA, 20 nt, Human
ucccaccacugguuuauggg

SEQ ID NO: 469495 - RNA, 24 nt, Human
ucccgaguagcugggauuacaggc

SEQ ID NO: 469496 - RNA, 27 nt, Human
uccucccaucucagccucccaaagugc

SEQ ID NO: 469497 - RNA, 21 nt, Human
uccuggguucaagcgauucuc

SEQ ID NO: 469498 - RNA, 24 nt, Human
uccuggguucaagcgauucuccug

SEQ ID NO: 469499 - RNA, 24 nt, Human
ucgcucaggcuggagugcaguggc

SEQ ID NO: 469500 - RNA, 22 nt, Human
ucuaacccuucccagcauuguc

SEQ ID NO: 469501 - RNA, 27 nt, Human
ucuauaccacugauauguggucaggga

SEQ ID NO: 469502 - RNA, 26 nt, Human
ucuaugaucacagaugcccccagagc

SEQ ID NO: 469503 - RNA, 19 nt, Human
ucucacuauguugcccagg

SEQ ID NO: 469504 - RNA, 23 nt, Human
ucucacuauguugcccaggcugg

SEQ ID NO: 469505 - RNA, 24 nt, Human
ucucacuauguugcccaggcuggu

SEQ ID NO: 469506 - RNA, 26 nt, Human
ucucacuauguugcccaggcuggucu

SEQ ID NO: 469507 - RNA, 23 nt, Human
ucucacucugucgcucaggcugg

SEQ ID NO: 469508 - RNA, 24 nt, Human
ucucacucugucgcucaggcugga

SEQ ID NO: 469509 - RNA, 21 nt, Human
ucucagccucccaaagugcua

SEQ ID NO: 469510 - RNA, 24 nt, Human
ucuccugccccagccucccgagua

SEQ ID NO: 469511 - RNA, 20 nt, Human
ucucuacuaaaaauacaaaa

SEQ ID NO: 469512 - RNA, 24 nt, Human
ucugucgcucaggcuggagugcag

SEQ ID NO: 469513 - RNA, 24 nt, Human
ugaagacuaaacucacuccccaga

SEQ ID NO: 469514 - RNA, 19 nt, Human
ugacaaagcuggaaacuga

SEQ ID NO: 469515 - RNA, 19 nt, Human
ugacagacgaugaaaacga

SEQ ID NO: 469516 - RNA, 24 nt, Human
ugagaccagccugaccaacaugga

SEQ ID NO: 469517 - RNA, 19 nt, Human
ugaggcgucagugaauuaa

SEQ ID NO: 469518 - RNA, 21 nt, Human
ugccaucuacuccauggccac

SEQ ID NO: 469519 - RNA, 24 nt, Human
ugcccaggcuggucucaaacuccu

SEQ ID NO: 469520 - RNA, 24 nt, Human
ugccccagccucccgaguagcugg

SEQ ID NO: 469521 - RNA, 21 nt, Human
ugcccugggccacagcagagu

SEQ ID NO: 469522 - RNA, 23 nt, Human
ugccuguaaucccagcacuuugg

SEQ ID NO: 469523 - RNA, 23 nt, Human
ugccuguaaucccagcuacucgg

SEQ ID NO: 469524 - RNA, 24 nt, Human
ugccuguaaucccagcuacucggg

SEQ ID NO: 469525 - RNA, 18 nt, Human
ugcuaagcacagaugcug

SEQ ID NO: 469526 - RNA, 24 nt, Human
ugcuaggauuacaggugugagcca

SEQ ID NO: 469527 - RNA, 21 nt, Human
ugcugagcccgcaucagaccc

SEQ ID NO: 469528 - RNA, 19 nt, Human
uggagugcaguggcgugau

SEQ ID NO: 469529 - RNA, 19 nt, Human
uggagugcaguggcgugau

SEQ ID NO: 469530 - RNA, 23 nt, Human
uggagugcaguggcgugauccua

SEQ ID NO: 469531 - RNA, 28 nt, Human
uggagugcaguggcgugauggcucuagc

SEQ ID NO: 469532 - RNA, 23 nt, Human
uggaucaccugcggucaggaguu

SEQ ID NO: 469533 - RNA, 24 nt, Human
uggaucaccugcggucaggaguuu

SEQ ID NO: 469534 - RNA, 24 nt, Human
uggcaagagccauucucuaaauac

SEQ ID NO: 469535 - RNA, 21 nt, Human
uggcaguauucuaugaucaca

SEQ ID NO: 469536 - RNA, 20 nt, Human
uggcccaaccucaagugauu

SEQ ID NO: 469537 - RNA, 20 nt, Human
uggcgugauccuagcucacu

SEQ ID NO: 469538 - RNA, 24 nt, Human
uggcgugauccuagcucacugcaa

SEQ ID NO: 469539 - RNA, 24 nt, Human
uggcucaugccuguaaucccagca

SEQ ID NO: 469540 - RNA, 19 nt, Human
ugggaaugguggugcuugc

SEQ ID NO: 469541 - RNA, 19 nt, Human
ugggaaugguggugcuugc

SEQ ID NO: 469542 - RNA, 24 nt, Human
ugggaggccgaggcagguggauca

SEQ ID NO: 469543 - RNA, 23 nt, Human
ugggauccaguaauccucccacc

SEQ ID NO: 469544 - RNA, 21 nt, Human
ugggauuacaggcguguacca

SEQ ID NO: 469545 - RNA, 22 nt, Human
ugggauuacaggcguguaccac

SEQ ID NO: 469546 - RNA, 24 nt, Human
ugggauuacaggcguguaccacca

SEQ ID NO: 469547 - RNA, 23 nt, Human
uggguucaagcgauucuccugcc

SEQ ID NO: 469548 - RNA, 18 nt, Human
uggucagggacauuucgg

SEQ ID NO: 469549 - RNA, 24 nt, Human
uggugacgcaugccuguaauccca

SEQ ID NO: 469550 - RNA, 20 nt, Human
uggugccaagauaugaaccc

SEQ ID NO: 469551 - RNA, 21 nt, Human
ugguguggugacgcaugccug

SEQ ID NO: 469552 - RNA, 24 nt, Human
ugguguggugacgcaugccuguaa

SEQ ID NO: 469553 - RNA, 22 nt, Human
ugucacagcaaaggccacagaa

SEQ ID NO: 469554 - RNA, 23 nt, Human
ugugaguuauuuucaggaguuuu

SEQ ID NO: 469555 - RNA, 23 nt, Human
uguuuacacacacgaucugugug

SEQ ID NO: 469556 - RNA, 24 nt, Human
uuaauuugcuuguuuacacacacu

SEQ ID NO: 469557 - RNA, 18 nt, Human
uuagucgagacgggguuu

SEQ ID NO: 469558 - RNA, 21 nt, Human
uuagucgagacgggguuuuau

SEQ ID NO: 469559 - RNA, 24 nt, Human
uuagucgagacgggguuuuaucau

SEQ ID NO: 469560 - RNA, 24 nt, Human
uucaagcgauucuccugccccagc

SEQ ID NO: 469561 - RNA, 25 nt, Human
uucaaucccuucaacaagccccugc

SEQ ID NO: 469562 - RNA, 21 nt, Human
uucuaaaccaaccaaccaauc

SEQ ID NO: 469563 - RNA, 24 nt, Human
uucucuaaauacaaucugguaccc

SEQ ID NO: 469564 - RNA, 19 nt, Human
uuggagagccuuuuuuuuu

SEQ ID NO: 469565 - RNA, 25 nt, Human
uugggaggccgaggcagguggauca

SEQ ID NO: 469566 - RNA, 19 nt, Human
uuggucggagaggcacugc

SEQ ID NO: 469567 - RNA, 19 nt, Human
uuuuggugcugaacaugac

SEQ ID NO: 469568 - RNA, 24 nt, Human
uuuuuagucgagacgggguuuuau

SEQ ID NO: 469569 - RNA, 21 nt, Human
uuuuugccaucagagggaggc

SEQ ID NO: 469570 - RNA, 20 nt, Human
uuuuuguauuuuuagucgag

SEQ ID NO: 469571 - RNA, 23 nt, Human
uuuuuguauuuuuagucgagacg

SEQ ID NO: 469572 - RNA, 20 nt, Human
uuuuuuuuuuugagacagag

SEQ ID NO: 469573 - RNA, 18 nt, Human
aggccuggggcugguggu

SEQ ID NO: 469574 - RNA, 22 nt, Human
aggguggggggugggagguggg

SEQ ID NO: 469575 - RNA, 23 nt, Human
aggugucaggaaagcuagcgagu

SEQ ID NO: 469576 - RNA, 21 nt, Human
aguggggagaggggcggggag

SEQ ID NO: 469577 - RNA, 18 nt, Human
caggaaagcuagcgagug

SEQ ID NO: 469578 - RNA, 22 nt, Human
caggguggggggugggaggugg

SEQ ID NO: 469579 - RNA, 20 nt, Human
caggugucaggaaagcuagc

SEQ ID NO: 469580 - RNA, 22 nt, Human
cgcgccacgacagagccucgug

SEQ ID NO: 469581 - RNA, 19 nt, Human
cggcgaccccucgcgggcc

SEQ ID NO: 469582 - RNA, 19 nt, Human
cugcuugcugcagccgccu

SEQ ID NO: 469583 - RNA, 24 nt, Human
gaccccucgcgggccucggcgcac

SEQ ID NO: 469584 - RNA, 20 nt, Human
gccuggggcuggugguaacc

SEQ ID NO: 469585 - RNA, 24 nt, Human
gccuggggcuggugguaaccgcuc

SEQ ID NO: 469586 - RNA, 19 nt, Human
gcggaguggggagaggggc

SEQ ID NO: 469587 - RNA, 22 nt, Human
ggagguggggaggggggcgagg

SEQ ID NO: 469588 - RNA, 25 nt, Human
ggaguggggagaggggcggggaggg

SEQ ID NO: 469589 - RNA, 23 nt, Human
ggccacggagcccauuugcagag

SEQ ID NO: 469590 - RNA, 20 nt, Human
gggcggcgaccccucgcggg

SEQ ID NO: 469591 - RNA, 20 nt, Human
ggggugggagguggggaggg

SEQ ID NO: 469592 - RNA, 19 nt, Human
ggugcacaguuccaggugu

SEQ ID NO: 469593 - RNA, 21 nt, Human
uacaggguggggggugggagg

SEQ ID NO: 469594 - RNA, 19 nt, Human
ucacugguuuuuggugucu

SEQ ID NO: 469595 - RNA, 22 nt, Human
ucugcuguguugaugcgaaggu

SEQ ID NO: 469596 - RNA, 22 nt, Human
ugccaggugcacaguuccaggu

SEQ ID NO: 469597 - RNA, 19 nt, Human
uggcuggugggaucugggc

SEQ ID NO: 469598 - RNA, 19 nt, Human
ugggagguggggagggggg

SEQ ID NO: 469599 - RNA, 21 nt, Human
ugggagguggggaggggggcg

SEQ ID NO: 469600 - RNA, 19 nt, Human
uggggagaggggcggggag

SEQ ID NO: 469601 - RNA, 21 nt, Human
uggggagaggggcggggaggg

SEQ ID NO: 469602 - RNA, 21 nt, Human
uggggggugggagguggggag

SEQ ID NO: 469603 - RNA, 24 nt, Human
uggggggugggagguggggagggg

SEQ ID NO: 469604 - RNA, 18 nt, Human
uuggugucugcuguguug

SEQ ID NO: 469605 - RNA, 19 nt, Human
uuggugucugcuguguuga

SEQ ID NO: 469606 - RNA, 22 nt, Human
uuuuuuuuuucggggcuacugg

SEQ ID NO: 469607 - RNA, 23 nt, Human
uuuuuuuuuuuuuuuuuucgggg

SEQ ID NO: 469608 - RNA, 25 nt, Human
aaaaaaaaagacccaaaaaaccaag

SEQ ID NO: 469609 - RNA, 21 nt, Human
aaaaaccacaucuccaagaug

SEQ ID NO: 469610 - RNA, 18 nt, Human
aaacauucugaggucuga

SEQ ID NO: 469611 - RNA, 23 nt, Human
aaagcuugguggcugaggcagug

SEQ ID NO: 469612 - RNA, 22 nt, Human
aaauaccaguaacaaaccucac

SEQ ID NO: 469613 - RNA, 19 nt, Human
aagaaaaacucagcagucc

SEQ ID NO: 469614 - RNA, 21 nt, Human
aaggaggagggccaggugggu

SEQ ID NO: 469615 - RNA, 22 nt, Human
aagucgucccagagccccucca

SEQ ID NO: 469616 - RNA, 23 nt, Human
aaguguguuuucaagucaacuuc

SEQ ID NO: 469617 - RNA, 21 nt, Human
aaguuaaacucagccauucca

SEQ ID NO: 469618 - RNA, 18 nt, Human
accagcugaccccccaug

SEQ ID NO: 469619 - RNA, 19 nt, Human
accagcugaccccccauga

SEQ ID NO: 469620 - RNA, 21 nt, Human
acccaaaaaaccaaaucccaa

SEQ ID NO: 469621 - RNA, 22 nt, Human
acccagcaugguggagcagcuu

SEQ ID NO: 469622 - RNA, 23 nt, Human
accucggugcccugagccuucug

SEQ ID NO: 469623 - RNA, 18 nt, Human
acgugaaaaaaauaccag

SEQ ID NO: 469624 - RNA, 24 nt, Human
agaaagcucuggaggagcucggcu

SEQ ID NO: 469625 - RNA, 21 nt, Human
agaaugacaggcugagacugu

SEQ ID NO: 469626 - RNA, 18 nt, Human
agacaaaauaacucaaac

SEQ ID NO: 469627 - RNA, 25 nt, Human
agaugggaucuggguggcaggagag

SEQ ID NO: 469628 - RNA, 21 nt, Human
agcuugguggcugaggcagug

SEQ ID NO: 469629 - RNA, 22 nt, Human
aggaaauggcaaagaggcaaaa

SEQ ID NO: 469630 - RNA, 20 nt, Human
aggaggagggccaggugggu

SEQ ID NO: 469631 - RNA, 24 nt, Human
aggcaaaaaggaaagcugcaccag

SEQ ID NO: 469632 - RNA, 21 nt, Human
aggggcguuaggauuucacag

SEQ ID NO: 469633 - RNA, 23 nt, Human
aggugcugggggugcuggcagga

SEQ ID NO: 469634 - RNA, 19 nt, Human
aguggcuguggaaaaggag

SEQ ID NO: 469635 - RNA, 23 nt, Human
aguggcuguggaaaaggaggagg

SEQ ID NO: 469636 - RNA, 24 nt, Human
aguuugguuuaacuacuggcuuug

SEQ ID NO: 469637 - RNA, 20 nt, Human
aucuggguggcaggagaggu

SEQ ID NO: 469638 - RNA, 20 nt, Human
augauccuuggcuugagggc

SEQ ID NO: 469639 - RNA, 18 nt, Human
auggcaaagaggcaaaaa

SEQ ID NO: 469640 - RNA, 23 nt, Human
caagauggcaccuguuuccugcc

SEQ ID NO: 469641 - RNA, 22 nt, Human
cacagaagggacaacgaccacc

SEQ ID NO: 469642 - RNA, 22 nt, Human
cacaucuccaagaugaaugccu

SEQ ID NO: 469643 - RNA, 21 nt, Human
caccagcggaggccaggugcc

SEQ ID NO: 469644 - RNA, 23 nt, Human
cagaagaaaaggcacugacgcac

SEQ ID NO: 469645 - RNA, 19 nt, Human
cagaagggacaacgaccac

SEQ ID NO: 469646 - RNA, 21 nt, Human
cagaucuccacccugacgcug

SEQ ID NO: 469647 - RNA, 23 nt, Human
cagcaguccuugguuauucagug

SEQ ID NO: 469648 - RNA, 19 nt, Human
cagcggcacaguugguguc

SEQ ID NO: 469649 - RNA, 21 nt, Human
caggugcugggggugcuggca

SEQ ID NO: 469650 - RNA, 24 nt, Human
caggugcugggggugcuggcagga

SEQ ID NO: 469651 - RNA, 22 nt, Human
caucauaaaaaugggacauaac

SEQ ID NO: 469652 - RNA, 21 nt, Human
ccaggccggcaagugcaccuc

SEQ ID NO: 469653 - RNA, 19 nt, Human
cccagagugucuccuggug

SEQ ID NO: 469654 - RNA, 23 nt, Human
cccgaaaaaccacaucuccaaga

SEQ ID NO: 469655 - RNA, 23 nt, Human
cccugacgcugugguggcugcgg

SEQ ID NO: 469656 - RNA, 20 nt, Human
cccugagccuucuguggggc

SEQ ID NO: 469657 - RNA, 23 nt, Human
cccuggagggcagguugggcgcg

SEQ ID NO: 469658 - RNA, 23 nt, Human
cccuuaaaaaaaaaagacccaaa

SEQ ID NO: 469659 - RNA, 24 nt, Human
ccuccagucugucccacacaccug

SEQ ID NO: 469660 - RNA, 20 nt, Human
ccugguaccaggcuggucuc

SEQ ID NO: 469661 - RNA, 18 nt, Human
ccuuaaaaaaaaaagacc

SEQ ID NO: 469662 - RNA, 20 nt, Human
cgcugcugcacgcugugaac

SEQ ID NO: 469663 - RNA, 19 nt, Human
cuaacuggacaccaaaagc

SEQ ID NO: 469664 - RNA, 24 nt, Human
cuagcaggugcugggggugcuggc

SEQ ID NO: 469665 - RNA, 21 nt, Human
cucuggaggagcucggcuuca

SEQ ID NO: 469666 - RNA, 21 nt, Human
cucuugagaugggaucugggu

SEQ ID NO: 469667 - RNA, 22 nt, Human
cuggcaggaggaggcgcggggc

SEQ ID NO: 469668 - RNA, 21 nt, Human
cuggucucaggcacgugaaaa

SEQ ID NO: 469669 - RNA, 21 nt, Human
cuucacacaucacaaagaccg

SEQ ID NO: 469670 - RNA, 23 nt, Human
cuuugaagcugaguccccucugg

SEQ ID NO: 469671 - RNA, 23 nt, Human
gaaggcgaggccaggggagacac

SEQ ID NO: 469672 - RNA, 24 nt, Human
gaauuuguugcaagaacuucagac

SEQ ID NO: 469673 - RNA, 19 nt, Human
gacaaagucgucccagagc

SEQ ID NO: 469674 - RNA, 20 nt, Human
gaggagggccaggugggugc

SEQ ID NO: 469675 - RNA, 23 nt, Human
gcacgugaaaaaaauaccaguaa

SEQ ID NO: 469676 - RNA, 24 nt, Human
gcccugagccuucuguggggccuc

SEQ ID NO: 469677 - RNA, 20 nt, Human
gcguuaggauuucacaguga

SEQ ID NO: 469678 - RNA, 24 nt, Human
gcuagcaggugcugggggugcugg

SEQ ID NO: 469679 - RNA, 22 nt, Human
gcuccacaauaagaaagaacaa

SEQ ID NO: 469680 - RNA, 20 nt, Human
gcuugguggcugaggcagug

SEQ ID NO: 469681 - RNA, 18 nt, Human
ggagaugcugcuggggaa

SEQ ID NO: 469682 - RNA, 22 nt, Human
ggaggagggccaggugggugcu

SEQ ID NO: 469683 - RNA, 19 nt, Human
ggcaaagaggcaaaaagga

SEQ ID NO: 469684 - RNA, 20 nt, Human
ggcaaagaggcaaaaaggaa

SEQ ID NO: 469685 - RNA, 20 nt, Human
ggcaggaggaggcgcggggc

SEQ ID NO: 469686 - RNA, 19 nt, Human
gggacccagcaugguggag

SEQ ID NO: 469687 - RNA, 22 nt, Human
gggagaugcugcuggggaaccc

SEQ ID NO: 469688 - RNA, 24 nt, Human
gggagccagcggcacaguuggugu

SEQ ID NO: 469689 - RNA, 23 nt, Human
ggggcguuaggauuucacaguga

SEQ ID NO: 469690 - RNA, 20 nt, Human
ggugcccugagccuucugug

SEQ ID NO: 469691 - RNA, 24 nt, Human
gguugguuaaugacuaaaucucac

SEQ ID NO: 469692 - RNA, 21 nt, Human
guaacaugggcgagcucuuga

SEQ ID NO: 469693 - RNA, 19 nt, Human
guagagcauggcaugggau

SEQ ID NO: 469694 - RNA, 20 nt, Human
gucccagagccccuccaggg

SEQ ID NO: 469695 - RNA, 22 nt, Human
gucccagagccccuccagggcc

SEQ ID NO: 469696 - RNA, 23 nt, Human
gucccagagccccuccagggcca

SEQ ID NO: 469697 - RNA, 21 nt, Human
gucugcacagaaagcauagga

SEQ ID NO: 469698 - RNA, 19 nt, Human
gugcuggcaggaggaggcg

SEQ ID NO: 469699 - RNA, 21 nt, Human
gugggcggagaaagcucugga

SEQ ID NO: 469700 - RNA, 22 nt, Human
uaaaaacagauaucuaagacaa

SEQ ID NO: 469701 - RNA, 24 nt, Human
uaaccauuuuuuguucccuuaaaa

SEQ ID NO: 469702 - RNA, 20 nt, Human
uaagacaaaauaacucaaac

SEQ ID NO: 469703 - RNA, 23 nt, Human
uaccacacaguggcagcuuuugg

SEQ ID NO: 469704 - RNA, 21 nt, Human
uagcaggugcugggggugcug

SEQ ID NO: 469705 - RNA, 18 nt, Human
uaggauguauuguauuaa

SEQ ID NO: 469706 - RNA, 20 nt, Human
uauguaaaaaugcaggagaa

SEQ ID NO: 469707 - RNA, 20 nt, Human
ucaaacauucugaggucuga

SEQ ID NO: 469708 - RNA, 27 nt, Human
ucagcaguccuugguuauucaguguuu

SEQ ID NO: 469709 - RNA, 24 nt, Human
ucaggcacgugaaaaaaauaccag

SEQ ID NO: 469710 - RNA, 19 nt, Human
uccacaacugcuaccggug

SEQ ID NO: 469711 - RNA, 23 nt, Human
uccacaauaagaaagaacaaagg

SEQ ID NO: 469712 - RNA, 19 nt, Human
uccacccugacgcuguggu

SEQ ID NO: 469713 - RNA, 23 nt, Human
ucccagagccccuccagggccag

SEQ ID NO: 469714 - RNA, 23 nt, Human
ucccaggccggcaagugcaccuc

SEQ ID NO: 469715 - RNA, 26 nt, Human
ucccuuaaaaaaaaaagacccaaaaa

SEQ ID NO: 469716 - RNA, 21 nt, Human
uccugguaccaggcuggucuc

SEQ ID NO: 469717 - RNA, 22 nt, Human
uccuuggcuugagggcaggcug

SEQ ID NO: 469718 - RNA, 21 nt, Human
ucggcuucagguggcagggag

SEQ ID NO: 469719 - RNA, 20 nt, Human
ucggugcccugagccuucug

SEQ ID NO: 469720 - RNA, 20 nt, Human
ucuggaggagcucggcuuca

SEQ ID NO: 469721 - RNA, 18 nt, Human
ugaagaaaaacucagcag

SEQ ID NO: 469722 - RNA, 18 nt, Human
ugaagggaaggcuucaca

SEQ ID NO: 469723 - RNA, 22 nt, Human
ugacuaaaucucacuacaugaa

SEQ ID NO: 469724 - RNA, 24 nt, Human
ugagaccagcugaccccccaugaa

SEQ ID NO: 469725 - RNA, 24 nt, Human
ugagaggcagaggguagagcaugg

SEQ ID NO: 469726 - RNA, 19 nt, Human
ugagguuguguggggugug

SEQ ID NO: 469727 - RNA, 20 nt, Human
ugaguggcuguggaaaagga

SEQ ID NO: 469728 - RNA, 21 nt, Human
ugauagcagaauuggcaucuc

SEQ ID NO: 469729 - RNA, 19 nt, Human
ugaugaggcagcuagcugg

SEQ ID NO: 469730 - RNA, 23 nt, Human
ugcaagaacuucagacagacgug

SEQ ID NO: 469731 - RNA, 20 nt, Human
ugcacagaagggacaacgac

SEQ ID NO: 469732 - RNA, 24 nt, Human
ugcacagaagggacaacgaccacc

SEQ ID NO: 469733 - RNA, 20 nt, Human
ugcaggagaauucucagaaa

SEQ ID NO: 469734 - RNA, 20 nt, Human
ugcccuccugccugaggguc

SEQ ID NO: 469735 - RNA, 22 nt, Human
ugcccugagccuucuguggggc

SEQ ID NO: 469736 - RNA, 18 nt, Human
ugcugcacgcugugaaca

SEQ ID NO: 469737 - RNA, 22 nt, Human
uggaaaaacuagagauggggcc

SEQ ID NO: 469738 - RNA, 18 nt, Human
uggaggagcucggcuuca

SEQ ID NO: 469739 - RNA, 21 nt, Human
uggcaggagagguugcuuuuc

SEQ ID NO: 469740 - RNA, 21 nt, Human
uggcaucauaaaaaugggaca

SEQ ID NO: 469741 - RNA, 24 nt, Human
uggccgagguggccaagauggcac

SEQ ID NO: 469742 - RNA, 24 nt, Human
uggccuaacuggacaccaaaagcu

SEQ ID NO: 469743 - RNA, 19 nt, Human
uggcuguggaaaaggagga

SEQ ID NO: 469744 - RNA, 18 nt, Human
uggcuugagggcaggcug

SEQ ID NO: 469745 - RNA, 21 nt, Human
ugggaucuggguggcaggaga

SEQ ID NO: 469746 - RNA, 18 nt, Human
ugggaugggcagcugucu

SEQ ID NO: 469747 - RNA, 21 nt, Human
ugggaugggcagcugucuguu

SEQ ID NO: 469748 - RNA, 24 nt, Human
ugggcugcccuggccgagguggaa

SEQ ID NO: 469749 - RNA, 18 nt, Human
ugguaggaaaaagcuugg

SEQ ID NO: 469750 - RNA, 24 nt, Human
ugguaggaaaaagcuugguggcug

SEQ ID NO: 469751 - RNA, 23 nt, Human
uggucagugcccuccugccugag

SEQ ID NO: 469752 - RNA, 22 nt, Human
ugguggccccagugaguggcug

SEQ ID NO: 469753 - RNA, 25 nt, Human
ugguuaaugacuaaaucucacuacc

SEQ ID NO: 469754 - RNA, 19 nt, Human
uguccuggaggcccagagu

SEQ ID NO: 469755 - RNA, 20 nt, Human
uguccuggaggcccagagug

SEQ ID NO: 469756 - RNA, 20 nt, Human
ugucgggagaugcugcuggg

SEQ ID NO: 469757 - RNA, 21 nt, Human
uguggucagugcccuccugcc

SEQ ID NO: 469758 - RNA, 18 nt, Human
ugugugggguguggucag

SEQ ID NO: 469759 - RNA, 23 nt, Human
uugguggccccagugaguggcug

SEQ ID NO: 469760 - RNA, 25 nt, Human
uugguggccccagugaguggcugug

SEQ ID NO: 469761 - RNA, 24 nt, Human
uuguucccuuaaaaaaaaaagacc

SEQ ID NO: 469762 - RNA, 22 nt, Human
uuuauguaaaaaugcaggagaa

SEQ ID NO: 469763 - RNA, 18 nt, Human
uuuguugcaagaacuuca

SEQ ID NO: 469764 - RNA, 24 nt, Human
uuuguugcaagaacuucagacaga

SEQ ID NO: 469765 - RNA, 18 nt, Human
accccucucgguccucca

SEQ ID NO: 469766 - RNA, 25 nt, Human
agcugcccugggcucacuguggguu

SEQ ID NO: 469767 - RNA, 20 nt, Human
agggagcaggugcugggcug

SEQ ID NO: 469768 - RNA, 21 nt, Human
agggcugggcuggagccugag

SEQ ID NO: 469769 - RNA, 22 nt, Human
agggguagggcugggcuggagc

SEQ ID NO: 469770 - RNA, 20 nt, Human
agguggagggcugccccggg

SEQ ID NO: 469771 - RNA, 19 nt, Human
cacagcagggguagggcug

SEQ ID NO: 469772 - RNA, 21 nt, Human
cacugucucccuccacccuca

SEQ ID NO: 469773 - RNA, 18 nt, Human
cagagagcugcccugggc

SEQ ID NO: 469774 - RNA, 20 nt, Human
cagagcauuucccagguggg

SEQ ID NO: 469775 - RNA, 21 nt, Human
cagagcauuucccaggugggu

SEQ ID NO: 469776 - RNA, 20 nt, Human
cagcagggguagggcugggc

SEQ ID NO: 469777 - RNA, 22 nt, Human
caggcagagagcugcccugggc

SEQ ID NO: 469778 - RNA, 19 nt, Human
ccagacaucuguuugcugu

SEQ ID NO: 469779 - RNA, 21 nt, Human
cccacugucucccuccacccu

SEQ ID NO: 469780 - RNA, 19 nt, Human
cccagguggguggagacgg

SEQ ID NO: 469781 - RNA, 21 nt, Human
ccccgggcucgcuguggaccc

SEQ ID NO: 469782 - RNA, 22 nt, Human
ccccgggcucgcuguggacccu

SEQ ID NO: 469783 - RNA, 23 nt, Human
cccgccuccaguccccacacccc

SEQ ID NO: 469784 - RNA, 21 nt, Human
ccgagugguccguugccuccc

SEQ ID NO: 469785 - RNA, 18 nt, Human
ccgucacucaggggaccc

SEQ ID NO: 469786 - RNA, 21 nt, Human
ccuccaguccccacaccccuc

SEQ ID NO: 469787 - RNA, 19 nt, Human
cucacugccagacaucugu

SEQ ID NO: 469788 - RNA, 23 nt, Human
cucacuguggguucagcugaggc

SEQ ID NO: 469789 - RNA, 18 nt, Human
cuccaguccccacacccc

SEQ ID NO: 469790 - RNA, 19 nt, Human
cugagaccccucucggucc

SEQ ID NO: 469791 - RNA, 18 nt, Human
cugaggcuggcuaggucu

SEQ ID NO: 469792 - RNA, 22 nt, Human
cuuggcgggcaggggugggggu

SEQ ID NO: 469793 - RNA, 23 nt, Human
gagcuuggcgggcaggggugggg

SEQ ID NO: 469794 - RNA, 21 nt, Human
gaggcuggcuaggucuucucc

SEQ ID NO: 469795 - RNA, 20 nt, Human
gagugguccguugccuccca

SEQ ID NO: 469796 - RNA, 21 nt, Human
gaucccgccuccaguccccac

SEQ ID NO: 469797 - RNA, 23 nt, Human
gcacagcagggguagggcugggc

SEQ ID NO: 469798 - RNA, 19 nt, Human
gcagagcauuucccaggug

SEQ ID NO: 469799 - RNA, 23 nt, Human
gcagggguggggguccgaguggu

SEQ ID NO: 469800 - RNA, 23 nt, Human
gccuccaguccccacacccccuu

SEQ ID NO: 469801 - RNA, 19 nt, Human
gccugggaacggcugcagu

SEQ ID NO: 469802 - RNA, 21 nt, Human
gcugggcugugggaggggccg

SEQ ID NO: 469803 - RNA, 23 nt, Human
gcuuggcgggcaggggugggggu

SEQ ID NO: 469804 - RNA, 18 nt, Human
ggacccggucuucgaggg

SEQ ID NO: 469805 - RNA, 23 nt, Human
ggagcaggugcugggcuguggga

SEQ ID NO: 469806 - RNA, 22 nt, Human
ggagcuuggcgggcaggggugg

SEQ ID NO: 469807 - RNA, 19 nt, Human
ggcagggguggggguccga

SEQ ID NO: 469808 - RNA, 22 nt, Human
ggcagggguggggguccgagug

SEQ ID NO: 469809 - RNA, 19 nt, Human
ggcucgcuguggacccugg

SEQ ID NO: 469810 - RNA, 20 nt, Human
ggugcugggcugugggaggg

SEQ ID NO: 469811 - RNA, 19 nt, Human
gguucagcugaggcuggcu

SEQ ID NO: 469812 - RNA, 24 nt, Human
gguucugugcagggcugccugcug

SEQ ID NO: 469813 - RNA, 20 nt, Human
gucucccuccacccucacug

SEQ ID NO: 469814 - RNA, 23 nt, Human
ucacugccagacaucuguuugcc

SEQ ID NO: 469815 - RNA, 18 nt, Human
ucagggagcaggugcugg

SEQ ID NO: 469816 - RNA, 20 nt, Human
uccacccucacugccagacc

SEQ ID NO: 469817 - RNA, 19 nt, Human
ucgagggugcugccgccca

SEQ ID NO: 469818 - RNA, 19 nt, Human
ugcacagcagggguagggc

SEQ ID NO: 469819 - RNA, 28 nt, Human
ugcagugcacagcagggguuggaaggcc

SEQ ID NO: 469820 - RNA, 18 nt, Human
ugccagacaucuguuugc

SEQ ID NO: 469821 - RNA, 18 nt, Human
ugcccucuccaggcccug

SEQ ID NO: 469822 - RNA, 18 nt, Human
ugcccucuccaggcugug

SEQ ID NO: 469823 - RNA, 18 nt, Human
ugccugggaacggcugca

SEQ ID NO: 469824 - RNA, 19 nt, Human
ugccugggaacggcugcag

SEQ ID NO: 469825 - RNA, 23 nt, Human
ugcuuggagcuuggcgggcaggg

SEQ ID NO: 469826 - RNA, 21 nt, Human
uggagccugagugaucccgcc

SEQ ID NO: 469827 - RNA, 19 nt, Human
ugggaggggccgcagagca

SEQ ID NO: 469828 - RNA, 18 nt, Human
uguggugagcaggcagag

SEQ ID NO: 469829 - RNA, 21 nt, Human
uguggugagcaggcagagagc

SEQ ID NO: 469830 - RNA, 19 nt, Human
uuggauggugugcccucuc

SEQ ID NO: 469831 - RNA, 20 nt, Human
uuggcgggcagggguggggg

SEQ ID NO: 469832 - RNA, 19 nt, Human
uuggguggugugcccucuc

SEQ ID NO: 469833 - RNA, 24 nt, Human
uuugcugucagcccacgagggggc

SEQ ID NO: 469834 - RNA, 20 nt, Human
agagcuccacuccacuccuc

SEQ ID NO: 469835 - RNA, 22 nt, Human
cacaacuagccccuuugccuuu

SEQ ID NO: 469836 - RNA, 24 nt, Human
ccaaaaauccaguaauacuagaaa

SEQ ID NO: 469837 - RNA, 21 nt, Human
ccccaaaaauccaguaauacu

SEQ ID NO: 469838 - RNA, 24 nt, Human
cuacaaauuuuuccccaaaaaucc

SEQ ID NO: 469839 - RNA, 18 nt, Human
gagcuccacuccacuccu

SEQ ID NO: 469840 - RNA, 22 nt, Human
uaaggaccccugugcucuuaca

SEQ ID NO: 469841 - RNA, 20 nt, Human
uagaaacaaauagauuuccu

SEQ ID NO: 469842 - RNA, 24 nt, Human
uuccugugcaggcaaauggcacaa

SEQ ID NO: 469843 - RNA, 18 nt, Human
aaacucaguuuccccacc

SEQ ID NO: 469844 - RNA, 22 nt, Human
aagaaauggggucuugcuaugu

SEQ ID NO: 469845 - RNA, 22 nt, Human
accgcagcuuccagaagguguc

SEQ ID NO: 469846 - RNA, 18 nt, Human
aggaauccucucaccuca

SEQ ID NO: 469847 - RNA, 20 nt, Human
aggaauccucucaccucagc

SEQ ID NO: 469848 - RNA, 19 nt, Human
aucauuuuucagagaacag

SEQ ID NO: 469849 - RNA, 18 nt, Human
caaaaaugccucaagcga

SEQ ID NO: 469850 - RNA, 24 nt, Human
caagcgaaaaucaggucuuccccu

SEQ ID NO: 469851 - RNA, 25 nt, Human
caccucagccuccugagucacugug

SEQ ID NO: 469852 - RNA, 20 nt, Human
caguucucuucagccgcagc

SEQ ID NO: 469853 - RNA, 26 nt, Human
ccaaagcucuccuaguucacaacugg

SEQ ID NO: 469854 - RNA, 19 nt, Human
ccggccggauucucccucc

SEQ ID NO: 469855 - RNA, 20 nt, Human
ccuaaauucuuuuuuggcgc

SEQ ID NO: 469856 - RNA, 26 nt, Human
ccucccguagagaagcaccacggggc

SEQ ID NO: 469857 - RNA, 24 nt, Human
ccucucaccucagccuccugaguc

SEQ ID NO: 469858 - RNA, 24 nt, Human
cuauguugcccaagguuggucucg

SEQ ID NO: 469859 - RNA, 19 nt, Human
cucaaggaauccucucacc

SEQ ID NO: 469860 - RNA, 22 nt, Human
cuccugagucacugugauuaca

SEQ ID NO: 469861 - RNA, 19 nt, Human
cucgaacccuggccucaag

SEQ ID NO: 469862 - RNA, 22 nt, Human
cucucuugcuugggacagaggu

SEQ ID NO: 469863 - RNA, 18 nt, Human
gacugugugugugugugu

SEQ ID NO: 469864 - RNA, 18 nt, Human
gauuacagugugagcuac

SEQ ID NO: 469865 - RNA, 22 nt, Human
gauuacagugugagcuacugca

SEQ ID NO: 469866 - RNA, 24 nt, Human
gcagcuuuccugucguccccgcgc

SEQ ID NO: 469867 - RNA, 21 nt, Human
ggaauccucucaccucagccu

SEQ ID NO: 469868 - RNA, 22 nt, Human
gggucuugcuauguugcccaag

SEQ ID NO: 469869 - RNA, 21 nt, Human
gugugugugugugugugugug

SEQ ID NO: 469870 - RNA, 21 nt, Human
gugugugugugugugugugug

SEQ ID NO: 469871 - RNA, 21 nt, Human
gugugugugugugugugugug

SEQ ID NO: 469872 - RNA, 20 nt, Human
uagcuccucaggcgacuccu

SEQ ID NO: 469873 - RNA, 18 nt, Human
uauguugcccaagguugg

SEQ ID NO: 469874 - RNA, 22 nt, Human
uauguugcccaagguuggucuc

SEQ ID NO: 469875 - RNA, 25 nt, Human
uauguugcccaagguuggucucgaa

SEQ ID NO: 469876 - RNA, 19 nt, Human
ucagccgcagcuuuccugu

SEQ ID NO: 469877 - RNA, 22 nt, Human
ucaggcgacuccugccaagucc

SEQ ID NO: 469878 - RNA, 21 nt, Human
ucaguuuccccaccgcagcuu

SEQ ID NO: 469879 - RNA, 22 nt, Human
uccccaccgcagcuuccagaag

SEQ ID NO: 469880 - RNA, 24 nt, Human
uccccgcgcggugcugaaccccau

SEQ ID NO: 469881 - RNA, 21 nt, Human
ucuccuaguucacaacugggc

SEQ ID NO: 469882 - RNA, 21 nt, Human
ucucuugcuugggacagaggu

SEQ ID NO: 469883 - RNA, 18 nt, Human
ucugcaauaaacccagga

SEQ ID NO: 469884 - RNA, 19 nt, Human
ucuugcuauguugcccaag

SEQ ID NO: 469885 - RNA, 20 nt, Human
ucuugcuauguugcccaagg

SEQ ID NO: 469886 - RNA, 24 nt, Human
ucuugcuauguugcccaagguugg

SEQ ID NO: 469887 - RNA, 25 nt, Human
ucuugcuauguugcccaagguuggu

SEQ ID NO: 469888 - RNA, 24 nt, Human
ugacugugugugugugugugugug

SEQ ID NO: 469889 - RNA, 19 nt, Human
ugcaauaaacccaggaggc

SEQ ID NO: 469890 - RNA, 23 nt, Human
ugcuauguugcccaagguugguc

SEQ ID NO: 469891 - RNA, 25 nt, Human
uggggucuugcuauguugcccaagg

SEQ ID NO: 469892 - RNA, 23 nt, Human
ugugagcuacugcaucuggagac

SEQ ID NO: 469893 - RNA, 21 nt, Human
ugugauuacagugugagcuac

SEQ ID NO: 469894 - RNA, 23 nt, Human
ugugauuacagugugagcuacug

SEQ ID NO: 469895 - RNA, 21 nt, Human
ugugugugucugucugucugu

SEQ ID NO: 469896 - RNA, 19 nt, Human
ugugugugugugucugucu

SEQ ID NO: 469897 - RNA, 20 nt, Human
ugugugugugugucugucug

SEQ ID NO: 469898 - RNA, 20 nt, Human
ugugugugugugugugucug

SEQ ID NO: 469899 - RNA, 21 nt, Human
ugugugugugugugugucugu

SEQ ID NO: 469900 - RNA, 18 nt, Human
ugugugugugugugugug

SEQ ID NO: 469901 - RNA, 18 nt, Human
ugugugugugugugugug

SEQ ID NO: 469902 - RNA, 18 nt, Human
ugugugugugugugugug

SEQ ID NO: 469903 - RNA, 18 nt, Human
ugugugugugugugugug

SEQ ID NO: 469904 - RNA, 18 nt, Human
ugugugugugugugugug

SEQ ID NO: 469905 - RNA, 18 nt, Human
ugugugugugugugugug

SEQ ID NO: 469906 - RNA, 18 nt, Human
ugugugugugugugugug

SEQ ID NO: 469907 - RNA, 18 nt, Human
ugugugugugugugugug

SEQ ID NO: 469908 - RNA, 18 nt, Human
ugugugugugugugugug

SEQ ID NO: 469909 - RNA, 18 nt, Human
ugugugugugugugugug

SEQ ID NO: 469910 - RNA, 18 nt, Human
ugugugugugugugugug

SEQ ID NO: 469911 - RNA, 18 nt, Human
ugugugugugugugugug

SEQ ID NO: 469912 - RNA, 18 nt, Human
ugugugugugugugugug

SEQ ID NO: 469913 - RNA, 18 nt, Human
ugugugugugugugugug

SEQ ID NO: 469914 - RNA, 22 nt, Human
ugugugugugugugugugucug

SEQ ID NO: 469915 - RNA, 21 nt, Human
ugugugugugugugugugugu

SEQ ID NO: 469916 - RNA, 21 nt, Human
ugugugugugugugugugugu

SEQ ID NO: 469917 - RNA, 21 nt, Human
ugugugugugugugugugugu

SEQ ID NO: 469918 - RNA, 21 nt, Human
ugugugugugugugugugugu

SEQ ID NO: 469919 - RNA, 21 nt, Human
ugugugugugugugugugugu

SEQ ID NO: 469920 - RNA, 21 nt, Human
ugugugugugugugugugugu

SEQ ID NO: 469921 - RNA, 21 nt, Human
ugugugugugugugugugugu

SEQ ID NO: 469922 - RNA, 21 nt, Human
ugugugugugugugugugugu

SEQ ID NO: 469923 - RNA, 21 nt, Human
ugugugugugugugugugugu

SEQ ID NO: 469924 - RNA, 21 nt, Human
ugugugugugugugugugugu

SEQ ID NO: 469925 - RNA, 21 nt, Human
ugugugugugugugugugugu

SEQ ID NO: 469926 - RNA, 21 nt, Human
ugugugugugugugugugugu

SEQ ID NO: 469927 - RNA, 21 nt, Human
ugugugugugugugugugugu

SEQ ID NO: 469928 - RNA, 21 nt, Human
ugugugugugugugugugugu

SEQ ID NO: 469929 - RNA, 21 nt, Human
ugugugugugugugugugugu

SEQ ID NO: 469930 - RNA, 21 nt, Human
ugugugugugugugugugugu

SEQ ID NO: 469931 - RNA, 21 nt, Human
ugugugugugugugugugugu

SEQ ID NO: 469932 - RNA, 21 nt, Human
ugugugugugugugugugugu

SEQ ID NO: 469933 - RNA, 21 nt, Human
ugugugugugugugugugugu

SEQ ID NO: 469934 - RNA, 21 nt, Human
ugugugugugugugugugugu

SEQ ID NO: 469935 - RNA, 21 nt, Human
ugugugugugugugugugugu

SEQ ID NO: 469936 - RNA, 21 nt, Human
ugugugugugugugugugugu

SEQ ID NO: 469937 - RNA, 21 nt, Human
ugugugugugugugugugugu

SEQ ID NO: 469938 - RNA, 21 nt, Human
ugugugugugugugugugugu

SEQ ID NO: 469939 - RNA, 22 nt, Human
ugugugugugugugugugugug

SEQ ID NO: 469940 - RNA, 22 nt, Human
ugugugugugugugugugugug

SEQ ID NO: 469941 - RNA, 22 nt, Human
ugugugugugugugugugugug

SEQ ID NO: 469942 - RNA, 22 nt, Human
ugugugugugugugugugugug

SEQ ID NO: 469943 - RNA, 22 nt, Human
ugugugugugugugugugugug

SEQ ID NO: 469944 - RNA, 22 nt, Human
ugugugugugugugugugugug

SEQ ID NO: 469945 - RNA, 22 nt, Human
ugugugugugugugugugugug

SEQ ID NO: 469946 - RNA, 22 nt, Human
ugugugugugugugugugugug

SEQ ID NO: 469947 - RNA, 22 nt, Human
ugugugugugugugugugugug

SEQ ID NO: 469948 - RNA, 23 nt, Human
ugugugugugugugugugugugu

SEQ ID NO: 469949 - RNA, 21 nt, Human
uuccagaaggugucuguagcc

SEQ ID NO: 469950 - RNA, 26 nt, Human
uucucccucccucccucccguagaga

SEQ ID NO: 469951 - RNA, 19 nt, Human
uuuccugucguccccgcgc

SEQ ID NO: 469952 - RNA, 23 nt, Human
aaaaugcaaaguauugaaggcac

SEQ ID NO: 469953 - RNA, 23 nt, Human
aaaugcaaaguauugaaggcacu

SEQ ID NO: 469954 - RNA, 22 nt, Human
acagagguaacucaacggccca

SEQ ID NO: 469955 - RNA, 18 nt, Human
aggacagaggguaggcaa

SEQ ID NO: 469956 - RNA, 20 nt, Human
aggcaggagcacacggcagc

SEQ ID NO: 469957 - RNA, 19 nt, Human
cacggcagcaaggggcagg

SEQ ID NO: 469958 - RNA, 18 nt, Human
cacuuacaauaacaaggc

SEQ ID NO: 469959 - RNA, 20 nt, Human
cagaagcuacaucaugagca

SEQ ID NO: 469960 - RNA, 21 nt, Human
caggcagccacucugccucca

SEQ ID NO: 469961 - RNA, 19 nt, Human
cgaguuaguggcucuucuc

SEQ ID NO: 469962 - RNA, 21 nt, Human
cggcagcaaggggcaggcugg

SEQ ID NO: 469963 - RNA, 20 nt, Human
cuuuuuuuuuuuuuuuuugg

SEQ ID NO: 469964 - RNA, 25 nt, Human
gaccguggaaugaaugcaggcagcc

SEQ ID NO: 469965 - RNA, 25 nt, Human
gacugucuuuggaacaagcugugga

SEQ ID NO: 469966 - RNA, 21 nt, Human
gaggguaggcaagugggggca

SEQ ID NO: 469967 - RNA, 22 nt, Human
gcccaccugcucacggcccagc

SEQ ID NO: 469968 - RNA, 24 nt, Human
gcggcuagcucuacagaagauaaa

SEQ ID NO: 469969 - RNA, 25 nt, Human
gcuuuuuuuuuuuuuuuuuguuuuu

SEQ ID NO: 469970 - RNA, 20 nt, Human
ggagcacacggcagcaaggg

SEQ ID NO: 469971 - RNA, 18 nt, Human
ggcaagugggggcacggg

SEQ ID NO: 469972 - RNA, 20 nt, Human
uaacucaacggcccaccugc

SEQ ID NO: 469973 - RNA, 25 nt, Human
uaacucaacggcccaccugcucacg

SEQ ID NO: 469974 - RNA, 21 nt, Human
uacaauaacaaggcaggacag

SEQ ID NO: 469975 - RNA, 23 nt, Human
uacaauaacaaggcaggacagag

SEQ ID NO: 469976 - RNA, 20 nt, Human
ucccaaaaugcaaaguauug

SEQ ID NO: 469977 - RNA, 19 nt, Human
ucuacagaagauaaaaauc

SEQ ID NO: 469978 - RNA, 23 nt, Human
ugaaaauaguuugucaagugcag

SEQ ID NO: 469979 - RNA, 23 nt, Human
uggaauggaccguggaaugaaug

SEQ ID NO: 469980 - RNA, 21 nt, Human
uggagaaaaagaaaagcuaca

SEQ ID NO: 469981 - RNA, 19 nt, Human
uggcucuucucagcagcga

SEQ ID NO: 469982 - RNA, 23 nt, Human
uuggcaggggagggagccuuuuu

SEQ ID NO: 469983 - RNA, 24 nt, Human
uuggcaggggagggagccuuuuuu

SEQ ID NO: 469984 - RNA, 27 nt, Human
uuuuuuuuuguuuuuuuuuuuuuuuuu

SEQ ID NO: 469985 - RNA, 24 nt, Human
uuuuuuuuuuggcaggggagggag

SEQ ID NO: 469986 - RNA, 19 nt, Human
uuuuuuuuuuuuggcaggg

SEQ ID NO: 469987 - RNA, 25 nt, Human
uuuuuuuuuuuuuuuuuggcagggg

SEQ ID NO: 469988 - RNA, 22 nt, Human
uuuuuuuuuuuuuuuuuuuggc

SEQ ID NO: 469989 - RNA, 19 nt, Human
aaaaagaccuucuacacuu

SEQ ID NO: 469990 - RNA, 20 nt, Human
aaccauaguuucucaaucug

SEQ ID NO: 469991 - RNA, 19 nt, Human
aagcugucagugaggaugc

SEQ ID NO: 469992 - RNA, 26 nt, Human
acaaagcaggaucgcugcucagcccc

SEQ ID NO: 469993 - RNA, 22 nt, Human
acccagaucaucccccugaguc

SEQ ID NO: 469994 - RNA, 18 nt, Human
acccuggagugaagaccc

SEQ ID NO: 469995 - RNA, 25 nt, Human
agacucagaggugggcugcugagcc

SEQ ID NO: 469996 - RNA, 23 nt, Human
agagccauggccguucaggugug

SEQ ID NO: 469997 - RNA, 20 nt, Human
agauucccucaagccccguc

SEQ ID NO: 469998 - RNA, 18 nt, Human
agcagguggagcccacuc

SEQ ID NO: 469999 - RNA, 24 nt, Human
agccagcccgguccacacacucaa

SEQ ID NO: 470000 - RNA, 19 nt, Human
agccuccagaaagcugcgg

SEQ ID NO: 470001 - RNA, 24 nt, Human
agcggcccaggagccccgggugac

SEQ ID NO: 470002 - RNA, 22 nt, Human
aggaagcccucgaaguagccga

SEQ ID NO: 470003 - RNA, 18 nt, Human
aggugggcugcugagcca

SEQ ID NO: 470004 - RNA, 21 nt, Human
auccuggagcugaaaaaaccc

SEQ ID NO: 470005 - RNA, 21 nt, Human
aucgcugcucagccccagccc

SEQ ID NO: 470006 - RNA, 18 nt, Human
caacccuggguggaggaa

SEQ ID NO: 470007 - RNA, 19 nt, Human
cacgcccuccaggaagccc

SEQ ID NO: 470008 - RNA, 21 nt, Human
cacucuucaugccuuccucag

SEQ ID NO: 470009 - RNA, 21 nt, Human
cagaaugggacccagaucauc

SEQ ID NO: 470010 - RNA, 23 nt, Human
cagaaugggacccagaucauccc

SEQ ID NO: 470011 - RNA, 24 nt, Human
cagaucaucccccugagucaaccc

SEQ ID NO: 470012 - RNA, 20 nt, Human
cagcagcaucgcaaacugcu

SEQ ID NO: 470013 - RNA, 27 nt, Human
cagcagcaucgcaaacugcuggaucuc

SEQ ID NO: 470014 - RNA, 20 nt, Human
cagccccagccgguacuccc

SEQ ID NO: 470015 - RNA, 25 nt, Human
cauggccccgggccccaagggcagg

SEQ ID NO: 470016 - RNA, 19 nt, Human
cauuaugcggcugcagagc

SEQ ID NO: 470017 - RNA, 21 nt, Human
cauuaugcggcugcagagcca

SEQ ID NO: 470018 - RNA, 20 nt, Human
ccagaaugggacccagauca

SEQ ID NO: 470019 - RNA, 20 nt, Human
ccaggagccccgggugacug

SEQ ID NO: 470020 - RNA, 22 nt, Human
cccacucuucaugccuuccuca

SEQ ID NO: 470021 - RNA, 24 nt, Human
ccccaagggcagggagcgagaccc

SEQ ID NO: 470022 - RNA, 19 nt, Human
ccccgggugacugccccgg

SEQ ID NO: 470023 - RNA, 20 nt, Human
ccccugagucaacccugggu

SEQ ID NO: 470024 - RNA, 24 nt, Human
ccccuggagccccggggcucaucc

SEQ ID NO: 470025 - RNA, 22 nt, Human
cccgccccuggagccccggggc

SEQ ID NO: 470026 - RNA, 18 nt, Human
cccucaguaaucccugug

SEQ ID NO: 470027 - RNA, 22 nt, Human
ccgcaacgugaccauguaaucc

SEQ ID NO: 470028 - RNA, 18 nt, Human
ccgcgccaucguagcugc

SEQ ID NO: 470029 - RNA, 23 nt, Human
ccguagagcuucagcaggccugu

SEQ ID NO: 470030 - RNA, 26 nt, Human
ccucgaaguagccgauguccuggucc

SEQ ID NO: 470031 - RNA, 19 nt, Human
ccugcaggacacuccaggu

SEQ ID NO: 470032 - RNA, 21 nt, Human
cucaaucuguaaaauaggacc

SEQ ID NO: 470033 - RNA, 25 nt, Human
cucagccccagcccggcagagcggc

SEQ ID NO: 470034 - RNA, 19 nt, Human
cucccgccccuggagcccc

SEQ ID NO: 470035 - RNA, 20 nt, Human
cuccucugcagcgucccugu

SEQ ID NO: 470036 - RNA, 24 nt, Human
cugagucaacccuggguggaggaa

SEQ ID NO: 470037 - RNA, 21 nt, Human
cugcggcgucgcucccgcccc

SEQ ID NO: 470038 - RNA, 22 nt, Human
cuggagcugaaaaaacccuugu

SEQ ID NO: 470039 - RNA, 24 nt, Human
cuggaucucgaggggccccagcuu

SEQ ID NO: 470040 - RNA, 21 nt, Human
gaagcaaagcugagacucaga

SEQ ID NO: 470041 - RNA, 22 nt, Human
gagacccuggagugaagacccc

SEQ ID NO: 470042 - RNA, 20 nt, Human
gaggguguguucuggggcug

SEQ ID NO: 470043 - RNA, 22 nt, Human
gagucaacccuggguggaggaa

SEQ ID NO: 470044 - RNA, 22 nt, Human
gaugggcagccccagccgguac

SEQ ID NO: 470045 - RNA, 22 nt, Human
gcagggagcgagacccuggagu

SEQ ID NO: 470046 - RNA, 21 nt, Human
gcccuggggauaggguccccg

SEQ ID NO: 470047 - RNA, 18 nt, Human
gcgcacugcggaggccga

SEQ ID NO: 470048 - RNA, 23 nt, Human
ggaaauucuuuucucagucggcc

SEQ ID NO: 470049 - RNA, 18 nt, Human
ggaccgaguucuggaaau

SEQ ID NO: 470050 - RNA, 20 nt, Human
ggaggcacacagagguuacg

SEQ ID NO: 470051 - RNA, 20 nt, Human
gggagccauggaaagaaggu

SEQ ID NO: 470052 - RNA, 22 nt, Human
gggcagccccagccgguacucc

SEQ ID NO: 470053 - RNA, 24 nt, Human
gggcagggagcgagacccuggagu

SEQ ID NO: 470054 - RNA, 20 nt, Human
gggccccaagggcagggagc

SEQ ID NO: 470055 - RNA, 19 nt, Human
gggggggcccuggggauag

SEQ ID NO: 470056 - RNA, 19 nt, Human
guggaggaaaccgucuacu

SEQ ID NO: 470057 - RNA, 18 nt, Human
uaacugcuccaagcccag

SEQ ID NO: 470058 - RNA, 22 nt, Human
uaauccuguaacugcuccaagc

SEQ ID NO: 470059 - RNA, 21 nt, Human
uacugcauggccccgggcccc

SEQ ID NO: 470060 - RNA, 22 nt, Human
uagcugcgcacugcggaggccg

SEQ ID NO: 470061 - RNA, 21 nt, Human
uaguccuggaugggcagcccc

SEQ ID NO: 470062 - RNA, 18 nt, Human
uccacacugacuguacaa

SEQ ID NO: 470063 - RNA, 20 nt, Human
ucccuguggccacccuguuc

SEQ ID NO: 470064 - RNA, 24 nt, Human
uccgggaugaagggccgcauccca

SEQ ID NO: 470065 - RNA, 21 nt, Human
ucgggggccagcgccucgaug

SEQ ID NO: 470066 - RNA, 20 nt, Human
ugagugcgcaggacuccucu

SEQ ID NO: 470067 - RNA, 25 nt, Human
ugccccggacuucagggcccggcuu

SEQ ID NO: 470068 - RNA, 18 nt, Human
ugccucgggccgcugcgc

SEQ ID NO: 470069 - RNA, 21 nt, Human
uggagcugaaaaaacccuugu

SEQ ID NO: 470070 - RNA, 26 nt, Human
uggagugaagaccccccggccccgcc

SEQ ID NO: 470071 - RNA, 20 nt, Human
uggccccgggccccaagggc

SEQ ID NO: 470072 - RNA, 20 nt, Human
ugggagccauggaaagaagg

SEQ ID NO: 470073 - RNA, 19 nt, Human
uguggccacccuguuaggu

SEQ ID NO: 470074 - RNA, 20 nt, Human
uuaaaaagaccuucuacacu

SEQ ID NO: 470075 - RNA, 18 nt, Human
uuagagccuuaaaaagac

SEQ ID NO: 470076 - RNA, 23 nt, Human
uuuagagccuuaaaaagaccuuc

SEQ ID NO: 470077 - RNA, 20 nt, Human
aaccugugccacagcccccc

SEQ ID NO: 470078 - RNA, 24 nt, Human
aagaggccuugccagcuugggggc

SEQ ID NO: 470079 - RNA, 19 nt, Human
accugugccacagcccccc

SEQ ID NO: 470080 - RNA, 19 nt, Human
aggcugugucagacuuccc

SEQ ID NO: 470081 - RNA, 18 nt, Human
aucugcuucacauucucu

SEQ ID NO: 470082 - RNA, 21 nt, Human
caagggcaaccccagccaaag

SEQ ID NO: 470083 - RNA, 24 nt, Human
caccaacaagggaacauugcccca

SEQ ID NO: 470084 - RNA, 19 nt, Human
caggggcgcgccgcgcccc

SEQ ID NO: 470085 - RNA, 21 nt, Human
ccaggggcagagucccuggcc

SEQ ID NO: 470086 - RNA, 21 nt, Human
ccccccgcagcccauggaggu

SEQ ID NO: 470087 - RNA, 23 nt, Human
cccucugcagccucccagcuauu

SEQ ID NO: 470088 - RNA, 29 nt, Human
cccuuaacuccaggacuccaggggcagag

SEQ ID NO: 470089 - RNA, 18 nt, Human
ccgcgccccagggguccg

SEQ ID NO: 470090 - RNA, 19 nt, Human
ccugcagccuugccuucau

SEQ ID NO: 470091 - RNA, 19 nt, Human
ccuuccccugccuucuggg

SEQ ID NO: 470092 - RNA, 21 nt, Human
cucccagcacccucugcagcc

SEQ ID NO: 470093 - RNA, 19 nt, Human
cucuccucacaguggccuu

SEQ ID NO: 470094 - RNA, 21 nt, Human
cugggccagaccugcagccuu

SEQ ID NO: 470095 - RNA, 18 nt, Human
cuucuggggcaaccccuc

SEQ ID NO: 470096 - RNA, 22 nt, Human
gaacuucuaggggcucccagca

SEQ ID NO: 470097 - RNA, 30 nt, Human
gcccaccaacaagggaacauugccccaacc

SEQ ID NO: 470098 - RNA, 24 nt, Human
gccuucuggggcaaccccucuccu

SEQ ID NO: 470099 - RNA, 18 nt, Human
ggcagagucccuggccuu

SEQ ID NO: 470100 - RNA, 25 nt, Human
gggcaaccccagccaaagcucaccc

SEQ ID NO: 470101 - RNA, 25 nt, Human
gggcucccagcacccucugcagccu

SEQ ID NO: 470102 - RNA, 20 nt, Human
uaacuccaggacuccagggg

SEQ ID NO: 470103 - RNA, 21 nt, Human
ucacccugagccuagcucaac

SEQ ID NO: 470104 - RNA, 18 nt, Human
ucagguccuuccccugcc

SEQ ID NO: 470105 - RNA, 20 nt, Human
ucccuggccuucagccaaga

SEQ ID NO: 470106 - RNA, 24 nt, Human
ucccuuaacuccaggacuccaggg

SEQ ID NO: 470107 - RNA, 20 nt, Human
ugccacagccccccggcugu

SEQ ID NO: 470108 - RNA, 21 nt, Human
ugccccaaccugugccacagc

SEQ ID NO: 470109 - RNA, 23 nt, Human
ugccccaaccugugccacagccc

SEQ ID NO: 470110 - RNA, 20 nt, Human
ugccuucuggggcaaccccu

SEQ ID NO: 470111 - RNA, 19 nt, Human
uuaacuccaggacuccagg

SEQ ID NO: 470112 - RNA, 22 nt, Human
uuccccugggccagaccugcag

SEQ ID NO: 470113 - RNA, 19 nt, Human
uugaucugcuucacauucu

SEQ ID NO: 470114 - RNA, 19 nt, Human
aaaaaaaaaaaaaaaaaga

SEQ ID NO: 470115 - RNA, 19 nt, Human
aaaaaaaaaaaaaagaaaa

SEQ ID NO: 470116 - RNA, 19 nt, Human
aaaaaaaaaaagaaaaaaa

SEQ ID NO: 470117 - RNA, 24 nt, Human
aaaaauauuaaaacaaaaccaaga

SEQ ID NO: 470118 - RNA, 22 nt, Human
aaacaaaaccaagaauauacaa

SEQ ID NO: 470119 - RNA, 19 nt, Human
aaaccucaaccucaccacc

SEQ ID NO: 470120 - RNA, 21 nt, Human
aacagcugacccaccuccucg

SEQ ID NO: 470121 - RNA, 18 nt, Human
aacggaacagagaagcca

SEQ ID NO: 470122 - RNA, 26 nt, Human
aagaaaaaaaauauuaaaacaaaacc

SEQ ID NO: 470123 - RNA, 23 nt, Human
aauguggaaggcugagagaagga

SEQ ID NO: 470124 - RNA, 26 nt, Human
acaaaaccaagaauauacaacagaga

SEQ ID NO: 470125 - RNA, 24 nt, Human
acaucugggccaggccuucagugu

SEQ ID NO: 470126 - RNA, 20 nt, Human
accaagccccaaaccucaac

SEQ ID NO: 470127 - RNA, 21 nt, Human
accacagcaagcucgcccagg

SEQ ID NO: 470128 - RNA, 20 nt, Human
accaggaagguauauaagac

SEQ ID NO: 470129 - RNA, 26 nt, Human
agagaagccauaccuuguuucucaga

SEQ ID NO: 470130 - RNA, 21 nt, Human
agagccaaugaggugugugga

SEQ ID NO: 470131 - RNA, 21 nt, Human
agcagcugcagcuggcagggg

SEQ ID NO: 470132 - RNA, 21 nt, Human
aggcuagacaaucauucccag

SEQ ID NO: 470133 - RNA, 19 nt, Human
agggggcuggggcugcacc

SEQ ID NO: 470134 - RNA, 23 nt, Human
auguggaaggcugagagaaggac

SEQ ID NO: 470135 - RNA, 19 nt, Human
caaaguagacugcucgggc

SEQ ID NO: 470136 - RNA, 19 nt, Human
caacagcugacccaccucc

SEQ ID NO: 470137 - RNA, 19 nt, Human
caacugcuaccaagcccca

SEQ ID NO: 470138 - RNA, 19 nt, Human
cagcaugucgggcuggagc

SEQ ID NO: 470139 - RNA, 22 nt, Human
cagccaggcuccgucgccccuc

SEQ ID NO: 470140 - RNA, 18 nt, Human
cagcucggcuucuccagc

SEQ ID NO: 470141 - RNA, 21 nt, Human
caggcuccgucgccccucgug

SEQ ID NO: 470142 - RNA, 22 nt, Human
cagggcagcugaccacggggcu

SEQ ID NO: 470143 - RNA, 22 nt, Human
cagugugagugaagcucgggca

SEQ ID NO: 470144 - RNA, 21 nt, Human
caucgagaauaaucagaguug

SEQ ID NO: 470145 - RNA, 20 nt, Human
ccaaagaugggcccacagcc

SEQ ID NO: 470146 - RNA, 19 nt, Human
ccacagcaagcucgcccag

SEQ ID NO: 470147 - RNA, 19 nt, Human
ccacugagccggcagcaug

SEQ ID NO: 470148 - RNA, 20 nt, Human
ccaggaugggacaaggaaaa

SEQ ID NO: 470149 - RNA, 23 nt, Human
ccaggugcuuauccagggucuca

SEQ ID NO: 470150 - RNA, 21 nt, Human
cccaaaccucaaccucaccac

SEQ ID NO: 470151 - RNA, 18 nt, Human
ccccagaggggccucuuc

SEQ ID NO: 470152 - RNA, 20 nt, Human
ccccuguaggaagccuccca

SEQ ID NO: 470153 - RNA, 18 nt, Human
cccucucaaaaaaaaaaa

SEQ ID NO: 470154 - RNA, 20 nt, Human
ccggcagcaugucgggcugg

SEQ ID NO: 470155 - RNA, 20 nt, Human
ccucccaggcuggagacaga

SEQ ID NO: 470156 - RNA, 24 nt, Human
ccucucaaaaaaaaaaaaaaaaaa

SEQ ID NO: 470157 - RNA, 18 nt, Human
cucaaaaaaaaaaaaaaa

SEQ ID NO: 470158 - RNA, 23 nt, Human
cucaaaaaaaaaaaaaaaaaaaa

SEQ ID NO: 470159 - RNA, 18 nt, Human
cucagguugccugcugug

SEQ ID NO: 470160 - RNA, 20 nt, Human
cuccagcggugagccagcca

SEQ ID NO: 470161 - RNA, 30 nt, Human
cuccagcggugagccagccagaugcggucc

SEQ ID NO: 470162 - RNA, 19 nt, Human
cucccaugcuggauuaaac

SEQ ID NO: 470163 - RNA, 22 nt, Human
cugcacccgagguccauccacc

SEQ ID NO: 470164 - RNA, 22 nt, Human
cugcagcuggcagggggcuggg

SEQ ID NO: 470165 - RNA, 20 nt, Human
gagcauggcuaggauguggc

SEQ ID NO: 470166 - RNA, 23 nt, Human
gagcauggcuaggauguggcggc

SEQ ID NO: 470167 - RNA, 21 nt, Human
gcacugagcauggcuaggaug

SEQ ID NO: 470168 - RNA, 18 nt, Human
gcagggggcuggggcugc

SEQ ID NO: 470169 - RNA, 24 nt, Human
gccccaaaccucaaccucaccacc

SEQ ID NO: 470170 - RNA, 20 nt, Human
gcuccgucgccccucgugcc

SEQ ID NO: 470171 - RNA, 19 nt, Human
gcugagcacauugugcucu

SEQ ID NO: 470172 - RNA, 21 nt, Human
ggcaagaugacccuccagcug

SEQ ID NO: 470173 - RNA, 18 nt, Human
ggggcugcaccuuauggg

SEQ ID NO: 470174 - RNA, 27 nt, Human
gggggcuggggcugcaccuuaugggua

SEQ ID NO: 470175 - RNA, 21 nt, Human
ggugcagugcugcaacagcug

SEQ ID NO: 470176 - RNA, 19 nt, Human
guaacggaacagagaagcc

SEQ ID NO: 470177 - RNA, 22 nt, Human
gucugagggagcaugauuguuc

SEQ ID NO: 470178 - RNA, 20 nt, Human
guucagggagccuggcugag

SEQ ID NO: 470179 - RNA, 18 nt, Human
uaaaacaaaaccaagaau

SEQ ID NO: 470180 - RNA, 20 nt, Human
uaaaacaaaaccaagaauau

SEQ ID NO: 470181 - RNA, 19 nt, Human
uaaucaggagcccauucag

SEQ ID NO: 470182 - RNA, 21 nt, Human
uaccaagccccaaaccucaac

SEQ ID NO: 470183 - RNA, 18 nt, Human
uagacaaucauucccaga

SEQ ID NO: 470184 - RNA, 21 nt, Human
uaggaagccucccagcccagc

SEQ ID NO: 470185 - RNA, 21 nt, Human
uaggauguggcggcagggcag

SEQ ID NO: 470186 - RNA, 19 nt, Human
uauacaacagagacuguau

SEQ ID NO: 470187 - RNA, 19 nt, Human
uaucuuagaccagggguug

SEQ ID NO: 470188 - RNA, 18 nt, Human
uauguggccaccugagua

SEQ ID NO: 470189 - RNA, 23 nt, Human
ucaaaaaaaaaaaaaaaaaaaaa

SEQ ID NO: 470190 - RNA, 20 nt, Human
ucaaccucaccaccugaugu

SEQ ID NO: 470191 - RNA, 22 nt, Human
ucauucccagaucuuuuuucca

SEQ ID NO: 470192 - RNA, 19 nt, Human
ucccaggcuggagacagac

SEQ ID NO: 470193 - RNA, 21 nt, Human
ucccaugcuggauuaaacuuc

SEQ ID NO: 470194 - RNA, 23 nt, Human
ucccucucaaaaaaaaaaaaaaa

SEQ ID NO: 470195 - RNA, 18 nt, Human
uccuuggugcagugcugc

SEQ ID NO: 470196 - RNA, 18 nt, Human
ucggugaggugagucacu

SEQ ID NO: 470197 - RNA, 19 nt, Human
ucucacuccacuugcugcc

SEQ ID NO: 470198 - RNA, 19 nt, Human
ucucacuccacuugcugcc

SEQ ID NO: 470199 - RNA, 25 nt, Human
ucucaugacuggggcaacugcuacc

SEQ ID NO: 470200 - RNA, 18 nt, Human
ucugcugcauguaacgga

SEQ ID NO: 470201 - RNA, 22 nt, Human
ugagcacauugugcucugcagg

SEQ ID NO: 470202 - RNA, 22 nt, Human
ugagggagugcuggauguggga

SEQ ID NO: 470203 - RNA, 18 nt, Human
ugcagauggcauugaggg

SEQ ID NO: 470204 - RNA, 23 nt, Human
ugcagcuggcagggggcuggggc

SEQ ID NO: 470205 - RNA, 21 nt, Human
ugcagugcugcaacagcugac

SEQ ID NO: 470206 - RNA, 22 nt, Human
ugccaaggucaaaauacuuucu

SEQ ID NO: 470207 - RNA, 21 nt, Human
uggaaggaaaugaggauccac

SEQ ID NO: 470208 - RNA, 24 nt, Human
uggaaggaaaugaggauccaccag

SEQ ID NO: 470209 - RNA, 22 nt, Human
uggagacagacucccucucaaa

SEQ ID NO: 470210 - RNA, 23 nt, Human
uggagggaugcaguugcucagga

SEQ ID NO: 470211 - RNA, 18 nt, Human
uggcauugagggagugcu

SEQ ID NO: 470212 - RNA, 24 nt, Human
uggccuggaggaacuuacaaaugu

SEQ ID NO: 470213 - RNA, 19 nt, Human
uggcggcagggcaggugga

SEQ ID NO: 470214 - RNA, 18 nt, Human
uggcugaggaugugggug

SEQ ID NO: 470215 - RNA, 23 nt, Human
ugggacaaggaaaaaaguucagg

SEQ ID NO: 470216 - RNA, 25 nt, Human
ugggagagaugggagcuguccaaau

SEQ ID NO: 470217 - RNA, 22 nt, Human
uggggcaacugcuaccaagccc

SEQ ID NO: 470218 - RNA, 18 nt, Human
ugguuaaaguagcagcug

SEQ ID NO: 470219 - RNA, 20 nt, Human
uguauguggccaccugagua

SEQ ID NO: 470220 - RNA, 27 nt, Human
uuauuuuauuuuuuuuagauggagucu

SEQ ID NO: 470221 - RNA, 21 nt, Human
uucaguuuuauugaccccagg

SEQ ID NO: 470222 - RNA, 23 nt, Human
uugaggcuggaggcuagacaauc

SEQ ID NO: 470223 - RNA, 24 nt, Human
uugaguccuuaaucaggagcccau

SEQ ID NO: 470224 - RNA, 24 nt, Human
uuuucugagccagagccaaugagg

SEQ ID NO: 470225 - RNA, 21 nt, Human
uuuuuuuuagauggagucuca

SEQ ID NO: 470226 - RNA, 18 nt, Human
agccacaggucuggggcc

SEQ ID NO: 470227 - RNA, 18 nt, Human
agggaccaaagaaggggc

SEQ ID NO: 470228 - RNA, 21 nt, Human
caggaugcagcugugcucugg

SEQ ID NO: 470229 - RNA, 23 nt, Human
caggaugcagcugugcucuggug

SEQ ID NO: 470230 - RNA, 21 nt, Human
ccacaacaggaucaucugauc

SEQ ID NO: 470231 - RNA, 23 nt, Human
cccccugacucccuuccccgagc

SEQ ID NO: 470232 - RNA, 19 nt, Human
ccccgagccucugcccggg

SEQ ID NO: 470233 - RNA, 22 nt, Human
ccgccaccgccccccagguccg

SEQ ID NO: 470234 - RNA, 18 nt, Human
ccgccuacaacuuagccg

SEQ ID NO: 470235 - RNA, 19 nt, Human
cgccuacaacuuagccguc

SEQ ID NO: 470236 - RNA, 21 nt, Human
cuggcagcaauguggccaacu

SEQ ID NO: 470237 - RNA, 23 nt, Human
cuggcagcaauguggccaacuuc

SEQ ID NO: 470238 - RNA, 21 nt, Human
cugugcucuggugcacugugg

SEQ ID NO: 470239 - RNA, 22 nt, Human
cuuggcuggcagcaauguggcc

SEQ ID NO: 470240 - RNA, 23 nt, Human
gcccgggcuacgaucugcgaggc

SEQ ID NO: 470241 - RNA, 20 nt, Human
gccuacaacuuagccguccc

SEQ ID NO: 470242 - RNA, 21 nt, Human
ggcaaugauggugaccgcaag

SEQ ID NO: 470243 - RNA, 19 nt, Human
ggccauagggcaggccagc

SEQ ID NO: 470244 - RNA, 19 nt, Human
uacaacuuagccguccaca

SEQ ID NO: 470245 - RNA, 22 nt, Human
uccacaacaggaucaucugauc

SEQ ID NO: 470246 - RNA, 21 nt, Human
ugaccgccaccgccccccagg

SEQ ID NO: 470247 - RNA, 21 nt, Human
ugacucccuuccccgagccuc

SEQ ID NO: 470248 - RNA, 22 nt, Human
ugcgaggcccgcggaccuugac

SEQ ID NO: 470249 - RNA, 24 nt, Human
aaacaggcccuuuuaccagaccga

SEQ ID NO: 470250 - RNA, 19 nt, Human
aaaggucacacuaugaggg

SEQ ID NO: 470251 - RNA, 22 nt, Human
aacaacugaggcucccaaggaa

SEQ ID NO: 470252 - RNA, 18 nt, Human
aacagccaaagaucaucc

SEQ ID NO: 470253 - RNA, 19 nt, Human
aaggguccgccccaacugg

SEQ ID NO: 470254 - RNA, 20 nt, Human
acaggcccuuuuaccagacc

SEQ ID NO: 470255 - RNA, 21 nt, Human
acaguggaguucccuuccucu

SEQ ID NO: 470256 - RNA, 18 nt, Human
accgauuuugucucaccc

SEQ ID NO: 470257 - RNA, 20 nt, Human
agcagcaacagccaaagaag

SEQ ID NO: 470258 - RNA, 21 nt, Human
aggggucaaaggucacacuau

SEQ ID NO: 470259 - RNA, 19 nt, Human
caacaacugaggcucccaa

SEQ ID NO: 470260 - RNA, 19 nt, Human
cagcaacagccaaagauca

SEQ ID NO: 470261 - RNA, 21 nt, Human
caguggaguucccuuccucuc

SEQ ID NO: 470262 - RNA, 19 nt, Human
cccaaggaaugccaaaagu

SEQ ID NO: 470263 - RNA, 26 nt, Human
ccgggcccaagaucacaccagggguc

SEQ ID NO: 470264 - RNA, 18 nt, Human
cgcccccacaacccacac

SEQ ID NO: 470265 - RNA, 24 nt, Human
cucccaaggaaugccaaaaguagg

SEQ ID NO: 470266 - RNA, 18 nt, Human
cugaucucaggggcuggg

SEQ ID NO: 470267 - RNA, 18 nt, Human
gagaaguguuuguggucc

SEQ ID NO: 470268 - RNA, 22 nt, Human
gagcaaauaagaucugaucuca

SEQ ID NO: 470269 - RNA, 21 nt, Human
gaggaaggggguguauuugcu

SEQ ID NO: 470270 - RNA, 19 nt, Human
gcuaaaaugcuaaacccua

SEQ ID NO: 470271 - RNA, 23 nt, Human
gcuaaacccuaguauguccugcc

SEQ ID NO: 470272 - RNA, 21 nt, Human
ggcuggucccagcccgggccc

SEQ ID NO: 470273 - RNA, 21 nt, Human
gggcugggggaggaagagggu

SEQ ID NO: 470274 - RNA, 22 nt, Human
ggggcugggggaggaagagggu

SEQ ID NO: 470275 - RNA, 23 nt, Human
guggccuauucuggaacucaggg

SEQ ID NO: 470276 - RNA, 21 nt, Human
uagccccaccuaggaagacau

SEQ ID NO: 470277 - RNA, 20 nt, Human
ucaaaggucacacuaugagg

SEQ ID NO: 470278 - RNA, 21 nt, Human
ucacacaguggaguucccuuc

SEQ ID NO: 470279 - RNA, 24 nt, Human
ucccugaaaacaggcccuuuuacc

SEQ ID NO: 470280 - RNA, 20 nt, Human
ucccuuccucucuacuguaa

SEQ ID NO: 470281 - RNA, 22 nt, Human
ugaacaacaacugaggcuccca

SEQ ID NO: 470282 - RNA, 25 nt, Human
ugaccuugcagcacggagauaacuu

SEQ ID NO: 470283 - RNA, 18 nt, Human
ugaggcagggauucaucu

SEQ ID NO: 470284 - RNA, 25 nt, Human
ugaggcucccaaggaaugccaaaag

SEQ ID NO: 470285 - RNA, 23 nt, Human
ugaggguuuauaggcaggcgugg

SEQ ID NO: 470286 - RNA, 24 nt, Human
uguccugcccacuuuaaacucuca

SEQ ID NO: 470287 - RNA, 22 nt, Human
uugaaaggacugucacacagug

SEQ ID NO: 470288 - RNA, 24 nt, Human
uugcagcacggagauaacuuuggc

SEQ ID NO: 470289 - RNA, 18 nt, Human
aauuguuucuuaucccaa

SEQ ID NO: 470290 - RNA, 22 nt, Human
acaaauauagaaccacaugcua

SEQ ID NO: 470291 - RNA, 22 nt, Human
acucugucaccggccggaaagu

SEQ ID NO: 470292 - RNA, 24 nt, Human
aggaagagggcuuuggaggagggc

SEQ ID NO: 470293 - RNA, 19 nt, Human
agggcuuuggaggagggcu

SEQ ID NO: 470294 - RNA, 21 nt, Human
caccggccggaaaguggcccu

SEQ ID NO: 470295 - RNA, 19 nt, Human
cacuacaaacucgcucagg

SEQ ID NO: 470296 - RNA, 21 nt, Human
ccgcugagauccaucuagggg

SEQ ID NO: 470297 - RNA, 21 nt, Human
cgccuccggcccccacaacuc

SEQ ID NO: 470298 - RNA, 19 nt, Human
cgcuggacucugucaccgg

SEQ ID NO: 470299 - RNA, 18 nt, Human
cggaaaguggcccucgug

SEQ ID NO: 470300 - RNA, 19 nt, Human
gaggaagagggcuuuggag

SEQ ID NO: 470301 - RNA, 24 nt, Human
gcccccacaacuccgcuggacucu

SEQ ID NO: 470302 - RNA, 20 nt, Human
ggcuuuggaggagggcugcc

SEQ ID NO: 470303 - RNA, 19 nt, Human
gggggugcugugcagugag

SEQ ID NO: 470304 - RNA, 18 nt, Human
gucccagcgguggccuca

SEQ ID NO: 470305 - RNA, 20 nt, Human
uaaugccgcugagauccauc

SEQ ID NO: 470306 - RNA, 24 nt, Human
uaggagcagucccagcgguggccu

SEQ ID NO: 470307 - RNA, 19 nt, Human
ucacuacaaacucgcucag

SEQ ID NO: 470308 - RNA, 21 nt, Human
ucacuacaaacucgcucaggc

SEQ ID NO: 470309 - RNA, 21 nt, Human
ucagccacgugaggaagaggg

SEQ ID NO: 470310 - RNA, 19 nt, Human
ucaggcacagcuuaaugcc

SEQ ID NO: 470311 - RNA, 22 nt, Human
ucuuaucccaauaacuuuacaa

SEQ ID NO: 470312 - RNA, 25 nt, Human
uggaggagggcugccaaguguggcc

SEQ ID NO: 470313 - RNA, 18 nt, Human
ugucaccggccggaaagu

SEQ ID NO: 470314 - RNA, 18 nt, Human
uuuuuuuuuuuuuuucug

SEQ ID NO: 470315 - RNA, 25 nt, Human
uuuuuuuuuuuuuuuuucuguguuu

SEQ ID NO: 470316 - RNA, 21 nt, Human
aaaaagccaaauauaucaucc

SEQ ID NO: 470317 - RNA, 20 nt, Human
cacaauacaagaagacaaga

SEQ ID NO: 470318 - RNA, 25 nt, Human
cacaauacaagaagacaagaaaaua

SEQ ID NO: 470319 - RNA, 22 nt, Human
cagcuuccucacuuugcuccag

SEQ ID NO: 470320 - RNA, 18 nt, Human
caucacuuucagaugaug

SEQ ID NO: 470321 - RNA, 22 nt, Human
uacaagacaaaacugacagcuc

SEQ ID NO: 470322 - RNA, 20 nt, Human
uaucaugcuacucauaauua

SEQ ID NO: 470323 - RNA, 22 nt, Human
ugaaaaaaagccaaauauauca

SEQ ID NO: 470324 - RNA, 25 nt, Human
ugccuuuauuuucauuauuauuuug

SEQ ID NO: 470325 - RNA, 24 nt, Human
uugaaaaaaagccaaauauaucau

SEQ ID NO: 470326 - RNA, 23 nt, Human
aaaaagaaguuugaacuuucaag

SEQ ID NO: 470327 - RNA, 24 nt, Human
aaaaugcuaggauuacaggcguga

SEQ ID NO: 470328 - RNA, 20 nt, Human
aaacaauccucccaccucaa

SEQ ID NO: 470329 - RNA, 24 nt, Human
aaaucaccuucagagccaugcuag

SEQ ID NO: 470330 - RNA, 26 nt, Human
aaaugcuaggauuacaggcgugagcc

SEQ ID NO: 470331 - RNA, 18 nt, Human
aagcaauccacccgccuc

SEQ ID NO: 470332 - RNA, 18 nt, Human
aaggccugcagcuguuuc

SEQ ID NO: 470333 - RNA, 18 nt, Human
acagucaguccugccagu

SEQ ID NO: 470334 - RNA, 21 nt, Human
acccgccucagucacccaaaa

SEQ ID NO: 470335 - RNA, 24 nt, Human
acgggucgcucuccacagccccag

SEQ ID NO: 470336 - RNA, 26 nt, Human
acgggucgcucuccacagccccaggu

SEQ ID NO: 470337 - RNA, 24 nt, Human
acucugucgcucaggcuggagugc

SEQ ID NO: 470338 - RNA, 21 nt, Human
acugacaagauccagauccag

SEQ ID NO: 470339 - RNA, 18 nt, Human
acugcagccucaaccucc

SEQ ID NO: 470340 - RNA, 22 nt, Human
agaacucacugcagccucaacc

SEQ ID NO: 470341 - RNA, 20 nt, Human
agccucaaccuccugggcuc

SEQ ID NO: 470342 - RNA, 18 nt, Human
aggcuggagugcaguggc

SEQ ID NO: 470343 - RNA, 18 nt, Human
aggugguaaacucugaaa

SEQ ID NO: 470344 - RNA, 19 nt, Human
agugcaguggcgcaauuag

SEQ ID NO: 470345 - RNA, 21 nt, Human
auaaaagaaugggccacugga

SEQ ID NO: 470346 - RNA, 24 nt, Human
caaaaugcuaggauuacaggcgug

SEQ ID NO: 470347 - RNA, 27 nt, Human
caaacaauccucccaccucagccuucu

SEQ ID NO: 470348 - RNA, 25 nt, Human
caaccuccugggcucaaacaauccu

SEQ ID NO: 470349 - RNA, 23 nt, Human
caacuucugggcucaagcaaucc

SEQ ID NO: 470350 - RNA, 22 nt, Human
cacauuccugggaaaauugucu

SEQ ID NO: 470351 - RNA, 23 nt, Human
cacccgccucagucacccaaaau

SEQ ID NO: 470352 - RNA, 23 nt, Human
caccucagccuucugaguagcua

SEQ ID NO: 470353 - RNA, 24 nt, Human
caccucagccuucugaguagcuag

SEQ ID NO: 470354 - RNA, 18 nt, Human
cacgcagucaccacgugc

SEQ ID NO: 470355 - RNA, 24 nt, Human
cacucugucgcucaggcuggagug

SEQ ID NO: 470356 - RNA, 19 nt, Human
cacugcagccucaaccucc

SEQ ID NO: 470357 - RNA, 18 nt, Human
cagccccaggucacuccu

SEQ ID NO: 470358 - RNA, 23 nt, Human
cagccucaaccuccugggcucaa

SEQ ID NO: 470359 - RNA, 25 nt, Human
cagccucaaccuccugggcucaaac

SEQ ID NO: 470360 - RNA, 21 nt, Human
cagggugaagcggucuccacc

SEQ ID NO: 470361 - RNA, 18 nt, Human
cauugcgcccagccucaa

SEQ ID NO: 470362 - RNA, 24 nt, Human
ccaaaaugcuaggauuacaggcgu

SEQ ID NO: 470363 - RNA, 21 nt, Human
ccacgugcuggggcacucuuc

SEQ ID NO: 470364 - RNA, 21 nt, Human
ccauugcgcccagccucaaaa

SEQ ID NO: 470365 - RNA, 22 nt, Human
ccauugcgcccagccucaaaac

SEQ ID NO: 470366 - RNA, 24 nt, Human
cccaccucagccuucugaguagcu

SEQ ID NO: 470367 - RNA, 18 nt, Human
ccucaaaacucuucuacc

SEQ ID NO: 470368 - RNA, 19 nt, Human
ccucaaccuccugggcuca

SEQ ID NO: 470369 - RNA, 24 nt, Human
ccucccaccucagccuucugagua

SEQ ID NO: 470370 - RNA, 19 nt, Human
ccugaaaaacaccuucaca

SEQ ID NO: 470371 - RNA, 21 nt, Human
ccuuauuucucaggcuggucu

SEQ ID NO: 470372 - RNA, 19 nt, Human
cgagcuguacugacaccuu

SEQ ID NO: 470373 - RNA, 24 nt, Human
cgcucaggcuggagugcaguggcg

SEQ ID NO: 470374 - RNA, 22 nt, Human
cggucaccgccuccgaaacucu

SEQ ID NO: 470375 - RNA, 21 nt, Human
cucaaacaauccucccaccuc

SEQ ID NO: 470376 - RNA, 24 nt, Human
cucaaacaauccucccaccucagc

SEQ ID NO: 470377 - RNA, 21 nt, Human
cucaagcaauccacccgccuc

SEQ ID NO: 470378 - RNA, 24 nt, Human
cucacucugucgcucaggcuggag

SEQ ID NO: 470379 - RNA, 24 nt, Human
cucacugcagccucaaccuccugg

SEQ ID NO: 470380 - RNA, 22 nt, Human
cugaagaucauuucaaaaaaga

SEQ ID NO: 470381 - RNA, 22 nt, Human
cugcagccucaaccuccugggc

SEQ ID NO: 470382 - RNA, 21 nt, Human
cugggcucaagcaauccaccc

SEQ ID NO: 470383 - RNA, 18 nt, Human
cuuuccgagcuguacuga

SEQ ID NO: 470384 - RNA, 23 nt, Human
cuuuccgagcuguacugacaccu

SEQ ID NO: 470385 - RNA, 21 nt, Human
gacaggguuucaccuuauuuc

SEQ ID NO: 470386 - RNA, 24 nt, Human
gaguagcuagcacuacaggcacac

SEQ ID NO: 470387 - RNA, 18 nt, Human
gauuacaggcgugagcca

SEQ ID NO: 470388 - RNA, 22 nt, Human
gauuacaggcgugagccauugc

SEQ ID NO: 470389 - RNA, 22 nt, Human
gauuacaggcgugagccauugc

SEQ ID NO: 470390 - RNA, 24 nt, Human
gcacccgcagccgauacucccuga

SEQ ID NO: 470391 - RNA, 20 nt, Human
gcacuacaggcacacgccac

SEQ ID NO: 470392 - RNA, 21 nt, Human
gcacucuucccauuccucucc

SEQ ID NO: 470393 - RNA, 18 nt, Human
gccuugcgcacccgcagc

SEQ ID NO: 470394 - RNA, 20 nt, Human
gcucaggcuggagugcagug

SEQ ID NO: 470395 - RNA, 18 nt, Human
gcucuccacagccccagg

SEQ ID NO: 470396 - RNA, 19 nt, Human
gcuggagugcaguggcgca

SEQ ID NO: 470397 - RNA, 24 nt, Human
ggauuacaggcgugagccauugcg

SEQ ID NO: 470398 - RNA, 24 nt, Human
gggucgcucuccacagccccaggu

SEQ ID NO: 470399 - RNA, 19 nt, Human
gguaaacucugaaacacaa

SEQ ID NO: 470400 - RNA, 22 nt, Human
guacugacaccuucuggaagca

SEQ ID NO: 470401 - RNA, 20 nt, Human
uaaaugauuuuuggauuguu

SEQ ID NO: 470402 - RNA, 22 nt, Human
uaacuuuuuguauuuuuuguag

SEQ ID NO: 470403 - RNA, 23 nt, Human
uaacuuuuuguauuuuuuguaga

SEQ ID NO: 470404 - RNA, 24 nt, Human
uacaggcacacgccaccacaccca

SEQ ID NO: 470405 - RNA, 19 nt, Human
uacaggcgugagccauugc

SEQ ID NO: 470406 - RNA, 24 nt, Human
uagcacuacaggcacacgccacca

SEQ ID NO: 470407 - RNA, 18 nt, Human
uagcuagcacuacaggca

SEQ ID NO: 470408 - RNA, 19 nt, Human
uaggauuacaggcgugagc

SEQ ID NO: 470409 - RNA, 21 nt, Human
uaggauuacaggcgugagcca

SEQ ID NO: 470410 - RNA, 21 nt, Human
uaggauuacaggcgugagcca

SEQ ID NO: 470411 - RNA, 22 nt, Human
uaggauuacaggcgugagccau

SEQ ID NO: 470412 - RNA, 24 nt, Human
uaggauuacaggcgugagccauug

SEQ ID NO: 470413 - RNA, 26 nt, Human
uaggauuacaggcgugagccauugcg

SEQ ID NO: 470414 - RNA, 24 nt, Human
uaggugguaaacucugaaacacaa

SEQ ID NO: 470415 - RNA, 19 nt, Human
ucaaaaccugaaaaacacc

SEQ ID NO: 470416 - RNA, 23 nt, Human
ucacccaaaaugcuaggauuaca

SEQ ID NO: 470417 - RNA, 18 nt, Human
ucacggucaccgccuccg

SEQ ID NO: 470418 - RNA, 24 nt, Human
ucacucugucgcucaggcuggagu

SEQ ID NO: 470419 - RNA, 25 nt, Human
ucacugaagucauccuaggugguaa

SEQ ID NO: 470420 - RNA, 23 nt, Human
ucacugcagccucaaccuccugg

SEQ ID NO: 470421 - RNA, 24 nt, Human
ucacugcagccucaaccuccuggg

SEQ ID NO: 470422 - RNA, 20 nt, Human
ucagccuucugaguagcuag

SEQ ID NO: 470423 - RNA, 21 nt, Human
ucauaaagucacugacaagau

SEQ ID NO: 470424 - RNA, 18 nt, Human
ucccugaucagggugaag

SEQ ID NO: 470425 - RNA, 22 nt, Human
uccugggcucaaacaauccucc

SEQ ID NO: 470426 - RNA, 24 nt, Human
uccugggcucaaacaauccuccca

SEQ ID NO: 470427 - RNA, 24 nt, Human
ucgcucaggcuggagugcaguggc

SEQ ID NO: 470428 - RNA, 21 nt, Human
ucuaauuguugcaugcuucuc

SEQ ID NO: 470429 - RNA, 23 nt, Human
ucucacucugucgcucaggcugg

SEQ ID NO: 470430 - RNA, 24 nt, Human
ucucacucugucgcucaggcugga

SEQ ID NO: 470431 - RNA, 18 nt, Human
ucuccucuugggcaccuu

SEQ ID NO: 470432 - RNA, 18 nt, Human
ucugaaacacaaggccac

SEQ ID NO: 470433 - RNA, 24 nt, Human
ucugaagaucauuucaaaaaagaa

SEQ ID NO: 470434 - RNA, 23 nt, Human
ucugaguagcuagcacuacaggc

SEQ ID NO: 470435 - RNA, 24 nt, Human
ucugaguagcuagcacuacaggca

SEQ ID NO: 470436 - RNA, 24 nt, Human
ucugucgcucaggcuggagugcag

SEQ ID NO: 470437 - RNA, 23 nt, Human
ucuucaacuucugggcucaagca

SEQ ID NO: 470438 - RNA, 24 nt, Human
ugcuaggauuacaggcgugagcca

SEQ ID NO: 470439 - RNA, 18 nt, Human
uggagugcaguggcgcaa

SEQ ID NO: 470440 - RNA, 19 nt, Human
uggagugcaguggcgcaau

SEQ ID NO: 470441 - RNA, 21 nt, Human
uggagugcaguggcgcaauua

SEQ ID NO: 470442 - RNA, 28 nt, Human
uggagugcaguggcgcaauucuagcacg

SEQ ID NO: 470443 - RNA, 23 nt, Human
uggcgcaauuagaacucacugca

SEQ ID NO: 470444 - RNA, 20 nt, Human
uuaguaucauuccuuuacaa

SEQ ID NO: 470445 - RNA, 23 nt, Human
uucacaggauaaagauaaaagaa

SEQ ID NO: 470446 - RNA, 20 nt, Human
uucccauuccucuccucuug

SEQ ID NO: 470447 - RNA, 24 nt, Human
uucugaguagcuagcacuacaggc

SEQ ID NO: 470448 - RNA, 21 nt, Human
uucuggaagcacuggguacuu

SEQ ID NO: 470449 - RNA, 23 nt, Human
uugcaugcuucucuuuccgagcu

SEQ ID NO: 470450 - RNA, 20 nt, Human
uuggauguacaaauuccauc

SEQ ID NO: 470451 - RNA, 24 nt, Human
uuguagacaggguuucaccuuauu

SEQ ID NO: 470452 - RNA, 21 nt, Human
uuguugcaugcuucucuuucc

SEQ ID NO: 470453 - RNA, 24 nt, Human
uuuccgagcuguacugacaccuuc

SEQ ID NO: 470454 - RNA, 19 nt, Human
uuuuuguauuuuuuguaga

SEQ ID NO: 470455 - RNA, 21 nt, Human
uuuuuguauuuuuuguagaca

SEQ ID NO: 470456 - RNA, 22 nt, Human
uuuuuuguagacaggguuucac

SEQ ID NO: 470457 - RNA, 20 nt, Human
aagaggccagggcagagaga

SEQ ID NO: 470458 - RNA, 18 nt, Human
aggccagggcagagagaa

SEQ ID NO: 470459 - RNA, 20 nt, Human
aucaagccaguuccauucgu

SEQ ID NO: 470460 - RNA, 20 nt, Human
auccaaagagggugaccgug

SEQ ID NO: 470461 - RNA, 19 nt, Human
cagcuaggcugagcuugug

SEQ ID NO: 470462 - RNA, 20 nt, Human
cagguaccccauagucuucc

SEQ ID NO: 470463 - RNA, 19 nt, Human
cagugauagaaacacuuuc

SEQ ID NO: 470464 - RNA, 21 nt, Human
ccaaccaccagagcacagugu

SEQ ID NO: 470465 - RNA, 23 nt, Human
ccagugauagaaacacuuuccuu

SEQ ID NO: 470466 - RNA, 23 nt, Human
cccuuggucugauuauccuccuu

SEQ ID NO: 470467 - RNA, 26 nt, Human
ccuccugcccuuuacccacccagaaa

SEQ ID NO: 470468 - RNA, 25 nt, Human
cgcaaugccucaaaacggucucuga

SEQ ID NO: 470469 - RNA, 21 nt, Human
cucugacugggcauggggugg

SEQ ID NO: 470470 - RNA, 21 nt, Human
cugauuauccuccuuccagug

SEQ ID NO: 470471 - RNA, 18 nt, Human
cugcuccugcacuagacg

SEQ ID NO: 470472 - RNA, 19 nt, Human
cugcuccugcacuagacgu

SEQ ID NO: 470473 - RNA, 25 nt, Human
cuuggagcccuuggucugauuaucc

SEQ ID NO: 470474 - RNA, 20 nt, Human
gagcacagugucagagguca

SEQ ID NO: 470475 - RNA, 23 nt, Human
gauggaugacuucgauuucugcu

SEQ ID NO: 470476 - RNA, 21 nt, Human
gcaugggguggaagaggccag

SEQ ID NO: 470477 - RNA, 19 nt, Human
gcccaguguugaccacuga

SEQ ID NO: 470478 - RNA, 18 nt, Human
ggagcacgcaucaagcca

SEQ ID NO: 470479 - RNA, 18 nt, Human
ggcugugugguggcagga

SEQ ID NO: 470480 - RNA, 22 nt, Human
gugaauagugagcuuguccaca

SEQ ID NO: 470481 - RNA, 21 nt, Human
uacaauuuccuccugcccuuu

SEQ ID NO: 470482 - RNA, 20 nt, Human
uacccacccagaaauaggau

SEQ ID NO: 470483 - RNA, 19 nt, Human
uaccccauagucuuccugg

SEQ ID NO: 470484 - RNA, 21 nt, Human
uaccccauagucuuccuggag

SEQ ID NO: 470485 - RNA, 21 nt, Human
uagcugauggaugacuucgau

SEQ ID NO: 470486 - RNA, 24 nt, Human
uccugcccuuuacccacccagaaa

SEQ ID NO: 470487 - RNA, 25 nt, Human
uccuuccagugauagaaacacuuuc

SEQ ID NO: 470488 - RNA, 18 nt, Human
uggccgggcccaguguug

SEQ ID NO: 470489 - RNA, 20 nt, Human
ugguggcaggaggagcaguu

SEQ ID NO: 470490 - RNA, 21 nt, Human
ugguggcaggaggagcaguug

SEQ ID NO: 470491 - RNA, 22 nt, Human
ugucagaggucauagacucucu

SEQ ID NO: 470492 - RNA, 21 nt, Human
ugugguggcaggaggagcagu

SEQ ID NO: 470493 - RNA, 27 nt, Human
ugugguggcaggaggagcaguugaggg

SEQ ID NO: 470494 - RNA, 18 nt, Human
uuccagugauagaaacac

SEQ ID NO: 470495 - RNA, 18 nt, Human
uugugugaauagugagcu

SEQ ID NO: 470496 - RNA, 24 nt, Human
aaaguguugggauuacaggcguga

SEQ ID NO: 470497 - RNA, 19 nt, Human
aaccuccgccucccggguc

SEQ ID NO: 470498 - RNA, 19 nt, Human
aagagcugagccaaggaca

SEQ ID NO: 470499 - RNA, 19 nt, Human
aagcugguuccuuggagca

SEQ ID NO: 470500 - RNA, 21 nt, Human
aaguguugggauuacaggcgu

SEQ ID NO: 470501 - RNA, 26 nt, Human
aaguguugggauuacaggcgugagcc

SEQ ID NO: 470502 - RNA, 24 nt, Human
aauguaguggugccaucuuggcuc

SEQ ID NO: 470503 - RNA, 19 nt, Human
acacuggggacuguccugg

SEQ ID NO: 470504 - RNA, 18 nt, Human
acgggguuucaucauguu

SEQ ID NO: 470505 - RNA, 23 nt, Human
acgggguuucaucauguuggcca

SEQ ID NO: 470506 - RNA, 24 nt, Human
acgggguuucaucauguuggccag

SEQ ID NO: 470507 - RNA, 22 nt, Human
agacggggaggcuggcaggaaa

SEQ ID NO: 470508 - RNA, 19 nt, Human
agagcugagccaaggacag

SEQ ID NO: 470509 - RNA, 18 nt, Human
aggaaacguggagcucgg

SEQ ID NO: 470510 - RNA, 23 nt, Human
aggcgugagccacugugccuggc

SEQ ID NO: 470511 - RNA, 18 nt, Human
agguaauccgccugccuc

SEQ ID NO: 470512 - RNA, 22 nt, Human
agguaauccgccugccucggcc

SEQ ID NO: 470513 - RNA, 24 nt, Human
agguaauccgccugccucggccuc

SEQ ID NO: 470514 - RNA, 19 nt, Human
aguagcugagauuacaggc

SEQ ID NO: 470515 - RNA, 24 nt, Human
agugacaagagcugagccaaggaa

SEQ ID NO: 470516 - RNA, 20 nt, Human
agugauucuccugccucagc

SEQ ID NO: 470517 - RNA, 24 nt, Human
agugauucuccugccucagccucc

SEQ ID NO: 470518 - RNA, 25 nt, Human
aucauguuggccaggcuggucuuga

SEQ ID NO: 470519 - RNA, 18 nt, Human
auucuccugccucagccu

SEQ ID NO: 470520 - RNA, 24 nt, Human
auuuuuguauuuuuaguagagacg

SEQ ID NO: 470521 - RNA, 24 nt, Human
caaaguguugggauuacaggcgug

SEQ ID NO: 470522 - RNA, 19 nt, Human
caagagcugagccaaggac

SEQ ID NO: 470523 - RNA, 24 nt, Human
caccaugcccagcuaauuuuugua

SEQ ID NO: 470524 - RNA, 21 nt, Human
cacugcaaccuccgccucccg

SEQ ID NO: 470525 - RNA, 23 nt, Human
cacugcaaccuccgccucccggg

SEQ ID NO: 470526 - RNA, 21 nt, Human
cacugcuggccaaagcugccc

SEQ ID NO: 470527 - RNA, 18 nt, Human
cacuggggacuguccugg

SEQ ID NO: 470528 - RNA, 21 nt, Human
cacuggggacuguccugggcc

SEQ ID NO: 470529 - RNA, 20 nt, Human
cagccuccugaguagcugag

SEQ ID NO: 470530 - RNA, 18 nt, Human
cauguuggccaggcuggu

SEQ ID NO: 470531 - RNA, 20 nt, Human
cauguuggccaggcuggucu

SEQ ID NO: 470532 - RNA, 20 nt, Human
cauguuggccaggcuggucu

SEQ ID NO: 470533 - RNA, 24 nt, Human
cauguuggccaggcuggucuugaa

SEQ ID NO: 470534 - RNA, 22 nt, Human
ccaaaguguugggauuacaggc

SEQ ID NO: 470535 - RNA, 22 nt, Human
ccaaaguguugggauuacaggc

SEQ ID NO: 470536 - RNA, 24 nt, Human
ccaaaguguugggauuacaggcgu

SEQ ID NO: 470537 - RNA, 23 nt, Human
cccggguccgagugauucuccug

SEQ ID NO: 470538 - RNA, 23 nt, Human
ccgagugauucuccugccucagc

SEQ ID NO: 470539 - RNA, 22 nt, Human
ccgccagccagagggaaccugc

SEQ ID NO: 470540 - RNA, 24 nt, Human
ccgccucccggguccgagugauuc

SEQ ID NO: 470541 - RNA, 21 nt, Human
ccggugggagugguggccacu

SEQ ID NO: 470542 - RNA, 19 nt, Human
ccgugucccucgcugccuc

SEQ ID NO: 470543 - RNA, 24 nt, Human
ccucccggguccgagugauucucc

SEQ ID NO: 470544 - RNA, 18 nt, Human
ccugaccucagguaaucc

SEQ ID NO: 470545 - RNA, 21 nt, Human
ccugaccucagguaauccgcc

SEQ ID NO: 470546 - RNA, 23 nt, Human
ccugaccucagguaauccgccug

SEQ ID NO: 470547 - RNA, 19 nt, Human
ccugaguagcugagauuac

SEQ ID NO: 470548 - RNA, 23 nt, Human
ccugaguagcugagauuacaggc

SEQ ID NO: 470549 - RNA, 24 nt, Human
ccugaguagcugagauuacaggcu

SEQ ID NO: 470550 - RNA, 23 nt, Human
ccugccucagccuccugaguagc

SEQ ID NO: 470551 - RNA, 24 nt, Human
ccugccucggccucccaaaguguu

SEQ ID NO: 470552 - RNA, 20 nt, Human
cgagugauucuccugccuca

SEQ ID NO: 470553 - RNA, 25 nt, Human
cucacccacuucguggucucugagg

SEQ ID NO: 470554 - RNA, 24 nt, Human
cucacugcaaccuccgccucccgg

SEQ ID NO: 470555 - RNA, 19 nt, Human
cucccggguccgagugauu

SEQ ID NO: 470556 - RNA, 20 nt, Human
cuccgugucccucgcugccu

SEQ ID NO: 470557 - RNA, 26 nt, Human
cuccugaccucagguaauccgccugc

SEQ ID NO: 470558 - RNA, 23 nt, Human
cugcaaccuccgccucccggguc

SEQ ID NO: 470559 - RNA, 21 nt, Human
cugcccugcgucuccucccca

SEQ ID NO: 470560 - RNA, 23 nt, Human
cugccucagccuccugaguagcu

SEQ ID NO: 470561 - RNA, 22 nt, Human
gacaagagcugagccaaggaca

SEQ ID NO: 470562 - RNA, 24 nt, Human
gaccucagguaauccgccugccuc

SEQ ID NO: 470563 - RNA, 18 nt, Human
gagacgggguuucaucau

SEQ ID NO: 470564 - RNA, 24 nt, Human
gagacgggguuucaucauguuggc

SEQ ID NO: 470565 - RNA, 19 nt, Human
gagccaaggacagugggag

SEQ ID NO: 470566 - RNA, 26 nt, Human
gaguagcugagauuacaggcucuugc

SEQ ID NO: 470567 - RNA, 18 nt, Human
gauuacaggcgugagcca

SEQ ID NO: 470568 - RNA, 21 nt, Human
gauuacaggcgugagccacug

SEQ ID NO: 470569 - RNA, 24 nt, Human
gauuacaggcgugagccacugugc

SEQ ID NO: 470570 - RNA, 24 nt, Human
gauuacaggcucuugccaccaugc

SEQ ID NO: 470571 - RNA, 22 nt, Human
gcccagcuaauuuuuguauuuu

SEQ ID NO: 470572 - RNA, 23 nt, Human
gcuggucuugaacuccugaccuc

SEQ ID NO: 470573 - RNA, 18 nt, Human
ggcaggcuggggugaucu

SEQ ID NO: 470574 - RNA, 19 nt, Human
ggccuggcacuuagaacug

SEQ ID NO: 470575 - RNA, 24 nt, Human
ggcuggucuugaacuccugaccuc

SEQ ID NO: 470576 - RNA, 21 nt, Human
gggagaaacagacggggaggc

SEQ ID NO: 470577 - RNA, 23 nt, Human
gggguuucaucauguuggccagg

SEQ ID NO: 470578 - RNA, 22 nt, Human
ggguuucaucauguuggccagg

SEQ ID NO: 470579 - RNA, 19 nt, Human
ggucuugaacuccugaccu

SEQ ID NO: 470580 - RNA, 23 nt, Human
guagagacgggguuucaucaugu

SEQ ID NO: 470581 - RNA, 24 nt, Human
gugauucuccugccucagccuccu

SEQ ID NO: 470582 - RNA, 18 nt, Human
gugccaucuuggcucacu

SEQ ID NO: 470583 - RNA, 23 nt, Human
uaaaaaauaauacuaaaagcugg

SEQ ID NO: 470584 - RNA, 24 nt, Human
uaauuuuuguauuuuuaguagaga

SEQ ID NO: 470585 - RNA, 22 nt, Human
uacaggcgugagccacugugcc

SEQ ID NO: 470586 - RNA, 22 nt, Human
uacaggcgugagccacugugcc

SEQ ID NO: 470587 - RNA, 23 nt, Human
uacaggcgugagccacugugccu

SEQ ID NO: 470588 - RNA, 24 nt, Human
uaguagagacgggguuucaucaug

SEQ ID NO: 470589 - RNA, 23 nt, Human
ucacugcaaccuccgccucccgg

SEQ ID NO: 470590 - RNA, 24 nt, Human
ucacugcaaccuccgccucccggg

SEQ ID NO: 470591 - RNA, 25 nt, Human
ucacugcaaccuccgccucccgggu

SEQ ID NO: 470592 - RNA, 27 nt, Human
ucacugcaaccuccgccucccgggucc

SEQ ID NO: 470593 - RNA, 21 nt, Human
ucagacccggcuggugugugc

SEQ ID NO: 470594 - RNA, 24 nt, Human
ucccaaaguguugggauuacaggc

SEQ ID NO: 470595 - RNA, 21 nt, Human
ucccggguccgagugauucuc

SEQ ID NO: 470596 - RNA, 24 nt, Human
ucccggguccgagugauucuccug

SEQ ID NO: 470597 - RNA, 18 nt, Human
uccgagugauucuccugc

SEQ ID NO: 470598 - RNA, 23 nt, Human
uccgagugauucuccugccucag

SEQ ID NO: 470599 - RNA, 20 nt, Human
uccugaccucagguaauccg

SEQ ID NO: 470600 - RNA, 24 nt, Human
uccugaguagcugagauuacaggc

SEQ ID NO: 470601 - RNA, 25 nt, Human
uccugggccuccguccccucgggag

SEQ ID NO: 470602 - RNA, 19 nt, Human
uccuuggagcagaaggcuc

SEQ ID NO: 470603 - RNA, 20 nt, Human
ucuacucccgcuaagucugu

SEQ ID NO: 470604 - RNA, 24 nt, Human
ucuccugccucagccuccugagua

SEQ ID NO: 470605 - RNA, 19 nt, Human
ucuuacuuucgcccaggcu

SEQ ID NO: 470606 - RNA, 22 nt, Human
ucuuacuuucgcccaggcugaa

SEQ ID NO: 470607 - RNA, 23 nt, Human
ucuugaacuccugaccucaggua

SEQ ID NO: 470608 - RNA, 24 nt, Human
ugaacuccugaccucagguaaucc

SEQ ID NO: 470609 - RNA, 20 nt, Human
ugacaagagcugagccaagg

SEQ ID NO: 470610 - RNA, 18 nt, Human
ugaccucagguaauccgc

SEQ ID NO: 470611 - RNA, 19 nt, Human
ugaccucagguaauccgcc

SEQ ID NO: 470612 - RNA, 20 nt, Human
ugagacagagucuuacuuuc

SEQ ID NO: 470613 - RNA, 22 nt, Human
ugagauuacaggcucuugccac

SEQ ID NO: 470614 - RNA, 24 nt, Human
ugagauuacaggcucuugccacca

SEQ ID NO: 470615 - RNA, 25 nt, Human
ugagauuacaggcucuugccaccau

SEQ ID NO: 470616 - RNA, 19 nt, Human
ugagccaaggacaguggga

SEQ ID NO: 470617 - RNA, 24 nt, Human
ugccucagccuccugaguagcuga

SEQ ID NO: 470618 - RNA, 24 nt, Human
ugccucggccucccaaaguguugg

SEQ ID NO: 470619 - RNA, 18 nt, Human
ugcggggauggcaugggg

SEQ ID NO: 470620 - RNA, 18 nt, Human
uggccacugggucacugc

SEQ ID NO: 470621 - RNA, 24 nt, Human
uggccaggcuggucuugaacuccu

SEQ ID NO: 470622 - RNA, 25 nt, Human
ugggagaaacagacggggaggcugg

SEQ ID NO: 470623 - RNA, 18 nt, Human
ugggauuacaggcgugag

SEQ ID NO: 470624 - RNA, 21 nt, Human
ugggauuacaggcgugagcca

SEQ ID NO: 470625 - RNA, 22 nt, Human
ugggauuacaggcgugagccac

SEQ ID NO: 470626 - RNA, 22 nt, Human
ugggauuacaggcgugagccac

SEQ ID NO: 470627 - RNA, 22 nt, Human
ugggauuacaggcgugagccac

SEQ ID NO: 470628 - RNA, 23 nt, Human
ugggauuacaggcgugagccacu

SEQ ID NO: 470629 - RNA, 24 nt, Human
ugggauuacaggcgugagccacug

SEQ ID NO: 470630 - RNA, 22 nt, Human
ugguggcagacaggacagccuc

SEQ ID NO: 470631 - RNA, 21 nt, Human
uguauuuuuaguagagacggg

SEQ ID NO: 470632 - RNA, 18 nt, Human
uuaguagagacgggguuu

SEQ ID NO: 470633 - RNA, 20 nt, Human
uuaguagagacgggguuuca

SEQ ID NO: 470634 - RNA, 24 nt, Human
uuaguagagacgggguuucaucau

SEQ ID NO: 470635 - RNA, 18 nt, Human
uucuacuccgugucccuc

SEQ ID NO: 470636 - RNA, 27 nt, Human
uugguggcagacaggacagccucuucu

SEQ ID NO: 470637 - RNA, 23 nt, Human
uuguauuuuuaguagagacgggg

SEQ ID NO: 470638 - RNA, 23 nt, Human
uuucaucauguuggccaggcugu

SEQ ID NO: 470639 - RNA, 23 nt, Human
uuuuuaguagagacgggguuuca

SEQ ID NO: 470640 - RNA, 20 nt, Human
uuuuuguauuuuuaguagag

SEQ ID NO: 470641 - RNA, 22 nt, Human
aaaaaaaaccaugucagagaaa

SEQ ID NO: 470642 - RNA, 26 nt, Human
aaaaaaguaagcgagggagugggcaa

SEQ ID NO: 470643 - RNA, 26 nt, Human
aaaagaaaaaaaaaaccaugucagag

SEQ ID NO: 470644 - RNA, 25 nt, Human
aaacaagcaaagucacuuuugcagg

SEQ ID NO: 470645 - RNA, 20 nt, Human
aaaguaaacaagcaaaguca

SEQ ID NO: 470646 - RNA, 24 nt, Human
aaagugcugggauuacaggcguga

SEQ ID NO: 470647 - RNA, 21 nt, Human
aacauaaggaguauauauaca

SEQ ID NO: 470648 - RNA, 26 nt, Human
aacucaaaaguagguuuuaccaccac

SEQ ID NO: 470649 - RNA, 24 nt, Human
aacucagcauaaacacuuuaguau

SEQ ID NO: 470650 - RNA, 26 nt, Human
aacuccccagaaaugagaggcaccac

SEQ ID NO: 470651 - RNA, 18 nt, Human
aacuguauaacacaugaa

SEQ ID NO: 470652 - RNA, 21 nt, Human
aacuuuguaacuauuacacug

SEQ ID NO: 470653 - RNA, 19 nt, Human
aaggaccacagggugugga

SEQ ID NO: 470654 - RNA, 19 nt, Human
aagugcugggauuacaggc

SEQ ID NO: 470655 - RNA, 19 nt, Human
aagugcugggauuacaggc

SEQ ID NO: 470656 - RNA, 26 nt, Human
aagugcugggauuacaggcgugagcc

SEQ ID NO: 470657 - RNA, 18 nt, Human
aaguuuaaaaugccccuc

SEQ ID NO: 470658 - RNA, 18 nt, Human
acacaaggcaaguagaau

SEQ ID NO: 470659 - RNA, 21 nt, Human
acacacagacaucacucagga

SEQ ID NO: 470660 - RNA, 24 nt, Human
acaggguuucuccauguuggucag

SEQ ID NO: 470661 - RNA, 19 nt, Human
acaugacggggaaaggcag

SEQ ID NO: 470662 - RNA, 25 nt, Human
agaaaaaaaaaaccaugucagagaa

SEQ ID NO: 470663 - RNA, 18 nt, Human
agacaggguuucuccaug

SEQ ID NO: 470664 - RNA, 18 nt, Human
agagagcugcauaaaaau

SEQ ID NO: 470665 - RNA, 20 nt, Human
agccaccacgcccagccacc

SEQ ID NO: 470666 - RNA, 21 nt, Human
agcuaugaucuagucgugaca

SEQ ID NO: 470667 - RNA, 19 nt, Human
agcuggggaggugacuucu

SEQ ID NO: 470668 - RNA, 23 nt, Human
aggcagaaaguaaacaagcaaag

SEQ ID NO: 470669 - RNA, 20 nt, Human
aggcaugcaccaccacaccc

SEQ ID NO: 470670 - RNA, 19 nt, Human
aggcccuuccuuuacaaau

SEQ ID NO: 470671 - RNA, 24 nt, Human
aggugauccgccugccucggccuc

SEQ ID NO: 470672 - RNA, 21 nt, Human
aguagcugggauuacaggcau

SEQ ID NO: 470673 - RNA, 24 nt, Human
agugcaauggcacgaucuuggcuc

SEQ ID NO: 470674 - RNA, 18 nt, Human
agugcugggauuacaggc

SEQ ID NO: 470675 - RNA, 24 nt, Human
auauguacaucuuuuguucacaua

SEQ ID NO: 470676 - RNA, 24 nt, Human
aucaaaaucagauuuuaaaagacc

SEQ ID NO: 470677 - RNA, 18 nt, Human
augucaaauauuucauuc

SEQ ID NO: 470678 - RNA, 21 nt, Human
caaaaacaaauacaguaauug

SEQ ID NO: 470679 - RNA, 26 nt, Human
caaaauacaaacucacuacucccuga

SEQ ID NO: 470680 - RNA, 24 nt, Human
caaagugcugggauuacaggcgug

SEQ ID NO: 470681 - RNA, 21 nt, Human
caacuccccagaaaugagagg

SEQ ID NO: 470682 - RNA, 21 nt, Human
caccacaaccuccgccucccg

SEQ ID NO: 470683 - RNA, 22 nt, Human
cagaaaacucacagcacaacua

SEQ ID NO: 470684 - RNA, 22 nt, Human
caggcaaggaacacacagacau

SEQ ID NO: 470685 - RNA, 24 nt, Human
caggguuucuccauguuggucagg

SEQ ID NO: 470686 - RNA, 22 nt, Human
caggugauccgccugccucggc

SEQ ID NO: 470687 - RNA, 23 nt, Human
caugcaccaccacacccggcuaa

SEQ ID NO: 470688 - RNA, 22 nt, Human
caugugaaaauggggagguaac

SEQ ID NO: 470689 - RNA, 24 nt, Human
cauguuggucaggcuggucuugaa

SEQ ID NO: 470690 - RNA, 22 nt, Human
ccaaagugcugggauuacaggc

SEQ ID NO: 470691 - RNA, 22 nt, Human
ccaaagugcugggauuacaggc

SEQ ID NO: 470692 - RNA, 24 nt, Human
ccaaagugcugggauuacaggcgu

SEQ ID NO: 470693 - RNA, 22 nt, Human
ccaagcaaaauaauaaaauccu

SEQ ID NO: 470694 - RNA, 18 nt, Human
ccacaaccuccgccuccc

SEQ ID NO: 470695 - RNA, 23 nt, Human
ccacaaccuccgccucccggguu

SEQ ID NO: 470696 - RNA, 24 nt, Human
ccacaaccuccgccucccggguuc

SEQ ID NO: 470697 - RNA, 19 nt, Human
ccauguuggucaggcuggu

SEQ ID NO: 470698 - RNA, 21 nt, Human
ccauguuggucaggcuggucu

SEQ ID NO: 470699 - RNA, 21 nt, Human
ccauguuggucaggcuggucu

SEQ ID NO: 470700 - RNA, 22 nt, Human
cccaccaaacagcaguaaucau

SEQ ID NO: 470701 - RNA, 20 nt, Human
ccccagaaaugagaggcacu

SEQ ID NO: 470702 - RNA, 18 nt, Human
cccgaccucaggugaucc

SEQ ID NO: 470703 - RNA, 21 nt, Human
cccgaccucaggugauccgcc

SEQ ID NO: 470704 - RNA, 23 nt, Human
cccgaccucaggugauccgccug

SEQ ID NO: 470705 - RNA, 27 nt, Human
cccggcugcggcgcgcugcggcagggg

SEQ ID NO: 470706 - RNA, 18 nt, Human
cccggguucaagagauuc

SEQ ID NO: 470707 - RNA, 24 nt, Human
cccucuuguugcccaggcuggagu

SEQ ID NO: 470708 - RNA, 23 nt, Human
ccgaguagcugggauuacaggca

SEQ ID NO: 470709 - RNA, 24 nt, Human
ccgaguagcugggauuacaggcau

SEQ ID NO: 470710 - RNA, 18 nt, Human
ccggcugcggcgcgcugc

SEQ ID NO: 470711 - RNA, 18 nt, Human
ccucaguucggagaacuc

SEQ ID NO: 470712 - RNA, 19 nt, Human
ccucauguuauucacuagg

SEQ ID NO: 470713 - RNA, 24 nt, Human
ccucuuguugcccaggcuggagug

SEQ ID NO: 470714 - RNA, 24 nt, Human
ccugccucggccucccaaagugcu

SEQ ID NO: 470715 - RNA, 18 nt, Human
cgaccucaggugauccgc

SEQ ID NO: 470716 - RNA, 24 nt, Human
cgaccucaggugauccgccugccu

SEQ ID NO: 470717 - RNA, 30 nt, Human
cggcuaauuuuguauuuuuaguggagacaa

SEQ ID NO: 470718 - RNA, 22 nt, Human
cucaaaaaagaaaaaaaaaacc

SEQ ID NO: 470719 - RNA, 22 nt, Human
cucaaaauauucuugcucaauc

SEQ ID NO: 470720 - RNA, 24 nt, Human
cucaccacaaccuccgccucccgg

SEQ ID NO: 470721 - RNA, 24 nt, Human
cucaccccaagcaaaauaauaaaa

SEQ ID NO: 470722 - RNA, 24 nt, Human
cuccauguuggucaggcuggucuu

SEQ ID NO: 470723 - RNA, 26 nt, Human
cucccgaccucaggugauccgccugc

SEQ ID NO: 470724 - RNA, 23 nt, Human
cucucccgccccucaccccaagc

SEQ ID NO: 470725 - RNA, 18 nt, Human
cucuuguugcccaggcug

SEQ ID NO: 470726 - RNA, 19 nt, Human
cugcagcggacacgugacg

SEQ ID NO: 470727 - RNA, 22 nt, Human
cugcggcaggggagcuggaggc

SEQ ID NO: 470728 - RNA, 24 nt, Human
cuuguugcccaggcuggagugcaa

SEQ ID NO: 470729 - RNA, 20 nt, Human
cuuuuuuuuuugaaacggag

SEQ ID NO: 470730 - RNA, 22 nt, Human
cuuuuuuuuuugaaacggaguu

SEQ ID NO: 470731 - RNA, 19 nt, Human
gaaaauaaccccacucagg

SEQ ID NO: 470732 - RNA, 23 nt, Human
gaaaggcuuauugaaagacacuu

SEQ ID NO: 470733 - RNA, 21 nt, Human
gaacagaaaacucacagcaca

SEQ ID NO: 470734 - RNA, 22 nt, Human
gaagaugaugacagcuggggag

SEQ ID NO: 470735 - RNA, 23 nt, Human
gaccucaggugauccgccugccu

SEQ ID NO: 470736 - RNA, 24 nt, Human
gaccucaggugauccgccugccuc

SEQ ID NO: 470737 - RNA, 20 nt, Human
gacgaggcugccagccuucc

SEQ ID NO: 470738 - RNA, 20 nt, Human
gagacaggguuucuccaugu

SEQ ID NO: 470739 - RNA, 21 nt, Human
gagacaggguuucuccauguu

SEQ ID NO: 470740 - RNA, 22 nt, Human
gagcaugcacauggauacauga

SEQ ID NO: 470741 - RNA, 24 nt, Human
gaguagcugggauuacaggcaugc

SEQ ID NO: 470742 - RNA, 18 nt, Human
gauuacaggcgugagcca

SEQ ID NO: 470743 - RNA, 21 nt, Human
gauuacaggcgugagccacca

SEQ ID NO: 470744 - RNA, 22 nt, Human
gauuacaggcgugagccaccac

SEQ ID NO: 470745 - RNA, 23 nt, Human
gcagcaacucagcauaaacacuu

SEQ ID NO: 470746 - RNA, 20 nt, Human
gcaggcuuuuuaaacuguau

SEQ ID NO: 470747 - RNA, 19 nt, Human
gcccaggcuggagugcaau

SEQ ID NO: 470748 - RNA, 20 nt, Human
gcggaggcgcgcagcuccgc

SEQ ID NO: 470749 - RNA, 19 nt, Human
gcucuugcaaacugaaaca

SEQ ID NO: 470750 - RNA, 23 nt, Human
gcuggucuugaacucccgaccuc

SEQ ID NO: 470751 - RNA, 19 nt, Human
ggauggugugagagggaaa

SEQ ID NO: 470752 - RNA, 19 nt, Human
ggauuacaggcgugagcca

SEQ ID NO: 470753 - RNA, 19 nt, Human
ggccaugaaacuucauaga

SEQ ID NO: 470754 - RNA, 24 nt, Human
ggcuggucuugaacucccgaccuc

SEQ ID NO: 470755 - RNA, 24 nt, Human
ggggugccucucuggagaagcuuu

SEQ ID NO: 470756 - RNA, 20 nt, Human
gggugccucucuggagaagc

SEQ ID NO: 470757 - RNA, 18 nt, Human
guagcugggauuacaggc

SEQ ID NO: 470758 - RNA, 20 nt, Human
guagcugggauuacaggcau

SEQ ID NO: 470759 - RNA, 21 nt, Human
gugcaugugaaaauggggagg

SEQ ID NO: 470760 - RNA, 20 nt, Human
uaaaauagucaaucugaggc

SEQ ID NO: 470761 - RNA, 20 nt, Human
uaaaauauaacccuugcaca

SEQ ID NO: 470762 - RNA, 25 nt, Human
uaaagguggacaaaaaugccaguca

SEQ ID NO: 470763 - RNA, 21 nt, Human
uaauacuuacuauauguacau

SEQ ID NO: 470764 - RNA, 18 nt, Human
uacaagucugaaaauuaa

SEQ ID NO: 470765 - RNA, 23 nt, Human
uacaggcaugcaccaccacaccc

SEQ ID NO: 470766 - RNA, 24 nt, Human
uacaggcgugagccaccacgccca

SEQ ID NO: 470767 - RNA, 19 nt, Human
uacauaauuuuuaucuaaa

SEQ ID NO: 470768 - RNA, 20 nt, Human
uaccauaaaaaauauuaugu

SEQ ID NO: 470769 - RNA, 24 nt, Human
uagcaaaacacucagugcuuuuga

SEQ ID NO: 470770 - RNA, 19 nt, Human
uagcagagaaaggaucaua

SEQ ID NO: 470771 - RNA, 24 nt, Human
uaguggagacaggguuucuccaug

SEQ ID NO: 470772 - RNA, 23 nt, Human
uauacauauacacauauguauag

SEQ ID NO: 470773 - RNA, 21 nt, Human
uauagaauaucuugcuuuuga

SEQ ID NO: 470774 - RNA, 22 nt, Human
uauauacauauacacauaugua

SEQ ID NO: 470775 - RNA, 24 nt, Human
uauauacauauacacauauguaua

SEQ ID NO: 470776 - RNA, 18 nt, Human
uaugaacagaaaacucac

SEQ ID NO: 470777 - RNA, 25 nt, Human
uauguaaacaacuccccagaaauga

SEQ ID NO: 470778 - RNA, 22 nt, Human
uauuccacucucccgccccuca

SEQ ID NO: 470779 - RNA, 24 nt, Human
uauucuugcucaaucugcuggaag

SEQ ID NO: 470780 - RNA, 22 nt, Human
ucaaaaaagaaaaaaaaaacca

SEQ ID NO: 470781 - RNA, 27 nt, Human
ucaaaaguagguuuuaccaccaccucu

SEQ ID NO: 470782 - RNA, 23 nt, Human
ucaaccauucaaggucucuaaga

SEQ ID NO: 470783 - RNA, 21 nt, Human
ucaagagauucucgucucaaa

SEQ ID NO: 470784 - RNA, 22 nt, Human
ucaaucugaggcagaaaguaaa

SEQ ID NO: 470785 - RNA, 19 nt, Human
ucaauuucuuucuuuuucu

SEQ ID NO: 470786 - RNA, 24 nt, Human
ucaauuucuuucuuuuucuuuuuu

SEQ ID NO: 470787 - RNA, 22 nt, Human
ucacaguauuuugacuuuugga

SEQ ID NO: 470788 - RNA, 24 nt, Human
ucaccacaaccuccgccucccggg

SEQ ID NO: 470789 - RNA, 25 nt, Human
ucaccacaaccuccgccucccgggu

SEQ ID NO: 470790 - RNA, 27 nt, Human
ucaccacaaccuccgccucccggguuc

SEQ ID NO: 470791 - RNA, 20 nt, Human
ucacuacucccugacuugag

SEQ ID NO: 470792 - RNA, 19 nt, Human
ucacugacacuuucccugg

SEQ ID NO: 470793 - RNA, 27 nt, Human
ucagcaaccuuacucauauuccacucu

SEQ ID NO: 470794 - RNA, 20 nt, Human
ucagccccaccaaacagcag

SEQ ID NO: 470795 - RNA, 19 nt, Human
ucaggguagaaauaaaggu

SEQ ID NO: 470796 - RNA, 21 nt, Human
ucaggugauccgccugccucg

SEQ ID NO: 470797 - RNA, 23 nt, Human
ucauauuccacucucccgccccu

SEQ ID NO: 470798 - RNA, 19 nt, Human
uccacucucccgccccuca

SEQ ID NO: 470799 - RNA, 19 nt, Human
uccauguguuuugauccuu

SEQ ID NO: 470800 - RNA, 24 nt, Human
ucccaaagugcugggauuacaggc

SEQ ID NO: 470801 - RNA, 21 nt, Human
ucccgccccucaccccaagca

SEQ ID NO: 470802 - RNA, 23 nt, Human
ucccgccccucaccccaagcaaa

SEQ ID NO: 470803 - RNA, 21 nt, Human
ucccggguucaagagauucuc

SEQ ID NO: 470804 - RNA, 22 nt, Human
ucccggguucaagagauucucg

SEQ ID NO: 470805 - RNA, 23 nt, Human
ucccucuuguugcccaggcugga

SEQ ID NO: 470806 - RNA, 23 nt, Human
uccgaguagcugggauuacaggc

SEQ ID NO: 470807 - RNA, 24 nt, Human
uccgaguagcugggauuacaggca

SEQ ID NO: 470808 - RNA, 19 nt, Human
uccuaaggguaaaaugaac

SEQ ID NO: 470809 - RNA, 19 nt, Human
uccugcucuugcaaacuga

SEQ ID NO: 470810 - RNA, 18 nt, Human
ucggccucccaaagugcu

SEQ ID NO: 470811 - RNA, 25 nt, Human
ucucccgccccucaccccaagcaaa

SEQ ID NO: 470812 - RNA, 21 nt, Human
ucucuagaaagcaaccagcuu

SEQ ID NO: 470813 - RNA, 24 nt, Human
ucucuagaaagcaaccagcuuagu

SEQ ID NO: 470814 - RNA, 22 nt, Human
ucuuguugcccaggcuggagug

SEQ ID NO: 470815 - RNA, 25 nt, Human
ucuuuuuuuuuuuaaagaaacuugg

SEQ ID NO: 470816 - RNA, 19 nt, Human
ugaaaaaaucacguggcug

SEQ ID NO: 470817 - RNA, 20 nt, Human
ugaaaaguuuacaagcuauu

SEQ ID NO: 470818 - RNA, 22 nt, Human
ugaaagacacuucccuuugaaa

SEQ ID NO: 470819 - RNA, 23 nt, Human
ugaauguagguccauguguuuug

SEQ ID NO: 470820 - RNA, 21 nt, Human
ugacagcuggggaggugacuu

SEQ ID NO: 470821 - RNA, 19 nt, Human
ugacuucuuuauuccucuu

SEQ ID NO: 470822 - RNA, 18 nt, Human
ugaggcagaaaguaaaca

SEQ ID NO: 470823 - RNA, 24 nt, Human
ugcaggucuuggcaauucagcauu

SEQ ID NO: 470824 - RNA, 23 nt, Human
ugcauaaaaaucuagcagagaaa

SEQ ID NO: 470825 - RNA, 24 nt, Human
ugccaaguuuuucauuugccccca

SEQ ID NO: 470826 - RNA, 18 nt, Human
ugcccaggcuggagugca

SEQ ID NO: 470827 - RNA, 21 nt, Human
ugcccaggcuggagugcaaug

SEQ ID NO: 470828 - RNA, 24 nt, Human
ugcccaggcuggagugcaauggca

SEQ ID NO: 470829 - RNA, 21 nt, Human
ugccucggccucccaaagugc

SEQ ID NO: 470830 - RNA, 24 nt, Human
ugccucggccucccaaagugcugg

SEQ ID NO: 470831 - RNA, 18 nt, Human
ugcuggaagaugaugaca

SEQ ID NO: 470832 - RNA, 23 nt, Human
ugcuggaagaugaugacagcugg

SEQ ID NO: 470833 - RNA, 24 nt, Human
ugcugggauuacaggcgugagcca

SEQ ID NO: 470834 - RNA, 19 nt, Human
uggaagaugaugacagcug

SEQ ID NO: 470835 - RNA, 23 nt, Human
uggagugcaauggcacgaucuug

SEQ ID NO: 470836 - RNA, 24 nt, Human
uggagugcaauggcacgaucuugg

SEQ ID NO: 470837 - RNA, 24 nt, Human
uggcacgaucuuggcucaccacaa

SEQ ID NO: 470838 - RNA, 21 nt, Human
ugggauuacaggcaugcacca

SEQ ID NO: 470839 - RNA, 24 nt, Human
ugggauuacaggcaugcaccacca

SEQ ID NO: 470840 - RNA, 18 nt, Human
ugggauuacaggcgugag

SEQ ID NO: 470841 - RNA, 19 nt, Human
ugggauuacaggcgugagc

SEQ ID NO: 470842 - RNA, 22 nt, Human
ugggauuacaggcgugagccac

SEQ ID NO: 470843 - RNA, 23 nt, Human
ugggauuacaggcgugagccacc

SEQ ID NO: 470844 - RNA, 24 nt, Human
ugggauuacaggcgugagccacca

SEQ ID NO: 470845 - RNA, 23 nt, Human
uggucaggcuggucuugaacucc

SEQ ID NO: 470846 - RNA, 20 nt, Human
uggugugagagggaaagaau

SEQ ID NO: 470847 - RNA, 20 nt, Human
uguaaacaacuccccagaaa

SEQ ID NO: 470848 - RNA, 21 nt, Human
uguaaagagugauuucccugg

SEQ ID NO: 470849 - RNA, 20 nt, Human
uguugcccaggcuggagugc

SEQ ID NO: 470850 - RNA, 24 nt, Human
uuaguggagacaggguuucuccau

SEQ ID NO: 470851 - RNA, 22 nt, Human
uucauauacuuacgugcaugug

SEQ ID NO: 470852 - RNA, 19 nt, Human
uuccacucucccgccccuc

SEQ ID NO: 470853 - RNA, 24 nt, Human
uucccucuuguugcccaggcugga

SEQ ID NO: 470854 - RNA, 24 nt, Human
uucucaauuucuuucuuuuucuuu

SEQ ID NO: 470855 - RNA, 24 nt, Human
uucucggaaauacaauaacccaug

SEQ ID NO: 470856 - RNA, 18 nt, Human
uugaaagacacuucccuu

SEQ ID NO: 470857 - RNA, 23 nt, Human
uugaaaguaaaaggcuaccauaa

SEQ ID NO: 470858 - RNA, 18 nt, Human
uugcugcuuuucugauga

SEQ ID NO: 470859 - RNA, 24 nt, Human
uuguaaagagugauuucccugggg

SEQ ID NO: 470860 - RNA, 18 nt, Human
uuuaaaaugccccucaaa

SEQ ID NO: 470861 - RNA, 24 nt, Human
uuucccucuuguugcccaggcugg

SEQ ID NO: 470862 - RNA, 21 nt, Human
uuucuccauguuggucaggcu

SEQ ID NO: 470863 - RNA, 22 nt, Human
uuucugaugagauucauucacc

SEQ ID NO: 470864 - RNA, 18 nt, Human
uuugauccuuuuacaggc

SEQ ID NO: 470865 - RNA, 19 nt, Human
uuuuguauuuuuaguggag

SEQ ID NO: 470866 - RNA, 20 nt, Human
uuuuguauuuuuaguggaga

SEQ ID NO: 470867 - RNA, 24 nt, Human
aaacagcaacaaggaccuuauagc

SEQ ID NO: 470868 - RNA, 21 nt, Human
aauagacagugcaaaccauaa

SEQ ID NO: 470869 - RNA, 20 nt, Human
acuucccaccccgcccgccc

SEQ ID NO: 470870 - RNA, 21 nt, Human
agagucgaaagcgauggaacc

SEQ ID NO: 470871 - RNA, 20 nt, Human
augcacguuuccaaugaguu

SEQ ID NO: 470872 - RNA, 21 nt, Human
auggaaccugccugcaccaca

SEQ ID NO: 470873 - RNA, 21 nt, Human
augucacaaacuccagaagac

SEQ ID NO: 470874 - RNA, 21 nt, Human
caacauuauaaacagcaggca

SEQ ID NO: 470875 - RNA, 18 nt, Human
caaguacacaaagagaug

SEQ ID NO: 470876 - RNA, 22 nt, Human
caccacagucugucugggccca

SEQ ID NO: 470877 - RNA, 20 nt, Human
caccccgcccgccccccucc

SEQ ID NO: 470878 - RNA, 24 nt, Human
cacgcacacgccugcucgcugcgc

SEQ ID NO: 470879 - RNA, 25 nt, Human
cacgcacacgccugcucgcugcgca

SEQ ID NO: 470880 - RNA, 21 nt, Human
cagagugguaaacacagggcc

SEQ ID NO: 470881 - RNA, 21 nt, Human
cagaugcauuauuacagcuaa

SEQ ID NO: 470882 - RNA, 25 nt, Human
cagcguaguccagaagcucaauguu

SEQ ID NO: 470883 - RNA, 26 nt, Human
caggcacuucccaccccgcccgcccc

SEQ ID NO: 470884 - RNA, 19 nt, Human
cauuucaacugcaaccagu

SEQ ID NO: 470885 - RNA, 26 nt, Human
ccacauccugccugccccacacacgc

SEQ ID NO: 470886 - RNA, 19 nt, Human
ccagucccgccgcucccug

SEQ ID NO: 470887 - RNA, 23 nt, Human
ccccgcccgccccccuccccccg

SEQ ID NO: 470888 - RNA, 26 nt, Human
ccgccccccuccccccgcccaucucc

SEQ ID NO: 470889 - RNA, 19 nt, Human
ccgccgcaggccucuccuc

SEQ ID NO: 470890 - RNA, 18 nt, Human
ccgccgcucccugccgcc

SEQ ID NO: 470891 - RNA, 19 nt, Human
ccgccgcucccugccgccg

SEQ ID NO: 470892 - RNA, 20 nt, Human
ccgccgcucccugccgccgc

SEQ ID NO: 470893 - RNA, 21 nt, Human
ccgccuccgccuccgccccgc

SEQ ID NO: 470894 - RNA, 19 nt, Human
ccgcucccugccgccgcag

SEQ ID NO: 470895 - RNA, 22 nt, Human
ccuacugcuuuggagugagagu

SEQ ID NO: 470896 - RNA, 19 nt, Human
ccugcaccacauccugccu

SEQ ID NO: 470897 - RNA, 24 nt, Human
ccugcaccacauccugccugcccc

SEQ ID NO: 470898 - RNA, 23 nt, Human
cgccgcgccggccuucgccgccc

SEQ ID NO: 470899 - RNA, 18 nt, Human
cgcucccugccgccgcag

SEQ ID NO: 470900 - RNA, 21 nt, Human
cgcuccggcucggcucggcuc

SEQ ID NO: 470901 - RNA, 22 nt, Human
cggccuucgccgcccgcuccgg

SEQ ID NO: 470902 - RNA, 19 nt, Human
cggcucgggucggcuccgg

SEQ ID NO: 470903 - RNA, 22 nt, Human
cuaagggcaaggaaaagccuau

SEQ ID NO: 470904 - RNA, 19 nt, Human
cuccuccgccuccgccucc

SEQ ID NO: 470905 - RNA, 19 nt, Human
cugggcccagccagcgcug

SEQ ID NO: 470906 - RNA, 22 nt, Human
cuucccaccccgcccgcccccc

SEQ ID NO: 470907 - RNA, 25 nt, Human
gaaccugccugcaccacauccugcc

SEQ ID NO: 470908 - RNA, 22 nt, Human
gccccacacacgcacacgccug

SEQ ID NO: 470909 - RNA, 20 nt, Human
ggcaaggaaaagccuauggc

SEQ ID NO: 470910 - RNA, 23 nt, Human
ggggugaggagugggccagagug

SEQ ID NO: 470911 - RNA, 19 nt, Human
gugagcagcaacgcggccc

SEQ ID NO: 470912 - RNA, 18 nt, Human
uaucacaaacagcaacaa

SEQ ID NO: 470913 - RNA, 22 nt, Human
uaucaguuaucacaaacagcaa

SEQ ID NO: 470914 - RNA, 22 nt, Human
ucaaaucaaugucacaaacucc

SEQ ID NO: 470915 - RNA, 24 nt, Human
ucaguuaucacaaacagcaacaag

SEQ ID NO: 470916 - RNA, 26 nt, Human
uccagaagcucaauguuggauuugcc

SEQ ID NO: 470917 - RNA, 27 nt, Human
ucccaccccgcccgccccccucccccc

SEQ ID NO: 470918 - RNA, 18 nt, Human
uccgccuccgccccgcag

SEQ ID NO: 470919 - RNA, 24 nt, Human
ucgccgcgccggccuucgccgccc

SEQ ID NO: 470920 - RNA, 21 nt, Human
ucucaagagaacaccauccau

SEQ ID NO: 470921 - RNA, 21 nt, Human
ucugccaguaccguacaagua

SEQ ID NO: 470922 - RNA, 22 nt, Human
ugcaccacauccugccugcccc

SEQ ID NO: 470923 - RNA, 24 nt, Human
ugcagagagugagcagcaacgcgg

SEQ ID NO: 470924 - RNA, 23 nt, Human
ugccugccccacacacgcacacg

SEQ ID NO: 470925 - RNA, 19 nt, Human
uggcuuuugaaaaaugacu

SEQ ID NO: 470926 - RNA, 19 nt, Human
uuacaaggacagaggcuac

SEQ ID NO: 470927 - RNA, 21 nt, Human
aaagaagcaccaucccuugca

SEQ ID NO: 470928 - RNA, 25 nt, Human
aaaggcacuggggcagaugugaccg

SEQ ID NO: 470929 - RNA, 21 nt, Human
aagcaucacacugcccgguga

SEQ ID NO: 470930 - RNA, 21 nt, Human
aaggcuggggucaggcagagg

SEQ ID NO: 470931 - RNA, 21 nt, Human
aaggcuggggucaggcagagg

SEQ ID NO: 470932 - RNA, 21 nt, Human
aagugaaaguggcggccccgg

SEQ ID NO: 470933 - RNA, 19 nt, Human
acacacagggcaggugaac

SEQ ID NO: 470934 - RNA, 19 nt, Human
accgcagugcaggcagggc

SEQ ID NO: 470935 - RNA, 19 nt, Human
accgcagugcaggcagggc

SEQ ID NO: 470936 - RNA, 24 nt, Human
acgcagagccggaccugacgggcu

SEQ ID NO: 470937 - RNA, 24 nt, Human
acgcagagccggaccugacgggcu

SEQ ID NO: 470938 - RNA, 20 nt, Human
acgcuacagcaagcaaggcc

SEQ ID NO: 470939 - RNA, 19 nt, Human
acggugcagcggauccagu

SEQ ID NO: 470940 - RNA, 19 nt, Human
agaaagcugacagcugaag

SEQ ID NO: 470941 - RNA, 19 nt, Human
agaaagcugacagcugaag

SEQ ID NO: 470942 - RNA, 21 nt, Human
agcauguggccccaccaucuu

SEQ ID NO: 470943 - RNA, 21 nt, Human
agcauguggccccaccaucuu

SEQ ID NO: 470944 - RNA, 22 nt, Human
aggaggaaacgggaccagccga

SEQ ID NO: 470945 - RNA, 23 nt, Human
aggcagagaaguuagccccagaa

SEQ ID NO: 470946 - RNA, 23 nt, Human
aggcagagaaguuagccccagaa

SEQ ID NO: 470947 - RNA, 23 nt, Human
aggcagaggugggagccgcaggg

SEQ ID NO: 470948 - RNA, 23 nt, Human
aggcagaggugggagccgcaggg

SEQ ID NO: 470949 - RNA, 19 nt, Human
aggcaguugacguggaaac

SEQ ID NO: 470950 - RNA, 20 nt, Human
aggccucuggccaggacccu

SEQ ID NO: 470951 - RNA, 20 nt, Human
aggccucuggccaggacccu

SEQ ID NO: 470952 - RNA, 24 nt, Human
aggcuggggucaggcagagguggg

SEQ ID NO: 470953 - RNA, 24 nt, Human
aggcuggggucaggcagagguggg

SEQ ID NO: 470954 - RNA, 22 nt, Human
aucaccuucagcaucucugucg

SEQ ID NO: 470955 - RNA, 26 nt, Human
caaaggcacuggggcagaugugaccg

SEQ ID NO: 470956 - RNA, 22 nt, Human
caagccccaagggaaggacaaa

SEQ ID NO: 470957 - RNA, 22 nt, Human
caagccccaagggaaggacaaa

SEQ ID NO: 470958 - RNA, 24 nt, Human
caagccccaagggaaggacaaagg

SEQ ID NO: 470959 - RNA, 24 nt, Human
caagccccaagggaaggacaaagg

SEQ ID NO: 470960 - RNA, 19 nt, Human
caagucccggaggaccccc

SEQ ID NO: 470961 - RNA, 18 nt, Human
caccacccagccggggcg

SEQ ID NO: 470962 - RNA, 23 nt, Human
caccacccagccggggcguucca

SEQ ID NO: 470963 - RNA, 19 nt, Human
cagagaaguuagccccaga

SEQ ID NO: 470964 - RNA, 19 nt, Human
cagagaaguuagccccaga

SEQ ID NO: 470965 - RNA, 20 nt, Human
cagcgcauggccucgcccug

SEQ ID NO: 470966 - RNA, 20 nt, Human
caucacacugcccggugacc

SEQ ID NO: 470967 - RNA, 19 nt, Human
cauccgggaccuccacugc

SEQ ID NO: 470968 - RNA, 21 nt, Human
cauccgggaccuccacugccc

SEQ ID NO: 470969 - RNA, 18 nt, Human
ccaagcccugugugugcc

SEQ ID NO: 470970 - RNA, 19 nt, Human
ccaagcccugugugugccu

SEQ ID NO: 470971 - RNA, 21 nt, Human
ccacaucguucugagcccgca

SEQ ID NO: 470972 - RNA, 20 nt, Human
cccaccccguccuccggggc

SEQ ID NO: 470973 - RNA, 21 nt, Human
cccagaaagcugacagcugaa

SEQ ID NO: 470974 - RNA, 21 nt, Human
cccagaaagcugacagcugaa

SEQ ID NO: 470975 - RNA, 20 nt, Human
cccauuuacccugcagcggc

SEQ ID NO: 470976 - RNA, 20 nt, Human
ccccagggccccagcguggg

SEQ ID NO: 470977 - RNA, 23 nt, Human
ccccagggccccagcgugggccc

SEQ ID NO: 470978 - RNA, 24 nt, Human
cccccagggccccagcgugggccc

SEQ ID NO: 470979 - RNA, 18 nt, Human
cccccugggggggaccgu

SEQ ID NO: 470980 - RNA, 24 nt, Human
ccccugggggggaccgugccuccu

SEQ ID NO: 470981 - RNA, 22 nt, Human
cccggguuucaaggcaaagccc

SEQ ID NO: 470982 - RNA, 23 nt, Human
cccugugugugccucgcuguccc

SEQ ID NO: 470983 - RNA, 21 nt, Human
cccuuggugacccagcagauc

SEQ ID NO: 470984 - RNA, 21 nt, Human
ccggcggcggcggacgccgag

SEQ ID NO: 470985 - RNA, 20 nt, Human
ccgggauccugcguggggcg

SEQ ID NO: 470986 - RNA, 24 nt, Human
ccucaggggucaggagcgccuuga

SEQ ID NO: 470987 - RNA, 18 nt, Human
ccucccgggaggccccag

SEQ ID NO: 470988 - RNA, 19 nt, Human
ccucuggccaggggcuaug

SEQ ID NO: 470989 - RNA, 19 nt, Human
ccucuggccaggggcuaug

SEQ ID NO: 470990 - RNA, 25 nt, Human
cgccuugaucucccucuccagcagc

SEQ ID NO: 470991 - RNA, 22 nt, Human
cgguguggcagacggugcagcg

SEQ ID NO: 470992 - RNA, 20 nt, Human
cguccacgaagcucccugag

SEQ ID NO: 470993 - RNA, 20 nt, Human
cguccacgaagcucccugag

SEQ ID NO: 470994 - RNA, 19 nt, Human
cguggcugugcccaucccc

SEQ ID NO: 470995 - RNA, 20 nt, Human
cucauugacaucauccucaa

SEQ ID NO: 470996 - RNA, 22 nt, Human
cuccaaccacaaaggcagagaa

SEQ ID NO: 470997 - RNA, 22 nt, Human
cuccaaccacaaaggcagagaa

SEQ ID NO: 470998 - RNA, 19 nt, Human
cuccagcagcuugcccgag

SEQ ID NO: 470999 - RNA, 20 nt, Human
cuccagcagcuugcccgagc

SEQ ID NO: 471000 - RNA, 18 nt, Human
cuccucccgggaggcccc

SEQ ID NO: 471001 - RNA, 19 nt, Human
cuccucccgggaggcccca

SEQ ID NO: 471002 - RNA, 19 nt, Human
cucucuccucccgggaggc

SEQ ID NO: 471003 - RNA, 19 nt, Human
cugacagcugaaggcgggu

SEQ ID NO: 471004 - RNA, 19 nt, Human
cugacagcugaaggcgggu

SEQ ID NO: 471005 - RNA, 19 nt, Human
cuggcucugaacagguuag

SEQ ID NO: 471006 - RNA, 19 nt, Human
cuggcucugaacagguuag

SEQ ID NO: 471007 - RNA, 21 nt, Human
cugggcccccagggccccagc

SEQ ID NO: 471008 - RNA, 21 nt, Human
gagcgccccuggcgucccggg

SEQ ID NO: 471009 - RNA, 24 nt, Human
gaggccccaguucuucgcaagggg

SEQ ID NO: 471010 - RNA, 21 nt, Human
gaucucccucuccagcagcuu

SEQ ID NO: 471011 - RNA, 25 nt, Human
gcaagccccaagggaaggacaaagg

SEQ ID NO: 471012 - RNA, 25 nt, Human
gcaagccccaagggaaggacaaagg

SEQ ID NO: 471013 - RNA, 24 nt, Human
gcaauggagaugcccaggucuaga

SEQ ID NO: 471014 - RNA, 19 nt, Human
gcagucuccuuccuggcuc

SEQ ID NO: 471015 - RNA, 19 nt, Human
gcagucuccuuccuggcuc

SEQ ID NO: 471016 - RNA, 22 nt, Human
gcagugcaggcagggccccuac

SEQ ID NO: 471017 - RNA, 22 nt, Human
gcagugcaggcagggccccuac

SEQ ID NO: 471018 - RNA, 21 nt, Human
gccucuggccaggggcuaugu

SEQ ID NO: 471019 - RNA, 21 nt, Human
gccucuggccaggggcuaugu

SEQ ID NO: 471020 - RNA, 22 nt, Human
gcggauccagucgcagccgucc

SEQ ID NO: 471021 - RNA, 19 nt, Human
gcggggaggcugagagugc

SEQ ID NO: 471022 - RNA, 19 nt, Human
gcggggaggcugagagugc

SEQ ID NO: 471023 - RNA, 25 nt, Human
gcuggggucaggcagaggugggagc

SEQ ID NO: 471024 - RNA, 25 nt, Human
gcuggggucaggcagaggugggagc

SEQ ID NO: 471025 - RNA, 25 nt, Human
ggaaggacaaaggcacuggggcaga

SEQ ID NO: 471026 - RNA, 25 nt, Human
ggaaggacaaaggcacuggggcaga

SEQ ID NO: 471027 - RNA, 18 nt, Human
ggacugggagggggggcc

SEQ ID NO: 471028 - RNA, 18 nt, Human
ggagccgcaggggagaga

SEQ ID NO: 471029 - RNA, 18 nt, Human
ggagccgcaggggagaga

SEQ ID NO: 471030 - RNA, 18 nt, Human
ggaggcugagagugcuug

SEQ ID NO: 471031 - RNA, 18 nt, Human
ggcagccacaucguucug

SEQ ID NO: 471032 - RNA, 19 nt, Human
ggccuccggcgcggcccaa

SEQ ID NO: 471033 - RNA, 24 nt, Human
gggaagcaucacacugcccgguga

SEQ ID NO: 471034 - RNA, 21 nt, Human
gggaggcugagagugcuuggu

SEQ ID NO: 471035 - RNA, 27 nt, Human
gggcagcgcauggccucggcccggcgg

SEQ ID NO: 471036 - RNA, 20 nt, Human
gggcgggacugggagggggg

SEQ ID NO: 471037 - RNA, 18 nt, Human
ggggucccagcggucccg

SEQ ID NO: 471038 - RNA, 19 nt, Human
guccgcacugggcgcagga

SEQ ID NO: 471039 - RNA, 23 nt, Human
gucgccucauccgggaccuccac

SEQ ID NO: 471040 - RNA, 23 nt, Human
gucuagaaaucgcugguaauccu

SEQ ID NO: 471041 - RNA, 20 nt, Human
guggugggaggaguauggag

SEQ ID NO: 471042 - RNA, 20 nt, Human
guggugggaggaguauggag

SEQ ID NO: 471043 - RNA, 18 nt, Human
uaccacgaucuggcacug

SEQ ID NO: 471044 - RNA, 22 nt, Human
uagcaagaguuccaagaggccg

SEQ ID NO: 471045 - RNA, 22 nt, Human
uagcaagaguuccaagaggccg

SEQ ID NO: 471046 - RNA, 25 nt, Human
uagcaagaguuccaagaggccucag

SEQ ID NO: 471047 - RNA, 25 nt, Human
uagcaagaguuccaagaggccucag

SEQ ID NO: 471048 - RNA, 23 nt, Human
uagcucaguggcaguucugacag

SEQ ID NO: 471049 - RNA, 22 nt, Human
ucccggaggacccccacuugcg

SEQ ID NO: 471050 - RNA, 19 nt, Human
uccugggcccccagggccc

SEQ ID NO: 471051 - RNA, 19 nt, Human
uccugggcccccagggccc

SEQ ID NO: 471052 - RNA, 22 nt, Human
ucgccucauccgggaccuccac

SEQ ID NO: 471053 - RNA, 18 nt, Human
ucgcggguccccggacuc

SEQ ID NO: 471054 - RNA, 23 nt, Human
ucuccugggcccccagggcccca

SEQ ID NO: 471055 - RNA, 21 nt, Human
ucugccgggcagccacaucgu

SEQ ID NO: 471056 - RNA, 19 nt, Human
ucuguaccacgaucuggca

SEQ ID NO: 471057 - RNA, 25 nt, Human
ucuguaccacgaucuggcacugggg

SEQ ID NO: 471058 - RNA, 23 nt, Human
ugacagcugaaggcggggaggcu

SEQ ID NO: 471059 - RNA, 23 nt, Human
ugacagcugaaggcggggaggcu

SEQ ID NO: 471060 - RNA, 20 nt, Human
ugcagucuccuuccuggcuc

SEQ ID NO: 471061 - RNA, 20 nt, Human
ugcagucuccuuccuggcuc

SEQ ID NO: 471062 - RNA, 23 nt, Human
ugcggggucccagcggucccggg

SEQ ID NO: 471063 - RNA, 22 nt, Human
uggagucacacagaggcuccac

SEQ ID NO: 471064 - RNA, 22 nt, Human
uggagucacacagaggcuccac

SEQ ID NO: 471065 - RNA, 21 nt, Human
uggauggccuugcagagcagg

SEQ ID NO: 471066 - RNA, 23 nt, Human
uggcaguucugacagcuugggug

SEQ ID NO: 471067 - RNA, 18 nt, Human
uggccuccggcgcggccc

SEQ ID NO: 471068 - RNA, 20 nt, Human
uggccuccggcgcggcccuc

SEQ ID NO: 471069 - RNA, 22 nt, Human
uggugggaggaguauggaguca

SEQ ID NO: 471070 - RNA, 22 nt, Human
uggugggaggaguauggaguca

SEQ ID NO: 471071 - RNA, 24 nt, Human
ugucuccugggcccccagggcccc

SEQ ID NO: 471072 - RNA, 24 nt, Human
uguggggcugggucagcauguggc

SEQ ID NO: 471073 - RNA, 24 nt, Human
uguggggcugggucagcauguggc

SEQ ID NO: 471074 - RNA, 19 nt, Human
uuccuggcucugaacaggu

SEQ ID NO: 471075 - RNA, 19 nt, Human
uuccuggcucugaacaggu

SEQ ID NO: 471076 - RNA, 20 nt, Human
uuccuggcucugaacagguu

SEQ ID NO: 471077 - RNA, 20 nt, Human
uuccuggcucugaacagguu

SEQ ID NO: 471078 - RNA, 23 nt, Human
uugcaaugguagcugaaggcacu

SEQ ID NO: 471079 - RNA, 24 nt, Human
uuguggugggaggaguauggaguc

SEQ ID NO: 471080 - RNA, 24 nt, Human
uuguggugggaggaguauggaguc

SEQ ID NO: 471081 - RNA, 24 nt, Human
aaaaaagaaaaagaaaauaaagaa

SEQ ID NO: 471082 - RNA, 22 nt, Human
aaaagaaaaagaaaauaaagaa

SEQ ID NO: 471083 - RNA, 25 nt, Human
aaaagagggaacacagagucaauau

SEQ ID NO: 471084 - RNA, 23 nt, Human
aaaaggacagauucagagaagug

SEQ ID NO: 471085 - RNA, 21 nt, Human
aaccacaguaauaauaacuga

SEQ ID NO: 471086 - RNA, 22 nt, Human
aagaaaaagaaaauaaagaaaa

SEQ ID NO: 471087 - RNA, 24 nt, Human
aaggcgcacaucacuuucucuguc

SEQ ID NO: 471088 - RNA, 19 nt, Human
aagggacaaaguaucuaca

SEQ ID NO: 471089 - RNA, 20 nt, Human
aauacugacugucauacaac

SEQ ID NO: 471090 - RNA, 23 nt, Human
aaucacaagaauccacaaaagga

SEQ ID NO: 471091 - RNA, 20 nt, Human
acaucacaaguguguuaaca

SEQ ID NO: 471092 - RNA, 24 nt, Human
acaucacuuucucuguccccccaa

SEQ ID NO: 471093 - RNA, 18 nt, Human
acccccccuuuaaccaag

SEQ ID NO: 471094 - RNA, 22 nt, Human
agaaggcgcacaucacuuucuc

SEQ ID NO: 471095 - RNA, 21 nt, Human
agaguuuuccaaugaccacac

SEQ ID NO: 471096 - RNA, 20 nt, Human
aggguggagggcagggucaa

SEQ ID NO: 471097 - RNA, 24 nt, Human
cacaaaaggacagauucagagaag

SEQ ID NO: 471098 - RNA, 24 nt, Human
cacaagaauccacaaaaggacaga

SEQ ID NO: 471099 - RNA, 22 nt, Human
cacaucacuuucucuguccccc

SEQ ID NO: 471100 - RNA, 23 nt, Human
ccagacagccggugacccccccu

SEQ ID NO: 471101 - RNA, 24 nt, Human
cgcacaucacuuucucuguccccc

SEQ ID NO: 471102 - RNA, 26 nt, Human
cuaagaauuuaaaaaagaaaaagaaa

SEQ ID NO: 471103 - RNA, 21 nt, Human
cucuguccccccaacccugac

SEQ ID NO: 471104 - RNA, 19 nt, Human
cugacugucauacaacuga

SEQ ID NO: 471105 - RNA, 21 nt, Human
gagaaacuguaacucuguaaa

SEQ ID NO: 471106 - RNA, 18 nt, Human
gagaggugaagcugcuuc

SEQ ID NO: 471107 - RNA, 21 nt, Human
gcggcgcugggcgaggcuuua

SEQ ID NO: 471108 - RNA, 21 nt, Human
gcuucggcggcgcugggcgag

SEQ ID NO: 471109 - RNA, 23 nt, Human
ggaaaaucacaagaauccacaaa

SEQ ID NO: 471110 - RNA, 25 nt, Human
ggaaaaucacaagaauccacaaaag

SEQ ID NO: 471111 - RNA, 24 nt, Human
ggugaggaaagcaugugagagaaa

SEQ ID NO: 471112 - RNA, 27 nt, Human
uaaaaaagaaaaagaaaauaaagaaaa

SEQ ID NO: 471113 - RNA, 24 nt, Human
uacaauagaaaaucauuucgugac

SEQ ID NO: 471114 - RNA, 23 nt, Human
uacacuaagaauuuaaaaaagaa

SEQ ID NO: 471115 - RNA, 20 nt, Human
uaguuaaucagaaccacagu

SEQ ID NO: 471116 - RNA, 21 nt, Human
uaguuuugaacagaacagaua

SEQ ID NO: 471117 - RNA, 25 nt, Human
uccgaacaaaauaaaggcuuucaaa

SEQ ID NO: 471118 - RNA, 19 nt, Human
uccugggugaaucuguggc

SEQ ID NO: 471119 - RNA, 25 nt, Human
ugagagaaacuguaacucuguaaac

SEQ ID NO: 471120 - RNA, 19 nt, Human
ugggagaaaguuggagagg

SEQ ID NO: 471121 - RNA, 21 nt, Human
uggggaggguggagggcaggg

SEQ ID NO: 471122 - RNA, 18 nt, Human
ugggugaagaaugaucuu

SEQ ID NO: 471123 - RNA, 22 nt, Human
uguaacucuguaaacaauacua

SEQ ID NO: 471124 - RNA, 18 nt, Human
ugucauacaacugaaaca

SEQ ID NO: 471125 - RNA, 22 nt, Human
uucaaauguuuuaugaagagac

SEQ ID NO: 471126 - RNA, 22 nt, Human
uucugugaccuccugggugaau

SEQ ID NO: 471127 - RNA, 24 nt, Human
uuucccuugcugucauucugugac

SEQ ID NO: 471128 - RNA, 18 nt, Human
uuuuuuuuuuuuaugggu

SEQ ID NO: 471129 - RNA, 24 nt, Human
uuuuuuuuuuuuuuuuuuuauggg

SEQ ID NO: 471130 - RNA, 18 nt, Human
aaaagaccuggccugaac

SEQ ID NO: 471131 - RNA, 24 nt, Human
aaagugcugggauuacaggcguga

SEQ ID NO: 471132 - RNA, 19 nt, Human
aagugcugggauuacaggc

SEQ ID NO: 471133 - RNA, 19 nt, Human
aagugcugggauuacaggc

SEQ ID NO: 471134 - RNA, 26 nt, Human
aagugcugggauuacaggcgugagcc

SEQ ID NO: 471135 - RNA, 25 nt, Human
accucccggguucacaccauucucc

SEQ ID NO: 471136 - RNA, 18 nt, Human
acgggguuucaccauguu

SEQ ID NO: 471137 - RNA, 19 nt, Human
acgggguuucaccauguua

SEQ ID NO: 471138 - RNA, 20 nt, Human
acgggguuucaccauguuag

SEQ ID NO: 471139 - RNA, 24 nt, Human
acgggguuucaccauguuagccag

SEQ ID NO: 471140 - RNA, 25 nt, Human
aggaaugcagagagcagccgguacc

SEQ ID NO: 471141 - RNA, 19 nt, Human
aggcagaugccccgagccc

SEQ ID NO: 471142 - RNA, 18 nt, Human
aggcuucugcacuguggc

SEQ ID NO: 471143 - RNA, 18 nt, Human
aggcuucugcacuguggc

SEQ ID NO: 471144 - RNA, 25 nt, Human
agguuccccaaggcaacucccuguc

SEQ ID NO: 471145 - RNA, 20 nt, Human
agugcaguggcgcgaucucg

SEQ ID NO: 471146 - RNA, 23 nt, Human
agugcaguggcgcgaucucggcu

SEQ ID NO: 471147 - RNA, 24 nt, Human
agugcaguggcgcgaucucggcuc

SEQ ID NO: 471148 - RNA, 18 nt, Human
agugcugggauuacaggc

SEQ ID NO: 471149 - RNA, 21 nt, Human
auggaagguaacuccaggcag

SEQ ID NO: 471150 - RNA, 24 nt, Human
caaaagaccuggccugaacccauc

SEQ ID NO: 471151 - RNA, 24 nt, Human
caaagugcugggauuacaggcgug

SEQ ID NO: 471152 - RNA, 22 nt, Human
caccauguuagccaggacgguc

SEQ ID NO: 471153 - RNA, 23 nt, Human
cacccccagccuguguccaagcc

SEQ ID NO: 471154 - RNA, 24 nt, Human
cacccccagccuguguccaagccc

SEQ ID NO: 471155 - RNA, 19 nt, Human
caccucccggguucacacc

SEQ ID NO: 471156 - RNA, 19 nt, Human
caccuccucuuggcacacc

SEQ ID NO: 471157 - RNA, 22 nt, Human
caccuccucuuggcacaccaaa

SEQ ID NO: 471158 - RNA, 21 nt, Human
cagcagcugcaaggagucgga

SEQ ID NO: 471159 - RNA, 21 nt, Human
caggugcccgccacaacgccc

SEQ ID NO: 471160 - RNA, 22 nt, Human
ccaaagugcugggauuacaggc

SEQ ID NO: 471161 - RNA, 22 nt, Human
ccaaagugcugggauuacaggc

SEQ ID NO: 471162 - RNA, 24 nt, Human
ccaaagugcugggauuacaggcgu

SEQ ID NO: 471163 - RNA, 18 nt, Human
ccacaaggggagggaugc

SEQ ID NO: 471164 - RNA, 18 nt, Human
ccacugcacccaguuggg

SEQ ID NO: 471165 - RNA, 18 nt, Human
ccacugcacccaguuggg

SEQ ID NO: 471166 - RNA, 19 nt, Human
ccacugcacccaguuggga

SEQ ID NO: 471167 - RNA, 20 nt, Human
ccacugcacccaguugggau

SEQ ID NO: 471168 - RNA, 21 nt, Human
cccaaggcaacucccugucau

SEQ ID NO: 471169 - RNA, 22 nt, Human
cccaccuccucuuggcacacca

SEQ ID NO: 471170 - RNA, 22 nt, Human
cccagccuggagugcaguggcg

SEQ ID NO: 471171 - RNA, 22 nt, Human
ccccagccuguguccaagcccc

SEQ ID NO: 471172 - RNA, 18 nt, Human
ccccgagcccaggaaaga

SEQ ID NO: 471173 - RNA, 24 nt, Human
cccuagcaugcgcccacccccaau

SEQ ID NO: 471174 - RNA, 24 nt, Human
cgccucggccucccaaagugcugg

SEQ ID NO: 471175 - RNA, 24 nt, Human
cgggguuucaccauguuagccagg

SEQ ID NO: 471176 - RNA, 22 nt, Human
cuacuccuggccaucaaaagac

SEQ ID NO: 471177 - RNA, 24 nt, Human
cucacuggaagcuccaccucccgg

SEQ ID NO: 471178 - RNA, 24 nt, Human
cucagccuccggaguagcugggac

SEQ ID NO: 471179 - RNA, 21 nt, Human
cucccggguucacaccauucu

SEQ ID NO: 471180 - RNA, 23 nt, Human
cucccucagccuccggaguagcu

SEQ ID NO: 471181 - RNA, 19 nt, Human
cucccugucaucuacuccu

SEQ ID NO: 471182 - RNA, 20 nt, Human
cucugucgcccagccuggag

SEQ ID NO: 471183 - RNA, 27 nt, Human
cugaacccacaaggggagggaugccag

SEQ ID NO: 471184 - RNA, 24 nt, Human
cuggaagcuccaccucccggguuc

SEQ ID NO: 471185 - RNA, 24 nt, Human
gaagguaacuccaggcagaugccc

SEQ ID NO: 471186 - RNA, 21 nt, Human
gaccuggccugaacccauccc

SEQ ID NO: 471187 - RNA, 24 nt, Human
gagacgggguuucaccauguuagc

SEQ ID NO: 471188 - RNA, 18 nt, Human
gauuacaggcgugagcca

SEQ ID NO: 471189 - RNA, 22 nt, Human
gauuacaggcgugagccacugc

SEQ ID NO: 471190 - RNA, 23 nt, Human
gauuacaggcgugagccacugca

SEQ ID NO: 471191 - RNA, 18 nt, Human
gcagguuaugucuggaag

SEQ ID NO: 471192 - RNA, 23 nt, Human
gcccggcuaauuuuuuguauuuu

SEQ ID NO: 471193 - RNA, 19 nt, Human
gcgcccacccccagccugu

SEQ ID NO: 471194 - RNA, 24 nt, Human
ggagucggagagacuuggcaggug

SEQ ID NO: 471195 - RNA, 25 nt, Human
ggggagggaugccagcuuccacugg

SEQ ID NO: 471196 - RNA, 23 nt, Human
gggguuucaccauguuagccagg

SEQ ID NO: 471197 - RNA, 25 nt, Human
ggugggcuaggucgaggcuggggcu

SEQ ID NO: 471198 - RNA, 23 nt, Human
guagagacgggguuucaccaugu

SEQ ID NO: 471199 - RNA, 24 nt, Human
gugcaggcuucugcacuguggccc

SEQ ID NO: 471200 - RNA, 31 nt, Human
uaauuuuuuguauuuuuuuuuuuaguagagg

SEQ ID NO: 471201 - RNA, 19 nt, Human
uacaggcgugagccacugc

SEQ ID NO: 471202 - RNA, 24 nt, Human
uacaggcgugagccacugcaccca

SEQ ID NO: 471203 - RNA, 22 nt, Human
uagagacgggguuucaccaugu

SEQ ID NO: 471204 - RNA, 18 nt, Human
uagcaugcgcccaccccc

SEQ ID NO: 471205 - RNA, 24 nt, Human
uaguagagacgggguuucaccaug

SEQ ID NO: 471206 - RNA, 25 nt, Human
uaguagagacgggguuucaccaugu

SEQ ID NO: 471207 - RNA, 22 nt, Human
ucaaaccacagcagguagccau

SEQ ID NO: 471208 - RNA, 21 nt, Human
ucacaccauucuccucccuca

SEQ ID NO: 471209 - RNA, 24 nt, Human
ucaccauguuagccaggacggucu

SEQ ID NO: 471210 - RNA, 24 nt, Human
ucacuggaagcuccaccucccggg

SEQ ID NO: 471211 - RNA, 25 nt, Human
ucacuggaagcuccaccucccgggu

SEQ ID NO: 471212 - RNA, 24 nt, Human
ucccaaagugcugggauuacaggc

SEQ ID NO: 471213 - RNA, 19 nt, Human
ucccaucuacccaccuccu

SEQ ID NO: 471214 - RNA, 21 nt, Human
ucccggguucacaccauucuc

SEQ ID NO: 471215 - RNA, 21 nt, Human
ucccuagcaugcgcccacccc

SEQ ID NO: 471216 - RNA, 21 nt, Human
ucccucagccuccggaguagc

SEQ ID NO: 471217 - RNA, 24 nt, Human
ucccucagccuccggaguagcugg

SEQ ID NO: 471218 - RNA, 24 nt, Human
ucccugucaucuacuccuggccau

SEQ ID NO: 471219 - RNA, 23 nt, Human
uccugaccuauugauccgcccgc

SEQ ID NO: 471220 - RNA, 22 nt, Human
ucgcccagccuggagugcagug

SEQ ID NO: 471221 - RNA, 26 nt, Human
ucuacccaccuccucuuggcacacca

SEQ ID NO: 471222 - RNA, 24 nt, Human
ucucgcucugucgcccagccugga

SEQ ID NO: 471223 - RNA, 22 nt, Human
ucugcacuguggcccugagagg

SEQ ID NO: 471224 - RNA, 20 nt, Human
ugaacccauccccaugccag

SEQ ID NO: 471225 - RNA, 25 nt, Human
ugacagcagcugcaaggagucggag

SEQ ID NO: 471226 - RNA, 22 nt, Human
ugagacggagucucgcucuguc

SEQ ID NO: 471227 - RNA, 23 nt, Human
ugcgcccacccccagccuguguc

SEQ ID NO: 471228 - RNA, 24 nt, Human
ugcugggauuacaggcgugagcca

SEQ ID NO: 471229 - RNA, 23 nt, Human
uggagugcaguggcgcgaucucg

SEQ ID NO: 471230 - RNA, 24 nt, Human
uggagugcaguggcgcgaucucgg

SEQ ID NO: 471231 - RNA, 18 nt, Human
ugggauuacaggcgugag

SEQ ID NO: 471232 - RNA, 19 nt, Human
ugggauuacaggcgugagc

SEQ ID NO: 471233 - RNA, 21 nt, Human
ugggauuacaggcgugagcca

SEQ ID NO: 471234 - RNA, 22 nt, Human
ugggauuacaggcgugagccac

SEQ ID NO: 471235 - RNA, 22 nt, Human
ugggauuacaggcgugagccac

SEQ ID NO: 471236 - RNA, 24 nt, Human
ugggauuacaggcgugagccacug

SEQ ID NO: 471237 - RNA, 26 nt, Human
ugggauuacaggcgugagccacugca

SEQ ID NO: 471238 - RNA, 30 nt, Human
ugggccugggggaccgagccccacucccuc

SEQ ID NO: 471239 - RNA, 21 nt, Human
ugucgcccagccuggagugca

SEQ ID NO: 471240 - RNA, 21 nt, Human
ugugcaggcuucugcacugug

SEQ ID NO: 471241 - RNA, 18 nt, Human
uuaguagagacgggguuu

SEQ ID NO: 471242 - RNA, 22 nt, Human
uuaguagagacgggguuucacc

SEQ ID NO: 471243 - RNA, 24 nt, Human
uuaguagagacgggguuucaccau

SEQ ID NO: 471244 - RNA, 23 nt, Human
uucaugcagguuaugucuggaag

SEQ ID NO: 471245 - RNA, 24 nt, Human
uugauccgcccgccucggccuccc

SEQ ID NO: 471246 - RNA, 22 nt, Human
uuucaccauguuagccaggacg

SEQ ID NO: 471247 - RNA, 24 nt, Human
uuuuuaguagagacgggguuucac

SEQ ID NO: 471248 - RNA, 25 nt, Human
uuuuuauuuauguauuuauuuuuuu

SEQ ID NO: 471249 - RNA, 29 nt, Human
uuuuuguauuuuuuuuuuuaguagagaag

SEQ ID NO: 471250 - RNA, 23 nt, Human
uuuuuuaguagagacgggguuuc

SEQ ID NO: 471251 - RNA, 30 nt, Human
uuuuuuguauuuuuuuuuuuaguagagacg

SEQ ID NO: 471252 - RNA, 24 nt, Human
uuuuuuuuuuuaguagagacgggg

SEQ ID NO: 471253 - RNA, 21 nt, Human
uuuuuuuuuuuuauggguggu

SEQ ID NO: 471254 - RNA, 24 nt, Human
uuuuuuuuuuuuuuuuuuuauggg

SEQ ID NO: 471255 - RNA, 21 nt, Human
aaauguccucuuaccucuggg

SEQ ID NO: 471256 - RNA, 24 nt, Human
aauguccucuuaccucuggguggc

SEQ ID NO: 471257 - RNA, 19 nt, Human
acagcugccccgugccuca

SEQ ID NO: 471258 - RNA, 19 nt, Human
acaggaaaaugaggcagag

SEQ ID NO: 471259 - RNA, 21 nt, Human
accaagccuguacccaaagac

SEQ ID NO: 471260 - RNA, 20 nt, Human
accuagggcccucagaccca

SEQ ID NO: 471261 - RNA, 20 nt, Human
agagagcagcagggaggaac

SEQ ID NO: 471262 - RNA, 18 nt, Human
agaggagcuacaggaaaa

SEQ ID NO: 471263 - RNA, 23 nt, Human
agcagccaaugagcaaacagaac

SEQ ID NO: 471264 - RNA, 21 nt, Human
agccaaugagcaaacagaacc

SEQ ID NO: 471265 - RNA, 19 nt, Human
aggaaaggugggcauggua

SEQ ID NO: 471266 - RNA, 22 nt, Human
aggaacgggaacagggcagggc

SEQ ID NO: 471267 - RNA, 21 nt, Human
aggagcuacaggaaaaugagg

SEQ ID NO: 471268 - RNA, 20 nt, Human
aggcagaggggcaggcuugg

SEQ ID NO: 471269 - RNA, 22 nt, Human
aggcagaggggcaggcuugggg

SEQ ID NO: 471270 - RNA, 22 nt, Human
aggcagaggggcaggcuugggg

SEQ ID NO: 471271 - RNA, 25 nt, Human
aggcagaggggcaggcuugggggaa

SEQ ID NO: 471272 - RNA, 23 nt, Human
aggcaggagcggcugccucaggc

SEQ ID NO: 471273 - RNA, 22 nt, Human
aggcagggcaggcacagcugcc

SEQ ID NO: 471274 - RNA, 19 nt, Human
aggcuugggggaaggcagc

SEQ ID NO: 471275 - RNA, 18 nt, Human
agggcuucuaggacuucc

SEQ ID NO: 471276 - RNA, 18 nt, Human
aggggcaggcuuggggga

SEQ ID NO: 471277 - RNA, 22 nt, Human
caagccuguacccaaagaccug

SEQ ID NO: 471278 - RNA, 18 nt, Human
cacaaggaagggccccau

SEQ ID NO: 471279 - RNA, 22 nt, Human
cacccauaucuuccuccccacu

SEQ ID NO: 471280 - RNA, 19 nt, Human
cagaagccuuugccugggu

SEQ ID NO: 471281 - RNA, 23 nt, Human
cagcagccaaugagcaaacagaa

SEQ ID NO: 471282 - RNA, 18 nt, Human
cagcagccucccgaggcc

SEQ ID NO: 471283 - RNA, 21 nt, Human
caggagcucacacagagcuaa

SEQ ID NO: 471284 - RNA, 23 nt, Human
ccaagaaaccggcaggagcucac

SEQ ID NO: 471285 - RNA, 23 nt, Human
ccacgcucacccacacuggccca

SEQ ID NO: 471286 - RNA, 22 nt, Human
ccagcagccucccgaggccugg

SEQ ID NO: 471287 - RNA, 22 nt, Human
ccauaucuuccuccccacucug

SEQ ID NO: 471288 - RNA, 23 nt, Human
cccaccaagccuguacccaaaga

SEQ ID NO: 471289 - RNA, 22 nt, Human
cccagggggaccaagggcuucu

SEQ ID NO: 471290 - RNA, 18 nt, Human
cccauaucuuccucccca

SEQ ID NO: 471291 - RNA, 22 nt, Human
ccccuuggaugaacacagcagc

SEQ ID NO: 471292 - RNA, 21 nt, Human
cccucacuucugggagaaccc

SEQ ID NO: 471293 - RNA, 18 nt, Human
ccucagacccagggggac

SEQ ID NO: 471294 - RNA, 21 nt, Human
ccucccaccaagccuguaccc

SEQ ID NO: 471295 - RNA, 21 nt, Human
ccucuggguggcccugggccc

SEQ ID NO: 471296 - RNA, 22 nt, Human
ccuguacccaaagaccuggggc

SEQ ID NO: 471297 - RNA, 23 nt, Human
cucaagggauggagggaaaggcc

SEQ ID NO: 471298 - RNA, 24 nt, Human
cucaagggauggagggaaaggccc

SEQ ID NO: 471299 - RNA, 22 nt, Human
cucacacagagcuaaugcuaaa

SEQ ID NO: 471300 - RNA, 19 nt, Human
cucccaccaagccuguacc

SEQ ID NO: 471301 - RNA, 18 nt, Human
cucccgaggccuggccca

SEQ ID NO: 471302 - RNA, 23 nt, Human
cucugggacugacugacagccaa

SEQ ID NO: 471303 - RNA, 18 nt, Human
cucuggguggcccugggc

SEQ ID NO: 471304 - RNA, 24 nt, Human
cugacagccaagaaaccggcagga

SEQ ID NO: 471305 - RNA, 19 nt, Human
cugguacccaccaccccug

SEQ ID NO: 471306 - RNA, 20 nt, Human
cuuggcucacagaugggggg

SEQ ID NO: 471307 - RNA, 22 nt, Human
gaaccagaggagcuacaggaaa

SEQ ID NO: 471308 - RNA, 27 nt, Human
gagagcagcagggaggaaccgguaccc

SEQ ID NO: 471309 - RNA, 19 nt, Human
gagcagcagggaggaacgg

SEQ ID NO: 471310 - RNA, 19 nt, Human
gagcggcugccucaggcag

SEQ ID NO: 471311 - RNA, 24 nt, Human
gagcggcugccucaggcagaggca

SEQ ID NO: 471312 - RNA, 19 nt, Human
gaggcucuccaugaccuag

SEQ ID NO: 471313 - RNA, 18 nt, Human
gcagaggggcaggcuugg

SEQ ID NO: 471314 - RNA, 22 nt, Human
gcaggcacagcugccccgugcc

SEQ ID NO: 471315 - RNA, 18 nt, Human
ggagggaaaggccccuca

SEQ ID NO: 471316 - RNA, 20 nt, Human
ggauggagggaaaggccccu

SEQ ID NO: 471317 - RNA, 21 nt, Human
ggcuugggggaaggcagcauu

SEQ ID NO: 471318 - RNA, 20 nt, Human
gggaccaagggcuucuagga

SEQ ID NO: 471319 - RNA, 22 nt, Human
gggaccaagggcuucuaggacu

SEQ ID NO: 471320 - RNA, 18 nt, Human
gggcaggcagagagcagc

SEQ ID NO: 471321 - RNA, 19 nt, Human
ggggaccaagggcuucuag

SEQ ID NO: 471322 - RNA, 19 nt, Human
gguggcccugggccccagg

SEQ ID NO: 471323 - RNA, 21 nt, Human
guggcccugggccccaggguu

SEQ ID NO: 471324 - RNA, 20 nt, Human
uacaggaaaaugaggcagag

SEQ ID NO: 471325 - RNA, 18 nt, Human
ucaagggauggagggaaa

SEQ ID NO: 471326 - RNA, 20 nt, Human
ucacuucugggagaaccccc

SEQ ID NO: 471327 - RNA, 23 nt, Human
uccaugaccuagggcccucagac

SEQ ID NO: 471328 - RNA, 21 nt, Human
ucucugguacccaccaccccu

SEQ ID NO: 471329 - RNA, 21 nt, Human
ugaggcagaggggcaggcuug

SEQ ID NO: 471330 - RNA, 19 nt, Human
ugccucaagggauggaggg

SEQ ID NO: 471331 - RNA, 20 nt, Human
ugccuggguccaaaggccag

SEQ ID NO: 471332 - RNA, 24 nt, Human
ugccuggguccaaaggccagggac

SEQ ID NO: 471333 - RNA, 20 nt, Human
ugggagaacccccuuggaug

SEQ ID NO: 471334 - RNA, 24 nt, Human
uguuaauaaauuggcaacacaagg

SEQ ID NO: 471335 - RNA, 23 nt, Human
uuccuccccacucugggacugac

SEQ ID NO: 471336 - RNA, 25 nt, Human
uuggaugaacacagcagccaaugag

SEQ ID NO: 471337 - RNA, 21 nt, Human
acuggcgggcuggcucuuuuu

SEQ ID NO: 471338 - RNA, 23 nt, Human
agagacuggcgggcuggcucuuu

SEQ ID NO: 471339 - RNA, 18 nt, Human
caaggagaaugcuucucu

SEQ ID NO: 471340 - RNA, 19 nt, Human
cacuuuaaaucagugguuc

SEQ ID NO: 471341 - RNA, 20 nt, Human
ccaaggagaaugcuucucuu

SEQ ID NO: 471342 - RNA, 21 nt, Human
cugaagggcuuuugugacuuu

SEQ ID NO: 471343 - RNA, 28 nt, Human
cuggcgggcuggcucuuuucccccuggg

SEQ ID NO: 471344 - RNA, 18 nt, Human
ggcuuuugugacuuuggu

SEQ ID NO: 471345 - RNA, 24 nt, Human
uauuucucccucugauccgcugga

SEQ ID NO: 471346 - RNA, 19 nt, Human
ucacaguauucugaaacug

SEQ ID NO: 471347 - RNA, 23 nt, Human
ucccugugagcaagaugaucuga

SEQ ID NO: 471348 - RNA, 18 nt, Human
ucugaaacaccuucccaa

SEQ ID NO: 471349 - RNA, 24 nt, Human
ugaaacugguaucggagagacugg

SEQ ID NO: 471350 - RNA, 19 nt, Human
ugaucugaaacaccuuccc

SEQ ID NO: 471351 - RNA, 20 nt, Human
ugguaucggagagacuggcg

SEQ ID NO: 471352 - RNA, 18 nt, Human
ugguucuguucucuggag

SEQ ID NO: 471353 - RNA, 18 nt, Human
uucacaguauucugaaac

SEQ ID NO: 471354 - RNA, 24 nt, Human
uuucugaagggcuuuugugacuuu

SEQ ID NO: 471355 - RNA, 24 nt, Human
aaggagcccccggcgggagcaggc

SEQ ID NO: 471356 - RNA, 19 nt, Human
acccagccaacccccucag

SEQ ID NO: 471357 - RNA, 18 nt, Human
agaaagaggcuugcagcg

SEQ ID NO: 471358 - RNA, 20 nt, Human
agacccagccaacccccuca

SEQ ID NO: 471359 - RNA, 23 nt, Human
agccuggaucccaaaugcugcag

SEQ ID NO: 471360 - RNA, 24 nt, Human
agggaagaccaggggcuccuuuga

SEQ ID NO: 471361 - RNA, 22 nt, Human
agucacacagggaagaccaggg

SEQ ID NO: 471362 - RNA, 22 nt, Human
auaaaacacuaguaaaauaggg

SEQ ID NO: 471363 - RNA, 20 nt, Human
auggaaagaacugagucaca

SEQ ID NO: 471364 - RNA, 21 nt, Human
caaggagcccccggcgggagc

SEQ ID NO: 471365 - RNA, 22 nt, Human
caccugagagccugagggcggg

SEQ ID NO: 471366 - RNA, 19 nt, Human
cacuggggcggccgccucc

SEQ ID NO: 471367 - RNA, 23 nt, Human
cagcacuggggcggccgccuccu

SEQ ID NO: 471368 - RNA, 21 nt, Human
caggaaggccacguuccgaug

SEQ ID NO: 471369 - RNA, 20 nt, Human
ccaagcagccacggggaagc

SEQ ID NO: 471370 - RNA, 19 nt, Human
cccaggugggugggggugg

SEQ ID NO: 471371 - RNA, 22 nt, Human
ccccucagcgaccacagugccu

SEQ ID NO: 471372 - RNA, 21 nt, Human
ccgacagcugcacgguccccg

SEQ ID NO: 471373 - RNA, 20 nt, Human
ccgccaccagggcugagggu

SEQ ID NO: 471374 - RNA, 24 nt, Human
ccggccgagcaaggagcccccggc

SEQ ID NO: 471375 - RNA, 21 nt, Human
cgcccgcuucucugccgccac

SEQ ID NO: 471376 - RNA, 21 nt, Human
cuacaaauucucuguaucugg

SEQ ID NO: 471377 - RNA, 19 nt, Human
cugcacgguccccgccucu

SEQ ID NO: 471378 - RNA, 21 nt, Human
cugcagcccacguagcgcuaa

SEQ ID NO: 471379 - RNA, 21 nt, Human
cuuugaggaagagugagguca

SEQ ID NO: 471380 - RNA, 18 nt, Human
gacagcugcacggucccc

SEQ ID NO: 471381 - RNA, 22 nt, Human
gauggaaagaacugagucacac

SEQ ID NO: 471382 - RNA, 20 nt, Human
gccucgcccgcuucucugcc

SEQ ID NO: 471383 - RNA, 25 nt, Human
gccuggaucccaaaugcugcagccc

SEQ ID NO: 471384 - RNA, 26 nt, Human
gcuaauccaugucaccaagcagccac

SEQ ID NO: 471385 - RNA, 19 nt, Human
gcuccuuugaggaagagug

SEQ ID NO: 471386 - RNA, 23 nt, Human
gggcagugugggcucauggcacu

SEQ ID NO: 471387 - RNA, 19 nt, Human
ggguggggguggccuucag

SEQ ID NO: 471388 - RNA, 18 nt, Human
uaauccgagguuuucccu

SEQ ID NO: 471389 - RNA, 19 nt, Human
uaucuggcauauaaaaacu

SEQ ID NO: 471390 - RNA, 18 nt, Human
ucaauaucugagcuggac

SEQ ID NO: 471391 - RNA, 25 nt, Human
ucaccaagcagccacggggaagcca

SEQ ID NO: 471392 - RNA, 22 nt, Human
uccaugucaccaagcagccacg

SEQ ID NO: 471393 - RNA, 19 nt, Human
ucggggucccacauggucc

SEQ ID NO: 471394 - RNA, 18 nt, Human
ucucuuaaagcaaaacau

SEQ ID NO: 471395 - RNA, 24 nt, Human
ucuuucagguccaucgggguccca

SEQ ID NO: 471396 - RNA, 18 nt, Human
ugacacacacguuucccc

SEQ ID NO: 471397 - RNA, 22 nt, Human
ugaggucauauuuuuauugcuu

SEQ ID NO: 471398 - RNA, 18 nt, Human
ugccccucuagguagccu

SEQ ID NO: 471399 - RNA, 19 nt, Human
ugccccucuagguagccug

SEQ ID NO: 471400 - RNA, 21 nt, Human
ugccucgcccgcuucucugcc

SEQ ID NO: 471401 - RNA, 20 nt, Human
uggaucccaaaugcugcagc

SEQ ID NO: 471402 - RNA, 24 nt, Human
uggcacucagacccagccaacccc

SEQ ID NO: 471403 - RNA, 25 nt, Human
ugggaugguaucacuguggccuggg

SEQ ID NO: 471404 - RNA, 19 nt, Human
ugguaucacuguggccugg

SEQ ID NO: 471405 - RNA, 24 nt, Human
ugucacagucagcgcagaaagagg

SEQ ID NO: 471406 - RNA, 22 nt, Human
uuaaauagugaaauaccaacca

SEQ ID NO: 471407 - RNA, 24 nt, Human
uuaguuucccaggugggugggggu

SEQ ID NO: 471408 - RNA, 24 nt, Human
aaaagaugugcaaacaacaaagaa

SEQ ID NO: 471409 - RNA, 22 nt, Human
aaagaugcaacacucaaccccc

SEQ ID NO: 471410 - RNA, 21 nt, Human
aaagcaccuuccaguuccucc

SEQ ID NO: 471411 - RNA, 19 nt, Human
aacacucaacccccgcacg

SEQ ID NO: 471412 - RNA, 22 nt, Human
aaccagaccuaaagcaccuucc

SEQ ID NO: 471413 - RNA, 24 nt, Human
aauacauagaaaaaguacaaauaa

SEQ ID NO: 471414 - RNA, 25 nt, Human
acaacaaagaaugcccgacccugaa

SEQ ID NO: 471415 - RNA, 19 nt, Human
acaagaaaggcaaagaugc

SEQ ID NO: 471416 - RNA, 21 nt, Human
acaggauuauaauacauagaa

SEQ ID NO: 471417 - RNA, 19 nt, Human
acagugagggacgaguggc

SEQ ID NO: 471418 - RNA, 20 nt, Human
accaccuccuccuccuccug

SEQ ID NO: 471419 - RNA, 20 nt, Human
acgcugaagagcagguagac

SEQ ID NO: 471420 - RNA, 21 nt, Human
agauccuacacuuaaagcuca

SEQ ID NO: 471421 - RNA, 21 nt, Human
agauggagguugugugcuugu

SEQ ID NO: 471422 - RNA, 22 nt, Human
aggacagugagggacgaguggc

SEQ ID NO: 471423 - RNA, 22 nt, Human
augcaacacucaacccccgcac

SEQ ID NO: 471424 - RNA, 22 nt, Human
caaccagcagcaucauccauca

SEQ ID NO: 471425 - RNA, 19 nt, Human
caacgacaagaaaggcaaa

SEQ ID NO: 471426 - RNA, 21 nt, Human
cacaauuucugccaaaauaga

SEQ ID NO: 471427 - RNA, 25 nt, Human
caccccacaaaaaugcccacuccca

SEQ ID NO: 471428 - RNA, 22 nt, Human
caccuccugggugucccgggag

SEQ ID NO: 471429 - RNA, 21 nt, Human
cacucccauugacgcugaaga

SEQ ID NO: 471430 - RNA, 21 nt, Human
cagaccccggcacuggugccg

SEQ ID NO: 471431 - RNA, 19 nt, Human
cagcauuauugguauaaaa

SEQ ID NO: 471432 - RNA, 21 nt, Human
caggaaaaaaaauuagacaca

SEQ ID NO: 471433 - RNA, 21 nt, Human
caggacagugagggacgagug

SEQ ID NO: 471434 - RNA, 21 nt, Human
cagguagacgggccccuugcu

SEQ ID NO: 471435 - RNA, 21 nt, Human
ccacgggggacuucaucucgg

SEQ ID NO: 471436 - RNA, 20 nt, Human
ccaggacagugagggacgag

SEQ ID NO: 471437 - RNA, 19 nt, Human
cccaacaccauccagccca

SEQ ID NO: 471438 - RNA, 21 nt, Human
cccaacaccauccagcccaau

SEQ ID NO: 471439 - RNA, 23 nt, Human
cccacaaaaaugcccacucccau

SEQ ID NO: 471440 - RNA, 19 nt, Human
ccccaacaccauccagccc

SEQ ID NO: 471441 - RNA, 20 nt, Human
ccccaacaccauccagccca

SEQ ID NO: 471442 - RNA, 23 nt, Human
cccgacccugaaccagaccuaaa

SEQ ID NO: 471443 - RNA, 26 nt, Human
cccugaaccagaccuaaagcaccuuc

SEQ ID NO: 471444 - RNA, 19 nt, Human
ccuugcgcaccaccuccuc

SEQ ID NO: 471445 - RNA, 18 nt, Human
cgacccugaaccagaccu

SEQ ID NO: 471446 - RNA, 20 nt, Human
cucacagaauaucaaaugac

SEQ ID NO: 471447 - RNA, 24 nt, Human
cuccacacaucaugccccaacacc

SEQ ID NO: 471448 - RNA, 20 nt, Human
cuccuccuggcgcuucucgu

SEQ ID NO: 471449 - RNA, 19 nt, Human
cucggccaccccacaaaaa

SEQ ID NO: 471450 - RNA, 20 nt, Human
cucuaaaugacaaaaugacu

SEQ ID NO: 471451 - RNA, 21 nt, Human
cucuaaaugacaaaaugacuc

SEQ ID NO: 471452 - RNA, 25 nt, Human
cuuccaguuccuccacacaucaugc

SEQ ID NO: 471453 - RNA, 18 nt, Human
gaacugauaauuuucagc

SEQ ID NO: 471454 - RNA, 23 nt, Human
gcaaacaacaaagaaugcccgac

SEQ ID NO: 471455 - RNA, 18 nt, Human
gcaacagaucuggaagga

SEQ ID NO: 471456 - RNA, 21 nt, Human
gccccaacaccauccagccca

SEQ ID NO: 471457 - RNA, 19 nt, Human
gcccgcuuuucagauucca

SEQ ID NO: 471458 - RNA, 20 nt, Human
gcucuaaauacaagucuaau

SEQ ID NO: 471459 - RNA, 23 nt, Human
gggcaaaaaucaacgacaagaaa

SEQ ID NO: 471460 - RNA, 24 nt, Human
uaaaaagaugugcaaacaacaaag

SEQ ID NO: 471461 - RNA, 18 nt, Human
uaaaaagcaauaaaggga

SEQ ID NO: 471462 - RNA, 24 nt, Human
uaaaaagcaauaaagggaugagaa

SEQ ID NO: 471463 - RNA, 25 nt, Human
uaacaaaaauccacuggacaucaaa

SEQ ID NO: 471464 - RNA, 21 nt, Human
uaagcugacaaaaaaaauacu

SEQ ID NO: 471465 - RNA, 21 nt, Human
uaaggcuuguauucuccuaga

SEQ ID NO: 471466 - RNA, 21 nt, Human
uaagggcaccuccuggguguc

SEQ ID NO: 471467 - RNA, 25 nt, Human
uaucaaaugacugaauuuaagaaca

SEQ ID NO: 471468 - RNA, 19 nt, Human
ucaacgacaagaaaggcaa

SEQ ID NO: 471469 - RNA, 22 nt, Human
ucaacgacaagaaaggcaaaga

SEQ ID NO: 471470 - RNA, 19 nt, Human
ucagagggucuuuuggagc

SEQ ID NO: 471471 - RNA, 24 nt, Human
ucagcacuugcuuggcuuuuucua

SEQ ID NO: 471472 - RNA, 24 nt, Human
ucauuccacaaaacaugacagcaa

SEQ ID NO: 471473 - RNA, 19 nt, Human
uccaggacuccauucaggc

SEQ ID NO: 471474 - RNA, 20 nt, Human
uccugggugucccgggaguu

SEQ ID NO: 471475 - RNA, 18 nt, Human
ucgaagauggagguugug

SEQ ID NO: 471476 - RNA, 23 nt, Human
ucuagcagaaaaaucaaaugggu

SEQ ID NO: 471477 - RNA, 19 nt, Human
ucugugcuacaccagaugg

SEQ ID NO: 471478 - RNA, 18 nt, Human
ugaaauuuacaaccagca

SEQ ID NO: 471479 - RNA, 19 nt, Human
ugaaccagaccuaaagcac

SEQ ID NO: 471480 - RNA, 21 nt, Human
ugaaccagaccuaaagcaccu

SEQ ID NO: 471481 - RNA, 26 nt, Human
ugagaccagaccccggcacuggugcc

SEQ ID NO: 471482 - RNA, 23 nt, Human
ugagcucaacggucccucauucc

SEQ ID NO: 471483 - RNA, 24 nt, Human
ugucguccaggacuccauucaggc

SEQ ID NO: 471484 - RNA, 20 nt, Human
ugugcaaacaacaaagaaug

SEQ ID NO: 471485 - RNA, 22 nt, Human
ugugcaaacaacaaagaaugcc

SEQ ID NO: 471486 - RNA, 22 nt, Human
ugugcaaacaacaaagaaugcc

SEQ ID NO: 471487 - RNA, 20 nt, Human
ugugugcuuguaggaacuga

SEQ ID NO: 471488 - RNA, 22 nt, Human
uucaaaaaaaaaaaaaaagugu

SEQ ID NO: 471489 - RNA, 21 nt, Human
uuccuccacacaucaugcccc

SEQ ID NO: 471490 - RNA, 23 nt, Human
uuccuccacacaucaugccccaa

SEQ ID NO: 471491 - RNA, 18 nt, Human
uugcgcaccaccuccucc

SEQ ID NO: 471492 - RNA, 24 nt, Human
uuuacccauucaacaggaaaaaaa

SEQ ID NO: 471493 - RNA, 24 nt, Human
uuucaguauuuucaagagauuuua

SEQ ID NO: 471494 - RNA, 19 nt, Human
uuuguugucguuauucucc

SEQ ID NO: 471495 - RNA, 21 nt, Human
uuuuggagcaaguaguuuuca

SEQ ID NO: 471496 - RNA, 20 nt, Human
uuuuuuuuuuuuuuuuugcu

SEQ ID NO: 471497 - RNA, 23 nt, Human
uuuuuuuuuuuuuuuuuugcuaa

SEQ ID NO: 471498 - RNA, 20 nt, Human
uuuuuuuuuuuuuuuuuugg

SEQ ID NO: 471499 - RNA, 20 nt, Human
aaaacuacaggcauaaguca

SEQ ID NO: 471500 - RNA, 20 nt, Human
aaagagagaaaaaaguccac

SEQ ID NO: 471501 - RNA, 21 nt, Human
aacaaaaccaccaggggcugg

SEQ ID NO: 471502 - RNA, 19 nt, Human
aaggaaaggaaugaacaaa

SEQ ID NO: 471503 - RNA, 23 nt, Human
auaaaggggagacccugccuaca

SEQ ID NO: 471504 - RNA, 18 nt, Human
cacucauccgcagcucca

SEQ ID NO: 471505 - RNA, 18 nt, Human
caggaacaugccugggau

SEQ ID NO: 471506 - RNA, 24 nt, Human
cagguaaauuuucuaauaaggcuu

SEQ ID NO: 471507 - RNA, 21 nt, Human
ccaaaagagagaaaaaagucc

SEQ ID NO: 471508 - RNA, 22 nt, Human
ccaaaagagagaaaaaagucca

SEQ ID NO: 471509 - RNA, 22 nt, Human
cccaaaagagagaaaaaagucc

SEQ ID NO: 471510 - RNA, 20 nt, Human
ccccaaaagagagaaaaaag

SEQ ID NO: 471511 - RNA, 22 nt, Human
ccgcagcuccaggacgccgcac

SEQ ID NO: 471512 - RNA, 21 nt, Human
cgccgcacuccacgcgcugcc

SEQ ID NO: 471513 - RNA, 19 nt, Human
gaacaaaaccaccaggggc

SEQ ID NO: 471514 - RNA, 18 nt, Human
guaaagcgagccugcccc

SEQ ID NO: 471515 - RNA, 24 nt, Human
guaacagcaagguuggccuuuucu

SEQ ID NO: 471516 - RNA, 22 nt, Human
gucaaaccaggcugcagagaac

SEQ ID NO: 471517 - RNA, 18 nt, Human
uaauaaggcuuuugauac

SEQ ID NO: 471518 - RNA, 19 nt, Human
uagcuucccaaacagcuug

SEQ ID NO: 471519 - RNA, 26 nt, Human
uccgcagcuccaggacgccgcacucc

SEQ ID NO: 471520 - RNA, 18 nt, Human
ucuaccuuuccucuugga

SEQ ID NO: 471521 - RNA, 24 nt, Human
ugaaaaccauaaaggggagacccu

SEQ ID NO: 471522 - RNA, 23 nt, Human
uguccccaaaagagagaaaaaag

SEQ ID NO: 471523 - RNA, 23 nt, Human
uuagcuucccaaacagcuugcag

SEQ ID NO: 471524 - RNA, 18 nt, Human
uucuucggcaaugaacaa

SEQ ID NO: 471525 - RNA, 23 nt, Human
uuuuuuauccuguccccaaaaga

SEQ ID NO: 471526 - RNA, 21 nt, Human
acagccuccuuucgggaucaa

SEQ ID NO: 471527 - RNA, 20 nt, Human
accaaguaacacagaccuga

SEQ ID NO: 471528 - RNA, 21 nt, Human
acccaccccaggcccucccuc

SEQ ID NO: 471529 - RNA, 19 nt, Human
accccaggcccucccucuc

SEQ ID NO: 471530 - RNA, 25 nt, Human
acgcagcaugucggggggacaaggc

SEQ ID NO: 471531 - RNA, 25 nt, Human
acuccacccccacacccaccccaga

SEQ ID NO: 471532 - RNA, 19 nt, Human
acugcagcggcggcggcug

SEQ ID NO: 471533 - RNA, 24 nt, Human
agagaggaggaagugggagaggag

SEQ ID NO: 471534 - RNA, 18 nt, Human
agcacaaaugaaggcaga

SEQ ID NO: 471535 - RNA, 18 nt, Human
aggacgagggaggggcag

SEQ ID NO: 471536 - RNA, 19 nt, Human
agggaggggcaggguggca

SEQ ID NO: 471537 - RNA, 23 nt, Human
cacuccacccccacacccacccc

SEQ ID NO: 471538 - RNA, 19 nt, Human
cagagccagcuccguccuc

SEQ ID NO: 471539 - RNA, 23 nt, Human
cagcagccucccaugcuccaggg

SEQ ID NO: 471540 - RNA, 27 nt, Human
cagcaguaauggggccacgacgccaca

SEQ ID NO: 471541 - RNA, 25 nt, Human
cagcaguggggacuagggaggggca

SEQ ID NO: 471542 - RNA, 23 nt, Human
cagcaugucggggggacaaggcg

SEQ ID NO: 471543 - RNA, 23 nt, Human
caggagacugaggcacacagaga

SEQ ID NO: 471544 - RNA, 18 nt, Human
cagggacaccagcgggag

SEQ ID NO: 471545 - RNA, 21 nt, Human
cagggacaccagcgggagccu

SEQ ID NO: 471546 - RNA, 20 nt, Human
caguggggacuagggagggg

SEQ ID NO: 471547 - RNA, 20 nt, Human
ccaccccaggcccucccucu

SEQ ID NO: 471548 - RNA, 19 nt, Human
ccacgcagcuccugccaga

SEQ ID NO: 471549 - RNA, 22 nt, Human
ccacgcagcuccugccagacac

SEQ ID NO: 471550 - RNA, 21 nt, Human
ccacuccacccccacacccac

SEQ ID NO: 471551 - RNA, 22 nt, Human
ccacuccacccccacacccacc

SEQ ID NO: 471552 - RNA, 24 nt, Human
cccacacccaccccagagaggggc

SEQ ID NO: 471553 - RNA, 18 nt, Human
cccaccccagagaggggc

SEQ ID NO: 471554 - RNA, 22 nt, Human
cccaggcccucccucucccuuc

SEQ ID NO: 471555 - RNA, 19 nt, Human
ccccaggcccucccucucc

SEQ ID NO: 471556 - RNA, 18 nt, Human
cccccacacccaccccag

SEQ ID NO: 471557 - RNA, 18 nt, Human
cccggggcaggcggggcc

SEQ ID NO: 471558 - RNA, 18 nt, Human
cccucccucucccuuccu

SEQ ID NO: 471559 - RNA, 24 nt, Human
ccucucccagacccuggugggagu

SEQ ID NO: 471560 - RNA, 20 nt, Human
cgagggaggggcaggguggc

SEQ ID NO: 471561 - RNA, 18 nt, Human
cggggggacaaggcgggg

SEQ ID NO: 471562 - RNA, 24 nt, Human
cugccagacaccgccacucacgcu

SEQ ID NO: 471563 - RNA, 23 nt, Human
gagccagcuccguccucucccag

SEQ ID NO: 471564 - RNA, 21 nt, Human
gagguggcugaagcaaggcag

SEQ ID NO: 471565 - RNA, 20 nt, Human
gcaguggggacuagggaggg

SEQ ID NO: 471566 - RNA, 20 nt, Human
gccacagagccagcuccguc

SEQ ID NO: 471567 - RNA, 19 nt, Human
gcccggggcaggcggggcc

SEQ ID NO: 471568 - RNA, 19 nt, Human
ggacgagggaggggcaggg

SEQ ID NO: 471569 - RNA, 21 nt, Human
ggaggaagugggagaggagga

SEQ ID NO: 471570 - RNA, 22 nt, Human
ggcccggggcaggcggggccuc

SEQ ID NO: 471571 - RNA, 23 nt, Human
gggagugggggacccaccccagg

SEQ ID NO: 471572 - RNA, 19 nt, Human
gggcaaggccacuccaccc

SEQ ID NO: 471573 - RNA, 21 nt, Human
gggcaaggccacuccaccccc

SEQ ID NO: 471574 - RNA, 21 nt, Human
gggcaggcggggccucgggcc

SEQ ID NO: 471575 - RNA, 19 nt, Human
gggcagggacgaccacugc

SEQ ID NO: 471576 - RNA, 19 nt, Human
gggccggggagggcaggga

SEQ ID NO: 471577 - RNA, 21 nt, Human
ggggacuagggaggggcagga

SEQ ID NO: 471578 - RNA, 21 nt, Human
gggugggggcuggggacugca

SEQ ID NO: 471579 - RNA, 25 nt, Human
guaacacagaccugagggguggggg

SEQ ID NO: 471580 - RNA, 24 nt, Human
gucccuguggcuugggguggggag

SEQ ID NO: 471581 - RNA, 24 nt, Human
uaaaaaccaaguaacacagaccug

SEQ ID NO: 471582 - RNA, 20 nt, Human
uagggaggggcaggagaggu

SEQ ID NO: 471583 - RNA, 22 nt, Human
ucagcagccucccaugcuccag

SEQ ID NO: 471584 - RNA, 21 nt, Human
uccacccccacacccacccca

SEQ ID NO: 471585 - RNA, 22 nt, Human
ucccaugcuccagggacaccag

SEQ ID NO: 471586 - RNA, 20 nt, Human
ucucccuuccucagacagcc

SEQ ID NO: 471587 - RNA, 19 nt, Human
ugaggggugggggcugggg

SEQ ID NO: 471588 - RNA, 23 nt, Human
uggcagcacaaaugaaggcagag

SEQ ID NO: 471589 - RNA, 20 nt, Human
uggcugaagcaaggcagcag

SEQ ID NO: 471590 - RNA, 20 nt, Human
ugggagaggaggacgaggga

SEQ ID NO: 471591 - RNA, 20 nt, Human
uggggacuagggaggggcag

SEQ ID NO: 471592 - RNA, 24 nt, Human
uggugggagucccuguggcuuggg

SEQ ID NO: 471593 - RNA, 19 nt, Human
uuaggguucuaucccaacg

SEQ ID NO: 471594 - RNA, 23 nt, Human
uuuuuuuuuuuuuuauccacugg

SEQ ID NO: 471595 - RNA, 22 nt, Human
aacugccucugccugccuaauc

SEQ ID NO: 471596 - RNA, 23 nt, Human
acagagccaagggaccgcccccc

SEQ ID NO: 471597 - RNA, 24 nt, Human
acgccgccguccucggagcugggc

SEQ ID NO: 471598 - RNA, 19 nt, Human
agaagcccauaacugccuc

SEQ ID NO: 471599 - RNA, 20 nt, Human
agaguuccugucccaucucc

SEQ ID NO: 471600 - RNA, 21 nt, Human
agaguuccugucccaucuccu

SEQ ID NO: 471601 - RNA, 22 nt, Human
agaguuccugucccaucuccuc

SEQ ID NO: 471602 - RNA, 18 nt, Human
agccccuuuccugccucc

SEQ ID NO: 471603 - RNA, 20 nt, Human
agccccuuuccugccucccg

SEQ ID NO: 471604 - RNA, 19 nt, Human
agcguaccgugccccccaa

SEQ ID NO: 471605 - RNA, 22 nt, Human
auacgcuggaggcugaggcgcc

SEQ ID NO: 471606 - RNA, 19 nt, Human
caaggcaaguggaggaaug

SEQ ID NO: 471607 - RNA, 19 nt, Human
cacaucgucgauguccucc

SEQ ID NO: 471608 - RNA, 24 nt, Human
cacaucgucgauguccucccuacu

SEQ ID NO: 471609 - RNA, 19 nt, Human
caccccuuccucuccagcu

SEQ ID NO: 471610 - RNA, 19 nt, Human
cagagaucaccagccuggu

SEQ ID NO: 471611 - RNA, 18 nt, Human
cagcgccgggagaugcaa

SEQ ID NO: 471612 - RNA, 18 nt, Human
cagcguaccgugcccccc

SEQ ID NO: 471613 - RNA, 24 nt, Human
cagcguaccgugccccccaacccc

SEQ ID NO: 471614 - RNA, 20 nt, Human
caggcucgugagagcagcgg

SEQ ID NO: 471615 - RNA, 21 nt, Human
cagucccgggccugcgcuccu

SEQ ID NO: 471616 - RNA, 20 nt, Human
caucuccucccacgcucacc

SEQ ID NO: 471617 - RNA, 23 nt, Human
ccagcaggcucgugagagcagcg

SEQ ID NO: 471618 - RNA, 24 nt, Human
ccagggcccucgaccaggccuucc

SEQ ID NO: 471619 - RNA, 18 nt, Human
cccacgcucacccauccc

SEQ ID NO: 471620 - RNA, 23 nt, Human
cccacgcucacccaucccaagga

SEQ ID NO: 471621 - RNA, 21 nt, Human
cccagguaagcucccaggagg

SEQ ID NO: 471622 - RNA, 21 nt, Human
cccauggcugagggcaugggg

SEQ ID NO: 471623 - RNA, 20 nt, Human
cccccaaccccagcugugug

SEQ ID NO: 471624 - RNA, 20 nt, Human
ccccgcgcggcccgggccgc

SEQ ID NO: 471625 - RNA, 25 nt, Human
ccccgcgcggcccgggccgccgcuc

SEQ ID NO: 471626 - RNA, 20 nt, Human
cccucagcggcccgggacaa

SEQ ID NO: 471627 - RNA, 25 nt, Human
cccugagccguaaccuucaaaccuu

SEQ ID NO: 471628 - RNA, 19 nt, Human
ccgggacaccuucaccucg

SEQ ID NO: 471629 - RNA, 22 nt, Human
ccuagaguuccugucccaucuc

SEQ ID NO: 471630 - RNA, 19 nt, Human
ccucaccccuuccucucca

SEQ ID NO: 471631 - RNA, 19 nt, Human
ccucccgucucaggcucag

SEQ ID NO: 471632 - RNA, 21 nt, Human
ccucccuggggguccgggaca

SEQ ID NO: 471633 - RNA, 21 nt, Human
ccucgaccaggccuucccuuc

SEQ ID NO: 471634 - RNA, 20 nt, Human
cgacccuucaggcgcuuccu

SEQ ID NO: 471635 - RNA, 23 nt, Human
cgccgccguccucggagcugggc

SEQ ID NO: 471636 - RNA, 22 nt, Human
cuagccccuuuccugccucccg

SEQ ID NO: 471637 - RNA, 24 nt, Human
cucaccccuuccucuccagcugcu

SEQ ID NO: 471638 - RNA, 21 nt, Human
cuccagcugcugcggucuccg

SEQ ID NO: 471639 - RNA, 18 nt, Human
cucccaggaggggcaggg

SEQ ID NO: 471640 - RNA, 22 nt, Human
cucccuacuccuggcgauccca

SEQ ID NO: 471641 - RNA, 25 nt, Human
cuccugcuucccccucccuacuucc

SEQ ID NO: 471642 - RNA, 23 nt, Human
gaagcccauaacugccucugccu

SEQ ID NO: 471643 - RNA, 18 nt, Human
gaggcgccgguggccggu

SEQ ID NO: 471644 - RNA, 21 nt, Human
gcacggucucuugagaggcca

SEQ ID NO: 471645 - RNA, 22 nt, Human
gccucaccccuuccucuccagc

SEQ ID NO: 471646 - RNA, 20 nt, Human
gcgcggcgucggggcucugg

SEQ ID NO: 471647 - RNA, 24 nt, Human
gcucaccgcugcuuacgcuccgcc

SEQ ID NO: 471648 - RNA, 19 nt, Human
gcucagcguaccgugcccc

SEQ ID NO: 471649 - RNA, 18 nt, Human
ggacaccuucaccucggg

SEQ ID NO: 471650 - RNA, 19 nt, Human
ggagggaggggugacugcu

SEQ ID NO: 471651 - RNA, 21 nt, Human
ggagugguaggaggcggcuca

SEQ ID NO: 471652 - RNA, 19 nt, Human
ggccuggccgccccagcgg

SEQ ID NO: 471653 - RNA, 23 nt, Human
ggcuccgcccucccaauggucua

SEQ ID NO: 471654 - RNA, 22 nt, Human
gggcauggggaacuagcgugga

SEQ ID NO: 471655 - RNA, 22 nt, Human
gggcguccccgcgcggcccggg

SEQ ID NO: 471656 - RNA, 23 nt, Human
guccauucuccugacccggaucu

SEQ ID NO: 471657 - RNA, 22 nt, Human
uaccgugccccccaaccccagc

SEQ ID NO: 471658 - RNA, 19 nt, Human
uaccuucaucugcaggacc

SEQ ID NO: 471659 - RNA, 18 nt, Human
uaggucucugcacguggc

SEQ ID NO: 471660 - RNA, 19 nt, Human
ucccagcuggggugagaag

SEQ ID NO: 471661 - RNA, 22 nt, Human
ucccagcuucuuuaccugagcu

SEQ ID NO: 471662 - RNA, 22 nt, Human
ucccuucucccccucuagcccc

SEQ ID NO: 471663 - RNA, 24 nt, Human
uccucccacgcucacccaucccaa

SEQ ID NO: 471664 - RNA, 18 nt, Human
uccugcuucccccucccu

SEQ ID NO: 471665 - RNA, 21 nt, Human
uccugcuucccccucccuacu

SEQ ID NO: 471666 - RNA, 20 nt, Human
ucuccugacccggaucuccg

SEQ ID NO: 471667 - RNA, 20 nt, Human
ucugcacguggcuucugggc

SEQ ID NO: 471668 - RNA, 21 nt, Human
ucugccugccuaauccagaga

SEQ ID NO: 471669 - RNA, 21 nt, Human
ugagcuggagcaggugcucca

SEQ ID NO: 471670 - RNA, 18 nt, Human
ugauucugggggugugga

SEQ ID NO: 471671 - RNA, 23 nt, Human
ugccccccaaccccagcuguguu

SEQ ID NO: 471672 - RNA, 18 nt, Human
ugcgcgaggagggagggg

SEQ ID NO: 471673 - RNA, 25 nt, Human
ugcuccaggcgccuuaccuucaucu

SEQ ID NO: 471674 - RNA, 24 nt, Human
uggggguguggacagagccaaggg

SEQ ID NO: 471675 - RNA, 23 nt, Human
ugucccaucuccucccacgcuca

SEQ ID NO: 471676 - RNA, 23 nt, Human
ugugcuggagucucauucuccug

SEQ ID NO: 471677 - RNA, 18 nt, Human
uucaucugcaggaccugc

SEQ ID NO: 471678 - RNA, 21 nt, Human
uuccagggcccucgaccaggc

SEQ ID NO: 471679 - RNA, 20 nt, Human
uucuccugacccggaucucc

SEQ ID NO: 471680 - RNA, 24 nt, Human
aaagugcugggauuacaggcguga

SEQ ID NO: 471681 - RNA, 19 nt, Human
aagugcugggauuacaggc

SEQ ID NO: 471682 - RNA, 19 nt, Human
aagugcugggauuacaggc

SEQ ID NO: 471683 - RNA, 26 nt, Human
aagugcugggauuacaggcgugagcc

SEQ ID NO: 471684 - RNA, 21 nt, Human
accuugaggcgcaaggcacuu

SEQ ID NO: 471685 - RNA, 24 nt, Human
acuauguuggccaggcuggucuug

SEQ ID NO: 471686 - RNA, 27 nt, Human
acucuguugcccaggcuggagugaagu

SEQ ID NO: 471687 - RNA, 19 nt, Human
agcagcucuaggcucagga

SEQ ID NO: 471688 - RNA, 21 nt, Human
agcagcucuaggcucaggaag

SEQ ID NO: 471689 - RNA, 21 nt, Human
aggcgucgccucagccuuccg

SEQ ID NO: 471690 - RNA, 24 nt, Human
agugaaguggcgcacucucggcuc

SEQ ID NO: 471691 - RNA, 24 nt, Human
augggguuucacuauguuggccag

SEQ ID NO: 471692 - RNA, 24 nt, Human
auuuuuguauuuuuaguagagaug

SEQ ID NO: 471693 - RNA, 21 nt, Human
caaagugcugggauuacaggc

SEQ ID NO: 471694 - RNA, 21 nt, Human
caaagugcugggauuacaggc

SEQ ID NO: 471695 - RNA, 23 nt, Human
caaagugcugggauuacaggcgu

SEQ ID NO: 471696 - RNA, 24 nt, Human
caaagugcugggauuacaggcgug

SEQ ID NO: 471697 - RNA, 24 nt, Human
cacaaaaggagcugcagaauccug

SEQ ID NO: 471698 - RNA, 20 nt, Human
cacccuagcacuaucggcug

SEQ ID NO: 471699 - RNA, 24 nt, Human
caccucagccccgcaaagugcugg

SEQ ID NO: 471700 - RNA, 21 nt, Human
cacuauguuggccaggcuggu

SEQ ID NO: 471701 - RNA, 24 nt, Human
cacuauguuggccaggcuggucuu

SEQ ID NO: 471702 - RNA, 24 nt, Human
cacucuguugcccaggcuggagug

SEQ ID NO: 471703 - RNA, 18 nt, Human
cacugagcaggaccuugu

SEQ ID NO: 471704 - RNA, 21 nt, Human
cacugcaaacucugccuccca

SEQ ID NO: 471705 - RNA, 21 nt, Human
cagcaacuucucucccugcag

SEQ ID NO: 471706 - RNA, 24 nt, Human
cagcaugcaggcacagcuccucca

SEQ ID NO: 471707 - RNA, 21 nt, Human
cagcccccuuucugcaggcuu

SEQ ID NO: 471708 - RNA, 18 nt, Human
cagcuaggauuacaggug

SEQ ID NO: 471709 - RNA, 22 nt, Human
caggcuagacugcucacauuca

SEQ ID NO: 471710 - RNA, 19 nt, Human
ccaccaagcgcuccccucc

SEQ ID NO: 471711 - RNA, 19 nt, Human
ccacuaaccugaggacagg

SEQ ID NO: 471712 - RNA, 24 nt, Human
ccauacacccagcuaauuuuugua

SEQ ID NO: 471713 - RNA, 22 nt, Human
cccaggcuggagugaaguggcg

SEQ ID NO: 471714 - RNA, 20 nt, Human
cccagguucaagugauuccc

SEQ ID NO: 471715 - RNA, 21 nt, Human
cccagguucaagugauuccca

SEQ ID NO: 471716 - RNA, 26 nt, Human
cccgcaaagugcugggauuacaggcg

SEQ ID NO: 471717 - RNA, 24 nt, Human
ccgcaaagugcugggauuacaggc

SEQ ID NO: 471718 - RNA, 18 nt, Human
ccuaagugggcacaaagc

SEQ ID NO: 471719 - RNA, 22 nt, Human
ccucccagguucaagugauucc

SEQ ID NO: 471720 - RNA, 22 nt, Human
ccuccguaaccuugaggcgcaa

SEQ ID NO: 471721 - RNA, 21 nt, Human
ccugcagcuccgguccgcugu

SEQ ID NO: 471722 - RNA, 24 nt, Human
cgaccugaggugguccaaccaccu

SEQ ID NO: 471723 - RNA, 19 nt, Human
cgccucagccuuccguccg

SEQ ID NO: 471724 - RNA, 25 nt, Human
cgcgccuggccuugacuguggguuu

SEQ ID NO: 471725 - RNA, 21 nt, Human
cggggugagcuccaggcagcu

SEQ ID NO: 471726 - RNA, 24 nt, Human
cucacucuguugcccaggcuggag

SEQ ID NO: 471727 - RNA, 23 nt, Human
cucacugcaaacucugccuccca

SEQ ID NO: 471728 - RNA, 21 nt, Human
cucagccccgcaaagugcugg

SEQ ID NO: 471729 - RNA, 19 nt, Human
cucagcgggggcuggacac

SEQ ID NO: 471730 - RNA, 20 nt, Human
cuccacccucugcccagccc

SEQ ID NO: 471731 - RNA, 19 nt, Human
cuccaggguggguggucac

SEQ ID NO: 471732 - RNA, 18 nt, Human
cucccagguucaagugau

SEQ ID NO: 471733 - RNA, 24 nt, Human
cugcaaacucugccucccagguuc

SEQ ID NO: 471734 - RNA, 24 nt, Human
gagaugggguuucacuauguuggc

SEQ ID NO: 471735 - RNA, 25 nt, Human
gagcagcuaggauuacaggugggcg

SEQ ID NO: 471736 - RNA, 18 nt, Human
gauuacaggcgugagcca

SEQ ID NO: 471737 - RNA, 22 nt, Human
gauuacaggcgugagccaccgc

SEQ ID NO: 471738 - RNA, 22 nt, Human
gauuacaggcgugagccaccgc

SEQ ID NO: 471739 - RNA, 21 nt, Human
gauuacaggugggcgccauac

SEQ ID NO: 471740 - RNA, 24 nt, Human
gcaaagugcugggauuacaggcgu

SEQ ID NO: 471741 - RNA, 24 nt, Human
gcacaucagagcugcuggguagga

SEQ ID NO: 471742 - RNA, 21 nt, Human
gcccccugagcagcuaggauu

SEQ ID NO: 471743 - RNA, 19 nt, Human
gcuggacacugagcaggac

SEQ ID NO: 471744 - RNA, 18 nt, Human
ggcuggucuugaacuccc

SEQ ID NO: 471745 - RNA, 19 nt, Human
gggcaccccgcccugaaug

SEQ ID NO: 471746 - RNA, 20 nt, Human
gggcuuggcacaaaaggagc

SEQ ID NO: 471747 - RNA, 22 nt, Human
gggguuucacuauguuggccag

SEQ ID NO: 471748 - RNA, 18 nt, Human
ggguuucacuauguuggc

SEQ ID NO: 471749 - RNA, 22 nt, Human
ggguuucacuauguuggccagg

SEQ ID NO: 471750 - RNA, 22 nt, Human
ggucuaaguaacacagcagcuc

SEQ ID NO: 471751 - RNA, 22 nt, Human
gugggauuuuuuuuuuuuuuuu

SEQ ID NO: 471752 - RNA, 24 nt, Human
uaauuuuuguauuuuuaguagaga

SEQ ID NO: 471753 - RNA, 22 nt, Human
uacaggcgugagccaccgcgcc

SEQ ID NO: 471754 - RNA, 22 nt, Human
uacaggcgugagccaccgcgcc

SEQ ID NO: 471755 - RNA, 23 nt, Human
uacaggcgugagccaccgcgccu

SEQ ID NO: 471756 - RNA, 22 nt, Human
uagagaugggguuucacuaugu

SEQ ID NO: 471757 - RNA, 21 nt, Human
uaggagggagaugccaagcuu

SEQ ID NO: 471758 - RNA, 21 nt, Human
uaggauuacaggugggcgcca

SEQ ID NO: 471759 - RNA, 22 nt, Human
uaggauuacaggugggcgccau

SEQ ID NO: 471760 - RNA, 23 nt, Human
uaguagagaugggguuucacuau

SEQ ID NO: 471761 - RNA, 24 nt, Human
uaguagagaugggguuucacuaug

SEQ ID NO: 471762 - RNA, 24 nt, Human
uauguuggccaggcuggucuugaa

SEQ ID NO: 471763 - RNA, 22 nt, Human
ucacuauguuggccaggcuggu

SEQ ID NO: 471764 - RNA, 24 nt, Human
ucacucuguugcccaggcuggagu

SEQ ID NO: 471765 - RNA, 18 nt, Human
ucacugcaaacucugccu

SEQ ID NO: 471766 - RNA, 19 nt, Human
ucacugcaaacucugccuc

SEQ ID NO: 471767 - RNA, 24 nt, Human
ucacugcaaacucugccucccagg

SEQ ID NO: 471768 - RNA, 19 nt, Human
ucagagcugcuggguagga

SEQ ID NO: 471769 - RNA, 18 nt, Human
ucagcccccugagcagcu

SEQ ID NO: 471770 - RNA, 22 nt, Human
ucauccaggcuagacugcucac

SEQ ID NO: 471771 - RNA, 19 nt, Human
ucccagguucaagugauuc

SEQ ID NO: 471772 - RNA, 19 nt, Human
ucuaaguaacacagcagcu

SEQ ID NO: 471773 - RNA, 23 nt, Human
ucucacucuguugcccaggcugg

SEQ ID NO: 471774 - RNA, 24 nt, Human
ucucacucuguugcccaggcugga

SEQ ID NO: 471775 - RNA, 26 nt, Human
ucucacucuguugcccaggcuggagu

SEQ ID NO: 471776 - RNA, 27 nt, Human
ucucacucuguugcccaggcuggagug

SEQ ID NO: 471777 - RNA, 18 nt, Human
ucuguugcccaggcugga

SEQ ID NO: 471778 - RNA, 22 nt, Human
ucuguugcccaggcuggaguga

SEQ ID NO: 471779 - RNA, 24 nt, Human
ucuugaacucccgaccugaggugg

SEQ ID NO: 471780 - RNA, 18 nt, Human
ugaacucagcgggggcug

SEQ ID NO: 471781 - RNA, 24 nt, Human
ugacucagcccccugagcagcuag

SEQ ID NO: 471782 - RNA, 22 nt, Human
ugagauggagucucacucuguu

SEQ ID NO: 471783 - RNA, 24 nt, Human
ugauaauacugccuaagugggcac

SEQ ID NO: 471784 - RNA, 20 nt, Human
ugccaccaagcgcuccccuc

SEQ ID NO: 471785 - RNA, 21 nt, Human
ugcccaggcuggagugaagug

SEQ ID NO: 471786 - RNA, 21 nt, Human
ugcccaggcuggagugaagug

SEQ ID NO: 471787 - RNA, 22 nt, Human
ugccccugcagcuccgguccgc

SEQ ID NO: 471788 - RNA, 19 nt, Human
ugccuaagugggcacaaag

SEQ ID NO: 471789 - RNA, 24 nt, Human
ugccuggugggaacgggcuuggca

SEQ ID NO: 471790 - RNA, 24 nt, Human
ugcugggauuacaggcgugagcca

SEQ ID NO: 471791 - RNA, 20 nt, Human
ugcuggguaggagggagaug

SEQ ID NO: 471792 - RNA, 19 nt, Human
uggaagaagagcgggguga

SEQ ID NO: 471793 - RNA, 22 nt, Human
uggaagaagagcggggugagcu

SEQ ID NO: 471794 - RNA, 24 nt, Human
uggagucucacucuguugcccagg

SEQ ID NO: 471795 - RNA, 20 nt, Human
uggcagggauggaggaaggu

SEQ ID NO: 471796 - RNA, 23 nt, Human
uggccaggcuggucuugaacucc

SEQ ID NO: 471797 - RNA, 18 nt, Human
ugggauuacaggcgugag

SEQ ID NO: 471798 - RNA, 19 nt, Human
ugggauuacaggcgugagc

SEQ ID NO: 471799 - RNA, 21 nt, Human
ugggauuacaggcgugagcca

SEQ ID NO: 471800 - RNA, 22 nt, Human
ugggauuacaggcgugagccac

SEQ ID NO: 471801 - RNA, 23 nt, Human
ugggauuacaggcgugagccacc

SEQ ID NO: 471802 - RNA, 24 nt, Human
ugggauuacaggcgugagccaccg

SEQ ID NO: 471803 - RNA, 21 nt, Human
ugggauuuuuuuuuuuuuuuu

SEQ ID NO: 471804 - RNA, 24 nt, Human
ugggguuucacuauguuggccagg

SEQ ID NO: 471805 - RNA, 21 nt, Human
ugugugucuacccucugccug

SEQ ID NO: 471806 - RNA, 21 nt, Human
uguugcccaggcuggagugaa

SEQ ID NO: 471807 - RNA, 18 nt, Human
uuaguagagaugggguuu

SEQ ID NO: 471808 - RNA, 21 nt, Human
uuaguagagaugggguuucac

SEQ ID NO: 471809 - RNA, 21 nt, Human
uuaguagagaugggguuucac

SEQ ID NO: 471810 - RNA, 24 nt, Human
uuaguagagaugggguuucacuau

SEQ ID NO: 471811 - RNA, 23 nt, Human
uucaagugauucccaugacucag

SEQ ID NO: 471812 - RNA, 18 nt, Human
uucccaugacucagcccc

SEQ ID NO: 471813 - RNA, 21 nt, Human
uugcccaggcuggagugaagu

SEQ ID NO: 471814 - RNA, 23 nt, Human
uuguauuuuuaguagagaugggg

SEQ ID NO: 471815 - RNA, 23 nt, Human
uuucacuauguuggccaggcugu

SEQ ID NO: 471816 - RNA, 24 nt, Human
uuuuuaguagagaugggguuucac

SEQ ID NO: 471817 - RNA, 20 nt, Human
uuuuuguauuuuuaguagag

SEQ ID NO: 471818 - RNA, 26 nt, Human
uuuuuuuuuuuugagauggagucuca

SEQ ID NO: 471819 - RNA, 22 nt, Human
uuuuuuuuuuuuuugagaugga

SEQ ID NO: 471820 - RNA, 20 nt, Human
aacaaagaucacagacaaga

SEQ ID NO: 471821 - RNA, 18 nt, Human
aagaaacccagcaaaguc

SEQ ID NO: 471822 - RNA, 20 nt, Human
aagaacaaagaucacagaca

SEQ ID NO: 471823 - RNA, 18 nt, Human
aaguccucucugagccgc

SEQ ID NO: 471824 - RNA, 18 nt, Human
agaaagacaagcccaggg

SEQ ID NO: 471825 - RNA, 18 nt, Human
agaaagacaagcccaggu

SEQ ID NO: 471826 - RNA, 19 nt, Human
agacaagacguuacuaaac

SEQ ID NO: 471827 - RNA, 24 nt, Human
agacaagcccagguggggcccggg

SEQ ID NO: 471828 - RNA, 22 nt, Human
aggugcauguggacacuugaac

SEQ ID NO: 471829 - RNA, 18 nt, Human
auggagagcccacgcccc

SEQ ID NO: 471830 - RNA, 22 nt, Human
caagaacaaagaucacagacaa

SEQ ID NO: 471831 - RNA, 19 nt, Human
caaggagcuucccaaaucc

SEQ ID NO: 471832 - RNA, 19 nt, Human
cacauaacccuugagaaca

SEQ ID NO: 471833 - RNA, 20 nt, Human
caccccugggccaugcuccc

SEQ ID NO: 471834 - RNA, 19 nt, Human
caggccuggugccugagug

SEQ ID NO: 471835 - RNA, 19 nt, Human
cauccccaccacaacgaag

SEQ ID NO: 471836 - RNA, 21 nt, Human
cauccccaccacaacgaagaa

SEQ ID NO: 471837 - RNA, 19 nt, Human
ccaauuccagcauggucag

SEQ ID NO: 471838 - RNA, 18 nt, Human
ccaccugagcccuguucc

SEQ ID NO: 471839 - RNA, 18 nt, Human
ccagcauggucagcacgg

SEQ ID NO: 471840 - RNA, 18 nt, Human
cccaccacaacgaagaaa

SEQ ID NO: 471841 - RNA, 22 nt, Human
ccccugggccaugcucccucug

SEQ ID NO: 471842 - RNA, 21 nt, Human
cccucuaaacagaaagacaag

SEQ ID NO: 471843 - RNA, 18 nt, Human
ccgcagcagcaagcucuc

SEQ ID NO: 471844 - RNA, 19 nt, Human
ccgcagcagcaagcucucu

SEQ ID NO: 471845 - RNA, 19 nt, Human
ccuagagaaugacuguacu

SEQ ID NO: 471846 - RNA, 18 nt, Human
ccucaacaccccugggcc

SEQ ID NO: 471847 - RNA, 31 nt, Human
ccucaacaccccugggccaugcucccucugg

SEQ ID NO: 471848 - RNA, 22 nt, Human
cuccuggaccaggccuggugcc

SEQ ID NO: 471849 - RNA, 19 nt, Human
cucgaggaaugaagcagcc

SEQ ID NO: 471850 - RNA, 19 nt, Human
cuguacuuagaaaguuuug

SEQ ID NO: 471851 - RNA, 23 nt, Human
cuugaaccacgacuguguccaca

SEQ ID NO: 471852 - RNA, 19 nt, Human
gauauguuacacuucccuc

SEQ ID NO: 471853 - RNA, 24 nt, Human
gcaaaguccucucugagccgcuag

SEQ ID NO: 471854 - RNA, 24 nt, Human
guaaagaagaacuuugaggccgca

SEQ ID NO: 471855 - RNA, 19 nt, Human
gugccuuacugcuccaccc

SEQ ID NO: 471856 - RNA, 21 nt, Human
guggacacuugaaccacgacu

SEQ ID NO: 471857 - RNA, 22 nt, Human
guuacuaaacggaccccugcag

SEQ ID NO: 471858 - RNA, 23 nt, Human
uaagagaaaauggcuuuacauga

SEQ ID NO: 471859 - RNA, 21 nt, Human
uaggucccgaauugcagaagg

SEQ ID NO: 471860 - RNA, 19 nt, Human
uauggagagcccacgcccc

SEQ ID NO: 471861 - RNA, 23 nt, Human
ucccucuaaacagaaagacaagc

SEQ ID NO: 471862 - RNA, 19 nt, Human
ucccucugcucuuccaucc

SEQ ID NO: 471863 - RNA, 20 nt, Human
ucucugagccgcuagagucg

SEQ ID NO: 471864 - RNA, 24 nt, Human
ucucugagccgcuagagucgacuu

SEQ ID NO: 471865 - RNA, 24 nt, Human
ucucuggguagugccuuacugcuc

SEQ ID NO: 471866 - RNA, 24 nt, Human
ugcaaggagcuucccaaauccuag

SEQ ID NO: 471867 - RNA, 20 nt, Human
ugcauguggacacuugaacc

SEQ ID NO: 471868 - RNA, 19 nt, Human
ugccugagugugaagacuc

SEQ ID NO: 471869 - RNA, 25 nt, Human
ugcuccacccaccugagcccuguuc

SEQ ID NO: 471870 - RNA, 27 nt, Human
ugcuccacccaccugagcccuguucca

SEQ ID NO: 471871 - RNA, 18 nt, Human
ugcucccucugcucuucc

SEQ ID NO: 471872 - RNA, 22 nt, Human
uggcagauauguuacacuuccc

SEQ ID NO: 471873 - RNA, 22 nt, Human
uguguagacauacuugugaaaa

SEQ ID NO: 471874 - RNA, 26 nt, Human
uguuuuguuuaagagaaaauggcuuu

SEQ ID NO: 471875 - RNA, 19 nt, Human
uucacagaaagaaacccag

SEQ ID NO: 471876 - RNA, 22 nt, Human
uucacagaaagaaacccagcaa

SEQ ID NO: 471877 - RNA, 25 nt, Human
uuccaagugcaaggagcuucccaaa

SEQ ID NO: 471878 - RNA, 24 nt, Human
aaacaucugcaagcugcagaauuc

SEQ ID NO: 471879 - RNA, 20 nt, Human
aagaaagcaaguaaaaaaaa

SEQ ID NO: 471880 - RNA, 21 nt, Human
aaguaaaaaaaauauuacaga

SEQ ID NO: 471881 - RNA, 19 nt, Human
acuuaauaauaagaaauua

SEQ ID NO: 471882 - RNA, 20 nt, Human
agaaagcaaguaaaaaaaau

SEQ ID NO: 471883 - RNA, 19 nt, Human
agaacaucuugauuuacaa

SEQ ID NO: 471884 - RNA, 22 nt, Human
agaacaucuugauuuacaaggg

SEQ ID NO: 471885 - RNA, 19 nt, Human
aggaaacagccaaaagucc

SEQ ID NO: 471886 - RNA, 21 nt, Human
aggacccaaaaaaaucuggcc

SEQ ID NO: 471887 - RNA, 23 nt, Human
aguaagaaagcaaguaaaaaaaa

SEQ ID NO: 471888 - RNA, 22 nt, Human
auaccacauuguuccauuugcu

SEQ ID NO: 471889 - RNA, 25 nt, Human
caaguaaaaaaaauauuacagauga

SEQ ID NO: 471890 - RNA, 18 nt, Human
cacauuguuccauuugcu

SEQ ID NO: 471891 - RNA, 22 nt, Human
ccacauuguuccauuugcuaca

SEQ ID NO: 471892 - RNA, 20 nt, Human
ccgcgccaggccgcccgcac

SEQ ID NO: 471893 - RNA, 23 nt, Human
ccucuaggcauccaggcugaucc

SEQ ID NO: 471894 - RNA, 19 nt, Human
gcgccgcgccaggccgccc

SEQ ID NO: 471895 - RNA, 23 nt, Human
ggaaaaacuugucagggcccagg

SEQ ID NO: 471896 - RNA, 24 nt, Human
ggaaaaacuugucagggcccaggg

SEQ ID NO: 471897 - RNA, 21 nt, Human
ggaaacagccaaaaguccggc

SEQ ID NO: 471898 - RNA, 25 nt, Human
ggcaaugaagacuauuuaaaagaaa

SEQ ID NO: 471899 - RNA, 20 nt, Human
uaaaagaaaugcucagcucu

SEQ ID NO: 471900 - RNA, 18 nt, Human
uaagaaagcaaguaaaaa

SEQ ID NO: 471901 - RNA, 21 nt, Human
uaagaaagcaaguaaaaaaaa

SEQ ID NO: 471902 - RNA, 22 nt, Human
uaaucugcagaacaucuugauu

SEQ ID NO: 471903 - RNA, 25 nt, Human
uaccacauuguuccauuugcuacaa

SEQ ID NO: 471904 - RNA, 19 nt, Human
uagguucacuuaacaucuu

SEQ ID NO: 471905 - RNA, 20 nt, Human
uaugcuguccaaccuacugg

SEQ ID NO: 471906 - RNA, 20 nt, Human
ucuaguccucuaggcaucca

SEQ ID NO: 471907 - RNA, 18 nt, Human
ugaaaacuugcucugcag

SEQ ID NO: 471908 - RNA, 24 nt, Human
ugaucuaguccucuaggcauccag

SEQ ID NO: 471909 - RNA, 18 nt, Human
uuccuuaguccucagcua

SEQ ID NO: 471910 - RNA, 20 nt, Human
uuuaaaauaaauuacuuaau

SEQ ID NO: 471911 - RNA, 22 nt, Human
agcagcagcagccacugcaacc

SEQ ID NO: 471912 - RNA, 24 nt, Human
auaguuuagccucaaaaaaauaaa

SEQ ID NO: 471913 - RNA, 22 nt, Human
cacugcaaccaguucauccugg

SEQ ID NO: 471914 - RNA, 25 nt, Human
cagcagcagcagccacugcaaccag

SEQ ID NO: 471915 - RNA, 22 nt, Human
cagcagcagccacugcaaccag

SEQ ID NO: 471916 - RNA, 20 nt, Human
cccccgcagcagcagcagcc

SEQ ID NO: 471917 - RNA, 26 nt, Human
ccucucagcgcccccgcagcagcagc

SEQ ID NO: 471918 - RNA, 18 nt, Human
ccugggagcugcugcggg

SEQ ID NO: 471919 - RNA, 25 nt, Human
cgcagcagcagcagccacugcaacc

SEQ ID NO: 471920 - RNA, 18 nt, Human
ucauccugggagcugcug

SEQ ID NO: 471921 - RNA, 20 nt, Human
aaacugaauucuauggagcu

SEQ ID NO: 471922 - RNA, 19 nt, Human
aaagaagaagaagaagaaa

SEQ ID NO: 471923 - RNA, 22 nt, Human
aagaagaagaagaaaaaaacac

SEQ ID NO: 471924 - RNA, 18 nt, Human
aagaagaagaagaagaaa

SEQ ID NO: 471925 - RNA, 21 nt, Human
aagaagaagaagaagaaaaaa

SEQ ID NO: 471926 - RNA, 22 nt, Human
aagaagaagaagaagaaaaaaa

SEQ ID NO: 471927 - RNA, 19 nt, Human
acaaaagaagaagaagaag

SEQ ID NO: 471928 - RNA, 20 nt, Human
ccacaaaagaagaagaagaa

SEQ ID NO: 471929 - RNA, 22 nt, Human
cucagaaacugaauucuaugga

SEQ ID NO: 471930 - RNA, 19 nt, Human
cugacgucucacuuugucu

SEQ ID NO: 471931 - RNA, 24 nt, Human
cuguaaguagagacugucacucau

SEQ ID NO: 471932 - RNA, 19 nt, Human
gaagaagaagaagaaaaaa

SEQ ID NO: 471933 - RNA, 21 nt, Human
gcagcuaguaucuccagcuuc

SEQ ID NO: 471934 - RNA, 18 nt, Human
gcuccccugagcucugca

SEQ ID NO: 471935 - RNA, 21 nt, Human
ggugagcagaggaggaaggga

SEQ ID NO: 471936 - RNA, 20 nt, Human
gugagcagaggaggaaggga

SEQ ID NO: 471937 - RNA, 24 nt, Human
ucggugauguggagcagcuccccu

SEQ ID NO: 471938 - RNA, 20 nt, Human
ucuccagcuucagaggcaga

SEQ ID NO: 471939 - RNA, 21 nt, Human
ucugcagcuaguaucuccagc

SEQ ID NO: 471940 - RNA, 21 nt, Human
ugaaaccacaaaagaagaaga

SEQ ID NO: 471941 - RNA, 25 nt, Human
ugaaaccacaaaagaagaagaagaa

SEQ ID NO: 471942 - RNA, 20 nt, Human
ugagcagaggaggaagggag

SEQ ID NO: 471943 - RNA, 22 nt, Human
ugagcagaggaggaagggaggu

SEQ ID NO: 471944 - RNA, 25 nt, Human
acacaaucccaccauccuucccacc

SEQ ID NO: 471945 - RNA, 24 nt, Human
acccgaacccugccuccggcacug

SEQ ID NO: 471946 - RNA, 18 nt, Human
accucaucuucucucucc

SEQ ID NO: 471947 - RNA, 23 nt, Human
acgcacacuugaugcucugcgcc

SEQ ID NO: 471948 - RNA, 24 nt, Human
acgcacccgaacccugccuccccc

SEQ ID NO: 471949 - RNA, 27 nt, Human
agaaagguacacaaucccaccauccuu

SEQ ID NO: 471950 - RNA, 23 nt, Human
augaguuaaggaguucacaucca

SEQ ID NO: 471951 - RNA, 19 nt, Human
caccauccuucccaccucu

SEQ ID NO: 471952 - RNA, 23 nt, Human
caccuuacuugaugaguuaagga

SEQ ID NO: 471953 - RNA, 20 nt, Human
cagccggacuccucugcacc

SEQ ID NO: 471954 - RNA, 22 nt, Human
ccaaaaaggauguaaggaggca

SEQ ID NO: 471955 - RNA, 23 nt, Human
ccaaccucaucuucucucuccuc

SEQ ID NO: 471956 - RNA, 19 nt, Human
cccacgcaacgacuacgca

SEQ ID NO: 471957 - RNA, 19 nt, Human
ccccgcgcagacccgcggc

SEQ ID NO: 471958 - RNA, 24 nt, Human
ccugccuccggcacccuuggccac

SEQ ID NO: 471959 - RNA, 22 nt, Human
cgcccccgccccgcgcagaccc

SEQ ID NO: 471960 - RNA, 18 nt, Human
cgcggcgggcgcccgcgc

SEQ ID NO: 471961 - RNA, 19 nt, Human
cuccgcccagccggacucc

SEQ ID NO: 471962 - RNA, 21 nt, Human
cuccucugcaccacccucgcc

SEQ ID NO: 471963 - RNA, 22 nt, Human
cucuggcugggccuguggucuc

SEQ ID NO: 471964 - RNA, 23 nt, Human
cugcaccacccucgccaccgacg

SEQ ID NO: 471965 - RNA, 21 nt, Human
cuugcugcgcccccgccccgc

SEQ ID NO: 471966 - RNA, 19 nt, Human
gccuguggucucaugugga

SEQ ID NO: 471967 - RNA, 23 nt, Human
gugggaggguugcagcaggaaaa

SEQ ID NO: 471968 - RNA, 21 nt, Human
uagaaagguacacaaucccac

SEQ ID NO: 471969 - RNA, 19 nt, Human
ucccaccauccuucccacc

SEQ ID NO: 471970 - RNA, 26 nt, Human
ucccaccauccuucccaccucuggug

SEQ ID NO: 471971 - RNA, 20 nt, Human
ucccgacaggcucuggcugg

SEQ ID NO: 471972 - RNA, 27 nt, Human
ugcucugcgccuuuugggcagcgccca

SEQ ID NO: 471973 - RNA, 19 nt, Human
uggugggaggguugcagca

SEQ ID NO: 471974 - RNA, 19 nt, Human
uuuuuuuuuuuuuuguugg

SEQ ID NO: 471975 - RNA, 20 nt, Human
uuuuuuuuuuuuuuuuuguu

SEQ ID NO: 471976 - RNA, 24 nt, Human
uuuuuuuuuuuuuuuuuuuguugg

SEQ ID NO: 471977 - RNA, 27 nt, Human
uuuuuuuuuuuuuuuuuuuuuuugggg

SEQ ID NO: 471978 - RNA, 22 nt, Human
aaaaagcagaaaagauccaaaa

SEQ ID NO: 471979 - RNA, 20 nt, Human
aaaaauucaaacuuggacgc

SEQ ID NO: 471980 - RNA, 23 nt, Human
aaaauagcaaacugaagucaaaa

SEQ ID NO: 471981 - RNA, 21 nt, Human
aaaauaucagcaaguaaauga

SEQ ID NO: 471982 - RNA, 23 nt, Human
aaagcucuccacacacaaggccc

SEQ ID NO: 471983 - RNA, 26 nt, Human
aaagcucuccacacacaaggcccuuc

SEQ ID NO: 471984 - RNA, 19 nt, Human
aacagccuucucuuuuucu

SEQ ID NO: 471985 - RNA, 22 nt, Human
aaccacagagacacugaagccc

SEQ ID NO: 471986 - RNA, 20 nt, Human
aacuucacacucagcaaucu

SEQ ID NO: 471987 - RNA, 21 nt, Human
aagaaauucagugauacucag

SEQ ID NO: 471988 - RNA, 22 nt, Human
aagacagaucuuacagauaaua

SEQ ID NO: 471989 - RNA, 20 nt, Human
aagcccagcaacucccaaga

SEQ ID NO: 471990 - RNA, 23 nt, Human
aaucacacacugacaacacagaa

SEQ ID NO: 471991 - RNA, 21 nt, Human
acagcacacaggcagcacgaa

SEQ ID NO: 471992 - RNA, 27 nt, Human
acaggaaaaaaucuguuuccuuuucca

SEQ ID NO: 471993 - RNA, 20 nt, Human
agacugaagcuugacuauga

SEQ ID NO: 471994 - RNA, 20 nt, Human
agcaguucccuuccccacaa

SEQ ID NO: 471995 - RNA, 21 nt, Human
agcucaagcuaagcuggugaa

SEQ ID NO: 471996 - RNA, 19 nt, Human
aggaaaagucuagcauaug

SEQ ID NO: 471997 - RNA, 21 nt, Human
aggaaacuuuacuuacaaucc

SEQ ID NO: 471998 - RNA, 22 nt, Human
aguuaaaaggcaacaacuauga

SEQ ID NO: 471999 - RNA, 19 nt, Human
auaucuauaaacuugaaac

SEQ ID NO: 472000 - RNA, 18 nt, Human
auuaaaaauaaacucugg

SEQ ID NO: 472001 - RNA, 23 nt, Human
auucugguauaaggugcgcagga

SEQ ID NO: 472002 - RNA, 26 nt, Human
auuuucccaaguuccagacugguaaa

SEQ ID NO: 472003 - RNA, 21 nt, Human
caaaaagcacaggcugcccau

SEQ ID NO: 472004 - RNA, 21 nt, Human
caaaagauguccuaaaaaaaa

SEQ ID NO: 472005 - RNA, 22 nt, Human
caaaagcaaauaguugucaaga

SEQ ID NO: 472006 - RNA, 21 nt, Human
caaaauaaccagagcucaagc

SEQ ID NO: 472007 - RNA, 22 nt, Human
caacacagaaauacgaaaugcu

SEQ ID NO: 472008 - RNA, 20 nt, Human
cacacacugacaacacagaa

SEQ ID NO: 472009 - RNA, 21 nt, Human
cagagacacugaagcccagca

SEQ ID NO: 472010 - RNA, 20 nt, Human
cagcuccucgggcgcguccc

SEQ ID NO: 472011 - RNA, 19 nt, Human
caguacuaaugugaucaca

SEQ ID NO: 472012 - RNA, 25 nt, Human
ccaccagauuuuuuuuaaaccaaau

SEQ ID NO: 472013 - RNA, 24 nt, Human
cccaaguuccagacugguaaaaaa

SEQ ID NO: 472014 - RNA, 18 nt, Human
ccgcggccgagcagcgcc

SEQ ID NO: 472015 - RNA, 23 nt, Human
cgaccugcucugaggauggaggg

SEQ ID NO: 472016 - RNA, 21 nt, Human
cgccugggcugccaccugcag

SEQ ID NO: 472017 - RNA, 20 nt, Human
cuaaaaaaaaaaaaaaaaaa

SEQ ID NO: 472018 - RNA, 18 nt, Human
cucggaauuccagaaaga

SEQ ID NO: 472019 - RNA, 21 nt, Human
cucuccacacacaaggcccag

SEQ ID NO: 472020 - RNA, 18 nt, Human
cugaagucaaaaagcaca

SEQ ID NO: 472021 - RNA, 21 nt, Human
cugcuaugugacuaccaaaaa

SEQ ID NO: 472022 - RNA, 25 nt, Human
cuucacacucagcaaucugcucuuc

SEQ ID NO: 472023 - RNA, 22 nt, Human
cuuccuauuucccccuuucaaa

SEQ ID NO: 472024 - RNA, 19 nt, Human
cuuucacacuuuauaagca

SEQ ID NO: 472025 - RNA, 20 nt, Human
gaaaagauccaaaauaacca

SEQ ID NO: 472026 - RNA, 23 nt, Human
gaacuagaagaaaaccauggugg

SEQ ID NO: 472027 - RNA, 23 nt, Human
gaagaaaaccaugguguggauga

SEQ ID NO: 472028 - RNA, 18 nt, Human
gauccaaaauaaccagag

SEQ ID NO: 472029 - RNA, 20 nt, Human
gcucaagcuaagcuggugaa

SEQ ID NO: 472030 - RNA, 26 nt, Human
gcucauuaaaaucuauguuucaaauu

SEQ ID NO: 472031 - RNA, 18 nt, Human
gcucugaggauggagggu

SEQ ID NO: 472032 - RNA, 18 nt, Human
gcuugugcuuucacacuu

SEQ ID NO: 472033 - RNA, 20 nt, Human
gguuagggcaaauguaacuu

SEQ ID NO: 472034 - RNA, 21 nt, Human
guacuaaugugaucacagaaa

SEQ ID NO: 472035 - RNA, 19 nt, Human
guuagaauaaugcccacaa

SEQ ID NO: 472036 - RNA, 21 nt, Human
uaaaaaaagcagaaaagaucc

SEQ ID NO: 472037 - RNA, 21 nt, Human
uaaaauacaaacuacucaaaa

SEQ ID NO: 472038 - RNA, 21 nt, Human
uaaaauauccugacuaccuuc

SEQ ID NO: 472039 - RNA, 20 nt, Human
uaaacaaaucauacaacuga

SEQ ID NO: 472040 - RNA, 25 nt, Human
uaaacaaaucauacaacugaauaga

SEQ ID NO: 472041 - RNA, 26 nt, Human
uaaacaaaucauacaacugaauagaa

SEQ ID NO: 472042 - RNA, 25 nt, Human
uaaaugaaaaucacacauuucucuu

SEQ ID NO: 472043 - RNA, 22 nt, Human
uaaccaauuucacagauagcac

SEQ ID NO: 472044 - RNA, 24 nt, Human
uaauauaauguccaaaaauuucca

SEQ ID NO: 472045 - RNA, 20 nt, Human
uacucagugccaguaauuaa

SEQ ID NO: 472046 - RNA, 18 nt, Human
uacuccaggcucggccgg

SEQ ID NO: 472047 - RNA, 21 nt, Human
uauauuaccaccagauuuuuu

SEQ ID NO: 472048 - RNA, 18 nt, Human
uaucacaagucaguguga

SEQ ID NO: 472049 - RNA, 25 nt, Human
ucacauauuaaaauacaaacuacuc

SEQ ID NO: 472050 - RNA, 26 nt, Human
ucagcaaucugcucuuccuauuuccc

SEQ ID NO: 472051 - RNA, 23 nt, Human
uccaaaauaaccagagcucaagc

SEQ ID NO: 472052 - RNA, 22 nt, Human
uccaaacuacaaaauaucagca

SEQ ID NO: 472053 - RNA, 21 nt, Human
uccacacacaaggcccagaga

SEQ ID NO: 472054 - RNA, 22 nt, Human
ucccuggauuuucccaaguucc

SEQ ID NO: 472055 - RNA, 20 nt, Human
uccuaaaaaaaaaaaaaaaa

SEQ ID NO: 472056 - RNA, 19 nt, Human
ucuagcauaaaggcaaaug

SEQ ID NO: 472057 - RNA, 19 nt, Human
ucuaugaagauucucucca

SEQ ID NO: 472058 - RNA, 21 nt, Human
ucucuaugaagauucucucca

SEQ ID NO: 472059 - RNA, 18 nt, Human
ugaaaccacagagacacu

SEQ ID NO: 472060 - RNA, 21 nt, Human
ugaaaccacagagacacugaa

SEQ ID NO: 472061 - RNA, 21 nt, Human
ugaaagacugaagcuugacua

SEQ ID NO: 472062 - RNA, 21 nt, Human
ugaagcccagcaacucccaag

SEQ ID NO: 472063 - RNA, 20 nt, Human
ugacaacacagaaauacgaa

SEQ ID NO: 472064 - RNA, 20 nt, Human
ugaguuaaaaggcaacaacu

SEQ ID NO: 472065 - RNA, 23 nt, Human
ugaucacagaaaaauagcaaacu

SEQ ID NO: 472066 - RNA, 18 nt, Human
ugcaauggagcuacuaaa

SEQ ID NO: 472067 - RNA, 20 nt, Human
ugcacaagucuauggcuuua

SEQ ID NO: 472068 - RNA, 24 nt, Human
ugcucuuccuauuucccccuuuca

SEQ ID NO: 472069 - RNA, 21 nt, Human
ugcuuucacacuuuauaagca

SEQ ID NO: 472070 - RNA, 20 nt, Human
uggaauaagcaauguaacuc

SEQ ID NO: 472071 - RNA, 21 nt, Human
uggugaaaccacagagacacu

SEQ ID NO: 472072 - RNA, 23 nt, Human
uguccaaaaauuuccaaguaagu

SEQ ID NO: 472073 - RNA, 25 nt, Human
uuaaaaaaagcagaaaagauccaaa

SEQ ID NO: 472074 - RNA, 19 nt, Human
uuaggcaauacuccaggcu

SEQ ID NO: 472075 - RNA, 18 nt, Human
uucaaacuuggacgcagg

SEQ ID NO: 472076 - RNA, 18 nt, Human
uucacagauagcacucau

SEQ ID NO: 472077 - RNA, 22 nt, Human
uuccccacaacgucugccucca

SEQ ID NO: 472078 - RNA, 20 nt, Human
uucucaugcaauggagcuac

SEQ ID NO: 472079 - RNA, 21 nt, Human
uuuauaagcuugugcuuucac

SEQ ID NO: 472080 - RNA, 18 nt, Human
uuucaagacaaaagucac

SEQ ID NO: 472081 - RNA, 24 nt, Human
uuucacagauagcacucauuuaau

SEQ ID NO: 472082 - RNA, 19 nt, Human
uuuccaaguaagugucuac

SEQ ID NO: 472083 - RNA, 18 nt, Human
uuugcacaagucuauggc

SEQ ID NO: 472084 - RNA, 19 nt, Human
aaaugcacuuuccuuuuca

SEQ ID NO: 472085 - RNA, 18 nt, Human
aacauuuuuuggauuuuc

SEQ ID NO: 472086 - RNA, 20 nt, Human
accuccugaauucuuuuuca

SEQ ID NO: 472087 - RNA, 18 nt, Human
agaagcucuguuuuccag

SEQ ID NO: 472088 - RNA, 18 nt, Human
aggucucugcaggcuuua

SEQ ID NO: 472089 - RNA, 22 nt, Human
caacuagaagaccaaaguacag

SEQ ID NO: 472090 - RNA, 24 nt, Human
caacuuacaacuagaagaccaaag

SEQ ID NO: 472091 - RNA, 22 nt, Human
caaugcccaaaaaauugguuca

SEQ ID NO: 472092 - RNA, 18 nt, Human
cagaggucucugcaggcu

SEQ ID NO: 472093 - RNA, 19 nt, Human
cagcaguggauaccagugc

SEQ ID NO: 472094 - RNA, 20 nt, Human
ccaccgagucuacccggcuc

SEQ ID NO: 472095 - RNA, 19 nt, Human
ccaggcuuuuagaauucuc

SEQ ID NO: 472096 - RNA, 20 nt, Human
ccaguagagguaguggaggg

SEQ ID NO: 472097 - RNA, 23 nt, Human
cccaccgagucuacccggcucca

SEQ ID NO: 472098 - RNA, 23 nt, Human
ccuucaaauaugaugcuuaguuu

SEQ ID NO: 472099 - RNA, 18 nt, Human
ccuuguuuugucauauua

SEQ ID NO: 472100 - RNA, 21 nt, Human
ccuuuguaaguuaccuggugc

SEQ ID NO: 472101 - RNA, 20 nt, Human
cgagucuacccggcuccaag

SEQ ID NO: 472102 - RNA, 21 nt, Human
cuacuaguucaauucuauugc

SEQ ID NO: 472103 - RNA, 19 nt, Human
cugcaggcuuuaguuuuca

SEQ ID NO: 472104 - RNA, 18 nt, Human
gaaagucuagggcugaag

SEQ ID NO: 472105 - RNA, 21 nt, Human
gcuuggugugaauuaucuugg

SEQ ID NO: 472106 - RNA, 22 nt, Human
ggagggugcagugacuucauca

SEQ ID NO: 472107 - RNA, 20 nt, Human
ggauguggcuuccugugagc

SEQ ID NO: 472108 - RNA, 21 nt, Human
ggccccaauucugucuuagcu

SEQ ID NO: 472109 - RNA, 20 nt, Human
gggucucgccacccaccgag

SEQ ID NO: 472110 - RNA, 22 nt, Human
gguggcuuggugugaauuaucu

SEQ ID NO: 472111 - RNA, 25 nt, Human
gguugguuuucugguuccuucucau

SEQ ID NO: 472112 - RNA, 24 nt, Human
guuuuuacuuuaagccaucuauuu

SEQ ID NO: 472113 - RNA, 21 nt, Human
uaaucugauagauuuuuccuu

SEQ ID NO: 472114 - RNA, 20 nt, Human
uagaugaaauaaaaaagucc

SEQ ID NO: 472115 - RNA, 21 nt, Human
uagaugaaauaaaaaaguccc

SEQ ID NO: 472116 - RNA, 26 nt, Human
ucaauuauucccccaaauauguuuuc

SEQ ID NO: 472117 - RNA, 19 nt, Human
ucccuugauguauuacucu

SEQ ID NO: 472118 - RNA, 18 nt, Human
ucccuugggguguucccu

SEQ ID NO: 472119 - RNA, 19 nt, Human
uccuucagaggucucugca

SEQ ID NO: 472120 - RNA, 24 nt, Human
ucuauugcugagacuuuccagagc

SEQ ID NO: 472121 - RNA, 19 nt, Human
ugacaguguaccuagguga

SEQ ID NO: 472122 - RNA, 24 nt, Human
ugacuguaucuuuccuucaaauau

SEQ ID NO: 472123 - RNA, 25 nt, Human
ugagaaaucagauuuagaugaaaua

SEQ ID NO: 472124 - RNA, 21 nt, Human
ugcauuucuaaaagugugucc

SEQ ID NO: 472125 - RNA, 23 nt, Human
uggcuuggugugaauuaucuugg

SEQ ID NO: 472126 - RNA, 25 nt, Human
ugggaaagucuagggcugaagacug

SEQ ID NO: 472127 - RNA, 21 nt, Human
ugguacuggggauugucucca

SEQ ID NO: 472128 - RNA, 22 nt, Human
uuaaaauucuuacaaugcccaa

SEQ ID NO: 472129 - RNA, 23 nt, Human
uucaaaauauuaauagugucaaa

SEQ ID NO: 472130 - RNA, 24 nt, Human
uuccaguagagguaguggagggug

SEQ ID NO: 472131 - RNA, 24 nt, Human
uuccaguagagguaguggaggguu

SEQ ID NO: 472132 - RNA, 21 nt, Human
uuccugggugaucuuugugcu

SEQ ID NO: 472133 - RNA, 19 nt, Human
uucucuggccucucccuga

SEQ ID NO: 472134 - RNA, 19 nt, Human
uuggugaugaauuuccugg

SEQ ID NO: 472135 - RNA, 23 nt, Human
uuguuuugucauauuaccaaggu

SEQ ID NO: 472136 - RNA, 22 nt, Human
uuuaagcucugaauuuuuuucu

SEQ ID NO: 472137 - RNA, 24 nt, Human
uuuccucaauuauucccccaaaua

SEQ ID NO: 472138 - RNA, 22 nt, Human
uuucugguuccuucucauuugg

SEQ ID NO: 472139 - RNA, 21 nt, Human
uuugagggggcugaagauagg

SEQ ID NO: 472140 - RNA, 23 nt, Human
uuugccuuucucuggccucuccc

SEQ ID NO: 472141 - RNA, 24 nt, Human
uuuuccaggcuuuuagaauucucu

SEQ ID NO: 472142 - RNA, 21 nt, Human
uuuuuaacuugugugugugug

SEQ ID NO: 472143 - RNA, 20 nt, Human
aagaaaauagcuauucauuu

SEQ ID NO: 472144 - RNA, 18 nt, Human
acacguuccggagguggc

SEQ ID NO: 472145 - RNA, 22 nt, Human
acagaguaaggcccaucucauu

SEQ ID NO: 472146 - RNA, 24 nt, Human
agaaggagggcgcagcccgcgcga

SEQ ID NO: 472147 - RNA, 25 nt, Human
agaccagggaggcccuagcggggga

SEQ ID NO: 472148 - RNA, 26 nt, Human
agcauucaucugguaacuuaagcagc

SEQ ID NO: 472149 - RNA, 18 nt, Human
agcccgcgcgaagguggg

SEQ ID NO: 472150 - RNA, 24 nt, Human
aggcagcgggcgcgggccccgggg

SEQ ID NO: 472151 - RNA, 21 nt, Human
aggcucucuccuccucugccc

SEQ ID NO: 472152 - RNA, 21 nt, Human
agugcgcccaagcggccgccc

SEQ ID NO: 472153 - RNA, 22 nt, Human
aguugcacuuuaaaaaaugaca

SEQ ID NO: 472154 - RNA, 21 nt, Human
aucuuuggagcuuuccuuugg

SEQ ID NO: 472155 - RNA, 22 nt, Human
cagcagggccacagacagaaga

SEQ ID NO: 472156 - RNA, 19 nt, Human
cagccccauucucgucuug

SEQ ID NO: 472157 - RNA, 18 nt, Human
cagcggcggcagcccgag

SEQ ID NO: 472158 - RNA, 19 nt, Human
cagggaagagaaggagggc

SEQ ID NO: 472159 - RNA, 23 nt, Human
cauccuagaucagcgagguccca

SEQ ID NO: 472160 - RNA, 24 nt, Human
cauucauccaccagaauccaucca

SEQ ID NO: 472161 - RNA, 19 nt, Human
cauucucgucuugcaggga

SEQ ID NO: 472162 - RNA, 22 nt, Human
ccaaugggucugcagagcagug

SEQ ID NO: 472163 - RNA, 21 nt, Human
ccacacagaccuggccccggg

SEQ ID NO: 472164 - RNA, 18 nt, Human
ccagcagggccacagaca

SEQ ID NO: 472165 - RNA, 18 nt, Human
ccaggaucacuaguuucu

SEQ ID NO: 472166 - RNA, 20 nt, Human
ccauaaaaaauaaacacuuu

SEQ ID NO: 472167 - RNA, 18 nt, Human
ccccacgccucuccccgc

SEQ ID NO: 472168 - RNA, 19 nt, Human
cccccgggagaggaagggg

SEQ ID NO: 472169 - RNA, 18 nt, Human
ccccgggugcucccccuc

SEQ ID NO: 472170 - RNA, 18 nt, Human
cccgccucugcuccuccg

SEQ ID NO: 472171 - RNA, 20 nt, Human
ccgccugcgcccccggcugc

SEQ ID NO: 472172 - RNA, 18 nt, Human
ccgcucugcuccccacgc

SEQ ID NO: 472173 - RNA, 24 nt, Human
ccggcaagugcgcccaagcggccg

SEQ ID NO: 472174 - RNA, 24 nt, Human
ccuagaucagcgaggucccaagag

SEQ ID NO: 472175 - RNA, 21 nt, Human
cgacagaguaaggcccaucuc

SEQ ID NO: 472176 - RNA, 24 nt, Human
cgcccugcgcucuccgccugcgcc

SEQ ID NO: 472177 - RNA, 21 nt, Human
cgccgggcgcggggcagcggc

SEQ ID NO: 472178 - RNA, 21 nt, Human
cgcugccaggcucucuccucc

SEQ ID NO: 472179 - RNA, 19 nt, Human
cggcccccgggagaggaag

SEQ ID NO: 472180 - RNA, 23 nt, Human
cggcugccccgagcgccgggcgc

SEQ ID NO: 472181 - RNA, 22 nt, Human
cggugcggcgcccgccucugcu

SEQ ID NO: 472182 - RNA, 21 nt, Human
cucagcgccgcucugcucccc

SEQ ID NO: 472183 - RNA, 20 nt, Human
cuccccgcccugcgcucucc

SEQ ID NO: 472184 - RNA, 21 nt, Human
cugccccgagcgccgggcgcg

SEQ ID NO: 472185 - RNA, 24 nt, Human
cugcgggguagcuguggaguguag

SEQ ID NO: 472186 - RNA, 19 nt, Human
cugcuccuccgcugccagg

SEQ ID NO: 472187 - RNA, 24 nt, Human
cuggcaggcugcagagagccgcgu

SEQ ID NO: 472188 - RNA, 24 nt, Human
cuggccccgggugcucccccucca

SEQ ID NO: 472189 - RNA, 24 nt, Human
cuggcugggcgucaggcugguggg

SEQ ID NO: 472190 - RNA, 18 nt, Human
cuuaagcagcaugaagca

SEQ ID NO: 472191 - RNA, 19 nt, Human
gagcgagcgugcggggcgg

SEQ ID NO: 472192 - RNA, 18 nt, Human
gagggcagggaagagaag

SEQ ID NO: 472193 - RNA, 19 nt, Human
gauuacuuauuucucagca

SEQ ID NO: 472194 - RNA, 27 nt, Human
gccccgagcgccgggcgcggggcagcg

SEQ ID NO: 472195 - RNA, 20 nt, Human
gcccgcgcgaagguggccac

SEQ ID NO: 472196 - RNA, 26 nt, Human
gccucuccccgcccugcgcucuccgc

SEQ ID NO: 472197 - RNA, 19 nt, Human
gcgcagcccgcgcgaaggu

SEQ ID NO: 472198 - RNA, 18 nt, Human
gcgcccccggcugccccg

SEQ ID NO: 472199 - RNA, 19 nt, Human
gcggcagcccgagcggcgg

SEQ ID NO: 472200 - RNA, 18 nt, Human
gcgggcgcgggccccggg

SEQ ID NO: 472201 - RNA, 22 nt, Human
gcgugcuggaggcagcgggcgc

SEQ ID NO: 472202 - RNA, 18 nt, Human
gcugggcgucaggcuggu

SEQ ID NO: 472203 - RNA, 18 nt, Human
ggacuccagcagggccac

SEQ ID NO: 472204 - RNA, 21 nt, Human
ggagaggaaggggugcgggga

SEQ ID NO: 472205 - RNA, 23 nt, Human
ggagucuugggaggggcgguggc

SEQ ID NO: 472206 - RNA, 24 nt, Human
ggcacuggcaggcugcagagagcc

SEQ ID NO: 472207 - RNA, 21 nt, Human
ggccaccaacuuuggcccaga

SEQ ID NO: 472208 - RNA, 20 nt, Human
ggcgagccgcuccucuucgc

SEQ ID NO: 472209 - RNA, 22 nt, Human
ggcggggagucgggagcugcgg

SEQ ID NO: 472210 - RNA, 18 nt, Human
gggaagccauuucuccuc

SEQ ID NO: 472211 - RNA, 20 nt, Human
gggcgcgggccccgggggag

SEQ ID NO: 472212 - RNA, 20 nt, Human
ggggcagcggcggcagcccg

SEQ ID NO: 472213 - RNA, 20 nt, Human
ggucugcagagcagugcagc

SEQ ID NO: 472214 - RNA, 23 nt, Human
gguggugugaagggaaagaaaga

SEQ ID NO: 472215 - RNA, 24 nt, Human
gucaggcuggugggcugggaaugu

SEQ ID NO: 472216 - RNA, 20 nt, Human
guggaguguagacacguucc

SEQ ID NO: 472217 - RNA, 23 nt, Human
uaugccugcuuccuccacgucca

SEQ ID NO: 472218 - RNA, 21 nt, Human
ucagcgaggucccaagagugc

SEQ ID NO: 472219 - RNA, 24 nt, Human
uccauggguaggaaaucccagggc

SEQ ID NO: 472220 - RNA, 21 nt, Human
uccccgcccugcgcucuccgc

SEQ ID NO: 472221 - RNA, 19 nt, Human
ucccgggcuuugcuggcuc

SEQ ID NO: 472222 - RNA, 19 nt, Human
ucgccuggccggcaggcug

SEQ ID NO: 472223 - RNA, 20 nt, Human
ucgccuggccggcaggcugg

SEQ ID NO: 472224 - RNA, 18 nt, Human
ucugggcacuggcaggcu

SEQ ID NO: 472225 - RNA, 24 nt, Human
ucuugggaggggcgguggccugcc

SEQ ID NO: 472226 - RNA, 18 nt, Human
ugcgguggcacucugggc

SEQ ID NO: 472227 - RNA, 19 nt, Human
ugcgguggcacucugggca

SEQ ID NO: 472228 - RNA, 19 nt, Human
ugcgguggcacucugggca

SEQ ID NO: 472229 - RNA, 25 nt, Human
ugcuuccuccacguccacacagacc

SEQ ID NO: 472230 - RNA, 22 nt, Human
ugcuucucagggucaggccaau

SEQ ID NO: 472231 - RNA, 19 nt, Human
uggccaccaacuuuggccc

SEQ ID NO: 472232 - RNA, 19 nt, Human
ugggguggugugaagggaa

SEQ ID NO: 472233 - RNA, 18 nt, Human
uggugcucuacacagugc

SEQ ID NO: 472234 - RNA, 24 nt, Human
uggugugaagggaaagaaagaggg

SEQ ID NO: 472235 - RNA, 25 nt, Human
uggugugaagggaaagaaagagggg

SEQ ID NO: 472236 - RNA, 24 nt, Human
ugugaagggaaagaaagaggggca

SEQ ID NO: 472237 - RNA, 18 nt, Human
ugugucuuuaggcugagg

SEQ ID NO: 472238 - RNA, 20 nt, Human
uuagcagugcccgucugucu

SEQ ID NO: 472239 - RNA, 22 nt, Human
uuccaggaucacuaguuucugc

SEQ ID NO: 472240 - RNA, 19 nt, Human
uuccuccacguccacacag

SEQ ID NO: 472241 - RNA, 18 nt, Human
uugaggagucuugggagg

SEQ ID NO: 472242 - RNA, 21 nt, Human
uugcacuuuaaaaaaugacaa

SEQ ID NO: 472243 - RNA, 19 nt, Human
uuguacuguacagcaucau

SEQ ID NO: 472244 - RNA, 26 nt, Human
uuuaaaaaaugacaagaaaauagcua

SEQ ID NO: 472245 - RNA, 20 nt, Human
aaacagagaaccagccgccc

SEQ ID NO: 472246 - RNA, 23 nt, Human
aaccaggagcucauuacuccggu

SEQ ID NO: 472247 - RNA, 20 nt, Human
aagcaaaagucucaaccagc

SEQ ID NO: 472248 - RNA, 19 nt, Human
aauucgggcugaucucccc

SEQ ID NO: 472249 - RNA, 21 nt, Human
acccacugggccucuggacag

SEQ ID NO: 472250 - RNA, 20 nt, Human
acuccgugacucugagccgg

SEQ ID NO: 472251 - RNA, 21 nt, Human
acucugagccgagaagagggg

SEQ ID NO: 472252 - RNA, 19 nt, Human
agaaguaaauggagaggcc

SEQ ID NO: 472253 - RNA, 26 nt, Human
agaggcaggcggcaauuccccaaggg

SEQ ID NO: 472254 - RNA, 21 nt, Human
aggaaacaaguggaagcaaaa

SEQ ID NO: 472255 - RNA, 21 nt, Human
aggaaccaggagcucauuacu

SEQ ID NO: 472256 - RNA, 21 nt, Human
aggauggguacagccucuuug

SEQ ID NO: 472257 - RNA, 21 nt, Human
agggaauucuggcuccaucuu

SEQ ID NO: 472258 - RNA, 21 nt, Human
aggugggaggugacagcacca

SEQ ID NO: 472259 - RNA, 22 nt, Human
agucacgguggcucuggugagg

SEQ ID NO: 472260 - RNA, 18 nt, Human
aguggaagcaaaagucuc

SEQ ID NO: 472261 - RNA, 21 nt, Human
auggcacagggacugugauca

SEQ ID NO: 472262 - RNA, 19 nt, Human
caaaaaaagucaccaacca

SEQ ID NO: 472263 - RNA, 22 nt, Human
caaguggaagcaaaagucucaa

SEQ ID NO: 472264 - RNA, 23 nt, Human
cacaaacagagaaccagccgccc

SEQ ID NO: 472265 - RNA, 22 nt, Human
caccagcaaggccucugaggcc

SEQ ID NO: 472266 - RNA, 21 nt, Human
caccagcgucccacaaacaga

SEQ ID NO: 472267 - RNA, 22 nt, Human
cacccaccuugggagaugaccc

SEQ ID NO: 472268 - RNA, 23 nt, Human
cagagacaccagcgucccacaag

SEQ ID NO: 472269 - RNA, 19 nt, Human
cagcugagagcgcuccccg

SEQ ID NO: 472270 - RNA, 21 nt, Human
caggcucuaaaguuaagaaaa

SEQ ID NO: 472271 - RNA, 23 nt, Human
caggucaucagaaacagucacgg

SEQ ID NO: 472272 - RNA, 22 nt, Human
ccacaaacagagaaccagccgc

SEQ ID NO: 472273 - RNA, 21 nt, Human
ccagagacaccagcgucccac

SEQ ID NO: 472274 - RNA, 21 nt, Human
cccacaaacagagaaccagcc

SEQ ID NO: 472275 - RNA, 21 nt, Human
ccccugggcaauccaggguuu

SEQ ID NO: 472276 - RNA, 20 nt, Human
ccgagaagaggggcggccca

SEQ ID NO: 472277 - RNA, 22 nt, Human
ccuccagagacaccagcguccc

SEQ ID NO: 472278 - RNA, 20 nt, Human
ccucuggacaggagaauggg

SEQ ID NO: 472279 - RNA, 19 nt, Human
ccuggagagauugcugccc

SEQ ID NO: 472280 - RNA, 21 nt, Human
ccuggagagauugcugcccug

SEQ ID NO: 472281 - RNA, 19 nt, Human
cgagaagaggggcggccca

SEQ ID NO: 472282 - RNA, 23 nt, Human
cggaauggaacaggugggaggug

SEQ ID NO: 472283 - RNA, 19 nt, Human
cuccaaggaaacaagugga

SEQ ID NO: 472284 - RNA, 20 nt, Human
cuccagagacaccagcgucc

SEQ ID NO: 472285 - RNA, 24 nt, Human
cugccucccuugaaacucucuucc

SEQ ID NO: 472286 - RNA, 23 nt, Human
cugcuagauugaauccagcugcc

SEQ ID NO: 472287 - RNA, 19 nt, Human
cuugaaacucucuucccaa

SEQ ID NO: 472288 - RNA, 22 nt, Human
gaacccacaaaugugccuucag

SEQ ID NO: 472289 - RNA, 21 nt, Human
gaagaaguaaauggagaggcc

SEQ ID NO: 472290 - RNA, 27 nt, Human
gaagcaaaagucucaaccaaucaacgg

SEQ ID NO: 472291 - RNA, 21 nt, Human
ggagcugcaggccaaguccuc

SEQ ID NO: 472292 - RNA, 24 nt, Human
ggcgaggugggccuaguucaaggc

SEQ ID NO: 472293 - RNA, 20 nt, Human
gggacugggaagauuuaggc

SEQ ID NO: 472294 - RNA, 23 nt, Human
gggcaauccaggguuucuuguuu

SEQ ID NO: 472295 - RNA, 23 nt, Human
gguucaauuccuucucauucaga

SEQ ID NO: 472296 - RNA, 19 nt, Human
gucaggguggcagggccug

SEQ ID NO: 472297 - RNA, 19 nt, Human
ucagccagguuagcaccaa

SEQ ID NO: 472298 - RNA, 21 nt, Human
ucaggaagggccuccagagac

SEQ ID NO: 472299 - RNA, 25 nt, Human
ucauuuaaccgcaaaaaaagucacc

SEQ ID NO: 472300 - RNA, 21 nt, Human
ucccaaggagcugcaggccaa

SEQ ID NO: 472301 - RNA, 19 nt, Human
ucccgaggaaccaggagcu

SEQ ID NO: 472302 - RNA, 19 nt, Human
ucugagccgagaagagggg

SEQ ID NO: 472303 - RNA, 25 nt, Human
ugaacaguggaagucacgcagagag

SEQ ID NO: 472304 - RNA, 21 nt, Human
ugacagcaccagcaaggccuc

SEQ ID NO: 472305 - RNA, 25 nt, Human
ugacagcaccagcaaggccucugag

SEQ ID NO: 472306 - RNA, 25 nt, Human
ugacagcaccagcaaggcuggagac

SEQ ID NO: 472307 - RNA, 24 nt, Human
ugacagcuccacagcgggacuggg

SEQ ID NO: 472308 - RNA, 19 nt, Human
ugaccaaaagaacccuuuu

SEQ ID NO: 472309 - RNA, 24 nt, Human
ugaccaaaagaacccuuuuucuuu

SEQ ID NO: 472310 - RNA, 19 nt, Human
ugaggaaggggaggguccc

SEQ ID NO: 472311 - RNA, 21 nt, Human
ugaggccaggguccacaccca

SEQ ID NO: 472312 - RNA, 23 nt, Human
ugaggccaggguccacacccacc

SEQ ID NO: 472313 - RNA, 20 nt, Human
ugcaaucagggucuccggcc

SEQ ID NO: 472314 - RNA, 19 nt, Human
uggaaaaacaucuccaagg

SEQ ID NO: 472315 - RNA, 22 nt, Human
uggaagcaaaagucucaaccag

SEQ ID NO: 472316 - RNA, 25 nt, Human
uggaaggcacaaaacuucguaaagg

SEQ ID NO: 472317 - RNA, 19 nt, Human
uggagaggccaggacugca

SEQ ID NO: 472318 - RNA, 19 nt, Human
uggcucuggugaggaaggg

SEQ ID NO: 472319 - RNA, 19 nt, Human
uggcugauggggaacccac

SEQ ID NO: 472320 - RNA, 22 nt, Human
ugugggaaggggccccucgcag

SEQ ID NO: 472321 - RNA, 19 nt, Human
uucgggcugaucuccccau

SEQ ID NO: 472322 - RNA, 22 nt, Human
uucguaaaggccuuaagaagcc

SEQ ID NO: 472323 - RNA, 23 nt, Human
uuggaaaaacaucuccaaggaaa

SEQ ID NO: 472324 - RNA, 21 nt, Human
uuggacuuuugguucaauucc

SEQ ID NO: 472325 - RNA, 19 nt, Human
uuuccuaagcuccuaugga

SEQ ID NO: 472326 - RNA, 18 nt, Human
uuuuuuuuuuuuuuuuug

SEQ ID NO: 472327 - RNA, 20 nt, Human
uuuuuuuuuuuuuuuuuggu

SEQ ID NO: 472328 - RNA, 24 nt, Human
uuuuuuuuuuuuuuuuuggucuca

SEQ ID NO: 472329 - RNA, 24 nt, Human
acaacaugauccaugggaaaaccc

SEQ ID NO: 472330 - RNA, 23 nt, Human
acccaccccuggccagccccaac

SEQ ID NO: 472331 - RNA, 19 nt, Human
cacuguggaugccaucagg

SEQ ID NO: 472332 - RNA, 19 nt, Human
cagggccccuggccacuac

SEQ ID NO: 472333 - RNA, 23 nt, Human
caugauccaugggaaaaccccuu

SEQ ID NO: 472334 - RNA, 20 nt, Human
ccaccccuggccagccccaa

SEQ ID NO: 472335 - RNA, 21 nt, Human
ccaccccuggccagccccaac

SEQ ID NO: 472336 - RNA, 23 nt, Human
ccaccccuggccagccccaaccu

SEQ ID NO: 472337 - RNA, 24 nt, Human
cccaaccuugacaucacuguggau

SEQ ID NO: 472338 - RNA, 20 nt, Human
cccaggcuccaaccccaacc

SEQ ID NO: 472339 - RNA, 24 nt, Human
cccaggcuccaaccccaaccugga

SEQ ID NO: 472340 - RNA, 19 nt, Human
ccccaaccuugacaucacu

SEQ ID NO: 472341 - RNA, 20 nt, Human
ccccuggccagccccaaccu

SEQ ID NO: 472342 - RNA, 22 nt, Human
cccuggccagccccaaccuuga

SEQ ID NO: 472343 - RNA, 18 nt, Human
ccuggccagccccaaccu

SEQ ID NO: 472344 - RNA, 22 nt, Human
ccuggccagccccaaccuugac

SEQ ID NO: 472345 - RNA, 23 nt, Human
cguccagggccccuggccacuac

SEQ ID NO: 472346 - RNA, 26 nt, Human
cuaguccacccaccccuggccagccc

SEQ ID NO: 472347 - RNA, 26 nt, Human
gaagcuuguggacaccaggcucugug

SEQ ID NO: 472348 - RNA, 18 nt, Human
gccagccccaaccuugac

SEQ ID NO: 472349 - RNA, 21 nt, Human
gcuccaaccccaaccuggaag

SEQ ID NO: 472350 - RNA, 23 nt, Human
gggccccuggccacuacucccaa

SEQ ID NO: 472351 - RNA, 21 nt, Human
uccguggcuagcguccagggc

SEQ ID NO: 472352 - RNA, 22 nt, Human
ugcuucuaguccacccaccccu

SEQ ID NO: 472353 - RNA, 18 nt, Human
uggaugccaucagggugg

SEQ ID NO: 472354 - RNA, 19 nt, Human
uggccagccccaaccuuga

SEQ ID NO: 472355 - RNA, 20 nt, Human
ugugcagcagcuccguggcu

SEQ ID NO: 472356 - RNA, 18 nt, Human
aaaaaacagagggggaga

SEQ ID NO: 472357 - RNA, 19 nt, Human
aaaagcaguuccaugaagg

SEQ ID NO: 472358 - RNA, 22 nt, Human
aaaagccaaaguccuuuagaua

SEQ ID NO: 472359 - RNA, 22 nt, Human
aaacccaccccucccaccucua

SEQ ID NO: 472360 - RNA, 27 nt, Human
aaagauaaaccaauauuguuugaaagc

SEQ ID NO: 472361 - RNA, 19 nt, Human
aaaugccuaaaccacuucu

SEQ ID NO: 472362 - RNA, 18 nt, Human
aacccagaguagaagcag

SEQ ID NO: 472363 - RNA, 18 nt, Human
aagacaggagcuaaaagc

SEQ ID NO: 472364 - RNA, 25 nt, Human
aaggcagagaugacacagcaaaaaa

SEQ ID NO: 472365 - RNA, 22 nt, Human
aaguguguguaggaacucccuc

SEQ ID NO: 472366 - RNA, 19 nt, Human
acagggcaaaguaaggaaa

SEQ ID NO: 472367 - RNA, 19 nt, Human
accccuagaccuuggccuc

SEQ ID NO: 472368 - RNA, 21 nt, Human
accccuagaccuuggccucca

SEQ ID NO: 472369 - RNA, 21 nt, Human
accucuaacaaaccaaaaugg

SEQ ID NO: 472370 - RNA, 22 nt, Human
agaagcauuauuuuaauguagg

SEQ ID NO: 472371 - RNA, 19 nt, Human
agacauggaucuggguuga

SEQ ID NO: 472372 - RNA, 21 nt, Human
agaccaaugacuaagaccaga

SEQ ID NO: 472373 - RNA, 24 nt, Human
agcaaacagguaaaaucugacauc

SEQ ID NO: 472374 - RNA, 20 nt, Human
agcaguggguuugaaugagg

SEQ ID NO: 472375 - RNA, 21 nt, Human
agcaguggguuugaaugagga

SEQ ID NO: 472376 - RNA, 21 nt, Human
agccccugugggggcagccag

SEQ ID NO: 472377 - RNA, 22 nt, Human
aggcuaaaagaggaauuuccag

SEQ ID NO: 472378 - RNA, 24 nt, Human
agggauuaguaacuugauuccaaa

SEQ ID NO: 472379 - RNA, 21 nt, Human
aguaaggaaagggaugugcca

SEQ ID NO: 472380 - RNA, 20 nt, Human
auagacaccugacuggaauc

SEQ ID NO: 472381 - RNA, 20 nt, Human
auggaaaugucagacaacua

SEQ ID NO: 472382 - RNA, 19 nt, Human
auuccaaauuuucuuccug

SEQ ID NO: 472383 - RNA, 19 nt, Human
auucuuucuuugcaucaug

SEQ ID NO: 472384 - RNA, 22 nt, Human
caaaacccaccccucccaccuc

SEQ ID NO: 472385 - RNA, 26 nt, Human
caaaauggaaaaugacaauucaggca

SEQ ID NO: 472386 - RNA, 18 nt, Human
cacaacuucgcagccucu

SEQ ID NO: 472387 - RNA, 18 nt, Human
cacaucuucacaaaggac

SEQ ID NO: 472388 - RNA, 22 nt, Human
caccccucccaccucuaacaaa

SEQ ID NO: 472389 - RNA, 28 nt, Human
caccccucccaccucuaacaaaccaaag

SEQ ID NO: 472390 - RNA, 21 nt, Human
caccccuccccuuucuacccc

SEQ ID NO: 472391 - RNA, 18 nt, Human
cagagaacuguaaccaca

SEQ ID NO: 472392 - RNA, 24 nt, Human
cagcagcaaacagguaaaauccua

SEQ ID NO: 472393 - RNA, 20 nt, Human
cagggcaagcacugucucaa

SEQ ID NO: 472394 - RNA, 22 nt, Human
caguggggagcugucagaccuu

SEQ ID NO: 472395 - RNA, 20 nt, Human
caguuccaugaaggacagga

SEQ ID NO: 472396 - RNA, 22 nt, Human
cauggaagaaacgcuccccuga

SEQ ID NO: 472397 - RNA, 24 nt, Human
cauuuugaaaagacaggagcuaaa

SEQ ID NO: 472398 - RNA, 22 nt, Human
ccagauggcagcuacuggcuca

SEQ ID NO: 472399 - RNA, 20 nt, Human
cccaccccucccaccucuaa

SEQ ID NO: 472400 - RNA, 21 nt, Human
cccaugacccagaccagccua

SEQ ID NO: 472401 - RNA, 25 nt, Human
cccaugacccagaccagccuaaagc

SEQ ID NO: 472402 - RNA, 26 nt, Human
ccccaccccuccccuuucuaccccua

SEQ ID NO: 472403 - RNA, 21 nt, Human
ccccagaaaucugaggagacc

SEQ ID NO: 472404 - RNA, 23 nt, Human
ccccagaaaucugaggagaccaa

SEQ ID NO: 472405 - RNA, 24 nt, Human
ccccagaaaucugaggagaccucg

SEQ ID NO: 472406 - RNA, 22 nt, Human
ccccaugacccagaccagccua

SEQ ID NO: 472407 - RNA, 18 nt, Human
ccccuccccuuucuaccc

SEQ ID NO: 472408 - RNA, 19 nt, Human
ccccuuucuaccccuagac

SEQ ID NO: 472409 - RNA, 20 nt, Human
cccuccccuuucuaccccua

SEQ ID NO: 472410 - RNA, 20 nt, Human
cccucuggggaggggcgccu

SEQ ID NO: 472411 - RNA, 22 nt, Human
ccuacccauuuuauagaaaaaa

SEQ ID NO: 472412 - RNA, 21 nt, Human
ccucccaccucuaacaaacca

SEQ ID NO: 472413 - RNA, 25 nt, Human
ccucggaacucuggccaggcucccu

SEQ ID NO: 472414 - RNA, 23 nt, Human
ccugccuacccauuuuauagaaa

SEQ ID NO: 472415 - RNA, 21 nt, Human
ccugugggggcagccaguggg

SEQ ID NO: 472416 - RNA, 20 nt, Human
cggaauugcugaggucucac

SEQ ID NO: 472417 - RNA, 21 nt, Human
cgggugccugggaggcuucau

SEQ ID NO: 472418 - RNA, 21 nt, Human
cuaccugguagccccaccccu

SEQ ID NO: 472419 - RNA, 21 nt, Human
cucaaggcagucucaaggcag

SEQ ID NO: 472420 - RNA, 19 nt, Human
cucccugaggggugcaucc

SEQ ID NO: 472421 - RNA, 23 nt, Human
cuccuuguucaaguuccuuauuu

SEQ ID NO: 472422 - RNA, 18 nt, Human
cugguauugcuuuugacc

SEQ ID NO: 472423 - RNA, 20 nt, Human
cuguaaccaaacaaaguuug

SEQ ID NO: 472424 - RNA, 18 nt, Human
cuuacaccccaaguucuu

SEQ ID NO: 472425 - RNA, 18 nt, Human
cuucgcagccucuaagau

SEQ ID NO: 472426 - RNA, 20 nt, Human
cuucucaaaacccaccccuc

SEQ ID NO: 472427 - RNA, 20 nt, Human
cuugacacuggcagguguuu

SEQ ID NO: 472428 - RNA, 21 nt, Human
gaaaacuguaaccaaacaaag

SEQ ID NO: 472429 - RNA, 18 nt, Human
gaaaugaccaacaucaag

SEQ ID NO: 472430 - RNA, 20 nt, Human
gaaaugucagacaacuauga

SEQ ID NO: 472431 - RNA, 23 nt, Human
gaccaguugggauagacaccuga

SEQ ID NO: 472432 - RNA, 24 nt, Human
gaguagaagcaguggagacauggg

SEQ ID NO: 472433 - RNA, 19 nt, Human
gauaagagggacgcuuccc

SEQ ID NO: 472434 - RNA, 21 nt, Human
gaugacacagcaaaaaacaga

SEQ ID NO: 472435 - RNA, 19 nt, Human
gaugacacugagggccacu

SEQ ID NO: 472436 - RNA, 20 nt, Human
gccccagaaaucugaggaga

SEQ ID NO: 472437 - RNA, 20 nt, Human
gccuuuggcuugccuuguug

SEQ ID NO: 472438 - RNA, 22 nt, Human
ggaaagggaugugccagcagug

SEQ ID NO: 472439 - RNA, 19 nt, Human
ggagcuaaaagcaguucca

SEQ ID NO: 472440 - RNA, 20 nt, Human
ggauuggagcuuuugccuua

SEQ ID NO: 472441 - RNA, 22 nt, Human
ggcaagcacugucucaaggcag

SEQ ID NO: 472442 - RNA, 18 nt, Human
ggccaggagucguaccaa

SEQ ID NO: 472443 - RNA, 19 nt, Human
gggcagccaguggggagcc

SEQ ID NO: 472444 - RNA, 24 nt, Human
guuccaugaaggacaggcguuucg

SEQ ID NO: 472445 - RNA, 24 nt, Human
guucuuuguguggcagaacaucua

SEQ ID NO: 472446 - RNA, 21 nt, Human
uaaaacaaaguugguuccuuu

SEQ ID NO: 472447 - RNA, 22 nt, Human
uaaccaaacaaaguuugguuaa

SEQ ID NO: 472448 - RNA, 20 nt, Human
uaacuuguagccauacaccu

SEQ ID NO: 472449 - RNA, 20 nt, Human
uacgguacacuuagcacuug

SEQ ID NO: 472450 - RNA, 23 nt, Human
uacgguacacuuagcacuuguuu

SEQ ID NO: 472451 - RNA, 19 nt, Human
uacuggcucagaaccaggg

SEQ ID NO: 472452 - RNA, 18 nt, Human
uagccauacaccuggcag

SEQ ID NO: 472453 - RNA, 20 nt, Human
ucaaaacccaccccucccac

SEQ ID NO: 472454 - RNA, 19 nt, Human
ucaaggcagucucaaggca

SEQ ID NO: 472455 - RNA, 18 nt, Human
ucacgggccucggaacuc

SEQ ID NO: 472456 - RNA, 22 nt, Human
uccaaaugccuaaaccacuucu

SEQ ID NO: 472457 - RNA, 22 nt, Human
uccagauggcagcuacuggcuc

SEQ ID NO: 472458 - RNA, 21 nt, Human
ucccaccucuaacaaaccaaa

SEQ ID NO: 472459 - RNA, 22 nt, Human
uccguggcugguagcacagggc

SEQ ID NO: 472460 - RNA, 22 nt, Human
ucucaaaacccaccccucccac

SEQ ID NO: 472461 - RNA, 19 nt, Human
ucugaggagaccaaugacu

SEQ ID NO: 472462 - RNA, 22 nt, Human
ugaaaaaauaauaaaauauugu

SEQ ID NO: 472463 - RNA, 21 nt, Human
ugaaaagacaggagcuaaaag

SEQ ID NO: 472464 - RNA, 23 nt, Human
ugaaaagacaggagcuaaaagca

SEQ ID NO: 472465 - RNA, 19 nt, Human
ugacacagcaaaaaacaga

SEQ ID NO: 472466 - RNA, 22 nt, Human
ugacacagcaaaaaacagaggg

SEQ ID NO: 472467 - RNA, 19 nt, Human
ugacuuaguaaugagacag

SEQ ID NO: 472468 - RNA, 21 nt, Human
ugagaaauaggacugagaaau

SEQ ID NO: 472469 - RNA, 24 nt, Human
ugagaaugggucugcccuucucuc

SEQ ID NO: 472470 - RNA, 20 nt, Human
ugaggaucugggugaccagc

SEQ ID NO: 472471 - RNA, 24 nt, Human
ugauuuacaaaagccaaaguccuu

SEQ ID NO: 472472 - RNA, 21 nt, Human
ugcauccuaggagaacugaaa

SEQ ID NO: 472473 - RNA, 21 nt, Human
ugccuaaaccacuucugagcu

SEQ ID NO: 472474 - RNA, 19 nt, Human
ugccuuauccuuacacccc

SEQ ID NO: 472475 - RNA, 23 nt, Human
uggaauccuugacacuggcaggg

SEQ ID NO: 472476 - RNA, 19 nt, Human
uggccaggcucccugaggg

SEQ ID NO: 472477 - RNA, 24 nt, Human
ugguggucuuugagaaugggucug

SEQ ID NO: 472478 - RNA, 23 nt, Human
ugucaacugcuaccugguagccc

SEQ ID NO: 472479 - RNA, 25 nt, Human
ugucacacuuguuuauuucuuuggg

SEQ ID NO: 472480 - RNA, 22 nt, Human
ugugauuuacaaaagccaaagu

SEQ ID NO: 472481 - RNA, 22 nt, Human
ugugggucaguggucaucuugg

SEQ ID NO: 472482 - RNA, 25 nt, Human
ugugggucaguggucaucuuggcag

SEQ ID NO: 472483 - RNA, 20 nt, Human
uucgcagccucuaagauuua

SEQ ID NO: 472484 - RNA, 20 nt, Human
uugcugaggucucacuucuc

SEQ ID NO: 472485 - RNA, 22 nt, Human
uuucuugugguucuccuuguuc

SEQ ID NO: 472486 - RNA, 18 nt, Human
uuuuuuuuuuuuuuuuug

SEQ ID NO: 472487 - RNA, 22 nt, Human
aacccaaucacugggugcccaa

SEQ ID NO: 472488 - RNA, 23 nt, Human
aagcaagcaugaccucgggccac

SEQ ID NO: 472489 - RNA, 22 nt, Human
agcaagcaugaccucgggccac

SEQ ID NO: 472490 - RNA, 20 nt, Human
agcagcaaacccccaaagcu

SEQ ID NO: 472491 - RNA, 20 nt, Human
agccccucccaugucccccc

SEQ ID NO: 472492 - RNA, 24 nt, Human
aggcagaccagcuuuauuuuugaa

SEQ ID NO: 472493 - RNA, 20 nt, Human
agguggaagcaagcaugacc

SEQ ID NO: 472494 - RNA, 19 nt, Human
cauaaaaagugcagcccac

SEQ ID NO: 472495 - RNA, 24 nt, Human
ccaacaaggauccuggcuccuccc

SEQ ID NO: 472496 - RNA, 20 nt, Human
ccccaaagcugucacuuccg

SEQ ID NO: 472497 - RNA, 23 nt, Human
ccccaaagcugucacuuccggga

SEQ ID NO: 472498 - RNA, 21 nt, Human
ccccccuggaaccgacacgcc

SEQ ID NO: 472499 - RNA, 19 nt, Human
ccccuggaaccgacacgcc

SEQ ID NO: 472500 - RNA, 19 nt, Human
ccucccauguccccccugg

SEQ ID NO: 472501 - RNA, 22 nt, Human
ccucgggccacugugcagcccc

SEQ ID NO: 472502 - RNA, 21 nt, Human
cgaaaugaugagauggggcac

SEQ ID NO: 472503 - RNA, 29 nt, Human
cuucuggggcaggagcggugggguacccc

SEQ ID NO: 472504 - RNA, 24 nt, Human
gaaaggaccaaaugcaccugcagg

SEQ ID NO: 472505 - RNA, 26 nt, Human
gacacgccucacaucaagaguggcca

SEQ ID NO: 472506 - RNA, 21 nt, Human
gcaaacccccaaagcugucac

SEQ ID NO: 472507 - RNA, 22 nt, Human
gcacucagaggcacaaagcgac

SEQ ID NO: 472508 - RNA, 30 nt, Human
ggaccaaaugcaccugcagguggaagcaaa

SEQ ID NO: 472509 - RNA, 20 nt, Human
ggagucucuuguuacugcaa

SEQ ID NO: 472510 - RNA, 23 nt, Human
uaacaguauuuagcuagaccaac

SEQ ID NO: 472511 - RNA, 25 nt, Human
uaauuaauaugugccaacucugcac

SEQ ID NO: 472512 - RNA, 19 nt, Human
uaugacacagaacuauaga

SEQ ID NO: 472513 - RNA, 22 nt, Human
ucacaucaagaguggccacacc

SEQ ID NO: 472514 - RNA, 23 nt, Human
uccccuaacaguauuuagcuaga

SEQ ID NO: 472515 - RNA, 23 nt, Human
uccuggccauggaaaggaccaaa

SEQ ID NO: 472516 - RNA, 18 nt, Human
ugaaggcuggccaggaca

SEQ ID NO: 472517 - RNA, 22 nt, Human
ugacacagaacuauagagagaa

SEQ ID NO: 472518 - RNA, 23 nt, Human
ugaugagauggggcacacucccc

SEQ ID NO: 472519 - RNA, 19 nt, Human
ugcccaacuaugacucugc

SEQ ID NO: 472520 - RNA, 20 nt, Human
ugcugguagcaagaucauua

SEQ ID NO: 472521 - RNA, 22 nt, Human
uggaaaggaccaaaugcaccug

SEQ ID NO: 472522 - RNA, 23 nt, Human
uggaaaggaccaaaugcaccugc

SEQ ID NO: 472523 - RNA, 25 nt, Human
uuaaagcccaguuucacuuggccua

SEQ ID NO: 472524 - RNA, 19 nt, Human
uugaaggcuggccaggacc

SEQ ID NO: 472525 - RNA, 20 nt, Human
uuuaaagcccaguuucacuu

SEQ ID NO: 472526 - RNA, 19 nt, Human
aaagcugggcacaggucug

SEQ ID NO: 472527 - RNA, 20 nt, Human
aaauggggccagguauuuga

SEQ ID NO: 472528 - RNA, 21 nt, Human
aauggccaacucaaccccaug

SEQ ID NO: 472529 - RNA, 22 nt, Human
acccccuuucuucacuuuaaga

SEQ ID NO: 472530 - RNA, 18 nt, Human
accccgggagagcuaggg

SEQ ID NO: 472531 - RNA, 19 nt, Human
acuagaggcaagagcagca

SEQ ID NO: 472532 - RNA, 23 nt, Human
acucaaccccauggcugaaagcc

SEQ ID NO: 472533 - RNA, 22 nt, Human
agacaggagacagcauguuccu

SEQ ID NO: 472534 - RNA, 21 nt, Human
agggaggggcaauaugguucc

SEQ ID NO: 472535 - RNA, 22 nt, Human
agggaggggcaauaugguuccc

SEQ ID NO: 472536 - RNA, 20 nt, Human
agguggcucugcagcacgug

SEQ ID NO: 472537 - RNA, 20 nt, Human
aguugcuggaggggguuggg

SEQ ID NO: 472538 - RNA, 18 nt, Human
auauaccucacccauaua

SEQ ID NO: 472539 - RNA, 29 nt, Human
aucccagccucuucccuuucuccgucucu

SEQ ID NO: 472540 - RNA, 25 nt, Human
caaaugacuuaggaugugaaagccc

SEQ ID NO: 472541 - RNA, 22 nt, Human
caacucaaccccauggcugaaa

SEQ ID NO: 472542 - RNA, 23 nt, Human
caagagcagcagagaccauccca

SEQ ID NO: 472543 - RNA, 22 nt, Human
cacuuuaagaaaaucccccaag

SEQ ID NO: 472544 - RNA, 19 nt, Human
cagguauuugacagaugcu

SEQ ID NO: 472545 - RNA, 27 nt, Human
caguucacugggagugacaaaggugac

SEQ ID NO: 472546 - RNA, 20 nt, Human
cauuacaaucugcuccuagg

SEQ ID NO: 472547 - RNA, 23 nt, Human
cccauggcugaaagccgagggac

SEQ ID NO: 472548 - RNA, 24 nt, Human
ccccuaagggagaggacaccccgg

SEQ ID NO: 472549 - RNA, 26 nt, Human
ccccuaagggagaggacaccccggga

SEQ ID NO: 472550 - RNA, 18 nt, Human
cccugggggguuucccuu

SEQ ID NO: 472551 - RNA, 25 nt, Human
cuagagcuccgcucgcaacaaaagc

SEQ ID NO: 472552 - RNA, 25 nt, Human
cucagaccaagguggcucugcagcc

SEQ ID NO: 472553 - RNA, 20 nt, Human
cuggagguuccucgaagcca

SEQ ID NO: 472554 - RNA, 19 nt, Human
cuggcuggcuguaucuugg

SEQ ID NO: 472555 - RNA, 22 nt, Human
cuguaucuuggccugaacagag

SEQ ID NO: 472556 - RNA, 20 nt, Human
cuuggucaucagaggccucc

SEQ ID NO: 472557 - RNA, 23 nt, Human
cuuucuucacuuuaagaaaaucc

SEQ ID NO: 472558 - RNA, 18 nt, Human
gagcugcgcggugcccuc

SEQ ID NO: 472559 - RNA, 26 nt, Human
gaggacaccccgggagagcuaggggu

SEQ ID NO: 472560 - RNA, 20 nt, Human
gaggaggggcugguccucaa

SEQ ID NO: 472561 - RNA, 22 nt, Human
gcagagagaagucucuguuucu

SEQ ID NO: 472562 - RNA, 21 nt, Human
gcccuguaccccagcagauca

SEQ ID NO: 472563 - RNA, 22 nt, Human
gcuagggguucucccagcccug

SEQ ID NO: 472564 - RNA, 20 nt, Human
ggacaacgcguggucaccga

SEQ ID NO: 472565 - RNA, 23 nt, Human
ggcaagagcagcagagaccaucc

SEQ ID NO: 472566 - RNA, 18 nt, Human
ggcacaggucugggucug

SEQ ID NO: 472567 - RNA, 19 nt, Human
gggaagggggaccaaagcu

SEQ ID NO: 472568 - RNA, 19 nt, Human
gggcacaggucugggucug

SEQ ID NO: 472569 - RNA, 18 nt, Human
gguccuggaccaacaggc

SEQ ID NO: 472570 - RNA, 22 nt, Human
guaccccagcagaucagacucc

SEQ ID NO: 472571 - RNA, 21 nt, Human
gugugcugggggacucucacu

SEQ ID NO: 472572 - RNA, 18 nt, Human
guucaggccacuuucugc

SEQ ID NO: 472573 - RNA, 23 nt, Human
uaccccagcagaucagacuccug

SEQ ID NO: 472574 - RNA, 19 nt, Human
ucacacacacacaggaggc

SEQ ID NO: 472575 - RNA, 22 nt, Human
ucagaccaagguggcucugcag

SEQ ID NO: 472576 - RNA, 22 nt, Human
ucagaggccuccugggucccag

SEQ ID NO: 472577 - RNA, 21 nt, Human
ucagaggucaguucaggccac

SEQ ID NO: 472578 - RNA, 18 nt, Human
ucaggccacuuucugcag

SEQ ID NO: 472579 - RNA, 23 nt, Human
ucaguucaggccacuuucugcag

SEQ ID NO: 472580 - RNA, 20 nt, Human
uccccacccccuuucuucac

SEQ ID NO: 472581 - RNA, 27 nt, Human
uccccaguaucucaugaaaggggaggc

SEQ ID NO: 472582 - RNA, 20 nt, Human
uccuaggccacagcaggccc

SEQ ID NO: 472583 - RNA, 21 nt, Human
uccuaggccacagcaggcccu

SEQ ID NO: 472584 - RNA, 24 nt, Human
uccuggaccaacaggcacuucucu

SEQ ID NO: 472585 - RNA, 23 nt, Human
uccugggucccagacgacaggcc

SEQ ID NO: 472586 - RNA, 21 nt, Human
ucuccaugaacuagaggcaag

SEQ ID NO: 472587 - RNA, 24 nt, Human
ucuccaugaacuagaggcaagagc

SEQ ID NO: 472588 - RNA, 19 nt, Human
ucucccagcccuguacccc

SEQ ID NO: 472589 - RNA, 22 nt, Human
ucugcaggguccuggaccaaca

SEQ ID NO: 472590 - RNA, 21 nt, Human
ucuuggccugaacagagacac

SEQ ID NO: 472591 - RNA, 27 nt, Human
ugaaagcccuuggucaucagaggccuc

SEQ ID NO: 472592 - RNA, 22 nt, Human
ugaaagccgagggacaacgcgu

SEQ ID NO: 472593 - RNA, 21 nt, Human
ugaaaggggaggccaagacag

SEQ ID NO: 472594 - RNA, 23 nt, Human
ugaaggaaguuugaugggggagg

SEQ ID NO: 472595 - RNA, 23 nt, Human
ugaaggaaguuugaugggggagg

SEQ ID NO: 472596 - RNA, 26 nt, Human
ugaaggaaguuugaugggggagggag

SEQ ID NO: 472597 - RNA, 21 nt, Human
ugagggaggaggggcuggucc

SEQ ID NO: 472598 - RNA, 18 nt, Human
ugcggagggcccagccca

SEQ ID NO: 472599 - RNA, 23 nt, Human
ugcucagaccaagguggcucugc

SEQ ID NO: 472600 - RNA, 24 nt, Human
ugcucagaccaagguggcucugca

SEQ ID NO: 472601 - RNA, 19 nt, Human
uggcagagagaagucucug

SEQ ID NO: 472602 - RNA, 22 nt, Human
uggcuguaucuuggccugaaca

SEQ ID NO: 472603 - RNA, 21 nt, Human
ugggcacaggucugggucugc

SEQ ID NO: 472604 - RNA, 20 nt, Human
uggggagugugugcuggggg

SEQ ID NO: 472605 - RNA, 18 nt, Human
ugggggagggaggggcaa

SEQ ID NO: 472606 - RNA, 18 nt, Human
uguaguugcuggaggggg

SEQ ID NO: 472607 - RNA, 24 nt, Human
uguucucuucuccccaguaucuca

SEQ ID NO: 472608 - RNA, 19 nt, Human
uuaaauaaacugagagaag

SEQ ID NO: 472609 - RNA, 20 nt, Human
uuaggaugugaaagcccuug

SEQ ID NO: 472610 - RNA, 18 nt, Human
uucucccagcccuguacc

SEQ ID NO: 472611 - RNA, 23 nt, Human
uucuccccaguaucucaugaaag

SEQ ID NO: 472612 - RNA, 22 nt, Human
uuguucucaaggccuccuucca

SEQ ID NO: 472613 - RNA, 24 nt, Human
uuucacagaagugggauauaccuc

SEQ ID NO: 472614 - RNA, 25 nt, Human
aaacaugacuagaaguuuaucacac

SEQ ID NO: 472615 - RNA, 21 nt, Human
aaagauguuuuguggucacaa

SEQ ID NO: 472616 - RNA, 20 nt, Human
aaaugcuaaaagaugugaac

SEQ ID NO: 472617 - RNA, 21 nt, Human
aagcacuguaaaauaaaggca

SEQ ID NO: 472618 - RNA, 19 nt, Human
acagcagcagggcaauggg

SEQ ID NO: 472619 - RNA, 22 nt, Human
accaacuuaucaaaaaaaaaaa

SEQ ID NO: 472620 - RNA, 19 nt, Human
acccugagagauguccggg

SEQ ID NO: 472621 - RNA, 22 nt, Human
acccugagagauguccggguag

SEQ ID NO: 472622 - RNA, 21 nt, Human
accugcuuuuacaaauguccu

SEQ ID NO: 472623 - RNA, 21 nt, Human
acuggaacccucaaaaucaga

SEQ ID NO: 472624 - RNA, 18 nt, Human
agagcacugcaaaacuca

SEQ ID NO: 472625 - RNA, 21 nt, Human
aggauaaggauuuaaaaauau

SEQ ID NO: 472626 - RNA, 22 nt, Human
aggcacagaggcuacaccugcc

SEQ ID NO: 472627 - RNA, 21 nt, Human
agugguuaguuucaggccaag

SEQ ID NO: 472628 - RNA, 21 nt, Human
aucaaaaaaaaaaaaaaaaaa

SEQ ID NO: 472629 - RNA, 21 nt, Human
caaaugauacacagcuccuuc

SEQ ID NO: 472630 - RNA, 23 nt, Human
caauuucuccuuuuaagugagcu

SEQ ID NO: 472631 - RNA, 31 nt, Human
caccaacuuaucaaaaaaaaaaaaaaaaaaa

SEQ ID NO: 472632 - RNA, 21 nt, Human
caccgcccccaaauccugcag

SEQ ID NO: 472633 - RNA, 22 nt, Human
caccgcccccaaauccugcagu

SEQ ID NO: 472634 - RNA, 22 nt, Human
caccuuuuucagaacaaggaua

SEQ ID NO: 472635 - RNA, 22 nt, Human
cagcccacgauacagcauacua

SEQ ID NO: 472636 - RNA, 23 nt, Human
cagugguuaguuucaggccaagc

SEQ ID NO: 472637 - RNA, 18 nt, Human
cccaaauccugcaguggc

SEQ ID NO: 472638 - RNA, 21 nt, Human
ccccaccgcccccaaauccug

SEQ ID NO: 472639 - RNA, 23 nt, Human
ccccaccgcccccaaauccugca

SEQ ID NO: 472640 - RNA, 23 nt, Human
cccccaaauccugcaguggcacc

SEQ ID NO: 472641 - RNA, 25 nt, Human
cuaagcacuguaaaauaaaggcaag

SEQ ID NO: 472642 - RNA, 23 nt, Human
cugcuacaauacauaaaacaaag

SEQ ID NO: 472643 - RNA, 21 nt, Human
cuuaagcuaaacaaaauuuaa

SEQ ID NO: 472644 - RNA, 20 nt, Human
cuuacaccaacuuaucaaaa

SEQ ID NO: 472645 - RNA, 18 nt, Human
cuucauguaaaaaagaug

SEQ ID NO: 472646 - RNA, 21 nt, Human
ggcaccauauuauuaaaaaca

SEQ ID NO: 472647 - RNA, 21 nt, Human
ggguagcgccaggggacaacg

SEQ ID NO: 472648 - RNA, 21 nt, Human
guucugggguugguccaaagu

SEQ ID NO: 472649 - RNA, 21 nt, Human
uaaaaaaucaaaggauaagga

SEQ ID NO: 472650 - RNA, 18 nt, Human
uaaggaauucccguuaag

SEQ ID NO: 472651 - RNA, 23 nt, Human
uaaguuacaaaacuugggcaaag

SEQ ID NO: 472652 - RNA, 20 nt, Human
uacaaaaaaaaaucagaaac

SEQ ID NO: 472653 - RNA, 22 nt, Human
uacaaaaaaaaaucagaaaccu

SEQ ID NO: 472654 - RNA, 23 nt, Human
uacaauacauaaaacaaaguaca

SEQ ID NO: 472655 - RNA, 20 nt, Human
uacacaauuucuccuuuuaa

SEQ ID NO: 472656 - RNA, 20 nt, Human
uacauuuacuggauuguuuu

SEQ ID NO: 472657 - RNA, 20 nt, Human
uagaggcccugcaucuguuu

SEQ ID NO: 472658 - RNA, 20 nt, Human
uagcaauuacaaaaccauga

SEQ ID NO: 472659 - RNA, 24 nt, Human
uaggcaaauguaaaaugcuaaaag

SEQ ID NO: 472660 - RNA, 23 nt, Human
ucaaauaucaauuauuuagcgau

SEQ ID NO: 472661 - RNA, 22 nt, Human
ucagguggaguuccaauguaug

SEQ ID NO: 472662 - RNA, 21 nt, Human
uccaaggguuucauuuaugaa

SEQ ID NO: 472663 - RNA, 23 nt, Human
uccccaccgcccccaaauccugc

SEQ ID NO: 472664 - RNA, 23 nt, Human
ucuguucugggguugguccaaag

SEQ ID NO: 472665 - RNA, 23 nt, Human
ucuuccccaccgcccccaaaucc

SEQ ID NO: 472666 - RNA, 19 nt, Human
ugaaaaaucuaccuuaagg

SEQ ID NO: 472667 - RNA, 22 nt, Human
ugauacacagcuccuucaugua

SEQ ID NO: 472668 - RNA, 19 nt, Human
ugauuuugacacauggcaa

SEQ ID NO: 472669 - RNA, 21 nt, Human
ugccucagagcaagacaucau

SEQ ID NO: 472670 - RNA, 21 nt, Human
uggcucugcucuguucugggg

SEQ ID NO: 472671 - RNA, 23 nt, Human
uguaaaauaaaggcaagagcuaa

SEQ ID NO: 472672 - RNA, 18 nt, Human
uuaaguaccaaaucaaaa

SEQ ID NO: 472673 - RNA, 18 nt, Human
uuacaccaacuuaucaaa

SEQ ID NO: 472674 - RNA, 21 nt, Human
uuagaggcccugcaucuguuu

SEQ ID NO: 472675 - RNA, 24 nt, Human
uucagaacaaggauaauuuacaga

SEQ ID NO: 472676 - RNA, 20 nt, Human
uugcagcugcccucuugaca

SEQ ID NO: 472677 - RNA, 26 nt, Human
uuuacagaaauuauacaaagcagauu

SEQ ID NO: 472678 - RNA, 19 nt, Human
aaaccccagggccuuggca

SEQ ID NO: 472679 - RNA, 23 nt, Human
aaccgugagcaccuugagagcaa

SEQ ID NO: 472680 - RNA, 23 nt, Human
acccacacucucagcaccuucca

SEQ ID NO: 472681 - RNA, 19 nt, Human
acccaguacuucuuccaca

SEQ ID NO: 472682 - RNA, 21 nt, Human
accccacgaccccaccaguua

SEQ ID NO: 472683 - RNA, 19 nt, Human
accccagggccuuggcagg

SEQ ID NO: 472684 - RNA, 19 nt, Human
accuuguagcacuggagcu

SEQ ID NO: 472685 - RNA, 24 nt, Human
agaagccauccuccaaacaaaacc

SEQ ID NO: 472686 - RNA, 18 nt, Human
agacagaaaaaagagaug

SEQ ID NO: 472687 - RNA, 19 nt, Human
agauguguuuguugguugg

SEQ ID NO: 472688 - RNA, 22 nt, Human
agcagcagaagccauccuccaa

SEQ ID NO: 472689 - RNA, 18 nt, Human
agccacaaacagggaccg

SEQ ID NO: 472690 - RNA, 19 nt, Human
aggaaccccuuucccagac

SEQ ID NO: 472691 - RNA, 23 nt, Human
agugcccagccacaaacagggac

SEQ ID NO: 472692 - RNA, 19 nt, Human
cacaccccacgaccccacc

SEQ ID NO: 472693 - RNA, 23 nt, Human
cacacucucagcaccuuccaccc

SEQ ID NO: 472694 - RNA, 25 nt, Human
cacccaguacuucuuccacaaggcc

SEQ ID NO: 472695 - RNA, 21 nt, Human
caccccacgaccccaccaguu

SEQ ID NO: 472696 - RNA, 23 nt, Human
caccccacgaccccaccaguuac

SEQ ID NO: 472697 - RNA, 19 nt, Human
cacccuggaagaaaucugg

SEQ ID NO: 472698 - RNA, 22 nt, Human
cacuccaccagccuucccuggc

SEQ ID NO: 472699 - RNA, 25 nt, Human
cagagaaaaaugaggauuccucuca

SEQ ID NO: 472700 - RNA, 22 nt, Human
cagcagugggugccacaugggu

SEQ ID NO: 472701 - RNA, 23 nt, Human
cagcuccuggaguggcccaggaa

SEQ ID NO: 472702 - RNA, 18 nt, Human
caggggguggaccuugua

SEQ ID NO: 472703 - RNA, 24 nt, Human
cagugggcugcuugcccguguggg

SEQ ID NO: 472704 - RNA, 20 nt, Human
cauaagcagaaacacaccaa

SEQ ID NO: 472705 - RNA, 19 nt, Human
cauagacucuucauuuuau

SEQ ID NO: 472706 - RNA, 20 nt, Human
caucccucacucauagacuc

SEQ ID NO: 472707 - RNA, 22 nt, Human
caucuggguccccagccugcgc

SEQ ID NO: 472708 - RNA, 23 nt, Human
ccaaacaaaaccguaugcaaaac

SEQ ID NO: 472709 - RNA, 21 nt, Human
ccaguacuucuuccacaaggc

SEQ ID NO: 472710 - RNA, 22 nt, Human
cccacacucucagcaccuucca

SEQ ID NO: 472711 - RNA, 21 nt, Human
cccaggaaccccuuucccaga

SEQ ID NO: 472712 - RNA, 19 nt, Human
cccagguucagagauauuc

SEQ ID NO: 472713 - RNA, 20 nt, Human
ccuggaagaaaucuggagcu

SEQ ID NO: 472714 - RNA, 21 nt, Human
cucccgcccaccauucacacc

SEQ ID NO: 472715 - RNA, 22 nt, Human
cucccgcccaccauucacaccc

SEQ ID NO: 472716 - RNA, 21 nt, Human
cuucauuuuauccagcuguuu

SEQ ID NO: 472717 - RNA, 18 nt, Human
cuuccacccaacucagcu

SEQ ID NO: 472718 - RNA, 19 nt, Human
gaaguggcccccacccaca

SEQ ID NO: 472719 - RNA, 25 nt, Human
gagcaggcauaaguuugaauuccau

SEQ ID NO: 472720 - RNA, 22 nt, Human
gcccagacugcuuuuacuuucc

SEQ ID NO: 472721 - RNA, 23 nt, Human
gcccagccacaaacagggaccuc

SEQ ID NO: 472722 - RNA, 24 nt, Human
gcccaggaaccccuuucccagacu

SEQ ID NO: 472723 - RNA, 22 nt, Human
gcucccaaauucugggagcaga

SEQ ID NO: 472724 - RNA, 19 nt, Human
ggccccgagcucucccucc

SEQ ID NO: 472725 - RNA, 18 nt, Human
gggagcaggggguggacc

SEQ ID NO: 472726 - RNA, 22 nt, Human
gggugccacaugggugcucaga

SEQ ID NO: 472727 - RNA, 21 nt, Human
ggugggcgggagcagggggug

SEQ ID NO: 472728 - RNA, 19 nt, Human
gugagcaccuugagagcag

SEQ ID NO: 472729 - RNA, 23 nt, Human
guggcccaggaaccccuuuccca

SEQ ID NO: 472730 - RNA, 23 nt, Human
uaaagcagccagauaaggugggc

SEQ ID NO: 472731 - RNA, 24 nt, Human
uaagcagaaacacaccaaccccgg

SEQ ID NO: 472732 - RNA, 25 nt, Human
uaagcagaaacacaccaacugacaa

SEQ ID NO: 472733 - RNA, 24 nt, Human
uaaguuugaauuccaucugggucc

SEQ ID NO: 472734 - RNA, 25 nt, Human
uacacaaaggccgugcccaauuacc

SEQ ID NO: 472735 - RNA, 19 nt, Human
uacccuaacauaagcagaa

SEQ ID NO: 472736 - RNA, 21 nt, Human
uagcaccaaaaacauuuuccu

SEQ ID NO: 472737 - RNA, 19 nt, Human
uagcacuggagcuaaagca

SEQ ID NO: 472738 - RNA, 23 nt, Human
uagcacuggagcuaaagcagcca

SEQ ID NO: 472739 - RNA, 22 nt, Human
uauauugaugccuccacacccu

SEQ ID NO: 472740 - RNA, 20 nt, Human
ucaccaguuacacaaaggcc

SEQ ID NO: 472741 - RNA, 25 nt, Human
ucagcaccuuccacccaacucagcu

SEQ ID NO: 472742 - RNA, 27 nt, Human
ucagcaccuuccacccaacucagcucc

SEQ ID NO: 472743 - RNA, 25 nt, Human
uccaaacaaaaccguaugcaaaacc

SEQ ID NO: 472744 - RNA, 26 nt, Human
uccaaacuuuuguauuuuuagcagca

SEQ ID NO: 472745 - RNA, 22 nt, Human
uccacaaggcccuaugugagcu

SEQ ID NO: 472746 - RNA, 19 nt, Human
uccccagccugcgcccaga

SEQ ID NO: 472747 - RNA, 19 nt, Human
uccccagccugcgcccaga

SEQ ID NO: 472748 - RNA, 26 nt, Human
ucccgcccaccauucacaccccacga

SEQ ID NO: 472749 - RNA, 23 nt, Human
ucccuggcucugcaucccucacu

SEQ ID NO: 472750 - RNA, 23 nt, Human
ucuuccacaaggcccuaugugag

SEQ ID NO: 472751 - RNA, 24 nt, Human
ugaauagacagaaaaaagagaugu

SEQ ID NO: 472752 - RNA, 24 nt, Human
ugagcucaguuuaaaaccccaggg

SEQ ID NO: 472753 - RNA, 22 nt, Human
ugccacagugagagggcagaga

SEQ ID NO: 472754 - RNA, 25 nt, Human
ugccuccacacccuggaagaaaucu

SEQ ID NO: 472755 - RNA, 24 nt, Human
ugcucagaaguggcccccacccac

SEQ ID NO: 472756 - RNA, 25 nt, Human
ugcucccgcccaccauucacacccc

SEQ ID NO: 472757 - RNA, 18 nt, Human
uggagcucccaaauucug

SEQ ID NO: 472758 - RNA, 18 nt, Human
ugggcgggagcagggggu

SEQ ID NO: 472759 - RNA, 18 nt, Human
uggguccccagccugcgc

SEQ ID NO: 472760 - RNA, 22 nt, Human
uggguccccagccugcgcccag

SEQ ID NO: 472761 - RNA, 22 nt, Human
uuagcagcagaagccauccucc

SEQ ID NO: 472762 - RNA, 19 nt, Human
uucauuuuauccagcuguu

SEQ ID NO: 472763 - RNA, 20 nt, Human
uuccacccaacucagcuccc

SEQ ID NO: 472764 - RNA, 22 nt, Human
uuggcuuuuuacucuuagcacc

SEQ ID NO: 472765 - RNA, 22 nt, Human
uuuccagugaauagacagaaaa

SEQ ID NO: 472766 - RNA, 21 nt, Human
aaaaaaaugaaaguccacaga

SEQ ID NO: 472767 - RNA, 20 nt, Human
aaaaccagucaacugaacac

SEQ ID NO: 472768 - RNA, 23 nt, Human
aaacaggacacaaaaccagucaa

SEQ ID NO: 472769 - RNA, 21 nt, Human
aaaccagucaacugaacacag

SEQ ID NO: 472770 - RNA, 24 nt, Human
aaugccuguagacccauaagccac

SEQ ID NO: 472771 - RNA, 21 nt, Human
acaggacacaaaaccagucaa

SEQ ID NO: 472772 - RNA, 19 nt, Human
acccauaagccacauugga

SEQ ID NO: 472773 - RNA, 23 nt, Human
augccuguagacccauaagccac

SEQ ID NO: 472774 - RNA, 19 nt, Human
caaaaccagucaacugaac

SEQ ID NO: 472775 - RNA, 23 nt, Human
caaaccauggaaaaacuuagccu

SEQ ID NO: 472776 - RNA, 22 nt, Human
cacacaggcuuauugcaaacca

SEQ ID NO: 472777 - RNA, 21 nt, Human
cagaaccuugaaauaaaacau

SEQ ID NO: 472778 - RNA, 19 nt, Human
cagaguuccaccgauaucc

SEQ ID NO: 472779 - RNA, 19 nt, Human
cagcugccgucgaggccgc

SEQ ID NO: 472780 - RNA, 21 nt, Human
cagcuugaccagaguuccacc

SEQ ID NO: 472781 - RNA, 18 nt, Human
ccacacagagucaggucc

SEQ ID NO: 472782 - RNA, 23 nt, Human
ccacuucuuccucuucuucuuca

SEQ ID NO: 472783 - RNA, 21 nt, Human
ccuucagcucgaggugcacgu

SEQ ID NO: 472784 - RNA, 23 nt, Human
cugaacacagagcagcucucuuc

SEQ ID NO: 472785 - RNA, 21 nt, Human
cuuaaaaaaaugaaaguccac

SEQ ID NO: 472786 - RNA, 24 nt, Human
cuuaaaaaaaugaaaguccacaga

SEQ ID NO: 472787 - RNA, 20 nt, Human
cuuagccuuugucccucggc

SEQ ID NO: 472788 - RNA, 25 nt, Human
cuuuggguucaaaauauaccagcuu

SEQ ID NO: 472789 - RNA, 18 nt, Human
gcaaauccucacacugcc

SEQ ID NO: 472790 - RNA, 23 nt, Human
gcuuuuaagacuuuccacuucuu

SEQ ID NO: 472791 - RNA, 24 nt, Human
gcuuuuaagacuuuccacuucuuc

SEQ ID NO: 472792 - RNA, 20 nt, Human
ucccgaaugccuguagaccc

SEQ ID NO: 472793 - RNA, 22 nt, Human
ucccgaaugccuguagacccau

SEQ ID NO: 472794 - RNA, 20 nt, Human
ucucuuaaaaaaaugaaagu

SEQ ID NO: 472795 - RNA, 23 nt, Human
ucuuaaggauuuaucuugaugac

SEQ ID NO: 472796 - RNA, 20 nt, Human
ugacuuagaaaaauacaccu

SEQ ID NO: 472797 - RNA, 22 nt, Human
ugcacagaugauugccaagacc

SEQ ID NO: 472798 - RNA, 23 nt, Human
ugcacagaugauugccaagacca

SEQ ID NO: 472799 - RNA, 21 nt, Human
ugccaagaccauauugacaaa

SEQ ID NO: 472800 - RNA, 24 nt, Human
uguuguuuuuaauauauuuuuccu

SEQ ID NO: 472801 - RNA, 20 nt, Human
uuugucccucggccuaguuc

SEQ ID NO: 472802 - RNA, 28 nt, Human
aaaaaacaggauaucccggagcaaaugc

SEQ ID NO: 472803 - RNA, 25 nt, Human
aacaaaaucagcccaggaacaauga

SEQ ID NO: 472804 - RNA, 26 nt, Human
aagaggccagcgguaagcggugggca

SEQ ID NO: 472805 - RNA, 19 nt, Human
aagcaacaaaaucagccca

SEQ ID NO: 472806 - RNA, 22 nt, Human
agcaacaaaaucagcccaggaa

SEQ ID NO: 472807 - RNA, 20 nt, Human
agggcaguuggagugagcac

SEQ ID NO: 472808 - RNA, 18 nt, Human
agguaugugggcaucugg

SEQ ID NO: 472809 - RNA, 22 nt, Human
augacggcaaagagcacaggua

SEQ ID NO: 472810 - RNA, 18 nt, Human
caaaaucagcccaggaac

SEQ ID NO: 472811 - RNA, 20 nt, Human
ccacgcccucaagucuuccc

SEQ ID NO: 472812 - RNA, 25 nt, Human
ccagugugguccaaugguguugucc

SEQ ID NO: 472813 - RNA, 19 nt, Human
ccaguuucagccaguucca

SEQ ID NO: 472814 - RNA, 24 nt, Human
ccauaguaaugguaaucuccaauu

SEQ ID NO: 472815 - RNA, 20 nt, Human
ccuccaagucccugaggcgg

SEQ ID NO: 472816 - RNA, 21 nt, Human
ccuccaagucccugaggcggc

SEQ ID NO: 472817 - RNA, 25 nt, Human
ccucccacuucuacauccuccaagu

SEQ ID NO: 472818 - RNA, 22 nt, Human
cucccacuucuacauccuccaa

SEQ ID NO: 472819 - RNA, 22 nt, Human
cugcuguuugauagucuuucuu

SEQ ID NO: 472820 - RNA, 21 nt, Human
cuguguggugacauuucuuuc

SEQ ID NO: 472821 - RNA, 30 nt, Human
gccacgcccucaagucuuccaagaggccaa

SEQ ID NO: 472822 - RNA, 25 nt, Human
ggaaacuguuuauuuaguggggaua

SEQ ID NO: 472823 - RNA, 22 nt, Human
gucuccucccacuucuacaucc

SEQ ID NO: 472824 - RNA, 23 nt, Human
uaagccagauugaacauggcuug

SEQ ID NO: 472825 - RNA, 28 nt, Human
uagcuggucuccuucaucuguaaaauuu

SEQ ID NO: 472826 - RNA, 24 nt, Human
uccaggagauuuucucuuuuauug

SEQ ID NO: 472827 - RNA, 22 nt, Human
uccgcuagcucgccugucacuu

SEQ ID NO: 472828 - RNA, 23 nt, Human
ucuccaggagauuuucucuuuuu

SEQ ID NO: 472829 - RNA, 25 nt, Human
ugagcacggacaauucguguugacc

SEQ ID NO: 472830 - RNA, 18 nt, Human
ugagcagguuuuccugug

SEQ ID NO: 472831 - RNA, 22 nt, Human
ugagcagguuuuccugugaucc

SEQ ID NO: 472832 - RNA, 24 nt, Human
ugaggccaaucacaaauaaguccc

SEQ ID NO: 472833 - RNA, 19 nt, Human
ugauuacauuacuagaugu

SEQ ID NO: 472834 - RNA, 22 nt, Human
ugcuguaguguguggcugcugu

SEQ ID NO: 472835 - RNA, 24 nt, Human
uggcucuacaggccacgcccucaa

SEQ ID NO: 472836 - RNA, 21 nt, Human
ugggcaucuggacucguuuga

SEQ ID NO: 472837 - RNA, 19 nt, Human
uguggcugcuguuugauag

SEQ ID NO: 472838 - RNA, 21 nt, Human
uucuucuuuuucuccaggaga

SEQ ID NO: 472839 - RNA, 25 nt, Human
uugauagcuggugaaaauccuccuc

SEQ ID NO: 472840 - RNA, 22 nt, Human
uuugauuucguucacugauacc

SEQ ID NO: 472841 - RNA, 18 nt, Human
aagaaaauaggcaaaaua

SEQ ID NO: 472842 - RNA, 21 nt, Human
acaaacgaagggccgggugug

SEQ ID NO: 472843 - RNA, 24 nt, Human
acacuggcaagaaaauaggcaaaa

SEQ ID NO: 472844 - RNA, 19 nt, Human
accggccuguggcccgggc

SEQ ID NO: 472845 - RNA, 20 nt, Human
agagugcgugugcccugcca

SEQ ID NO: 472846 - RNA, 22 nt, Human
agcacaaucauugcaggccaca

SEQ ID NO: 472847 - RNA, 23 nt, Human
agccagaaccucgagggcuucug

SEQ ID NO: 472848 - RNA, 20 nt, Human
agggaacacggccagagggg

SEQ ID NO: 472849 - RNA, 19 nt, Human
agugggucuggguccccgg

SEQ ID NO: 472850 - RNA, 20 nt, Human
caccccucccuacccucuuu

SEQ ID NO: 472851 - RNA, 31 nt, Human
caccccucccuacccucuuuuggugacuugg

SEQ ID NO: 472852 - RNA, 18 nt, Human
cagucagccucucugcuc

SEQ ID NO: 472853 - RNA, 20 nt, Human
ccagauaaacgcgcgcccac

SEQ ID NO: 472854 - RNA, 23 nt, Human
ccauggcgcgccuggucuccucc

SEQ ID NO: 472855 - RNA, 22 nt, Human
ccauggcgcgccuggucuccuu

SEQ ID NO: 472856 - RNA, 18 nt, Human
cccacgucucugcugggc

SEQ ID NO: 472857 - RNA, 24 nt, Human
cccgcggccagagccaaccauggc

SEQ ID NO: 472858 - RNA, 22 nt, Human
cccggcccccuccagccugggg

SEQ ID NO: 472859 - RNA, 23 nt, Human
cccucccuacccucuuuugguga

SEQ ID NO: 472860 - RNA, 23 nt, Human
ccuccagauaaacgcgcgcccac

SEQ ID NO: 472861 - RNA, 18 nt, Human
ccucccuacccucuuuug

SEQ ID NO: 472862 - RNA, 23 nt, Human
ccucccuacccucuuuuggugac

SEQ ID NO: 472863 - RNA, 20 nt, Human
cgggugggauuggccaauuc

SEQ ID NO: 472864 - RNA, 26 nt, Human
cucccuggucuccucgggggagagau

SEQ ID NO: 472865 - RNA, 22 nt, Human
cuggacacuggcaagaaaauag

SEQ ID NO: 472866 - RNA, 21 nt, Human
cuggguccccggcccccucca

SEQ ID NO: 472867 - RNA, 22 nt, Human
cuugucuuccuggguuacaggg

SEQ ID NO: 472868 - RNA, 24 nt, Human
gaccagaggaaggaacaaggguuu

SEQ ID NO: 472869 - RNA, 18 nt, Human
gagcuugucuuccugggu

SEQ ID NO: 472870 - RNA, 24 nt, Human
gccaggacagacgucauugcugug

SEQ ID NO: 472871 - RNA, 19 nt, Human
gccaggagaggcuggaucc

SEQ ID NO: 472872 - RNA, 21 nt, Human
gcgcgccuggucuccuccaga

SEQ ID NO: 472873 - RNA, 21 nt, Human
gcuggauccccagcucaccgg

SEQ ID NO: 472874 - RNA, 21 nt, Human
gcugugcggugcuugagugcc

SEQ ID NO: 472875 - RNA, 20 nt, Human
gcuucugucccuggaucuuc

SEQ ID NO: 472876 - RNA, 21 nt, Human
ggacaaacgaagggccgggug

SEQ ID NO: 472877 - RNA, 23 nt, Human
ggcccagccagaaccucgagggc

SEQ ID NO: 472878 - RNA, 18 nt, Human
ggcccgggcauccugggc

SEQ ID NO: 472879 - RNA, 18 nt, Human
ggcucugagccggggagg

SEQ ID NO: 472880 - RNA, 21 nt, Human
gggagggaacacggccagagg

SEQ ID NO: 472881 - RNA, 26 nt, Human
gggccgagggugguaacuaggaggag

SEQ ID NO: 472882 - RNA, 21 nt, Human
gguccccggcccccuccagcc

SEQ ID NO: 472883 - RNA, 19 nt, Human
gguggccugggucggugcu

SEQ ID NO: 472884 - RNA, 25 nt, Human
gguuacaggguccugagcuuggccg

SEQ ID NO: 472885 - RNA, 18 nt, Human
uaaaacgccaggagaggc

SEQ ID NO: 472886 - RNA, 20 nt, Human
uaacuaggaggaguggcucu

SEQ ID NO: 472887 - RNA, 20 nt, Human
uagcucaauacucauucaga

SEQ ID NO: 472888 - RNA, 21 nt, Human
ucaaugaccagaggaaggaac

SEQ ID NO: 472889 - RNA, 22 nt, Human
ucagcacgugggcccagccaga

SEQ ID NO: 472890 - RNA, 19 nt, Human
uccccagcucaccggccug

SEQ ID NO: 472891 - RNA, 22 nt, Human
ucgggugggauuggccaauucc

SEQ ID NO: 472892 - RNA, 19 nt, Human
ugacagcccuguguccuuc

SEQ ID NO: 472893 - RNA, 19 nt, Human
ugacuugggguggccuggg

SEQ ID NO: 472894 - RNA, 18 nt, Human
ugcagagggagggccgag

SEQ ID NO: 472895 - RNA, 18 nt, Human
ugcagagggagggccgag

SEQ ID NO: 472896 - RNA, 23 nt, Human
ugcagagggagggccgagggugg

SEQ ID NO: 472897 - RNA, 22 nt, Human
uggccugggucggugcucagcc

SEQ ID NO: 472898 - RNA, 20 nt, Human
uggcucugagccggggaggg

SEQ ID NO: 472899 - RNA, 20 nt, Human
ugggcuugcagagggagggc

SEQ ID NO: 472900 - RNA, 21 nt, Human
uggguccccggcccccuccag

SEQ ID NO: 472901 - RNA, 24 nt, Human
uggguccccggcccccuccagccu

SEQ ID NO: 472902 - RNA, 22 nt, Human
uucuaggcuggggaguagugga

SEQ ID NO: 472903 - RNA, 21 nt, Human
uuuguccaccccucccuaccc

SEQ ID NO: 472904 - RNA, 18 nt, Human
uuuuguccaccccucccu

SEQ ID NO: 472905 - RNA, 21 nt, Human
uuuuguccaccccucccuacc

SEQ ID NO: 472906 - RNA, 21 nt, Human
cgguaggcugggaagugggcc

SEQ ID NO: 472907 - RNA, 24 nt, Human
cuccaccacccucuucgcguuccg

SEQ ID NO: 472908 - RNA, 20 nt, Human
cuggcccaagagucgggcgg

SEQ ID NO: 472909 - RNA, 23 nt, Human
ggaagugggcccaagggcucagg

SEQ ID NO: 472910 - RNA, 18 nt, Human
ggcccaagggcucagggg

SEQ ID NO: 472911 - RNA, 20 nt, Human
ggcggggacggaagcgguag

SEQ ID NO: 472912 - RNA, 21 nt, Human
gugggcccaggcgcuggccca

SEQ ID NO: 472913 - RNA, 19 nt, Human
uagcccgacuccaccaccc

SEQ ID NO: 472914 - RNA, 19 nt, Human
ugcgggggauaggaaagug

SEQ ID NO: 472915 - RNA, 20 nt, Human
uggcccaagagucgggcggg

SEQ ID NO: 472916 - RNA, 26 nt, Human
ugggaagugggcccaagggcucaggg

SEQ ID NO: 472917 - RNA, 26 nt, Human
aaacagaaacuaaaacaaaauaacaa

SEQ ID NO: 472918 - RNA, 22 nt, Human
agagaagccaaaugacuuuccc

SEQ ID NO: 472919 - RNA, 18 nt, Human
agcagggaaugccuuuau

SEQ ID NO: 472920 - RNA, 19 nt, Human
agcagguggcccaggaggg

SEQ ID NO: 472921 - RNA, 21 nt, Human
agcuggucgucacagguagug

SEQ ID NO: 472922 - RNA, 18 nt, Human
aggaaggccauggcggua

SEQ ID NO: 472923 - RNA, 21 nt, Human
aggguacuuacucuccaacua

SEQ ID NO: 472924 - RNA, 24 nt, Human
auaugcaccuuuuuguagagacac

SEQ ID NO: 472925 - RNA, 23 nt, Human
aucagcagguggcccaggagggc

SEQ ID NO: 472926 - RNA, 18 nt, Human
aucaucucucccugcuuc

SEQ ID NO: 472927 - RNA, 25 nt, Human
augaaaaacagaaacuaaaacaaaa

SEQ ID NO: 472928 - RNA, 20 nt, Human
augcaugaagaaacaggcac

SEQ ID NO: 472929 - RNA, 20 nt, Human
augccugugagguaguuggu

SEQ ID NO: 472930 - RNA, 20 nt, Human
caaagcaaaggagaucugag

SEQ ID NO: 472931 - RNA, 21 nt, Human
caacugggccaaucuucacgu

SEQ ID NO: 472932 - RNA, 21 nt, Human
caaggucacacagccugaagg

SEQ ID NO: 472933 - RNA, 21 nt, Human
cacacugagaauccgaaagcc

SEQ ID NO: 472934 - RNA, 20 nt, Human
cacccuugggccugccucca

SEQ ID NO: 472935 - RNA, 25 nt, Human
caccucuguugccuccauuugagag

SEQ ID NO: 472936 - RNA, 23 nt, Human
cagaggcuuucucagaucagccu

SEQ ID NO: 472937 - RNA, 23 nt, Human
cagcaaaucaucucucccugcuu

SEQ ID NO: 472938 - RNA, 19 nt, Human
caggaaggggugugugggg

SEQ ID NO: 472939 - RNA, 18 nt, Human
caguccucucuugagagu

SEQ ID NO: 472940 - RNA, 20 nt, Human
ccauacuucuuccuucuagu

SEQ ID NO: 472941 - RNA, 26 nt, Human
ccccaccagcaaaucaucucucccug

SEQ ID NO: 472942 - RNA, 18 nt, Human
ccccucugugagacugag

SEQ ID NO: 472943 - RNA, 20 nt, Human
ccccucugugagacugaggg

SEQ ID NO: 472944 - RNA, 25 nt, Human
ccuccacacugagaauccgaaagcc

SEQ ID NO: 472945 - RNA, 19 nt, Human
ccucugcagcaagcggccu

SEQ ID NO: 472946 - RNA, 21 nt, Human
cgaaagccaagaugcccaaga

SEQ ID NO: 472947 - RNA, 23 nt, Human
cggggcagugguauaugcaccuu

SEQ ID NO: 472948 - RNA, 24 nt, Human
cgucacagguagugugacacagag

SEQ ID NO: 472949 - RNA, 22 nt, Human
cuuacuggaauccccacugcau

SEQ ID NO: 472950 - RNA, 22 nt, Human
cuugcucugugaccuggccucu

SEQ ID NO: 472951 - RNA, 22 nt, Human
cuuuaacuccauacuucuuccu

SEQ ID NO: 472952 - RNA, 24 nt, Human
gaaaaacagaaacuaaaagggagc

SEQ ID NO: 472953 - RNA, 20 nt, Human
gaaacaggcacagagaagcu

SEQ ID NO: 472954 - RNA, 25 nt, Human
gaagaaacaggcacagagaagccaa

SEQ ID NO: 472955 - RNA, 19 nt, Human
gaggggcaaaggagagagg

SEQ ID NO: 472956 - RNA, 20 nt, Human
gcaggggcgugucucaaccc

SEQ ID NO: 472957 - RNA, 20 nt, Human
gcucugucucucuguuccug

SEQ ID NO: 472958 - RNA, 18 nt, Human
gcuugcuugaugcgggcu

SEQ ID NO: 472959 - RNA, 24 nt, Human
gggcagaggggcucuccugggauc

SEQ ID NO: 472960 - RNA, 24 nt, Human
gggcagugguauaugcaccuuuuu

SEQ ID NO: 472961 - RNA, 20 nt, Human
gguagugugacacagaguug

SEQ ID NO: 472962 - RNA, 18 nt, Human
gucuuguagaagccccuc

SEQ ID NO: 472963 - RNA, 23 nt, Human
uacgucccuccacacugagaauc

SEQ ID NO: 472964 - RNA, 18 nt, Human
uacuggaauccccacugc

SEQ ID NO: 472965 - RNA, 20 nt, Human
uagugugacacagaguuggg

SEQ ID NO: 472966 - RNA, 20 nt, Human
ucaaagcaaaggagaucuga

SEQ ID NO: 472967 - RNA, 22 nt, Human
ucaaagcaaaggagaucugagc

SEQ ID NO: 472968 - RNA, 19 nt, Human
uccaggggcucugcauguc

SEQ ID NO: 472969 - RNA, 18 nt, Human
uccauacuucuuccuucu

SEQ ID NO: 472970 - RNA, 24 nt, Human
uccccagccccaccagcaaaucau

SEQ ID NO: 472971 - RNA, 20 nt, Human
ucuccugggaucuggacugg

SEQ ID NO: 472972 - RNA, 18 nt, Human
ucuguuccugccccuugc

SEQ ID NO: 472973 - RNA, 24 nt, Human
ugaccuggccucucuggaccccag

SEQ ID NO: 472974 - RNA, 24 nt, Human
ugcaugaagaaacaggcacagagg

SEQ ID NO: 472975 - RNA, 23 nt, Human
ugccugugagguaguugguacuu

SEQ ID NO: 472976 - RNA, 19 nt, Human
ugcucugugaccuggccuc

SEQ ID NO: 472977 - RNA, 19 nt, Human
ugggggcggggucggcggc

SEQ ID NO: 472978 - RNA, 18 nt, Human
uguccgggacuccucagu

SEQ ID NO: 472979 - RNA, 19 nt, Human
ugucuuguagaagccccuc

SEQ ID NO: 472980 - RNA, 21 nt, Human
ugucuuguagaagccccucug

SEQ ID NO: 472981 - RNA, 18 nt, Human
uguuccugccccuugcuc

SEQ ID NO: 472982 - RNA, 24 nt, Human
uuauuuaaaaaaaugaaaaacaga

SEQ ID NO: 472983 - RNA, 25 nt, Human
uuccaggggcucugcaugucugguc

SEQ ID NO: 472984 - RNA, 24 nt, Human
uucuagguugugcagacugccacu

SEQ ID NO: 472985 - RNA, 21 nt, Human
uugucuuguagaagccccucu

SEQ ID NO: 472986 - RNA, 25 nt, Human
uuuaaaaaaaugaaaaacagaaacu

SEQ ID NO: 472987 - RNA, 20 nt, Human
uuuccaggugccaucuuccc

SEQ ID NO: 472988 - RNA, 31 nt, Human
uuuuuuuuuuuuuuuuuuuuaaaagcagggg

SEQ ID NO: 472989 - RNA, 23 nt, Human
aaaaaaaaaaaaaaaaacucgag

SEQ ID NO: 472990 - RNA, 18 nt, Human
aaaacccuucgagaguca

SEQ ID NO: 472991 - RNA, 18 nt, Human
aagagagguccagggacc

SEQ ID NO: 472992 - RNA, 18 nt, Human
aagcaccgcaaaugcagc

SEQ ID NO: 472993 - RNA, 22 nt, Human
aagcaccgcaaaugcagcccca

SEQ ID NO: 472994 - RNA, 23 nt, Human
aagcaccgcaaaugcagccccac

SEQ ID NO: 472995 - RNA, 25 nt, Human
aagcaccgcaaaugcagccccacaa

SEQ ID NO: 472996 - RNA, 23 nt, Human
aaggaagaggaagucagcaaagg

SEQ ID NO: 472997 - RNA, 22 nt, Human
aaggacagaggccaaggaagga

SEQ ID NO: 472998 - RNA, 24 nt, Human
acagaggccaaggaaggaaggagg

SEQ ID NO: 472999 - RNA, 21 nt, Human
acaguggggagggcaaagcac

SEQ ID NO: 473000 - RNA, 18 nt, Human
agaggccaaggaaggaag

SEQ ID NO: 473001 - RNA, 19 nt, Human
agccucuaagccuuugccu

SEQ ID NO: 473002 - RNA, 20 nt, Human
aggaagaggaagucagcaaa

SEQ ID NO: 473003 - RNA, 21 nt, Human
aggaaggaaggaggaaacaga

SEQ ID NO: 473004 - RNA, 23 nt, Human
aggaaggaaggaggaaacagagc

SEQ ID NO: 473005 - RNA, 21 nt, Human
agggaaggagagagaaaaaaa

SEQ ID NO: 473006 - RNA, 23 nt, Human
aggggaggaggggguucucaggu

SEQ ID NO: 473007 - RNA, 18 nt, Human
aggggguucucagguguc

SEQ ID NO: 473008 - RNA, 22 nt, Human
agucaaagcaaugcagacuccu

SEQ ID NO: 473009 - RNA, 20 nt, Human
caguggauaggccccucccc

SEQ ID NO: 473010 - RNA, 19 nt, Human
ccaaagccaagaacaaaac

SEQ ID NO: 473011 - RNA, 21 nt, Human
ccaaagccaagaacaaaaccc

SEQ ID NO: 473012 - RNA, 20 nt, Human
ccacaagaggaacuaagcag

SEQ ID NO: 473013 - RNA, 24 nt, Human
ccaccuaggccagcugccaaggac

SEQ ID NO: 473014 - RNA, 21 nt, Human
cccuccccacugccccgaccc

SEQ ID NO: 473015 - RNA, 21 nt, Human
cccuccuauagucugcccacc

SEQ ID NO: 473016 - RNA, 21 nt, Human
ccguccuguggcgaauuccag

SEQ ID NO: 473017 - RNA, 21 nt, Human
cuaagccuuugccuccauacc

SEQ ID NO: 473018 - RNA, 21 nt, Human
gagccucugacacggccgucu

SEQ ID NO: 473019 - RNA, 24 nt, Human
gccaaggacuaggaagagcagugg

SEQ ID NO: 473020 - RNA, 23 nt, Human
gccccuccccacugccccgaccc

SEQ ID NO: 473021 - RNA, 19 nt, Human
ggaaggagagagaaaaaaa

SEQ ID NO: 473022 - RNA, 20 nt, Human
ggaggaaacagagccgcugg

SEQ ID NO: 473023 - RNA, 21 nt, Human
ggccccuccccacugccccga

SEQ ID NO: 473024 - RNA, 18 nt, Human
ggggaggggaggaggggg

SEQ ID NO: 473025 - RNA, 19 nt, Human
gggggaggggaggaggggg

SEQ ID NO: 473026 - RNA, 21 nt, Human
gucuagagaauggaugcaaga

SEQ ID NO: 473027 - RNA, 21 nt, Human
uaaccaaggagagggaaguca

SEQ ID NO: 473028 - RNA, 18 nt, Human
uaagccuuugccuccaua

SEQ ID NO: 473029 - RNA, 19 nt, Human
uaccaaguucacaacaggg

SEQ ID NO: 473030 - RNA, 24 nt, Human
ucaaagcaaugcagacuccuaacc

SEQ ID NO: 473031 - RNA, 21 nt, Human
ucagcaaaggacagaggccaa

SEQ ID NO: 473032 - RNA, 21 nt, Human
uccaaagccaagaacaaaacc

SEQ ID NO: 473033 - RNA, 28 nt, Human
uccaaagccaagaacaaaaccggggucc

SEQ ID NO: 473034 - RNA, 20 nt, Human
uccagggaccacuugccucu

SEQ ID NO: 473035 - RNA, 21 nt, Human
ucccuuggccccucacucaca

SEQ ID NO: 473036 - RNA, 23 nt, Human
ugacacggccgucuagagaaugg

SEQ ID NO: 473037 - RNA, 18 nt, Human
ugccaaggacuaggaaga

SEQ ID NO: 473038 - RNA, 19 nt, Human
ugccaaggacuaggaagag

SEQ ID NO: 473039 - RNA, 23 nt, Human
ugccccgaccccagggugaguuc

SEQ ID NO: 473040 - RNA, 19 nt, Human
ugcugcagggaaggagaga

SEQ ID NO: 473041 - RNA, 18 nt, Human
uucucucucucucucucc

SEQ ID NO: 473042 - RNA, 18 nt, Human
uuuuuuuuuuuuuccuug

SEQ ID NO: 473043 - RNA, 20 nt, Human
aagagaaaggaaauuacaaa

SEQ ID NO: 473044 - RNA, 21 nt, Human
aagagaaaggaaauuacaaac

SEQ ID NO: 473045 - RNA, 20 nt, Human
aggugcugccggccgccuga

SEQ ID NO: 473046 - RNA, 20 nt, Human
cacgcgccgcagccuggacc

SEQ ID NO: 473047 - RNA, 19 nt, Human
caggaucagcuguuuccuc

SEQ ID NO: 473048 - RNA, 20 nt, Human
cagggcaggugcugccggcc

SEQ ID NO: 473049 - RNA, 18 nt, Human
cccccgcccccgcuccgc

SEQ ID NO: 473050 - RNA, 20 nt, Human
cccccgcccccgcuccgccc

SEQ ID NO: 473051 - RNA, 21 nt, Human
cccccgcuccgcccgcucccc

SEQ ID NO: 473052 - RNA, 25 nt, Human
cccccgggugccccgcgcucggccc

SEQ ID NO: 473053 - RNA, 26 nt, Human
ccccgcccccgcuccgcccgcucccc

SEQ ID NO: 473054 - RNA, 23 nt, Human
ccccgcgcucggcccccgccccc

SEQ ID NO: 473055 - RNA, 19 nt, Human
ccccgggugccccgcgcuc

SEQ ID NO: 473056 - RNA, 24 nt, Human
cccugccgcccuggcuggugucca

SEQ ID NO: 473057 - RNA, 23 nt, Human
ccgcccccgcuccgcccgcuccc

SEQ ID NO: 473058 - RNA, 25 nt, Human
ccgcccgcuccccacgcgccgcagc

SEQ ID NO: 473059 - RNA, 21 nt, Human
ccgcgcucggcccccgccccc

SEQ ID NO: 473060 - RNA, 20 nt, Human
ccuggggggugcuggguggg

SEQ ID NO: 473061 - RNA, 22 nt, Human
cgcccgcuccccacgcgccgca

SEQ ID NO: 473062 - RNA, 22 nt, Human
cgggugccccgcgcucggcccc

SEQ ID NO: 473063 - RNA, 21 nt, Human
cugccgcccuggcuggugucc

SEQ ID NO: 473064 - RNA, 22 nt, Human
cuggggggugcugggugggggc

SEQ ID NO: 473065 - RNA, 21 nt, Human
gagcaggaucagcuguuuccu

SEQ ID NO: 473066 - RNA, 20 nt, Human
gccccgcgcucggcccccgc

SEQ ID NO: 473067 - RNA, 18 nt, Human
gcccgcuccccacgcgcc

SEQ ID NO: 473068 - RNA, 18 nt, Human
ggcccccgcccccgcucc

SEQ ID NO: 473069 - RNA, 20 nt, Human
gggggugcugggugggggcg

SEQ ID NO: 473070 - RNA, 18 nt, Human
gugcugccggccgccugg

SEQ ID NO: 473071 - RNA, 23 nt, Human
uagaacccagggcaggugcugcc

SEQ ID NO: 473072 - RNA, 19 nt, Human
ucccaaggccugggagcuc

SEQ ID NO: 473073 - RNA, 21 nt, Human
ucccaaggccugggagcuccu

SEQ ID NO: 473074 - RNA, 22 nt, Human
ucccaaggccugggagcuccug

SEQ ID NO: 473075 - RNA, 25 nt, Human
ugcccugccgcccuggcuggugucc

SEQ ID NO: 473076 - RNA, 19 nt, Human
uggggggugcugggugggg

SEQ ID NO: 473077 - RNA, 21 nt, Human
aaacagaaagccggcgcagga

SEQ ID NO: 473078 - RNA, 22 nt, Human
aaccaaggaaccacguugccag

SEQ ID NO: 473079 - RNA, 21 nt, Human
aaccccacccugcagcaccuc

SEQ ID NO: 473080 - RNA, 23 nt, Human
aacgaaaagggagguagaaagaa

SEQ ID NO: 473081 - RNA, 18 nt, Human
aagacgcuggagaggcca

SEQ ID NO: 473082 - RNA, 21 nt, Human
aaggcagccccauccuccucu

SEQ ID NO: 473083 - RNA, 25 nt, Human
aaggcagccccauccuccucuccug

SEQ ID NO: 473084 - RNA, 18 nt, Human
acacugaguccccugugu

SEQ ID NO: 473085 - RNA, 21 nt, Human
acagagcaaagacgcuggaga

SEQ ID NO: 473086 - RNA, 24 nt, Human
acagagcaaagacgcuggagaggc

SEQ ID NO: 473087 - RNA, 23 nt, Human
acagcccgccagagacacagcaa

SEQ ID NO: 473088 - RNA, 21 nt, Human
acccacccugacggccacacc

SEQ ID NO: 473089 - RNA, 22 nt, Human
acccaggcccaccccacccucc

SEQ ID NO: 473090 - RNA, 22 nt, Human
accucgguggccucaaacccca

SEQ ID NO: 473091 - RNA, 22 nt, Human
agagagaaacccgcugaauagu

SEQ ID NO: 473092 - RNA, 23 nt, Human
agcaaaguccaguggaaccugga

SEQ ID NO: 473093 - RNA, 18 nt, Human
agcagaaucaccaggccu

SEQ ID NO: 473094 - RNA, 19 nt, Human
agcagaaucaccaggccug

SEQ ID NO: 473095 - RNA, 19 nt, Human
agcuguuguggacucuucu

SEQ ID NO: 473096 - RNA, 18 nt, Human
aggacggggccaaguccu

SEQ ID NO: 473097 - RNA, 18 nt, Human
aggcagccccauccuccu

SEQ ID NO: 473098 - RNA, 21 nt, Human
aggcccagagagcagcgagcc

SEQ ID NO: 473099 - RNA, 20 nt, Human
aggcugcagccuggugccag

SEQ ID NO: 473100 - RNA, 21 nt, Human
aggcugcagccuggugccagc

SEQ ID NO: 473101 - RNA, 23 nt, Human
aggcugcagccuggugccagccu

SEQ ID NO: 473102 - RNA, 21 nt, Human
agggauggguggaggccaggg

SEQ ID NO: 473103 - RNA, 23 nt, Human
agucagggcagauggcgacucau

SEQ ID NO: 473104 - RNA, 24 nt, Human
agugaccaagucccacacacugag

SEQ ID NO: 473105 - RNA, 26 nt, Human
augagaugaucagagagaaacccgcu

SEQ ID NO: 473106 - RNA, 21 nt, Human
augcggguucgagagccugcg

SEQ ID NO: 473107 - RNA, 22 nt, Human
augcugggcagggcccaagggg

SEQ ID NO: 473108 - RNA, 18 nt, Human
auggagugaccaaguccc

SEQ ID NO: 473109 - RNA, 19 nt, Human
caaaccccacagacagggg

SEQ ID NO: 473110 - RNA, 21 nt, Human
caaggaaccacguugccagua

SEQ ID NO: 473111 - RNA, 25 nt, Human
caccaaacagaaagccggcgcagga

SEQ ID NO: 473112 - RNA, 18 nt, Human
caccaaccaaggaaccac

SEQ ID NO: 473113 - RNA, 19 nt, Human
caccaaggaggacagcccg

SEQ ID NO: 473114 - RNA, 21 nt, Human
cacccacccugacggccacac

SEQ ID NO: 473115 - RNA, 22 nt, Human
cacccacugcccugggggucuc

SEQ ID NO: 473116 - RNA, 18 nt, Human
caccccacccucccacca

SEQ ID NO: 473117 - RNA, 21 nt, Human
caccgugauggcucuguaacc

SEQ ID NO: 473118 - RNA, 19 nt, Human
caccugccgucagcaaagu

SEQ ID NO: 473119 - RNA, 23 nt, Human
cacugaguccccugugucccggg

SEQ ID NO: 473120 - RNA, 28 nt, Human
cagagcaaagacgcuggagaggccaagg

SEQ ID NO: 473121 - RNA, 22 nt, Human
cagcccgccagagacacagcaa

SEQ ID NO: 473122 - RNA, 21 nt, Human
cagccuggugccagccucaca

SEQ ID NO: 473123 - RNA, 18 nt, Human
caggacagcucccaccaa

SEQ ID NO: 473124 - RNA, 18 nt, Human
caggaggggagagcggcg

SEQ ID NO: 473125 - RNA, 18 nt, Human
cagggcccaaggggugcc

SEQ ID NO: 473126 - RNA, 21 nt, Human
caugagccaccugccgucagc

SEQ ID NO: 473127 - RNA, 18 nt, Human
ccacagugguuuguguuc

SEQ ID NO: 473128 - RNA, 21 nt, Human
ccaccccacccucccaccagc

SEQ ID NO: 473129 - RNA, 29 nt, Human
ccacccucccaccagcuguuguggacucc

SEQ ID NO: 473130 - RNA, 21 nt, Human
ccacugugguugaaggucugg

SEQ ID NO: 473131 - RNA, 21 nt, Human
ccaggccugggaaagccaugc

SEQ ID NO: 473132 - RNA, 18 nt, Human
ccaguggaaccuggaagg

SEQ ID NO: 473133 - RNA, 19 nt, Human
cccacacacugaguccccu

SEQ ID NO: 473134 - RNA, 18 nt, Human
cccacccacccugacggc

SEQ ID NO: 473135 - RNA, 19 nt, Human
cccacccacccugacggcc

SEQ ID NO: 473136 - RNA, 21 nt, Human
cccacccacccugacggccac

SEQ ID NO: 473137 - RNA, 25 nt, Human
cccacccacccugacggccacacca

SEQ ID NO: 473138 - RNA, 21 nt, Human
cccacccucccaccagcuguu

SEQ ID NO: 473139 - RNA, 22 nt, Human
cccaggcacagagcaaagacgc

SEQ ID NO: 473140 - RNA, 21 nt, Human
cccauccuccucuccugggcc

SEQ ID NO: 473141 - RNA, 23 nt, Human
ccccacagacaggggaacuccug

SEQ ID NO: 473142 - RNA, 22 nt, Human
cccccucugaagggaggcacaa

SEQ ID NO: 473143 - RNA, 26 nt, Human
cccugggcuaccaggaugggaacaua

SEQ ID NO: 473144 - RNA, 20 nt, Human
ccgccacccacccacugccc

SEQ ID NO: 473145 - RNA, 22 nt, Human
ccggggacccugggcuaccagg

SEQ ID NO: 473146 - RNA, 21 nt, Human
ccuacagugugcaggacagcu

SEQ ID NO: 473147 - RNA, 20 nt, Human
ccucacauuggcaggcgggc

SEQ ID NO: 473148 - RNA, 18 nt, Human
ccucucugcucguguguc

SEQ ID NO: 473149 - RNA, 20 nt, Human
cgccagggucccggacacag

SEQ ID NO: 473150 - RNA, 18 nt, Human
cgccccucaccugccaag

SEQ ID NO: 473151 - RNA, 22 nt, Human
cgccuacuaacaauaaccccag

SEQ ID NO: 473152 - RNA, 21 nt, Human
cgccuggguccuuggagaggc

SEQ ID NO: 473153 - RNA, 18 nt, Human
cggaaucgccaccaacca

SEQ ID NO: 473154 - RNA, 25 nt, Human
cggcuguguuggccacaccaaacaa

SEQ ID NO: 473155 - RNA, 20 nt, Human
cuagcccgccacccacccac

SEQ ID NO: 473156 - RNA, 19 nt, Human
cuccugggccugcucuggg

SEQ ID NO: 473157 - RNA, 24 nt, Human
cugaagggaggcacaaccccaccc

SEQ ID NO: 473158 - RNA, 19 nt, Human
cugacggccacaccagccu

SEQ ID NO: 473159 - RNA, 24 nt, Human
cugaugcaaagaccacagacucac

SEQ ID NO: 473160 - RNA, 22 nt, Human
cugcaugagcuuccgcaccgug

SEQ ID NO: 473161 - RNA, 21 nt, Human
cugcgccuacuaacaauaacc

SEQ ID NO: 473162 - RNA, 24 nt, Human
cugcgccuacuaacaauaacccca

SEQ ID NO: 473163 - RNA, 19 nt, Human
cuggaggccgauggaggcu

SEQ ID NO: 473164 - RNA, 22 nt, Human
cuggauguuaacagaaaugcca

SEQ ID NO: 473165 - RNA, 23 nt, Human
cugggcagggcccaaggggugcc

SEQ ID NO: 473166 - RNA, 22 nt, Human
cugugguugaaggucuggaggc

SEQ ID NO: 473167 - RNA, 20 nt, Human
cuuuggcgugcuuuuccaca

SEQ ID NO: 473168 - RNA, 20 nt, Human
gacccugggcuaccaggaug

SEQ ID NO: 473169 - RNA, 22 nt, Human
gaggacagcccgccagagacac

SEQ ID NO: 473170 - RNA, 22 nt, Human
gaggcacaaccccacccugcag

SEQ ID NO: 473171 - RNA, 22 nt, Human
gcaccgugauggcucuguaacc

SEQ ID NO: 473172 - RNA, 18 nt, Human
gcccgccccucaccugcc

SEQ ID NO: 473173 - RNA, 18 nt, Human
gcgggcgcugcaggaggc

SEQ ID NO: 473174 - RNA, 20 nt, Human
gcugcagccuggugccagcc

SEQ ID NO: 473175 - RNA, 20 nt, Human
gcuggagaggccaaggccca

SEQ ID NO: 473176 - RNA, 20 nt, Human
gcugggcagggcccaagggg

SEQ ID NO: 473177 - RNA, 21 nt, Human
ggauccacaggaggggagagc

SEQ ID NO: 473178 - RNA, 18 nt, Human
ggcccaccccacccuccc

SEQ ID NO: 473179 - RNA, 20 nt, Human
ggccugcucuggggucugug

SEQ ID NO: 473180 - RNA, 18 nt, Human
ggcugugggguugggagc

SEQ ID NO: 473181 - RNA, 22 nt, Human
gggcugggauuggggaggcugc

SEQ ID NO: 473182 - RNA, 20 nt, Human
gggucuguguguucuggggu

SEQ ID NO: 473183 - RNA, 21 nt, Human
ggguggaggccagggauaccu

SEQ ID NO: 473184 - RNA, 20 nt, Human
gucucuagcccgccacccac

SEQ ID NO: 473185 - RNA, 19 nt, Human
guggacucuucuuaaggag

SEQ ID NO: 473186 - RNA, 23 nt, Human
gugucugacauggagugaccaag

SEQ ID NO: 473187 - RNA, 24 nt, Human
uaacaauaaccccacccacccuga

SEQ ID NO: 473188 - RNA, 24 nt, Human
uaacaauaaccccacccacccuga

SEQ ID NO: 473189 - RNA, 25 nt, Human
uaacaauaaccccacccacccugac

SEQ ID NO: 473190 - RNA, 22 nt, Human
uaacccugauugaugagaugau

SEQ ID NO: 473191 - RNA, 21 nt, Human
ucaaaccccacagacagggga

SEQ ID NO: 473192 - RNA, 23 nt, Human
ucacagaagcuggagguguggcc

SEQ ID NO: 473193 - RNA, 21 nt, Human
ucaggcaacgaaaagggaggu

SEQ ID NO: 473194 - RNA, 22 nt, Human
ucagggcagauggcgacucaug

SEQ ID NO: 473195 - RNA, 19 nt, Human
ucccggggacccugggcua

SEQ ID NO: 473196 - RNA, 23 nt, Human
ucccggggacccugggcuaccag

SEQ ID NO: 473197 - RNA, 18 nt, Human
uccugggcacagaggccc

SEQ ID NO: 473198 - RNA, 21 nt, Human
uccugggcacagaggcccgcc

SEQ ID NO: 473199 - RNA, 20 nt, Human
ucguggugggaaugaggcuc

SEQ ID NO: 473200 - RNA, 19 nt, Human
ucuccugggccugcucugg

SEQ ID NO: 473201 - RNA, 19 nt, Human
ucugacauggagugaccaa

SEQ ID NO: 473202 - RNA, 18 nt, Human
ucuguaacccugauugau

SEQ ID NO: 473203 - RNA, 20 nt, Human
ugaagggaggcacaacccca

SEQ ID NO: 473204 - RNA, 21 nt, Human
ugaagggaggcacaaccccac

SEQ ID NO: 473205 - RNA, 24 nt, Human
ugaccaagucccacacacugaguc

SEQ ID NO: 473206 - RNA, 18 nt, Human
ugagucagggcagauggc

SEQ ID NO: 473207 - RNA, 20 nt, Human
ugagucagggcagauggcga

SEQ ID NO: 473208 - RNA, 20 nt, Human
ugaugcaaagaccacagacu

SEQ ID NO: 473209 - RNA, 18 nt, Human
ugccaaggccccggcugu

SEQ ID NO: 473210 - RNA, 19 nt, Human
ugccaaggccccggcugug

SEQ ID NO: 473211 - RNA, 23 nt, Human
ugcccugggggucucugucaggc

SEQ ID NO: 473212 - RNA, 18 nt, Human
ugcggagggauccacagg

SEQ ID NO: 473213 - RNA, 21 nt, Human
uggaaccuggaaggcagcccc

SEQ ID NO: 473214 - RNA, 18 nt, Human
uggaaggcagccccaucc

SEQ ID NO: 473215 - RNA, 19 nt, Human
uggcaggcgggcgcugcag

SEQ ID NO: 473216 - RNA, 19 nt, Human
uggcagguggggaaacuga

SEQ ID NO: 473217 - RNA, 19 nt, Human
uggcccaggcacagagcaa

SEQ ID NO: 473218 - RNA, 21 nt, Human
uggccucaaaccccacagaca

SEQ ID NO: 473219 - RNA, 22 nt, Human
ugggauuggggaggcugcagcc

SEQ ID NO: 473220 - RNA, 20 nt, Human
ugggcugggauuggggaggc

SEQ ID NO: 473221 - RNA, 21 nt, Human
ugggcugggauuggggaggcu

SEQ ID NO: 473222 - RNA, 24 nt, Human
uggggcccgcccccgaggaaggug

SEQ ID NO: 473223 - RNA, 23 nt, Human
uggugccagccucacauuggcag

SEQ ID NO: 473224 - RNA, 18 nt, Human
uggugggaaugaggcugc

SEQ ID NO: 473225 - RNA, 19 nt, Human
uguggcccaggcacagagc

SEQ ID NO: 473226 - RNA, 24 nt, Human
uguggcccaggcacagagcaaaga

SEQ ID NO: 473227 - RNA, 18 nt, Human
uuuuuuuuuuuuuuuuug

SEQ ID NO: 473228 - RNA, 21 nt, Human
aacccgcuccgcaggccccug

SEQ ID NO: 473229 - RNA, 21 nt, Human
aacuaucguuucccccgcccc

SEQ ID NO: 473230 - RNA, 23 nt, Human
acaccaggacugugccaccacac

SEQ ID NO: 473231 - RNA, 24 nt, Human
acccugcacaaccuccuuccuccu

SEQ ID NO: 473232 - RNA, 27 nt, Human
agaaaugcuacccucauaauugccucc

SEQ ID NO: 473233 - RNA, 22 nt, Human
agaacuaucguuucccccgccc

SEQ ID NO: 473234 - RNA, 27 nt, Human
agacggcgcuggcaccgcgccggcgcg

SEQ ID NO: 473235 - RNA, 20 nt, Human
agcuccgcccucccgacagc

SEQ ID NO: 473236 - RNA, 24 nt, Human
agcuccgcccucccgacagcucca

SEQ ID NO: 473237 - RNA, 23 nt, Human
aggccccugaaccgaaagagggc

SEQ ID NO: 473238 - RNA, 18 nt, Human
agggaagugccugacauu

SEQ ID NO: 473239 - RNA, 18 nt, Human
agggcggggccgggcaga

SEQ ID NO: 473240 - RNA, 26 nt, Human
aucccacccccaccccuacucggcca

SEQ ID NO: 473241 - RNA, 18 nt, Human
aucccgggcccgcagcuc

SEQ ID NO: 473242 - RNA, 21 nt, Human
cacagucauauuugggugguc

SEQ ID NO: 473243 - RNA, 24 nt, Human
caccaggacugugccaccacaccu

SEQ ID NO: 473244 - RNA, 21 nt, Human
caccugucccucuggagucca

SEQ ID NO: 473245 - RNA, 20 nt, Human
cagguccagacccugcacaa

SEQ ID NO: 473246 - RNA, 24 nt, Human
ccacaccaggacugugccaccaca

SEQ ID NO: 473247 - RNA, 21 nt, Human
ccacccacucucccaugacug

SEQ ID NO: 473248 - RNA, 19 nt, Human
ccagacccugcacaaccuc

SEQ ID NO: 473249 - RNA, 19 nt, Human
ccauccacccuccagcugc

SEQ ID NO: 473250 - RNA, 22 nt, Human
cccacccacucucccaugaccu

SEQ ID NO: 473251 - RNA, 23 nt, Human
ccccaacccgcuccgcaggcccc

SEQ ID NO: 473252 - RNA, 29 nt, Human
ccccauccacccuccagcugcucuuccaa

SEQ ID NO: 473253 - RNA, 27 nt, Human
cccccgccccaacccgcuccgcaggcc

SEQ ID NO: 473254 - RNA, 22 nt, Human
cccccggggcuggagggcgugg

SEQ ID NO: 473255 - RNA, 18 nt, Human
ccccggggcuggagggcg

SEQ ID NO: 473256 - RNA, 23 nt, Human
ccccugaaccgaaagagggcggg

SEQ ID NO: 473257 - RNA, 21 nt, Human
ccgagucaauagcagagcugg

SEQ ID NO: 473258 - RNA, 21 nt, Human
ccgcccucccgacagcuccag

SEQ ID NO: 473259 - RNA, 18 nt, Human
ccgccgcgaucccgggcc

SEQ ID NO: 473260 - RNA, 21 nt, Human
ccucagggcucucaggcaggu

SEQ ID NO: 473261 - RNA, 24 nt, Human
ccucagggcucucaggcagguggg

SEQ ID NO: 473262 - RNA, 21 nt, Human
ccuccugccaucccaccccca

SEQ ID NO: 473263 - RNA, 18 nt, Human
ccuccugcggcuccuccu

SEQ ID NO: 473264 - RNA, 24 nt, Human
ccucuggaguccacuuccagucac

SEQ ID NO: 473265 - RNA, 21 nt, Human
ccugccaucccacccccaccc

SEQ ID NO: 473266 - RNA, 22 nt, Human
ccugucccucuggaguccacuu

SEQ ID NO: 473267 - RNA, 21 nt, Human
cgaaagaaaugcuacccucau

SEQ ID NO: 473268 - RNA, 18 nt, Human
cggcgcuggcaccgcgcc

SEQ ID NO: 473269 - RNA, 25 nt, Human
cggcuccuccugccaucccaccccc

SEQ ID NO: 473270 - RNA, 27 nt, Human
cggggccgggcagacggcgcuggcacc

SEQ ID NO: 473271 - RNA, 19 nt, Human
cucaggcagguggggcugu

SEQ ID NO: 473272 - RNA, 18 nt, Human
cuccagccccguccagcc

SEQ ID NO: 473273 - RNA, 24 nt, Human
cuccccauccacccuccagcugcu

SEQ ID NO: 473274 - RNA, 21 nt, Human
cugccuggcucccgguugggg

SEQ ID NO: 473275 - RNA, 18 nt, Human
cugcggcuccuccugcca

SEQ ID NO: 473276 - RNA, 20 nt, Human
cuucagcccugcagguccag

SEQ ID NO: 473277 - RNA, 21 nt, Human
cuugcaaaccucuucucuuac

SEQ ID NO: 473278 - RNA, 24 nt, Human
cuugcaaaccucuucucuuacccu

SEQ ID NO: 473279 - RNA, 18 nt, Human
gaaagaaaugcuacccuc

SEQ ID NO: 473280 - RNA, 18 nt, Human
gagucaauagcagagcug

SEQ ID NO: 473281 - RNA, 20 nt, Human
gcagucagcggaccagugcc

SEQ ID NO: 473282 - RNA, 23 nt, Human
gccaccacaccugucccucugga

SEQ ID NO: 473283 - RNA, 20 nt, Human
gcccucccgacagcuccagc

SEQ ID NO: 473284 - RNA, 19 nt, Human
gcccuguagcuccgcccuc

SEQ ID NO: 473285 - RNA, 20 nt, Human
gcccuguagcuccgcccucc

SEQ ID NO: 473286 - RNA, 22 nt, Human
gccgcgaucccgggcccgcagc

SEQ ID NO: 473287 - RNA, 18 nt, Human
gccuccccauccacccuc

SEQ ID NO: 473288 - RNA, 24 nt, Human
gcuccgcaggccccugaaccgaaa

SEQ ID NO: 473289 - RNA, 22 nt, Human
gcuccgcccucccgacagcucc

SEQ ID NO: 473290 - RNA, 23 nt, Human
gcugaccuuggggccuucccaga

SEQ ID NO: 473291 - RNA, 23 nt, Human
ggcgggucccuucagccuggcag

SEQ ID NO: 473292 - RNA, 19 nt, Human
gguggggcuguugcaugcc

SEQ ID NO: 473293 - RNA, 19 nt, Human
gucuugcaaaccucuucuc

SEQ ID NO: 473294 - RNA, 20 nt, Human
guggucagcaccacaccagg

SEQ ID NO: 473295 - RNA, 20 nt, Human
uacccucauaauugccucca

SEQ ID NO: 473296 - RNA, 20 nt, Human
uaggaaacugaggcccauga

SEQ ID NO: 473297 - RNA, 20 nt, Human
ucagaccaggacucuucugu

SEQ ID NO: 473298 - RNA, 23 nt, Human
uccacaauucacagucauauuug

SEQ ID NO: 473299 - RNA, 19 nt, Human
ucccaugaccuuaucuccc

SEQ ID NO: 473300 - RNA, 25 nt, Human
ucccaugaccuuaucucccccgggg

SEQ ID NO: 473301 - RNA, 27 nt, Human
ucccccgccccaacccgcuccgcaggc

SEQ ID NO: 473302 - RNA, 19 nt, Human
ucccccggggcuggagggc

SEQ ID NO: 473303 - RNA, 20 nt, Human
ucccucuggccuccccaucc

SEQ ID NO: 473304 - RNA, 19 nt, Human
uccgcaggccccugaaccg

SEQ ID NO: 473305 - RNA, 21 nt, Human
uccgcaggccccugaaccgaa

SEQ ID NO: 473306 - RNA, 21 nt, Human
ugagugaacuucagcccugca

SEQ ID NO: 473307 - RNA, 22 nt, Human
ugccaccacaccugucccucug

SEQ ID NO: 473308 - RNA, 26 nt, Human
ugccccuugccgggcugcgcgcucug

SEQ ID NO: 473309 - RNA, 19 nt, Human
ugcuacccucauaauugcc

SEQ ID NO: 473310 - RNA, 22 nt, Human
uggcagucagcggaccagugcc

SEQ ID NO: 473311 - RNA, 25 nt, Human
uggcugggguggggugcaagugggg

SEQ ID NO: 473312 - RNA, 20 nt, Human
ugggguccuucauaagcuga

SEQ ID NO: 473313 - RNA, 23 nt, Human
ugggguggggugcaagugggguc

SEQ ID NO: 473314 - RNA, 23 nt, Human
ugucucgaaagaaaugcuacccu

SEQ ID NO: 473315 - RNA, 18 nt, Human
uugcucccucuggccucc

SEQ ID NO: 473316 - RNA, 18 nt, Human
uuucccccgccccaaccc

SEQ ID NO: 473317 - RNA, 24 nt, Human
aaaaaaaaacacuggguuagaggg

SEQ ID NO: 473318 - RNA, 19 nt, Human
aaaaugcugguuguauccc

SEQ ID NO: 473319 - RNA, 18 nt, Human
aaacauagcuucuucuaa

SEQ ID NO: 473320 - RNA, 20 nt, Human
aaagcaauaaaaauaaaaac

SEQ ID NO: 473321 - RNA, 23 nt, Human
aaauacccaauucugccuagaac

SEQ ID NO: 473322 - RNA, 20 nt, Human
aacauguacacaacaacaac

SEQ ID NO: 473323 - RNA, 18 nt, Human
acaaagcaauaaaaauaa

SEQ ID NO: 473324 - RNA, 22 nt, Human
acaaagcaauaaaaauaaaaac

SEQ ID NO: 473325 - RNA, 23 nt, Human
acaacaacaaaaaaaaacacugg

SEQ ID NO: 473326 - RNA, 23 nt, Human
acaaggacuaaaaagagaauaau

SEQ ID NO: 473327 - RNA, 21 nt, Human
acacgugaaaguuucauaaaa

SEQ ID NO: 473328 - RNA, 22 nt, Human
acccaauacccaacagggugcc

SEQ ID NO: 473329 - RNA, 22 nt, Human
acccaauacccaacagggugcc

SEQ ID NO: 473330 - RNA, 23 nt, Human
agguaaccacaaaaauacaaagc

SEQ ID NO: 473331 - RNA, 27 nt, Human
auaacauguacacaacaacaacaaaaa

SEQ ID NO: 473332 - RNA, 25 nt, Human
aucccucucuucccuucccacccaa

SEQ ID NO: 473333 - RNA, 19 nt, Human
caaaaaaaaacacuggguu

SEQ ID NO: 473334 - RNA, 24 nt, Human
caaaaaaaaacacuggguuagagg

SEQ ID NO: 473335 - RNA, 20 nt, Human
caacagcuccaaccgaucag

SEQ ID NO: 473336 - RNA, 25 nt, Human
cagcgaguaucagcaacugagacuu

SEQ ID NO: 473337 - RNA, 21 nt, Human
cauccuugucucacaaggacu

SEQ ID NO: 473338 - RNA, 19 nt, Human
caugacccugaaagagaaa

SEQ ID NO: 473339 - RNA, 23 nt, Human
ccaauacccaacagggugccaag

SEQ ID NO: 473340 - RNA, 23 nt, Human
ccaauacccaacagggugccaag

SEQ ID NO: 473341 - RNA, 24 nt, Human
cccaauucugccuagaacaugacu

SEQ ID NO: 473342 - RNA, 18 nt, Human
cccucucuucccuuccca

SEQ ID NO: 473343 - RNA, 18 nt, Human
ccugugccuuaaaccaga

SEQ ID NO: 473344 - RNA, 24 nt, Human
cuaaaaagagaauaauguucucau

SEQ ID NO: 473345 - RNA, 19 nt, Human
cucuaccuacuuacugccu

SEQ ID NO: 473346 - RNA, 19 nt, Human
cugaagccugagguucccu

SEQ ID NO: 473347 - RNA, 21 nt, Human
cugagacuucauccuugucuc

SEQ ID NO: 473348 - RNA, 22 nt, Human
cugguacuuuugcauccacacu

SEQ ID NO: 473349 - RNA, 23 nt, Human
cuucccuucccacccaaacauag

SEQ ID NO: 473350 - RNA, 22 nt, Human
gaaaagaaacugaggcugggca

SEQ ID NO: 473351 - RNA, 23 nt, Human
gagacuucauccuugucucacaa

SEQ ID NO: 473352 - RNA, 26 nt, Human
gcuguauucuauuucauuuuuuaaaa

SEQ ID NO: 473353 - RNA, 18 nt, Human
gguucaaugccacaccca

SEQ ID NO: 473354 - RNA, 20 nt, Human
gguuguaucccauuaaacug

SEQ ID NO: 473355 - RNA, 19 nt, Human
guaagugguuacgccuccc

SEQ ID NO: 473356 - RNA, 33 nt, Human
gucacaaucugggagaagccuguccucaauuuu

SEQ ID NO: 473357 - RNA, 19 nt, Human
uaaaagcuagcuccuggua

SEQ ID NO: 473358 - RNA, 22 nt, Human
uacaaagcaauaaaaauaaaaa

SEQ ID NO: 473359 - RNA, 24 nt, Human
uacacaacaacaacaaaaaaaaac

SEQ ID NO: 473360 - RNA, 22 nt, Human
uacccaacagggugccaaguac

SEQ ID NO: 473361 - RNA, 25 nt, Human
uagaaaucaacucaguuuguuuagc

SEQ ID NO: 473362 - RNA, 21 nt, Human
uauguuuguugauuggaguuu

SEQ ID NO: 473363 - RNA, 23 nt, Human
uauguuuguugauuggaguuuac

SEQ ID NO: 473364 - RNA, 25 nt, Human
uauuuucuuaucccucucuucccuu

SEQ ID NO: 473365 - RNA, 21 nt, Human
ucacaaggacuaaaaagagaa

SEQ ID NO: 473366 - RNA, 19 nt, Human
ucacaaucugggagaagcc

SEQ ID NO: 473367 - RNA, 18 nt, Human
ucccugcaggaagggcuc

SEQ ID NO: 473368 - RNA, 21 nt, Human
ucccugcaggaagggcucuug

SEQ ID NO: 473369 - RNA, 21 nt, Human
ucucuucccuucccacccaaa

SEQ ID NO: 473370 - RNA, 24 nt, Human
ugaaagagaaauauauuugacauc

SEQ ID NO: 473371 - RNA, 18 nt, Human
ugacacgaucacauacca

SEQ ID NO: 473372 - RNA, 19 nt, Human
ugagguucccugcaggaag

SEQ ID NO: 473373 - RNA, 20 nt, Human
ugcaggaagggcucuugugg

SEQ ID NO: 473374 - RNA, 22 nt, Human
ugccaaggaacacaaaaggcac

SEQ ID NO: 473375 - RNA, 18 nt, Human
ugccaaguacccaauacc

SEQ ID NO: 473376 - RNA, 22 nt, Human
ugcugguuguaucccauuaaac

SEQ ID NO: 473377 - RNA, 25 nt, Human
uuacaaggaagaaagguauuuucuu

SEQ ID NO: 473378 - RNA, 20 nt, Human
uucacaagucacuucaccau

SEQ ID NO: 473379 - RNA, 21 nt, Human
uucccugcaggaagggcucug

SEQ ID NO: 473380 - RNA, 22 nt, Human
uucccugcaggaagggcucuug

SEQ ID NO: 473381 - RNA, 25 nt, Human
uucccugcaggaagggcucuugugg

SEQ ID NO: 473382 - RNA, 23 nt, Human
uuccggccuguaagugguuacgc

SEQ ID NO: 473383 - RNA, 20 nt, Human
uugacaucaaaacucagcac

SEQ ID NO: 473384 - RNA, 20 nt, Human
uuuuuuaaaaugcugguugu

SEQ ID NO: 473385 - RNA, 20 nt, Human
uuuuuugaucaugacccuga

SEQ ID NO: 473386 - RNA, 22 nt, Human
acacccacacaggacccucugg

SEQ ID NO: 473387 - RNA, 21 nt, Human
aggcaaggaaaggccugcagg

SEQ ID NO: 473388 - RNA, 18 nt, Human
aggcagggaggggagccc

SEQ ID NO: 473389 - RNA, 22 nt, Human
aggcagggaggggagcccuggc

SEQ ID NO: 473390 - RNA, 21 nt, Human
aguggaguggacgggagccca

SEQ ID NO: 473391 - RNA, 20 nt, Human
augggacuuggagggaguuu

SEQ ID NO: 473392 - RNA, 19 nt, Human
cagcaguccagacuagcac

SEQ ID NO: 473393 - RNA, 20 nt, Human
cagccggauggacccccaca

SEQ ID NO: 473394 - RNA, 23 nt, Human
cagccggggucccucugaggccc

SEQ ID NO: 473395 - RNA, 23 nt, Human
ccagccggauggacccccacagg

SEQ ID NO: 473396 - RNA, 22 nt, Human
cccacacaggacccucuggggu

SEQ ID NO: 473397 - RNA, 18 nt, Human
ccccuggggcuccuccuc

SEQ ID NO: 473398 - RNA, 20 nt, Human
ccccuggggcuccuccuccc

SEQ ID NO: 473399 - RNA, 21 nt, Human
ccccuggggcuccuccucccc

SEQ ID NO: 473400 - RNA, 21 nt, Human
ccgcugccgccaucccucguc

SEQ ID NO: 473401 - RNA, 27 nt, Human
ccguuuugccgccuccgccucgcccuc

SEQ ID NO: 473402 - RNA, 19 nt, Human
ccuccgccucgcccucccc

SEQ ID NO: 473403 - RNA, 20 nt, Human
ccuccgccucgcccucccca

SEQ ID NO: 473404 - RNA, 20 nt, Human
ccucugaggccccaggggcc

SEQ ID NO: 473405 - RNA, 23 nt, Human
ccucugaggccccaggggcccga

SEQ ID NO: 473406 - RNA, 18 nt, Human
cgccucgcccuccccagc

SEQ ID NO: 473407 - RNA, 21 nt, Human
cggauggacccccacaggguc

SEQ ID NO: 473408 - RNA, 22 nt, Human
cuccacacccacacaggacccu

SEQ ID NO: 473409 - RNA, 18 nt, Human
gacaggcagggaggggag

SEQ ID NO: 473410 - RNA, 20 nt, Human
gcaacagggugaggggcggg

SEQ ID NO: 473411 - RNA, 20 nt, Human
gcaaggaaaggccugcagga

SEQ ID NO: 473412 - RNA, 19 nt, Human
gcagccggggucccucuga

SEQ ID NO: 473413 - RNA, 20 nt, Human
ggaaaggccugcaggaagac

SEQ ID NO: 473414 - RNA, 19 nt, Human
ggacuggaggggacgcggc

SEQ ID NO: 473415 - RNA, 21 nt, Human
ggcagggaggggagcccuggc

SEQ ID NO: 473416 - RNA, 22 nt, Human
ggcagggaggggagcccuggca

SEQ ID NO: 473417 - RNA, 21 nt, Human
gggacaggcagggaggggagc

SEQ ID NO: 473418 - RNA, 24 nt, Human
ggggacaggcagggaggggagccc

SEQ ID NO: 473419 - RNA, 22 nt, Human
gggucccacagaggcaaggaaa

SEQ ID NO: 473420 - RNA, 28 nt, Human
gguggcaacagggugaggggcgggguug

SEQ ID NO: 473421 - RNA, 22 nt, Human
guuuugccgccuccgccucgcc

SEQ ID NO: 473422 - RNA, 19 nt, Human
uagcaccccuggggcuccu

SEQ ID NO: 473423 - RNA, 23 nt, Human
ucaguggcagccggggucccucu

SEQ ID NO: 473424 - RNA, 22 nt, Human
uccagacuagcaccccuggggc

SEQ ID NO: 473425 - RNA, 19 nt, Human
uccagccggauggaccccc

SEQ ID NO: 473426 - RNA, 18 nt, Human
uccccagcgccgcugccg

SEQ ID NO: 473427 - RNA, 20 nt, Human
ucccucugaggccccagggg

SEQ ID NO: 473428 - RNA, 21 nt, Human
ucccucugaggccccaggggc

SEQ ID NO: 473429 - RNA, 22 nt, Human
ucuccagccggauggaccccca

SEQ ID NO: 473430 - RNA, 20 nt, Human
ucugcucgaccgcccguuuu

SEQ ID NO: 473431 - RNA, 18 nt, Human
ucuguauuuccuuuuaca

SEQ ID NO: 473432 - RNA, 18 nt, Human
ugagaggcuuuucuucuc

SEQ ID NO: 473433 - RNA, 21 nt, Human
ugaggccccaggggcccgagu

SEQ ID NO: 473434 - RNA, 18 nt, Human
ugaggugaggacuugggg

SEQ ID NO: 473435 - RNA, 19 nt, Human
ugcccggagcggacuggag

SEQ ID NO: 473436 - RNA, 19 nt, Human
uggcagaaccauaaucuuc

SEQ ID NO: 473437 - RNA, 22 nt, Human
uggggggguuucuguauuuccu

SEQ ID NO: 473438 - RNA, 21 nt, Human
uuagcaugagaggcuuuucuu

SEQ ID NO: 473439 - RNA, 23 nt, Human
uuuuuuuuuuuuggggggguuuc

SEQ ID NO: 473440 - RNA, 19 nt, Human
uuuuuuuuuuuuuuggggg

SEQ ID NO: 473441 - RNA, 20 nt, Human
uuuuuuuuuuuuuuuggggg

SEQ ID NO: 473442 - RNA, 22 nt, Human
uuuuuuuuuuuuuuuuuggggg

SEQ ID NO: 473443 - RNA, 19 nt, Human
aaaaagguguaaaagguca

SEQ ID NO: 473444 - RNA, 19 nt, Human
aaacaauaugaaacugaaa

SEQ ID NO: 473445 - RNA, 22 nt, Human
aaauucuaaaaccacauaacuc

SEQ ID NO: 473446 - RNA, 20 nt, Human
aacaggacugugaacuugga

SEQ ID NO: 473447 - RNA, 21 nt, Human
accaagcguaucccaguuuca

SEQ ID NO: 473448 - RNA, 19 nt, Human
acccacaccauggagauaa

SEQ ID NO: 473449 - RNA, 24 nt, Human
agauaaaaaagaaauaagguuaaa

SEQ ID NO: 473450 - RNA, 19 nt, Human
agcccccacccauggacag

SEQ ID NO: 473451 - RNA, 18 nt, Human
aggcggaagagagacuga

SEQ ID NO: 473452 - RNA, 25 nt, Human
agguagggugggguguaaaaccaug

SEQ ID NO: 473453 - RNA, 23 nt, Human
auacaguaaaggagggaaggaag

SEQ ID NO: 473454 - RNA, 19 nt, Human
cagaugcuuuaaaaaaaaa

SEQ ID NO: 473455 - RNA, 21 nt, Human
cagcaguauccuuaugagaac

SEQ ID NO: 473456 - RNA, 21 nt, Human
caggcuaacacacagccccca

SEQ ID NO: 473457 - RNA, 21 nt, Human
cauuucugaugaaaauucugg

SEQ ID NO: 473458 - RNA, 18 nt, Human
cccacccacaccauggag

SEQ ID NO: 473459 - RNA, 18 nt, Human
cccccacccauggacagc

SEQ ID NO: 473460 - RNA, 24 nt, Human
cuaacacacagcccccacccaugg

SEQ ID NO: 473461 - RNA, 22 nt, Human
cuaacuggaaacaaaacacuua

SEQ ID NO: 473462 - RNA, 24 nt, Human
cuccucgacaacaacaggacugug

SEQ ID NO: 473463 - RNA, 18 nt, Human
cugguauucuuuaaaaug

SEQ ID NO: 473464 - RNA, 20 nt, Human
cuucuaaauucuaaaaccac

SEQ ID NO: 473465 - RNA, 20 nt, Human
cuucucagccuucucccugc

SEQ ID NO: 473466 - RNA, 21 nt, Human
cuuuaaaauguuuucuucuuc

SEQ ID NO: 473467 - RNA, 25 nt, Human
gaaaagacagcgaacagcuaacugg

SEQ ID NO: 473468 - RNA, 20 nt, Human
gaacuuggauuaggauaaua

SEQ ID NO: 473469 - RNA, 23 nt, Human
gacugagaggagacagaaggaaa

SEQ ID NO: 473470 - RNA, 19 nt, Human
guuuaagcccugaaauuac

SEQ ID NO: 473471 - RNA, 22 nt, Human
uaaaacaaaaaagcuaccaagc

SEQ ID NO: 473472 - RNA, 18 nt, Human
uaaaauguuuucuucuuc

SEQ ID NO: 473473 - RNA, 19 nt, Human
uaacuggaaacaaaacacu

SEQ ID NO: 473474 - RNA, 22 nt, Human
uacaguaaaggagggaaggaag

SEQ ID NO: 473475 - RNA, 18 nt, Human
uacuuuguguuaaaacaa

SEQ ID NO: 473476 - RNA, 21 nt, Human
uaugugaacauuauuugcaaa

SEQ ID NO: 473477 - RNA, 20 nt, Human
uauucaucuguuccccuuca

SEQ ID NO: 473478 - RNA, 22 nt, Human
uauuuuccaaggcauuuacaua

SEQ ID NO: 473479 - RNA, 20 nt, Human
ucccugcuuccucuauguuc

SEQ ID NO: 473480 - RNA, 21 nt, Human
ucuggagaaggugcauauuca

SEQ ID NO: 473481 - RNA, 19 nt, Human
ucuuugcuuuuaggcugaa

SEQ ID NO: 473482 - RNA, 21 nt, Human
ugaaaaagguguaaaagguca

SEQ ID NO: 473483 - RNA, 19 nt, Human
ugaagaugaggcuagggca

SEQ ID NO: 473484 - RNA, 20 nt, Human
ugaaggcugaagaugaggcu

SEQ ID NO: 473485 - RNA, 21 nt, Human
ugagaacagaaacaauaugaa

SEQ ID NO: 473486 - RNA, 18 nt, Human
ugagaggagacagaagga

SEQ ID NO: 473487 - RNA, 23 nt, Human
ugagaggagacagaaggaaaugc

SEQ ID NO: 473488 - RNA, 19 nt, Human
uggaaaagacagcgaacag

SEQ ID NO: 473489 - RNA, 19 nt, Human
uguaacugaauaucuacua

SEQ ID NO: 473490 - RNA, 20 nt, Human
uguaacugaauaucuacuau

SEQ ID NO: 473491 - RNA, 22 nt, Human
uuaaaacaaaaaagcuaccaag

SEQ ID NO: 473492 - RNA, 23 nt, Human
uuaaaacaaaaaagcuaccaagc

SEQ ID NO: 473493 - RNA, 23 nt, Human
aaggggguggggcaagccacugg

SEQ ID NO: 473494 - RNA, 23 nt, Human
agcaugcaccacagugguccucc

SEQ ID NO: 473495 - RNA, 21 nt, Human
auaaggggguggggcaagcca

SEQ ID NO: 473496 - RNA, 22 nt, Human
augcaccacagugguccuccuc

SEQ ID NO: 473497 - RNA, 21 nt, Human
caggcuuucacgcugguuagg

SEQ ID NO: 473498 - RNA, 25 nt, Human
cagugguccuccucauucguccucu

SEQ ID NO: 473499 - RNA, 21 nt, Human
ggaaccaaucagcaugcacca

SEQ ID NO: 473500 - RNA, 26 nt, Human
ggacucaggcuuucacgcugguuagg

SEQ ID NO: 473501 - RNA, 20 nt, Human
uaaggggguggggcaagcca

SEQ ID NO: 473502 - RNA, 26 nt, Human
uaucugggaagguccuucugguggga

SEQ ID NO: 473503 - RNA, 18 nt, Human
ugacugugaggagaaggg

SEQ ID NO: 473504 - RNA, 20 nt, Human
ugacugugaggagaaggggu

SEQ ID NO: 473505 - RNA, 19 nt, Human
ugggaagguccuucuggug

SEQ ID NO: 473506 - RNA, 23 nt, Human
ugggacucaggcuuucacgcugg

SEQ ID NO: 473507 - RNA, 25 nt, Human
uuaggugguggcagcagcuuccugg

SEQ ID NO: 473508 - RNA, 21 nt, Human
uucuggugggacucaggcuuu

SEQ ID NO: 473509 - RNA, 22 nt, Human
accccagggcccaggugggagg

SEQ ID NO: 473510 - RNA, 22 nt, Human
acccuucagagcuagaguuuau

SEQ ID NO: 473511 - RNA, 18 nt, Human
accuaaaccccagggccc

SEQ ID NO: 473512 - RNA, 20 nt, Human
acucuaagggagacuuaagg

SEQ ID NO: 473513 - RNA, 23 nt, Human
agaggacauaccuggaccggggc

SEQ ID NO: 473514 - RNA, 20 nt, Human
aucagaauuagcccccagca

SEQ ID NO: 473515 - RNA, 18 nt, Human
augcuguggggaggggcu

SEQ ID NO: 473516 - RNA, 19 nt, Human
cagaggacauaccuggacc

SEQ ID NO: 473517 - RNA, 22 nt, Human
caugcagaggguuggcugguuu

SEQ ID NO: 473518 - RNA, 22 nt, Human
ccacagagccugggguaaaguu

SEQ ID NO: 473519 - RNA, 18 nt, Human
ccaccagggcuugcucac

SEQ ID NO: 473520 - RNA, 20 nt, Human
cccagcaugcuguggggagg

SEQ ID NO: 473521 - RNA, 18 nt, Human
ccccagggcccagguggg

SEQ ID NO: 473522 - RNA, 21 nt, Human
ccugggcagacggcuuugagg

SEQ ID NO: 473523 - RNA, 30 nt, Human
cuguucuaugaggcuuuucaacaguuucaa

SEQ ID NO: 473524 - RNA, 23 nt, Human
cuuugaggguggcagucuggagg

SEQ ID NO: 473525 - RNA, 24 nt, Human
cuuuucaacaguuucacauccagc

SEQ ID NO: 473526 - RNA, 18 nt, Human
gcgcugccaccagggcuu

SEQ ID NO: 473527 - RNA, 18 nt, Human
uaccuggaccaucagcac

SEQ ID NO: 473528 - RNA, 18 nt, Human
uaggagaggaugguaugu

SEQ ID NO: 473529 - RNA, 23 nt, Human
ucagaauuagcccccagcaugcu

SEQ ID NO: 473530 - RNA, 23 nt, Human
ucagaggacauaccuggaccauc

SEQ ID NO: 473531 - RNA, 31 nt, Human
ucagaggacauaccuggaccaucagcacagg

SEQ ID NO: 473532 - RNA, 23 nt, Human
ucaugguggguugguucaugagc

SEQ ID NO: 473533 - RNA, 27 nt, Human
uccacagagccugggguagcggaccgc

SEQ ID NO: 473534 - RNA, 18 nt, Human
uccuucugaucagcagaa

SEQ ID NO: 473535 - RNA, 21 nt, Human
ugacuucuagaccuaaacccc

SEQ ID NO: 473536 - RNA, 23 nt, Human
ugagcagccuccuguucuaugag

SEQ ID NO: 473537 - RNA, 21 nt, Human
ugcagaaagaugacaucagaa

SEQ ID NO: 473538 - RNA, 22 nt, Human
ugggcagacggcuuugagggug

SEQ ID NO: 473539 - RNA, 21 nt, Human
uggggccugggcagacggcuu

SEQ ID NO: 473540 - RNA, 22 nt, Human
uggguugguucaugagcagccu

SEQ ID NO: 473541 - RNA, 18 nt, Human
ugguauguccacagagcc

SEQ ID NO: 473542 - RNA, 21 nt, Human
ugguauguccacagagccugg

SEQ ID NO: 473543 - RNA, 20 nt, Human
uguggacuuuccuucugauc

SEQ ID NO: 473544 - RNA, 20 nt, Human
uguggggaggggcugcacug

SEQ ID NO: 473545 - RNA, 20 nt, Human
uuucugcagaaagaugacaa

SEQ ID NO: 473546 - RNA, 21 nt, Human
aaaaccccaauguaugaaaca

SEQ ID NO: 473547 - RNA, 18 nt, Human
aaacaauaauugacucua

SEQ ID NO: 473548 - RNA, 24 nt, Human
aagacagaaaacccuuccccaggg

SEQ ID NO: 473549 - RNA, 19 nt, Human
accacgccccccccccccc

SEQ ID NO: 473550 - RNA, 20 nt, Human
accacgccccccccccccca

SEQ ID NO: 473551 - RNA, 19 nt, Human
accccaauguaugaaacaa

SEQ ID NO: 473552 - RNA, 24 nt, Human
acuggccucuggcuacuucugggg

SEQ ID NO: 473553 - RNA, 19 nt, Human
agaaggugcugaauguucc

SEQ ID NO: 473554 - RNA, 21 nt, Human
agacagaaaacccuuccccag

SEQ ID NO: 473555 - RNA, 19 nt, Human
agagguagcauagcuggga

SEQ ID NO: 473556 - RNA, 19 nt, Human
auaagacagaaaacccuuc

SEQ ID NO: 473557 - RNA, 22 nt, Human
auguucaaacuggccucuggcu

SEQ ID NO: 473558 - RNA, 22 nt, Human
cacacagcugggggcauguagc

SEQ ID NO: 473559 - RNA, 20 nt, Human
caccagcaugacugcccauc

SEQ ID NO: 473560 - RNA, 24 nt, Human
cacgcccccccccccccaaugucc

SEQ ID NO: 473561 - RNA, 20 nt, Human
cagcaauauauguucccaaa

SEQ ID NO: 473562 - RNA, 23 nt, Human
cagccucacugccuuccaaucuc

SEQ ID NO: 473563 - RNA, 18 nt, Human
ccccagggcuguaauggg

SEQ ID NO: 473564 - RNA, 25 nt, Human
cccccaaugucccucaagggaguac

SEQ ID NO: 473565 - RNA, 20 nt, Human
cccuauagcugaaaaacucc

SEQ ID NO: 473566 - RNA, 19 nt, Human
cccucugggugaacccugg

SEQ ID NO: 473567 - RNA, 24 nt, Human
ccuauagcugaaaaacuccacaaa

SEQ ID NO: 473568 - RNA, 18 nt, Human
ccucccugcacacagcug

SEQ ID NO: 473569 - RNA, 19 nt, Human
ccucugggugaacccuggg

SEQ ID NO: 473570 - RNA, 22 nt, Human
ccugggaccacgcccccccccc

SEQ ID NO: 473571 - RNA, 23 nt, Human
cgccagaaauaguuacuaaaaca

SEQ ID NO: 473572 - RNA, 24 nt, Human
cgcccccccccccccaaugucccu

SEQ ID NO: 473573 - RNA, 18 nt, Human
cuauuugcaacggucgaa

SEQ ID NO: 473574 - RNA, 23 nt, Human
cucaagggaguacaagagucacc

SEQ ID NO: 473575 - RNA, 27 nt, Human
cugcccauccugcguguccuccuuuca

SEQ ID NO: 473576 - RNA, 22 nt, Human
cuggccucuggcuacuucuggg

SEQ ID NO: 473577 - RNA, 22 nt, Human
gaccacgcccccccccccccaa

SEQ ID NO: 473578 - RNA, 18 nt, Human
gagucaccagcaugacug

SEQ ID NO: 473579 - RNA, 21 nt, Human
gccucacugccuuccaaucuc

SEQ ID NO: 473580 - RNA, 24 nt, Human
gcgacauggugaauauacugucuu

SEQ ID NO: 473581 - RNA, 23 nt, Human
gguuaaauguaagcuuuucccag

SEQ ID NO: 473582 - RNA, 20 nt, Human
gucuauuugcaacggucgaa

SEQ ID NO: 473583 - RNA, 19 nt, Human
uaagacagaaaacccuucc

SEQ ID NO: 473584 - RNA, 24 nt, Human
uacaagagucaccagcaugacugc

SEQ ID NO: 473585 - RNA, 18 nt, Human
uaccuauugaauagaaac

SEQ ID NO: 473586 - RNA, 26 nt, Human
uagaaaaccccaauguaugaaacaag

SEQ ID NO: 473587 - RNA, 22 nt, Human
uagccccuuccccucuggguga

SEQ ID NO: 473588 - RNA, 18 nt, Human
uagcugaaaaacuccaca

SEQ ID NO: 473589 - RNA, 19 nt, Human
uauagaaaaccccaaugua

SEQ ID NO: 473590 - RNA, 19 nt, Human
uaugaaaauggcuacccaa

SEQ ID NO: 473591 - RNA, 21 nt, Human
uauguucccaaacugugagaa

SEQ ID NO: 473592 - RNA, 20 nt, Human
ucaaacuggccucuggcuac

SEQ ID NO: 473593 - RNA, 22 nt, Human
ucaagggaguacaagagucacc

SEQ ID NO: 473594 - RNA, 22 nt, Human
ucacuccauaagacagaaaacc

SEQ ID NO: 473595 - RNA, 20 nt, Human
ucccaaacccagggacaacu

SEQ ID NO: 473596 - RNA, 22 nt, Human
ucccucaagggaguacaagagu

SEQ ID NO: 473597 - RNA, 23 nt, Human
ugagaaggugcugaauguuccca

SEQ ID NO: 473598 - RNA, 24 nt, Human
ugagaaggugcugaauguucccaa

SEQ ID NO: 473599 - RNA, 24 nt, Human
ugcuaagacucacuccauaagaca

SEQ ID NO: 473600 - RNA, 24 nt, Human
ugggaccacgccccccccccccca

SEQ ID NO: 473601 - RNA, 21 nt, Human
ugggugaacccuggggaaauc

SEQ ID NO: 473602 - RNA, 25 nt, Human
ugguguuggcagcgguagugggcug

SEQ ID NO: 473603 - RNA, 20 nt, Human
uguaaugggcauuuaaguuu

SEQ ID NO: 473604 - RNA, 20 nt, Human
uguccucccugcacacagcu

SEQ ID NO: 473605 - RNA, 25 nt, Human
uuccccuccccuauagcugaaaaac

SEQ ID NO: 473606 - RNA, 22 nt, Human
uuucccagcugaaauauauaga

SEQ ID NO: 473607 - RNA, 21 nt, Human
aaacaccacacuauaaaaagc

SEQ ID NO: 473608 - RNA, 19 nt, Human
aacauuuuaaagagauaca

SEQ ID NO: 473609 - RNA, 18 nt, Human
aagcaagaaaacaagaaa

SEQ ID NO: 473610 - RNA, 21 nt, Human
aagcugguuucuucaucuucu

SEQ ID NO: 473611 - RNA, 23 nt, Human
aagcugguuucuuccgugacaca

SEQ ID NO: 473612 - RNA, 20 nt, Human
acaagcaagaaaacaagaaa

SEQ ID NO: 473613 - RNA, 23 nt, Human
acaagcaagaaaacaagaaaaug

SEQ ID NO: 473614 - RNA, 19 nt, Human
accacacuauaaaaagcua

SEQ ID NO: 473615 - RNA, 21 nt, Human
accagaaaaauauacuaaucc

SEQ ID NO: 473616 - RNA, 23 nt, Human
agagaugccucaggggacccaaa

SEQ ID NO: 473617 - RNA, 19 nt, Human
agcaccagggcggggagga

SEQ ID NO: 473618 - RNA, 22 nt, Human
aggaggcuuccccucucugcac

SEQ ID NO: 473619 - RNA, 25 nt, Human
auacaagcaagaaaacaagaaaaug

SEQ ID NO: 473620 - RNA, 21 nt, Human
auggagauaaugacaagguag

SEQ ID NO: 473621 - RNA, 24 nt, Human
auuagauuuuaaaauacaagcaag

SEQ ID NO: 473622 - RNA, 24 nt, Human
caagguagcuccuagaugcacuga

SEQ ID NO: 473623 - RNA, 24 nt, Human
caauggcuaggguuccugaaauuu

SEQ ID NO: 473624 - RNA, 24 nt, Human
caccacacuauaaaaagcuauuaa

SEQ ID NO: 473625 - RNA, 21 nt, Human
caccagauuccaacauaucaa

SEQ ID NO: 473626 - RNA, 19 nt, Human
caccucgguucccuugagc

SEQ ID NO: 473627 - RNA, 18 nt, Human
cagcccagacagggucag

SEQ ID NO: 473628 - RNA, 23 nt, Human
caggaagggugguccggccuccg

SEQ ID NO: 473629 - RNA, 21 nt, Human
caggacgaguaugugaccugg

SEQ ID NO: 473630 - RNA, 19 nt, Human
caggaggcuuccccucucu

SEQ ID NO: 473631 - RNA, 19 nt, Human
cauuucuucuucugcuguu

SEQ ID NO: 473632 - RNA, 21 nt, Human
cccaaacucguggguacgggg

SEQ ID NO: 473633 - RNA, 18 nt, Human
ccuugagcacaagcuugg

SEQ ID NO: 473634 - RNA, 24 nt, Human
cgccaggaagggugguccggccuc

SEQ ID NO: 473635 - RNA, 25 nt, Human
cucacuccuugauacuuucuuucca

SEQ ID NO: 473636 - RNA, 20 nt, Human
cucgccuaacaauaucaaaa

SEQ ID NO: 473637 - RNA, 21 nt, Human
cuugauacuuucuuuccaucu

SEQ ID NO: 473638 - RNA, 20 nt, Human
gaaaacaagaaaaugaaagc

SEQ ID NO: 473639 - RNA, 23 nt, Human
gaaaagaacugaggaggcucccg

SEQ ID NO: 473640 - RNA, 26 nt, Human
gaaaaugaaagcauaaaaagagcauu

SEQ ID NO: 473641 - RNA, 21 nt, Human
gaaguaaacacucccugacag

SEQ ID NO: 473642 - RNA, 20 nt, Human
gagcagcaccagggcgggga

SEQ ID NO: 473643 - RNA, 22 nt, Human
gagugcguccgaaaagaacuga

SEQ ID NO: 473644 - RNA, 20 nt, Human
gaucauuucuucuucugcug

SEQ ID NO: 473645 - RNA, 18 nt, Human
gccauggcuccgggagac

SEQ ID NO: 473646 - RNA, 19 nt, Human
gccggagcugcaggaccca

SEQ ID NO: 473647 - RNA, 24 nt, Human
gccggcucuccgcaccacggcucc

SEQ ID NO: 473648 - RNA, 21 nt, Human
gcguccgaaaagaacugagga

SEQ ID NO: 473649 - RNA, 21 nt, Human
ggcaaaucaggcagaggccug

SEQ ID NO: 473650 - RNA, 19 nt, Human
gggaggccacgaagccggc

SEQ ID NO: 473651 - RNA, 19 nt, Human
gggauuuguaauuaaaaau

SEQ ID NO: 473652 - RNA, 22 nt, Human
ggggaggaacagaaguguaggc

SEQ ID NO: 473653 - RNA, 18 nt, Human
guccgaaaagaacugagg

SEQ ID NO: 473654 - RNA, 28 nt, Human
uaaaaagagcauguggaacuaccagaaa

SEQ ID NO: 473655 - RNA, 20 nt, Human
uaaaucuuuaaagugacagu

SEQ ID NO: 473656 - RNA, 21 nt, Human
uaagaguacuaggccauggcu

SEQ ID NO: 473657 - RNA, 18 nt, Human
uaccacauuguauaaaca

SEQ ID NO: 473658 - RNA, 18 nt, Human
uaucacggaggccaggag

SEQ ID NO: 473659 - RNA, 23 nt, Human
uauuuaaaaauguuggaccacgu

SEQ ID NO: 473660 - RNA, 24 nt, Human
ucaccaaaguuuguuacuguucac

SEQ ID NO: 473661 - RNA, 18 nt, Human
ucccgccggagcugcagg

SEQ ID NO: 473662 - RNA, 23 nt, Human
ucucuuuuucucuucuuaucuuu

SEQ ID NO: 473663 - RNA, 23 nt, Human
ucuucugcuguuuuacuuuuugc

SEQ ID NO: 473664 - RNA, 19 nt, Human
ugaccuggagcagcaccag

SEQ ID NO: 473665 - RNA, 21 nt, Human
ugacuuaacauuuuaaagaga

SEQ ID NO: 473666 - RNA, 18 nt, Human
uggaccacguguacaugu

SEQ ID NO: 473667 - RNA, 24 nt, Human
uggcuucagcucacuccuugauac

SEQ ID NO: 473668 - RNA, 18 nt, Human
ugggaggccacgaagccg

SEQ ID NO: 473669 - RNA, 19 nt, Human
ugggaggccacgaagccgg

SEQ ID NO: 473670 - RNA, 23 nt, Human
uguaggcgaaguaaacacucccu

SEQ ID NO: 473671 - RNA, 22 nt, Human
uuccagggucguccgcgcagga

SEQ ID NO: 473672 - RNA, 19 nt, Human
acaagaacaauaccaggca

SEQ ID NO: 473673 - RNA, 18 nt, Human
acagggcgcaggagccag

SEQ ID NO: 473674 - RNA, 18 nt, Human
acagggcgcaggagccag

SEQ ID NO: 473675 - RNA, 18 nt, Human
augucccgcccugagcga

SEQ ID NO: 473676 - RNA, 20 nt, Human
caagucccggggcuccgcgg

SEQ ID NO: 473677 - RNA, 23 nt, Human
cacagcccagcgcccagcgcucu

SEQ ID NO: 473678 - RNA, 22 nt, Human
caccagcaacgacaggcaaguc

SEQ ID NO: 473679 - RNA, 18 nt, Human
cacccaugucccgcccug

SEQ ID NO: 473680 - RNA, 24 nt, Human
cacuuggcgggcgcgaagcccagg

SEQ ID NO: 473681 - RNA, 22 nt, Human
cagcgggcuccuagccaagccu

SEQ ID NO: 473682 - RNA, 24 nt, Human
cagcgggcuccuagccaagccuca

SEQ ID NO: 473683 - RNA, 19 nt, Human
cagucgguucugcaaagcu

SEQ ID NO: 473684 - RNA, 19 nt, Human
caguggugauggccgcggc

SEQ ID NO: 473685 - RNA, 26 nt, Human
cauagcagacacccuagcccaguacc

SEQ ID NO: 473686 - RNA, 22 nt, Human
ccaagccucauguucccgcgcc

SEQ ID NO: 473687 - RNA, 18 nt, Human
ccaccagcaacgacaggc

SEQ ID NO: 473688 - RNA, 19 nt, Human
ccaguaccugaggugccag

SEQ ID NO: 473689 - RNA, 21 nt, Human
ccauuggcacauccaguccca

SEQ ID NO: 473690 - RNA, 20 nt, Human
cccagcgcccagcgcucucc

SEQ ID NO: 473691 - RNA, 23 nt, Human
ccccgcagagaccguggguccaa

SEQ ID NO: 473692 - RNA, 19 nt, Human
ccgcgcgccuggcccgcag

SEQ ID NO: 473693 - RNA, 20 nt, Human
ccucaggccucggcgccucg

SEQ ID NO: 473694 - RNA, 24 nt, Human
ccuggcccgcagcgggcuccuagc

SEQ ID NO: 473695 - RNA, 25 nt, Human
cgauggagguggccgccacagggcg

SEQ ID NO: 473696 - RNA, 21 nt, Human
cgggcuggggucucggggcgg

SEQ ID NO: 473697 - RNA, 20 nt, Human
cgguggccccgacggcgccu

SEQ ID NO: 473698 - RNA, 20 nt, Human
cuagcccaguaccugaggug

SEQ ID NO: 473699 - RNA, 22 nt, Human
cuggcccgcagcgggcuccuag

SEQ ID NO: 473700 - RNA, 20 nt, Human
gaggugccaggcaggcccug

SEQ ID NO: 473701 - RNA, 19 nt, Human
gcccaguaccugaggugcc

SEQ ID NO: 473702 - RNA, 23 nt, Human
gggcugggcccacuuggcgggcg

SEQ ID NO: 473703 - RNA, 21 nt, Human
guggugauggccgcggcggcg

SEQ ID NO: 473704 - RNA, 22 nt, Human
uaccaggcauagcagacacccu

SEQ ID NO: 473705 - RNA, 21 nt, Human
uagcagacacccuagcccagu

SEQ ID NO: 473706 - RNA, 21 nt, Human
ucccgcgccccagucggccag

SEQ ID NO: 473707 - RNA, 18 nt, Human
ucuccaugcgagcgucgc

SEQ ID NO: 473708 - RNA, 21 nt, Human
ucugcaaagcucccgccccgc

SEQ ID NO: 473709 - RNA, 20 nt, Human
ugacagcaauggacaagaag

SEQ ID NO: 473710 - RNA, 19 nt, Human
ugagcgacccccagugccc

SEQ ID NO: 473711 - RNA, 19 nt, Human
ugcccacaguggugauggc

SEQ ID NO: 473712 - RNA, 20 nt, Human
ugcccgaagggaaagcaagg

SEQ ID NO: 473713 - RNA, 23 nt, Human
aagauuccccagauugacccucc

SEQ ID NO: 473714 - RNA, 23 nt, Human
accucagucucuuucccccuuug

SEQ ID NO: 473715 - RNA, 22 nt, Human
acgcugcagacagaccagagac

SEQ ID NO: 473716 - RNA, 26 nt, Human
acuaagauuccccagauugacccuuu

SEQ ID NO: 473717 - RNA, 22 nt, Human
agccuauuuaaaaccaguccuc

SEQ ID NO: 473718 - RNA, 21 nt, Human
auaacauuugguuuaaggugg

SEQ ID NO: 473719 - RNA, 27 nt, Human
aucaccuugugcauguacuucuuuaag

SEQ ID NO: 473720 - RNA, 25 nt, Human
auuccaaaauucccuuucucuucca

SEQ ID NO: 473721 - RNA, 19 nt, Human
caaaauucccuuucucuuc

SEQ ID NO: 473722 - RNA, 21 nt, Human
caagaccggguccguuucugg

SEQ ID NO: 473723 - RNA, 20 nt, Human
cacccacuguggcuuccagg

SEQ ID NO: 473724 - RNA, 21 nt, Human
cagcaaggugccucaugacca

SEQ ID NO: 473725 - RNA, 19 nt, Human
cauuaaacuccucgcuucc

SEQ ID NO: 473726 - RNA, 22 nt, Human
ccacaucgcuccccaggggcag

SEQ ID NO: 473727 - RNA, 19 nt, Human
ccagguucuucuucuggcu

SEQ ID NO: 473728 - RNA, 22 nt, Human
cccacaucgcuccccaggggca

SEQ ID NO: 473729 - RNA, 22 nt, Human
ccccagauugacccuccccccc

SEQ ID NO: 473730 - RNA, 22 nt, Human
ccuucugcccacaucgcucccc

SEQ ID NO: 473731 - RNA, 22 nt, Human
cgcuucccgcaagcagacucac

SEQ ID NO: 473732 - RNA, 21 nt, Human
gaaccaacuuuauuuuuccua

SEQ ID NO: 473733 - RNA, 21 nt, Human
gggcuguauggucccaccccc

SEQ ID NO: 473734 - RNA, 23 nt, Human
guggcauuaaacuccucgcuucc

SEQ ID NO: 473735 - RNA, 20 nt, Human
uaaaaaacuaagauucccca

SEQ ID NO: 473736 - RNA, 24 nt, Human
uaaaacauaaaaaacuaagauucc

SEQ ID NO: 473737 - RNA, 22 nt, Human
uaaagccuauuuaaaaccaguc

SEQ ID NO: 473738 - RNA, 20 nt, Human
uaacauuugguuuaaggugg

SEQ ID NO: 473739 - RNA, 24 nt, Human
uaagaaccaacuuuauuuuuccua

SEQ ID NO: 473740 - RNA, 22 nt, Human
uaagauuccccagauugacccu

SEQ ID NO: 473741 - RNA, 20 nt, Human
uccagguucuucuucuggcu

SEQ ID NO: 473742 - RNA, 22 nt, Human
uccccagauugacccucccccc

SEQ ID NO: 473743 - RNA, 20 nt, Human
uccccauccuucugcccaca

SEQ ID NO: 473744 - RNA, 19 nt, Human
uccugggcaguuuggacgg

SEQ ID NO: 473745 - RNA, 18 nt, Human
ucuucugaaccugcuagg

SEQ ID NO: 473746 - RNA, 18 nt, Human
ugacgcugcagacagacc

SEQ ID NO: 473747 - RNA, 23 nt, Human
ugacucaauaaauacuuuacaaa

SEQ ID NO: 473748 - RNA, 20 nt, Human
ugagaaauacucauguggua

SEQ ID NO: 473749 - RNA, 23 nt, Human
ugcccacaucgcuccccaggggc

SEQ ID NO: 473750 - RNA, 18 nt, Human
ugcuacuucuuguuuuua

SEQ ID NO: 473751 - RNA, 19 nt, Human
uggcagcuguccuaaaagu

SEQ ID NO: 473752 - RNA, 18 nt, Human
uggccuggggcuguaugg

SEQ ID NO: 473753 - RNA, 18 nt, Human
uggcuuccaaguuguccc

SEQ ID NO: 473754 - RNA, 20 nt, Human
uggggcuguauggucccacc

SEQ ID NO: 473755 - RNA, 25 nt, Human
uguccccauccuucugcccacaucg

SEQ ID NO: 473756 - RNA, 21 nt, Human
ugugguauauacaaauauaca

SEQ ID NO: 473757 - RNA, 26 nt, Human
uuaaaacauaaaaaacuaagauuccc

SEQ ID NO: 473758 - RNA, 21 nt, Human
uuaucuuuuucccauuuguuu

SEQ ID NO: 473759 - RNA, 27 nt, Human
uuccaaaauucccuuucucuuccacuu

SEQ ID NO: 473760 - RNA, 18 nt, Human
uuccccagauugacccuc

SEQ ID NO: 473761 - RNA, 20 nt, Human
uugguggcauuaaacuccuc

SEQ ID NO: 473762 - RNA, 22 nt, Human
uuuugauauauuuccauugcaa

SEQ ID NO: 473763 - RNA, 25 nt, Human
uuuugcagcucauccagcgcucacc

SEQ ID NO: 473764 - RNA, 27 nt, Human
aaaaacaaaugagagaagccgguaccc

SEQ ID NO: 473765 - RNA, 26 nt, Human
aaagcuacauugaaggaccuagacaa

SEQ ID NO: 473766 - RNA, 19 nt, Human
aaugaaaagcuacauugaa

SEQ ID NO: 473767 - RNA, 27 nt, Human
caucccaugagcaaguacgcaggggac

SEQ ID NO: 473768 - RNA, 23 nt, Human
cuacauugaaggaccuagacaaa

SEQ ID NO: 473769 - RNA, 24 nt, Human
gacgugaacauucuggaaggguga

SEQ ID NO: 473770 - RNA, 21 nt, Human
gcaaugaaaagcuacauugaa

SEQ ID NO: 473771 - RNA, 20 nt, Human
gcccugggugccuggugacc

SEQ ID NO: 473772 - RNA, 20 nt, Human
gccugggggcucugugcgcc

SEQ ID NO: 473773 - RNA, 22 nt, Human
gguaucaaaaacaaaugagaga

SEQ ID NO: 473774 - RNA, 21 nt, Human
uaaagcccugcauagaaauuc

SEQ ID NO: 473775 - RNA, 20 nt, Human
uaucuggauagagaaacacc

SEQ ID NO: 473776 - RNA, 22 nt, Human
uaugcagcaccccugggcagaa

SEQ ID NO: 473777 - RNA, 23 nt, Human
uaugcagcaccccugggcagaac

SEQ ID NO: 473778 - RNA, 22 nt, Human
uccucgggauucaggggagcuc

SEQ ID NO: 473779 - RNA, 22 nt, Human
ugcagcaccccugggcagaacu

SEQ ID NO: 473780 - RNA, 22 nt, Human
uggcauggcccugggugccugg

SEQ ID NO: 473781 - RNA, 26 nt, Human
uuagccaagaaugggugucugccgac

SEQ ID NO: 473782 - RNA, 19 nt, Human
uucccuggcauggcccugg

SEQ ID NO: 473783 - RNA, 22 nt, Human
uugcaacaucccaugagcaagu

SEQ ID NO: 473784 - RNA, 19 nt, Human
aaagacagaugcaaccaua

SEQ ID NO: 473785 - RNA, 18 nt, Human
auggaauguaucuuacau

SEQ ID NO: 473786 - RNA, 18 nt, Human
cagaaaaagcuucaagag

SEQ ID NO: 473787 - RNA, 23 nt, Human
ccgcccagcaucccgggccaggu

SEQ ID NO: 473788 - RNA, 20 nt, Human
cgggccagguauccaaggcc

SEQ ID NO: 473789 - RNA, 19 nt, Human
gaagaugcauauaccuucc

SEQ ID NO: 473790 - RNA, 19 nt, Human
gggccagguauccaaggcc

SEQ ID NO: 473791 - RNA, 22 nt, Human
aaccuuggugcucaggucagaa

SEQ ID NO: 473792 - RNA, 19 nt, Human
aagcacccaagcaggaacu

SEQ ID NO: 473793 - RNA, 18 nt, Human
acaaaggcagcugguuug

SEQ ID NO: 473794 - RNA, 19 nt, Human
acacaggcuucugccuuuc

SEQ ID NO: 473795 - RNA, 21 nt, Human
acauacucaugguauccaaaa

SEQ ID NO: 473796 - RNA, 22 nt, Human
acccaguguagacagugaccuu

SEQ ID NO: 473797 - RNA, 24 nt, Human
acugguacaaaguguacccaguca

SEQ ID NO: 473798 - RNA, 22 nt, Human
agcaggaacugcaugugugugg

SEQ ID NO: 473799 - RNA, 22 nt, Human
aggcaggagaaggcuuggagcu

SEQ ID NO: 473800 - RNA, 25 nt, Human
auggaaaaguguugucagcucaagg

SEQ ID NO: 473801 - RNA, 21 nt, Human
caaaccggagcuaaucccccg

SEQ ID NO: 473802 - RNA, 21 nt, Human
caaagcagauguguacacagc

SEQ ID NO: 473803 - RNA, 18 nt, Human
cagcggacgcgcgcggag

SEQ ID NO: 473804 - RNA, 23 nt, Human
cagcuccagcccugcccgggucc

SEQ ID NO: 473805 - RNA, 19 nt, Human
caggacagacccugccuaa

SEQ ID NO: 473806 - RNA, 23 nt, Human
cagggauaccucccuuucucuga

SEQ ID NO: 473807 - RNA, 24 nt, Human
cagguggccacaggacagacccug

SEQ ID NO: 473808 - RNA, 20 nt, Human
caucucugugagcagggaau

SEQ ID NO: 473809 - RNA, 21 nt, Human
ccagcaccgagaacagggcuu

SEQ ID NO: 473810 - RNA, 22 nt, Human
ccagcccagcuccagcccugcc

SEQ ID NO: 473811 - RNA, 21 nt, Human
ccagggcaccagcaggugggc

SEQ ID NO: 473812 - RNA, 20 nt, Human
cccagcaccgagaacagggc

SEQ ID NO: 473813 - RNA, 27 nt, Human
ccccaaguguccccagaagagucccac

SEQ ID NO: 473814 - RNA, 21 nt, Human
ccccgucguuccgcgugggcc

SEQ ID NO: 473815 - RNA, 23 nt, Human
ccccgucguuccgcgugggcccg

SEQ ID NO: 473816 - RNA, 22 nt, Human
ccgccggggcucagagccucca

SEQ ID NO: 473817 - RNA, 21 nt, Human
ccugagcaccagcaucagugg

SEQ ID NO: 473818 - RNA, 23 nt, Human
cgagaacagggcuuggcaccuga

SEQ ID NO: 473819 - RNA, 20 nt, Human
cucaaccuuggugcucaggu

SEQ ID NO: 473820 - RNA, 18 nt, Human
cucacugcuguacuccca

SEQ ID NO: 473821 - RNA, 18 nt, Human
cuccagcccugcccgggu

SEQ ID NO: 473822 - RNA, 20 nt, Human
cucccagcaccgagaacagg

SEQ ID NO: 473823 - RNA, 20 nt, Human
cucccuuucucugaaaaggu

SEQ ID NO: 473824 - RNA, 21 nt, Human
cuggagccuuuggcacaggga

SEQ ID NO: 473825 - RNA, 23 nt, Human
cuucugccuuucucccuucugga

SEQ ID NO: 473826 - RNA, 23 nt, Human
gaaggcacugaagguuuggcuca

SEQ ID NO: 473827 - RNA, 18 nt, Human
gagcuaaucccccggucc

SEQ ID NO: 473828 - RNA, 20 nt, Human
gcaggaacugcaugugugug

SEQ ID NO: 473829 - RNA, 26 nt, Human
gccccgucguuccgcguggggccgcc

SEQ ID NO: 473830 - RNA, 21 nt, Human
gcgcgcccggcccccgguccg

SEQ ID NO: 473831 - RNA, 22 nt, Human
gcuguacucccagcaccgagaa

SEQ ID NO: 473832 - RNA, 18 nt, Human
ggcacagguaaacauaca

SEQ ID NO: 473833 - RNA, 18 nt, Human
gggaauauugucuccuuu

SEQ ID NO: 473834 - RNA, 19 nt, Human
uacccccaaacucaaucca

SEQ ID NO: 473835 - RNA, 20 nt, Human
uagacaagaacuagccucau

SEQ ID NO: 473836 - RNA, 21 nt, Human
uaucucuggcccaaaucccag

SEQ ID NO: 473837 - RNA, 24 nt, Human
uccacuguuggcagcugagcgugu

SEQ ID NO: 473838 - RNA, 22 nt, Human
ucccagagugagcugggcuugg

SEQ ID NO: 473839 - RNA, 25 nt, Human
ucccagcaccgagaacaggguaccc

SEQ ID NO: 473840 - RNA, 18 nt, Human
uccuuugcucacugcugu

SEQ ID NO: 473841 - RNA, 18 nt, Human
uccuuugcucacugcugu

SEQ ID NO: 473842 - RNA, 18 nt, Human
ucucugugagcagggaau

SEQ ID NO: 473843 - RNA, 24 nt, Human
ucucuuaaucaagaggacagagau

SEQ ID NO: 473844 - RNA, 25 nt, Human
ugaaaagguacaagauacaaaggca

SEQ ID NO: 473845 - RNA, 22 nt, Human
ugaaagggauuguccuuggaca

SEQ ID NO: 473846 - RNA, 22 nt, Human
ugagcugggcuuggguccugag

SEQ ID NO: 473847 - RNA, 20 nt, Human
ugcccggguccuagcagcgg

SEQ ID NO: 473848 - RNA, 22 nt, Human
uggaaaaguguugucagcucaa

SEQ ID NO: 473849 - RNA, 18 nt, Human
uggaccccaagugucccc

SEQ ID NO: 473850 - RNA, 23 nt, Human
uggaccccaaguguccccagaag

SEQ ID NO: 473851 - RNA, 19 nt, Human
uggcaccugauaagcaccc

SEQ ID NO: 473852 - RNA, 23 nt, Human
ugguacaaaguguacccagugua

SEQ ID NO: 473853 - RNA, 21 nt, Human
uggugcucaggucagaagccc

SEQ ID NO: 473854 - RNA, 24 nt, Human
uguguacacagcacacuccacaca

SEQ ID NO: 473855 - RNA, 24 nt, Human
uguuugugaaagggauuguccuug

SEQ ID NO: 473856 - RNA, 23 nt, Human
uuaggcacagguaaacauacaua

SEQ ID NO: 473857 - RNA, 19 nt, Human
uuggcaccugauaagcacc

SEQ ID NO: 473858 - RNA, 24 nt, Human
uuggguccugaguugcaggggaga

SEQ ID NO: 473859 - RNA, 24 nt, Human
uuuggcacagggauaccucccuuu

SEQ ID NO: 473860 - RNA, 21 nt, Human
uuuuuuuuuuuuuuuuuauuu

SEQ ID NO: 473861 - RNA, 21 nt, Human
aaaaugcagguagaagacaca

SEQ ID NO: 473862 - RNA, 22 nt, Human
aaagggagaaguuggggaaaca

SEQ ID NO: 473863 - RNA, 19 nt, Human
aaccaggaaggugaggggc

SEQ ID NO: 473864 - RNA, 22 nt, Human
aacccacuuuuccugcccccua

SEQ ID NO: 473865 - RNA, 22 nt, Human
aacccacuuuuccugcccccua

SEQ ID NO: 473866 - RNA, 18 nt, Human
aaccuguccuccacccug

SEQ ID NO: 473867 - RNA, 23 nt, Human
acaacccacuuuuccugcccccu

SEQ ID NO: 473868 - RNA, 19 nt, Human
acccacuuuuccugccccc

SEQ ID NO: 473869 - RNA, 21 nt, Human
acccugaggacccucagggaa

SEQ ID NO: 473870 - RNA, 21 nt, Human
accucaccuaucaacuagggc

SEQ ID NO: 473871 - RNA, 18 nt, Human
agaaguuggggaaacacu

SEQ ID NO: 473872 - RNA, 23 nt, Human
agacaacccacuuuuccugcccc

SEQ ID NO: 473873 - RNA, 26 nt, Human
agacugaagguaaggguuagggaggg

SEQ ID NO: 473874 - RNA, 18 nt, Human
agagaggcaggagcugau

SEQ ID NO: 473875 - RNA, 20 nt, Human
agauguguuucuaguuccug

SEQ ID NO: 473876 - RNA, 22 nt, Human
agccaccugggaccaucaggcc

SEQ ID NO: 473877 - RNA, 20 nt, Human
agcugaaugacccccacccc

SEQ ID NO: 473878 - RNA, 19 nt, Human
aggaggaggcugaagauga

SEQ ID NO: 473879 - RNA, 20 nt, Human
aggaggcccuucaggcuggu

SEQ ID NO: 473880 - RNA, 24 nt, Human
aggggcuggcgccucugagagagc

SEQ ID NO: 473881 - RNA, 22 nt, Human
agguggacuuugaggggggauc

SEQ ID NO: 473882 - RNA, 20 nt, Human
augaggagggggcgugaggc

SEQ ID NO: 473883 - RNA, 22 nt, Human
caaaaugcagguagaagacaca

SEQ ID NO: 473884 - RNA, 19 nt, Human
caggaggaggcugaagaug

SEQ ID NO: 473885 - RNA, 23 nt, Human
caggaugaggagggggcgugagg

SEQ ID NO: 473886 - RNA, 23 nt, Human
ccaaaguauauccagagccaccu

SEQ ID NO: 473887 - RNA, 19 nt, Human
ccaccuguagcacaagagc

SEQ ID NO: 473888 - RNA, 21 nt, Human
cccauuuauuaucagggucac

SEQ ID NO: 473889 - RNA, 23 nt, Human
ccccaccccuucaucugugucua

SEQ ID NO: 473890 - RNA, 23 nt, Human
ccccugagggccuugggaagagg

SEQ ID NO: 473891 - RNA, 26 nt, Human
cccugagggccuugggaagagggugu

SEQ ID NO: 473892 - RNA, 22 nt, Human
ccucagggaaccaggaagguga

SEQ ID NO: 473893 - RNA, 23 nt, Human
ccucagggaaccaggaaggugag

SEQ ID NO: 473894 - RNA, 18 nt, Human
ccuccagccuucuucacc

SEQ ID NO: 473895 - RNA, 22 nt, Human
ccuccagccuucuucacccacc

SEQ ID NO: 473896 - RNA, 23 nt, Human
ccuccggcuggggagggaggggc

SEQ ID NO: 473897 - RNA, 18 nt, Human
ccugggaccaucaggccu

SEQ ID NO: 473898 - RNA, 21 nt, Human
ccugggaccaucaggccucug

SEQ ID NO: 473899 - RNA, 20 nt, Human
ccuggggagggagcacuggg

SEQ ID NO: 473900 - RNA, 22 nt, Human
cggcuggggagggaggggcugg

SEQ ID NO: 473901 - RNA, 19 nt, Human
cuccacccugaggacccuc

SEQ ID NO: 473902 - RNA, 19 nt, Human
cuggcccaggaggaggcug

SEQ ID NO: 473903 - RNA, 18 nt, Human
gaaggugggauggaaggg

SEQ ID NO: 473904 - RNA, 20 nt, Human
gacacacugcuuccuggagg

SEQ ID NO: 473905 - RNA, 19 nt, Human
gacuugaggaaugcuggua

SEQ ID NO: 473906 - RNA, 18 nt, Human
gagagccuugagcgcugc

SEQ ID NO: 473907 - RNA, 19 nt, Human
gaggaggcugaagaugugu

SEQ ID NO: 473908 - RNA, 25 nt, Human
gcccucauggcagagaggcaggagc

SEQ ID NO: 473909 - RNA, 19 nt, Human
gcgcugcucuccagcugca

SEQ ID NO: 473910 - RNA, 21 nt, Human
ggaagaguuggggccccacuc

SEQ ID NO: 473911 - RNA, 22 nt, Human
ggacaugucaccuccagccuuc

SEQ ID NO: 473912 - RNA, 19 nt, Human
ggagaaguuggggaaacac

SEQ ID NO: 473913 - RNA, 20 nt, Human
ggagacugaagguaaggguu

SEQ ID NO: 473914 - RNA, 18 nt, Human
ggagcugauggcuugaaa

SEQ ID NO: 473915 - RNA, 19 nt, Human
gggaaacacugagaggggg

SEQ ID NO: 473916 - RNA, 23 nt, Human
ggugagaaggggggaaggaucca

SEQ ID NO: 473917 - RNA, 22 nt, Human
guggagacugaagguaaggguu

SEQ ID NO: 473918 - RNA, 24 nt, Human
guugugugaccucggacaugucac

SEQ ID NO: 473919 - RNA, 18 nt, Human
uaaaagggagaaguuggg

SEQ ID NO: 473920 - RNA, 29 nt, Human
uacccccggcucuuagagaccauuuaaau

SEQ ID NO: 473921 - RNA, 19 nt, Human
uagaagacacacugugaga

SEQ ID NO: 473922 - RNA, 23 nt, Human
ucacucauccugcagggaaaggc

SEQ ID NO: 473923 - RNA, 21 nt, Human
uccaccuuucugggucucagu

SEQ ID NO: 473924 - RNA, 19 nt, Human
uccgccccaccuguagcac

SEQ ID NO: 473925 - RNA, 18 nt, Human
uccgccccaccuguagcc

SEQ ID NO: 473926 - RNA, 22 nt, Human
ucuccagcugcaucagagcucc

SEQ ID NO: 473927 - RNA, 23 nt, Human
ugacccccaccccuucaucugug

SEQ ID NO: 473928 - RNA, 21 nt, Human
ugagaaggggggaaggaucca

SEQ ID NO: 473929 - RNA, 18 nt, Human
ugagaggggguuauggug

SEQ ID NO: 473930 - RNA, 21 nt, Human
ugaggacccucagggaaccag

SEQ ID NO: 473931 - RNA, 18 nt, Human
ugagggccuugggaagag

SEQ ID NO: 473932 - RNA, 21 nt, Human
ugcagaggaaggaguggggac

SEQ ID NO: 473933 - RNA, 19 nt, Human
ugcagggaaaggccaagug

SEQ ID NO: 473934 - RNA, 20 nt, Human
ugcaugcugcuuuguugugu

SEQ ID NO: 473935 - RNA, 18 nt, Human
ugcccuggugggggccgc

SEQ ID NO: 473936 - RNA, 18 nt, Human
uggaaggggugcaggaug

SEQ ID NO: 473937 - RNA, 18 nt, Human
uggcccaggaggaggcug

SEQ ID NO: 473938 - RNA, 21 nt, Human
ugggaccaucaggccucuggc

SEQ ID NO: 473939 - RNA, 24 nt, Human
ugggaccaucaggccucuggcuag

SEQ ID NO: 473940 - RNA, 18 nt, Human
ugggauuugagcuccaga

SEQ ID NO: 473941 - RNA, 22 nt, Human
ugggcucuggagccugaccacu

SEQ ID NO: 473942 - RNA, 21 nt, Human
uggggacggguugaaggagau

SEQ ID NO: 473943 - RNA, 22 nt, Human
uggggagggaggggcuggcgcc

SEQ ID NO: 473944 - RNA, 20 nt, Human
uguggguaggaaguuuuggg

SEQ ID NO: 473945 - RNA, 20 nt, Human
uuggggaaacacugagaggg

SEQ ID NO: 473946 - RNA, 18 nt, Human
aaaaugccacaaacuggg

SEQ ID NO: 473947 - RNA, 20 nt, Human
aaacuggguggcuuaaacaa

SEQ ID NO: 473948 - RNA, 19 nt, Human
aaugccacaaacugggugg

SEQ ID NO: 473949 - RNA, 19 nt, Human
augccucucuaggcuucug

SEQ ID NO: 473950 - RNA, 22 nt, Human
caucugaaugcccacacacaga

SEQ ID NO: 473951 - RNA, 22 nt, Human
ccacacucuuaccaguccagaa

SEQ ID NO: 473952 - RNA, 22 nt, Human
ccauagcugguucauucaguag

SEQ ID NO: 473953 - RNA, 22 nt, Human
ccucauauccacaagauggcug

SEQ ID NO: 473954 - RNA, 19 nt, Human
cugaaggcucugagggaga

SEQ ID NO: 473955 - RNA, 25 nt, Human
cugaaugcccacacacagacaauuc

SEQ ID NO: 473956 - RNA, 25 nt, Human
cuggugauuuucugucaaucuuugg

SEQ ID NO: 473957 - RNA, 18 nt, Human
cugguucauucaguagcu

SEQ ID NO: 473958 - RNA, 19 nt, Human
cuguguccacauuuccccu

SEQ ID NO: 473959 - RNA, 20 nt, Human
gaaggcucugagggagaaug

SEQ ID NO: 473960 - RNA, 22 nt, Human
gaccuguguccacauuuccccu

SEQ ID NO: 473961 - RNA, 25 nt, Human
guagucuauuuggcucuucccucau

SEQ ID NO: 473962 - RNA, 18 nt, Human
gugcugcuguaacaaaau

SEQ ID NO: 473963 - RNA, 21 nt, Human
guucuagaggcucaaagucca

SEQ ID NO: 473964 - RNA, 21 nt, Human
uaacaaaaugccacaaacugg

SEQ ID NO: 473965 - RNA, 24 nt, Human
uagcugguucauucaguagcucca

SEQ ID NO: 473966 - RNA, 21 nt, Human
uagucuauuuggcucuucccu

SEQ ID NO: 473967 - RNA, 24 nt, Human
uccaagaugaaggugccagcagga

SEQ ID NO: 473968 - RNA, 24 nt, Human
uccccacacucuuaccaguccaga

SEQ ID NO: 473969 - RNA, 19 nt, Human
ugaaugcccacacacagac

SEQ ID NO: 473970 - RNA, 21 nt, Human
ugaaugcccacacacagacaa

SEQ ID NO: 473971 - RNA, 18 nt, Human
ugcugcaugucuacaguu

SEQ ID NO: 473972 - RNA, 19 nt, Human
ugcuguaacaaaaugccac

SEQ ID NO: 473973 - RNA, 18 nt, Human
uggguggcuuaaacaaca

SEQ ID NO: 473974 - RNA, 18 nt, Human
uucacagacaccagucac

SEQ ID NO: 473975 - RNA, 18 nt, Human
uuuuuuuacugggucaga

SEQ ID NO: 473976 - RNA, 22 nt, Human
aaagaacacugguggaaaauag

SEQ ID NO: 473977 - RNA, 21 nt, Human
aaagauuaaggggaaccagga

SEQ ID NO: 473978 - RNA, 25 nt, Human
aaagccacaucuuacaugacacagg

SEQ ID NO: 473979 - RNA, 21 nt, Human
aaaguccucucaacuuuucuu

SEQ ID NO: 473980 - RNA, 24 nt, Human
aaagugcugggauuauaggcguga

SEQ ID NO: 473981 - RNA, 25 nt, Human
aaauccaccccaccugcucgcugcc

SEQ ID NO: 473982 - RNA, 19 nt, Human
aacagccccaagcaccacc

SEQ ID NO: 473983 - RNA, 23 nt, Human
aacagccccaagcaccaccaaac

SEQ ID NO: 473984 - RNA, 19 nt, Human
aaccuccaccucugcaucc

SEQ ID NO: 473985 - RNA, 24 nt, Human
aaccugcuccccuccaccccccac

SEQ ID NO: 473986 - RNA, 24 nt, Human
aacucugaugcugggcaccuacag

SEQ ID NO: 473987 - RNA, 20 nt, Human
aacugagccaauguacugaa

SEQ ID NO: 473988 - RNA, 21 nt, Human
aagauugcaguggccccucga

SEQ ID NO: 473989 - RNA, 22 nt, Human
aagcaccaccaaacaugccccu

SEQ ID NO: 473990 - RNA, 20 nt, Human
aagcagaggugccuauaacc

SEQ ID NO: 473991 - RNA, 23 nt, Human
aagcccagcgagccucccccugg

SEQ ID NO: 473992 - RNA, 19 nt, Human
aagccguggaaauccaccc

SEQ ID NO: 473993 - RNA, 19 nt, Human
aagugcugggauuauaggc

SEQ ID NO: 473994 - RNA, 19 nt, Human
aagugcugggauuauaggc

SEQ ID NO: 473995 - RNA, 18 nt, Human
aaucaagccaaccuggac

SEQ ID NO: 473996 - RNA, 24 nt, Human
aaugaaaggaaaacacaaaaaccu

SEQ ID NO: 473997 - RNA, 24 nt, Human
aauuacaggugugcgcuaccaugc

SEQ ID NO: 473998 - RNA, 22 nt, Human
acaaaaauagacauuaacaagc

SEQ ID NO: 473999 - RNA, 23 nt, Human
acaaaaccaaggcauugucagca

SEQ ID NO: 474000 - RNA, 18 nt, Human
acacucagauacagcgcu

SEQ ID NO: 474001 - RNA, 23 nt, Human
acagaaacaauucuaaagaacac

SEQ ID NO: 474002 - RNA, 21 nt, Human
acagagcccaagaaagugucu

SEQ ID NO: 474003 - RNA, 20 nt, Human
acaggaacagccccaagcac

SEQ ID NO: 474004 - RNA, 23 nt, Human
accaugccuggcuaauuuuugua

SEQ ID NO: 474005 - RNA, 24 nt, Human
accauguugggaaggcugguuucg

SEQ ID NO: 474006 - RNA, 21 nt, Human
accccccccauccuaaaucaa

SEQ ID NO: 474007 - RNA, 18 nt, Human
agaaacaauucuaaagaa

SEQ ID NO: 474008 - RNA, 23 nt, Human
agacacaaacgcuuccaagccug

SEQ ID NO: 474009 - RNA, 23 nt, Human
agacaggaccucucaauugcaga

SEQ ID NO: 474010 - RNA, 19 nt, Human
agacagugcaagacaauua

SEQ ID NO: 474011 - RNA, 20 nt, Human
agccucccgaguagcuggaa

SEQ ID NO: 474012 - RNA, 18 nt, Human
agcuacaaccccaacuaa

SEQ ID NO: 474013 - RNA, 25 nt, Human
aggaaaacacaaaaaccuuacaaaa

SEQ ID NO: 474014 - RNA, 18 nt, Human
aggaacagccccaagcac

SEQ ID NO: 474015 - RNA, 20 nt, Human
aggaacagccccaagcacca

SEQ ID NO: 474016 - RNA, 21 nt, Human
aggaacagccccaagcaccac

SEQ ID NO: 474017 - RNA, 21 nt, Human
aggaagaaguggccuccaggg

SEQ ID NO: 474018 - RNA, 24 nt, Human
aggagaguuuuaaaggaacagacg

SEQ ID NO: 474019 - RNA, 19 nt, Human
aggagcaagcccagcgagc

SEQ ID NO: 474020 - RNA, 18 nt, Human
aggccuggagccagggau

SEQ ID NO: 474021 - RNA, 24 nt, Human
aggcgagcucaguggagccaggga

SEQ ID NO: 474022 - RNA, 24 nt, Human
aggugauucacccgccuuggccuc

SEQ ID NO: 474023 - RNA, 18 nt, Human
aguagcuggaauuacagg

SEQ ID NO: 474024 - RNA, 20 nt, Human
aguuggcuugggcuauggau

SEQ ID NO: 474025 - RNA, 25 nt, Human
auauacccuuccacaacaucauaca

SEQ ID NO: 474026 - RNA, 21 nt, Human
augaagccguggaaauccacc

SEQ ID NO: 474027 - RNA, 18 nt, Human
augggguuucaccauguu

SEQ ID NO: 474028 - RNA, 19 nt, Human
augggguuucaccauguug

SEQ ID NO: 474029 - RNA, 24 nt, Human
augggguuucaccauguugggaag

SEQ ID NO: 474030 - RNA, 21 nt, Human
augugacaguggaucugggac

SEQ ID NO: 474031 - RNA, 22 nt, Human
auucccuuccuccacacuaagu

SEQ ID NO: 474032 - RNA, 24 nt, Human
caaagugcugggauuauaggcgug

SEQ ID NO: 474033 - RNA, 19 nt, Human
caacaaugaaaggaaaaca

SEQ ID NO: 474034 - RNA, 21 nt, Human
caacuaugaugccugccuccc

SEQ ID NO: 474035 - RNA, 20 nt, Human
caagcaccaccaaacaugcc

SEQ ID NO: 474036 - RNA, 21 nt, Human
caagcaccaccaaacaugccc

SEQ ID NO: 474037 - RNA, 22 nt, Human
caagccccuagagaggaagggg

SEQ ID NO: 474038 - RNA, 18 nt, Human
caaguucaggauagucuc

SEQ ID NO: 474039 - RNA, 24 nt, Human
caccauguugggaaggcugguuuc

SEQ ID NO: 474040 - RNA, 21 nt, Human
caccccccaccccccccaucc

SEQ ID NO: 474041 - RNA, 22 nt, Human
caccccccaccccccccauccu

SEQ ID NO: 474042 - RNA, 23 nt, Human
cacccgccuuggccucccaaagu

SEQ ID NO: 474043 - RNA, 24 nt, Human
cacccgccuuggccucccaaagug

SEQ ID NO: 474044 - RNA, 20 nt, Human
caccuaaaacagaaacaauu

SEQ ID NO: 474045 - RNA, 20 nt, Human
cagaagacccauaugucccc

SEQ ID NO: 474046 - RNA, 23 nt, Human
cagacaaaaccaaggcauuguca

SEQ ID NO: 474047 - RNA, 19 nt, Human
cagagcagaucccaagagc

SEQ ID NO: 474048 - RNA, 24 nt, Human
cagaucccaagagccccaggcaug

SEQ ID NO: 474049 - RNA, 24 nt, Human
cagcaucacacagcaaaucucaga

SEQ ID NO: 474050 - RNA, 25 nt, Human
cagcaugggaagacccgcccccaug

SEQ ID NO: 474051 - RNA, 18 nt, Human
cagccccaagcaccacca

SEQ ID NO: 474052 - RNA, 23 nt, Human
cagcccugaguucaccugguccu

SEQ ID NO: 474053 - RNA, 24 nt, Human
cagccuuucaaagacagagcccaa

SEQ ID NO: 474054 - RNA, 19 nt, Human
caggaaaccccccagcccc

SEQ ID NO: 474055 - RNA, 25 nt, Human
caggaacagccccaagcaccaccaa

SEQ ID NO: 474056 - RNA, 26 nt, Human
cagggaaacuccccuuuauaaaacca

SEQ ID NO: 474057 - RNA, 18 nt, Human
ccaaaccauaucaccaag

SEQ ID NO: 474058 - RNA, 23 nt, Human
ccaaagauaggccuuggagaggu

SEQ ID NO: 474059 - RNA, 22 nt, Human
ccaaagugcugggauuauaggc

SEQ ID NO: 474060 - RNA, 24 nt, Human
ccaaagugcugggauuauaggcgu

SEQ ID NO: 474061 - RNA, 22 nt, Human
ccacauuccuugcaacucugau

SEQ ID NO: 474062 - RNA, 18 nt, Human
ccaccccccacccccccc

SEQ ID NO: 474063 - RNA, 19 nt, Human
ccaccccccacccccccca

SEQ ID NO: 474064 - RNA, 22 nt, Human
ccagacccaccccacucuccuc

SEQ ID NO: 474065 - RNA, 24 nt, Human
ccaggccggguaagcaggaucuau

SEQ ID NO: 474066 - RNA, 22 nt, Human
cccaaaugcugucacagaacac

SEQ ID NO: 474067 - RNA, 19 nt, Human
cccaagaaagugucucccc

SEQ ID NO: 474068 - RNA, 21 nt, Human
cccaccugcucgcugccccuc

SEQ ID NO: 474069 - RNA, 21 nt, Human
cccagcgagccucccccugga

SEQ ID NO: 474070 - RNA, 20 nt, Human
cccagguucaagcgauuccc

SEQ ID NO: 474071 - RNA, 23 nt, Human
cccagguucaagcgauuccccug

SEQ ID NO: 474072 - RNA, 18 nt, Human
ccccaccccccccauccu

SEQ ID NO: 474073 - RNA, 23 nt, Human
ccccaccccccccauccuaaauc

SEQ ID NO: 474074 - RNA, 23 nt, Human
ccccccaccccccccauccuaaa

SEQ ID NO: 474075 - RNA, 23 nt, Human
cccgaguagcuggaauuacaggu

SEQ ID NO: 474076 - RNA, 19 nt, Human
cccgccggcucccccagau

SEQ ID NO: 474077 - RNA, 20 nt, Human
cccuccaccccccacccccc

SEQ ID NO: 474078 - RNA, 24 nt, Human
cccuccaccccccaccccccccau

SEQ ID NO: 474079 - RNA, 18 nt, Human
cccugaguucaccugguc

SEQ ID NO: 474080 - RNA, 20 nt, Human
cccuggcaaccucacaggcu

SEQ ID NO: 474081 - RNA, 24 nt, Human
ccgaguagcuggaauuacaggugu

SEQ ID NO: 474082 - RNA, 19 nt, Human
ccucaaccuccaccucugc

SEQ ID NO: 474083 - RNA, 22 nt, Human
ccucaaccuccaccucugcauc

SEQ ID NO: 474084 - RNA, 27 nt, Human
ccucacaggcucaggcgagcucagugg

SEQ ID NO: 474085 - RNA, 18 nt, Human
ccuccaccucccagguuc

SEQ ID NO: 474086 - RNA, 22 nt, Human
ccuccaccucugcauccagaag

SEQ ID NO: 474087 - RNA, 22 nt, Human
ccucccagguucaagcgauucc

SEQ ID NO: 474088 - RNA, 20 nt, Human
ccugaccucaggugauucac

SEQ ID NO: 474089 - RNA, 22 nt, Human
ccugaccucaggugauucaccc

SEQ ID NO: 474090 - RNA, 23 nt, Human
ccugccuuagccucccgaguagc

SEQ ID NO: 474091 - RNA, 19 nt, Human
ccuggcccggggcccugcg

SEQ ID NO: 474092 - RNA, 23 nt, Human
ccuggcccggggcccugcggguc

SEQ ID NO: 474093 - RNA, 24 nt, Human
ccuguguggccuucccuauggggu

SEQ ID NO: 474094 - RNA, 24 nt, Human
ccuucaaccuccccacagccuuuc

SEQ ID NO: 474095 - RNA, 21 nt, Human
cgacacacucaacagaaaucu

SEQ ID NO: 474096 - RNA, 20 nt, Human
cgacaggagagcuccuccac

SEQ ID NO: 474097 - RNA, 18 nt, Human
cggaaauuuuaacuguga

SEQ ID NO: 474098 - RNA, 19 nt, Human
cucaaagcagaggucaaau

SEQ ID NO: 474099 - RNA, 19 nt, Human
cucacuguagccuccaccu

SEQ ID NO: 474100 - RNA, 24 nt, Human
cucacuguagccuccaccucccag

SEQ ID NO: 474101 - RNA, 25 nt, Human
cuccagggaaagaccugaggccuag

SEQ ID NO: 474102 - RNA, 22 nt, Human
cuccccuccaccccccaccccc

SEQ ID NO: 474103 - RNA, 22 nt, Human
cucuccacuuaggagcuggaaa

SEQ ID NO: 474104 - RNA, 24 nt, Human
cugaggccuaguuccugacaaagc

SEQ ID NO: 474105 - RNA, 20 nt, Human
cugccaggucagcucacugc

SEQ ID NO: 474106 - RNA, 23 nt, Human
cugccuuagccucccgaguagcu

SEQ ID NO: 474107 - RNA, 19 nt, Human
cugcuccccuccacccccc

SEQ ID NO: 474108 - RNA, 25 nt, Human
cugcugaaaaauaaacuuuaaacau

SEQ ID NO: 474109 - RNA, 18 nt, Human
cugucaccuaggcuggag

SEQ ID NO: 474110 - RNA, 27 nt, Human
gaaaggaaaacacaaaaaccuuacaaa

SEQ ID NO: 474111 - RNA, 19 nt, Human
gacccaccccacucuccuc

SEQ ID NO: 474112 - RNA, 19 nt, Human
gacccucaauggggguccc

SEQ ID NO: 474113 - RNA, 23 nt, Human
gaccucaggugauucacccgccu

SEQ ID NO: 474114 - RNA, 18 nt, Human
gagaugggguuucaccau

SEQ ID NO: 474115 - RNA, 20 nt, Human
gagaugggguuucaccaugu

SEQ ID NO: 474116 - RNA, 18 nt, Human
gagauuugugucgugacg

SEQ ID NO: 474117 - RNA, 21 nt, Human
gagcagaucccaagagcccca

SEQ ID NO: 474118 - RNA, 21 nt, Human
gagcagcgcuugccugagucc

SEQ ID NO: 474119 - RNA, 25 nt, Human
gaggcucuggucaucaggacccguc

SEQ ID NO: 474120 - RNA, 24 nt, Human
gaguagcuggaauuacaggugugc

SEQ ID NO: 474121 - RNA, 22 nt, Human
gaucccaagagccccaggcaug

SEQ ID NO: 474122 - RNA, 18 nt, Human
gauuauaggcgugagcca

SEQ ID NO: 474123 - RNA, 23 nt, Human
gauuauaggcgugagccaccuca

SEQ ID NO: 474124 - RNA, 24 nt, Human
gauuauaggcgugagccaccucac

SEQ ID NO: 474125 - RNA, 20 nt, Human
gauuuaaaagggagaacaaa

SEQ ID NO: 474126 - RNA, 18 nt, Human
gcaaaggaagagcaaagc

SEQ ID NO: 474127 - RNA, 23 nt, Human
gccaacgccugucagcagccagg

SEQ ID NO: 474128 - RNA, 19 nt, Human
gccaggucagcucacugca

SEQ ID NO: 474129 - RNA, 22 nt, Human
gccuuggccucccaaagugcug

SEQ ID NO: 474130 - RNA, 24 nt, Human
gcgauuccccugccuuagccuccc

SEQ ID NO: 474131 - RNA, 19 nt, Human
gcuggagcgcaauggcacg

SEQ ID NO: 474132 - RNA, 23 nt, Human
gcugguuucgaacuccugaccuc

SEQ ID NO: 474133 - RNA, 21 nt, Human
ggaaaccccccagccccacag

SEQ ID NO: 474134 - RNA, 21 nt, Human
ggaaccaggaagagaacgcuu

SEQ ID NO: 474135 - RNA, 20 nt, Human
ggagcauccuaugccuuuga

SEQ ID NO: 474136 - RNA, 21 nt, Human
ggagucacggccucaaccucc

SEQ ID NO: 474137 - RNA, 24 nt, Human
ggcugguuucgaacuccugaccuc

SEQ ID NO: 474138 - RNA, 18 nt, Human
gggguuucaccauguugg

SEQ ID NO: 474139 - RNA, 24 nt, Human
ggguagggaaggggacaagugagg

SEQ ID NO: 474140 - RNA, 22 nt, Human
ggguuucaccauguugggaagg

SEQ ID NO: 474141 - RNA, 19 nt, Human
gguuucgaacuccugaccu

SEQ ID NO: 474142 - RNA, 23 nt, Human
guagagaugggguuucaccaugu

SEQ ID NO: 474143 - RNA, 24 nt, Human
gugauucacccgccuuggccuccc

SEQ ID NO: 474144 - RNA, 21 nt, Human
gugcagggaaacuccccuuua

SEQ ID NO: 474145 - RNA, 21 nt, Human
uaaaacagccacauccuaggc

SEQ ID NO: 474146 - RNA, 18 nt, Human
uaaaauaacugugccccc

SEQ ID NO: 474147 - RNA, 21 nt, Human
uaaaauaacugugccccccgc

SEQ ID NO: 474148 - RNA, 22 nt, Human
uaaaaugaacuacacucagaua

SEQ ID NO: 474149 - RNA, 21 nt, Human
uaaacaagcagaggugccuau

SEQ ID NO: 474150 - RNA, 20 nt, Human
uaaaguccucucaacuuuuc

SEQ ID NO: 474151 - RNA, 18 nt, Human
uaacacagaugaaucucu

SEQ ID NO: 474152 - RNA, 23 nt, Human
uaacacccgccggcucccccaga

SEQ ID NO: 474153 - RNA, 19 nt, Human
uaaccaaaggaauccccaa

SEQ ID NO: 474154 - RNA, 24 nt, Human
uaaccaaaggaauccccaaagaua

SEQ ID NO: 474155 - RNA, 20 nt, Human
uaacugugccccccgcccca

SEQ ID NO: 474156 - RNA, 24 nt, Human
uaagaguaaaauucugaccuuuaa

SEQ ID NO: 474157 - RNA, 24 nt, Human
uaauuuuuguauuuuuaguagaga

SEQ ID NO: 474158 - RNA, 22 nt, Human
uagagaugggguuucaccaugu

SEQ ID NO: 474159 - RNA, 20 nt, Human
uagaggccauuugcauguag

SEQ ID NO: 474160 - RNA, 23 nt, Human
uaggaagaaguggccuccaggga

SEQ ID NO: 474161 - RNA, 25 nt, Human
uaggagcuggaaaauuucgacacac

SEQ ID NO: 474162 - RNA, 24 nt, Human
uaguagagaugggguuucaccaug

SEQ ID NO: 474163 - RNA, 23 nt, Human
uauaaaaccaucagaucucauga

SEQ ID NO: 474164 - RNA, 22 nt, Human
uauaaaaugaacuacacucaga

SEQ ID NO: 474165 - RNA, 21 nt, Human
uauaaccaaaggaauccccaa

SEQ ID NO: 474166 - RNA, 22 nt, Human
uauacccuuccacaacaucaua

SEQ ID NO: 474167 - RNA, 18 nt, Human
ucaaagacagagcccaag

SEQ ID NO: 474168 - RNA, 19 nt, Human
ucaaagacagagcccaaga

SEQ ID NO: 474169 - RNA, 20 nt, Human
ucaccauguugggaaggcug

SEQ ID NO: 474170 - RNA, 19 nt, Human
ucaccugguccuucuguac

SEQ ID NO: 474171 - RNA, 24 nt, Human
ucacuguagccuccaccucccagg

SEQ ID NO: 474172 - RNA, 25 nt, Human
ucacuguagccuccaccucccaggu

SEQ ID NO: 474173 - RNA, 25 nt, Human
ucacuuucaggucguuucucuccac

SEQ ID NO: 474174 - RNA, 19 nt, Human
uccaccccccacccccccc

SEQ ID NO: 474175 - RNA, 20 nt, Human
uccaccccccacccccccca

SEQ ID NO: 474176 - RNA, 27 nt, Human
uccacuaacacccgccggcucccccag

SEQ ID NO: 474177 - RNA, 24 nt, Human
ucccaaagugcugggauuauaggc

SEQ ID NO: 474178 - RNA, 18 nt, Human
ucccaagagccccaggca

SEQ ID NO: 474179 - RNA, 19 nt, Human
ucccagguucaagcgauuc

SEQ ID NO: 474180 - RNA, 24 nt, Human
ucccagguucaagcgauuccccug

SEQ ID NO: 474181 - RNA, 22 nt, Human
uccccaaagauaggccuuggag

SEQ ID NO: 474182 - RNA, 21 nt, Human
uccccagaccaauguccuucc

SEQ ID NO: 474183 - RNA, 21 nt, Human
ucccccagaugugauggcauc

SEQ ID NO: 474184 - RNA, 21 nt, Human
ucccccagaugugauggcauc

SEQ ID NO: 474185 - RNA, 24 nt, Human
uccccugccuuagccucccgagua

SEQ ID NO: 474186 - RNA, 23 nt, Human
ucccgaguagcuggaauuacagg

SEQ ID NO: 474187 - RNA, 24 nt, Human
ucccgaguagcuggaauuacaggu

SEQ ID NO: 474188 - RNA, 21 nt, Human
ucgacacacucaacagaaauc

SEQ ID NO: 474189 - RNA, 23 nt, Human
ucgcugccccucccugugccccc

SEQ ID NO: 474190 - RNA, 19 nt, Human
ucucuagaauggccaccuu

SEQ ID NO: 474191 - RNA, 18 nt, Human
ucucuggaaacccuugau

SEQ ID NO: 474192 - RNA, 18 nt, Human
ucugucaccuaggcugga

SEQ ID NO: 474193 - RNA, 20 nt, Human
ucuugcucugucaccuaggc

SEQ ID NO: 474194 - RNA, 22 nt, Human
ucuugcucugucaccuaggcug

SEQ ID NO: 474195 - RNA, 23 nt, Human
ucuugcucugucaccuaggcugg

SEQ ID NO: 474196 - RNA, 24 nt, Human
ucuugcucugucaccuaggcugga

SEQ ID NO: 474197 - RNA, 22 nt, Human
ugaaaucaagccaaccuggaca

SEQ ID NO: 474198 - RNA, 24 nt, Human
ugaccucaggugauucacccgccu

SEQ ID NO: 474199 - RNA, 25 nt, Human
ugacucaaccaaacuucuagaagcu

SEQ ID NO: 474200 - RNA, 18 nt, Human
ugagcuggaacucggcuu

SEQ ID NO: 474201 - RNA, 23 nt, Human
ugagugaacuggugaaaucaagc

SEQ ID NO: 474202 - RNA, 22 nt, Human
ugcaccuucaaccuccccacag

SEQ ID NO: 474203 - RNA, 20 nt, Human
ugccacagggaaccccuggc

SEQ ID NO: 474204 - RNA, 19 nt, Human
ugccuguguggccuucccu

SEQ ID NO: 474205 - RNA, 24 nt, Human
ugccuuagccucccgaguagcugg

SEQ ID NO: 474206 - RNA, 24 nt, Human
ugcucugucaccuaggcuggagcg

SEQ ID NO: 474207 - RNA, 18 nt, Human
uggaaaauacacgaacaa

SEQ ID NO: 474208 - RNA, 22 nt, Human
uggaauuacaggugugcgcuac

SEQ ID NO: 474209 - RNA, 24 nt, Human
uggaauuacaggugugcgcuacca

SEQ ID NO: 474210 - RNA, 25 nt, Human
uggaauuacaggugugcgcuaccau

SEQ ID NO: 474211 - RNA, 20 nt, Human
uggagucacggccucaaccu

SEQ ID NO: 474212 - RNA, 19 nt, Human
uggagucuugcucugucac

SEQ ID NO: 474213 - RNA, 24 nt, Human
uggcacgaucucagcucacuguag

SEQ ID NO: 474214 - RNA, 23 nt, Human
uggcagcagacacaaacgcuucc

SEQ ID NO: 474215 - RNA, 22 nt, Human
uggcaggaaaccccccagcccc

SEQ ID NO: 474216 - RNA, 29 nt, Human
uggcagguguggcaggaaaccccccucuu

SEQ ID NO: 474217 - RNA, 18 nt, Human
uggcccggggcccugcgg

SEQ ID NO: 474218 - RNA, 24 nt, Human
ugggaaggcugguuucgaacuccu

SEQ ID NO: 474219 - RNA, 18 nt, Human
ugggauuauaggcgugag

SEQ ID NO: 474220 - RNA, 19 nt, Human
ugggauuauaggcgugagc

SEQ ID NO: 474221 - RNA, 21 nt, Human
ugggauuauaggcgugagcca

SEQ ID NO: 474222 - RNA, 22 nt, Human
ugggauuauaggcgugagccac

SEQ ID NO: 474223 - RNA, 23 nt, Human
ugggauuauaggcgugagccacc

SEQ ID NO: 474224 - RNA, 23 nt, Human
ugggauuauaggcgugagccacc

SEQ ID NO: 474225 - RNA, 24 nt, Human
ugggguuucaccauguugggaagg

SEQ ID NO: 474226 - RNA, 18 nt, Human
uguaggaagaaguggccu

SEQ ID NO: 474227 - RNA, 21 nt, Human
uguaggaagaaguggccucca

SEQ ID NO: 474228 - RNA, 21 nt, Human
uguauuuuuaguagagauggg

SEQ ID NO: 474229 - RNA, 21 nt, Human
ugucaaagaacugagccaaug

SEQ ID NO: 474230 - RNA, 21 nt, Human
uguggagcaaaaauagccucu

SEQ ID NO: 474231 - RNA, 18 nt, Human
uuaaaauaacugugcccc

SEQ ID NO: 474232 - RNA, 22 nt, Human
uuaaaauaacugugccccccgc

SEQ ID NO: 474233 - RNA, 18 nt, Human
uuaguagagaugggguuu

SEQ ID NO: 474234 - RNA, 22 nt, Human
uuaguagagaugggguuucacc

SEQ ID NO: 474235 - RNA, 24 nt, Human
uuaguagagaugggguuucaccau

SEQ ID NO: 474236 - RNA, 22 nt, Human
uucaaccuccccacagccuuuc

SEQ ID NO: 474237 - RNA, 20 nt, Human
uucaagcgauuccccugccu

SEQ ID NO: 474238 - RNA, 24 nt, Human
uucaagcgauuccccugccuuagc

SEQ ID NO: 474239 - RNA, 21 nt, Human
uucaaguucaggauagucuca

SEQ ID NO: 474240 - RNA, 19 nt, Human
uuccccugccuuagccucc

SEQ ID NO: 474241 - RNA, 21 nt, Human
uucucuggaaacccuugacuc

SEQ ID NO: 474242 - RNA, 18 nt, Human
uucugcauucagaagugc

SEQ ID NO: 474243 - RNA, 21 nt, Human
uugagauggagucuugcucug

SEQ ID NO: 474244 - RNA, 19 nt, Human
uugccccucggggguuucc

SEQ ID NO: 474245 - RNA, 22 nt, Human
uugcugaguuuauugagcacac

SEQ ID NO: 474246 - RNA, 31 nt, Human
uugcugggcccuaagaaccugggaggcagcc

SEQ ID NO: 474247 - RNA, 19 nt, Human
uugcuuuguagacagugca

SEQ ID NO: 474248 - RNA, 18 nt, Human
uuggccucccaaagugcu

SEQ ID NO: 474249 - RNA, 22 nt, Human
uuuauauuuuaagucaggugaa

SEQ ID NO: 474250 - RNA, 20 nt, Human
uuuaugugacaguggaucug

SEQ ID NO: 474251 - RNA, 18 nt, Human
uuuauuuuuaaaauaacu

SEQ ID NO: 474252 - RNA, 23 nt, Human
uuucgaacuccugaccucaggug

SEQ ID NO: 474253 - RNA, 20 nt, Human
uuuuguauuuuuaguagaga

SEQ ID NO: 474254 - RNA, 24 nt, Human
uuuuuaguagagaugggguuucac

SEQ ID NO: 474255 - RNA, 20 nt, Human
uuuuuguauuuuuaguagag

SEQ ID NO: 474256 - RNA, 26 nt, Human
uuuuuuauuuuuuugagauggagucu

SEQ ID NO: 474257 - RNA, 24 nt, Human
aagcagaaaaaaagacuaaggcaa

SEQ ID NO: 474258 - RNA, 23 nt, Human
accaagagccccuuccuccaccu

SEQ ID NO: 474259 - RNA, 18 nt, Human
agagccccuuccuccacc

SEQ ID NO: 474260 - RNA, 18 nt, Human
auaaagcagaaaaaaaga

SEQ ID NO: 474261 - RNA, 26 nt, Human
auaaagcagaaaaaaagacuaaggca

SEQ ID NO: 474262 - RNA, 22 nt, Human
caguugauacaccaggaauauc

SEQ ID NO: 474263 - RNA, 28 nt, Human
cauaaagcagaaaaaaagacuaaggcaa

SEQ ID NO: 474264 - RNA, 24 nt, Human
ggaaagaaaguucacuuguaaaag

SEQ ID NO: 474265 - RNA, 18 nt, Human
ggcauaaagcagaaaaaa

SEQ ID NO: 474266 - RNA, 19 nt, Human
guggaaguuuauuuaaaag

SEQ ID NO: 474267 - RNA, 21 nt, Human
uauuucauagauuuuguuuca

SEQ ID NO: 474268 - RNA, 19 nt, Human
ucugcaaagcuucuaaggc

SEQ ID NO: 474269 - RNA, 23 nt, Human
ugaggggcauaaagcagaaaaaa

SEQ ID NO: 474270 - RNA, 20 nt, Human
ugcagcaacuucaauucuug

SEQ ID NO: 474271 - RNA, 18 nt, Human
ugccaugcagucuucagg

SEQ ID NO: 474272 - RNA, 18 nt, Human
ugucaaagaaucagucaa

SEQ ID NO: 474273 - RNA, 23 nt, Human
uuaaaacaggaaagaaaguucac

SEQ ID NO: 474274 - RNA, 19 nt, Human
uucccagugguuacuccaa

SEQ ID NO: 474275 - RNA, 21 nt, Human
uuccuccaccugaaacauucc

SEQ ID NO: 474276 - RNA, 23 nt, Human
uucuugccuccucagaugaaaga

SEQ ID NO: 474277 - RNA, 20 nt, Human
uuuguaagcuucugcaaagc

SEQ ID NO: 474278 - RNA, 19 nt, Human
aaacaggacucugggcaac

SEQ ID NO: 474279 - RNA, 22 nt, Human
aagcgccaccuugagaggccag

SEQ ID NO: 474280 - RNA, 19 nt, Human
aagcucuccccacccaagg

SEQ ID NO: 474281 - RNA, 21 nt, Human
accaccaccaugguucgccau

SEQ ID NO: 474282 - RNA, 18 nt, Human
accugucguugucaguag

SEQ ID NO: 474283 - RNA, 18 nt, Human
acucugauagcugcugug

SEQ ID NO: 474284 - RNA, 21 nt, Human
agaccacagguccagaaagcu

SEQ ID NO: 474285 - RNA, 21 nt, Human
agaggacauucccuccuccug

SEQ ID NO: 474286 - RNA, 22 nt, Human
agaggccaggagcaugcuuaga

SEQ ID NO: 474287 - RNA, 19 nt, Human
agcuacugaaaaauaaaca

SEQ ID NO: 474288 - RNA, 20 nt, Human
agcuacugaaaaauaaacac

SEQ ID NO: 474289 - RNA, 21 nt, Human
agcugaccuacacugaacccc

SEQ ID NO: 474290 - RNA, 22 nt, Human
agcugaccuacacugaacccca

SEQ ID NO: 474291 - RNA, 21 nt, Human
aggaggaaaaagaaauucugg

SEQ ID NO: 474292 - RNA, 23 nt, Human
aggaggaaaaagaaauucuggca

SEQ ID NO: 474293 - RNA, 23 nt, Human
aggccaggagcaugcuuagagga

SEQ ID NO: 474294 - RNA, 20 nt, Human
aggcgccggcggccgcuucc

SEQ ID NO: 474295 - RNA, 21 nt, Human
aggggucaggaaacuauggcc

SEQ ID NO: 474296 - RNA, 18 nt, Human
aggguaaacaggacucug

SEQ ID NO: 474297 - RNA, 26 nt, Human
aucagcugaccuacacugaaccccag

SEQ ID NO: 474298 - RNA, 21 nt, Human
caaaacucaagaauaagaaca

SEQ ID NO: 474299 - RNA, 19 nt, Human
cacacugccccacacccac

SEQ ID NO: 474300 - RNA, 21 nt, Human
cacagccucacaaucccagaa

SEQ ID NO: 474301 - RNA, 18 nt, Human
caccgccaaucugccccu

SEQ ID NO: 474302 - RNA, 21 nt, Human
caccucagugcagccacacag

SEQ ID NO: 474303 - RNA, 20 nt, Human
cacugccccacacccaccgc

SEQ ID NO: 474304 - RNA, 20 nt, Human
cagaaccugugcugcccccu

SEQ ID NO: 474305 - RNA, 19 nt, Human
cagaagucugcccacucuc

SEQ ID NO: 474306 - RNA, 25 nt, Human
cagaaucaagcagacaggcccacca

SEQ ID NO: 474307 - RNA, 20 nt, Human
cagaggaggugaccaaaugc

SEQ ID NO: 474308 - RNA, 18 nt, Human
cagccaccaccccagccc

SEQ ID NO: 474309 - RNA, 19 nt, Human
caggaagcucuccccaccc

SEQ ID NO: 474310 - RNA, 20 nt, Human
caggaugagccagcucccca

SEQ ID NO: 474311 - RNA, 19 nt, Human
caggccccguggugacaga

SEQ ID NO: 474312 - RNA, 24 nt, Human
caggccccguggugacagaccaca

SEQ ID NO: 474313 - RNA, 18 nt, Human
caucuuaaaagcacaacc

SEQ ID NO: 474314 - RNA, 23 nt, Human
ccacaggccgcugagagcugugc

SEQ ID NO: 474315 - RNA, 19 nt, Human
ccagaacaaagcagaaaga

SEQ ID NO: 474316 - RNA, 19 nt, Human
ccccagcacgggccugaac

SEQ ID NO: 474317 - RNA, 23 nt, Human
cccuccacagaagucugcccacu

SEQ ID NO: 474318 - RNA, 20 nt, Human
cccuggagcccagccaugcc

SEQ ID NO: 474319 - RNA, 27 nt, Human
ccucacaaucccagaaccugugcugcc

SEQ ID NO: 474320 - RNA, 19 nt, Human
ccucacacugccccacacc

SEQ ID NO: 474321 - RNA, 18 nt, Human
ccuccacagaagucugcc

SEQ ID NO: 474322 - RNA, 21 nt, Human
ccuccacagaagucugcccac

SEQ ID NO: 474323 - RNA, 23 nt, Human
ccugcauguccugggggcagcca

SEQ ID NO: 474324 - RNA, 21 nt, Human
ccugccuccugaggccagcag

SEQ ID NO: 474325 - RNA, 20 nt, Human
cgggccugaacaggaccagg

SEQ ID NO: 474326 - RNA, 18 nt, Human
cugaauauugaaaaaaaa

SEQ ID NO: 474327 - RNA, 20 nt, Human
cugcccacucuccauacagc

SEQ ID NO: 474328 - RNA, 18 nt, Human
gaaagcuucaaaugguua

SEQ ID NO: 474329 - RNA, 23 nt, Human
gcagccacacagggaagggcugg

SEQ ID NO: 474330 - RNA, 19 nt, Human
gcagccaccaccccagccc

SEQ ID NO: 474331 - RNA, 18 nt, Human
gcaguuccaaggccacag

SEQ ID NO: 474332 - RNA, 18 nt, Human
gcgccaccuugagaggcc

SEQ ID NO: 474333 - RNA, 23 nt, Human
gcuccuggcugccucacaguccg

SEQ ID NO: 474334 - RNA, 20 nt, Human
ggaggguaaacaggacucug

SEQ ID NO: 474335 - RNA, 18 nt, Human
gggcccuccacagaaguc

SEQ ID NO: 474336 - RNA, 23 nt, Human
gugucagauaagaagcaggcccc

SEQ ID NO: 474337 - RNA, 25 nt, Human
uaaacacaaaguguauauacaaaca

SEQ ID NO: 474338 - RNA, 19 nt, Human
uaagaacagaagccaaacc

SEQ ID NO: 474339 - RNA, 23 nt, Human
uaagaacagaagccaaaccacca

SEQ ID NO: 474340 - RNA, 18 nt, Human
uacacugaaccccagaau

SEQ ID NO: 474341 - RNA, 20 nt, Human
ucacagccucacaaucccag

SEQ ID NO: 474342 - RNA, 22 nt, Human
ucagagcaucuuaaaagcacaa

SEQ ID NO: 474343 - RNA, 21 nt, Human
ucagcugaccuacacugaacc

SEQ ID NO: 474344 - RNA, 19 nt, Human
uccacagaagucugcccac

SEQ ID NO: 474345 - RNA, 22 nt, Human
uccaccuucacucacagccuca

SEQ ID NO: 474346 - RNA, 21 nt, Human
uccccagguggaaaggccugc

SEQ ID NO: 474347 - RNA, 22 nt, Human
uccccagguggaaaggccugcc

SEQ ID NO: 474348 - RNA, 19 nt, Human
ucccuggagcccagccaug

SEQ ID NO: 474349 - RNA, 26 nt, Human
ugagaaaggaauuugaguucuuggga

SEQ ID NO: 474350 - RNA, 24 nt, Human
ugagaggccaggagcaugcuuaga

SEQ ID NO: 474351 - RNA, 21 nt, Human
ugagcuagucauucuucccaa

SEQ ID NO: 474352 - RNA, 23 nt, Human
ugccgauggccgcucugcagaau

SEQ ID NO: 474353 - RNA, 18 nt, Human
uggaagcugugugucccc

SEQ ID NO: 474354 - RNA, 24 nt, Human
uggcauagcacaggggucaggaaa

SEQ ID NO: 474355 - RNA, 19 nt, Human
ugggaagaaugaacccugg

SEQ ID NO: 474356 - RNA, 20 nt, Human
ugggaggguaaacaggacuc

SEQ ID NO: 474357 - RNA, 22 nt, Human
ugucagauaagaagcaggcccc

SEQ ID NO: 474358 - RNA, 21 nt, Human
uuuuaauguucaaggggcugu

SEQ ID NO: 474359 - RNA, 21 nt, Human
aaaaaacccuggaugucaacu

SEQ ID NO: 474360 - RNA, 20 nt, Human
aaaaacccuggaugucaacu

SEQ ID NO: 474361 - RNA, 21 nt, Human
aaaaagaagaaaaaaaaaucc

SEQ ID NO: 474362 - RNA, 19 nt, Human
aaaacaaaagcccucaagc

SEQ ID NO: 474363 - RNA, 20 nt, Human
aaaagccaaaaacaaaagcc

SEQ ID NO: 474364 - RNA, 22 nt, Human
aaaagccaaaaacaaaagcccu

SEQ ID NO: 474365 - RNA, 19 nt, Human
aaaagcccucaagccacaa

SEQ ID NO: 474366 - RNA, 25 nt, Human
aaacaaacccaaacaagggcacccc

SEQ ID NO: 474367 - RNA, 22 nt, Human
aaacaacaaaccacaagccuaa

SEQ ID NO: 474368 - RNA, 33 nt, Human
aaacaacaaaccacaagccuaaaugaugaacga

SEQ ID NO: 474369 - RNA, 19 nt, Human
aaacccagcaagacaagcg

SEQ ID NO: 474370 - RNA, 20 nt, Human
aaagcagguuggaaaaguca

SEQ ID NO: 474371 - RNA, 19 nt, Human
aacagagugaaacuccauc

SEQ ID NO: 474372 - RNA, 20 nt, Human
aacagagugaaacuccaucu

SEQ ID NO: 474373 - RNA, 21 nt, Human
aacagagugaaacuccaucuc

SEQ ID NO: 474374 - RNA, 20 nt, Human
aacccaaacaagggcacccc

SEQ ID NO: 474375 - RNA, 21 nt, Human
aagaaacccagcaagacaagc

SEQ ID NO: 474376 - RNA, 22 nt, Human
aagaaacccagcaagacaagcg

SEQ ID NO: 474377 - RNA, 23 nt, Human
aagaagaaaaaaaaauccuauaa

SEQ ID NO: 474378 - RNA, 20 nt, Human
aagcaaaaaucuaaacgggc

SEQ ID NO: 474379 - RNA, 23 nt, Human
aagcaaaaaucuaaacgggcaac

SEQ ID NO: 474380 - RNA, 24 nt, Human
aagcugccauugcacuccagccug

SEQ ID NO: 474381 - RNA, 26 nt, Human
aagggcaccccaaccuguguccaaga

SEQ ID NO: 474382 - RNA, 23 nt, Human
aagguggguggaucaccugaggu

SEQ ID NO: 474383 - RNA, 25 nt, Human
aagguggguggaucaccugagguca

SEQ ID NO: 474384 - RNA, 23 nt, Human
aaucgcuugaaccaggaggugga

SEQ ID NO: 474385 - RNA, 22 nt, Human
aauuuugguuuuuauacagguu

SEQ ID NO: 474386 - RNA, 22 nt, Human
aauuuugguuuuuauauagguu

SEQ ID NO: 474387 - RNA, 22 nt, Human
aauuuugguuuuuauauagguu

SEQ ID NO: 474388 - RNA, 22 nt, Human
acaaaagcccucaagccacaaa

SEQ ID NO: 474389 - RNA, 21 nt, Human
acaaagcaaacggggaagggu

SEQ ID NO: 474390 - RNA, 22 nt, Human
acacacacacuuaaagcuccau

SEQ ID NO: 474391 - RNA, 19 nt, Human
acaccaugaaaaaacaaac

SEQ ID NO: 474392 - RNA, 24 nt, Human
acagagugaaacuccaucucgaaa

SEQ ID NO: 474393 - RNA, 21 nt, Human
acagcccaagcucugcagcug

SEQ ID NO: 474394 - RNA, 23 nt, Human
accaacaugagcacccaguucca

SEQ ID NO: 474395 - RNA, 24 nt, Human
accaacauggugagacuccauuuc

SEQ ID NO: 474396 - RNA, 27 nt, Human
accgcacuccagcgucaggacaucggg

SEQ ID NO: 474397 - RNA, 20 nt, Human
accugagacacaaaauaauu

SEQ ID NO: 474398 - RNA, 24 nt, Human
accugaggucaggaguucgagacc

SEQ ID NO: 474399 - RNA, 22 nt, Human
acgucuucuggcuuggagguga

SEQ ID NO: 474400 - RNA, 24 nt, Human
acuccagccugggcaacagaguga

SEQ ID NO: 474401 - RNA, 20 nt, Human
acuccauuucuacuaaauag

SEQ ID NO: 474402 - RNA, 21 nt, Human
acugaaauagaaaggcaacug

SEQ ID NO: 474403 - RNA, 18 nt, Human
acuggcagcacuuggcaa

SEQ ID NO: 474404 - RNA, 22 nt, Human
acuuucauccagacaaaagcca

SEQ ID NO: 474405 - RNA, 24 nt, Human
agaaaaggccauuggauggagaca

SEQ ID NO: 474406 - RNA, 21 nt, Human
agaaucgcuugaaccaggagg

SEQ ID NO: 474407 - RNA, 20 nt, Human
agacaaaagccaaaaacaaa

SEQ ID NO: 474408 - RNA, 28 nt, Human
agacaaaagccaaaaacaaaagggaccc

SEQ ID NO: 474409 - RNA, 21 nt, Human
agagauacguguccugccuuc

SEQ ID NO: 474410 - RNA, 30 nt, Human
agccaaaaacaaaagcccucaagccacaaa

SEQ ID NO: 474411 - RNA, 23 nt, Human
agccaggugugguggcgcgugcc

SEQ ID NO: 474412 - RNA, 22 nt, Human
agccugaccaacauggugagac

SEQ ID NO: 474413 - RNA, 24 nt, Human
agccugaccaacauggugagacuc

SEQ ID NO: 474414 - RNA, 22 nt, Human
agccugggcaacagagugaaac

SEQ ID NO: 474415 - RNA, 24 nt, Human
agccugggcaacagagugaaacuc

SEQ ID NO: 474416 - RNA, 18 nt, Human
agcgcucauagaaggaau

SEQ ID NO: 474417 - RNA, 22 nt, Human
aggcaggaaaaaaaacccugga

SEQ ID NO: 474418 - RNA, 22 nt, Human
aggcaggagaaucgcuugaacc

SEQ ID NO: 474419 - RNA, 24 nt, Human
aggcaggagaaucgcuugaaccag

SEQ ID NO: 474420 - RNA, 21 nt, Human
aggccaagguggguggaucac

SEQ ID NO: 474421 - RNA, 20 nt, Human
aggcugaggcaggagaaucg

SEQ ID NO: 474422 - RNA, 24 nt, Human
aggcugaggcaggagaaucgcuug

SEQ ID NO: 474423 - RNA, 23 nt, Human
agggcaccccaaccuguguccaa

SEQ ID NO: 474424 - RNA, 19 nt, Human
agguggagguugcaguaag

SEQ ID NO: 474425 - RNA, 20 nt, Human
agguggccaguaaaacccaa

SEQ ID NO: 474426 - RNA, 24 nt, Human
aggugugguggcgcgugccuguaa

SEQ ID NO: 474427 - RNA, 26 nt, Human
aguaaacaacaaaccacaagccuaaa

SEQ ID NO: 474428 - RNA, 24 nt, Human
auaacacacacacacacuuaaagc

SEQ ID NO: 474429 - RNA, 22 nt, Human
aucugugaaugaacugaaauag

SEQ ID NO: 474430 - RNA, 19 nt, Human
augccuauaaucccagcac

SEQ ID NO: 474431 - RNA, 24 nt, Human
auggcuaauaucaaagguagauga

SEQ ID NO: 474432 - RNA, 24 nt, Human
auugcacuccagccugggcaacag

SEQ ID NO: 474433 - RNA, 21 nt, Human
auuuugguuuucauauagguu

SEQ ID NO: 474434 - RNA, 21 nt, Human
auuuugguuuuuauacagguu

SEQ ID NO: 474435 - RNA, 21 nt, Human
auuuugguuuuuauauagguu

SEQ ID NO: 474436 - RNA, 21 nt, Human
caaaaacaaaagcccucaagc

SEQ ID NO: 474437 - RNA, 24 nt, Human
caaaaaucuaaacgggcaccaggg

SEQ ID NO: 474438 - RNA, 19 nt, Human
caaaauucugaagcgcuca

SEQ ID NO: 474439 - RNA, 21 nt, Human
caaaggaacccacccaagccc

SEQ ID NO: 474440 - RNA, 24 nt, Human
caacauggugagacuccauuucua

SEQ ID NO: 474441 - RNA, 21 nt, Human
caagaacacuucaccccaaug

SEQ ID NO: 474442 - RNA, 25 nt, Human
caagaacacuucaccccaaugauga

SEQ ID NO: 474443 - RNA, 19 nt, Human
caagcagcagaugaagaga

SEQ ID NO: 474444 - RNA, 24 nt, Human
caagguggguggaucaccugaggu

SEQ ID NO: 474445 - RNA, 19 nt, Human
cacaaagaacagaggcacc

SEQ ID NO: 474446 - RNA, 20 nt, Human
cacaacugggcaaaacuuuc

SEQ ID NO: 474447 - RNA, 19 nt, Human
cacacauaacacacacaca

SEQ ID NO: 474448 - RNA, 21 nt, Human
cacagcccaagcucugcagcu

SEQ ID NO: 474449 - RNA, 23 nt, Human
caccaugaaaaaacaaaccugua

SEQ ID NO: 474450 - RNA, 25 nt, Human
caccaugaaaaaacaaaccuguaua

SEQ ID NO: 474451 - RNA, 20 nt, Human
caccgcacuccagcgucagg

SEQ ID NO: 474452 - RNA, 20 nt, Human
caccgcacuccagcgucagg

SEQ ID NO: 474453 - RNA, 21 nt, Human
caccgcacuccagcgucaggc

SEQ ID NO: 474454 - RNA, 23 nt, Human
caccugaggucaggaguucgaga

SEQ ID NO: 474455 - RNA, 22 nt, Human
cacuccagccugggcaacagag

SEQ ID NO: 474456 - RNA, 24 nt, Human
cacuccagccugggcaacagagug

SEQ ID NO: 474457 - RNA, 24 nt, Human
cagcacgcugggaggccaaggugg

SEQ ID NO: 474458 - RNA, 18 nt, Human
cagcccaagcucugcagc

SEQ ID NO: 474459 - RNA, 24 nt, Human
cagcuacuugggaggcugaggcag

SEQ ID NO: 474460 - RNA, 19 nt, Human
caggaaacaccugccuucg

SEQ ID NO: 474461 - RNA, 29 nt, Human
caggagguggagguugcaguaacaacggu

SEQ ID NO: 474462 - RNA, 22 nt, Human
caguggggagagggccuggcag

SEQ ID NO: 474463 - RNA, 21 nt, Human
caugccuauaaucccagcacg

SEQ ID NO: 474464 - RNA, 19 nt, Human
cauugcacuccagccuggg

SEQ ID NO: 474465 - RNA, 21 nt, Human
cauugcacuccagccugggca

SEQ ID NO: 474466 - RNA, 22 nt, Human
cauugcacuccagccugggcaa

SEQ ID NO: 474467 - RNA, 24 nt, Human
cauugcacuccagccugggcaaca

SEQ ID NO: 474468 - RNA, 25 nt, Human
cauuuuaaagucacuugauaauucc

SEQ ID NO: 474469 - RNA, 25 nt, Human
ccaaaagacuaacagugaugccuga

SEQ ID NO: 474470 - RNA, 25 nt, Human
ccagaucaagagccgugagauuacu

SEQ ID NO: 474471 - RNA, 20 nt, Human
ccaggagguggagguugcag

SEQ ID NO: 474472 - RNA, 20 nt, Human
ccauugcacuccagccuggg

SEQ ID NO: 474473 - RNA, 21 nt, Human
ccauugcacuccagccugggc

SEQ ID NO: 474474 - RNA, 23 nt, Human
ccauugcacuccagccugggcaa

SEQ ID NO: 474475 - RNA, 24 nt, Human
ccauugcacuccagccugggcaac

SEQ ID NO: 474476 - RNA, 20 nt, Human
ccauuucacuccuccacaaa

SEQ ID NO: 474477 - RNA, 20 nt, Human
cccagcacgcugggaggcca

SEQ ID NO: 474478 - RNA, 19 nt, Human
cccuacaccaugaaaaaac

SEQ ID NO: 474479 - RNA, 23 nt, Human
ccgcacuccagcgucaggccaaa

SEQ ID NO: 474480 - RNA, 22 nt, Human
ccgcgggggccuugcccugugc

SEQ ID NO: 474481 - RNA, 20 nt, Human
ccuauguuccacuucccugu

SEQ ID NO: 474482 - RNA, 18 nt, Human
ccucucugggagaagccu

SEQ ID NO: 474483 - RNA, 24 nt, Human
ccugaccaacauggugagacucca

SEQ ID NO: 474484 - RNA, 25 nt, Human
ccuggaaaaccugccacuuucuucu

SEQ ID NO: 474485 - RNA, 24 nt, Human
ccugggcaacagagugaaacucca

SEQ ID NO: 474486 - RNA, 18 nt, Human
ccuguaaucccagcuacu

SEQ ID NO: 474487 - RNA, 19 nt, Human
ccuguaaucccagcuacuu

SEQ ID NO: 474488 - RNA, 21 nt, Human
ccuguaaucccagcuacuugg

SEQ ID NO: 474489 - RNA, 19 nt, Human
ccuucgguggccagcagug

SEQ ID NO: 474490 - RNA, 24 nt, Human
cgagaccagccugaccaacauggu

SEQ ID NO: 474491 - RNA, 18 nt, Human
cggaaggaagcuugccca

SEQ ID NO: 474492 - RNA, 19 nt, Human
cggaaggaagcuugcccau

SEQ ID NO: 474493 - RNA, 26 nt, Human
cgguuuggggcaguggggagagggcc

SEQ ID NO: 474494 - RNA, 19 nt, Human
cgucuauagagguggccag

SEQ ID NO: 474495 - RNA, 21 nt, Human
cguguugccuuugccuuugcu

SEQ ID NO: 474496 - RNA, 23 nt, Human
cuaggccgguuuggggcaguggg

SEQ ID NO: 474497 - RNA, 26 nt, Human
cucaaaccugcccuccacaaucuauu

SEQ ID NO: 474498 - RNA, 25 nt, Human
cucagacuugaaacuugacgaaaau

SEQ ID NO: 474499 - RNA, 19 nt, Human
cucaugccuauaaucccag

SEQ ID NO: 474500 - RNA, 18 nt, Human
cuccagcgucaggccaaa

SEQ ID NO: 474501 - RNA, 19 nt, Human
cucucucucuaaaaaagaa

SEQ ID NO: 474502 - RNA, 21 nt, Human
cugaaauagaaaggcaacuga

SEQ ID NO: 474503 - RNA, 19 nt, Human
cugccuuccaccauccacc

SEQ ID NO: 474504 - RNA, 21 nt, Human
cugcucaaagcaacuuugcaa

SEQ ID NO: 474505 - RNA, 21 nt, Human
cuuaaagcuccauuucacucc

SEQ ID NO: 474506 - RNA, 19 nt, Human
cuuccuacaucugucguag

SEQ ID NO: 474507 - RNA, 23 nt, Human
cuucuccaaaggaacccacccaa

SEQ ID NO: 474508 - RNA, 20 nt, Human
gaacaaggagauggcuacuu

SEQ ID NO: 474509 - RNA, 18 nt, Human
gaacccacccaagcccgu

SEQ ID NO: 474510 - RNA, 24 nt, Human
gaagcuugcccauuuccgucucca

SEQ ID NO: 474511 - RNA, 19 nt, Human
gaagugagaucugugaaug

SEQ ID NO: 474512 - RNA, 21 nt, Human
gaaugcaaacggucauggacc

SEQ ID NO: 474513 - RNA, 19 nt, Human
gagaacgaggcaguguauu

SEQ ID NO: 474514 - RNA, 23 nt, Human
gagguugcaguaagcugccauug

SEQ ID NO: 474515 - RNA, 24 nt, Human
gaucaccugaggucaggaguucga

SEQ ID NO: 474516 - RNA, 24 nt, Human
gcaaaacuuucauccagacaaaag

SEQ ID NO: 474517 - RNA, 26 nt, Human
gcaaaacuuucauccagacaaaagcc

SEQ ID NO: 474518 - RNA, 27 nt, Human
gcaaaacuuucauccagacaaaagcca

SEQ ID NO: 474519 - RNA, 24 nt, Human
gcacuccagccugggcaacagagu

SEQ ID NO: 474520 - RNA, 21 nt, Human
gcaggguuuacgccagccccg

SEQ ID NO: 474521 - RNA, 24 nt, Human
gccaaaaacaaaagcccucaagcc

SEQ ID NO: 474522 - RNA, 22 nt, Human
gccauugcacuccagccugggc

SEQ ID NO: 474523 - RNA, 24 nt, Human
gccauugcacuccagccugggcaa

SEQ ID NO: 474524 - RNA, 20 nt, Human
gccuguaaucccagcuacuu

SEQ ID NO: 474525 - RNA, 22 nt, Human
gcgcgugccuguaaucccagcu

SEQ ID NO: 474526 - RNA, 21 nt, Human
gcgugugugcaaacacacaua

SEQ ID NO: 474527 - RNA, 18 nt, Human
ggagguugcaguaagcug

SEQ ID NO: 474528 - RNA, 24 nt, Human
ggagguugcaguaagcugccauug

SEQ ID NO: 474529 - RNA, 22 nt, Human
ggaucaccugaggucaggaguu

SEQ ID NO: 474530 - RNA, 20 nt, Human
ggcaccuccuuuuugugaca

SEQ ID NO: 474531 - RNA, 21 nt, Human
ggcaguggggagagggccugg

SEQ ID NO: 474532 - RNA, 22 nt, Human
gggcaguggggagagggccugg

SEQ ID NO: 474533 - RNA, 21 nt, Human
ggucauggacccaaguuaacc

SEQ ID NO: 474534 - RNA, 18 nt, Human
gguccuuggagaucccug

SEQ ID NO: 474535 - RNA, 21 nt, Human
gguggaucaccugaggucagg

SEQ ID NO: 474536 - RNA, 24 nt, Human
gguggcgcgugccuguaaucccag

SEQ ID NO: 474537 - RNA, 24 nt, Human
gguggcucaugccuauaaucccag

SEQ ID NO: 474538 - RNA, 22 nt, Human
guauaaaacagcuuggaaaaca

SEQ ID NO: 474539 - RNA, 20 nt, Human
gucccucaaaccugcccucc

SEQ ID NO: 474540 - RNA, 25 nt, Human
gugugugcaaacacacauaacaccg

SEQ ID NO: 474541 - RNA, 19 nt, Human
uaaaacacaacugggcaaa

SEQ ID NO: 474542 - RNA, 21 nt, Human
uaaagcuccauuucacuccuc

SEQ ID NO: 474543 - RNA, 23 nt, Human
uaacacacacacacacuuaaagc

SEQ ID NO: 474544 - RNA, 18 nt, Human
uaacacacgcgugugugc

SEQ ID NO: 474545 - RNA, 19 nt, Human
uaagacugacaccugagac

SEQ ID NO: 474546 - RNA, 21 nt, Human
uaagacugacaccugagacac

SEQ ID NO: 474547 - RNA, 21 nt, Human
uaauuuugguuuugauaccgg

SEQ ID NO: 474548 - RNA, 23 nt, Human
uacccuacaccaugaaaaaacaa

SEQ ID NO: 474549 - RNA, 24 nt, Human
uacccuacaccaugaaaaaacaaa

SEQ ID NO: 474550 - RNA, 22 nt, Human
uacucagggccagcugcauuuu

SEQ ID NO: 474551 - RNA, 20 nt, Human
uacucugaaguuuccagauc

SEQ ID NO: 474552 - RNA, 21 nt, Human
uauaaaacagcuuggaaaaca

SEQ ID NO: 474553 - RNA, 22 nt, Human
ucaccgcacuccagcgucaggc

SEQ ID NO: 474554 - RNA, 20 nt, Human
ucaccugaggucaggaguuc

SEQ ID NO: 474555 - RNA, 22 nt, Human
ucaggccaaaccuuuccgugga

SEQ ID NO: 474556 - RNA, 20 nt, Human
ucaugggauucaucuggaaa

SEQ ID NO: 474557 - RNA, 23 nt, Human
uccaaaaucaaauaaaaaagaac

SEQ ID NO: 474558 - RNA, 18 nt, Human
uccaagcagcagaugaag

SEQ ID NO: 474559 - RNA, 19 nt, Human
uccacaaagaacagaggca

SEQ ID NO: 474560 - RNA, 20 nt, Human
uccacaaagaacagaggcac

SEQ ID NO: 474561 - RNA, 22 nt, Human
uccacaaagaacagaggcaccu

SEQ ID NO: 474562 - RNA, 21 nt, Human
uccacaaucuauuagagcaua

SEQ ID NO: 474563 - RNA, 23 nt, Human
uccaccaaaacaaacccaaacaa

SEQ ID NO: 474564 - RNA, 28 nt, Human
uccagacaaaagccaaaaacaaaagccc

SEQ ID NO: 474565 - RNA, 18 nt, Human
uccaggcauggacccaaa

SEQ ID NO: 474566 - RNA, 24 nt, Human
ucccaaaagacuaacagugaugcc

SEQ ID NO: 474567 - RNA, 22 nt, Human
uccggcggacacacuggcugcg

SEQ ID NO: 474568 - RNA, 20 nt, Human
uccuggggccggccuggugg

SEQ ID NO: 474569 - RNA, 23 nt, Human
ucgcuugaaccaggagguggagg

SEQ ID NO: 474570 - RNA, 20 nt, Human
ucuaauauugaacccuaacu

SEQ ID NO: 474571 - RNA, 24 nt, Human
ucuguaacuucagaaaaggccauc

SEQ ID NO: 474572 - RNA, 24 nt, Human
ucuguaacuucagaaaaggccauu

SEQ ID NO: 474573 - RNA, 21 nt, Human
ugacagcacaggggggcaccu

SEQ ID NO: 474574 - RNA, 20 nt, Human
ugacaugguccaggcaugga

SEQ ID NO: 474575 - RNA, 21 nt, Human
ugaccaacauggugagacucc

SEQ ID NO: 474576 - RNA, 20 nt, Human
ugagagcaagaaggcuuaau

SEQ ID NO: 474577 - RNA, 20 nt, Human
ugaggaaagcgacuggaaug

SEQ ID NO: 474578 - RNA, 24 nt, Human
ugaggcaggagaaucgcuugaacc

SEQ ID NO: 474579 - RNA, 22 nt, Human
ugcaaguaggcucaaaguaaac

SEQ ID NO: 474580 - RNA, 22 nt, Human
ugcacuccagccugggcaacag

SEQ ID NO: 474581 - RNA, 24 nt, Human
ugccauugcacuccagccugggca

SEQ ID NO: 474582 - RNA, 18 nt, Human
ugcccugugcaggcugcu

SEQ ID NO: 474583 - RNA, 23 nt, Human
ugccuauaaucccagcacgcugg

SEQ ID NO: 474584 - RNA, 24 nt, Human
ugccuauaaucccagcacgcuggg

SEQ ID NO: 474585 - RNA, 24 nt, Human
ugccuguaaucccagcuacuuggg

SEQ ID NO: 474586 - RNA, 22 nt, Human
ugccuuugccuuugcuucauaa

SEQ ID NO: 474587 - RNA, 22 nt, Human
ugcugcagggcugucuucggcg

SEQ ID NO: 474588 - RNA, 23 nt, Human
uggaacaccuaagaaguuuguaa

SEQ ID NO: 474589 - RNA, 19 nt, Human
uggaagaaacccagcaaga

SEQ ID NO: 474590 - RNA, 21 nt, Human
uggacccaaaacaacacuugu

SEQ ID NO: 474591 - RNA, 23 nt, Human
uggaccuggaaaaccugccacuu

SEQ ID NO: 474592 - RNA, 24 nt, Human
uggaucaccugaggucaggaguuc

SEQ ID NO: 474593 - RNA, 27 nt, Human
uggaucaccugaggucaggaguucgag

SEQ ID NO: 474594 - RNA, 22 nt, Human
uggcagcacuuggcaaaaucca

SEQ ID NO: 474595 - RNA, 21 nt, Human
uggcgcgugccuguaauccca

SEQ ID NO: 474596 - RNA, 21 nt, Human
uggcucaugccuauaauccca

SEQ ID NO: 474597 - RNA, 22 nt, Human
uggcucaugccuauaaucccag

SEQ ID NO: 474598 - RNA, 24 nt, Human
uggcucaugccuauaaucccagca

SEQ ID NO: 474599 - RNA, 21 nt, Human
ugggagaagccuccuggcugg

SEQ ID NO: 474600 - RNA, 23 nt, Human
ugggaggccaagguggguggauc

SEQ ID NO: 474601 - RNA, 24 nt, Human
ugggaggccaagguggguggauca

SEQ ID NO: 474602 - RNA, 19 nt, Human
ugggaggcugaggcaggag

SEQ ID NO: 474603 - RNA, 23 nt, Human
ugggaggcugaggcaggagaauc

SEQ ID NO: 474604 - RNA, 24 nt, Human
uggguggaucaccugaggucagga

SEQ ID NO: 474605 - RNA, 24 nt, Human
ugguggcgcgugccuguaauccca

SEQ ID NO: 474606 - RNA, 24 nt, Human
ugguggcucaugccuauaauccca

SEQ ID NO: 474607 - RNA, 25 nt, Human
uggugugccagguuugugauguuuu

SEQ ID NO: 474608 - RNA, 23 nt, Human
ugugcgugucuacaggaagcaga

SEQ ID NO: 474609 - RNA, 23 nt, Human
uuaaaacacaacugggcaaaacu

SEQ ID NO: 474610 - RNA, 27 nt, Human
uuaaaaccaacaugagcacccaguucc

SEQ ID NO: 474611 - RNA, 18 nt, Human
uuaaucuccuucuaauau

SEQ ID NO: 474612 - RNA, 20 nt, Human
uucaucugacaggcccgcug

SEQ ID NO: 474613 - RNA, 18 nt, Human
uuccuacaucugucguag

SEQ ID NO: 474614 - RNA, 23 nt, Human
uugaaccaggagguggagguugc

SEQ ID NO: 474615 - RNA, 20 nt, Human
uugaacucagacuugaaacu

SEQ ID NO: 474616 - RNA, 22 nt, Human
uugcaguaagcugccauugcac

SEQ ID NO: 474617 - RNA, 24 nt, Human
uugggaggcugaggcaggagaauc

SEQ ID NO: 474618 - RNA, 24 nt, Human
uuguuuuggcuacuggcagcacuu

SEQ ID NO: 474619 - RNA, 18 nt, Human
uuuaaggauuaacaagag

SEQ ID NO: 474620 - RNA, 18 nt, Human
uuugcucugcaggauucc

SEQ ID NO: 474621 - RNA, 20 nt, Human
uuugcucugcaggauuccgc

SEQ ID NO: 474622 - RNA, 19 nt, Human
uuuguccucucugggagaa

SEQ ID NO: 474623 - RNA, 18 nt, Human
uuuuuguuauugcuacaa

SEQ ID NO: 474624 - RNA, 21 nt, Human
aagaaacaaaacauuuaaugu

SEQ ID NO: 474625 - RNA, 18 nt, Human
accuaucuacaaacagaa

SEQ ID NO: 474626 - RNA, 23 nt, Human
aggagacugcugcgccacaaccc

SEQ ID NO: 474627 - RNA, 20 nt, Human
cacaacccugccggcguccc

SEQ ID NO: 474628 - RNA, 26 nt, Human
cuaucuacaaacagaauauaacaaaa

SEQ ID NO: 474629 - RNA, 18 nt, Human
cuccaccucagccccggg

SEQ ID NO: 474630 - RNA, 21 nt, Human
cuccaccucagccccgggagc

SEQ ID NO: 474631 - RNA, 25 nt, Human
uaacaaaaggaaaaugugacuuaaa

SEQ ID NO: 474632 - RNA, 21 nt, Human
uauaacaaaaggaaaauguga

SEQ ID NO: 474633 - RNA, 24 nt, Human
uuuggcaauguguacugagagaua

SEQ ID NO: 474634 - RNA, 19 nt, Human
aacuguaacacucuaagca

SEQ ID NO: 474635 - RNA, 30 nt, Human
agcuuguuccuucaaaaaugucucucccag

SEQ ID NO: 474636 - RNA, 23 nt, Human
agucuccacgauggugcauggga

SEQ ID NO: 474637 - RNA, 18 nt, Human
aucacaauagauuugauc

SEQ ID NO: 474638 - RNA, 20 nt, Human
auccagccagucuccacgau

SEQ ID NO: 474639 - RNA, 19 nt, Human
augucucucccaucuucug

SEQ ID NO: 474640 - RNA, 19 nt, Human
cacaauagauuugauccau

SEQ ID NO: 474641 - RNA, 24 nt, Human
cagaaggagacacugaccuauuua

SEQ ID NO: 474642 - RNA, 25 nt, Human
ccagccagucuccacgauggugcaa

SEQ ID NO: 474643 - RNA, 21 nt, Human
cuccacgauggugcaugggau

SEQ ID NO: 474644 - RNA, 23 nt, Human
cuucaaaaaugucucucccaucu

SEQ ID NO: 474645 - RNA, 21 nt, Human
cuucacucugauuugccccuc

SEQ ID NO: 474646 - RNA, 23 nt, Human
gaaggcuaggacaccuccuguaa

SEQ ID NO: 474647 - RNA, 18 nt, Human
gagcacagggcauccagc

SEQ ID NO: 474648 - RNA, 21 nt, Human
uaacuucugugagacccaagu

SEQ ID NO: 474649 - RNA, 24 nt, Human
uaagggggauaaaaaucacaauag

SEQ ID NO: 474650 - RNA, 18 nt, Human
uaggauugaaagcaggca

SEQ ID NO: 474651 - RNA, 20 nt, Human
uaggauugaaagcaggcaac

SEQ ID NO: 474652 - RNA, 21 nt, Human
uaugaaccauuucccagaaaa

SEQ ID NO: 474653 - RNA, 24 nt, Human
uauuuuauuuuucucucugaaaac

SEQ ID NO: 474654 - RNA, 21 nt, Human
uccacgaagcugagaagggug

SEQ ID NO: 474655 - RNA, 24 nt, Human
ucccaggcaggaucaguccuuguu

SEQ ID NO: 474656 - RNA, 24 nt, Human
ucucaguuucuguagaugagaagu

SEQ ID NO: 474657 - RNA, 19 nt, Human
ucucugaaaaccaaggcug

SEQ ID NO: 474658 - RNA, 26 nt, Human
ucuggcuuccucuucacucugauuug

SEQ ID NO: 474659 - RNA, 23 nt, Human
ucuucacucugauuugccccucu

SEQ ID NO: 474660 - RNA, 19 nt, Human
ugaaagcaggcaacuguaa

SEQ ID NO: 474661 - RNA, 28 nt, Human
ugaauugaaaacagguuugcaguggauu

SEQ ID NO: 474662 - RNA, 24 nt, Human
ugaccuauuuauauuccuucucaa

SEQ ID NO: 474663 - RNA, 21 nt, Human
uggggcugcugcagucucauu

SEQ ID NO: 474664 - RNA, 22 nt, Human
uguacucugacaacaacugcag

SEQ ID NO: 474665 - RNA, 18 nt, Human
ugucaggcuuuauauuga

SEQ ID NO: 474666 - RNA, 21 nt, Human
ugucuaaacacuuguauaaag

SEQ ID NO: 474667 - RNA, 23 nt, Human
uuugcuguguucucugcucaggg

SEQ ID NO: 474668 - RNA, 21 nt, Human
aaaaacacuuguucauacagc

SEQ ID NO: 474669 - RNA, 23 nt, Human
aaaaacacuuguucauacagcua

SEQ ID NO: 474670 - RNA, 19 nt, Human
aacaaaauaguaaaauuca

SEQ ID NO: 474671 - RNA, 24 nt, Human
aacaaaauaguaaaauucagggaa

SEQ ID NO: 474672 - RNA, 21 nt, Human
aauaaagaagcaacuaagaga

SEQ ID NO: 474673 - RNA, 19 nt, Human
agauggaauagggaagaug

SEQ ID NO: 474674 - RNA, 24 nt, Human
agcaaaaaaaaaaaauuccaaaaa

SEQ ID NO: 474675 - RNA, 21 nt, Human
agguguggcgcguggcugagc

SEQ ID NO: 474676 - RNA, 22 nt, Human
auuuuauagcuucacaacugaa

SEQ ID NO: 474677 - RNA, 23 nt, Human
cacacauauuuucaaaccaacaa

SEQ ID NO: 474678 - RNA, 23 nt, Human
caguaaauucuguucuaaguauu

SEQ ID NO: 474679 - RNA, 24 nt, Human
cagucuauucaaaaccuuacgaac

SEQ ID NO: 474680 - RNA, 19 nt, Human
cauauuuguuccuuugagg

SEQ ID NO: 474681 - RNA, 22 nt, Human
ccaguguguucucuccauucua

SEQ ID NO: 474682 - RNA, 26 nt, Human
cuaaagaaaauguagaucaauuucag

SEQ ID NO: 474683 - RNA, 25 nt, Human
cucaaaucuucucuuccucuucauc

SEQ ID NO: 474684 - RNA, 19 nt, Human
cuuuauucaucuccucuuc

SEQ ID NO: 474685 - RNA, 20 nt, Human
gcaaguuauuagagaccuau

SEQ ID NO: 474686 - RNA, 21 nt, Human
gggaauucuucagccagaguc

SEQ ID NO: 474687 - RNA, 20 nt, Human
gguguggcgcguggcugagc

SEQ ID NO: 474688 - RNA, 22 nt, Human
uaaaauauucagggaauucuuc

SEQ ID NO: 474689 - RNA, 23 nt, Human
uaaaugcauuugugaucuccagu

SEQ ID NO: 474690 - RNA, 21 nt, Human
uaagagauuuacaagaaugga

SEQ ID NO: 474691 - RNA, 23 nt, Human
uagcaaaaaaaaaaaauuccaaa

SEQ ID NO: 474692 - RNA, 25 nt, Human
uagguauuuuucuuuucuauaaaug

SEQ ID NO: 474693 - RNA, 23 nt, Human
uauggcaugaguuugugcaugug

SEQ ID NO: 474694 - RNA, 21 nt, Human
ucaggguucccuuuuaucgug

SEQ ID NO: 474695 - RNA, 21 nt, Human
uccauacacagcagaagcuua

SEQ ID NO: 474696 - RNA, 25 nt, Human
ucuagcaaaaaaaaaaaauuccaaa

SEQ ID NO: 474697 - RNA, 19 nt, Human
ucuccaguguguucucuca

SEQ ID NO: 474698 - RNA, 19 nt, Human
ucuguguuauaaccuagag

SEQ ID NO: 474699 - RNA, 23 nt, Human
ugaaacaguuggugaaaaagaau

SEQ ID NO: 474700 - RNA, 19 nt, Human
ugaaauaaagaagcaacua

SEQ ID NO: 474701 - RNA, 23 nt, Human
uuaaacuuucucuucugcugggu

SEQ ID NO: 474702 - RNA, 23 nt, Human
uuagauuuuucucuccuuguuuu

SEQ ID NO: 474703 - RNA, 24 nt, Human
uucaaaaccuuacgaaccaaaucc

SEQ ID NO: 474704 - RNA, 22 nt, Human
uuccugaauaucauagcuaauu

SEQ ID NO: 474705 - RNA, 22 nt, Human
uuuagccagguguggcgcgugg

SEQ ID NO: 474706 - RNA, 24 nt, Human
uuugugaucuccaguguguucucu

SEQ ID NO: 474707 - RNA, 20 nt, Human
ggaagggcgggggcagaaug

SEQ ID NO: 474708 - RNA, 19 nt, Human
uacaaaucgcccgcgcccc

SEQ ID NO: 474709 - RNA, 19 nt, Human
aaaaauuagaugagaaagg

SEQ ID NO: 474710 - RNA, 20 nt, Human
aaaagaaaaauccuaugaga

SEQ ID NO: 474711 - RNA, 19 nt, Human
aaacaguuuccacuacuaa

SEQ ID NO: 474712 - RNA, 23 nt, Human
aaagaacucuugucuucgaauug

SEQ ID NO: 474713 - RNA, 29 nt, Human
aaauccuccuccauucaacagggcacucc

SEQ ID NO: 474714 - RNA, 18 nt, Human
aagacucccuccucccga

SEQ ID NO: 474715 - RNA, 22 nt, Human
aagcaagacucccuccucccga

SEQ ID NO: 474716 - RNA, 22 nt, Human
aagcauauugcauacauaagca

SEQ ID NO: 474717 - RNA, 18 nt, Human
acaagcccccaacagaca

SEQ ID NO: 474718 - RNA, 21 nt, Human
accaugaugagauuaucuuac

SEQ ID NO: 474719 - RNA, 20 nt, Human
agaaaaccccugugugaggg

SEQ ID NO: 474720 - RNA, 24 nt, Human
agaggcagcuggaaggucugauug

SEQ ID NO: 474721 - RNA, 18 nt, Human
aggacuaccauugccacu

SEQ ID NO: 474722 - RNA, 23 nt, Human
agugguggaggaugagugagagg

SEQ ID NO: 474723 - RNA, 23 nt, Human
aucaacacaagcccccaacagac

SEQ ID NO: 474724 - RNA, 20 nt, Human
caacaguagagcaaaggacc

SEQ ID NO: 474725 - RNA, 21 nt, Human
caagcaagacucccuccuccc

SEQ ID NO: 474726 - RNA, 23 nt, Human
caagccaauuauccacucaaacc

SEQ ID NO: 474727 - RNA, 21 nt, Human
cauauugcauacauaagcaua

SEQ ID NO: 474728 - RNA, 24 nt, Human
ccacagggucccuuggguaggggg

SEQ ID NO: 474729 - RNA, 27 nt, Human
cccccaacagacaaguacaugagaggc

SEQ ID NO: 474730 - RNA, 18 nt, Human
cccuccucccgauugucc

SEQ ID NO: 474731 - RNA, 23 nt, Human
cuccugaucaacacaagccccca

SEQ ID NO: 474732 - RNA, 22 nt, Human
cucugggagaggcuguuuggag

SEQ ID NO: 474733 - RNA, 23 nt, Human
cugugugagggaaaaaaaaaaaa

SEQ ID NO: 474734 - RNA, 19 nt, Human
gaccaaucauuuuguccac

SEQ ID NO: 474735 - RNA, 19 nt, Human
gagaggcagccgcagaggg

SEQ ID NO: 474736 - RNA, 23 nt, Human
gcagaggggaaacuccauccgga

SEQ ID NO: 474737 - RNA, 20 nt, Human
gcagccgcagaggggaaacu

SEQ ID NO: 474738 - RNA, 21 nt, Human
gcauauuuacacccacaucua

SEQ ID NO: 474739 - RNA, 19 nt, Human
gccaauuauccacucaaac

SEQ ID NO: 474740 - RNA, 19 nt, Human
ggaauccuucaugcccauu

SEQ ID NO: 474741 - RNA, 18 nt, Human
gggaaacuccauccggac

SEQ ID NO: 474742 - RNA, 18 nt, Human
ggggagacaaagggugug

SEQ ID NO: 474743 - RNA, 18 nt, Human
gggggagacaaagggugu

SEQ ID NO: 474744 - RNA, 20 nt, Human
guagagcaaaggaccugacc

SEQ ID NO: 474745 - RNA, 20 nt, Human
guuccaggccacaggguccc

SEQ ID NO: 474746 - RNA, 24 nt, Human
uaaaaauuagaugagaaaggcaaa

SEQ ID NO: 474747 - RNA, 20 nt, Human
uagcucaaaguaauccacag

SEQ ID NO: 474748 - RNA, 18 nt, Human
uaggacuaccauugccac

SEQ ID NO: 474749 - RNA, 28 nt, Human
uaggacuaccauugccacuuccaccaga

SEQ ID NO: 474750 - RNA, 23 nt, Human
uauaagcauauugcauacauagu

SEQ ID NO: 474751 - RNA, 22 nt, Human
uauagcauuucacacugcgguu

SEQ ID NO: 474752 - RNA, 23 nt, Human
uauauacuuuuccauacuucuga

SEQ ID NO: 474753 - RNA, 23 nt, Human
ucaacacaagcccccaacagaca

SEQ ID NO: 474754 - RNA, 23 nt, Human
uccaaacuugagcuccaagaaaa

SEQ ID NO: 474755 - RNA, 21 nt, Human
uccagcuugccaugggcgaga

SEQ ID NO: 474756 - RNA, 23 nt, Human
ugaaaugucuuuagcucaaagua

SEQ ID NO: 474757 - RNA, 20 nt, Human
ugagaaaaugaccacaagcc

SEQ ID NO: 474758 - RNA, 22 nt, Human
ugagaaaaugaccacaagccaa

SEQ ID NO: 474759 - RNA, 20 nt, Human
ugagaaaggcaaagaacucu

SEQ ID NO: 474760 - RNA, 22 nt, Human
ugagaggcagcuggaaggucug

SEQ ID NO: 474761 - RNA, 23 nt, Human
ugagugagaggcagccgcagagg

SEQ ID NO: 474762 - RNA, 21 nt, Human
uggaggaugagugagaggcag

SEQ ID NO: 474763 - RNA, 19 nt, Human
uggggucauccaaacuuga

SEQ ID NO: 474764 - RNA, 21 nt, Human
uggguagggggagacaaaggg

SEQ ID NO: 474765 - RNA, 23 nt, Human
uggguagggggagacaaagggug

SEQ ID NO: 474766 - RNA, 23 nt, Human
uggguagggggagacaaagggug

SEQ ID NO: 474767 - RNA, 21 nt, Human
uuagcucaaaguaauccacag

SEQ ID NO: 474768 - RNA, 23 nt, Human
uucauuugaaggaauccuucaug

SEQ ID NO: 474769 - RNA, 22 nt, Human
uuccacuacuaaaagaaaaauc

SEQ ID NO: 474770 - RNA, 18 nt, Human
aaaaaaccuuucuugauu

SEQ ID NO: 474771 - RNA, 18 nt, Human
aaauacuggaaguggcuu

SEQ ID NO: 474772 - RNA, 23 nt, Human
acaauggccaaaaaauacuggaa

SEQ ID NO: 474773 - RNA, 22 nt, Human
acacugacaauggccaaaaaau

SEQ ID NO: 474774 - RNA, 25 nt, Human
acacugacaauggccaaaaaauacu

SEQ ID NO: 474775 - RNA, 21 nt, Human
acuucuuuuguuuuuauaagg

SEQ ID NO: 474776 - RNA, 19 nt, Human
aguguccaaaagacuuuga

SEQ ID NO: 474777 - RNA, 23 nt, Human
ccaacggucugggagccggcugc

SEQ ID NO: 474778 - RNA, 18 nt, Human
ccagaggccagaaaaacc

SEQ ID NO: 474779 - RNA, 21 nt, Human
ccccgcccccuccucaccugg

SEQ ID NO: 474780 - RNA, 18 nt, Human
ccgccccccugccgcgcc

SEQ ID NO: 474781 - RNA, 18 nt, Human
cucccgccccccugccgc

SEQ ID NO: 474782 - RNA, 23 nt, Human
cucccgccccccugccgcgccuc

SEQ ID NO: 474783 - RNA, 21 nt, Human
cuccucaccugcgcagaccug

SEQ ID NO: 474784 - RNA, 24 nt, Human
cugggcucugacaauuucuuucug

SEQ ID NO: 474785 - RNA, 20 nt, Human
cuuccuagcaaugaccuggu

SEQ ID NO: 474786 - RNA, 21 nt, Human
gaggucgguccugccccgccc

SEQ ID NO: 474787 - RNA, 24 nt, Human
gaucguauuuuaauaaauuuccac

SEQ ID NO: 474788 - RNA, 18 nt, Human
uaaaacggagcuccugag

SEQ ID NO: 474789 - RNA, 23 nt, Human
uaaaacggagcuccugagacccc

SEQ ID NO: 474790 - RNA, 22 nt, Human
uacccagaguucuuccuagcaa

SEQ ID NO: 474791 - RNA, 23 nt, Human
uagcaaugaccuggucugauacu

SEQ ID NO: 474792 - RNA, 21 nt, Human
uaggaaggagcuaucugccag

SEQ ID NO: 474793 - RNA, 24 nt, Human
uaggaaggagcuaucugccagagg

SEQ ID NO: 474794 - RNA, 21 nt, Human
ucugacaauuucuuucugagc

SEQ ID NO: 474795 - RNA, 23 nt, Human
ucugggcucugacaauuucuuuc

SEQ ID NO: 474796 - RNA, 20 nt, Human
ugaauagaaucaagugucca

SEQ ID NO: 474797 - RNA, 19 nt, Human
ugaccuggucugauacugg

SEQ ID NO: 474798 - RNA, 21 nt, Human
ugagacccccuauuuucuagg

SEQ ID NO: 474799 - RNA, 21 nt, Human
ugcgaaggugguuaucauggc

SEQ ID NO: 474800 - RNA, 21 nt, Human
uggauugaauagaaucaagug

SEQ ID NO: 474801 - RNA, 21 nt, Human
ugggauauauaaacgcuaaaa

SEQ ID NO: 474802 - RNA, 18 nt, Human
uggguuucuaucugugac

SEQ ID NO: 474803 - RNA, 20 nt, Human
uuccgcggcucccgcccccc

SEQ ID NO: 474804 - RNA, 19 nt, Human
uuugcugcuauugcaauaa

SEQ ID NO: 474805 - RNA, 21 nt, Human
uuuuuuuuuuucaaaaugauc

SEQ ID NO: 474806 - RNA, 23 nt, Human
aacaacgagggucuauggaagga

SEQ ID NO: 474807 - RNA, 20 nt, Human
aaccacaaggaggaagcaac

SEQ ID NO: 474808 - RNA, 20 nt, Human
aagaauaaccagcccuuuaa

SEQ ID NO: 474809 - RNA, 20 nt, Human
aagcaacaacgagggucuau

SEQ ID NO: 474810 - RNA, 19 nt, Human
acaaggaggaagcaacaac

SEQ ID NO: 474811 - RNA, 21 nt, Human
accacaaggaggaagcaacaa

SEQ ID NO: 474812 - RNA, 24 nt, Human
agaaaagggggcggguugggggug

SEQ ID NO: 474813 - RNA, 24 nt, Human
agagaaaagggggcggguuggggg

SEQ ID NO: 474814 - RNA, 22 nt, Human
agcggaaggagcgguucccaga

SEQ ID NO: 474815 - RNA, 18 nt, Human
agcgguucccagagaaaa

SEQ ID NO: 474816 - RNA, 19 nt, Human
agguuccccucguacguuc

SEQ ID NO: 474817 - RNA, 18 nt, Human
auccggccagaaggacuc

SEQ ID NO: 474818 - RNA, 23 nt, Human
ccccgcagccuccaccccucccg

SEQ ID NO: 474819 - RNA, 23 nt, Human
cccgcagccuccaccccucccgc

SEQ ID NO: 474820 - RNA, 18 nt, Human
ccgcagccuccaccccuc

SEQ ID NO: 474821 - RNA, 19 nt, Human
ccgcgucccgcuuucagaa

SEQ ID NO: 474822 - RNA, 21 nt, Human
ccuccaccccucccgcguccc

SEQ ID NO: 474823 - RNA, 24 nt, Human
cggcuccccgcagccuccaccccu

SEQ ID NO: 474824 - RNA, 20 nt, Human
cuccccgcagccuccacccc

SEQ ID NO: 474825 - RNA, 22 nt, Human
cuccccgcagccuccaccccuc

SEQ ID NO: 474826 - RNA, 25 nt, Human
gaccccggcuccccgcagccuccac

SEQ ID NO: 474827 - RNA, 21 nt, Human
gagcgguucccagagaaaagg

SEQ ID NO: 474828 - RNA, 21 nt, Human
gcagacccacgcgggugaaug

SEQ ID NO: 474829 - RNA, 24 nt, Human
gcgcggacgcggcggggugcgggg

SEQ ID NO: 474830 - RNA, 23 nt, Human
gcggaauccggccagaaggacuc

SEQ ID NO: 474831 - RNA, 24 nt, Human
ggagagaggcgcgcggacgcggcg

SEQ ID NO: 474832 - RNA, 20 nt, Human
ggcggguugggggugcgcgc

SEQ ID NO: 474833 - RNA, 25 nt, Human
gggccggguccucuggggucugggg

SEQ ID NO: 474834 - RNA, 19 nt, Human
ggggagggacaggagaggg

SEQ ID NO: 474835 - RNA, 26 nt, Human
ggggagggacaggagaggggacaggu

SEQ ID NO: 474836 - RNA, 20 nt, Human
gggggccggguccucugggg

SEQ ID NO: 474837 - RNA, 19 nt, Human
gggugcggggaggggcaac

SEQ ID NO: 474838 - RNA, 21 nt, Human
uccccgcagccuccaccccuc

SEQ ID NO: 474839 - RNA, 21 nt, Human
ucgugugcgaccccggcuccc

SEQ ID NO: 474840 - RNA, 18 nt, Human
ucucgcuugggagacuaa

SEQ ID NO: 474841 - RNA, 19 nt, Human
ugggagacuaaaaacccgc

SEQ ID NO: 474842 - RNA, 24 nt, Human
ugugcgaccccggcuccccgcagc

SEQ ID NO: 474843 - RNA, 22 nt, Human
agcccaagcaccgguguugccu

SEQ ID NO: 474844 - RNA, 18 nt, Human
cacagcccaccucccucc

SEQ ID NO: 474845 - RNA, 20 nt, Human
caccugcccguccaugucag

SEQ ID NO: 474846 - RNA, 20 nt, Human
caggagacgacuguaggggc

SEQ ID NO: 474847 - RNA, 30 nt, Human
ccuaccugcaaacuuucaaagauggaagcu

SEQ ID NO: 474848 - RNA, 19 nt, Human
ccucccugguucuguuacu

SEQ ID NO: 474849 - RNA, 22 nt, Human
ccugcaaacuuucaaagaugga

SEQ ID NO: 474850 - RNA, 23 nt, Human
cgagagcacagagucucuggaau

SEQ ID NO: 474851 - RNA, 21 nt, Human
cucagcaggagcccaagcacc

SEQ ID NO: 474852 - RNA, 18 nt, Human
cugggacaggguuccucc

SEQ ID NO: 474853 - RNA, 19 nt, Human
cuucaagaggcacgaaaag

SEQ ID NO: 474854 - RNA, 21 nt, Human
gaacugcucagcaggagccca

SEQ ID NO: 474855 - RNA, 19 nt, Human
gaaucaccuucaagaggca

SEQ ID NO: 474856 - RNA, 22 nt, Human
gaggccacagcccaccucccuc

SEQ ID NO: 474857 - RNA, 20 nt, Human
gcaggaaagaacugcucagc

SEQ ID NO: 474858 - RNA, 18 nt, Human
ggaaagaacugcucagca

SEQ ID NO: 474859 - RNA, 19 nt, Human
gggcaggggaggccacagc

SEQ ID NO: 474860 - RNA, 23 nt, Human
ggggagcucugcagcucaguggc

SEQ ID NO: 474861 - RNA, 20 nt, Human
uagcugcgcugggcccuucg

SEQ ID NO: 474862 - RNA, 22 nt, Human
ucccuggggagcucugcagcuc

SEQ ID NO: 474863 - RNA, 21 nt, Human
ugagagaagugaguguuacug

SEQ ID NO: 474864 - RNA, 18 nt, Human
ugcccguccaugucagca

SEQ ID NO: 474865 - RNA, 18 nt, Human
uguaggggcaggggaggc

SEQ ID NO: 474866 - RNA, 20 nt, Human
ugucagcaccagguggcugu

SEQ ID NO: 474867 - RNA, 20 nt, Human
uguugccugcagggcgggcc

SEQ ID NO: 474868 - RNA, 27 nt, Human
aaaugucuuuucaaagcaguguuaucc

SEQ ID NO: 474869 - RNA, 21 nt, Human
aagagcaacagugaagcagag

SEQ ID NO: 474870 - RNA, 19 nt, Human
accacagcugcgccucugc

SEQ ID NO: 474871 - RNA, 25 nt, Human
accacccacacagucugagaggaca

SEQ ID NO: 474872 - RNA, 23 nt, Human
agaaggccccggcugcguggccc

SEQ ID NO: 474873 - RNA, 23 nt, Human
agaaggccccggcugcguggccc

SEQ ID NO: 474874 - RNA, 21 nt, Human
agccgccagcucaagcucaga

SEQ ID NO: 474875 - RNA, 25 nt, Human
caagcccguacggagcugcggccgg

SEQ ID NO: 474876 - RNA, 19 nt, Human
caccacagcugcgccucug

SEQ ID NO: 474877 - RNA, 21 nt, Human
caccacagcugcgccucugcc

SEQ ID NO: 474878 - RNA, 20 nt, Human
cacucgcucccggaagugga

SEQ ID NO: 474879 - RNA, 22 nt, Human
ccagcucaagcucagaacccga

SEQ ID NO: 474880 - RNA, 21 nt, Human
cccacacagucugagaggaca

SEQ ID NO: 474881 - RNA, 18 nt, Human
cccagcaauccaagcccg

SEQ ID NO: 474882 - RNA, 20 nt, Human
cccguacggagcugcggccg

SEQ ID NO: 474883 - RNA, 23 nt, Human
cggaaucccacgcucccuagccc

SEQ ID NO: 474884 - RNA, 20 nt, Human
cggguccugccggccgaggg

SEQ ID NO: 474885 - RNA, 20 nt, Human
cggguccugccggccgaggg

SEQ ID NO: 474886 - RNA, 20 nt, Human
cguggcccgcggguccugcc

SEQ ID NO: 474887 - RNA, 20 nt, Human
cguggcccgcggguccugcc

SEQ ID NO: 474888 - RNA, 26 nt, Human
cuggagcucccuguccccuuugcuga

SEQ ID NO: 474889 - RNA, 21 nt, Human
gaagugucaucagcuggugaa

SEQ ID NO: 474890 - RNA, 21 nt, Human
gaagugucaucagcuggugaa

SEQ ID NO: 474891 - RNA, 19 nt, Human
gagaaaggugagcuaaucu

SEQ ID NO: 474892 - RNA, 19 nt, Human
gagaaaggugagcuaaucu

SEQ ID NO: 474893 - RNA, 20 nt, Human
gagccgccagcucaagcuca

SEQ ID NO: 474894 - RNA, 21 nt, Human
gcaccgaggcccagcaaucca

SEQ ID NO: 474895 - RNA, 26 nt, Human
gcaucaucaucauuuucuuccaaucu

SEQ ID NO: 474896 - RNA, 18 nt, Human
ggaagugucaucagcugg

SEQ ID NO: 474897 - RNA, 18 nt, Human
ggaagugucaucagcugg

SEQ ID NO: 474898 - RNA, 27 nt, Human
ggcaucaucaucauuuucuuccaaucu

SEQ ID NO: 474899 - RNA, 19 nt, Human
uaacagccgcucacagucc

SEQ ID NO: 474900 - RNA, 24 nt, Human
ucagaacccgagugggggaggcug

SEQ ID NO: 474901 - RNA, 24 nt, Human
uccccacguagucugaaagcuucu

SEQ ID NO: 474902 - RNA, 23 nt, Human
ugagaggacagcugauuccuccc

SEQ ID NO: 474903 - RNA, 23 nt, Human
ugagcgggggaaacggcacucgc

SEQ ID NO: 474904 - RNA, 19 nt, Human
ugagcuccucuugucuucu

SEQ ID NO: 474905 - RNA, 19 nt, Human
uggggugcaccgaggccca

SEQ ID NO: 474906 - RNA, 22 nt, Human
uugcugaaucuuggcgauaauu

SEQ ID NO: 474907 - RNA, 26 nt, Human
uugcugaaucuuggcgauaauuuuuc

SEQ ID NO: 474908 - RNA, 23 nt, Human
uuggcgauaauuuugguuuuuuc

SEQ ID NO: 474909 - RNA, 20 nt, Human
uuuggaagugucaucagcug

SEQ ID NO: 474910 - RNA, 20 nt, Human
uuuggaagugucaucagcug

SEQ ID NO: 474911 - RNA, 21 nt, Human
uuuggaagugucaucagcugg

SEQ ID NO: 474912 - RNA, 23 nt, Human
aaaaggccaacaguggcaagaua

SEQ ID NO: 474913 - RNA, 19 nt, Human
aaaaucaaaaggccaacag

SEQ ID NO: 474914 - RNA, 26 nt, Human
aaacugguuuuauuucauaagauguu

SEQ ID NO: 474915 - RNA, 19 nt, Human
aaacuuacaaaccgccuca

SEQ ID NO: 474916 - RNA, 24 nt, Human
aaggcagguaagggagaagggggu

SEQ ID NO: 474917 - RNA, 27 nt, Human
aaucaggaaguaaaaguuuucccagaa

SEQ ID NO: 474918 - RNA, 18 nt, Human
agguaagggagaaggggg

SEQ ID NO: 474919 - RNA, 24 nt, Human
aucaaaaggccaacaguggcaaga

SEQ ID NO: 474920 - RNA, 21 nt, Human
auguaucuuuaaucaggaagu

SEQ ID NO: 474921 - RNA, 21 nt, Human
caaauaacuccuccagcucca

SEQ ID NO: 474922 - RNA, 22 nt, Human
caacaauguggcaacuggcauc

SEQ ID NO: 474923 - RNA, 21 nt, Human
cagaauucccaaggccaaagc

SEQ ID NO: 474924 - RNA, 21 nt, Human
cagcagcucaacaauguggca

SEQ ID NO: 474925 - RNA, 18 nt, Human
caguaagggggggaggag

SEQ ID NO: 474926 - RNA, 24 nt, Human
ccagcuccagucaucacuuuggug

SEQ ID NO: 474927 - RNA, 27 nt, Human
cccaaggccaaagcuguguccugaggc

SEQ ID NO: 474928 - RNA, 19 nt, Human
cgacccaaaacuuacaaac

SEQ ID NO: 474929 - RNA, 22 nt, Human
cgacccaaaacuuacaaaccgc

SEQ ID NO: 474930 - RNA, 25 nt, Human
cugaggccacugagaguuguuaguu

SEQ ID NO: 474931 - RNA, 23 nt, Human
gacccaaaacuuacaaaccgccu

SEQ ID NO: 474932 - RNA, 22 nt, Human
gcuccagucaucacuuuggugu

SEQ ID NO: 474933 - RNA, 21 nt, Human
gcugcauauguaucuuuaauc

SEQ ID NO: 474934 - RNA, 20 nt, Human
gggggaggagguggccuagc

SEQ ID NO: 474935 - RNA, 19 nt, Human
uauuucauaagauguuuag

SEQ ID NO: 474936 - RNA, 22 nt, Human
ucccaaggccaaagcugugucc

SEQ ID NO: 474937 - RNA, 23 nt, Human
uccccaacauucuagaauggaac

SEQ ID NO: 474938 - RNA, 22 nt, Human
ucuuuaaucaggaaguaaaagu

SEQ ID NO: 474939 - RNA, 23 nt, Human
ugaggccacugagaguuguuagu

SEQ ID NO: 474940 - RNA, 23 nt, Human
ugccccacuccccaacauucuag

SEQ ID NO: 474941 - RNA, 22 nt, Human
uggcaguaagggggggaggagg

SEQ ID NO: 474942 - RNA, 20 nt, Human
uggcaucuucguggcucucu

SEQ ID NO: 474943 - RNA, 26 nt, Human
uggcgaccuaccggaaaaaaaaaaaa

SEQ ID NO: 474944 - RNA, 24 nt, Human
uguguccugaggccacugagaguu

SEQ ID NO: 474945 - RNA, 24 nt, Human
uucaaauaacuccuccagcuccag

SEQ ID NO: 474946 - RNA, 20 nt, Human
uucaagaaaaagugggaaaa

SEQ ID NO: 474947 - RNA, 25 nt, Human
uugcaacagaggcugaaaggggagc

SEQ ID NO: 474948 - RNA, 23 nt, Human
uuuagagacaggcaauggcuggu

SEQ ID NO: 474949 - RNA, 23 nt, Human
uuuuuuuuuuuaaacaaaacugg

SEQ ID NO: 474950 - RNA, 24 nt, Human
aaagucccuccagcccacacaccu

SEQ ID NO: 474951 - RNA, 28 nt, Human
aaagucccuccagcccacacaccugcau

SEQ ID NO: 474952 - RNA, 18 nt, Human
aaauggccucuaagaaga

SEQ ID NO: 474953 - RNA, 21 nt, Human
aacucucucuucuuccaaagc

SEQ ID NO: 474954 - RNA, 21 nt, Human
accuaggugcccuuucugcua

SEQ ID NO: 474955 - RNA, 18 nt, Human
agcaacaccugggaugac

SEQ ID NO: 474956 - RNA, 21 nt, Human
augcuccugcucuaguugcac

SEQ ID NO: 474957 - RNA, 19 nt, Human
caauaaacucagcaacacc

SEQ ID NO: 474958 - RNA, 21 nt, Human
caccugcauagccuccccauu

SEQ ID NO: 474959 - RNA, 22 nt, Human
ccacugcaaucuuugucaaagg

SEQ ID NO: 474960 - RNA, 20 nt, Human
ccagcccacacaccugcaua

SEQ ID NO: 474961 - RNA, 25 nt, Human
cccacacaccugcauagccucccca

SEQ ID NO: 474962 - RNA, 20 nt, Human
ccuccagcccacacaccugc

SEQ ID NO: 474963 - RNA, 22 nt, Human
gcucaauaaacucagcaacacc

SEQ ID NO: 474964 - RNA, 21 nt, Human
gcucuaguugcacuugaccua

SEQ ID NO: 474965 - RNA, 23 nt, Human
guugcacuugaccuaggugcccu

SEQ ID NO: 474966 - RNA, 19 nt, Human
uaagaagaacgaggaacgg

SEQ ID NO: 474967 - RNA, 24 nt, Human
uaagcaagcaggcuaggugugcuc

SEQ ID NO: 474968 - RNA, 28 nt, Human
uagucaacucucucuucuuccaaagcuc

SEQ ID NO: 474969 - RNA, 18 nt, Human
ugcaaagucccuccagcc

SEQ ID NO: 474970 - RNA, 18 nt, Human
ugcuacaugcaaauggcc

SEQ ID NO: 474971 - RNA, 22 nt, Human
uggguccgugcagguaaucaag

SEQ ID NO: 474972 - RNA, 24 nt, Human
ugugcucaauaaacucagcaacac

SEQ ID NO: 474973 - RNA, 19 nt, Human
uuuuauuuuccuacucuuc

SEQ ID NO: 474974 - RNA, 22 nt, Human
aucugagaguuccaccgugagg

SEQ ID NO: 474975 - RNA, 19 nt, Human
augcugucaucugagaguu

SEQ ID NO: 474976 - RNA, 21 nt, Human
auggagccugcggagagaggc

SEQ ID NO: 474977 - RNA, 21 nt, Human
caccgugaggccucgccucuc

SEQ ID NO: 474978 - RNA, 18 nt, Human
cacuccacagaccucugc

SEQ ID NO: 474979 - RNA, 27 nt, Human
cagcaugggccagcguguuuauccccc

SEQ ID NO: 474980 - RNA, 18 nt, Human
cagcguguuuaucccccc

SEQ ID NO: 474981 - RNA, 25 nt, Human
cugcaugcugucaucugagaguucc

SEQ ID NO: 474982 - RNA, 18 nt, Human
cuguaugugcguccacuc

SEQ ID NO: 474983 - RNA, 24 nt, Human
gagcugguuauugguauguguggc

SEQ ID NO: 474984 - RNA, 21 nt, Human
ggccucgccucuccacuccac

SEQ ID NO: 474985 - RNA, 26 nt, Human
guguuuauccccccucuuuuugaacc

SEQ ID NO: 474986 - RNA, 22 nt, Human
ugcauguccccagcucagugca

SEQ ID NO: 474987 - RNA, 19 nt, Human
uuguugcauguccccagcu

SEQ ID NO: 474988 - RNA, 19 nt, Human
aaauagguuuuucagucuu

SEQ ID NO: 474989 - RNA, 20 nt, Human
agguuuuucagucucauaga

SEQ ID NO: 474990 - RNA, 19 nt, Human
agacacagcccccaacccc

SEQ ID NO: 474991 - RNA, 20 nt, Human
agacacagcccccaaccccc

SEQ ID NO: 474992 - RNA, 21 nt, Human
agagacacagcccccaacccc

SEQ ID NO: 474993 - RNA, 24 nt, Human
agccugggcgacagcgcgagacuc

SEQ ID NO: 474994 - RNA, 25 nt, Human
aggcgggaggaucgcucgaguccug

SEQ ID NO: 474995 - RNA, 20 nt, Human
aggcugaggcgggaggaucg

SEQ ID NO: 474996 - RNA, 24 nt, Human
aggcugaggcgggaggaucgcucg

SEQ ID NO: 474997 - RNA, 18 nt, Human
agggagcugggcuggcuc

SEQ ID NO: 474998 - RNA, 18 nt, Human
agggauggagagacacag

SEQ ID NO: 474999 - RNA, 20 nt, Human
auggagagacacagccccca

SEQ ID NO: 475000 - RNA, 23 nt, Human
auugcgcuccagccugggcgaca

SEQ ID NO: 475001 - RNA, 24 nt, Human
auugcgcuccagccugggcgacag

SEQ ID NO: 475002 - RNA, 25 nt, Human
cacagcccccaacccccagggagcu

SEQ ID NO: 475003 - RNA, 19 nt, Human
cauugcgcuccagccuggg

SEQ ID NO: 475004 - RNA, 20 nt, Human
cauugcgcuccagccugggc

SEQ ID NO: 475005 - RNA, 21 nt, Human
cauugcgcuccagccugggcg

SEQ ID NO: 475006 - RNA, 22 nt, Human
cauugcgcuccagccugggcga

SEQ ID NO: 475007 - RNA, 24 nt, Human
cauugcgcuccagccugggcgaca

SEQ ID NO: 475008 - RNA, 20 nt, Human
ccauugcgcuccagccuggg

SEQ ID NO: 475009 - RNA, 21 nt, Human
ccauugcgcuccagccugggc

SEQ ID NO: 475010 - RNA, 22 nt, Human
ccauugcgcuccagccugggcg

SEQ ID NO: 475011 - RNA, 23 nt, Human
ccauugcgcuccagccugggcga

SEQ ID NO: 475012 - RNA, 24 nt, Human
ccauugcgcuccagccugggcgac

SEQ ID NO: 475013 - RNA, 28 nt, Human
cccacgaucuagacagaaaccggggucc

SEQ ID NO: 475014 - RNA, 25 nt, Human
cccacgaucuagacagaaacucguu

SEQ ID NO: 475015 - RNA, 21 nt, Human
ccccaacccccagggagcugg

SEQ ID NO: 475016 - RNA, 24 nt, Human
ccccaacccccagggagcugggcu

SEQ ID NO: 475017 - RNA, 18 nt, Human
cccccaacccccagggag

SEQ ID NO: 475018 - RNA, 23 nt, Human
cccccagggagcugggcuggcuc

SEQ ID NO: 475019 - RNA, 19 nt, Human
cucgugcuccgcgccaccc

SEQ ID NO: 475020 - RNA, 22 nt, Human
cugccgcggggcucgcguccuc

SEQ ID NO: 475021 - RNA, 26 nt, Human
cugggcgacagcgcgagacuccuucu

SEQ ID NO: 475022 - RNA, 20 nt, Human
gagacacagcccccaacccc

SEQ ID NO: 475023 - RNA, 23 nt, Human
gagacuccuucucaaauauagaa

SEQ ID NO: 475024 - RNA, 22 nt, Human
gccauugcgcuccagccugggc

SEQ ID NO: 475025 - RNA, 24 nt, Human
gccauugcgcuccagccugggcga

SEQ ID NO: 475026 - RNA, 21 nt, Human
gcccccaacccccagggagcu

SEQ ID NO: 475027 - RNA, 24 nt, Human
ggagagacacagcccccaaccccc

SEQ ID NO: 475028 - RNA, 21 nt, Human
gugcugcuucucgagaggcug

SEQ ID NO: 475029 - RNA, 24 nt, Human
uccagccugggcgacagcgcgaga

SEQ ID NO: 475030 - RNA, 18 nt, Human
ucccccacgaucuagaca

SEQ ID NO: 475031 - RNA, 25 nt, Human
uccuucucaaauauagaauuuuaaa

SEQ ID NO: 475032 - RNA, 23 nt, Human
ucgcgccauugcgcuccagccug

SEQ ID NO: 475033 - RNA, 22 nt, Human
ugaggcgggaggaucgcucgag

SEQ ID NO: 475034 - RNA, 18 nt, Human
ugaguugggaguugcugu

SEQ ID NO: 475035 - RNA, 22 nt, Human
ugcgcuccagccugggcgacag

SEQ ID NO: 475036 - RNA, 24 nt, Human
uucgcgccauugcgcuccagccug

SEQ ID NO: 475037 - RNA, 18 nt, Human
uuugaagcuuccuccuuu

SEQ ID NO: 475038 - RNA, 20 nt, Human
uuugaagcuuccuccuuugu

SEQ ID NO: 475039 - RNA, 23 nt, Human
uuugaagcuuccuccuuuguaca

SEQ ID NO: 475040 - RNA, 21 nt, Human
uuuuuuuuuuuuuugaguugg

SEQ ID NO: 475041 - RNA, 24 nt, Human
uuuuuuuuuuuuuuuugaguuggg

SEQ ID NO: 475042 - RNA, 18 nt, Human
uuuuuuuuuuuuuuuuug

SEQ ID NO: 475043 - RNA, 18 nt, Human
aaaccuggcaggcaggca

SEQ ID NO: 475044 - RNA, 24 nt, Human
acccagaggccagcagcagaggac

SEQ ID NO: 475045 - RNA, 18 nt, Human
accucgcgccuccccgcc

SEQ ID NO: 475046 - RNA, 20 nt, Human
agaaagugugggcagaagcc

SEQ ID NO: 475047 - RNA, 25 nt, Human
agacaaaggccaggcccaggugaaa

SEQ ID NO: 475048 - RNA, 18 nt, Human
agccaggggcggggcagg

SEQ ID NO: 475049 - RNA, 19 nt, Human
agcccaggcugcccagccu

SEQ ID NO: 475050 - RNA, 23 nt, Human
agccugcacuggcagagcugacg

SEQ ID NO: 475051 - RNA, 23 nt, Human
aggacggggccggggccgggaga

SEQ ID NO: 475052 - RNA, 21 nt, Human
aggcaggcaggagcccguggg

SEQ ID NO: 475053 - RNA, 18 nt, Human
agggagggaagcuagggg

SEQ ID NO: 475054 - RNA, 23 nt, Human
agggauagggagggaagcuagga

SEQ ID NO: 475055 - RNA, 22 nt, Human
aggugcugggggaccgcgggcg

SEQ ID NO: 475056 - RNA, 21 nt, Human
augagcccuggagaucuggaa

SEQ ID NO: 475057 - RNA, 24 nt, Human
cacgacccagaggccagcagcaga

SEQ ID NO: 475058 - RNA, 19 nt, Human
cacuggcagagcugacgga

SEQ ID NO: 475059 - RNA, 24 nt, Human
cagcagaggacggggccggggccg

SEQ ID NO: 475060 - RNA, 22 nt, Human
caggacccccaagcgcagcuca

SEQ ID NO: 475061 - RNA, 22 nt, Human
caggagcccgugggggaggguu

SEQ ID NO: 475062 - RNA, 18 nt, Human
cagggccccccgggugcc

SEQ ID NO: 475063 - RNA, 20 nt, Human
cagggccccccgggugcccc

SEQ ID NO: 475064 - RNA, 23 nt, Human
cagggucauggccuggccccuca

SEQ ID NO: 475065 - RNA, 18 nt, Human
cagguggagacaaaggcc

SEQ ID NO: 475066 - RNA, 18 nt, Human
cauccuuguccuccagga

SEQ ID NO: 475067 - RNA, 21 nt, Human
cccagggccccccgggugccc

SEQ ID NO: 475068 - RNA, 22 nt, Human
ccccaagcgcagcucagucugc

SEQ ID NO: 475069 - RNA, 20 nt, Human
ccccagaaggaccucgcgcc

SEQ ID NO: 475070 - RNA, 25 nt, Human
ccccagaaggaccucgcgccucccc

SEQ ID NO: 475071 - RNA, 19 nt, Human
ccccagggaggugaggggg

SEQ ID NO: 475072 - RNA, 21 nt, Human
cccccaagcgcagcucagucu

SEQ ID NO: 475073 - RNA, 22 nt, Human
cccccaagcgcagcucagucug

SEQ ID NO: 475074 - RNA, 23 nt, Human
cccccagaaggaccucgcgccuc

SEQ ID NO: 475075 - RNA, 18 nt, Human
ccccucauccccagggag

SEQ ID NO: 475076 - RNA, 24 nt, Human
ccgccaggacccccaagcgcagcu

SEQ ID NO: 475077 - RNA, 19 nt, Human
ccgccgggcuccgaccgcc

SEQ ID NO: 475078 - RNA, 20 nt, Human
ccgccgggcuccgaccgccu

SEQ ID NO: 475079 - RNA, 20 nt, Human
ccucaggcugcagggauagg

SEQ ID NO: 475080 - RNA, 18 nt, Human
ccucauccuuguccucca

SEQ ID NO: 475081 - RNA, 21 nt, Human
cgacccagaggccagcagcag

SEQ ID NO: 475082 - RNA, 23 nt, Human
cgacccagggccccccgggugcc

SEQ ID NO: 475083 - RNA, 24 nt, Human
cgccaggacccccaagcgcagcuc

SEQ ID NO: 475084 - RNA, 25 nt, Human
cuaaagcccaggcugcccagccugc

SEQ ID NO: 475085 - RNA, 18 nt, Human
cucauccuuguccuccag

SEQ ID NO: 475086 - RNA, 22 nt, Human
cucgcgccuccccgccgggcuc

SEQ ID NO: 475087 - RNA, 24 nt, Human
gacccagaggccagcagcagagga

SEQ ID NO: 475088 - RNA, 23 nt, Human
gaccucgcgccuccccgccgggc

SEQ ID NO: 475089 - RNA, 20 nt, Human
gacucauaguuguuuuccuu

SEQ ID NO: 475090 - RNA, 18 nt, Human
gagcccuggagaucugga

SEQ ID NO: 475091 - RNA, 23 nt, Human
gcagaagccagcucuaaagccca

SEQ ID NO: 475092 - RNA, 25 nt, Human
gcagaagccagcucuaaagcccagg

SEQ ID NO: 475093 - RNA, 20 nt, Human
gccccgguggagaaggcgcu

SEQ ID NO: 475094 - RNA, 20 nt, Human
gcccuggagaucuggaauga

SEQ ID NO: 475095 - RNA, 25 nt, Human
gccgaaugugcugccggaguccccc

SEQ ID NO: 475096 - RNA, 19 nt, Human
gccuggguucggugcggga

SEQ ID NO: 475097 - RNA, 26 nt, Human
gcguuuggcagacucauaguuguuuu

SEQ ID NO: 475098 - RNA, 19 nt, Human
gcuuggggaggugcugggg

SEQ ID NO: 475099 - RNA, 25 nt, Human
ggagcccagguggggacuuaagggu

SEQ ID NO: 475100 - RNA, 18 nt, Human
ggagggaagcuaggggug

SEQ ID NO: 475101 - RNA, 20 nt, Human
ggcacgacccagaggccagc

SEQ ID NO: 475102 - RNA, 22 nt, Human
ggcaggagcccgugggggaggg

SEQ ID NO: 475103 - RNA, 18 nt, Human
ggcggggcaggagcccag

SEQ ID NO: 475104 - RNA, 21 nt, Human
gggaggugcugggggaccgcg

SEQ ID NO: 475105 - RNA, 19 nt, Human
gggcaggagcccagguggg

SEQ ID NO: 475106 - RNA, 26 nt, Human
gggccggggccgggagagggcgggga

SEQ ID NO: 475107 - RNA, 25 nt, Human
ggggcaggagcccagguggggacuu

SEQ ID NO: 475108 - RNA, 18 nt, Human
gguaugucaggagcuggg

SEQ ID NO: 475109 - RNA, 19 nt, Human
guguggcuuggggaggugc

SEQ ID NO: 475110 - RNA, 18 nt, Human
uauccacauuccuccucc

SEQ ID NO: 475111 - RNA, 19 nt, Human
ucauccuuguccuccagga

SEQ ID NO: 475112 - RNA, 23 nt, Human
uccccagugaccuagaaauccau

SEQ ID NO: 475113 - RNA, 21 nt, Human
uccgccccgacccagggcccc

SEQ ID NO: 475114 - RNA, 22 nt, Human
ucggugcgggacggcccaggcc

SEQ ID NO: 475115 - RNA, 19 nt, Human
ucuaaagcccaggcugccc

SEQ ID NO: 475116 - RNA, 21 nt, Human
ugacagaguauggggugagaa

SEQ ID NO: 475117 - RNA, 19 nt, Human
ugagcguggaaucguugcc

SEQ ID NO: 475118 - RNA, 18 nt, Human
ugaggcagaugugcccag

SEQ ID NO: 475119 - RNA, 23 nt, Human
ugcccagccugcacuggcagagc

SEQ ID NO: 475120 - RNA, 19 nt, Human
ugccccuuugagcguggaa

SEQ ID NO: 475121 - RNA, 19 nt, Human
ugccggaguccccagugac

SEQ ID NO: 475122 - RNA, 19 nt, Human
uggaacacacaggcagcca

SEQ ID NO: 475123 - RNA, 19 nt, Human
uggagacaaaggccaggcc

SEQ ID NO: 475124 - RNA, 26 nt, Human
uggcagugacagaguauggggugaga

SEQ ID NO: 475125 - RNA, 21 nt, Human
ugggaggucaaggccagggcu

SEQ ID NO: 475126 - RNA, 19 nt, Human
aaaaacauauaucuuugga

SEQ ID NO: 475127 - RNA, 23 nt, Human
aaacaauauuuuuccaugucccc

SEQ ID NO: 475128 - RNA, 23 nt, Human
aaacaucuccuuaaauccaaaac

SEQ ID NO: 475129 - RNA, 31 nt, Human
aagaaaaaaacauauaucuuuggaaaagaaa

SEQ ID NO: 475130 - RNA, 23 nt, Human
aagaguucaauuugagaaaaugu

SEQ ID NO: 475131 - RNA, 23 nt, Human
acccaaguaauguccaaacaaua

SEQ ID NO: 475132 - RNA, 19 nt, Human
agacaguugucaugugggu

SEQ ID NO: 475133 - RNA, 21 nt, Human
auagacaguugucaugugggu

SEQ ID NO: 475134 - RNA, 23 nt, Human
aucuccuuaaauccaaaacaaaa

SEQ ID NO: 475135 - RNA, 21 nt, Human
aucuuuggaaaagaauucuga

SEQ ID NO: 475136 - RNA, 18 nt, Human
augaagcaaaugcagccu

SEQ ID NO: 475137 - RNA, 24 nt, Human
caaaacaaaacaauaguuacaagu

SEQ ID NO: 475138 - RNA, 20 nt, Human
caaguaauguccaaacaaua

SEQ ID NO: 475139 - RNA, 20 nt, Human
caaguugucuuucaccuccc

SEQ ID NO: 475140 - RNA, 19 nt, Human
cacacugaaaaauuuaaag

SEQ ID NO: 475141 - RNA, 20 nt, Human
cacagcccucccucgcucuc

SEQ ID NO: 475142 - RNA, 20 nt, Human
caccucccaugucuuaaucu

SEQ ID NO: 475143 - RNA, 18 nt, Human
cagagauguuuacuguga

SEQ ID NO: 475144 - RNA, 19 nt, Human
cagccaguuagcauuggca

SEQ ID NO: 475145 - RNA, 19 nt, Human
cagcccucccucgcucucg

SEQ ID NO: 475146 - RNA, 20 nt, Human
cauguccccccucccccaga

SEQ ID NO: 475147 - RNA, 18 nt, Human
ccagaacacacacaggca

SEQ ID NO: 475148 - RNA, 22 nt, Human
ccauguccccccucccccagaa

SEQ ID NO: 475149 - RNA, 23 nt, Human
cccccucccccagaacacacaca

SEQ ID NO: 475150 - RNA, 24 nt, Human
cuggcaguccucacagcccucccu

SEQ ID NO: 475151 - RNA, 25 nt, Human
cuuugcaugacaguaauuuaaccac

SEQ ID NO: 475152 - RNA, 24 nt, Human
ggugauagguagaacaaggagaaa

SEQ ID NO: 475153 - RNA, 22 nt, Human
guugucauguggguaauacaga

SEQ ID NO: 475154 - RNA, 19 nt, Human
uaaauccaaaacaaaacaa

SEQ ID NO: 475155 - RNA, 26 nt, Human
ucaauagucuauuuuuaucauuuucu

SEQ ID NO: 475156 - RNA, 21 nt, Human
ucaccucccaugucuuaaucu

SEQ ID NO: 475157 - RNA, 23 nt, Human
uccaaaaacauauacuaguaaua

SEQ ID NO: 475158 - RNA, 19 nt, Human
uccaaaacaaaacaauagu

SEQ ID NO: 475159 - RNA, 21 nt, Human
uccauguccccccucccccag

SEQ ID NO: 475160 - RNA, 23 nt, Human
ucccccagaacacacacaggcaa

SEQ ID NO: 475161 - RNA, 19 nt, Human
uccccccucccccagaacc

SEQ ID NO: 475162 - RNA, 19 nt, Human
ucugacaguuuaaauuuga

SEQ ID NO: 475163 - RNA, 25 nt, Human
ugaaaaagaaguuacaugaauagaa

SEQ ID NO: 475164 - RNA, 25 nt, Human
ugaagcaaaugcagccuuaucuguu

SEQ ID NO: 475165 - RNA, 26 nt, Human
ugcuuugguuacaaacaugguuucug

SEQ ID NO: 475166 - RNA, 21 nt, Human
ugucauguggguaauacagag

SEQ ID NO: 475167 - RNA, 24 nt, Human
uguccccccucccccagaacacac

SEQ ID NO: 475168 - RNA, 21 nt, Human
uguggugauagguagaacaag

SEQ ID NO: 475169 - RNA, 22 nt, Human
uguggugauagguagaacaagg

SEQ ID NO: 475170 - RNA, 18 nt, Human
uguuguacagcaugauca

SEQ ID NO: 475171 - RNA, 27 nt, Human
uuaaugaucucauuuaaaauaucccuu

SEQ ID NO: 475172 - RNA, 22 nt, Human
uuacugaucuaaaacaucuccu

SEQ ID NO: 475173 - RNA, 21 nt, Human
uucaugaagaagcuuuuagga

SEQ ID NO: 475174 - RNA, 26 nt, Human
uugaaggauaaaaaucagaguauaaa

SEQ ID NO: 475175 - RNA, 21 nt, Human
uugucccaugguuuaacucug

SEQ ID NO: 475176 - RNA, 21 nt, Human
uugucuuucaccucccauguc

SEQ ID NO: 475177 - RNA, 25 nt, Human
uuuaaaauaucccuucucucaagcu

SEQ ID NO: 475178 - RNA, 18 nt, Human
uuuuccauguccccccuc

SEQ ID NO: 475179 - RNA, 21 nt, Human
cccacauguguccugaggagu

SEQ ID NO: 475180 - RNA, 24 nt, Human
cccacauguguccugaggaguugu

SEQ ID NO: 475181 - RNA, 20 nt, Human
gcggagcacggccucgugcc

SEQ ID NO: 475182 - RNA, 21 nt, Human
gcucucuacuuggcccacaug

SEQ ID NO: 475183 - RNA, 18 nt, Human
ggaaguucacagagccau

SEQ ID NO: 475184 - RNA, 18 nt, Human
ggccaugguccuugaggg

SEQ ID NO: 475185 - RNA, 20 nt, Human
ugagccccacaaccgaccag

SEQ ID NO: 475186 - RNA, 26 nt, Human
uggcagugcaggggaaguucacagag

SEQ ID NO: 475187 - RNA, 20 nt, Human
uuuuuugggaacggcccugg

SEQ ID NO: 475188 - RNA, 23 nt, Human
uuuuuuuuugggaacggcccugg

SEQ ID NO: 475189 - RNA, 24 nt, Human
uuuuuuuuuugggaacggcccugg

SEQ ID NO: 475190 - RNA, 24 nt, Human
uuuuuuuuuuuuuuuuuuuuuggg

SEQ ID NO: 475191 - RNA, 20 nt, Human
acaagaagagguucugagac

SEQ ID NO: 475192 - RNA, 25 nt, Human
caagaugaacaauuaacuucagccc

SEQ ID NO: 475193 - RNA, 21 nt, Human
cccagggaaacacugaaccag

SEQ ID NO: 475194 - RNA, 24 nt, Human
cgggaaugaugggaaaaugcgaca

SEQ ID NO: 475195 - RNA, 18 nt, Human
cucagggcagggggcaga

SEQ ID NO: 475196 - RNA, 19 nt, Human
gaaccagaugcuacaggag

SEQ ID NO: 475197 - RNA, 22 nt, Human
gggaaugaugggaaaaugcgac

SEQ ID NO: 475198 - RNA, 18 nt, Human
ugagacgaggccagcuau

SEQ ID NO: 475199 - RNA, 19 nt, Human
ugagacgaggccagcuaug

SEQ ID NO: 475200 - RNA, 18 nt, Human
ugugcaugagaacuaaag

SEQ ID NO: 475201 - RNA, 21 nt, Human
uucagcccagggaaacacuga

SEQ ID NO: 475202 - RNA, 19 nt, Human
agaccaauaaagggcaggg

SEQ ID NO: 475203 - RNA, 18 nt, Human
agauguuaaauacugccu

SEQ ID NO: 475204 - RNA, 23 nt, Human
ccuguccgcuccgcgggccacca

SEQ ID NO: 475205 - RNA, 24 nt, Human
cgcgggccaccaccgccguuccgu

SEQ ID NO: 475206 - RNA, 21 nt, Human
gagaccaauaaagggcagggc

SEQ ID NO: 475207 - RNA, 22 nt, Human
gggcagggcauacgaaguaagu

SEQ ID NO: 475208 - RNA, 25 nt, Human
uaaaaaaacggaccacaacuuucuu

SEQ ID NO: 475209 - RNA, 18 nt, Human
ucgauggcaacguggcgg

SEQ ID NO: 475210 - RNA, 18 nt, Human
ucugggagaccaauaaag

SEQ ID NO: 475211 - RNA, 20 nt, Human
ugaccauaaaaaaacggacc

SEQ ID NO: 475212 - RNA, 19 nt, Human
aagccaggaaggggcgggg

SEQ ID NO: 475213 - RNA, 21 nt, Human
aaggggccacggcagccuggg

SEQ ID NO: 475214 - RNA, 25 nt, Human
acaccaaaccugccggggcccuggu

SEQ ID NO: 475215 - RNA, 22 nt, Human
acagguaccuucuuacagcagc

SEQ ID NO: 475216 - RNA, 18 nt, Human
accagagcuugcuggagc

SEQ ID NO: 475217 - RNA, 23 nt, Human
acccucgcugggcuguggcccug

SEQ ID NO: 475218 - RNA, 19 nt, Human
acgcucccccaccucaccc

SEQ ID NO: 475219 - RNA, 26 nt, Human
acgcucccccaccucacccucgcugg

SEQ ID NO: 475220 - RNA, 21 nt, Human
agaugcuaggggcagagagcc

SEQ ID NO: 475221 - RNA, 24 nt, Human
agcagcugcccagcccaaggcucc

SEQ ID NO: 475222 - RNA, 19 nt, Human
agccaggaaggggcggggg

SEQ ID NO: 475223 - RNA, 21 nt, Human
agcccuucucuccuucuccuu

SEQ ID NO: 475224 - RNA, 19 nt, Human
aggaaggggcggggguggu

SEQ ID NO: 475225 - RNA, 22 nt, Human
aggagaagguccagaaggugaa

SEQ ID NO: 475226 - RNA, 18 nt, Human
aggccagcagcugcccag

SEQ ID NO: 475227 - RNA, 25 nt, Human
aggggccagggaggagaugcuaggg

SEQ ID NO: 475228 - RNA, 23 nt, Human
agggucagggaggcuggauggcu

SEQ ID NO: 475229 - RNA, 23 nt, Human
agguaccagagcuugcuggagcu

SEQ ID NO: 475230 - RNA, 21 nt, Human
aggugggccgggcacagggcg

SEQ ID NO: 475231 - RNA, 20 nt, Human
aggugggucucagccuggga

SEQ ID NO: 475232 - RNA, 24 nt, Human
caacaguguucagaggugaggccu

SEQ ID NO: 475233 - RNA, 23 nt, Human
caccaaaccugccggggcccugg

SEQ ID NO: 475234 - RNA, 23 nt, Human
caccgugugagccacauacuuuc

SEQ ID NO: 475235 - RNA, 18 nt, Human
cacuggccucacaccgug

SEQ ID NO: 475236 - RNA, 22 nt, Human
cagaagccaggaaggggcgggg

SEQ ID NO: 475237 - RNA, 23 nt, Human
cagcagcugcccagcccaaggcc

SEQ ID NO: 475238 - RNA, 24 nt, Human
cagcagcugcccagcccaaggcuc

SEQ ID NO: 475239 - RNA, 21 nt, Human
caggaaggggcggggguggug

SEQ ID NO: 475240 - RNA, 19 nt, Human
caggcagacugguagcuga

SEQ ID NO: 475241 - RNA, 22 nt, Human
caggguaaaguggggaagaagg

SEQ ID NO: 475242 - RNA, 19 nt, Human
caggugcccucccucaggu

SEQ ID NO: 475243 - RNA, 26 nt, Human
cagugaaugccuccucuccacggucu

SEQ ID NO: 475244 - RNA, 20 nt, Human
ccagccacaugcuccgugcc

SEQ ID NO: 475245 - RNA, 23 nt, Human
ccagccccaccaugcuuccugca

SEQ ID NO: 475246 - RNA, 20 nt, Human
ccaggguaaaguggggaaga

SEQ ID NO: 475247 - RNA, 21 nt, Human
cccaggcucgugaaucgccuc

SEQ ID NO: 475248 - RNA, 23 nt, Human
cccgugguugcagguaccagagc

SEQ ID NO: 475249 - RNA, 19 nt, Human
cccucccucaggugagagu

SEQ ID NO: 475250 - RNA, 23 nt, Human
cccucgcugggcuguggccccuu

SEQ ID NO: 475251 - RNA, 19 nt, Human
cccuggggccagccaagcu

SEQ ID NO: 475252 - RNA, 23 nt, Human
ccgugcccacagaucccuggggc

SEQ ID NO: 475253 - RNA, 21 nt, Human
ccguguggagggucagggagg

SEQ ID NO: 475254 - RNA, 20 nt, Human
ccucagccaggacgcucccc

SEQ ID NO: 475255 - RNA, 24 nt, Human
ccucaggugagaguccacucggcc

SEQ ID NO: 475256 - RNA, 20 nt, Human
ccuccgaaauccauguugaa

SEQ ID NO: 475257 - RNA, 18 nt, Human
ccuccugccuucugcuau

SEQ ID NO: 475258 - RNA, 18 nt, Human
ccugcuccgugccuggca

SEQ ID NO: 475259 - RNA, 18 nt, Human
ccuggccagcaggcgucc

SEQ ID NO: 475260 - RNA, 18 nt, Human
ccugggaccgcccagccc

SEQ ID NO: 475261 - RNA, 22 nt, Human
ccuucucuccuucuccuguguc

SEQ ID NO: 475262 - RNA, 23 nt, Human
cgcugggcuguggcccuggggac

SEQ ID NO: 475263 - RNA, 30 nt, Human
cgucccguccccugcguugggcagcuucaa

SEQ ID NO: 475264 - RNA, 20 nt, Human
cuccacaccugcuccgugcc

SEQ ID NO: 475265 - RNA, 19 nt, Human
cucccccaccucacccucg

SEQ ID NO: 475266 - RNA, 21 nt, Human
cuccucuccacggucuccaac

SEQ ID NO: 475267 - RNA, 18 nt, Human
cuccugugucucuccagg

SEQ ID NO: 475268 - RNA, 21 nt, Human
cucuccacggucuccaugucc

SEQ ID NO: 475269 - RNA, 22 nt, Human
cugcuccgugccuggcagucaa

SEQ ID NO: 475270 - RNA, 18 nt, Human
cugcuccuaagcgccccc

SEQ ID NO: 475271 - RNA, 18 nt, Human
cuguguuccuccgaaauc

SEQ ID NO: 475272 - RNA, 21 nt, Human
cuguguuccuccgaaauccau

SEQ ID NO: 475273 - RNA, 21 nt, Human
cuucaccugcucauccugcuc

SEQ ID NO: 475274 - RNA, 22 nt, Human
cuucugcuaugagaggacacag

SEQ ID NO: 475275 - RNA, 18 nt, Human
cuugcuggagcuggcugg

SEQ ID NO: 475276 - RNA, 20 nt, Human
cuugcuggagcuggcugggc

SEQ ID NO: 475277 - RNA, 22 nt, Human
cuugcuggagcuggcugggcuu

SEQ ID NO: 475278 - RNA, 24 nt, Human
gcaccaccgugugagccacauacu

SEQ ID NO: 475279 - RNA, 24 nt, Human
gcagagagcaguccucgccaaaca

SEQ ID NO: 475280 - RNA, 19 nt, Human
gcagucaugguccaggggc

SEQ ID NO: 475281 - RNA, 24 nt, Human
gccaccacuggccucacaccgugg

SEQ ID NO: 475282 - RNA, 18 nt, Human
gcccaaggcuccuugcac

SEQ ID NO: 475283 - RNA, 18 nt, Human
gcccgugguugcagguac

SEQ ID NO: 475284 - RNA, 25 nt, Human
gcccucagccaggacgcucccccac

SEQ ID NO: 475285 - RNA, 20 nt, Human
gccgggcacagggcggcccg

SEQ ID NO: 475286 - RNA, 22 nt, Human
gccuccucuccacggucuccau

SEQ ID NO: 475287 - RNA, 19 nt, Human
gcggggguggugcggaagc

SEQ ID NO: 475288 - RNA, 19 nt, Human
gcucccccaccucacccuc

SEQ ID NO: 475289 - RNA, 24 nt, Human
gcuuccugcagaugcgagcagcca

SEQ ID NO: 475290 - RNA, 22 nt, Human
ggacgcucccccaccucacccu

SEQ ID NO: 475291 - RNA, 21 nt, Human
ggacucggauccaggccagca

SEQ ID NO: 475292 - RNA, 24 nt, Human
ggauaggagaagguccagaaggug

SEQ ID NO: 475293 - RNA, 22 nt, Human
gggaggcuggauggcuuuuccu

SEQ ID NO: 475294 - RNA, 22 nt, Human
gggcaggacucggauccaggcc

SEQ ID NO: 475295 - RNA, 19 nt, Human
gguaaaguggggaagaagg

SEQ ID NO: 475296 - RNA, 19 nt, Human
ggucuugggaggcugaugu

SEQ ID NO: 475297 - RNA, 21 nt, Human
gugaaugccuccucuccacgg

SEQ ID NO: 475298 - RNA, 19 nt, Human
gugggugaauuucaucaug

SEQ ID NO: 475299 - RNA, 20 nt, Human
guguggagggucagggaggc

SEQ ID NO: 475300 - RNA, 24 nt, Human
guucaguuucacagaagccaggaa

SEQ ID NO: 475301 - RNA, 19 nt, Human
guuucacagaagccaggaa

SEQ ID NO: 475302 - RNA, 19 nt, Human
uacagaauagcccuucucu

SEQ ID NO: 475303 - RNA, 22 nt, Human
uacagcagcacaaaggggccac

SEQ ID NO: 475304 - RNA, 19 nt, Human
uagcccuucucuccuucuc

SEQ ID NO: 475305 - RNA, 25 nt, Human
uaggagaagguccagaaggugaagu

SEQ ID NO: 475306 - RNA, 21 nt, Human
uaggggcagagagccaaggug

SEQ ID NO: 475307 - RNA, 23 nt, Human
ucagccaggacgcucccccaccu

SEQ ID NO: 475308 - RNA, 23 nt, Human
uccacggucuccaugucccuggc

SEQ ID NO: 475309 - RNA, 20 nt, Human
uccaggggccagggaggaga

SEQ ID NO: 475310 - RNA, 18 nt, Human
ucccucaggugagagucc

SEQ ID NO: 475311 - RNA, 20 nt, Human
ucuccaggggccagggagga

SEQ ID NO: 475312 - RNA, 21 nt, Human
ucuccuucuccugugucucuc

SEQ ID NO: 475313 - RNA, 22 nt, Human
ucucugccaaaaccagagucga

SEQ ID NO: 475314 - RNA, 24 nt, Human
ucucugccaaaaccagagucgagg

SEQ ID NO: 475315 - RNA, 21 nt, Human
ucugcaggggaaauggcuguc

SEQ ID NO: 475316 - RNA, 25 nt, Human
ucugcuccuaagcgccccccucacg

SEQ ID NO: 475317 - RNA, 22 nt, Human
ugaccggggccuggccagcagg

SEQ ID NO: 475318 - RNA, 19 nt, Human
ugagaggugagaggugagg

SEQ ID NO: 475319 - RNA, 19 nt, Human
ugagcaguacauuucugcu

SEQ ID NO: 475320 - RNA, 22 nt, Human
ugcacucaugaccggggccugg

SEQ ID NO: 475321 - RNA, 18 nt, Human
ugccuuggugcccagccu

SEQ ID NO: 475322 - RNA, 20 nt, Human
ugcuccuaagcgccccccuc

SEQ ID NO: 475323 - RNA, 21 nt, Human
ugcugugguuucaaugucugu

SEQ ID NO: 475324 - RNA, 21 nt, Human
ugggaccgcccagccccacca

SEQ ID NO: 475325 - RNA, 23 nt, Human
ugggaccgcccagccccaccaug

SEQ ID NO: 475326 - RNA, 23 nt, Human
uggugugggugaauuucaucaug

SEQ ID NO: 475327 - RNA, 19 nt, Human
ugugcuuagcagugaaaau

SEQ ID NO: 475328 - RNA, 21 nt, Human
uguggagggucagggaggcug

SEQ ID NO: 475329 - RNA, 24 nt, Human
uguggcgggauccgccuggcugcu

SEQ ID NO: 475330 - RNA, 19 nt, Human
uguucagaggugaggccuu

SEQ ID NO: 475331 - RNA, 25 nt, Human
uuccugcagaugcgagcagccaggg

SEQ ID NO: 475332 - RNA, 23 nt, Human
uugcagguaccagagcuugcugg

SEQ ID NO: 475333 - RNA, 19 nt, Human
uuucagacuucccagacuc

SEQ ID NO: 475334 - RNA, 19 nt, Human
aaaaauccaaaaacuagcc

SEQ ID NO: 475335 - RNA, 19 nt, Human
aaaaauccaaaaacuagcc

SEQ ID NO: 475336 - RNA, 19 nt, Human
aaagugcugggauuacaga

SEQ ID NO: 475337 - RNA, 24 nt, Human
aaagugcugggauuacagacguga

SEQ ID NO: 475338 - RNA, 18 nt, Human
aacaauaguuuggacucu

SEQ ID NO: 475339 - RNA, 18 nt, Human
aacaccacucucgccauc

SEQ ID NO: 475340 - RNA, 20 nt, Human
aacagagcaagaccccgucu

SEQ ID NO: 475341 - RNA, 22 nt, Human
aacaguggugccugccuccccc

SEQ ID NO: 475342 - RNA, 24 nt, Human
aagugauccacccgccuuggccuc

SEQ ID NO: 475343 - RNA, 19 nt, Human
aagugcugggauuacagac

SEQ ID NO: 475344 - RNA, 26 nt, Human
aagugcugggauuacagacgugagcc

SEQ ID NO: 475345 - RNA, 22 nt, Human
aauccaaaaacuagccagaaau

SEQ ID NO: 475346 - RNA, 23 nt, Human
acaaaaaauccaaaaacuagcca

SEQ ID NO: 475347 - RNA, 22 nt, Human
acagcuccaagaaccuggcacc

SEQ ID NO: 475348 - RNA, 19 nt, Human
acaggguuucaccaugucg

SEQ ID NO: 475349 - RNA, 20 nt, Human
acaggguuucaccaugucgg

SEQ ID NO: 475350 - RNA, 24 nt, Human
acaggguuucaccaugucggccag

SEQ ID NO: 475351 - RNA, 21 nt, Human
accaagaccaaccccuccucu

SEQ ID NO: 475352 - RNA, 24 nt, Human
accauguuggccaggccggucucg

SEQ ID NO: 475353 - RNA, 19 nt, Human
accccgucucaauaaaaaa

SEQ ID NO: 475354 - RNA, 18 nt, Human
accccuccucuuccuuag

SEQ ID NO: 475355 - RNA, 25 nt, Human
acccgccuuggccucccaaagugcu

SEQ ID NO: 475356 - RNA, 18 nt, Human
acgggguuucaccauguu

SEQ ID NO: 475357 - RNA, 23 nt, Human
acgggguuucaccauguuggcca

SEQ ID NO: 475358 - RNA, 24 nt, Human
acgggguuucaccauguuggccag

SEQ ID NO: 475359 - RNA, 25 nt, Human
acuacguugcccaggccggacccga

SEQ ID NO: 475360 - RNA, 24 nt, Human
acugcacuccagccuggacaacag

SEQ ID NO: 475361 - RNA, 24 nt, Human
acugcacuccagccuggacaacag

SEQ ID NO: 475362 - RNA, 25 nt, Human
acugcacugucagacauuuauaaca

SEQ ID NO: 475363 - RNA, 23 nt, Human
agaaagcagaagcccagugcuca

SEQ ID NO: 475364 - RNA, 23 nt, Human
agaauggaguacugauggugggg

SEQ ID NO: 475365 - RNA, 23 nt, Human
agcacuuugggaggccgaggugg

SEQ ID NO: 475366 - RNA, 24 nt, Human
agcacuuugggaggccgagguggg

SEQ ID NO: 475367 - RNA, 20 nt, Human
agcaguaaguaacuacuaau

SEQ ID NO: 475368 - RNA, 18 nt, Human
agccacugugcccagccc

SEQ ID NO: 475369 - RNA, 24 nt, Human
agcgcaggagcgugaucucggcuc

SEQ ID NO: 475370 - RNA, 21 nt, Human
agcggguggggagggaagagu

SEQ ID NO: 475371 - RNA, 19 nt, Human
aggaguucgagaccagccu

SEQ ID NO: 475372 - RNA, 18 nt, Human
aggcaggaggaucaccug

SEQ ID NO: 475373 - RNA, 18 nt, Human
aggcaggaggaucaccug

SEQ ID NO: 475374 - RNA, 24 nt, Human
aggcaggaggaucaccugaaccca

SEQ ID NO: 475375 - RNA, 19 nt, Human
aggccgaggugggaggauc

SEQ ID NO: 475376 - RNA, 23 nt, Human
aggccuugggggaaacaacgguc

SEQ ID NO: 475377 - RNA, 22 nt, Human
aggcgauccgcccaccagccuc

SEQ ID NO: 475378 - RNA, 21 nt, Human
aggcguaagccacugugccca

SEQ ID NO: 475379 - RNA, 24 nt, Human
aggcugaggcaggaggaucaccug

SEQ ID NO: 475380 - RNA, 18 nt, Human
aggugggaggaucacccg

SEQ ID NO: 475381 - RNA, 23 nt, Human
aguaaccgggaccacaggcaugc

SEQ ID NO: 475382 - RNA, 24 nt, Human
agugcugggauuacagacgugagc

SEQ ID NO: 475383 - RNA, 23 nt, Human
auaaaaaaaaaauauucuccuca

SEQ ID NO: 475384 - RNA, 21 nt, Human
auacacuuuuugacaaaacug

SEQ ID NO: 475385 - RNA, 19 nt, Human
augccuauaauccuagcac

SEQ ID NO: 475386 - RNA, 18 nt, Human
auggaguacugauggugg

SEQ ID NO: 475387 - RNA, 24 nt, Human
auuuccauguuuuuaguagagaca

SEQ ID NO: 475388 - RNA, 24 nt, Human
auuucugcacuuuuaguagagacg

SEQ ID NO: 475389 - RNA, 26 nt, Human
caaaaaauccaaaaacuagccagaaa

SEQ ID NO: 475390 - RNA, 19 nt, Human
caaaauauauacugaaaau

SEQ ID NO: 475391 - RNA, 19 nt, Human
caaagcacaaauagggugu

SEQ ID NO: 475392 - RNA, 21 nt, Human
caaagccaccuugccaggaac

SEQ ID NO: 475393 - RNA, 23 nt, Human
caaaguacuaggauuacagucau

SEQ ID NO: 475394 - RNA, 24 nt, Human
caaaguacugauauuaaaggcgua

SEQ ID NO: 475395 - RNA, 24 nt, Human
caaagugcugggauuacagacgug

SEQ ID NO: 475396 - RNA, 18 nt, Human
caacggucugcgcgggag

SEQ ID NO: 475397 - RNA, 22 nt, Human
caagacggagucuugcucuguu

SEQ ID NO: 475398 - RNA, 19 nt, Human
caagaggugagcaucucuc

SEQ ID NO: 475399 - RNA, 22 nt, Human
caagcaauucuccugccucagc

SEQ ID NO: 475400 - RNA, 19 nt, Human
caagcaauucugccucagc

SEQ ID NO: 475401 - RNA, 19 nt, Human
cacaccugcggucccagcc

SEQ ID NO: 475402 - RNA, 21 nt, Human
cacagcucccaccugcccuuc

SEQ ID NO: 475403 - RNA, 19 nt, Human
cacaggcaugcgccaccac

SEQ ID NO: 475404 - RNA, 22 nt, Human
caccaccaugcccagccaauuu

SEQ ID NO: 475405 - RNA, 21 nt, Human
caccaugucggccaggcuggu

SEQ ID NO: 475406 - RNA, 24 nt, Human
caccaugucggccaggcuggucuc

SEQ ID NO: 475407 - RNA, 27 nt, Human
caccaugucggccaggcuggucucaaa

SEQ ID NO: 475408 - RNA, 18 nt, Human
caccauguuggccaggcc

SEQ ID NO: 475409 - RNA, 21 nt, Human
caccauguuggccaggccggu

SEQ ID NO: 475410 - RNA, 24 nt, Human
caccauguuggccaggccggucuc

SEQ ID NO: 475411 - RNA, 27 nt, Human
caccauguuggccaggccggucucgaa

SEQ ID NO: 475412 - RNA, 23 nt, Human
cacccgccuuggccucccaaagu

SEQ ID NO: 475413 - RNA, 24 nt, Human
cacccgccuuggccucccaaagug

SEQ ID NO: 475414 - RNA, 24 nt, Human
caccucagccuuccgaguaacugg

SEQ ID NO: 475415 - RNA, 23 nt, Human
caccugcggucccagccacucgg

SEQ ID NO: 475416 - RNA, 24 nt, Human
caccugcggucccagccacucggg

SEQ ID NO: 475417 - RNA, 20 nt, Human
caccuugccaggaaccacag

SEQ ID NO: 475418 - RNA, 18 nt, Human
cacuacguugcccaggcc

SEQ ID NO: 475419 - RNA, 24 nt, Human
cacuacguugcccaggccggaccc

SEQ ID NO: 475420 - RNA, 23 nt, Human
cacuccagccuggacaacagagc

SEQ ID NO: 475421 - RNA, 18 nt, Human
cacugcacuccagccugg

SEQ ID NO: 475422 - RNA, 19 nt, Human
cacugcacuccagccugga

SEQ ID NO: 475423 - RNA, 21 nt, Human
cacugcacuccagccuggaca

SEQ ID NO: 475424 - RNA, 27 nt, Human
cacugcacuccagccuggacaacagag

SEQ ID NO: 475425 - RNA, 18 nt, Human
cagcaggaacuugggaua

SEQ ID NO: 475426 - RNA, 24 nt, Human
cagccacucgggaggcugaggcag

SEQ ID NO: 475427 - RNA, 20 nt, Human
cagccuccugaguaaccggg

SEQ ID NO: 475428 - RNA, 21 nt, Human
caggccgggugugguggcuca

SEQ ID NO: 475429 - RNA, 21 nt, Human
cagggucucucacuacguugc

SEQ ID NO: 475430 - RNA, 24 nt, Human
caggguuucaccaugucggccagg

SEQ ID NO: 475431 - RNA, 18 nt, Human
cauaccaccacaccuggc

SEQ ID NO: 475432 - RNA, 20 nt, Human
caugccuauaauccuagcac

SEQ ID NO: 475433 - RNA, 24 nt, Human
caugccuauaauccuagcacuuug

SEQ ID NO: 475434 - RNA, 24 nt, Human
caugucggccaggcuggucucaaa

SEQ ID NO: 475435 - RNA, 24 nt, Human
cauguuggccaggccggucucgaa

SEQ ID NO: 475436 - RNA, 22 nt, Human
ccaaagugcugggauuacagac

SEQ ID NO: 475437 - RNA, 24 nt, Human
ccaaagugcugggauuacagacgu

SEQ ID NO: 475438 - RNA, 23 nt, Human
ccaacgaucagagacaauuuguc

SEQ ID NO: 475439 - RNA, 23 nt, Human
ccaagaccaaccccuccucuucc

SEQ ID NO: 475440 - RNA, 20 nt, Human
ccacagacaaaggccacugg

SEQ ID NO: 475441 - RNA, 20 nt, Human
ccaccacgcuuggcuaauuu

SEQ ID NO: 475442 - RNA, 26 nt, Human
ccacugcacucaggcccccuugugac

SEQ ID NO: 475443 - RNA, 19 nt, Human
ccacugcacuccagccugg

SEQ ID NO: 475444 - RNA, 19 nt, Human
ccacugcacuccagccugg

SEQ ID NO: 475445 - RNA, 20 nt, Human
ccacugcacuccagccugga

SEQ ID NO: 475446 - RNA, 21 nt, Human
ccacugcacuccagccuggac

SEQ ID NO: 475447 - RNA, 18 nt, Human
ccacugugcccagcccau

SEQ ID NO: 475448 - RNA, 20 nt, Human
ccaggaguucgagaccagcc

SEQ ID NO: 475449 - RNA, 21 nt, Human
cccaagccggagcgcaggagc

SEQ ID NO: 475450 - RNA, 25 nt, Human
cccaccugcccuuccagacugcaaa

SEQ ID NO: 475451 - RNA, 25 nt, Human
cccagcccaucuuauuuuuuaaaaa

SEQ ID NO: 475452 - RNA, 20 nt, Human
cccccacuuuuucugccucu

SEQ ID NO: 475453 - RNA, 19 nt, Human
cccccuccaccucccccac

SEQ ID NO: 475454 - RNA, 21 nt, Human
cccgccucuacaaaaaaucca

SEQ ID NO: 475455 - RNA, 24 nt, Human
cccugagacaccaagaccaacccc

SEQ ID NO: 475456 - RNA, 21 nt, Human
ccgcccaccagccucccaaag

SEQ ID NO: 475457 - RNA, 24 nt, Human
ccgcccaccucagccuuccgagua

SEQ ID NO: 475458 - RNA, 19 nt, Human
ccgccucggggauucaagc

SEQ ID NO: 475459 - RNA, 24 nt, Human
ccuaaccccugaguuguucaagga

SEQ ID NO: 475460 - RNA, 20 nt, Human
ccucaaauguuaccuggucu

SEQ ID NO: 475461 - RNA, 21 nt, Human
ccucacagcuccaagaaccug

SEQ ID NO: 475462 - RNA, 22 nt, Human
ccucccgccuuagccuuccaaa

SEQ ID NO: 475463 - RNA, 25 nt, Human
ccucccgccuuagccuuccaaagua

SEQ ID NO: 475464 - RNA, 22 nt, Human
ccucuacaaaaaauccaaaaac

SEQ ID NO: 475465 - RNA, 22 nt, Human
ccugaccucaagugauccaccc

SEQ ID NO: 475466 - RNA, 23 nt, Human
ccugaccucaagugauccacccg

SEQ ID NO: 475467 - RNA, 24 nt, Human
ccugaucucaggcgauccgcccac

SEQ ID NO: 475468 - RNA, 20 nt, Human
ccuggccucaagggauccuc

SEQ ID NO: 475469 - RNA, 18 nt, Human
ccuuagacuauucaaccc

SEQ ID NO: 475470 - RNA, 21 nt, Human
cgaggugggaggaucacccga

SEQ ID NO: 475471 - RNA, 22 nt, Human
cgauccgcccaccagccuccca

SEQ ID NO: 475472 - RNA, 23 nt, Human
cgcgcaccaccaugcccagccaa

SEQ ID NO: 475473 - RNA, 24 nt, Human
cggccaggcuggucucaaacuccu

SEQ ID NO: 475474 - RNA, 24 nt, Human
cgggaggcugaggcaggaggauca

SEQ ID NO: 475475 - RNA, 24 nt, Human
cgggguuucaccauguuggccagg

SEQ ID NO: 475476 - RNA, 24 nt, Human
cguguucgugccacugcacuccag

SEQ ID NO: 475477 - RNA, 24 nt, Human
cucaagugauccacccgccuuggc

SEQ ID NO: 475478 - RNA, 24 nt, Human
cucaugccuauaauccuagcacuu

SEQ ID NO: 475479 - RNA, 19 nt, Human
cuccaacaccacucucgcc

SEQ ID NO: 475480 - RNA, 24 nt, Human
cuccugaguaaccgggaccacagg

SEQ ID NO: 475481 - RNA, 22 nt, Human
cucucuacaaaugcuuuuucac

SEQ ID NO: 475482 - RNA, 24 nt, Human
cugcaaccuccgccucauggguuc

SEQ ID NO: 475483 - RNA, 19 nt, Human
cugcacucaggcccccuug

SEQ ID NO: 475484 - RNA, 23 nt, Human
cugccucagccucccgagcggcu

SEQ ID NO: 475485 - RNA, 22 nt, Human
cugcugccuuuggcuucuccua

SEQ ID NO: 475486 - RNA, 22 nt, Human
cuuucuuauuuauuuauuuuug

SEQ ID NO: 475487 - RNA, 24 nt, Human
cuuuuaguagagacgggguuucac

SEQ ID NO: 475488 - RNA, 24 nt, Human
gaccucaagugauccacccgccuu

SEQ ID NO: 475489 - RNA, 21 nt, Human
gacuauucaacccugagacag

SEQ ID NO: 475490 - RNA, 23 nt, Human
gacuccagucauccgcccaccuc

SEQ ID NO: 475491 - RNA, 24 nt, Human
gagacgggguuucaccauguuggc

SEQ ID NO: 475492 - RNA, 24 nt, Human
gagcagaaagcagaagcccagugc

SEQ ID NO: 475493 - RNA, 22 nt, Human
gagcccaggaguucgagaccag

SEQ ID NO: 475494 - RNA, 23 nt, Human
gaggugggaggaucacccgagcc

SEQ ID NO: 475495 - RNA, 26 nt, Human
gaguaacugggaccacuggugcauac

SEQ ID NO: 475496 - RNA, 18 nt, Human
gauauuaaaggcguaagc

SEQ ID NO: 475497 - RNA, 24 nt, Human
gaucacccgagcccaggaguucga

SEQ ID NO: 475498 - RNA, 25 nt, Human
gaucaccugaacccaggagagguug

SEQ ID NO: 475499 - RNA, 26 nt, Human
gaucaccugaacccaggagagguuga

SEQ ID NO: 475500 - RNA, 22 nt, Human
gaucucaggcgauccgcccacc

SEQ ID NO: 475501 - RNA, 18 nt, Human
gauuacagacgugagcca

SEQ ID NO: 475502 - RNA, 22 nt, Human
gauuacagacgugagccacugc

SEQ ID NO: 475503 - RNA, 23 nt, Human
gauuacagacgugagccacugca

SEQ ID NO: 475504 - RNA, 22 nt, Human
gauuacagucaugagucccugc

SEQ ID NO: 475505 - RNA, 23 nt, Human
gauuacagucaugagucccugca

SEQ ID NO: 475506 - RNA, 24 nt, Human
gcacuccagccuggacaacagagc

SEQ ID NO: 475507 - RNA, 21 nt, Human
gcaggaacuugggauaauaaa

SEQ ID NO: 475508 - RNA, 22 nt, Human
gcaggaggaucaccugaaccca

SEQ ID NO: 475509 - RNA, 24 nt, Human
gccagagcagaaagcagaagccca

SEQ ID NO: 475510 - RNA, 22 nt, Human
gcccaagccggagcgcaggagc

SEQ ID NO: 475511 - RNA, 22 nt, Human
gcccaggaguucgagaccagcc

SEQ ID NO: 475512 - RNA, 23 nt, Human
gccggacccgaacuccuggccuc

SEQ ID NO: 475513 - RNA, 25 nt, Human
gccggagcgcaggagcgugaucucg

SEQ ID NO: 475514 - RNA, 23 nt, Human
gccucccccuccaccucccccac

SEQ ID NO: 475515 - RNA, 19 nt, Human
gccugccucccccuccacc

SEQ ID NO: 475516 - RNA, 22 nt, Human
gccuuggccucccaaagugcug

SEQ ID NO: 475517 - RNA, 20 nt, Human
gcgauccgcccaccagccuc

SEQ ID NO: 475518 - RNA, 22 nt, Human
gcgauccgcccaccagccuccc

SEQ ID NO: 475519 - RNA, 24 nt, Human
gcuccaagaaccuggcaccgggag

SEQ ID NO: 475520 - RNA, 23 nt, Human
gcuggucucaaacuccugaccuc

SEQ ID NO: 475521 - RNA, 23 nt, Human
ggaaccacagacaaaggccacug

SEQ ID NO: 475522 - RNA, 22 nt, Human
ggaaucuuuuuccacucugcuu

SEQ ID NO: 475523 - RNA, 23 nt, Human
ggaucacccgagcccaggaguuc

SEQ ID NO: 475524 - RNA, 20 nt, Human
ggauccucccgccuuagccu

SEQ ID NO: 475525 - RNA, 27 nt, Human
ggccgaggugggaggaucacccgagcc

SEQ ID NO: 475526 - RNA, 24 nt, Human
ggccggacccgaacuccuggccuc

SEQ ID NO: 475527 - RNA, 23 nt, Human
ggccgggugugguggcucaugcc

SEQ ID NO: 475528 - RNA, 24 nt, Human
ggccggucucgaacuccugaucuc

SEQ ID NO: 475529 - RNA, 24 nt, Human
ggcuggucucaaacuccugaccuc

SEQ ID NO: 475530 - RNA, 20 nt, Human
gggaccacaggcaugcgcca

SEQ ID NO: 475531 - RNA, 23 nt, Human
gggaccacaggcaugcgccacca

SEQ ID NO: 475532 - RNA, 23 nt, Human
gggaggcugaggcaggaggauca

SEQ ID NO: 475533 - RNA, 21 nt, Human
gggccagagcagaaagcagaa

SEQ ID NO: 475534 - RNA, 23 nt, Human
gggguuucaccauguuggccagg

SEQ ID NO: 475535 - RNA, 24 nt, Human
gggugugguggcucaugccuauaa

SEQ ID NO: 475536 - RNA, 24 nt, Human
gguggcacacaccugcggucccag

SEQ ID NO: 475537 - RNA, 24 nt, Human
gguggcucaugccuauaauccuag

SEQ ID NO: 475538 - RNA, 22 nt, Human
guaagccacugugcccagccca

SEQ ID NO: 475539 - RNA, 23 nt, Human
guagagacgggguuucaccaugu

SEQ ID NO: 475540 - RNA, 24 nt, Human
gucauccgcccaccucagccuucc

SEQ ID NO: 475541 - RNA, 24 nt, Human
gugauccacccgccuuggccuccc

SEQ ID NO: 475542 - RNA, 23 nt, Human
gugcaguggcaccaucucggcuc

SEQ ID NO: 475543 - RNA, 19 nt, Human
guggggagggaagaguuuu

SEQ ID NO: 475544 - RNA, 21 nt, Human
uaacaguggugccugccuccc

SEQ ID NO: 475545 - RNA, 18 nt, Human
uaaguaacuacuaauagc

SEQ ID NO: 475546 - RNA, 24 nt, Human
uaauuuccauguuuuuaguagaga

SEQ ID NO: 475547 - RNA, 24 nt, Human
uacaaaaaauccaaaaacuagcca

SEQ ID NO: 475548 - RNA, 24 nt, Human
uacagacgugagccacugcacuca

SEQ ID NO: 475549 - RNA, 18 nt, Human
uacguugcccaggccgga

SEQ ID NO: 475550 - RNA, 24 nt, Human
uacguugcccaggccggacccgaa

SEQ ID NO: 475551 - RNA, 20 nt, Human
uacuacuggucaacagcagg

SEQ ID NO: 475552 - RNA, 22 nt, Human
uagagacaggguuucaccaugu

SEQ ID NO: 475553 - RNA, 22 nt, Human
uagagacgggguuucaccaugu

SEQ ID NO: 475554 - RNA, 24 nt, Human
uagcacuuugggaggccgaggugg

SEQ ID NO: 475555 - RNA, 19 nt, Human
uagcauacuacuggucaac

SEQ ID NO: 475556 - RNA, 25 nt, Human
uagcauacuacuggucaacagcagg

SEQ ID NO: 475557 - RNA, 18 nt, Human
uaggauuacagucaugag

SEQ ID NO: 475558 - RNA, 24 nt, Human
uaguagagacaggguuucaccaug

SEQ ID NO: 475559 - RNA, 26 nt, Human
uaguagagacaggguuucaccauguc

SEQ ID NO: 475560 - RNA, 24 nt, Human
uaguagagacgggguuucaccaug

SEQ ID NO: 475561 - RNA, 26 nt, Human
uaguagagacgggguuucaccauguu

SEQ ID NO: 475562 - RNA, 23 nt, Human
uaguagauauauauuuucuuccu

SEQ ID NO: 475563 - RNA, 19 nt, Human
uauaacauuuucuuuucuc

SEQ ID NO: 475564 - RNA, 19 nt, Human
uauauauuuucuuccuuau

SEQ ID NO: 475565 - RNA, 24 nt, Human
uauuguaagaauacaguguauaag

SEQ ID NO: 475566 - RNA, 19 nt, Human
ucaaggaucaacugaguuu

SEQ ID NO: 475567 - RNA, 20 nt, Human
ucacagcuccaagaaccugg

SEQ ID NO: 475568 - RNA, 18 nt, Human
ucacaugugggccagagc

SEQ ID NO: 475569 - RNA, 18 nt, Human
ucacugcaaccuccgccu

SEQ ID NO: 475570 - RNA, 23 nt, Human
ucacugcaaccuccgccucaugg

SEQ ID NO: 475571 - RNA, 24 nt, Human
ucacugcaaccuccgccucauggg

SEQ ID NO: 475572 - RNA, 22 nt, Human
ucacugccaccuugaacuccug

SEQ ID NO: 475573 - RNA, 24 nt, Human
ucacugccaccuugaacuccugga

SEQ ID NO: 475574 - RNA, 23 nt, Human
ucagccuuccgaguaacugggac

SEQ ID NO: 475575 - RNA, 26 nt, Human
ucaggccgggugugguggcucaugcc

SEQ ID NO: 475576 - RNA, 18 nt, Human
ucagugcaaccuccgccu

SEQ ID NO: 475577 - RNA, 21 nt, Human
ucagugcaaccuccgccucgg

SEQ ID NO: 475578 - RNA, 22 nt, Human
ucagugcaaccuccgccucggg

SEQ ID NO: 475579 - RNA, 22 nt, Human
ucagugcaaccuccgccucggg

SEQ ID NO: 475580 - RNA, 21 nt, Human
uccaaaaacuagccagaaaug

SEQ ID NO: 475581 - RNA, 23 nt, Human
uccaacaccacucucgccaucuc

SEQ ID NO: 475582 - RNA, 18 nt, Human
ucccaaagugcugggauu

SEQ ID NO: 475583 - RNA, 24 nt, Human
ucccaaagugcugggauuacagac

SEQ ID NO: 475584 - RNA, 19 nt, Human
ucccaggcuggaguacagu

SEQ ID NO: 475585 - RNA, 23 nt, Human
ucccgagcggcugggaccacagg

SEQ ID NO: 475586 - RNA, 18 nt, Human
ucccugagacaccaagac

SEQ ID NO: 475587 - RNA, 21 nt, Human
uccgcccaccucagccuuccg

SEQ ID NO: 475588 - RNA, 24 nt, Human
uccucaaauguuaccuggucucac

SEQ ID NO: 475589 - RNA, 23 nt, Human
uccuggacuccagucauccgccc

SEQ ID NO: 475590 - RNA, 19 nt, Human
uccuuauggcuuucuuauu

SEQ ID NO: 475591 - RNA, 24 nt, Human
ucgcauuguuucccaggcuggagu

SEQ ID NO: 475592 - RNA, 25 nt, Human
ucgggaggcugaggcaggaggauca

SEQ ID NO: 475593 - RNA, 23 nt, Human
ucgugccacugcacuccagccug

SEQ ID NO: 475594 - RNA, 24 nt, Human
ucucacuacguugcccaggccgga

SEQ ID NO: 475595 - RNA, 22 nt, Human
ucucacucucgcccaagccgga

SEQ ID NO: 475596 - RNA, 20 nt, Human
ucuccaacaccacucucgcc

SEQ ID NO: 475597 - RNA, 23 nt, Human
ucucgaacuccugaucucaggcg

SEQ ID NO: 475598 - RNA, 20 nt, Human
ucugccucagccuccugagu

SEQ ID NO: 475599 - RNA, 18 nt, Human
ucuugcucuguuguccag

SEQ ID NO: 475600 - RNA, 19 nt, Human
ucuugcucuguuguccaga

SEQ ID NO: 475601 - RNA, 22 nt, Human
ucuugcucuguuguccagaugg

SEQ ID NO: 475602 - RNA, 25 nt, Human
ucuugcucuguuguccagauggugc

SEQ ID NO: 475603 - RNA, 24 nt, Human
ugaacuccuggacuccagucaucc

SEQ ID NO: 475604 - RNA, 24 nt, Human
ugaccucaagugauccacccgccu

SEQ ID NO: 475605 - RNA, 22 nt, Human
ugacuuuccuuauaacauuuuc

SEQ ID NO: 475606 - RNA, 19 nt, Human
ugagaaaaagucucucuac

SEQ ID NO: 475607 - RNA, 21 nt, Human
ugagacaccaagaccaacccc

SEQ ID NO: 475608 - RNA, 20 nt, Human
ugaggcaggaggaucaccug

SEQ ID NO: 475609 - RNA, 24 nt, Human
ugaggcaggaggaucaccugaacc

SEQ ID NO: 475610 - RNA, 25 nt, Human
ugaggcaggaggaucaccugaaccc

SEQ ID NO: 475611 - RNA, 24 nt, Human
ugauauuaaaggcguaagccacug

SEQ ID NO: 475612 - RNA, 18 nt, Human
ugaucucaggcgauccgc

SEQ ID NO: 475613 - RNA, 18 nt, Human
ugaucucugaacaauagu

SEQ ID NO: 475614 - RNA, 22 nt, Human
ugcaguggcaccaucucggcuc

SEQ ID NO: 475615 - RNA, 23 nt, Human
ugccaccuugaacuccuggacuc

SEQ ID NO: 475616 - RNA, 24 nt, Human
ugccacugcacuccagccuggaca

SEQ ID NO: 475617 - RNA, 20 nt, Human
ugcccaggccggacccgaac

SEQ ID NO: 475618 - RNA, 24 nt, Human
ugccuauaauccuagcacuuuggg

SEQ ID NO: 475619 - RNA, 24 nt, Human
ugccucagccucccgagcggcugg

SEQ ID NO: 475620 - RNA, 24 nt, Human
ugccucagccuccugaguaaccgg

SEQ ID NO: 475621 - RNA, 23 nt, Human
ugccugccucccccuccaccucc

SEQ ID NO: 475622 - RNA, 24 nt, Human
ugcugggauuacagacgugagcca

SEQ ID NO: 475623 - RNA, 22 nt, Human
uggcaccgggaguaagccacug

SEQ ID NO: 475624 - RNA, 24 nt, Human
uggccaggccggucucgaacuccu

SEQ ID NO: 475625 - RNA, 20 nt, Human
uggccucaagggauccuccc

SEQ ID NO: 475626 - RNA, 24 nt, Human
uggccucaagggauccucccgccu

SEQ ID NO: 475627 - RNA, 19 nt, Human
uggcucaugccuauaaucc

SEQ ID NO: 475628 - RNA, 19 nt, Human
uggcucaugccuauaaucc

SEQ ID NO: 475629 - RNA, 24 nt, Human
uggcucaugccuauaauccuagca

SEQ ID NO: 475630 - RNA, 21 nt, Human
ugggaccacaggcgcgcacca

SEQ ID NO: 475631 - RNA, 24 nt, Human
ugggaccacaggcgcgcaccacca

SEQ ID NO: 475632 - RNA, 18 nt, Human
ugggaccacuggugcaua

SEQ ID NO: 475633 - RNA, 21 nt, Human
ugggaccacuggugcauacca

SEQ ID NO: 475634 - RNA, 24 nt, Human
ugggaccacuggugcauaccacca

SEQ ID NO: 475635 - RNA, 19 nt, Human
ugggaggccgaggugggag

SEQ ID NO: 475636 - RNA, 24 nt, Human
ugggaggccgaggugggaggauca

SEQ ID NO: 475637 - RNA, 19 nt, Human
ugggauuacagacgugagc

SEQ ID NO: 475638 - RNA, 21 nt, Human
ugggauuacagacgugagcca

SEQ ID NO: 475639 - RNA, 22 nt, Human
ugggauuacagacgugagccac

SEQ ID NO: 475640 - RNA, 22 nt, Human
ugggauuacagacgugagccac

SEQ ID NO: 475641 - RNA, 24 nt, Human
ugggauuacagacgugagccacug

SEQ ID NO: 475642 - RNA, 24 nt, Human
ugggauuacagacgugagccacug

SEQ ID NO: 475643 - RNA, 20 nt, Human
ugggccagagcagaaagcag

SEQ ID NO: 475644 - RNA, 23 nt, Human
ugguggcacacaccugcgguccc

SEQ ID NO: 475645 - RNA, 22 nt, Human
ugguggcucaugccuauaaucc

SEQ ID NO: 475646 - RNA, 25 nt, Human
ugguggggucaagauacacuuuuug

SEQ ID NO: 475647 - RNA, 21 nt, Human
uguccaagaauagucuaugcc

SEQ ID NO: 475648 - RNA, 23 nt, Human
ugugcagggcaggggguguuggg

SEQ ID NO: 475649 - RNA, 21 nt, Human
ugugucacagcucccaccugc

SEQ ID NO: 475650 - RNA, 19 nt, Human
uguuccuccucacagcucc

SEQ ID NO: 475651 - RNA, 18 nt, Human
uuacuguauuguaagaau

SEQ ID NO: 475652 - RNA, 24 nt, Human
uuaguagagacaggguuucaccau

SEQ ID NO: 475653 - RNA, 18 nt, Human
uuaguagagacgggguuu

SEQ ID NO: 475654 - RNA, 22 nt, Human
uuaguagagacgggguuucacc

SEQ ID NO: 475655 - RNA, 24 nt, Human
uuaguagagacgggguuucaccau

SEQ ID NO: 475656 - RNA, 21 nt, Human
uucaagcaauucuccugccuc

SEQ ID NO: 475657 - RNA, 24 nt, Human
uucaagcaauucuccugccucagc

SEQ ID NO: 475658 - RNA, 21 nt, Human
uucaagcaauucugccucagc

SEQ ID NO: 475659 - RNA, 20 nt, Human
uuccagacugcaaagccacc

SEQ ID NO: 475660 - RNA, 18 nt, Human
uuccuccucacagcucca

SEQ ID NO: 475661 - RNA, 23 nt, Human
uuccuuauaacauuuucuuuucu

SEQ ID NO: 475662 - RNA, 24 nt, Human
uucgugccacugcacuccagccug

SEQ ID NO: 475663 - RNA, 18 nt, Human
uuggccucccaaagugcu

SEQ ID NO: 475664 - RNA, 25 nt, Human
uugggaggccgaggugggaggauca

SEQ ID NO: 475665 - RNA, 21 nt, Human
uugggauaauaaauacaagau

SEQ ID NO: 475666 - RNA, 21 nt, Human
uuuauuuuugagacggagucu

SEQ ID NO: 475667 - RNA, 24 nt, Human
uuucaccaugucggccaggcuggu

SEQ ID NO: 475668 - RNA, 24 nt, Human
uuucaccauguuggccaggccggu

SEQ ID NO: 475669 - RNA, 20 nt, Human
uuuccauguuuuuaguagag

SEQ ID NO: 475670 - RNA, 24 nt, Human
uuugcacugcacugucagacauuu

SEQ ID NO: 475671 - RNA, 24 nt, Human
uuuuuaguagagacaggguuucac

SEQ ID NO: 475672 - RNA, 19 nt, Human
aaaaagcucaucagcagcc

SEQ ID NO: 475673 - RNA, 25 nt, Human
aaaagcacucagccacauccuacuc

SEQ ID NO: 475674 - RNA, 26 nt, Human
aaacaggaaaguagcauaaaaauaua

SEQ ID NO: 475675 - RNA, 23 nt, Human
aaagcaaagccagugcucccuuc

SEQ ID NO: 475676 - RNA, 18 nt, Human
acacgccaaacaccaaca

SEQ ID NO: 475677 - RNA, 18 nt, Human
accaaaaagcucaucagc

SEQ ID NO: 475678 - RNA, 22 nt, Human
agccgggguccaagcgcucccc

SEQ ID NO: 475679 - RNA, 21 nt, Human
aggaaaguagcauaaaaauau

SEQ ID NO: 475680 - RNA, 21 nt, Human
aggcaagaagagagaggccug

SEQ ID NO: 475681 - RNA, 24 nt, Human
caaaaaaaaagcacucagccacau

SEQ ID NO: 475682 - RNA, 21 nt, Human
caauaaaugucucuggggucu

SEQ ID NO: 475683 - RNA, 27 nt, Human
caccaaaaagcucaucagcagccccag

SEQ ID NO: 475684 - RNA, 22 nt, Human
cagccacauccuacuccccaau

SEQ ID NO: 475685 - RNA, 27 nt, Human
caggaaaguagcauaaaaauauagugg

SEQ ID NO: 475686 - RNA, 21 nt, Human
caggcagugcaucugaagcac

SEQ ID NO: 475687 - RNA, 22 nt, Human
cauccaugaccccaacacagag

SEQ ID NO: 475688 - RNA, 21 nt, Human
caucugaagcaccuucuaguu

SEQ ID NO: 475689 - RNA, 22 nt, Human
caucugaagcaccuucuaguua

SEQ ID NO: 475690 - RNA, 18 nt, Human
ccagaggaggccaggugu

SEQ ID NO: 475691 - RNA, 24 nt, Human
ccagcaaggacucuguagcccaga

SEQ ID NO: 475692 - RNA, 20 nt, Human
ccagugccugugggucucau

SEQ ID NO: 475693 - RNA, 23 nt, Human
ccccagcaaggacucuguagccc

SEQ ID NO: 475694 - RNA, 23 nt, Human
ccccgaacccccagcaaggacuc

SEQ ID NO: 475695 - RNA, 20 nt, Human
cccgaacccccagcaaggac

SEQ ID NO: 475696 - RNA, 20 nt, Human
cccuucuccugacgcguccc

SEQ ID NO: 475697 - RNA, 18 nt, Human
ccucugugcggucugguu

SEQ ID NO: 475698 - RNA, 19 nt, Human
ccugacgcgucccagaagc

SEQ ID NO: 475699 - RNA, 21 nt, Human
ccugccuuuaagagccaagag

SEQ ID NO: 475700 - RNA, 25 nt, Human
ccuucuauugccaacccaagggugc

SEQ ID NO: 475701 - RNA, 20 nt, Human
ccuuuaagagccaagagagc

SEQ ID NO: 475702 - RNA, 19 nt, Human
cuggaaucuugguuuucuc

SEQ ID NO: 475703 - RNA, 21 nt, Human
cuggccaaaaaaaaagcacuc

SEQ ID NO: 475704 - RNA, 21 nt, Human
cuuuaaaggcaagaagagaga

SEQ ID NO: 475705 - RNA, 20 nt, Human
gaacccccagcaaggacucu

SEQ ID NO: 475706 - RNA, 18 nt, Human
gaacuccagccgcuucuc

SEQ ID NO: 475707 - RNA, 19 nt, Human
gagccgcucauccaugacc

SEQ ID NO: 475708 - RNA, 22 nt, Human
gagccgcucauccaugacccca

SEQ ID NO: 475709 - RNA, 18 nt, Human
gcucauccaugaccccac

SEQ ID NO: 475710 - RNA, 21 nt, Human
gcugaagccagaggaggccag

SEQ ID NO: 475711 - RNA, 18 nt, Human
ggaaggcuggugcuugcu

SEQ ID NO: 475712 - RNA, 20 nt, Human
ggaggauucuuuaaaggcaa

SEQ ID NO: 475713 - RNA, 21 nt, Human
gggacauguguguuugcgagc

SEQ ID NO: 475714 - RNA, 21 nt, Human
gucaccuucuauugccaaccc

SEQ ID NO: 475715 - RNA, 19 nt, Human
gucccagaagccggggucc

SEQ ID NO: 475716 - RNA, 18 nt, Human
gugaggaaggaggauucu

SEQ ID NO: 475717 - RNA, 19 nt, Human
ucacacgccaaacaccaac

SEQ ID NO: 475718 - RNA, 23 nt, Human
ucagcagccccaggccucugugc

SEQ ID NO: 475719 - RNA, 21 nt, Human
uccaagcgcuccccgaacccc

SEQ ID NO: 475720 - RNA, 25 nt, Human
ucccagaagccgggguccaagcgcu

SEQ ID NO: 475721 - RNA, 25 nt, Human
uccgcuagucuggccaaaaaaaaag

SEQ ID NO: 475722 - RNA, 18 nt, Human
ucuauugccaacccaagg

SEQ ID NO: 475723 - RNA, 19 nt, Human
ucucccaacacaacccaac

SEQ ID NO: 475724 - RNA, 20 nt, Human
ugaaagcaaagccagugcuc

SEQ ID NO: 475725 - RNA, 21 nt, Human
ugaaagcaaagccagugcucc

SEQ ID NO: 475726 - RNA, 18 nt, Human
ugagaagcugaagccaga

SEQ ID NO: 475727 - RNA, 19 nt, Human
ugccaacccaagggugcca

SEQ ID NO: 475728 - RNA, 25 nt, Human
ugcucccuucuccugacgcguccca

SEQ ID NO: 475729 - RNA, 19 nt, Human
uggaaggcuggugcuugcu

SEQ ID NO: 475730 - RNA, 22 nt, Human
ugucacacgccaaacaccaaca

SEQ ID NO: 475731 - RNA, 24 nt, Human
uucuaguuacuauccccaucugga

SEQ ID NO: 475732 - RNA, 25 nt, Human
aaacagucaguaagggacccucugc

SEQ ID NO: 475733 - RNA, 18 nt, Human
aaagugcugggauuacag

SEQ ID NO: 475734 - RNA, 19 nt, Human
aaccagcugaauuaacgca

SEQ ID NO: 475735 - RNA, 23 nt, Human
aagugcugggauuacagccgugu

SEQ ID NO: 475736 - RNA, 21 nt, Human
aauagcugggauuacaggcau

SEQ ID NO: 475737 - RNA, 24 nt, Human
aaugaaauggugcaaucucagcuc

SEQ ID NO: 475738 - RNA, 23 nt, Human
acaaagaugggaaacuuuagcac

SEQ ID NO: 475739 - RNA, 20 nt, Human
acaaggcccccacccaucca

SEQ ID NO: 475740 - RNA, 24 nt, Human
acaaggcccccacccauccaaaca

SEQ ID NO: 475741 - RNA, 19 nt, Human
acacauggggagaaacuca

SEQ ID NO: 475742 - RNA, 25 nt, Human
acaggcagugucguucuuggggacg

SEQ ID NO: 475743 - RNA, 18 nt, Human
acaggguuuugcuauguu

SEQ ID NO: 475744 - RNA, 23 nt, Human
acaggguuuugcuauguuggcca

SEQ ID NO: 475745 - RNA, 24 nt, Human
acaggguuuugcuauguuggccag

SEQ ID NO: 475746 - RNA, 21 nt, Human
accugucauucuaagaaccuc

SEQ ID NO: 475747 - RNA, 21 nt, Human
acucauguugcccaggcugga

SEQ ID NO: 475748 - RNA, 23 nt, Human
acuggucuugaacuccugaccuc

SEQ ID NO: 475749 - RNA, 18 nt, Human
agacaggguuuugcuaug

SEQ ID NO: 475750 - RNA, 18 nt, Human
agccuuccgaauagcugg

SEQ ID NO: 475751 - RNA, 23 nt, Human
agcucagaggcugggauccucca

SEQ ID NO: 475752 - RNA, 20 nt, Human
aggcaugcaccaccaugccc

SEQ ID NO: 475753 - RNA, 24 nt, Human
aggugaucugccaaccuuggccuc

SEQ ID NO: 475754 - RNA, 24 nt, Human
agugauucuccugccucagccuuc

SEQ ID NO: 475755 - RNA, 18 nt, Human
auagcugggauuacaggc

SEQ ID NO: 475756 - RNA, 26 nt, Human
aucaugcuauucucuucccuccaccc

SEQ ID NO: 475757 - RNA, 18 nt, Human
auguauuagaguuaagug

SEQ ID NO: 475758 - RNA, 19 nt, Human
auguuggccagacuggucu

SEQ ID NO: 475759 - RNA, 24 nt, Human
auuuuuguauuuuuaguagagaca

SEQ ID NO: 475760 - RNA, 26 nt, Human
caaagugcugggauuacagccgugug

SEQ ID NO: 475761 - RNA, 21 nt, Human
caacagguaacaacgcuuccu

SEQ ID NO: 475762 - RNA, 27 nt, Human
caaccgauuuuuuuuuuuuuaaggcuu

SEQ ID NO: 475763 - RNA, 20 nt, Human
caagugauucuccugccuca

SEQ ID NO: 475764 - RNA, 22 nt, Human
caagugauucuccugccucagc

SEQ ID NO: 475765 - RNA, 22 nt, Human
cacaagaucacacaugggccag

SEQ ID NO: 475766 - RNA, 24 nt, Human
cacacaugggccagccuacccccc

SEQ ID NO: 475767 - RNA, 22 nt, Human
cacaggcgaaagguugcuuccu

SEQ ID NO: 475768 - RNA, 22 nt, Human
caccaccaugcccagauaauuu

SEQ ID NO: 475769 - RNA, 25 nt, Human
caccccacaagaucacacaugggcc

SEQ ID NO: 475770 - RNA, 21 nt, Human
caccgcaaccuccgccuccug

SEQ ID NO: 475771 - RNA, 22 nt, Human
cacuacacagcaaugcggaggu

SEQ ID NO: 475772 - RNA, 23 nt, Human
cagccgugugccacugcacccaa

SEQ ID NO: 475773 - RNA, 21 nt, Human
cagccuaccccccaucacaag

SEQ ID NO: 475774 - RNA, 25 nt, Human
cagcgcgacgucagccccgcccccc

SEQ ID NO: 475775 - RNA, 22 nt, Human
cagcugaauuaacgcaugcuga

SEQ ID NO: 475776 - RNA, 19 nt, Human
caggguuuugcuauguugg

SEQ ID NO: 475777 - RNA, 23 nt, Human
caggguuuugcuauguuggccag

SEQ ID NO: 475778 - RNA, 23 nt, Human
caguggagaggaggcggaagcuc

SEQ ID NO: 475779 - RNA, 19 nt, Human
cauaaaaccaacucagcuc

SEQ ID NO: 475780 - RNA, 18 nt, Human
caucuuguuacccccgcc

SEQ ID NO: 475781 - RNA, 21 nt, Human
caugcuauucucuucccucca

SEQ ID NO: 475782 - RNA, 20 nt, Human
caugggccagccuacccccc

SEQ ID NO: 475783 - RNA, 18 nt, Human
cauguugcccaggcugga

SEQ ID NO: 475784 - RNA, 23 nt, Human
cauguugcccaggcuggaaugaa

SEQ ID NO: 475785 - RNA, 23 nt, Human
ccaaacaccugucauucuaagaa

SEQ ID NO: 475786 - RNA, 20 nt, Human
ccaaagugcugggauuacag

SEQ ID NO: 475787 - RNA, 24 nt, Human
ccaaagugcugggauuacagccgu

SEQ ID NO: 475788 - RNA, 20 nt, Human
ccacugcacccaaccgauuu

SEQ ID NO: 475789 - RNA, 22 nt, Human
cccacccauccaaacaccuguc

SEQ ID NO: 475790 - RNA, 20 nt, Human
cccccacccauccaaacacc

SEQ ID NO: 475791 - RNA, 20 nt, Human
cccccacccauccaaacacc

SEQ ID NO: 475792 - RNA, 21 nt, Human
cccccacccauccaaacaccu

SEQ ID NO: 475793 - RNA, 19 nt, Human
cccgcaagcgcucucuacc

SEQ ID NO: 475794 - RNA, 24 nt, Human
ccgaauagcugggauuacaggcau

SEQ ID NO: 475795 - RNA, 18 nt, Human
ccgcaaccuccgccuccu

SEQ ID NO: 475796 - RNA, 23 nt, Human
ccgcaaccuccgccuccuggguu

SEQ ID NO: 475797 - RNA, 24 nt, Human
ccgcaaccuccgccuccuggguuc

SEQ ID NO: 475798 - RNA, 19 nt, Human
ccgcagcagcuccgcccgc

SEQ ID NO: 475799 - RNA, 24 nt, Human
ccgccuccuggguucaagugauuc

SEQ ID NO: 475800 - RNA, 22 nt, Human
ccuccgccuccuggguucaagu

SEQ ID NO: 475801 - RNA, 24 nt, Human
ccuccuggguucaagugauucucc

SEQ ID NO: 475802 - RNA, 19 nt, Human
ccuggggggcugaggugaa

SEQ ID NO: 475803 - RNA, 23 nt, Human
ccuggguucaagugauucuccuc

SEQ ID NO: 475804 - RNA, 23 nt, Human
ccuggguucaagugauucuccug

SEQ ID NO: 475805 - RNA, 22 nt, Human
cgaacugcaccccuucccacag

SEQ ID NO: 475806 - RNA, 22 nt, Human
cgacgucagccccgccccccuc

SEQ ID NO: 475807 - RNA, 23 nt, Human
cggcucggguccugauccgcagc

SEQ ID NO: 475808 - RNA, 23 nt, Human
cggguccugauccgcagcagcuc

SEQ ID NO: 475809 - RNA, 20 nt, Human
cgugugccacugcacccaac

SEQ ID NO: 475810 - RNA, 24 nt, Human
cucagccuuccgaauagcugggau

SEQ ID NO: 475811 - RNA, 21 nt, Human
cucauguugcccaggcuggaa

SEQ ID NO: 475812 - RNA, 24 nt, Human
cucauguugcccaggcuggaauga

SEQ ID NO: 475813 - RNA, 20 nt, Human
cuccuggguucaagugauuc

SEQ ID NO: 475814 - RNA, 21 nt, Human
cuccuggguucaagugauucu

SEQ ID NO: 475815 - RNA, 18 nt, Human
cugcaccccuucccacag

SEQ ID NO: 475816 - RNA, 20 nt, Human
cugcaccccuucccacagca

SEQ ID NO: 475817 - RNA, 23 nt, Human
cugccucagccuuccgaauagcu

SEQ ID NO: 475818 - RNA, 18 nt, Human
cugccucagugucucggc

SEQ ID NO: 475819 - RNA, 20 nt, Human
cugggauccuccacgucaca

SEQ ID NO: 475820 - RNA, 20 nt, Human
cuuggcuccugccugggggg

SEQ ID NO: 475821 - RNA, 24 nt, Human
gaauagcugggauuacaggcaugc

SEQ ID NO: 475822 - RNA, 18 nt, Human
gaaugaaauggugcaauc

SEQ ID NO: 475823 - RNA, 23 nt, Human
gaccucaggugaucugccaaccu

SEQ ID NO: 475824 - RNA, 18 nt, Human
gacucgccuccucaagug

SEQ ID NO: 475825 - RNA, 24 nt, Human
gacuggucuugaacuccugaccuc

SEQ ID NO: 475826 - RNA, 23 nt, Human
gauuacagccgugugccacugca

SEQ ID NO: 475827 - RNA, 22 nt, Human
gauuacaggcaugcaccaccau

SEQ ID NO: 475828 - RNA, 19 nt, Human
gccagccuaccccccauca

SEQ ID NO: 475829 - RNA, 19 nt, Human
gcccaggcuggaaugaaau

SEQ ID NO: 475830 - RNA, 19 nt, Human
gccucagugucucggccag

SEQ ID NO: 475831 - RNA, 19 nt, Human
gcuagacucgccuccucaa

SEQ ID NO: 475832 - RNA, 20 nt, Human
gcuauguuggccagacuggu

SEQ ID NO: 475833 - RNA, 24 nt, Human
ggauuacaggcaugcaccaccaug

SEQ ID NO: 475834 - RNA, 18 nt, Human
gggaagugggaucaugcu

SEQ ID NO: 475835 - RNA, 19 nt, Human
ggucuugaacuccugaccu

SEQ ID NO: 475836 - RNA, 23 nt, Human
guagagacaggguuuugcuaugu

SEQ ID NO: 475837 - RNA, 23 nt, Human
gucaagguuaucaucuuugcaga

SEQ ID NO: 475838 - RNA, 20 nt, Human
gucccugcagaaaauaagcc

SEQ ID NO: 475839 - RNA, 24 nt, Human
gugauucuccugccucagccuucc

SEQ ID NO: 475840 - RNA, 19 nt, Human
gugugccacugcacccaac

SEQ ID NO: 475841 - RNA, 24 nt, Human
uaauuuuuguauuuuuaguagaga

SEQ ID NO: 475842 - RNA, 22 nt, Human
uacagccgugugccacugcacc

SEQ ID NO: 475843 - RNA, 24 nt, Human
uacaggcaugcaccaccaugccca

SEQ ID NO: 475844 - RNA, 22 nt, Human
uagagacaggguuuugcuaugu

SEQ ID NO: 475845 - RNA, 24 nt, Human
uaguagagacaggguuuugcuaug

SEQ ID NO: 475846 - RNA, 24 nt, Human
uauguuggccagacuggucuugaa

SEQ ID NO: 475847 - RNA, 19 nt, Human
ucaagugauucuccugccu

SEQ ID NO: 475848 - RNA, 24 nt, Human
ucaccgcaaccuccgccuccuggg

SEQ ID NO: 475849 - RNA, 25 nt, Human
ucaccgcaaccuccgccuccugggu

SEQ ID NO: 475850 - RNA, 26 nt, Human
ucaccgcaaccuccgccuccuggguu

SEQ ID NO: 475851 - RNA, 22 nt, Human
ucacucauguugcccaggcugg

SEQ ID NO: 475852 - RNA, 23 nt, Human
ucacucauguugcccaggcugga

SEQ ID NO: 475853 - RNA, 23 nt, Human
ucaugcuggaacagucugaccau

SEQ ID NO: 475854 - RNA, 22 nt, Human
ucccaaagugcugggauuacag

SEQ ID NO: 475855 - RNA, 23 nt, Human
uccgaauagcugggauuacaggc

SEQ ID NO: 475856 - RNA, 24 nt, Human
uccgaauagcugggauuacaggca

SEQ ID NO: 475857 - RNA, 23 nt, Human
uccuccacgucacaggcaggggu

SEQ ID NO: 475858 - RNA, 21 nt, Human
uccuggguucaagugauucuc

SEQ ID NO: 475859 - RNA, 24 nt, Human
uccuggguucaagugauucuccug

SEQ ID NO: 475860 - RNA, 26 nt, Human
ucuccugccucagccuuccgaauagc

SEQ ID NO: 475861 - RNA, 23 nt, Human
ucuugaacuccugaccucaggug

SEQ ID NO: 475862 - RNA, 20 nt, Human
ugaaauggugcaaucucagc

SEQ ID NO: 475863 - RNA, 23 nt, Human
ugaaauggugcaaucucagcuca

SEQ ID NO: 475864 - RNA, 20 nt, Human
ugacaggcagugucguucuu

SEQ ID NO: 475865 - RNA, 18 nt, Human
ugaccucaggugaucugc

SEQ ID NO: 475866 - RNA, 24 nt, Human
ugaccucaggugaucugccaaccu

SEQ ID NO: 475867 - RNA, 20 nt, Human
ugauucuccugccucagccu

SEQ ID NO: 475868 - RNA, 21 nt, Human
ugcccaggcuggaaugaaaug

SEQ ID NO: 475869 - RNA, 24 nt, Human
ugccucagccuuccgaauagcugg

SEQ ID NO: 475870 - RNA, 24 nt, Human
ugcuauguuggccagacuggucuu

SEQ ID NO: 475871 - RNA, 24 nt, Human
uggccagacuggucuugaacuccu

SEQ ID NO: 475872 - RNA, 22 nt, Human
ugggauuacagccgugugccac

SEQ ID NO: 475873 - RNA, 24 nt, Human
ugggauuacagccgugugccacug

SEQ ID NO: 475874 - RNA, 21 nt, Human
ugggauuacaggcaugcacca

SEQ ID NO: 475875 - RNA, 24 nt, Human
ugggauuacaggcaugcaccacca

SEQ ID NO: 475876 - RNA, 19 nt, Human
uggggggcugaggugaaug

SEQ ID NO: 475877 - RNA, 18 nt, Human
ugggucgggaucgggaau

SEQ ID NO: 475878 - RNA, 23 nt, Human
uggguucaagugauucuccugcc

SEQ ID NO: 475879 - RNA, 24 nt, Human
uggguucaagugauucuccugccu

SEQ ID NO: 475880 - RNA, 24 nt, Human
uggugcaaucucagcucaccgcaa

SEQ ID NO: 475881 - RNA, 18 nt, Human
uuaguagagacaggguuu

SEQ ID NO: 475882 - RNA, 24 nt, Human
uuaguagagacaggguuuugcuau

SEQ ID NO: 475883 - RNA, 21 nt, Human
uucaagugauucuccugccuc

SEQ ID NO: 475884 - RNA, 23 nt, Human
uucaagugauucuccugccucag

SEQ ID NO: 475885 - RNA, 24 nt, Human
uucaagugauucuccugccucagc

SEQ ID NO: 475886 - RNA, 24 nt, Human
uucacucauguugcccaggcugga

SEQ ID NO: 475887 - RNA, 21 nt, Human
uucccagcgcgacgucagccc

SEQ ID NO: 475888 - RNA, 23 nt, Human
uuccgaauagcugggauuacagg

SEQ ID NO: 475889 - RNA, 19 nt, Human
uuuaguagucaagguuauc

SEQ ID NO: 475890 - RNA, 23 nt, Human
uuucacucauguugcccaggcug

SEQ ID NO: 475891 - RNA, 23 nt, Human
uuuugcuauguuggccagacugg

SEQ ID NO: 475892 - RNA, 21 nt, Human
uuuuuaguagagacaggguuu

SEQ ID NO: 475893 - RNA, 21 nt, Human
uuuuuaguagagacaggguuu

SEQ ID NO: 475894 - RNA, 20 nt, Human
uuuuuguauuuuuaguagag

SEQ ID NO: 475895 - RNA, 20 nt, Human
aacaguacccacugagugau

SEQ ID NO: 475896 - RNA, 25 nt, Human
acccuaagacccucucugggugcuc

SEQ ID NO: 475897 - RNA, 21 nt, Human
acgcagaaauacugcgcgauc

SEQ ID NO: 475898 - RNA, 27 nt, Human
agaaaccaucugggcuugacaaagucu

SEQ ID NO: 475899 - RNA, 18 nt, Human
agccauggucacaacagu

SEQ ID NO: 475900 - RNA, 24 nt, Human
caaaauggugcuuguaaugaccca

SEQ ID NO: 475901 - RNA, 19 nt, Human
cacagccauggucacaaca

SEQ ID NO: 475902 - RNA, 27 nt, Human
caccggugccacgcagaaauacugcgc

SEQ ID NO: 475903 - RNA, 23 nt, Human
cagaguggaauucagcacccgcc

SEQ ID NO: 475904 - RNA, 20 nt, Human
cagcacccgccacagcagcc

SEQ ID NO: 475905 - RNA, 18 nt, Human
cagcagccagccaugggg

SEQ ID NO: 475906 - RNA, 22 nt, Human
cagcagccagccauggggugcc

SEQ ID NO: 475907 - RNA, 22 nt, Human
caggaagaaaggaaucauauuc

SEQ ID NO: 475908 - RNA, 23 nt, Human
caggucagaaguggugggaagca

SEQ ID NO: 475909 - RNA, 23 nt, Human
ccauggucacaacaguacccacu

SEQ ID NO: 475910 - RNA, 21 nt, Human
cccaguggauaccuuuagaca

SEQ ID NO: 475911 - RNA, 22 nt, Human
cccgccacagcagccagccaug

SEQ ID NO: 475912 - RNA, 21 nt, Human
cccuaagacccucucuggggg

SEQ ID NO: 475913 - RNA, 22 nt, Human
cuaaaugaacaggccacagguc

SEQ ID NO: 475914 - RNA, 23 nt, Human
cucagaggcuccaucugcauucc

SEQ ID NO: 475915 - RNA, 20 nt, Human
cuccccucuccacauagaag

SEQ ID NO: 475916 - RNA, 19 nt, Human
cucuccacauagaaguggg

SEQ ID NO: 475917 - RNA, 23 nt, Human
cucucugggugcuccccucucca

SEQ ID NO: 475918 - RNA, 21 nt, Human
cugcauuccggggcaggggcu

SEQ ID NO: 475919 - RNA, 19 nt, Human
cuggcagcuagcgccucuc

SEQ ID NO: 475920 - RNA, 18 nt, Human
cugugagucucagaggcu

SEQ ID NO: 475921 - RNA, 27 nt, Human
cuuuacagccgcauccgcaccggugcc

SEQ ID NO: 475922 - RNA, 26 nt, Human
gaacaaauaagcuuaucccucugaaa

SEQ ID NO: 475923 - RNA, 22 nt, Human
gccacagcagccagccaugggg

SEQ ID NO: 475924 - RNA, 23 nt, Human
gggaagcaggcccaguggauacc

SEQ ID NO: 475925 - RNA, 20 nt, Human
gggcugcuggagcuggcagc

SEQ ID NO: 475926 - RNA, 22 nt, Human
guaaauccuaaaacaggaagaa

SEQ ID NO: 475927 - RNA, 26 nt, Human
guggcagggaagucuccucgggaggg

SEQ ID NO: 475928 - RNA, 18 nt, Human
uaacacagccauggucac

SEQ ID NO: 475929 - RNA, 20 nt, Human
uaacagaguggaauucagca

SEQ ID NO: 475930 - RNA, 19 nt, Human
uaaguaaauccuaaaacag

SEQ ID NO: 475931 - RNA, 24 nt, Human
uacagccgcauccgcaccggugcc

SEQ ID NO: 475932 - RNA, 19 nt, Human
uagaagugggcucccggag

SEQ ID NO: 475933 - RNA, 22 nt, Human
uagaagugggcucccggaggcg

SEQ ID NO: 475934 - RNA, 24 nt, Human
ucucagaggcuccaucugcauucc

SEQ ID NO: 475935 - RNA, 28 nt, Human
ucugggcugcuggagcuggggccgaacc

SEQ ID NO: 475936 - RNA, 20 nt, Human
ugaggauggcccugccuggc

SEQ ID NO: 475937 - RNA, 20 nt, Human
ugcugaguaugccuuggggu

SEQ ID NO: 475938 - RNA, 21 nt, Human
ugcuuuacagccgcauccgca

SEQ ID NO: 475939 - RNA, 19 nt, Human
uggcagaggaguggacucc

SEQ ID NO: 475940 - RNA, 20 nt, Human
uggcagaggaguggacucca

SEQ ID NO: 475941 - RNA, 22 nt, Human
uggcagaggaguggacuccagu

SEQ ID NO: 475942 - RNA, 24 nt, Human
uggcagaggaguggacuccagugg

SEQ ID NO: 475943 - RNA, 23 nt, Human
uggcagcuagcgccucucgcucc

SEQ ID NO: 475944 - RNA, 18 nt, Human
uggcagggaagucuccuc

SEQ ID NO: 475945 - RNA, 18 nt, Human
uggccaguuaaucauugu

SEQ ID NO: 475946 - RNA, 21 nt, Human
uggccugaggauggcccugcc

SEQ ID NO: 475947 - RNA, 23 nt, Human
uggccugaggauggcccugccug

SEQ ID NO: 475948 - RNA, 20 nt, Human
ugggcuggccugaggauggc

SEQ ID NO: 475949 - RNA, 23 nt, Human
ugguaggaugggcuggccugagg

SEQ ID NO: 475950 - RNA, 26 nt, Human
ugguaggaugggcuggccugaggaug

SEQ ID NO: 475951 - RNA, 18 nt, Human
ugugguugaauacuugcc

SEQ ID NO: 475952 - RNA, 24 nt, Human
ugugguugaauacuugccuaaggc

SEQ ID NO: 475953 - RNA, 20 nt, Human
uuccugaauucagaaaacua

SEQ ID NO: 475954 - RNA, 29 nt, Human
uuccugaauucagaaaacuaaaugaacaa

SEQ ID NO: 475955 - RNA, 22 nt, Human
uugggcuacccugcccgucucu

SEQ ID NO: 475956 - RNA, 22 nt, Human
aaacugguuuuuauucuaaaca

SEQ ID NO: 475957 - RNA, 19 nt, Human
aagggccugccugugcccc

SEQ ID NO: 475958 - RNA, 22 nt, Human
aagggccugccugugccccacu

SEQ ID NO: 475959 - RNA, 20 nt, Human
aauggaaagacaaggacgga

SEQ ID NO: 475960 - RNA, 21 nt, Human
accccgaaaggccggucgggg

SEQ ID NO: 475961 - RNA, 22 nt, Human
acggagauucuuccgguggcgg

SEQ ID NO: 475962 - RNA, 22 nt, Human
agaacccugaauccauuccgcc

SEQ ID NO: 475963 - RNA, 21 nt, Human
agagcgcgcccggcaaccccg

SEQ ID NO: 475964 - RNA, 18 nt, Human
aggacggucaaggguggu

SEQ ID NO: 475965 - RNA, 24 nt, Human
caaccccgaaaggccggucgggga

SEQ ID NO: 475966 - RNA, 22 nt, Human
cacccaagggccugccugugcc

SEQ ID NO: 475967 - RNA, 21 nt, Human
cagaauggaaagacaaggacg

SEQ ID NO: 475968 - RNA, 19 nt, Human
cagagcgcgcccggcaacc

SEQ ID NO: 475969 - RNA, 18 nt, Human
cagaggugccccugcucc

SEQ ID NO: 475970 - RNA, 21 nt, Human
caugcuggggggccucuccug

SEQ ID NO: 475971 - RNA, 21 nt, Human
ccagcccuuagcacccaaggg

SEQ ID NO: 475972 - RNA, 19 nt, Human
ccccacuguggcccucuuu

SEQ ID NO: 475973 - RNA, 23 nt, Human
ccccgaaaggccggucggggacc

SEQ ID NO: 475974 - RNA, 19 nt, Human
ccccggcugggagucagga

SEQ ID NO: 475975 - RNA, 22 nt, Human
ccccugcuccccacuguggccc

SEQ ID NO: 475976 - RNA, 19 nt, Human
ccccuuugcagagcgcgcc

SEQ ID NO: 475977 - RNA, 21 nt, Human
ccccuuugcagagcgcgcccg

SEQ ID NO: 475978 - RNA, 25 nt, Human
cccgagaacccugaauccauuccgc

SEQ ID NO: 475979 - RNA, 26 nt, Human
cccugcuccccacuguggcccucuuu

SEQ ID NO: 475980 - RNA, 19 nt, Human
ccugccgaccggcuggcgc

SEQ ID NO: 475981 - RNA, 22 nt, Human
cggauagaguagggggucccag

SEQ ID NO: 475982 - RNA, 22 nt, Human
cggggaccccggcugggaguca

SEQ ID NO: 475983 - RNA, 23 nt, Human
cggggaccccggcugggagucag

SEQ ID NO: 475984 - RNA, 24 nt, Human
cgugaccccugccgaccggcuggc

SEQ ID NO: 475985 - RNA, 23 nt, Human
cuccagaggugccccugcucccc

SEQ ID NO: 475986 - RNA, 22 nt, Human
cucccgggcgcgacccgagaac

SEQ ID NO: 475987 - RNA, 24 nt, Human
cuccugccuccagaggugccccug

SEQ ID NO: 475988 - RNA, 21 nt, Human
cuggggggccucuccugccuc

SEQ ID NO: 475989 - RNA, 22 nt, Human
gcagagcgcgcccggcaacccc

SEQ ID NO: 475990 - RNA, 26 nt, Human
gccggucggggaccccggcugggagu

SEQ ID NO: 475991 - RNA, 20 nt, Human
gcuggggggccucuccugcc

SEQ ID NO: 475992 - RNA, 20 nt, Human
ggaucugucugguucgaacu

SEQ ID NO: 475993 - RNA, 19 nt, Human
uacccacaugcagcccagc

SEQ ID NO: 475994 - RNA, 19 nt, Human
uagcucccgggcgcgaccc

SEQ ID NO: 475995 - RNA, 19 nt, Human
uccgcgcacacccggccgc

SEQ ID NO: 475996 - RNA, 23 nt, Human
uccuggggcugugugcuuacugg

SEQ ID NO: 475997 - RNA, 23 nt, Human
ucggggaccccggcugggaguca

SEQ ID NO: 475998 - RNA, 18 nt, Human
ucuaaacacguacuaggg

SEQ ID NO: 475999 - RNA, 18 nt, Human
ugccccugcuccccacug

SEQ ID NO: 476000 - RNA, 24 nt, Human
ugccccugcuccccacuguggccc

SEQ ID NO: 476001 - RNA, 19 nt, Human
uugguugaggacggucaag

SEQ ID NO: 476002 - RNA, 22 nt, Human
uugguugaggacggucaagggu

SEQ ID NO: 476003 - RNA, 20 nt, Human
aaaacagaagcagaaacaca

SEQ ID NO: 476004 - RNA, 21 nt, Human
aaacagaagcagaaacacaca

SEQ ID NO: 476005 - RNA, 21 nt, Human
aaacagaagcagaaacaggga

SEQ ID NO: 476006 - RNA, 20 nt, Human
aaaugcacacagggcugaac

SEQ ID NO: 476007 - RNA, 28 nt, Human
aagccagucccaaggccccuggagccaa

SEQ ID NO: 476008 - RNA, 18 nt, Human
aaggaaccaguccacagc

SEQ ID NO: 476009 - RNA, 23 nt, Human
aaggaggcggcaggaggaggagg

SEQ ID NO: 476010 - RNA, 23 nt, Human
aaggccccuggagccaaggacac

SEQ ID NO: 476011 - RNA, 24 nt, Human
acagcauuuugugcuaauuuccau

SEQ ID NO: 476012 - RNA, 19 nt, Human
acagcugugaggggaccuc

SEQ ID NO: 476013 - RNA, 24 nt, Human
acauggcccgacagccuggguggg

SEQ ID NO: 476014 - RNA, 20 nt, Human
acccggcccuccccuagcgg

SEQ ID NO: 476015 - RNA, 19 nt, Human
acccggggcccuccccugg

SEQ ID NO: 476016 - RNA, 27 nt, Human
accgguccaugauggaaccagucacac

SEQ ID NO: 476017 - RNA, 18 nt, Human
agacagcacaccccgaac

SEQ ID NO: 476018 - RNA, 20 nt, Human
agaccuggacaaggacagca

SEQ ID NO: 476019 - RNA, 18 nt, Human
agacuuaaggcccgcggc

SEQ ID NO: 476020 - RNA, 19 nt, Human
agcaggacuccaaagaggg

SEQ ID NO: 476021 - RNA, 21 nt, Human
agccccaaggaaccaguccac

SEQ ID NO: 476022 - RNA, 21 nt, Human
agcgcaccacauccagacagc

SEQ ID NO: 476023 - RNA, 20 nt, Human
agcggcccuuuccugugccc

SEQ ID NO: 476024 - RNA, 23 nt, Human
aggggccuaccaccagccaggca

SEQ ID NO: 476025 - RNA, 24 nt, Human
aucuagaaaaggaggcggcaggag

SEQ ID NO: 476026 - RNA, 18 nt, Human
augccuguaugucccaca

SEQ ID NO: 476027 - RNA, 21 nt, Human
caagucccaggaagucuccaa

SEQ ID NO: 476028 - RNA, 21 nt, Human
caagucccaggaagucuccaa

SEQ ID NO: 476029 - RNA, 25 nt, Human
cacacacaucacuuaugccuguaug

SEQ ID NO: 476030 - RNA, 23 nt, Human
caccacauccagacagcacaccc

SEQ ID NO: 476031 - RNA, 20 nt, Human
caccagugggucgcugagga

SEQ ID NO: 476032 - RNA, 22 nt, Human
cacccagacagcaggacuccaa

SEQ ID NO: 476033 - RNA, 23 nt, Human
cacggcugcuccugagggacaga

SEQ ID NO: 476034 - RNA, 19 nt, Human
cacucggcgggcucacggc

SEQ ID NO: 476035 - RNA, 20 nt, Human
cacugaucuuuauuccgugu

SEQ ID NO: 476036 - RNA, 21 nt, Human
cagcagcagugaaauacagcu

SEQ ID NO: 476037 - RNA, 21 nt, Human
cagcccaacauggcccgacag

SEQ ID NO: 476038 - RNA, 21 nt, Human
cagcccgggaccagcucacag

SEQ ID NO: 476039 - RNA, 24 nt, Human
cagucacaccuccccuacaccugg

SEQ ID NO: 476040 - RNA, 23 nt, Human
caucaaccaccucgagaagcagg

SEQ ID NO: 476041 - RNA, 23 nt, Human
caugauggaaccagucacaccuc

SEQ ID NO: 476042 - RNA, 20 nt, Human
caugcagccugugacacacc

SEQ ID NO: 476043 - RNA, 18 nt, Human
cauggcccgacagccugg

SEQ ID NO: 476044 - RNA, 24 nt, Human
ccaacaccucucacauucagucuu

SEQ ID NO: 476045 - RNA, 26 nt, Human
ccacccgggacagugaggccagcugc

SEQ ID NO: 476046 - RNA, 23 nt, Human
ccagacagcacaccccgaacauu

SEQ ID NO: 476047 - RNA, 26 nt, Human
ccagacagcacaccccgaacauucca

SEQ ID NO: 476048 - RNA, 19 nt, Human
ccagcagcagugaaauaca

SEQ ID NO: 476049 - RNA, 28 nt, Human
ccagucccaaggccccuggagccaagga

SEQ ID NO: 476050 - RNA, 21 nt, Human
cccacagucucuggcaguguc

SEQ ID NO: 476051 - RNA, 22 nt, Human
cccagacagcaggacuccaaag

SEQ ID NO: 476052 - RNA, 22 nt, Human
ccccugaccugccucuggccgc

SEQ ID NO: 476053 - RNA, 23 nt, Human
cccgcauuccaggggucaugcag

SEQ ID NO: 476054 - RNA, 22 nt, Human
cccgcggcccagacaccccgag

SEQ ID NO: 476055 - RNA, 23 nt, Human
cccggcccuccccuagcggcccu

SEQ ID NO: 476056 - RNA, 19 nt, Human
cccucagacccgcggccca

SEQ ID NO: 476057 - RNA, 18 nt, Human
ccgggacagugaggccag

SEQ ID NO: 476058 - RNA, 24 nt, Human
ccuagcggcccuuuccugugcccc

SEQ ID NO: 476059 - RNA, 23 nt, Human
ccucuggccgccgaacccggggc

SEQ ID NO: 476060 - RNA, 24 nt, Human
ccucuggccgccgaacccggggcc

SEQ ID NO: 476061 - RNA, 18 nt, Human
ccugcccgcauuccaggg

SEQ ID NO: 476062 - RNA, 19 nt, Human
ccugcguggcggggccacu

SEQ ID NO: 476063 - RNA, 20 nt, Human
ccugugccccggguggcccc

SEQ ID NO: 476064 - RNA, 22 nt, Human
ccuuccgcacuuagagccccaa

SEQ ID NO: 476065 - RNA, 19 nt, Human
cgacccccugcccgucugc

SEQ ID NO: 476066 - RNA, 23 nt, Human
cgaggcagucauuuggcaaggac

SEQ ID NO: 476067 - RNA, 23 nt, Human
cgauggcgaggccucccucugcu

SEQ ID NO: 476068 - RNA, 18 nt, Human
cgcagccuucuggccaca

SEQ ID NO: 476069 - RNA, 19 nt, Human
cggcaugaucugagcugga

SEQ ID NO: 476070 - RNA, 19 nt, Human
cggccuccuaggcugcccc

SEQ ID NO: 476071 - RNA, 22 nt, Human
cggcuuggacuccagccuucag

SEQ ID NO: 476072 - RNA, 28 nt, Human
cguuuacauacaugaggaaaugcacaca

SEQ ID NO: 476073 - RNA, 22 nt, Human
cucccgggacuccagagccuag

SEQ ID NO: 476074 - RNA, 21 nt, Human
cugggcccuuccgcacuuaga

SEQ ID NO: 476075 - RNA, 22 nt, Human
cugucccugucuuugucagccc

SEQ ID NO: 476076 - RNA, 24 nt, Human
cuuagagccccaaggaaccagucc

SEQ ID NO: 476077 - RNA, 20 nt, Human
cuuggcccuggaccucaggg

SEQ ID NO: 476078 - RNA, 23 nt, Human
cuugugacggaauccccucccca

SEQ ID NO: 476079 - RNA, 21 nt, Human
cuuuccugugccccggguggc

SEQ ID NO: 476080 - RNA, 24 nt, Human
gaaccaguccacagcgggaaccag

SEQ ID NO: 476081 - RNA, 23 nt, Human
gaaccaguccacggcagaaccgg

SEQ ID NO: 476082 - RNA, 22 nt, Human
gaaccaguccagggcagaacca

SEQ ID NO: 476083 - RNA, 23 nt, Human
gaaccaguccagggcagaaccag

SEQ ID NO: 476084 - RNA, 23 nt, Human
gaaccgguccacggaggaaccgg

SEQ ID NO: 476085 - RNA, 23 nt, Human
gaaccgguccaugauggaaccag

SEQ ID NO: 476086 - RNA, 23 nt, Human
gaaccgguccauggaggaaccgg

SEQ ID NO: 476087 - RNA, 23 nt, Human
gaaccgguccauggcggaaccgg

SEQ ID NO: 476088 - RNA, 21 nt, Human
gacaaggacagcaagucccag

SEQ ID NO: 476089 - RNA, 19 nt, Human
gaccccgggucagcgcaac

SEQ ID NO: 476090 - RNA, 19 nt, Human
gacuguggcuguggcccug

SEQ ID NO: 476091 - RNA, 22 nt, Human
gagaagagcacugugguucagg

SEQ ID NO: 476092 - RNA, 21 nt, Human
gaggaacccuugacccugggg

SEQ ID NO: 476093 - RNA, 19 nt, Human
gaggaaccgguccauggag

SEQ ID NO: 476094 - RNA, 22 nt, Human
gccaacaccucucacauucagu

SEQ ID NO: 476095 - RNA, 19 nt, Human
gccccggacuaggggcagc

SEQ ID NO: 476096 - RNA, 23 nt, Human
gccccuccucaucccucagaccc

SEQ ID NO: 476097 - RNA, 18 nt, Human
gcccuggaccucagggag

SEQ ID NO: 476098 - RNA, 20 nt, Human
gccggcgccuaccugcgugg

SEQ ID NO: 476099 - RNA, 23 nt, Human
gcgcaccacauccagacagcaca

SEQ ID NO: 476100 - RNA, 21 nt, Human
gcucuggcugaggccggcgcc

SEQ ID NO: 476101 - RNA, 22 nt, Human
gcuuggacuccagccuucagcu

SEQ ID NO: 476102 - RNA, 21 nt, Human
ggacagugaggccagcugcgg

SEQ ID NO: 476103 - RNA, 18 nt, Human
ggaggaaccgguccaugg

SEQ ID NO: 476104 - RNA, 20 nt, Human
ggcaggagugguccagggca

SEQ ID NO: 476105 - RNA, 22 nt, Human
ggcuuggacuccagccuucagc

SEQ ID NO: 476106 - RNA, 18 nt, Human
gggcaggagugguccagg

SEQ ID NO: 476107 - RNA, 20 nt, Human
gggcaggagugguccagggc

SEQ ID NO: 476108 - RNA, 20 nt, Human
gggcaggagugguccauggc

SEQ ID NO: 476109 - RNA, 20 nt, Human
gggcaggagugguccauggc

SEQ ID NO: 476110 - RNA, 19 nt, Human
gggcucagggaucagacag

SEQ ID NO: 476111 - RNA, 23 nt, Human
gguggggccaccucacaaggccc

SEQ ID NO: 476112 - RNA, 19 nt, Human
gucacaccuccccuacacc

SEQ ID NO: 476113 - RNA, 20 nt, Human
guccacggcagaaccggucc

SEQ ID NO: 476114 - RNA, 19 nt, Human
gucucuggcaguguccuag

SEQ ID NO: 476115 - RNA, 26 nt, Human
uacaccuggcagaccuggacaaggac

SEQ ID NO: 476116 - RNA, 18 nt, Human
uaccucguuccggcccug

SEQ ID NO: 476117 - RNA, 19 nt, Human
uagagccccaaggaaccag

SEQ ID NO: 476118 - RNA, 22 nt, Human
uagcagcccgggaccagcucac

SEQ ID NO: 476119 - RNA, 21 nt, Human
uagcggcccuuuccugugccc

SEQ ID NO: 476120 - RNA, 21 nt, Human
uaucucagaaaacaaaggcug

SEQ ID NO: 476121 - RNA, 18 nt, Human
uccaaaagcucauuccgc

SEQ ID NO: 476122 - RNA, 22 nt, Human
uccaaaagcucauuccgcuucc

SEQ ID NO: 476123 - RNA, 25 nt, Human
uccacagcgggaaccaguccagggc

SEQ ID NO: 476124 - RNA, 24 nt, Human
uccacggcagaaccgguccagggc

SEQ ID NO: 476125 - RNA, 23 nt, Human
uccagagccuagagccgagaagc

SEQ ID NO: 476126 - RNA, 18 nt, Human
uccagggcaggagugguc

SEQ ID NO: 476127 - RNA, 22 nt, Human
uccagggcaggagugguccaug

SEQ ID NO: 476128 - RNA, 20 nt, Human
uccaggggcucuggcugagg

SEQ ID NO: 476129 - RNA, 23 nt, Human
ucccagccacguuuaaaccaagc

SEQ ID NO: 476130 - RNA, 20 nt, Human
uccccuggaggguggggcca

SEQ ID NO: 476131 - RNA, 18 nt, Human
uccccuggcucucuuugg

SEQ ID NO: 476132 - RNA, 18 nt, Human
ucccucugcucccagccu

SEQ ID NO: 476133 - RNA, 22 nt, Human
ucccugucuuugucagcccuag

SEQ ID NO: 476134 - RNA, 19 nt, Human
uccgcuuccaggcugcggu

SEQ ID NO: 476135 - RNA, 21 nt, Human
uccggcccuggcacccagaca

SEQ ID NO: 476136 - RNA, 20 nt, Human
uccugugccccggguggccc

SEQ ID NO: 476137 - RNA, 22 nt, Human
ucucuggcaguguccuagggcc

SEQ ID NO: 476138 - RNA, 20 nt, Human
ucuggcaguguccuagggcc

SEQ ID NO: 476139 - RNA, 19 nt, Human
ugacccugggguggggaca

SEQ ID NO: 476140 - RNA, 21 nt, Human
ugacggaauccccuccccaau

SEQ ID NO: 476141 - RNA, 18 nt, Human
ugaggaaaugcacacagg

SEQ ID NO: 476142 - RNA, 20 nt, Human
ugccccggacuaggggcagc

SEQ ID NO: 476143 - RNA, 21 nt, Human
ugccuguaugucccacagucu

SEQ ID NO: 476144 - RNA, 21 nt, Human
uggcccgacagccuggguggg

SEQ ID NO: 476145 - RNA, 20 nt, Human
uggcgaggccucccucugcu

SEQ ID NO: 476146 - RNA, 19 nt, Human
ugggaagccagucccaagg

SEQ ID NO: 476147 - RNA, 18 nt, Human
ugggagaggacacggcug

SEQ ID NO: 476148 - RNA, 20 nt, Human
ugggagcaucugacguuugc

SEQ ID NO: 476149 - RNA, 22 nt, Human
uggggcuuccugcacacggccg

SEQ ID NO: 476150 - RNA, 18 nt, Human
ugggguggggacacggaa

SEQ ID NO: 476151 - RNA, 23 nt, Human
ugggguggggacacggaaggcag

SEQ ID NO: 476152 - RNA, 18 nt, Human
uguaugucccacagucuc

SEQ ID NO: 476153 - RNA, 23 nt, Human
uguguccgcagccuucuggccac

SEQ ID NO: 476154 - RNA, 23 nt, Human
uguuuuuagcgcaccacauccag

SEQ ID NO: 476155 - RNA, 20 nt, Human
uucaagguggaaaguaaggc

SEQ ID NO: 476156 - RNA, 20 nt, Human
uuccaggggucaugcagccu

SEQ ID NO: 476157 - RNA, 18 nt, Human
aaaagaaagaauccccag

SEQ ID NO: 476158 - RNA, 21 nt, Human
aacccagggauaaucuggguu

SEQ ID NO: 476159 - RNA, 24 nt, Human
aagaaaauuuaaaaaaaaaaagac

SEQ ID NO: 476160 - RNA, 21 nt, Human
aagcaagggcucugcccaaag

SEQ ID NO: 476161 - RNA, 19 nt, Human
aagcagauggcggggcagg

SEQ ID NO: 476162 - RNA, 22 nt, Human
aaggcccaugggcgagccuggc

SEQ ID NO: 476163 - RNA, 21 nt, Human
aagggcucugcccaaagcuau

SEQ ID NO: 476164 - RNA, 18 nt, Human
agaaagaauccccaguga

SEQ ID NO: 476165 - RNA, 22 nt, Human
agaaggcugcagccgcuggucc

SEQ ID NO: 476166 - RNA, 22 nt, Human
agacggcugggccccaacucuc

SEQ ID NO: 476167 - RNA, 18 nt, Human
agaggaggggcuuggugg

SEQ ID NO: 476168 - RNA, 19 nt, Human
agaggccugggucaggagg

SEQ ID NO: 476169 - RNA, 24 nt, Human
agagguguggagggggagaggagg

SEQ ID NO: 476170 - RNA, 20 nt, Human
agagucucgcggggaggagg

SEQ ID NO: 476171 - RNA, 18 nt, Human
agccaggaagcaagggcu

SEQ ID NO: 476172 - RNA, 20 nt, Human
agccggacucugcgggcggg

SEQ ID NO: 476173 - RNA, 23 nt, Human
agcuggccucuggccgugacaca

SEQ ID NO: 476174 - RNA, 21 nt, Human
aggaggaggaggggauggagc

SEQ ID NO: 476175 - RNA, 19 nt, Human
aggaggggauggagcgguc

SEQ ID NO: 476176 - RNA, 24 nt, Human
aggcaggcagagguguggccacga

SEQ ID NO: 476177 - RNA, 21 nt, Human
aggccugggucaggaggggag

SEQ ID NO: 476178 - RNA, 22 nt, Human
agggggagaggaggggcuuggu

SEQ ID NO: 476179 - RNA, 22 nt, Human
agguguggagggggagaggagg

SEQ ID NO: 476180 - RNA, 24 nt, Human
augccacagaggccugggucagga

SEQ ID NO: 476181 - RNA, 23 nt, Human
auggcggggcagggccagggcug

SEQ ID NO: 476182 - RNA, 24 nt, Human
auuccccccaccucccagcucccc

SEQ ID NO: 476183 - RNA, 23 nt, Human
caagauggagggggagagcugga

SEQ ID NO: 476184 - RNA, 23 nt, Human
cacagagcgcccacauccccacu

SEQ ID NO: 476185 - RNA, 20 nt, Human
cacccacaugcaggccucug

SEQ ID NO: 476186 - RNA, 26 nt, Human
cacccucccgggcagcuugggcccaa

SEQ ID NO: 476187 - RNA, 21 nt, Human
cacugagcuccccccacccuc

SEQ ID NO: 476188 - RNA, 22 nt, Human
cacugagcuccccccacccucc

SEQ ID NO: 476189 - RNA, 19 nt, Human
cacugugccagcugccucc

SEQ ID NO: 476190 - RNA, 21 nt, Human
cagagcgcccacauccccacu

SEQ ID NO: 476191 - RNA, 24 nt, Human
cagaugggguagaacaccaggccc

SEQ ID NO: 476192 - RNA, 18 nt, Human
cagcacuuuggccuggag

SEQ ID NO: 476193 - RNA, 22 nt, Human
cagcaucagccugggaaggagg

SEQ ID NO: 476194 - RNA, 19 nt, Human
cagcaugcccccagcacag

SEQ ID NO: 476195 - RNA, 19 nt, Human
cagcugaacuaagagcccc

SEQ ID NO: 476196 - RNA, 19 nt, Human
caggagcccauggcggugg

SEQ ID NO: 476197 - RNA, 23 nt, Human
cagggccagggcugguccucagc

SEQ ID NO: 476198 - RNA, 19 nt, Human
caguguccucugcccucgc

SEQ ID NO: 476199 - RNA, 18 nt, Human
caugcccccagcacagga

SEQ ID NO: 476200 - RNA, 19 nt, Human
cauuccccccaccucccag

SEQ ID NO: 476201 - RNA, 18 nt, Human
ccacagaggccuggguca

SEQ ID NO: 476202 - RNA, 20 nt, Human
ccacaugcaggccucugccu

SEQ ID NO: 476203 - RNA, 19 nt, Human
ccacugagcuccccccacc

SEQ ID NO: 476204 - RNA, 22 nt, Human
ccagcagcugaacuaagagccc

SEQ ID NO: 476205 - RNA, 23 nt, Human
cccaacucuccucacagguggca

SEQ ID NO: 476206 - RNA, 23 nt, Human
cccacaugcaggccucugccacg

SEQ ID NO: 476207 - RNA, 21 nt, Human
ccccacggaccgcugauuccc

SEQ ID NO: 476208 - RNA, 25 nt, Human
ccccacuguguggccaccccucccg

SEQ ID NO: 476209 - RNA, 18 nt, Human
ccccccaagauggagggg

SEQ ID NO: 476210 - RNA, 20 nt, Human
ccccccacccuccacgcaaa

SEQ ID NO: 476211 - RNA, 23 nt, Human
ccccccacccuccacgcaaacag

SEQ ID NO: 476212 - RNA, 23 nt, Human
ccccccaccucccagcuccccac

SEQ ID NO: 476213 - RNA, 22 nt, Human
cccguccccacgaccccacgga

SEQ ID NO: 476214 - RNA, 20 nt, Human
cccugaagcagccaggaagc

SEQ ID NO: 476215 - RNA, 19 nt, Human
cccugagcccugaagcagc

SEQ ID NO: 476216 - RNA, 20 nt, Human
cccugagcccugaagcagcc

SEQ ID NO: 476217 - RNA, 22 nt, Human
cccugccacugagcucccccca

SEQ ID NO: 476218 - RNA, 21 nt, Human
cccugccggacugccuucccc

SEQ ID NO: 476219 - RNA, 20 nt, Human
ccucccgggcagcuugggcc

SEQ ID NO: 476220 - RNA, 22 nt, Human
ccugagcccugaagcagccagg

SEQ ID NO: 476221 - RNA, 24 nt, Human
ccugccacugagcuccccccaccc

SEQ ID NO: 476222 - RNA, 23 nt, Human
ccuggcugucccccguuccucug

SEQ ID NO: 476223 - RNA, 18 nt, Human
ccugggugcggcuggucc

SEQ ID NO: 476224 - RNA, 22 nt, Human
ccugugucugcacccacccucc

SEQ ID NO: 476225 - RNA, 19 nt, Human
ccuugguaggccaggggga

SEQ ID NO: 476226 - RNA, 24 nt, Human
cgaaaaccaagggagugggaauca

SEQ ID NO: 476227 - RNA, 23 nt, Human
cgaggaaaggaaggaggccagga

SEQ ID NO: 476228 - RNA, 23 nt, Human
cgaggaaggacccaagugagccg

SEQ ID NO: 476229 - RNA, 25 nt, Human
cgccagcacuuccgccacugcagcc

SEQ ID NO: 476230 - RNA, 20 nt, Human
cggcagggucccucucccuu

SEQ ID NO: 476231 - RNA, 19 nt, Human
cgggagggagaagccccaa

SEQ ID NO: 476232 - RNA, 18 nt, Human
cggggccagcacaucccc

SEQ ID NO: 476233 - RNA, 21 nt, Human
cuagccucaggagcccauggc

SEQ ID NO: 476234 - RNA, 19 nt, Human
cucagccugugucugcacc

SEQ ID NO: 476235 - RNA, 20 nt, Human
cucauggcagucauacaaca

SEQ ID NO: 476236 - RNA, 21 nt, Human
cucauggcagucauacaacaa

SEQ ID NO: 476237 - RNA, 24 nt, Human
cuccaggugacugcagcccaaacc

SEQ ID NO: 476238 - RNA, 18 nt, Human
cucugcccucgcccgggc

SEQ ID NO: 476239 - RNA, 18 nt, Human
cugagcccugaagcagcc

SEQ ID NO: 476240 - RNA, 18 nt, Human
cugagcccugaagcagcc

SEQ ID NO: 476241 - RNA, 21 nt, Human
cugcagcccaaacccagggau

SEQ ID NO: 476242 - RNA, 18 nt, Human
cugcccucgcccgggcag

SEQ ID NO: 476243 - RNA, 20 nt, Human
cuggcagcaggaggcucccu

SEQ ID NO: 476244 - RNA, 21 nt, Human
cuguucauuccaggaaggacc

SEQ ID NO: 476245 - RNA, 24 nt, Human
cuugggcccaacugcuccgccccc

SEQ ID NO: 476246 - RNA, 21 nt, Human
gaaagaauccccagugaacac

SEQ ID NO: 476247 - RNA, 18 nt, Human
gaaggagggcugggagcc

SEQ ID NO: 476248 - RNA, 18 nt, Human
gacaugugaguguuucug

SEQ ID NO: 476249 - RNA, 23 nt, Human
gaccccacggaccgcugauuccc

SEQ ID NO: 476250 - RNA, 18 nt, Human
gagaagccccaaagagag

SEQ ID NO: 476251 - RNA, 22 nt, Human
gagccacggcuugccgaccuca

SEQ ID NO: 476252 - RNA, 18 nt, Human
gagcuccccccacccucc

SEQ ID NO: 476253 - RNA, 18 nt, Human
gagggaugcaggcgggaa

SEQ ID NO: 476254 - RNA, 21 nt, Human
gaugggguagaacaccaggcc

SEQ ID NO: 476255 - RNA, 22 nt, Human
gcaagggcucugcccaaagcua

SEQ ID NO: 476256 - RNA, 21 nt, Human
gcacccacccucccgggcagc

SEQ ID NO: 476257 - RNA, 24 nt, Human
gcacugugccagcugccuccuggc

SEQ ID NO: 476258 - RNA, 19 nt, Human
gcaguggggcugcccucgg

SEQ ID NO: 476259 - RNA, 20 nt, Human
gcauccuaaggaggaggagg

SEQ ID NO: 476260 - RNA, 22 nt, Human
gccaggaagacggcugggcccc

SEQ ID NO: 476261 - RNA, 23 nt, Human
gccuggagggagaagggaagcca

SEQ ID NO: 476262 - RNA, 24 nt, Human
gcggggaggaggggcuagaaggcu

SEQ ID NO: 476263 - RNA, 18 nt, Human
gcuccccccacccuccac

SEQ ID NO: 476264 - RNA, 21 nt, Human
gcugucccccguuccucugga

SEQ ID NO: 476265 - RNA, 21 nt, Human
ggaaagaaaauuuaaaaaaaa

SEQ ID NO: 476266 - RNA, 21 nt, Human
ggaaaggaaggaggccaggaa

SEQ ID NO: 476267 - RNA, 20 nt, Human
ggacccaagugagccggcag

SEQ ID NO: 476268 - RNA, 21 nt, Human
ggaggaggaggggauggagcg

SEQ ID NO: 476269 - RNA, 20 nt, Human
ggccugggucaggaggggag

SEQ ID NO: 476270 - RNA, 18 nt, Human
ggccugguggugaggcug

SEQ ID NO: 476271 - RNA, 20 nt, Human
ggcuagaaggcugcagccgc

SEQ ID NO: 476272 - RNA, 20 nt, Human
gggaccauuccccccaccuc

SEQ ID NO: 476273 - RNA, 18 nt, Human
gggagagcuggccucugg

SEQ ID NO: 476274 - RNA, 18 nt, Human
gggagggaugcaggcggg

SEQ ID NO: 476275 - RNA, 18 nt, Human
gggauacccaggggccca

SEQ ID NO: 476276 - RNA, 18 nt, Human
gggauggagcggucgggc

SEQ ID NO: 476277 - RNA, 27 nt, Human
gggcagcaggggcauaagccuugcucc

SEQ ID NO: 476278 - RNA, 19 nt, Human
gggcagggccagggcuggu

SEQ ID NO: 476279 - RNA, 22 nt, Human
gggcugguccucagccuguguc

SEQ ID NO: 476280 - RNA, 20 nt, Human
ggggagaggaggggcuuggu

SEQ ID NO: 476281 - RNA, 18 nt, Human
ggggauggagcggucggg

SEQ ID NO: 476282 - RNA, 22 nt, Human
ggggcccugaaugcccuuccug

SEQ ID NO: 476283 - RNA, 20 nt, Human
gggguagaacaccaggcccu

SEQ ID NO: 476284 - RNA, 25 nt, Human
ggugaaagcagauggcggggcaggg

SEQ ID NO: 476285 - RNA, 23 nt, Human
ggugaaucuagcacuggacaaag

SEQ ID NO: 476286 - RNA, 22 nt, Human
guggggcugcccucggggauca

SEQ ID NO: 476287 - RNA, 18 nt, Human
uaaaaugucacagggacc

SEQ ID NO: 476288 - RNA, 22 nt, Human
uaaaaugucacagggaccaaaa

SEQ ID NO: 476289 - RNA, 22 nt, Human
uaaaugccaggacacuuugccu

SEQ ID NO: 476290 - RNA, 20 nt, Human
uaaggaggaggaggggaugg

SEQ ID NO: 476291 - RNA, 19 nt, Human
uacaaaacuaggagacucu

SEQ ID NO: 476292 - RNA, 18 nt, Human
ucacagggaccaaaauag

SEQ ID NO: 476293 - RNA, 20 nt, Human
ucauauauagauuucuuccu

SEQ ID NO: 476294 - RNA, 21 nt, Human
uccacacacaagcauuggggc

SEQ ID NO: 476295 - RNA, 23 nt, Human
uccccacgaccccacggaccgcu

SEQ ID NO: 476296 - RNA, 22 nt, Human
uccccacuguguggccaccccu

SEQ ID NO: 476297 - RNA, 19 nt, Human
uccccccacccuccacgca

SEQ ID NO: 476298 - RNA, 19 nt, Human
ucccgggcagcuugggccc

SEQ ID NO: 476299 - RNA, 22 nt, Human
ucccguccccacgaccccacgg

SEQ ID NO: 476300 - RNA, 22 nt, Human
ucccugagggaaaccuuugcag

SEQ ID NO: 476301 - RNA, 24 nt, Human
ucccugccacugagcuccccccac

SEQ ID NO: 476302 - RNA, 21 nt, Human
ucccugccggacugccuuccc

SEQ ID NO: 476303 - RNA, 22 nt, Human
uccgcccccccaagauggaggg

SEQ ID NO: 476304 - RNA, 19 nt, Human
uccucugcccucgcccggg

SEQ ID NO: 476305 - RNA, 22 nt, Human
uccuggguggggccugugacuc

SEQ ID NO: 476306 - RNA, 21 nt, Human
ucgggcacauguucccguccc

SEQ ID NO: 476307 - RNA, 20 nt, Human
ucugucacgcauuuaaaaug

SEQ ID NO: 476308 - RNA, 21 nt, Human
ugaaacgggagggagaagccc

SEQ ID NO: 476309 - RNA, 21 nt, Human
ugaaagcagauggcggggcag

SEQ ID NO: 476310 - RNA, 23 nt, Human
ugaagcagccaggaagcaagggc

SEQ ID NO: 476311 - RNA, 20 nt, Human
ugacuccuggugucuggcuc

SEQ ID NO: 476312 - RNA, 23 nt, Human
ugagggaaaccuuugcagaaagu

SEQ ID NO: 476313 - RNA, 24 nt, Human
ugcagcaugccacagaggccuggg

SEQ ID NO: 476314 - RNA, 24 nt, Human
ugcauccuaaggaggaggagggga

SEQ ID NO: 476315 - RNA, 24 nt, Human
ugcccggggugaggugaaucuagc

SEQ ID NO: 476316 - RNA, 25 nt, Human
ugccggacugccuucccccagaagc

SEQ ID NO: 476317 - RNA, 24 nt, Human
ugcugcggucgugggcgacgcugg

SEQ ID NO: 476318 - RNA, 26 nt, Human
uggacaaagguggacaggggagggau

SEQ ID NO: 476319 - RNA, 22 nt, Human
uggacaggggagggaugcaggc

SEQ ID NO: 476320 - RNA, 18 nt, Human
uggagggggagaggaggg

SEQ ID NO: 476321 - RNA, 19 nt, Human
uggcggggcagggccaggg

SEQ ID NO: 476322 - RNA, 23 nt, Human
uggcggggcagggccagggcugg

SEQ ID NO: 476323 - RNA, 22 nt, Human
ugggaaggagggcugggagccc

SEQ ID NO: 476324 - RNA, 22 nt, Human
ugggcccagcacugcaggaucc

SEQ ID NO: 476325 - RNA, 22 nt, Human
ugguccugaccacuccugaggc

SEQ ID NO: 476326 - RNA, 22 nt, Human
uggugccuggcagcaggaggcu

SEQ ID NO: 476327 - RNA, 21 nt, Human
ugguggugaggcuggaggugg

SEQ ID NO: 476328 - RNA, 21 nt, Human
ugucauggugccuggcagcag

SEQ ID NO: 476329 - RNA, 23 nt, Human
ugucauggugccuggcagcagga

SEQ ID NO: 476330 - RNA, 22 nt, Human
ugugacacgaggcucuuccuaa

SEQ ID NO: 476331 - RNA, 18 nt, Human
ugugaguguuucuggucc

SEQ ID NO: 476332 - RNA, 20 nt, Human
uguggccaccccucccgguc

SEQ ID NO: 476333 - RNA, 21 nt, Human
uguucccguccccacgacccc

SEQ ID NO: 476334 - RNA, 21 nt, Human
uuccccccaccucccagcucc

SEQ ID NO: 476335 - RNA, 19 nt, Human
uuugcagaaagugacaagc

SEQ ID NO: 476336 - RNA, 19 nt, Human
aaacugcaaacucuguaac

SEQ ID NO: 476337 - RNA, 21 nt, Human
aaagaucaucuuccagcaguc

SEQ ID NO: 476338 - RNA, 24 nt, Human
aaagcauggaaccaaacugcaaac

SEQ ID NO: 476339 - RNA, 24 nt, Human
aaagugcugggauuacaggcguga

SEQ ID NO: 476340 - RNA, 19 nt, Human
aacugcaaacucuguaacc

SEQ ID NO: 476341 - RNA, 21 nt, Human
aagcauggaaccaaacugcaa

SEQ ID NO: 476342 - RNA, 23 nt, Human
aagucccggggaacaaacaguuu

SEQ ID NO: 476343 - RNA, 24 nt, Human
aagugauccacccgccuccgccuc

SEQ ID NO: 476344 - RNA, 19 nt, Human
aagugcugggauuacaggc

SEQ ID NO: 476345 - RNA, 19 nt, Human
aagugcugggauuacaggc

SEQ ID NO: 476346 - RNA, 26 nt, Human
aagugcugggauuacaggcgugagcc

SEQ ID NO: 476347 - RNA, 20 nt, Human
acaaauagcaaauguacagc

SEQ ID NO: 476348 - RNA, 27 nt, Human
accacaauaagccuacggccuccgauc

SEQ ID NO: 476349 - RNA, 24 nt, Human
accacguuggccaggcuggucucg

SEQ ID NO: 476350 - RNA, 20 nt, Human
acccgccuccgccucccaaa

SEQ ID NO: 476351 - RNA, 20 nt, Human
acgggauuucaccacguugg

SEQ ID NO: 476352 - RNA, 24 nt, Human
acgggauuucaccacguuggccag

SEQ ID NO: 476353 - RNA, 21 nt, Human
acuuuaggaaccccaaaacaa

SEQ ID NO: 476354 - RNA, 27 nt, Human
agagagagacagauuuauuauacagaa

SEQ ID NO: 476355 - RNA, 23 nt, Human
agugcagaaagaucaucuuccag

SEQ ID NO: 476356 - RNA, 18 nt, Human
agugcugggauuacaggc

SEQ ID NO: 476357 - RNA, 24 nt, Human
auaugucuucccuaccuugacugu

SEQ ID NO: 476358 - RNA, 19 nt, Human
aucuuguuuccugccccua

SEQ ID NO: 476359 - RNA, 21 nt, Human
auuccugacugcucucuuuca

SEQ ID NO: 476360 - RNA, 22 nt, Human
caaacugcaaacucuguaaccu

SEQ ID NO: 476361 - RNA, 24 nt, Human
caaagugcugggauuacaggcgug

SEQ ID NO: 476362 - RNA, 27 nt, Human
caagugauccacccgccuccccugaag

SEQ ID NO: 476363 - RNA, 22 nt, Human
cacaauaagccuacggccuccg

SEQ ID NO: 476364 - RNA, 27 nt, Human
cacagucucagugcagaaagaucaucu

SEQ ID NO: 476365 - RNA, 20 nt, Human
caccacaauaagccuacggg

SEQ ID NO: 476366 - RNA, 21 nt, Human
caccacguuggccaggcuggu

SEQ ID NO: 476367 - RNA, 24 nt, Human
caccacguuggccaggcuggucuc

SEQ ID NO: 476368 - RNA, 27 nt, Human
caccacguuggccaggcuggucucgaa

SEQ ID NO: 476369 - RNA, 24 nt, Human
caccaugcccagcuaauuuuugua

SEQ ID NO: 476370 - RNA, 23 nt, Human
cacccgccuccgccucccaaagu

SEQ ID NO: 476371 - RNA, 24 nt, Human
cacguuggccaggcuggucucgaa

SEQ ID NO: 476372 - RNA, 22 nt, Human
cacuagcauuccugacugcucu

SEQ ID NO: 476373 - RNA, 22 nt, Human
cagaggggcucacaucuccccu

SEQ ID NO: 476374 - RNA, 23 nt, Human
cagcaaacucuggugggugauau

SEQ ID NO: 476375 - RNA, 18 nt, Human
cagcucagaccaggguca

SEQ ID NO: 476376 - RNA, 19 nt, Human
cagcucagaccagggucaa

SEQ ID NO: 476377 - RNA, 24 nt, Human
caggcgugagccaccgugcccggc

SEQ ID NO: 476378 - RNA, 18 nt, Human
caguagaaacgggauuuc

SEQ ID NO: 476379 - RNA, 26 nt, Human
caguagaaacgggauuucaccacguu

SEQ ID NO: 476380 - RNA, 20 nt, Human
cauugccuuaucucucccca

SEQ ID NO: 476381 - RNA, 22 nt, Human
ccaaagugcugggauuacaggc

SEQ ID NO: 476382 - RNA, 22 nt, Human
ccaaagugcugggauuacaggc

SEQ ID NO: 476383 - RNA, 24 nt, Human
ccaaagugcugggauuacaggcgu

SEQ ID NO: 476384 - RNA, 21 nt, Human
ccaugcacauugccuuaucuc

SEQ ID NO: 476385 - RNA, 22 nt, Human
cccaguccugugccugcucccc

SEQ ID NO: 476386 - RNA, 21 nt, Human
ccccaaaacaaccagguuugc

SEQ ID NO: 476387 - RNA, 26 nt, Human
ccccaaaacaaccagguuugcaagaa

SEQ ID NO: 476388 - RNA, 18 nt, Human
cccccaugcacauugccu

SEQ ID NO: 476389 - RNA, 24 nt, Human
ccgccuccgccucccaaagugcug

SEQ ID NO: 476390 - RNA, 25 nt, Human
ccuacggccuccgaucuuguuuccu

SEQ ID NO: 476391 - RNA, 21 nt, Human
ccugaccgcaagugauccacc

SEQ ID NO: 476392 - RNA, 22 nt, Human
ccugaccgcaagugauccaccc

SEQ ID NO: 476393 - RNA, 23 nt, Human
ccugaccgcaagugauccacccg

SEQ ID NO: 476394 - RNA, 20 nt, Human
ccuguaaucccagcacuuug

SEQ ID NO: 476395 - RNA, 22 nt, Human
ccuguaaucccagcacuuuggg

SEQ ID NO: 476396 - RNA, 19 nt, Human
ccugugccugcuccccacc

SEQ ID NO: 476397 - RNA, 24 nt, Human
ccuuggcuuccccaaacuccacag

SEQ ID NO: 476398 - RNA, 24 nt, Human
cgccuccgccucccaaagugcugg

SEQ ID NO: 476399 - RNA, 19 nt, Human
cgcgcuuccccaggguccc

SEQ ID NO: 476400 - RNA, 20 nt, Human
cgcuaccaccacccccccca

SEQ ID NO: 476401 - RNA, 24 nt, Human
cgggauuucaccacguuggccagg

SEQ ID NO: 476402 - RNA, 24 nt, Human
cuaccuuggaacuguauuagauaa

SEQ ID NO: 476403 - RNA, 22 nt, Human
cuagcauuccugacugcucucu

SEQ ID NO: 476404 - RNA, 19 nt, Human
cugacugcucucuuucaca

SEQ ID NO: 476405 - RNA, 23 nt, Human
cugucccugaagucccggggaac

SEQ ID NO: 476406 - RNA, 19 nt, Human
cuucccuaccuugacuguc

SEQ ID NO: 476407 - RNA, 20 nt, Human
cuucccuaccuugacugucu

SEQ ID NO: 476408 - RNA, 21 nt, Human
gaauacaggcacgccaccaug

SEQ ID NO: 476409 - RNA, 24 nt, Human
gaccgcaagugauccacccgccuc

SEQ ID NO: 476410 - RNA, 21 nt, Human
gaggggcucacaucuccccuc

SEQ ID NO: 476411 - RNA, 19 nt, Human
gaggggugcaaggcccugc

SEQ ID NO: 476412 - RNA, 18 nt, Human
gauuacaggcgugagcca

SEQ ID NO: 476413 - RNA, 20 nt, Human
gauuacaggcgugagccacc

SEQ ID NO: 476414 - RNA, 21 nt, Human
gauuacaggcgugagccaccg

SEQ ID NO: 476415 - RNA, 22 nt, Human
gcccagcuaauuuuuguauuuu

SEQ ID NO: 476416 - RNA, 19 nt, Human
gccuguaaucccagcacuu

SEQ ID NO: 476417 - RNA, 19 nt, Human
ggaggagcagaggggcuca

SEQ ID NO: 476418 - RNA, 24 nt, Human
ggccagugaugccuguaaucccag

SEQ ID NO: 476419 - RNA, 23 nt, Human
ggccgcgcuuccccagggucccg

SEQ ID NO: 476420 - RNA, 23 nt, Human
gggauuucaccacguuggccagg

SEQ ID NO: 476421 - RNA, 24 nt, Human
ggggggguggagaggggugcaagg

SEQ ID NO: 476422 - RNA, 25 nt, Human
ggggguggagaggggugcaaggccc

SEQ ID NO: 476423 - RNA, 21 nt, Human
ggguggagaggggugcaaggc

SEQ ID NO: 476424 - RNA, 24 nt, Human
gugauccacccgccuccgccuccc

SEQ ID NO: 476425 - RNA, 21 nt, Human
gugaugccuguaaucccagca

SEQ ID NO: 476426 - RNA, 20 nt, Human
guuuguucaguuuuucacca

SEQ ID NO: 476427 - RNA, 21 nt, Human
uaaacaaauagcaaauguaca

SEQ ID NO: 476428 - RNA, 23 nt, Human
uaaccuccuaucugucccugaag

SEQ ID NO: 476429 - RNA, 22 nt, Human
uaauuuuuguauuuucaguaga

SEQ ID NO: 476430 - RNA, 20 nt, Human
uacagaauuggcucugccug

SEQ ID NO: 476431 - RNA, 22 nt, Human
uacaggcacgccaccaugccca

SEQ ID NO: 476432 - RNA, 23 nt, Human
uacaggcgugagccaccgugccc

SEQ ID NO: 476433 - RNA, 24 nt, Human
uacuaugauuguguaugugccgcu

SEQ ID NO: 476434 - RNA, 18 nt, Human
uaggaaccccaaaacaac

SEQ ID NO: 476435 - RNA, 21 nt, Human
uaggaaccccaaaacaaccag

SEQ ID NO: 476436 - RNA, 22 nt, Human
uaggaaccccaaaacaaccagg

SEQ ID NO: 476437 - RNA, 25 nt, Human
ucacaucuccccucugauuccccca

SEQ ID NO: 476438 - RNA, 23 nt, Human
ucaccacuagcauuccugacugc

SEQ ID NO: 476439 - RNA, 22 nt, Human
ucaguuuuucaccacuagcauu

SEQ ID NO: 476440 - RNA, 19 nt, Human
uccacccgccuccgccucc

SEQ ID NO: 476441 - RNA, 23 nt, Human
uccacccgccuccgccucccaaa

SEQ ID NO: 476442 - RNA, 24 nt, Human
ucccaaagugcugggauuacaggc

SEQ ID NO: 476443 - RNA, 20 nt, Human
uccccaaacuccacagucuc

SEQ ID NO: 476444 - RNA, 23 nt, Human
uccccaucuagccaggaaucuau

SEQ ID NO: 476445 - RNA, 21 nt, Human
ucccugaagucccggggaaca

SEQ ID NO: 476446 - RNA, 22 nt, Human
ucccugaagucccggggaacaa

SEQ ID NO: 476447 - RNA, 19 nt, Human
uccugccccuagucggggc

SEQ ID NO: 476448 - RNA, 22 nt, Human
uccugugccugcuccccaccgc

SEQ ID NO: 476449 - RNA, 23 nt, Human
uccuuuagcacaugggaaucugg

SEQ ID NO: 476450 - RNA, 21 nt, Human
ucuccuuuagcacaugggaau

SEQ ID NO: 476451 - RNA, 21 nt, Human
ucucgaacuccugaccgcaag

SEQ ID NO: 476452 - RNA, 21 nt, Human
ucucuuucacaguucuucucc

SEQ ID NO: 476453 - RNA, 21 nt, Human
ugcccggcccaaaggggaaac

SEQ ID NO: 476454 - RNA, 23 nt, Human
ugccuguaaucccagcacuuugg

SEQ ID NO: 476455 - RNA, 23 nt, Human
ugccuguaaucccagcacuuugg

SEQ ID NO: 476456 - RNA, 18 nt, Human
ugccuucaaagcauggaa

SEQ ID NO: 476457 - RNA, 24 nt, Human
ugcugggauuacaggcgugagcca

SEQ ID NO: 476458 - RNA, 24 nt, Human
uggccaggcuggucucgaacuccu

SEQ ID NO: 476459 - RNA, 20 nt, Human
ugggaauacaggcacgccac

SEQ ID NO: 476460 - RNA, 22 nt, Human
ugggaauacaggcacgccacca

SEQ ID NO: 476461 - RNA, 23 nt, Human
ugggaauacaggcacgccaccau

SEQ ID NO: 476462 - RNA, 18 nt, Human
ugggauuacaggcgugag

SEQ ID NO: 476463 - RNA, 21 nt, Human
ugggauuacaggcgugagcca

SEQ ID NO: 476464 - RNA, 22 nt, Human
ugggauuacaggcgugagccac

SEQ ID NO: 476465 - RNA, 23 nt, Human
ugggauuacaggcgugagccacc

SEQ ID NO: 476466 - RNA, 23 nt, Human
ugggauuacaggcgugagccacc

SEQ ID NO: 476467 - RNA, 24 nt, Human
ugggauuacaggcgugagccaccg

SEQ ID NO: 476468 - RNA, 21 nt, Human
uggucucgaacuccugaccgc

SEQ ID NO: 476469 - RNA, 26 nt, Human
ugucuucccuaccuugacugucucca

SEQ ID NO: 476470 - RNA, 24 nt, Human
ugugacaucaacaguuucugguuu

SEQ ID NO: 476471 - RNA, 18 nt, Human
uuccagcagucagcucag

SEQ ID NO: 476472 - RNA, 18 nt, Human
uucuguuuguucaguuuu

SEQ ID NO: 476473 - RNA, 27 nt, Human
uuguguaugugccgcuaccaccacccc

SEQ ID NO: 476474 - RNA, 21 nt, Human
uuucaccacguuggccaggcu

SEQ ID NO: 476475 - RNA, 18 nt, Human
uuuuacaccacuggauac

SEQ ID NO: 476476 - RNA, 24 nt, Human
uuuuucaccacuagcauuccugac

SEQ ID NO: 476477 - RNA, 22 nt, Human
uuuuuuuuuuuuuuuuuuucag

SEQ ID NO: 476478 - RNA, 26 nt, Human
aaaacaauuaaaacaagauaaaaccc

SEQ ID NO: 476479 - RNA, 21 nt, Human
aaaacagauucaaucauuuuc

SEQ ID NO: 476480 - RNA, 22 nt, Human
aaagaaaugacugaguaaauga

SEQ ID NO: 476481 - RNA, 19 nt, Human
aacaagauaaaacccaagu

SEQ ID NO: 476482 - RNA, 21 nt, Human
aauaauaaaaauagugguuuu

SEQ ID NO: 476483 - RNA, 26 nt, Human
acaagauaaaacccaaguggaagcuu

SEQ ID NO: 476484 - RNA, 22 nt, Human
acguaucuuaucuauaaaaaca

SEQ ID NO: 476485 - RNA, 24 nt, Human
acucugaguauuuuccuccauucu

SEQ ID NO: 476486 - RNA, 21 nt, Human
auacaaaaacaauuaaaacaa

SEQ ID NO: 476487 - RNA, 24 nt, Human
aucuaaauuuauuaauauuuugga

SEQ ID NO: 476488 - RNA, 26 nt, Human
caagagacaauaaaaacauagaagua

SEQ ID NO: 476489 - RNA, 19 nt, Human
cacucacucacucucucaa

SEQ ID NO: 476490 - RNA, 24 nt, Human
ccacacgucauaugaugauuuaaa

SEQ ID NO: 476491 - RNA, 20 nt, Human
ccucggcgcccgccuugccc

SEQ ID NO: 476492 - RNA, 19 nt, Human
ccuggaucaggauucggag

SEQ ID NO: 476493 - RNA, 20 nt, Human
cggcgcccgccuugcccgcc

SEQ ID NO: 476494 - RNA, 21 nt, Human
cuaaguaauuauuuucuuuau

SEQ ID NO: 476495 - RNA, 25 nt, Human
cuaggaaaugauuauuuaaaaugga

SEQ ID NO: 476496 - RNA, 21 nt, Human
cucaagaauagguagcacacc

SEQ ID NO: 476497 - RNA, 24 nt, Human
cucaagagacaauaaaaacauaga

SEQ ID NO: 476498 - RNA, 23 nt, Human
cucugaaccacauagaaugcuga

SEQ ID NO: 476499 - RNA, 20 nt, Human
gccuggaucaggauucggag

SEQ ID NO: 476500 - RNA, 24 nt, Human
ggaggcgaggggccccuggccccc

SEQ ID NO: 476501 - RNA, 23 nt, Human
ggauguguacaccuucaugguuu

SEQ ID NO: 476502 - RNA, 24 nt, Human
ggauucggagcuggcuagagggag

SEQ ID NO: 476503 - RNA, 20 nt, Human
ggcccccgccuggaucagga

SEQ ID NO: 476504 - RNA, 18 nt, Human
gggccccuggcccccgcc

SEQ ID NO: 476505 - RNA, 23 nt, Human
ggguuucuggccgcugcgagccu

SEQ ID NO: 476506 - RNA, 23 nt, Human
uaaaaaaaaaacaucaaaucuaa

SEQ ID NO: 476507 - RNA, 21 nt, Human
uaaaacaagauaaaacccaag

SEQ ID NO: 476508 - RNA, 22 nt, Human
uaaaacaagauaaaacccaagu

SEQ ID NO: 476509 - RNA, 23 nt, Human
uaaaacaagauaaaacccaagug

SEQ ID NO: 476510 - RNA, 19 nt, Human
uaaaacccaaguggaagcu

SEQ ID NO: 476511 - RNA, 22 nt, Human
uaaaauaaaagaauaaaaccaa

SEQ ID NO: 476512 - RNA, 24 nt, Human
uaaaauaaucaaguacucugagua

SEQ ID NO: 476513 - RNA, 18 nt, Human
uaaguaauuauuuucuuu

SEQ ID NO: 476514 - RNA, 20 nt, Human
uaauaaaaauagugguuuug

SEQ ID NO: 476515 - RNA, 24 nt, Human
uacacacacuccuaauaauuuaga

SEQ ID NO: 476516 - RNA, 21 nt, Human
uauaucccaauagaaauagag

SEQ ID NO: 476517 - RNA, 19 nt, Human
uaucacaccaaccuaccuu

SEQ ID NO: 476518 - RNA, 18 nt, Human
ucccuguaaaaauaacuu

SEQ ID NO: 476519 - RNA, 20 nt, Human
ucuaaaaaaaaaacaucaaa

SEQ ID NO: 476520 - RNA, 26 nt, Human
ucuaaaaaaaaaacaucaaaucuaac

SEQ ID NO: 476521 - RNA, 19 nt, Human
ucuagcaauagaugaagca

SEQ ID NO: 476522 - RNA, 22 nt, Human
ucuuaacuaaggcucaagagac

SEQ ID NO: 476523 - RNA, 24 nt, Human
ugaaaaaauagacguaucuuaucu

SEQ ID NO: 476524 - RNA, 23 nt, Human
ugcaaaaaucacagcucugaacc

SEQ ID NO: 476525 - RNA, 24 nt, Human
ugcaaaaaucacagcucugaacca

SEQ ID NO: 476526 - RNA, 18 nt, Human
uggaagcucaguccaucu

SEQ ID NO: 476527 - RNA, 22 nt, Human
uuaagauuuggcuguguccuua

SEQ ID NO: 476528 - RNA, 23 nt, Human
uuacuucugauacacacacuccu

SEQ ID NO: 476529 - RNA, 22 nt, Human
uucauaaauuauugauggaaau

SEQ ID NO: 476530 - RNA, 18 nt, Human
uucaugcauuucuacacu

SEQ ID NO: 476531 - RNA, 25 nt, Human
uucaugcauuucuacacuacucuua

SEQ ID NO: 476532 - RNA, 28 nt, Human
uuuauucguaaaauaaaagaauaaaacc

SEQ ID NO: 476533 - RNA, 21 nt, Human
uuugcaaaccucggcgcccgc

SEQ ID NO: 476534 - RNA, 18 nt, Human
aauuccuggguuuccccu

SEQ ID NO: 476535 - RNA, 19 nt, Human
acccuugggggcccugggg

SEQ ID NO: 476536 - RNA, 21 nt, Human
agaagcccuggggccugucuc

SEQ ID NO: 476537 - RNA, 19 nt, Human
caaacccuuuuccucuacc

SEQ ID NO: 476538 - RNA, 19 nt, Human
cacccuugggggcccuggg

SEQ ID NO: 476539 - RNA, 20 nt, Human
cacugugcagagacccuggg

SEQ ID NO: 476540 - RNA, 18 nt, Human
cagccuagcaacgcccaa

SEQ ID NO: 476541 - RNA, 24 nt, Human
cagggccgggcccggcccggcgcc

SEQ ID NO: 476542 - RNA, 24 nt, Human
ccacuuguccccagaugcuaucuc

SEQ ID NO: 476543 - RNA, 21 nt, Human
cccaaacccuuuuccucuacc

SEQ ID NO: 476544 - RNA, 21 nt, Human
cccagaugcuaucuccaaauu

SEQ ID NO: 476545 - RNA, 21 nt, Human
ccccagaugcuaucuccaaau

SEQ ID NO: 476546 - RNA, 20 nt, Human
cccgccgcgcgucgcucgca

SEQ ID NO: 476547 - RNA, 18 nt, Human
ccggcgccgcguuuccuc

SEQ ID NO: 476548 - RNA, 26 nt, Human
ccuagcaacgcccaaacccuuuuccu

SEQ ID NO: 476549 - RNA, 22 nt, Human
ccuggggccugucucuugccuc

SEQ ID NO: 476550 - RNA, 23 nt, Human
ccuucagcuccuuuuguuucggg

SEQ ID NO: 476551 - RNA, 21 nt, Human
cgccgccccgccgcgcgucgc

SEQ ID NO: 476552 - RNA, 23 nt, Human
cgccgcguuuccucucgccgccc

SEQ ID NO: 476553 - RNA, 18 nt, Human
cggcccggcgccgcguuu

SEQ ID NO: 476554 - RNA, 20 nt, Human
cggcccggcgccgcguuucc

SEQ ID NO: 476555 - RNA, 23 nt, Human
cuaaaaagucagugaggguuuau

SEQ ID NO: 476556 - RNA, 19 nt, Human
cuagccagaagcccugggg

SEQ ID NO: 476557 - RNA, 24 nt, Human
cucucaggccaccugccuucagcu

SEQ ID NO: 476558 - RNA, 20 nt, Human
gacccuggguaggggaggcu

SEQ ID NO: 476559 - RNA, 23 nt, Human
gcccggcgccgcguuuccucucg

SEQ ID NO: 476560 - RNA, 18 nt, Human
gcgccgcguuuccucucg

SEQ ID NO: 476561 - RNA, 19 nt, Human
ggaagggaaggccaguggu

SEQ ID NO: 476562 - RNA, 21 nt, Human
gggcccuggggaagggaaggc

SEQ ID NO: 476563 - RNA, 20 nt, Human
ggggaagggaaggccagugg

SEQ ID NO: 476564 - RNA, 19 nt, Human
ggguaggggaggcuggagc

SEQ ID NO: 476565 - RNA, 22 nt, Human
ggguaggggaggcuggagccag

SEQ ID NO: 476566 - RNA, 22 nt, Human
ggguaggggaggcuggagccag

SEQ ID NO: 476567 - RNA, 20 nt, Human
gucagugaggguuuauugag

SEQ ID NO: 476568 - RNA, 21 nt, Human
uaaaaagucagugaggguuua

SEQ ID NO: 476569 - RNA, 21 nt, Human
uagcaugagacacccuugggg

SEQ ID NO: 476570 - RNA, 24 nt, Human
uagccagaagcccuggggccuguc

SEQ ID NO: 476571 - RNA, 19 nt, Human
uauggcuggaaugugggac

SEQ ID NO: 476572 - RNA, 21 nt, Human
uccaaauuccaaguagcaaaa

SEQ ID NO: 476573 - RNA, 19 nt, Human
uccccagaugcuaucucca

SEQ ID NO: 476574 - RNA, 21 nt, Human
uccccagaugcuaucuccaaa

SEQ ID NO: 476575 - RNA, 21 nt, Human
ucgccgccccgccgcgcgucg

SEQ ID NO: 476576 - RNA, 24 nt, Human
ucgccgccccgccgcgcgucgcuc

SEQ ID NO: 476577 - RNA, 22 nt, Human
ucuagccagaagcccuggggcc

SEQ ID NO: 476578 - RNA, 19 nt, Human
ugaguccccaaacaccagc

SEQ ID NO: 476579 - RNA, 18 nt, Human
ugcuaaaaagucagugag

SEQ ID NO: 476580 - RNA, 21 nt, Human
uguccccagaugcuaucucca

SEQ ID NO: 476581 - RNA, 23 nt, Human
ugugcagagacccuggguagggg

SEQ ID NO: 476582 - RNA, 18 nt, Human
uuuuuuuuuuuuuuuuug

SEQ ID NO: 476583 - RNA, 21 nt, Human
uuuuuuuuuuuuuuuuugcaa

SEQ ID NO: 476584 - RNA, 18 nt, Human
aaccccguucccuuuagg

SEQ ID NO: 476585 - RNA, 22 nt, Human
agccaauugaacuaacaacccc

SEQ ID NO: 476586 - RNA, 23 nt, Human
agucauucauguccaguuuuccu

SEQ ID NO: 476587 - RNA, 27 nt, Human
ccaucuggccacucugcaggggagggg

SEQ ID NO: 476588 - RNA, 19 nt, Human
ccggggggaacgacccgcc

SEQ ID NO: 476589 - RNA, 19 nt, Human
cucugcaggggaggggcgg

SEQ ID NO: 476590 - RNA, 22 nt, Human
gaacuaacaaccccguucccuu

SEQ ID NO: 476591 - RNA, 25 nt, Human
gaacuaacaaccccguucccuuuag

SEQ ID NO: 476592 - RNA, 25 nt, Human
gcccagccugguuuuuuccgguaga

SEQ ID NO: 476593 - RNA, 19 nt, Human
ggggaggggcgggggggca

SEQ ID NO: 476594 - RNA, 22 nt, Human
ggggggcagucauucaugucca

SEQ ID NO: 476595 - RNA, 23 nt, Human
uaacaaccccguucccuuuagga

SEQ ID NO: 476596 - RNA, 24 nt, Human
ucacggcggcgcccuaccucuucu

SEQ ID NO: 476597 - RNA, 18 nt, Human
ugccggcguagggcuguc

SEQ ID NO: 476598 - RNA, 21 nt, Human
uuccugccgucagaggagucc

SEQ ID NO: 476599 - RNA, 24 nt, Human
uuuuuuuuuuuuuuuuuuucccag

SEQ ID NO: 476600 - RNA, 19 nt, Human
agggcauguccgcggcuca

SEQ ID NO: 476601 - RNA, 23 nt, Human
ccagcuuccugucucugcacucu

SEQ ID NO: 476602 - RNA, 18 nt, Human
uccgcgagcccgagcucc

SEQ ID NO: 476603 - RNA, 20 nt, Human
uccgcgagcccgagcucccg

SEQ ID NO: 476604 - RNA, 27 nt, Human
uccgcgagcccgagcucccgcuccgaa

SEQ ID NO: 476605 - RNA, 20 nt, Human
ugacuuuauaaagacaucuu

SEQ ID NO: 476606 - RNA, 21 nt, Human
ugcgggaagcaaugcgagggc

SEQ ID NO: 476607 - RNA, 25 nt, Human
aagugcccuugcugggucccaaccc

SEQ ID NO: 476608 - RNA, 23 nt, Human
aauagaacuaauguuuacaauga

SEQ ID NO: 476609 - RNA, 23 nt, Human
acaaugcuaaggaaaaauuuaau

SEQ ID NO: 476610 - RNA, 22 nt, Human
caaaaaacugagacaguagcug

SEQ ID NO: 476611 - RNA, 23 nt, Human
ccaacccccagagauuccgauuc

SEQ ID NO: 476612 - RNA, 24 nt, Human
ccccagagauuccgauucagcaag

SEQ ID NO: 476613 - RNA, 21 nt, Human
ccgcuggauugauucuuugac

SEQ ID NO: 476614 - RNA, 19 nt, Human
cgcuggauugauucuuuga

SEQ ID NO: 476615 - RNA, 25 nt, Human
cugagacaguagcugaaggcuucag

SEQ ID NO: 476616 - RNA, 27 nt, Human
cuuauaaacuuucacuaugugauugcc

SEQ ID NO: 476617 - RNA, 21 nt, Human
cuugcugggucccaaccccca

SEQ ID NO: 476618 - RNA, 23 nt, Human
uaaacuucaaaaaacugagacag

SEQ ID NO: 476619 - RNA, 22 nt, Human
uaagagccccugcuuguuggcu

SEQ ID NO: 476620 - RNA, 22 nt, Human
uaagugcccuugcuggguccca

SEQ ID NO: 476621 - RNA, 21 nt, Human
uagcuucucuuauuucacaua

SEQ ID NO: 476622 - RNA, 19 nt, Human
ucagcaagucugggaugcg

SEQ ID NO: 476623 - RNA, 20 nt, Human
ucagcaagucugggaugcgg

SEQ ID NO: 476624 - RNA, 22 nt, Human
ugaaguccgcugcucaccauau

SEQ ID NO: 476625 - RNA, 25 nt, Human
ugagaauuugcauuucuaacaaguu

SEQ ID NO: 476626 - RNA, 21 nt, Human
ugccuaagagccccugcuugu

SEQ ID NO: 476627 - RNA, 20 nt, Human
ugcugggucccaacccccag

SEQ ID NO: 476628 - RNA, 19 nt, Human
uggaugucuccacgagucc

SEQ ID NO: 476629 - RNA, 22 nt, Human
uucagcaccuggaugucuccac

SEQ ID NO: 476630 - RNA, 21 nt, Human
uuuacaaugcuaaggaaaaau

SEQ ID NO: 476631 - RNA, 24 nt, Human
uuuuuuuuuuuuuuuuuuacaaug

SEQ ID NO: 476632 - RNA, 22 nt, Human
aaaaaguuuccccuuuggcccc

SEQ ID NO: 476633 - RNA, 20 nt, Human
aaaacugaacaaacagaagu

SEQ ID NO: 476634 - RNA, 18 nt, Human
aaaauuagcugggcaugg

SEQ ID NO: 476635 - RNA, 22 nt, Human
aaacaaagcaaagggguaaccc

SEQ ID NO: 476636 - RNA, 24 nt, Human
aaacaaagcaaagggguaacccuc

SEQ ID NO: 476637 - RNA, 25 nt, Human
aaacaaagcaaagggguaacccucg

SEQ ID NO: 476638 - RNA, 21 nt, Human
aaacagaagugauuuuaucua

SEQ ID NO: 476639 - RNA, 19 nt, Human
aagcaagacgccuucucca

SEQ ID NO: 476640 - RNA, 24 nt, Human
aaucacuugaacccaggaggugga

SEQ ID NO: 476641 - RNA, 21 nt, Human
acaaagcaaagggguaacccu

SEQ ID NO: 476642 - RNA, 24 nt, Human
acccaggagguggagguugcggug

SEQ ID NO: 476643 - RNA, 24 nt, Human
acuugcggucaggaguucgagacc

SEQ ID NO: 476644 - RNA, 24 nt, Human
agcacuuugggaggcggaggcggg

SEQ ID NO: 476645 - RNA, 22 nt, Human
agccccucugcuccucccacaa

SEQ ID NO: 476646 - RNA, 24 nt, Human
agccuggccaacguggugaaaucc

SEQ ID NO: 476647 - RNA, 18 nt, Human
aggcaggaaaaucacuug

SEQ ID NO: 476648 - RNA, 23 nt, Human
aggcaggaaaaucacuugaaccc

SEQ ID NO: 476649 - RNA, 24 nt, Human
aggcaggaaaaucacuugaaccca

SEQ ID NO: 476650 - RNA, 19 nt, Human
aggcagggccuugcacccc

SEQ ID NO: 476651 - RNA, 21 nt, Human
aggcggaggcggguggaucac

SEQ ID NO: 476652 - RNA, 26 nt, Human
aggcggguggaucacuugcggucagg

SEQ ID NO: 476653 - RNA, 21 nt, Human
aggcugaggcaggaaaaucac

SEQ ID NO: 476654 - RNA, 24 nt, Human
aggcugaggcaggaaaaucacuug

SEQ ID NO: 476655 - RNA, 20 nt, Human
agguggagguugcggugagc

SEQ ID NO: 476656 - RNA, 24 nt, Human
agguggagguugcggugagcugag

SEQ ID NO: 476657 - RNA, 26 nt, Human
aguaaauuggcagaagaaaaacacaa

SEQ ID NO: 476658 - RNA, 24 nt, Human
aucccgccacugcauuccagcgug

SEQ ID NO: 476659 - RNA, 24 nt, Human
caacguggugaaaucccguuucua

SEQ ID NO: 476660 - RNA, 24 nt, Human
cacgccuguaaucccagcacuuug

SEQ ID NO: 476661 - RNA, 21 nt, Human
cacugcauuccagcgugggug

SEQ ID NO: 476662 - RNA, 20 nt, Human
cagaagaaaaacacaauaga

SEQ ID NO: 476663 - RNA, 22 nt, Human
cagcacuuugggaggcggaggc

SEQ ID NO: 476664 - RNA, 24 nt, Human
cagcacuuugggaggcggaggcgg

SEQ ID NO: 476665 - RNA, 24 nt, Human
cagcuacuugggaggcugaggcag

SEQ ID NO: 476666 - RNA, 21 nt, Human
caggagguggagguugcggug

SEQ ID NO: 476667 - RNA, 24 nt, Human
caggagguggagguugcggugagc

SEQ ID NO: 476668 - RNA, 21 nt, Human
ccaaaaaaaaguuuccccuuu

SEQ ID NO: 476669 - RNA, 20 nt, Human
ccaccucccuggcuuuucca

SEQ ID NO: 476670 - RNA, 20 nt, Human
ccacugcauuccagcguggg

SEQ ID NO: 476671 - RNA, 20 nt, Human
ccacugcauuccagcguggg

SEQ ID NO: 476672 - RNA, 21 nt, Human
ccacugcauuccagcgugggu

SEQ ID NO: 476673 - RNA, 24 nt, Human
ccacugcauuccagcgugggugac

SEQ ID NO: 476674 - RNA, 20 nt, Human
cccacaagaguuuccccuuu

SEQ ID NO: 476675 - RNA, 19 nt, Human
cccaggagguggagguugc

SEQ ID NO: 476676 - RNA, 23 nt, Human
ccccucugcuccucccacaagag

SEQ ID NO: 476677 - RNA, 25 nt, Human
ccccuuuggccccaaaugaagacuu

SEQ ID NO: 476678 - RNA, 23 nt, Human
ccuggccaacguggugaaauccc

SEQ ID NO: 476679 - RNA, 24 nt, Human
ccuggccaacguggugaaaucccg

SEQ ID NO: 476680 - RNA, 21 nt, Human
ccuguauucccagcuacuugg

SEQ ID NO: 476681 - RNA, 22 nt, Human
ccuguauucccagcuacuuggg

SEQ ID NO: 476682 - RNA, 24 nt, Human
cgagaccagccuggccaacguggu

SEQ ID NO: 476683 - RNA, 23 nt, Human
cgccuguaaucccagcacuuugg

SEQ ID NO: 476684 - RNA, 24 nt, Human
cgccuguaaucccagcacuuuggg

SEQ ID NO: 476685 - RNA, 24 nt, Human
cggguggaucacuugcggucagga

SEQ ID NO: 476686 - RNA, 25 nt, Human
cuagauggggagagauaaggcaaug

SEQ ID NO: 476687 - RNA, 22 nt, Human
cucacgccuguaaucccagcac

SEQ ID NO: 476688 - RNA, 24 nt, Human
cucacgccuguaaucccagcacuu

SEQ ID NO: 476689 - RNA, 21 nt, Human
cuugaacccaggagguggagg

SEQ ID NO: 476690 - RNA, 18 nt, Human
cuuggcuggcagcagagg

SEQ ID NO: 476691 - RNA, 23 nt, Human
gagaucccgccacugcauuccag

SEQ ID NO: 476692 - RNA, 25 nt, Human
gaggcggguggaucacuugcgguca

SEQ ID NO: 476693 - RNA, 22 nt, Human
gagguugcggugagcugagauc

SEQ ID NO: 476694 - RNA, 24 nt, Human
gaucacuugcggucaggaguucga

SEQ ID NO: 476695 - RNA, 21 nt, Human
gcagaagaaaaacacaauaga

SEQ ID NO: 476696 - RNA, 20 nt, Human
gcagcagaggcacagcugga

SEQ ID NO: 476697 - RNA, 22 nt, Human
gcaggaaaaucacuugaaccca

SEQ ID NO: 476698 - RNA, 21 nt, Human
gccaacguggugaaaucccgu

SEQ ID NO: 476699 - RNA, 24 nt, Human
gccacugcauuccagcguggguga

SEQ ID NO: 476700 - RNA, 18 nt, Human
gccuguaaagguauggaa

SEQ ID NO: 476701 - RNA, 21 nt, Human
gcuggcagcagaggcacagcu

SEQ ID NO: 476702 - RNA, 18 nt, Human
ggagguugcggugagcug

SEQ ID NO: 476703 - RNA, 22 nt, Human
ggagguugcggugagcugagau

SEQ ID NO: 476704 - RNA, 23 nt, Human
ggagguugcggugagcugagauc

SEQ ID NO: 476705 - RNA, 23 nt, Human
ggcacgguggcucacgccuguaa

SEQ ID NO: 476706 - RNA, 21 nt, Human
ggccgggcacgguggcucacg

SEQ ID NO: 476707 - RNA, 21 nt, Human
ggcucacgccuguaaucccag

SEQ ID NO: 476708 - RNA, 22 nt, Human
ggggguggugguagcggcacau

SEQ ID NO: 476709 - RNA, 19 nt, Human
gguggagguugcggugagc

SEQ ID NO: 476710 - RNA, 23 nt, Human
gguggcucacgccuguaauccca

SEQ ID NO: 476711 - RNA, 24 nt, Human
gguggcucacgccuguaaucccag

SEQ ID NO: 476712 - RNA, 22 nt, Human
guaaugccgauaaaacaaagca

SEQ ID NO: 476713 - RNA, 24 nt, Human
uaaaacaaagcaaagggguaaccc

SEQ ID NO: 476714 - RNA, 21 nt, Human
uaaaauaagcaauugagaggc

SEQ ID NO: 476715 - RNA, 21 nt, Human
uaaauuggcagaagaaaaaca

SEQ ID NO: 476716 - RNA, 23 nt, Human
uacugaaaauacaaaaauuagcu

SEQ ID NO: 476717 - RNA, 20 nt, Human
ucacuugcggucaggaguuc

SEQ ID NO: 476718 - RNA, 23 nt, Human
uccaagguagaaaaaguggagca

SEQ ID NO: 476719 - RNA, 24 nt, Human
uccagcgugggugacaaagcaaga

SEQ ID NO: 476720 - RNA, 24 nt, Human
uccccuuuggccccaaaugaagac

SEQ ID NO: 476721 - RNA, 24 nt, Human
ucccgcacaggccaccagggaaau

SEQ ID NO: 476722 - RNA, 19 nt, Human
ugaaaaacugaacaaacag

SEQ ID NO: 476723 - RNA, 18 nt, Human
ugaaaagggagacgagua

SEQ ID NO: 476724 - RNA, 22 nt, Human
ugagaucccgccacugcauucc

SEQ ID NO: 476725 - RNA, 22 nt, Human
ugagcugagaucccgccacugc

SEQ ID NO: 476726 - RNA, 22 nt, Human
ugaggaacugaagcacaauaca

SEQ ID NO: 476727 - RNA, 20 nt, Human
ugaggcaggaaaaucacuug

SEQ ID NO: 476728 - RNA, 24 nt, Human
ugaggcaggaaaaucacuugaacc

SEQ ID NO: 476729 - RNA, 25 nt, Human
ugaggcaggaaaaucacuugaaccc

SEQ ID NO: 476730 - RNA, 21 nt, Human
ugcaccccucuccaccccccc

SEQ ID NO: 476731 - RNA, 22 nt, Human
ugcaccccucuccaccccccca

SEQ ID NO: 476732 - RNA, 23 nt, Human
ugccuguauucccagcuacuugg

SEQ ID NO: 476733 - RNA, 24 nt, Human
ugccuguauucccagcuacuuggg

SEQ ID NO: 476734 - RNA, 20 nt, Human
ugcggucaggaguucgagac

SEQ ID NO: 476735 - RNA, 18 nt, Human
uggaagagguggaugagg

SEQ ID NO: 476736 - RNA, 24 nt, Human
uggaucacuugcggucaggaguuc

SEQ ID NO: 476737 - RNA, 21 nt, Human
uggcagaagaaaaacacaaua

SEQ ID NO: 476738 - RNA, 23 nt, Human
uggcagaagaaaaacacaauaga

SEQ ID NO: 476739 - RNA, 19 nt, Human
uggcagcagaggcacagcu

SEQ ID NO: 476740 - RNA, 24 nt, Human
uggccaacguggugaaaucccguu

SEQ ID NO: 476741 - RNA, 22 nt, Human
uggcucacgccuguaaucccag

SEQ ID NO: 476742 - RNA, 24 nt, Human
uggcucacgccuguaaucccagca

SEQ ID NO: 476743 - RNA, 24 nt, Human
uggcuggcagcagaggcacagcug

SEQ ID NO: 476744 - RNA, 24 nt, Human
ugggaggcggaggcggguggauca

SEQ ID NO: 476745 - RNA, 24 nt, Human
ugggaggcugaggcaggaaaauca

SEQ ID NO: 476746 - RNA, 20 nt, Human
ugggggggguggugguagcc

SEQ ID NO: 476747 - RNA, 19 nt, Human
uuagcugggcaugguggcg

SEQ ID NO: 476748 - RNA, 22 nt, Human
uuagcugggcaugguggcgugc

SEQ ID NO: 476749 - RNA, 24 nt, Human
uugaacccaggagguggagguugc

SEQ ID NO: 476750 - RNA, 19 nt, Human
uugcggugagcugagaucc

SEQ ID NO: 476751 - RNA, 22 nt, Human
uugcggugagcugagaucccgc

SEQ ID NO: 476752 - RNA, 25 nt, Human
uugggaggcugaggcaggaaaauca

SEQ ID NO: 476753 - RNA, 21 nt, Human
uuuccccuuuggccccaaaug

SEQ ID NO: 476754 - RNA, 23 nt, Human
uuucuacugaaaauacaaaaauu

SEQ ID NO: 476755 - RNA, 19 nt, Human
uuuuuugaaaaacugaaca

SEQ ID NO: 476756 - RNA, 23 nt, Human
uuuuuugaaaaacugaacaaaca

SEQ ID NO: 476757 - RNA, 20 nt, Human
uuuuuuuuuuuuuuuuuugg

SEQ ID NO: 476758 - RNA, 21 nt, Human
aaaaaaaaaaaaagacuugga

SEQ ID NO: 476759 - RNA, 24 nt, Human
aaaaaaaaaaagacuuggauuuua

SEQ ID NO: 476760 - RNA, 20 nt, Human
aaaggcuuucacccccauuc

SEQ ID NO: 476761 - RNA, 21 nt, Human
aacguacauauaguacaccaa

SEQ ID NO: 476762 - RNA, 23 nt, Human
aagaaccaggacgacggggagua

SEQ ID NO: 476763 - RNA, 23 nt, Human
aagcaugugguaaguuagaaaug

SEQ ID NO: 476764 - RNA, 23 nt, Human
aauggguccuuggauucugcaac

SEQ ID NO: 476765 - RNA, 23 nt, Human
accaaacacagcaguacaaacca

SEQ ID NO: 476766 - RNA, 20 nt, Human
acccggaggcucuggaggcu

SEQ ID NO: 476767 - RNA, 18 nt, Human
agaaauguugauagcuga

SEQ ID NO: 476768 - RNA, 18 nt, Human
agacccggaggcucugga

SEQ ID NO: 476769 - RNA, 19 nt, Human
agccguccgggucuggccc

SEQ ID NO: 476770 - RNA, 18 nt, Human
aggaacaagaaccaggac

SEQ ID NO: 476771 - RNA, 18 nt, Human
aggcacaacguacauaua

SEQ ID NO: 476772 - RNA, 22 nt, Human
aggcucuggaggcucuggagcc

SEQ ID NO: 476773 - RNA, 20 nt, Human
aguacaaucaucacugcacu

SEQ ID NO: 476774 - RNA, 19 nt, Human
agugagaaacagacauucu

SEQ ID NO: 476775 - RNA, 24 nt, Human
augacaggaaagugcuccccaaag

SEQ ID NO: 476776 - RNA, 21 nt, Human
auggggcaguaaucagguagc

SEQ ID NO: 476777 - RNA, 22 nt, Human
caaacacagcaguacaaaccac

SEQ ID NO: 476778 - RNA, 24 nt, Human
caaagcagugggagaggcaaugug

SEQ ID NO: 476779 - RNA, 23 nt, Human
caacaaagaaaggcuuucacccc

SEQ ID NO: 476780 - RNA, 19 nt, Human
cacacuccuaauacccaca

SEQ ID NO: 476781 - RNA, 26 nt, Human
cacccggugcacauagugagaaacag

SEQ ID NO: 476782 - RNA, 20 nt, Human
caccgggcccguccccagcc

SEQ ID NO: 476783 - RNA, 21 nt, Human
cagacccggaggcucuggagg

SEQ ID NO: 476784 - RNA, 20 nt, Human
cagcaguacaaaccacuccu

SEQ ID NO: 476785 - RNA, 20 nt, Human
cagcccauccccaaauaaau

SEQ ID NO: 476786 - RNA, 18 nt, Human
caguacaaaccacuccuu

SEQ ID NO: 476787 - RNA, 24 nt, Human
cauauaguacaccaagcauguggu

SEQ ID NO: 476788 - RNA, 24 nt, Human
cauaugaggcacaacguacauaua

SEQ ID NO: 476789 - RNA, 25 nt, Human
cauggcuagaugagcccuggcaggu

SEQ ID NO: 476790 - RNA, 22 nt, Human
cauucccacacuccuaauaccc

SEQ ID NO: 476791 - RNA, 19 nt, Human
ccaaacacagcaguacaaa

SEQ ID NO: 476792 - RNA, 19 nt, Human
ccacacuccuaauacccac

SEQ ID NO: 476793 - RNA, 21 nt, Human
ccagacccggaggcucuggag

SEQ ID NO: 476794 - RNA, 18 nt, Human
ccauucaaggcaaacauu

SEQ ID NO: 476795 - RNA, 20 nt, Human
cccacauugaugucaucuuc

SEQ ID NO: 476796 - RNA, 21 nt, Human
cccgaacccacacagccgcac

SEQ ID NO: 476797 - RNA, 20 nt, Human
cccuucucaggaacaagaac

SEQ ID NO: 476798 - RNA, 18 nt, Human
ccgaacccacacagccgc

SEQ ID NO: 476799 - RNA, 23 nt, Human
ccgaacccacacagccgcaccgg

SEQ ID NO: 476800 - RNA, 22 nt, Human
ccgcucccgaacccacacagcc

SEQ ID NO: 476801 - RNA, 22 nt, Human
ccguugauuuuuaauauuuucu

SEQ ID NO: 476802 - RNA, 21 nt, Human
ccugaccuccaaaagaagugu

SEQ ID NO: 476803 - RNA, 20 nt, Human
ccugugaugaauaaaaucua

SEQ ID NO: 476804 - RNA, 21 nt, Human
cgcucccgaacccacacagcc

SEQ ID NO: 476805 - RNA, 20 nt, Human
cgggaggagccgaagcgccg

SEQ ID NO: 476806 - RNA, 27 nt, Human
cgggaggagccgaagcgccgcccagac

SEQ ID NO: 476807 - RNA, 20 nt, Human
cggggcuagcaggcggcucg

SEQ ID NO: 476808 - RNA, 24 nt, Human
cguacauauaguacaccaagcaug

SEQ ID NO: 476809 - RNA, 19 nt, Human
cguccgggucuggccccug

SEQ ID NO: 476810 - RNA, 18 nt, Human
cucccgaacccacacagc

SEQ ID NO: 476811 - RNA, 22 nt, Human
cucccgaacccacacagccgca

SEQ ID NO: 476812 - RNA, 23 nt, Human
cucccgaacccacacagccgcac

SEQ ID NO: 476813 - RNA, 22 nt, Human
cuccuuggcagacaugugcuuc

SEQ ID NO: 476814 - RNA, 25 nt, Human
cuccuuggcagacaugugcuucuaa

SEQ ID NO: 476815 - RNA, 22 nt, Human
cugaacucccacauugauguca

SEQ ID NO: 476816 - RNA, 22 nt, Human
cuggauauugcccauaucuagu

SEQ ID NO: 476817 - RNA, 24 nt, Human
gaacaagaaccaggacgacgggga

SEQ ID NO: 476818 - RNA, 22 nt, Human
gcaacuccgcucccgaacccac

SEQ ID NO: 476819 - RNA, 20 nt, Human
gcccguccccagccuguggg

SEQ ID NO: 476820 - RNA, 20 nt, Human
gccuguaaucacccggugca

SEQ ID NO: 476821 - RNA, 24 nt, Human
gcugagguacugaaacuaacaaaa

SEQ ID NO: 476822 - RNA, 19 nt, Human
gggaggagccgaagcgccg

SEQ ID NO: 476823 - RNA, 27 nt, Human
gguaaggaaaacuuauagcagaaaaaa

SEQ ID NO: 476824 - RNA, 20 nt, Human
guccuuggauucugcaacuc

SEQ ID NO: 476825 - RNA, 26 nt, Human
guuguccuugauuauucuguccuguu

SEQ ID NO: 476826 - RNA, 19 nt, Human
uagcucuggauggugcucc

SEQ ID NO: 476827 - RNA, 20 nt, Human
uagcugaacuacuaggcuac

SEQ ID NO: 476828 - RNA, 21 nt, Human
uaggcuauacucaccuuaguu

SEQ ID NO: 476829 - RNA, 20 nt, Human
uauaguacaccaagcaugug

SEQ ID NO: 476830 - RNA, 18 nt, Human
uaucacauucccacacuc

SEQ ID NO: 476831 - RNA, 24 nt, Human
ucacucccagcccauccccaaaua

SEQ ID NO: 476832 - RNA, 19 nt, Human
uccagugcgaaagaccucg

SEQ ID NO: 476833 - RNA, 18 nt, Human
uccaugacacagaggaac

SEQ ID NO: 476834 - RNA, 23 nt, Human
ucccacauugaugucaucuucuc

SEQ ID NO: 476835 - RNA, 23 nt, Human
uccccaguuauacugaacuccca

SEQ ID NO: 476836 - RNA, 18 nt, Human
uccgcucccgaacccaca

SEQ ID NO: 476837 - RNA, 30 nt, Human
uccuaauacccacaaaacaagaauuucacu

SEQ ID NO: 476838 - RNA, 25 nt, Human
uccugaccuccaaaagaagugucag

SEQ ID NO: 476839 - RNA, 18 nt, Human
ucucaggaacaagaacca

SEQ ID NO: 476840 - RNA, 25 nt, Human
ucucucaucccaacauuuguucacu

SEQ ID NO: 476841 - RNA, 23 nt, Human
ucuguccugugaugaauaaaauc

SEQ ID NO: 476842 - RNA, 23 nt, Human
ucuucuaguuuauccccaguuau

SEQ ID NO: 476843 - RNA, 23 nt, Human
ucuuuccaaucaucuaggcugga

SEQ ID NO: 476844 - RNA, 20 nt, Human
ucuuuuuccuggaauaucug

SEQ ID NO: 476845 - RNA, 22 nt, Human
ugacaggaaagugcuccccaaa

SEQ ID NO: 476846 - RNA, 22 nt, Human
ugagaaaauguaguuguuccug

SEQ ID NO: 476847 - RNA, 20 nt, Human
ugagucucucucucccuugu

SEQ ID NO: 476848 - RNA, 24 nt, Human
uggaauuucagagcaaagguuguu

SEQ ID NO: 476849 - RNA, 23 nt, Human
uggggcaguaaucagguagcuga

SEQ ID NO: 476850 - RNA, 23 nt, Human
uggguccuuggauucugcaacuc

SEQ ID NO: 476851 - RNA, 25 nt, Human
uguucacucuuuuaugcugucucca

SEQ ID NO: 476852 - RNA, 19 nt, Human
uuauagcagaaaaaagacu

SEQ ID NO: 476853 - RNA, 19 nt, Human
uucacccccauucaaggca

SEQ ID NO: 476854 - RNA, 20 nt, Human
uucacuccaugacacagagg

SEQ ID NO: 476855 - RNA, 25 nt, Human
uucccacacuccuaauacccacaaa

SEQ ID NO: 476856 - RNA, 19 nt, Human
uuccuggaaaaaaaaaaaa

SEQ ID NO: 476857 - RNA, 21 nt, Human
uucucagucuuccagguuaug

SEQ ID NO: 476858 - RNA, 23 nt, Human
uucuggaaaggauuuuugauacu

SEQ ID NO: 476859 - RNA, 23 nt, Human
aaaagaaaagaaaaagacaagag

SEQ ID NO: 476860 - RNA, 19 nt, Human
aagugagaguacaacagcc

SEQ ID NO: 476861 - RNA, 25 nt, Human
acauggcagcucccuucagcucucc

SEQ ID NO: 476862 - RNA, 20 nt, Human
agaaaagaaaaagacaagag

SEQ ID NO: 476863 - RNA, 20 nt, Human
aguuaaaaagaaaagaaaaa

SEQ ID NO: 476864 - RNA, 19 nt, Human
caagagcaagccacugcca

SEQ ID NO: 476865 - RNA, 24 nt, Human
caccuucaguccccggccucgcuu

SEQ ID NO: 476866 - RNA, 21 nt, Human
cagcaggcugaccaaagagug

SEQ ID NO: 476867 - RNA, 21 nt, Human
gaguuucaaguucagagcacu

SEQ ID NO: 476868 - RNA, 20 nt, Human
gcagcucccuucagcucucc

SEQ ID NO: 476869 - RNA, 20 nt, Human
gcgcucaggacuucaagucc

SEQ ID NO: 476870 - RNA, 23 nt, Human
gugaguuucaaguucagagcacu

SEQ ID NO: 476871 - RNA, 22 nt, Human
uaaagugagaguacaacagccc

SEQ ID NO: 476872 - RNA, 22 nt, Human
uaccagcacuuaaauuugucag

SEQ ID NO: 476873 - RNA, 24 nt, Human
uagguggguggauauauucaugua

SEQ ID NO: 476874 - RNA, 20 nt, Human
uauauucauguaugcauaua

SEQ ID NO: 476875 - RNA, 24 nt, Human
ucaucggacauggcagcucccuuc

SEQ ID NO: 476876 - RNA, 23 nt, Human
uccccggccucgcuuuggagucc

SEQ ID NO: 476877 - RNA, 23 nt, Human
ucgacacccacaccuucaguccc

SEQ ID NO: 476878 - RNA, 18 nt, Human
ucuccagugaguuucaag

SEQ ID NO: 476879 - RNA, 23 nt, Human
ucuccagugaguuucaaguucag

SEQ ID NO: 476880 - RNA, 24 nt, Human
ugaccaaagaguggccugucuguu

SEQ ID NO: 476881 - RNA, 22 nt, Human
uggcagcucccuucagcucucc

SEQ ID NO: 476882 - RNA, 19 nt, Human
uggguggauauauucaugu

SEQ ID NO: 476883 - RNA, 23 nt, Human
uguacgaggugagaauccgugca

SEQ ID NO: 476884 - RNA, 25 nt, Human
ugucagcaggcugaccaaagagugg

SEQ ID NO: 476885 - RNA, 21 nt, Human
uucaacuuuaaucuuuugcga

SEQ ID NO: 476886 - RNA, 19 nt, Human
uuugacccagguuaacccu

SEQ ID NO: 476887 - RNA, 29 nt, Human
aaacaaagguaagagucaggagggacccc

SEQ ID NO: 476888 - RNA, 23 nt, Human
aaacucucaacauaucaacacuc

SEQ ID NO: 476889 - RNA, 24 nt, Human
aacacuguauuuuucacuuuuugu

SEQ ID NO: 476890 - RNA, 22 nt, Human
aacgaaaacucaaaaaguugga

SEQ ID NO: 476891 - RNA, 20 nt, Human
aagaagcaguggaaauuggc

SEQ ID NO: 476892 - RNA, 23 nt, Human
aagaggaaagaaaaaaaauccaa

SEQ ID NO: 476893 - RNA, 18 nt, Human
aagccuccuaaaacaaag

SEQ ID NO: 476894 - RNA, 21 nt, Human
aagguaagagucaggagccau

SEQ ID NO: 476895 - RNA, 22 nt, Human
acaaacaauagacaugcccaug

SEQ ID NO: 476896 - RNA, 21 nt, Human
acaaagguaagagucaggagc

SEQ ID NO: 476897 - RNA, 21 nt, Human
acaacacugaaauggacauac

SEQ ID NO: 476898 - RNA, 22 nt, Human
acaacagcaaagugaacauaaa

SEQ ID NO: 476899 - RNA, 19 nt, Human
acaggaaaaagaagcagug

SEQ ID NO: 476900 - RNA, 23 nt, Human
acagugcagauacaaacagcugc

SEQ ID NO: 476901 - RNA, 20 nt, Human
acauacacauuacagauaca

SEQ ID NO: 476902 - RNA, 19 nt, Human
acauuacagauacaaacaa

SEQ ID NO: 476903 - RNA, 18 nt, Human
accaaacaccuuacaaag

SEQ ID NO: 476904 - RNA, 22 nt, Human
accaaacaccuuacaaagguuc

SEQ ID NO: 476905 - RNA, 23 nt, Human
accacaagaaauaaagaccauag

SEQ ID NO: 476906 - RNA, 22 nt, Human
accauaguuggagguuaauggg

SEQ ID NO: 476907 - RNA, 19 nt, Human
agacagaaaacucucaacu

SEQ ID NO: 476908 - RNA, 19 nt, Human
agacugaauuuuugcacga

SEQ ID NO: 476909 - RNA, 22 nt, Human
agagguuucccaaagaaacuaa

SEQ ID NO: 476910 - RNA, 23 nt, Human
agcacacuuuuaauaacccuggu

SEQ ID NO: 476911 - RNA, 22 nt, Human
aggaaagaaaaaaaauccaaaa

SEQ ID NO: 476912 - RNA, 23 nt, Human
aggaaagaaaaaaaauccaaaac

SEQ ID NO: 476913 - RNA, 26 nt, Human
agucuaucaccugcauacuaaaacag

SEQ ID NO: 476914 - RNA, 20 nt, Human
auaauguaaaaagaaagcac

SEQ ID NO: 476915 - RNA, 23 nt, Human
auacacauuacagauacaaacaa

SEQ ID NO: 476916 - RNA, 20 nt, Human
cacaccaggaagggauuuag

SEQ ID NO: 476917 - RNA, 19 nt, Human
cacaggaaaaagaagcagu

SEQ ID NO: 476918 - RNA, 24 nt, Human
cacauuacagauacaaacaauaga

SEQ ID NO: 476919 - RNA, 20 nt, Human
cagacagaaaacucucaaca

SEQ ID NO: 476920 - RNA, 22 nt, Human
cagccagacagaaaacucucaa

SEQ ID NO: 476921 - RNA, 19 nt, Human
caggaaaaagaagcagugg

SEQ ID NO: 476922 - RNA, 20 nt, Human
caggaaagauaagagcaaug

SEQ ID NO: 476923 - RNA, 22 nt, Human
caggaaagauaagagcaaugac

SEQ ID NO: 476924 - RNA, 23 nt, Human
caggagccauacagaaaacagag

SEQ ID NO: 476925 - RNA, 21 nt, Human
ccuaaauccucagugcaacau

SEQ ID NO: 476926 - RNA, 19 nt, Human
ccucgcccggcugaacugg

SEQ ID NO: 476927 - RNA, 19 nt, Human
cucccuaaauccucagugc

SEQ ID NO: 476928 - RNA, 18 nt, Human
cuccuaaaacaaagguaa

SEQ ID NO: 476929 - RNA, 18 nt, Human
cucucccuaaauccucag

SEQ ID NO: 476930 - RNA, 20 nt, Human
cuggaauaaauaaauagcag

SEQ ID NO: 476931 - RNA, 21 nt, Human
cuucacuccuaucuacucucc

SEQ ID NO: 476932 - RNA, 26 nt, Human
gaaaaugggaagugacucaggaaaga

SEQ ID NO: 476933 - RNA, 20 nt, Human
gcagauacaaacagcugcca

SEQ ID NO: 476934 - RNA, 24 nt, Human
gcugaacuggaauucuugcaguua

SEQ ID NO: 476935 - RNA, 24 nt, Human
gugaagaggaaagaaaaaaaaucc

SEQ ID NO: 476936 - RNA, 25 nt, Human
uaaaaaagacauugagguuauggua

SEQ ID NO: 476937 - RNA, 20 nt, Human
uaaaaacaauugagaggugg

SEQ ID NO: 476938 - RNA, 24 nt, Human
uaaaaaggcacaggaaaaagaagc

SEQ ID NO: 476939 - RNA, 24 nt, Human
uaaaauagcaaagagaagggaggc

SEQ ID NO: 476940 - RNA, 19 nt, Human
uaaaauuucaaguaaacac

SEQ ID NO: 476941 - RNA, 22 nt, Human
uaaaauuucaaguaaacacugu

SEQ ID NO: 476942 - RNA, 24 nt, Human
uaauggacagccagaacuuuagau

SEQ ID NO: 476943 - RNA, 24 nt, Human
uacaguaguggaauaaauaaauaa

SEQ ID NO: 476944 - RNA, 18 nt, Human
uacuaaaacagacaacac

SEQ ID NO: 476945 - RNA, 19 nt, Human
uacuuauaaaaaaaugacu

SEQ ID NO: 476946 - RNA, 23 nt, Human
uagacagacacagugcagauaca

SEQ ID NO: 476947 - RNA, 18 nt, Human
uagcacaacuuguuuucg

SEQ ID NO: 476948 - RNA, 21 nt, Human
ucaguauuauuuuaaaaaaau

SEQ ID NO: 476949 - RNA, 22 nt, Human
ucagugcaacauacguccgcag

SEQ ID NO: 476950 - RNA, 24 nt, Human
uccacaaauaaaaauuaaaaacaa

SEQ ID NO: 476951 - RNA, 22 nt, Human
ucccuaauccauuaaagcuaag

SEQ ID NO: 476952 - RNA, 21 nt, Human
ugaaaacagcacuaauacugc

SEQ ID NO: 476953 - RNA, 24 nt, Human
ugaaaacagcacuaauacugcugg

SEQ ID NO: 476954 - RNA, 22 nt, Human
ugaaaccagacucgcaaacugg

SEQ ID NO: 476955 - RNA, 24 nt, Human
ugaaauggacauacacauuacaga

SEQ ID NO: 476956 - RNA, 26 nt, Human
ugaaauggacauacacauuacagaua

SEQ ID NO: 476957 - RNA, 22 nt, Human
ugaaccuccucaacagaaaucu

SEQ ID NO: 476958 - RNA, 21 nt, Human
ugacucaggaaagauaagagc

SEQ ID NO: 476959 - RNA, 25 nt, Human
ugacucaggaaagauaagagcaagg

SEQ ID NO: 476960 - RNA, 21 nt, Human
ugagagguggggaaaauauca

SEQ ID NO: 476961 - RNA, 22 nt, Human
ugagagguggggaaaauaucag

SEQ ID NO: 476962 - RNA, 26 nt, Human
ugccaaaugcuucacuccuaucuacu

SEQ ID NO: 476963 - RNA, 20 nt, Human
ugcuacaguaguggaauaaa

SEQ ID NO: 476964 - RNA, 20 nt, Human
uggaaauuggcuucucccag

SEQ ID NO: 476965 - RNA, 23 nt, Human
uggcauucagacugcuccaggau

SEQ ID NO: 476966 - RNA, 24 nt, Human
uguaaaaagaaagcacacuuuuaa

SEQ ID NO: 476967 - RNA, 21 nt, Human
uguaaagcaggcaguuucuug

SEQ ID NO: 476968 - RNA, 18 nt, Human
uguuaaaaaggcacagga

SEQ ID NO: 476969 - RNA, 20 nt, Human
uuaaauuacagacugaauuu

SEQ ID NO: 476970 - RNA, 23 nt, Human
uuacaaagguucaugaaaccaga

SEQ ID NO: 476971 - RNA, 18 nt, Human
uuaguggugaauguguau

SEQ ID NO: 476972 - RNA, 19 nt, Human
uucuuuacgcugccaaaug

SEQ ID NO: 476973 - RNA, 19 nt, Human
uugaguguuaaaaaggcac

SEQ ID NO: 476974 - RNA, 21 nt, Human
uugauacacaccaggaaggga

SEQ ID NO: 476975 - RNA, 20 nt, Human
uugcugaguuuggaaaaugg

SEQ ID NO: 476976 - RNA, 22 nt, Human
aaaccagcgcagcagaagcugg

SEQ ID NO: 476977 - RNA, 25 nt, Human
accccacgcuccaaaguccaggcug

SEQ ID NO: 476978 - RNA, 21 nt, Human
agagaaguaggugagagggaa

SEQ ID NO: 476979 - RNA, 19 nt, Human
agagacaaggaugagaagg

SEQ ID NO: 476980 - RNA, 19 nt, Human
aucacacacagacauaagg

SEQ ID NO: 476981 - RNA, 24 nt, Human
caaaaagcuagaacaccccugcca

SEQ ID NO: 476982 - RNA, 21 nt, Human
cacacacagacauaaggcacg

SEQ ID NO: 476983 - RNA, 21 nt, Human
cacacagacauaaggcacggu

SEQ ID NO: 476984 - RNA, 22 nt, Human
cacccaccccacgcuccaaagu

SEQ ID NO: 476985 - RNA, 23 nt, Human
caccccacgcuccaaaguccagg

SEQ ID NO: 476986 - RNA, 21 nt, Human
cagugcuuagaguggggagcc

SEQ ID NO: 476987 - RNA, 25 nt, Human
ccaaagccgcaaaccagcgcagcag

SEQ ID NO: 476988 - RNA, 22 nt, Human
ccccaaagaugcggggaguagg

SEQ ID NO: 476989 - RNA, 21 nt, Human
ccccugggugugccgccuccg

SEQ ID NO: 476990 - RNA, 24 nt, Human
cccuuggcguccccccugggugug

SEQ ID NO: 476991 - RNA, 21 nt, Human
ccgccuccgagcucgggcccu

SEQ ID NO: 476992 - RNA, 23 nt, Human
ccucaaaaagcuagaacaccccu

SEQ ID NO: 476993 - RNA, 19 nt, Human
ccucucucucaccuucccc

SEQ ID NO: 476994 - RNA, 23 nt, Human
cguccugcucccuuggcgucccc

SEQ ID NO: 476995 - RNA, 21 nt, Human
cucacucuguccuaacaucac

SEQ ID NO: 476996 - RNA, 19 nt, Human
gaagugaugagaagagggg

SEQ ID NO: 476997 - RNA, 22 nt, Human
gagccauugucccacccacccc

SEQ ID NO: 476998 - RNA, 20 nt, Human
gauuccccaaagaugcgggg

SEQ ID NO: 476999 - RNA, 20 nt, Human
ggaguaggggaggcagugcu

SEQ ID NO: 477000 - RNA, 24 nt, Human
ggggaggcagugcuuagagugggg

SEQ ID NO: 477001 - RNA, 24 nt, Human
guccucaaaaagcuagaacacccc

SEQ ID NO: 477002 - RNA, 23 nt, Human
uaccugagcccaggaugaguaac

SEQ ID NO: 477003 - RNA, 19 nt, Human
ucacacacagacauaaggc

SEQ ID NO: 477004 - RNA, 21 nt, Human
ucccacccaccccacgcucca

SEQ ID NO: 477005 - RNA, 27 nt, Human
ucccacccaccccacgcuccaaagucc

SEQ ID NO: 477006 - RNA, 19 nt, Human
uccccgugacagcugacuu

SEQ ID NO: 477007 - RNA, 21 nt, Human
ucccugcccucgaggagcuca

SEQ ID NO: 477008 - RNA, 20 nt, Human
ucccuuggcguccccccugg

SEQ ID NO: 477009 - RNA, 21 nt, Human
ugagagggaaauuuccaggug

SEQ ID NO: 477010 - RNA, 22 nt, Human
ugaugagaagagggguacccag

SEQ ID NO: 477011 - RNA, 23 nt, Human
ugucccacccaccccacgcucca

SEQ ID NO: 477012 - RNA, 19 nt, Human
uguccuaacaucacaagag

SEQ ID NO: 477013 - RNA, 27 nt, Human
acugggaggaugagguugugcucugcc

SEQ ID NO: 477014 - RNA, 21 nt, Human
agauuugagguaggaggcugg

SEQ ID NO: 477015 - RNA, 20 nt, Human
aggaagaaaauuauaauuaa

SEQ ID NO: 477016 - RNA, 19 nt, Human
aggcaaacucuuuaaccuu

SEQ ID NO: 477017 - RNA, 21 nt, Human
aggucgugcggugagguacug

SEQ ID NO: 477018 - RNA, 19 nt, Human
cacccucucucuucuccag

SEQ ID NO: 477019 - RNA, 22 nt, Human
cauccccuaagcuugucauccu

SEQ ID NO: 477020 - RNA, 22 nt, Human
caucuccaaguggggaaaaaaa

SEQ ID NO: 477021 - RNA, 22 nt, Human
ccacccucucucuucuccagua

SEQ ID NO: 477022 - RNA, 19 nt, Human
cuccaaguggggaaaaaaa

SEQ ID NO: 477023 - RNA, 21 nt, Human
cuuugucuuuucaacauguug

SEQ ID NO: 477024 - RNA, 18 nt, Human
gagcugucagaaacgcuc

SEQ ID NO: 477025 - RNA, 20 nt, Human
gcuuguuuucuggucaugac

SEQ ID NO: 477026 - RNA, 22 nt, Human
gggcuuguuuucuggucaugac

SEQ ID NO: 477027 - RNA, 18 nt, Human
gguucuaauccagauucu

SEQ ID NO: 477028 - RNA, 24 nt, Human
guaauugauccacagccucccagg

SEQ ID NO: 477029 - RNA, 21 nt, Human
ucagaagggggggaaaaggca

SEQ ID NO: 477030 - RNA, 18 nt, Human
uccaguauucuuugucuu

SEQ ID NO: 477031 - RNA, 24 nt, Human
ucccaggaaguccuuguuuuucuu

SEQ ID NO: 477032 - RNA, 21 nt, Human
ucuaagcaaccucaggcaaac

SEQ ID NO: 477033 - RNA, 19 nt, Human
ugagguaggaggcuggcag

SEQ ID NO: 477034 - RNA, 20 nt, Human
ugagguaggaggcuggcagg

SEQ ID NO: 477035 - RNA, 26 nt, Human
ugcucugcccacccucucucuucucc

SEQ ID NO: 477036 - RNA, 22 nt, Human
uuccugcauuucaauuugucau

SEQ ID NO: 477037 - RNA, 20 nt, Human
uuucuggucaugaccucacu

SEQ ID NO: 477038 - RNA, 23 nt, Human
uuucuuaucucugucuuuugugu

SEQ ID NO: 477039 - RNA, 20 nt, Human
uuugccaaugcucaguucuu

SEQ ID NO: 477040 - RNA, 21 nt, Human
uuugccaaugcucaguucuuu

SEQ ID NO: 477041 - RNA, 22 nt, Human
uuugucuuuucaacauguuggu

SEQ ID NO: 477042 - RNA, 18 nt, Human
uuuuucuuaucucugucu

SEQ ID NO: 477043 - RNA, 22 nt, Human
aaaaacagacaggugcggccug

SEQ ID NO: 477044 - RNA, 19 nt, Human
aaaaagcaacgcgaaagcu

SEQ ID NO: 477045 - RNA, 24 nt, Human
aaaguucugggauuaccugccuga

SEQ ID NO: 477046 - RNA, 22 nt, Human
aagcgauccuucugucugggcc

SEQ ID NO: 477047 - RNA, 21 nt, Human
acaggguuucaccauguuggc

SEQ ID NO: 477048 - RNA, 23 nt, Human
acaggguuucaccauguuggcca

SEQ ID NO: 477049 - RNA, 24 nt, Human
acaggguuucaccauguuggccag

SEQ ID NO: 477050 - RNA, 21 nt, Human
aggagcgggcgagcgggcggg

SEQ ID NO: 477051 - RNA, 20 nt, Human
aggcacgcgagaaaaagcaa

SEQ ID NO: 477052 - RNA, 18 nt, Human
aguaugggaacagcugga

SEQ ID NO: 477053 - RNA, 23 nt, Human
aguggagugaacaagaagcccag

SEQ ID NO: 477054 - RNA, 20 nt, Human
caaaaacagacaggugcggc

SEQ ID NO: 477055 - RNA, 20 nt, Human
caaaguucugggauuaccug

SEQ ID NO: 477056 - RNA, 27 nt, Human
caagcgauccuucugucugggccuccc

SEQ ID NO: 477057 - RNA, 19 nt, Human
caccauguuggccaggucu

SEQ ID NO: 477058 - RNA, 20 nt, Human
caccauguuggccaggucuc

SEQ ID NO: 477059 - RNA, 24 nt, Human
cacuucagcuuccugcagagccgg

SEQ ID NO: 477060 - RNA, 20 nt, Human
cagccgccgccgccgccccg

SEQ ID NO: 477061 - RNA, 24 nt, Human
caggguuucaccauguuggccagg

SEQ ID NO: 477062 - RNA, 19 nt, Human
ccaaaaacagacaggugcg

SEQ ID NO: 477063 - RNA, 19 nt, Human
ccaaaaacagacaggugcg

SEQ ID NO: 477064 - RNA, 20 nt, Human
ccaaaguucugggauuaccu

SEQ ID NO: 477065 - RNA, 19 nt, Human
ccacaggagcgggcgagcg

SEQ ID NO: 477066 - RNA, 18 nt, Human
ccccccagaggcagcccc

SEQ ID NO: 477067 - RNA, 22 nt, Human
cccgcagccgccgccgccgccc

SEQ ID NO: 477068 - RNA, 24 nt, Human
cccgcgacuagcggaccccccaga

SEQ ID NO: 477069 - RNA, 21 nt, Human
cccucccggagcccgcacgcu

SEQ ID NO: 477070 - RNA, 21 nt, Human
ccgcagccgccgccgccgccc

SEQ ID NO: 477071 - RNA, 24 nt, Human
ccuccggugaguggcccuagcccu

SEQ ID NO: 477072 - RNA, 18 nt, Human
ccugaccucaagcgaucc

SEQ ID NO: 477073 - RNA, 20 nt, Human
ccugaccucaagcgauccuu

SEQ ID NO: 477074 - RNA, 21 nt, Human
ccugagucacccgcccggccu

SEQ ID NO: 477075 - RNA, 21 nt, Human
ccugcagagccggggcauccu

SEQ ID NO: 477076 - RNA, 21 nt, Human
cgagcgggcgggcgggcgagc

SEQ ID NO: 477077 - RNA, 19 nt, Human
cgcucagaaaaaccacagg

SEQ ID NO: 477078 - RNA, 19 nt, Human
cgggcgggcgggcgggcgg

SEQ ID NO: 477079 - RNA, 22 nt, Human
cgggcgggcgggcgggcggagg

SEQ ID NO: 477080 - RNA, 21 nt, Human
cgggcgggcgggcgggcgggc

SEQ ID NO: 477081 - RNA, 22 nt, Human
cugccccgggcgggcugggccc

SEQ ID NO: 477082 - RNA, 23 nt, Human
gaacuuucccucuggaaggauuu

SEQ ID NO: 477083 - RNA, 22 nt, Human
gacuugacuucaaacaggaagc

SEQ ID NO: 477084 - RNA, 20 nt, Human
gagcgggcgggcgggcgagc

SEQ ID NO: 477085 - RNA, 27 nt, Human
gagcgggcgggcgggcgagcgggcggg

SEQ ID NO: 477086 - RNA, 20 nt, Human
gagcgggcgggcgggcgggc

SEQ ID NO: 477087 - RNA, 26 nt, Human
gcaguggagugaacaagaagcccaga

SEQ ID NO: 477088 - RNA, 21 nt, Human
gcccucuccgggccucucacu

SEQ ID NO: 477089 - RNA, 18 nt, Human
gcgagcgggcgggcgggc

SEQ ID NO: 477090 - RNA, 18 nt, Human
gcgagcgggcgggcgggc

SEQ ID NO: 477091 - RNA, 20 nt, Human
gcgagcgggcgggcgggcgg

SEQ ID NO: 477092 - RNA, 21 nt, Human
gcgagcgggcgggcgggcggg

SEQ ID NO: 477093 - RNA, 21 nt, Human
gcgggcgagcgggcgggcggg

SEQ ID NO: 477094 - RNA, 21 nt, Human
gcgggcgagcgggcgggcggg

SEQ ID NO: 477095 - RNA, 18 nt, Human
gcgggcgggcgggcgggc

SEQ ID NO: 477096 - RNA, 21 nt, Human
gcgggcgggcgggcgggcggg

SEQ ID NO: 477097 - RNA, 21 nt, Human
ggcugggcccucuccgggccu

SEQ ID NO: 477098 - RNA, 22 nt, Human
ggguuucaccauguuggccagg

SEQ ID NO: 477099 - RNA, 24 nt, Human
uaaacaaagaacuuucccucugga

SEQ ID NO: 477100 - RNA, 24 nt, Human
uacaacacuuaaacaaagggacau

SEQ ID NO: 477101 - RNA, 22 nt, Human
uagagacaggguuucaccaugu

SEQ ID NO: 477102 - RNA, 22 nt, Human
uagaggcaguggagugaacaag

SEQ ID NO: 477103 - RNA, 24 nt, Human
uaguagagacaggguuucaccaug

SEQ ID NO: 477104 - RNA, 26 nt, Human
uaguagagacaggguuucaccauguu

SEQ ID NO: 477105 - RNA, 25 nt, Human
uauuuuacuccagcauucccuucca

SEQ ID NO: 477106 - RNA, 18 nt, Human
ucagccucagcauccccu

SEQ ID NO: 477107 - RNA, 24 nt, Human
ucccaaaguucugggauuaccugc

SEQ ID NO: 477108 - RNA, 24 nt, Human
ucgcgcccgcagccgccgccgccg

SEQ ID NO: 477109 - RNA, 18 nt, Human
ugaccucaagcgauccuu

SEQ ID NO: 477110 - RNA, 21 nt, Human
ugaccucaagcgauccuucug

SEQ ID NO: 477111 - RNA, 24 nt, Human
ugaccucaagcgauccuucugucu

SEQ ID NO: 477112 - RNA, 22 nt, Human
ugacuucaaacaggaagcccug

SEQ ID NO: 477113 - RNA, 20 nt, Human
ugacuucaagugcaggcccc

SEQ ID NO: 477114 - RNA, 20 nt, Human
ugacuugacuucaaacagga

SEQ ID NO: 477115 - RNA, 24 nt, Human
ugacuugacuucaaacaggaagcc

SEQ ID NO: 477116 - RNA, 21 nt, Human
ugcaggccccgcccuccuccg

SEQ ID NO: 477117 - RNA, 24 nt, Human
uggcccuagcccuggaggcagcuc

SEQ ID NO: 477118 - RNA, 22 nt, Human
ugggauuaccugccugagucac

SEQ ID NO: 477119 - RNA, 23 nt, Human
ugggccucccaaaguucugggau

SEQ ID NO: 477120 - RNA, 24 nt, Human
uuaguagagacaggguuucaccau

SEQ ID NO: 477121 - RNA, 22 nt, Human
uucaaacaggaagcccugaaga

SEQ ID NO: 477122 - RNA, 19 nt, Human
uuucaccauguuggccagg

SEQ ID NO: 477123 - RNA, 20 nt, Human
uuucaccauguuggccaggu

SEQ ID NO: 477124 - RNA, 24 nt, Human
uuuuuaguagagacaggguuucac

SEQ ID NO: 477125 - RNA, 23 nt, Human
uuuuuuaguagagacaggguuuc

SEQ ID NO: 477126 - RNA, 31 nt, Human
uuuuuuuuuuuuaguagagacaggguuucaa

SEQ ID NO: 477127 - RNA, 24 nt, Human
uuuuuuuuuuuuuuaguagagaca

SEQ ID NO: 477128 - RNA, 29 nt, Human
uuuuuuuuuuuuuuuaguagagacagggg

SEQ ID NO: 477129 - RNA, 20 nt, Human
agaacacaagaaaccuuuga

SEQ ID NO: 477130 - RNA, 23 nt, Human
augauucucucccucuccccacc

SEQ ID NO: 477131 - RNA, 21 nt, Human
cacaagaaaccuuugagacag

SEQ ID NO: 477132 - RNA, 18 nt, Human
caccagaacacaagaaac

SEQ ID NO: 477133 - RNA, 24 nt, Human
cagaacacaagaaaccuuugagac

SEQ ID NO: 477134 - RNA, 25 nt, Human
caugauucucucccucuccccaccc

SEQ ID NO: 477135 - RNA, 20 nt, Human
cgcagcaucauccccaaaga

SEQ ID NO: 477136 - RNA, 18 nt, Human
cucccucuccccaccccc

SEQ ID NO: 477137 - RNA, 21 nt, Human
uacaaaauaacccaauaucca

SEQ ID NO: 477138 - RNA, 22 nt, Human
uacagacaaggacgacccaucc

SEQ ID NO: 477139 - RNA, 25 nt, Human
ucauggaauucaccagaacacaaga

SEQ ID NO: 477140 - RNA, 18 nt, Human
ucucccucuccccacccc

SEQ ID NO: 477141 - RNA, 20 nt, Human
uggaaugcacaauucaugga

SEQ ID NO: 477142 - RNA, 25 nt, Human
uggaauucaccagaacacaagaaac

SEQ ID NO: 477143 - RNA, 19 nt, Human
uucucucccucuccccacc

SEQ ID NO: 477144 - RNA, 21 nt, Human
aaaaagaguggauaccaaaau

SEQ ID NO: 477145 - RNA, 21 nt, Human
aaaaguaaaugaaaggaucaa

SEQ ID NO: 477146 - RNA, 22 nt, Human
aaacaaaaaaauccucauugcu

SEQ ID NO: 477147 - RNA, 24 nt, Human
aaacaugcuaaagaauacauuaaa

SEQ ID NO: 477148 - RNA, 23 nt, Human
aaagaauacugugagaaccugaa

SEQ ID NO: 477149 - RNA, 23 nt, Human
aacagugaccggcacguaacccc

SEQ ID NO: 477150 - RNA, 26 nt, Human
aacauuuuugccugagugucccacua

SEQ ID NO: 477151 - RNA, 25 nt, Human
aacgacaagaauuccucacacaaac

SEQ ID NO: 477152 - RNA, 18 nt, Human
aaggcaacaaucuuccuc

SEQ ID NO: 477153 - RNA, 19 nt, Human
acacucaaacaaaaaaauc

SEQ ID NO: 477154 - RNA, 24 nt, Human
accccacuccuucauuucugcagg

SEQ ID NO: 477155 - RNA, 22 nt, Human
acuaaauuauuuuucucuggcu

SEQ ID NO: 477156 - RNA, 21 nt, Human
agcuucaacauuccuuuggag

SEQ ID NO: 477157 - RNA, 19 nt, Human
aggaagcuccgcaccuauc

SEQ ID NO: 477158 - RNA, 23 nt, Human
aggacuauggcccacuucaacac

SEQ ID NO: 477159 - RNA, 23 nt, Human
augcuaaagaauacauuaaaaca

SEQ ID NO: 477160 - RNA, 21 nt, Human
caaaaguaaaugaaaggauca

SEQ ID NO: 477161 - RNA, 19 nt, Human
caaaauagcuuuuaggaag

SEQ ID NO: 477162 - RNA, 24 nt, Human
caaacaugcguucucccuucuucc

SEQ ID NO: 477163 - RNA, 20 nt, Human
caaacgagagauucgacgua

SEQ ID NO: 477164 - RNA, 22 nt, Human
caacaugucaaagaaagaccaa

SEQ ID NO: 477165 - RNA, 18 nt, Human
caagucccaggucaaaac

SEQ ID NO: 477166 - RNA, 22 nt, Human
cacauucaagaaugggguccca

SEQ ID NO: 477167 - RNA, 19 nt, Human
caccccuccugccucguuc

SEQ ID NO: 477168 - RNA, 23 nt, Human
cacuaaaccgcuuucacagcccu

SEQ ID NO: 477169 - RNA, 23 nt, Human
caguagaguaggguucagcuaug

SEQ ID NO: 477170 - RNA, 22 nt, Human
ccccuccugccucguucaggaa

SEQ ID NO: 477171 - RNA, 26 nt, Human
ccccugaaccucgcaccccuccugcc

SEQ ID NO: 477172 - RNA, 20 nt, Human
cccugaaccucgcaccccuc

SEQ ID NO: 477173 - RNA, 21 nt, Human
cccugaaccucgcaccccucc

SEQ ID NO: 477174 - RNA, 21 nt, Human
ccucaaugccaaauaucuacu

SEQ ID NO: 477175 - RNA, 20 nt, Human
ccucccuaacgacuucggcu

SEQ ID NO: 477176 - RNA, 23 nt, Human
ccuguccugcagcgauugugggg

SEQ ID NO: 477177 - RNA, 22 nt, Human
ccuugggcgucacaagucccag

SEQ ID NO: 477178 - RNA, 19 nt, Human
cgacuucggcugcccgggc

SEQ ID NO: 477179 - RNA, 24 nt, Human
cggcugcccgggcccugccccuga

SEQ ID NO: 477180 - RNA, 22 nt, Human
cucccuucuucccacauucaag

SEQ ID NO: 477181 - RNA, 18 nt, Human
cucgcaccccuccugccu

SEQ ID NO: 477182 - RNA, 23 nt, Human
cugccccugaaccucgcaccccu

SEQ ID NO: 477183 - RNA, 21 nt, Human
cuggaguuuacuuucuuccug

SEQ ID NO: 477184 - RNA, 22 nt, Human
cuucaacacucaaacaaaaaaa

SEQ ID NO: 477185 - RNA, 18 nt, Human
gaauuacaacaacuggaa

SEQ ID NO: 477186 - RNA, 23 nt, Human
gaguagccagaauaagguggcau

SEQ ID NO: 477187 - RNA, 25 nt, Human
gauuuuauuccagaaaggagaaagu

SEQ ID NO: 477188 - RNA, 19 nt, Human
gggcgucacaagucccagg

SEQ ID NO: 477189 - RNA, 23 nt, Human
guaaugaugacagaguuuacaua

SEQ ID NO: 477190 - RNA, 18 nt, Human
gucaaaacgucuccauuc

SEQ ID NO: 477191 - RNA, 21 nt, Human
gucacaagucccaggucaaaa

SEQ ID NO: 477192 - RNA, 21 nt, Human
gucauccuggggagggggagc

SEQ ID NO: 477193 - RNA, 18 nt, Human
uaaaaagaguggauacca

SEQ ID NO: 477194 - RNA, 21 nt, Human
uaaaaguuauaucaaaaacau

SEQ ID NO: 477195 - RNA, 22 nt, Human
uaaaauaaccccacuccuucau

SEQ ID NO: 477196 - RNA, 22 nt, Human
uaaaccgcuuucacagcccucg

SEQ ID NO: 477197 - RNA, 18 nt, Human
uaaauugcugaagagagc

SEQ ID NO: 477198 - RNA, 19 nt, Human
uagcuuuuaggaagacgac

SEQ ID NO: 477199 - RNA, 20 nt, Human
uaguagcuaagagcacgggc

SEQ ID NO: 477200 - RNA, 22 nt, Human
uauauccaugacaaaauugaua

SEQ ID NO: 477201 - RNA, 23 nt, Human
uauaugguagacacgaaacacau

SEQ ID NO: 477202 - RNA, 26 nt, Human
uauuacaaagguuuuagaagaugagg

SEQ ID NO: 477203 - RNA, 21 nt, Human
ucaaaaacaugcuaaagaaua

SEQ ID NO: 477204 - RNA, 18 nt, Human
ucaaaacgucuccauucu

SEQ ID NO: 477205 - RNA, 19 nt, Human
ucaaccaguuauauccaug

SEQ ID NO: 477206 - RNA, 24 nt, Human
ucaagaauggggucccaaacgaga

SEQ ID NO: 477207 - RNA, 18 nt, Human
ucagugacgcgauaugug

SEQ ID NO: 477208 - RNA, 19 nt, Human
ucccaggucaaaacgucuc

SEQ ID NO: 477209 - RNA, 19 nt, Human
ucccuaacgacuucggcug

SEQ ID NO: 477210 - RNA, 20 nt, Human
uccuucauuucugcaggaga

SEQ ID NO: 477211 - RNA, 22 nt, Human
ucgcaccccuccugccucguuc

SEQ ID NO: 477212 - RNA, 27 nt, Human
ucgcaccccuccugccucguucaggaa

SEQ ID NO: 477213 - RNA, 21 nt, Human
ucuacuaagaauuuaaaaaag

SEQ ID NO: 477214 - RNA, 22 nt, Human
ucucccuucuucccacauucaa

SEQ ID NO: 477215 - RNA, 24 nt, Human
ucucuaaauugcauuuacuggccu

SEQ ID NO: 477216 - RNA, 19 nt, Human
ucugcaaacauaaaacugc

SEQ ID NO: 477217 - RNA, 20 nt, Human
ucugcaaacauaaaacugcu

SEQ ID NO: 477218 - RNA, 21 nt, Human
ucugcaaacauaaaacugcuu

SEQ ID NO: 477219 - RNA, 19 nt, Human
ugaaacuuucuauuuccaa

SEQ ID NO: 477220 - RNA, 21 nt, Human
ugacaugaagugugucauccu

SEQ ID NO: 477221 - RNA, 24 nt, Human
ugagaaccugaauacuucaaucaa

SEQ ID NO: 477222 - RNA, 24 nt, Human
ugagcaaacaugcguucucccuuc

SEQ ID NO: 477223 - RNA, 19 nt, Human
ugauaacauuuugcaacau

SEQ ID NO: 477224 - RNA, 21 nt, Human
ugccccugaaccucgcacccc

SEQ ID NO: 477225 - RNA, 23 nt, Human
ugcuaaagaauacauuaaaacaa

SEQ ID NO: 477226 - RNA, 28 nt, Human
ugcuaaagaauacauuaaaacaaacaaa

SEQ ID NO: 477227 - RNA, 23 nt, Human
ugggcugcaaauuauauccauga

SEQ ID NO: 477228 - RNA, 19 nt, Human
uggggaagucaggucaccu

SEQ ID NO: 477229 - RNA, 21 nt, Human
uuaauagucucuuaaauugcu

SEQ ID NO: 477230 - RNA, 18 nt, Human
uucaacacucaaacaaaa

SEQ ID NO: 477231 - RNA, 19 nt, Human
uucucuggcuuaucaacca

SEQ ID NO: 477232 - RNA, 24 nt, Human
uugguggggugaugguuuguaucc

SEQ ID NO: 477233 - RNA, 19 nt, Human
uuugccugagugucccacu

SEQ ID NO: 477234 - RNA, 19 nt, Human
aaagccuuuuguccuucua

SEQ ID NO: 477235 - RNA, 24 nt, Human
aaccucaaggauuuuguuugauac

SEQ ID NO: 477236 - RNA, 24 nt, Human
aaccucaaggauuuuguuugauac

SEQ ID NO: 477237 - RNA, 21 nt, Human
aagagaacugaaaguuggaaa

SEQ ID NO: 477238 - RNA, 21 nt, Human
aagagaacugaaaguuggaaa

SEQ ID NO: 477239 - RNA, 24 nt, Human
aagaguaaggucaucccagugugg

SEQ ID NO: 477240 - RNA, 24 nt, Human
aagaguaaggucaucccagugugg

SEQ ID NO: 477241 - RNA, 23 nt, Human
aagccuuuuggggcaggaagggg

SEQ ID NO: 477242 - RNA, 23 nt, Human
aagccuuuuggggcaggaagggg

SEQ ID NO: 477243 - RNA, 23 nt, Human
aagccuuuuguccuucuaggccc

SEQ ID NO: 477244 - RNA, 23 nt, Human
aagccuuuuguccuucuaggccc

SEQ ID NO: 477245 - RNA, 18 nt, Human
aagcuaacuccugauccu

SEQ ID NO: 477246 - RNA, 18 nt, Human
aaggauuuugcucuuugc

SEQ ID NO: 477247 - RNA, 18 nt, Human
aaggauuuugcucuuugc

SEQ ID NO: 477248 - RNA, 22 nt, Human
aaggauuuugcucuuugcucug

SEQ ID NO: 477249 - RNA, 22 nt, Human
aaggauuuugcucuuugcucug

SEQ ID NO: 477250 - RNA, 18 nt, Human
aaggugguagccacagug

SEQ ID NO: 477251 - RNA, 18 nt, Human
aaggugguagccacagug

SEQ ID NO: 477252 - RNA, 18 nt, Human
acccagcaccccauagca

SEQ ID NO: 477253 - RNA, 19 nt, Human
accccacaccugucaccac

SEQ ID NO: 477254 - RNA, 19 nt, Human
accccacaccugucaccac

SEQ ID NO: 477255 - RNA, 20 nt, Human
acuaaaaugcagguuuccag

SEQ ID NO: 477256 - RNA, 20 nt, Human
acuaaaaugcagguuuccag

SEQ ID NO: 477257 - RNA, 26 nt, Human
agaaacugguaaagcauucgggggag

SEQ ID NO: 477258 - RNA, 26 nt, Human
agaaacugguaaagcauucgggggag

SEQ ID NO: 477259 - RNA, 27 nt, Human
agacaggcgagacuguggaaggccagg

SEQ ID NO: 477260 - RNA, 27 nt, Human
agacaggcgagacuguggaaggccagg

SEQ ID NO: 477261 - RNA, 20 nt, Human
agacuuggaccuagcugaua

SEQ ID NO: 477262 - RNA, 20 nt, Human
agacuuggaccuagcugaua

SEQ ID NO: 477263 - RNA, 23 nt, Human
agaguaaggucaucccagugugg

SEQ ID NO: 477264 - RNA, 23 nt, Human
agaguaaggucaucccagugugg

SEQ ID NO: 477265 - RNA, 21 nt, Human
agcagcugugguuuugccuuu

SEQ ID NO: 477266 - RNA, 18 nt, Human
agcauguuggagacugca

SEQ ID NO: 477267 - RNA, 20 nt, Human
agccaggcagccuccagucc

SEQ ID NO: 477268 - RNA, 20 nt, Human
agccaggcagccuccagucc

SEQ ID NO: 477269 - RNA, 22 nt, Human
agccaggcagccuccagucccc

SEQ ID NO: 477270 - RNA, 22 nt, Human
agccaggcagccuccagucccc

SEQ ID NO: 477271 - RNA, 24 nt, Human
agccaggcagccuccagucccccu

SEQ ID NO: 477272 - RNA, 24 nt, Human
agccaggcagccuccagucccccu

SEQ ID NO: 477273 - RNA, 22 nt, Human
agccagguccaccaaggccaga

SEQ ID NO: 477274 - RNA, 22 nt, Human
agccagguccaccaaggccaga

SEQ ID NO: 477275 - RNA, 19 nt, Human
agccuccagucccccuccu

SEQ ID NO: 477276 - RNA, 22 nt, Human
agccuccagucccccuccuuuc

SEQ ID NO: 477277 - RNA, 22 nt, Human
agcugagggcaaaagccuccua

SEQ ID NO: 477278 - RNA, 22 nt, Human
agcugagggcaaaagccuccua

SEQ ID NO: 477279 - RNA, 22 nt, Human
aggaagaaggaguccauuuuga

SEQ ID NO: 477280 - RNA, 22 nt, Human
aggaagaaggaguccauuuuga

SEQ ID NO: 477281 - RNA, 19 nt, Human
aggagccagcugugccuca

SEQ ID NO: 477282 - RNA, 18 nt, Human
aggcaggaagggaaggug

SEQ ID NO: 477283 - RNA, 18 nt, Human
aggcaggaagggaaggug

SEQ ID NO: 477284 - RNA, 23 nt, Human
aggccagagacagacaggcgaga

SEQ ID NO: 477285 - RNA, 23 nt, Human
aggccagagacagacaggcgaga

SEQ ID NO: 477286 - RNA, 21 nt, Human
agggaaaccuuuuguuugcgg

SEQ ID NO: 477287 - RNA, 21 nt, Human
agggaaaccuuuuguuugcgg

SEQ ID NO: 477288 - RNA, 19 nt, Human
agggcugggcccuucugcc

SEQ ID NO: 477289 - RNA, 19 nt, Human
agggcugggcccuucugcc

SEQ ID NO: 477290 - RNA, 19 nt, Human
aguaguuugaagaaagccu

SEQ ID NO: 477291 - RNA, 18 nt, Human
aucuccuacccuucucuu

SEQ ID NO: 477292 - RNA, 18 nt, Human
aucuccuacccuucucuu

SEQ ID NO: 477293 - RNA, 22 nt, Human
auggaggacaagugggagccca

SEQ ID NO: 477294 - RNA, 22 nt, Human
auggaggacaagugggagccca

SEQ ID NO: 477295 - RNA, 24 nt, Human
auggaggugguccagcacacccag

SEQ ID NO: 477296 - RNA, 23 nt, Human
augguguuucuuguggauuuucu

SEQ ID NO: 477297 - RNA, 18 nt, Human
cacagagggaaaccuuuu

SEQ ID NO: 477298 - RNA, 18 nt, Human
cacagagggaaaccuuuu

SEQ ID NO: 477299 - RNA, 21 nt, Human
caccaccauccugaccaucug

SEQ ID NO: 477300 - RNA, 21 nt, Human
caccaccauccugaccaucug

SEQ ID NO: 477301 - RNA, 19 nt, Human
cacccagcaccccauagca

SEQ ID NO: 477302 - RNA, 18 nt, Human
caccugucaccaccaucc

SEQ ID NO: 477303 - RNA, 18 nt, Human
caccugucaccaccaucc

SEQ ID NO: 477304 - RNA, 19 nt, Human
cagaaggaaaagaguaagg

SEQ ID NO: 477305 - RNA, 20 nt, Human
cagaaggaaaagaguaaggu

SEQ ID NO: 477306 - RNA, 18 nt, Human
cagcagcugagaacuuac

SEQ ID NO: 477307 - RNA, 18 nt, Human
cagcagcugagaacuuac

SEQ ID NO: 477308 - RNA, 19 nt, Human
cagcaucagaauccccugg

SEQ ID NO: 477309 - RNA, 19 nt, Human
cagcaucagaauccccugg

SEQ ID NO: 477310 - RNA, 20 nt, Human
cagccuccagucccccuccu

SEQ ID NO: 477311 - RNA, 18 nt, Human
caggaagggaagguggua

SEQ ID NO: 477312 - RNA, 20 nt, Human
cauccugcccaggccacaaa

SEQ ID NO: 477313 - RNA, 20 nt, Human
cauccugcccaggccacaaa

SEQ ID NO: 477314 - RNA, 23 nt, Human
caugcuggaggcuuccgugcaga

SEQ ID NO: 477315 - RNA, 20 nt, Human
cauuucauuugugccagccu

SEQ ID NO: 477316 - RNA, 19 nt, Human
ccacaggguuccuggccau

SEQ ID NO: 477317 - RNA, 19 nt, Human
ccacaggguuccuggccau

SEQ ID NO: 477318 - RNA, 21 nt, Human
ccacucacucagaguguuugg

SEQ ID NO: 477319 - RNA, 21 nt, Human
ccacucacucagaguguuugg

SEQ ID NO: 477320 - RNA, 18 nt, Human
ccagaguaaaaacggggc

SEQ ID NO: 477321 - RNA, 23 nt, Human
cccaagcugcugugguuuugccu

SEQ ID NO: 477322 - RNA, 19 nt, Human
cccacaccugucaccacca

SEQ ID NO: 477323 - RNA, 19 nt, Human
cccacaccugucaccacca

SEQ ID NO: 477324 - RNA, 19 nt, Human
cccauggcugagggacagc

SEQ ID NO: 477325 - RNA, 18 nt, Human
cccccaguuggaggagga

SEQ ID NO: 477326 - RNA, 18 nt, Human
cccccaguuggaggagga

SEQ ID NO: 477327 - RNA, 21 nt, Human
cccccaguuggaggaggaccc

SEQ ID NO: 477328 - RNA, 21 nt, Human
cccccaguuggaggaggaccc

SEQ ID NO: 477329 - RNA, 18 nt, Human
ccuccagucccccuccuu

SEQ ID NO: 477330 - RNA, 18 nt, Human
ccuccagucccccuccuu

SEQ ID NO: 477331 - RNA, 21 nt, Human
ccuccuagggagggagccagg

SEQ ID NO: 477332 - RNA, 21 nt, Human
ccuccuagggagggagccagg

SEQ ID NO: 477333 - RNA, 21 nt, Human
ccucuggucccagaaggagcu

SEQ ID NO: 477334 - RNA, 21 nt, Human
ccucuggucccagaaggagcu

SEQ ID NO: 477335 - RNA, 20 nt, Human
ccugcuaucagaagcuuaag

SEQ ID NO: 477336 - RNA, 20 nt, Human
ccugcuaucagaagcuuaag

SEQ ID NO: 477337 - RNA, 21 nt, Human
ccugguaaaugcucagcuggc

SEQ ID NO: 477338 - RNA, 21 nt, Human
ccugguaagugcucagcuggc

SEQ ID NO: 477339 - RNA, 22 nt, Human
ccuuuuguccuucuaggccccu

SEQ ID NO: 477340 - RNA, 22 nt, Human
ccuuuuguccuucuaggccccu

SEQ ID NO: 477341 - RNA, 23 nt, Human
cggggagaaagagggcucuaacc

SEQ ID NO: 477342 - RNA, 23 nt, Human
cggggagaaagagggcucuaacc

SEQ ID NO: 477343 - RNA, 24 nt, Human
cuaaagagaauguccagagcuuau

SEQ ID NO: 477344 - RNA, 22 nt, Human
cuaaguucucuucccuuucagc

SEQ ID NO: 477345 - RNA, 20 nt, Human
cuauauuuuaaacaagcauc

SEQ ID NO: 477346 - RNA, 20 nt, Human
cuauauuuuaaacaagcauc

SEQ ID NO: 477347 - RNA, 19 nt, Human
cucacacauuucucagccc

SEQ ID NO: 477348 - RNA, 19 nt, Human
cucacacauuucucagccc

SEQ ID NO: 477349 - RNA, 19 nt, Human
cucacauguaaacugagau

SEQ ID NO: 477350 - RNA, 18 nt, Human
cuccugauccuauugagg

SEQ ID NO: 477351 - RNA, 24 nt, Human
cucgcuggagccaggcagccucca

SEQ ID NO: 477352 - RNA, 24 nt, Human
cucgcuggagccaggcagccucca

SEQ ID NO: 477353 - RNA, 19 nt, Human
cucugcugcaggcuaaccu

SEQ ID NO: 477354 - RNA, 21 nt, Human
cugaaaguuggaaaaggcaca

SEQ ID NO: 477355 - RNA, 21 nt, Human
cugaaaguuggaaaaggcaca

SEQ ID NO: 477356 - RNA, 19 nt, Human
cugcugcaggcuaaccuug

SEQ ID NO: 477357 - RNA, 18 nt, Human
cugcugcggcucugcugc

SEQ ID NO: 477358 - RNA, 18 nt, Human
cugggcccuucugccaag

SEQ ID NO: 477359 - RNA, 18 nt, Human
cugggcccuucugccaag

SEQ ID NO: 477360 - RNA, 18 nt, Human
cugggcccuucugccaag

SEQ ID NO: 477361 - RNA, 19 nt, Human
cugggcccuucugccaagg

SEQ ID NO: 477362 - RNA, 19 nt, Human
cugggcccuucugccaagg

SEQ ID NO: 477363 - RNA, 19 nt, Human
gaagaggugaugagugcag

SEQ ID NO: 477364 - RNA, 25 nt, Human
gacccaauuucagaaggaaaagagu

SEQ ID NO: 477365 - RNA, 25 nt, Human
gacccaauuucagaaggaaaagagu

SEQ ID NO: 477366 - RNA, 20 nt, Human
gagaugguggugaugaugag

SEQ ID NO: 477367 - RNA, 20 nt, Human
gagaugguggugaugaugag

SEQ ID NO: 477368 - RNA, 21 nt, Human
gagggcucuaaccuuuggucc

SEQ ID NO: 477369 - RNA, 21 nt, Human
gagggcucuaaccuuuggucc

SEQ ID NO: 477370 - RNA, 20 nt, Human
gaguaaaaacggggccuuua

SEQ ID NO: 477371 - RNA, 19 nt, Human
gaugaugagggccaaggaa

SEQ ID NO: 477372 - RNA, 21 nt, Human
gcaucagaauccccuggaaca

SEQ ID NO: 477373 - RNA, 21 nt, Human
gcaucagaauccccuggaaca

SEQ ID NO: 477374 - RNA, 20 nt, Human
gccuagggacccauuguggg

SEQ ID NO: 477375 - RNA, 20 nt, Human
gccuagggacccauuguggg

SEQ ID NO: 477376 - RNA, 21 nt, Human
gcuccuggauuucuuuuucuc

SEQ ID NO: 477377 - RNA, 21 nt, Human
gcuccuggauuucuuuuucuc

SEQ ID NO: 477378 - RNA, 18 nt, Human
ggaaaccuuuuguuugcg

SEQ ID NO: 477379 - RNA, 18 nt, Human
ggaaaccuuuuguuugcg

SEQ ID NO: 477380 - RNA, 23 nt, Human
ggaaggugguagccacaguggga

SEQ ID NO: 477381 - RNA, 23 nt, Human
ggaaggugguagccacaguggga

SEQ ID NO: 477382 - RNA, 18 nt, Human
ggagaaagagggcucuaa

SEQ ID NO: 477383 - RNA, 18 nt, Human
ggagaaagagggcucuaa

SEQ ID NO: 477384 - RNA, 23 nt, Human
ggaguccauuuugauaguccugc

SEQ ID NO: 477385 - RNA, 23 nt, Human
ggaguccauuuugauaguccugc

SEQ ID NO: 477386 - RNA, 18 nt, Human
ggcaggaaggggcaaagu

SEQ ID NO: 477387 - RNA, 18 nt, Human
ggcaggaaggggcaaagu

SEQ ID NO: 477388 - RNA, 18 nt, Human
ggccagagacagacaggc

SEQ ID NO: 477389 - RNA, 18 nt, Human
ggccagagacagacaggc

SEQ ID NO: 477390 - RNA, 24 nt, Human
ggcccugcucccccagauaccuua

SEQ ID NO: 477391 - RNA, 19 nt, Human
ggcucuggccugagucggg

SEQ ID NO: 477392 - RNA, 19 nt, Human
ggcucuggccugagucggg

SEQ ID NO: 477393 - RNA, 24 nt, Human
gggacccauuguggggagaagguc

SEQ ID NO: 477394 - RNA, 24 nt, Human
gggacccauuguggggagaagguc

SEQ ID NO: 477395 - RNA, 19 nt, Human
gggcguguggccgaaggag

SEQ ID NO: 477396 - RNA, 21 nt, Human
ggguaugugaaagccuuuugg

SEQ ID NO: 477397 - RNA, 21 nt, Human
ggguaugugaaagccuuuugg

SEQ ID NO: 477398 - RNA, 18 nt, Human
gguagucguggaauucag

SEQ ID NO: 477399 - RNA, 18 nt, Human
gguagucguggaauucag

SEQ ID NO: 477400 - RNA, 20 nt, Human
gguaugugaaagccuuuugg

SEQ ID NO: 477401 - RNA, 18 nt, Human
ggugaaggagccuggccu

SEQ ID NO: 477402 - RNA, 21 nt, Human
ggugauggaggacaaguggga

SEQ ID NO: 477403 - RNA, 22 nt, Human
gguggugaugaugagggccaag

SEQ ID NO: 477404 - RNA, 22 nt, Human
gguggugaugaugagggccaag

SEQ ID NO: 477405 - RNA, 19 nt, Human
guccagcacacccagcacc

SEQ ID NO: 477406 - RNA, 20 nt, Human
gucucggguguccccaaagg

SEQ ID NO: 477407 - RNA, 20 nt, Human
gucucggguguccccaaagg

SEQ ID NO: 477408 - RNA, 23 nt, Human
guggcuguugcugcugcggcucu

SEQ ID NO: 477409 - RNA, 22 nt, Human
guggugccaucauuagggcgug

SEQ ID NO: 477410 - RNA, 20 nt, Human
guguguguauguuugugugu

SEQ ID NO: 477411 - RNA, 20 nt, Human
guguguguauguuugugugu

SEQ ID NO: 477412 - RNA, 20 nt, Human
guguuaaaguuuggucugca

SEQ ID NO: 477413 - RNA, 18 nt, Human
guuaaaguuuggucugca

SEQ ID NO: 477414 - RNA, 18 nt, Human
uaaccugccugccaaaag

SEQ ID NO: 477415 - RNA, 18 nt, Human
uaaccugccugccaaaag

SEQ ID NO: 477416 - RNA, 24 nt, Human
uaagcuaacuccugauccuauuga

SEQ ID NO: 477417 - RNA, 23 nt, Human
uaaguucucuucccuuucagccc

SEQ ID NO: 477418 - RNA, 18 nt, Human
uaaugggcccacuaucac

SEQ ID NO: 477419 - RNA, 18 nt, Human
uaaugggcccacuaucac

SEQ ID NO: 477420 - RNA, 18 nt, Human
uaccagugccugcuauca

SEQ ID NO: 477421 - RNA, 19 nt, Human
uaccuuaguucagcauauu

SEQ ID NO: 477422 - RNA, 19 nt, Human
uaccuuaguucagcauauu

SEQ ID NO: 477423 - RNA, 18 nt, Human
uagaagagagaggacggc

SEQ ID NO: 477424 - RNA, 19 nt, Human
uagggcugggcccuucugc

SEQ ID NO: 477425 - RNA, 19 nt, Human
uagggcugggcccuucugc

SEQ ID NO: 477426 - RNA, 18 nt, Human
uagucguggaauucaggc

SEQ ID NO: 477427 - RNA, 22 nt, Human
uaucuggaguccuccuuugaaa

SEQ ID NO: 477428 - RNA, 24 nt, Human
uaucuguucuuucuccuuaucucc

SEQ ID NO: 477429 - RNA, 24 nt, Human
uaucuguucuuucuccuuaucucc

SEQ ID NO: 477430 - RNA, 21 nt, Human
ucaaagggcccagaguccaaa

SEQ ID NO: 477431 - RNA, 21 nt, Human
ucaaagggcccagaguccaaa

SEQ ID NO: 477432 - RNA, 20 nt, Human
ucaaaucuaaguucucuucc

SEQ ID NO: 477433 - RNA, 22 nt, Human
ucaccaccauccugaccaucug

SEQ ID NO: 477434 - RNA, 22 nt, Human
ucaccaccauccugaccaucug

SEQ ID NO: 477435 - RNA, 19 nt, Human
ucaccagcaucagaauccc

SEQ ID NO: 477436 - RNA, 19 nt, Human
ucaccagcaucagaauccc

SEQ ID NO: 477437 - RNA, 18 nt, Human
ucacuccauccucuuugg

SEQ ID NO: 477438 - RNA, 19 nt, Human
ucagucccauggagguggu

SEQ ID NO: 477439 - RNA, 19 nt, Human
uccacauaaggcuaaaggu

SEQ ID NO: 477440 - RNA, 19 nt, Human
uccacauaaggcuaaaggu

SEQ ID NO: 477441 - RNA, 20 nt, Human
ucccacccucuggucccaga

SEQ ID NO: 477442 - RNA, 20 nt, Human
ucccacccucuggucccaga

SEQ ID NO: 477443 - RNA, 21 nt, Human
ucccacccucuggucccagaa

SEQ ID NO: 477444 - RNA, 21 nt, Human
ucccacccucuggucccagaa

SEQ ID NO: 477445 - RNA, 20 nt, Human
ucccagugugguuauuuucc

SEQ ID NO: 477446 - RNA, 20 nt, Human
ucccagugugguuauuuucc

SEQ ID NO: 477447 - RNA, 21 nt, Human
ucccauggcugagggacagcc

SEQ ID NO: 477448 - RNA, 21 nt, Human
ucccgggggccacuccaaacc

SEQ ID NO: 477449 - RNA, 21 nt, Human
ucccgggggccacuccaaacc

SEQ ID NO: 477450 - RNA, 18 nt, Human
ucccucugaccagccucc

SEQ ID NO: 477451 - RNA, 18 nt, Human
ucccucugaccagccucc

SEQ ID NO: 477452 - RNA, 26 nt, Human
uccuugugauugccugccgguuccac

SEQ ID NO: 477453 - RNA, 20 nt, Human
ucggggagaaagagggcucu

SEQ ID NO: 477454 - RNA, 20 nt, Human
ucggggagaaagagggcucu

SEQ ID NO: 477455 - RNA, 18 nt, Human
ucucacuccauccucuuu

SEQ ID NO: 477456 - RNA, 22 nt, Human
ucucccccacagagggaaaccu

SEQ ID NO: 477457 - RNA, 22 nt, Human
ucucccccacagagggaaaccu

SEQ ID NO: 477458 - RNA, 20 nt, Human
ucuccuacccuucucuuuaa

SEQ ID NO: 477459 - RNA, 20 nt, Human
ucuccuacccuucucuuuaa

SEQ ID NO: 477460 - RNA, 18 nt, Human
ucucucacuccauccucu

SEQ ID NO: 477461 - RNA, 22 nt, Human
ucucucacuccauccucuuugg

SEQ ID NO: 477462 - RNA, 22 nt, Human
ucuguucuuucuccuuaucucc

SEQ ID NO: 477463 - RNA, 22 nt, Human
ucuguucuuucuccuuaucucc

SEQ ID NO: 477464 - RNA, 23 nt, Human
ucuguucuuucuccuuaucuccu

SEQ ID NO: 477465 - RNA, 23 nt, Human
ucuguucuuucuccuuaucuccu

SEQ ID NO: 477466 - RNA, 20 nt, Human
ucuucggggagaaagagggc

SEQ ID NO: 477467 - RNA, 20 nt, Human
ucuucggggagaaagagggc

SEQ ID NO: 477468 - RNA, 21 nt, Human
ucuuuggggagucugggaugc

SEQ ID NO: 477469 - RNA, 21 nt, Human
ugaaagccuuuuggggcagga

SEQ ID NO: 477470 - RNA, 21 nt, Human
ugaaagccuuuuggggcagga

SEQ ID NO: 477471 - RNA, 18 nt, Human
ugaaaguuggaaaaggca

SEQ ID NO: 477472 - RNA, 18 nt, Human
ugaaaguuggaaaaggca

SEQ ID NO: 477473 - RNA, 23 nt, Human
ugaccaucugcaucagaauaagc

SEQ ID NO: 477474 - RNA, 23 nt, Human
ugaccaucugcaucagaauaagc

SEQ ID NO: 477475 - RNA, 22 nt, Human
ugagaccuauaaugauuugcca

SEQ ID NO: 477476 - RNA, 22 nt, Human
ugagaccuauaaugauuugcca

SEQ ID NO: 477477 - RNA, 18 nt, Human
ugagaggaggccaggaug

SEQ ID NO: 477478 - RNA, 27 nt, Human
ugagcccuagacaggaugaggagccag

SEQ ID NO: 477479 - RNA, 24 nt, Human
ugagcgcaggccagcagcugagaa

SEQ ID NO: 477480 - RNA, 18 nt, Human
ugagggacaucaagggca

SEQ ID NO: 477481 - RNA, 18 nt, Human
ugagggccaaggaaaacc

SEQ ID NO: 477482 - RNA, 18 nt, Human
ugagggccaaggaaaacc

SEQ ID NO: 477483 - RNA, 21 nt, Human
ugagggccaaggaaaaccaca

SEQ ID NO: 477484 - RNA, 21 nt, Human
ugagggccaaggaaaaccaca

SEQ ID NO: 477485 - RNA, 24 nt, Human
ugagugcaggccagcagcugagaa

SEQ ID NO: 477486 - RNA, 25 nt, Human
ugauugccugcaggaguuuugaaau

SEQ ID NO: 477487 - RNA, 23 nt, Human
ugcaagaggagggaugauugaag

SEQ ID NO: 477488 - RNA, 21 nt, Human
ugcaccaggaacuguauucaa

SEQ ID NO: 477489 - RNA, 21 nt, Human
ugcaccaggaacuguauucaa

SEQ ID NO: 477490 - RNA, 23 nt, Human
ugcaccaggaacuguauucaagc

SEQ ID NO: 477491 - RNA, 23 nt, Human
ugcaccaggaacuguauucaagc

SEQ ID NO: 477492 - RNA, 22 nt, Human
ugccagggugucuuggcucugg

SEQ ID NO: 477493 - RNA, 22 nt, Human
ugccagggugucuuggcucugg

SEQ ID NO: 477494 - RNA, 19 nt, Human
ugccuagggacccauugug

SEQ ID NO: 477495 - RNA, 19 nt, Human
ugccuagggacccauugug

SEQ ID NO: 477496 - RNA, 21 nt, Human
ugcugugguuuugccuuugau

SEQ ID NO: 477497 - RNA, 24 nt, Human
uggaguggaauucaagagccuaua

SEQ ID NO: 477498 - RNA, 25 nt, Human
uggaguggaauucaagagccuauau

SEQ ID NO: 477499 - RNA, 21 nt, Human
uggcucuggccugagucgggu

SEQ ID NO: 477500 - RNA, 21 nt, Human
uggcucuggccugagucgggu

SEQ ID NO: 477501 - RNA, 19 nt, Human
uggcugagggacagccagg

SEQ ID NO: 477502 - RNA, 22 nt, Human
uggcugagggacagccaggaug

SEQ ID NO: 477503 - RNA, 18 nt, Human
ugggagaugguggugaug

SEQ ID NO: 477504 - RNA, 18 nt, Human
ugggagaugguggugaug

SEQ ID NO: 477505 - RNA, 18 nt, Human
ugggaugcucucagagag

SEQ ID NO: 477506 - RNA, 21 nt, Human
uggggaguugcuaccaaugca

SEQ ID NO: 477507 - RNA, 21 nt, Human
uggggaguugcuaccaaugca

SEQ ID NO: 477508 - RNA, 24 nt, Human
uggggcaggaaggggcaaagugau

SEQ ID NO: 477509 - RNA, 24 nt, Human
uggggcaggaaggggcaaagugau

SEQ ID NO: 477510 - RNA, 24 nt, Human
uggguaaaagggcuuuucacaguu

SEQ ID NO: 477511 - RNA, 24 nt, Human
uggguaaaagggcuuuucacaguu

SEQ ID NO: 477512 - RNA, 21 nt, Human
ugguaccagaggcaaacuucc

SEQ ID NO: 477513 - RNA, 19 nt, Human
uggucugcaccucguuggu

SEQ ID NO: 477514 - RNA, 19 nt, Human
uggucugcaccucguuggu

SEQ ID NO: 477515 - RNA, 25 nt, Human
ugguguguguauguuugugugugug

SEQ ID NO: 477516 - RNA, 25 nt, Human
ugguguguguauguuugugugugug

SEQ ID NO: 477517 - RNA, 19 nt, Human
uguacuuuucuaaagagaa

SEQ ID NO: 477518 - RNA, 19 nt, Human
uguacuuuucuaaagagaa

SEQ ID NO: 477519 - RNA, 18 nt, Human
ugugauugccugcaggag

SEQ ID NO: 477520 - RNA, 18 nt, Human
ugugauugccugcaggag

SEQ ID NO: 477521 - RNA, 18 nt, Human
uguggaaggccagggaga

SEQ ID NO: 477522 - RNA, 18 nt, Human
uguggaaggccagggaga

SEQ ID NO: 477523 - RNA, 23 nt, Human
ugugguuauuuucccagccauca

SEQ ID NO: 477524 - RNA, 23 nt, Human
ugugguuauuuucccagccauca

SEQ ID NO: 477525 - RNA, 18 nt, Human
uguguauguuugugugug

SEQ ID NO: 477526 - RNA, 18 nt, Human
uguguauguuugugugug

SEQ ID NO: 477527 - RNA, 21 nt, Human
uguguauguuugugugugugu

SEQ ID NO: 477528 - RNA, 21 nt, Human
uguguauguuugugugugugu

SEQ ID NO: 477529 - RNA, 21 nt, Human
uguguguauguuugugugugu

SEQ ID NO: 477530 - RNA, 21 nt, Human
uguguguauguuugugugugu

SEQ ID NO: 477531 - RNA, 22 nt, Human
uguguguauguuugugugugug

SEQ ID NO: 477532 - RNA, 19 nt, Human
uguguguguguugggugaa

SEQ ID NO: 477533 - RNA, 19 nt, Human
uguguguguguugggugaa

SEQ ID NO: 477534 - RNA, 23 nt, Human
uguucuugggaaccacaggguuu

SEQ ID NO: 477535 - RNA, 23 nt, Human
uguucuugggaaccacaggguuu

SEQ ID NO: 477536 - RNA, 21 nt, Human
uguuuguguguguguugggug

SEQ ID NO: 477537 - RNA, 21 nt, Human
uguuuguguguguguugggug

SEQ ID NO: 477538 - RNA, 19 nt, Human
uuaggggucucgggugucc

SEQ ID NO: 477539 - RNA, 19 nt, Human
uuaggggucucgggugucc

SEQ ID NO: 477540 - RNA, 24 nt, Human
uuagucccaaggugguaccagagg

SEQ ID NO: 477541 - RNA, 25 nt, Human
uucacaguuucccagcaguugguuu

SEQ ID NO: 477542 - RNA, 22 nt, Human
uugaaaaagucuggggcuuuca

SEQ ID NO: 477543 - RNA, 22 nt, Human
uugaaaaagucuggggcuuuca

SEQ ID NO: 477544 - RNA, 18 nt, Human
uugcggugggccagaguu

SEQ ID NO: 477545 - RNA, 22 nt, Human
uugcucugccauguuuuuccga

SEQ ID NO: 477546 - RNA, 22 nt, Human
uugcucugccauguuuuuccga

SEQ ID NO: 477547 - RNA, 22 nt, Human
uugcugcugcggcucugcugca

SEQ ID NO: 477548 - RNA, 20 nt, Human
uuggaguggaauucaagaga

SEQ ID NO: 477549 - RNA, 20 nt, Human
uuggaguggaauucaagaga

SEQ ID NO: 477550 - RNA, 23 nt, Human
uugguguguguauguuugugugu

SEQ ID NO: 477551 - RNA, 23 nt, Human
uugguguguguauguuugugugu

SEQ ID NO: 477552 - RNA, 26 nt, Human
uugguguguguauguuugugugugug

SEQ ID NO: 477553 - RNA, 26 nt, Human
uugguguguguauguuugugugugug

SEQ ID NO: 477554 - RNA, 24 nt, Human
uuucccagcaguugguuuuugguu

SEQ ID NO: 477555 - RNA, 24 nt, Human
uuucccagcaguugguuuuugguu

SEQ ID NO: 477556 - RNA, 26 nt, Human
uuucccagccaucagaccucuucccc

SEQ ID NO: 477557 - RNA, 26 nt, Human
uuucccagccaucagaccucuucccc

SEQ ID NO: 477558 - RNA, 20 nt, Human
uuucucagcccuccuacccc

SEQ ID NO: 477559 - RNA, 20 nt, Human
uuucucagcccuccuacccc

SEQ ID NO: 477560 - RNA, 19 nt, Human
uuucuuuuucucccccaca

SEQ ID NO: 477561 - RNA, 19 nt, Human
uuucuuuuucucccccaca

SEQ ID NO: 477562 - RNA, 23 nt, Human
uuuucacaguuucccagcaguug

SEQ ID NO: 477563 - RNA, 23 nt, Human
uuuucacaguuucccagcaguug

SEQ ID NO: 477564 - RNA, 22 nt, Human
uuuuugguuuccacauaaggcu

SEQ ID NO: 477565 - RNA, 24 nt, Human
uuuuuuuuucaugaagaccaguuu

SEQ ID NO: 477566 - RNA, 27 nt, Human
aaaaaaaaaaagauaacccccugaagg

SEQ ID NO: 477567 - RNA, 22 nt, Human
aaaaagcaccagaaaaaaaagu

SEQ ID NO: 477568 - RNA, 21 nt, Human
aaaagccaugcaaagccaaag

SEQ ID NO: 477569 - RNA, 18 nt, Human
aaaagcuugcauuuccaa

SEQ ID NO: 477570 - RNA, 25 nt, Human
aaacaguaacucaggaaacaguaac

SEQ ID NO: 477571 - RNA, 19 nt, Human
aaaccagucagaccacuga

SEQ ID NO: 477572 - RNA, 21 nt, Human
aaagccaugcaaagccaaagg

SEQ ID NO: 477573 - RNA, 24 nt, Human
aaaugaaaccagucagaccacuga

SEQ ID NO: 477574 - RNA, 21 nt, Human
aacacacaaaucugagcacca

SEQ ID NO: 477575 - RNA, 19 nt, Human
aacacaguugcguaugugc

SEQ ID NO: 477576 - RNA, 18 nt, Human
aacaguaacugaaguccc

SEQ ID NO: 477577 - RNA, 24 nt, Human
aacaucacuuacgcucccuugaga

SEQ ID NO: 477578 - RNA, 19 nt, Human
aaggaaaaaaagauaugcu

SEQ ID NO: 477579 - RNA, 24 nt, Human
aaugaagugccagacacagcaaug

SEQ ID NO: 477580 - RNA, 24 nt, Human
acaaaaugagauucucugagugcc

SEQ ID NO: 477581 - RNA, 18 nt, Human
acacaaaucugagcacca

SEQ ID NO: 477582 - RNA, 24 nt, Human
acaguaccugaagaaaagccaugc

SEQ ID NO: 477583 - RNA, 21 nt, Human
accacuacacauccuguaaac

SEQ ID NO: 477584 - RNA, 22 nt, Human
accagcuacccucacugagcaa

SEQ ID NO: 477585 - RNA, 30 nt, Human
agaaacaaaaaguugguaauaacaaaaagg

SEQ ID NO: 477586 - RNA, 19 nt, Human
agcccuuguuaagaacaga

SEQ ID NO: 477587 - RNA, 22 nt, Human
aggaaaaaaagauaugcuaaga

SEQ ID NO: 477588 - RNA, 18 nt, Human
agggccuacuuacucucc

SEQ ID NO: 477589 - RNA, 24 nt, Human
agguacaugugaaaaugcaguggu

SEQ ID NO: 477590 - RNA, 22 nt, Human
agguuuucccucaccccccacc

SEQ ID NO: 477591 - RNA, 20 nt, Human
aguaaugagaaacaaaaagu

SEQ ID NO: 477592 - RNA, 19 nt, Human
agucaaagugagacaguca

SEQ ID NO: 477593 - RNA, 21 nt, Human
aguuaagaaaaccaugcauga

SEQ ID NO: 477594 - RNA, 24 nt, Human
aucuucauccgggagcugugugac

SEQ ID NO: 477595 - RNA, 22 nt, Human
auggaacaucacuuacgcuccc

SEQ ID NO: 477596 - RNA, 20 nt, Human
caaaaaguugguaauaacaa

SEQ ID NO: 477597 - RNA, 23 nt, Human
caaagugagacagucaucaaucc

SEQ ID NO: 477598 - RNA, 19 nt, Human
caauccaaaaaagcaccag

SEQ ID NO: 477599 - RNA, 23 nt, Human
caccagaaaaaaaaguuaacacu

SEQ ID NO: 477600 - RNA, 23 nt, Human
cacuaccagguuuucccucaccc

SEQ ID NO: 477601 - RNA, 21 nt, Human
caugcaaaacauggguauagu

SEQ ID NO: 477602 - RNA, 18 nt, Human
cauggcuauuuucucaca

SEQ ID NO: 477603 - RNA, 21 nt, Human
caugugguauaaaaaauaaaa

SEQ ID NO: 477604 - RNA, 19 nt, Human
cauugcacacacgggugaa

SEQ ID NO: 477605 - RNA, 24 nt, Human
ccagaaaaaaaaguuaacacuuag

SEQ ID NO: 477606 - RNA, 25 nt, Human
ccagacacagcaaugccauuauacu

SEQ ID NO: 477607 - RNA, 23 nt, Human
ccccagaaaaaggcauugcacac

SEQ ID NO: 477608 - RNA, 18 nt, Human
cccccaccccccagaaaa

SEQ ID NO: 477609 - RNA, 22 nt, Human
ccccccagaaaaaggcauugca

SEQ ID NO: 477610 - RNA, 25 nt, Human
cccgcggcgacggcaagagggcgag

SEQ ID NO: 477611 - RNA, 21 nt, Human
cccguucccuggccgcggccg

SEQ ID NO: 477612 - RNA, 21 nt, Human
cccucaccccccaccccccag

SEQ ID NO: 477613 - RNA, 23 nt, Human
ccgggagcugugugaccagcgaa

SEQ ID NO: 477614 - RNA, 21 nt, Human
ccucaccccccaccccccaga

SEQ ID NO: 477615 - RNA, 21 nt, Human
ccuguaaacagcugcuuuaaa

SEQ ID NO: 477616 - RNA, 19 nt, Human
cgaccccccggauaccccc

SEQ ID NO: 477617 - RNA, 24 nt, Human
cggggccagcccgguaagcgaccc

SEQ ID NO: 477618 - RNA, 26 nt, Human
cgguaagcgaccccccggauaccccc

SEQ ID NO: 477619 - RNA, 19 nt, Human
cuacacauucacuaccagg

SEQ ID NO: 477620 - RNA, 23 nt, Human
cuaccaacuguuaucuucauccg

SEQ ID NO: 477621 - RNA, 20 nt, Human
cucaccccccaccccccaga

SEQ ID NO: 477622 - RNA, 20 nt, Human
cuggccgcggccgcuucucc

SEQ ID NO: 477623 - RNA, 22 nt, Human
cuguuaauucuaaaaugaaacc

SEQ ID NO: 477624 - RNA, 19 nt, Human
gaacagggggagagagugg

SEQ ID NO: 477625 - RNA, 21 nt, Human
gacgcggaacagggggagaga

SEQ ID NO: 477626 - RNA, 18 nt, Human
gagcaccaucagaguucc

SEQ ID NO: 477627 - RNA, 19 nt, Human
gaggggaaaaaaaaaaaga

SEQ ID NO: 477628 - RNA, 19 nt, Human
gcacaaaugaagucaccau

SEQ ID NO: 477629 - RNA, 21 nt, Human
gccagcccgguaagcgacccc

SEQ ID NO: 477630 - RNA, 19 nt, Human
gcggcgacggcaagagggc

SEQ ID NO: 477631 - RNA, 27 nt, Human
ggaaaaaaagauaugcuaagaguauau

SEQ ID NO: 477632 - RNA, 23 nt, Human
ggaaaacagagaacacaguugcg

SEQ ID NO: 477633 - RNA, 18 nt, Human
ggcaccacaaccaaguac

SEQ ID NO: 477634 - RNA, 19 nt, Human
gggagagaguggcgacaga

SEQ ID NO: 477635 - RNA, 25 nt, Human
gggcaggauuuagugcuuuucuuua

SEQ ID NO: 477636 - RNA, 25 nt, Human
uaaaaaauaaaacauucauauaaga

SEQ ID NO: 477637 - RNA, 24 nt, Human
uaaaaugaaaccagucagaccacu

SEQ ID NO: 477638 - RNA, 21 nt, Human
uaagaaaaaggcaacagaaga

SEQ ID NO: 477639 - RNA, 23 nt, Human
uaagcgaccccccggauaccccc

SEQ ID NO: 477640 - RNA, 21 nt, Human
uaaucguuggaaccgcgaugc

SEQ ID NO: 477641 - RNA, 22 nt, Human
uacacagugcacauaaaauuag

SEQ ID NO: 477642 - RNA, 23 nt, Human
uaccagguuuucccucacccccc

SEQ ID NO: 477643 - RNA, 20 nt, Human
uacugcucaacuaugacaca

SEQ ID NO: 477644 - RNA, 19 nt, Human
uauacaguuuuuauuugua

SEQ ID NO: 477645 - RNA, 20 nt, Human
uaucuggagguggguugggg

SEQ ID NO: 477646 - RNA, 23 nt, Human
uaugaagauuuuccuccaauuuu

SEQ ID NO: 477647 - RNA, 20 nt, Human
uauggacauuuuugcaugug

SEQ ID NO: 477648 - RNA, 18 nt, Human
ucaauccaaaaaagcacc

SEQ ID NO: 477649 - RNA, 22 nt, Human
ucaauccaaaaaagcaccagaa

SEQ ID NO: 477650 - RNA, 21 nt, Human
ucacaccauugccagcggaua

SEQ ID NO: 477651 - RNA, 21 nt, Human
ucagaguuccuacauacugac

SEQ ID NO: 477652 - RNA, 18 nt, Human
uccaaaguucuugaaguu

SEQ ID NO: 477653 - RNA, 23 nt, Human
ucccucaccccccaccccccaga

SEQ ID NO: 477654 - RNA, 23 nt, Human
ucccucaccccccaccccccaga

SEQ ID NO: 477655 - RNA, 30 nt, Human
uccgcggccgagaagccucuuccuggggcc

SEQ ID NO: 477656 - RNA, 20 nt, Human
ucuaccagcuacugcucaac

SEQ ID NO: 477657 - RNA, 24 nt, Human
ucuguaguacaaaacaaugaagua

SEQ ID NO: 477658 - RNA, 18 nt, Human
ucugugguuaauauggaa

SEQ ID NO: 477659 - RNA, 20 nt, Human
ucugugugugauguguggug

SEQ ID NO: 477660 - RNA, 23 nt, Human
ucugugugugauguguggugugu

SEQ ID NO: 477661 - RNA, 23 nt, Human
ugaacacacaaaucugagcacca

SEQ ID NO: 477662 - RNA, 24 nt, Human
ugaagaaaagccaugcaaagccaa

SEQ ID NO: 477663 - RNA, 20 nt, Human
ugaccaaaggguggucccuu

SEQ ID NO: 477664 - RNA, 22 nt, Human
ugacuuauaaaaauaugguacu

SEQ ID NO: 477665 - RNA, 19 nt, Human
ugagaaacaaaaaguuggu

SEQ ID NO: 477666 - RNA, 25 nt, Human
ugagugccugacaaaacgaauuuaa

SEQ ID NO: 477667 - RNA, 19 nt, Human
ugauccagacaaaucacac

SEQ ID NO: 477668 - RNA, 18 nt, Human
ugauuuugguuuucuagg

SEQ ID NO: 477669 - RNA, 25 nt, Human
ugcaaagccaaaggaaaaaaagaua

SEQ ID NO: 477670 - RNA, 19 nt, Human
ugcacauaaaauuagaugu

SEQ ID NO: 477671 - RNA, 20 nt, Human
uggagaggacagucuguggu

SEQ ID NO: 477672 - RNA, 18 nt, Human
uggagguggguuggggaa

SEQ ID NO: 477673 - RNA, 18 nt, Human
uggcaccacaaccaagua

SEQ ID NO: 477674 - RNA, 20 nt, Human
uggcagaagaucagccugua

SEQ ID NO: 477675 - RNA, 22 nt, Human
uggcuucugcaccagcuacccu

SEQ ID NO: 477676 - RNA, 23 nt, Human
uggggcggccgcugacggggagg

SEQ ID NO: 477677 - RNA, 24 nt, Human
ugguggacauauauaucuauauau

SEQ ID NO: 477678 - RNA, 21 nt, Human
uguacuguuagcacaaaugaa

SEQ ID NO: 477679 - RNA, 21 nt, Human
ugucuuuucuuucaguacuua

SEQ ID NO: 477680 - RNA, 21 nt, Human
ugugugugauguguggugugu

SEQ ID NO: 477681 - RNA, 18 nt, Human
uuaagccugacccaaauc

SEQ ID NO: 477682 - RNA, 21 nt, Human
uuagcuaguuaagaaaaccau

SEQ ID NO: 477683 - RNA, 21 nt, Human
uuaugaauaaccuaguuguau

SEQ ID NO: 477684 - RNA, 21 nt, Human
uuauggcagaagaucagccug

SEQ ID NO: 477685 - RNA, 19 nt, Human
uucaguaaugagaaacaaa

SEQ ID NO: 477686 - RNA, 22 nt, Human
uuccuacauacugacauggcua

SEQ ID NO: 477687 - RNA, 20 nt, Human
uugcauuuccaaaguucuug

SEQ ID NO: 477688 - RNA, 18 nt, Human
uuucccucaccccccacc

SEQ ID NO: 477689 - RNA, 23 nt, Human
uuuggauacacuccuaucuggag

SEQ ID NO: 477690 - RNA, 24 nt, Human
uuuugcagccagaaaucaaagcuu

SEQ ID NO: 477691 - RNA, 23 nt, Human
aaaaaaaggccagcucagaaaaa

SEQ ID NO: 477692 - RNA, 20 nt, Human
aaaaaauauggugacacccc

SEQ ID NO: 477693 - RNA, 23 nt, Human
aaaaaauauggugacacccccca

SEQ ID NO: 477694 - RNA, 20 nt, Human
aaaaaggccagcucagaaaa

SEQ ID NO: 477695 - RNA, 20 nt, Human
aaaacagcuaaaguggaggg

SEQ ID NO: 477696 - RNA, 21 nt, Human
aaaagaggcagguggaauaua

SEQ ID NO: 477697 - RNA, 20 nt, Human
aaaaugaaauccuuugcaga

SEQ ID NO: 477698 - RNA, 24 nt, Human
aaaaugaaccaauucuugaaaagu

SEQ ID NO: 477699 - RNA, 25 nt, Human
aaacaaaaaaguaaauucaauccaa

SEQ ID NO: 477700 - RNA, 19 nt, Human
aaacucccaacugcuucuc

SEQ ID NO: 477701 - RNA, 24 nt, Human
aaauccuuugcagagucggugaug

SEQ ID NO: 477702 - RNA, 21 nt, Human
aacacaccuuuccacaaguac

SEQ ID NO: 477703 - RNA, 21 nt, Human
aacacccugcuguaccccaaa

SEQ ID NO: 477704 - RNA, 20 nt, Human
aagcaaaggggcuagugaaa

SEQ ID NO: 477705 - RNA, 24 nt, Human
aagcaagaugacaguucugacuag

SEQ ID NO: 477706 - RNA, 18 nt, Human
aaugacaaccaaacuccc

SEQ ID NO: 477707 - RNA, 24 nt, Human
acacagccacagaggcagaaccuc

SEQ ID NO: 477708 - RNA, 19 nt, Human
accacacuacacacacagc

SEQ ID NO: 477709 - RNA, 24 nt, Human
acccugcuguaccccaaaaugaaa

SEQ ID NO: 477710 - RNA, 23 nt, Human
acccugcuguaccccaaaaugag

SEQ ID NO: 477711 - RNA, 21 nt, Human
accuacuggccaaccacacua

SEQ ID NO: 477712 - RNA, 21 nt, Human
accucauguuuaacacacaca

SEQ ID NO: 477713 - RNA, 19 nt, Human
acugccucacuucuucagc

SEQ ID NO: 477714 - RNA, 24 nt, Human
acuggccaaccacacuacacacac

SEQ ID NO: 477715 - RNA, 21 nt, Human
agaaccucauguuuaacacac

SEQ ID NO: 477716 - RNA, 21 nt, Human
agaccccuuccuucccugccc

SEQ ID NO: 477717 - RNA, 21 nt, Human
agagagcccugggaugaggau

SEQ ID NO: 477718 - RNA, 20 nt, Human
agagccccucaacccugcuu

SEQ ID NO: 477719 - RNA, 19 nt, Human
agaugggcaacuccugggc

SEQ ID NO: 477720 - RNA, 19 nt, Human
agcacagggacuuuggcag

SEQ ID NO: 477721 - RNA, 18 nt, Human
agccaaucuacagcagag

SEQ ID NO: 477722 - RNA, 22 nt, Human
agccacaugcccuggaggugug

SEQ ID NO: 477723 - RNA, 18 nt, Human
agccaccuccucucugga

SEQ ID NO: 477724 - RNA, 18 nt, Human
agccuagugguaacuagc

SEQ ID NO: 477725 - RNA, 18 nt, Human
aggaagaaaacacaaaga

SEQ ID NO: 477726 - RNA, 26 nt, Human
aggaggaaaagaaauuggcaccaggg

SEQ ID NO: 477727 - RNA, 22 nt, Human
aggaggcugacucaacccccca

SEQ ID NO: 477728 - RNA, 20 nt, Human
aggcagguggaauauagccu

SEQ ID NO: 477729 - RNA, 21 nt, Human
aggcagguggaauauagccug

SEQ ID NO: 477730 - RNA, 23 nt, Human
aggcagguggaauauagccuggu

SEQ ID NO: 477731 - RNA, 21 nt, Human
agggaggagccucugagggcc

SEQ ID NO: 477732 - RNA, 21 nt, Human
agggcagagggugaggggaaa

SEQ ID NO: 477733 - RNA, 25 nt, Human
aggggaaaagggucccaucagcaga

SEQ ID NO: 477734 - RNA, 19 nt, Human
auaaaacaaaguuuacgaa

SEQ ID NO: 477735 - RNA, 24 nt, Human
auaaaacuuuauuuuuucaaacac

SEQ ID NO: 477736 - RNA, 24 nt, Human
auggucucucaggcccaauuagag

SEQ ID NO: 477737 - RNA, 27 nt, Human
auggugcccuggggcuuuuggucaacc

SEQ ID NO: 477738 - RNA, 21 nt, Human
auugacccagugucagccaca

SEQ ID NO: 477739 - RNA, 21 nt, Human
auugguuuccugcagucaccu

SEQ ID NO: 477740 - RNA, 23 nt, Human
caaacacagccacagaggcagaa

SEQ ID NO: 477741 - RNA, 21 nt, Human
caaaugauggaugucuucccu

SEQ ID NO: 477742 - RNA, 21 nt, Human
caacagcagugcuggggugag

SEQ ID NO: 477743 - RNA, 21 nt, Human
caaccaaacucccaacugcuu

SEQ ID NO: 477744 - RNA, 24 nt, Human
caacuccugggcucacaguuuccc

SEQ ID NO: 477745 - RNA, 25 nt, Human
caacucuacucaagagggcaaaaga

SEQ ID NO: 477746 - RNA, 22 nt, Human
caagcaaacuauuaaaugcuaa

SEQ ID NO: 477747 - RNA, 19 nt, Human
cacaagcuauugugguggc

SEQ ID NO: 477748 - RNA, 18 nt, Human
cacaaguacacucccaug

SEQ ID NO: 477749 - RNA, 19 nt, Human
cacagcacuuaaaacaccc

SEQ ID NO: 477750 - RNA, 18 nt, Human
caccccuucuucccucuc

SEQ ID NO: 477751 - RNA, 23 nt, Human
caccccuucuucccucucaagga

SEQ ID NO: 477752 - RNA, 19 nt, Human
caccuuuccacaaguacac

SEQ ID NO: 477753 - RNA, 21 nt, Human
cacuuggaccagcuguccugg

SEQ ID NO: 477754 - RNA, 23 nt, Human
cagacugaaaguaauggaauuaa

SEQ ID NO: 477755 - RNA, 20 nt, Human
cagcagugcuggggugagcu

SEQ ID NO: 477756 - RNA, 19 nt, Human
cagccaaucuacagcagag

SEQ ID NO: 477757 - RNA, 23 nt, Human
cagucaccuucccaacagcagug

SEQ ID NO: 477758 - RNA, 25 nt, Human
ccagaaaaugucagguucaauucca

SEQ ID NO: 477759 - RNA, 19 nt, Human
ccagugucagccacaugcc

SEQ ID NO: 477760 - RNA, 21 nt, Human
cccacccuggccaaauucuaa

SEQ ID NO: 477761 - RNA, 22 nt, Human
cccaugcacgcacacacucuca

SEQ ID NO: 477762 - RNA, 26 nt, Human
cccaugcacgcacacacucucacggu

SEQ ID NO: 477763 - RNA, 22 nt, Human
ccccaaccucccuauggucucu

SEQ ID NO: 477764 - RNA, 22 nt, Human
ccccaggauuugacuugcacac

SEQ ID NO: 477765 - RNA, 19 nt, Human
ccccauucccaggcucggc

SEQ ID NO: 477766 - RNA, 26 nt, Human
ccccauucccaggcucggcccccagc

SEQ ID NO: 477767 - RNA, 18 nt, Human
ccccccaccugcauuccc

SEQ ID NO: 477768 - RNA, 22 nt, Human
ccccccaccugcauuccccaau

SEQ ID NO: 477769 - RNA, 21 nt, Human
ccccuagagaccugguagccu

SEQ ID NO: 477770 - RNA, 18 nt, Human
ccccuuccuucccugccc

SEQ ID NO: 477771 - RNA, 22 nt, Human
cccuagagaccugguagccuag

SEQ ID NO: 477772 - RNA, 20 nt, Human
cccuauggucucucaggccc

SEQ ID NO: 477773 - RNA, 25 nt, Human
ccucccgccaccagcuccguuuauc

SEQ ID NO: 477774 - RNA, 19 nt, Human
ccucugagggccagaggcu

SEQ ID NO: 477775 - RNA, 21 nt, Human
ccucuugacuccuugagcaaa

SEQ ID NO: 477776 - RNA, 24 nt, Human
ccugcuguaccccaaaaugaaauc

SEQ ID NO: 477777 - RNA, 19 nt, Human
cgcaaacacaccuuuccac

SEQ ID NO: 477778 - RNA, 26 nt, Human
cggagcccuccacucacccccauucc

SEQ ID NO: 477779 - RNA, 23 nt, Human
cucagaaaaaauauggugacacc

SEQ ID NO: 477780 - RNA, 27 nt, Human
cucggcccccagccuuggggacucgac

SEQ ID NO: 477781 - RNA, 23 nt, Human
cugcuguaccccaaaaugaaauc

SEQ ID NO: 477782 - RNA, 25 nt, Human
cuggccaaccacacuacacacacag

SEQ ID NO: 477783 - RNA, 21 nt, Human
cuuuccacaaguacacuccca

SEQ ID NO: 477784 - RNA, 19 nt, Human
cuuuggcagcaggugggag

SEQ ID NO: 477785 - RNA, 19 nt, Human
gaagcuggcacagccaauc

SEQ ID NO: 477786 - RNA, 21 nt, Human
gacaccccccaccugcauucc

SEQ ID NO: 477787 - RNA, 22 nt, Human
gacacuuguuaguagccaugag

SEQ ID NO: 477788 - RNA, 20 nt, Human
gacauagccaccuccucucu

SEQ ID NO: 477789 - RNA, 18 nt, Human
gaccugguagccuagugg

SEQ ID NO: 477790 - RNA, 20 nt, Human
gacucgacacuuguuaguag

SEQ ID NO: 477791 - RNA, 21 nt, Human
gacuuagaagggcagagggug

SEQ ID NO: 477792 - RNA, 18 nt, Human
gagagagagagauagagc

SEQ ID NO: 477793 - RNA, 19 nt, Human
gagcccuccacucaccccc

SEQ ID NO: 477794 - RNA, 22 nt, Human
gagugaagggcagcugagcugc

SEQ ID NO: 477795 - RNA, 21 nt, Human
gcaccagggaaauuauggccu

SEQ ID NO: 477796 - RNA, 23 nt, Human
gcuacgcaaacacaccuuuccac

SEQ ID NO: 477797 - RNA, 22 nt, Human
gcuccguuuaucuugucccggc

SEQ ID NO: 477798 - RNA, 21 nt, Human
gcuugggaaaauggauuauuc

SEQ ID NO: 477799 - RNA, 20 nt, Human
ggagaagagccaggggagga

SEQ ID NO: 477800 - RNA, 18 nt, Human
ggagcccuccacucaccc

SEQ ID NO: 477801 - RNA, 21 nt, Human
ggaggugugcuccacucuggg

SEQ ID NO: 477802 - RNA, 22 nt, Human
ggaugaggaugccccaggagga

SEQ ID NO: 477803 - RNA, 23 nt, Human
ggcagcaggugggagugaagggc

SEQ ID NO: 477804 - RNA, 20 nt, Human
ggccugaagagggagaagag

SEQ ID NO: 477805 - RNA, 23 nt, Human
gggacugaaugccacuucugguc

SEQ ID NO: 477806 - RNA, 18 nt, Human
gggaggggguggggcuga

SEQ ID NO: 477807 - RNA, 24 nt, Human
gggcagcugagcugccacugggcc

SEQ ID NO: 477808 - RNA, 22 nt, Human
gggccagaggcuuaagaagaca

SEQ ID NO: 477809 - RNA, 19 nt, Human
gggcuuuggggaaaccagg

SEQ ID NO: 477810 - RNA, 19 nt, Human
ggggaggggguggggcuga

SEQ ID NO: 477811 - RNA, 18 nt, Human
guaaagcaaaaugaacca

SEQ ID NO: 477812 - RNA, 24 nt, Human
gugaaaauucaaauagucaaaaca

SEQ ID NO: 477813 - RNA, 18 nt, Human
gugcuggggugagcucac

SEQ ID NO: 477814 - RNA, 25 nt, Human
guggagggagguugcuugcuuuaca

SEQ ID NO: 477815 - RNA, 21 nt, Human
uaaaacacccugcuguacccc

SEQ ID NO: 477816 - RNA, 20 nt, Human
uaaaaccucacaagcuauug

SEQ ID NO: 477817 - RNA, 19 nt, Human
uaaucccauuagcacaggg

SEQ ID NO: 477818 - RNA, 21 nt, Human
uacacacacagcacagaugca

SEQ ID NO: 477819 - RNA, 21 nt, Human
uacuggccaaccacacuacac

SEQ ID NO: 477820 - RNA, 21 nt, Human
uagaaaaaaggaaaacuuggu

SEQ ID NO: 477821 - RNA, 22 nt, Human
uagagccccucaacccugcuuc

SEQ ID NO: 477822 - RNA, 20 nt, Human
uagaucgagcuaguggggag

SEQ ID NO: 477823 - RNA, 21 nt, Human
uagccuagugguaacuagcca

SEQ ID NO: 477824 - RNA, 20 nt, Human
uagccuggacaaucugauga

SEQ ID NO: 477825 - RNA, 20 nt, Human
ucaaaaaggcugggccugga

SEQ ID NO: 477826 - RNA, 25 nt, Human
ucaacccugcuucaguugcccaugu

SEQ ID NO: 477827 - RNA, 19 nt, Human
ucaccuucccaacagcagu

SEQ ID NO: 477828 - RNA, 19 nt, Human
ucacugggcacaggaggag

SEQ ID NO: 477829 - RNA, 23 nt, Human
ucacuugugagccgucuucugcc

SEQ ID NO: 477830 - RNA, 20 nt, Human
ucagaaaaaauauggugaca

SEQ ID NO: 477831 - RNA, 24 nt, Human
ucaggcccaauuagaggcaaauaa

SEQ ID NO: 477832 - RNA, 20 nt, Human
uccacaaguacacucccaug

SEQ ID NO: 477833 - RNA, 20 nt, Human
ucccaucagcagaggagaga

SEQ ID NO: 477834 - RNA, 21 nt, Human
ucccucagugagccccaaccu

SEQ ID NO: 477835 - RNA, 24 nt, Human
ucccuggauucucuagagggccuc

SEQ ID NO: 477836 - RNA, 24 nt, Human
ucccuguuguucuuccagaccuca

SEQ ID NO: 477837 - RNA, 21 nt, Human
ucccuuacaugaggaacuggg

SEQ ID NO: 477838 - RNA, 19 nt, Human
uccugggcucacaguuucc

SEQ ID NO: 477839 - RNA, 19 nt, Human
ucgagcuugcuggagcgag

SEQ ID NO: 477840 - RNA, 24 nt, Human
ucuaugacuuagaagggccggggc

SEQ ID NO: 477841 - RNA, 23 nt, Human
ucucccuuaaggauggugcccug

SEQ ID NO: 477842 - RNA, 24 nt, Human
ucucccuuaaggauggugcccugg

SEQ ID NO: 477843 - RNA, 24 nt, Human
ucucugaggaggcugacucaaccc

SEQ ID NO: 477844 - RNA, 19 nt, Human
ugaagcaaaggggcuagug

SEQ ID NO: 477845 - RNA, 22 nt, Human
ugacucaaccccccacccuggc

SEQ ID NO: 477846 - RNA, 19 nt, Human
ugacuccuugagcaaaccc

SEQ ID NO: 477847 - RNA, 18 nt, Human
ugacuuagaagggcagag

SEQ ID NO: 477848 - RNA, 18 nt, Human
ugagaaaaaaaggccagc

SEQ ID NO: 477849 - RNA, 24 nt, Human
ugagcaaacccaacauccuguaaa

SEQ ID NO: 477850 - RNA, 18 nt, Human
ugagucggagcccuccac

SEQ ID NO: 477851 - RNA, 24 nt, Human
ugaugcuccugacaugcaggagau

SEQ ID NO: 477852 - RNA, 22 nt, Human
ugcccuggggcuuuggggaaac

SEQ ID NO: 477853 - RNA, 20 nt, Human
ugcuauggauuacaagccug

SEQ ID NO: 477854 - RNA, 30 nt, Human
ugcuuuauacauccucagccaaucccucaa

SEQ ID NO: 477855 - RNA, 19 nt, Human
uggaacagaucuacuguug

SEQ ID NO: 477856 - RNA, 24 nt, Human
uggaccagcuguccuggcucaagu

SEQ ID NO: 477857 - RNA, 22 nt, Human
uggaugucuucccuguuguucu

SEQ ID NO: 477858 - RNA, 18 nt, Human
uggcagcaggugggagug

SEQ ID NO: 477859 - RNA, 24 nt, Human
uggcaggaguggaagacaagcaaa

SEQ ID NO: 477860 - RNA, 20 nt, Human
uggcagggauacucacacuc

SEQ ID NO: 477861 - RNA, 18 nt, Human
ugggaagcaagaugacag

SEQ ID NO: 477862 - RNA, 18 nt, Human
uggggaaaccaggaugga

SEQ ID NO: 477863 - RNA, 18 nt, Human
uggggaggggguggggcu

SEQ ID NO: 477864 - RNA, 18 nt, Human
uggggaggggguggggcu

SEQ ID NO: 477865 - RNA, 19 nt, Human
uggggaggggguggggcug

SEQ ID NO: 477866 - RNA, 21 nt, Human
uggggucggcagaccccuucc

SEQ ID NO: 477867 - RNA, 18 nt, Human
uggguccuaggaaacccu

SEQ ID NO: 477868 - RNA, 19 nt, Human
uguagaccuucucccuuaa

SEQ ID NO: 477869 - RNA, 20 nt, Human
ugugcaacucuacucaagag

SEQ ID NO: 477870 - RNA, 23 nt, Human
ugugguggcagcuucaguaugug

SEQ ID NO: 477871 - RNA, 24 nt, Human
uuaaaacacccugcuguaccccaa

SEQ ID NO: 477872 - RNA, 24 nt, Human
uucaaacacagccacagaggcaga

SEQ ID NO: 477873 - RNA, 20 nt, Human
uuccccgagcuggggucggc

SEQ ID NO: 477874 - RNA, 23 nt, Human
uuggaagcuggcacagccaaucu

SEQ ID NO: 477875 - RNA, 23 nt, Human
aaaaaaaaaaaguaacugugaac

SEQ ID NO: 477876 - RNA, 24 nt, Human
aaaacaaaaaaccucauguuggaa

SEQ ID NO: 477877 - RNA, 19 nt, Human
aacugugugugugaacagu

SEQ ID NO: 477878 - RNA, 19 nt, Human
aagaggaaaagaaaagaaa

SEQ ID NO: 477879 - RNA, 19 nt, Human
aagcgcccgauccgcccgc

SEQ ID NO: 477880 - RNA, 21 nt, Human
aauacagaaagugaaauuaaa

SEQ ID NO: 477881 - RNA, 20 nt, Human
acaagaggaaaagaaaagaa

SEQ ID NO: 477882 - RNA, 21 nt, Human
accccauacuuguaccaguua

SEQ ID NO: 477883 - RNA, 22 nt, Human
accccccccaacagccaccagu

SEQ ID NO: 477884 - RNA, 22 nt, Human
acccgcggccgccguucccccc

SEQ ID NO: 477885 - RNA, 21 nt, Human
acuguccuucccauuuggaaa

SEQ ID NO: 477886 - RNA, 26 nt, Human
agagauauacauuuuccaauguaccc

SEQ ID NO: 477887 - RNA, 23 nt, Human
agccaccaccaaccaccggcgca

SEQ ID NO: 477888 - RNA, 18 nt, Human
aggaaaagaaaagaaagg

SEQ ID NO: 477889 - RNA, 24 nt, Human
aguguugaggcagcguagaagaga

SEQ ID NO: 477890 - RNA, 29 nt, Human
auacagaaagugaaauuaaaagggacccc

SEQ ID NO: 477891 - RNA, 25 nt, Human
auccuggagccuccugggaaaagca

SEQ ID NO: 477892 - RNA, 21 nt, Human
caaaauuaaaauacagaaagu

SEQ ID NO: 477893 - RNA, 21 nt, Human
caacagccaccaccaaccacc

SEQ ID NO: 477894 - RNA, 19 nt, Human
caagaggaaaagaaaagaa

SEQ ID NO: 477895 - RNA, 24 nt, Human
caaugaaucccaccauuuucaaau

SEQ ID NO: 477896 - RNA, 23 nt, Human
cacacauggggaacacaccacag

SEQ ID NO: 477897 - RNA, 19 nt, Human
caccccccccaacagccac

SEQ ID NO: 477898 - RNA, 23 nt, Human
cacuaaauacacacauuuccuaa

SEQ ID NO: 477899 - RNA, 18 nt, Human
cagcaaagagcccugccg

SEQ ID NO: 477900 - RNA, 20 nt, Human
cagcgccccccguggccggg

SEQ ID NO: 477901 - RNA, 19 nt, Human
caggaaaacaacuguggua

SEQ ID NO: 477902 - RNA, 19 nt, Human
caggauagggauguggcac

SEQ ID NO: 477903 - RNA, 24 nt, Human
ccaaucagcccuucaacaaaauua

SEQ ID NO: 477904 - RNA, 22 nt, Human
ccaccaccaaccaccggcgcag

SEQ ID NO: 477905 - RNA, 21 nt, Human
ccaccaccuccgccgccaagc

SEQ ID NO: 477906 - RNA, 27 nt, Human
ccaccaccuccgccgccaagcgcccga

SEQ ID NO: 477907 - RNA, 20 nt, Human
cccaccaccuccgccgccaa

SEQ ID NO: 477908 - RNA, 23 nt, Human
cccaccccccccaacagccacca

SEQ ID NO: 477909 - RNA, 20 nt, Human
ccccaccccccccaacagcc

SEQ ID NO: 477910 - RNA, 20 nt, Human
cccccaacagccaccaccaa

SEQ ID NO: 477911 - RNA, 22 nt, Human
cccccaccccccccaacagcca

SEQ ID NO: 477912 - RNA, 23 nt, Human
ccccccaacagccaccaccaacc

SEQ ID NO: 477913 - RNA, 19 nt, Human
cccccccaccccccccaac

SEQ ID NO: 477914 - RNA, 20 nt, Human
cccccguggccgggagcgga

SEQ ID NO: 477915 - RNA, 21 nt, Human
cccgcccgccgccucccacca

SEQ ID NO: 477916 - RNA, 21 nt, Human
cccgccgccucccaccaccuc

SEQ ID NO: 477917 - RNA, 21 nt, Human
cccuccgcaccacccgcggcc

SEQ ID NO: 477918 - RNA, 20 nt, Human
cccugggucuugcaagacuc

SEQ ID NO: 477919 - RNA, 24 nt, Human
ccgcaaggccucccuccgcaccac

SEQ ID NO: 477920 - RNA, 21 nt, Human
ccgccucccaccaccuccgcc

SEQ ID NO: 477921 - RNA, 21 nt, Human
ccgcgcucccgcccgccgccu

SEQ ID NO: 477922 - RNA, 23 nt, Human
ccucccaccaccuccgccgccaa

SEQ ID NO: 477923 - RNA, 19 nt, Human
ccugggucuugcaagacuc

SEQ ID NO: 477924 - RNA, 23 nt, Human
cgaaaggaagacuaaauguaaug

SEQ ID NO: 477925 - RNA, 22 nt, Human
cgcagcgccccccguggccggg

SEQ ID NO: 477926 - RNA, 23 nt, Human
cgccgccaagcgcccgauccgcc

SEQ ID NO: 477927 - RNA, 19 nt, Human
cgccguucccccccacccc

SEQ ID NO: 477928 - RNA, 22 nt, Human
cgccguucccccccaccccccc

SEQ ID NO: 477929 - RNA, 22 nt, Human
cggccgccguucccccccaccc

SEQ ID NO: 477930 - RNA, 21 nt, Human
cuaggcacaagaggaaaagaa

SEQ ID NO: 477931 - RNA, 22 nt, Human
cucaagguaagacuaagauggg

SEQ ID NO: 477932 - RNA, 30 nt, Human
cucccaccaccuccgccgccaagcgcccgg

SEQ ID NO: 477933 - RNA, 23 nt, Human
cucccuccgcaccacccgcggcc

SEQ ID NO: 477934 - RNA, 21 nt, Human
cuggagucaccaguguuguac

SEQ ID NO: 477935 - RNA, 20 nt, Human
cugggugaagggccucugcu

SEQ ID NO: 477936 - RNA, 21 nt, Human
gaauacugaccacacuggcuc

SEQ ID NO: 477937 - RNA, 23 nt, Human
gaaugugcaggaaagccccgcca

SEQ ID NO: 477938 - RNA, 25 nt, Human
gagaaaaagaauccuaaaaaagcca

SEQ ID NO: 477939 - RNA, 21 nt, Human
gaggagcuuggaguuucucca

SEQ ID NO: 477940 - RNA, 22 nt, Human
gaggaguccccagggaacacug

SEQ ID NO: 477941 - RNA, 20 nt, Human
gccaagcgcccgauccgccc

SEQ ID NO: 477942 - RNA, 23 nt, Human
gcccgcaaggccucccuccgcac

SEQ ID NO: 477943 - RNA, 23 nt, Human
gccugacccgcgcucccgcccgc

SEQ ID NO: 477944 - RNA, 21 nt, Human
gcguagaagagaguggcugga

SEQ ID NO: 477945 - RNA, 24 nt, Human
gcucugggugaagggccucugcuc

SEQ ID NO: 477946 - RNA, 20 nt, Human
ggaacacaccacagcuuaga

SEQ ID NO: 477947 - RNA, 22 nt, Human
ggccgggagcggagccgcagcc

SEQ ID NO: 477948 - RNA, 25 nt, Human
ggcgcagcgcagcgccccccguggc

SEQ ID NO: 477949 - RNA, 22 nt, Human
gugauuuccccuaucuccaaac

SEQ ID NO: 477950 - RNA, 19 nt, Human
gugcagagacgcuaucaga

SEQ ID NO: 477951 - RNA, 22 nt, Human
gugcagagacgcuaucagacuu

SEQ ID NO: 477952 - RNA, 19 nt, Human
guucccccccacccccccc

SEQ ID NO: 477953 - RNA, 20 nt, Human
uaacugugaacauauaaaca

SEQ ID NO: 477954 - RNA, 20 nt, Human
uagaagagaguggcuggaga

SEQ ID NO: 477955 - RNA, 18 nt, Human
uagcugauuucuaaaaau

SEQ ID NO: 477956 - RNA, 23 nt, Human
uccaaaaggccacaggauaggga

SEQ ID NO: 477957 - RNA, 24 nt, Human
ucccccccaccccccccaacagcc

SEQ ID NO: 477958 - RNA, 18 nt, Human
ucccgcccgccgccuccc

SEQ ID NO: 477959 - RNA, 19 nt, Human
uccgcaccacccgcggccg

SEQ ID NO: 477960 - RNA, 26 nt, Human
ugaaauaguaacuauuucacuacaaa

SEQ ID NO: 477961 - RNA, 21 nt, Human
ugaacauauaaacagccugca

SEQ ID NO: 477962 - RNA, 21 nt, Human
ugaagggccucugcuccagca

SEQ ID NO: 477963 - RNA, 23 nt, Human
uggauaaaaaacaaaaaaccuca

SEQ ID NO: 477964 - RNA, 21 nt, Human
ugggaaaagcaguggguucuc

SEQ ID NO: 477965 - RNA, 21 nt, Human
ugggagggggagaaaaagaau

SEQ ID NO: 477966 - RNA, 24 nt, Human
uggguagcugauuucuaaaaauca

SEQ ID NO: 477967 - RNA, 18 nt, Human
uucccccccacccccccc

SEQ ID NO: 477968 - RNA, 21 nt, Human
uucccccccaccccccccaac

SEQ ID NO: 477969 - RNA, 24 nt, Human
uucccccccaccccccccaacagc

SEQ ID NO: 477970 - RNA, 24 nt, Human
agaccccugcuccugagacaccag

SEQ ID NO: 477971 - RNA, 20 nt, Human
aucuguagacacagaccccu

SEQ ID NO: 477972 - RNA, 25 nt, Human
caagaagcaaaauguaugaaaauac

SEQ ID NO: 477973 - RNA, 24 nt, Human
cacagaccccugcuccugagacac

SEQ ID NO: 477974 - RNA, 24 nt, Human
cagcccaucuguagacacagaccc

SEQ ID NO: 477975 - RNA, 18 nt, Human
ccagacccuaagccucgg

SEQ ID NO: 477976 - RNA, 24 nt, Human
cccaccccagugugguccggggga

SEQ ID NO: 477977 - RNA, 22 nt, Human
ccugagacaccagccccaggag

SEQ ID NO: 477978 - RNA, 22 nt, Human
cggcucugccaccugucccugc

SEQ ID NO: 477979 - RNA, 21 nt, Human
cuccugagacaccagccccag

SEQ ID NO: 477980 - RNA, 24 nt, Human
cuccugggcccagggacaggcccc

SEQ ID NO: 477981 - RNA, 26 nt, Human
cucggcucugccaccugucccugcug

SEQ ID NO: 477982 - RNA, 18 nt, Human
ggcaagaagcaaaaugua

SEQ ID NO: 477983 - RNA, 19 nt, Human
gucuccagcuguggggggu

SEQ ID NO: 477984 - RNA, 19 nt, Human
uaaggucaucuuguuguuc

SEQ ID NO: 477985 - RNA, 21 nt, Human
uccugggcccagggacaggcc

SEQ ID NO: 477986 - RNA, 22 nt, Human
uccugggcccagggacaggccc

SEQ ID NO: 477987 - RNA, 24 nt, Human
ugaaacaguuaagaaauaagguca

SEQ ID NO: 477988 - RNA, 21 nt, Human
ugccagacccuaagccucggc

SEQ ID NO: 477989 - RNA, 20 nt, Human
ugcugggcaagaagcaaaau

SEQ ID NO: 477990 - RNA, 20 nt, Human
uggcuccugggcccagggac

SEQ ID NO: 477991 - RNA, 21 nt, Human
ugggcaagaagcaaaauguau

SEQ ID NO: 477992 - RNA, 19 nt, Human
uuaagaaauaaggucaucu

SEQ ID NO: 477993 - RNA, 24 nt, Human
aaaguggugagauuacaagcauga

SEQ ID NO: 477994 - RNA, 22 nt, Human
aacaucuauucaugucuuuugc

SEQ ID NO: 477995 - RNA, 24 nt, Human
aagaaauucauaaacucuuuccca

SEQ ID NO: 477996 - RNA, 24 nt, Human
aagagucucacuauguugcccagg

SEQ ID NO: 477997 - RNA, 25 nt, Human
aagcacuccucccaucuuggccucc

SEQ ID NO: 477998 - RNA, 20 nt, Human
aagugauccuccugccuccc

SEQ ID NO: 477999 - RNA, 23 nt, Human
aaucuguagcuuaucuuuuccuc

SEQ ID NO: 478000 - RNA, 19 nt, Human
aauguccaggagcacaacu

SEQ ID NO: 478001 - RNA, 24 nt, Human
acuauguugcccaggcuggucugg

SEQ ID NO: 478002 - RNA, 23 nt, Human
acuccucccaucuuggccuccca

SEQ ID NO: 478003 - RNA, 19 nt, Human
acucuguuacacagguugg

SEQ ID NO: 478004 - RNA, 21 nt, Human
agagguucuuuuuucuccucg

SEQ ID NO: 478005 - RNA, 21 nt, Human
agcugggacuacuggugugug

SEQ ID NO: 478006 - RNA, 20 nt, Human
aggacaucuggguuguuucc

SEQ ID NO: 478007 - RNA, 23 nt, Human
aguagcugggacuacuggugugu

SEQ ID NO: 478008 - RNA, 22 nt, Human
agucauacauaccccacacccc

SEQ ID NO: 478009 - RNA, 24 nt, Human
aguuuuguggccuuuuuuuuuuuu

SEQ ID NO: 478010 - RNA, 20 nt, Human
auaccccugagguacaacca

SEQ ID NO: 478011 - RNA, 20 nt, Human
auagauccucuucagugaaa

SEQ ID NO: 478012 - RNA, 21 nt, Human
auuacaagcaugagcuaccau

SEQ ID NO: 478013 - RNA, 21 nt, Human
auugaucagauauaugguuug

SEQ ID NO: 478014 - RNA, 25 nt, Human
caaacuccugggcucaagugauccu

SEQ ID NO: 478015 - RNA, 20 nt, Human
caaaguccaagaacuuguca

SEQ ID NO: 478016 - RNA, 24 nt, Human
caaaguggugagauuacaagcaug

SEQ ID NO: 478017 - RNA, 22 nt, Human
caagaacuugucaccuagccca

SEQ ID NO: 478018 - RNA, 22 nt, Human
cacccccuccagucccuauccc

SEQ ID NO: 478019 - RNA, 24 nt, Human
caccuagcccaagauccugaagau

SEQ ID NO: 478020 - RNA, 19 nt, Human
cacuauguugcccaggcug

SEQ ID NO: 478021 - RNA, 22 nt, Human
cacuauguugcccaggcugguc

SEQ ID NO: 478022 - RNA, 24 nt, Human
cacuccucccaucuuggccuccca

SEQ ID NO: 478023 - RNA, 24 nt, Human
cacucuguuacacagguuggagug

SEQ ID NO: 478024 - RNA, 24 nt, Human
cacuggauauuuucaucuuucccc

SEQ ID NO: 478025 - RNA, 24 nt, Human
cagccucaaacuccugggcucaag

SEQ ID NO: 478026 - RNA, 20 nt, Human
caggagcacaacugcugggu

SEQ ID NO: 478027 - RNA, 18 nt, Human
cauuucaauaauuuuguc

SEQ ID NO: 478028 - RNA, 20 nt, Human
ccaagaacuugucaccuagc

SEQ ID NO: 478029 - RNA, 23 nt, Human
ccacacccccuccagucccuauc

SEQ ID NO: 478030 - RNA, 22 nt, Human
ccauaauaccccugagguacaa

SEQ ID NO: 478031 - RNA, 22 nt, Human
ccccacacccccuccagucccu

SEQ ID NO: 478032 - RNA, 23 nt, Human
ccgcagccucaaacuccugggcu

SEQ ID NO: 478033 - RNA, 24 nt, Human
ccucacucuguuacacagguugga

SEQ ID NO: 478034 - RNA, 24 nt, Human
ccuccauugaauugcuuuuucacu

SEQ ID NO: 478035 - RNA, 19 nt, Human
ccucccaucuuggccuccc

SEQ ID NO: 478036 - RNA, 18 nt, Human
ccuccugccucccuagua

SEQ ID NO: 478037 - RNA, 22 nt, Human
ccugggcucaagugauccuccu

SEQ ID NO: 478038 - RNA, 23 nt, Human
ccugggcucaagugauccuccug

SEQ ID NO: 478039 - RNA, 21 nt, Human
ccuguuguaggacaucugggu

SEQ ID NO: 478040 - RNA, 27 nt, Human
ccuuuauagucauacauaccccacacc

SEQ ID NO: 478041 - RNA, 22 nt, Human
cgccaugggugucuaauugcuc

SEQ ID NO: 478042 - RNA, 26 nt, Human
cggggcaaaguccaagaacuugucac

SEQ ID NO: 478043 - RNA, 24 nt, Human
cucaagcacuccucccaucuuggc

SEQ ID NO: 478044 - RNA, 27 nt, Human
cucaagugauccuccugccucccuagu

SEQ ID NO: 478045 - RNA, 24 nt, Human
cuccucccaucuuggccucccaaa

SEQ ID NO: 478046 - RNA, 21 nt, Human
cuccugccucccuaguagcug

SEQ ID NO: 478047 - RNA, 23 nt, Human
cuccugggcucaagugauccucc

SEQ ID NO: 478048 - RNA, 26 nt, Human
cuggauauuuucaucuuuccccaaua

SEQ ID NO: 478049 - RNA, 19 nt, Human
cuguuccucugccaauacc

SEQ ID NO: 478050 - RNA, 21 nt, Human
gaccauuugagacugguuuuu

SEQ ID NO: 478051 - RNA, 24 nt, Human
gagugugguggugugaucacagcu

SEQ ID NO: 478052 - RNA, 26 nt, Human
gaguuuuguggccuuuuuuuuuuuuu

SEQ ID NO: 478053 - RNA, 24 nt, Human
gauuacaagcaugagcuaccaugc

SEQ ID NO: 478054 - RNA, 19 nt, Human
gcauucauuuguguguaug

SEQ ID NO: 478055 - RNA, 23 nt, Human
gcuggucuggaacgccuaaccuc

SEQ ID NO: 478056 - RNA, 21 nt, Human
gggcucaagugauccuccugc

SEQ ID NO: 478057 - RNA, 22 nt, Human
gggcucaagugauccuccugcc

SEQ ID NO: 478058 - RNA, 21 nt, Human
guauguagguccauacaacuu

SEQ ID NO: 478059 - RNA, 23 nt, Human
uaaaauauccaguuuguauccuc

SEQ ID NO: 478060 - RNA, 21 nt, Human
uaaguaacuuuacacuggaua

SEQ ID NO: 478061 - RNA, 22 nt, Human
uacaagcaugagcuaccaugcc

SEQ ID NO: 478062 - RNA, 19 nt, Human
uacaugcauucauuugugu

SEQ ID NO: 478063 - RNA, 24 nt, Human
uacaugcauucauuuguguguaug

SEQ ID NO: 478064 - RNA, 18 nt, Human
uaccccacacccccucca

SEQ ID NO: 478065 - RNA, 22 nt, Human
uaccccacacccccuccagucc

SEQ ID NO: 478066 - RNA, 18 nt, Human
uagcccaagauccugaag

SEQ ID NO: 478067 - RNA, 20 nt, Human
uagcccaagauccugaagau

SEQ ID NO: 478068 - RNA, 22 nt, Human
uagcugggacuacuggugugug

SEQ ID NO: 478069 - RNA, 23 nt, Human
uagcuuaucuuuuccucuucuua

SEQ ID NO: 478070 - RNA, 24 nt, Human
uaggacaucuggguuguuuccagu

SEQ ID NO: 478071 - RNA, 20 nt, Human
uaguagcugggacuacuggu

SEQ ID NO: 478072 - RNA, 22 nt, Human
uauguugcccaggcuggucugg

SEQ ID NO: 478073 - RNA, 23 nt, Human
uauguugcccaggcuggucugga

SEQ ID NO: 478074 - RNA, 24 nt, Human
uauguugcccaggcuggucuggaa

SEQ ID NO: 478075 - RNA, 24 nt, Human
ucaccgcagccucaaacuccuggg

SEQ ID NO: 478076 - RNA, 23 nt, Human
ucaucuuuccccauuuugucucc

SEQ ID NO: 478077 - RNA, 25 nt, Human
ucaugugcuuaaccucauaaucaaa

SEQ ID NO: 478078 - RNA, 23 nt, Human
ucccagaguggcuguaccauuuu

SEQ ID NO: 478079 - RNA, 21 nt, Human
uccugggcucaagugauccuc

SEQ ID NO: 478080 - RNA, 22 nt, Human
uccugggcucaagugauccucc

SEQ ID NO: 478081 - RNA, 24 nt, Human
uccugggcucaagugauccuccug

SEQ ID NO: 478082 - RNA, 19 nt, Human
ucucacuauguugcccagg

SEQ ID NO: 478083 - RNA, 23 nt, Human
ucucacuauguugcccaggcugg

SEQ ID NO: 478084 - RNA, 24 nt, Human
ucucacuauguugcccaggcuggu

SEQ ID NO: 478085 - RNA, 26 nt, Human
ucucacuauguugcccaggcuggucu

SEQ ID NO: 478086 - RNA, 22 nt, Human
ucuuauguuuaacuugauuaaa

SEQ ID NO: 478087 - RNA, 23 nt, Human
ucuucagugaaacaucuauucau

SEQ ID NO: 478088 - RNA, 24 nt, Human
ugacuucaguugaguuuuuaguac

SEQ ID NO: 478089 - RNA, 22 nt, Human
ugagaugaggccucacucuguu

SEQ ID NO: 478090 - RNA, 22 nt, Human
ugagauuacaagcaugagcuac

SEQ ID NO: 478091 - RNA, 24 nt, Human
ugagauuacaagcaugagcuacca

SEQ ID NO: 478092 - RNA, 24 nt, Human
ugcaaauucaucucaaucuguagc

SEQ ID NO: 478093 - RNA, 20 nt, Human
ugcgaucauacaguauguga

SEQ ID NO: 478094 - RNA, 30 nt, Human
uggaaugaauguccaggagcacaacugcuu

SEQ ID NO: 478095 - RNA, 24 nt, Human
uggauauuuucaucuuuccccauu

SEQ ID NO: 478096 - RNA, 18 nt, Human
uggccuuuuuuuuuuuuu

SEQ ID NO: 478097 - RNA, 20 nt, Human
ugggcucaagugauccuccu

SEQ ID NO: 478098 - RNA, 24 nt, Human
ugggcucaagugauccuccugccu

SEQ ID NO: 478099 - RNA, 20 nt, Human
uggugagauuacaagcauga

SEQ ID NO: 478100 - RNA, 24 nt, Human
uggugugaucacagcucaccgcag

SEQ ID NO: 478101 - RNA, 18 nt, Human
uguccaggagcacaacug

SEQ ID NO: 478102 - RNA, 19 nt, Human
ugucuguuccucugccaau

SEQ ID NO: 478103 - RNA, 20 nt, Human
uguguguauguagguccaua

SEQ ID NO: 478104 - RNA, 19 nt, Human
uguugcccaggcuggucug

SEQ ID NO: 478105 - RNA, 19 nt, Human
uguuuaaccauguaccugu

SEQ ID NO: 478106 - RNA, 30 nt, Human
uuaaccucauaaucaaauguuauaaucaaa

SEQ ID NO: 478107 - RNA, 21 nt, Human
uuacaugcauucauuugugug

SEQ ID NO: 478108 - RNA, 18 nt, Human
uucuccuguggcuuuuuu

SEQ ID NO: 478109 - RNA, 21 nt, Human
uucucuggaaugaauguccag

SEQ ID NO: 478110 - RNA, 22 nt, Human
uugacguaugugucuguuccuu

SEQ ID NO: 478111 - RNA, 24 nt, Human
uugcgucaucccuuuauagucaua

SEQ ID NO: 478112 - RNA, 21 nt, Human
uuuguauccucaucaguauuu

SEQ ID NO: 478113 - RNA, 23 nt, Human
uuuuuuuuuuuugagaugaggcc

SEQ ID NO: 478114 - RNA, 19 nt, Human
aaaugaugggauuacaggc

SEQ ID NO: 478115 - RNA, 23 nt, Human
aaaugaugggauuacaggcguga

SEQ ID NO: 478116 - RNA, 20 nt, Human
caaaugaugggauuacaggc

SEQ ID NO: 478117 - RNA, 21 nt, Human
caaaugaugggauuacaggcg

SEQ ID NO: 478118 - RNA, 24 nt, Human
caaaugaugggauuacaggcguga

SEQ ID NO: 478119 - RNA, 24 nt, Human
cccuuguaggcagagaugcagagg

SEQ ID NO: 478120 - RNA, 19 nt, Human
gaaacuucugaagagcaga

SEQ ID NO: 478121 - RNA, 22 nt, Human
gauuacaggcgugagccucugc

SEQ ID NO: 478122 - RNA, 22 nt, Human
gauuacaggcgugagccucugc

SEQ ID NO: 478123 - RNA, 23 nt, Human
gcaaaugaugggauuacaggcgu

SEQ ID NO: 478124 - RNA, 22 nt, Human
ggauaugguuuguaucuggagu

SEQ ID NO: 478125 - RNA, 20 nt, Human
uaaaacgaaaaacucaaguu

SEQ ID NO: 478126 - RNA, 22 nt, Human
uaugaagaugaaagggauuuua

SEQ ID NO: 478127 - RNA, 19 nt, Human
ugaagagcagaaacuguga

SEQ ID NO: 478128 - RNA, 19 nt, Human
ugagccucugcgcucccag

SEQ ID NO: 478129 - RNA, 18 nt, Human
ugagguuuguggcugaga

SEQ ID NO: 478130 - RNA, 18 nt, Human
ugggauuacaggcgugag

SEQ ID NO: 478131 - RNA, 19 nt, Human
ugggauuacaggcgugagc

SEQ ID NO: 478132 - RNA, 19 nt, Human
ugggauuacaggcgugagc

SEQ ID NO: 478133 - RNA, 20 nt, Human
ugggauuacaggcgugagcc

SEQ ID NO: 478134 - RNA, 20 nt, Human
ugggauuacaggcgugagcc

SEQ ID NO: 478135 - RNA, 21 nt, Human
ugggauuacaggcgugagccu

SEQ ID NO: 478136 - RNA, 24 nt, Human
ugggauuacaggcgugagccucug

SEQ ID NO: 478137 - RNA, 24 nt, Human
ugggauuacaggcgugagccucug

SEQ ID NO: 478138 - RNA, 19 nt, Human
ugucagagagagaucaagg

SEQ ID NO: 478139 - RNA, 24 nt, Human
aauaccaacccaccccaggagaca

SEQ ID NO: 478140 - RNA, 23 nt, Human
acucauuucccuacaggugaucu

SEQ ID NO: 478141 - RNA, 22 nt, Human
caacccaccccaggagacagcu

SEQ ID NO: 478142 - RNA, 18 nt, Human
ccccaccuccuuguucca

SEQ ID NO: 478143 - RNA, 21 nt, Human
ccccaggagacagcuguccac

SEQ ID NO: 478144 - RNA, 18 nt, Human
cccccaccuccuuguucc

SEQ ID NO: 478145 - RNA, 19 nt, Human
cccccaguuggggaagggg

SEQ ID NO: 478146 - RNA, 19 nt, Human
ccucuuuaauaccaaccca

SEQ ID NO: 478147 - RNA, 21 nt, Human
cgcccacccgaacggcgauca

SEQ ID NO: 478148 - RNA, 21 nt, Human
cugcccccaccuccuuguucc

SEQ ID NO: 478149 - RNA, 24 nt, Human
gggaacacucauuucccuacaggu

SEQ ID NO: 478150 - RNA, 22 nt, Human
ggugaucuuggggagagacugu

SEQ ID NO: 478151 - RNA, 22 nt, Human
uccacgugcaaaacucuucuca

SEQ ID NO: 478152 - RNA, 21 nt, Human
ucccaggcaacccuggagucu

SEQ ID NO: 478153 - RNA, 19 nt, Human
ucgcccacccgaacggcga

SEQ ID NO: 478154 - RNA, 20 nt, Human
uuggggaaggggccacacug

SEQ ID NO: 478155 - RNA, 21 nt, Human
aggcucuggaggaggaagggg

SEQ ID NO: 478156 - RNA, 21 nt, Human
caggcucuggaggaggaaggg

SEQ ID NO: 478157 - RNA, 18 nt, Human
ccugguccagguccccug

SEQ ID NO: 478158 - RNA, 21 nt, Human
cggcggggccugcugagggcu

SEQ ID NO: 478159 - RNA, 21 nt, Human
cggcggggccugcugagggcu

SEQ ID NO: 478160 - RNA, 24 nt, Human
cucuuccuccuuuacuggccucug

SEQ ID NO: 478161 - RNA, 18 nt, Human
cuggccucuggggcucgg

SEQ ID NO: 478162 - RNA, 19 nt, Human
cuuccuccuuuacuggccu

SEQ ID NO: 478163 - RNA, 21 nt, Human
gaggaggaaggggaggaagac

SEQ ID NO: 478164 - RNA, 24 nt, Human
gggguucaggccuuuuuuuuuuug

SEQ ID NO: 478165 - RNA, 25 nt, Human
gggguucaggccuuuuuuuuuuuuu

SEQ ID NO: 478166 - RNA, 19 nt, Human
uagagcaggcucgguuccu

SEQ ID NO: 478167 - RNA, 19 nt, Human
ucaaacuacaacugcauag

SEQ ID NO: 478168 - RNA, 19 nt, Human
ucaaacuacaacugcauag

SEQ ID NO: 478169 - RNA, 19 nt, Human
ucaaacuacaacugcauag

SEQ ID NO: 478170 - RNA, 24 nt, Human
uccgcuguggacagccggcggggc

SEQ ID NO: 478171 - RNA, 24 nt, Human
uccgcuguggacagccggcggggc

SEQ ID NO: 478172 - RNA, 21 nt, Human
ucuggaggaggaaggggagga

SEQ ID NO: 478173 - RNA, 19 nt, Human
uggacagccggcggggccu

SEQ ID NO: 478174 - RNA, 19 nt, Human
uggacagccggcggggccu

SEQ ID NO: 478175 - RNA, 20 nt, Human
uggaggaggaaggggaggaa

SEQ ID NO: 478176 - RNA, 18 nt, Human
ugggguucaggccuuuuu

SEQ ID NO: 478177 - RNA, 20 nt, Human
ugguggaggcaucagcaggg

SEQ ID NO: 478178 - RNA, 20 nt, Human
ugguggaggcaucagcaggg

SEQ ID NO: 478179 - RNA, 18 nt, Human
aaacagaaaaaggagccu

SEQ ID NO: 478180 - RNA, 20 nt, Human
aaacagaaaaaggagccugg

SEQ ID NO: 478181 - RNA, 19 nt, Human
aaacaugcuucuucccaga

SEQ ID NO: 478182 - RNA, 23 nt, Human
accccucugucuucccucuaauc

SEQ ID NO: 478183 - RNA, 18 nt, Human
agaaacagaaaaaggagc

SEQ ID NO: 478184 - RNA, 18 nt, Human
agcaggacuguguaggga

SEQ ID NO: 478185 - RNA, 23 nt, Human
agcaggacuguguagggagccug

SEQ ID NO: 478186 - RNA, 24 nt, Human
aguuucaguuuuauuuuuguauuu

SEQ ID NO: 478187 - RNA, 20 nt, Human
aucucccuuggaccccucug

SEQ ID NO: 478188 - RNA, 22 nt, Human
augagacaccaagaagaugaag

SEQ ID NO: 478189 - RNA, 18 nt, Human
augucauauaggggagaa

SEQ ID NO: 478190 - RNA, 18 nt, Human
caaaauuucuagagaaac

SEQ ID NO: 478191 - RNA, 24 nt, Human
caaguucugcucccuucgucuuuc

SEQ ID NO: 478192 - RNA, 18 nt, Human
cacuggugcagcccgggc

SEQ ID NO: 478193 - RNA, 23 nt, Human
cacuguauuuuuacugaggcagg

SEQ ID NO: 478194 - RNA, 21 nt, Human
cagccucucaggccccuuccu

SEQ ID NO: 478195 - RNA, 20 nt, Human
cauggcucugaggugggaag

SEQ ID NO: 478196 - RNA, 21 nt, Human
ccaacaugucugaacuucauu

SEQ ID NO: 478197 - RNA, 19 nt, Human
ccaccggagucucaggagg

SEQ ID NO: 478198 - RNA, 21 nt, Human
cccagagggauuucaaagaaa

SEQ ID NO: 478199 - RNA, 24 nt, Human
ccccgccagagcccuggcuccccc

SEQ ID NO: 478200 - RNA, 19 nt, Human
ccccgcugagccaucuccu

SEQ ID NO: 478201 - RNA, 19 nt, Human
ccccugggucuuggcggcu

SEQ ID NO: 478202 - RNA, 18 nt, Human
ccccuuccugcugugucu

SEQ ID NO: 478203 - RNA, 23 nt, Human
cccgccagagcccuggcucccca

SEQ ID NO: 478204 - RNA, 18 nt, Human
cccugggucuuggcggcu

SEQ ID NO: 478205 - RNA, 22 nt, Human
ccucucaggccccuuccugcug

SEQ ID NO: 478206 - RNA, 18 nt, Human
ccugcaccaagggcaccc

SEQ ID NO: 478207 - RNA, 20 nt, Human
ccugcguagccaaaggaaga

SEQ ID NO: 478208 - RNA, 18 nt, Human
ccugggguagaauccggg

SEQ ID NO: 478209 - RNA, 18 nt, Human
ccuggguggugcaggaac

SEQ ID NO: 478210 - RNA, 23 nt, Human
cgaccaggcucugaguguaaauc

SEQ ID NO: 478211 - RNA, 18 nt, Human
cgccagagcccuggcucc

SEQ ID NO: 478212 - RNA, 25 nt, Human
cuaccuggagccauuuuuuagcugu

SEQ ID NO: 478213 - RNA, 18 nt, Human
cucccucagauggucuuc

SEQ ID NO: 478214 - RNA, 19 nt, Human
cucuccagagccugcaucc

SEQ ID NO: 478215 - RNA, 21 nt, Human
cucugaggugggaagggugga

SEQ ID NO: 478216 - RNA, 23 nt, Human
cuucuucccagagggauuucaaa

SEQ ID NO: 478217 - RNA, 20 nt, Human
gagucucaggaggcugggga

SEQ ID NO: 478218 - RNA, 20 nt, Human
gagugagaggaggguuuaga

SEQ ID NO: 478219 - RNA, 23 nt, Human
gcagccccgcugagccaucuccu

SEQ ID NO: 478220 - RNA, 18 nt, Human
gcagcuccagacccugcc

SEQ ID NO: 478221 - RNA, 20 nt, Human
gccugcaccaagggcacccc

SEQ ID NO: 478222 - RNA, 18 nt, Human
gcggcuuguccccagcgg

SEQ ID NO: 478223 - RNA, 18 nt, Human
gcuggucccuccccucca

SEQ ID NO: 478224 - RNA, 22 nt, Human
ggccccuuccugcugugucugu

SEQ ID NO: 478225 - RNA, 18 nt, Human
ggccucuuggccccuugg

SEQ ID NO: 478226 - RNA, 22 nt, Human
ggcucugaggugggaagggugg

SEQ ID NO: 478227 - RNA, 18 nt, Human
ggguucguucucaugaag

SEQ ID NO: 478228 - RNA, 21 nt, Human
gucccuccccuccaccccugc

SEQ ID NO: 478229 - RNA, 25 nt, Human
guugaguuaagaaacagaaaaagga

SEQ ID NO: 478230 - RNA, 23 nt, Human
uaaacuuuauuccuaauaugaaa

SEQ ID NO: 478231 - RNA, 18 nt, Human
uagaaaauucucaccaag

SEQ ID NO: 478232 - RNA, 19 nt, Human
ucaaaccaggccuggccau

SEQ ID NO: 478233 - RNA, 23 nt, Human
ucaauaaacaugcuucuucccag

SEQ ID NO: 478234 - RNA, 20 nt, Human
ucaguuuuauuuuuguauuu

SEQ ID NO: 478235 - RNA, 21 nt, Human
ucucaggaggcuggggaggac

SEQ ID NO: 478236 - RNA, 19 nt, Human
ucugcucccuucgucuuuc

SEQ ID NO: 478237 - RNA, 19 nt, Human
ucuggagcaguuucaguuu

SEQ ID NO: 478238 - RNA, 20 nt, Human
ugaaguauccugggguagaa

SEQ ID NO: 478239 - RNA, 20 nt, Human
ugagacaccaagaagaugaa

SEQ ID NO: 478240 - RNA, 18 nt, Human
ugaggacaugagacacca

SEQ ID NO: 478241 - RNA, 20 nt, Human
ugaggcagggcagguucccc

SEQ ID NO: 478242 - RNA, 22 nt, Human
ugaggcagggcagguuccccug

SEQ ID NO: 478243 - RNA, 21 nt, Human
ugaggugggaaggguggagcc

SEQ ID NO: 478244 - RNA, 21 nt, Human
ugaggugggaaggguggagcc

SEQ ID NO: 478245 - RNA, 22 nt, Human
ugaguuaagaaacagaaaaagg

SEQ ID NO: 478246 - RNA, 21 nt, Human
ugccacagggcauccuguucu

SEQ ID NO: 478247 - RNA, 19 nt, Human
ugccuugcacccauccugc

SEQ ID NO: 478248 - RNA, 21 nt, Human
ugcugucgcugugccucccuc

SEQ ID NO: 478249 - RNA, 18 nt, Human
uggagaaagcugcuuucu

SEQ ID NO: 478250 - RNA, 19 nt, Human
uggccccuuggugcagccc

SEQ ID NO: 478251 - RNA, 20 nt, Human
uggccccuuggugcagcccc

SEQ ID NO: 478252 - RNA, 22 nt, Human
ugggaaggguggagccacuccc

SEQ ID NO: 478253 - RNA, 18 nt, Human
uggggaggacacuggaag

SEQ ID NO: 478254 - RNA, 20 nt, Human
ugggguagaauccgggaguc

SEQ ID NO: 478255 - RNA, 21 nt, Human
uggucccuccccuccaccccu

SEQ ID NO: 478256 - RNA, 22 nt, Human
uguuagaaaauucucaccaagg

SEQ ID NO: 478257 - RNA, 22 nt, Human
uucaguggacuuggggagaacu

SEQ ID NO: 478258 - RNA, 24 nt, Human
uuccugcugugucugucugaggcu

SEQ ID NO: 478259 - RNA, 19 nt, Human
uucugacucuuucaccagg

SEQ ID NO: 478260 - RNA, 21 nt, Human
uuuggagaaagcugcuuucug

SEQ ID NO: 478261 - RNA, 22 nt, Human
aaagagggaggggaagaggagg

SEQ ID NO: 478262 - RNA, 20 nt, Human
aaaggcaggugcuggggacu

SEQ ID NO: 478263 - RNA, 29 nt, Human
aacccacaaaaccaucauuaguaaaaaaa

SEQ ID NO: 478264 - RNA, 19 nt, Human
aaccccuucaaguauuggg

SEQ ID NO: 478265 - RNA, 18 nt, Human
aagagggaggggaagagg

SEQ ID NO: 478266 - RNA, 18 nt, Human
agaaagcuccaagcgcug

SEQ ID NO: 478267 - RNA, 18 nt, Human
agaguagaggggaggagg

SEQ ID NO: 478268 - RNA, 22 nt, Human
aggaaacucuccuaccaucucc

SEQ ID NO: 478269 - RNA, 19 nt, Human
agggaggggaagaggagga

SEQ ID NO: 478270 - RNA, 20 nt, Human
aggugcuggggacugggaag

SEQ ID NO: 478271 - RNA, 23 nt, Human
aggugcuggggacugggaaggcu

SEQ ID NO: 478272 - RNA, 22 nt, Human
aucauuaguaaaaaaacaaaac

SEQ ID NO: 478273 - RNA, 22 nt, Human
cagccuacuuauccuccccuuc

SEQ ID NO: 478274 - RNA, 19 nt, Human
cccagccuacuuauccucc

SEQ ID NO: 478275 - RNA, 23 nt, Human
ccccaaaugaaucacaugcugcc

SEQ ID NO: 478276 - RNA, 23 nt, Human
ccgaugcgggacagauuccuucc

SEQ ID NO: 478277 - RNA, 22 nt, Human
ccggaccgggaagacagcaggg

SEQ ID NO: 478278 - RNA, 21 nt, Human
ccuuccauccccaaaugaauc

SEQ ID NO: 478279 - RNA, 18 nt, Human
cgccgcgggcagcgggcc

SEQ ID NO: 478280 - RNA, 21 nt, Human
gagaaguagugagaaaggccg

SEQ ID NO: 478281 - RNA, 22 nt, Human
gccuacuuauccuccccuucuc

SEQ ID NO: 478282 - RNA, 20 nt, Human
gcuuugaaguuucccagccu

SEQ ID NO: 478283 - RNA, 25 nt, Human
ggccggaccgggaagacagcagggu

SEQ ID NO: 478284 - RNA, 19 nt, Human
gggaagacagcagggugcu

SEQ ID NO: 478285 - RNA, 20 nt, Human
ggggacugggaaggcuuuga

SEQ ID NO: 478286 - RNA, 21 nt, Human
ggugcugcgagcaggucuggg

SEQ ID NO: 478287 - RNA, 23 nt, Human
guuagggguucugggcugggacu

SEQ ID NO: 478288 - RNA, 19 nt, Human
guucugggcugggacuugg

SEQ ID NO: 478289 - RNA, 27 nt, Human
uaaaaaaaacccacaaaaccaucauua

SEQ ID NO: 478290 - RNA, 20 nt, Human
uaaaaaaacaaaaccccuuc

SEQ ID NO: 478291 - RNA, 19 nt, Human
uaggaaacucuccuaccau

SEQ ID NO: 478292 - RNA, 20 nt, Human
ucccuuaaaaaaaacccaca

SEQ ID NO: 478293 - RNA, 25 nt, Human
ucccuuaaaaaaaacccacaaaacc

SEQ ID NO: 478294 - RNA, 23 nt, Human
ugaaagagggaggggaagaggag

SEQ ID NO: 478295 - RNA, 18 nt, Human
ugggacuugggguuaugg

SEQ ID NO: 478296 - RNA, 20 nt, Human
uggggacugggaaggcuuug

SEQ ID NO: 478297 - RNA, 21 nt, Human
uuaaaaaaaacccacaaaacc

SEQ ID NO: 478298 - RNA, 23 nt, Human
uuucccagccuacuuauccuccc

SEQ ID NO: 478299 - RNA, 23 nt, Human
aaaguguuggauuacaggcguga

SEQ ID NO: 478300 - RNA, 24 nt, Human
aaccuuuuuuuaccacaaaaugga

SEQ ID NO: 478301 - RNA, 19 nt, Human
aaucuuuuuguuuguuugu

SEQ ID NO: 478302 - RNA, 24 nt, Human
accauguuggccaggcuggucucg

SEQ ID NO: 478303 - RNA, 24 nt, Human
agagucugucacccagguuggagu

SEQ ID NO: 478304 - RNA, 24 nt, Human
agcgauucuccugccucagccucc

SEQ ID NO: 478305 - RNA, 24 nt, Human
aggugauccgcccgccucagccuc

SEQ ID NO: 478306 - RNA, 25 nt, Human
agguuggagugcaguggcgcgaucu

SEQ ID NO: 478307 - RNA, 22 nt, Human
agguuucaccauguuggccagg

SEQ ID NO: 478308 - RNA, 18 nt, Human
aguagcugggaugacagg

SEQ ID NO: 478309 - RNA, 20 nt, Human
agugcaguggcgcgaucucg

SEQ ID NO: 478310 - RNA, 23 nt, Human
agugcaguggcgcgaucucggcu

SEQ ID NO: 478311 - RNA, 24 nt, Human
agugcaguggcgcgaucucggcuc

SEQ ID NO: 478312 - RNA, 18 nt, Human
caaaguguuggauuacag

SEQ ID NO: 478313 - RNA, 20 nt, Human
caaaguguuggauuacaggc

SEQ ID NO: 478314 - RNA, 22 nt, Human
caaaguguuggauuacaggcgu

SEQ ID NO: 478315 - RNA, 24 nt, Human
caaaguguuggauuacaggcguga

SEQ ID NO: 478316 - RNA, 20 nt, Human
caaccucugccucccggguu

SEQ ID NO: 478317 - RNA, 22 nt, Human
caagcgauucuccugccucagc

SEQ ID NO: 478318 - RNA, 24 nt, Human
caccacucucggcuaauuuuugua

SEQ ID NO: 478319 - RNA, 21 nt, Human
caccauguuggccaggcuggu

SEQ ID NO: 478320 - RNA, 24 nt, Human
caccauguuggccaggcuggucuc

SEQ ID NO: 478321 - RNA, 27 nt, Human
caccauguuggccaggcuggucucgaa

SEQ ID NO: 478322 - RNA, 24 nt, Human
cacccagguuggagugcaguggcg

SEQ ID NO: 478323 - RNA, 23 nt, Human
cacggcgccuggccuaaaaccuu

SEQ ID NO: 478324 - RNA, 21 nt, Human
cacugcaaccucugccucccg

SEQ ID NO: 478325 - RNA, 23 nt, Human
cacugcaaccucugccucccggg

SEQ ID NO: 478326 - RNA, 23 nt, Human
cagagucugucacccagguugga

SEQ ID NO: 478327 - RNA, 24 nt, Human
cauguuggccaggcuggucucgaa

SEQ ID NO: 478328 - RNA, 18 nt, Human
cccgaguagcugggauga

SEQ ID NO: 478329 - RNA, 23 nt, Human
cccggguucaagcgauucuccug

SEQ ID NO: 478330 - RNA, 19 nt, Human
ccgcccgccucagccucuc

SEQ ID NO: 478331 - RNA, 24 nt, Human
ccucccggguucaagcgauucucc

SEQ ID NO: 478332 - RNA, 21 nt, Human
ccugacucaggugauccgccc

SEQ ID NO: 478333 - RNA, 19 nt, Human
ccuggaucagggccggagc

SEQ ID NO: 478334 - RNA, 24 nt, Human
cgccucagccucucaaaguguugg

SEQ ID NO: 478335 - RNA, 24 nt, Human
cggagguuucaccauguuggccag

SEQ ID NO: 478336 - RNA, 24 nt, Human
cucaaaguguuggauuacaggcgu

SEQ ID NO: 478337 - RNA, 24 nt, Human
cucacugcaaccucugccucccgg

SEQ ID NO: 478338 - RNA, 24 nt, Human
cucagccucccgaguagcugggau

SEQ ID NO: 478339 - RNA, 25 nt, Human
cuccugacucaggugauccgcccgc

SEQ ID NO: 478340 - RNA, 24 nt, Human
cugcaaccucugccucccggguuc

SEQ ID NO: 478341 - RNA, 23 nt, Human
cugccucagccucccgaguagcu

SEQ ID NO: 478342 - RNA, 23 nt, Human
gacaggugcaugccaccacucuc

SEQ ID NO: 478343 - RNA, 23 nt, Human
gacucaggugauccgcccgccuc

SEQ ID NO: 478344 - RNA, 23 nt, Human
gaguuaacaaaauaucuuuaaua

SEQ ID NO: 478345 - RNA, 18 nt, Human
gauuacaggcgugagcca

SEQ ID NO: 478346 - RNA, 22 nt, Human
gauuacaggcgugagccacggc

SEQ ID NO: 478347 - RNA, 20 nt, Human
gccucagccucccgaguagc

SEQ ID NO: 478348 - RNA, 23 nt, Human
gccucagccucucaaaguguugg

SEQ ID NO: 478349 - RNA, 24 nt, Human
gcgauucuccugccucagccuccc

SEQ ID NO: 478350 - RNA, 18 nt, Human
gcuggacggugggggugg

SEQ ID NO: 478351 - RNA, 20 nt, Human
ggagaccuguaaggcgaagu

SEQ ID NO: 478352 - RNA, 24 nt, Human
ggagguuucaccauguuggccagg

SEQ ID NO: 478353 - RNA, 25 nt, Human
gggugcaguccuggaucagggccgg

SEQ ID NO: 478354 - RNA, 18 nt, Human
gucugucacccagguugg

SEQ ID NO: 478355 - RNA, 22 nt, Human
gugauccgcccgccucagccuc

SEQ ID NO: 478356 - RNA, 24 nt, Human
gugauccgcccgccucagccucuc

SEQ ID NO: 478357 - RNA, 23 nt, Human
guggggguggggugcaguccugg

SEQ ID NO: 478358 - RNA, 18 nt, Human
guuucaccauguuggcca

SEQ ID NO: 478359 - RNA, 19 nt, Human
guuucaccauguuggccag

SEQ ID NO: 478360 - RNA, 25 nt, Human
uaauagagacggagguuucaccaug

SEQ ID NO: 478361 - RNA, 24 nt, Human
uaauuuuuguauuuuuaauagaga

SEQ ID NO: 478362 - RNA, 22 nt, Human
uacaggcgugagccacggcgcc

SEQ ID NO: 478363 - RNA, 22 nt, Human
uacaggcgugagccacggcgcc

SEQ ID NO: 478364 - RNA, 23 nt, Human
uacaggcgugagccacggcgccu

SEQ ID NO: 478365 - RNA, 23 nt, Human
uagcugggaugacaggugcaugc

SEQ ID NO: 478366 - RNA, 23 nt, Human
ucaaaguguuggauuacaggcgu

SEQ ID NO: 478367 - RNA, 24 nt, Human
ucacccagguuggagugcaguggc

SEQ ID NO: 478368 - RNA, 24 nt, Human
ucacugcaaccucugccucccggg

SEQ ID NO: 478369 - RNA, 25 nt, Human
ucacugcaaccucugccucccgggu

SEQ ID NO: 478370 - RNA, 20 nt, Human
ucagccucccgaguagcugg

SEQ ID NO: 478371 - RNA, 23 nt, Human
ucccgaguagcugggaugacagg

SEQ ID NO: 478372 - RNA, 21 nt, Human
ucccggguucaagcgauucuc

SEQ ID NO: 478373 - RNA, 24 nt, Human
ucccggguucaagcgauucuccug

SEQ ID NO: 478374 - RNA, 21 nt, Human
uccgcccgccucagccucuca

SEQ ID NO: 478375 - RNA, 23 nt, Human
ucucaaaguguuggauuacaggc

SEQ ID NO: 478376 - RNA, 24 nt, Human
ucuccugccucagccucccgagua

SEQ ID NO: 478377 - RNA, 22 nt, Human
ucucgaacuccugacucaggug

SEQ ID NO: 478378 - RNA, 18 nt, Human
ucugucacccagguugga

SEQ ID NO: 478379 - RNA, 20 nt, Human
ucugucacccagguuggagu

SEQ ID NO: 478380 - RNA, 24 nt, Human
ucugucacccagguuggagugcag

SEQ ID NO: 478381 - RNA, 24 nt, Human
ugacaggugcaugccaccacucuc

SEQ ID NO: 478382 - RNA, 23 nt, Human
ugacucaggugauccgcccgccu

SEQ ID NO: 478383 - RNA, 24 nt, Human
ugacucaggugauccgcccgccuc

SEQ ID NO: 478384 - RNA, 21 nt, Human
ugcaguccuggaucagggccg

SEQ ID NO: 478385 - RNA, 22 nt, Human
ugcaguggcgcgaucucggcuc

SEQ ID NO: 478386 - RNA, 25 nt, Human
ugccaccacucucggcuaauuuuug

SEQ ID NO: 478387 - RNA, 24 nt, Human
ugccucagccucccgaguagcugg

SEQ ID NO: 478388 - RNA, 23 nt, Human
uggagugcaguggcgcgaucucg

SEQ ID NO: 478389 - RNA, 24 nt, Human
uggagugcaguggcgcgaucucgg

SEQ ID NO: 478390 - RNA, 20 nt, Human
uggauuacaggcgugagcca

SEQ ID NO: 478391 - RNA, 25 nt, Human
uggauuacaggcgugagccacggcg

SEQ ID NO: 478392 - RNA, 24 nt, Human
uggccaggcuggucucgaacuccu

SEQ ID NO: 478393 - RNA, 21 nt, Human
uggcuggacgguggggguggg

SEQ ID NO: 478394 - RNA, 22 nt, Human
ugggaugacaggugcaugccac

SEQ ID NO: 478395 - RNA, 24 nt, Human
ugggaugacaggugcaugccacca

SEQ ID NO: 478396 - RNA, 22 nt, Human
uggggguggggugcaguccugg

SEQ ID NO: 478397 - RNA, 25 nt, Human
uuaauagagacggagguuucaccau

SEQ ID NO: 478398 - RNA, 21 nt, Human
uucaagcgauucuccugccuc

SEQ ID NO: 478399 - RNA, 23 nt, Human
uucaagcgauucuccugccucag

SEQ ID NO: 478400 - RNA, 24 nt, Human
uucaagcgauucuccugccucagc

SEQ ID NO: 478401 - RNA, 23 nt, Human
uuggauggcuggacggugggggu

SEQ ID NO: 478402 - RNA, 18 nt, Human
uuggauuacaggcgugag

SEQ ID NO: 478403 - RNA, 22 nt, Human
uuggauuacaggcgugagccac

SEQ ID NO: 478404 - RNA, 20 nt, Human
uuguuuguuuguuuuguuuu

SEQ ID NO: 478405 - RNA, 18 nt, Human
uuucaccauguuggccag

SEQ ID NO: 478406 - RNA, 24 nt, Human
uuucaccauguuggccaggcuggu

SEQ ID NO: 478407 - RNA, 25 nt, Human
uuuuuaauagagacggagguuucac

SEQ ID NO: 478408 - RNA, 20 nt, Human
uuuuuguauuuuuaauagag

SEQ ID NO: 478409 - RNA, 23 nt, Human
uuuuuguauuuuuaauagagacg

SEQ ID NO: 478410 - RNA, 23 nt, Human
uuuuuguuuguuuguuuuguuuu

SEQ ID NO: 478411 - RNA, 18 nt, Human
aaaagaaggcggagccug

SEQ ID NO: 478412 - RNA, 18 nt, Human
aaaagcaaaaggaaaggu

SEQ ID NO: 478413 - RNA, 19 nt, Human
aagcaaaaggaaagguucu

SEQ ID NO: 478414 - RNA, 18 nt, Human
aagcggcgucccuggggg

SEQ ID NO: 478415 - RNA, 21 nt, Human
aaggcggggccgccgagggga

SEQ ID NO: 478416 - RNA, 20 nt, Human
aaguucacacacacucacac

SEQ ID NO: 478417 - RNA, 22 nt, Human
acacucacacacagaucagaac

SEQ ID NO: 478418 - RNA, 23 nt, Human
accaggaacuucccaaauguccu

SEQ ID NO: 478419 - RNA, 21 nt, Human
accccgcggagaagaaaagaa

SEQ ID NO: 478420 - RNA, 19 nt, Human
acugaaucaccccgcggag

SEQ ID NO: 478421 - RNA, 18 nt, Human
agaagaaaagaaggcgga

SEQ ID NO: 478422 - RNA, 21 nt, Human
agaucgaggggcgcagagugg

SEQ ID NO: 478423 - RNA, 20 nt, Human
aggcggggccgccgagggga

SEQ ID NO: 478424 - RNA, 21 nt, Human
caaacccaaucacuggacuga

SEQ ID NO: 478425 - RNA, 21 nt, Human
cacacacacucacacacagau

SEQ ID NO: 478426 - RNA, 19 nt, Human
cacacucacacacagauca

SEQ ID NO: 478427 - RNA, 18 nt, Human
caccaggaacuucccaaa

SEQ ID NO: 478428 - RNA, 18 nt, Human
cacuggacugaaucaccc

SEQ ID NO: 478429 - RNA, 23 nt, Human
cagguuucuuaucccagggagaa

SEQ ID NO: 478430 - RNA, 20 nt, Human
cauuggguccgcgguaugac

SEQ ID NO: 478431 - RNA, 22 nt, Human
ccacaaacccaaucacuggacu

SEQ ID NO: 478432 - RNA, 21 nt, Human
cccuggggguguggguuuugg

SEQ ID NO: 478433 - RNA, 22 nt, Human
ccgccgaggggagcggggagcg

SEQ ID NO: 478434 - RNA, 20 nt, Human
ccugccgaccuggaggcggg

SEQ ID NO: 478435 - RNA, 21 nt, Human
ccuuaaaaaaagcaaaaggaa

SEQ ID NO: 478436 - RNA, 20 nt, Human
cgggguuuugucagagcugg

SEQ ID NO: 478437 - RNA, 21 nt, Human
cugcagaaagagccugggaga

SEQ ID NO: 478438 - RNA, 18 nt, Human
cugcccggcugcccaggg

SEQ ID NO: 478439 - RNA, 18 nt, Human
cugggauuagcaagaaaa

SEQ ID NO: 478440 - RNA, 21 nt, Human
cuuugagggugagggggccug

SEQ ID NO: 478441 - RNA, 18 nt, Human
gaccaaaccgagguugcu

SEQ ID NO: 478442 - RNA, 18 nt, Human
gcuggagucugggugcug

SEQ ID NO: 478443 - RNA, 19 nt, Human
ggccggugcuggagucugg

SEQ ID NO: 478444 - RNA, 18 nt, Human
gggagcggggacuuggga

SEQ ID NO: 478445 - RNA, 23 nt, Human
gggagcggggagcggggacuugg

SEQ ID NO: 478446 - RNA, 18 nt, Human
gucugggugcuggauggc

SEQ ID NO: 478447 - RNA, 20 nt, Human
gugggggccuuacuacccca

SEQ ID NO: 478448 - RNA, 19 nt, Human
uaaaaaaagcaaaaggaaa

SEQ ID NO: 478449 - RNA, 20 nt, Human
uacagagcguuuacaggcag

SEQ ID NO: 478450 - RNA, 19 nt, Human
uaccuggguggaggaggga

SEQ ID NO: 478451 - RNA, 19 nt, Human
uagggaccaaaccgagguu

SEQ ID NO: 478452 - RNA, 19 nt, Human
uaugacugcagaaagagcc

SEQ ID NO: 478453 - RNA, 23 nt, Human
ucccaaauguccuuaaaaaaagc

SEQ ID NO: 478454 - RNA, 22 nt, Human
ucccugcagccggagugggggu

SEQ ID NO: 478455 - RNA, 22 nt, Human
ucccuggggguguggguuuugg

SEQ ID NO: 478456 - RNA, 21 nt, Human
uccgcgguaugacugcagaaa

SEQ ID NO: 478457 - RNA, 21 nt, Human
uccuacaccaggaacuuccca

SEQ ID NO: 478458 - RNA, 20 nt, Human
ucgcugggacagggucccug

SEQ ID NO: 478459 - RNA, 18 nt, Human
ucggccggugcuggaguc

SEQ ID NO: 478460 - RNA, 25 nt, Human
ucugggugcuggauggcgcagccgg

SEQ ID NO: 478461 - RNA, 18 nt, Human
ugcccggcugcccagggg

SEQ ID NO: 478462 - RNA, 24 nt, Human
ugcuuauagaggaggcgggguuuu

SEQ ID NO: 478463 - RNA, 19 nt, Human
ugggauggguggaagggag

SEQ ID NO: 478464 - RNA, 20 nt, Human
uggggguguggguuuuggag

SEQ ID NO: 478465 - RNA, 24 nt, Human
uuccugaggaacuggauuccgagc

SEQ ID NO: 478466 - RNA, 23 nt, Human
uucugcccggcugcccaggggcu

SEQ ID NO: 478467 - RNA, 23 nt, Human
uugcucgguugggggcgcuacac

SEQ ID NO: 478468 - RNA, 21 nt, Human
aaaaaaaacaacagcagcaga

SEQ ID NO: 478469 - RNA, 22 nt, Human
aaaaaaaacaacagcagcagaa

SEQ ID NO: 478470 - RNA, 22 nt, Human
aaaaaagaaguacaaccaugga

SEQ ID NO: 478471 - RNA, 20 nt, Human
aaacaagauuggccaugagu

SEQ ID NO: 478472 - RNA, 18 nt, Human
aaacagccuccuccccca

SEQ ID NO: 478473 - RNA, 25 nt, Human
aaagugggcagacaacaaaucggua

SEQ ID NO: 478474 - RNA, 23 nt, Human
aagcuaaaaaaaacaacagcagc

SEQ ID NO: 478475 - RNA, 24 nt, Human
aauggaaagaccaauuucacuaga

SEQ ID NO: 478476 - RNA, 23 nt, Human
acaauugcccuuuaaagacucaa

SEQ ID NO: 478477 - RNA, 19 nt, Human
aggacaaacagccuccucc

SEQ ID NO: 478478 - RNA, 19 nt, Human
agggaugggcacacuggga

SEQ ID NO: 478479 - RNA, 23 nt, Human
agggaugggcacacugggaucca

SEQ ID NO: 478480 - RNA, 25 nt, Human
cagcagaacucucugguaguacauc

SEQ ID NO: 478481 - RNA, 20 nt, Human
cagcucagcaaggaaggcag

SEQ ID NO: 478482 - RNA, 21 nt, Human
cccagagagagaaggacaaac

SEQ ID NO: 478483 - RNA, 21 nt, Human
ccccagagagagaaggacaaa

SEQ ID NO: 478484 - RNA, 23 nt, Human
cucaaagaaagaaaagcuaaaaa

SEQ ID NO: 478485 - RNA, 21 nt, Human
cuuuaaagacucaaagaaaga

SEQ ID NO: 478486 - RNA, 20 nt, Human
gagguugagggaugggcaca

SEQ ID NO: 478487 - RNA, 21 nt, Human
ggacaaacagccuccuccccc

SEQ ID NO: 478488 - RNA, 19 nt, Human
ggggacaggcuagcaggaa

SEQ ID NO: 478489 - RNA, 19 nt, Human
gucgguaguccauugucuu

SEQ ID NO: 478490 - RNA, 24 nt, Human
uaaaaaucuuuauauccaaaaaag

SEQ ID NO: 478491 - RNA, 19 nt, Human
uauauccaaaaaagaagua

SEQ ID NO: 478492 - RNA, 26 nt, Human
uauccaaaaaagaaguacaaccuuga

SEQ ID NO: 478493 - RNA, 24 nt, Human
uccccucccucccucuccaggaga

SEQ ID NO: 478494 - RNA, 20 nt, Human
ugacuucaauccagagaggg

SEQ ID NO: 478495 - RNA, 22 nt, Human
ugcagaagaauccagagggaag

SEQ ID NO: 478496 - RNA, 26 nt, Human
uggcacaauaucugggacugguugca

SEQ ID NO: 478497 - RNA, 25 nt, Human
uguugcugcagguuuuuaaaucccc

SEQ ID NO: 478498 - RNA, 26 nt, Human
uuaaaaaaugcauuuaaaaaucuuua

SEQ ID NO: 478499 - RNA, 19 nt, Human
uuaaauccccucccucccu

SEQ ID NO: 478500 - RNA, 18 nt, Human
uucacuagaccuuccuca

SEQ ID NO: 478501 - RNA, 19 nt, Human
uugaagaauaggaaacaag

SEQ ID NO: 478502 - RNA, 23 nt, Human
uuuaaauccccucccucccucuc

SEQ ID NO: 478503 - RNA, 18 nt, Human
uuuuuuuuuuuuuguuuc

SEQ ID NO: 478504 - RNA, 23 nt, Human
uuuuuuuuuuuuuuuguuucaag

SEQ ID NO: 478505 - RNA, 23 nt, Human
uuuuuuuuuuuuuuuuguuucaa

SEQ ID NO: 478506 - RNA, 18 nt, Human
uuuuuuuuuuuuuuuuug

SEQ ID NO: 478507 - RNA, 22 nt, Human
uuuuuuuuuuuuuuuuuuguuu

SEQ ID NO: 478508 - RNA, 21 nt, Human
aaacaaaagauuugaagacaa

SEQ ID NO: 478509 - RNA, 26 nt, Human
aaagaacagcauaguaggauagccau

SEQ ID NO: 478510 - RNA, 22 nt, Human
aaagaaccuaauguuuucaagc

SEQ ID NO: 478511 - RNA, 23 nt, Human
aacacaggcaggaauaacuaccu

SEQ ID NO: 478512 - RNA, 18 nt, Human
aacacuuugggaggcuga

SEQ ID NO: 478513 - RNA, 24 nt, Human
aacacuuugggaggcugagguggg

SEQ ID NO: 478514 - RNA, 20 nt, Human
aacagaaaauucuacaugag

SEQ ID NO: 478515 - RNA, 22 nt, Human
aacccacaaaucucacaaaaag

SEQ ID NO: 478516 - RNA, 20 nt, Human
aacguggcaaaacccugucu

SEQ ID NO: 478517 - RNA, 21 nt, Human
aacuggaguuaaaucaugucc

SEQ ID NO: 478518 - RNA, 23 nt, Human
aagaaccuaauguuuucaagcau

SEQ ID NO: 478519 - RNA, 18 nt, Human
aagcaaaacacaagacca

SEQ ID NO: 478520 - RNA, 19 nt, Human
aagcaaaacacaagaccaa

SEQ ID NO: 478521 - RNA, 22 nt, Human
aagcaaaacacaagaccaauag

SEQ ID NO: 478522 - RNA, 20 nt, Human
aaguucagauauuugaggau

SEQ ID NO: 478523 - RNA, 24 nt, Human
aaugucuguaaucccaacacuuug

SEQ ID NO: 478524 - RNA, 23 nt, Human
acaccagaagcuuguauaagaca

SEQ ID NO: 478525 - RNA, 24 nt, Human
acagaguaagacccugucucagaa

SEQ ID NO: 478526 - RNA, 24 nt, Human
acccugucucuacaaaaaaugcaa

SEQ ID NO: 478527 - RNA, 24 nt, Human
acugcacuccagccugggcgacag

SEQ ID NO: 478528 - RNA, 26 nt, Human
acugcacuccagccugggcgacagag

SEQ ID NO: 478529 - RNA, 20 nt, Human
acuuaggaggcugagguggg

SEQ ID NO: 478530 - RNA, 23 nt, Human
agacagaagccuuggggacaaug

SEQ ID NO: 478531 - RNA, 23 nt, Human
agacagaagccuugggggggacc

SEQ ID NO: 478532 - RNA, 19 nt, Human
agagggauccuuagaacca

SEQ ID NO: 478533 - RNA, 20 nt, Human
agauauguuggaggggcuau

SEQ ID NO: 478534 - RNA, 23 nt, Human
agccaggugugguggcacgcgcc

SEQ ID NO: 478535 - RNA, 22 nt, Human
agccugggcgacagaguaagac

SEQ ID NO: 478536 - RNA, 19 nt, Human
agcuuccaguagaagacuc

SEQ ID NO: 478537 - RNA, 18 nt, Human
aggaagaaaacaaaagau

SEQ ID NO: 478538 - RNA, 23 nt, Human
aggaguucaagaccagccuaagc

SEQ ID NO: 478539 - RNA, 24 nt, Human
aggcugaggugggaggauugcuug

SEQ ID NO: 478540 - RNA, 24 nt, Human
aggcugaggugggcggaucacuug

SEQ ID NO: 478541 - RNA, 21 nt, Human
agggcuucugagcccuucuuu

SEQ ID NO: 478542 - RNA, 21 nt, Human
agggcuucugagcccuucuuu

SEQ ID NO: 478543 - RNA, 22 nt, Human
aggucgaggcugcagugagccg

SEQ ID NO: 478544 - RNA, 22 nt, Human
aggugggaggauugcuugagcu

SEQ ID NO: 478545 - RNA, 24 nt, Human
aggugugguggcacgcgccuguag

SEQ ID NO: 478546 - RNA, 19 nt, Human
aguagacagaagccuuggg

SEQ ID NO: 478547 - RNA, 27 nt, Human
aguagacagaagccuugggggggaccc

SEQ ID NO: 478548 - RNA, 18 nt, Human
aguucaggaguucaagac

SEQ ID NO: 478549 - RNA, 21 nt, Human
aguucaggaguucaagaccag

SEQ ID NO: 478550 - RNA, 25 nt, Human
auaaagauuauuggaaagcuucagu

SEQ ID NO: 478551 - RNA, 20 nt, Human
auaguugucgagaaaggagg

SEQ ID NO: 478552 - RNA, 24 nt, Human
aucacugcacuccagccugggcga

SEQ ID NO: 478553 - RNA, 23 nt, Human
aucacuugaguucaggaguucaa

SEQ ID NO: 478554 - RNA, 24 nt, Human
aucacuugaguucaggaguucaag

SEQ ID NO: 478555 - RNA, 22 nt, Human
auggcuaaugucuguaauccca

SEQ ID NO: 478556 - RNA, 19 nt, Human
auuccauuaccaaagaaca

SEQ ID NO: 478557 - RNA, 24 nt, Human
auugcaucacugcacuccagccug

SEQ ID NO: 478558 - RNA, 22 nt, Human
auuuauaaggcacaaaacccac

SEQ ID NO: 478559 - RNA, 20 nt, Human
caaaaaaugcaaaaauuagc

SEQ ID NO: 478560 - RNA, 21 nt, Human
caaaacccacaaaucucacaa

SEQ ID NO: 478561 - RNA, 22 nt, Human
caacaacaaaacucuuaaaucc

SEQ ID NO: 478562 - RNA, 24 nt, Human
caacacuuugggaggcugaggugg

SEQ ID NO: 478563 - RNA, 22 nt, Human
caacguggcaaaacccugucuc

SEQ ID NO: 478564 - RNA, 24 nt, Human
caacguggcaaaacccugucucua

SEQ ID NO: 478565 - RNA, 19 nt, Human
caagcaaaacacaagacca

SEQ ID NO: 478566 - RNA, 20 nt, Human
caauagaauuaguagacaga

SEQ ID NO: 478567 - RNA, 23 nt, Human
caauauauauuuuuucuuauccc

SEQ ID NO: 478568 - RNA, 18 nt, Human
cacaauucccccauccuc

SEQ ID NO: 478569 - RNA, 22 nt, Human
caccaccuaucccauagaagcu

SEQ ID NO: 478570 - RNA, 22 nt, Human
caccuacuuacuuuccagucca

SEQ ID NO: 478571 - RNA, 19 nt, Human
cacugcacuccagccuggg

SEQ ID NO: 478572 - RNA, 20 nt, Human
cacugcacuccagccugggc

SEQ ID NO: 478573 - RNA, 20 nt, Human
cacugcacuccagccugggc

SEQ ID NO: 478574 - RNA, 22 nt, Human
cacugcacuccagccugggcga

SEQ ID NO: 478575 - RNA, 23 nt, Human
cacugcacuccagccugggcgac

SEQ ID NO: 478576 - RNA, 24 nt, Human
cacugcacuccagccugggcgaca

SEQ ID NO: 478577 - RNA, 26 nt, Human
cacugcacuccagccugggcgacaga

SEQ ID NO: 478578 - RNA, 22 nt, Human
cacuucagagaaaacugccagg

SEQ ID NO: 478579 - RNA, 18 nt, Human
cagaacagaaaauucuac

SEQ ID NO: 478580 - RNA, 20 nt, Human
cagcccgcgcucccgccucg

SEQ ID NO: 478581 - RNA, 24 nt, Human
cagggaccaauccacaguaaacac

SEQ ID NO: 478582 - RNA, 24 nt, Human
cagguacuuaggaggcugaggugg

SEQ ID NO: 478583 - RNA, 22 nt, Human
caucuaagaaaacaauguagcu

SEQ ID NO: 478584 - RNA, 18 nt, Human
caugaagaugauucuccu

SEQ ID NO: 478585 - RNA, 21 nt, Human
caugcacuccgugccgcgccc

SEQ ID NO: 478586 - RNA, 18 nt, Human
cauuccaacagggugagg

SEQ ID NO: 478587 - RNA, 23 nt, Human
ccaacuaauccuaccaagagcuu

SEQ ID NO: 478588 - RNA, 18 nt, Human
ccagcccgcgcucccgcc

SEQ ID NO: 478589 - RNA, 23 nt, Human
ccagccuaagcaacguggcaaaa

SEQ ID NO: 478590 - RNA, 19 nt, Human
cccaagcaccaccuauccc

SEQ ID NO: 478591 - RNA, 21 nt, Human
cccaauaacccagaacagaaa

SEQ ID NO: 478592 - RNA, 23 nt, Human
ccccuggaggccauagucggaau

SEQ ID NO: 478593 - RNA, 20 nt, Human
cccgcggguggcugugaccc

SEQ ID NO: 478594 - RNA, 20 nt, Human
cccgugcgcguagcccagcc

SEQ ID NO: 478595 - RNA, 24 nt, Human
cccucccuucuccuuccaacuuuc

SEQ ID NO: 478596 - RNA, 28 nt, Human
cccucccuucuccuuccaacuuucaaaa

SEQ ID NO: 478597 - RNA, 20 nt, Human
cccuucuccuuccaacuuuc

SEQ ID NO: 478598 - RNA, 21 nt, Human
cccuucuccuuccaacuuuca

SEQ ID NO: 478599 - RNA, 21 nt, Human
ccgccucggggucccggccac

SEQ ID NO: 478600 - RNA, 19 nt, Human
ccguaauaaagaaaacuuc

SEQ ID NO: 478601 - RNA, 20 nt, Human
ccuauuucuuucuagcuucc

SEQ ID NO: 478602 - RNA, 23 nt, Human
ccuuagaaccaacuaauccuacc

SEQ ID NO: 478603 - RNA, 20 nt, Human
ccuucuucccuucugcucuc

SEQ ID NO: 478604 - RNA, 21 nt, Human
cgccuguaguaccagguacuu

SEQ ID NO: 478605 - RNA, 24 nt, Human
cggaucacuugaguucaggaguuc

SEQ ID NO: 478606 - RNA, 19 nt, Human
cggggucccggccacgagc

SEQ ID NO: 478607 - RNA, 19 nt, Human
cgugcgcguagcccagccc

SEQ ID NO: 478608 - RNA, 21 nt, Human
cuagguuaguuuugugggucc

SEQ ID NO: 478609 - RNA, 20 nt, Human
cucaaugccucucaaauauc

SEQ ID NO: 478610 - RNA, 22 nt, Human
cucacccaaaggagccuucagg

SEQ ID NO: 478611 - RNA, 23 nt, Human
cuccacacguugccccacuugcc

SEQ ID NO: 478612 - RNA, 21 nt, Human
cugaaaugggaaaugaacccc

SEQ ID NO: 478613 - RNA, 21 nt, Human
cugcagugagccgugauugca

SEQ ID NO: 478614 - RNA, 18 nt, Human
cuggacuuuggguuccuc

SEQ ID NO: 478615 - RNA, 25 nt, Human
cugucucuacaaaaaaugcaaaaag

SEQ ID NO: 478616 - RNA, 23 nt, Human
cuguuucuagggcaggcgugaug

SEQ ID NO: 478617 - RNA, 20 nt, Human
cuucccucccuucuccuucc

SEQ ID NO: 478618 - RNA, 20 nt, Human
cuucccuucugcucucuucc

SEQ ID NO: 478619 - RNA, 23 nt, Human
cuugaguucaggaguucaagacc

SEQ ID NO: 478620 - RNA, 24 nt, Human
cuuuuaggaauugccccuggaggc

SEQ ID NO: 478621 - RNA, 21 nt, Human
gacagaguaagacccugucuc

SEQ ID NO: 478622 - RNA, 18 nt, Human
gacccugucucagaaaaa

SEQ ID NO: 478623 - RNA, 20 nt, Human
gagcuucccgcggguggcug

SEQ ID NO: 478624 - RNA, 23 nt, Human
gagcuugacuuacaccuucuucc

SEQ ID NO: 478625 - RNA, 21 nt, Human
gaggugggaggauugcuugag

SEQ ID NO: 478626 - RNA, 23 nt, Human
gaucacuugaguucaggaguuca

SEQ ID NO: 478627 - RNA, 24 nt, Human
gaucacuugaguucaggaguucaa

SEQ ID NO: 478628 - RNA, 19 nt, Human
gauucccuggugcaacccc

SEQ ID NO: 478629 - RNA, 21 nt, Human
gcaauaucuucaugccuguuc

SEQ ID NO: 478630 - RNA, 19 nt, Human
gcaaucaagcaaaacacaa

SEQ ID NO: 478631 - RNA, 23 nt, Human
gcacuccagccugggcgacagag

SEQ ID NO: 478632 - RNA, 24 nt, Human
gcacuccagccugggcgacagagu

SEQ ID NO: 478633 - RNA, 19 nt, Human
gccacaacacaucaauccc

SEQ ID NO: 478634 - RNA, 24 nt, Human
gcccgugcgcguagcccagcccgg

SEQ ID NO: 478635 - RNA, 19 nt, Human
gccucggggucccggccac

SEQ ID NO: 478636 - RNA, 23 nt, Human
gcgacagaguaagacccugucuc

SEQ ID NO: 478637 - RNA, 24 nt, Human
gcuggggaggucgaggcugcagug

SEQ ID NO: 478638 - RNA, 22 nt, Human
gcuuccugaauguccacaugaa

SEQ ID NO: 478639 - RNA, 23 nt, Human
gcuucugagcccuucuuuugaca

SEQ ID NO: 478640 - RNA, 23 nt, Human
ggaggcuggacuuuggguuccuc

SEQ ID NO: 478641 - RNA, 23 nt, Human
ggauagccauuccaacaggguga

SEQ ID NO: 478642 - RNA, 23 nt, Human
ggaucacuugaguucaggaguuc

SEQ ID NO: 478643 - RNA, 19 nt, Human
ggcaggaauaacuaccuuc

SEQ ID NO: 478644 - RNA, 20 nt, Human
gggaggauugcuugagcugg

SEQ ID NO: 478645 - RNA, 20 nt, Human
gggaggcugaggugggcgga

SEQ ID NO: 478646 - RNA, 18 nt, Human
guggauuugaacuaaaga

SEQ ID NO: 478647 - RNA, 22 nt, Human
gugggaggauugcuugagcugg

SEQ ID NO: 478648 - RNA, 18 nt, Human
uaaagaucucugcccaca

SEQ ID NO: 478649 - RNA, 19 nt, Human
uaaaguuaaccagcagaau

SEQ ID NO: 478650 - RNA, 18 nt, Human
uaaauuaagagagagaga

SEQ ID NO: 478651 - RNA, 21 nt, Human
uaacuaagggaccucauacug

SEQ ID NO: 478652 - RNA, 25 nt, Human
uaacucucaaguaauccuguagucc

SEQ ID NO: 478653 - RNA, 21 nt, Human
uagaaccaacuaauccuacca

SEQ ID NO: 478654 - RNA, 21 nt, Human
uagacaccagaagcuuguaua

SEQ ID NO: 478655 - RNA, 21 nt, Human
uagagggauccuuagaaccaa

SEQ ID NO: 478656 - RNA, 26 nt, Human
uagcccagcccggcccagcccgcgcu

SEQ ID NO: 478657 - RNA, 22 nt, Human
uaggaggcugaggugggaggau

SEQ ID NO: 478658 - RNA, 24 nt, Human
uaggaggcugaggugggaggauug

SEQ ID NO: 478659 - RNA, 23 nt, Human
uagucaagaucccuucccuuccu

SEQ ID NO: 478660 - RNA, 23 nt, Human
uaguuuuuucaaagguauuuaca

SEQ ID NO: 478661 - RNA, 18 nt, Human
uauccauucagcuuuuag

SEQ ID NO: 478662 - RNA, 21 nt, Human
uauguuuguuuguggccaaaa

SEQ ID NO: 478663 - RNA, 22 nt, Human
uauuggaaagcuucaguugaau

SEQ ID NO: 478664 - RNA, 21 nt, Human
ucacugcacuccagccugggc

SEQ ID NO: 478665 - RNA, 24 nt, Human
ucacugcacuccagccugggcgac

SEQ ID NO: 478666 - RNA, 25 nt, Human
ucaguucaacccaguucaguuuugc

SEQ ID NO: 478667 - RNA, 24 nt, Human
uccagccugggcgacagaguaaga

SEQ ID NO: 478668 - RNA, 23 nt, Human
ucccuggugcaacccccagaucu

SEQ ID NO: 478669 - RNA, 23 nt, Human
uccguaauaaagaaaacuucaaa

SEQ ID NO: 478670 - RNA, 22 nt, Human
uccuuuggcuuucaaacacugc

SEQ ID NO: 478671 - RNA, 25 nt, Human
ucuaagcugaagcagaaccgggguc

SEQ ID NO: 478672 - RNA, 26 nt, Human
ucucaaguaauccuguaguccaccgu

SEQ ID NO: 478673 - RNA, 19 nt, Human
ucugcucuaagcugaagca

SEQ ID NO: 478674 - RNA, 18 nt, Human
ucugcucucuucccuccc

SEQ ID NO: 478675 - RNA, 22 nt, Human
ugaaacuacagugcaguaacca

SEQ ID NO: 478676 - RNA, 19 nt, Human
ugaaaugggaaaugaaccc

SEQ ID NO: 478677 - RNA, 18 nt, Human
ugaacaggugggcaacac

SEQ ID NO: 478678 - RNA, 20 nt, Human
ugacacagccuccuucacug

SEQ ID NO: 478679 - RNA, 19 nt, Human
ugagcuggggaggucgagg

SEQ ID NO: 478680 - RNA, 20 nt, Human
ugaggugggaggauugcuug

SEQ ID NO: 478681 - RNA, 22 nt, Human
ugaggugggaggauugcuugag

SEQ ID NO: 478682 - RNA, 23 nt, Human
ugaggugggaggauugcuugagc

SEQ ID NO: 478683 - RNA, 23 nt, Human
ugaggugggaggauugcuugagc

SEQ ID NO: 478684 - RNA, 21 nt, Human
ugaggugggcggaucacuuga

SEQ ID NO: 478685 - RNA, 22 nt, Human
ugaggugggcggaucacuugag

SEQ ID NO: 478686 - RNA, 22 nt, Human
ugaggugggcggaucacuugag

SEQ ID NO: 478687 - RNA, 23 nt, Human
ugaggugggcggaucacuugagu

SEQ ID NO: 478688 - RNA, 25 nt, Human
ugaggugggcggaucacuugaguug

SEQ ID NO: 478689 - RNA, 20 nt, Human
ugaguaagacaugaaugcca

SEQ ID NO: 478690 - RNA, 24 nt, Human
ugauggcuaaugucuguaauccca

SEQ ID NO: 478691 - RNA, 21 nt, Human
ugcaucacugcacuccagccu

SEQ ID NO: 478692 - RNA, 18 nt, Human
ugcuaaauuuucaggcau

SEQ ID NO: 478693 - RNA, 22 nt, Human
uggaaguaugacugcuuccuag

SEQ ID NO: 478694 - RNA, 28 nt, Human
uggacaacuugaaauccaaaugaaauuc

SEQ ID NO: 478695 - RNA, 24 nt, Human
uggcuaaugucuguaaucccaaca

SEQ ID NO: 478696 - RNA, 20 nt, Human
uggcugggccuccugguggc

SEQ ID NO: 478697 - RNA, 23 nt, Human
ugggaaaugaaccccuagagucu

SEQ ID NO: 478698 - RNA, 18 nt, Human
ugggaggcugaggugggc

SEQ ID NO: 478699 - RNA, 19 nt, Human
ugggaggcugaggugggcg

SEQ ID NO: 478700 - RNA, 24 nt, Human
ugggaggcugaggugggcggauca

SEQ ID NO: 478701 - RNA, 22 nt, Human
uggguuccucuugaaauaauga

SEQ ID NO: 478702 - RNA, 18 nt, Human
uguaucaaguuuucucca

SEQ ID NO: 478703 - RNA, 23 nt, Human
ugucacaggccauuaacaauguu

SEQ ID NO: 478704 - RNA, 19 nt, Human
uguccuagacaccagaagc

SEQ ID NO: 478705 - RNA, 23 nt, Human
ugucuguaaucccaacacuuugg

SEQ ID NO: 478706 - RNA, 23 nt, Human
ugucuguaaucccaacacuuugg

SEQ ID NO: 478707 - RNA, 24 nt, Human
ugucuguaaucccaacacuuuggg

SEQ ID NO: 478708 - RNA, 20 nt, Human
uguugagugaaguacuuucc

SEQ ID NO: 478709 - RNA, 21 nt, Human
uuacaccuucuucccuucugc

SEQ ID NO: 478710 - RNA, 19 nt, Human
uuauauucaagagcuugac

SEQ ID NO: 478711 - RNA, 19 nt, Human
uuccugugcucaucauguc

SEQ ID NO: 478712 - RNA, 25 nt, Human
uucugcucucuucccucccuucucc

SEQ ID NO: 478713 - RNA, 30 nt, Human
uucugcucucuucccucccuucuccuuccc

SEQ ID NO: 478714 - RNA, 23 nt, Human
uugaggauuaacaggagaaaucc

SEQ ID NO: 478715 - RNA, 23 nt, Human
uugcaucacugcacuccagccug

SEQ ID NO: 478716 - RNA, 18 nt, Human
uugcuugagcuggggagg

SEQ ID NO: 478717 - RNA, 20 nt, Human
uuggaaagcuucaguugaau

SEQ ID NO: 478718 - RNA, 25 nt, Human
uugggaggcugaggugggcggauca

SEQ ID NO: 478719 - RNA, 21 nt, Human
uuucugaaguuucuuucauuc

SEQ ID NO: 478720 - RNA, 20 nt, Human
uuugaggauuaacaggagaa

SEQ ID NO: 478721 - RNA, 23 nt, Human
uuuuuugccaagcaaucaagcaa

SEQ ID NO: 478722 - RNA, 18 nt, Human
aacugagacaaaaugaca

SEQ ID NO: 478723 - RNA, 19 nt, Human
acaacugagacaaaaugac

SEQ ID NO: 478724 - RNA, 22 nt, Human
acccucccccagcacgcacaca

SEQ ID NO: 478725 - RNA, 24 nt, Human
acccucccccagcacgcacacaca

SEQ ID NO: 478726 - RNA, 23 nt, Human
agaaagguuccgcuaccgccucc

SEQ ID NO: 478727 - RNA, 24 nt, Human
aguaggaagaaauugcacaacuga

SEQ ID NO: 478728 - RNA, 20 nt, Human
caacugagacaaaaugacaa

SEQ ID NO: 478729 - RNA, 22 nt, Human
cacccacuuccuaccauacagg

SEQ ID NO: 478730 - RNA, 24 nt, Human
cacgcacacacauacucuccugug

SEQ ID NO: 478731 - RNA, 21 nt, Human
caguccuuuugcugucauggu

SEQ ID NO: 478732 - RNA, 18 nt, Human
cccucccccagcacgcac

SEQ ID NO: 478733 - RNA, 18 nt, Human
ccgcuaccgccuccuccu

SEQ ID NO: 478734 - RNA, 22 nt, Human
ccgcuaccgccuccuccugugc

SEQ ID NO: 478735 - RNA, 21 nt, Human
cuaaucagaauaagacuucca

SEQ ID NO: 478736 - RNA, 24 nt, Human
cucauuuggauuucaauguuuccu

SEQ ID NO: 478737 - RNA, 24 nt, Human
cuggacauauugacauauuaaagu

SEQ ID NO: 478738 - RNA, 22 nt, Human
gaaaggcucuugaaacuccuuu

SEQ ID NO: 478739 - RNA, 22 nt, Human
gaagcgagaaccaggcggagga

SEQ ID NO: 478740 - RNA, 21 nt, Human
gacauauugacauauuaaagu

SEQ ID NO: 478741 - RNA, 18 nt, Human
gacuguggaagacaggag

SEQ ID NO: 478742 - RNA, 21 nt, Human
gccacacccacuuccuaccau

SEQ ID NO: 478743 - RNA, 24 nt, Human
gccacacccacuuccuaccauaca

SEQ ID NO: 478744 - RNA, 24 nt, Human
ggcaaguaggaagaaauugcacaa

SEQ ID NO: 478745 - RNA, 21 nt, Human
gucuccagagccaccccuuuc

SEQ ID NO: 478746 - RNA, 18 nt, Human
guucagagauccagacca

SEQ ID NO: 478747 - RNA, 18 nt, Human
uaaauagucuucuuaacu

SEQ ID NO: 478748 - RNA, 20 nt, Human
uacucaggugacuuucuggu

SEQ ID NO: 478749 - RNA, 22 nt, Human
ucagcaaucugcccauguuccu

SEQ ID NO: 478750 - RNA, 23 nt, Human
uccacauaaggaaguuauuccug

SEQ ID NO: 478751 - RNA, 19 nt, Human
uccugggagaaaucagucc

SEQ ID NO: 478752 - RNA, 18 nt, Human
ucucuggacauauugaca

SEQ ID NO: 478753 - RNA, 21 nt, Human
ucugcccauguuccugggaga

SEQ ID NO: 478754 - RNA, 27 nt, Human
ugacaagaaaggcucuugaaacucccu

SEQ ID NO: 478755 - RNA, 22 nt, Human
uggaagacaggagggaguuggg

SEQ ID NO: 478756 - RNA, 18 nt, Human
uggcuuuuuguuuuaagu

SEQ ID NO: 478757 - RNA, 19 nt, Human
ugucauggugucuccagag

SEQ ID NO: 478758 - RNA, 24 nt, Human
uguggaagacaggagggaguuggg

SEQ ID NO: 478759 - RNA, 23 nt, Human
uucaagcaagggcaucagguaaa

SEQ ID NO: 478760 - RNA, 19 nt, Human
uugcuucaacuguuacaaa

SEQ ID NO: 478761 - RNA, 18 nt, Human
uuuauagggccuucaagc

SEQ ID NO: 478762 - RNA, 21 nt, Human
uuuuuguuuuaaguauaagaa

SEQ ID NO: 478763 - RNA, 24 nt, Human
aaaaaaaagaaaaaaaaaucccac

SEQ ID NO: 478764 - RNA, 24 nt, Human
aaaagaaaaaaaaaucccacuaaa

SEQ ID NO: 478765 - RNA, 21 nt, Human
aaaagacaaaacuucuuccug

SEQ ID NO: 478766 - RNA, 18 nt, Human
aaacugaacaauguuucc

SEQ ID NO: 478767 - RNA, 19 nt, Human
aaccuggauuaaccuagca

SEQ ID NO: 478768 - RNA, 20 nt, Human
aaccugguugcuucuaauga

SEQ ID NO: 478769 - RNA, 21 nt, Human
aacuuugaaacaacuaagcag

SEQ ID NO: 478770 - RNA, 24 nt, Human
aagcaaccaacaauaagcaaacag

SEQ ID NO: 478771 - RNA, 22 nt, Human
aagccucagacaguaaucccaa

SEQ ID NO: 478772 - RNA, 25 nt, Human
aagcugcuacagcaaacccaucagg

SEQ ID NO: 478773 - RNA, 20 nt, Human
aagcuuugccaaacuuaaaa

SEQ ID NO: 478774 - RNA, 24 nt, Human
aaggaaacaaaucacaggcgcuaa

SEQ ID NO: 478775 - RNA, 20 nt, Human
aauccuuuuuagcagucagg

SEQ ID NO: 478776 - RNA, 28 nt, Human
acacacacauauaauuuauacacacaua

SEQ ID NO: 478777 - RNA, 24 nt, Human
acauaagcuuugccaaacuuaaaa

SEQ ID NO: 478778 - RNA, 27 nt, Human
accacucccuccccgcgaccccuccug

SEQ ID NO: 478779 - RNA, 23 nt, Human
accuaacacacuucaucuucaac

SEQ ID NO: 478780 - RNA, 23 nt, Human
acuacauaugcacaagacuauag

SEQ ID NO: 478781 - RNA, 20 nt, Human
acucauuugucaagaguuag

SEQ ID NO: 478782 - RNA, 21 nt, Human
acucauuugucaagaguuagg

SEQ ID NO: 478783 - RNA, 20 nt, Human
agaacaccucaaagcaggca

SEQ ID NO: 478784 - RNA, 24 nt, Human
agcaaaacaagaucauuccacaga

SEQ ID NO: 478785 - RNA, 18 nt, Human
agcuggauuuacugcaaa

SEQ ID NO: 478786 - RNA, 18 nt, Human
agcuguuuuugcuugcau

SEQ ID NO: 478787 - RNA, 21 nt, Human
aggagaaagggugguuuuagg

SEQ ID NO: 478788 - RNA, 22 nt, Human
aggaguucuugaggcagcugga

SEQ ID NO: 478789 - RNA, 23 nt, Human
aggcacuuugauguauauuggug

SEQ ID NO: 478790 - RNA, 18 nt, Human
aggcucuuccaaacaaaa

SEQ ID NO: 478791 - RNA, 23 nt, Human
agguuguggagauuaugugguug

SEQ ID NO: 478792 - RNA, 21 nt, Human
agugcagcggcuguugcagcu

SEQ ID NO: 478793 - RNA, 25 nt, Human
auaaacacaaaaggaaacaaaucac

SEQ ID NO: 478794 - RNA, 24 nt, Human
auaaauuuuaagcaauugugcaaa

SEQ ID NO: 478795 - RNA, 27 nt, Human
augcucccacaucuauuaaaagauaca

SEQ ID NO: 478796 - RNA, 24 nt, Human
auugaacugaaauaguaaugccag

SEQ ID NO: 478797 - RNA, 23 nt, Human
caaagugagcagauacuugaucc

SEQ ID NO: 478798 - RNA, 24 nt, Human
caaagugagcagauacuugauccc

SEQ ID NO: 478799 - RNA, 22 nt, Human
caaccaacaauaagcaaacaga

SEQ ID NO: 478800 - RNA, 22 nt, Human
caacuaagcuaccaacccugaa

SEQ ID NO: 478801 - RNA, 24 nt, Human
caacuaagcuaccaacccugaagu

SEQ ID NO: 478802 - RNA, 23 nt, Human
cacaagacuauaguacacacaaa

SEQ ID NO: 478803 - RNA, 21 nt, Human
cacacuaggccagauaaacac

SEQ ID NO: 478804 - RNA, 26 nt, Human
cacuucaucuucaacaacaacaaaaa

SEQ ID NO: 478805 - RNA, 21 nt, Human
cagaaaacuuugaaacaacua

SEQ ID NO: 478806 - RNA, 19 nt, Human
cagauacagcaaacccaua

SEQ ID NO: 478807 - RNA, 20 nt, Human
cagcuguuuuugcuugcauu

SEQ ID NO: 478808 - RNA, 18 nt, Human
caggagaaccugguugcu

SEQ ID NO: 478809 - RNA, 22 nt, Human
caggugcuggcacuuccaacua

SEQ ID NO: 478810 - RNA, 19 nt, Human
cauauaaaauguauauaua

SEQ ID NO: 478811 - RNA, 22 nt, Human
caucacacauuucuucucuugu

SEQ ID NO: 478812 - RNA, 21 nt, Human
ccaacaauaagcaaacagaaa

SEQ ID NO: 478813 - RNA, 22 nt, Human
ccagaccccugccgccugcgcu

SEQ ID NO: 478814 - RNA, 18 nt, Human
ccccgcgaccccuccugc

SEQ ID NO: 478815 - RNA, 25 nt, Human
ccccugccgccugcgcucaccacuc

SEQ ID NO: 478816 - RNA, 26 nt, Human
ccccugccgccugcgcucaccacucc

SEQ ID NO: 478817 - RNA, 20 nt, Human
cccugaaguaagcaagaaaa

SEQ ID NO: 478818 - RNA, 19 nt, Human
ccgcugccaccccagcugc

SEQ ID NO: 478819 - RNA, 19 nt, Human
ccuccccgcgaccccuccu

SEQ ID NO: 478820 - RNA, 20 nt, Human
ccuccguucugcaaggcuuu

SEQ ID NO: 478821 - RNA, 19 nt, Human
ccuccugcgccgcugccac

SEQ ID NO: 478822 - RNA, 21 nt, Human
ccugccgccugcgcucaccac

SEQ ID NO: 478823 - RNA, 21 nt, Human
ccuggaggcggccgccccuuc

SEQ ID NO: 478824 - RNA, 22 nt, Human
ccuggaggcggccgccccuucu

SEQ ID NO: 478825 - RNA, 19 nt, Human
ccugugacgcagccuauag

SEQ ID NO: 478826 - RNA, 20 nt, Human
cgaacuggcggcucuugcug

SEQ ID NO: 478827 - RNA, 22 nt, Human
cgagcgagagcgaaaccgagag

SEQ ID NO: 478828 - RNA, 24 nt, Human
cuccugcgccgcugccaccccagc

SEQ ID NO: 478829 - RNA, 21 nt, Human
cuggaggcggccgccccuucu

SEQ ID NO: 478830 - RNA, 22 nt, Human
cuguaaacaaaauucacaaucu

SEQ ID NO: 478831 - RNA, 24 nt, Human
cuuugguccuugagcacacuuucu

SEQ ID NO: 478832 - RNA, 18 nt, Human
cuuuuuagcagucaggga

SEQ ID NO: 478833 - RNA, 19 nt, Human
gaaaacaacuuuaugcaca

SEQ ID NO: 478834 - RNA, 19 nt, Human
gagcagauacagcaaaccc

SEQ ID NO: 478835 - RNA, 19 nt, Human
gagcgcagcgagcgagagc

SEQ ID NO: 478836 - RNA, 23 nt, Human
gaucacucuuuuuuuuuucuuuu

SEQ ID NO: 478837 - RNA, 24 nt, Human
gaucacucuuuuuuuuuucuuuuu

SEQ ID NO: 478838 - RNA, 24 nt, Human
gcaaacccauauugucaucacaca

SEQ ID NO: 478839 - RNA, 23 nt, Human
gcacuuugauguauauuggugug

SEQ ID NO: 478840 - RNA, 26 nt, Human
gcucaccacucccuccccgcgacccc

SEQ ID NO: 478841 - RNA, 22 nt, Human
ggcuuuuugguuucaccuaaca

SEQ ID NO: 478842 - RNA, 22 nt, Human
gguuggagggagagacagccag

SEQ ID NO: 478843 - RNA, 20 nt, Human
guaaaccuuuaaaaacggca

SEQ ID NO: 478844 - RNA, 19 nt, Human
gugguccagaaaugcagaa

SEQ ID NO: 478845 - RNA, 19 nt, Human
guguauauauacauauaaa

SEQ ID NO: 478846 - RNA, 21 nt, Human
uaaacugauucacaaguugga

SEQ ID NO: 478847 - RNA, 22 nt, Human
uaaagaaacagcacacuaggcc

SEQ ID NO: 478848 - RNA, 21 nt, Human
uaacaaauauaaucucucuuc

SEQ ID NO: 478849 - RNA, 21 nt, Human
uaacaagcguugcauugaaaa

SEQ ID NO: 478850 - RNA, 24 nt, Human
uaagucuuaaaguaaaugcuagaa

SEQ ID NO: 478851 - RNA, 19 nt, Human
uaauuuuuuuagaugugga

SEQ ID NO: 478852 - RNA, 22 nt, Human
uacaaguauuugcaagaaaaaa

SEQ ID NO: 478853 - RNA, 18 nt, Human
uacuguguauauauacau

SEQ ID NO: 478854 - RNA, 21 nt, Human
uauaaaauguauauauacaca

SEQ ID NO: 478855 - RNA, 21 nt, Human
uauauaaaauguauauauaca

SEQ ID NO: 478856 - RNA, 18 nt, Human
ucaaagcaggcaugauug

SEQ ID NO: 478857 - RNA, 25 nt, Human
ucaccaaagaaaaaaaaaaaaagaa

SEQ ID NO: 478858 - RNA, 21 nt, Human
ucaccuggaggcggccgcccc

SEQ ID NO: 478859 - RNA, 19 nt, Human
ucagaucaacaaauguuaa

SEQ ID NO: 478860 - RNA, 21 nt, Human
uccaacugucaaaauggcagu

SEQ ID NO: 478861 - RNA, 18 nt, Human
uccaauaccaaagugagc

SEQ ID NO: 478862 - RNA, 19 nt, Human
uccaucuugguguaggagu

SEQ ID NO: 478863 - RNA, 18 nt, Human
ucccuccuucauuuaauu

SEQ ID NO: 478864 - RNA, 19 nt, Human
ucuugaggcagcuggauuu

SEQ ID NO: 478865 - RNA, 23 nt, Human
ugaacugacagcuuucaacauaa

SEQ ID NO: 478866 - RNA, 24 nt, Human
ugacaaccagaucaaagauguuuc

SEQ ID NO: 478867 - RNA, 20 nt, Human
ugacaggucucucuuuuuuu

SEQ ID NO: 478868 - RNA, 23 nt, Human
ugcaccaaccuacuacuguucau

SEQ ID NO: 478869 - RNA, 23 nt, Human
ugcagugugacaaccagaucaaa

SEQ ID NO: 478870 - RNA, 19 nt, Human
ugccgccugcgcucaccac

SEQ ID NO: 478871 - RNA, 26 nt, Human
ugcuauauaugaaauuacuuuuuuug

SEQ ID NO: 478872 - RNA, 18 nt, Human
uggaaagcgcaagcgaga

SEQ ID NO: 478873 - RNA, 18 nt, Human
uggaaagcgcaagcgaga

SEQ ID NO: 478874 - RNA, 23 nt, Human
uggauugugucaucauaaguucu

SEQ ID NO: 478875 - RNA, 18 nt, Human
uggcagagucagagaccu

SEQ ID NO: 478876 - RNA, 23 nt, Human
uggguaggagaauaagagaaggg

SEQ ID NO: 478877 - RNA, 21 nt, Human
ugguaguaggaggaguuccuu

SEQ ID NO: 478878 - RNA, 20 nt, Human
uguaaacaaaauucacaauc

SEQ ID NO: 478879 - RNA, 21 nt, Human
uguauauauaaaauguauaua

SEQ ID NO: 478880 - RNA, 21 nt, Human
uguauuguuacuauuaauauc

SEQ ID NO: 478881 - RNA, 19 nt, Human
ugucacaggcuauguguuc

SEQ ID NO: 478882 - RNA, 23 nt, Human
ugucaccuggaggcggccgcccc

SEQ ID NO: 478883 - RNA, 18 nt, Human
uguguauauauacauaua

SEQ ID NO: 478884 - RNA, 25 nt, Human
uguguauauauacauauaaaaugua

SEQ ID NO: 478885 - RNA, 19 nt, Human
uuaaccuagcacuaagcau

SEQ ID NO: 478886 - RNA, 22 nt, Human
uuagcaaaacaagaucauucca

SEQ ID NO: 478887 - RNA, 23 nt, Human
uucagaaaacuuugaaacaacua

SEQ ID NO: 478888 - RNA, 19 nt, Human
uucauauagucuacuauau

SEQ ID NO: 478889 - RNA, 22 nt, Human
uucuagaucauagucaaucuac

SEQ ID NO: 478890 - RNA, 18 nt, Human
uucugauaggugagugcc

SEQ ID NO: 478891 - RNA, 21 nt, Human
uugacaucuuccaacuuugua

SEQ ID NO: 478892 - RNA, 18 nt, Human
uuguggagauuauguggu

SEQ ID NO: 478893 - RNA, 20 nt, Human
uuuguuagcaaaacaagauc

SEQ ID NO: 478894 - RNA, 24 nt, Human
uuuuauggcucaccaaagaaaaaa

SEQ ID NO: 478895 - RNA, 22 nt, Human
uuuuugaacugacagcuuucaa

SEQ ID NO: 478896 - RNA, 25 nt, Human
uuuuugguuucaccuaacacacuuc

SEQ ID NO: 478897 - RNA, 19 nt, Human
uuuuuuuucucuccugucu

SEQ ID NO: 478898 - RNA, 18 nt, Human
aaaaaaacaaaacggugg

SEQ ID NO: 478899 - RNA, 18 nt, Human
aaaaaaaccagccaggag

SEQ ID NO: 478900 - RNA, 23 nt, Human
aaaaaaagaaaaaaaaaacaaaa

SEQ ID NO: 478901 - RNA, 19 nt, Human
aaaaaagauaaugaaaaaa

SEQ ID NO: 478902 - RNA, 18 nt, Human
aaaauuagcugggcaugg

SEQ ID NO: 478903 - RNA, 19 nt, Human
aaagagaaagaagacuuga

SEQ ID NO: 478904 - RNA, 22 nt, Human
aaagaguauuuagaauuuaggu

SEQ ID NO: 478905 - RNA, 24 nt, Human
aaagagugagacccugucucaaaa

SEQ ID NO: 478906 - RNA, 24 nt, Human
aaagugcugggauuacaggcguga

SEQ ID NO: 478907 - RNA, 24 nt, Human
aaagugcugggauuacagguguga

SEQ ID NO: 478908 - RNA, 20 nt, Human
aacauggcaaaacccugucu

SEQ ID NO: 478909 - RNA, 21 nt, Human
aacauggcaaaacccugucuc

SEQ ID NO: 478910 - RNA, 23 nt, Human
aaccaaaauuagaacacagacua

SEQ ID NO: 478911 - RNA, 20 nt, Human
aaccuccuucauucaugaga

SEQ ID NO: 478912 - RNA, 23 nt, Human
aagaaucacuugaacccaggagg

SEQ ID NO: 478913 - RNA, 19 nt, Human
aagagaaagaagacuugaa

SEQ ID NO: 478914 - RNA, 25 nt, Human
aagcaggaaguggaagcuggggacc

SEQ ID NO: 478915 - RNA, 21 nt, Human
aagggccccaaacauggccug

SEQ ID NO: 478916 - RNA, 22 nt, Human
aaguaaaacauaaucuuacaaa

SEQ ID NO: 478917 - RNA, 18 nt, Human
aagugcugggauuacagg

SEQ ID NO: 478918 - RNA, 19 nt, Human
aagugcugggauuacaggc

SEQ ID NO: 478919 - RNA, 19 nt, Human
aagugcugggauuacaggc

SEQ ID NO: 478920 - RNA, 19 nt, Human
aagugcugggauuacaggu

SEQ ID NO: 478921 - RNA, 26 nt, Human
aagugcugggauuacaggugugagcc

SEQ ID NO: 478922 - RNA, 18 nt, Human
aaucacuugaacccagga

SEQ ID NO: 478923 - RNA, 24 nt, Human
aaucacuugaacccaggaggcgca

SEQ ID NO: 478924 - RNA, 24 nt, Human
aaucacuugagcccaggaauucga

SEQ ID NO: 478925 - RNA, 25 nt, Human
aaucacuugagcccaggaauucgag

SEQ ID NO: 478926 - RNA, 21 nt, Human
acaccauuuuccugccucagc

SEQ ID NO: 478927 - RNA, 21 nt, Human
acagaaaaaaaccagccagga

SEQ ID NO: 478928 - RNA, 21 nt, Human
acagagcgagacucugucuca

SEQ ID NO: 478929 - RNA, 23 nt, Human
acagagcgagacucugucucaaa

SEQ ID NO: 478930 - RNA, 19 nt, Human
acaggcgccugccaccacg

SEQ ID NO: 478931 - RNA, 18 nt, Human
accauguuggccaggcug

SEQ ID NO: 478932 - RNA, 24 nt, Human
acccaggaggcgcagguugcagug

SEQ ID NO: 478933 - RNA, 24 nt, Human
acccugucucuacaaaaaauacaa

SEQ ID NO: 478934 - RNA, 24 nt, Human
acccugucucuacuaaaaauacaa

SEQ ID NO: 478935 - RNA, 20 nt, Human
acggacagacagacugggcc

SEQ ID NO: 478936 - RNA, 23 nt, Human
acggagccuaggaagccucugcu

SEQ ID NO: 478937 - RNA, 25 nt, Human
acucuauugcccaggcuggagugca

SEQ ID NO: 478938 - RNA, 18 nt, Human
acugcaagcuccgccucc

SEQ ID NO: 478939 - RNA, 24 nt, Human
acugcacuccagccuggacgacag

SEQ ID NO: 478940 - RNA, 26 nt, Human
acugcacuccagccuggacgacagag

SEQ ID NO: 478941 - RNA, 18 nt, Human
acuguacugcagccuggg

SEQ ID NO: 478942 - RNA, 23 nt, Human
acuguacugcagccugggaaaga

SEQ ID NO: 478943 - RNA, 24 nt, Human
acuguacugcagccugggaaagag

SEQ ID NO: 478944 - RNA, 24 nt, Human
acugugucacuguacugcagccug

SEQ ID NO: 478945 - RNA, 24 nt, Human
agaaaaaaaaaacaaaacggugga

SEQ ID NO: 478946 - RNA, 18 nt, Human
agaaaaaaaccagccagg

SEQ ID NO: 478947 - RNA, 18 nt, Human
agaacaagggccccaaac

SEQ ID NO: 478948 - RNA, 23 nt, Human
agaagaacaggcucugaagcagg

SEQ ID NO: 478949 - RNA, 24 nt, Human
agacucugucucaaacaaaaaaaa

SEQ ID NO: 478950 - RNA, 19 nt, Human
agagauggaguuucaccgu

SEQ ID NO: 478951 - RNA, 24 nt, Human
agcacuuugggaggccgagguggg

SEQ ID NO: 478952 - RNA, 22 nt, Human
agcagagaugggguuucaccau

SEQ ID NO: 478953 - RNA, 24 nt, Human
agccuggacaacauggcaaaaccc

SEQ ID NO: 478954 - RNA, 24 nt, Human
agccuggacgacagagcgagacuc

SEQ ID NO: 478955 - RNA, 21 nt, Human
agccuuguuuaagaggcuagu

SEQ ID NO: 478956 - RNA, 23 nt, Human
agcugggcaugguggcaggcgcc

SEQ ID NO: 478957 - RNA, 23 nt, Human
agcuugcagccccaaaaagucuu

SEQ ID NO: 478958 - RNA, 23 nt, Human
aggaauucgagacuagccuggac

SEQ ID NO: 478959 - RNA, 22 nt, Human
aggagucacuuuauuucuuaaa

SEQ ID NO: 478960 - RNA, 23 nt, Human
aggaguucgagaccagucuggcc

SEQ ID NO: 478961 - RNA, 18 nt, Human
aggcagaagaaucacuug

SEQ ID NO: 478962 - RNA, 23 nt, Human
aggcagaagaaucacuugaaccc

SEQ ID NO: 478963 - RNA, 18 nt, Human
aggcaggugaaucacuug

SEQ ID NO: 478964 - RNA, 21 nt, Human
aggccgaggugggcggaucac

SEQ ID NO: 478965 - RNA, 19 nt, Human
aggcgcagguugcagugag

SEQ ID NO: 478966 - RNA, 24 nt, Human
aggcgcagguugcagugagccaag

SEQ ID NO: 478967 - RNA, 20 nt, Human
aggcgccugccaccacgccc

SEQ ID NO: 478968 - RNA, 25 nt, Human
aggcuggagugcaguggcgcaaucu

SEQ ID NO: 478969 - RNA, 24 nt, Human
aggucaaagcugcagugagcugag

SEQ ID NO: 478970 - RNA, 20 nt, Human
aggucucaaaacuacggaac

SEQ ID NO: 478971 - RNA, 24 nt, Human
aggugggcggaucacaaggucagg

SEQ ID NO: 478972 - RNA, 24 nt, Human
agguugaggcagaagaaucacuug

SEQ ID NO: 478973 - RNA, 22 nt, Human
agguugcagugagccaagauug

SEQ ID NO: 478974 - RNA, 21 nt, Human
aguagaagaacaggcucugaa

SEQ ID NO: 478975 - RNA, 18 nt, Human
aguagcugggauuacagg

SEQ ID NO: 478976 - RNA, 24 nt, Human
agucagauccugagaaccauaauc

SEQ ID NO: 478977 - RNA, 21 nt, Human
agucuggccaauaugaaaccc

SEQ ID NO: 478978 - RNA, 21 nt, Human
agucuggccaauaugaaaccc

SEQ ID NO: 478979 - RNA, 24 nt, Human
agugauucuccugccucagccucc

SEQ ID NO: 478980 - RNA, 24 nt, Human
agugcagugacaugaucucggcuc

SEQ ID NO: 478981 - RNA, 20 nt, Human
agugcaguggcgcaaucucg

SEQ ID NO: 478982 - RNA, 24 nt, Human
agugcaguggcgcaaucucggcuc

SEQ ID NO: 478983 - RNA, 21 nt, Human
auaaugaaaaaagagaaagaa

SEQ ID NO: 478984 - RNA, 22 nt, Human
auaauuaugaaaaugaaaacuc

SEQ ID NO: 478985 - RNA, 21 nt, Human
aucacaaggucaggaguucga

SEQ ID NO: 478986 - RNA, 22 nt, Human
auccuagcacuuugggaggcca

SEQ ID NO: 478987 - RNA, 19 nt, Human
augaaaaaagagaaagaag

SEQ ID NO: 478988 - RNA, 21 nt, Human
augaaacccugucucuacuaa

SEQ ID NO: 478989 - RNA, 24 nt, Human
augauccgccugccucagccuccc

SEQ ID NO: 478990 - RNA, 18 nt, Human
auggaguuucaccguguu

SEQ ID NO: 478991 - RNA, 24 nt, Human
auggaguuucaccguguuagccag

SEQ ID NO: 478992 - RNA, 18 nt, Human
augggguuucaccauguu

SEQ ID NO: 478993 - RNA, 22 nt, Human
augggguuucaccauguuggcc

SEQ ID NO: 478994 - RNA, 24 nt, Human
augggguuucaccauguuggccag

SEQ ID NO: 478995 - RNA, 18 nt, Human
auguguucuuuuucugga

SEQ ID NO: 478996 - RNA, 24 nt, Human
auguuggcugggugugguggcuca

SEQ ID NO: 478997 - RNA, 24 nt, Human
auugcagcacugcacuccagccug

SEQ ID NO: 478998 - RNA, 21 nt, Human
caaaauuagaacacagacuac

SEQ ID NO: 478999 - RNA, 24 nt, Human
caaagugcugggauuacaggcgug

SEQ ID NO: 479000 - RNA, 24 nt, Human
caaagugcugggauuacaggugug

SEQ ID NO: 479001 - RNA, 22 nt, Human
caacacuucauacacauaugca

SEQ ID NO: 479002 - RNA, 22 nt, Human
caacauggcaaaacccugucuc

SEQ ID NO: 479003 - RNA, 24 nt, Human
caacauggcaaaacccugucucua

SEQ ID NO: 479004 - RNA, 24 nt, Human
caaggcaggugaaucacuugagcc

SEQ ID NO: 479005 - RNA, 21 nt, Human
caagggccccaaacauggccu

SEQ ID NO: 479006 - RNA, 22 nt, Human
caagugauucuccugccucagc

SEQ ID NO: 479007 - RNA, 18 nt, Human
caauaugaaacccugucu

SEQ ID NO: 479008 - RNA, 19 nt, Human
caauaugaaacccugucuc

SEQ ID NO: 479009 - RNA, 18 nt, Human
cacaccaccaugcccggc

SEQ ID NO: 479010 - RNA, 24 nt, Human
cacaccuguaaucccagcacuuug

SEQ ID NO: 479011 - RNA, 18 nt, Human
caccacggacagacagac

SEQ ID NO: 479012 - RNA, 21 nt, Human
caccauguuggccaggcuggu

SEQ ID NO: 479013 - RNA, 24 nt, Human
caccauguuggccaggcuggucuc

SEQ ID NO: 479014 - RNA, 27 nt, Human
caccauguuggccaggcuggucucaaa

SEQ ID NO: 479015 - RNA, 18 nt, Human
caccguguuagccaggau

SEQ ID NO: 479016 - RNA, 23 nt, Human
caccguguuagccaggauggucu

SEQ ID NO: 479017 - RNA, 24 nt, Human
caccguguuagccaggauggucuu

SEQ ID NO: 479018 - RNA, 24 nt, Human
caccuauagucccugcuacuuggg

SEQ ID NO: 479019 - RNA, 19 nt, Human
caccugagcccggcaaggu

SEQ ID NO: 479020 - RNA, 19 nt, Human
caccuguaaucccagcacu

SEQ ID NO: 479021 - RNA, 24 nt, Human
caccuguaaucccagcacuuuggg

SEQ ID NO: 479022 - RNA, 24 nt, Human
cacuccagccuggacgacagagcg

SEQ ID NO: 479023 - RNA, 24 nt, Human
cacucuauugcccaggcuggagug

SEQ ID NO: 479024 - RNA, 21 nt, Human
cacugcaaccucugccucccg

SEQ ID NO: 479025 - RNA, 23 nt, Human
cacugcaaccucugccucccggg

SEQ ID NO: 479026 - RNA, 18 nt, Human
cacugcacuccagccugg

SEQ ID NO: 479027 - RNA, 18 nt, Human
cacugcacuccagccugg

SEQ ID NO: 479028 - RNA, 19 nt, Human
cacugcacuccagccugga

SEQ ID NO: 479029 - RNA, 19 nt, Human
cacugcacuccagccugga

SEQ ID NO: 479030 - RNA, 20 nt, Human
cacugcacuccagccuggac

SEQ ID NO: 479031 - RNA, 22 nt, Human
cacugcacuccagccuggacga

SEQ ID NO: 479032 - RNA, 24 nt, Human
cacugcacuccagccuggacgaca

SEQ ID NO: 479033 - RNA, 18 nt, Human
cacuguacugcagccugg

SEQ ID NO: 479034 - RNA, 19 nt, Human
cacuguacugcagccuggg

SEQ ID NO: 479035 - RNA, 18 nt, Human
cacuucauacacauaugc

SEQ ID NO: 479036 - RNA, 20 nt, Human
cacuugagcccaggaauucg

SEQ ID NO: 479037 - RNA, 22 nt, Human
cagagaugggguuucaccaugu

SEQ ID NO: 479038 - RNA, 24 nt, Human
cagcacuuugggaggccgaggugg

SEQ ID NO: 479039 - RNA, 23 nt, Human
caggcgccugccaccacgcccgg

SEQ ID NO: 479040 - RNA, 18 nt, Human
cagguugcagugagccaa

SEQ ID NO: 479041 - RNA, 26 nt, Human
caguagcugggacuacaggcgccugc

SEQ ID NO: 479042 - RNA, 23 nt, Human
caucuguaauccuagcacuuugg

SEQ ID NO: 479043 - RNA, 24 nt, Human
caugauccgccugccucagccucc

SEQ ID NO: 479044 - RNA, 24 nt, Human
caugucauuuuauaaaugaguccc

SEQ ID NO: 479045 - RNA, 24 nt, Human
cauguuggccaggcuggucucaaa

SEQ ID NO: 479046 - RNA, 20 nt, Human
ccaaagugcugggauuacag

SEQ ID NO: 479047 - RNA, 21 nt, Human
ccaaagugcugggauuacagg

SEQ ID NO: 479048 - RNA, 21 nt, Human
ccaaagugcugggauuacagg

SEQ ID NO: 479049 - RNA, 22 nt, Human
ccaaagugcugggauuacaggc

SEQ ID NO: 479050 - RNA, 22 nt, Human
ccaaagugcugggauuacaggc

SEQ ID NO: 479051 - RNA, 24 nt, Human
ccaaagugcugggauuacaggcgu

SEQ ID NO: 479052 - RNA, 24 nt, Human
ccaaagugcugggauuacaggugu

SEQ ID NO: 479053 - RNA, 24 nt, Human
ccacggacagacagacugggcccg

SEQ ID NO: 479054 - RNA, 19 nt, Human
ccacugcgcccagccuaaa

SEQ ID NO: 479055 - RNA, 21 nt, Human
ccacugcgcccagccuaaaaa

SEQ ID NO: 479056 - RNA, 23 nt, Human
cccaagcuagagugcagugacau

SEQ ID NO: 479057 - RNA, 23 nt, Human
cccaguagcugggacuacaggcg

SEQ ID NO: 479058 - RNA, 24 nt, Human
cccaucuguaauccuagcacuuug

SEQ ID NO: 479059 - RNA, 19 nt, Human
ccccaaaaagucuucauug

SEQ ID NO: 479060 - RNA, 18 nt, Human
ccccaacacuucauacac

SEQ ID NO: 479061 - RNA, 23 nt, Human
cccgaguagcugggauuacaggu

SEQ ID NO: 479062 - RNA, 24 nt, Human
cccgaguagcugggauuacaggug

SEQ ID NO: 479063 - RNA, 23 nt, Human
cccggguucaagugauucuccuc

SEQ ID NO: 479064 - RNA, 23 nt, Human
cccggguucaagugauucuccug

SEQ ID NO: 479065 - RNA, 23 nt, Human
cccggguugacaccauuuuccug

SEQ ID NO: 479066 - RNA, 21 nt, Human
ccgaguagcugggauuacagg

SEQ ID NO: 479067 - RNA, 26 nt, Human
ccgccugccucagccucccaaagugc

SEQ ID NO: 479068 - RNA, 22 nt, Human
ccggcaaggucaaagcugcagu

SEQ ID NO: 479069 - RNA, 22 nt, Human
ccuauaggucuagcuacuugau

SEQ ID NO: 479070 - RNA, 22 nt, Human
ccuauaggucuagcuacuuggg

SEQ ID NO: 479071 - RNA, 24 nt, Human
ccucccggguucaagugauucucc

SEQ ID NO: 479072 - RNA, 18 nt, Human
ccugaagugauugauagg

SEQ ID NO: 479073 - RNA, 21 nt, Human
ccugaccucaaaugaucugcc

SEQ ID NO: 479074 - RNA, 23 nt, Human
ccugaccucaaaugaucugccug

SEQ ID NO: 479075 - RNA, 23 nt, Human
ccugccucagccucccgaguagc

SEQ ID NO: 479076 - RNA, 22 nt, Human
ccuggacaacauggcaaaaccc

SEQ ID NO: 479077 - RNA, 24 nt, Human
ccuggacaacauggcaaaacccug

SEQ ID NO: 479078 - RNA, 22 nt, Human
ccuggacgacagagcgagacuc

SEQ ID NO: 479079 - RNA, 20 nt, Human
ccuggccucagugaucuggg

SEQ ID NO: 479080 - RNA, 19 nt, Human
cgagaccagucuggccaau

SEQ ID NO: 479081 - RNA, 19 nt, Human
cgccucccggguugacacc

SEQ ID NO: 479082 - RNA, 24 nt, Human
cgcucugucucccaagcuagagug

SEQ ID NO: 479083 - RNA, 18 nt, Human
cggacagacagacugggc

SEQ ID NO: 479084 - RNA, 22 nt, Human
cggaucacaaggucaggaguuc

SEQ ID NO: 479085 - RNA, 21 nt, Human
cggcggcuucucgucucccuc

SEQ ID NO: 479086 - RNA, 24 nt, Human
cggggaggaacagaaaaaaaccag

SEQ ID NO: 479087 - RNA, 24 nt, Human
cuagagugcagugacaugaucucg

SEQ ID NO: 479088 - RNA, 23 nt, Human
cuaguuuuucuucucuuuuccua

SEQ ID NO: 479089 - RNA, 19 nt, Human
cuauuuuuuaaagaacaaa

SEQ ID NO: 479090 - RNA, 22 nt, Human
cucacaccuguaaucccagcac

SEQ ID NO: 479091 - RNA, 24 nt, Human
cucacaccuguaaucccagcacuu

SEQ ID NO: 479092 - RNA, 20 nt, Human
cucacucuauugcccaggcc

SEQ ID NO: 479093 - RNA, 24 nt, Human
cucacugcaaccucugccucccgg

SEQ ID NO: 479094 - RNA, 24 nt, Human
cucagccuccccaguagcugggac

SEQ ID NO: 479095 - RNA, 23 nt, Human
cucagccucccgaguagcuggga

SEQ ID NO: 479096 - RNA, 24 nt, Human
cucccaucuguaauccuagcacuu

SEQ ID NO: 479097 - RNA, 20 nt, Human
cucccggguucaagugauuc

SEQ ID NO: 479098 - RNA, 26 nt, Human
cuccugaccucaaaugaucugccugc

SEQ ID NO: 479099 - RNA, 24 nt, Human
cuccugaccucaugauccgccugc

SEQ ID NO: 479100 - RNA, 22 nt, Human
cuccugccucagccucccgagu

SEQ ID NO: 479101 - RNA, 21 nt, Human
cucgucucccuccaccuucuc

SEQ ID NO: 479102 - RNA, 19 nt, Human
cugcaaccucugccucccg

SEQ ID NO: 479103 - RNA, 23 nt, Human
cugcaaccucugccucccggguu

SEQ ID NO: 479104 - RNA, 24 nt, Human
cugcaaccucugccucccggguuc

SEQ ID NO: 479105 - RNA, 19 nt, Human
cugcagugagcugagacug

SEQ ID NO: 479106 - RNA, 22 nt, Human
cugcagugagcugagacugugu

SEQ ID NO: 479107 - RNA, 23 nt, Human
cugccucagccucccaaagugcu

SEQ ID NO: 479108 - RNA, 24 nt, Human
cugccucagccucccaaagugcug

SEQ ID NO: 479109 - RNA, 23 nt, Human
cugccucagccuccccaguagcu

SEQ ID NO: 479110 - RNA, 23 nt, Human
cugccucagccucccgaguagcu

SEQ ID NO: 479111 - RNA, 23 nt, Human
cugccucccggguucaagugauu

SEQ ID NO: 479112 - RNA, 24 nt, Human
cugcgcccagccuaaaaaucuuua

SEQ ID NO: 479113 - RNA, 29 nt, Human
cugcgcccagccuaaaaaucuuuauugca

SEQ ID NO: 479114 - RNA, 18 nt, Human
cuggccaauaugaaaccc

SEQ ID NO: 479115 - RNA, 21 nt, Human
cuguaauccuagcacuuuggg

SEQ ID NO: 479116 - RNA, 25 nt, Human
cugucucuacaaaaaauacaaaaag

SEQ ID NO: 479117 - RNA, 20 nt, Human
cuugcuaagcacugagaggc

SEQ ID NO: 479118 - RNA, 27 nt, Human
gaaaccuccuucauucaugaggcacuc

SEQ ID NO: 479119 - RNA, 24 nt, Human
gacagagcgagacucugucucaaa

SEQ ID NO: 479120 - RNA, 23 nt, Human
gaccucaaaugaucugccugccu

SEQ ID NO: 479121 - RNA, 22 nt, Human
gaccucaugauccgccugccuc

SEQ ID NO: 479122 - RNA, 24 nt, Human
gaccucaugauccgccugccucag

SEQ ID NO: 479123 - RNA, 21 nt, Human
gacugggcugggcgugguggc

SEQ ID NO: 479124 - RNA, 20 nt, Human
gagaugggguuucaccaugu

SEQ ID NO: 479125 - RNA, 24 nt, Human
gagaugggguuucaccauguuggc

SEQ ID NO: 479126 - RNA, 21 nt, Human
gaggcgcagguugcagugagc

SEQ ID NO: 479127 - RNA, 24 nt, Human
gaggugggcggaucacaaggucag

SEQ ID NO: 479128 - RNA, 26 nt, Human
gaguagcugggauuacaggugcacac

SEQ ID NO: 479129 - RNA, 21 nt, Human
gaucacaaggucaggaguucg

SEQ ID NO: 479130 - RNA, 24 nt, Human
gaucacaaggucaggaguucgaga

SEQ ID NO: 479131 - RNA, 21 nt, Human
gauuacaggugcacaccacca

SEQ ID NO: 479132 - RNA, 18 nt, Human
gauuacaggugugagcca

SEQ ID NO: 479133 - RNA, 22 nt, Human
gauuacaggugugagccacugc

SEQ ID NO: 479134 - RNA, 22 nt, Human
gauuacaggugugagccacugc

SEQ ID NO: 479135 - RNA, 24 nt, Human
gcacuccagccuggacgacagagc

SEQ ID NO: 479136 - RNA, 21 nt, Human
gcacugcacuccagccuggac

SEQ ID NO: 479137 - RNA, 22 nt, Human
gcagaagaaucacuugaaccca

SEQ ID NO: 479138 - RNA, 18 nt, Human
gcagcacugcacuccagc

SEQ ID NO: 479139 - RNA, 23 nt, Human
gcaggugaaucacuugagcccag

SEQ ID NO: 479140 - RNA, 20 nt, Human
gcagguugcagugagccaag

SEQ ID NO: 479141 - RNA, 24 nt, Human
gcagguugcagugagccaagauug

SEQ ID NO: 479142 - RNA, 21 nt, Human
gccaauaugaaacccugucuc

SEQ ID NO: 479143 - RNA, 19 nt, Human
gcccaggcuggagugcagu

SEQ ID NO: 479144 - RNA, 24 nt, Human
gcccggcuauuuuuuuuguauuuu

SEQ ID NO: 479145 - RNA, 23 nt, Human
gccuauaggucuagcuacuuggg

SEQ ID NO: 479146 - RNA, 24 nt, Human
gccuuagcuucccaaagugcuggg

SEQ ID NO: 479147 - RNA, 19 nt, Human
gcuagagugcagugacaug

SEQ ID NO: 479148 - RNA, 20 nt, Human
gcucugaagcaggaagugga

SEQ ID NO: 479149 - RNA, 19 nt, Human
gcuggagugcaguggcgca

SEQ ID NO: 479150 - RNA, 23 nt, Human
gcuggucucaaacuccugaccuc

SEQ ID NO: 479151 - RNA, 18 nt, Human
ggaggaacauaugggaca

SEQ ID NO: 479152 - RNA, 18 nt, Human
ggaguuucaccguguuag

SEQ ID NO: 479153 - RNA, 22 nt, Human
ggaguuucaccguguuagccag

SEQ ID NO: 479154 - RNA, 23 nt, Human
ggaucacaaggucaggaguucga

SEQ ID NO: 479155 - RNA, 24 nt, Human
ggauggucuugaucuccugaccuc

SEQ ID NO: 479156 - RNA, 24 nt, Human
ggccaauaugaaacccugucucua

SEQ ID NO: 479157 - RNA, 23 nt, Human
ggcggaucacaaggucaggaguu

SEQ ID NO: 479158 - RNA, 19 nt, Human
ggcugggugugguggcuca

SEQ ID NO: 479159 - RNA, 21 nt, Human
ggcugggugugguggcucaca

SEQ ID NO: 479160 - RNA, 24 nt, Human
ggcuggucucaaacuccugaccuc

SEQ ID NO: 479161 - RNA, 20 nt, Human
gggaggccgaggugggcgga

SEQ ID NO: 479162 - RNA, 22 nt, Human
gggguuucaccauguuggccag

SEQ ID NO: 479163 - RNA, 24 nt, Human
gggugugguggcucacaccuguaa

SEQ ID NO: 479164 - RNA, 22 nt, Human
ggguucaagugauucuccugcc

SEQ ID NO: 479165 - RNA, 23 nt, Human
ggguucaagugauucuccugccu

SEQ ID NO: 479166 - RNA, 18 nt, Human
ggguuucaccauguuggc

SEQ ID NO: 479167 - RNA, 24 nt, Human
gguggcucacaccuguaaucccag

SEQ ID NO: 479168 - RNA, 18 nt, Human
guacugcagccugggaaa

SEQ ID NO: 479169 - RNA, 23 nt, Human
guagaaccaaaauuagaacacag

SEQ ID NO: 479170 - RNA, 18 nt, Human
guagcugggacuacaggc

SEQ ID NO: 479171 - RNA, 18 nt, Human
guagcugggauuacaggu

SEQ ID NO: 479172 - RNA, 22 nt, Human
gucucaaaaaaaagaaaaaaaa

SEQ ID NO: 479173 - RNA, 21 nt, Human
gucuggccaauaugaaacccu

SEQ ID NO: 479174 - RNA, 24 nt, Human
gugauucuccugccucagccuccc

SEQ ID NO: 479175 - RNA, 23 nt, Human
guggcucacaccuguaaucccag

SEQ ID NO: 479176 - RNA, 20 nt, Human
guggcucccaucuguaaucc

SEQ ID NO: 479177 - RNA, 18 nt, Human
gugugguggcucacaccu

SEQ ID NO: 479178 - RNA, 21 nt, Human
uaagggucaccugagcccggc

SEQ ID NO: 479179 - RNA, 23 nt, Human
uacaggcgccugccaccacgccc

SEQ ID NO: 479180 - RNA, 19 nt, Human
uacaggugugagccacugc

SEQ ID NO: 479181 - RNA, 24 nt, Human
uacaggugugagccacugcgccca

SEQ ID NO: 479182 - RNA, 20 nt, Human
uacugcagccugggaaagag

SEQ ID NO: 479183 - RNA, 22 nt, Human
uagaagaacaggcucugaagca

SEQ ID NO: 479184 - RNA, 24 nt, Human
uagagugcagugacaugaucucgg

SEQ ID NO: 479185 - RNA, 24 nt, Human
uagcacuuugggaggccaaggcag

SEQ ID NO: 479186 - RNA, 25 nt, Human
uagcacuuugggaggccaaggcagg

SEQ ID NO: 479187 - RNA, 24 nt, Human
uagcagagaugggguuucaccaug

SEQ ID NO: 479188 - RNA, 26 nt, Human
uagcagagaugggguuucaccauguu

SEQ ID NO: 479189 - RNA, 24 nt, Human
uagcuacuugggagguugaggcag

SEQ ID NO: 479190 - RNA, 20 nt, Human
uaggaagccucugcucaaaa

SEQ ID NO: 479191 - RNA, 21 nt, Human
uaguagagauggaguuucacc

SEQ ID NO: 479192 - RNA, 24 nt, Human
uaguagagauggaguuucaccgug

SEQ ID NO: 479193 - RNA, 26 nt, Human
uaguagagauggaguuucaccguguu

SEQ ID NO: 479194 - RNA, 19 nt, Human
uauauggauauguguaugu

SEQ ID NO: 479195 - RNA, 19 nt, Human
uauauggauauguguaugu

SEQ ID NO: 479196 - RNA, 18 nt, Human
uaucaaccugaggguauu

SEQ ID NO: 479197 - RNA, 22 nt, Human
uaugaaaaugaaaacucaguca

SEQ ID NO: 479198 - RNA, 19 nt, Human
uauugcccaggcuggagug

SEQ ID NO: 479199 - RNA, 19 nt, Human
ucaagugauucuccugccu

SEQ ID NO: 479200 - RNA, 24 nt, Human
ucacaaggucaggaguucgagacc

SEQ ID NO: 479201 - RNA, 24 nt, Human
ucaccguguuagccaggauggucu

SEQ ID NO: 479202 - RNA, 20 nt, Human
ucaccugagcccggcaaggu

SEQ ID NO: 479203 - RNA, 24 nt, Human
ucacucuauugcccaggcuggagu

SEQ ID NO: 479204 - RNA, 24 nt, Human
ucacugcaaccucugccucccggg

SEQ ID NO: 479205 - RNA, 25 nt, Human
ucacugcaaccucugccucccgggu

SEQ ID NO: 479206 - RNA, 18 nt, Human
ucacugcaagcuccgccu

SEQ ID NO: 479207 - RNA, 19 nt, Human
ucacugcaagcuccgccuc

SEQ ID NO: 479208 - RNA, 24 nt, Human
ucacugcaagcuccgccucccggg

SEQ ID NO: 479209 - RNA, 19 nt, Human
ucacuguacugcagccugg

SEQ ID NO: 479210 - RNA, 25 nt, Human
ucagacuaaaaaagauaaugaaaaa

SEQ ID NO: 479211 - RNA, 18 nt, Human
ucagccuccccaguagcu

SEQ ID NO: 479212 - RNA, 20 nt, Human
ucagccuccccaguagcugg

SEQ ID NO: 479213 - RNA, 20 nt, Human
ucagccucccgaguagcugg

SEQ ID NO: 479214 - RNA, 19 nt, Human
uccaaauaugaaagucagu

SEQ ID NO: 479215 - RNA, 18 nt, Human
uccaccuucuccgggccc

SEQ ID NO: 479216 - RNA, 23 nt, Human
uccagccuggacgacagagcgag

SEQ ID NO: 479217 - RNA, 24 nt, Human
uccagccuggacgacagagcgaga

SEQ ID NO: 479218 - RNA, 23 nt, Human
ucccaaagugcugggauuacagg

SEQ ID NO: 479219 - RNA, 24 nt, Human
ucccaaagugcugggauuacaggc

SEQ ID NO: 479220 - RNA, 22 nt, Human
uccccaguagcugggacuacag

SEQ ID NO: 479221 - RNA, 24 nt, Human
uccccaguagcugggacuacaggc

SEQ ID NO: 479222 - RNA, 23 nt, Human
ucccgaguagcugggauuacagg

SEQ ID NO: 479223 - RNA, 24 nt, Human
ucccgaguagcugggauuacaggu

SEQ ID NO: 479224 - RNA, 21 nt, Human
ucccggguucaagugauucuc

SEQ ID NO: 479225 - RNA, 24 nt, Human
ucccggguucaagugauucuccug

SEQ ID NO: 479226 - RNA, 24 nt, Human
ucccggguugacaccauuuuccug

SEQ ID NO: 479227 - RNA, 21 nt, Human
ucccuccaccuucuccgggcc

SEQ ID NO: 479228 - RNA, 19 nt, Human
ucccuggaaucuaagaaaa

SEQ ID NO: 479229 - RNA, 18 nt, Human
ucccugugggcagugaau

SEQ ID NO: 479230 - RNA, 18 nt, Human
uccugaccucaaaugauc

SEQ ID NO: 479231 - RNA, 24 nt, Human
ucuacuugcuaagcacugagaggc

SEQ ID NO: 479232 - RNA, 24 nt, Human
ucuauugcccaggcuggagugcag

SEQ ID NO: 479233 - RNA, 18 nt, Human
ucucaaacaaaaaaaaag

SEQ ID NO: 479234 - RNA, 23 nt, Human
ucucacucuauugcccaggcugg

SEQ ID NO: 479235 - RNA, 24 nt, Human
ucucacucuauugcccaggcugga

SEQ ID NO: 479236 - RNA, 26 nt, Human
ucucacucuauugcccaggcuggagu

SEQ ID NO: 479237 - RNA, 27 nt, Human
ucucacucuauugcccaggcuggagug

SEQ ID NO: 479238 - RNA, 24 nt, Human
ucucgcucugucucccaagcuaga

SEQ ID NO: 479239 - RNA, 21 nt, Human
ucucuacuaaaaauacaaaaa

SEQ ID NO: 479240 - RNA, 20 nt, Human
ucuggccaauaugaaacccu

SEQ ID NO: 479241 - RNA, 31 nt, Human
ucugucucaaacaaaaaaaaagaagaagaaa

SEQ ID NO: 479242 - RNA, 24 nt, Human
ucugucucccaagcuagagugcag

SEQ ID NO: 479243 - RNA, 20 nt, Human
ugaaucacuugagcccagga

SEQ ID NO: 479244 - RNA, 24 nt, Human
ugaaucacuugagcccaggaauuc

SEQ ID NO: 479245 - RNA, 18 nt, Human
ugaccucaaaugaucugc

SEQ ID NO: 479246 - RNA, 22 nt, Human
ugagacggagucucacucuauu

SEQ ID NO: 479247 - RNA, 22 nt, Human
ugagacggagucucgcucuguc

SEQ ID NO: 479248 - RNA, 23 nt, Human
ugagcccaggaauucgagacuag

SEQ ID NO: 479249 - RNA, 22 nt, Human
ugagccuuguuuaagaggcuag

SEQ ID NO: 479250 - RNA, 22 nt, Human
ugagcugagacugugucacugu

SEQ ID NO: 479251 - RNA, 24 nt, Human
ugaggauacacaagcaucuggcua

SEQ ID NO: 479252 - RNA, 20 nt, Human
ugaggcagaagaaucacuug

SEQ ID NO: 479253 - RNA, 24 nt, Human
ugaggcagaagaaucacuugaacc

SEQ ID NO: 479254 - RNA, 25 nt, Human
ugaggcagaagaaucacuugaaccc

SEQ ID NO: 479255 - RNA, 20 nt, Human
ugauucuccugccucagccu

SEQ ID NO: 479256 - RNA, 20 nt, Human
ugcagccugggaaagaguga

SEQ ID NO: 479257 - RNA, 22 nt, Human
ugcaguggcgcaaucucggcuc

SEQ ID NO: 479258 - RNA, 23 nt, Human
ugcaguggcgcaaucucggcuca

SEQ ID NO: 479259 - RNA, 19 nt, Human
ugccaccacgcccggcuau

SEQ ID NO: 479260 - RNA, 18 nt, Human
ugcccaggcuggagugca

SEQ ID NO: 479261 - RNA, 21 nt, Human
ugcccaggcuggagugcagug

SEQ ID NO: 479262 - RNA, 22 nt, Human
ugcccaggcuggagugcagugg

SEQ ID NO: 479263 - RNA, 24 nt, Human
ugcccaggcuggagugcaguggcg

SEQ ID NO: 479264 - RNA, 24 nt, Human
ugccucagccucccaaagugcugg

SEQ ID NO: 479265 - RNA, 21 nt, Human
ugccucagccuccccaguagc

SEQ ID NO: 479266 - RNA, 24 nt, Human
ugccucagccuccccaguagcugg

SEQ ID NO: 479267 - RNA, 24 nt, Human
ugccucagccucccgaguagcugg

SEQ ID NO: 479268 - RNA, 22 nt, Human
ugccucccggguucaagugauu

SEQ ID NO: 479269 - RNA, 24 nt, Human
ugccuuagcuucccaaagugcugg

SEQ ID NO: 479270 - RNA, 21 nt, Human
ugcucaaaaucucccuguggg

SEQ ID NO: 479271 - RNA, 20 nt, Human
ugcugggauuacaggcguga

SEQ ID NO: 479272 - RNA, 23 nt, Human
ugcugggauuacaggcgugagaa

SEQ ID NO: 479273 - RNA, 24 nt, Human
ugcugggauuacaggugugagcca

SEQ ID NO: 479274 - RNA, 18 nt, Human
ugcugucagaacaagggc

SEQ ID NO: 479275 - RNA, 19 nt, Human
uggacugggcugggcgugg

SEQ ID NO: 479276 - RNA, 23 nt, Human
uggagugcaguggcgcaaucucg

SEQ ID NO: 479277 - RNA, 24 nt, Human
uggagugcaguggcgcaaucucgg

SEQ ID NO: 479278 - RNA, 24 nt, Human
uggaguuucaccguguuagccagg

SEQ ID NO: 479279 - RNA, 21 nt, Human
uggccaauaugaaacccuguc

SEQ ID NO: 479280 - RNA, 24 nt, Human
uggccaggcuggucucaaacuccu

SEQ ID NO: 479281 - RNA, 20 nt, Human
uggccuggccucagugaucu

SEQ ID NO: 479282 - RNA, 21 nt, Human
uggcucacaccuguaauccca

SEQ ID NO: 479283 - RNA, 24 nt, Human
uggcucacaccuguaaucccagca

SEQ ID NO: 479284 - RNA, 19 nt, Human
uggcucccaucuguaaucc

SEQ ID NO: 479285 - RNA, 24 nt, Human
uggcucccaucuguaauccuagca

SEQ ID NO: 479286 - RNA, 20 nt, Human
uggcugggugugguggcuca

SEQ ID NO: 479287 - RNA, 18 nt, Human
ugggaaagagugagaccc

SEQ ID NO: 479288 - RNA, 21 nt, Human
ugggacuacaggcgccugcca

SEQ ID NO: 479289 - RNA, 22 nt, Human
ugggacuacaggcgccugccac

SEQ ID NO: 479290 - RNA, 24 nt, Human
ugggacuacaggcgccugccacca

SEQ ID NO: 479291 - RNA, 24 nt, Human
ugggaggccaaggcaggugaauca

SEQ ID NO: 479292 - RNA, 19 nt, Human
ugggaggccgaggugggcg

SEQ ID NO: 479293 - RNA, 24 nt, Human
ugggaggccgaggugggcggauca

SEQ ID NO: 479294 - RNA, 24 nt, Human
ugggaggcugaaguguaaggguca

SEQ ID NO: 479295 - RNA, 25 nt, Human
ugggaggcugaaguguaagggucaa

SEQ ID NO: 479296 - RNA, 24 nt, Human
ugggagguugaggcagaagaauca

SEQ ID NO: 479297 - RNA, 18 nt, Human
ugggauuacaggcgugag

SEQ ID NO: 479298 - RNA, 18 nt, Human
ugggauuacaggcgugag

SEQ ID NO: 479299 - RNA, 18 nt, Human
ugggauuacaggcgugag

SEQ ID NO: 479300 - RNA, 19 nt, Human
ugggauuacaggcgugaga

SEQ ID NO: 479301 - RNA, 23 nt, Human
ugggauuacaggcgugagaagau

SEQ ID NO: 479302 - RNA, 24 nt, Human
ugggauuacaggcgugagaagaua

SEQ ID NO: 479303 - RNA, 21 nt, Human
ugggauuacaggugcacacca

SEQ ID NO: 479304 - RNA, 22 nt, Human
ugggauuacaggugcacaccac

SEQ ID NO: 479305 - RNA, 22 nt, Human
ugggauuacaggugcacaccac

SEQ ID NO: 479306 - RNA, 24 nt, Human
ugggauuacaggugcacaccacca

SEQ ID NO: 479307 - RNA, 19 nt, Human
ugggauuacaggugugagc

SEQ ID NO: 479308 - RNA, 21 nt, Human
ugggauuacaggugugagcca

SEQ ID NO: 479309 - RNA, 22 nt, Human
ugggauuacaggugugagccac

SEQ ID NO: 479310 - RNA, 22 nt, Human
ugggauuacaggugugagccac

SEQ ID NO: 479311 - RNA, 24 nt, Human
ugggauuacaggugugagccacug

SEQ ID NO: 479312 - RNA, 23 nt, Human
ugggggccagagggccucucggg

SEQ ID NO: 479313 - RNA, 24 nt, Human
ugggguuucaccauguuggccagg

SEQ ID NO: 479314 - RNA, 24 nt, Human
ugguggcucacaccuguaauccca

SEQ ID NO: 479315 - RNA, 22 nt, Human
ugguggcucccaucuguaaucc

SEQ ID NO: 479316 - RNA, 18 nt, Human
ugguuaaaaaggguuguu

SEQ ID NO: 479317 - RNA, 21 nt, Human
uguagucagauccugagaacc

SEQ ID NO: 479318 - RNA, 19 nt, Human
uguauacauauuuuauaua

SEQ ID NO: 479319 - RNA, 21 nt, Human
uguauacauauuuuauauaug

SEQ ID NO: 479320 - RNA, 22 nt, Human
uguauuuuuaguagagauggag

SEQ ID NO: 479321 - RNA, 19 nt, Human
ugucaggaggaacauaugg

SEQ ID NO: 479322 - RNA, 23 nt, Human
uguguuuggguguuuuccagguu

SEQ ID NO: 479323 - RNA, 19 nt, Human
uguuacaugucagaaaguc

SEQ ID NO: 479324 - RNA, 24 nt, Human
uguuuguuuuuugagacggagucu

SEQ ID NO: 479325 - RNA, 23 nt, Human
uguuuuccagguuauccaaauau

SEQ ID NO: 479326 - RNA, 20 nt, Human
uuaaaacagaaaccuccuuc

SEQ ID NO: 479327 - RNA, 18 nt, Human
uuagcagagaugggguuu

SEQ ID NO: 479328 - RNA, 22 nt, Human
uuagcagagaugggguuucacc

SEQ ID NO: 479329 - RNA, 24 nt, Human
uuagcagagaugggguuucaccau

SEQ ID NO: 479330 - RNA, 18 nt, Human
uuagcugggcaugguggc

SEQ ID NO: 479331 - RNA, 24 nt, Human
uuagcugggcaugguggcaggcgc

SEQ ID NO: 479332 - RNA, 18 nt, Human
uuaguagagauggaguuu

SEQ ID NO: 479333 - RNA, 22 nt, Human
uuaguagagauggaguuucacc

SEQ ID NO: 479334 - RNA, 24 nt, Human
uuaguagagauggaguuucaccgu

SEQ ID NO: 479335 - RNA, 21 nt, Human
uucaagugauucuccugccuc

SEQ ID NO: 479336 - RNA, 23 nt, Human
uucaagugauucuccugccucag

SEQ ID NO: 479337 - RNA, 24 nt, Human
uucaagugauucuccugccucagc

SEQ ID NO: 479338 - RNA, 23 nt, Human
uucauugucuuaguagcuugggc

SEQ ID NO: 479339 - RNA, 23 nt, Human
uucuagccuacaucccccaacac

SEQ ID NO: 479340 - RNA, 18 nt, Human
uugaaguuuguguuuggg

SEQ ID NO: 479341 - RNA, 20 nt, Human
uugcagugagccaagauugc

SEQ ID NO: 479342 - RNA, 24 nt, Human
uugcccaggcuggagugcaguggc

SEQ ID NO: 479343 - RNA, 22 nt, Human
uuggcugggugugguggcucac

SEQ ID NO: 479344 - RNA, 25 nt, Human
uugggaggccgaggugggcggauca

SEQ ID NO: 479345 - RNA, 25 nt, Human
uugggaggcugaaguguaaggguca

SEQ ID NO: 479346 - RNA, 23 nt, Human
uuguauuuuuaguagagauggag

SEQ ID NO: 479347 - RNA, 24 nt, Human
uuucaccauguuggccaggcuggu

SEQ ID NO: 479348 - RNA, 19 nt, Human
uuucaccguguuagccagg

SEQ ID NO: 479349 - RNA, 22 nt, Human
uuucuuagauccaccacggaca

SEQ ID NO: 479350 - RNA, 18 nt, Human
uuucuuguaauuuuagca

SEQ ID NO: 479351 - RNA, 22 nt, Human
uuucuuguaauuuuagcagaga

SEQ ID NO: 479352 - RNA, 23 nt, Human
uuuuagcagagaugggguuucac

SEQ ID NO: 479353 - RNA, 24 nt, Human
uuuuuaguagagauggaguuucac

SEQ ID NO: 479354 - RNA, 23 nt, Human
uuuuucuucucuuuuccuauuuu

SEQ ID NO: 479355 - RNA, 21 nt, Human
uuuuuguauuuuuaguagaga

SEQ ID NO: 479356 - RNA, 21 nt, Human
uuuuuuguauuuuuaguagag

SEQ ID NO: 479357 - RNA, 24 nt, Human
uuuuuuguauuuuuaguagagaug

SEQ ID NO: 479358 - RNA, 24 nt, Human
uuuuuuuuguauuuuuaguagaga

SEQ ID NO: 479359 - RNA, 19 nt, Human
aaaagacucccagccacuc

SEQ ID NO: 479360 - RNA, 20 nt, Human
aaaauccuccauccaaucca

SEQ ID NO: 479361 - RNA, 20 nt, Human
aacuggugguguccccacaa

SEQ ID NO: 479362 - RNA, 23 nt, Human
aagcaagaguugagggcaugcaa

SEQ ID NO: 479363 - RNA, 18 nt, Human
aagcacaaaaugcugaca

SEQ ID NO: 479364 - RNA, 25 nt, Human
acacaaccaaaacaucagacagacu

SEQ ID NO: 479365 - RNA, 21 nt, Human
acccaccuucccuucuuacug

SEQ ID NO: 479366 - RNA, 20 nt, Human
accccucagucucagggauc

SEQ ID NO: 479367 - RNA, 25 nt, Human
accccugccaagcaagaguugaggg

SEQ ID NO: 479368 - RNA, 31 nt, Human
acugccucaagcucccauggaccugugggcc

SEQ ID NO: 479369 - RNA, 22 nt, Human
acugggaggaaggguagagcug

SEQ ID NO: 479370 - RNA, 18 nt, Human
agacucccagccacuccu

SEQ ID NO: 479371 - RNA, 19 nt, Human
agccaaaagcacaaaaugc

SEQ ID NO: 479372 - RNA, 21 nt, Human
caaaugcugagccaaaagcac

SEQ ID NO: 479373 - RNA, 18 nt, Human
cacagcccguaaaccccu

SEQ ID NO: 479374 - RNA, 22 nt, Human
caccuucccuucuuacugggag

SEQ ID NO: 479375 - RNA, 19 nt, Human
cagcagcaguggggaggga

SEQ ID NO: 479376 - RNA, 19 nt, Human
cagcagcaguggggaggga

SEQ ID NO: 479377 - RNA, 31 nt, Human
cagcagcaguggggagggagggugggcaacg

SEQ ID NO: 479378 - RNA, 22 nt, Human
cagcaguggggagggagggugg

SEQ ID NO: 479379 - RNA, 21 nt, Human
cagcccguaaaccccucaguc

SEQ ID NO: 479380 - RNA, 21 nt, Human
caggugcccacccaccuuccc

SEQ ID NO: 479381 - RNA, 19 nt, Human
caguggggagggagggugg

SEQ ID NO: 479382 - RNA, 20 nt, Human
caguggggagggaggguggg

SEQ ID NO: 479383 - RNA, 21 nt, Human
ccaguggcaaggaagggcugg

SEQ ID NO: 479384 - RNA, 18 nt, Human
ccaucucgccuguuccca

SEQ ID NO: 479385 - RNA, 21 nt, Human
cccacaaguuagggaaaagac

SEQ ID NO: 479386 - RNA, 20 nt, Human
cccagccacuccuugagaug

SEQ ID NO: 479387 - RNA, 23 nt, Human
ccccaauuccauguauucuucua

SEQ ID NO: 479388 - RNA, 23 nt, Human
cccguaaaccccucagucucagg

SEQ ID NO: 479389 - RNA, 23 nt, Human
ccuccauccaauccaaaugcuga

SEQ ID NO: 479390 - RNA, 20 nt, Human
cugggaggggcaugguuccc

SEQ ID NO: 479391 - RNA, 21 nt, Human
cuugacaacuggugguguccc

SEQ ID NO: 479392 - RNA, 18 nt, Human
cuuucagucucugguacc

SEQ ID NO: 479393 - RNA, 20 nt, Human
gaaaauccuccauccaaucc

SEQ ID NO: 479394 - RNA, 23 nt, Human
gaaaauccuccauccaauccaaa

SEQ ID NO: 479395 - RNA, 19 nt, Human
gaagacaauuauuccaugg

SEQ ID NO: 479396 - RNA, 24 nt, Human
gcccucagacccuacugccuagua

SEQ ID NO: 479397 - RNA, 23 nt, Human
gcugcccagcuuugagaccagug

SEQ ID NO: 479398 - RNA, 18 nt, Human
ggacugggaggggcaugg

SEQ ID NO: 479399 - RNA, 23 nt, Human
ggacugggaggggcaugguucca

SEQ ID NO: 479400 - RNA, 20 nt, Human
ggagaaacgggacugggagg

SEQ ID NO: 479401 - RNA, 20 nt, Human
ggagggagggugggcagggc

SEQ ID NO: 479402 - RNA, 22 nt, Human
ggagggugggcagggcugaagg

SEQ ID NO: 479403 - RNA, 19 nt, Human
gggagggagggugggcagg

SEQ ID NO: 479404 - RNA, 22 nt, Human
gggcauuucuuggagggcuggg

SEQ ID NO: 479405 - RNA, 19 nt, Human
gggcugggggaccacaguc

SEQ ID NO: 479406 - RNA, 21 nt, Human
gggggugcugguagugggacu

SEQ ID NO: 479407 - RNA, 19 nt, Human
guggaagacaauuauucca

SEQ ID NO: 479408 - RNA, 21 nt, Human
uaaccucucagguggaggccu

SEQ ID NO: 479409 - RNA, 21 nt, Human
uaccccugccaagcaagaguu

SEQ ID NO: 479410 - RNA, 23 nt, Human
uauauuuauucacacaaccaaaa

SEQ ID NO: 479411 - RNA, 18 nt, Human
ucagguggaggccugagc

SEQ ID NO: 479412 - RNA, 23 nt, Human
uccaaaugcugagccaaaagcac

SEQ ID NO: 479413 - RNA, 25 nt, Human
uccauggucgguggcgacggagggc

SEQ ID NO: 479414 - RNA, 19 nt, Human
ucccagggaaggugaugug

SEQ ID NO: 479415 - RNA, 27 nt, Human
ucccauggaccugugggcggggaguuc

SEQ ID NO: 479416 - RNA, 24 nt, Human
ucccuguuccaucucgccuguucu

SEQ ID NO: 479417 - RNA, 19 nt, Human
uccuugagaugggugccug

SEQ ID NO: 479418 - RNA, 21 nt, Human
uccuugguuuaugggcauuuc

SEQ ID NO: 479419 - RNA, 25 nt, Human
ucgguggcgacggagggcugguuuc

SEQ ID NO: 479420 - RNA, 22 nt, Human
ucucaggugcccacccaccuuc

SEQ ID NO: 479421 - RNA, 23 nt, Human
ucucagguggaggccugagcccu

SEQ ID NO: 479422 - RNA, 23 nt, Human
ucucagguuauaaccucucaggu

SEQ ID NO: 479423 - RNA, 21 nt, Human
ugaaaauccuccauccaaucc

SEQ ID NO: 479424 - RNA, 23 nt, Human
ugaaaauccuccauccaauccaa

SEQ ID NO: 479425 - RNA, 20 nt, Human
ugaggacuuucacccugucc

SEQ ID NO: 479426 - RNA, 21 nt, Human
ugcaaugggcugcccagcuuu

SEQ ID NO: 479427 - RNA, 18 nt, Human
ugcccacccaccuucccu

SEQ ID NO: 479428 - RNA, 21 nt, Human
ugcccacccaccuucccuucu

SEQ ID NO: 479429 - RNA, 21 nt, Human
ugccucaagcucccauggacc

SEQ ID NO: 479430 - RNA, 21 nt, Human
uggaagacaauuauuccaugg

SEQ ID NO: 479431 - RNA, 24 nt, Human
uggaccugugggcggggaguuaaa

SEQ ID NO: 479432 - RNA, 26 nt, Human
uggaggccugagcccucagacccuac

SEQ ID NO: 479433 - RNA, 23 nt, Human
uggcaccagggaagaguuucgug

SEQ ID NO: 479434 - RNA, 25 nt, Human
uggcaccagggaagaguuucgugga

SEQ ID NO: 479435 - RNA, 23 nt, Human
ugggaaguggaggauucagaucc

SEQ ID NO: 479436 - RNA, 24 nt, Human
ugggaggggcaugguuccaguggg

SEQ ID NO: 479437 - RNA, 19 nt, Human
uggggagggagggugggca

SEQ ID NO: 479438 - RNA, 22 nt, Human
uggggagggagggugggcaggg

SEQ ID NO: 479439 - RNA, 24 nt, Human
uuccauggucgguggcgacggagg

SEQ ID NO: 479440 - RNA, 19 nt, Human
uucccauucuucuccccaa

SEQ ID NO: 479441 - RNA, 21 nt, Human
uugaggacuuucacccugucc

SEQ ID NO: 479442 - RNA, 23 nt, Human
uuugugccgugucuuucagucuc

SEQ ID NO: 479443 - RNA, 20 nt, Human
uuuucccauucuucucccca

SEQ ID NO: 479444 - RNA, 19 nt, Human
uuuuuuuuuuuuccagagg

SEQ ID NO: 479445 - RNA, 28 nt, Human
uuuuuuuuuuuuuuccagaggggaauua

SEQ ID NO: 479446 - RNA, 21 nt, Human
uuuuuuuuuuuuuuuuccaga

SEQ ID NO: 479447 - RNA, 24 nt, Human
uuuuuuuuuuuuuuuuuccagagg

SEQ ID NO: 479448 - RNA, 22 nt, Human
aaaaagaugguagggaacaaaa

SEQ ID NO: 479449 - RNA, 19 nt, Human
aaaaucccacaaauccaua

SEQ ID NO: 479450 - RNA, 19 nt, Human
aaugaaaucaucaucugaa

SEQ ID NO: 479451 - RNA, 26 nt, Human
auaccagagccauucuggagaugcca

SEQ ID NO: 479452 - RNA, 24 nt, Human
aucugaaaaaaaagaugguagggg

SEQ ID NO: 479453 - RNA, 24 nt, Human
caaaguguugccuuugccagugua

SEQ ID NO: 479454 - RNA, 18 nt, Human
cggugcaagcggcgaacu

SEQ ID NO: 479455 - RNA, 18 nt, Human
gagaugccauguaagaaa

SEQ ID NO: 479456 - RNA, 23 nt, Human
ucagaacuggggagaagggucca

SEQ ID NO: 479457 - RNA, 21 nt, Human
ugccauguaagaaaucuggag

SEQ ID NO: 479458 - RNA, 19 nt, Human
ugguagggaacaaaacgug

SEQ ID NO: 479459 - RNA, 22 nt, Human
aaaaauaacaaaaagaccuuac

SEQ ID NO: 479460 - RNA, 22 nt, Human
aaauguugcaaguuauccuacu

SEQ ID NO: 479461 - RNA, 20 nt, Human
aacaaaaagaccuuacuaau

SEQ ID NO: 479462 - RNA, 26 nt, Human
aaccucgcagccgcguucucccaccg

SEQ ID NO: 479463 - RNA, 20 nt, Human
aaucaaagucaucaucuuug

SEQ ID NO: 479464 - RNA, 24 nt, Human
acuaauuauccaaucaaagucauc

SEQ ID NO: 479465 - RNA, 21 nt, Human
agccgcguucucccaccggaa

SEQ ID NO: 479466 - RNA, 20 nt, Human
caacaauaccugauacgaug

SEQ ID NO: 479467 - RNA, 21 nt, Human
caagauguuccugacacauga

SEQ ID NO: 479468 - RNA, 19 nt, Human
cacaacuuaaaguuuuguc

SEQ ID NO: 479469 - RNA, 18 nt, Human
cgaaaaccucgcagccgc

SEQ ID NO: 479470 - RNA, 23 nt, Human
cucuaauaucaacaauaccugau

SEQ ID NO: 479471 - RNA, 23 nt, Human
gagccaaagccgaaaaccucgca

SEQ ID NO: 479472 - RNA, 20 nt, Human
gccgcguucucccaccggaa

SEQ ID NO: 479473 - RNA, 22 nt, Human
guaaaucucuaaaaugugguag

SEQ ID NO: 479474 - RNA, 21 nt, Human
guagguacuuccagagcuaaa

SEQ ID NO: 479475 - RNA, 28 nt, Human
uaaaacauugaaaaaacauuaaaagaca

SEQ ID NO: 479476 - RNA, 20 nt, Human
uaaaucucuaaaauguggua

SEQ ID NO: 479477 - RNA, 21 nt, Human
uaacaaaaagaccuuacuaau

SEQ ID NO: 479478 - RNA, 23 nt, Human
uaacaaaaagaccuuacuaauua

SEQ ID NO: 479479 - RNA, 20 nt, Human
uccagagcuaaauguugcaa

SEQ ID NO: 479480 - RNA, 23 nt, Human
aaacaaccggggcccaggcccag

SEQ ID NO: 479481 - RNA, 22 nt, Human
aaacggccaggcccacgaagca

SEQ ID NO: 479482 - RNA, 18 nt, Human
aacagaaaaccagacccc

SEQ ID NO: 479483 - RNA, 21 nt, Human
aacaggagggccagccucagg

SEQ ID NO: 479484 - RNA, 23 nt, Human
aacgcguugccucaauucacucc

SEQ ID NO: 479485 - RNA, 21 nt, Human
aacggaagaguccuaagacug

SEQ ID NO: 479486 - RNA, 21 nt, Human
aagacccuuccuuuucuucua

SEQ ID NO: 479487 - RNA, 20 nt, Human
aagacgccugagcggcgcgg

SEQ ID NO: 479488 - RNA, 25 nt, Human
aagaguccuaagacugcaaagaccc

SEQ ID NO: 479489 - RNA, 21 nt, Human
aagggccaggagucacggacg

SEQ ID NO: 479490 - RNA, 18 nt, Human
aaguaacagaaaaccaga

SEQ ID NO: 479491 - RNA, 22 nt, Human
aaguaacagaaaaccagacccc

SEQ ID NO: 479492 - RNA, 19 nt, Human
accacagccaccgcaggga

SEQ ID NO: 479493 - RNA, 18 nt, Human
accgcagggaaacaaccg

SEQ ID NO: 479494 - RNA, 18 nt, Human
acgccugagcggcgcggg

SEQ ID NO: 479495 - RNA, 19 nt, Human
agccccugggaggaacccu

SEQ ID NO: 479496 - RNA, 19 nt, Human
aggacucaaauacgucacc

SEQ ID NO: 479497 - RNA, 22 nt, Human
agucuacuuaucugagcccaaa

SEQ ID NO: 479498 - RNA, 23 nt, Human
agucucagcucugccaguuccug

SEQ ID NO: 479499 - RNA, 21 nt, Human
caaaaauacugaguccaccug

SEQ ID NO: 479500 - RNA, 19 nt, Human
caaccggggcccaggccca

SEQ ID NO: 479501 - RNA, 19 nt, Human
cacaacccgcaacgagaag

SEQ ID NO: 479502 - RNA, 23 nt, Human
cacaacccgcaacgagaagcaaa

SEQ ID NO: 479503 - RNA, 19 nt, Human
cacacgcggcucagucacc

SEQ ID NO: 479504 - RNA, 23 nt, Human
caccucaugauaagacagcaaua

SEQ ID NO: 479505 - RNA, 19 nt, Human
cagaaaacugcccucgacu

SEQ ID NO: 479506 - RNA, 22 nt, Human
cagaaaacugcccucgacuaac

SEQ ID NO: 479507 - RNA, 19 nt, Human
cagcgcagcgaaggggcgg

SEQ ID NO: 479508 - RNA, 18 nt, Human
ccaaacgcaaacggccag

SEQ ID NO: 479509 - RNA, 21 nt, Human
ccaaacgcaaacggccaggcc

SEQ ID NO: 479510 - RNA, 25 nt, Human
ccaaacgcaaacggccaggcccacg

SEQ ID NO: 479511 - RNA, 19 nt, Human
ccacagagaagggccagga

SEQ ID NO: 479512 - RNA, 22 nt, Human
ccaccgcagggaaacaaccggg

SEQ ID NO: 479513 - RNA, 22 nt, Human
ccaggcagucggcgccugcgcu

SEQ ID NO: 479514 - RNA, 19 nt, Human
cccacaaaaauacugaguc

SEQ ID NO: 479515 - RNA, 25 nt, Human
cccaggacugaagaaguaccagggc

SEQ ID NO: 479516 - RNA, 18 nt, Human
ccccagaaaacugcccuc

SEQ ID NO: 479517 - RNA, 23 nt, Human
ccgccgggggcugcggacuacag

SEQ ID NO: 479518 - RNA, 22 nt, Human
ccuccuuccaagguucacaggg

SEQ ID NO: 479519 - RNA, 25 nt, Human
ccuccuuccaagguucacagggugg

SEQ ID NO: 479520 - RNA, 19 nt, Human
ccuguagaacccuccuucc

SEQ ID NO: 479521 - RNA, 20 nt, Human
ccuguagaacccuccuucca

SEQ ID NO: 479522 - RNA, 21 nt, Human
ccuuccuuuucuucuagaucc

SEQ ID NO: 479523 - RNA, 20 nt, Human
cgaagcaggaaacacaaccc

SEQ ID NO: 479524 - RNA, 19 nt, Human
cgacuaacagcgcagcgaa

SEQ ID NO: 479525 - RNA, 21 nt, Human
cgagccaagacgccugagcgg

SEQ ID NO: 479526 - RNA, 21 nt, Human
cgcggggggaucgggggaucc

SEQ ID NO: 479527 - RNA, 20 nt, Human
cgcucgagacccuggaacgg

SEQ ID NO: 479528 - RNA, 18 nt, Human
cggccaggcccacgaagc

SEQ ID NO: 479529 - RNA, 19 nt, Human
cggcucagucaccuaggga

SEQ ID NO: 479530 - RNA, 18 nt, Human
cucgagacccuggaacgg

SEQ ID NO: 479531 - RNA, 19 nt, Human
cugcgcccacaaagccgcc

SEQ ID NO: 479532 - RNA, 19 nt, Human
cugcgcccacaaagccgcc

SEQ ID NO: 479533 - RNA, 21 nt, Human
cugcgcccacaaagccgccgg

SEQ ID NO: 479534 - RNA, 22 nt, Human
cugcgcccacaaagccgccggg

SEQ ID NO: 479535 - RNA, 20 nt, Human
cugcucaggagcgugaacga

SEQ ID NO: 479536 - RNA, 19 nt, Human
cuggaacgggaacgaccac

SEQ ID NO: 479537 - RNA, 21 nt, Human
gaagaacagcccgagcucaca

SEQ ID NO: 479538 - RNA, 21 nt, Human
gaagaguucuagcucgcgaca

SEQ ID NO: 479539 - RNA, 20 nt, Human
gagggaccagacuuaaguuc

SEQ ID NO: 479540 - RNA, 18 nt, Human
ggaaaaggccagcgggcc

SEQ ID NO: 479541 - RNA, 18 nt, Human
ggaaggcucugcucagga

SEQ ID NO: 479542 - RNA, 21 nt, Human
gggaaacaaccggggcccagg

SEQ ID NO: 479543 - RNA, 20 nt, Human
gggagcaggaaaaggccagc

SEQ ID NO: 479544 - RNA, 22 nt, Human
ggggcccaggcccaggugggcg

SEQ ID NO: 479545 - RNA, 22 nt, Human
gugaacgacaccgcccgcugca

SEQ ID NO: 479546 - RNA, 19 nt, Human
uaacaccuacgucgcggaa

SEQ ID NO: 479547 - RNA, 21 nt, Human
uaacagaaaaccagaccccau

SEQ ID NO: 479548 - RNA, 20 nt, Human
uaagaaaagauaaaacaaac

SEQ ID NO: 479549 - RNA, 23 nt, Human
uaagacagcaauacaacugcccc

SEQ ID NO: 479550 - RNA, 24 nt, Human
uaaguugaaccaacacaauaauug

SEQ ID NO: 479551 - RNA, 19 nt, Human
uagcucgcgacagccccug

SEQ ID NO: 479552 - RNA, 23 nt, Human
uaggaagaugagcuugccaaaaa

SEQ ID NO: 479553 - RNA, 21 nt, Human
ucagggaaguuuaaaaaaaau

SEQ ID NO: 479554 - RNA, 26 nt, Human
ucaguuagaauuaaauaaauuuucca

SEQ ID NO: 479555 - RNA, 21 nt, Human
ucccaggacugaagaaguacc

SEQ ID NO: 479556 - RNA, 19 nt, Human
ucccccagaaaacugcccu

SEQ ID NO: 479557 - RNA, 20 nt, Human
uccuaagacugcaaagaccc

SEQ ID NO: 479558 - RNA, 20 nt, Human
ucgacuaacagcgcagcgaa

SEQ ID NO: 479559 - RNA, 21 nt, Human
ucucaccacagccauaaggcg

SEQ ID NO: 479560 - RNA, 25 nt, Human
ugaagccaguaagagaaaagacuaa

SEQ ID NO: 479561 - RNA, 24 nt, Human
ugagccacgcggaggaggaagaac

SEQ ID NO: 479562 - RNA, 23 nt, Human
ugcaaagacccuuccuuuucuuc

SEQ ID NO: 479563 - RNA, 21 nt, Human
ugcaaguaacagaaaaccaga

SEQ ID NO: 479564 - RNA, 21 nt, Human
ugcauagauaucauuccaauu

SEQ ID NO: 479565 - RNA, 20 nt, Human
ugcauuuguauauuuuccuu

SEQ ID NO: 479566 - RNA, 22 nt, Human
uggaaaggaacgcguugccuca

SEQ ID NO: 479567 - RNA, 21 nt, Human
uggagaguggcuaaugucccc

SEQ ID NO: 479568 - RNA, 19 nt, Human
uggagugagccacgcggag

SEQ ID NO: 479569 - RNA, 18 nt, Human
uggcgucgaguaaagcac

SEQ ID NO: 479570 - RNA, 22 nt, Human
ugggcauggagugugagggacc

SEQ ID NO: 479571 - RNA, 24 nt, Human
uguagaacccuccuuccaagguuc

SEQ ID NO: 479572 - RNA, 20 nt, Human
ugugucacacacgcggcuca

SEQ ID NO: 479573 - RNA, 20 nt, Human
uuauggcuguuauccuaaca

SEQ ID NO: 479574 - RNA, 23 nt, Human
uuccuguagaacccuccuuccaa

SEQ ID NO: 479575 - RNA, 19 nt, Human
aagaagaagcucaacagcu

SEQ ID NO: 479576 - RNA, 21 nt, Human
aagaagcucaacagcugccaa

SEQ ID NO: 479577 - RNA, 25 nt, Human
aagccagcucuggacugaguucuag

SEQ ID NO: 479578 - RNA, 24 nt, Human
aagucgaguucccuguugacccug

SEQ ID NO: 479579 - RNA, 22 nt, Human
agaaagaaacuaaucuauaaaa

SEQ ID NO: 479580 - RNA, 19 nt, Human
aggaagaagucgaguuccc

SEQ ID NO: 479581 - RNA, 21 nt, Human
aggauggaacuaggggaagaa

SEQ ID NO: 479582 - RNA, 22 nt, Human
auagcaaaauauuuuuggucau

SEQ ID NO: 479583 - RNA, 27 nt, Human
caaagagcauuucccacuuuaugccaa

SEQ ID NO: 479584 - RNA, 24 nt, Human
caagaagaagcucaacagcugguu

SEQ ID NO: 479585 - RNA, 20 nt, Human
cccacuuuaugccaaauguc

SEQ ID NO: 479586 - RNA, 21 nt, Human
ccugaauggcgacucccucug

SEQ ID NO: 479587 - RNA, 21 nt, Human
gaacaaugagaugaagucagg

SEQ ID NO: 479588 - RNA, 19 nt, Human
gaggauggaacuaggggaa

SEQ ID NO: 479589 - RNA, 20 nt, Human
gcaagaagaagcucaacagc

SEQ ID NO: 479590 - RNA, 18 nt, Human
ggaccccauagacuagca

SEQ ID NO: 479591 - RNA, 20 nt, Human
uagaaagaaacuaaucuaua

SEQ ID NO: 479592 - RNA, 22 nt, Human
uagaaagaaacuaaucuauaaa

SEQ ID NO: 479593 - RNA, 26 nt, Human
uauaaaauggagacaauucuccccaa

SEQ ID NO: 479594 - RNA, 22 nt, Human
uaucaagaaggugaacagcuuc

SEQ ID NO: 479595 - RNA, 20 nt, Human
ucaggaagaagucgaguucc

SEQ ID NO: 479596 - RNA, 18 nt, Human
uccaaagagcauuuccca

SEQ ID NO: 479597 - RNA, 21 nt, Human
uccaaagagcauuucccacuu

SEQ ID NO: 479598 - RNA, 25 nt, Human
uccauauacaaagaaagaaauagca

SEQ ID NO: 479599 - RNA, 23 nt, Human
ucuccaauaucaaaaaggucacu

SEQ ID NO: 479600 - RNA, 22 nt, Human
ucucucauagaagagcauaagc

SEQ ID NO: 479601 - RNA, 21 nt, Human
ugacccugaauggcgacuccc

SEQ ID NO: 479602 - RNA, 24 nt, Human
ugacccugaauggcgacucccucu

SEQ ID NO: 479603 - RNA, 23 nt, Human
ugagaugaagucagguuuguguu

SEQ ID NO: 479604 - RNA, 25 nt, Human
ugccaaaugucuuuguaaggacccc

SEQ ID NO: 479605 - RNA, 23 nt, Human
uggagacaauucuccccaauuca

SEQ ID NO: 479606 - RNA, 20 nt, Human
caaaauauaauacauuaaca

SEQ ID NO: 479607 - RNA, 28 nt, Human
caaacauucacacgcaggcaacagaaua

SEQ ID NO: 479608 - RNA, 19 nt, Human
ccuuuggguuuaccaagga

SEQ ID NO: 479609 - RNA, 21 nt, Human
gcaacagaauaagccuuuggg

SEQ ID NO: 479610 - RNA, 24 nt, Human
uuaacagacaaugauauagcucuu

SEQ ID NO: 479611 - RNA, 18 nt, Human
acauaggccuugguuucc

SEQ ID NO: 479612 - RNA, 23 nt, Human
agacauaggccuugguuucccca

SEQ ID NO: 479613 - RNA, 18 nt, Human
uaggccuugguuucccca

SEQ ID NO: 479614 - RNA, 22 nt, Human
aacacaucaguaacagucuuau

SEQ ID NO: 479615 - RNA, 23 nt, Human
aacccaaugguuucgguuacugu

SEQ ID NO: 479616 - RNA, 22 nt, Human
aagaaaaaccuaauuuggcauu

SEQ ID NO: 479617 - RNA, 21 nt, Human
aagcaagagccagucacagag

SEQ ID NO: 479618 - RNA, 22 nt, Human
aagcaagagccagucacagaga

SEQ ID NO: 479619 - RNA, 18 nt, Human
aagcaucacgaccaucuu

SEQ ID NO: 479620 - RNA, 22 nt, Human
aagcccuccgcuccagccccuc

SEQ ID NO: 479621 - RNA, 19 nt, Human
aauagguccuggggcccuu

SEQ ID NO: 479622 - RNA, 18 nt, Human
aaucacucaguugcaucc

SEQ ID NO: 479623 - RNA, 20 nt, Human
aauuggacugacuacauuca

SEQ ID NO: 479624 - RNA, 20 nt, Human
acaccaaaggucagaaacac

SEQ ID NO: 479625 - RNA, 26 nt, Human
acacuggcugccagccacuggggcuu

SEQ ID NO: 479626 - RNA, 21 nt, Human
acagagacacuggcauccaca

SEQ ID NO: 479627 - RNA, 18 nt, Human
acagccuucugcaaaaau

SEQ ID NO: 479628 - RNA, 20 nt, Human
acaggaacgugaccguggag

SEQ ID NO: 479629 - RNA, 18 nt, Human
acaggcacaucugacaug

SEQ ID NO: 479630 - RNA, 21 nt, Human
acaggcacaucugacaugccu

SEQ ID NO: 479631 - RNA, 19 nt, Human
acccagagaaugaagaaag

SEQ ID NO: 479632 - RNA, 19 nt, Human
acuaacaagugaacaacac

SEQ ID NO: 479633 - RNA, 24 nt, Human
agaaaaaccuaauuuggcauuuuu

SEQ ID NO: 479634 - RNA, 23 nt, Human
agaccagacuggcaggaagaagg

SEQ ID NO: 479635 - RNA, 20 nt, Human
agagauggauggauaaugag

SEQ ID NO: 479636 - RNA, 24 nt, Human
aggaacgugaccguggagggaugg

SEQ ID NO: 479637 - RNA, 23 nt, Human
aggaagaagucacaguagacaga

SEQ ID NO: 479638 - RNA, 24 nt, Human
aggaggcauagaacuucuggcucu

SEQ ID NO: 479639 - RNA, 18 nt, Human
aggaggccccggucacgc

SEQ ID NO: 479640 - RNA, 21 nt, Human
auaaaguucucuuaggauaaa

SEQ ID NO: 479641 - RNA, 23 nt, Human
caaaagaaaagcaaccucucccc

SEQ ID NO: 479642 - RNA, 18 nt, Human
caagagccagucacagag

SEQ ID NO: 479643 - RNA, 19 nt, Human
caagugaacaacacaucag

SEQ ID NO: 479644 - RNA, 20 nt, Human
caccaguggucucccaggcu

SEQ ID NO: 479645 - RNA, 20 nt, Human
cacccaagcuacgcuagugc

SEQ ID NO: 479646 - RNA, 20 nt, Human
caccccuccagcccaagccc

SEQ ID NO: 479647 - RNA, 22 nt, Human
caccuugacccaaauguucuga

SEQ ID NO: 479648 - RNA, 19 nt, Human
cagagacacuggcauccac

SEQ ID NO: 479649 - RNA, 26 nt, Human
cagcacuguacacauguggugagcca

SEQ ID NO: 479650 - RNA, 21 nt, Human
cagcucagggcucccgccucg

SEQ ID NO: 479651 - RNA, 18 nt, Human
caggagccggccucagag

SEQ ID NO: 479652 - RNA, 18 nt, Human
caggaugggccucugggc

SEQ ID NO: 479653 - RNA, 18 nt, Human
caggaugggccucugggc

SEQ ID NO: 479654 - RNA, 22 nt, Human
cagggcucccgccucgccuccc

SEQ ID NO: 479655 - RNA, 18 nt, Human
caguagacagagcagcca

SEQ ID NO: 479656 - RNA, 25 nt, Human
caguagacagagcagccagaugccg

SEQ ID NO: 479657 - RNA, 24 nt, Human
caguuacuaacaagugaacaacac

SEQ ID NO: 479658 - RNA, 21 nt, Human
cauaauaaaguucucuuagga

SEQ ID NO: 479659 - RNA, 18 nt, Human
ccacacccagggccccug

SEQ ID NO: 479660 - RNA, 18 nt, Human
ccacugagauuacacagg

SEQ ID NO: 479661 - RNA, 18 nt, Human
cccaggggcccugcuggg

SEQ ID NO: 479662 - RNA, 18 nt, Human
ccccagguuucacuuugc

SEQ ID NO: 479663 - RNA, 21 nt, Human
cccccagguuucacuuugcuc

SEQ ID NO: 479664 - RNA, 19 nt, Human
ccccgccgccuccuccugc

SEQ ID NO: 479665 - RNA, 20 nt, Human
ccccuccagcccaagcccuc

SEQ ID NO: 479666 - RNA, 19 nt, Human
cccuccgcuccagccccuc

SEQ ID NO: 479667 - RNA, 18 nt, Human
cccugcuggggacucgcc

SEQ ID NO: 479668 - RNA, 18 nt, Human
cccuguggggccacuguc

SEQ ID NO: 479669 - RNA, 21 nt, Human
ccgcgcugcccggccucagcu

SEQ ID NO: 479670 - RNA, 21 nt, Human
ccuccaggccucuuugauagc

SEQ ID NO: 479671 - RNA, 22 nt, Human
cgagggcacggggggcgcaggg

SEQ ID NO: 479672 - RNA, 19 nt, Human
cgccgguguccccgccgcc

SEQ ID NO: 479673 - RNA, 23 nt, Human
cgggaagggcagguggcuggaga

SEQ ID NO: 479674 - RNA, 20 nt, Human
cucagacauuuaacuuaucc

SEQ ID NO: 479675 - RNA, 23 nt, Human
cucccgccucgccuccccgagcu

SEQ ID NO: 479676 - RNA, 22 nt, Human
cuccgcccagucugagggcucc

SEQ ID NO: 479677 - RNA, 23 nt, Human
cucgccgguguccccgccgccuc

SEQ ID NO: 479678 - RNA, 21 nt, Human
cugaccucccuaaccugcugg

SEQ ID NO: 479679 - RNA, 20 nt, Human
cugagagggaccgcgcagug

SEQ ID NO: 479680 - RNA, 24 nt, Human
cugagguggagaguagagggguug

SEQ ID NO: 479681 - RNA, 21 nt, Human
cugcaaacagcacuguacaca

SEQ ID NO: 479682 - RNA, 25 nt, Human
cuuggcaguguuugugcagagcucu

SEQ ID NO: 479683 - RNA, 22 nt, Human
cuuggccucagcuuccucugac

SEQ ID NO: 479684 - RNA, 24 nt, Human
gaacccaaugguuucgguuacugu

SEQ ID NO: 479685 - RNA, 18 nt, Human
gaagaaggcccagagcuc

SEQ ID NO: 479686 - RNA, 19 nt, Human
gaagccugugggugccaug

SEQ ID NO: 479687 - RNA, 18 nt, Human
gacaccccuccagcccaa

SEQ ID NO: 479688 - RNA, 30 nt, Human
gacaccccuccagcccaagcccuccgcucu

SEQ ID NO: 479689 - RNA, 19 nt, Human
gagacacuggcauccacac

SEQ ID NO: 479690 - RNA, 19 nt, Human
gagggauggauuauggugg

SEQ ID NO: 479691 - RNA, 23 nt, Human
gauggauaaugaguacaacugcc

SEQ ID NO: 479692 - RNA, 22 nt, Human
gcacucgaagaccagacuggca

SEQ ID NO: 479693 - RNA, 21 nt, Human
gcagagcucugaggaaggaca

SEQ ID NO: 479694 - RNA, 21 nt, Human
gcagugaagaggcucuuugga

SEQ ID NO: 479695 - RNA, 20 nt, Human
gcagugugcggguuuggcaa

SEQ ID NO: 479696 - RNA, 21 nt, Human
gcauguucucugucgugugug

SEQ ID NO: 479697 - RNA, 22 nt, Human
gccaugcuccacagaaggcagg

SEQ ID NO: 479698 - RNA, 24 nt, Human
gccguaugaccccagacugaccuc

SEQ ID NO: 479699 - RNA, 20 nt, Human
gccucgccuccccgagcucc

SEQ ID NO: 479700 - RNA, 23 nt, Human
gcgggacagccuucugcaaaaau

SEQ ID NO: 479701 - RNA, 22 nt, Human
gcucccugucaauguugcugag

SEQ ID NO: 479702 - RNA, 20 nt, Human
gcuugguggguggcacaguu

SEQ ID NO: 479703 - RNA, 22 nt, Human
ggacagcaguacaugguccuca

SEQ ID NO: 479704 - RNA, 22 nt, Human
ggcuggagacccuuccgggagc

SEQ ID NO: 479705 - RNA, 19 nt, Human
gggagcccaggggcccugc

SEQ ID NO: 479706 - RNA, 20 nt, Human
ggggaggcuugguggguggc

SEQ ID NO: 479707 - RNA, 21 nt, Human
gggugugggucuugaacucgg

SEQ ID NO: 479708 - RNA, 19 nt, Human
ggucaggcacaaaaucuca

SEQ ID NO: 479709 - RNA, 18 nt, Human
gguggagaguagaggggu

SEQ ID NO: 479710 - RNA, 23 nt, Human
gguggcaggggagcugagaggga

SEQ ID NO: 479711 - RNA, 21 nt, Human
ggugugugugugugugugugu

SEQ ID NO: 479712 - RNA, 24 nt, Human
gucacaguagacagagcagccaga

SEQ ID NO: 479713 - RNA, 22 nt, Human
gucaccaguggucucccaggcu

SEQ ID NO: 479714 - RNA, 21 nt, Human
gucccagggaccccugccucc

SEQ ID NO: 479715 - RNA, 18 nt, Human
gugccaaggucuaucugu

SEQ ID NO: 479716 - RNA, 23 nt, Human
gugcccccaucacaugucccagc

SEQ ID NO: 479717 - RNA, 21 nt, Human
guggagggauggauuauggug

SEQ ID NO: 479718 - RNA, 18 nt, Human
gugggggcugagguggag

SEQ ID NO: 479719 - RNA, 18 nt, Human
gugggugggggcugaggu

SEQ ID NO: 479720 - RNA, 24 nt, Human
guguggguggcagugaagaggcuc

SEQ ID NO: 479721 - RNA, 33 nt, Human
guguguggggguguguguguguguguguguggu

SEQ ID NO: 479722 - RNA, 21 nt, Human
gugugugugugugugugugag

SEQ ID NO: 479723 - RNA, 20 nt, Human
gugugugugugugugugugu

SEQ ID NO: 479724 - RNA, 21 nt, Human
gugugugugugugugugugug

SEQ ID NO: 479725 - RNA, 21 nt, Human
gugugugugugugugugugug

SEQ ID NO: 479726 - RNA, 25 nt, Human
uaaggugacaccaccagaauccacc

SEQ ID NO: 479727 - RNA, 24 nt, Human
uagaaaacaucgcugucccccucc

SEQ ID NO: 479728 - RNA, 24 nt, Human
ucaagccugcccaggcccuccagg

SEQ ID NO: 479729 - RNA, 23 nt, Human
ucaccaguggucucccaggcugu

SEQ ID NO: 479730 - RNA, 22 nt, Human
ucagcccacaaaagaaaagcaa

SEQ ID NO: 479731 - RNA, 25 nt, Human
ucccagggaccccugccuccgggag

SEQ ID NO: 479732 - RNA, 23 nt, Human
uccccaaacaugugucuugaucu

SEQ ID NO: 479733 - RNA, 20 nt, Human
uccccgccgccuccuccugc

SEQ ID NO: 479734 - RNA, 22 nt, Human
ucccgccucgccuccccgagcu

SEQ ID NO: 479735 - RNA, 21 nt, Human
ucgccgguguccccgccgccu

SEQ ID NO: 479736 - RNA, 26 nt, Human
ucgugugugugugugugggggugugu

SEQ ID NO: 479737 - RNA, 22 nt, Human
ucuauagccuaaacagcugugc

SEQ ID NO: 479738 - RNA, 22 nt, Human
ucucaucuugggucaccuccuc

SEQ ID NO: 479739 - RNA, 21 nt, Human
ucugacaccccuccagcccaa

SEQ ID NO: 479740 - RNA, 18 nt, Human
ucugcagagcucuuuggg

SEQ ID NO: 479741 - RNA, 24 nt, Human
ucugcagagcucuuuggguaguaa

SEQ ID NO: 479742 - RNA, 22 nt, Human
ugaaggcaucaagacaugacca

SEQ ID NO: 479743 - RNA, 22 nt, Human
ugacaccaaaggucagaaacac

SEQ ID NO: 479744 - RNA, 24 nt, Human
ugacaccaaaggucagaaacacuc

SEQ ID NO: 479745 - RNA, 22 nt, Human
ugacaccccuccagcccaagcc

SEQ ID NO: 479746 - RNA, 22 nt, Human
ugagagggaccgcgcagugagc

SEQ ID NO: 479747 - RNA, 24 nt, Human
ugaguacaacugcaaacagcacug

SEQ ID NO: 479748 - RNA, 23 nt, Human
ugcacccaagcuacgcuagugcc

SEQ ID NO: 479749 - RNA, 19 nt, Human
ugcagagcucuuuggguag

SEQ ID NO: 479750 - RNA, 19 nt, Human
ugcccuguggggccacugu

SEQ ID NO: 479751 - RNA, 19 nt, Human
ugccugguucagucaccag

SEQ ID NO: 479752 - RNA, 21 nt, Human
ugccuugcuccaccuugaccc

SEQ ID NO: 479753 - RNA, 24 nt, Human
ugccuugcuccaccuugacccaaa

SEQ ID NO: 479754 - RNA, 24 nt, Human
ugcgagggcacggggggcgcaggg

SEQ ID NO: 479755 - RNA, 22 nt, Human
ugcugagucauguacuuagggu

SEQ ID NO: 479756 - RNA, 20 nt, Human
ugcuggggacucgccggugu

SEQ ID NO: 479757 - RNA, 21 nt, Human
uggagggauggauuauggugg

SEQ ID NO: 479758 - RNA, 18 nt, Human
uggcaggaagaaggccca

SEQ ID NO: 479759 - RNA, 22 nt, Human
uggcaggaagaaggcccagagc

SEQ ID NO: 479760 - RNA, 20 nt, Human
uggcaggggagcugagaggg

SEQ ID NO: 479761 - RNA, 22 nt, Human
uggccucagcuuccucugacac

SEQ ID NO: 479762 - RNA, 23 nt, Human
ugggacggagguuaggccaaugu

SEQ ID NO: 479763 - RNA, 27 nt, Human
ugggagaugugggugggggcugaggug

SEQ ID NO: 479764 - RNA, 22 nt, Human
ugggcuuuccugcauggguuca

SEQ ID NO: 479765 - RNA, 21 nt, Human
ugggggugugugugugugugu

SEQ ID NO: 479766 - RNA, 25 nt, Human
ugggggugugugugugugugugugg

SEQ ID NO: 479767 - RNA, 22 nt, Human
uggugagccaggaggcugggac

SEQ ID NO: 479768 - RNA, 20 nt, Human
uguccccgccgccuccuccu

SEQ ID NO: 479769 - RNA, 22 nt, Human
uguccugaacgcacucgaagac

SEQ ID NO: 479770 - RNA, 19 nt, Human
ugucgugugugugugugug

SEQ ID NO: 479771 - RNA, 19 nt, Human
uguguaggucagcccgaga

SEQ ID NO: 479772 - RNA, 25 nt, Human
ugugugggggugugugugugugugu

SEQ ID NO: 479773 - RNA, 25 nt, Human
ugugugugggggugugugugugugu

SEQ ID NO: 479774 - RNA, 21 nt, Human
ugugugugugggggugugugu

SEQ ID NO: 479775 - RNA, 21 nt, Human
ugugugugugggggugugugu

SEQ ID NO: 479776 - RNA, 21 nt, Human
ugugugugugggggugugugu

SEQ ID NO: 479777 - RNA, 21 nt, Human
ugugugugugggggugugugu

SEQ ID NO: 479778 - RNA, 25 nt, Human
ugugugugugggggugugugugugu

SEQ ID NO: 479779 - RNA, 27 nt, Human
ugugugugugugggggugugugugugu

SEQ ID NO: 479780 - RNA, 30 nt, Human
ugugugugugugugggggugugugugugug

SEQ ID NO: 479781 - RNA, 19 nt, Human
uguguguguguguguguag

SEQ ID NO: 479782 - RNA, 21 nt, Human
uguguguguguguguguaggu

SEQ ID NO: 479783 - RNA, 18 nt, Human
ugugugugugugugugug

SEQ ID NO: 479784 - RNA, 18 nt, Human
ugugugugugugugugug

SEQ ID NO: 479785 - RNA, 18 nt, Human
ugugugugugugugugug

SEQ ID NO: 479786 - RNA, 18 nt, Human
ugugugugugugugugug

SEQ ID NO: 479787 - RNA, 18 nt, Human
ugugugugugugugugug

SEQ ID NO: 479788 - RNA, 18 nt, Human
ugugugugugugugugug

SEQ ID NO: 479789 - RNA, 18 nt, Human
ugugugugugugugugug

SEQ ID NO: 479790 - RNA, 21 nt, Human
ugugugugugugugugugugu

SEQ ID NO: 479791 - RNA, 21 nt, Human
ugugugugugugugugugugu

SEQ ID NO: 479792 - RNA, 21 nt, Human
ugugugugugugugugugugu

SEQ ID NO: 479793 - RNA, 21 nt, Human
ugugugugugugugugugugu

SEQ ID NO: 479794 - RNA, 21 nt, Human
ugugugugugugugugugugu

SEQ ID NO: 479795 - RNA, 21 nt, Human
ugugugugugugugugugugu

SEQ ID NO: 479796 - RNA, 21 nt, Human
ugugugugugugugugugugu

SEQ ID NO: 479797 - RNA, 21 nt, Human
ugugugugugugugugugugu

SEQ ID NO: 479798 - RNA, 21 nt, Human
ugugugugugugugugugugu

SEQ ID NO: 479799 - RNA, 21 nt, Human
ugugugugugugugugugugu

SEQ ID NO: 479800 - RNA, 22 nt, Human
ugugugugugugugugugugua

SEQ ID NO: 479801 - RNA, 22 nt, Human
ugugugugugugugugugugug

SEQ ID NO: 479802 - RNA, 22 nt, Human
ugugugugugugugugugugug

SEQ ID NO: 479803 - RNA, 22 nt, Human
ugugugugugugugugugugug

SEQ ID NO: 479804 - RNA, 22 nt, Human
uguguguguguguguguguguu

SEQ ID NO: 479805 - RNA, 24 nt, Human
uuagaggacagcaacagcacguga

SEQ ID NO: 479806 - RNA, 21 nt, Human
uuaggccaauguugcugcuga

SEQ ID NO: 479807 - RNA, 24 nt, Human
uucugucuacuagagaucauucau

SEQ ID NO: 479808 - RNA, 20 nt, Human
uuggagaugcauguggccag

SEQ ID NO: 479809 - RNA, 18 nt, Human
uuggcaguguuugugcag

SEQ ID NO: 479810 - RNA, 23 nt, Human
uuggcugcguuguucugccuacu

SEQ ID NO: 479811 - RNA, 20 nt, Human
uugguauugcuacagggugu

SEQ ID NO: 479812 - RNA, 22 nt, Human
uuucagaauaugggaugggcuu

SEQ ID NO: 479813 - RNA, 19 nt, Human
uuuggcauuuuuucagaau

SEQ ID NO: 479814 - RNA, 22 nt, Human
uuuucagaauaugggaugggcu

SEQ ID NO: 479815 - RNA, 23 nt, Human
aaaaccuccuccacacauccagg

SEQ ID NO: 479816 - RNA, 19 nt, Human
aaccucagggucucauccc

SEQ ID NO: 479817 - RNA, 19 nt, Human
aaccugaggcacagagaau

SEQ ID NO: 479818 - RNA, 24 nt, Human
acagccaggcuaaugaaaggcaaa

SEQ ID NO: 479819 - RNA, 23 nt, Human
agaauucuccaaagcucccaaaa

SEQ ID NO: 479820 - RNA, 19 nt, Human
agaggaaaagaaauggcag

SEQ ID NO: 479821 - RNA, 22 nt, Human
agaggagaucaaaaccuccucc

SEQ ID NO: 479822 - RNA, 19 nt, Human
agaggucauuuccaucagc

SEQ ID NO: 479823 - RNA, 20 nt, Human
agaucggagauuccugcuaa

SEQ ID NO: 479824 - RNA, 20 nt, Human
agccaggcuaaugaaaggca

SEQ ID NO: 479825 - RNA, 21 nt, Human
aggagcaugggcauuagucca

SEQ ID NO: 479826 - RNA, 20 nt, Human
aucaccuaccuacgcguggc

SEQ ID NO: 479827 - RNA, 19 nt, Human
auccagaauucuccaaagc

SEQ ID NO: 479828 - RNA, 25 nt, Human
augaaaggcaaaccucagggucuca

SEQ ID NO: 479829 - RNA, 27 nt, Human
auggagcagcgucuccaccggccucug

SEQ ID NO: 479830 - RNA, 24 nt, Human
auuauugucuccaagaguuagggg

SEQ ID NO: 479831 - RNA, 25 nt, Human
auuuggaaaguaaggcuguccugcu

SEQ ID NO: 479832 - RNA, 22 nt, Human
caaagcucccaaaaucucagac

SEQ ID NO: 479833 - RNA, 19 nt, Human
cacccuugucccaggaagg

SEQ ID NO: 479834 - RNA, 21 nt, Human
cagaauucuccaaagcuccca

SEQ ID NO: 479835 - RNA, 22 nt, Human
cagaauucuccaaagcucccaa

SEQ ID NO: 479836 - RNA, 19 nt, Human
cagccaggcuaaugaaagg

SEQ ID NO: 479837 - RNA, 23 nt, Human
caggcuaaugaaaggcaaaccuc

SEQ ID NO: 479838 - RNA, 25 nt, Human
caguagguuucuggagguucuugga

SEQ ID NO: 479839 - RNA, 19 nt, Human
cagugggagacuuuccaga

SEQ ID NO: 479840 - RNA, 21 nt, Human
cauaaaagaaaccugaggcac

SEQ ID NO: 479841 - RNA, 23 nt, Human
ccaagaccacaaauggccuuccc

SEQ ID NO: 479842 - RNA, 24 nt, Human
ccagaauucuccaaagcucccaaa

SEQ ID NO: 479843 - RNA, 21 nt, Human
ccaggcagagaccagucugca

SEQ ID NO: 479844 - RNA, 25 nt, Human
ccaggcuaaugaaaggcaaaccuca

SEQ ID NO: 479845 - RNA, 26 nt, Human
ccaguagguuucuggagguucuugga

SEQ ID NO: 479846 - RNA, 22 nt, Human
ccauccuagcaucucuggucac

SEQ ID NO: 479847 - RNA, 23 nt, Human
cccaggcagagaccagucugcac

SEQ ID NO: 479848 - RNA, 23 nt, Human
cccccugccuccauccacaggcc

SEQ ID NO: 479849 - RNA, 23 nt, Human
ccucauguugccauccuagcauc

SEQ ID NO: 479850 - RNA, 25 nt, Human
ccuccuucuaugggccuggaggcag

SEQ ID NO: 479851 - RNA, 24 nt, Human
ccucugagagaaccaagaaagugu

SEQ ID NO: 479852 - RNA, 26 nt, Human
ccuucuaugggccuggaggcaggagc

SEQ ID NO: 479853 - RNA, 18 nt, Human
cuaggagauaaaacuguu

SEQ ID NO: 479854 - RNA, 24 nt, Human
cucagugggagacuuuccagaccc

SEQ ID NO: 479855 - RNA, 18 nt, Human
cugcccugggaaaugauc

SEQ ID NO: 479856 - RNA, 19 nt, Human
cugccuccauccacaggcc

SEQ ID NO: 479857 - RNA, 24 nt, Human
cuuucuaagugcccgguccugccc

SEQ ID NO: 479858 - RNA, 20 nt, Human
gaaaguaaggcuguccugcu

SEQ ID NO: 479859 - RNA, 26 nt, Human
gaccaagaagaggagaucaaaaccuc

SEQ ID NO: 479860 - RNA, 25 nt, Human
gagaucaaaaccuccuccacacauc

SEQ ID NO: 479861 - RNA, 20 nt, Human
gagcaguucugaccaagaag

SEQ ID NO: 479862 - RNA, 20 nt, Human
gaggaggaggcaucccugaa

SEQ ID NO: 479863 - RNA, 22 nt, Human
gcagcaaauaucgauccugcag

SEQ ID NO: 479864 - RNA, 21 nt, Human
ggcuaaugaaaggcaaaccuc

SEQ ID NO: 479865 - RNA, 24 nt, Human
gggagggaacuuguccaagaccac

SEQ ID NO: 479866 - RNA, 23 nt, Human
gguacuaaggagcucaggagaga

SEQ ID NO: 479867 - RNA, 18 nt, Human
uaaaagaaaccugaggca

SEQ ID NO: 479868 - RNA, 18 nt, Human
uaaaagagauuaguggua

SEQ ID NO: 479869 - RNA, 24 nt, Human
uaacuccugaguucccacccuugu

SEQ ID NO: 479870 - RNA, 23 nt, Human
uaauacagauugcuucuacauuu

SEQ ID NO: 479871 - RNA, 18 nt, Human
uagaaugugugugcagag

SEQ ID NO: 479872 - RNA, 18 nt, Human
uagguauucaccauaacc

SEQ ID NO: 479873 - RNA, 19 nt, Human
ucacuucuagggggaggag

SEQ ID NO: 479874 - RNA, 19 nt, Human
ucagcccccugccuccauc

SEQ ID NO: 479875 - RNA, 20 nt, Human
uccaaagcucccaaaaucuc

SEQ ID NO: 479876 - RNA, 27 nt, Human
uccaagaccacaaauggccuucccagg

SEQ ID NO: 479877 - RNA, 21 nt, Human
uccacagaucggagauuccug

SEQ ID NO: 479878 - RNA, 22 nt, Human
uccagaauucuccaaagcuccc

SEQ ID NO: 479879 - RNA, 23 nt, Human
uccaguaagggauuuuauccaga

SEQ ID NO: 479880 - RNA, 23 nt, Human
ucccaggaaggcugggcacaauu

SEQ ID NO: 479881 - RNA, 21 nt, Human
ucccagggugggguggcggug

SEQ ID NO: 479882 - RNA, 23 nt, Human
ucccagggugggguggcgguggu

SEQ ID NO: 479883 - RNA, 21 nt, Human
ucccugaauugcaugucacgu

SEQ ID NO: 479884 - RNA, 23 nt, Human
ucggagauuccugcuaaguccag

SEQ ID NO: 479885 - RNA, 18 nt, Human
ucuagggggaggaggagg

SEQ ID NO: 479886 - RNA, 18 nt, Human
ucucugaggagacuucuc

SEQ ID NO: 479887 - RNA, 25 nt, Human
ucucuggucaccucuguuugcugcu

SEQ ID NO: 479888 - RNA, 18 nt, Human
ucugcaaacucgcuagac

SEQ ID NO: 479889 - RNA, 20 nt, Human
ugaaaggcaaaccucagggu

SEQ ID NO: 479890 - RNA, 19 nt, Human
ugagagaaccaagaaagug

SEQ ID NO: 479891 - RNA, 19 nt, Human
ugagagaaccaagaaagug

SEQ ID NO: 479892 - RNA, 20 nt, Human
ugagcccaggcagagaccag

SEQ ID NO: 479893 - RNA, 22 nt, Human
ugagccuggacucacagacuag

SEQ ID NO: 479894 - RNA, 21 nt, Human
ugaggccuggaacagcuuccu

SEQ ID NO: 479895 - RNA, 19 nt, Human
ugccagaaaucacagaggu

SEQ ID NO: 479896 - RNA, 21 nt, Human
ugccuccuccuucuaugggcc

SEQ ID NO: 479897 - RNA, 25 nt, Human
uggagcagcgucuccaccggccucu

SEQ ID NO: 479898 - RNA, 24 nt, Human
uggcagcaaauaucgauccugcag

SEQ ID NO: 479899 - RNA, 22 nt, Human
uggguguacaaccaacauuaau

SEQ ID NO: 479900 - RNA, 19 nt, Human
ugguaagcucauccaguag

SEQ ID NO: 479901 - RNA, 27 nt, Human
uguccaagaccacaaauuaccauaggg

SEQ ID NO: 479902 - RNA, 23 nt, Human
uguccugcuacuuucagggggua

SEQ ID NO: 479903 - RNA, 19 nt, Human
ugugcagaggaaaagaaau

SEQ ID NO: 479904 - RNA, 21 nt, Human
uguuauaauuuucauaaaaga

SEQ ID NO: 479905 - RNA, 22 nt, Human
uuaguccagggugagucugauc

SEQ ID NO: 479906 - RNA, 25 nt, Human
uugacguuucccccagucaguuccu

SEQ ID NO: 479907 - RNA, 21 nt, Human
uugagcccaggcagagaccag

SEQ ID NO: 479908 - RNA, 21 nt, Human
uugcuucuacauuuggcuauu

SEQ ID NO: 479909 - RNA, 21 nt, Human
uuuccagaccccucauguugc

SEQ ID NO: 479910 - RNA, 19 nt, Human
aaaaaugcugagcaagugu

SEQ ID NO: 479911 - RNA, 19 nt, Human
aaaagauaacagguuugga

SEQ ID NO: 479912 - RNA, 20 nt, Human
aacuugguucuaucagcacu

SEQ ID NO: 479913 - RNA, 20 nt, Human
aagacagggauuggccaagg

SEQ ID NO: 479914 - RNA, 21 nt, Human
aaggcagcuggagaaacagcu

SEQ ID NO: 479915 - RNA, 18 nt, Human
aauaagggaaaaaauuga

SEQ ID NO: 479916 - RNA, 20 nt, Human
aaucagagucaucuuuuccg

SEQ ID NO: 479917 - RNA, 21 nt, Human
aauuguauuauugcucuuagg

SEQ ID NO: 479918 - RNA, 18 nt, Human
acagugcuuuuuuuuuuu

SEQ ID NO: 479919 - RNA, 23 nt, Human
acaucaacaccucugcggccucu

SEQ ID NO: 479920 - RNA, 18 nt, Human
accagcuuaugccguggu

SEQ ID NO: 479921 - RNA, 19 nt, Human
accccgcccucagccgcac

SEQ ID NO: 479922 - RNA, 23 nt, Human
accucagucuccuccucugugag

SEQ ID NO: 479923 - RNA, 21 nt, Human
acuguaaaauccuugacacca

SEQ ID NO: 479924 - RNA, 23 nt, Human
agaaaccaagacagggauuggcc

SEQ ID NO: 479925 - RNA, 19 nt, Human
agaauccagguacgauuca

SEQ ID NO: 479926 - RNA, 27 nt, Human
agagcagaaaccaagacagcagggacu

SEQ ID NO: 479927 - RNA, 22 nt, Human
agauaugauggucagagccuca

SEQ ID NO: 479928 - RNA, 20 nt, Human
aggcaagaccgggccacgcg

SEQ ID NO: 479929 - RNA, 20 nt, Human
aggcagcuggagaaacagcu

SEQ ID NO: 479930 - RNA, 22 nt, Human
aggcugcagugcagagguacca

SEQ ID NO: 479931 - RNA, 23 nt, Human
aggcugcagugcagagguaccau

SEQ ID NO: 479932 - RNA, 18 nt, Human
agguuggcuggggccuug

SEQ ID NO: 479933 - RNA, 23 nt, Human
agugaguggcaguugucuauggu

SEQ ID NO: 479934 - RNA, 24 nt, Human
agugcagagguaccaucucggcuc

SEQ ID NO: 479935 - RNA, 21 nt, Human
aucaugcaaaaaacaaacacu

SEQ ID NO: 479936 - RNA, 21 nt, Human
auucuguugcccaggcugcag

SEQ ID NO: 479937 - RNA, 24 nt, Human
caaagaaucaugcaaaaaacaaac

SEQ ID NO: 479938 - RNA, 22 nt, Human
caacgagagguuggcuggggcc

SEQ ID NO: 479939 - RNA, 19 nt, Human
caccacagacaggguucca

SEQ ID NO: 479940 - RNA, 20 nt, Human
cacccgccucugcucaggcg

SEQ ID NO: 479941 - RNA, 18 nt, Human
caccggagcagaggugca

SEQ ID NO: 479942 - RNA, 25 nt, Human
caccucugcggccucuucuaucucc

SEQ ID NO: 479943 - RNA, 22 nt, Human
cacugcaaccuccaccucuggg

SEQ ID NO: 479944 - RNA, 25 nt, Human
cacugcguauaauguaguuuccaac

SEQ ID NO: 479945 - RNA, 22 nt, Human
cagaggcucagguccaaagcuu

SEQ ID NO: 479946 - RNA, 27 nt, Human
caggcaauucucgugccucagccuccc

SEQ ID NO: 479947 - RNA, 19 nt, Human
cagguaggcacagaaucca

SEQ ID NO: 479948 - RNA, 21 nt, Human
cauccuucuuucuagggcugu

SEQ ID NO: 479949 - RNA, 20 nt, Human
caugucaacgagagguuggc

SEQ ID NO: 479950 - RNA, 24 nt, Human
cauucuguugcccaggcugcagug

SEQ ID NO: 479951 - RNA, 21 nt, Human
ccacacccgccucugcucagg

SEQ ID NO: 479952 - RNA, 19 nt, Human
ccacguagcugggacuaca

SEQ ID NO: 479953 - RNA, 20 nt, Human
cccacacccgccucugcuca

SEQ ID NO: 479954 - RNA, 21 nt, Human
ccuccucugugagauggggau

SEQ ID NO: 479955 - RNA, 19 nt, Human
ccugcaugacagugcuuuu

SEQ ID NO: 479956 - RNA, 23 nt, Human
ccugugguuuccguggccugugu

SEQ ID NO: 479957 - RNA, 24 nt, Human
ccuucgugacauuauuguugcugc

SEQ ID NO: 479958 - RNA, 18 nt, Human
cgagaagagagauguugc

SEQ ID NO: 479959 - RNA, 24 nt, Human
cguagcugggacuacaggcaugug

SEQ ID NO: 479960 - RNA, 23 nt, Human
cucacugcaaccuccaccucugg

SEQ ID NO: 479961 - RNA, 24 nt, Human
cucagccucccacguagcugggac

SEQ ID NO: 479962 - RNA, 23 nt, Human
cucccacguagcugggacuacag

SEQ ID NO: 479963 - RNA, 22 nt, Human
cuccuaugguugcggugaggau

SEQ ID NO: 479964 - RNA, 25 nt, Human
cucgugccucagccucccacguagc

SEQ ID NO: 479965 - RNA, 24 nt, Human
cugcaaccuccaccucugggguuc

SEQ ID NO: 479966 - RNA, 18 nt, Human
gacgcuggcccugugguu

SEQ ID NO: 479967 - RNA, 21 nt, Human
gagcagaaaccaagacaggga

SEQ ID NO: 479968 - RNA, 25 nt, Human
gcaccaaagcccugccuuugggcca

SEQ ID NO: 479969 - RNA, 24 nt, Human
gcagagaaaggagcacuuuccaga

SEQ ID NO: 479970 - RNA, 20 nt, Human
gcucugugggcugccugcgg

SEQ ID NO: 479971 - RNA, 21 nt, Human
gcuggggccuugggacccugc

SEQ ID NO: 479972 - RNA, 19 nt, Human
ggacuacaggcaugugcca

SEQ ID NO: 479973 - RNA, 20 nt, Human
ggagagaugauaucucccuu

SEQ ID NO: 479974 - RNA, 20 nt, Human
ggcaaaagcguggagaagcg

SEQ ID NO: 479975 - RNA, 24 nt, Human
ggcaauucucgugccucagccucc

SEQ ID NO: 479976 - RNA, 19 nt, Human
ggcccagaggcucaggucc

SEQ ID NO: 479977 - RNA, 18 nt, Human
gggaugucaggauccagc

SEQ ID NO: 479978 - RNA, 18 nt, Human
gguaccaucucggcucac

SEQ ID NO: 479979 - RNA, 24 nt, Human
ggugcaggggcgucccgggaagaa

SEQ ID NO: 479980 - RNA, 18 nt, Human
guagcugggacuacaggc

SEQ ID NO: 479981 - RNA, 22 nt, Human
guagcugggacuacaggcaugu

SEQ ID NO: 479982 - RNA, 19 nt, Human
gugcgugccagccucugug

SEQ ID NO: 479983 - RNA, 21 nt, Human
guggaguuuucugcuuuagau

SEQ ID NO: 479984 - RNA, 20 nt, Human
guggccugugucugcccaaa

SEQ ID NO: 479985 - RNA, 22 nt, Human
guggcucugugggcugccugcg

SEQ ID NO: 479986 - RNA, 20 nt, Human
gugggcaccugccuuaaggu

SEQ ID NO: 479987 - RNA, 20 nt, Human
gugggcugccugcggggccu

SEQ ID NO: 479988 - RNA, 21 nt, Human
guggugcgggacucccucggc

SEQ ID NO: 479989 - RNA, 21 nt, Human
uaauuuaccggagcucacacg

SEQ ID NO: 479990 - RNA, 26 nt, Human
uaauuuuuuuuguaaauuaguagaga

SEQ ID NO: 479991 - RNA, 22 nt, Human
uauuugccacgucauuaaccuc

SEQ ID NO: 479992 - RNA, 19 nt, Human
ucacugcaaccuccaccuc

SEQ ID NO: 479993 - RNA, 22 nt, Human
ucacugcaaccuccaccucugg

SEQ ID NO: 479994 - RNA, 23 nt, Human
ucacugcaaccuccaccucuggg

SEQ ID NO: 479995 - RNA, 24 nt, Human
ucacugcaaccuccaccucugggg

SEQ ID NO: 479996 - RNA, 18 nt, Human
ucagggaggcaagaccgg

SEQ ID NO: 479997 - RNA, 22 nt, Human
ucaugcaaaaaacaaacacuga

SEQ ID NO: 479998 - RNA, 24 nt, Human
uccaaagcuuuaugugaccucugg

SEQ ID NO: 479999 - RNA, 20 nt, Human
uccaccucugggguucaggc

SEQ ID NO: 480000 - RNA, 22 nt, Human
uccagaccgcggggcccagagg

SEQ ID NO: 480001 - RNA, 21 nt, Human
uccagugggcaccugccuuaa

SEQ ID NO: 480002 - RNA, 22 nt, Human
uccagugggcaccugccuuaag

SEQ ID NO: 480003 - RNA, 24 nt, Human
uccauagcgguccagaaccggggc

SEQ ID NO: 480004 - RNA, 21 nt, Human
uccauggguagacagcggagg

SEQ ID NO: 480005 - RNA, 23 nt, Human
uccauggguagacagcggagggg

SEQ ID NO: 480006 - RNA, 24 nt, Human
ucccacguagcugggacuacaggc

SEQ ID NO: 480007 - RNA, 18 nt, Human
ucccuuggcaacuugguu

SEQ ID NO: 480008 - RNA, 23 nt, Human
uccgggugaaaugggcuuaauuu

SEQ ID NO: 480009 - RNA, 21 nt, Human
ucuagggcugugguugugggu

SEQ ID NO: 480010 - RNA, 19 nt, Human
ucucauucuguugcccagg

SEQ ID NO: 480011 - RNA, 21 nt, Human
ucucauucuguugcccaggcu

SEQ ID NO: 480012 - RNA, 22 nt, Human
ucucauucuguugcccaggcug

SEQ ID NO: 480013 - RNA, 23 nt, Human
ucucauucuguugcccaggcugc

SEQ ID NO: 480014 - RNA, 24 nt, Human
ucucauucuguugcccaggcugca

SEQ ID NO: 480015 - RNA, 18 nt, Human
ucugcagacuggaccagc

SEQ ID NO: 480016 - RNA, 24 nt, Human
ucuguugcccaggcugcagugcag

SEQ ID NO: 480017 - RNA, 25 nt, Human
ucuguugcccaggcugcagugcaga

SEQ ID NO: 480018 - RNA, 21 nt, Human
ucuguuuuguucaaggcugug

SEQ ID NO: 480019 - RNA, 24 nt, Human
ucuuaggugcucuuguaaugcugg

SEQ ID NO: 480020 - RNA, 22 nt, Human
ucuugcucuguuuuguucaagg

SEQ ID NO: 480021 - RNA, 20 nt, Human
ugacuauaagcaugaguuga

SEQ ID NO: 480022 - RNA, 21 nt, Human
ugaggagaugcuucuggaagu

SEQ ID NO: 480023 - RNA, 20 nt, Human
ugcagagaaaggagcacuuc

SEQ ID NO: 480024 - RNA, 22 nt, Human
ugcagagaaaggagcacuuucc

SEQ ID NO: 480025 - RNA, 23 nt, Human
ugccgugguaacagacuauuccu

SEQ ID NO: 480026 - RNA, 24 nt, Human
ugccgugguaacagacuauuccua

SEQ ID NO: 480027 - RNA, 22 nt, Human
ugccucagccucccacguagcu

SEQ ID NO: 480028 - RNA, 24 nt, Human
ugccucagccucccacguagcugg

SEQ ID NO: 480029 - RNA, 19 nt, Human
ugcggggccugccuggcug

SEQ ID NO: 480030 - RNA, 20 nt, Human
uggagaaacagcuuggucac

SEQ ID NO: 480031 - RNA, 19 nt, Human
uggagaagcggccgcggug

SEQ ID NO: 480032 - RNA, 22 nt, Human
uggccaagggcagggaugacaa

SEQ ID NO: 480033 - RNA, 22 nt, Human
uggcccugugguuuccguggcc

SEQ ID NO: 480034 - RNA, 26 nt, Human
uggcucugugggcugccugcggggcc

SEQ ID NO: 480035 - RNA, 18 nt, Human
ugggacuacaggcaugug

SEQ ID NO: 480036 - RNA, 21 nt, Human
ugggacuacaggcaugugcca

SEQ ID NO: 480037 - RNA, 24 nt, Human
ugggacuacaggcaugugccaaca

SEQ ID NO: 480038 - RNA, 25 nt, Human
ugggcugccugcggggccugccugg

SEQ ID NO: 480039 - RNA, 18 nt, Human
ugguugugggugauugca

SEQ ID NO: 480040 - RNA, 23 nt, Human
ugucagugacuauaagcaugagu

SEQ ID NO: 480041 - RNA, 24 nt, Human
uuauucuuuauuuucaacacagaa

SEQ ID NO: 480042 - RNA, 23 nt, Human
uucucugugaauaagggaaaaaa

SEQ ID NO: 480043 - RNA, 18 nt, Human
uucuuucuagggcugugg

SEQ ID NO: 480044 - RNA, 23 nt, Human
uucuuucuagggcugugguugug

SEQ ID NO: 480045 - RNA, 18 nt, Human
uugaagcauaaaucaucc

SEQ ID NO: 480046 - RNA, 25 nt, Human
uugacaccacagacaggguuccagu

SEQ ID NO: 480047 - RNA, 18 nt, Human
uugcagccaguguggucc

SEQ ID NO: 480048 - RNA, 18 nt, Human
uugcccaggcugcagugc

SEQ ID NO: 480049 - RNA, 20 nt, Human
uuggcuggggccuugggacc

SEQ ID NO: 480050 - RNA, 20 nt, Human
uuuuuguaaauuaguagaga

SEQ ID NO: 480051 - RNA, 20 nt, Human
uuuuuuguaaauuaguagag

SEQ ID NO: 480052 - RNA, 24 nt, Human
uuuuuuuguaaauuaguagagacg

SEQ ID NO: 480053 - RNA, 27 nt, Human
uuuuuuuuuuuugaagacacagucuca

SEQ ID NO: 480054 - RNA, 22 nt, Human
aaaaaaacaaaucacagcauag

SEQ ID NO: 480055 - RNA, 19 nt, Human
aaaaacaguggcuagaaac

SEQ ID NO: 480056 - RNA, 18 nt, Human
aaaacccuacaaaaacug

SEQ ID NO: 480057 - RNA, 22 nt, Human
aaaagaaaacccuuugaaugga

SEQ ID NO: 480058 - RNA, 19 nt, Human
aaaauucuuucaguaaccc

SEQ ID NO: 480059 - RNA, 22 nt, Human
aaacaguggcuagaaacaaagc

SEQ ID NO: 480060 - RNA, 22 nt, Human
aaagaaggcagggauugcugcc

SEQ ID NO: 480061 - RNA, 24 nt, Human
aaagugcugggauuacagguguga

SEQ ID NO: 480062 - RNA, 23 nt, Human
aaauaaaaacaaaguuacacaga

SEQ ID NO: 480063 - RNA, 20 nt, Human
aaccaccacucugagcccua

SEQ ID NO: 480064 - RNA, 20 nt, Human
aaccaccacucugagcccua

SEQ ID NO: 480065 - RNA, 24 nt, Human
aaccccccaucaucaguccccacc

SEQ ID NO: 480066 - RNA, 18 nt, Human
aacccuacaaaaacugaa

SEQ ID NO: 480067 - RNA, 24 nt, Human
aaccucaggugauccgccugccuu

SEQ ID NO: 480068 - RNA, 20 nt, Human
aaccucugccucccgaguuc

SEQ ID NO: 480069 - RNA, 20 nt, Human
aacuucugagcaagcuggcc

SEQ ID NO: 480070 - RNA, 19 nt, Human
aagauacauagaaccauag

SEQ ID NO: 480071 - RNA, 21 nt, Human
aagccacaggcauuaagacca

SEQ ID NO: 480072 - RNA, 24 nt, Human
aagccagagguggucauggagggc

SEQ ID NO: 480073 - RNA, 22 nt, Human
aaggaaacaagaaaaaaaaaac

SEQ ID NO: 480074 - RNA, 22 nt, Human
aagggaaaucaaaugaguugga

SEQ ID NO: 480075 - RNA, 22 nt, Human
aagggaaaucaaaugaguugga

SEQ ID NO: 480076 - RNA, 22 nt, Human
aaguagcugggauuacaggugc

SEQ ID NO: 480077 - RNA, 25 nt, Human
aaguagcugggauuacaggugccug

SEQ ID NO: 480078 - RNA, 22 nt, Human
aaguaugaccaucuuacuuuca

SEQ ID NO: 480079 - RNA, 27 nt, Human
aagucauauaaacugcuuaccugaaau

SEQ ID NO: 480080 - RNA, 27 nt, Human
aagucauauaaacugcuuaccugaaau

SEQ ID NO: 480081 - RNA, 18 nt, Human
aagugcugggauuacagg

SEQ ID NO: 480082 - RNA, 19 nt, Human
aagugcugggauuacaggu

SEQ ID NO: 480083 - RNA, 23 nt, Human
acaacaaaaaagcaguggcugga

SEQ ID NO: 480084 - RNA, 19 nt, Human
acccacagacaucuccuac

SEQ ID NO: 480085 - RNA, 19 nt, Human
acccacagacaucuccuac

SEQ ID NO: 480086 - RNA, 23 nt, Human
accccccaucaucaguccccacc

SEQ ID NO: 480087 - RNA, 22 nt, Human
accugaaauaaaaccccccauc

SEQ ID NO: 480088 - RNA, 22 nt, Human
accugaaauaaaaccccccauc

SEQ ID NO: 480089 - RNA, 19 nt, Human
acgagcaagaaaaccguca

SEQ ID NO: 480090 - RNA, 21 nt, Human
acuugggguggggcagcugca

SEQ ID NO: 480091 - RNA, 18 nt, Human
agaaaaccgucacacccc

SEQ ID NO: 480092 - RNA, 18 nt, Human
agaacacuggacugcauu

SEQ ID NO: 480093 - RNA, 18 nt, Human
agaacacuggacugcauu

SEQ ID NO: 480094 - RNA, 25 nt, Human
agaagaaaaaaaaaaaacaaaucac

SEQ ID NO: 480095 - RNA, 22 nt, Human
agacacaguagccacuagccaa

SEQ ID NO: 480096 - RNA, 23 nt, Human
agagaugggguuucgcauguugg

SEQ ID NO: 480097 - RNA, 19 nt, Human
agaucccuccacaucuauu

SEQ ID NO: 480098 - RNA, 24 nt, Human
agccauuacuucacugucuacaaa

SEQ ID NO: 480099 - RNA, 24 nt, Human
agcccuagggcaaggagcaaagug

SEQ ID NO: 480100 - RNA, 24 nt, Human
agcccuagggcaaggagcaaagug

SEQ ID NO: 480101 - RNA, 22 nt, Human
aggaaacaagaaaaaaaaaaca

SEQ ID NO: 480102 - RNA, 24 nt, Human
aggugauccgccugccuuggccuc

SEQ ID NO: 480103 - RNA, 19 nt, Human
augggguuucgcauguugg

SEQ ID NO: 480104 - RNA, 24 nt, Human
augggguuucgcauguuggccagg

SEQ ID NO: 480105 - RNA, 21 nt, Human
auucuccugccucagccuccc

SEQ ID NO: 480106 - RNA, 22 nt, Human
caaaaaagcaguggcuggaacc

SEQ ID NO: 480107 - RNA, 24 nt, Human
caaagugcugggauuacaggugug

SEQ ID NO: 480108 - RNA, 19 nt, Human
caagaaagcacaccucuaa

SEQ ID NO: 480109 - RNA, 22 nt, Human
caagcaauucuccugccucagc

SEQ ID NO: 480110 - RNA, 27 nt, Human
caagcaauucuccugccucagccuccc

SEQ ID NO: 480111 - RNA, 22 nt, Human
cacaacccaugggcuauacagg

SEQ ID NO: 480112 - RNA, 19 nt, Human
cacacacaugcagacaaga

SEQ ID NO: 480113 - RNA, 19 nt, Human
cacacacaugcagacaaga

SEQ ID NO: 480114 - RNA, 21 nt, Human
cacacagcugucucuggagac

SEQ ID NO: 480115 - RNA, 24 nt, Human
cacagacacaguagccacuagcca

SEQ ID NO: 480116 - RNA, 20 nt, Human
cacccccuaccccucaaucu

SEQ ID NO: 480117 - RNA, 23 nt, Human
cacgagcaagaaaaccgucacac

SEQ ID NO: 480118 - RNA, 18 nt, Human
cacugcaaccucugccuc

SEQ ID NO: 480119 - RNA, 21 nt, Human
cacugcaaccucugccucccg

SEQ ID NO: 480120 - RNA, 19 nt, Human
caggacaucucuugacuga

SEQ ID NO: 480121 - RNA, 18 nt, Human
caggauauaagaaaaacc

SEQ ID NO: 480122 - RNA, 23 nt, Human
cagugagccuuuauccaggcugu

SEQ ID NO: 480123 - RNA, 19 nt, Human
cauccugaaucucccaagg

SEQ ID NO: 480124 - RNA, 21 nt, Human
cauguuggccaggguggucuc

SEQ ID NO: 480125 - RNA, 21 nt, Human
ccaaagugcugggauuacagg

SEQ ID NO: 480126 - RNA, 21 nt, Human
ccaaagugcugggauuacagg

SEQ ID NO: 480127 - RNA, 24 nt, Human
ccaaagugcugggauuacaggugu

SEQ ID NO: 480128 - RNA, 21 nt, Human
ccaaguagcugggauuacagg

SEQ ID NO: 480129 - RNA, 23 nt, Human
cccaaguagcugggauuacaggu

SEQ ID NO: 480130 - RNA, 24 nt, Human
cccaaguagcugggauuacaggug

SEQ ID NO: 480131 - RNA, 22 nt, Human
ccccaucaucaguccccacccu

SEQ ID NO: 480132 - RNA, 22 nt, Human
ccccaucaucaguccccacccu

SEQ ID NO: 480133 - RNA, 23 nt, Human
cccgaguucaagcaauucuccug

SEQ ID NO: 480134 - RNA, 23 nt, Human
cccggccaagggaaaugaccacc

SEQ ID NO: 480135 - RNA, 23 nt, Human
ccgagcccacgagcaagaaaacc

SEQ ID NO: 480136 - RNA, 18 nt, Human
ccuaaccucaggugaucc

SEQ ID NO: 480137 - RNA, 21 nt, Human
ccuaaccucaggugauccgcc

SEQ ID NO: 480138 - RNA, 23 nt, Human
ccuaaccucaggugauccgccug

SEQ ID NO: 480139 - RNA, 18 nt, Human
ccuaccccucaaucucag

SEQ ID NO: 480140 - RNA, 24 nt, Human
ccucccgaguucaagcaauucucc

SEQ ID NO: 480141 - RNA, 23 nt, Human
ccugccucagccucccaaguagc

SEQ ID NO: 480142 - RNA, 22 nt, Human
ccugccuuggccucccaaagug

SEQ ID NO: 480143 - RNA, 24 nt, Human
ccuugcucuauugcccaagcuaga

SEQ ID NO: 480144 - RNA, 22 nt, Human
ccuuggaaaacccuacaaaaac

SEQ ID NO: 480145 - RNA, 23 nt, Human
cgcauguuggccaggguggucuc

SEQ ID NO: 480146 - RNA, 18 nt, Human
cucaaaauguucugaccu

SEQ ID NO: 480147 - RNA, 21 nt, Human
cucaaaauguucugaccuagu

SEQ ID NO: 480148 - RNA, 23 nt, Human
cucacugcaaccucugccucccg

SEQ ID NO: 480149 - RNA, 24 nt, Human
cucacugcaaccucugccucccga

SEQ ID NO: 480150 - RNA, 24 nt, Human
cucagccucccaaguagcugggau

SEQ ID NO: 480151 - RNA, 18 nt, Human
cucccagcacaagccaca

SEQ ID NO: 480152 - RNA, 26 nt, Human
cuccuaaccucaggugauccgccugc

SEQ ID NO: 480153 - RNA, 21 nt, Human
cuccuccacacauggugucag

SEQ ID NO: 480154 - RNA, 20 nt, Human
cucuauugcccaagcuagag

SEQ ID NO: 480155 - RNA, 20 nt, Human
cucugcagcuguuucuucac

SEQ ID NO: 480156 - RNA, 20 nt, Human
cucugcagcuguuucuucac

SEQ ID NO: 480157 - RNA, 22 nt, Human
cugauuugcuccacacagcugu

SEQ ID NO: 480158 - RNA, 23 nt, Human
cugcaaccucugccucccgaguu

SEQ ID NO: 480159 - RNA, 24 nt, Human
cugcaaccucugccucccgaguuc

SEQ ID NO: 480160 - RNA, 23 nt, Human
cugcagcaggacuugacucuacu

SEQ ID NO: 480161 - RNA, 23 nt, Human
cugccucagccucccaaguagcu

SEQ ID NO: 480162 - RNA, 23 nt, Human
cugccuuggccucccaaagugcu

SEQ ID NO: 480163 - RNA, 20 nt, Human
cuucacagcucuacuggcaa

SEQ ID NO: 480164 - RNA, 24 nt, Human
cuuggaaaacccuacaaaaacugg

SEQ ID NO: 480165 - RNA, 24 nt, Human
gaagauggguauaggaguuggcgg

SEQ ID NO: 480166 - RNA, 19 nt, Human
gaaugccaggaaggucaaa

SEQ ID NO: 480167 - RNA, 19 nt, Human
gaaugccaggaaggucaaa

SEQ ID NO: 480168 - RNA, 24 nt, Human
gaccuaguaaugaaaaagaaaacc

SEQ ID NO: 480169 - RNA, 21 nt, Human
gagaagaaaaaaaaaaaacaa

SEQ ID NO: 480170 - RNA, 19 nt, Human
gagaugggguuucgcaugu

SEQ ID NO: 480171 - RNA, 23 nt, Human
gagaugggguuucgcauguuggc

SEQ ID NO: 480172 - RNA, 21 nt, Human
gauagaaacuugggguggggc

SEQ ID NO: 480173 - RNA, 24 nt, Human
gauuacaggugccugacaccaugc

SEQ ID NO: 480174 - RNA, 18 nt, Human
gauuacaggugugagcca

SEQ ID NO: 480175 - RNA, 22 nt, Human
gauuacaggugugagccaccgc

SEQ ID NO: 480176 - RNA, 22 nt, Human
gauuacaggugugagccaccgc

SEQ ID NO: 480177 - RNA, 24 nt, Human
gcaaggagcaaaguguauacaaaa

SEQ ID NO: 480178 - RNA, 24 nt, Human
gcaaggagcaaaguguauacaaaa

SEQ ID NO: 480179 - RNA, 18 nt, Human
gcacaagccacaggcauu

SEQ ID NO: 480180 - RNA, 22 nt, Human
gccuuggccucccaaagugcug

SEQ ID NO: 480181 - RNA, 21 nt, Human
gcucacugcaaccucugccuc

SEQ ID NO: 480182 - RNA, 27 nt, Human
gcucuauugcccaagcuagagugggau

SEQ ID NO: 480183 - RNA, 21 nt, Human
ggaaaacccuacaaaaacuga

SEQ ID NO: 480184 - RNA, 19 nt, Human
ggaagacagucagagaagg

SEQ ID NO: 480185 - RNA, 22 nt, Human
ggacacccccuaccccucaauc

SEQ ID NO: 480186 - RNA, 18 nt, Human
ggaggcagaggugagaac

SEQ ID NO: 480187 - RNA, 22 nt, Human
ggauuuaaguucauuucuucac

SEQ ID NO: 480188 - RNA, 18 nt, Human
ggcccaaaaagaaggcag

SEQ ID NO: 480189 - RNA, 18 nt, Human
gggggggggggugggggg

SEQ ID NO: 480190 - RNA, 21 nt, Human
gggguuucgcauguuggccag

SEQ ID NO: 480191 - RNA, 24 nt, Human
ggucaaauguucucugcagcuguu

SEQ ID NO: 480192 - RNA, 24 nt, Human
ggucaaauguucucugcagcuguu

SEQ ID NO: 480193 - RNA, 19 nt, Human
gguggggggugggggucag

SEQ ID NO: 480194 - RNA, 23 nt, Human
gguggucucgaacuccuaaccuc

SEQ ID NO: 480195 - RNA, 22 nt, Human
guagagaugggguuucgcaugu

SEQ ID NO: 480196 - RNA, 18 nt, Human
guagcugggauuacaggu

SEQ ID NO: 480197 - RNA, 20 nt, Human
gucagcucauaacagggcca

SEQ ID NO: 480198 - RNA, 22 nt, Human
guggugaucaagcucugacucu

SEQ ID NO: 480199 - RNA, 22 nt, Human
guggugaucaagcucugacucu

SEQ ID NO: 480200 - RNA, 24 nt, Human
guucucugcagcuguuucuucaca

SEQ ID NO: 480201 - RNA, 24 nt, Human
guucucugcagcuguuucuucaca

SEQ ID NO: 480202 - RNA, 18 nt, Human
guuggccaggguggucuc

SEQ ID NO: 480203 - RNA, 26 nt, Human
uaaaacagcuccuuuuccugaaucaa

SEQ ID NO: 480204 - RNA, 24 nt, Human
uaaaaccccccaucaucagucccc

SEQ ID NO: 480205 - RNA, 24 nt, Human
uaaaaccccccaucaucagucccc

SEQ ID NO: 480206 - RNA, 26 nt, Human
uaaaauaacucacacacaugcagaca

SEQ ID NO: 480207 - RNA, 26 nt, Human
uaaaauaacucacacacaugcagaca

SEQ ID NO: 480208 - RNA, 22 nt, Human
uaacaaggaucccacuccagca

SEQ ID NO: 480209 - RNA, 18 nt, Human
uaaccucaggugauccgc

SEQ ID NO: 480210 - RNA, 22 nt, Human
uacacagacagguuaguugucc

SEQ ID NO: 480211 - RNA, 23 nt, Human
uacaggugugagccaccgcgccc

SEQ ID NO: 480212 - RNA, 26 nt, Human
uacagguuggacacccccuaccccuc

SEQ ID NO: 480213 - RNA, 24 nt, Human
uacauucacagacacaguagccac

SEQ ID NO: 480214 - RNA, 18 nt, Human
uagaggucaaaggucaag

SEQ ID NO: 480215 - RNA, 18 nt, Human
uagaggucaaaggucaag

SEQ ID NO: 480216 - RNA, 21 nt, Human
uagagugggauggcaugaucu

SEQ ID NO: 480217 - RNA, 24 nt, Human
uagagugggauggcaugaucuugg

SEQ ID NO: 480218 - RNA, 32 nt, Human
uaggaguuggcggggggggggguggggggucg

SEQ ID NO: 480219 - RNA, 19 nt, Human
uauucagagaagcugagcu

SEQ ID NO: 480220 - RNA, 24 nt, Human
ucaaguuaagaccugagcaaagug

SEQ ID NO: 480221 - RNA, 22 nt, Human
ucacagcauaggugaaaagaug

SEQ ID NO: 480222 - RNA, 22 nt, Human
ucacagcauaggugaaaagaug

SEQ ID NO: 480223 - RNA, 24 nt, Human
ucacucccaggcacauuuuguugc

SEQ ID NO: 480224 - RNA, 18 nt, Human
ucacugcaaccucugccu

SEQ ID NO: 480225 - RNA, 19 nt, Human
ucacugcaaccucugccuc

SEQ ID NO: 480226 - RNA, 22 nt, Human
ucacugcaaccucugccucccg

SEQ ID NO: 480227 - RNA, 24 nt, Human
ucacugcaaccucugccucccgag

SEQ ID NO: 480228 - RNA, 21 nt, Human
ucacugucuacaaaauugcag

SEQ ID NO: 480229 - RNA, 18 nt, Human
ucagccucccaaguagcu

SEQ ID NO: 480230 - RNA, 20 nt, Human
ucagccucccaaguagcugg

SEQ ID NO: 480231 - RNA, 20 nt, Human
ucagccugacuugcguugcc

SEQ ID NO: 480232 - RNA, 18 nt, Human
uccacacauggugucaga

SEQ ID NO: 480233 - RNA, 23 nt, Human
ucccaaagugcugggauuacagg

SEQ ID NO: 480234 - RNA, 23 nt, Human
ucccaaguagcugggauuacagg

SEQ ID NO: 480235 - RNA, 24 nt, Human
ucccagcacaagccacaggguacc

SEQ ID NO: 480236 - RNA, 21 nt, Human
ucccgaguucaagcaauucuc

SEQ ID NO: 480237 - RNA, 24 nt, Human
ucccgaguucaagcaauucuccug

SEQ ID NO: 480238 - RNA, 23 nt, Human
ucguagagaugggguuucgcaug

SEQ ID NO: 480239 - RNA, 24 nt, Human
ucucaggauauaagaaaaaccuuu

SEQ ID NO: 480240 - RNA, 26 nt, Human
ucuccugccucagccucccaaguagc

SEQ ID NO: 480241 - RNA, 21 nt, Human
ugaauugguguuuucugaggu

SEQ ID NO: 480242 - RNA, 25 nt, Human
ugacagcaucccuaauuaagccagc

SEQ ID NO: 480243 - RNA, 25 nt, Human
ugacagcaucccuaauuaagccagc

SEQ ID NO: 480244 - RNA, 19 nt, Human
ugaccuaguaaugaaaaag

SEQ ID NO: 480245 - RNA, 23 nt, Human
ugagaaacauucaaccaagguga

SEQ ID NO: 480246 - RNA, 21 nt, Human
ugaguuggagguaacacucua

SEQ ID NO: 480247 - RNA, 21 nt, Human
ugaguuggagguaacacucua

SEQ ID NO: 480248 - RNA, 18 nt, Human
ugauuugcuccacacagc

SEQ ID NO: 480249 - RNA, 21 nt, Human
ugcacacauaaccugucaggc

SEQ ID NO: 480250 - RNA, 22 nt, Human
ugcaggcgcuccguacucgucc

SEQ ID NO: 480251 - RNA, 22 nt, Human
ugccaggaaggucaaauguucu

SEQ ID NO: 480252 - RNA, 22 nt, Human
ugccaggaaggucaaauguucu

SEQ ID NO: 480253 - RNA, 24 nt, Human
ugcccaagcuagagugggauggca

SEQ ID NO: 480254 - RNA, 24 nt, Human
ugccucagccucccaaguagcugg

SEQ ID NO: 480255 - RNA, 24 nt, Human
ugcugggauuacaggugugagcca

SEQ ID NO: 480256 - RNA, 24 nt, Human
uggaagacagucagagaagguagu

SEQ ID NO: 480257 - RNA, 19 nt, Human
uggaggcagaggugagaac

SEQ ID NO: 480258 - RNA, 24 nt, Human
uggaggcagaggugagaacacugg

SEQ ID NO: 480259 - RNA, 24 nt, Human
uggaggcagaggugagaacacugg

SEQ ID NO: 480260 - RNA, 22 nt, Human
uggcacagccauuccaaccugg

SEQ ID NO: 480261 - RNA, 19 nt, Human
uggcaugaucuuggcucac

SEQ ID NO: 480262 - RNA, 21 nt, Human
uggcaugaucuuggcucacug

SEQ ID NO: 480263 - RNA, 24 nt, Human
uggccaggguggucucgaacuccu

SEQ ID NO: 480264 - RNA, 18 nt, Human
uggcuggaacccuacuga

SEQ ID NO: 480265 - RNA, 24 nt, Human
ugggauuacaggugccugacacca

SEQ ID NO: 480266 - RNA, 25 nt, Human
ugggauuacaggugccugacaccau

SEQ ID NO: 480267 - RNA, 19 nt, Human
ugggauuacaggugugagc

SEQ ID NO: 480268 - RNA, 21 nt, Human
ugggauuacaggugugagcca

SEQ ID NO: 480269 - RNA, 22 nt, Human
ugggauuacaggugugagccac

SEQ ID NO: 480270 - RNA, 23 nt, Human
ugggauuacaggugugagccacc

SEQ ID NO: 480271 - RNA, 24 nt, Human
ugggauuacaggugugagccaccg

SEQ ID NO: 480272 - RNA, 20 nt, Human
ugggcaugucauguugcucu

SEQ ID NO: 480273 - RNA, 20 nt, Human
ugggguggggcagcugcagc

SEQ ID NO: 480274 - RNA, 23 nt, Human
ugggguuucgcauguuggccagg

SEQ ID NO: 480275 - RNA, 22 nt, Human
uggugaucaagcucugacucua

SEQ ID NO: 480276 - RNA, 22 nt, Human
uggugaucaagcucugacucua

SEQ ID NO: 480277 - RNA, 20 nt, Human
ugucuagaggucaaagguca

SEQ ID NO: 480278 - RNA, 20 nt, Human
ugucuagaggucaaagguca

SEQ ID NO: 480279 - RNA, 21 nt, Human
uucaagcaauucuccugccuc

SEQ ID NO: 480280 - RNA, 24 nt, Human
uucaagcaauucuccugccucagc

SEQ ID NO: 480281 - RNA, 20 nt, Human
uucacagacacaguagccac

SEQ ID NO: 480282 - RNA, 24 nt, Human
uucacuacagaaucucuacaauaa

SEQ ID NO: 480283 - RNA, 21 nt, Human
uucacugucuacaaaauugca

SEQ ID NO: 480284 - RNA, 18 nt, Human
uucagccugacuugcguu

SEQ ID NO: 480285 - RNA, 23 nt, Human
uucguagagaugggguuucgcau

SEQ ID NO: 480286 - RNA, 25 nt, Human
uugcaaguuaacuccagauagcugc

SEQ ID NO: 480287 - RNA, 21 nt, Human
uugcucaguugcugagccuca

SEQ ID NO: 480288 - RNA, 21 nt, Human
uugcucaguugcugagccuca

SEQ ID NO: 480289 - RNA, 25 nt, Human
uuggaggcagaggugagaacacugg

SEQ ID NO: 480290 - RNA, 18 nt, Human
uuggccucccaaagugcu

SEQ ID NO: 480291 - RNA, 18 nt, Human
uugggguggggcagcugc

SEQ ID NO: 480292 - RNA, 18 nt, Human
uuucgcauguuggccagg

SEQ ID NO: 480293 - RNA, 23 nt, Human
uuucuucacagcucuacuggcaa

SEQ ID NO: 480294 - RNA, 19 nt, Human
uuucuucuuuuucaccaca

SEQ ID NO: 480295 - RNA, 22 nt, Human
uuugaaguaaggggagcuaaca

SEQ ID NO: 480296 - RNA, 24 nt, Human
uuuuggcacagccauuccaaccug

SEQ ID NO: 480297 - RNA, 23 nt, Human
uuuuucguagagaugggguuucg

SEQ ID NO: 480298 - RNA, 24 nt, Human
uuuuucguagagaugggguuucgc

SEQ ID NO: 480299 - RNA, 27 nt, Human
aaccaaaagguggcguaagguuuuacu

SEQ ID NO: 480300 - RNA, 18 nt, Human
aagcaucacagaccaaaa

SEQ ID NO: 480301 - RNA, 19 nt, Human
aagcaucacagaccaaaag

SEQ ID NO: 480302 - RNA, 21 nt, Human
aagcaucacagaccaaaagcc

SEQ ID NO: 480303 - RNA, 22 nt, Human
aagcauuuuguucuccucugua

SEQ ID NO: 480304 - RNA, 18 nt, Human
acagaccaaaagccacaa

SEQ ID NO: 480305 - RNA, 18 nt, Human
accagucuguucaguccu

SEQ ID NO: 480306 - RNA, 21 nt, Human
accagucuguucaguccuggu

SEQ ID NO: 480307 - RNA, 25 nt, Human
agaaacuauagagucuuuauaaacu

SEQ ID NO: 480308 - RNA, 23 nt, Human
agaccaagcaucacagaccaaaa

SEQ ID NO: 480309 - RNA, 21 nt, Human
aucacagaccaaaagccacaa

SEQ ID NO: 480310 - RNA, 24 nt, Human
aucacagaccaaaagccacaaagu

SEQ ID NO: 480311 - RNA, 24 nt, Human
caagcaucacagaccaaaagccac

SEQ ID NO: 480312 - RNA, 26 nt, Human
caagcaucacagaccaaaagccacaa

SEQ ID NO: 480313 - RNA, 19 nt, Human
cagcaaaaugcugcaucug

SEQ ID NO: 480314 - RNA, 20 nt, Human
cccucucccuccucccuucc

SEQ ID NO: 480315 - RNA, 21 nt, Human
cccuguccucccucucccucc

SEQ ID NO: 480316 - RNA, 21 nt, Human
ccuagggccugacaaagugac

SEQ ID NO: 480317 - RNA, 18 nt, Human
ccucccucucccuccucc

SEQ ID NO: 480318 - RNA, 19 nt, Human
ccucccucucccuccuccc

SEQ ID NO: 480319 - RNA, 19 nt, Human
ccucccuuccccuaucuau

SEQ ID NO: 480320 - RNA, 20 nt, Human
ccucuguaacagcacagggc

SEQ ID NO: 480321 - RNA, 20 nt, Human
ccuggucccuuuccaguccc

SEQ ID NO: 480322 - RNA, 18 nt, Human
ccuugcugaaagcauuuu

SEQ ID NO: 480323 - RNA, 21 nt, Human
ccuuuccagccucuggagucc

SEQ ID NO: 480324 - RNA, 23 nt, Human
cugcaguaacuguaugaaauuua

SEQ ID NO: 480325 - RNA, 23 nt, Human
gaagagaagcuuguaagguagca

SEQ ID NO: 480326 - RNA, 20 nt, Human
gagucuuuguaaccagucug

SEQ ID NO: 480327 - RNA, 24 nt, Human
ggagucuuuguaaccagucuguuc

SEQ ID NO: 480328 - RNA, 20 nt, Human
gucaucuccagccaucuguu

SEQ ID NO: 480329 - RNA, 22 nt, Human
gucccggucccuuuccagccuc

SEQ ID NO: 480330 - RNA, 19 nt, Human
gucccuuuccagccucugg

SEQ ID NO: 480331 - RNA, 20 nt, Human
guuaaaaaaaaaaaaaaagu

SEQ ID NO: 480332 - RNA, 19 nt, Human
uaccaauagacaauacuca

SEQ ID NO: 480333 - RNA, 22 nt, Human
uaccaauagacaauacucaggc

SEQ ID NO: 480334 - RNA, 21 nt, Human
uagcagcaaaaugcugcaucu

SEQ ID NO: 480335 - RNA, 25 nt, Human
ucagcucccaggcuuuccagagagu

SEQ ID NO: 480336 - RNA, 28 nt, Human
uccauguggugcacuuuuucaggcauug

SEQ ID NO: 480337 - RNA, 23 nt, Human
ucccggucccuuuccagccucug

SEQ ID NO: 480338 - RNA, 20 nt, Human
uccucccucucccuccuccc

SEQ ID NO: 480339 - RNA, 27 nt, Human
ucuauuugguuaaaaaaaaaaaaaaaa

SEQ ID NO: 480340 - RNA, 21 nt, Human
ucucacaaacucacuuggucu

SEQ ID NO: 480341 - RNA, 19 nt, Human
ucucccuccucccuucccc

SEQ ID NO: 480342 - RNA, 19 nt, Human
ucucccuguccucccucuc

SEQ ID NO: 480343 - RNA, 23 nt, Human
ucuguagugaaaucauucucccc

SEQ ID NO: 480344 - RNA, 24 nt, Human
ugacaaagugacccuggauaaaug

SEQ ID NO: 480345 - RNA, 22 nt, Human
ugagaccaagcaucacagacca

SEQ ID NO: 480346 - RNA, 22 nt, Human
uggaaauauuuugaacacucag

SEQ ID NO: 480347 - RNA, 20 nt, Human
ugguuaaaaaaaaaaaaaaa

SEQ ID NO: 480348 - RNA, 24 nt, Human
uugaacacucagauauaaaaauuc

SEQ ID NO: 480349 - RNA, 19 nt, Human
uugguuaaaaaaaaaaaaa

SEQ ID NO: 480350 - RNA, 22 nt, Human
uugguuaaaaaaaaaaaaaaag

SEQ ID NO: 480351 - RNA, 18 nt, Human
uuguaaccagucuguuca

SEQ ID NO: 480352 - RNA, 21 nt, Human
uuuggagucuuuguaaccagu

SEQ ID NO: 480353 - RNA, 24 nt, Human
uuuuuuuuuuuuuuuuuacucuaa

SEQ ID NO: 480354 - RNA, 26 nt, Human
aaauuuucuacaaugacccaccacau

SEQ ID NO: 480355 - RNA, 19 nt, Human
aacuaugaguuagaaccac

SEQ ID NO: 480356 - RNA, 24 nt, Human
aagaaaaaaaugguaaauaugaaa

SEQ ID NO: 480357 - RNA, 24 nt, Human
aagaaaccaauacauaucagagca

SEQ ID NO: 480358 - RNA, 21 nt, Human
aagaggaaaaagaugguagaa

SEQ ID NO: 480359 - RNA, 21 nt, Human
aaugaggaaauaauggaaaaa

SEQ ID NO: 480360 - RNA, 20 nt, Human
accaccucccucucugaugu

SEQ ID NO: 480361 - RNA, 25 nt, Human
accucggaagacaucagagcagaag

SEQ ID NO: 480362 - RNA, 21 nt, Human
accuugcucuagcuccagucc

SEQ ID NO: 480363 - RNA, 26 nt, Human
agaagaaauucucccucaaacgugga

SEQ ID NO: 480364 - RNA, 20 nt, Human
agcuguauguggugaggaaa

SEQ ID NO: 480365 - RNA, 22 nt, Human
aggcaucuaucauaaagaaaca

SEQ ID NO: 480366 - RNA, 22 nt, Human
auccuccaucgcugucuucaac

SEQ ID NO: 480367 - RNA, 25 nt, Human
caagaaaccaauacauaucagagca

SEQ ID NO: 480368 - RNA, 25 nt, Human
caccgcaacucuagaaucuucaauu

SEQ ID NO: 480369 - RNA, 20 nt, Human
cacuauguugcuuacaguag

SEQ ID NO: 480370 - RNA, 22 nt, Human
cauggaaucugacuacaugcua

SEQ ID NO: 480371 - RNA, 18 nt, Human
ccaccaggcucauucucu

SEQ ID NO: 480372 - RNA, 25 nt, Human
ccaccaggcucauucucucuaaugc

SEQ ID NO: 480373 - RNA, 23 nt, Human
ccaggauaauagaaaucuuucuu

SEQ ID NO: 480374 - RNA, 25 nt, Human
cgugaaauuuguaaauaaaagauga

SEQ ID NO: 480375 - RNA, 21 nt, Human
cucuaaugcccugaugaagcc

SEQ ID NO: 480376 - RNA, 27 nt, Human
gaaaaagaaaacaauuauaaaaaauac

SEQ ID NO: 480377 - RNA, 23 nt, Human
gaacaacuaugaguuagaaccac

SEQ ID NO: 480378 - RNA, 20 nt, Human
gagaagagcuguauguggug

SEQ ID NO: 480379 - RNA, 20 nt, Human
gcuauaagcaccugcucaaa

SEQ ID NO: 480380 - RNA, 21 nt, Human
gcuccaguccauccauccauc

SEQ ID NO: 480381 - RNA, 27 nt, Human
ggaaauaauggaaaaagaccgguaccc

SEQ ID NO: 480382 - RNA, 18 nt, Human
ggagaagagcuguaugug

SEQ ID NO: 480383 - RNA, 19 nt, Human
guaaauaaaagaugaauac

SEQ ID NO: 480384 - RNA, 28 nt, Human
uaaaugcaaagaucauacgaaaauccug

SEQ ID NO: 480385 - RNA, 19 nt, Human
uaagaggaaaaagauggua

SEQ ID NO: 480386 - RNA, 19 nt, Human
uaaguggagaaaccauuaa

SEQ ID NO: 480387 - RNA, 19 nt, Human
uacaguagacuacaaaugu

SEQ ID NO: 480388 - RNA, 23 nt, Human
uacuucaacaaugcaucaccuac

SEQ ID NO: 480389 - RNA, 18 nt, Human
uagaagacacuauguugc

SEQ ID NO: 480390 - RNA, 21 nt, Human
uagcagaugauaagacucucc

SEQ ID NO: 480391 - RNA, 23 nt, Human
uagcagaugauaagacucuccca

SEQ ID NO: 480392 - RNA, 22 nt, Human
ucaauauuugcauauucucuaa

SEQ ID NO: 480393 - RNA, 18 nt, Human
ucacaguaaacccaccag

SEQ ID NO: 480394 - RNA, 23 nt, Human
ucacaguaaacccaccaggcuca

SEQ ID NO: 480395 - RNA, 18 nt, Human
ucauaaagaaacaucacc

SEQ ID NO: 480396 - RNA, 18 nt, Human
ucccucucugauguuucu

SEQ ID NO: 480397 - RNA, 18 nt, Human
ucucagaugguuuggcua

SEQ ID NO: 480398 - RNA, 18 nt, Human
ugaaauagaauaguagug

SEQ ID NO: 480399 - RNA, 20 nt, Human
ugacacaacucgaccuugau

SEQ ID NO: 480400 - RNA, 19 nt, Human
ugagaagaaauucucccuc

SEQ ID NO: 480401 - RNA, 24 nt, Human
ugcucuagcuccaguccauccauc

SEQ ID NO: 480402 - RNA, 18 nt, Human
uggaaaaagacugauaua

SEQ ID NO: 480403 - RNA, 21 nt, Human
ugggauccuccaucgcugucu

SEQ ID NO: 480404 - RNA, 22 nt, Human
ugggauccuccaucgcugucuu

SEQ ID NO: 480405 - RNA, 23 nt, Human
ugggauccuccaucgcugucuuc

SEQ ID NO: 480406 - RNA, 22 nt, Human
uguauguggugaggaaagcggg

SEQ ID NO: 480407 - RNA, 19 nt, Human
ugucaccaccucccucucu

SEQ ID NO: 480408 - RNA, 22 nt, Human
uucaagaaaccaauacauauca

SEQ ID NO: 480409 - RNA, 24 nt, Human
uucaagaaaccaauacauaucaga

SEQ ID NO: 480410 - RNA, 24 nt, Human
uucuacaaugacccaccacaugaa

SEQ ID NO: 480411 - RNA, 25 nt, Human
uucuuagggagaaugcuugccucua

SEQ ID NO: 480412 - RNA, 25 nt, Human
uuucuagcuguuaacaauuaucauu

SEQ ID NO: 480413 - RNA, 21 nt, Human
aaauggcaacaucagagacac

SEQ ID NO: 480414 - RNA, 22 nt, Human
acuaaaauuuuaaccacaaacu

SEQ ID NO: 480415 - RNA, 23 nt, Human
agaauuccugaugagaagaaacu

SEQ ID NO: 480416 - RNA, 20 nt, Human
agacagaaaugaacaacuug

SEQ ID NO: 480417 - RNA, 23 nt, Human
caggagcaccagccuucuuacaa

SEQ ID NO: 480418 - RNA, 23 nt, Human
cauccccuucccuugaaaauuua

SEQ ID NO: 480419 - RNA, 22 nt, Human
ccacugcauugcauaagccuga

SEQ ID NO: 480420 - RNA, 22 nt, Human
ccugccugcuagauuucaggag

SEQ ID NO: 480421 - RNA, 20 nt, Human
cuggaaauacuaugcugcau

SEQ ID NO: 480422 - RNA, 22 nt, Human
cuggauccuucuggaaauacua

SEQ ID NO: 480423 - RNA, 23 nt, Human
cuucuuauucauucuccuggagg

SEQ ID NO: 480424 - RNA, 18 nt, Human
uaagaggcaaauaagaaa

SEQ ID NO: 480425 - RNA, 23 nt, Human
uaguaagcaccugccugcuagau

SEQ ID NO: 480426 - RNA, 23 nt, Human
uccccuucccuugaaaauuuacc

SEQ ID NO: 480427 - RNA, 25 nt, Human
ucgcuccaaagcaugccauuuuuuc

SEQ ID NO: 480428 - RNA, 19 nt, Human
ucuggaaauacuaugcugc

SEQ ID NO: 480429 - RNA, 22 nt, Human
ugaaaauggcaacaucagagac

SEQ ID NO: 480430 - RNA, 22 nt, Human
ugaaaauggcaacaucagagac

SEQ ID NO: 480431 - RNA, 18 nt, Human
ugaagacagaaaugaaca

SEQ ID NO: 480432 - RNA, 24 nt, Human
ugagaagaaacuagaugaauagca

SEQ ID NO: 480433 - RNA, 27 nt, Human
ugagaagaaacuagaugaauagcacau

SEQ ID NO: 480434 - RNA, 24 nt, Human
uggcaacaucagagacacaguuuc

SEQ ID NO: 480435 - RNA, 22 nt, Human
uggggugaaaauggcaacauca

SEQ ID NO: 480436 - RNA, 24 nt, Human
caauaagauuucuucaccggguuc

SEQ ID NO: 480437 - RNA, 19 nt, Human
aaaaacauucacaaccaaa

SEQ ID NO: 480438 - RNA, 28 nt, Human
aaaacauucacaaccaaaggucacccaa

SEQ ID NO: 480439 - RNA, 20 nt, Human
aaaagcaaaaacauucacaa

SEQ ID NO: 480440 - RNA, 22 nt, Human
aaagcaaaaacauucacaacca

SEQ ID NO: 480441 - RNA, 21 nt, Human
aaccaaaggucacccaacaca

SEQ ID NO: 480442 - RNA, 21 nt, Human
aacucgcuccucaaccacccc

SEQ ID NO: 480443 - RNA, 22 nt, Human
aacucgcuccucaaccacccca

SEQ ID NO: 480444 - RNA, 20 nt, Human
aagagugugagcagcuuccu

SEQ ID NO: 480445 - RNA, 18 nt, Human
aagugaccauguaacuca

SEQ ID NO: 480446 - RNA, 20 nt, Human
acaacagaaaauaucucuau

SEQ ID NO: 480447 - RNA, 23 nt, Human
acaaccaaaggucacccaacaca

SEQ ID NO: 480448 - RNA, 25 nt, Human
acagggagaggccacggggcccaaa

SEQ ID NO: 480449 - RNA, 21 nt, Human
acaugagcccugguugggaaa

SEQ ID NO: 480450 - RNA, 20 nt, Human
acccugagucuacacugcuc

SEQ ID NO: 480451 - RNA, 21 nt, Human
accuccaacuucuacagcagc

SEQ ID NO: 480452 - RNA, 23 nt, Human
acuggagugucaggaaagcacug

SEQ ID NO: 480453 - RNA, 19 nt, Human
agaacagcucaucuccccc

SEQ ID NO: 480454 - RNA, 20 nt, Human
agaacagcucaucucccccu

SEQ ID NO: 480455 - RNA, 22 nt, Human
agaacagcucaucucccccuca

SEQ ID NO: 480456 - RNA, 33 nt, Human
agacacuggagugucaggaaagcacugagcuuc

SEQ ID NO: 480457 - RNA, 20 nt, Human
agaggccacggggcccaaaa

SEQ ID NO: 480458 - RNA, 19 nt, Human
agcccggccacagcagcuc

SEQ ID NO: 480459 - RNA, 24 nt, Human
aggucacccaacacaacagaaaau

SEQ ID NO: 480460 - RNA, 22 nt, Human
aucugcgcgaccacgaggucac

SEQ ID NO: 480461 - RNA, 21 nt, Human
caacacaacagaaaauaucuc

SEQ ID NO: 480462 - RNA, 22 nt, Human
caacuucuacagcagcaauuuu

SEQ ID NO: 480463 - RNA, 23 nt, Human
caaggcaaacccgagggaggaac

SEQ ID NO: 480464 - RNA, 19 nt, Human
caauaagccuccauuaguc

SEQ ID NO: 480465 - RNA, 20 nt, Human
caaucccaccucaaaagggg

SEQ ID NO: 480466 - RNA, 23 nt, Human
caaucccaccucaaaagggguua

SEQ ID NO: 480467 - RNA, 23 nt, Human
cacaaccaaaggucacccaacac

SEQ ID NO: 480468 - RNA, 20 nt, Human
cacacugcccagcccggcca

SEQ ID NO: 480469 - RNA, 21 nt, Human
cacagcuccaccuccaacuuc

SEQ ID NO: 480470 - RNA, 26 nt, Human
caccuccaacuucuacagcagcaauu

SEQ ID NO: 480471 - RNA, 26 nt, Human
cacuuccauuuuaagagugugagcag

SEQ ID NO: 480472 - RNA, 19 nt, Human
cagcagcaauuuuuagugg

SEQ ID NO: 480473 - RNA, 19 nt, Human
cagcagcaauuuuuagugg

SEQ ID NO: 480474 - RNA, 20 nt, Human
cagcagccaggagcuguuca

SEQ ID NO: 480475 - RNA, 23 nt, Human
cagcagggaaccaccuaaaaacc

SEQ ID NO: 480476 - RNA, 18 nt, Human
cagcuccaccuccaacuu

SEQ ID NO: 480477 - RNA, 21 nt, Human
cagggccuguggcagccuaac

SEQ ID NO: 480478 - RNA, 19 nt, Human
caugucuccaagaggcaau

SEQ ID NO: 480479 - RNA, 24 nt, Human
ccaaaaacgcaacacgucucaagg

SEQ ID NO: 480480 - RNA, 18 nt, Human
ccagaacgucuucccagg

SEQ ID NO: 480481 - RNA, 20 nt, Human
ccagaacgucuucccagggc

SEQ ID NO: 480482 - RNA, 21 nt, Human
ccaguaguauccauguuuucu

SEQ ID NO: 480483 - RNA, 20 nt, Human
cccaacgagaacccucucgg

SEQ ID NO: 480484 - RNA, 18 nt, Human
ccccaacgagaacccucu

SEQ ID NO: 480485 - RNA, 20 nt, Human
cccggccacagcagcucagc

SEQ ID NO: 480486 - RNA, 21 nt, Human
cccucaugugaaagauuaaau

SEQ ID NO: 480487 - RNA, 18 nt, Human
cccuggcgccucgcgggc

SEQ ID NO: 480488 - RNA, 21 nt, Human
cccugguugggaaagaagaac

SEQ ID NO: 480489 - RNA, 18 nt, Human
ccgcccccgcucgacccc

SEQ ID NO: 480490 - RNA, 22 nt, Human
ccggaagccacgcccccggcgc

SEQ ID NO: 480491 - RNA, 21 nt, Human
ccuacauuccuuguccaggaa

SEQ ID NO: 480492 - RNA, 22 nt, Human
ccucaaccaccccagacacugg

SEQ ID NO: 480493 - RNA, 26 nt, Human
ccugaccugagccuugcgccgguucc

SEQ ID NO: 480494 - RNA, 23 nt, Human
ccuugggucuuagaauaaggcuu

SEQ ID NO: 480495 - RNA, 27 nt, Human
cgccgcggcgacuagcaagcuguggcc

SEQ ID NO: 480496 - RNA, 19 nt, Human
cgcugcggucgggggagga

SEQ ID NO: 480497 - RNA, 20 nt, Human
cuacagcagcaauuuuuagu

SEQ ID NO: 480498 - RNA, 21 nt, Human
cucaaccaccccagacacugg

SEQ ID NO: 480499 - RNA, 20 nt, Human
cuccaacuucuacagcagca

SEQ ID NO: 480500 - RNA, 24 nt, Human
cucgcuccucaaccaccccagaca

SEQ ID NO: 480501 - RNA, 18 nt, Human
cugcggucgggggaggag

SEQ ID NO: 480502 - RNA, 18 nt, Human
cugcggucgggggaggag

SEQ ID NO: 480503 - RNA, 18 nt, Human
cuucuacagcagcaauuu

SEQ ID NO: 480504 - RNA, 19 nt, Human
gaacucgcuccucaaccac

SEQ ID NO: 480505 - RNA, 22 nt, Human
gacacagcacucacuuccuaca

SEQ ID NO: 480506 - RNA, 24 nt, Human
gaccccaacgagaacccucucggc

SEQ ID NO: 480507 - RNA, 18 nt, Human
gaggagcgccugucagcu

SEQ ID NO: 480508 - RNA, 25 nt, Human
gccacgcccccggcgccugccauga

SEQ ID NO: 480509 - RNA, 19 nt, Human
gcuguuggggcacacugcc

SEQ ID NO: 480510 - RNA, 21 nt, Human
ggaacugugggcuucagcaac

SEQ ID NO: 480511 - RNA, 21 nt, Human
ggagaggccacggggcccaaa

SEQ ID NO: 480512 - RNA, 25 nt, Human
gggaaagaagaacuauccagaacgu

SEQ ID NO: 480513 - RNA, 21 nt, Human
gggacgcgagcugggggccgc

SEQ ID NO: 480514 - RNA, 24 nt, Human
ggucacccaacacaacagaaaaua

SEQ ID NO: 480515 - RNA, 22 nt, Human
guaugugacaauucaaguuuuc

SEQ ID NO: 480516 - RNA, 19 nt, Human
gucacagcuccaccuccaa

SEQ ID NO: 480517 - RNA, 23 nt, Human
gucugggaggaagagagaacucg

SEQ ID NO: 480518 - RNA, 24 nt, Human
guucaaguuucaaagacacugcag

SEQ ID NO: 480519 - RNA, 22 nt, Human
guugggaaagaagaacuaucca

SEQ ID NO: 480520 - RNA, 24 nt, Human
uaaaaaacugaaaccaagauuccc

SEQ ID NO: 480521 - RNA, 22 nt, Human
uaaagcaaaaaaaaaaagguca

SEQ ID NO: 480522 - RNA, 24 nt, Human
uaacggacacuuccauuuuaagag

SEQ ID NO: 480523 - RNA, 24 nt, Human
uagaauaaaaaacugaaaccaaga

SEQ ID NO: 480524 - RNA, 22 nt, Human
uagcagccgggcacacuuuggu

SEQ ID NO: 480525 - RNA, 21 nt, Human
uagcauagaauaaaaaacuga

SEQ ID NO: 480526 - RNA, 27 nt, Human
uagcauagaauaaaaaacugaaaccaa

SEQ ID NO: 480527 - RNA, 19 nt, Human
uaucacaaaauuucccaca

SEQ ID NO: 480528 - RNA, 23 nt, Human
ucaaaagggguuaaaagcaaaaa

SEQ ID NO: 480529 - RNA, 20 nt, Human
ucaaacaaguauaauucuca

SEQ ID NO: 480530 - RNA, 18 nt, Human
ucgcuccucaaccacccc

SEQ ID NO: 480531 - RNA, 22 nt, Human
ucucaaggcaaacccgagggag

SEQ ID NO: 480532 - RNA, 23 nt, Human
ucuccaagaggcaaucccaccuc

SEQ ID NO: 480533 - RNA, 23 nt, Human
ucugcgcgaccacgaggucacgc

SEQ ID NO: 480534 - RNA, 21 nt, Human
ucugggaggaagagagaacuc

SEQ ID NO: 480535 - RNA, 21 nt, Human
ucuuagguacugguagacccc

SEQ ID NO: 480536 - RNA, 24 nt, Human
ugaccugagccuugcgcucccugc

SEQ ID NO: 480537 - RNA, 23 nt, Human
ugacggagucgggcaauuccggg

SEQ ID NO: 480538 - RNA, 21 nt, Human
ugcggucgggggaggagcgcc

SEQ ID NO: 480539 - RNA, 21 nt, Human
ugguagcagauccaaaccuug

SEQ ID NO: 480540 - RNA, 18 nt, Human
uguaaaauguaugugaca

SEQ ID NO: 480541 - RNA, 25 nt, Human
uguaaagcaaaaaaaaaaaggucaa

SEQ ID NO: 480542 - RNA, 20 nt, Human
ugugggcuucagcaccucca

SEQ ID NO: 480543 - RNA, 18 nt, Human
uguucaccuuccagaagc

SEQ ID NO: 480544 - RNA, 23 nt, Human
uuaaaagcaaaaacauucacaac

SEQ ID NO: 480545 - RNA, 22 nt, Human
uuaucacaaaauuucccacaaa

SEQ ID NO: 480546 - RNA, 24 nt, Human
uugauucaaacaaguauaauucuc

SEQ ID NO: 480547 - RNA, 21 nt, Human
aaacaugaaguaggagggacc

SEQ ID NO: 480548 - RNA, 18 nt, Human
aaacgagaaaagcuaaua

SEQ ID NO: 480549 - RNA, 21 nt, Human
aacagggugaaaccucguccu

SEQ ID NO: 480550 - RNA, 18 nt, Human
aacuuacugcaaacacac

SEQ ID NO: 480551 - RNA, 22 nt, Human
aaggaaaccuccacaacagccg

SEQ ID NO: 480552 - RNA, 25 nt, Human
aaggcaggugcaucacuucagguca

SEQ ID NO: 480553 - RNA, 21 nt, Human
acaaacucagauuuagugaac

SEQ ID NO: 480554 - RNA, 22 nt, Human
acacugaauccacugcuccugu

SEQ ID NO: 480555 - RNA, 22 nt, Human
acauucuucuacccugcugugu

SEQ ID NO: 480556 - RNA, 20 nt, Human
accagccuggccaacagggu

SEQ ID NO: 480557 - RNA, 19 nt, Human
acgagaaaagcuaauagug

SEQ ID NO: 480558 - RNA, 23 nt, Human
acgagcucauuagaaacuuaaag

SEQ ID NO: 480559 - RNA, 25 nt, Human
acugcaaacacacggugauuaccau

SEQ ID NO: 480560 - RNA, 24 nt, Human
acuuuaugacucaacacuccgcca

SEQ ID NO: 480561 - RNA, 19 nt, Human
agaaguccugaaaugguug

SEQ ID NO: 480562 - RNA, 26 nt, Human
agagagcaggcaaaggugagcgccug

SEQ ID NO: 480563 - RNA, 21 nt, Human
agccaagcugaugaggaaaca

SEQ ID NO: 480564 - RNA, 20 nt, Human
agccaguccguaggaacuga

SEQ ID NO: 480565 - RNA, 23 nt, Human
agccuggccaacagggugaaacc

SEQ ID NO: 480566 - RNA, 19 nt, Human
aggaacugauccuagguuc

SEQ ID NO: 480567 - RNA, 26 nt, Human
aggcaggugcaucacuucaggucagg

SEQ ID NO: 480568 - RNA, 23 nt, Human
agggaccacccaaaaggcuccug

SEQ ID NO: 480569 - RNA, 21 nt, Human
agggcacagagaaauggcaaa

SEQ ID NO: 480570 - RNA, 22 nt, Human
agguguuuucaaguggcagaag

SEQ ID NO: 480571 - RNA, 27 nt, Human
aguacaaccauuaucagaaggucaucc

SEQ ID NO: 480572 - RNA, 23 nt, Human
aguaggauuauuccagaugagau

SEQ ID NO: 480573 - RNA, 19 nt, Human
aucacuauucaaaggcgga

SEQ ID NO: 480574 - RNA, 23 nt, Human
aucacuucaggucaggaguucga

SEQ ID NO: 480575 - RNA, 18 nt, Human
auucaaaggcggagcuuc

SEQ ID NO: 480576 - RNA, 18 nt, Human
auucuuggcacauugucu

SEQ ID NO: 480577 - RNA, 25 nt, Human
caacacaacuccuuugcaccuggag

SEQ ID NO: 480578 - RNA, 23 nt, Human
caacccaguguuucaggaacuga

SEQ ID NO: 480579 - RNA, 20 nt, Human
caacugcaaucaccucccuc

SEQ ID NO: 480580 - RNA, 24 nt, Human
caagcaacugcaaucaccucccuc

SEQ ID NO: 480581 - RNA, 18 nt, Human
caagccaaccaccuuucc

SEQ ID NO: 480582 - RNA, 18 nt, Human
caagcugaugaggaaaca

SEQ ID NO: 480583 - RNA, 24 nt, Human
cacagagaaauggcaaaauaaccg

SEQ ID NO: 480584 - RNA, 22 nt, Human
caccagaucugcaggugccuga

SEQ ID NO: 480585 - RNA, 22 nt, Human
caccucccucacuuuuccacca

SEQ ID NO: 480586 - RNA, 24 nt, Human
cacgccuguaauuccagcaccuug

SEQ ID NO: 480587 - RNA, 24 nt, Human
cacugcuccuguguagauuccuau

SEQ ID NO: 480588 - RNA, 21 nt, Human
cacuuuagauggacuuggcug

SEQ ID NO: 480589 - RNA, 18 nt, Human
caggucaggaguucgaga

SEQ ID NO: 480590 - RNA, 21 nt, Human
caggugagaguaaaaugugug

SEQ ID NO: 480591 - RNA, 19 nt, Human
cauaaccgauauguccaca

SEQ ID NO: 480592 - RNA, 24 nt, Human
caucacuucaggucaggaguucga

SEQ ID NO: 480593 - RNA, 23 nt, Human
cauuuggagauccucuucugcuc

SEQ ID NO: 480594 - RNA, 21 nt, Human
ccaaccaccuuuccaaacauc

SEQ ID NO: 480595 - RNA, 18 nt, Human
ccaagcaacugcaaucac

SEQ ID NO: 480596 - RNA, 19 nt, Human
ccacagggcuuugagucag

SEQ ID NO: 480597 - RNA, 23 nt, Human
ccacccaaaaggcuccuggucac

SEQ ID NO: 480598 - RNA, 19 nt, Human
ccagcaccuugggaagcca

SEQ ID NO: 480599 - RNA, 23 nt, Human
ccaguccguaggaacugaucccc

SEQ ID NO: 480600 - RNA, 22 nt, Human
ccgaucccuggagcugucaaaa

SEQ ID NO: 480601 - RNA, 20 nt, Human
ccgccaaauugguaguuacu

SEQ ID NO: 480602 - RNA, 21 nt, Human
ccuacugccuuuucccucaaa

SEQ ID NO: 480603 - RNA, 22 nt, Human
ccucagccuugacuaacucauu

SEQ ID NO: 480604 - RNA, 29 nt, Human
ccugaacgauucucugcaggccgaccucg

SEQ ID NO: 480605 - RNA, 21 nt, Human
ccuggccaacagggugaaacc

SEQ ID NO: 480606 - RNA, 24 nt, Human
ccuggccaacagggugaaaccucg

SEQ ID NO: 480607 - RNA, 22 nt, Human
ccuguaauuccagcaccuuggg

SEQ ID NO: 480608 - RNA, 24 nt, Human
cgaaacaaaacaugaaguaggauu

SEQ ID NO: 480609 - RNA, 23 nt, Human
cgagaaaagcuaauagugaagau

SEQ ID NO: 480610 - RNA, 24 nt, Human
cgagaccagccuggccaacagggu

SEQ ID NO: 480611 - RNA, 21 nt, Human
cgccuguaauuccagcaccuu

SEQ ID NO: 480612 - RNA, 20 nt, Human
cuaaugaccucuuuauuggu

SEQ ID NO: 480613 - RNA, 24 nt, Human
cuaggccgggcgcgguggcucacg

SEQ ID NO: 480614 - RNA, 24 nt, Human
cucacgccuguaauuccagcaccu

SEQ ID NO: 480615 - RNA, 18 nt, Human
cuccaggccaccuccacc

SEQ ID NO: 480616 - RNA, 22 nt, Human
cuccaggccaccuccacuggcu

SEQ ID NO: 480617 - RNA, 23 nt, Human
cuccugcuguggacucaacacaa

SEQ ID NO: 480618 - RNA, 27 nt, Human
cugcucuucuucaaccucagccuugac

SEQ ID NO: 480619 - RNA, 21 nt, Human
cugcuuugcuuuagaugcccc

SEQ ID NO: 480620 - RNA, 20 nt, Human
cuggugcccgcuccuccuga

SEQ ID NO: 480621 - RNA, 23 nt, Human
cuucaggucaggaguucgagacc

SEQ ID NO: 480622 - RNA, 21 nt, Human
cuuugcaccuggagcaucucc

SEQ ID NO: 480623 - RNA, 22 nt, Human
gaaaccuccacaacagccguau

SEQ ID NO: 480624 - RNA, 21 nt, Human
gaagauaaucccaagggagaa

SEQ ID NO: 480625 - RNA, 19 nt, Human
gaaguccugaaaugguugu

SEQ ID NO: 480626 - RNA, 23 nt, Human
gaccuacugccuuuucccucuuu

SEQ ID NO: 480627 - RNA, 19 nt, Human
gaccugacaccggggcgau

SEQ ID NO: 480628 - RNA, 23 nt, Human
gaccugacaccggggcgauccaa

SEQ ID NO: 480629 - RNA, 21 nt, Human
gagaaaagcuaauagugaaga

SEQ ID NO: 480630 - RNA, 19 nt, Human
gagagaaaagguaaaugag

SEQ ID NO: 480631 - RNA, 21 nt, Human
gagcucauuagaaacuuaaag

SEQ ID NO: 480632 - RNA, 23 nt, Human
gaucagccucauccugcuuugcu

SEQ ID NO: 480633 - RNA, 18 nt, Human
gcuccaggccaccuccac

SEQ ID NO: 480634 - RNA, 19 nt, Human
ggaagccaaggcaggugca

SEQ ID NO: 480635 - RNA, 20 nt, Human
ggcaccguggagccccgcag

SEQ ID NO: 480636 - RNA, 19 nt, Human
ggcagagaguagcaugggc

SEQ ID NO: 480637 - RNA, 23 nt, Human
ggcgcgguggcucacgccuguaa

SEQ ID NO: 480638 - RNA, 23 nt, Human
gguggcucacgccuguaauucca

SEQ ID NO: 480639 - RNA, 24 nt, Human
gguggcucacgccuguaauuccag

SEQ ID NO: 480640 - RNA, 23 nt, Human
guggagacuugccuuugcaugcu

SEQ ID NO: 480641 - RNA, 20 nt, Human
uaaaacaaaacgagaaaagc

SEQ ID NO: 480642 - RNA, 24 nt, Human
uaacaucucacaacuuacugcaaa

SEQ ID NO: 480643 - RNA, 21 nt, Human
uacucuguaagucaccacaaa

SEQ ID NO: 480644 - RNA, 24 nt, Human
uaggugccgaaacaaaacaugaag

SEQ ID NO: 480645 - RNA, 22 nt, Human
uagugaacacugaauccacugc

SEQ ID NO: 480646 - RNA, 22 nt, Human
uauaaaagaauccucuaggccg

SEQ ID NO: 480647 - RNA, 19 nt, Human
ucaaaagggcacagagaaa

SEQ ID NO: 480648 - RNA, 20 nt, Human
ucacuucaggucaggaguuc

SEQ ID NO: 480649 - RNA, 24 nt, Human
ucacuucaggucaggaguucgaga

SEQ ID NO: 480650 - RNA, 19 nt, Human
uccaaaugaccagauccau

SEQ ID NO: 480651 - RNA, 18 nt, Human
uccaagcaacugcaauca

SEQ ID NO: 480652 - RNA, 19 nt, Human
uccaaggaaaccuccacaa

SEQ ID NO: 480653 - RNA, 19 nt, Human
uccacaucgacaacagagc

SEQ ID NO: 480654 - RNA, 19 nt, Human
uccauaguuaugucuagga

SEQ ID NO: 480655 - RNA, 20 nt, Human
uccaugcaggcuuuugcauu

SEQ ID NO: 480656 - RNA, 18 nt, Human
ucccucacuuuuccacca

SEQ ID NO: 480657 - RNA, 24 nt, Human
ucuaggacuggggcaccguggagc

SEQ ID NO: 480658 - RNA, 19 nt, Human
ucugcaggugccugaacug

SEQ ID NO: 480659 - RNA, 23 nt, Human
ucuuucgguuacuggggagcugg

SEQ ID NO: 480660 - RNA, 22 nt, Human
ugaaaaaauaaaacaaaacgag

SEQ ID NO: 480661 - RNA, 21 nt, Human
ugaacaugaagcuuggcgacc

SEQ ID NO: 480662 - RNA, 20 nt, Human
ugaacgauucucugcaggca

SEQ ID NO: 480663 - RNA, 19 nt, Human
ugaccagauccaugcaggc

SEQ ID NO: 480664 - RNA, 20 nt, Human
ugaucagccucauccugcuu

SEQ ID NO: 480665 - RNA, 23 nt, Human
ugcaauucacuuuuccucuggga

SEQ ID NO: 480666 - RNA, 24 nt, Human
ugcaucacuucaggucaggaguuc

SEQ ID NO: 480667 - RNA, 19 nt, Human
ugccucacauuugugucau

SEQ ID NO: 480668 - RNA, 20 nt, Human
ugcugugucaaccugaggga

SEQ ID NO: 480669 - RNA, 19 nt, Human
ugcuuuagaugccccaagu

SEQ ID NO: 480670 - RNA, 20 nt, Human
uggagacuugccuuugcaug

SEQ ID NO: 480671 - RNA, 19 nt, Human
uggagccccgcaggcccag

SEQ ID NO: 480672 - RNA, 18 nt, Human
uggagcugucaaaagggc

SEQ ID NO: 480673 - RNA, 23 nt, Human
uggcaguacaaaugcuggcaccg

SEQ ID NO: 480674 - RNA, 22 nt, Human
uggcucacgccuguaauuccag

SEQ ID NO: 480675 - RNA, 24 nt, Human
uggcucacgccuguaauuccagca

SEQ ID NO: 480676 - RNA, 24 nt, Human
ugggaagccaaggcaggugcauca

SEQ ID NO: 480677 - RNA, 22 nt, Human
uggggcuuguuagcagugggac

SEQ ID NO: 480678 - RNA, 18 nt, Human
ugguacccugaauggucu

SEQ ID NO: 480679 - RNA, 23 nt, Human
ugugaaaaaauaaaacaaaacga

SEQ ID NO: 480680 - RNA, 18 nt, Human
uuaaagacauucuuucau

SEQ ID NO: 480681 - RNA, 19 nt, Human
uucuuuuaccuuccaaaug

SEQ ID NO: 480682 - RNA, 23 nt, Human
uuuccauaguuaugucuaggacu

SEQ ID NO: 480683 - RNA, 23 nt, Human
uuugagucaguucuucaagugcu

SEQ ID NO: 480684 - RNA, 18 nt, Human
uuuuccacaucgacaaca

SEQ ID NO: 480685 - RNA, 18 nt, Human
aaggggaggcccaggcag

SEQ ID NO: 480686 - RNA, 18 nt, Human
acucaaggccugggcaga

SEQ ID NO: 480687 - RNA, 21 nt, Human
aggcaggaaggguggcccagg

SEQ ID NO: 480688 - RNA, 20 nt, Human
aggcaggcagacccaccagg

SEQ ID NO: 480689 - RNA, 22 nt, Human
aggccagagccuagcccaggga

SEQ ID NO: 480690 - RNA, 23 nt, Human
aggguugggucccgguugggggc

SEQ ID NO: 480691 - RNA, 19 nt, Human
caccaggggucccugaagg

SEQ ID NO: 480692 - RNA, 23 nt, Human
caggagggcaugccagguggugg

SEQ ID NO: 480693 - RNA, 18 nt, Human
caggccagagccuagccc

SEQ ID NO: 480694 - RNA, 21 nt, Human
ccaggcaggaaggguggccca

SEQ ID NO: 480695 - RNA, 18 nt, Human
ccagggaggcaggguugg

SEQ ID NO: 480696 - RNA, 22 nt, Human
cgcccgaagggccgcgcgacga

SEQ ID NO: 480697 - RNA, 22 nt, Human
cuagcccagggaggcaggguug

SEQ ID NO: 480698 - RNA, 19 nt, Human
gaaggguggcccaggcagg

SEQ ID NO: 480699 - RNA, 19 nt, Human
gcccgaagggccgcgcgac

SEQ ID NO: 480700 - RNA, 18 nt, Human
gcucgggcgcccgaaggg

SEQ ID NO: 480701 - RNA, 28 nt, Human
ggaguugggugggcaggcaagugggugg

SEQ ID NO: 480702 - RNA, 19 nt, Human
ggcaggcaagugggugggu

SEQ ID NO: 480703 - RNA, 23 nt, Human
gggcagaguggggagcgcccagg

SEQ ID NO: 480704 - RNA, 19 nt, Human
gggcaugccaggugguggg

SEQ ID NO: 480705 - RNA, 20 nt, Human
guggugggggcuggcccagg

SEQ ID NO: 480706 - RNA, 20 nt, Human
uagcccagggaggcaggguu

SEQ ID NO: 480707 - RNA, 23 nt, Human
ucccgguugggggcucuuggagc

SEQ ID NO: 480708 - RNA, 19 nt, Human
uggcccagguaggccaagg

SEQ ID NO: 480709 - RNA, 23 nt, Human
ugggcaggcaaguggguggguug

SEQ ID NO: 480710 - RNA, 22 nt, Human
uggggagcgcccaggaguuggg

SEQ ID NO: 480711 - RNA, 21 nt, Human
uuuuuuuuuugugggagaccc

SEQ ID NO: 480712 - RNA, 19 nt, Human
uuuuuuuuuuuuuuuuugu

SEQ ID NO: 480713 - RNA, 22 nt, Human
uuuuuuuuuuuuuuuuuguggg

SEQ ID NO: 480714 - RNA, 21 nt, Human
aaauauauuuauacuaaagac

SEQ ID NO: 480715 - RNA, 25 nt, Human
aaucuucuuugacuacaaaagaagc

SEQ ID NO: 480716 - RNA, 19 nt, Human
acuaaagacuucccaaucc

SEQ ID NO: 480717 - RNA, 22 nt, Human
agugcuuagaaaagguguaagu

SEQ ID NO: 480718 - RNA, 23 nt, Human
ccaaaagcacuucugcuuuacgg

SEQ ID NO: 480719 - RNA, 20 nt, Human
cccaaaaggcugacugugaa

SEQ ID NO: 480720 - RNA, 18 nt, Human
cccauucaggaagauggc

SEQ ID NO: 480721 - RNA, 18 nt, Human
cucugugcuauagcacuc

SEQ ID NO: 480722 - RNA, 18 nt, Human
cuguuggcccugcagcug

SEQ ID NO: 480723 - RNA, 18 nt, Human
gcacuucugcuuuacgga

SEQ ID NO: 480724 - RNA, 18 nt, Human
gggucucaaaucccauuc

SEQ ID NO: 480725 - RNA, 20 nt, Human
uacuaaagacuucccaaucc

SEQ ID NO: 480726 - RNA, 23 nt, Human
uccaaaaagcugaaauuauauga

SEQ ID NO: 480727 - RNA, 21 nt, Human
ucuauacuuaguuccuucucu

SEQ ID NO: 480728 - RNA, 19 nt, Human
ucuuccaaaaagcugaaau

SEQ ID NO: 480729 - RNA, 18 nt, Human
ugacauucaguaaaguuc

SEQ ID NO: 480730 - RNA, 22 nt, Human
ugguauguggaucauaaaaagg

SEQ ID NO: 480731 - RNA, 18 nt, Human
uguaaauauccaaaagca

SEQ ID NO: 480732 - RNA, 19 nt, Human
uucuuccaaaaagcugaaa

SEQ ID NO: 480733 - RNA, 19 nt, Human
uuugaaauuucuucugccc

SEQ ID NO: 480734 - RNA, 22 nt, Human
aaaauaaaaagcuagcaaaaag

SEQ ID NO: 480735 - RNA, 19 nt, Human
aaagugcugggauuacaga

SEQ ID NO: 480736 - RNA, 24 nt, Human
aaagugcugggauuacagauguga

SEQ ID NO: 480737 - RNA, 23 nt, Human
aacacuuuuuuuuuuuccuuggg

SEQ ID NO: 480738 - RNA, 20 nt, Human
aacaucucuuggaacuacug

SEQ ID NO: 480739 - RNA, 26 nt, Human
aacucagcauuccuucauuuuaauug

SEQ ID NO: 480740 - RNA, 20 nt, Human
aacuucagaacucaaacagc

SEQ ID NO: 480741 - RNA, 18 nt, Human
aagaaacauuagcuguag

SEQ ID NO: 480742 - RNA, 20 nt, Human
aagaaccugauauuuaugcu

SEQ ID NO: 480743 - RNA, 26 nt, Human
aagcugaugugauguacuugugaaau

SEQ ID NO: 480744 - RNA, 18 nt, Human
aagugcugggauuacaga

SEQ ID NO: 480745 - RNA, 23 nt, Human
aaguucucucuuguccaggcauu

SEQ ID NO: 480746 - RNA, 20 nt, Human
aauuaaacacaauacugauu

SEQ ID NO: 480747 - RNA, 18 nt, Human
acagccuggccaagaacc

SEQ ID NO: 480748 - RNA, 24 nt, Human
accaguguauaaaaugaaacuuuu

SEQ ID NO: 480749 - RNA, 22 nt, Human
accaugcaaucccccaccccca

SEQ ID NO: 480750 - RNA, 28 nt, Human
acccagcaagaaacauuagcuguaguuu

SEQ ID NO: 480751 - RNA, 18 nt, Human
acugcagccucgaccucc

SEQ ID NO: 480752 - RNA, 20 nt, Human
acuucagaacucaaacagca

SEQ ID NO: 480753 - RNA, 20 nt, Human
agacaagccacuuaaaccua

SEQ ID NO: 480754 - RNA, 26 nt, Human
agacuauagccacaccaccgugccca

SEQ ID NO: 480755 - RNA, 20 nt, Human
agagaaaaggaagaggagga

SEQ ID NO: 480756 - RNA, 20 nt, Human
agagaggagcauaccugugu

SEQ ID NO: 480757 - RNA, 25 nt, Human
agagcuuguauuuucuccccuccca

SEQ ID NO: 480758 - RNA, 20 nt, Human
agcaaauauacuugcuuucu

SEQ ID NO: 480759 - RNA, 21 nt, Human
agcaauccacccaccucagcc

SEQ ID NO: 480760 - RNA, 22 nt, Human
agcccuguauguacuauaggac

SEQ ID NO: 480761 - RNA, 19 nt, Human
aggaagaggaggaagagcu

SEQ ID NO: 480762 - RNA, 24 nt, Human
aggaccaccuaauuuuagaagucc

SEQ ID NO: 480763 - RNA, 18 nt, Human
aggagacugcaaggucag

SEQ ID NO: 480764 - RNA, 25 nt, Human
aggcuggagugcaguggcgccaucu

SEQ ID NO: 480765 - RNA, 23 nt, Human
aggguucagcuaagaacuacagu

SEQ ID NO: 480766 - RNA, 20 nt, Human
agugcaguggcgccaucuug

SEQ ID NO: 480767 - RNA, 24 nt, Human
agugcaguggcgccaucuuggcuc

SEQ ID NO: 480768 - RNA, 24 nt, Human
agugcugggauuacagaugugagc

SEQ ID NO: 480769 - RNA, 22 nt, Human
auaaaaagcuagcaaaaagcua

SEQ ID NO: 480770 - RNA, 21 nt, Human
aucucuguugcccugugaaaa

SEQ ID NO: 480771 - RNA, 23 nt, Human
augggguuuugccauguugccua

SEQ ID NO: 480772 - RNA, 18 nt, Human
caaaaagcuaguaagaaa

SEQ ID NO: 480773 - RNA, 22 nt, Human
caaaauucugcugaaaacuaac

SEQ ID NO: 480774 - RNA, 24 nt, Human
caaacagcacucacauaacaugga

SEQ ID NO: 480775 - RNA, 22 nt, Human
caaagcaaguuagcuaagaaac

SEQ ID NO: 480776 - RNA, 18 nt, Human
caaggcacugugcuaaga

SEQ ID NO: 480777 - RNA, 24 nt, Human
cacaccaccgugcccagcuaauuu

SEQ ID NO: 480778 - RNA, 23 nt, Human
caccaaaaacuuuucagagccuc

SEQ ID NO: 480779 - RNA, 22 nt, Human
cacccaccucagccuuccaaag

SEQ ID NO: 480780 - RNA, 24 nt, Human
cacccaggcuggagugcaguggcg

SEQ ID NO: 480781 - RNA, 24 nt, Human
caccucagccuuccaaagugcugg

SEQ ID NO: 480782 - RNA, 24 nt, Human
cacucucucacccaggcuggagug

SEQ ID NO: 480783 - RNA, 19 nt, Human
cacugcagccucgaccucc

SEQ ID NO: 480784 - RNA, 18 nt, Human
cacugucaugggccaacc

SEQ ID NO: 480785 - RNA, 20 nt, Human
cagaacucaaacagcacuca

SEQ ID NO: 480786 - RNA, 24 nt, Human
cagcagaaucugcacacaacggag

SEQ ID NO: 480787 - RNA, 20 nt, Human
cagccuccugaguagcucag

SEQ ID NO: 480788 - RNA, 23 nt, Human
cagccucgaccuccuggacucag

SEQ ID NO: 480789 - RNA, 26 nt, Human
caggaggcuucugcuucuuuccuggg

SEQ ID NO: 480790 - RNA, 24 nt, Human
caguggcugcagacagcaugugug

SEQ ID NO: 480791 - RNA, 24 nt, Human
cauacaucagccuccugaguagcu

SEQ ID NO: 480792 - RNA, 18 nt, Human
caucugcugggucucugc

SEQ ID NO: 480793 - RNA, 21 nt, Human
caugguagccuuuucuaaaug

SEQ ID NO: 480794 - RNA, 24 nt, Human
cauguugccuaggcugaucucaaa

SEQ ID NO: 480795 - RNA, 21 nt, Human
ccaaagugcugggauuacaga

SEQ ID NO: 480796 - RNA, 21 nt, Human
ccaaagugcugggauuacaga

SEQ ID NO: 480797 - RNA, 22 nt, Human
ccaaagugcugggauuacagau

SEQ ID NO: 480798 - RNA, 24 nt, Human
ccaaagugcugggauuacagaugu

SEQ ID NO: 480799 - RNA, 20 nt, Human
ccacaguaauagaucugcca

SEQ ID NO: 480800 - RNA, 21 nt, Human
ccaguagugacacauuccuga

SEQ ID NO: 480801 - RNA, 22 nt, Human
ccauguugccuaggcugaucuc

SEQ ID NO: 480802 - RNA, 22 nt, Human
ccccacccccaacacacacaca

SEQ ID NO: 480803 - RNA, 18 nt, Human
cccugagguugaaagcuc

SEQ ID NO: 480804 - RNA, 21 nt, Human
ccuauaaacccugagguugaa

SEQ ID NO: 480805 - RNA, 18 nt, Human
ccuggacucaggugaucc

SEQ ID NO: 480806 - RNA, 24 nt, Human
ccugggcucaagcaauccacccac

SEQ ID NO: 480807 - RNA, 22 nt, Human
cuaagaacuacaguccacucuc

SEQ ID NO: 480808 - RNA, 21 nt, Human
cuaccccccaacacuuuuuuu

SEQ ID NO: 480809 - RNA, 21 nt, Human
cuauagccacaccaccgugcc

SEQ ID NO: 480810 - RNA, 22 nt, Human
cucaaccaugaagaaaaggaaa

SEQ ID NO: 480811 - RNA, 21 nt, Human
cucaagcaauccacccaccuc

SEQ ID NO: 480812 - RNA, 24 nt, Human
cucaagcaauccacccaccucagc

SEQ ID NO: 480813 - RNA, 21 nt, Human
cucacugcagccucgaccucc

SEQ ID NO: 480814 - RNA, 24 nt, Human
cucacugcagccucgaccuccugg

SEQ ID NO: 480815 - RNA, 24 nt, Human
cuccaucacccuguacagugccug

SEQ ID NO: 480816 - RNA, 20 nt, Human
cucccaggguuauaauauaa

SEQ ID NO: 480817 - RNA, 23 nt, Human
cugcagccucgaccuccuggacu

SEQ ID NO: 480818 - RNA, 20 nt, Human
cuggggcaccucugcuccug

SEQ ID NO: 480819 - RNA, 18 nt, Human
cuuugagaugcucugagg

SEQ ID NO: 480820 - RNA, 18 nt, Human
gaacaacggacugcagaa

SEQ ID NO: 480821 - RNA, 23 nt, Human
gaaccuuagcuucuccaucagug

SEQ ID NO: 480822 - RNA, 19 nt, Human
gaagagaaaaggaagagga

SEQ ID NO: 480823 - RNA, 18 nt, Human
gagaugggguuuugccau

SEQ ID NO: 480824 - RNA, 20 nt, Human
gagaugggguuuugccaugu

SEQ ID NO: 480825 - RNA, 26 nt, Human
gagcccccccaucuguacaauaagga

SEQ ID NO: 480826 - RNA, 21 nt, Human
gaggaggaagagcuucagucu

SEQ ID NO: 480827 - RNA, 21 nt, Human
gagggugugaagaaaccuugc

SEQ ID NO: 480828 - RNA, 18 nt, Human
gauagcaacaccaaucuc

SEQ ID NO: 480829 - RNA, 18 nt, Human
gauuacagaugugagcca

SEQ ID NO: 480830 - RNA, 21 nt, Human
gauuacagaugugagccacca

SEQ ID NO: 480831 - RNA, 27 nt, Human
gauuguuuuaaacaguagaaaggguuc

SEQ ID NO: 480832 - RNA, 22 nt, Human
gcaaaaagcuaguaagaaacca

SEQ ID NO: 480833 - RNA, 18 nt, Human
gcgccaucuuggcucacu

SEQ ID NO: 480834 - RNA, 22 nt, Human
gcucaagcaauccacccaccuc

SEQ ID NO: 480835 - RNA, 21 nt, Human
gcucacugcagccucgaccuc

SEQ ID NO: 480836 - RNA, 21 nt, Human
gcugcucaaccaugaagaaaa

SEQ ID NO: 480837 - RNA, 20 nt, Human
gcuggagugcaguggcgcca

SEQ ID NO: 480838 - RNA, 18 nt, Human
gcuucagucuuuguaucu

SEQ ID NO: 480839 - RNA, 20 nt, Human
ggaaaaauuucaagccaggg

SEQ ID NO: 480840 - RNA, 21 nt, Human
ggaaacuacagguccuaggaa

SEQ ID NO: 480841 - RNA, 19 nt, Human
gggguuuugccauguugcc

SEQ ID NO: 480842 - RNA, 22 nt, Human
gggguuuugccauguugccuag

SEQ ID NO: 480843 - RNA, 22 nt, Human
ggguuuugccauguugccuagg

SEQ ID NO: 480844 - RNA, 21 nt, Human
guagaacaacggacugcagaa

SEQ ID NO: 480845 - RNA, 21 nt, Human
gucgagaugggguuuugccau

SEQ ID NO: 480846 - RNA, 23 nt, Human
gugauccucauacaucagccucc

SEQ ID NO: 480847 - RNA, 22 nt, Human
guuccacuuucaaaggcuacag

SEQ ID NO: 480848 - RNA, 23 nt, Human
guuuuaaacaguagaaaggguuc

SEQ ID NO: 480849 - RNA, 21 nt, Human
uaaaaagcaguuccacuuuca

SEQ ID NO: 480850 - RNA, 19 nt, Human
uaaaaagcuagcaaaaagc

SEQ ID NO: 480851 - RNA, 21 nt, Human
uaaaaagcuagcaaaaagcua

SEQ ID NO: 480852 - RNA, 18 nt, Human
uaaaauacaaagcagccc

SEQ ID NO: 480853 - RNA, 24 nt, Human
uaaaauacaaagcagcccgcagca

SEQ ID NO: 480854 - RNA, 25 nt, Human
uaaaauacaaagcagcccgcagcaa

SEQ ID NO: 480855 - RNA, 24 nt, Human
uaaauaaguggcacugcaaagggc

SEQ ID NO: 480856 - RNA, 19 nt, Human
uaacauagauaaccaaagu

SEQ ID NO: 480857 - RNA, 20 nt, Human
uaacuggcuguauguguaug

SEQ ID NO: 480858 - RNA, 24 nt, Human
uaagaaaccagaugucuaguaaag

SEQ ID NO: 480859 - RNA, 22 nt, Human
uaagggucuuaggaggccccuc

SEQ ID NO: 480860 - RNA, 18 nt, Human
uaaucuaaccccucacag

SEQ ID NO: 480861 - RNA, 23 nt, Human
uacagaguuuguuuacauacaag

SEQ ID NO: 480862 - RNA, 19 nt, Human
uacagaugugagccaccac

SEQ ID NO: 480863 - RNA, 23 nt, Human
uacagccuggccaagaacccuuu

SEQ ID NO: 480864 - RNA, 20 nt, Human
uacagugccuggcacagaau

SEQ ID NO: 480865 - RNA, 20 nt, Human
uacaucagccuccugaguag

SEQ ID NO: 480866 - RNA, 19 nt, Human
uacugauuuuacacaccac

SEQ ID NO: 480867 - RNA, 22 nt, Human
uagaacaacggacugcagaaaa

SEQ ID NO: 480868 - RNA, 18 nt, Human
uagaaggaacacuaauac

SEQ ID NO: 480869 - RNA, 19 nt, Human
uagaaggaacacuaauaca

SEQ ID NO: 480870 - RNA, 21 nt, Human
uagcuaagaaacagcauuugu

SEQ ID NO: 480871 - RNA, 20 nt, Human
uagggaugucuucucaaaga

SEQ ID NO: 480872 - RNA, 23 nt, Human
uauaaacuuaggggaauaucacc

SEQ ID NO: 480873 - RNA, 19 nt, Human
uauuuuaagggucuuagga

SEQ ID NO: 480874 - RNA, 20 nt, Human
ucaaaggacccuguaguccu

SEQ ID NO: 480875 - RNA, 19 nt, Human
ucaaauaagccaccccacc

SEQ ID NO: 480876 - RNA, 20 nt, Human
ucaagccaggguaccagugu

SEQ ID NO: 480877 - RNA, 24 nt, Human
ucacccaggcuggagugcaguggc

SEQ ID NO: 480878 - RNA, 18 nt, Human
ucacucaacuacacacuc

SEQ ID NO: 480879 - RNA, 24 nt, Human
ucacucucucacccaggcuggagu

SEQ ID NO: 480880 - RNA, 19 nt, Human
ucacugcagccucgaccuc

SEQ ID NO: 480881 - RNA, 23 nt, Human
ucacugcagccucgaccuccugg

SEQ ID NO: 480882 - RNA, 21 nt, Human
ucagacuauagccacaccacc

SEQ ID NO: 480883 - RNA, 24 nt, Human
ucagacuauagccacaccaccgug

SEQ ID NO: 480884 - RNA, 19 nt, Human
ucagaggagacugcaaggu

SEQ ID NO: 480885 - RNA, 20 nt, Human
ucaggauuugcuuccauacu

SEQ ID NO: 480886 - RNA, 22 nt, Human
ucagugacuucuuagggagaug

SEQ ID NO: 480887 - RNA, 21 nt, Human
uccacccaccucagccuucca

SEQ ID NO: 480888 - RNA, 26 nt, Human
uccauuagggaugucuucccucgugg

SEQ ID NO: 480889 - RNA, 21 nt, Human
uccauuagggaugucuucuca

SEQ ID NO: 480890 - RNA, 21 nt, Human
ucccugggcucaagcaaucca

SEQ ID NO: 480891 - RNA, 26 nt, Human
uccuccgccacagccgcccccgaggg

SEQ ID NO: 480892 - RNA, 23 nt, Human
uccugaagaaacuuccucuuucu

SEQ ID NO: 480893 - RNA, 19 nt, Human
ucuagaaagugacaggacc

SEQ ID NO: 480894 - RNA, 21 nt, Human
ucucaaaggacccuguagucc

SEQ ID NO: 480895 - RNA, 22 nt, Human
ucucacucucucacccaggcug

SEQ ID NO: 480896 - RNA, 23 nt, Human
ucucacucucucacccaggcugg

SEQ ID NO: 480897 - RNA, 24 nt, Human
ucucacucucucacccaggcugga

SEQ ID NO: 480898 - RNA, 24 nt, Human
ucucucacccaggcuggagugcag

SEQ ID NO: 480899 - RNA, 20 nt, Human
ucugaggaauaaagaagggg

SEQ ID NO: 480900 - RNA, 20 nt, Human
ucugaggccaaauccuacua

SEQ ID NO: 480901 - RNA, 24 nt, Human
ucugcacacaacggagucaaagau

SEQ ID NO: 480902 - RNA, 23 nt, Human
ucugccagcuaaacacuucuuau

SEQ ID NO: 480903 - RNA, 21 nt, Human
ucuguaaaccuuccucauugc

SEQ ID NO: 480904 - RNA, 21 nt, Human
ucuguuacuaacuggcuguau

SEQ ID NO: 480905 - RNA, 20 nt, Human
ucuuaaaccaggaaaaaauu

SEQ ID NO: 480906 - RNA, 21 nt, Human
ugaaaaaccugcaaaauuaaa

SEQ ID NO: 480907 - RNA, 19 nt, Human
ugaaaaucccaugccuucu

SEQ ID NO: 480908 - RNA, 21 nt, Human
ugaaagcucuggauagcucac

SEQ ID NO: 480909 - RNA, 21 nt, Human
ugaaauuuuucuuaaguagug

SEQ ID NO: 480910 - RNA, 25 nt, Human
ugaagaaaaggaaagagaaguagaa

SEQ ID NO: 480911 - RNA, 18 nt, Human
ugaccaugcaauccccca

SEQ ID NO: 480912 - RNA, 22 nt, Human
ugaccaugcaaucccccacccc

SEQ ID NO: 480913 - RNA, 19 nt, Human
ugaggaauaaagaagggga

SEQ ID NO: 480914 - RNA, 21 nt, Human
ugaguagcucagacuauagcc

SEQ ID NO: 480915 - RNA, 24 nt, Human
ugauguacuugugaaauaguaugu

SEQ ID NO: 480916 - RNA, 21 nt, Human
ugcaaagggcaaagaaggguu

SEQ ID NO: 480917 - RNA, 23 nt, Human
ugcaauuuuaacaauaacuaaga

SEQ ID NO: 480918 - RNA, 19 nt, Human
ugcagaaaaaaaagaacuc

SEQ ID NO: 480919 - RNA, 22 nt, Human
ugcaguggcgccaucuuggcuc

SEQ ID NO: 480920 - RNA, 24 nt, Human
ugccauguugccuaggcugaucuc

SEQ ID NO: 480921 - RNA, 18 nt, Human
ugcuaagagaugggaaaa

SEQ ID NO: 480922 - RNA, 18 nt, Human
ugcugggauuacagaugu

SEQ ID NO: 480923 - RNA, 24 nt, Human
ugcugggauuacagaugugagcca

SEQ ID NO: 480924 - RNA, 20 nt, Human
uggacucaggugauccucau

SEQ ID NO: 480925 - RNA, 21 nt, Human
uggacuuggagucagaaguuc

SEQ ID NO: 480926 - RNA, 22 nt, Human
uggagucagaaguucugcaacu

SEQ ID NO: 480927 - RNA, 28 nt, Human
uggagugcaguggcgccauccuagcacg

SEQ ID NO: 480928 - RNA, 23 nt, Human
uggagugcaguggcgccaucuug

SEQ ID NO: 480929 - RNA, 24 nt, Human
uggagugcaguggcgccaucuugg

SEQ ID NO: 480930 - RNA, 18 nt, Human
uggcagaguuccaaauaa

SEQ ID NO: 480931 - RNA, 24 nt, Human
uggcucacugcagccucgaccucc

SEQ ID NO: 480932 - RNA, 18 nt, Human
ugggagcagaggauaggc

SEQ ID NO: 480933 - RNA, 18 nt, Human
ugggauuacagaugugag

SEQ ID NO: 480934 - RNA, 19 nt, Human
ugggauuacagaugugagc

SEQ ID NO: 480935 - RNA, 22 nt, Human
ugggauuacagaugugagccac

SEQ ID NO: 480936 - RNA, 24 nt, Human
ugggauuacagaugugagccacca

SEQ ID NO: 480937 - RNA, 22 nt, Human
ugggccaacccacacuagacuc

SEQ ID NO: 480938 - RNA, 22 nt, Human
ugggcucaagcaauccacccac

SEQ ID NO: 480939 - RNA, 24 nt, Human
ugggguuuugccauguugccuagg

SEQ ID NO: 480940 - RNA, 23 nt, Human
uguaacauguuggauuucuuccc

SEQ ID NO: 480941 - RNA, 24 nt, Human
ugucgagaugggguuuugccaugu

SEQ ID NO: 480942 - RNA, 19 nt, Human
ugugagccaccaccuacag

SEQ ID NO: 480943 - RNA, 18 nt, Human
ugugauguacuugugaaa

SEQ ID NO: 480944 - RNA, 20 nt, Human
uguucaaaacucuuagaagu

SEQ ID NO: 480945 - RNA, 20 nt, Human
uguuuuagugaaugaaugaa

SEQ ID NO: 480946 - RNA, 21 nt, Human
uuaaaccaggaaaaaauuaca

SEQ ID NO: 480947 - RNA, 19 nt, Human
uuaccacaugauucauuca

SEQ ID NO: 480948 - RNA, 18 nt, Human
uuaggaaaaauuauuaau

SEQ ID NO: 480949 - RNA, 22 nt, Human
uuauugugauaucugagauauu

SEQ ID NO: 480950 - RNA, 20 nt, Human
uucagagccuccagagcccc

SEQ ID NO: 480951 - RNA, 20 nt, Human
uuccuccgccacagccgccc

SEQ ID NO: 480952 - RNA, 18 nt, Human
uuccucuaaucuaacccc

SEQ ID NO: 480953 - RNA, 21 nt, Human
uuguaaacuugaucaagggcc

SEQ ID NO: 480954 - RNA, 24 nt, Human
uugucgagaugggguuuugccaug

SEQ ID NO: 480955 - RNA, 19 nt, Human
uuuaaaauacaaagcagcc

SEQ ID NO: 480956 - RNA, 18 nt, Human
uuuaaaguugcaauucaa

SEQ ID NO: 480957 - RNA, 24 nt, Human
uuucaaaggcuacagaguuuguuu

SEQ ID NO: 480958 - RNA, 26 nt, Human
uuuccuauaaacccugagguugaaag

SEQ ID NO: 480959 - RNA, 24 nt, Human
uuugucgagaugggguuuugccau

SEQ ID NO: 480960 - RNA, 19 nt, Human
uuuugccauguugccuagg

SEQ ID NO: 480961 - RNA, 22 nt, Human
uuuugugguauaaacuuagggg

SEQ ID NO: 480962 - RNA, 24 nt, Human
uuuuuugucgagaugggguuuugc

SEQ ID NO: 480963 - RNA, 21 nt, Human
aacacagaggaacaaacaaga

SEQ ID NO: 480964 - RNA, 19 nt, Human
aagcaggcaagccaggcag

SEQ ID NO: 480965 - RNA, 26 nt, Human
acaaacaagaaggaaagggcgccaca

SEQ ID NO: 480966 - RNA, 23 nt, Human
acacacacacacacacacacaca

SEQ ID NO: 480967 - RNA, 23 nt, Human
acacacacacacacacacacaca

SEQ ID NO: 480968 - RNA, 30 nt, Human
acacacacacacacacacacacagcccuuu

SEQ ID NO: 480969 - RNA, 19 nt, Human
acagaacacagaggaacaa

SEQ ID NO: 480970 - RNA, 21 nt, Human
acagaacacagaggaacaaac

SEQ ID NO: 480971 - RNA, 20 nt, Human
acagcaggucacaggcagcc

SEQ ID NO: 480972 - RNA, 21 nt, Human
acagcugcugcaggcucugcc

SEQ ID NO: 480973 - RNA, 22 nt, Human
acaggcagcccugucuguggug

SEQ ID NO: 480974 - RNA, 26 nt, Human
acaggggcagccuuccuugauccaca

SEQ ID NO: 480975 - RNA, 22 nt, Human
accagcagccaguggcuccugg

SEQ ID NO: 480976 - RNA, 20 nt, Human
accagccugccacuccuggc

SEQ ID NO: 480977 - RNA, 23 nt, Human
accagccugccacuccuggccuc

SEQ ID NO: 480978 - RNA, 18 nt, Human
accaggcaggagcggccc

SEQ ID NO: 480979 - RNA, 19 nt, Human
accccacgcccagcccacc

SEQ ID NO: 480980 - RNA, 23 nt, Human
accccacgcccagcccaccagcc

SEQ ID NO: 480981 - RNA, 19 nt, Human
acgcccccugggcgacagg

SEQ ID NO: 480982 - RNA, 23 nt, Human
acuggccugaggaagguggcccc

SEQ ID NO: 480983 - RNA, 21 nt, Human
agaaaaccccacgcccagccc

SEQ ID NO: 480984 - RNA, 23 nt, Human
agaagcaggcaagccaggcagaa

SEQ ID NO: 480985 - RNA, 24 nt, Human
agacccucacaccagcagccagug

SEQ ID NO: 480986 - RNA, 23 nt, Human
agagguguuccugggaaacaguu

SEQ ID NO: 480987 - RNA, 23 nt, Human
agcccuugcuccuugugggaggu

SEQ ID NO: 480988 - RNA, 19 nt, Human
aggaacaaacaagaaggaa

SEQ ID NO: 480989 - RNA, 18 nt, Human
aggaacccugaaggcaca

SEQ ID NO: 480990 - RNA, 20 nt, Human
aggcagaagggggcccgggg

SEQ ID NO: 480991 - RNA, 18 nt, Human
aggcagggugacaguggg

SEQ ID NO: 480992 - RNA, 19 nt, Human
aggcagggugacagugggc

SEQ ID NO: 480993 - RNA, 20 nt, Human
aggccagcaggggcgggggg

SEQ ID NO: 480994 - RNA, 21 nt, Human
agggaccccaggacugcacag

SEQ ID NO: 480995 - RNA, 20 nt, Human
aggggacagggagggagggg

SEQ ID NO: 480996 - RNA, 22 nt, Human
agguguuccugggaaacaguuc

SEQ ID NO: 480997 - RNA, 23 nt, Human
auacacacacacacacacacaca

SEQ ID NO: 480998 - RNA, 27 nt, Human
caagccaggaccagcaucuccagggga

SEQ ID NO: 480999 - RNA, 19 nt, Human
caagccaggcagaaggggg

SEQ ID NO: 481000 - RNA, 20 nt, Human
cacacacacacacacacaca

SEQ ID NO: 481001 - RNA, 20 nt, Human
cacacacacacacacacaca

SEQ ID NO: 481002 - RNA, 20 nt, Human
cacacacacacacacacaca

SEQ ID NO: 481003 - RNA, 20 nt, Human
cacacacacacacacacaca

SEQ ID NO: 481004 - RNA, 22 nt, Human
cacacacacacacacacacaca

SEQ ID NO: 481005 - RNA, 26 nt, Human
cacacacacacacacacacacacaca

SEQ ID NO: 481006 - RNA, 31 nt, Human
cacacacauauacauacacacacacacacag

SEQ ID NO: 481007 - RNA, 20 nt, Human
cacacagcccagaccaggca

SEQ ID NO: 481008 - RNA, 19 nt, Human
cacagcccagaccaggcag

SEQ ID NO: 481009 - RNA, 21 nt, Human
caccagcucucugcauccucc

SEQ ID NO: 481010 - RNA, 18 nt, Human
cacccagggcagugggga

SEQ ID NO: 481011 - RNA, 19 nt, Human
cacccuaggcagcaguggg

SEQ ID NO: 481012 - RNA, 28 nt, Human
cacugcauacaugggacagaugugugca

SEQ ID NO: 481013 - RNA, 18 nt, Human
cagaaaaccccacgccca

SEQ ID NO: 481014 - RNA, 22 nt, Human
cagaacacagaggaacaaacaa

SEQ ID NO: 481015 - RNA, 19 nt, Human
cagaugccacucccagccu

SEQ ID NO: 481016 - RNA, 19 nt, Human
cagcagccaguggcuccug

SEQ ID NO: 481017 - RNA, 21 nt, Human
cagcagcccagacccucacac

SEQ ID NO: 481018 - RNA, 19 nt, Human
cagcccagacccucacacc

SEQ ID NO: 481019 - RNA, 25 nt, Human
cagcccagacccucacaccagcagc

SEQ ID NO: 481020 - RNA, 23 nt, Human
cagcgcaggcccagccugggguu

SEQ ID NO: 481021 - RNA, 19 nt, Human
cagcggcaggcugucccag

SEQ ID NO: 481022 - RNA, 20 nt, Human
caggagcaccugaguggggc

SEQ ID NO: 481023 - RNA, 19 nt, Human
caggagcccaccaaguccc

SEQ ID NO: 481024 - RNA, 22 nt, Human
caggcagaagggggcccggggu

SEQ ID NO: 481025 - RNA, 19 nt, Human
caggcucugccucaagucc

SEQ ID NO: 481026 - RNA, 23 nt, Human
caggcugucccaggcccuggggc

SEQ ID NO: 481027 - RNA, 19 nt, Human
cagggcagagggaauaugg

SEQ ID NO: 481028 - RNA, 19 nt, Human
cagggucccacuugccccu

SEQ ID NO: 481029 - RNA, 20 nt, Human
cagggucccacuugccccuc

SEQ ID NO: 481030 - RNA, 18 nt, Human
cagugggagguugcuggc

SEQ ID NO: 481031 - RNA, 26 nt, Human
cauauacauacacacacacacacaca

SEQ ID NO: 481032 - RNA, 21 nt, Human
ccaagccccaccugggcuaag

SEQ ID NO: 481033 - RNA, 25 nt, Human
ccacacacauauacauacacacaca

SEQ ID NO: 481034 - RNA, 24 nt, Human
ccacacagcugcugcaggcucugc

SEQ ID NO: 481035 - RNA, 24 nt, Human
ccacacccgcccgcuucugccaag

SEQ ID NO: 481036 - RNA, 22 nt, Human
ccaccaaguccccagggcagua

SEQ ID NO: 481037 - RNA, 21 nt, Human
ccaccauuuccccacagggua

SEQ ID NO: 481038 - RNA, 19 nt, Human
ccaccugggcuaagccagg

SEQ ID NO: 481039 - RNA, 19 nt, Human
ccacucccggccucagaug

SEQ ID NO: 481040 - RNA, 24 nt, Human
ccagaaaaccccacgcccagccca

SEQ ID NO: 481041 - RNA, 22 nt, Human
ccagaccaggcaggagcggccc

SEQ ID NO: 481042 - RNA, 18 nt, Human
ccagcagaggaguagggc

SEQ ID NO: 481043 - RNA, 18 nt, Human
ccagcccaccagccugcc

SEQ ID NO: 481044 - RNA, 21 nt, Human
ccaggcuauaaugccccugcc

SEQ ID NO: 481045 - RNA, 18 nt, Human
ccaguaccugcgcuccag

SEQ ID NO: 481046 - RNA, 20 nt, Human
ccaugcacccaccauuuccc

SEQ ID NO: 481047 - RNA, 20 nt, Human
cccacacacauauacauaca

SEQ ID NO: 481048 - RNA, 21 nt, Human
cccacacacauauacauacac

SEQ ID NO: 481049 - RNA, 22 nt, Human
cccacacacauauacauacaca

SEQ ID NO: 481050 - RNA, 28 nt, Human
cccacacacauauacauacacacacaca

SEQ ID NO: 481051 - RNA, 19 nt, Human
cccagaaaaccccacgccc

SEQ ID NO: 481052 - RNA, 20 nt, Human
ccccacgcccagcccaccag

SEQ ID NO: 481053 - RNA, 19 nt, Human
ccccagcaggcccagggag

SEQ ID NO: 481054 - RNA, 18 nt, Human
ccccagggcaguacuggg

SEQ ID NO: 481055 - RNA, 21 nt, Human
ccccggaggaacccugaaggc

SEQ ID NO: 481056 - RNA, 20 nt, Human
ccccuccccucaagccagga

SEQ ID NO: 481057 - RNA, 23 nt, Human
ccccugcuggacagcacgccccc

SEQ ID NO: 481058 - RNA, 19 nt, Human
ccccugggcgacaggguca

SEQ ID NO: 481059 - RNA, 21 nt, Human
cccgagagguguuccugggaa

SEQ ID NO: 481060 - RNA, 18 nt, Human
cccucaagccaggaccag

SEQ ID NO: 481061 - RNA, 19 nt, Human
cccugagggcagggcuugg

SEQ ID NO: 481062 - RNA, 21 nt, Human
cccugccacccuggggcucag

SEQ ID NO: 481063 - RNA, 22 nt, Human
cccugcuggacagcacgccccc

SEQ ID NO: 481064 - RNA, 19 nt, Human
cccuggggcuccaccugcu

SEQ ID NO: 481065 - RNA, 21 nt, Human
ccgcccgcuucugccaagccc

SEQ ID NO: 481066 - RNA, 23 nt, Human
ccugccacuccuggccucagaug

SEQ ID NO: 481067 - RNA, 18 nt, Human
ccuggccucagaugccac

SEQ ID NO: 481068 - RNA, 21 nt, Human
ccuggccucagaugccacucc

SEQ ID NO: 481069 - RNA, 18 nt, Human
cgcaggcccagccugggg

SEQ ID NO: 481070 - RNA, 20 nt, Human
cgcccgcuucugccaagccc

SEQ ID NO: 481071 - RNA, 20 nt, Human
cggccucagaugccacuccc

SEQ ID NO: 481072 - RNA, 22 nt, Human
cucacagcccucacaaagggcc

SEQ ID NO: 481073 - RNA, 18 nt, Human
cucagugcccagguggca

SEQ ID NO: 481074 - RNA, 28 nt, Human
cucggugccagggagagccugcucuccc

SEQ ID NO: 481075 - RNA, 21 nt, Human
cucugcccaguucuuaaaagg

SEQ ID NO: 481076 - RNA, 19 nt, Human
cugcagacuugcugggaac

SEQ ID NO: 481077 - RNA, 19 nt, Human
cugccucaaguccagcagc

SEQ ID NO: 481078 - RNA, 20 nt, Human
cugcgcuccagaagcucagg

SEQ ID NO: 481079 - RNA, 19 nt, Human
cugcugcaggcucugccuc

SEQ ID NO: 481080 - RNA, 19 nt, Human
cuugcugggaaccugggac

SEQ ID NO: 481081 - RNA, 19 nt, Human
gaagggggcccgggguccc

SEQ ID NO: 481082 - RNA, 25 nt, Human
gaccaggcaccugcccgauggcuga

SEQ ID NO: 481083 - RNA, 22 nt, Human
gacccgcuaacccacuaauggg

SEQ ID NO: 481084 - RNA, 20 nt, Human
gagcagagggcgggcagagc

SEQ ID NO: 481085 - RNA, 25 nt, Human
gagcaucccccacccagcuguccag

SEQ ID NO: 481086 - RNA, 18 nt, Human
gaggccacagggcagagg

SEQ ID NO: 481087 - RNA, 20 nt, Human
gagggcagggcuugggcagg

SEQ ID NO: 481088 - RNA, 20 nt, Human
gaguagggcuggguaguguc

SEQ ID NO: 481089 - RNA, 21 nt, Human
gauguugacggggccacacca

SEQ ID NO: 481090 - RNA, 19 nt, Human
gcacccagggcagugggga

SEQ ID NO: 481091 - RNA, 18 nt, Human
gcagcccagacccucaca

SEQ ID NO: 481092 - RNA, 23 nt, Human
gcaggccagcaggagcaccugag

SEQ ID NO: 481093 - RNA, 23 nt, Human
gcccgcuucugccaagccccacc

SEQ ID NO: 481094 - RNA, 23 nt, Human
gcccucacaaagggcucgguagc

SEQ ID NO: 481095 - RNA, 25 nt, Human
gcgcagcucacagcccucacaaagg

SEQ ID NO: 481096 - RNA, 22 nt, Human
gcgggcagagcccuugcuccuu

SEQ ID NO: 481097 - RNA, 23 nt, Human
gcggggggugaugggcagaaccu

SEQ ID NO: 481098 - RNA, 20 nt, Human
gcugggcuguggcugauguu

SEQ ID NO: 481099 - RNA, 21 nt, Human
gcuugggcaggccagcaggag

SEQ ID NO: 481100 - RNA, 18 nt, Human
ggacagggagggaggggc

SEQ ID NO: 481101 - RNA, 18 nt, Human
ggacaggugacacgccca

SEQ ID NO: 481102 - RNA, 19 nt, Human
ggacaggugacacgcccac

SEQ ID NO: 481103 - RNA, 20 nt, Human
ggagggaggggcgcccagcc

SEQ ID NO: 481104 - RNA, 19 nt, Human
ggcagagggaauauggggg

SEQ ID NO: 481105 - RNA, 19 nt, Human
ggcagggcuugggcaggcc

SEQ ID NO: 481106 - RNA, 21 nt, Human
ggccagcaggggcggggggug

SEQ ID NO: 481107 - RNA, 22 nt, Human
gggcagagggaauaugggggug

SEQ ID NO: 481108 - RNA, 24 nt, Human
gggcagggcccagaaaaccccacg

SEQ ID NO: 481109 - RNA, 18 nt, Human
gggcuugggcaggccagc

SEQ ID NO: 481110 - RNA, 21 nt, Human
ggguaguguccacacagcugc

SEQ ID NO: 481111 - RNA, 23 nt, Human
gggugcacauccugggcaccagc

SEQ ID NO: 481112 - RNA, 23 nt, Human
gguacaggggcagccuuccuuga

SEQ ID NO: 481113 - RNA, 22 nt, Human
ggucagggaccccaggacugca

SEQ ID NO: 481114 - RNA, 25 nt, Human
gugcacccacacacauauacauaca

SEQ ID NO: 481115 - RNA, 20 nt, Human
uacacacacacacacacaca

SEQ ID NO: 481116 - RNA, 25 nt, Human
uacacacacacacacacacacacac

SEQ ID NO: 481117 - RNA, 26 nt, Human
uacauacacacacacacacacacaca

SEQ ID NO: 481118 - RNA, 20 nt, Human
uaccggggugcaccuuagga

SEQ ID NO: 481119 - RNA, 22 nt, Human
uaccggggugcaccuuaggagc

SEQ ID NO: 481120 - RNA, 19 nt, Human
ucagcuggccagacuccca

SEQ ID NO: 481121 - RNA, 19 nt, Human
uccacacagcugcugcagg

SEQ ID NO: 481122 - RNA, 24 nt, Human
uccacacagcugcugcaggcucug

SEQ ID NO: 481123 - RNA, 23 nt, Human
uccacacccgcccgcuucugcca

SEQ ID NO: 481124 - RNA, 25 nt, Human
ucccagccucagacgcagaugggcc

SEQ ID NO: 481125 - RNA, 21 nt, Human
ucccugagggcagggcuuggg

SEQ ID NO: 481126 - RNA, 23 nt, Human
ucccuggguaggccuggcuccgg

SEQ ID NO: 481127 - RNA, 18 nt, Human
uccugcugucucuggcug

SEQ ID NO: 481128 - RNA, 21 nt, Human
ucuccugcugucucuggcugu

SEQ ID NO: 481129 - RNA, 21 nt, Human
ucucuggcugucagugagacc

SEQ ID NO: 481130 - RNA, 19 nt, Human
ugacuguggccucugccca

SEQ ID NO: 481131 - RNA, 18 nt, Human
ugagggcagggcuugggc

SEQ ID NO: 481132 - RNA, 24 nt, Human
ugaggucagacccgcuaacccacu

SEQ ID NO: 481133 - RNA, 22 nt, Human
ugaggucagacccgcuaacccc

SEQ ID NO: 481134 - RNA, 23 nt, Human
ugagguggccuguccaagguucc

SEQ ID NO: 481135 - RNA, 24 nt, Human
ugcacccacacacauauacauaca

SEQ ID NO: 481136 - RNA, 22 nt, Human
ugcacccaccauuuccccacag

SEQ ID NO: 481137 - RNA, 18 nt, Human
ugccaaggcugcaguucc

SEQ ID NO: 481138 - RNA, 21 nt, Human
ugccacucccagccucagacg

SEQ ID NO: 481139 - RNA, 22 nt, Human
ugcuaagagagcugggggaggu

SEQ ID NO: 481140 - RNA, 22 nt, Human
ugcuuaagacgcacacagaaca

SEQ ID NO: 481141 - RNA, 22 nt, Human
uggacccacacagagccagaag

SEQ ID NO: 481142 - RNA, 21 nt, Human
uggagaaaggagcagaggacu

SEQ ID NO: 481143 - RNA, 20 nt, Human
uggcccagggccuuccaccu

SEQ ID NO: 481144 - RNA, 20 nt, Human
uggccucagaugccacuccc

SEQ ID NO: 481145 - RNA, 22 nt, Human
ugggaaccugggacaggugaca

SEQ ID NO: 481146 - RNA, 24 nt, Human
ugggaugcugcugacccaggagcc

SEQ ID NO: 481147 - RNA, 22 nt, Human
ugggcagaaccuaggggcccca

SEQ ID NO: 481148 - RNA, 24 nt, Human
ugggcgacagggucagggacccca

SEQ ID NO: 481149 - RNA, 23 nt, Human
uggggcugggcuguggcugaugu

SEQ ID NO: 481150 - RNA, 22 nt, Human
uggguaggaaugagcagagggc

SEQ ID NO: 481151 - RNA, 24 nt, Human
uggugugagaucugcagacccacc

SEQ ID NO: 481152 - RNA, 23 nt, Human
uguccacacagcugcugcaggcu

SEQ ID NO: 481153 - RNA, 21 nt, Human
uguccaccaggcuauaaugcc

SEQ ID NO: 481154 - RNA, 22 nt, Human
uguccagucacugccaaggcug

SEQ ID NO: 481155 - RNA, 18 nt, Human
uguggcccagggccuucc

SEQ ID NO: 481156 - RNA, 25 nt, Human
ugugggagguagacaggucucacug

SEQ ID NO: 481157 - RNA, 26 nt, Human
ugugugcacccacacacauauacaua

SEQ ID NO: 481158 - RNA, 21 nt, Human
uguugacggggccacaccagg

SEQ ID NO: 481159 - RNA, 18 nt, Human
uuggacccacacagagcc

SEQ ID NO: 481160 - RNA, 22 nt, Human
uuuuuuuuuuuuuuuuucgcga

SEQ ID NO: 481161 - RNA, 21 nt, Human
uuuuuuuuuuuuuuuuuucgg

SEQ ID NO: 481162 - RNA, 23 nt, Human
aaaaagaaguuaaagcaagaaga

SEQ ID NO: 481163 - RNA, 25 nt, Human
aaacuccaucucaaaaaauaaaaaa

SEQ ID NO: 481164 - RNA, 21 nt, Human
aaagcaagagggccgggcgcu

SEQ ID NO: 481165 - RNA, 19 nt, Human
aacauggugaaacgcuguc

SEQ ID NO: 481166 - RNA, 20 nt, Human
aacauggugaaacgcugucu

SEQ ID NO: 481167 - RNA, 21 nt, Human
aacauggugaaacgcugucuc

SEQ ID NO: 481168 - RNA, 23 nt, Human
aagaucgugccacugcacuccag

SEQ ID NO: 481169 - RNA, 18 nt, Human
aagcaacaauaauacaga

SEQ ID NO: 481170 - RNA, 20 nt, Human
aagcaagaagagagagaggg

SEQ ID NO: 481171 - RNA, 21 nt, Human
aagcucagaagccagggacac

SEQ ID NO: 481172 - RNA, 23 nt, Human
aaucgcuugaaccuggaggugga

SEQ ID NO: 481173 - RNA, 24 nt, Human
aauggcgugaaccugggaggcgga

SEQ ID NO: 481174 - RNA, 20 nt, Human
acagagcgagacuccgucuc

SEQ ID NO: 481175 - RNA, 23 nt, Human
acagagcgagacuccgucucaaa

SEQ ID NO: 481176 - RNA, 24 nt, Human
acagagcgagacuccgucucaaaa

SEQ ID NO: 481177 - RNA, 18 nt, Human
acagagugaaacuccauc

SEQ ID NO: 481178 - RNA, 20 nt, Human
acagagugaaacuccaucuc

SEQ ID NO: 481179 - RNA, 24 nt, Human
acagagugaaacuccaucucaaaa

SEQ ID NO: 481180 - RNA, 21 nt, Human
acagucagacauuacuuuggg

SEQ ID NO: 481181 - RNA, 21 nt, Human
acccccacuccauccuggagg

SEQ ID NO: 481182 - RNA, 21 nt, Human
acccucugcaaaacugcagcc

SEQ ID NO: 481183 - RNA, 24 nt, Human
accgcacuccagccugggcgacag

SEQ ID NO: 481184 - RNA, 26 nt, Human
accgcacuccagccugggcgacagag

SEQ ID NO: 481185 - RNA, 24 nt, Human
acgaggguagaucaugaggucagg

SEQ ID NO: 481186 - RNA, 22 nt, Human
acgcugaguuccacaugccgac

SEQ ID NO: 481187 - RNA, 24 nt, Human
acuccagccugggagacagaguga

SEQ ID NO: 481188 - RNA, 18 nt, Human
acugcacuccagccuggg

SEQ ID NO: 481189 - RNA, 24 nt, Human
acugcacuccagccugggagacag

SEQ ID NO: 481190 - RNA, 18 nt, Human
acuggagccggauguggc

SEQ ID NO: 481191 - RNA, 18 nt, Human
agcacuuugggaggccga

SEQ ID NO: 481192 - RNA, 24 nt, Human
agcacuuugggaggccgaggcggg

SEQ ID NO: 481193 - RNA, 24 nt, Human
agccuggccaacguggugaagccc

SEQ ID NO: 481194 - RNA, 24 nt, Human
agccugggcgacagagcgagacuc

SEQ ID NO: 481195 - RNA, 19 nt, Human
agcgugugccuugccuaca

SEQ ID NO: 481196 - RNA, 22 nt, Human
aggaagcaacaauaauacagaa

SEQ ID NO: 481197 - RNA, 20 nt, Human
aggagaagaggaauccgagc

SEQ ID NO: 481198 - RNA, 24 nt, Human
aggagaagaggaauccgagccgca

SEQ ID NO: 481199 - RNA, 22 nt, Human
aggcaggagaaucgcuugaacc

SEQ ID NO: 481200 - RNA, 24 nt, Human
aggcaggagaaucgcuugaaccug

SEQ ID NO: 481201 - RNA, 22 nt, Human
aggcaggagaauggcgugaacc

SEQ ID NO: 481202 - RNA, 24 nt, Human
aggcaggagaauggcgugaaccug

SEQ ID NO: 481203 - RNA, 24 nt, Human
aggcgagguggugggcgccuguag

SEQ ID NO: 481204 - RNA, 21 nt, Human
aggcggagguugcagugagcc

SEQ ID NO: 481205 - RNA, 24 nt, Human
aggcggagguugcagugagccgag

SEQ ID NO: 481206 - RNA, 26 nt, Human
aggcggguggaccaguugaggucagg

SEQ ID NO: 481207 - RNA, 18 nt, Human
aggcguggcacuggagcc

SEQ ID NO: 481208 - RNA, 20 nt, Human
aggcugaggcaggagaaucg

SEQ ID NO: 481209 - RNA, 24 nt, Human
aggcugaggcaggagaaucgcuug

SEQ ID NO: 481210 - RNA, 19 nt, Human
aggcugaggcaggagaaug

SEQ ID NO: 481211 - RNA, 24 nt, Human
aggugccguggcucacaccuguaa

SEQ ID NO: 481212 - RNA, 24 nt, Human
agguggagguugcagugagccaag

SEQ ID NO: 481213 - RNA, 24 nt, Human
aggugggguggugggcgccuguaa

SEQ ID NO: 481214 - RNA, 19 nt, Human
aguaaaggcgaaggaaagg

SEQ ID NO: 481215 - RNA, 24 nt, Human
aguugaggucaggaguucaagacc

SEQ ID NO: 481216 - RNA, 22 nt, Human
aucacccucugcaaaacugcag

SEQ ID NO: 481217 - RNA, 24 nt, Human
aucgugccacugcacuccagccug

SEQ ID NO: 481218 - RNA, 24 nt, Human
caacguggugaagccccgucucua

SEQ ID NO: 481219 - RNA, 24 nt, Human
caagaccagccuggccaacguggu

SEQ ID NO: 481220 - RNA, 24 nt, Human
cacaccuguaaucccagcacuuug

SEQ ID NO: 481221 - RNA, 24 nt, Human
caccgcacuccagccugggcgaca

SEQ ID NO: 481222 - RNA, 23 nt, Human
caccuguaaucccagcacuuugg

SEQ ID NO: 481223 - RNA, 24 nt, Human
caccuguaaucccagcacuuuggg

SEQ ID NO: 481224 - RNA, 24 nt, Human
cacgccuguaaucccagcacuuug

SEQ ID NO: 481225 - RNA, 22 nt, Human
cacuccagccugggagacagag

SEQ ID NO: 481226 - RNA, 23 nt, Human
cacuccagccugggagacagagu

SEQ ID NO: 481227 - RNA, 24 nt, Human
cacuccagccugggagacagagug

SEQ ID NO: 481228 - RNA, 23 nt, Human
cacuccagccugggcgacagagc

SEQ ID NO: 481229 - RNA, 24 nt, Human
cacuccagccugggcgacagagcg

SEQ ID NO: 481230 - RNA, 18 nt, Human
cacugcacuccagccugg

SEQ ID NO: 481231 - RNA, 19 nt, Human
cacugcacuccagccuggg

SEQ ID NO: 481232 - RNA, 22 nt, Human
cacugcacuccagccugggaga

SEQ ID NO: 481233 - RNA, 24 nt, Human
cacugcacuccagccugggagaca

SEQ ID NO: 481234 - RNA, 24 nt, Human
cacugcacuccagccugggagaca

SEQ ID NO: 481235 - RNA, 18 nt, Human
cagcacuuugggaggccg

SEQ ID NO: 481236 - RNA, 22 nt, Human
cagcacuuugggaggccgaggc

SEQ ID NO: 481237 - RNA, 24 nt, Human
cagcacuuugggaggccgaggcgg

SEQ ID NO: 481238 - RNA, 19 nt, Human
cagcagggacaggcguggc

SEQ ID NO: 481239 - RNA, 24 nt, Human
cagcuacucaggaggcugaggcag

SEQ ID NO: 481240 - RNA, 24 nt, Human
cagcuacuugggaggcugaggcag

SEQ ID NO: 481241 - RNA, 20 nt, Human
cagugcccuccugggacccc

SEQ ID NO: 481242 - RNA, 23 nt, Human
caguugaggucaggaguucaaga

SEQ ID NO: 481243 - RNA, 22 nt, Human
caucgcccuugcucaggagcca

SEQ ID NO: 481244 - RNA, 20 nt, Human
ccaccgcacuccagccuggg

SEQ ID NO: 481245 - RNA, 21 nt, Human
ccaccgcacuccagccugggc

SEQ ID NO: 481246 - RNA, 23 nt, Human
ccaccgcacuccagccugggcga

SEQ ID NO: 481247 - RNA, 23 nt, Human
ccaccgcacuccagccugggcga

SEQ ID NO: 481248 - RNA, 24 nt, Human
ccaccgcacuccagccugggcgac

SEQ ID NO: 481249 - RNA, 19 nt, Human
ccacugcacuccagccugg

SEQ ID NO: 481250 - RNA, 20 nt, Human
ccacugcacuccagccuggg

SEQ ID NO: 481251 - RNA, 22 nt, Human
ccacugcacuccagccugggag

SEQ ID NO: 481252 - RNA, 24 nt, Human
ccacugcacuccagccugggagac

SEQ ID NO: 481253 - RNA, 18 nt, Human
ccaggugggguggugggc

SEQ ID NO: 481254 - RNA, 24 nt, Human
cccacuccauccuggaggggagca

SEQ ID NO: 481255 - RNA, 21 nt, Human
cccccacuccauccuggaggg

SEQ ID NO: 481256 - RNA, 23 nt, Human
cccgcagcagggacaggcguggc

SEQ ID NO: 481257 - RNA, 26 nt, Human
ccuacaguuggggcuggugguggggc

SEQ ID NO: 481258 - RNA, 20 nt, Human
ccuccugggacccucuacca

SEQ ID NO: 481259 - RNA, 18 nt, Human
ccucucccaaguaaaggc

SEQ ID NO: 481260 - RNA, 20 nt, Human
ccuggagguggagguugcag

SEQ ID NO: 481261 - RNA, 23 nt, Human
ccuggccaacguggugaagcccc

SEQ ID NO: 481262 - RNA, 24 nt, Human
ccuggccaacguggugaagccccg

SEQ ID NO: 481263 - RNA, 20 nt, Human
ccuggcuaacauggugaaac

SEQ ID NO: 481264 - RNA, 19 nt, Human
ccugggaggcggagguugc

SEQ ID NO: 481265 - RNA, 22 nt, Human
ccugggcgacagagcgagacuc

SEQ ID NO: 481266 - RNA, 22 nt, Human
ccuguaaucccagcacuuuggg

SEQ ID NO: 481267 - RNA, 21 nt, Human
ccuguaauuccagcuacucag

SEQ ID NO: 481268 - RNA, 22 nt, Human
ccuguaauuccagcuacucagg

SEQ ID NO: 481269 - RNA, 18 nt, Human
ccuguagucccagcuacu

SEQ ID NO: 481270 - RNA, 21 nt, Human
ccuguagucccagcuacuugg

SEQ ID NO: 481271 - RNA, 22 nt, Human
ccuguagucccagcuacuuggg

SEQ ID NO: 481272 - RNA, 24 nt, Human
cgaggcggguggaccaguugaggu

SEQ ID NO: 481273 - RNA, 21 nt, Human
cgaggguagaucaugagguca

SEQ ID NO: 481274 - RNA, 24 nt, Human
cgagguugcgccaccgcacuccag

SEQ ID NO: 481275 - RNA, 24 nt, Human
cgccuguaauuccagcuacucagg

SEQ ID NO: 481276 - RNA, 24 nt, Human
cggguggaccaguugaggucagga

SEQ ID NO: 481277 - RNA, 24 nt, Human
cguggcucacaccuguaaucccag

SEQ ID NO: 481278 - RNA, 24 nt, Human
cucaaaaaauaaaaaaauaaacac

SEQ ID NO: 481279 - RNA, 22 nt, Human
cucacaccuguaaucccagcac

SEQ ID NO: 481280 - RNA, 24 nt, Human
cucacaccuguaaucccagcacuu

SEQ ID NO: 481281 - RNA, 22 nt, Human
cucacgccuguaaucccagcac

SEQ ID NO: 481282 - RNA, 24 nt, Human
cucacgccuguaaucccagcacuu

SEQ ID NO: 481283 - RNA, 19 nt, Human
cuccgucucaaaaaaaaaa

SEQ ID NO: 481284 - RNA, 26 nt, Human
cuccugggacccucuaccacaccauc

SEQ ID NO: 481285 - RNA, 19 nt, Human
cugaguuccacaugccgac

SEQ ID NO: 481286 - RNA, 24 nt, Human
cuggagguggagguugcagugagc

SEQ ID NO: 481287 - RNA, 19 nt, Human
gaagccccgucucuacuaa

SEQ ID NO: 481288 - RNA, 23 nt, Human
gaauacuuuuuauucuugacugu

SEQ ID NO: 481289 - RNA, 20 nt, Human
gacagagugaaacuccaucu

SEQ ID NO: 481290 - RNA, 24 nt, Human
gaccaguugaggucaggaguucaa

SEQ ID NO: 481291 - RNA, 21 nt, Human
gacuacgcugugaaaaccagg

SEQ ID NO: 481292 - RNA, 25 nt, Human
gaggcggguggaccaguugagguca

SEQ ID NO: 481293 - RNA, 23 nt, Human
gagguugcagugagccaagaucg

SEQ ID NO: 481294 - RNA, 23 nt, Human
gagguugcagugagccgagguug

SEQ ID NO: 481295 - RNA, 23 nt, Human
gcacuccagccugggagacagag

SEQ ID NO: 481296 - RNA, 24 nt, Human
gcacuccagccugggcgacagagc

SEQ ID NO: 481297 - RNA, 24 nt, Human
gccaacguggugaagccccgucuc

SEQ ID NO: 481298 - RNA, 20 nt, Human
gccaagaucgugccacugca

SEQ ID NO: 481299 - RNA, 22 nt, Human
gccaccgcacuccagccugggc

SEQ ID NO: 481300 - RNA, 22 nt, Human
gcccuccugggacccucuacca

SEQ ID NO: 481301 - RNA, 18 nt, Human
gccggggaggucggggcg

SEQ ID NO: 481302 - RNA, 23 nt, Human
gccuguaauuccagcuacucagg

SEQ ID NO: 481303 - RNA, 23 nt, Human
gccuguagucccagcuacuuggg

SEQ ID NO: 481304 - RNA, 22 nt, Human
gcgugaaccugggaggcggagg

SEQ ID NO: 481305 - RNA, 18 nt, Human
gcuaacauggugaaacgc

SEQ ID NO: 481306 - RNA, 24 nt, Human
gcuaacauggugaaacgcugucuc

SEQ ID NO: 481307 - RNA, 22 nt, Human
gcugaggcaggagaauggcgug

SEQ ID NO: 481308 - RNA, 21 nt, Human
ggaaaaaccaacagucagagg

SEQ ID NO: 481309 - RNA, 22 nt, Human
ggaccaguugaggucaggaguu

SEQ ID NO: 481310 - RNA, 20 nt, Human
ggagguugcagugagccaag

SEQ ID NO: 481311 - RNA, 24 nt, Human
ggagguugcagugagccaagaucg

SEQ ID NO: 481312 - RNA, 20 nt, Human
ggagguugcagugagccgag

SEQ ID NO: 481313 - RNA, 20 nt, Human
ggagguugcagugagccgag

SEQ ID NO: 481314 - RNA, 24 nt, Human
ggagguugcagugagccgagguug

SEQ ID NO: 481315 - RNA, 21 nt, Human
ggccaggugccguggcucaca

SEQ ID NO: 481316 - RNA, 23 nt, Human
ggcgcuguggcucacgccuguaa

SEQ ID NO: 481317 - RNA, 19 nt, Human
ggguagaucaugaggucag

SEQ ID NO: 481318 - RNA, 25 nt, Human
ggguggaccaguugaggucaggagu

SEQ ID NO: 481319 - RNA, 21 nt, Human
gguagaucaugaggucaggag

SEQ ID NO: 481320 - RNA, 21 nt, Human
gguggaccaguugaggucagg

SEQ ID NO: 481321 - RNA, 23 nt, Human
gguggugggcgccuguaguccca

SEQ ID NO: 481322 - RNA, 24 nt, Human
gguggugggcgccuguagucccag

SEQ ID NO: 481323 - RNA, 20 nt, Human
gucauuuacaggagaagagg

SEQ ID NO: 481324 - RNA, 19 nt, Human
gucucuacuaaaaauacaa

SEQ ID NO: 481325 - RNA, 24 nt, Human
gugaaccugggaggcggagguugc

SEQ ID NO: 481326 - RNA, 22 nt, Human
guggcucacgccuguaauccca

SEQ ID NO: 481327 - RNA, 23 nt, Human
guggugggcgccuguaauuccag

SEQ ID NO: 481328 - RNA, 19 nt, Human
guugcagugagccgagguu

SEQ ID NO: 481329 - RNA, 24 nt, Human
guugcgccaccgcacuccagccug

SEQ ID NO: 481330 - RNA, 20 nt, Human
uaaaauccaaauuaaacagc

SEQ ID NO: 481331 - RNA, 22 nt, Human
uaacauggugaaacgcugucuc

SEQ ID NO: 481332 - RNA, 24 nt, Human
uaacauggugaaacgcugucucua

SEQ ID NO: 481333 - RNA, 24 nt, Human
uaccacaccauccuguuugggcaa

SEQ ID NO: 481334 - RNA, 23 nt, Human
ucagcacggagccugaugcuuag

SEQ ID NO: 481335 - RNA, 23 nt, Human
ucagugcccuccugggacccucu

SEQ ID NO: 481336 - RNA, 24 nt, Human
ucaugaggucaggagauugagacc

SEQ ID NO: 481337 - RNA, 23 nt, Human
uccagccugggcgacagagcgag

SEQ ID NO: 481338 - RNA, 24 nt, Human
uccagccugggcgacagagcgaga

SEQ ID NO: 481339 - RNA, 21 nt, Human
ucccaaguaaaggcgaaggaa

SEQ ID NO: 481340 - RNA, 20 nt, Human
uccccugugaagggaaaaac

SEQ ID NO: 481341 - RNA, 22 nt, Human
uccccugugaagggaaaaacca

SEQ ID NO: 481342 - RNA, 21 nt, Human
uccgucucaaaaaaaaaagaa

SEQ ID NO: 481343 - RNA, 23 nt, Human
ucgcuugaaccuggagguggagg

SEQ ID NO: 481344 - RNA, 23 nt, Human
ucgugccacugcacuccagccug

SEQ ID NO: 481345 - RNA, 18 nt, Human
ucuccagcuugaucaccc

SEQ ID NO: 481346 - RNA, 24 nt, Human
ucucuacuaaaaauacaaaaaauu

SEQ ID NO: 481347 - RNA, 24 nt, Human
ucugcaaaacugcagcccgcagca

SEQ ID NO: 481348 - RNA, 24 nt, Human
ugaaccugggaggcggagguugca

SEQ ID NO: 481349 - RNA, 18 nt, Human
ugacaguucagugcccuc

SEQ ID NO: 481350 - RNA, 24 nt, Human
ugagaccauccuggcuaacauggu

SEQ ID NO: 481351 - RNA, 22 nt, Human
ugagccaagaucgugccacugc

SEQ ID NO: 481352 - RNA, 22 nt, Human
ugagccgagguugcgccaccgc

SEQ ID NO: 481353 - RNA, 18 nt, Human
ugaggaagcaacaauaau

SEQ ID NO: 481354 - RNA, 20 nt, Human
ugaggcaggagaaucgcuug

SEQ ID NO: 481355 - RNA, 24 nt, Human
ugaggcaggagaaucgcuugaacc

SEQ ID NO: 481356 - RNA, 25 nt, Human
ugaggcaggagaaucgcuugaaccu

SEQ ID NO: 481357 - RNA, 23 nt, Human
ugaggcaggagaauggcgugaac

SEQ ID NO: 481358 - RNA, 24 nt, Human
ugaggcaggagaauggcgugaacc

SEQ ID NO: 481359 - RNA, 25 nt, Human
ugaggcaggagaauggcgugaaccu

SEQ ID NO: 481360 - RNA, 21 nt, Human
ugccgacccccacuccauccu

SEQ ID NO: 481361 - RNA, 23 nt, Human
ugccuacaguuggggcugguggu

SEQ ID NO: 481362 - RNA, 24 nt, Human
uggaccaguugaggucaggaguuc

SEQ ID NO: 481363 - RNA, 24 nt, Human
uggccaacguggugaagccccguc

SEQ ID NO: 481364 - RNA, 24 nt, Human
uggcgugaaccugggaggcggagg

SEQ ID NO: 481365 - RNA, 21 nt, Human
uggcucacaccuguaauccca

SEQ ID NO: 481366 - RNA, 22 nt, Human
uggcucacaccuguaaucccag

SEQ ID NO: 481367 - RNA, 24 nt, Human
uggcucacaccuguaaucccagca

SEQ ID NO: 481368 - RNA, 24 nt, Human
uggcucacgccuguaaucccagca

SEQ ID NO: 481369 - RNA, 23 nt, Human
uggcugauucccuugggguuagu

SEQ ID NO: 481370 - RNA, 19 nt, Human
ugggaggccgaggcgggug

SEQ ID NO: 481371 - RNA, 24 nt, Human
ugggaggccgaggcggguggacca

SEQ ID NO: 481372 - RNA, 27 nt, Human
ugggaggccgaucacgaggguagauca

SEQ ID NO: 481373 - RNA, 29 nt, Human
ugggaggcggagguugcagugacaacggu

SEQ ID NO: 481374 - RNA, 24 nt, Human
ugggaggcggagguugcagugagc

SEQ ID NO: 481375 - RNA, 18 nt, Human
ugggaggcugaggcagga

SEQ ID NO: 481376 - RNA, 24 nt, Human
ugggaggcugaggcaggagaaugg

SEQ ID NO: 481377 - RNA, 19 nt, Human
uggugaaacgcugucucua

SEQ ID NO: 481378 - RNA, 21 nt, Human
uggugggcgccuguaauucca

SEQ ID NO: 481379 - RNA, 22 nt, Human
ugguggggcaaggagcagaugg

SEQ ID NO: 481380 - RNA, 24 nt, Human
ugguggggcaaggagcagaugguc

SEQ ID NO: 481381 - RNA, 19 nt, Human
ugugaagggaaaaaccaac

SEQ ID NO: 481382 - RNA, 24 nt, Human
uguggcucacgccuguaaucccag

SEQ ID NO: 481383 - RNA, 22 nt, Human
uuagaaguggaaauguuagaag

SEQ ID NO: 481384 - RNA, 24 nt, Human
uuagccaggcgagguggugggcgc

SEQ ID NO: 481385 - RNA, 24 nt, Human
uuagccaggugggguggugggcgc

SEQ ID NO: 481386 - RNA, 24 nt, Human
uucugucauggucucccucuccca

SEQ ID NO: 481387 - RNA, 23 nt, Human
uugaaccuggagguggagguugc

SEQ ID NO: 481388 - RNA, 22 nt, Human
uugcagugagccaagaucgugc

SEQ ID NO: 481389 - RNA, 22 nt, Human
uugcagugagccgagguugcgc

SEQ ID NO: 481390 - RNA, 18 nt, Human
aacuaaaugcagcucugc

SEQ ID NO: 481391 - RNA, 22 nt, Human
acaacgcuuccuuccuucaaag

SEQ ID NO: 481392 - RNA, 20 nt, Human
ccccaguggaagugaaauug

SEQ ID NO: 481393 - RNA, 18 nt, Human
ccucguucacugcucccc

SEQ ID NO: 481394 - RNA, 21 nt, Human
cgcuuccuuccuucaaaguca

SEQ ID NO: 481395 - RNA, 19 nt, Human
gcuuccuuccuucaaaguc

SEQ ID NO: 481396 - RNA, 19 nt, Human
uccccaguggaagugaaau

SEQ ID NO: 481397 - RNA, 24 nt, Human
ugacuccagucugaagagggugau

SEQ ID NO: 481398 - RNA, 24 nt, Human
ugagccccccucguucacugcucc

SEQ ID NO: 481399 - RNA, 25 nt, Human
uuccaagggcccgccacuaauuccu

SEQ ID NO: 481400 - RNA, 21 nt, Human
aaaguaaauguuugugauucu

SEQ ID NO: 481401 - RNA, 30 nt, Human
aagcagcucacagucggucugccuccccgg

SEQ ID NO: 481402 - RNA, 30 nt, Human; identical to SEQ ID NO: 481401

SEQ ID NO: 481403 - RNA, 20 nt, Human
accagccccgcgccccgacc

SEQ ID NO: 481404 - RNA, 26 nt, Human
accccggacccuccccugaacuuccu

SEQ ID NO: 481405 - RNA, 22 nt, Human
acccggcacccuccccugaacu

SEQ ID NO: 481406 - RNA, 23 nt, Human
agcggcggcccugggaggggccg

SEQ ID NO: 481407 - RNA, 23 nt, Human
agcggcggcccugggaggggccg

SEQ ID NO: 481408 - RNA, 20 nt, Human
aggacccggcacccuccccu

SEQ ID NO: 481409 - RNA, 22 nt, Human
aggaggaagugagguccuggcc

SEQ ID NO: 481410 - RNA, 22 nt, Human
aggaggaagugagguccuggcc

SEQ ID NO: 481411 - RNA, 24 nt, Human
aggcagcugcgggaccuggguggu

SEQ ID NO: 481412 - RNA, 21 nt, Human
aggccccgggaaggaccccgg

SEQ ID NO: 481413 - RNA, 21 nt, Human
agggaggaggcgcgccgcggg

SEQ ID NO: 481414 - RNA, 22 nt, Human
agggaggaggcggcgccgcggg

SEQ ID NO: 481415 - RNA, 22 nt, Human
aggggcagaggaggaagugagg

SEQ ID NO: 481416 - RNA, 24 nt, Human
aggggcagaggaggaagugagguc

SEQ ID NO: 481417 - RNA, 24 nt, Human
aggugggguccgggacagccacgg

SEQ ID NO: 481418 - RNA, 24 nt, Human
aggugggguccgggacagccacgg

SEQ ID NO: 481419 - RNA, 18 nt, Human
caagcagcucacagucgg

SEQ ID NO: 481420 - RNA, 18 nt, Human
caagcagcucacagucgg

SEQ ID NO: 481421 - RNA, 21 nt, Human
cacagaccagccccgcgcccc

SEQ ID NO: 481422 - RNA, 25 nt, Human
cacagcccagccccgcgccccgacc

SEQ ID NO: 481423 - RNA, 21 nt, Human
cacggagggcucugugucccc

SEQ ID NO: 481424 - RNA, 21 nt, Human
cacggagggcucugugucccc

SEQ ID NO: 481425 - RNA, 20 nt, Human
cacugccaucuuucuugcgg

SEQ ID NO: 481426 - RNA, 20 nt, Human
cacugccaucuuucuugcgg

SEQ ID NO: 481427 - RNA, 18 nt, Human
cagcggcagcugcgggac

SEQ ID NO: 481428 - RNA, 20 nt, Human
caggugcugggaggggcagg

SEQ ID NO: 481429 - RNA, 20 nt, Human
caggugcugggaggggcagg

SEQ ID NO: 481430 - RNA, 22 nt, Human
ccaaagccccgccggggugcgc

SEQ ID NO: 481431 - RNA, 22 nt, Human
ccaaagccccgccggggugcgc

SEQ ID NO: 481432 - RNA, 21 nt, Human
ccacugccaucuuucuugcgg

SEQ ID NO: 481433 - RNA, 21 nt, Human
ccacugccaucuuucuugcgg

SEQ ID NO: 481434 - RNA, 20 nt, Human
ccaggccccgggaaggaccc

SEQ ID NO: 481435 - RNA, 19 nt, Human
ccaggcccgggaaggaccc

SEQ ID NO: 481436 - RNA, 20 nt, Human
ccagguggugguucugguuc

SEQ ID NO: 481437 - RNA, 28 nt, Human
cccagccccgcgccccgaccgcgucaca

SEQ ID NO: 481438 - RNA, 22 nt, Human
ccccgggcaccacggagggcuc

SEQ ID NO: 481439 - RNA, 22 nt, Human
ccccgggcaccacggagggcuc

SEQ ID NO: 481440 - RNA, 23 nt, Human
ccccgguggugcguggggggcgg

SEQ ID NO: 481441 - RNA, 23 nt, Human
cccggacccuccccugaacuucc

SEQ ID NO: 481442 - RNA, 19 nt, Human
cccggcacccuccccugaa

SEQ ID NO: 481443 - RNA, 25 nt, Human
cccggcacccuccccugaacuuccc

SEQ ID NO: 481444 - RNA, 18 nt, Human
ccgggacagccacggagc

SEQ ID NO: 481445 - RNA, 18 nt, Human
ccugggugguuccgacac

SEQ ID NO: 481446 - RNA, 22 nt, Human
cgccaggccccgggaaggaccc

SEQ ID NO: 481447 - RNA, 21 nt, Human
cgccaggcccgggaaggaccc

SEQ ID NO: 481448 - RNA, 18 nt, Human
cgccgcggggccacagac

SEQ ID NO: 481449 - RNA, 18 nt, Human
cgcgaggcccccccggug

SEQ ID NO: 481450 - RNA, 24 nt, Human
cgcggccgggcgcucaaaacuccc

SEQ ID NO: 481451 - RNA, 24 nt, Human
cgcggccgggcgcucaaaacuccu

SEQ ID NO: 481452 - RNA, 21 nt, Human
cggcccugggaggggccgggc

SEQ ID NO: 481453 - RNA, 21 nt, Human
cggcccugggaggggccgggc

SEQ ID NO: 481454 - RNA, 24 nt, Human
cggccgguggcgggcggcagggaa

SEQ ID NO: 481455 - RNA, 25 nt, Human
cgggaaggacccggcacccuccccu

SEQ ID NO: 481456 - RNA, 22 nt, Human
cuccagguggugguucugguuc

SEQ ID NO: 481457 - RNA, 21 nt, Human
cuccucgggcuccagguggug

SEQ ID NO: 481458 - RNA, 20 nt, Human
cucgugcacgcugcgcgcgg

SEQ ID NO: 481459 - RNA, 22 nt, Human
cuuccuggcuacucauuuccag

SEQ ID NO: 481460 - RNA, 22 nt, Human
cuuccuggcuacucauuuccag

SEQ ID NO: 481461 - RNA, 18 nt, Human
gaacgggcgcgaccucac

SEQ ID NO: 481462 - RNA, 21 nt, Human
gaagcgucagugacgccgcca

SEQ ID NO: 481463 - RNA, 21 nt, Human
gaagcgucagugacgccgcca

SEQ ID NO: 481464 - RNA, 19 nt, Human
gacggccgcaggaugggga

SEQ ID NO: 481465 - RNA, 19 nt, Human
gacggccgcaggaugggga

SEQ ID NO: 481466 - RNA, 26 nt, Human
gacggccgcaggauggggacaagcag

SEQ ID NO: 481467 - RNA, 26 nt, Human
gacggccgcaggauggggacaagcag

SEQ ID NO: 481468 - RNA, 21 nt, Human
gcccagccccgcgccccgacc

SEQ ID NO: 481469 - RNA, 18 nt, Human
gcccugggaggggccggg

SEQ ID NO: 481470 - RNA, 19 nt, Human
gcgaagcgucagugacgcc

SEQ ID NO: 481471 - RNA, 19 nt, Human
gcgaagcgucagugacgcc

SEQ ID NO: 481472 - RNA, 19 nt, Human
gcgccgcggggccacagac

SEQ ID NO: 481473 - RNA, 23 nt, Human
gcgggcgggggcggugcgaacgg

SEQ ID NO: 481474 - RNA, 18 nt, Human
ggaccagggaggaggcgc

SEQ ID NO: 481475 - RNA, 20 nt, Human
ggcaccacggagggcucugu

SEQ ID NO: 481476 - RNA, 20 nt, Human
ggcaccacggagggcucugu

SEQ ID NO: 481477 - RNA, 18 nt, Human
ggcagaggaggaagugag

SEQ ID NO: 481478 - RNA, 19 nt, Human
ggcagggaagagguggggu

SEQ ID NO: 481479 - RNA, 20 nt, Human
ggcaggggcaggggcagagg

SEQ ID NO: 481480 - RNA, 20 nt, Human
ggcaggggcaggggcagagg

SEQ ID NO: 481481 - RNA, 22 nt, Human
ggcaggggcaggggggaggucc

SEQ ID NO: 481482 - RNA, 22 nt, Human
ggcaggggcaggggggaggucc

SEQ ID NO: 481483 - RNA, 19 nt, Human
ggcccagagguuccggccg

SEQ ID NO: 481484 - RNA, 19 nt, Human
ggcccagagguuccggccg

SEQ ID NO: 481485 - RNA, 21 nt, Human
ggccgguggcgggcggcagga

SEQ ID NO: 481486 - RNA, 19 nt, Human
ggccgguggugggcggcag

SEQ ID NO: 481487 - RNA, 23 nt, Human
ggccgguggugggcggcagagaa

SEQ ID NO: 481488 - RNA, 20 nt, Human
ggcgaucaucugcuuggccu

SEQ ID NO: 481489 - RNA, 19 nt, Human
gggcagaggaggaagugag

SEQ ID NO: 481490 - RNA, 18 nt, Human
gggcggcgcggggcgcgg

SEQ ID NO: 481491 - RNA, 18 nt, Human
gggcggcgcggggcgcgg

SEQ ID NO: 481492 - RNA, 18 nt, Human
gggcgggcugcagggugu

SEQ ID NO: 481493 - RNA, 18 nt, Human
gggcgggcugcagggugu

SEQ ID NO: 481494 - RNA, 19 nt, Human
ggugcgaacgggcgcgacc

SEQ ID NO: 481495 - RNA, 21 nt, Human
gucacagccaaagccccgccg

SEQ ID NO: 481496 - RNA, 21 nt, Human
gucacagccaaagccccgccg

SEQ ID NO: 481497 - RNA, 18 nt, Human
gugggccaggugcuggga

SEQ ID NO: 481498 - RNA, 18 nt, Human
gugggccaggugcuggga

SEQ ID NO: 481499 - RNA, 18 nt, Human
guggugggcggcagagaa

SEQ ID NO: 481500 - RNA, 21 nt, Human
guuccggccgcgaugccguca

SEQ ID NO: 481501 - RNA, 21 nt, Human
guuccggccgcgaugccguca

SEQ ID NO: 481502 - RNA, 25 nt, Human
ucaaaacuccucgugcacgcugcgc

SEQ ID NO: 481503 - RNA, 22 nt, Human
ucauuuccagcgaaguuuaucu

SEQ ID NO: 481504 - RNA, 18 nt, Human
uccccgggcaccacggag

SEQ ID NO: 481505 - RNA, 18 nt, Human
uccccgggcaccacggag

SEQ ID NO: 481506 - RNA, 23 nt, Human
uccccgggcaccacggagggcuc

SEQ ID NO: 481507 - RNA, 23 nt, Human
uccccgggcaccacggagggcuc

SEQ ID NO: 481508 - RNA, 25 nt, Human
uccccgggcaccacggagggcucug

SEQ ID NO: 481509 - RNA, 25 nt, Human
uccccgggcaccacggagggcucug

SEQ ID NO: 481510 - RNA, 20 nt, Human
uccccugaacuuccuggcua

SEQ ID NO: 481511 - RNA, 20 nt, Human
uccccugaacuuccuggcua

SEQ ID NO: 481512 - RNA, 20 nt, Human
uccccugaacuuccuggcua

SEQ ID NO: 481513 - RNA, 20 nt, Human
uccccugaacuuccuggcua

SEQ ID NO: 481514 - RNA, 18 nt, Human
uccucgggcuccaggugg

SEQ ID NO: 481515 - RNA, 19 nt, Human
ucgagggaccagggaggag

SEQ ID NO: 481516 - RNA, 19 nt, Human
ucgagggaccagggaggag

SEQ ID NO: 481517 - RNA, 24 nt, Human
ucgagggaccagggaggaggcggc

SEQ ID NO: 481518 - RNA, 18 nt, Human
ucuugcgggcgggggcgg

SEQ ID NO: 481519 - RNA, 18 nt, Human
ucuugcgggcgggggcgg

SEQ ID NO: 481520 - RNA, 21 nt, Human
ugcguggggggcggcgcgggg

SEQ ID NO: 481521 - RNA, 21 nt, Human
ugcguggggggcggcgcgggg

SEQ ID NO: 481522 - RNA, 22 nt, Human
ugggaggggcaggggcaggggc

SEQ ID NO: 481523 - RNA, 22 nt, Human
ugggaggggcaggggcaggggc

SEQ ID NO: 481524 - RNA, 22 nt, Human
ugggccaggugcugggaggggc

SEQ ID NO: 481525 - RNA, 22 nt, Human
ugggccaggugcugggaggggc

SEQ ID NO: 481526 - RNA, 22 nt, Human
uuaaaguaaauguaugugauuc

SEQ ID NO: 481527 - RNA, 20 nt, Human
uucgagggaccagggaggag

SEQ ID NO: 481528 - RNA, 20 nt, Human
uucgagggaccagggaggag

SEQ ID NO: 481529 - RNA, 21 nt, Human
uugcugcccgugaagaacucg

SEQ ID NO: 481530 - RNA, 18 nt, Human
uuucuugcgggcgggggc

SEQ ID NO: 481531 - RNA, 18 nt, Human
uuucuugcgggcgggggc

SEQ ID NO: 481532 - RNA, 18 nt, Human
uuuuuuuuuuuuuuuuug

SEQ ID NO: 481533 - RNA, 21 nt, Human
agaaaagcaaccaaaaaaagg

SEQ ID NO: 481534 - RNA, 24 nt, Human
aggggugagccuggcccuaaagga

SEQ ID NO: 481535 - RNA, 25 nt, Human
augugguguggacagccugaccugg

SEQ ID NO: 481536 - RNA, 21 nt, Human
cacaacucuccaggcgucucc

SEQ ID NO: 481537 - RNA, 20 nt, Human
cacugugacacaggcagagc

SEQ ID NO: 481538 - RNA, 21 nt, Human
ccaggccuggcugguccccug

SEQ ID NO: 481539 - RNA, 22 nt, Human
cccuggggcguggcgguggggc

SEQ ID NO: 481540 - RNA, 21 nt, Human
cuccucugggcucccaugugg

SEQ ID NO: 481541 - RNA, 22 nt, Human
cuggcccuaaaggaccccucca

SEQ ID NO: 481542 - RNA, 22 nt, Human
cugggggcuguguggggagugg

SEQ ID NO: 481543 - RNA, 19 nt, Human
gccugggggcugugugggg

SEQ ID NO: 481544 - RNA, 22 nt, Human
gcguggcgguggggcugcagug

SEQ ID NO: 481545 - RNA, 20 nt, Human
ggaguggcauccaugugggc

SEQ ID NO: 481546 - RNA, 22 nt, Human
ggcugggcaggccugggggcug

SEQ ID NO: 481547 - RNA, 21 nt, Human
gggcugggcaggccugggggc

SEQ ID NO: 481548 - RNA, 18 nt, Human
gguguggacagccugacc

SEQ ID NO: 481549 - RNA, 23 nt, Human
guggcauccaugugggccucugg

SEQ ID NO: 481550 - RNA, 25 nt, Human
uccccuggggcguggcgguggggcu

SEQ ID NO: 481551 - RNA, 22 nt, Human
ucuccacagcaacggccagucu

SEQ ID NO: 481552 - RNA, 27 nt, Human
ucuccacagcaacggccagucuguccc

SEQ ID NO: 481553 - RNA, 21 nt, Human
ugccaugaggaggugggcugg

SEQ ID NO: 481554 - RNA, 20 nt, Human
ugcccaggguccugcccagg

SEQ ID NO: 481555 - RNA, 18 nt, Human
uggcaaagguugccccag

SEQ ID NO: 481556 - RNA, 20 nt, Human
uggcgugcagauggcgacca

SEQ ID NO: 481557 - RNA, 27 nt, Human
uggcuaaggcgggccccuccuccucug

SEQ ID NO: 481558 - RNA, 19 nt, Human
ugggcagauuuacaaaguc

SEQ ID NO: 481559 - RNA, 20 nt, Human
ugggccucugguccugccca

SEQ ID NO: 481560 - RNA, 21 nt, Human
ugggccucugguccugcccag

SEQ ID NO: 481561 - RNA, 24 nt, Human
ugggcugggcaggccugggggcug

SEQ ID NO: 481562 - RNA, 18 nt, Human
ugggggcuguguggggag

SEQ ID NO: 481563 - RNA, 25 nt, Human
ugguccugcccaggguccugcccag

SEQ ID NO: 481564 - RNA, 24 nt, Human
ugugacacaggcagagccggcuca

SEQ ID NO: 481565 - RNA, 24 nt, Human
uuagaaaagcaaccaaaaaaaggg

SEQ ID NO: 481566 - RNA, 20 nt, Human
uucacauggcuaaggcgggc

SEQ ID NO: 481567 - RNA, 18 nt, Human
aggcaggccccauccgcc

SEQ ID NO: 481568 - RNA, 23 nt, Human
cauccgccaguacauccugggcu

SEQ ID NO: 481569 - RNA, 18 nt, Human
ccauccgccaguacaucc

SEQ ID NO: 481570 - RNA, 22 nt, Human
ccccggggugcaggcaggcccc

SEQ ID NO: 481571 - RNA, 20 nt, Human
ccgccaguacauccugggcu

SEQ ID NO: 481572 - RNA, 19 nt, Human
ccuaaguugaggcagcccc

SEQ ID NO: 481573 - RNA, 21 nt, Human
cuuagccccgccuuugggagc

SEQ ID NO: 481574 - RNA, 18 nt, Human
cuugggauccccgggucc

SEQ ID NO: 481575 - RNA, 19 nt, Human
gaggcagccccucuuggga

SEQ ID NO: 481576 - RNA, 25 nt, Human
ggcaagcucuagcuccucuuagccc

SEQ ID NO: 481577 - RNA, 18 nt, Human
uccaugaaggaggcuccu

SEQ ID NO: 481578 - RNA, 23 nt, Human
ugaggcaagcucuagcuccucuu

SEQ ID NO: 481579 - RNA, 19 nt, Human
aaggcaggcaagggcacug

SEQ ID NO: 481580 - RNA, 21 nt, Human
aggccuggaaccccgggggug

SEQ ID NO: 481581 - RNA, 19 nt, Human
caggcaagggcacugcaca

SEQ ID NO: 481582 - RNA, 20 nt, Human
caugccaggccuggaacccc

SEQ ID NO: 481583 - RNA, 21 nt, Human
cccggggguggcccggguggg

SEQ ID NO: 481584 - RNA, 22 nt, Human
cccugaaccaugccaggccugg

SEQ ID NO: 481585 - RNA, 22 nt, Human
ccggggguggcccgggugggcc

SEQ ID NO: 481586 - RNA, 25 nt, Human
ccuggaaccccggggguggcccggg

SEQ ID NO: 481587 - RNA, 19 nt, Human
ccuugaguccuuuaugcug

SEQ ID NO: 481588 - RNA, 18 nt, Human
cuggugggcagaggcugu

SEQ ID NO: 481589 - RNA, 21 nt, Human
cuucaaggaacaugcuggugg

SEQ ID NO: 481590 - RNA, 18 nt, Human
gagaaaaggagggucccc

SEQ ID NO: 481591 - RNA, 27 nt, Human
gagacaaggccaggcggcuuuauugaa

SEQ ID NO: 481592 - RNA, 19 nt, Human
gcccugaaccaugccaggc

SEQ ID NO: 481593 - RNA, 22 nt, Human
ggccuggaaccccggggguggc

SEQ ID NO: 481594 - RNA, 19 nt, Human
gggauggggagaaaaggag

SEQ ID NO: 481595 - RNA, 22 nt, Human
gguaaggcaggcaagggcacug

SEQ ID NO: 481596 - RNA, 25 nt, Human
ugccaggccuggaaccccgggggug

SEQ ID NO: 481597 - RNA, 22 nt, Human
uggcccgggugggccucggcgg

SEQ ID NO: 481598 - RNA, 18 nt, Human
uggggagaaaaggagggc

SEQ ID NO: 481599 - RNA, 19 nt, Human
uggggguaaggcaggcaag

SEQ ID NO: 481600 - RNA, 24 nt, Human
uuauugaaaaaguggugguggggg

SEQ ID NO: 481601 - RNA, 26 nt, Human
uuuuuuuuuuugacagagacaaggcc

SEQ ID NO: 481602 - RNA, 22 nt, Human
uuuuuuuuuuuuuuuuugacag

SEQ ID NO: 481603 - RNA, 27 nt, Human
uuuuuuuuuuuuuuuuuuuuuuugggg

SEQ ID NO: 481604 - RNA, 19 nt, Human
aagccaacauugaggccag

SEQ ID NO: 481605 - RNA, 20 nt, Human
agaaguagucugggggcugc

SEQ ID NO: 481606 - RNA, 21 nt, Human
aggagguaaggaugagggugg

SEQ ID NO: 481607 - RNA, 20 nt, Human
aguagucugggggcugcugg

SEQ ID NO: 481608 - RNA, 18 nt, Human
aucaugccacuggggggu

SEQ ID NO: 481609 - RNA, 18 nt, Human
auugaggccagguguuuu

SEQ ID NO: 481610 - RNA, 24 nt, Human
caacagauauucccuccuggagcc

SEQ ID NO: 481611 - RNA, 25 nt, Human
caccacaccccugggcacccuuggc

SEQ ID NO: 481612 - RNA, 21 nt, Human
cacccuuggcuuucaggaccc

SEQ ID NO: 481613 - RNA, 19 nt, Human
cagggaacucccuaccucc

SEQ ID NO: 481614 - RNA, 21 nt, Human
cauucaucaugccacuggggg

SEQ ID NO: 481615 - RNA, 24 nt, Human
cauucaucaugccacugggggguu

SEQ ID NO: 481616 - RNA, 19 nt, Human
cauugaggccagguguuuu

SEQ ID NO: 481617 - RNA, 24 nt, Human
ccugggcacccuuggcuuucagga

SEQ ID NO: 481618 - RNA, 19 nt, Human
cugcagccugggucuggcu

SEQ ID NO: 481619 - RNA, 19 nt, Human
cuugcucacacugaggaac

SEQ ID NO: 481620 - RNA, 18 nt, Human
gagacaccacaccccugg

SEQ ID NO: 481621 - RNA, 21 nt, Human
gagcaggucuucuccaggcag

SEQ ID NO: 481622 - RNA, 22 nt, Human
gcagcugagagcaggucuucuc

SEQ ID NO: 481623 - RNA, 19 nt, Human
gcaggucuucuccaggcag

SEQ ID NO: 481624 - RNA, 23 nt, Human
ggaggcuccugggggaggccugc

SEQ ID NO: 481625 - RNA, 25 nt, Human
ggagguaaggaugagggugggcagg

SEQ ID NO: 481626 - RNA, 22 nt, Human
uaacaagccaacauugaggcca

SEQ ID NO: 481627 - RNA, 19 nt, Human
uaccucccagaggucugga

SEQ ID NO: 481628 - RNA, 18 nt, Human
uaggaggagguaaggaug

SEQ ID NO: 481629 - RNA, 26 nt, Human
uccauccuggaggcuccugggggagg

SEQ ID NO: 481630 - RNA, 21 nt, Human
ucccagaggucuggagagacc

SEQ ID NO: 481631 - RNA, 20 nt, Human
ucuccaggcagcuugaguag

SEQ ID NO: 481632 - RNA, 23 nt, Human
ugaggaacggugggcagcugaga

SEQ ID NO: 481633 - RNA, 19 nt, Human
uggaagggguccagccauc

SEQ ID NO: 481634 - RNA, 19 nt, Human
uucagggauagaaguaguc

SEQ ID NO: 481635 - RNA, 25 nt, Human
uugaggccagguguuuucagggaua

SEQ ID NO: 481636 - RNA, 24 nt, Human
aagaaucauuggaauuuuuggggg

SEQ ID NO: 481637 - RNA, 22 nt, Human
aagauaccgcucugggucucac

SEQ ID NO: 481638 - RNA, 22 nt, Human
aaggggaucuggggcuuuuggg

SEQ ID NO: 481639 - RNA, 23 nt, Human
aaggggaucuggggcuuuugggc

SEQ ID NO: 481640 - RNA, 24 nt, Human
aaggggaucuggggcuuuugggcu

SEQ ID NO: 481641 - RNA, 21 nt, Human
agaaucauuggaauuuuuggg

SEQ ID NO: 481642 - RNA, 25 nt, Human
agcucagccuccuuaucuucuccaa

SEQ ID NO: 481643 - RNA, 24 nt, Human
aggucacagggacuuaggacuacg

SEQ ID NO: 481644 - RNA, 20 nt, Human
agguggagagggucuggagc

SEQ ID NO: 481645 - RNA, 20 nt, Human
auaaaguauaauuugucccc

SEQ ID NO: 481646 - RNA, 18 nt, Human
auccacagacucuuccuu

SEQ ID NO: 481647 - RNA, 24 nt, Human
aucuucuccagcacuccuuugcca

SEQ ID NO: 481648 - RNA, 18 nt, Human
auuuccauccacagacuc

SEQ ID NO: 481649 - RNA, 19 nt, Human
caagauggccccuccuccc

SEQ ID NO: 481650 - RNA, 27 nt, Human
caaugcccucccucccgccugcccucc

SEQ ID NO: 481651 - RNA, 21 nt, Human
caccucuuccugccucucuug

SEQ ID NO: 481652 - RNA, 25 nt, Human
ccagcacuccuuugccaccucuucc

SEQ ID NO: 481653 - RNA, 22 nt, Human
ccagucucaagauggccccucc

SEQ ID NO: 481654 - RNA, 23 nt, Human
ccagucucaagauggccccuccu

SEQ ID NO: 481655 - RNA, 22 nt, Human
cccauccuggcaaagauaccgc

SEQ ID NO: 481656 - RNA, 23 nt, Human
cccaugcacagcgccgcaugcca

SEQ ID NO: 481657 - RNA, 25 nt, Human
cccaugcacagcgccgcaugccaau

SEQ ID NO: 481658 - RNA, 23 nt, Human
ccccuccucccugcucccugucg

SEQ ID NO: 481659 - RNA, 21 nt, Human
ccucccucccgccugcccucc

SEQ ID NO: 481660 - RNA, 22 nt, Human
ccuggcaaagauaccgcucugg

SEQ ID NO: 481661 - RNA, 28 nt, Human
ccuuugccaccucuuccugccucucuug

SEQ ID NO: 481662 - RNA, 21 nt, Human
cuccagcacuccuuugccacc

SEQ ID NO: 481663 - RNA, 21 nt, Human
cucccacgcuuccuauuucca

SEQ ID NO: 481664 - RNA, 20 nt, Human
cuccuuugccaccucuuccu

SEQ ID NO: 481665 - RNA, 23 nt, Human
cugaaccuuuugauacccaacag

SEQ ID NO: 481666 - RNA, 24 nt, Human
gaauuuuuggggguggcaacugga

SEQ ID NO: 481667 - RNA, 24 nt, Human
gacucuuccuucuuaaccuaguuc

SEQ ID NO: 481668 - RNA, 21 nt, Human
gacuuaggacuacgugaagug

SEQ ID NO: 481669 - RNA, 19 nt, Human
ggacccucccacgcuuccu

SEQ ID NO: 481670 - RNA, 19 nt, Human
ggaggggugggguggagcu

SEQ ID NO: 481671 - RNA, 21 nt, Human
ggcaggucacagggacuuagg

SEQ ID NO: 481672 - RNA, 19 nt, Human
gguggagagggucuggagc

SEQ ID NO: 481673 - RNA, 24 nt, Human
guggagcucgcagggcaccagucu

SEQ ID NO: 481674 - RNA, 27 nt, Human
uauuuucacccaaggggaagcugggga

SEQ ID NO: 481675 - RNA, 24 nt, Human
uccacagacucuuccuucuuaacc

SEQ ID NO: 481676 - RNA, 19 nt, Human
ucccgccugcccucccucu

SEQ ID NO: 481677 - RNA, 21 nt, Human
ucugaaccuuuugauacccaa

SEQ ID NO: 481678 - RNA, 19 nt, Human
ucugcagacgcccccaucc

SEQ ID NO: 481679 - RNA, 22 nt, Human
ucugcagacgcccccauccugg

SEQ ID NO: 481680 - RNA, 19 nt, Human
ugaaaagaugucaagaauc

SEQ ID NO: 481681 - RNA, 20 nt, Human
ugaagucugggcuguucaug

SEQ ID NO: 481682 - RNA, 21 nt, Human
uggagcucgcagggcaccagu

SEQ ID NO: 481683 - RNA, 22 nt, Human
uggagcucgcagggcaccaguc

SEQ ID NO: 481684 - RNA, 20 nt, Human
uggccccuccucccugcucc

SEQ ID NO: 481685 - RNA, 25 nt, Human
uuggggguggcaacuggacccuccc

SEQ ID NO: 481686 - RNA, 21 nt, Human
uuuagggaguacaagugcggu

SEQ ID NO: 481687 - RNA, 20 nt, Human
uuuguccccuuaccgggaga

SEQ ID NO: 481688 - RNA, 21 nt, Human
uuuuguugauuugcauccuuu

SEQ ID NO: 481689 - RNA, 19 nt, Human
uuuuuuuuuuuuuuguuga

SEQ ID NO: 481690 - RNA, 19 nt, Human
aagacaucugacugugaaa

SEQ ID NO: 481691 - RNA, 24 nt, Human
acaauaaaggguccacauguuaga

SEQ ID NO: 481692 - RNA, 22 nt, Human
agacaucugacugugaaacgac

SEQ ID NO: 481693 - RNA, 22 nt, Human
agguggggcacuggucuucuug

SEQ ID NO: 481694 - RNA, 23 nt, Human
auaaaggguccacauguuagaac

SEQ ID NO: 481695 - RNA, 20 nt, Human
caacagaaaggaaaacaggg

SEQ ID NO: 481696 - RNA, 23 nt, Human
caacauaucucaagacaucugac

SEQ ID NO: 481697 - RNA, 18 nt, Human
cacgguuaccuccccagc

SEQ ID NO: 481698 - RNA, 21 nt, Human
cagcaauaccguaacuuccaa

SEQ ID NO: 481699 - RNA, 20 nt, Human
caggugcagguggcggugau

SEQ ID NO: 481700 - RNA, 23 nt, Human
caucuuguccacuuggaggauua

SEQ ID NO: 481701 - RNA, 19 nt, Human
cauuacacugguggcagac

SEQ ID NO: 481702 - RNA, 21 nt, Human
ccuacuaagauaaaagguggg

SEQ ID NO: 481703 - RNA, 23 nt, Human
ccuccccagcaauaccguaacuu

SEQ ID NO: 481704 - RNA, 18 nt, Human
cuaagauaaaaggugggg

SEQ ID NO: 481705 - RNA, 21 nt, Human
cuuccaaagggagcacauuug

SEQ ID NO: 481706 - RNA, 19 nt, Human
cuuuugguggaugcugcug

SEQ ID NO: 481707 - RNA, 19 nt, Human
gaacauuugagccuacuaa

SEQ ID NO: 481708 - RNA, 25 nt, Human
gauacauuacacugguggcagacuc

SEQ ID NO: 481709 - RNA, 23 nt, Human
ggaaaacagggcuuuuuggccug

SEQ ID NO: 481710 - RNA, 18 nt, Human
ggagcacauuugucacca

SEQ ID NO: 481711 - RNA, 20 nt, Human
gggaaagcaacagaaaggaa

SEQ ID NO: 481712 - RNA, 18 nt, Human
gggagcacauuugucacc

SEQ ID NO: 481713 - RNA, 18 nt, Human
gguggugguuguccucgu

SEQ ID NO: 481714 - RNA, 21 nt, Human
uaaauagaggguugcuugggg

SEQ ID NO: 481715 - RNA, 20 nt, Human
uacacugguggcagacuccu

SEQ ID NO: 481716 - RNA, 18 nt, Human
uaccuccccagcaauacc

SEQ ID NO: 481717 - RNA, 18 nt, Human
uagacaauaaagggucca

SEQ ID NO: 481718 - RNA, 21 nt, Human
uagcauucuggggacuuaggg

SEQ ID NO: 481719 - RNA, 27 nt, Human
uagcauucuggggacuuaggguauguu

SEQ ID NO: 481720 - RNA, 20 nt, Human
ucacgguuaccuccccagca

SEQ ID NO: 481721 - RNA, 26 nt, Human
ucccugugcuuccugaacauuugagc

SEQ ID NO: 481722 - RNA, 20 nt, Human
uccuuaggauuagguaaaua

SEQ ID NO: 481723 - RNA, 27 nt, Human
ucuguaacucaacugcuuuccggccgc

SEQ ID NO: 481724 - RNA, 18 nt, Human
ugaaacgacagcaugucc

SEQ ID NO: 481725 - RNA, 18 nt, Human
uggccuggggacaucuug

SEQ ID NO: 481726 - RNA, 21 nt, Human
uggggaaaaggcccaggugca

SEQ ID NO: 481727 - RNA, 22 nt, Human
uggggacaucuuguccacuugg

SEQ ID NO: 481728 - RNA, 19 nt, Human
ugugagcaguagucacggu

SEQ ID NO: 481729 - RNA, 22 nt, Human
uuacacugguggcagacuccuc

SEQ ID NO: 481730 - RNA, 18 nt, Human
uucuuggugucgcccauc

SEQ ID NO: 481731 - RNA, 20 nt, Human
uuggaaaagugacuuuuggu

SEQ ID NO: 481732 - RNA, 24 nt, Human
uuggggaaaaggcccaggugcagg

SEQ ID NO: 481733 - RNA, 18 nt, Human
uuuuuuuagcuacaucuu

SEQ ID NO: 481734 - RNA, 19 nt, Human
agugggcuggguggugggg

SEQ ID NO: 481735 - RNA, 22 nt, Human
cagugggcugggugguggggga

SEQ ID NO: 481736 - RNA, 25 nt, Human
caucgggccugggcaggacaucauc

SEQ ID NO: 481737 - RNA, 20 nt, Human
cauugagcccucucaggcca

SEQ ID NO: 481738 - RNA, 23 nt, Human
cccccggcuucagcgcggcuccc

SEQ ID NO: 481739 - RNA, 22 nt, Human
ccccgcaccgucgccucgugcc

SEQ ID NO: 481740 - RNA, 19 nt, Human
cccugcucccaucccgcug

SEQ ID NO: 481741 - RNA, 23 nt, Human
ccgcgcgccccgcaccgucgccu

SEQ ID NO: 481742 - RNA, 19 nt, Human
ccggcuucagcgcggcucc

SEQ ID NO: 481743 - RNA, 23 nt, Human
cgcccccggcuucagcgcggcuc

SEQ ID NO: 481744 - RNA, 24 nt, Human
cuccgcgcuggucccgcccccggc

SEQ ID NO: 481745 - RNA, 24 nt, Human
gagcagaguugcuugcaggguccu

SEQ ID NO: 481746 - RNA, 18 nt, Human
gcagugggcuggguggug

SEQ ID NO: 481747 - RNA, 19 nt, Human
gccgccgggggacccugcu

SEQ ID NO: 481748 - RNA, 18 nt, Human
gccuggucacagagcaga

SEQ ID NO: 481749 - RNA, 21 nt, Human
gcuggcccgucgcccgcgcgc

SEQ ID NO: 481750 - RNA, 18 nt, Human
gcuggucccgcccccggc

SEQ ID NO: 481751 - RNA, 22 nt, Human
gcuugcaggguccuaguggcca

SEQ ID NO: 481752 - RNA, 19 nt, Human
ggcccgucgcccgcgcgcc

SEQ ID NO: 481753 - RNA, 25 nt, Human
gggcuggguggugggggagaggguu

SEQ ID NO: 481754 - RNA, 24 nt, Human
gguggugggggagaggguugaaag

SEQ ID NO: 481755 - RNA, 20 nt, Human
ucagaauaaagucucauuuc

SEQ ID NO: 481756 - RNA, 18 nt, Human
uccauugagcccucucag

SEQ ID NO: 481757 - RNA, 20 nt, Human
uccauugagcccucucaggc

SEQ ID NO: 481758 - RNA, 21 nt, Human
uccuaguggccaucgggccug

SEQ ID NO: 481759 - RNA, 24 nt, Human
ucucuguucuuuuuaauaauuuca

SEQ ID NO: 481760 - RNA, 20 nt, Human
uggguggugggggagagggu

SEQ ID NO: 481761 - RNA, 19 nt, Human
uuggguccccgagggucca

SEQ ID NO: 481762 - RNA, 19 nt, Human
uuggguccccgagggucca

SEQ ID NO: 481763 - RNA, 18 nt, Human
uuuuuuuuuuuuuuuuug

SEQ ID NO: 481764 - RNA, 22 nt, Human
agaugucagggcuaagggugcu

SEQ ID NO: 481765 - RNA, 20 nt, Human
uaagggugcuuggaauuaaa

SEQ ID NO: 481766 - RNA, 20 nt, Human
ucacugcauuuugcuuaggu

SEQ ID NO: 481767 - RNA, 22 nt, Human
uguggccccaaagcuugacaga

SEQ ID NO: 481768 - RNA, 25 nt, Human
aaacucggagaaacccgaaccagaa

SEQ ID NO: 481769 - RNA, 18 nt, Human
accccgcucggcgcccgg

SEQ ID NO: 481770 - RNA, 21 nt, Human
agcaaaacucggagaaacccg

SEQ ID NO: 481771 - RNA, 23 nt, Human
agcggggcccccagaccccaggg

SEQ ID NO: 481772 - RNA, 19 nt, Human
aggguucugccugggccuc

SEQ ID NO: 481773 - RNA, 21 nt, Human
caccccagcggggcccccaga

SEQ ID NO: 481774 - RNA, 21 nt, Human
caccucgcucugcuggccggc

SEQ ID NO: 481775 - RNA, 21 nt, Human
cagagucacaggacgcuucug

SEQ ID NO: 481776 - RNA, 19 nt, Human
cagcggggcccccagaccc

SEQ ID NO: 481777 - RNA, 21 nt, Human
caggguccaugcaggguuccu

SEQ ID NO: 481778 - RNA, 28 nt, Human
ccaaagccgugggcggcaccaagccccg

SEQ ID NO: 481779 - RNA, 21 nt, Human
ccagcccgcccggcucccggc

SEQ ID NO: 481780 - RNA, 21 nt, Human
ccagcgaguguccuguaacaa

SEQ ID NO: 481781 - RNA, 27 nt, Human
cccagcgccuccgcccccggccccggc

SEQ ID NO: 481782 - RNA, 20 nt, Human
ccccagaccccagggccaaa

SEQ ID NO: 481783 - RNA, 23 nt, Human
ccccagcgccuccgcccccggcc

SEQ ID NO: 481784 - RNA, 23 nt, Human
ccccagcgccuccgcccccggcc

SEQ ID NO: 481785 - RNA, 25 nt, Human
ccccagcgccuccgcccccggcccg

SEQ ID NO: 481786 - RNA, 28 nt, Human
ccccagggccaaagccgugggcggcacc

SEQ ID NO: 481787 - RNA, 21 nt, Human
cccccagaccccagggccaaa

SEQ ID NO: 481788 - RNA, 24 nt, Human
cccccagcgaguguccuguaacaa

SEQ ID NO: 481789 - RNA, 27 nt, Human
cccccagcgccuccgcccccggcccgc

SEQ ID NO: 481790 - RNA, 18 nt, Human
cccccggccccggccccg

SEQ ID NO: 481791 - RNA, 22 nt, Human
cccccggccccggccccggccc

SEQ ID NO: 481792 - RNA, 18 nt, Human
cccccggcccgcgucccc

SEQ ID NO: 481793 - RNA, 21 nt, Human
cccccggcccgcguccccagc

SEQ ID NO: 481794 - RNA, 26 nt, Human
ccccggccccggccccggcccccagc

SEQ ID NO: 481795 - RNA, 21 nt, Human
cccgcgggcaucgcccgggcg

SEQ ID NO: 481796 - RNA, 21 nt, Human
cccggccccggcccccagcgc

SEQ ID NO: 481797 - RNA, 21 nt, Human
cccggccccggcccccagcgc

SEQ ID NO: 481798 - RNA, 19 nt, Human
cccggcucccggccgcggc

SEQ ID NO: 481799 - RNA, 24 nt, Human
cccggcucccggccgcggcucgac

SEQ ID NO: 481800 - RNA, 25 nt, Human
ccgcccccggccccggccccggccc

SEQ ID NO: 481801 - RNA, 19 nt, Human
ccgccggcaagggcacagg

SEQ ID NO: 481802 - RNA, 20 nt, Human
ccgcgguggcugcaaccugc

SEQ ID NO: 481803 - RNA, 20 nt, Human
ccggcagcuacuccugcuuc

SEQ ID NO: 481804 - RNA, 20 nt, Human
ccggccccggcccccagcgc

SEQ ID NO: 481805 - RNA, 20 nt, Human
ccggccccggcccccagcgc

SEQ ID NO: 481806 - RNA, 25 nt, Human
ccggccccggcccccagcgccuccg

SEQ ID NO: 481807 - RNA, 25 nt, Human
ccggccccggcccccagcgccuccg

SEQ ID NO: 481808 - RNA, 22 nt, Human
ccggcccgcguccccagcccgc

SEQ ID NO: 481809 - RNA, 26 nt, Human
ccuccaccccagcggggcccccagac

SEQ ID NO: 481810 - RNA, 22 nt, Human
ccuccgcccccggccccggccc

SEQ ID NO: 481811 - RNA, 18 nt, Human
ccuccgcccccggcccgc

SEQ ID NO: 481812 - RNA, 18 nt, Human
ccugcuucgcugggcaga

SEQ ID NO: 481813 - RNA, 23 nt, Human
ccugggccgucauccuccccggg

SEQ ID NO: 481814 - RNA, 20 nt, Human
ccuguaacaacgcggggccu

SEQ ID NO: 481815 - RNA, 21 nt, Human
cgcccccggccccggccccgg

SEQ ID NO: 481816 - RNA, 24 nt, Human
cgccggcaagggcacagggccccc

SEQ ID NO: 481817 - RNA, 24 nt, Human
cgccuccgcccccggccccggccc

SEQ ID NO: 481818 - RNA, 28 nt, Human
cgccuccgcccccggccccggccccggc

SEQ ID NO: 481819 - RNA, 23 nt, Human
cgccuccgcccccggcccgcguc

SEQ ID NO: 481820 - RNA, 21 nt, Human
cggaaagggugguggcuggaa

SEQ ID NO: 481821 - RNA, 22 nt, Human
cggauggaggcucguggggccc

SEQ ID NO: 481822 - RNA, 23 nt, Human
cggcccccagcgccuccgccccc

SEQ ID NO: 481823 - RNA, 21 nt, Human
cggcuccggcucgcccggcgg

SEQ ID NO: 481824 - RNA, 23 nt, Human
cgggaggcugacccaguugcccg

SEQ ID NO: 481825 - RNA, 22 nt, Human
cgguggcugcaaccugccgccg

SEQ ID NO: 481826 - RNA, 26 nt, Human
cuccaccccagcggggcccccagacc

SEQ ID NO: 481827 - RNA, 23 nt, Human
cucccggccgcggcucgacuccc

SEQ ID NO: 481828 - RNA, 26 nt, Human
cucggcgcccggccccggccccggcc

SEQ ID NO: 481829 - RNA, 25 nt, Human
cugacccaguugcccgcacagccuc

SEQ ID NO: 481830 - RNA, 19 nt, Human
cuggaaggggaggguggug

SEQ ID NO: 481831 - RNA, 24 nt, Human
gccccuuagugaggugucaccucu

SEQ ID NO: 481832 - RNA, 26 nt, Human
gcccggccccggccccggcccccagc

SEQ ID NO: 481833 - RNA, 25 nt, Human
gcggcgcggucaccgcggaccccgc

SEQ ID NO: 481834 - RNA, 20 nt, Human
gcggggcccccagaccccag

SEQ ID NO: 481835 - RNA, 20 nt, Human
gcucguggggcccggcagcu

SEQ ID NO: 481836 - RNA, 19 nt, Human
gcuggccggcggcgucccc

SEQ ID NO: 481837 - RNA, 20 nt, Human
ggaaagggugguggcuggaa

SEQ ID NO: 481838 - RNA, 18 nt, Human
ggaggcgacggcggcggc

SEQ ID NO: 481839 - RNA, 19 nt, Human
ggcagagaaccagggccug

SEQ ID NO: 481840 - RNA, 22 nt, Human
ggcagcaccucgcucugcuggc

SEQ ID NO: 481841 - RNA, 22 nt, Human
ggcccccagcgccuccgccccc

SEQ ID NO: 481842 - RNA, 22 nt, Human
ggccccggcccccagcgccucc

SEQ ID NO: 481843 - RNA, 22 nt, Human
ggccccggcccccagcgccucc

SEQ ID NO: 481844 - RNA, 19 nt, Human
ggccggcagcaccucgcuc

SEQ ID NO: 481845 - RNA, 20 nt, Human
ggccggcggcguccccgcgg

SEQ ID NO: 481846 - RNA, 19 nt, Human
ggcgacggcggcggccucu

SEQ ID NO: 481847 - RNA, 21 nt, Human
ggcuggaaggggaggguggug

SEQ ID NO: 481848 - RNA, 18 nt, Human
gggcacagggcccccagc

SEQ ID NO: 481849 - RNA, 21 nt, Human
gggcagagaaccagggccugg

SEQ ID NO: 481850 - RNA, 20 nt, Human
guaacaacgcggggccugaa

SEQ ID NO: 481851 - RNA, 23 nt, Human
ucccacagacgcggcuucucucc

SEQ ID NO: 481852 - RNA, 20 nt, Human
uccccagcccgcccggcucc

SEQ ID NO: 481853 - RNA, 21 nt, Human
ucgcugggcagagaaccaggg

SEQ ID NO: 481854 - RNA, 21 nt, Human
ucucuggcgggugcccggucu

SEQ ID NO: 481855 - RNA, 18 nt, Human
uggaaggggaggguggug

SEQ ID NO: 481856 - RNA, 19 nt, Human
uggcuggaaggggagggug

SEQ ID NO: 481857 - RNA, 19 nt, Human
ugggaaggcccgagcggaa

SEQ ID NO: 481858 - RNA, 21 nt, Human
ugggcagagaaccagggccuc

SEQ ID NO: 481859 - RNA, 20 nt, Human
ugguggcuggaaggggaggg

SEQ ID NO: 481860 - RNA, 24 nt, Human
auacacauauauauauauauauau

SEQ ID NO: 481861 - RNA, 19 nt, Human
auauauauauauauauaua

SEQ ID NO: 481862 - RNA, 19 nt, Human
auauauauauauauauaua

SEQ ID NO: 481863 - RNA, 19 nt, Human
auauauauauauauauaua

SEQ ID NO: 481864 - RNA, 19 nt, Human
auauauauauauauauaua

SEQ ID NO: 481865 - RNA, 23 nt, Human
auauauauauauauauguaugua

SEQ ID NO: 481866 - RNA, 29 nt, Human
auauauauauaugcauauauauauauaua

SEQ ID NO: 481867 - RNA, 21 nt, Human
auauauguauguauaugcacu

SEQ ID NO: 481868 - RNA, 25 nt, Human
auguguguguguauacacauauaua

SEQ ID NO: 481869 - RNA, 23 nt, Human
auugcugucugcuccuggcuccu

SEQ ID NO: 481870 - RNA, 21 nt, Human
cacauauauauauauauauau

SEQ ID NO: 481871 - RNA, 22 nt, Human
cacauauauauauauauauaua

SEQ ID NO: 481872 - RNA, 19 nt, Human
caccaugggccacgcaggc

SEQ ID NO: 481873 - RNA, 19 nt, Human
ccggcugucgggcgccugu

SEQ ID NO: 481874 - RNA, 18 nt, Human
ccugugcccugcgggccc

SEQ ID NO: 481875 - RNA, 23 nt, Human
cgccugugcccugcgggcccugc

SEQ ID NO: 481876 - RNA, 24 nt, Human
cgccugugcccugcgggcccugcg

SEQ ID NO: 481877 - RNA, 22 nt, Human
cuccugagguaaagaaggugag

SEQ ID NO: 481878 - RNA, 18 nt, Human
cugcgcgaucccaggugu

SEQ ID NO: 481879 - RNA, 21 nt, Human
gacggggcgggcggugggcgg

SEQ ID NO: 481880 - RNA, 18 nt, Human
gcacuggaagggccacca

SEQ ID NO: 481881 - RNA, 20 nt, Human
gcugucugcuccuggcuccu

SEQ ID NO: 481882 - RNA, 22 nt, Human
ggcgggcggugggcggccgggg

SEQ ID NO: 481883 - RNA, 18 nt, Human
ggcggugggcggccgggg

SEQ ID NO: 481884 - RNA, 24 nt, Human
guguguguauacacauauauauau

SEQ ID NO: 481885 - RNA, 18 nt, Human
uauacacauauauauaua

SEQ ID NO: 481886 - RNA, 20 nt, Human
uauacacauauauauauaua

SEQ ID NO: 481887 - RNA, 20 nt, Human
uauacacauauauauauaua

SEQ ID NO: 481888 - RNA, 24 nt, Human
uauacacauauauauauauauaua

SEQ ID NO: 481889 - RNA, 19 nt, Human
uauauauauauauauauau

SEQ ID NO: 481890 - RNA, 19 nt, Human
uauauauauauauauauau

SEQ ID NO: 481891 - RNA, 19 nt, Human
uauauauauauauauauau

SEQ ID NO: 481892 - RNA, 21 nt, Human
uauauauauauauauaugcau

SEQ ID NO: 481893 - RNA, 19 nt, Human
uauauauauauauaugcau

SEQ ID NO: 481894 - RNA, 22 nt, Human
uauauauauauaugcauauaua

SEQ ID NO: 481895 - RNA, 24 nt, Human
uauauauauauaugcauauauaua

SEQ ID NO: 481896 - RNA, 24 nt, Human
uauauauauaugucugucuaugug

SEQ ID NO: 481897 - RNA, 20 nt, Human
uauauauaugcauauauaua

SEQ ID NO: 481898 - RNA, 20 nt, Human
uauauauaugcauauauaua

SEQ ID NO: 481899 - RNA, 24 nt, Human
uauauauaugcauauauauauaua

SEQ ID NO: 481900 - RNA, 24 nt, Human
uauauauaugcauauauauauaua

SEQ ID NO: 481901 - RNA, 19 nt, Human
uauauauauguauguauau

SEQ ID NO: 481902 - RNA, 18 nt, Human
uauauaugcauauauaua

SEQ ID NO: 481903 - RNA, 22 nt, Human
uauaugcauauauauauauaua

SEQ ID NO: 481904 - RNA, 24 nt, Human
uauaugcauauauauauauauaug

SEQ ID NO: 481905 - RNA, 19 nt, Human
uauauguauguauaugcac

SEQ ID NO: 481906 - RNA, 24 nt, Human
uauaugucugucuaugugugugug

SEQ ID NO: 481907 - RNA, 21 nt, Human
uaugcauauauauauauauau

SEQ ID NO: 481908 - RNA, 24 nt, Human
uaugcauauauauauauauaugua

SEQ ID NO: 481909 - RNA, 24 nt, Human
uaugucugucuaugugugugugua

SEQ ID NO: 481910 - RNA, 18 nt, Human
uauguguguguguauaca

SEQ ID NO: 481911 - RNA, 22 nt, Human
uauguguguguguauacacaua

SEQ ID NO: 481912 - RNA, 23 nt, Human
ugggcggccgggggccccugcga

SEQ ID NO: 481913 - RNA, 18 nt, Human
uguauacacauauauaua

SEQ ID NO: 481914 - RNA, 18 nt, Human
uguauacacauauauaua

SEQ ID NO: 481915 - RNA, 24 nt, Human
uguauacacauauauauauauaua

SEQ ID NO: 481916 - RNA, 20 nt, Human
uguguauacacauauauaua

SEQ ID NO: 481917 - RNA, 24 nt, Human
uguguauacacauauauauauaua

SEQ ID NO: 481918 - RNA, 20 nt, Human
uguguguauacacauauaua

SEQ ID NO: 481919 - RNA, 24 nt, Human
uguguguauacacauauauauaua

SEQ ID NO: 481920 - RNA, 26 nt, Human
uguguguguguauacacauauauaua

SEQ ID NO: 481921 - RNA, 19 nt, Human
aaggaucugacacccugac

SEQ ID NO: 481922 - RNA, 25 nt, Human
augcaacaacaaacgcccaaauuuu

SEQ ID NO: 481923 - RNA, 21 nt, Human
cagugggugccuuaggagucu

SEQ ID NO: 481924 - RNA, 20 nt, Human
cauggaacaggcccagcuaa

SEQ ID NO: 481925 - RNA, 19 nt, Human
cgaagaucaaugcccccuc

SEQ ID NO: 481926 - RNA, 18 nt, Human
gcaacaacaaacgcccaa

SEQ ID NO: 481927 - RNA, 28 nt, Human
gcccaaauuuuccaauagaggacacugc

SEQ ID NO: 481928 - RNA, 18 nt, Human
gcgaucgaagaucaaugc

SEQ ID NO: 481929 - RNA, 20 nt, Human
gucuggaguuuaacuaugca

SEQ ID NO: 481930 - RNA, 24 nt, Human
uaugcagauuugguuuuuagaagg

SEQ ID NO: 481931 - RNA, 23 nt, Human
ugagggcagggcucauguuuugg

SEQ ID NO: 481932 - RNA, 19 nt, Human
ugcagcauucacacacguu

SEQ ID NO: 481933 - RNA, 21 nt, Human
uggaacaggcccagcuaaugu

SEQ ID NO: 481934 - RNA, 22 nt, Human
uggaacaggcccagcuaauguu

SEQ ID NO: 481935 - RNA, 24 nt, Human
uuuuauagcugacccuacguuacu

SEQ ID NO: 481936 - RNA, 27 nt, Human
aaaaaagacagaacaaccaacccaaaa

SEQ ID NO: 481937 - RNA, 19 nt, Human
aaaaagacagaacaaccaa

SEQ ID NO: 481938 - RNA, 23 nt, Human
aaaaagacagaacaaccaaccca

SEQ ID NO: 481939 - RNA, 24 nt, Human
aaaaagacagaacaaccaacccaa

SEQ ID NO: 481940 - RNA, 18 nt, Human
aaccaacccaaaaccagu

SEQ ID NO: 481941 - RNA, 21 nt, Human
aacucacuccacuccguccug

SEQ ID NO: 481942 - RNA, 21 nt, Human
aagaggauagccagcaacagc

SEQ ID NO: 481943 - RNA, 25 nt, Human
aagcagcugacaagagcccagagac

SEQ ID NO: 481944 - RNA, 19 nt, Human
acaaccaacccaaaaccag

SEQ ID NO: 481945 - RNA, 21 nt, Human
agaacaaccaacccaaaacca

SEQ ID NO: 481946 - RNA, 30 nt, Human
agaacaaccaacccaaaaccaguaguaggg

SEQ ID NO: 481947 - RNA, 18 nt, Human
agaagcaaagaggauagc

SEQ ID NO: 481948 - RNA, 21 nt, Human
agacccagcuggccgcgggga

SEQ ID NO: 481949 - RNA, 24 nt, Human
agagaaggugggcacaggccacca

SEQ ID NO: 481950 - RNA, 21 nt, Human
aggaaccucagguucaaaagc

SEQ ID NO: 481951 - RNA, 18 nt, Human
aggaagagaagcccagcu

SEQ ID NO: 481952 - RNA, 20 nt, Human
aggaaugggcggcccagggc

SEQ ID NO: 481953 - RNA, 22 nt, Human
aggacuacaggcgacuguucca

SEQ ID NO: 481954 - RNA, 20 nt, Human
aggaucauaggccacugcca

SEQ ID NO: 481955 - RNA, 18 nt, Human
aggauucauuggaacaca

SEQ ID NO: 481956 - RNA, 20 nt, Human
aggcagaaacuuccagaagc

SEQ ID NO: 481957 - RNA, 22 nt, Human
aggcagaaacuuccagaagcaa

SEQ ID NO: 481958 - RNA, 24 nt, Human
aggcagccucaggaaagcucuggg

SEQ ID NO: 481959 - RNA, 18 nt, Human
aggcagggagggaaggcc

SEQ ID NO: 481960 - RNA, 18 nt, Human
agggagagaaggugggca

SEQ ID NO: 481961 - RNA, 23 nt, Human
agggggaagaaaagaauggcugg

SEQ ID NO: 481962 - RNA, 23 nt, Human
aggggugggggcgagggggcggg

SEQ ID NO: 481963 - RNA, 22 nt, Human
agguacuggagucacaggugcu

SEQ ID NO: 481964 - RNA, 24 nt, Human
aguuggcugcagagcugucuucag

SEQ ID NO: 481965 - RNA, 19 nt, Human
auccaaacucacuccacuc

SEQ ID NO: 481966 - RNA, 22 nt, Human
caaaaccaguaguagguacugg

SEQ ID NO: 481967 - RNA, 22 nt, Human
caaagccagcccacgccaccuc

SEQ ID NO: 481968 - RNA, 26 nt, Human
caaagugcugagaucuccccucugua

SEQ ID NO: 481969 - RNA, 18 nt, Human
cacagaaguccaggcucc

SEQ ID NO: 481970 - RNA, 25 nt, Human
cacagcacacaggggcccuggcagg

SEQ ID NO: 481971 - RNA, 19 nt, Human
cacaggccaccacaucccc

SEQ ID NO: 481972 - RNA, 20 nt, Human
cacaggccaccacauccccc

SEQ ID NO: 481973 - RNA, 23 nt, Human
cacaggggugggggcgagggggc

SEQ ID NO: 481974 - RNA, 22 nt, Human
caccucucccccgggaccccca

SEQ ID NO: 481975 - RNA, 22 nt, Human
cagaacaaccaacccaaaacca

SEQ ID NO: 481976 - RNA, 21 nt, Human
cagcacaaccuucgugcaaag

SEQ ID NO: 481977 - RNA, 21 nt, Human
cagccccggguccggucuccc

SEQ ID NO: 481978 - RNA, 23 nt, Human
cagcgcaaaggccaaagcaccag

SEQ ID NO: 481979 - RNA, 20 nt, Human
cagcgggaggggagguggcg

SEQ ID NO: 481980 - RNA, 23 nt, Human
cagcuaccaggacuacaggcgac

SEQ ID NO: 481981 - RNA, 20 nt, Human
cagcuucuucugcagccccg

SEQ ID NO: 481982 - RNA, 22 nt, Human
caggcagccucaggaaagcucu

SEQ ID NO: 481983 - RNA, 22 nt, Human
caggguggaucaaggagucuca

SEQ ID NO: 481984 - RNA, 21 nt, Human
caguuggcugcagagcugucu

SEQ ID NO: 481985 - RNA, 18 nt, Human
caucagaugaugccaacc

SEQ ID NO: 481986 - RNA, 18 nt, Human
ccaccucucccccgggac

SEQ ID NO: 481987 - RNA, 21 nt, Human
ccaccucuggaggccagggag

SEQ ID NO: 481988 - RNA, 25 nt, Human
ccagcacaaccuucgugcaaagcca

SEQ ID NO: 481989 - RNA, 20 nt, Human
ccagcacacggcgacaguca

SEQ ID NO: 481990 - RNA, 19 nt, Human
ccaguuggagggagguguc

SEQ ID NO: 481991 - RNA, 18 nt, Human
cccaggucgagggaagcc

SEQ ID NO: 481992 - RNA, 19 nt, Human
cccccagccuuuaccuggg

SEQ ID NO: 481993 - RNA, 20 nt, Human
cccccagccuuuaccugggc

SEQ ID NO: 481994 - RNA, 21 nt, Human
cccccgggacccccaacgcuc

SEQ ID NO: 481995 - RNA, 20 nt, Human
ccccggagacccagcuggcc

SEQ ID NO: 481996 - RNA, 22 nt, Human
ccccgggacccccaacgcucag

SEQ ID NO: 481997 - RNA, 22 nt, Human
cccgggacccccaacgcucagg

SEQ ID NO: 481998 - RNA, 25 nt, Human
cccuaggugggcccugcuuacucug

SEQ ID NO: 481999 - RNA, 21 nt, Human
cccugaugggagcgaaggcuc

SEQ ID NO: 482000 - RNA, 19 nt, Human
cccuucuuccuacucuuuc

SEQ ID NO: 482001 - RNA, 20 nt, Human
ccgaacggaccugggucuga

SEQ ID NO: 482002 - RNA, 21 nt, Human
ccgaacggaccugggucugaa

SEQ ID NO: 482003 - RNA, 21 nt, Human
ccucaggaaagcucuggggcu

SEQ ID NO: 482004 - RNA, 19 nt, Human
ccugugugacaaaaagagc

SEQ ID NO: 482005 - RNA, 23 nt, Human
ccuucagcuucuucugcagcccc

SEQ ID NO: 482006 - RNA, 24 nt, Human
ccuucggccuggucauggcagugg

SEQ ID NO: 482007 - RNA, 22 nt, Human
cgaacggaccugggucugaacc

SEQ ID NO: 482008 - RNA, 24 nt, Human
cgaaggcucuggagcacagcacac

SEQ ID NO: 482009 - RNA, 23 nt, Human
cgacacccaggcagggagggaag

SEQ ID NO: 482010 - RNA, 21 nt, Human
cgguccguuuauccaaacuca

SEQ ID NO: 482011 - RNA, 20 nt, Human
cucaggggacagaguugcuc

SEQ ID NO: 482012 - RNA, 22 nt, Human
cuccacaggccacggccucccc

SEQ ID NO: 482013 - RNA, 18 nt, Human
cucccccgggacccccaa

SEQ ID NO: 482014 - RNA, 18 nt, Human
cucuguagggaggaagag

SEQ ID NO: 482015 - RNA, 19 nt, Human
cugcuuacucugccuggga

SEQ ID NO: 482016 - RNA, 20 nt, Human
cugcuuacucugccugggac

SEQ ID NO: 482017 - RNA, 21 nt, Human
cuggagcacagcacacagggg

SEQ ID NO: 482018 - RNA, 21 nt, Human
cuggcaagauucguuuccaag

SEQ ID NO: 482019 - RNA, 20 nt, Human
cuuacucugccugggacugg

SEQ ID NO: 482020 - RNA, 20 nt, Human
cuuccaagccugcacacgcc

SEQ ID NO: 482021 - RNA, 19 nt, Human
cuucgugcaaagccagccc

SEQ ID NO: 482022 - RNA, 20 nt, Human
gaaggcccugaaaucccguu

SEQ ID NO: 482023 - RNA, 21 nt, Human
gaaguccaggcuccuguugcc

SEQ ID NO: 482024 - RNA, 22 nt, Human
gaggaagagaagcccagcucgg

SEQ ID NO: 482025 - RNA, 19 nt, Human
gagggcguucccugccuuc

SEQ ID NO: 482026 - RNA, 22 nt, Human
gauagccagcaacagcccccag

SEQ ID NO: 482027 - RNA, 18 nt, Human
gcagagcugucuucagga

SEQ ID NO: 482028 - RNA, 19 nt, Human
gcagggagggaaggcccug

SEQ ID NO: 482029 - RNA, 21 nt, Human
gcccgacacccaggcagggag

SEQ ID NO: 482030 - RNA, 22 nt, Human
gccuggucauggcaguggaggu

SEQ ID NO: 482031 - RNA, 23 nt, Human
gccuuuaccugggccuccuccac

SEQ ID NO: 482032 - RNA, 22 nt, Human
gcgcucguuauuuccaagcaca

SEQ ID NO: 482033 - RNA, 18 nt, Human
gcguugauuugcaggaag

SEQ ID NO: 482034 - RNA, 24 nt, Human
ggaaugggcggcccagggcccagg

SEQ ID NO: 482035 - RNA, 23 nt, Human
ggagaaggcugagaaggcccggg

SEQ ID NO: 482036 - RNA, 18 nt, Human
ggaggagggagagaaggu

SEQ ID NO: 482037 - RNA, 20 nt, Human
ggaugcguccuuuccugggg

SEQ ID NO: 482038 - RNA, 27 nt, Human
ggccagggagggcugcauuuggcuuuc

SEQ ID NO: 482039 - RNA, 19 nt, Human
ggcccaggguccccggaga

SEQ ID NO: 482040 - RNA, 18 nt, Human
gggacagaguugcuccuu

SEQ ID NO: 482041 - RNA, 19 nt, Human
gggagagauggagaggaag

SEQ ID NO: 482042 - RNA, 23 nt, Human
gggaggggacaaagucagccuuc

SEQ ID NO: 482043 - RNA, 19 nt, Human
ggggugggggcgagggggc

SEQ ID NO: 482044 - RNA, 23 nt, Human
gucgagggaagcuggccccggga

SEQ ID NO: 482045 - RNA, 20 nt, Human
gugaaggccuugagcucugg

SEQ ID NO: 482046 - RNA, 21 nt, Human
gugaggcagaaacuuccagaa

SEQ ID NO: 482047 - RNA, 21 nt, Human
guggaucaaggagucucaaaa

SEQ ID NO: 482048 - RNA, 22 nt, Human
uaaaaaaaagacagaacaacca

SEQ ID NO: 482049 - RNA, 20 nt, Human
uaagacaaagaaaugaaggu

SEQ ID NO: 482050 - RNA, 22 nt, Human
uaauuaaaaaaaagacagaaca

SEQ ID NO: 482051 - RNA, 22 nt, Human
ucaaggccaggcagccucagga

SEQ ID NO: 482052 - RNA, 20 nt, Human
ucacagaagaaaagucucgg

SEQ ID NO: 482053 - RNA, 21 nt, Human
ucaggaaagcucuggggcuuc

SEQ ID NO: 482054 - RNA, 18 nt, Human
ucaggagggggaagaaaa

SEQ ID NO: 482055 - RNA, 18 nt, Human
uccaaacucacuccacuc

SEQ ID NO: 482056 - RNA, 21 nt, Human
uccaagaggagauaauggcuc

SEQ ID NO: 482057 - RNA, 24 nt, Human
uccaccucucccccgggaccccca

SEQ ID NO: 482058 - RNA, 20 nt, Human
uccccaggucgagggaagcu

SEQ ID NO: 482059 - RNA, 23 nt, Human
ucccccgggacccccaacgcuca

SEQ ID NO: 482060 - RNA, 19 nt, Human
uccccggagacccagcugg

SEQ ID NO: 482061 - RNA, 23 nt, Human
uccccggagacccagcuggccgc

SEQ ID NO: 482062 - RNA, 23 nt, Human
ucgggaggagggagagaaggugg

SEQ ID NO: 482063 - RNA, 21 nt, Human
ucggggaggggacaaagucag

SEQ ID NO: 482064 - RNA, 19 nt, Human
ucucuaggguuuuuauugg

SEQ ID NO: 482065 - RNA, 26 nt, Human
ucucuaggguuuuuauuggccacugu

SEQ ID NO: 482066 - RNA, 24 nt, Human
ucuguccaccucucccccgggacc

SEQ ID NO: 482067 - RNA, 21 nt, Human
ugaaguccagucagugggucu

SEQ ID NO: 482068 - RNA, 19 nt, Human
ugacaggaguuguggggcc

SEQ ID NO: 482069 - RNA, 18 nt, Human
ugaggcaaggaugcgcuc

SEQ ID NO: 482070 - RNA, 24 nt, Human
ugaugccaacccugaugggagcga

SEQ ID NO: 482071 - RNA, 21 nt, Human
ugcaaagccagcccacgccac

SEQ ID NO: 482072 - RNA, 19 nt, Human
ugcucccggcucguccccu

SEQ ID NO: 482073 - RNA, 19 nt, Human
uggaaaaacuguaaaacac

SEQ ID NO: 482074 - RNA, 24 nt, Human
uggaaaucacagaagaaaagucuc

SEQ ID NO: 482075 - RNA, 23 nt, Human
uggacagcgggacuggggagggc

SEQ ID NO: 482076 - RNA, 21 nt, Human
uggagagagggagagauggag

SEQ ID NO: 482077 - RNA, 24 nt, Human
uggagagagggagagauggagagg

SEQ ID NO: 482078 - RNA, 21 nt, Human
uggagcggagagaaagggcag

SEQ ID NO: 482079 - RNA, 22 nt, Human
uggagucacaggugcuuaacug

SEQ ID NO: 482080 - RNA, 19 nt, Human
uggaugcguccuuuccugg

SEQ ID NO: 482081 - RNA, 20 nt, Human
uggcagaauaacuuacaaug

SEQ ID NO: 482082 - RNA, 19 nt, Human
uggcccgacacccaggcag

SEQ ID NO: 482083 - RNA, 23 nt, Human
uggcucaacgacgcaggaaccuc

SEQ ID NO: 482084 - RNA, 19 nt, Human
ugggagcgaaggcucugga

SEQ ID NO: 482085 - RNA, 19 nt, Human
ugucuguccaccucucccc

SEQ ID NO: 482086 - RNA, 22 nt, Human
ugucuguccaccucucccccgg

SEQ ID NO: 482087 - RNA, 22 nt, Human
uuaccugggccuccuccacagg

SEQ ID NO: 482088 - RNA, 24 nt, Human
uucaaaagcagcugacaagagccc

SEQ ID NO: 482089 - RNA, 21 nt, Human
uuccccugaccgauggaaccc

SEQ ID NO: 482090 - RNA, 19 nt, Human
uuuaccugggccuccucca

SEQ ID NO: 482091 - RNA, 24 nt, Human
uuucuggcaagauucguuuccaag

SEQ ID NO: 482092 - RNA, 27 nt, Human
uuuugcucccggcucguccccuucuuc

SEQ ID NO: 482093 - RNA, 18 nt, Human
aaaaacacaacagcacgg

SEQ ID NO: 482094 - RNA, 25 nt, Human
aaaacagaaaaacacaacagcacgg

SEQ ID NO: 482095 - RNA, 24 nt, Human
aaacucccaggugguuccaacucu

SEQ ID NO: 482096 - RNA, 21 nt, Human
accuguuucgugaaagagggu

SEQ ID NO: 482097 - RNA, 23 nt, Human
agcaaaacagaaaaacacaacag

SEQ ID NO: 482098 - RNA, 19 nt, Human
caaaacagaaaaacacaac

SEQ ID NO: 482099 - RNA, 20 nt, Human
caagaacaaaucauuauuau

SEQ ID NO: 482100 - RNA, 25 nt, Human
cagaaaaacacaacagcacgguauc

SEQ ID NO: 482101 - RNA, 22 nt, Human
caugagcaagcgaaucaguucc

SEQ ID NO: 482102 - RNA, 22 nt, Human
cgagcaaaacagaaaaacacaa

SEQ ID NO: 482103 - RNA, 21 nt, Human
gagcaaaacagaaaaacacaa

SEQ ID NO: 482104 - RNA, 18 nt, Human
gcaaaacagaaaaacaca

SEQ ID NO: 482105 - RNA, 19 nt, Human
ucccaggugguuccaacuc

SEQ ID NO: 482106 - RNA, 19 nt, Human
uuaagaggacaucuguacc

SEQ ID NO: 482107 - RNA, 19 nt, Human
uucccagagcucccugcug

SEQ ID NO: 482108 - RNA, 22 nt, Human
uugcacuaaacaagaacaaauc

SEQ ID NO: 482109 - RNA, 20 nt, Human
uuuaagaggacaucuguacc

SEQ ID NO: 482110 - RNA, 28 nt, Human
uuucaauacuccuugaaacccuucuuuc

SEQ ID NO: 482111 - RNA, 22 nt, Human
uuucccagagcucccugcugca

SEQ ID NO: 482112 - RNA, 22 nt, Human
uuucuuuuuggucguuuucaau

SEQ ID NO: 482113 - RNA, 22 nt, Human
aaagcgacagagucagagaccc

SEQ ID NO: 482114 - RNA, 19 nt, Human
acuuagagaaaagcgacag

SEQ ID NO: 482115 - RNA, 19 nt, Human
agucagagacccacggggg

SEQ ID NO: 482116 - RNA, 22 nt, Human
cgcccgggccgggcugcggggc

SEQ ID NO: 482117 - RNA, 19 nt, Human
cggggcugcagcgagggcg

SEQ ID NO: 482118 - RNA, 18 nt, Human
gcagcugcugcaggacgc

SEQ ID NO: 482119 - RNA, 19 nt, Human
uggggacacgaacacggcg

SEQ ID NO: 482120 - RNA, 20 nt, Human
cagcgcggcgcgggcggcgg

SEQ ID NO: 482121 - RNA, 21 nt, Human
gagagccuggcuggcgggcgc

SEQ ID NO: 482122 - RNA, 29 nt, Human
gagcccgggccagcgcggcgcgggcggcc

SEQ ID NO: 482123 - RNA, 27 nt, Human
gcgcggcgcgggcggcgggcgcggagg

SEQ ID NO: 482124 - RNA, 19 nt, Human
ggcggcgggcgcggagagc

SEQ ID NO: 482125 - RNA, 24 nt, Human
gggagagcccgggccagcgcggcg

SEQ ID NO: 482126 - RNA, 19 nt, Human
aaaacaaaaccauuaaagc

SEQ ID NO: 482127 - RNA, 22 nt, Human
aaacaggauggcggcgccucuc

SEQ ID NO: 482128 - RNA, 26 nt, Human
aaagggaacuauuacaucuagagauu

SEQ ID NO: 482129 - RNA, 24 nt, Human
aaagugcugggauuauagguguga

SEQ ID NO: 482130 - RNA, 22 nt, Human
aacacaguguggcuggcgggag

SEQ ID NO: 482131 - RNA, 19 nt, Human
aaccucaccgccaguccca

SEQ ID NO: 482132 - RNA, 22 nt, Human
aacucauaaacaucuuuucccc

SEQ ID NO: 482133 - RNA, 20 nt, Human
aagcaaagcagccagggugc

SEQ ID NO: 482134 - RNA, 20 nt, Human
aagccaccuucaaagaagua

SEQ ID NO: 482135 - RNA, 23 nt, Human
aaggacacaguaaacacagaucc

SEQ ID NO: 482136 - RNA, 25 nt, Human
aaggggcaggcaugcagugugcagg

SEQ ID NO: 482137 - RNA, 20 nt, Human
aaggguugccaugguaauau

SEQ ID NO: 482138 - RNA, 19 nt, Human
aagguggcgcggacccaga

SEQ ID NO: 482139 - RNA, 21 nt, Human
aagugauccaccugccuuggc

SEQ ID NO: 482140 - RNA, 24 nt, Human
aagugauccaccugccuuggccuc

SEQ ID NO: 482141 - RNA, 18 nt, Human
aagugcugggauuauagg

SEQ ID NO: 482142 - RNA, 20 nt, Human
aaugagccaaccuguguuug

SEQ ID NO: 482143 - RNA, 19 nt, Human
aauggcagcacaggcggca

SEQ ID NO: 482144 - RNA, 23 nt, Human
acacaagcuugaauucauaguag

SEQ ID NO: 482145 - RNA, 18 nt, Human
accaaaaaauccuaccca

SEQ ID NO: 482146 - RNA, 22 nt, Human
accacguuggccaggcuggucu

SEQ ID NO: 482147 - RNA, 21 nt, Human
accccuauggaugugguuggg

SEQ ID NO: 482148 - RNA, 19 nt, Human
accccugccccaaagaagc

SEQ ID NO: 482149 - RNA, 22 nt, Human
accgcaccugguccuuaaugcu

SEQ ID NO: 482150 - RNA, 22 nt, Human
accuaaaccucaguucaccaaa

SEQ ID NO: 482151 - RNA, 19 nt, Human
accucaguucaccaaaguu

SEQ ID NO: 482152 - RNA, 22 nt, Human
acuccaggaaguuuugcagagg

SEQ ID NO: 482153 - RNA, 19 nt, Human
acucugagcuccugaaguc

SEQ ID NO: 482154 - RNA, 22 nt, Human
agaagcagggaugaguguggga

SEQ ID NO: 482155 - RNA, 19 nt, Human
agagcaccccagcucuacc

SEQ ID NO: 482156 - RNA, 21 nt, Human
agagcaccccagcucuaccaa

SEQ ID NO: 482157 - RNA, 18 nt, Human
agagggcaaacugcccag

SEQ ID NO: 482158 - RNA, 19 nt, Human
agcaggauacagaugcaga

SEQ ID NO: 482159 - RNA, 18 nt, Human
agccaacaggagcagcag

SEQ ID NO: 482160 - RNA, 20 nt, Human
agccaccgcaccugguccuu

SEQ ID NO: 482161 - RNA, 18 nt, Human
aggaacacacaacgcacc

SEQ ID NO: 482162 - RNA, 18 nt, Human
aggaauauucauagucuc

SEQ ID NO: 482163 - RNA, 23 nt, Human
aggcagagauaccacccagauuc

SEQ ID NO: 482164 - RNA, 20 nt, Human
agggaccugugaucccccag

SEQ ID NO: 482165 - RNA, 19 nt, Human
agggagcuguccugggugg

SEQ ID NO: 482166 - RNA, 24 nt, Human
aggggggaagcauguaguuuuagg

SEQ ID NO: 482167 - RNA, 19 nt, Human
agggguugcagcucugcag

SEQ ID NO: 482168 - RNA, 21 nt, Human
aggguugaccucagcagagag

SEQ ID NO: 482169 - RNA, 19 nt, Human
aggugugagccaccgcacc

SEQ ID NO: 482170 - RNA, 24 nt, Human
aguccccucucauggaggaggggg

SEQ ID NO: 482171 - RNA, 19 nt, Human
auccuuggauucaguucuc

SEQ ID NO: 482172 - RNA, 20 nt, Human
augggguuucaccacguugg

SEQ ID NO: 482173 - RNA, 21 nt, Human
caaaauaaagaccugagcuug

SEQ ID NO: 482174 - RNA, 22 nt, Human
caaccugccucaccccugcccc

SEQ ID NO: 482175 - RNA, 21 nt, Human
caacgcaccaaaaaauccuac

SEQ ID NO: 482176 - RNA, 19 nt, Human
caagugccgacggaaacug

SEQ ID NO: 482177 - RNA, 19 nt, Human
cacaacgcaccaaaaaauc

SEQ ID NO: 482178 - RNA, 20 nt, Human
caccacguuggccaggcugg

SEQ ID NO: 482179 - RNA, 21 nt, Human
caccacguuggccaggcuggu

SEQ ID NO: 482180 - RNA, 24 nt, Human
caccacguuggccaggcuggucuu

SEQ ID NO: 482181 - RNA, 27 nt, Human
caccacguuggccaggcuggucuugaa

SEQ ID NO: 482182 - RNA, 22 nt, Human
caccgcaccugguccuuaaugc

SEQ ID NO: 482183 - RNA, 24 nt, Human
caccugccuuggccucccaaagug

SEQ ID NO: 482184 - RNA, 24 nt, Human
cacguuggccaggcuggucuugaa

SEQ ID NO: 482185 - RNA, 22 nt, Human
cacugcauagagacaagaaagc

SEQ ID NO: 482186 - RNA, 23 nt, Human
cagaccuccugguuauacaacca

SEQ ID NO: 482187 - RNA, 27 nt, Human
cagaguaagcaguaaucuccugcugau

SEQ ID NO: 482188 - RNA, 22 nt, Human
cagcacaggcggcaaagcuggg

SEQ ID NO: 482189 - RNA, 21 nt, Human
cagccaacaggagcagcagaa

SEQ ID NO: 482190 - RNA, 23 nt, Human
cagcugcagcauuucaguccccu

SEQ ID NO: 482191 - RNA, 23 nt, Human
cagguagcuccugcucuccugag

SEQ ID NO: 482192 - RNA, 21 nt, Human
caguccccuccccccucaacc

SEQ ID NO: 482193 - RNA, 24 nt, Human
cauuagaaaacaaaaccauuaaag

SEQ ID NO: 482194 - RNA, 18 nt, Human
ccaaaaaauccuacccac

SEQ ID NO: 482195 - RNA, 24 nt, Human
ccaaaaugcuggugcgggaugggc

SEQ ID NO: 482196 - RNA, 21 nt, Human
ccaaagugcugggauuauagg

SEQ ID NO: 482197 - RNA, 24 nt, Human
ccaaagugcugggauuauaggugu

SEQ ID NO: 482198 - RNA, 23 nt, Human
cccaaaccagggagcuguccugg

SEQ ID NO: 482199 - RNA, 21 nt, Human
ccccucaaccugccucacccc

SEQ ID NO: 482200 - RNA, 21 nt, Human
ccuaaaccucaguucaccaaa

SEQ ID NO: 482201 - RNA, 21 nt, Human
ccugaucuuaagugauccacc

SEQ ID NO: 482202 - RNA, 24 nt, Human
ccugccuuggccucccaaagugcu

SEQ ID NO: 482203 - RNA, 22 nt, Human
ccugggugguugcauccuucau

SEQ ID NO: 482204 - RNA, 24 nt, Human
ccuuggguugaaagaauggggagu

SEQ ID NO: 482205 - RNA, 18 nt, Human
cgggaugggcucuaggaa

SEQ ID NO: 482206 - RNA, 18 nt, Human
cguccggagucgucugcu

SEQ ID NO: 482207 - RNA, 22 nt, Human
cguuggccaggcuggucuugaa

SEQ ID NO: 482208 - RNA, 25 nt, Human
cuaaacucauaaacaucuuuucccc

SEQ ID NO: 482209 - RNA, 19 nt, Human
cuagauucugucugggggc

SEQ ID NO: 482210 - RNA, 23 nt, Human
cuagauucugucugggggcuuug

SEQ ID NO: 482211 - RNA, 26 nt, Human
cucaaccugccucaccccugccccaa

SEQ ID NO: 482212 - RNA, 23 nt, Human
cucuaggaacagaaagccaagug

SEQ ID NO: 482213 - RNA, 20 nt, Human
cugaagccuuaguuuuacuu

SEQ ID NO: 482214 - RNA, 27 nt, Human
cugaagccuuaguuuuacuugugcuca

SEQ ID NO: 482215 - RNA, 19 nt, Human
cugcaaauaaaacacccag

SEQ ID NO: 482216 - RNA, 21 nt, Human
cugcaaauaaaacacccagac

SEQ ID NO: 482217 - RNA, 18 nt, Human
cugccaaggagaugaagc

SEQ ID NO: 482218 - RNA, 21 nt, Human
cugggauuauaggugugagcc

SEQ ID NO: 482219 - RNA, 21 nt, Human
cuguuaucuuggugaaauggu

SEQ ID NO: 482220 - RNA, 23 nt, Human
cuuaagugauccaccugccuugg

SEQ ID NO: 482221 - RNA, 24 nt, Human
cuuaagugauccaccugccuuggc

SEQ ID NO: 482222 - RNA, 19 nt, Human
cuugggugcuccaagucug

SEQ ID NO: 482223 - RNA, 21 nt, Human
cuuggucuggccuugcugggc

SEQ ID NO: 482224 - RNA, 24 nt, Human
gaagauaacuccuaggcugucaga

SEQ ID NO: 482225 - RNA, 22 nt, Human
gaaucuucagccgugagcuuca

SEQ ID NO: 482226 - RNA, 19 nt, Human
gaccuugggugcuccaagu

SEQ ID NO: 482227 - RNA, 22 nt, Human
gagaaaggcucucugcagguuc

SEQ ID NO: 482228 - RNA, 18 nt, Human
gagaugggguuucaccac

SEQ ID NO: 482229 - RNA, 24 nt, Human
gagaugggguuucaccacguuggc

SEQ ID NO: 482230 - RNA, 19 nt, Human
gagcagcagaaggggcagg

SEQ ID NO: 482231 - RNA, 21 nt, Human
gagcagcagaaggggcaggca

SEQ ID NO: 482232 - RNA, 24 nt, Human
gaucuuaagugauccaccugccuu

SEQ ID NO: 482233 - RNA, 18 nt, Human
gauuauaggugugagcca

SEQ ID NO: 482234 - RNA, 20 nt, Human
gauuauaggugugagccacc

SEQ ID NO: 482235 - RNA, 23 nt, Human
gauuauaggugugagccaccgca

SEQ ID NO: 482236 - RNA, 18 nt, Human
gccagggugcaagucacc

SEQ ID NO: 482237 - RNA, 18 nt, Human
gccgacuuuaagaauaaa

SEQ ID NO: 482238 - RNA, 22 nt, Human
gccuuggccucccaaagugcug

SEQ ID NO: 482239 - RNA, 22 nt, Human
gccuuuggagaaauaguguggc

SEQ ID NO: 482240 - RNA, 21 nt, Human
gcugacaucuaggaaaaguca

SEQ ID NO: 482241 - RNA, 18 nt, Human
gcugcaacacaguguggc

SEQ ID NO: 482242 - RNA, 22 nt, Human
gcuggaauuccgagaugaagau

SEQ ID NO: 482243 - RNA, 24 nt, Human
gcuuacaucugcucccuccuccau

SEQ ID NO: 482244 - RNA, 19 nt, Human
gcuuuguggguaucuggaa

SEQ ID NO: 482245 - RNA, 19 nt, Human
ggaauccugcagccuuucc

SEQ ID NO: 482246 - RNA, 20 nt, Human
ggcagguauugagaaagaag

SEQ ID NO: 482247 - RNA, 18 nt, Human
ggcauagagacguggugg

SEQ ID NO: 482248 - RNA, 21 nt, Human
ggcccuagcauaaaauuugug

SEQ ID NO: 482249 - RNA, 23 nt, Human
ggcuggucuugaacuccugaucu

SEQ ID NO: 482250 - RNA, 24 nt, Human
gggagaaggggcugggaguaggga

SEQ ID NO: 482251 - RNA, 19 nt, Human
ggggaaaggcagguugcug

SEQ ID NO: 482252 - RNA, 19 nt, Human
ggggaguggaggugacugu

SEQ ID NO: 482253 - RNA, 20 nt, Human
gggggcuuuguggguaucug

SEQ ID NO: 482254 - RNA, 20 nt, Human
gggggggucuccacugggug

SEQ ID NO: 482255 - RNA, 22 nt, Human
gggguuucaccacguuggccag

SEQ ID NO: 482256 - RNA, 23 nt, Human
ggguggaggaaggaagccagggu

SEQ ID NO: 482257 - RNA, 22 nt, Human
ggguuucaccacguuggccagg

SEQ ID NO: 482258 - RNA, 20 nt, Human
gguaucuggaaagguggggc

SEQ ID NO: 482259 - RNA, 20 nt, Human
ggugaaaugguaaaaaaugu

SEQ ID NO: 482260 - RNA, 21 nt, Human
ggugggcuugcggucuugcug

SEQ ID NO: 482261 - RNA, 18 nt, Human
ggugguucgggggucagg

SEQ ID NO: 482262 - RNA, 24 nt, Human
gugauccaccugccuuggccuccc

SEQ ID NO: 482263 - RNA, 20 nt, Human
uaaaacacccagacauuucu

SEQ ID NO: 482264 - RNA, 23 nt, Human
uaaaacacccagacauuucugaa

SEQ ID NO: 482265 - RNA, 24 nt, Human
uaaaacacccagacauuucugaaa

SEQ ID NO: 482266 - RNA, 22 nt, Human
uaagaacggaagcggugagggg

SEQ ID NO: 482267 - RNA, 22 nt, Human
uaagaauaaaaccacggaccuc

SEQ ID NO: 482268 - RNA, 21 nt, Human
uaaguccggaggacagaauga

SEQ ID NO: 482269 - RNA, 23 nt, Human
uaauggcagcacaggcggcaaag

SEQ ID NO: 482270 - RNA, 22 nt, Human
uagagaugggguuucaccacgu

SEQ ID NO: 482271 - RNA, 20 nt, Human
uaggagcaagguaauuccau

SEQ ID NO: 482272 - RNA, 24 nt, Human
uaggagcaagguaauuccauuaca

SEQ ID NO: 482273 - RNA, 19 nt, Human
uaguagagaugggguuuca

SEQ ID NO: 482274 - RNA, 24 nt, Human
uaguagagaugggguuucaccacg

SEQ ID NO: 482275 - RNA, 19 nt, Human
uauacaaccaggaugugug

SEQ ID NO: 482276 - RNA, 23 nt, Human
uauacccaagacaaacuguccaa

SEQ ID NO: 482277 - RNA, 23 nt, Human
uauaggugugagccaccgcaccu

SEQ ID NO: 482278 - RNA, 19 nt, Human
ucaaccugccucaccccug

SEQ ID NO: 482279 - RNA, 21 nt, Human
ucaccccugccccaaagaagc

SEQ ID NO: 482280 - RNA, 22 nt, Human
ucagaaagaauucugugucuuc

SEQ ID NO: 482281 - RNA, 19 nt, Human
ucagccaacaggagcagca

SEQ ID NO: 482282 - RNA, 21 nt, Human
ucaggaacacacaacgcacca

SEQ ID NO: 482283 - RNA, 21 nt, Human
ucagucccugggugccacaug

SEQ ID NO: 482284 - RNA, 20 nt, Human
ucauggaggagggggcuuug

SEQ ID NO: 482285 - RNA, 20 nt, Human
uccacacaguugggcagcca

SEQ ID NO: 482286 - RNA, 27 nt, Human
uccagaacuccuuuuccucccuacucc

SEQ ID NO: 482287 - RNA, 20 nt, Human
uccaggggggcggcgggggg

SEQ ID NO: 482288 - RNA, 23 nt, Human
ucccaaagugcugggauuauagg

SEQ ID NO: 482289 - RNA, 21 nt, Human
ucccaaggaaaaugccuucuu

SEQ ID NO: 482290 - RNA, 22 nt, Human
ucccccaaccuccugaaaauga

SEQ ID NO: 482291 - RNA, 28 nt, Human
uccccuggggagggugggcuugcuucca

SEQ ID NO: 482292 - RNA, 23 nt, Human
uccccuucucucccaaggaaaau

SEQ ID NO: 482293 - RNA, 23 nt, Human
ucccuacuccugcacaguggcua

SEQ ID NO: 482294 - RNA, 18 nt, Human
ucccuauacccaagacaa

SEQ ID NO: 482295 - RNA, 25 nt, Human
uccucuagaaaaggcaguaagaacg

SEQ ID NO: 482296 - RNA, 22 nt, Human
uccuucauuuucuguccaugcc

SEQ ID NO: 482297 - RNA, 21 nt, Human
uccuucugcuggguuguuggu

SEQ ID NO: 482298 - RNA, 23 nt, Human
ucuagagauuacuggcuaaucug

SEQ ID NO: 482299 - RNA, 26 nt, Human
ucucaguucugaaacauaucgcuuua

SEQ ID NO: 482300 - RNA, 22 nt, Human
ucuccaugacuccagauggcug

SEQ ID NO: 482301 - RNA, 18 nt, Human
ucucuugcucucucacca

SEQ ID NO: 482302 - RNA, 22 nt, Human
ucugcagguuccaaaaugcugg

SEQ ID NO: 482303 - RNA, 21 nt, Human
ucuugaacuccugaucuuaag

SEQ ID NO: 482304 - RNA, 19 nt, Human
ucuuuuuuuuuugucagau

SEQ ID NO: 482305 - RNA, 23 nt, Human
ugaaugagaaaacuuucauugga

SEQ ID NO: 482306 - RNA, 19 nt, Human
ugacuucaagaacgaagac

SEQ ID NO: 482307 - RNA, 21 nt, Human
ugagaaaacuuucauuggaga

SEQ ID NO: 482308 - RNA, 21 nt, Human
ugagagcaccccagcucuacc

SEQ ID NO: 482309 - RNA, 23 nt, Human
ugagcaggaagacagggagggaa

SEQ ID NO: 482310 - RNA, 19 nt, Human
ugagugugggagggaggac

SEQ ID NO: 482311 - RNA, 24 nt, Human
ugaucuuaagugauccaccugccu

SEQ ID NO: 482312 - RNA, 19 nt, Human
ugccucaccccugccccaa

SEQ ID NO: 482313 - RNA, 23 nt, Human
ugcuggaauuccgagaugaagau

SEQ ID NO: 482314 - RNA, 18 nt, Human
ugcugggcugaacuccag

SEQ ID NO: 482315 - RNA, 24 nt, Human
ugcuuuccaggggggcggcggggg

SEQ ID NO: 482316 - RNA, 20 nt, Human
uggaaagguggggcgcagcu

SEQ ID NO: 482317 - RNA, 24 nt, Human
uggaaugcaaggguugccauggua

SEQ ID NO: 482318 - RNA, 25 nt, Human
uggccaggccagcccaaaccaggga

SEQ ID NO: 482319 - RNA, 24 nt, Human
uggccaggcuggucuugaacuccu

SEQ ID NO: 482320 - RNA, 20 nt, Human
uggcggcgccucuccagaac

SEQ ID NO: 482321 - RNA, 23 nt, Human
ugggagaaaggcucucugcaggu

SEQ ID NO: 482322 - RNA, 20 nt, Human
ugggagaaggggcugggagu

SEQ ID NO: 482323 - RNA, 19 nt, Human
ugggauuauaggugugagc

SEQ ID NO: 482324 - RNA, 22 nt, Human
ugggauuauaggugugagccac

SEQ ID NO: 482325 - RNA, 23 nt, Human
ugggauuauaggugugagccacc

SEQ ID NO: 482326 - RNA, 24 nt, Human
ugggauuauaggugugagccaccg

SEQ ID NO: 482327 - RNA, 18 nt, Human
ugggcaugggagaccagg

SEQ ID NO: 482328 - RNA, 21 nt, Human
ugggcugaacuccaggaaguu

SEQ ID NO: 482329 - RNA, 24 nt, Human
uggggagggugggcuugcuuccag

SEQ ID NO: 482330 - RNA, 24 nt, Human
ugggguuucaccacguuggccagg

SEQ ID NO: 482331 - RNA, 19 nt, Human
uguccugggugguugcauc

SEQ ID NO: 482332 - RNA, 20 nt, Human
ugucugcuguguggaggaag

SEQ ID NO: 482333 - RNA, 24 nt, Human
ugugcggaauuuauuccuucugcu

SEQ ID NO: 482334 - RNA, 18 nt, Human
uguggagggaagauggcu

SEQ ID NO: 482335 - RNA, 21 nt, Human
uguggcaacccugaagucagc

SEQ ID NO: 482336 - RNA, 23 nt, Human
ugugugaacagggcugggaguug

SEQ ID NO: 482337 - RNA, 21 nt, Human
uuaagugauccaccugccuug

SEQ ID NO: 482338 - RNA, 18 nt, Human
uuaguagagaugggguuu

SEQ ID NO: 482339 - RNA, 22 nt, Human
uuaguagagaugggguuucacc

SEQ ID NO: 482340 - RNA, 24 nt, Human
uuaguagagaugggguuucaccac

SEQ ID NO: 482341 - RNA, 25 nt, Human
uuaguagagaugggguuucaccacg

SEQ ID NO: 482342 - RNA, 19 nt, Human
uucauagucucccacagag

SEQ ID NO: 482343 - RNA, 22 nt, Human
uuccaggggggcggcggggggu

SEQ ID NO: 482344 - RNA, 21 nt, Human
uuccuagcaggggaauuccag

SEQ ID NO: 482345 - RNA, 19 nt, Human
uucuccccuucuggggcag

SEQ ID NO: 482346 - RNA, 21 nt, Human
uucuuuggggaucaagggggu

SEQ ID NO: 482347 - RNA, 21 nt, Human
uugaaagaauggggaguggag

SEQ ID NO: 482348 - RNA, 23 nt, Human
uuggagaccuugggugcuccaag

SEQ ID NO: 482349 - RNA, 18 nt, Human
uuggccucccaaagugcu

SEQ ID NO: 482350 - RNA, 19 nt, Human
uugugugaacagggcuggg

SEQ ID NO: 482351 - RNA, 23 nt, Human
uuuaugauucuaugaaugggaag

SEQ ID NO: 482352 - RNA, 21 nt, Human
uuucaccacguuggccaggcu

SEQ ID NO: 482353 - RNA, 23 nt, Human
uuuccaggggggcggcggggggu

SEQ ID NO: 482354 - RNA, 24 nt, Human
uuuuuaguagagaugggguuucac

SEQ ID NO: 482355 - RNA, 23 nt, Human
uuuuuuaguagagaugggguuuc

SEQ ID NO: 482356 - RNA, 24 nt, Human
uuuuuuuuuuuuuuaguagagaug

SEQ ID NO: 482357 - RNA, 23 nt, Human
cagggugcagaagcgagacucga

SEQ ID NO: 482358 - RNA, 22 nt, Human
agccgcaucgccggcccgcgcu

SEQ ID NO: 482359 - RNA, 18 nt, Human
agcggggccuccuccccc

SEQ ID NO: 482360 - RNA, 24 nt, Human
augcagcauccggggcugaggagc

SEQ ID NO: 482361 - RNA, 20 nt, Human
cagcuccggagugccuggcg

SEQ ID NO: 482362 - RNA, 24 nt, Human
cccccgcgccuccgccucccgggc

SEQ ID NO: 482363 - RNA, 19 nt, Human
ccccgcgccuccgccuccc

SEQ ID NO: 482364 - RNA, 18 nt, Human
cccggagcccgccgcccg

SEQ ID NO: 482365 - RNA, 22 nt, Human
ccgcaucgccggcccgcgcucc

SEQ ID NO: 482366 - RNA, 19 nt, Human
ccgcgcuccuggccgcugc

SEQ ID NO: 482367 - RNA, 21 nt, Human
ccugggccggggcgggggggc

SEQ ID NO: 482368 - RNA, 26 nt, Human
cgccggcccgcgcuccuggccgcugc

SEQ ID NO: 482369 - RNA, 23 nt, Human
cgccugggccggggcgggggggc

SEQ ID NO: 482370 - RNA, 19 nt, Human
cggaaggaugaagucaugc

SEQ ID NO: 482371 - RNA, 19 nt, Human
cggagugccuggcggcggc

SEQ ID NO: 482372 - RNA, 18 nt, Human
cggggugggcgcggggcg

SEQ ID NO: 482373 - RNA, 19 nt, Human
cuggccgcugcgaggcugg

SEQ ID NO: 482374 - RNA, 23 nt, Human
gacugcggcggggcgcgggcggc

SEQ ID NO: 482375 - RNA, 19 nt, Human
gccuccucccccgcgccuc

SEQ ID NO: 482376 - RNA, 18 nt, Human
gcgcggggcgggagcggg

SEQ ID NO: 482377 - RNA, 23 nt, Human
gcgggcgcggggugggcgcgggg

SEQ ID NO: 482378 - RNA, 19 nt, Human
gcggggcgcgggcggcggg

SEQ ID NO: 482379 - RNA, 23 nt, Human
ggagugccuggcggcggcggcgg

SEQ ID NO: 482380 - RNA, 18 nt, Human
ggcccggagcccgccgcc

SEQ ID NO: 482381 - RNA, 26 nt, Human
ggcggcggcggcacggcccugcagcc

SEQ ID NO: 482382 - RNA, 23 nt, Human
gggcuugcugccggaccggcccu

SEQ ID NO: 482383 - RNA, 18 nt, Human
ggggcgcgggcggcgggc

SEQ ID NO: 482384 - RNA, 22 nt, Human
gugccuggcggcggcggcggca

SEQ ID NO: 482385 - RNA, 24 nt, Human
ucccccgcgccuccgccucccggg

SEQ ID NO: 482386 - RNA, 24 nt, Human
ucgccggcccgcgcuccuggccgc

SEQ ID NO: 482387 - RNA, 19 nt, Human
ugaggagccaagcggggcc

SEQ ID NO: 482388 - RNA, 19 nt, Human
uggccgcugcgaggcuggg

SEQ ID NO: 482389 - RNA, 20 nt, Human
uggcggcggcggcggcacgg

SEQ ID NO: 482390 - RNA, 25 nt, Human
uggcggcggcggcggcacggcccug

SEQ ID NO: 482391 - RNA, 19 nt, Human
uggugcugaagcggacagc

SEQ ID NO: 482392 - RNA, 18 nt, Human
acuugcucugccuuccuc

SEQ ID NO: 482393 - RNA, 21 nt, Human
acuugcucugccuuccucccu

SEQ ID NO: 482394 - RNA, 23 nt, Human
caaggcuucuacgccuuggggcu

SEQ ID NO: 482395 - RNA, 20 nt, Human
ccagaaacugcuccugcuaa

SEQ ID NO: 482396 - RNA, 24 nt, Human
cuacgccuuggggcucccuccugg

SEQ ID NO: 482397 - RNA, 20 nt, Human
cuccugcuaagcccugcucc

SEQ ID NO: 482398 - RNA, 25 nt, Human
cugaaaauugcagugacauaggcac

SEQ ID NO: 482399 - RNA, 18 nt, Human
cugcuaagcccugcucca

SEQ ID NO: 482400 - RNA, 21 nt, Human
cuggugggcaccgcuucuccu

SEQ ID NO: 482401 - RNA, 20 nt, Human
gaggggcugccccgcuggca

SEQ ID NO: 482402 - RNA, 21 nt, Human
gccuuggggcucccuccuggg

SEQ ID NO: 482403 - RNA, 22 nt, Human
gcuccugcuaagcccugcucca

SEQ ID NO: 482404 - RNA, 24 nt, Human
ggcuggugcuucuggccagaaacu

SEQ ID NO: 482405 - RNA, 24 nt, Human
uagacaccagguuuggaagagcag

SEQ ID NO: 482406 - RNA, 23 nt, Human
uccagaguugaagcuucugagga

SEQ ID NO: 482407 - RNA, 21 nt, Human
ugaauaugucuccugaaaauu

SEQ ID NO: 482408 - RNA, 24 nt, Human
ugcucugccuuccucccucugccg

SEQ ID NO: 482409 - RNA, 19 nt, Human
uggaagagcagaggaguug

SEQ ID NO: 482410 - RNA, 23 nt, Human
uggcagcaggcuggugcuucugg

SEQ ID NO: 482411 - RNA, 21 nt, Human
uggccagaaacugcuccugcu

SEQ ID NO: 482412 - RNA, 21 nt, Human
uucaacaaggcuucuacgccu

SEQ ID NO: 482413 - RNA, 21 nt, Human
uucuccugcucacagcuucaa

SEQ ID NO: 482414 - RNA, 18 nt, Human
uuggaagagcagaggagu

SEQ ID NO: 482415 - RNA, 18 nt, Human
cagacacaaacaugcgac

SEQ ID NO: 482416 - RNA, 19 nt, Human
cagucgggcuccaaacacc

SEQ ID NO: 482417 - RNA, 23 nt, Human
cccgagggcagucgggcuccaaa

SEQ ID NO: 482418 - RNA, 21 nt, Human
cgggcuccaaacaccaacucu

SEQ ID NO: 482419 - RNA, 20 nt, Human
gcagacacaaacaugcgaca

SEQ ID NO: 482420 - RNA, 22 nt, Human
ggcggcggcgacuccggcuccg

SEQ ID NO: 482421 - RNA, 20 nt, Human
uccaaacaccaacucugucc

SEQ ID NO: 482422 - RNA, 18 nt, Human
ugugcccgagggcagucg

SEQ ID NO: 482423 - RNA, 23 nt, Human
acaccucgguacagcagagacag

SEQ ID NO: 482424 - RNA, 19 nt, Human
acagcagagacagacacga

SEQ ID NO: 482425 - RNA, 23 nt, Human
accaggaggauauacaggaugac

SEQ ID NO: 482426 - RNA, 24 nt, Human
agacacgaagggcgggcgggaggg

SEQ ID NO: 482427 - RNA, 21 nt, Human
agcaaaaccaaaccaagccug

SEQ ID NO: 482428 - RNA, 21 nt, Human
aucaaguucuuggcuucagga

SEQ ID NO: 482429 - RNA, 23 nt, Human
caggaugaccccgcaggcccaga

SEQ ID NO: 482430 - RNA, 20 nt, Human
ccagcaaaaccaaaccaagc

SEQ ID NO: 482431 - RNA, 18 nt, Human
ccagcagcagguucucag

SEQ ID NO: 482432 - RNA, 21 nt, Human
cccuccagagccacuggcugc

SEQ ID NO: 482433 - RNA, 22 nt, Human
ccucaagaccucaggggacaag

SEQ ID NO: 482434 - RNA, 24 nt, Human
ccuccggcuggaaucuccuaaagc

SEQ ID NO: 482435 - RNA, 21 nt, Human
cggcuggaaucuccuaaagcc

SEQ ID NO: 482436 - RNA, 20 nt, Human
cuccagagccacuggcugcg

SEQ ID NO: 482437 - RNA, 25 nt, Human
cuccggcuggaaucuccuaaagccc

SEQ ID NO: 482438 - RNA, 20 nt, Human
cuucaggaguuaccgugucc

SEQ ID NO: 482439 - RNA, 22 nt, Human
gcuaggccaaaaucagccagcu

SEQ ID NO: 482440 - RNA, 26 nt, Human
gguacagcagagacagacacgaaggg

SEQ ID NO: 482441 - RNA, 20 nt, Human
guaaaaaacaccucgguaca

SEQ ID NO: 482442 - RNA, 21 nt, Human
guaaaaaacaccucgguacag

SEQ ID NO: 482443 - RNA, 20 nt, Human
gugaugggaaaucauaggcu

SEQ ID NO: 482444 - RNA, 22 nt, Human
uagggaucuuuccucaagaccu

SEQ ID NO: 482445 - RNA, 21 nt, Human
uccagaaucugauguauacag

SEQ ID NO: 482446 - RNA, 19 nt, Human
uccagagccacuggcugcg

SEQ ID NO: 482447 - RNA, 24 nt, Human
ucuccuaaagccccuguggcugag

SEQ ID NO: 482448 - RNA, 21 nt, Human
ugccagcaaaaccaaaccaag

SEQ ID NO: 482449 - RNA, 19 nt, Human
ugcugauccucaucccaga

SEQ ID NO: 482450 - RNA, 23 nt, Human
ugcugguggaugugguuaacacu

SEQ ID NO: 482451 - RNA, 26 nt, Human
aaaagacaacaaaaaaggaaucagaa

SEQ ID NO: 482452 - RNA, 18 nt, Human
aaaagcccuuguccaucc

SEQ ID NO: 482453 - RNA, 18 nt, Human
aaacaacgaugccaacca

SEQ ID NO: 482454 - RNA, 21 nt, Human
aaacaacgaugccaaccaaaa

SEQ ID NO: 482455 - RNA, 18 nt, Human
aacacuggcccugucccc

SEQ ID NO: 482456 - RNA, 23 nt, Human
aacucacuuccugggaaguuaau

SEQ ID NO: 482457 - RNA, 22 nt, Human
aacuugccuuccacuaacucua

SEQ ID NO: 482458 - RNA, 23 nt, Human
aaguaaaagacaacaaaaaagga

SEQ ID NO: 482459 - RNA, 18 nt, Human
acaaaaaaggaaucagaa

SEQ ID NO: 482460 - RNA, 22 nt, Human
accccccucuccaccauaugcc

SEQ ID NO: 482461 - RNA, 18 nt, Human
acugcugauguccucagg

SEQ ID NO: 482462 - RNA, 21 nt, Human
agaauucuccaacacuggccc

SEQ ID NO: 482463 - RNA, 20 nt, Human
agagagaaggugaaggcugc

SEQ ID NO: 482464 - RNA, 20 nt, Human
agccaggccugcccggcccc

SEQ ID NO: 482465 - RNA, 24 nt, Human
agcccuggugucuucuccagccuc

SEQ ID NO: 482466 - RNA, 23 nt, Human
agcccuuguccauccauguuucc

SEQ ID NO: 482467 - RNA, 23 nt, Human
agccggggagaaacguggaccca

SEQ ID NO: 482468 - RNA, 22 nt, Human
agcugagccaggccugcccggc

SEQ ID NO: 482469 - RNA, 20 nt, Human
aggagggccaagaagaggag

SEQ ID NO: 482470 - RNA, 21 nt, Human
aggagggccaagaagaggagg

SEQ ID NO: 482471 - RNA, 21 nt, Human
aggccaaggagggccaagaag

SEQ ID NO: 482472 - RNA, 21 nt, Human
aucuuggucuccugccucugg

SEQ ID NO: 482473 - RNA, 22 nt, Human
augcagcacgaugggggagggg

SEQ ID NO: 482474 - RNA, 23 nt, Human
augcagcacgaugggggaggggc

SEQ ID NO: 482475 - RNA, 22 nt, Human
auucaaaaacaacgaugccaac

SEQ ID NO: 482476 - RNA, 18 nt, Human
caacaggacacccacacc

SEQ ID NO: 482477 - RNA, 22 nt, Human
caagcagggccucuccccgaac

SEQ ID NO: 482478 - RNA, 21 nt, Human
caaggugggcaggguaccccc

SEQ ID NO: 482479 - RNA, 21 nt, Human
cacaccuguggccaaaagccc

SEQ ID NO: 482480 - RNA, 19 nt, Human
cacauucggcuccuagccu

SEQ ID NO: 482481 - RNA, 21 nt, Human
caccaccccaaggugggcagg

SEQ ID NO: 482482 - RNA, 23 nt, Human
cacccacaccuguggccaaaagc

SEQ ID NO: 482483 - RNA, 19 nt, Human
cacccccgcucugagcagg

SEQ ID NO: 482484 - RNA, 18 nt, Human
caccuguggccaaaagcc

SEQ ID NO: 482485 - RNA, 20 nt, Human
cacugccuuagcccagagga

SEQ ID NO: 482486 - RNA, 19 nt, Human
cagaauucuccaacacugg

SEQ ID NO: 482487 - RNA, 21 nt, Human
caggcgcggagaugcagcggg

SEQ ID NO: 482488 - RNA, 18 nt, Human
caggguaccccccucucc

SEQ ID NO: 482489 - RNA, 25 nt, Human
cagguuaaaaacaaaaguaaaagac

SEQ ID NO: 482490 - RNA, 22 nt, Human
ccacacugccuuagcccagagg

SEQ ID NO: 482491 - RNA, 25 nt, Human
ccacaggccugucgcguccauggcc

SEQ ID NO: 482492 - RNA, 23 nt, Human
ccaccugccagcgugcacacccc

SEQ ID NO: 482493 - RNA, 21 nt, Human
ccaggccugcccggccccagc

SEQ ID NO: 482494 - RNA, 18 nt, Human
cccaagaccccaaaugac

SEQ ID NO: 482495 - RNA, 24 nt, Human
cccagguuaaaaacaaaaguaaaa

SEQ ID NO: 482496 - RNA, 19 nt, Human
ccccacagaaugggucagg

SEQ ID NO: 482497 - RNA, 23 nt, Human
ccccaccgccucgcuggggccca

SEQ ID NO: 482498 - RNA, 20 nt, Human
ccccagcccccugccugcgg

SEQ ID NO: 482499 - RNA, 22 nt, Human
ccccagcccccugccugcgggg

SEQ ID NO: 482500 - RNA, 19 nt, Human
cccccaagaccccaaauga

SEQ ID NO: 482501 - RNA, 25 nt, Human
cccccagccagccucccuucuccaa

SEQ ID NO: 482502 - RNA, 21 nt, Human
ccccugagcuuuccaagggug

SEQ ID NO: 482503 - RNA, 23 nt, Human
ccccugagcuuuccaaggguggg

SEQ ID NO: 482504 - RNA, 25 nt, Human
cccgccccaccgccucgcuggggcc

SEQ ID NO: 482505 - RNA, 18 nt, Human
cccgccccgccccgcccc

SEQ ID NO: 482506 - RNA, 18 nt, Human
cccgccccgccccgcccc

SEQ ID NO: 482507 - RNA, 19 nt, Human
cccgccccgccccgccccc

SEQ ID NO: 482508 - RNA, 20 nt, Human
cccgccccgccccgccccgc

SEQ ID NO: 482509 - RNA, 23 nt, Human
cccugcccccaagaccccaaaug

SEQ ID NO: 482510 - RNA, 18 nt, Human
ccgccccgccccaccgcc

SEQ ID NO: 482511 - RNA, 19 nt, Human
ccgccccgccccaccgccu

SEQ ID NO: 482512 - RNA, 21 nt, Human
ccgccccgccccaccgccucg

SEQ ID NO: 482513 - RNA, 24 nt, Human
ccuccugccccaggccaugccaac

SEQ ID NO: 482514 - RNA, 21 nt, Human
ccucugccuccugccccaggc

SEQ ID NO: 482515 - RNA, 21 nt, Human
ccuggacgugcgugcguggag

SEQ ID NO: 482516 - RNA, 21 nt, Human
ccuuguccauccauguuucca

SEQ ID NO: 482517 - RNA, 18 nt, Human
cggcccggcgggcggccc

SEQ ID NO: 482518 - RNA, 21 nt, Human
cgggaugagugugcugccggg

SEQ ID NO: 482519 - RNA, 23 nt, Human
cgugaucccuccgaccuggacag

SEQ ID NO: 482520 - RNA, 22 nt, Human
cuagccuuaaauagacguagaa

SEQ ID NO: 482521 - RNA, 25 nt, Human
cuccagcacccccgcucugagcagg

SEQ ID NO: 482522 - RNA, 18 nt, Human
cucccccagccagccucc

SEQ ID NO: 482523 - RNA, 21 nt, Human
cucccuucuccaaacaagccc

SEQ ID NO: 482524 - RNA, 21 nt, Human
cuccugccccaggccaugcca

SEQ ID NO: 482525 - RNA, 24 nt, Human
cugccaaauaaucuugggcugugc

SEQ ID NO: 482526 - RNA, 19 nt, Human
cugcccccaagaccccaaa

SEQ ID NO: 482527 - RNA, 18 nt, Human
cugccggguggcccuggg

SEQ ID NO: 482528 - RNA, 19 nt, Human
cugccucugccuccugccc

SEQ ID NO: 482529 - RNA, 20 nt, Human
cugccucugccuccugcccc

SEQ ID NO: 482530 - RNA, 21 nt, Human
cuucuccagccucagcucuag

SEQ ID NO: 482531 - RNA, 19 nt, Human
gagaaacguggacccacug

SEQ ID NO: 482532 - RNA, 18 nt, Human
gagcaggcugacugcuga

SEQ ID NO: 482533 - RNA, 18 nt, Human
gaggauggccucguggga

SEQ ID NO: 482534 - RNA, 18 nt, Human
gagggccaagaagaggag

SEQ ID NO: 482535 - RNA, 20 nt, Human
gagggccaagaagaggagga

SEQ ID NO: 482536 - RNA, 25 nt, Human
gauuggcucuuaacuugccuuccac

SEQ ID NO: 482537 - RNA, 19 nt, Human
gccccaggccaugccaacc

SEQ ID NO: 482538 - RNA, 22 nt, Human
gccccgccccaccgccucgcug

SEQ ID NO: 482539 - RNA, 21 nt, Human
gcugccggguggcccugggug

SEQ ID NO: 482540 - RNA, 22 nt, Human
ggaggauggccucgugggagcc

SEQ ID NO: 482541 - RNA, 18 nt, Human
ggccaagaagaggaggau

SEQ ID NO: 482542 - RNA, 24 nt, Human
ggccaagaagaggaggauggccuc

SEQ ID NO: 482543 - RNA, 19 nt, Human
gggaaccugggcgccgggc

SEQ ID NO: 482544 - RNA, 24 nt, Human
gggauccggguuucucccccagcc

SEQ ID NO: 482545 - RNA, 19 nt, Human
gggcaggguaccccccucu

SEQ ID NO: 482546 - RNA, 23 nt, Human
gggcugcaguccccagcccccug

SEQ ID NO: 482547 - RNA, 22 nt, Human
gggggaggggcgggaguggggc

SEQ ID NO: 482548 - RNA, 22 nt, Human
gguaccccccucuccaccauau

SEQ ID NO: 482549 - RNA, 21 nt, Human
gugcugccggguggcccuggg

SEQ ID NO: 482550 - RNA, 25 nt, Human
gugggggucaaccucuaugagcauu

SEQ ID NO: 482551 - RNA, 21 nt, Human
gugugcugccggguggcccug

SEQ ID NO: 482552 - RNA, 21 nt, Human
uaaaaacaaaaguaaaagaca

SEQ ID NO: 482553 - RNA, 21 nt, Human
uaaaagacaacaaaaaaggaa

SEQ ID NO: 482554 - RNA, 23 nt, Human
uaccccccucuccaccauaugcc

SEQ ID NO: 482555 - RNA, 24 nt, Human
uaggagugugagugcagcucuugg

SEQ ID NO: 482556 - RNA, 24 nt, Human
ucaaaaacaacgaugccaaccaaa

SEQ ID NO: 482557 - RNA, 19 nt, Human
ucagaauucuccaacacug

SEQ ID NO: 482558 - RNA, 23 nt, Human
ucagugauuggcucuuaacuugc

SEQ ID NO: 482559 - RNA, 24 nt, Human
uccaacacuggcccuguccccagu

SEQ ID NO: 482560 - RNA, 18 nt, Human
uccaacaggacacccaca

SEQ ID NO: 482561 - RNA, 22 nt, Human
uccagcacccccgcucugagca

SEQ ID NO: 482562 - RNA, 24 nt, Human
uccauccauguuuccagggcagug

SEQ ID NO: 482563 - RNA, 18 nt, Human
ucccccagccagccuccc

SEQ ID NO: 482564 - RNA, 21 nt, Human
uccccgaacccccagguuaaa

SEQ ID NO: 482565 - RNA, 21 nt, Human
uccgaucaaaguggucccccc

SEQ ID NO: 482566 - RNA, 23 nt, Human
uccgcuucaggccucugcucaga

SEQ ID NO: 482567 - RNA, 21 nt, Human
ucuccugccucugccuccugc

SEQ ID NO: 482568 - RNA, 23 nt, Human
ucuccugccucugccuccugccc

SEQ ID NO: 482569 - RNA, 21 nt, Human
ucugagcaggcugacugcuga

SEQ ID NO: 482570 - RNA, 24 nt, Human
ucuuauagaguuugcucaucgcuu

SEQ ID NO: 482571 - RNA, 20 nt, Human
ugagcaucccaccugggccu

SEQ ID NO: 482572 - RNA, 20 nt, Human
ugaggggugggccucuggag

SEQ ID NO: 482573 - RNA, 18 nt, Human
ugauguccucagggugag

SEQ ID NO: 482574 - RNA, 22 nt, Human
ugcacaccccuccagguucugu

SEQ ID NO: 482575 - RNA, 19 nt, Human
ugcacccacaggcgcggag

SEQ ID NO: 482576 - RNA, 20 nt, Human
ugcacgcgcuccagcacccc

SEQ ID NO: 482577 - RNA, 22 nt, Human
ugccccaggccaugccaaccag

SEQ ID NO: 482578 - RNA, 21 nt, Human
ugccucugccuccugccccag

SEQ ID NO: 482579 - RNA, 19 nt, Human
ugccuuagcccagaggagc

SEQ ID NO: 482580 - RNA, 28 nt, Human
uggccaaaagcccuuguccauccauguu

SEQ ID NO: 482581 - RNA, 18 nt, Human
uggcugccaaauaaucuu

SEQ ID NO: 482582 - RNA, 20 nt, Human
ugggcagggacgauguggug

SEQ ID NO: 482583 - RNA, 23 nt, Human
uggggaucagugauuggcucuua

SEQ ID NO: 482584 - RNA, 24 nt, Human
uguggcagcugagccaggccugcc

SEQ ID NO: 482585 - RNA, 19 nt, Human
ugugguaagccuggccucc

SEQ ID NO: 482586 - RNA, 23 nt, Human
ugugugcaacagaugagcacgcg

SEQ ID NO: 482587 - RNA, 25 nt, Human
uuacagaugcauguaccagugcagg

SEQ ID NO: 482588 - RNA, 23 nt, Human
uugcaugaggggugggccucugg

SEQ ID NO: 482589 - RNA, 24 nt, Human
aaaagaaaaaaaaaaagucaucaa

SEQ ID NO: 482590 - RNA, 22 nt, Human
aaacaagagaagcccugcagaa

SEQ ID NO: 482591 - RNA, 23 nt, Human
aaacaagagaagcccugcagaag

SEQ ID NO: 482592 - RNA, 23 nt, Human
aaacgcggugcagcagcccccca

SEQ ID NO: 482593 - RNA, 19 nt, Human
aaacuaaccaagccccauc

SEQ ID NO: 482594 - RNA, 23 nt, Human
aaagggcagaggaaaugggaagu

SEQ ID NO: 482595 - RNA, 19 nt, Human
aaagugcugggauuacagg

SEQ ID NO: 482596 - RNA, 23 nt, Human
aaagugcugggauuacaggugug

SEQ ID NO: 482597 - RNA, 24 nt, Human
aaagugcugggauuacagguguga

SEQ ID NO: 482598 - RNA, 24 nt, Human
aaccaccuccauggccucagaccc

SEQ ID NO: 482599 - RNA, 19 nt, Human
aacuaaccaagccccaucu

SEQ ID NO: 482600 - RNA, 21 nt, Human
aacuggguggauuuccagccc

SEQ ID NO: 482601 - RNA, 22 nt, Human
aagcaggcugggccuaagacua

SEQ ID NO: 482602 - RNA, 23 nt, Human
aaggaaaaaacaaauaaccagag

SEQ ID NO: 482603 - RNA, 18 nt, Human
aagugcugggauuacagg

SEQ ID NO: 482604 - RNA, 19 nt, Human
aagugcugggauuacaggu

SEQ ID NO: 482605 - RNA, 24 nt, Human
acaaaggggaacuuccugugccaa

SEQ ID NO: 482606 - RNA, 19 nt, Human
acagcugggugcugccuga

SEQ ID NO: 482607 - RNA, 24 nt, Human
accaaauuggucccacagaugagc

SEQ ID NO: 482608 - RNA, 18 nt, Human
accacggcucuggaaggu

SEQ ID NO: 482609 - RNA, 28 nt, Human
acccagcaagcaggccagacgacccuuu

SEQ ID NO: 482610 - RNA, 18 nt, Human
accccacugcccccacag

SEQ ID NO: 482611 - RNA, 21 nt, Human
acccucgaccuccccaggcuc

SEQ ID NO: 482612 - RNA, 24 nt, Human
accucgugauccacccgccuuggc

SEQ ID NO: 482613 - RNA, 22 nt, Human
accugccucucaggaaaggcca

SEQ ID NO: 482614 - RNA, 25 nt, Human
agacaagugagagcgacaggccagg

SEQ ID NO: 482615 - RNA, 18 nt, Human
agacagggucucucugug

SEQ ID NO: 482616 - RNA, 23 nt, Human
agacagggucucucuguguugcc

SEQ ID NO: 482617 - RNA, 23 nt, Human
agaccuggagggcucccugaacc

SEQ ID NO: 482618 - RNA, 25 nt, Human
agaggaaaugggaaguggauggagg

SEQ ID NO: 482619 - RNA, 20 nt, Human
agaguccuuccagcuuuccu

SEQ ID NO: 482620 - RNA, 21 nt, Human
agaguccuuccagcuuuccuc

SEQ ID NO: 482621 - RNA, 21 nt, Human
agcacgaucacggcucgcugc

SEQ ID NO: 482622 - RNA, 23 nt, Human
agccaggagggcaagaggaagug

SEQ ID NO: 482623 - RNA, 22 nt, Human
agcccuuucuguuuuccugacu

SEQ ID NO: 482624 - RNA, 18 nt, Human
agcgacccaggggauguc

SEQ ID NO: 482625 - RNA, 21 nt, Human
agcguacccugaaacuucccu

SEQ ID NO: 482626 - RNA, 21 nt, Human
agcugaucagauggaaacaau

SEQ ID NO: 482627 - RNA, 23 nt, Human
aggaaaaaacaaauaaccagaga

SEQ ID NO: 482628 - RNA, 19 nt, Human
aggagaaacgaagaccugg

SEQ ID NO: 482629 - RNA, 24 nt, Human
aggcagaguccuuccagcuuuccu

SEQ ID NO: 482630 - RNA, 18 nt, Human
aggccagaccaguaggga

SEQ ID NO: 482631 - RNA, 21 nt, Human
aggccagaccaguagggaaag

SEQ ID NO: 482632 - RNA, 23 nt, Human
aggcuuucugggagccacuggca

SEQ ID NO: 482633 - RNA, 19 nt, Human
agggggagguggaaaaggg

SEQ ID NO: 482634 - RNA, 23 nt, Human
aggugugagucaccgcgcccggc

SEQ ID NO: 482635 - RNA, 18 nt, Human
aguagcugggauuacagg

SEQ ID NO: 482636 - RNA, 18 nt, Human
aguccuuuuuuuuuuuuu

SEQ ID NO: 482637 - RNA, 23 nt, Human
agugcaguagcacgaucacggcu

SEQ ID NO: 482638 - RNA, 20 nt, Human
agugcagugacgcgaucucg

SEQ ID NO: 482639 - RNA, 19 nt, Human
aguuaacuggguggauuuc

SEQ ID NO: 482640 - RNA, 19 nt, Human
auccacccgccuuggccuc

SEQ ID NO: 482641 - RNA, 23 nt, Human
aucuagcccccuacucccucuca

SEQ ID NO: 482642 - RNA, 19 nt, Human
aucuuggcuuauccuuuuc

SEQ ID NO: 482643 - RNA, 19 nt, Human
augggguuucaccauguug

SEQ ID NO: 482644 - RNA, 24 nt, Human
augggguuucaccauguuguccag

SEQ ID NO: 482645 - RNA, 30 nt, Human
caaaccccacacacagucacuugguauauc

SEQ ID NO: 482646 - RNA, 22 nt, Human
caaaggaaaaaacaaauaacca

SEQ ID NO: 482647 - RNA, 20 nt, Human
caaccaaacuucccaauauc

SEQ ID NO: 482648 - RNA, 21 nt, Human
caaccaccuccauggccucag

SEQ ID NO: 482649 - RNA, 20 nt, Human
caaccucugccucccagguu

SEQ ID NO: 482650 - RNA, 22 nt, Human
caagccccaucuggugccagaa

SEQ ID NO: 482651 - RNA, 21 nt, Human
cacagcugcugaauacccuuc

SEQ ID NO: 482652 - RNA, 22 nt, Human
caccacagcugcugaauacccu

SEQ ID NO: 482653 - RNA, 24 nt, Human
caccauacuuggcuaauuuuugua

SEQ ID NO: 482654 - RNA, 22 nt, Human
caccauguuguccaggcuaauc

SEQ ID NO: 482655 - RNA, 23 nt, Human
caccauguuguccaggcuaaucu

SEQ ID NO: 482656 - RNA, 24 nt, Human
caccauguuguccaggcuaaucuu

SEQ ID NO: 482657 - RNA, 19 nt, Human
cacccgccuguccagccag

SEQ ID NO: 482658 - RNA, 24 nt, Human
cacccgccuuggccuccgaaagug

SEQ ID NO: 482659 - RNA, 19 nt, Human
cacgcuggagugcagugac

SEQ ID NO: 482660 - RNA, 19 nt, Human
cacuaggagccacaucuag

SEQ ID NO: 482661 - RNA, 18 nt, Human
cacugcaaccucugccuc

SEQ ID NO: 482662 - RNA, 21 nt, Human
cacugcaaccucugccuccca

SEQ ID NO: 482663 - RNA, 20 nt, Human
cagaguccuuccagcuuucc

SEQ ID NO: 482664 - RNA, 22 nt, Human
cagcaagcaggccagacgaccc

SEQ ID NO: 482665 - RNA, 25 nt, Human
cagcaagcaggccagacgacccucu

SEQ ID NO: 482666 - RNA, 23 nt, Human
cagcuacugagggccagcccugc

SEQ ID NO: 482667 - RNA, 19 nt, Human
caggaaaggccagaccagg

SEQ ID NO: 482668 - RNA, 21 nt, Human
caggagaaauguuuccccacc

SEQ ID NO: 482669 - RNA, 21 nt, Human
caggagagucaaccuccaagu

SEQ ID NO: 482670 - RNA, 22 nt, Human
caggcugggccuaagacuaggg

SEQ ID NO: 482671 - RNA, 24 nt, Human
cagggucucucuguguugcccagg

SEQ ID NO: 482672 - RNA, 19 nt, Human
caguucucugccucagucu

SEQ ID NO: 482673 - RNA, 19 nt, Human
cauaccccaacgagugcug

SEQ ID NO: 482674 - RNA, 19 nt, Human
cauccagcacacuggggca

SEQ ID NO: 482675 - RNA, 22 nt, Human
cauggagucaaguccuuuuuuu

SEQ ID NO: 482676 - RNA, 24 nt, Human
cauguuguccaggcuaaucuugaa

SEQ ID NO: 482677 - RNA, 24 nt, Human
ccacacaagcaggcugggccuaag

SEQ ID NO: 482678 - RNA, 22 nt, Human
ccaccaggccaggccagagccc

SEQ ID NO: 482679 - RNA, 22 nt, Human
cccagguucaagcaguucucug

SEQ ID NO: 482680 - RNA, 24 nt, Human
cccauaaacauaaagccaggaggg

SEQ ID NO: 482681 - RNA, 27 nt, Human
ccccacugcccccacagcugggugcug

SEQ ID NO: 482682 - RNA, 19 nt, Human
ccccagaaacucggccucc

SEQ ID NO: 482683 - RNA, 21 nt, Human
ccccagaaacucggccuccag

SEQ ID NO: 482684 - RNA, 20 nt, Human
ccccccagaggcgacgcggc

SEQ ID NO: 482685 - RNA, 24 nt, Human
cccccggaguuuucugcucgccuu

SEQ ID NO: 482686 - RNA, 20 nt, Human
ccccugggccagccaccagg

SEQ ID NO: 482687 - RNA, 23 nt, Human
cccgaguagcugggauuacaggc

SEQ ID NO: 482688 - RNA, 24 nt, Human
cccgaguagcugggauuacaggcg

SEQ ID NO: 482689 - RNA, 20 nt, Human
cccggaguuuucugcucgcc

SEQ ID NO: 482690 - RNA, 21 nt, Human
cccggcccacucccauuuuuu

SEQ ID NO: 482691 - RNA, 22 nt, Human
ccgaaagugcugggauuacagg

SEQ ID NO: 482692 - RNA, 24 nt, Human
ccgaaagugcugggauuacaggug

SEQ ID NO: 482693 - RNA, 22 nt, Human
ccgacucccuuuuuuuuuuuuu

SEQ ID NO: 482694 - RNA, 22 nt, Human
ccgaguagcugggauuacaggc

SEQ ID NO: 482695 - RNA, 19 nt, Human
ccuccagcuggagagggga

SEQ ID NO: 482696 - RNA, 24 nt, Human
ccucccagguucaagcaguucucu

SEQ ID NO: 482697 - RNA, 20 nt, Human
ccugaccucgugauccaccc

SEQ ID NO: 482698 - RNA, 19 nt, Human
ccuggcccuucagaaacug

SEQ ID NO: 482699 - RNA, 24 nt, Human
ccuuuuuuuuuuuuuuuugucccc

SEQ ID NO: 482700 - RNA, 24 nt, Human
cgaaagugcugggauuacaggugu

SEQ ID NO: 482701 - RNA, 23 nt, Human
cgagccaaugagagcuccacccc

SEQ ID NO: 482702 - RNA, 22 nt, Human
cgcagccccaagugucaacaag

SEQ ID NO: 482703 - RNA, 24 nt, Human
cgcagccccaagugucaacaaggg

SEQ ID NO: 482704 - RNA, 24 nt, Human
cgcccacgcuggagugcagugacg

SEQ ID NO: 482705 - RNA, 18 nt, Human
cgcgcccggcccacuccc

SEQ ID NO: 482706 - RNA, 24 nt, Human
cgcucugucgcccacgcuggagug

SEQ ID NO: 482707 - RNA, 18 nt, Human
cuaagcacugcugccccc

SEQ ID NO: 482708 - RNA, 24 nt, Human
cucaaaugcucuguguuuacagcc

SEQ ID NO: 482709 - RNA, 21 nt, Human
cucaacuucacacuccccuac

SEQ ID NO: 482710 - RNA, 24 nt, Human
cucagucucccgaguagcugggau

SEQ ID NO: 482711 - RNA, 20 nt, Human
cucccccaccccacugcccc

SEQ ID NO: 482712 - RNA, 21 nt, Human
cuccuuguuccagaaaggcuc

SEQ ID NO: 482713 - RNA, 19 nt, Human
cucuagaguucacucuagu

SEQ ID NO: 482714 - RNA, 22 nt, Human
cucucaggaaaggccagaccag

SEQ ID NO: 482715 - RNA, 23 nt, Human
cucucccauaaacauaaagccag

SEQ ID NO: 482716 - RNA, 24 nt, Human
cucucuguguugcccaggcuggag

SEQ ID NO: 482717 - RNA, 21 nt, Human
cucuggaaggagucacacuug

SEQ ID NO: 482718 - RNA, 22 nt, Human
cucuguguugcccaggcuggag

SEQ ID NO: 482719 - RNA, 23 nt, Human
cucuuaaguucauguacuuuuua

SEQ ID NO: 482720 - RNA, 24 nt, Human
cugcaaccucugccucccagguuc

SEQ ID NO: 482721 - RNA, 23 nt, Human
cugccucagucucccgaguagcu

SEQ ID NO: 482722 - RNA, 19 nt, Human
cuggaaggagucacacuug

SEQ ID NO: 482723 - RNA, 18 nt, Human
cuggacuuuuagcuacaa

SEQ ID NO: 482724 - RNA, 19 nt, Human
cuggcagcuggugggaugg

SEQ ID NO: 482725 - RNA, 24 nt, Human
cugggagccacuggcagcuggugg

SEQ ID NO: 482726 - RNA, 22 nt, Human
cuucaaaaccagcauucccuaa

SEQ ID NO: 482727 - RNA, 21 nt, Human
cuuggccuccgaaagugcugg

SEQ ID NO: 482728 - RNA, 27 nt, Human
cuuuuuuuuuuuuuuuuuuuuuucuuu

SEQ ID NO: 482729 - RNA, 20 nt, Human
gaaaauccccuuccagcagc

SEQ ID NO: 482730 - RNA, 20 nt, Human
gaagggggagguggaaaagg

SEQ ID NO: 482731 - RNA, 21 nt, Human
gaccucgugauccacccgccu

SEQ ID NO: 482732 - RNA, 21 nt, Human
gaccucgugauccacccgccu

SEQ ID NO: 482733 - RNA, 22 nt, Human
gaccucgugauccacccgccuu

SEQ ID NO: 482734 - RNA, 24 nt, Human
gaccucgugauccacccgccuugg

SEQ ID NO: 482735 - RNA, 20 nt, Human
gacucccuuuuuuuuuuuuu

SEQ ID NO: 482736 - RNA, 23 nt, Human
gacucccuuuuuuuuuuuuuuuu

SEQ ID NO: 482737 - RNA, 29 nt, Human
gacucccuuuuuuuuuuuuuuuuuuuuuu

SEQ ID NO: 482738 - RNA, 20 nt, Human
gagaugggguuucaccaugu

SEQ ID NO: 482739 - RNA, 23 nt, Human
gagaugggguuucaccauguugu

SEQ ID NO: 482740 - RNA, 18 nt, Human
gagccacuuugcuggagc

SEQ ID NO: 482741 - RNA, 18 nt, Human
gagggccagcccugcucu

SEQ ID NO: 482742 - RNA, 27 nt, Human
gaguagcugggauuacaggcgccggcc

SEQ ID NO: 482743 - RNA, 22 nt, Human
gaugggguuucaccauguuguc

SEQ ID NO: 482744 - RNA, 18 nt, Human
gauuacaggcgccggcca

SEQ ID NO: 482745 - RNA, 18 nt, Human
gauuacaggugugaguca

SEQ ID NO: 482746 - RNA, 22 nt, Human
gauuacaggugugagucaccgc

SEQ ID NO: 482747 - RNA, 22 nt, Human
gauuacaggugugagucaccgc

SEQ ID NO: 482748 - RNA, 19 nt, Human
gcaaaacaagucuggcuaa

SEQ ID NO: 482749 - RNA, 22 nt, Human
gcaaccucugccucccagguuc

SEQ ID NO: 482750 - RNA, 19 nt, Human
gcauugucugaugcagcug

SEQ ID NO: 482751 - RNA, 21 nt, Human
gccaagaaggcccagggcucc

SEQ ID NO: 482752 - RNA, 20 nt, Human
gccagaccaguagggaaagg

SEQ ID NO: 482753 - RNA, 19 nt, Human
gccaucuuggcuuauccuu

SEQ ID NO: 482754 - RNA, 19 nt, Human
gcccaggcuggagugcagu

SEQ ID NO: 482755 - RNA, 18 nt, Human
gccgucuuuccccagccc

SEQ ID NO: 482756 - RNA, 24 nt, Human
gccucagucucccgaguagcuggg

SEQ ID NO: 482757 - RNA, 22 nt, Human
gccuuggccuccgaaagugcug

SEQ ID NO: 482758 - RNA, 26 nt, Human
gcucggucagcuaucucagaaaccug

SEQ ID NO: 482759 - RNA, 21 nt, Human
gcugaauacccuuccaggcuu

SEQ ID NO: 482760 - RNA, 21 nt, Human
ggaaacaauggggaagcagag

SEQ ID NO: 482761 - RNA, 18 nt, Human
ggaaaggccuccgcagcc

SEQ ID NO: 482762 - RNA, 24 nt, Human
ggagccacaucuagcccccuacuc

SEQ ID NO: 482763 - RNA, 18 nt, Human
ggagggcaagaggaagug

SEQ ID NO: 482764 - RNA, 24 nt, Human
ggcuaaucuugaauuccugaccuc

SEQ ID NO: 482765 - RNA, 20 nt, Human
ggcugggcaggggcacgagg

SEQ ID NO: 482766 - RNA, 23 nt, Human
gggaaugaaacagaagcaucggg

SEQ ID NO: 482767 - RNA, 20 nt, Human
gggagguggaaaagggcaga

SEQ ID NO: 482768 - RNA, 19 nt, Human
gggccagcccugcucugac

SEQ ID NO: 482769 - RNA, 19 nt, Human
ggggaagcagaguuucccg

SEQ ID NO: 482770 - RNA, 22 nt, Human
gggguuucaccauguuguccag

SEQ ID NO: 482771 - RNA, 23 nt, Human
gggguuucaccauguuguccagg

SEQ ID NO: 482772 - RNA, 19 nt, Human
gggugcugccugauugcug

SEQ ID NO: 482773 - RNA, 19 nt, Human
guagagaugggguuucacc

SEQ ID NO: 482774 - RNA, 21 nt, Human
guagagaugggguuucaccau

SEQ ID NO: 482775 - RNA, 22 nt, Human
guagagaugggguuucaccaug

SEQ ID NO: 482776 - RNA, 23 nt, Human
guagagaugggguuucaccaugu

SEQ ID NO: 482777 - RNA, 18 nt, Human
guagcugggauuacaggc

SEQ ID NO: 482778 - RNA, 18 nt, Human
gucaaaccccacacacag

SEQ ID NO: 482779 - RNA, 31 nt, Human
gucaaguccuuuuuuuuuuuuuuuugucccc

SEQ ID NO: 482780 - RNA, 22 nt, Human
guccuuccagcuuuccuccccc

SEQ ID NO: 482781 - RNA, 22 nt, Human
gugauccacccgccuuggccuc

SEQ ID NO: 482782 - RNA, 24 nt, Human
uaaaaagcaauuucccaaaaugca

SEQ ID NO: 482783 - RNA, 23 nt, Human
uaaaacaacaaaggaaaaaacaa

SEQ ID NO: 482784 - RNA, 22 nt, Human
uaaaagguucaaagcccucuag

SEQ ID NO: 482785 - RNA, 24 nt, Human
uaacagcaccuccuuuccugacug

SEQ ID NO: 482786 - RNA, 22 nt, Human
uaaccaagccccaucuggugcc

SEQ ID NO: 482787 - RNA, 22 nt, Human
uaauuuuuguauuuuucguaga

SEQ ID NO: 482788 - RNA, 24 nt, Human
uaauuuuuguauuuuucguagaga

SEQ ID NO: 482789 - RNA, 19 nt, Human
uacaaagacccagcaagca

SEQ ID NO: 482790 - RNA, 22 nt, Human
uacccugaaacuucccuagcac

SEQ ID NO: 482791 - RNA, 23 nt, Human
uagaaaaaucugcaguccccaga

SEQ ID NO: 482792 - RNA, 24 nt, Human
uagacuaccuguccuuugcucuuc

SEQ ID NO: 482793 - RNA, 22 nt, Human
uagagaugggguuucaccaugu

SEQ ID NO: 482794 - RNA, 23 nt, Human
uagcaaaacaagucuggcuaaac

SEQ ID NO: 482795 - RNA, 21 nt, Human
uaggagccacaucuagccccc

SEQ ID NO: 482796 - RNA, 21 nt, Human
uauggaagccaagaaggccca

SEQ ID NO: 482797 - RNA, 19 nt, Human
ucaaccaaacuucccaaua

SEQ ID NO: 482798 - RNA, 22 nt, Human
ucacaccacagcugaucagaug

SEQ ID NO: 482799 - RNA, 19 nt, Human
ucacugcaaccucugccuc

SEQ ID NO: 482800 - RNA, 24 nt, Human
ucacugcaaccucugccucccagg

SEQ ID NO: 482801 - RNA, 25 nt, Human
ucacugcaaccucugccucccaggu

SEQ ID NO: 482802 - RNA, 23 nt, Human
ucagucucccgaguagcugggau

SEQ ID NO: 482803 - RNA, 21 nt, Human
ucauuaaaagaaaaaaaaaaa

SEQ ID NO: 482804 - RNA, 21 nt, Human
ucccagguucaagcaguucuc

SEQ ID NO: 482805 - RNA, 21 nt, Human
ucccagguucaagcaguucuc

SEQ ID NO: 482806 - RNA, 21 nt, Human
ucccauaaacauaaagccagg

SEQ ID NO: 482807 - RNA, 22 nt, Human
ucccccaccccacugcccccac

SEQ ID NO: 482808 - RNA, 24 nt, Human
ucccgaguagcugggauuacaggc

SEQ ID NO: 482809 - RNA, 18 nt, Human
ucccuagcaccuuggaag

SEQ ID NO: 482810 - RNA, 18 nt, Human
ucccuuuuuuuuuuuuuu

SEQ ID NO: 482811 - RNA, 24 nt, Human
uccgaaagugcugggauuacaggu

SEQ ID NO: 482812 - RNA, 25 nt, Human
uccugugccaagcccugguuuccuc

SEQ ID NO: 482813 - RNA, 19 nt, Human
uccuuccagcuuuccuccc

SEQ ID NO: 482814 - RNA, 24 nt, Human
uccuugagaccacggcucuggaag

SEQ ID NO: 482815 - RNA, 19 nt, Human
uccuuuucauguggggcag

SEQ ID NO: 482816 - RNA, 18 nt, Human
ucgcccacgcuggagugc

SEQ ID NO: 482817 - RNA, 21 nt, Human
ucguagagaugggguuucacc

SEQ ID NO: 482818 - RNA, 24 nt, Human
ucguagagaugggguuucaccaug

SEQ ID NO: 482819 - RNA, 20 nt, Human
ucucccccaccccacugccc

SEQ ID NO: 482820 - RNA, 26 nt, Human
ucucccccaccccacugcccccacag

SEQ ID NO: 482821 - RNA, 18 nt, Human
ucucgcucugucgcccac

SEQ ID NO: 482822 - RNA, 23 nt, Human
ucucgcucugucgcccacgcugg

SEQ ID NO: 482823 - RNA, 24 nt, Human
ucucgcucugucgcccacgcugga

SEQ ID NO: 482824 - RNA, 23 nt, Human
ucucucuguguugcccaggcugg

SEQ ID NO: 482825 - RNA, 24 nt, Human
ucucucuguguugcccaggcugga

SEQ ID NO: 482826 - RNA, 20 nt, Human
ucucuguguugcccaggcug

SEQ ID NO: 482827 - RNA, 21 nt, Human
ucucuguguugcccaggcugg

SEQ ID NO: 482828 - RNA, 23 nt, Human
ucucuguguugcccaggcuggag

SEQ ID NO: 482829 - RNA, 24 nt, Human
ucucuguguugcccaggcuggagu

SEQ ID NO: 482830 - RNA, 18 nt, Human
ucugcaguccccagaaac

SEQ ID NO: 482831 - RNA, 19 nt, Human
ucugguauuucuaggccgu

SEQ ID NO: 482832 - RNA, 24 nt, Human
ucugucgcccacgcuggagugcag

SEQ ID NO: 482833 - RNA, 20 nt, Human
ucuguguugcccaggcugga

SEQ ID NO: 482834 - RNA, 22 nt, Human
ugaaaacaaaaccuuagcaguc

SEQ ID NO: 482835 - RNA, 22 nt, Human
ugaaacagaagcaucgggcauu

SEQ ID NO: 482836 - RNA, 22 nt, Human
ugaaacggagucucgcucuguc

SEQ ID NO: 482837 - RNA, 19 nt, Human
ugaaagcauuucccaccug

SEQ ID NO: 482838 - RNA, 23 nt, Human
ugaaccucaaccaaacuucccaa

SEQ ID NO: 482839 - RNA, 22 nt, Human
ugacaaagagauuuaccagagc

SEQ ID NO: 482840 - RNA, 18 nt, Human
ugagacagggucucucug

SEQ ID NO: 482841 - RNA, 23 nt, Human
ugagacagggucucucuguguug

SEQ ID NO: 482842 - RNA, 23 nt, Human
ugccaugguuuccgguuugcacu

SEQ ID NO: 482843 - RNA, 18 nt, Human
ugcccaggcuggagugca

SEQ ID NO: 482844 - RNA, 19 nt, Human
ugcccaggcuggagugcag

SEQ ID NO: 482845 - RNA, 23 nt, Human
ugccucagucucccgaguagcug

SEQ ID NO: 482846 - RNA, 24 nt, Human
ugccucagucucccgaguagcugg

SEQ ID NO: 482847 - RNA, 22 nt, Human
ugccugaagcugugaaauauau

SEQ ID NO: 482848 - RNA, 18 nt, Human
ugcguuggaucccccagc

SEQ ID NO: 482849 - RNA, 23 nt, Human
ugcguuggaucccccagcuggau

SEQ ID NO: 482850 - RNA, 18 nt, Human
ugcugggauuacaggugu

SEQ ID NO: 482851 - RNA, 24 nt, Human
ugcugggauuacaggugugaguca

SEQ ID NO: 482852 - RNA, 19 nt, Human
ugcuggguuacaaagaccc

SEQ ID NO: 482853 - RNA, 18 nt, Human
ugcuguggguuucaacag

SEQ ID NO: 482854 - RNA, 22 nt, Human
uggaaacaauggggaagcagag

SEQ ID NO: 482855 - RNA, 18 nt, Human
uggaagacaagugagagc

SEQ ID NO: 482856 - RNA, 24 nt, Human
uggaaggugccaugguuuccgguu

SEQ ID NO: 482857 - RNA, 30 nt, Human
uggagggcucccugaaccguccuacggggg

SEQ ID NO: 482858 - RNA, 24 nt, Human
uggagucaaguccuuuuuuuuuuu

SEQ ID NO: 482859 - RNA, 21 nt, Human
uggagugcaguagcacgauca

SEQ ID NO: 482860 - RNA, 24 nt, Human
uggagugcaguagcacgaucacgg

SEQ ID NO: 482861 - RNA, 19 nt, Human
uggagugcagugacgcgau

SEQ ID NO: 482862 - RNA, 23 nt, Human
uggagugcagugacgcgaucucg

SEQ ID NO: 482863 - RNA, 24 nt, Human
uggagugcagugacgcgaucucgg

SEQ ID NO: 482864 - RNA, 22 nt, Human
uggcuaaacuacagucaagagc

SEQ ID NO: 482865 - RNA, 24 nt, Human
ugggaaguggauggaggguuugug

SEQ ID NO: 482866 - RNA, 25 nt, Human
ugggaaucucccaaggcagaguccu

SEQ ID NO: 482867 - RNA, 22 nt, Human
ugggagccacuggcagcugguc

SEQ ID NO: 482868 - RNA, 22 nt, Human
ugggagccacuggcagcuggug

SEQ ID NO: 482869 - RNA, 24 nt, Human
ugggagccacuggcagcugguggg

SEQ ID NO: 482870 - RNA, 21 nt, Human
ugggauuacaggcgccggcca

SEQ ID NO: 482871 - RNA, 22 nt, Human
ugggauuacaggcgccggccac

SEQ ID NO: 482872 - RNA, 24 nt, Human
ugggauuacaggcgccggccacca

SEQ ID NO: 482873 - RNA, 25 nt, Human
ugggauuacaggcgccggccaccau

SEQ ID NO: 482874 - RNA, 18 nt, Human
ugggauuacaggugugag

SEQ ID NO: 482875 - RNA, 18 nt, Human
ugggauuacaggugugag

SEQ ID NO: 482876 - RNA, 21 nt, Human
ugggauuacaggugugaguca

SEQ ID NO: 482877 - RNA, 22 nt, Human
ugggauuacaggugugagucac

SEQ ID NO: 482878 - RNA, 23 nt, Human
ugggauuacaggugugagucacc

SEQ ID NO: 482879 - RNA, 24 nt, Human
ugggauuacaggugugagucaccg

SEQ ID NO: 482880 - RNA, 24 nt, Human
ugggguuucaccauguuguccagg

SEQ ID NO: 482881 - RNA, 25 nt, Human
ugggucucccccaccccacugcccc

SEQ ID NO: 482882 - RNA, 23 nt, Human
ugggugcugccugauugcuggca

SEQ ID NO: 482883 - RNA, 22 nt, Human
uguaaacaagagaagcccugca

SEQ ID NO: 482884 - RNA, 24 nt, Human
uguccaggcuaaucuugaauuccu

SEQ ID NO: 482885 - RNA, 22 nt, Human
uguguugcccaggcuggagugc

SEQ ID NO: 482886 - RNA, 24 nt, Human
uguguugcccaggcuggagugcag

SEQ ID NO: 482887 - RNA, 19 nt, Human
uguuuaaucuuaagccaug

SEQ ID NO: 482888 - RNA, 19 nt, Human
uuaaucuuaagccauguaa

SEQ ID NO: 482889 - RNA, 20 nt, Human
uuaccagagcucggucagcu

SEQ ID NO: 482890 - RNA, 22 nt, Human
uuauccuuuucauguggggcag

SEQ ID NO: 482891 - RNA, 24 nt, Human
uuauuaaauuucaagcccuuucug

SEQ ID NO: 482892 - RNA, 21 nt, Human
uucaaagcccucuaguuaacu

SEQ ID NO: 482893 - RNA, 23 nt, Human
uucaaagcccucuaguuaacugg

SEQ ID NO: 482894 - RNA, 24 nt, Human
uuccugaccucgugauccacccgc

SEQ ID NO: 482895 - RNA, 24 nt, Human
uucguagagaugggguuucaccau

SEQ ID NO: 482896 - RNA, 23 nt, Human
uucuaggccguagggacacucac

SEQ ID NO: 482897 - RNA, 22 nt, Human
uugagacagggucucucugugu

SEQ ID NO: 482898 - RNA, 24 nt, Human
uugagacagggucucucuguguug

SEQ ID NO: 482899 - RNA, 23 nt, Human
uugagaccacggcucuggaaggu

SEQ ID NO: 482900 - RNA, 23 nt, Human
uugcacuaggagccacaucuagc

SEQ ID NO: 482901 - RNA, 24 nt, Human
uugcccaggcuggagugcaguagc

SEQ ID NO: 482902 - RNA, 24 nt, Human
uuguuuugagacagggucucucug

SEQ ID NO: 482903 - RNA, 21 nt, Human
uuucaccauguuguccaggcu

SEQ ID NO: 482904 - RNA, 22 nt, Human
uuugacaaagagauuuaccaga

SEQ ID NO: 482905 - RNA, 24 nt, Human
uuuuucguagagaugggguuucac

SEQ ID NO: 482906 - RNA, 20 nt, Human
uuuuuguauuuuucguagag

SEQ ID NO: 482907 - RNA, 23 nt, Human
uuuuuguauuuuucguagagaug

SEQ ID NO: 482908 - RNA, 22 nt, Human
uuuuuuuuuuuaccauuuugcu

SEQ ID NO: 482909 - RNA, 19 nt, Human
uuuuuuuuuuuucuuuucu

SEQ ID NO: 482910 - RNA, 27 nt, Human
uuuuuuuuuuuuuuuucuuuucugggg

SEQ ID NO: 482911 - RNA, 24 nt, Human
uuuuuuuuuuuuuuuuuuucuuuu

SEQ ID NO: 482912 - RNA, 24 nt, Human
uuuuuuuuuuuuuuuuuuuucuuu

SEQ ID NO: 482913 - RNA, 23 nt, Human
aaacaggaaaaaauguacuucaa

SEQ ID NO: 482914 - RNA, 23 nt, Human
aaaccccaggcuccaaaucaaga

SEQ ID NO: 482915 - RNA, 21 nt, Human
aaauuuugaaaaguuacauug

SEQ ID NO: 482916 - RNA, 26 nt, Human
aacaccuucccgaaaccccaggcucc

SEQ ID NO: 482917 - RNA, 18 nt, Human
acacuucagcaaagaaga

SEQ ID NO: 482918 - RNA, 19 nt, Human
acaggaaaaaauguacuuc

SEQ ID NO: 482919 - RNA, 22 nt, Human
accuucccgaaaccccaggcuc

SEQ ID NO: 482920 - RNA, 22 nt, Human
acuucagcaaagaagauggcac

SEQ ID NO: 482921 - RNA, 20 nt, Human
agccacaaacuggggauucc

SEQ ID NO: 482922 - RNA, 19 nt, Human
augcagcccugaggugucu

SEQ ID NO: 482923 - RNA, 18 nt, Human
augucaaauaauuccuuc

SEQ ID NO: 482924 - RNA, 20 nt, Human
auuguaaacauaaauauuau

SEQ ID NO: 482925 - RNA, 19 nt, Human
caacacuucagcaaagaag

SEQ ID NO: 482926 - RNA, 22 nt, Human
caaucuuugaaagugcaaaaca

SEQ ID NO: 482927 - RNA, 23 nt, Human
cacaucucaucccauaaacacuc

SEQ ID NO: 482928 - RNA, 26 nt, Human
cagguacaauaaauuuguagccaaua

SEQ ID NO: 482929 - RNA, 25 nt, Human
cccauaaacacucuuagaaaaaaau

SEQ ID NO: 482930 - RNA, 26 nt, Human
cccgaaaccccaggcuccaaaucaag

SEQ ID NO: 482931 - RNA, 20 nt, Human
ccgcgcggaccccgcuccuc

SEQ ID NO: 482932 - RNA, 22 nt, Human
ccgcgcucgcucugccugcgcc

SEQ ID NO: 482933 - RNA, 23 nt, Human
ccuccugcccccgccucguccgc

SEQ ID NO: 482934 - RNA, 19 nt, Human
ccugcgccuccugcccccg

SEQ ID NO: 482935 - RNA, 19 nt, Human
cgcggaccccgcuccuccc

SEQ ID NO: 482936 - RNA, 21 nt, Human
cucugugcugcggcgaccucc

SEQ ID NO: 482937 - RNA, 22 nt, Human
cuucccgaaaccccaggcucca

SEQ ID NO: 482938 - RNA, 24 nt, Human
gaaaugaaacaggguagccacaaa

SEQ ID NO: 482939 - RNA, 19 nt, Human
gcacaaguggaaaugaaac

SEQ ID NO: 482940 - RNA, 22 nt, Human
gcuggcaaauuuaagaaucuug

SEQ ID NO: 482941 - RNA, 21 nt, Human
gguucuauuccuucagaggua

SEQ ID NO: 482942 - RNA, 19 nt, Human
uaaauuacauaaacagcca

SEQ ID NO: 482943 - RNA, 23 nt, Human
uaacauuuaaguccagaaaauau

SEQ ID NO: 482944 - RNA, 20 nt, Human
uaagcugaaugcagcccuga

SEQ ID NO: 482945 - RNA, 28 nt, Human
uacagaagauauacauacauacagugug

SEQ ID NO: 482946 - RNA, 23 nt, Human
uaccaaacucuucacgugggccu

SEQ ID NO: 482947 - RNA, 20 nt, Human
uagauuccucaacaccuucc

SEQ ID NO: 482948 - RNA, 23 nt, Human
uagcacaucucaucccauaaaca

SEQ ID NO: 482949 - RNA, 18 nt, Human
uagucuaauugugaaaac

SEQ ID NO: 482950 - RNA, 19 nt, Human
uauugugcucuucugaaau

SEQ ID NO: 482951 - RNA, 21 nt, Human
uauugugcucuucugaaaugu

SEQ ID NO: 482952 - RNA, 23 nt, Human
uauugugcucuucugaaauguua

SEQ ID NO: 482953 - RNA, 18 nt, Human
ucccgaaaccccaggcuc

SEQ ID NO: 482954 - RNA, 18 nt, Human
ucccgcgcucgcucugcc

SEQ ID NO: 482955 - RNA, 24 nt, Human
ucuauagauuccucaacaccuucc

SEQ ID NO: 482956 - RNA, 19 nt, Human
ucuaucccauuuguagcac

SEQ ID NO: 482957 - RNA, 22 nt, Human
ucugugcugcggcgaccucccg

SEQ ID NO: 482958 - RNA, 22 nt, Human
ugcagcccugaggugucucagg

SEQ ID NO: 482959 - RNA, 21 nt, Human
uggcacaguaucuauuaugua

SEQ ID NO: 482960 - RNA, 24 nt, Human
uguaaauuuugaaaaguuacauug

SEQ ID NO: 482961 - RNA, 23 nt, Human
ugugaaaacaggaaaaaauguac

SEQ ID NO: 482962 - RNA, 28 nt, Human
uguggucagguucuauuccccguggucg

SEQ ID NO: 482963 - RNA, 21 nt, Human
uuauuuggcacaguaucuauc

SEQ ID NO: 482964 - RNA, 24 nt, Human
uuccucaacaccuucccgaaaccc

SEQ ID NO: 482965 - RNA, 21 nt, Human
uucuaccaaacucuucacgug

SEQ ID NO: 482966 - RNA, 19 nt, Human
uugcuuugggcauuugaaa

SEQ ID NO: 482967 - RNA, 19 nt, Human
uuguagcacaucucauccc

SEQ ID NO: 482968 - RNA, 21 nt, Human
aaaaacauggaauuuacuggc

SEQ ID NO: 482969 - RNA, 21 nt, Human
aaaacaaacaaacaaacaaac

SEQ ID NO: 482970 - RNA, 20 nt, Human
aaacagaaaugaaaacaguc

SEQ ID NO: 482971 - RNA, 23 nt, Human
aaacagaaaugaaaacagucuga

SEQ ID NO: 482972 - RNA, 26 nt, Human
aaauaaacagugaaggaaaugagaac

SEQ ID NO: 482973 - RNA, 23 nt, Human
aaauaaccggcaggugcaggaac

SEQ ID NO: 482974 - RNA, 22 nt, Human
aacaaacaaacaaacaaaaaua

SEQ ID NO: 482975 - RNA, 19 nt, Human
aacaugaaaaaggggacaa

SEQ ID NO: 482976 - RNA, 24 nt, Human
aacaugaaaaaggggacaagauga

SEQ ID NO: 482977 - RNA, 22 nt, Human
aagauucagcuucuuggaaaua

SEQ ID NO: 482978 - RNA, 19 nt, Human
aagugcaaaugcaaugacc

SEQ ID NO: 482979 - RNA, 23 nt, Human
aauccugcagcugaucuccccaa

SEQ ID NO: 482980 - RNA, 18 nt, Human
acaaacaaacaaacaaac

SEQ ID NO: 482981 - RNA, 20 nt, Human
acccgcccuggccccgcccc

SEQ ID NO: 482982 - RNA, 19 nt, Human
accggcaggugcaggaaca

SEQ ID NO: 482983 - RNA, 24 nt, Human
accugccccucugcaaauuuccac

SEQ ID NO: 482984 - RNA, 25 nt, Human
accuuuucuuaucuauauuuuuggu

SEQ ID NO: 482985 - RNA, 20 nt, Human
acgugugugugugugcgugu

SEQ ID NO: 482986 - RNA, 18 nt, Human
agaacgcagcaccacacu

SEQ ID NO: 482987 - RNA, 24 nt, Human
agagauuaaaacaaacaaacaaac

SEQ ID NO: 482988 - RNA, 22 nt, Human
agcugcuucucauuauuuccca

SEQ ID NO: 482989 - RNA, 22 nt, Human
auagugaaauaaaguuuuuuug

SEQ ID NO: 482990 - RNA, 23 nt, Human
augcauuacccguuuaccacaca

SEQ ID NO: 482991 - RNA, 18 nt, Human
augucucugcuaaaaaca

SEQ ID NO: 482992 - RNA, 22 nt, Human
auguguguguacgugugugugu

SEQ ID NO: 482993 - RNA, 20 nt, Human
auugcacaugaaaguaaggc

SEQ ID NO: 482994 - RNA, 23 nt, Human
caaaacauuccuguuaaaauccu

SEQ ID NO: 482995 - RNA, 20 nt, Human
caagaugauuacuacccucg

SEQ ID NO: 482996 - RNA, 24 nt, Human
caauuaauauaaucccuuucaaau

SEQ ID NO: 482997 - RNA, 23 nt, Human
caccugccccucugcaaauuucc

SEQ ID NO: 482998 - RNA, 25 nt, Human
cagcccuauaugagaaggaaauggc

SEQ ID NO: 482999 - RNA, 22 nt, Human
caucgcucccgccgccaaucgc

SEQ ID NO: 483000 - RNA, 22 nt, Human
ccaccccgccgccgccgcgcac

SEQ ID NO: 483001 - RNA, 21 nt, Human
ccaggggucucacuacucucc

SEQ ID NO: 483002 - RNA, 23 nt, Human
cccaaagauucagcuucuuggaa

SEQ ID NO: 483003 - RNA, 25 nt, Human
cccaugcauuacccguuuaccacac

SEQ ID NO: 483004 - RNA, 29 nt, Human
ccccgcaccaggggucucacuacucuccc

SEQ ID NO: 483005 - RNA, 20 nt, Human
ccccgccccgcggcccacgc

SEQ ID NO: 483006 - RNA, 22 nt, Human
ccccgccgccgccgcgcacccg

SEQ ID NO: 483007 - RNA, 27 nt, Human
ccccgccgccgccgcgcacccgcccug

SEQ ID NO: 483008 - RNA, 21 nt, Human
cccgcccuggccccgccccgc

SEQ ID NO: 483009 - RNA, 23 nt, Human
cccgccgccgccgcgcacccgcc

SEQ ID NO: 483010 - RNA, 21 nt, Human
cccuauaugagaaggaaaugg

SEQ ID NO: 483011 - RNA, 22 nt, Human
cccucugcaaauuuccacaaga

SEQ ID NO: 483012 - RNA, 21 nt, Human
ccgccgccgccgccggcccag

SEQ ID NO: 483013 - RNA, 19 nt, Human
ccggcccagccaccccgcc

SEQ ID NO: 483014 - RNA, 23 nt, Human
ccugcagcugaucuccccaaaac

SEQ ID NO: 483015 - RNA, 20 nt, Human
ccuggccccgccccgcggcc

SEQ ID NO: 483016 - RNA, 22 nt, Human
cgccccgcaccaggggucucac

SEQ ID NO: 483017 - RNA, 22 nt, Human
cgccccgcggcccacgcacagc

SEQ ID NO: 483018 - RNA, 24 nt, Human
cgccccgcggcccacgcacagcuc

SEQ ID NO: 483019 - RNA, 24 nt, Human
cgcccuggccccgccccgcggccc

SEQ ID NO: 483020 - RNA, 18 nt, Human
cgcgaccgggaccccgag

SEQ ID NO: 483021 - RNA, 23 nt, Human
cgggaccccgagcgcgcgccucg

SEQ ID NO: 483022 - RNA, 19 nt, Human
cucacuuuucauuucuacc

SEQ ID NO: 483023 - RNA, 22 nt, Human
cugcagauuucaaaaguugcau

SEQ ID NO: 483024 - RNA, 18 nt, Human
cugccccucugcaaauuu

SEQ ID NO: 483025 - RNA, 21 nt, Human
gaacgcagcaccacacugauc

SEQ ID NO: 483026 - RNA, 18 nt, Human
gcaggaacagcauucuuu

SEQ ID NO: 483027 - RNA, 24 nt, Human
gccccgccccgcggcccacgcaca

SEQ ID NO: 483028 - RNA, 27 nt, Human
gcgcgccucguaccgccgccgccgccg

SEQ ID NO: 483029 - RNA, 25 nt, Human
gcuuuuguucauuucuuuuuucuug

SEQ ID NO: 483030 - RNA, 22 nt, Human
ggaugagauauagccaaaaaca

SEQ ID NO: 483031 - RNA, 23 nt, Human
ggggucucacuacucuccgggag

SEQ ID NO: 483032 - RNA, 20 nt, Human
gggucucacuacucuccggg

SEQ ID NO: 483033 - RNA, 24 nt, Human
gguggcaaauguccaggcaagguu

SEQ ID NO: 483034 - RNA, 24 nt, Human
gugugcgugugugcguguguguug

SEQ ID NO: 483035 - RNA, 21 nt, Human
guguguguacgugugugugug

SEQ ID NO: 483036 - RNA, 21 nt, Human
gugugugugcgugugugcgug

SEQ ID NO: 483037 - RNA, 21 nt, Human
uaaaaaaggcuacaugcguua

SEQ ID NO: 483038 - RNA, 22 nt, Human
uaaaaaaggcuacaugcguuac

SEQ ID NO: 483039 - RNA, 26 nt, Human
uaaaaguuguccaugaaagugcaaau

SEQ ID NO: 483040 - RNA, 22 nt, Human
uaaaauccugcagcugaucucc

SEQ ID NO: 483041 - RNA, 21 nt, Human
uaaacagugaaggaaaugaga

SEQ ID NO: 483042 - RNA, 23 nt, Human
uaaacucugugagcugcuucuca

SEQ ID NO: 483043 - RNA, 19 nt, Human
uaccacacaccugccccuc

SEQ ID NO: 483044 - RNA, 21 nt, Human
uaccgccgccgccgccggccc

SEQ ID NO: 483045 - RNA, 23 nt, Human
uacgugugugugugugcgugugu

SEQ ID NO: 483046 - RNA, 18 nt, Human
uagccccaccuuuucuua

SEQ ID NO: 483047 - RNA, 23 nt, Human
uauguguguguacgugugugugu

SEQ ID NO: 483048 - RNA, 24 nt, Human
ucaugcuuuagcaaaauguucucc

SEQ ID NO: 483049 - RNA, 23 nt, Human
ucauucagacaaaacuauacaaa

SEQ ID NO: 483050 - RNA, 23 nt, Human
ucuaccuucuauauauacacaga

SEQ ID NO: 483051 - RNA, 24 nt, Human
ucucauuauuucccaugcauuacc

SEQ ID NO: 483052 - RNA, 26 nt, Human
ucucugcuaaaaacagaaaugaaaac

SEQ ID NO: 483053 - RNA, 19 nt, Human
ugagaacacacggacccaa

SEQ ID NO: 483054 - RNA, 19 nt, Human
ugagaagaggaagccucuu

SEQ ID NO: 483055 - RNA, 20 nt, Human
ugagaaggaaauggcuucuu

SEQ ID NO: 483056 - RNA, 21 nt, Human
ugagaaggaaauggcuucuuc

SEQ ID NO: 483057 - RNA, 24 nt, Human
ugagaaggaaauggcuucuuccug

SEQ ID NO: 483058 - RNA, 23 nt, Human
ugagauauagccaaaaacaugga

SEQ ID NO: 483059 - RNA, 22 nt, Human
ugcagcugaucuccccaaaacu

SEQ ID NO: 483060 - RNA, 18 nt, Human
uggaaggugguggggaca

SEQ ID NO: 483061 - RNA, 27 nt, Human
uguguacguguguguguggugacacac

SEQ ID NO: 483062 - RNA, 19 nt, Human
uguguacgugugugugugu

SEQ ID NO: 483063 - RNA, 19 nt, Human
uguguacgugugugugugu

SEQ ID NO: 483064 - RNA, 20 nt, Human
ugugugcgugugugcgugug

SEQ ID NO: 483065 - RNA, 21 nt, Human
ugugugcgugugugcgugugu

SEQ ID NO: 483066 - RNA, 22 nt, Human
ugugugcgugugugcgugugug

SEQ ID NO: 483067 - RNA, 26 nt, Human
uguguguacgugugugugugugcgug

SEQ ID NO: 483068 - RNA, 18 nt, Human
ugugugugugugcgugug

SEQ ID NO: 483069 - RNA, 21 nt, Human
ugugugugugugcgugugugc

SEQ ID NO: 483070 - RNA, 22 nt, Human
ugugugugugugcgugugugcg

SEQ ID NO: 483071 - RNA, 28 nt, Human
uuaucuugccauguuauugaccuuugug

SEQ ID NO: 483072 - RNA, 23 nt, Human
uuguucauuucuuuuuucuugau

SEQ ID NO: 483073 - RNA, 18 nt, Human
uuguugcaugucucugcu

SEQ ID NO: 483074 - RNA, 23 nt, Human
uuucaaauauuuucucacuuuuc

SEQ ID NO: 483075 - RNA, 23 nt, Human
uuuguauguguguguacgugugu

SEQ ID NO: 483076 - RNA, 21 nt, Human
uuuuuuuuuuuuugcaguuua

SEQ ID NO: 483077 - RNA, 25 nt, Human
aaccacaagcccggccgugcagccc

SEQ ID NO: 483078 - RNA, 18 nt, Human
acaaaggugaacaggaaa

SEQ ID NO: 483079 - RNA, 24 nt, Human
acaaauaaauaaggcaagucagga

SEQ ID NO: 483080 - RNA, 18 nt, Human
agacggggcacgaccagg

SEQ ID NO: 483081 - RNA, 20 nt, Human
agcgaaggcaguggugggaa

SEQ ID NO: 483082 - RNA, 20 nt, Human
agcggccauucuaccccaca

SEQ ID NO: 483083 - RNA, 23 nt, Human
aggaaacagacgcaaacaugcgg

SEQ ID NO: 483084 - RNA, 21 nt, Human
aggagaggggugugggagcaa

SEQ ID NO: 483085 - RNA, 18 nt, Human
aggagcuggggagcaggg

SEQ ID NO: 483086 - RNA, 18 nt, Human
aggagggacgaggagagg

SEQ ID NO: 483087 - RNA, 21 nt, Human
aggagggggccgagucgggug

SEQ ID NO: 483088 - RNA, 18 nt, Human
aggcaagucaggaggggg

SEQ ID NO: 483089 - RNA, 21 nt, Human
aggggugugggagcaaggcgu

SEQ ID NO: 483090 - RNA, 22 nt, Human
aggggugugggagcaaggcgug

SEQ ID NO: 483091 - RNA, 27 nt, Human
aggggugugggagcaaggcguggggag

SEQ ID NO: 483092 - RNA, 23 nt, Human
caaggucacccccggccugaggg

SEQ ID NO: 483093 - RNA, 22 nt, Human
caggagggacgaggagaggggu

SEQ ID NO: 483094 - RNA, 19 nt, Human
cagggccagagagggagga

SEQ ID NO: 483095 - RNA, 18 nt, Human
ccccagaaagcccucucc

SEQ ID NO: 483096 - RNA, 18 nt, Human
ccccagaaagcccucucc

SEQ ID NO: 483097 - RNA, 19 nt, Human
cccccaggguggugagaaa

SEQ ID NO: 483098 - RNA, 25 nt, Human
cccccgccgcgcuagagaaccacaa

SEQ ID NO: 483099 - RNA, 20 nt, Human
cccgccgcgcuagagaacca

SEQ ID NO: 483100 - RNA, 21 nt, Human
cccgccgcgcuagagaaccac

SEQ ID NO: 483101 - RNA, 22 nt, Human
cccgccgcgcuagagaaccaca

SEQ ID NO: 483102 - RNA, 22 nt, Human
cccggccgugcagcccuccccg

SEQ ID NO: 483103 - RNA, 21 nt, Human
cccugaaacacgaggggcgug

SEQ ID NO: 483104 - RNA, 23 nt, Human
cccugccccagaaagcccucucc

SEQ ID NO: 483105 - RNA, 21 nt, Human
ccugccccagaaagcccucuc

SEQ ID NO: 483106 - RNA, 20 nt, Human
cgaacaaauaaauaaggcaa

SEQ ID NO: 483107 - RNA, 21 nt, Human
cggagucggguggggacacgg

SEQ ID NO: 483108 - RNA, 23 nt, Human
cgggugcaggcaggaggagcugg

SEQ ID NO: 483109 - RNA, 21 nt, Human
cguauaaaccaagcccaugca

SEQ ID NO: 483110 - RNA, 25 nt, Human
gaacaaauaaauaaggcaagucagg

SEQ ID NO: 483111 - RNA, 21 nt, Human
gaagaugcagguauguggggc

SEQ ID NO: 483112 - RNA, 22 nt, Human
gacggggcacgaccaggaggga

SEQ ID NO: 483113 - RNA, 18 nt, Human
gaggagggaggaggccua

SEQ ID NO: 483114 - RNA, 20 nt, Human
gcacgaccaggagggacgag

SEQ ID NO: 483115 - RNA, 23 nt, Human
gcagcggccauucuaccccacac

SEQ ID NO: 483116 - RNA, 26 nt, Human
gcaguggugggaaccgaggcggauac

SEQ ID NO: 483117 - RNA, 19 nt, Human
gcgcggguuuucuggagcc

SEQ ID NO: 483118 - RNA, 18 nt, Human
gcuggggagcaggggcag

SEQ ID NO: 483119 - RNA, 19 nt, Human
ggagucggguggggacacg

SEQ ID NO: 483120 - RNA, 18 nt, Human
gggcaggcagggcuccgg

SEQ ID NO: 483121 - RNA, 21 nt, Human
gggccggggggagggggaguc

SEQ ID NO: 483122 - RNA, 24 nt, Human
gggugcaggcaggaggagcugggg

SEQ ID NO: 483123 - RNA, 24 nt, Human
ggugcagcgauguuuaauggcaau

SEQ ID NO: 483124 - RNA, 21 nt, Human
guuacaguauguacaagaccc

SEQ ID NO: 483125 - RNA, 19 nt, Human
uacaccaccuccccuucgg

SEQ ID NO: 483126 - RNA, 27 nt, Human
uauguacaccaccuccccuucggcccu

SEQ ID NO: 483127 - RNA, 20 nt, Human
ucagcccugaaacacgaggg

SEQ ID NO: 483128 - RNA, 25 nt, Human
ucagcccugaaacacgaggggcgug

SEQ ID NO: 483129 - RNA, 19 nt, Human
ucuaccccacaccgacccc

SEQ ID NO: 483130 - RNA, 24 nt, Human
ucuggagccaggaccaaaagagac

SEQ ID NO: 483131 - RNA, 22 nt, Human
ugacggcggcagcggccauucu

SEQ ID NO: 483132 - RNA, 20 nt, Human
ugcaggcaggaggagcuggg

SEQ ID NO: 483133 - RNA, 20 nt, Human
ugcagguauguggggcgcgg

SEQ ID NO: 483134 - RNA, 22 nt, Human
uggccagagucgggugaugggg

SEQ ID NO: 483135 - RNA, 18 nt, Human
uggggaggagggaggagg

SEQ ID NO: 483136 - RNA, 23 nt, Human
aagaccuaaaaccagccugcagu

SEQ ID NO: 483137 - RNA, 20 nt, Human
aagggcacugcuacagcagc

SEQ ID NO: 483138 - RNA, 22 nt, Human
acaggacaaucucucuucccac

SEQ ID NO: 483139 - RNA, 24 nt, Human
accagcuucugcuaccuucaugcu

SEQ ID NO: 483140 - RNA, 19 nt, Human
accaucuggaaacacaccg

SEQ ID NO: 483141 - RNA, 19 nt, Human
agaaagaaaggguccaaga

SEQ ID NO: 483142 - RNA, 21 nt, Human
agaagaaccaucuggaaacac

SEQ ID NO: 483143 - RNA, 23 nt, Human
agaauaacccccaaaagcucaaa

SEQ ID NO: 483144 - RNA, 18 nt, Human
agagacucuccuaucuca

SEQ ID NO: 483145 - RNA, 19 nt, Human
agagcagagaagcaguuuu

SEQ ID NO: 483146 - RNA, 18 nt, Human
agcugugcuucucagagc

SEQ ID NO: 483147 - RNA, 21 nt, Human
aggacaaucucucuucccacc

SEQ ID NO: 483148 - RNA, 19 nt, Human
augacagggaaaaggaggc

SEQ ID NO: 483149 - RNA, 27 nt, Human
auguggguuuuuuuuuuuuuuuccuuu

SEQ ID NO: 483150 - RNA, 21 nt, Human
caccccaaaucucagccugag

SEQ ID NO: 483151 - RNA, 20 nt, Human
cagaagccauaagcugauga

SEQ ID NO: 483152 - RNA, 20 nt, Human
cagaguuccgccucaccucc

SEQ ID NO: 483153 - RNA, 18 nt, Human
caggacaaucucucuucc

SEQ ID NO: 483154 - RNA, 20 nt, Human
ccaccaaaaaaaaguugcau

SEQ ID NO: 483155 - RNA, 25 nt, Human
ccagagacucuccuaucucacgguu

SEQ ID NO: 483156 - RNA, 26 nt, Human
ccaggauagaauagagaauaaaagga

SEQ ID NO: 483157 - RNA, 24 nt, Human
ccaucuggaaacacaccagcuucu

SEQ ID NO: 483158 - RNA, 22 nt, Human
ccugcaguggagguuucagucc

SEQ ID NO: 483159 - RNA, 22 nt, Human
cuagagggaaaaacaacugaaa

SEQ ID NO: 483160 - RNA, 26 nt, Human
cucagagcagagaagcaguuuuaaga

SEQ ID NO: 483161 - RNA, 21 nt, Human
cucagaguuccgccucaccuc

SEQ ID NO: 483162 - RNA, 21 nt, Human
gaagaaccaucuggaaacaca

SEQ ID NO: 483163 - RNA, 19 nt, Human
gacagggaaaaggaggcag

SEQ ID NO: 483164 - RNA, 19 nt, Human
gagacucuccuaucucacg

SEQ ID NO: 483165 - RNA, 21 nt, Human
ggaaugccagacuccuugaaa

SEQ ID NO: 483166 - RNA, 19 nt, Human
gggcaaagaacccaguggc

SEQ ID NO: 483167 - RNA, 22 nt, Human
gggcagggaucccagagaaaga

SEQ ID NO: 483168 - RNA, 19 nt, Human
ggguuuuuuuuuuuuuuuc

SEQ ID NO: 483169 - RNA, 20 nt, Human
ggguuuuuuuuuuuuuuucc

SEQ ID NO: 483170 - RNA, 21 nt, Human
ggguuuuuuuuuuuuuuuccu

SEQ ID NO: 483171 - RNA, 26 nt, Human
ggugacaggcaccuggcagggaagaa

SEQ ID NO: 483172 - RNA, 25 nt, Human
gguuuuuuuuuuuuuuuccuuuuaa

SEQ ID NO: 483173 - RNA, 26 nt, Human
guagaauaacccccaaaagcucaaag

SEQ ID NO: 483174 - RNA, 23 nt, Human
guccaagacuccauuaacugccc

SEQ ID NO: 483175 - RNA, 23 nt, Human
gugaagggagggcaaagaaccca

SEQ ID NO: 483176 - RNA, 21 nt, Human
guuagaagaaccaucuggaaa

SEQ ID NO: 483177 - RNA, 20 nt, Human
uaaaaccagccugcagugga

SEQ ID NO: 483178 - RNA, 24 nt, Human
uaacuuuauucuauuuucuguaua

SEQ ID NO: 483179 - RNA, 25 nt, Human
uaagagcaaaaagguagaggaaauc

SEQ ID NO: 483180 - RNA, 22 nt, Human
uacagcagcuaguaccagagac

SEQ ID NO: 483181 - RNA, 22 nt, Human
uacauuagcagugcugugcaag

SEQ ID NO: 483182 - RNA, 19 nt, Human
uagaagaaccaucuggaaa

SEQ ID NO: 483183 - RNA, 18 nt, Human
uagaauaacccccaaaag

SEQ ID NO: 483184 - RNA, 23 nt, Human
uagaauaacccccaaaagcucaa

SEQ ID NO: 483185 - RNA, 19 nt, Human
uagaauagagaauaaaagg

SEQ ID NO: 483186 - RNA, 22 nt, Human
ucaaagcuaaaaugcaucauca

SEQ ID NO: 483187 - RNA, 20 nt, Human
ucaucaguccuagucggcag

SEQ ID NO: 483188 - RNA, 21 nt, Human
uccacaggccucaggaaaugg

SEQ ID NO: 483189 - RNA, 18 nt, Human
ugaccugcuaucccaccc

SEQ ID NO: 483190 - RNA, 24 nt, Human
ugcaacccuugccucgcuugucaa

SEQ ID NO: 483191 - RNA, 20 nt, Human
ugccagacuccuugaaauca

SEQ ID NO: 483192 - RNA, 23 nt, Human
ugcuacagcagcuaguaccagag

SEQ ID NO: 483193 - RNA, 19 nt, Human
uggaaugcuagauggccaa

SEQ ID NO: 483194 - RNA, 24 nt, Human
uggaaugcuagauggccaagccuc

SEQ ID NO: 483195 - RNA, 21 nt, Human
uggaccaccugcucagaguuc

SEQ ID NO: 483196 - RNA, 18 nt, Human
uggcagggaagaaggauu

SEQ ID NO: 483197 - RNA, 18 nt, Human
uggcagggaagaaggauu

SEQ ID NO: 483198 - RNA, 23 nt, Human
uggccaagccucagccuuugguc

SEQ ID NO: 483199 - RNA, 24 nt, Human
uggugugaagggagggcaaagaac

SEQ ID NO: 483200 - RNA, 30 nt, Human
uguggguuuuuuuuuuuuuuuccuuuuaaa

SEQ ID NO: 483201 - RNA, 22 nt, Human
uguuaauuccagggacuguuuu

SEQ ID NO: 483202 - RNA, 19 nt, Human
uguucaggugcuuagacag

SEQ ID NO: 483203 - RNA, 21 nt, Human
uuccacaggccucaggaaaug

SEQ ID NO: 483204 - RNA, 22 nt, Human
uugguccagugcaacccuugcc

SEQ ID NO: 483205 - RNA, 25 nt, Human
uuuaagagcaaaaagguagaggaaa

SEQ ID NO: 483206 - RNA, 23 nt, Human
aaacaagcacacaaacaauagac

SEQ ID NO: 483207 - RNA, 23 nt, Human
aaacagccaaaggauguagacaa

SEQ ID NO: 483208 - RNA, 24 nt, Human
aaacuccagaaugugaaguuggca

SEQ ID NO: 483209 - RNA, 21 nt, Human
aaauaaacuccagaaugugaa

SEQ ID NO: 483210 - RNA, 26 nt, Human
aacgacaagaugaaacccaagaggaa

SEQ ID NO: 483211 - RNA, 23 nt, Human
aagaaaugaaauaaacuccagaa

SEQ ID NO: 483212 - RNA, 22 nt, Human
aagacaagugcaggaguaaacc

SEQ ID NO: 483213 - RNA, 20 nt, Human
aagcacacaaacaauagaca

SEQ ID NO: 483214 - RNA, 20 nt, Human
aagcccagaagaaaugcugg

SEQ ID NO: 483215 - RNA, 20 nt, Human
aaggacaacgugauccuaca

SEQ ID NO: 483216 - RNA, 24 nt, Human
agacaagugcaggaguaaaccaag

SEQ ID NO: 483217 - RNA, 24 nt, Human
agacaauaucuuuuugucuuuggu

SEQ ID NO: 483218 - RNA, 18 nt, Human
agacuacagcucaacauc

SEQ ID NO: 483219 - RNA, 22 nt, Human
agcaucucuuaugcucuaaugu

SEQ ID NO: 483220 - RNA, 21 nt, Human
agcccagaagaaaugcuggua

SEQ ID NO: 483221 - RNA, 21 nt, Human
aggaggcagaaaggcccagga

SEQ ID NO: 483222 - RNA, 22 nt, Human
aggaggcagaaaggcccaggac

SEQ ID NO: 483223 - RNA, 23 nt, Human
aggcagaguuaaauuguacagug

SEQ ID NO: 483224 - RNA, 19 nt, Human
aguuucaguaucguaagga

SEQ ID NO: 483225 - RNA, 18 nt, Human
augaaucuuucacuucug

SEQ ID NO: 483226 - RNA, 27 nt, Human
auggaagaaaauggucuucaaaaagaa

SEQ ID NO: 483227 - RNA, 20 nt, Human
auuacacugugcaacccugc

SEQ ID NO: 483228 - RNA, 20 nt, Human
auuuaucuauaccucucuca

SEQ ID NO: 483229 - RNA, 19 nt, Human
caaaacaagcacacaaaca

SEQ ID NO: 483230 - RNA, 21 nt, Human
caaaaugcaaauauuccaaug

SEQ ID NO: 483231 - RNA, 21 nt, Human
caagaaaccuuugcuucucuu

SEQ ID NO: 483232 - RNA, 20 nt, Human
caagcccagaagaaaugcug

SEQ ID NO: 483233 - RNA, 21 nt, Human
cacaaacugaaaagaaaaggc

SEQ ID NO: 483234 - RNA, 20 nt, Human
cacaagcccagaagaaaugc

SEQ ID NO: 483235 - RNA, 23 nt, Human
cagacauuauugagcuugccuau

SEQ ID NO: 483236 - RNA, 23 nt, Human
cauuucuuuguuuucaugcccac

SEQ ID NO: 483237 - RNA, 26 nt, Human
ccaaauaacacaaacugaaaagaaaa

SEQ ID NO: 483238 - RNA, 19 nt, Human
ccagcccugcauugguccu

SEQ ID NO: 483239 - RNA, 19 nt, Human
cccacacagagaacacuaa

SEQ ID NO: 483240 - RNA, 20 nt, Human
ccgggugcccuccucgcacc

SEQ ID NO: 483241 - RNA, 21 nt, Human
cgcaaaacaagcacacaaaca

SEQ ID NO: 483242 - RNA, 25 nt, Human
cgcaaaacaagcacacaaacaauag

SEQ ID NO: 483243 - RNA, 24 nt, Human
cgcaccgggugcccuccucgcacc

SEQ ID NO: 483244 - RNA, 21 nt, Human
cggaaaccagucaagaaggca

SEQ ID NO: 483245 - RNA, 20 nt, Human
cucaacaucacaagcccaga

SEQ ID NO: 483246 - RNA, 20 nt, Human
cugaguaucugugauucugg

SEQ ID NO: 483247 - RNA, 19 nt, Human
cugcccacugaaaauaacc

SEQ ID NO: 483248 - RNA, 19 nt, Human
cuggaugccugagaugguc

SEQ ID NO: 483249 - RNA, 21 nt, Human
cuucaguaggggcauuucuuu

SEQ ID NO: 483250 - RNA, 20 nt, Human
gaacggaaaccagucaagaa

SEQ ID NO: 483251 - RNA, 21 nt, Human
gaagaaaauggucuucaaaaa

SEQ ID NO: 483252 - RNA, 24 nt, Human
gaugcaaaggcaaguuuggaggga

SEQ ID NO: 483253 - RNA, 18 nt, Human
gauuacacugugcaaccc

SEQ ID NO: 483254 - RNA, 19 nt, Human
gcaaaacaagcacacaaac

SEQ ID NO: 483255 - RNA, 18 nt, Human
gcccagaagaaaugcugg

SEQ ID NO: 483256 - RNA, 24 nt, Human
ggagcagcugguagagauucagaa

SEQ ID NO: 483257 - RNA, 22 nt, Human
ggcagacauuauugagcuugcc

SEQ ID NO: 483258 - RNA, 23 nt, Human
ggcauuucuuuguuuucaugccc

SEQ ID NO: 483259 - RNA, 23 nt, Human
gguuaaggguuuaauacuguuua

SEQ ID NO: 483260 - RNA, 18 nt, Human
gguugcccggccuggccu

SEQ ID NO: 483261 - RNA, 20 nt, Human
gguuuaaaauucuuuagaug

SEQ ID NO: 483262 - RNA, 24 nt, Human
uaaaaaauguuccauagcgcaaaa

SEQ ID NO: 483263 - RNA, 24 nt, Human
uaaaaaauuuacagcagcuguaaa

SEQ ID NO: 483264 - RNA, 18 nt, Human
uaaaagaaccagcccugc

SEQ ID NO: 483265 - RNA, 24 nt, Human
uaaacgacaagaugaaacccaaga

SEQ ID NO: 483266 - RNA, 19 nt, Human
uaaacuuucuuauuaaaaa

SEQ ID NO: 483267 - RNA, 22 nt, Human
uaaaguuucaguaucguaagga

SEQ ID NO: 483268 - RNA, 18 nt, Human
uaacacaaacugaaaaga

SEQ ID NO: 483269 - RNA, 19 nt, Human
uaacagcaucucugacuuc

SEQ ID NO: 483270 - RNA, 21 nt, Human
uaaccccaagaaaccuuugcu

SEQ ID NO: 483271 - RNA, 23 nt, Human
uaaguacaagguccagaagcacu

SEQ ID NO: 483272 - RNA, 19 nt, Human
uaagucagguguuucuggc

SEQ ID NO: 483273 - RNA, 22 nt, Human
uacagcucaacaucacaagccc

SEQ ID NO: 483274 - RNA, 22 nt, Human
uaccacauuguccuaugaacuc

SEQ ID NO: 483275 - RNA, 24 nt, Human
uagaaaaacaaccuacagucccau

SEQ ID NO: 483276 - RNA, 24 nt, Human
uagaagcuucaagauggagguuua

SEQ ID NO: 483277 - RNA, 26 nt, Human
uagaccagaauuacauuucaaaagug

SEQ ID NO: 483278 - RNA, 21 nt, Human
uagcgcaaaacaagcacacaa

SEQ ID NO: 483279 - RNA, 21 nt, Human
uaggauuacacugugcaaccc

SEQ ID NO: 483280 - RNA, 22 nt, Human
uaggggcauuucuuuguuuuca

SEQ ID NO: 483281 - RNA, 21 nt, Human
ucagugcuuuccuuauuuguc

SEQ ID NO: 483282 - RNA, 18 nt, Human
ucauuuccuaaaucauuc

SEQ ID NO: 483283 - RNA, 22 nt, Human
uccacacuacugguuaauaacc

SEQ ID NO: 483284 - RNA, 23 nt, Human
uccacuuugccaugccuggaugc

SEQ ID NO: 483285 - RNA, 18 nt, Human
uccgcccucggcuaccac

SEQ ID NO: 483286 - RNA, 22 nt, Human
ucugugauucugggagcagcug

SEQ ID NO: 483287 - RNA, 20 nt, Human
ucuuagucaauuugcucauu

SEQ ID NO: 483288 - RNA, 21 nt, Human
ucuuuggugcacacacucauu

SEQ ID NO: 483289 - RNA, 18 nt, Human
ugaguaucugugauucug

SEQ ID NO: 483290 - RNA, 24 nt, Human
ugcaaaaugcaaauauuccaauga

SEQ ID NO: 483291 - RNA, 20 nt, Human
ugggguuuuucuaauauacu

SEQ ID NO: 483292 - RNA, 18 nt, Human
ugguagagauucagaaug

SEQ ID NO: 483293 - RNA, 25 nt, Human
uguaccacauuguccuaugaacucc

SEQ ID NO: 483294 - RNA, 21 nt, Human
uuccacacuacugguuaauaa

SEQ ID NO: 483295 - RNA, 18 nt, Human
uuccaugguauagaccag

SEQ ID NO: 483296 - RNA, 22 nt, Human
uuccuuggccacauaaaacuag

SEQ ID NO: 483297 - RNA, 23 nt, Human
uugaagguuugcaggccaaaaug

SEQ ID NO: 483298 - RNA, 22 nt, Human
uugcccggccuggccuccccgc

SEQ ID NO: 483299 - RNA, 22 nt, Human
uuggugcacacacucauuuccu

SEQ ID NO: 483300 - RNA, 22 nt, Human
uuguaaauaugaauccaguaga

SEQ ID NO: 483301 - RNA, 19 nt, Human
uuguaucaugcuucuaacc

SEQ ID NO: 483302 - RNA, 21 nt, Human
uuuccuuauuugucaagagcu

SEQ ID NO: 483303 - RNA, 20 nt, Human
uuuguuaaaaccacagguuc

SEQ ID NO: 483304 - RNA, 20 nt, Human
uuuuuuuucagaugcaggua

SEQ ID NO: 483305 - RNA, 20 nt, Human
acuucuccucucugcauccc

SEQ ID NO: 483306 - RNA, 21 nt, Human
agaagacuuccgagguccuuu

SEQ ID NO: 483307 - RNA, 24 nt, Human
aggcagguaaaauaguccaucaag

SEQ ID NO: 483308 - RNA, 20 nt, Human
cacaacauaguucccagggc

SEQ ID NO: 483309 - RNA, 21 nt, Human
cacaccccauaauuauccccu

SEQ ID NO: 483310 - RNA, 21 nt, Human
cagcaagucacucaccggucc

SEQ ID NO: 483311 - RNA, 20 nt, Human
cagcucugucauuugcaucu

SEQ ID NO: 483312 - RNA, 21 nt, Human
caggugccugucacugucugg

SEQ ID NO: 483313 - RNA, 19 nt, Human
cauucugagguugaaaugg

SEQ ID NO: 483314 - RNA, 20 nt, Human
ccccucccuuucuaagcucu

SEQ ID NO: 483315 - RNA, 18 nt, Human
ccccuuucuccaauccca

SEQ ID NO: 483316 - RNA, 21 nt, Human
ccucagguccccuuucuccaa

SEQ ID NO: 483317 - RNA, 23 nt, Human
ccucucugcaucccaguaagggc

SEQ ID NO: 483318 - RNA, 19 nt, Human
cggaugagacugggugggg

SEQ ID NO: 483319 - RNA, 18 nt, Human
cuagguaccauaccugcu

SEQ ID NO: 483320 - RNA, 21 nt, Human
cucacaccccauaauuauccc

SEQ ID NO: 483321 - RNA, 30 nt, Human
cucauugugcagagccccuggcagcuauuu

SEQ ID NO: 483322 - RNA, 21 nt, Human
cucuccuuagaagacuuccga

SEQ ID NO: 483323 - RNA, 21 nt, Human
cucugcauuccagcuugaagu

SEQ ID NO: 483324 - RNA, 25 nt, Human
cuuuccaggcacagcagaacuccag

SEQ ID NO: 483325 - RNA, 18 nt, Human
gagacuggcagaggagga

SEQ ID NO: 483326 - RNA, 18 nt, Human
gagcauaucuguugaaaa

SEQ ID NO: 483327 - RNA, 20 nt, Human
gagcauaucuguugaaaaug

SEQ ID NO: 483328 - RNA, 23 nt, Human
ggaggggagacgggcagguucca

SEQ ID NO: 483329 - RNA, 26 nt, Human
ggcagcaaggaugcuguaugugccac

SEQ ID NO: 483330 - RNA, 20 nt, Human
gguccccuuucuccaauccc

SEQ ID NO: 483331 - RNA, 21 nt, Human
gugcaaccacaacauaguucc

SEQ ID NO: 483332 - RNA, 18 nt, Human
uagaagacuuccgagguc

SEQ ID NO: 483333 - RNA, 19 nt, Human
ucaagucacuucuccucuc

SEQ ID NO: 483334 - RNA, 22 nt, Human
ucaccggucccucacuuuuucc

SEQ ID NO: 483335 - RNA, 18 nt, Human
ucagguccccuuucucca

SEQ ID NO: 483336 - RNA, 19 nt, Human
ucauugugcagagccccug

SEQ ID NO: 483337 - RNA, 21 nt, Human
uccccuuucuccaaucccacg

SEQ ID NO: 483338 - RNA, 25 nt, Human
ucucuaccgagcuuggcagccacag

SEQ ID NO: 483339 - RNA, 19 nt, Human
ucugaagggcuucccuuca

SEQ ID NO: 483340 - RNA, 21 nt, Human
ugaaauggcugcucaggugcc

SEQ ID NO: 483341 - RNA, 20 nt, Human
ugccagguuggugggaggug

SEQ ID NO: 483342 - RNA, 21 nt, Human
uggaggaggggagacgggcag

SEQ ID NO: 483343 - RNA, 19 nt, Human
uggcauuuucaggaagauu

SEQ ID NO: 483344 - RNA, 21 nt, Human
ugguauaaacuuuagcagcaa

SEQ ID NO: 483345 - RNA, 20 nt, Human
uguucugaagggcuucccuu

SEQ ID NO: 483346 - RNA, 20 nt, Human
uguugaaaaugcuuuguugg

SEQ ID NO: 483347 - RNA, 18 nt, Human
uuggugggagguggccga

SEQ ID NO: 483348 - RNA, 20 nt, Human
uuuuuccaucuguuuccuag

SEQ ID NO: 483349 - RNA, 19 nt, Human
uuuuuuuuuuuuuuaacgg

SEQ ID NO: 483350 - RNA, 22 nt, Human
uuuuuuuuuuuuuuuuuaacgg

SEQ ID NO: 483351 - RNA, 21 nt, Human
aaacaacugaaaacaucaaag

SEQ ID NO: 483352 - RNA, 18 nt, Human
aaacagacuggaaaacau

SEQ ID NO: 483353 - RNA, 25 nt, Human
aagaccuggcaccugacggaaaaua

SEQ ID NO: 483354 - RNA, 22 nt, Human
acaacugaaaacaucaaagaca

SEQ ID NO: 483355 - RNA, 18 nt, Human
acugaaaacaucaaagac

SEQ ID NO: 483356 - RNA, 18 nt, Human
agacuggaaaacauggua

SEQ ID NO: 483357 - RNA, 23 nt, Human
agcgagcuaaaaaugaaugcuug

SEQ ID NO: 483358 - RNA, 22 nt, Human
agggaaggcuucauggaggagg

SEQ ID NO: 483359 - RNA, 18 nt, Human
agguauggggaauuuauc

SEQ ID NO: 483360 - RNA, 21 nt, Human
agucaggggccccaaacuggc

SEQ ID NO: 483361 - RNA, 22 nt, Human
aucucacccccggaagccccag

SEQ ID NO: 483362 - RNA, 25 nt, Human
caaacaaacacccccagcgagugaa

SEQ ID NO: 483363 - RNA, 21 nt, Human
caaacaacugaaaacaucaaa

SEQ ID NO: 483364 - RNA, 26 nt, Human
caccaggaagcuuucucaacaugaag

SEQ ID NO: 483365 - RNA, 21 nt, Human
cacugcagaaguuaaacagac

SEQ ID NO: 483366 - RNA, 19 nt, Human
caggggccccaaacuggcu

SEQ ID NO: 483367 - RNA, 19 nt, Human
cauguccagcugcuggagg

SEQ ID NO: 483368 - RNA, 21 nt, Human
cauugaacuccagcucuugau

SEQ ID NO: 483369 - RNA, 25 nt, Human
cauugaacuccagcucuugauuaag

SEQ ID NO: 483370 - RNA, 22 nt, Human
ccaaagucucaaguccccagau

SEQ ID NO: 483371 - RNA, 24 nt, Human
ccauugagcugaagcucaggcccc

SEQ ID NO: 483372 - RNA, 22 nt, Human
cccccggaagccccagagaucc

SEQ ID NO: 483373 - RNA, 21 nt, Human
cccugcugcugcugcugcugc

SEQ ID NO: 483374 - RNA, 22 nt, Human
cccugcugcugcugcugcugcc

SEQ ID NO: 483375 - RNA, 20 nt, Human
ccgaggcuuugucucccacu

SEQ ID NO: 483376 - RNA, 23 nt, Human
ccgaggcuuugucucccacugca

SEQ ID NO: 483377 - RNA, 21 nt, Human
ccgcugcugcuguuagccagg

SEQ ID NO: 483378 - RNA, 26 nt, Human
cgugcgcgcccaugugcgcgugugug

SEQ ID NO: 483379 - RNA, 18 nt, Human
cucaggccccucucacug

SEQ ID NO: 483380 - RNA, 18 nt, Human
cuccccauguccagcugc

SEQ ID NO: 483381 - RNA, 22 nt, Human
cucuggcugcugggugaaaugc

SEQ ID NO: 483382 - RNA, 22 nt, Human
cuggcaccugacggaaaauaaa

SEQ ID NO: 483383 - RNA, 22 nt, Human
cugucgggggugacuugggucg

SEQ ID NO: 483384 - RNA, 22 nt, Human
cuuacuuaucuuuccucuugcc

SEQ ID NO: 483385 - RNA, 19 nt, Human
cuuguggcacacagcaggc

SEQ ID NO: 483386 - RNA, 18 nt, Human
cuuguuuguaaaccuagc

SEQ ID NO: 483387 - RNA, 22 nt, Human
cuuguuuguaaaccuagcagca

SEQ ID NO: 483388 - RNA, 24 nt, Human
gaaaauaaaaggguggccgguacc

SEQ ID NO: 483389 - RNA, 21 nt, Human
gacugucgccuccccaugucc

SEQ ID NO: 483390 - RNA, 20 nt, Human
gaggagucugggcugggacc

SEQ ID NO: 483391 - RNA, 23 nt, Human
gaugguggugaguggugguggug

SEQ ID NO: 483392 - RNA, 19 nt, Human
gcugcugggugaaaugcug

SEQ ID NO: 483393 - RNA, 18 nt, Human
ggagguauauagguuaug

SEQ ID NO: 483394 - RNA, 21 nt, Human
ggcaaacaaacacccccagcg

SEQ ID NO: 483395 - RNA, 22 nt, Human
ggcagaaaguugauagguuaag

SEQ ID NO: 483396 - RNA, 18 nt, Human
ggcugcugggugaaaugc

SEQ ID NO: 483397 - RNA, 23 nt, Human
ggcugcugggugaaaugcugcuc

SEQ ID NO: 483398 - RNA, 21 nt, Human
ggcuuccauugagcugaagcu

SEQ ID NO: 483399 - RNA, 18 nt, Human
ggggugacuuggguuagg

SEQ ID NO: 483400 - RNA, 24 nt, Human
guaaggcaguguagugaaggcacu

SEQ ID NO: 483401 - RNA, 23 nt, Human
uaaaagucuguucagucagugug

SEQ ID NO: 483402 - RNA, 18 nt, Human
uacugggccuugaaggag

SEQ ID NO: 483403 - RNA, 21 nt, Human
uagauaggacugucgccuccc

SEQ ID NO: 483404 - RNA, 19 nt, Human
uaggaggcacaggacaaug

SEQ ID NO: 483405 - RNA, 19 nt, Human
uaggguguccagccucuug

SEQ ID NO: 483406 - RNA, 18 nt, Human
uauguagcuacagaugcu

SEQ ID NO: 483407 - RNA, 24 nt, Human
uauugugaaucucauucuuucuaa

SEQ ID NO: 483408 - RNA, 18 nt, Human
ucaaagacaucuguaggg

SEQ ID NO: 483409 - RNA, 18 nt, Human
ucagcccuccuccuuccu

SEQ ID NO: 483410 - RNA, 18 nt, Human
ucagcccuccuccuuccu

SEQ ID NO: 483411 - RNA, 20 nt, Human
ucaggagcuaggaugucagg

SEQ ID NO: 483412 - RNA, 22 nt, Human
ucauugaacuccagcucuugau

SEQ ID NO: 483413 - RNA, 18 nt, Human
ucccacugcagcuucuuc

SEQ ID NO: 483414 - RNA, 23 nt, Human
ucucucaucuuuuagguguguau

SEQ ID NO: 483415 - RNA, 24 nt, Human
ugaacaaagauucuggcuuucuua

SEQ ID NO: 483416 - RNA, 19 nt, Human
ugaagcaucccaacugaga

SEQ ID NO: 483417 - RNA, 23 nt, Human
ugaagguaaaauuuacugucggg

SEQ ID NO: 483418 - RNA, 18 nt, Human
ugaauucucucaucuuuu

SEQ ID NO: 483419 - RNA, 19 nt, Human
ugagugguggugguggugg

SEQ ID NO: 483420 - RNA, 21 nt, Human
ugccugaguuaucccaggagc

SEQ ID NO: 483421 - RNA, 18 nt, Human
ugcugcugcugccguugc

SEQ ID NO: 483422 - RNA, 21 nt, Human
ugcugcugcugcugcugcugc

SEQ ID NO: 483423 - RNA, 21 nt, Human
ugcugcugcugcugcugcugc

SEQ ID NO: 483424 - RNA, 21 nt, Human
ugcugcugcugcugcugcugc

SEQ ID NO: 483425 - RNA, 21 nt, Human
ugcugcugcugcugcugcugc

SEQ ID NO: 483426 - RNA, 21 nt, Human
ugcugcugcugcugcugcugc

SEQ ID NO: 483427 - RNA, 21 nt, Human
ugcugcugcugcugcugcugc

SEQ ID NO: 483428 - RNA, 20 nt, Human
uggaugggugggggaccgag

SEQ ID NO: 483429 - RNA, 23 nt, Human
uggaugggugggggaccgaggcu

SEQ ID NO: 483430 - RNA, 18 nt, Human
ugguaguucgugcgcgcc

SEQ ID NO: 483431 - RNA, 23 nt, Human
ugguggucgugguuggugguggu

SEQ ID NO: 483432 - RNA, 21 nt, Human
uggugguggucgugguuggug

SEQ ID NO: 483433 - RNA, 18 nt, Human
uggugguggugguggugg

SEQ ID NO: 483434 - RNA, 20 nt, Human
uggugguggugguggugguc

SEQ ID NO: 483435 - RNA, 19 nt, Human
uguagugaaggcacugcag

SEQ ID NO: 483436 - RNA, 21 nt, Human
ugugugaguguaggugugugu

SEQ ID NO: 483437 - RNA, 19 nt, Human
uuaaagccggcucuggcug

SEQ ID NO: 483438 - RNA, 19 nt, Human
uuauguagcuacagaugcu

SEQ ID NO: 483439 - RNA, 21 nt, Human
uugaucagcccuccuccuucc

SEQ ID NO: 483440 - RNA, 23 nt, Human
uugggguggaauuagggaaggcu

SEQ ID NO: 483441 - RNA, 19 nt, Human
aacuguguacagcuuggca

SEQ ID NO: 483442 - RNA, 23 nt, Human
aacuguguacagcuuggcaaggu

SEQ ID NO: 483443 - RNA, 28 nt, Human
aagcaaaugcggcagcaaucuuagagau

SEQ ID NO: 483444 - RNA, 18 nt, Human
cacaggguaucagcaacu

SEQ ID NO: 483445 - RNA, 20 nt, Human
cacaggguaucagcaacugu

SEQ ID NO: 483446 - RNA, 19 nt, Human
cagcacaugaucagaaaua

SEQ ID NO: 483447 - RNA, 21 nt, Human
cagcacaugaucagaaauaug

SEQ ID NO: 483448 - RNA, 19 nt, Human
cagcaguaaaaggcagcac

SEQ ID NO: 483449 - RNA, 22 nt, Human
ccuccagggaggaucuugacuu

SEQ ID NO: 483450 - RNA, 18 nt, Human
cuugccaggaaaugagag

SEQ ID NO: 483451 - RNA, 21 nt, Human
ggcagcaaucuuagagauggu

SEQ ID NO: 483452 - RNA, 21 nt, Human
guaaaaggcagcacaugauca

SEQ ID NO: 483453 - RNA, 18 nt, Human
uaacaagcaaaugcggca

SEQ ID NO: 483454 - RNA, 24 nt, Human
uaggguugugaaagagcuugccag

SEQ ID NO: 483455 - RNA, 19 nt, Human
ugacuucucaguucccacu

SEQ ID NO: 483456 - RNA, 19 nt, Human
ugccaggaaaugagagcug

SEQ ID NO: 483457 - RNA, 26 nt, Human
ugguaugaaaaaagaugaaauggagu

SEQ ID NO: 483458 - RNA, 24 nt, Human
uuagagaugguaugaaaaaagaug

SEQ ID NO: 483459 - RNA, 20 nt, Human
uugccaggaaaugagagcug

SEQ ID NO: 483460 - RNA, 20 nt, Human
uuucaguccuguccuccagg

SEQ ID NO: 483461 - RNA, 29 nt, Human
uuuuuuuuuuuuuuuuuuuuuuaugaaaa

SEQ ID NO: 483462 - RNA, 19 nt, Human
aagaaaacauuccaugagc

SEQ ID NO: 483463 - RNA, 24 nt, Human
agaagcaaagcuucugaaaugagg

SEQ ID NO: 483464 - RNA, 23 nt, Human
gcaacagaagcaaagcuucugaa

SEQ ID NO: 483465 - RNA, 26 nt, Human
ucaaaggauaagaaaacauuccauga

SEQ ID NO: 483466 - RNA, 25 nt, Human
ugaggaguguucaaaggauaagaaa

SEQ ID NO: 483467 - RNA, 19 nt, Human
ugucuauccaugaaagccc

SEQ ID NO: 483468 - RNA, 19 nt, Human
uuaacauucaagcugaagg

SEQ ID NO: 483469 - RNA, 21 nt, Human
uuaacauucaagcugaagguu

SEQ ID NO: 483470 - RNA, 21 nt, Human
uucaaaggauaagaaaacauu

SEQ ID NO: 483471 - RNA, 22 nt, Human
uucaaaggauaagaaaacauuc

SEQ ID NO: 483472 - RNA, 20 nt, Human
aaaaaacaaugugaaaggac

SEQ ID NO: 483473 - RNA, 26 nt, Human
aaaaacaaugugaaaggacaggaaac

SEQ ID NO: 483474 - RNA, 20 nt, Human
aaaaagcagaauaaaagaac

SEQ ID NO: 483475 - RNA, 24 nt, Human
aaaacaaacaaacaagaaaccaga

SEQ ID NO: 483476 - RNA, 22 nt, Human
aaacaaaacaaaacaaaacaaa

SEQ ID NO: 483477 - RNA, 21 nt, Human
aaacaaaacaaaacaaacaaa

SEQ ID NO: 483478 - RNA, 20 nt, Human
aaacaaacaaacaagaaacc

SEQ ID NO: 483479 - RNA, 25 nt, Human
aaacaaacaagaaaccagaauaaag

SEQ ID NO: 483480 - RNA, 23 nt, Human
aaacaagaaaccagaauaaagga

SEQ ID NO: 483481 - RNA, 20 nt, Human
aaagcagaauaaaagaacaa

SEQ ID NO: 483482 - RNA, 19 nt, Human
aacaacucauaaaguuguc

SEQ ID NO: 483483 - RNA, 19 nt, Human
aacacuaacacaccccuac

SEQ ID NO: 483484 - RNA, 18 nt, Human
aacagacuauacauuuuc

SEQ ID NO: 483485 - RNA, 24 nt, Human
aacaggcauacacaugcacaaaca

SEQ ID NO: 483486 - RNA, 23 nt, Human
aagaaaaagauaugugacaaaaa

SEQ ID NO: 483487 - RNA, 22 nt, Human
aagaauuuagccagugaaaaua

SEQ ID NO: 483488 - RNA, 23 nt, Human
aauaaaagaacaaauacaacugg

SEQ ID NO: 483489 - RNA, 20 nt, Human
acaaaacaaaacaaaacaaa

SEQ ID NO: 483490 - RNA, 19 nt, Human
acaaaacaaaacaaacaaa

SEQ ID NO: 483491 - RNA, 21 nt, Human
acaaaacaaacaaacaagaaa

SEQ ID NO: 483492 - RNA, 20 nt, Human
acaacaguacauaauuuaga

SEQ ID NO: 483493 - RNA, 19 nt, Human
acagaaaacaucuauaauc

SEQ ID NO: 483494 - RNA, 21 nt, Human
agaaaaagauaugugacaaaa

SEQ ID NO: 483495 - RNA, 20 nt, Human
agauuuaaaagacaagucag

SEQ ID NO: 483496 - RNA, 21 nt, Human
aggaagaaaugacuagcaaag

SEQ ID NO: 483497 - RNA, 22 nt, Human
aggaagagguagcaaaagggac

SEQ ID NO: 483498 - RNA, 19 nt, Human
aguguugaugacauaugua

SEQ ID NO: 483499 - RNA, 22 nt, Human
auaguaacagaaaaaugugaca

SEQ ID NO: 483500 - RNA, 20 nt, Human
aucaucucuccaauaaaaug

SEQ ID NO: 483501 - RNA, 23 nt, Human
aucaucucuccaauaaaaugcuu

SEQ ID NO: 483502 - RNA, 18 nt, Human
aucuuuacaaauguaagg

SEQ ID NO: 483503 - RNA, 22 nt, Human
augcacaaacacuaacacaccc

SEQ ID NO: 483504 - RNA, 22 nt, Human
caaaacaaaacaaaacaaacaa

SEQ ID NO: 483505 - RNA, 25 nt, Human
caaaacaaaacaaaacaaacaaaca

SEQ ID NO: 483506 - RNA, 18 nt, Human
caaaacaaacaaacaaga

SEQ ID NO: 483507 - RNA, 19 nt, Human
caacaguacauaauuuaga

SEQ ID NO: 483508 - RNA, 18 nt, Human
caagauaaguaauaaacc

SEQ ID NO: 483509 - RNA, 22 nt, Human
cacaugcacaaacacuaacaca

SEQ ID NO: 483510 - RNA, 22 nt, Human
caccaauaauaccacguuugaa

SEQ ID NO: 483511 - RNA, 20 nt, Human
cagaaaacaucuauaaucac

SEQ ID NO: 483512 - RNA, 19 nt, Human
caggaagaaaugacuagca

SEQ ID NO: 483513 - RNA, 24 nt, Human
caugcacaaacacuaacacacccc

SEQ ID NO: 483514 - RNA, 22 nt, Human
caugccaacauuaagaacaggu

SEQ ID NO: 483515 - RNA, 24 nt, Human
cauuugaaauauucuauauacaga

SEQ ID NO: 483516 - RNA, 21 nt, Human
ccaagaaaaagauaugugaca

SEQ ID NO: 483517 - RNA, 20 nt, Human
cccaggaagaaaugacuagc

SEQ ID NO: 483518 - RNA, 22 nt, Human
cuauaugcauauugagcacccc

SEQ ID NO: 483519 - RNA, 25 nt, Human
cuuucauauugcucaauaacaaucg

SEQ ID NO: 483520 - RNA, 20 nt, Human
gaaguugaaaacaacucaua

SEQ ID NO: 483521 - RNA, 21 nt, Human
gcacaaacacuaacacacccc

SEQ ID NO: 483522 - RNA, 22 nt, Human
gcacaaacacuaacacaccccu

SEQ ID NO: 483523 - RNA, 18 nt, Human
gcaucaugggguaaaccu

SEQ ID NO: 483524 - RNA, 21 nt, Human
uaaaaaaaucaagaaauaaag

SEQ ID NO: 483525 - RNA, 21 nt, Human
uaaaaagcagaauaaaagaac

SEQ ID NO: 483526 - RNA, 30 nt, Human
uaaaaagcagaauaaaagaacaaauacaaa

SEQ ID NO: 483527 - RNA, 21 nt, Human
uaaaagaacaaauacaacugg

SEQ ID NO: 483528 - RNA, 25 nt, Human
uaacuacauugugcucuauuuaacc

SEQ ID NO: 483529 - RNA, 20 nt, Human
uaaguaauaaaccaaaaaga

SEQ ID NO: 483530 - RNA, 22 nt, Human
uaaguuuuaguaccuucucaca

SEQ ID NO: 483531 - RNA, 20 nt, Human
uaauaaagaacauuucccuu

SEQ ID NO: 483532 - RNA, 21 nt, Human
uagaaaauuuaaaauuaugaa

SEQ ID NO: 483533 - RNA, 20 nt, Human
uagaaagaaugauuauaaua

SEQ ID NO: 483534 - RNA, 23 nt, Human
uagaagacagauuuaaaagacaa

SEQ ID NO: 483535 - RNA, 23 nt, Human
uagcaaaaaacaaugugaaagga

SEQ ID NO: 483536 - RNA, 19 nt, Human
ucucuguauucccaggaag

SEQ ID NO: 483537 - RNA, 20 nt, Human
ugaaaggacaggaaacuugg

SEQ ID NO: 483538 - RNA, 21 nt, Human
ugaaaggacaggaaacuuggu

SEQ ID NO: 483539 - RNA, 23 nt, Human
ugaaaggacaggaaacuugguua

SEQ ID NO: 483540 - RNA, 27 nt, Human
ugagaaaacaaaacaaaacaaaacaaa

SEQ ID NO: 483541 - RNA, 24 nt, Human
ugccauauuguuugaugcagaugu

SEQ ID NO: 483542 - RNA, 20 nt, Human
ugggcauuagaauaacuacc

SEQ ID NO: 483543 - RNA, 20 nt, Human
ugguggcaaauauauucuga

SEQ ID NO: 483544 - RNA, 22 nt, Human
ugugaaaggacaggaaacuugg

SEQ ID NO: 483545 - RNA, 24 nt, Human
ugugaacaggcauacacaugcaca

SEQ ID NO: 483546 - RNA, 23 nt, Human
uuaaaaagcagaauaaaagaaca

SEQ ID NO: 483547 - RNA, 21 nt, Human
uuaagaugucuauaguuggau

SEQ ID NO: 483548 - RNA, 24 nt, Human
uuagaagacagauuuaaaagacaa

SEQ ID NO: 483549 - RNA, 20 nt, Human
uuaggcaauaauuacugaac

SEQ ID NO: 483550 - RNA, 23 nt, Human
uucaccaauaauaccacguuuga

SEQ ID NO: 483551 - RNA, 24 nt, Human
uuccuuggauucauauaugcaaca

SEQ ID NO: 483552 - RNA, 21 nt, Human
uugaauuaucucacuggcuuu

SEQ ID NO: 483553 - RNA, 23 nt, Human
uugagaaaacaaaacaaaacaaa

SEQ ID NO: 483554 - RNA, 18 nt, Human
uuguaggguuuaagaugu

SEQ ID NO: 483555 - RNA, 23 nt, Human
agcgucugcuggggcagcucugu

SEQ ID NO: 483556 - RNA, 20 nt, Human
aggccuccggcuuccuccag

SEQ ID NO: 483557 - RNA, 20 nt, Human
agggcugggggaaugggcug

SEQ ID NO: 483558 - RNA, 23 nt, Human
aggggcugcagggccgggagggg

SEQ ID NO: 483559 - RNA, 27 nt, Human
caccggguggggcggagcgucugcugg

SEQ ID NO: 483560 - RNA, 23 nt, Human
ccacaggauccccccgcacccac

SEQ ID NO: 483561 - RNA, 19 nt, Human
cccccgggcccggagccgu

SEQ ID NO: 483562 - RNA, 18 nt, Human
cccccggggcuccaucac

SEQ ID NO: 483563 - RNA, 18 nt, Human
ccccgggcccggagccgu

SEQ ID NO: 483564 - RNA, 21 nt, Human
ccccggggcuccaucaccggg

SEQ ID NO: 483565 - RNA, 22 nt, Human
cccgcccuacuggcggcagcau

SEQ ID NO: 483566 - RNA, 19 nt, Human
cccgggcccggagccgucc

SEQ ID NO: 483567 - RNA, 21 nt, Human
ccgcacccacugcaucucucc

SEQ ID NO: 483568 - RNA, 19 nt, Human
ccgcccgcccaggggcugc

SEQ ID NO: 483569 - RNA, 26 nt, Human
ccuccaggcgaccaggcccuccgucc

SEQ ID NO: 483570 - RNA, 20 nt, Human
ccugcuaaggccagcagggc

SEQ ID NO: 483571 - RNA, 25 nt, Human
cgccacagagucucucugcccaggg

SEQ ID NO: 483572 - RNA, 20 nt, Human
cgcccaggggcugcagggcc

SEQ ID NO: 483573 - RNA, 22 nt, Human
cggagcgucugcuggggcagcu

SEQ ID NO: 483574 - RNA, 22 nt, Human
cgggagggggcugcgggcggcg

SEQ ID NO: 483575 - RNA, 20 nt, Human
cuacuggcggcagcaugccu

SEQ ID NO: 483576 - RNA, 25 nt, Human
cuccacgcaggccuccggcuuccuc

SEQ ID NO: 483577 - RNA, 26 nt, Human
cucuggcucucgagaggccggaaagc

SEQ ID NO: 483578 - RNA, 19 nt, Human
cugcaucucucugcccagg

SEQ ID NO: 483579 - RNA, 19 nt, Human
cugccucauaggaugcccc

SEQ ID NO: 483580 - RNA, 20 nt, Human
cugcgcggggcgccuccucc

SEQ ID NO: 483581 - RNA, 23 nt, Human
cuggcggcagcaugccugucccc

SEQ ID NO: 483582 - RNA, 19 nt, Human
cugucucccugcuaaggcc

SEQ ID NO: 483583 - RNA, 18 nt, Human
gcaugccuguccccagca

SEQ ID NO: 483584 - RNA, 18 nt, Human
gccagcagggccaaacug

SEQ ID NO: 483585 - RNA, 18 nt, Human
gcuaggccaggucagcca

SEQ ID NO: 483586 - RNA, 21 nt, Human
ggcagcaugccuguccccagc

SEQ ID NO: 483587 - RNA, 19 nt, Human
ggccgggagggggcugcgg

SEQ ID NO: 483588 - RNA, 18 nt, Human
ggcugggggaaugggcug

SEQ ID NO: 483589 - RNA, 20 nt, Human
gggccuccggcuuggcguuc

SEQ ID NO: 483590 - RNA, 22 nt, Human
gggcugcagggccgggaggggg

SEQ ID NO: 483591 - RNA, 21 nt, Human
gggggcugcgggcggcgcggc

SEQ ID NO: 483592 - RNA, 22 nt, Human
gucagccagggcugggggaaug

SEQ ID NO: 483593 - RNA, 22 nt, Human
uacccugcuccuccccaggcac

SEQ ID NO: 483594 - RNA, 18 nt, Human
ucaccggguggggcggag

SEQ ID NO: 483595 - RNA, 23 nt, Human
ucaccuggcuguccggguccccg

SEQ ID NO: 483596 - RNA, 23 nt, Human
uccccaggcacgacugucccccc

SEQ ID NO: 483597 - RNA, 19 nt, Human
uccccugucucccugcuaa

SEQ ID NO: 483598 - RNA, 20 nt, Human
uccggcuggaucuugucguc

SEQ ID NO: 483599 - RNA, 20 nt, Human
ugaguguguccccaggacug

SEQ ID NO: 483600 - RNA, 18 nt, Human
ugcagugcuugggaucug

SEQ ID NO: 483601 - RNA, 23 nt, Human
ugcuggggcagcucugugggcca

SEQ ID NO: 483602 - RNA, 18 nt, Human
uggggauguguuuauggg

SEQ ID NO: 483603 - RNA, 21 nt, Human
uuccccgaucuguccugccug

SEQ ID NO: 483604 - RNA, 21 nt, Human
aacaggcacacagaagccccc

SEQ ID NO: 483605 - RNA, 20 nt, Human
aagccuuugacacaucaaaa

SEQ ID NO: 483606 - RNA, 21 nt, Human
acacagaagcccccacagucc

SEQ ID NO: 483607 - RNA, 21 nt, Human
acacuggucucuguaaacugg

SEQ ID NO: 483608 - RNA, 20 nt, Human
agagccggccucaugugcca

SEQ ID NO: 483609 - RNA, 19 nt, Human
aggcacacagaagccccca

SEQ ID NO: 483610 - RNA, 19 nt, Human
aggcgccccacccgcugcc

SEQ ID NO: 483611 - RNA, 18 nt, Human
agugucuccaaagcccag

SEQ ID NO: 483612 - RNA, 19 nt, Human
caaaaaccccuggucagaa

SEQ ID NO: 483613 - RNA, 19 nt, Human
caaagcagcaccaggugaa

SEQ ID NO: 483614 - RNA, 25 nt, Human
caaagcccaguguggugccagcugc

SEQ ID NO: 483615 - RNA, 19 nt, Human
caaagugaccacccagagc

SEQ ID NO: 483616 - RNA, 21 nt, Human
cacaggggccacggggcacag

SEQ ID NO: 483617 - RNA, 25 nt, Human
cacaucaaaauguaaaagggaagug

SEQ ID NO: 483618 - RNA, 21 nt, Human
cacccaggcgccccacccgcu

SEQ ID NO: 483619 - RNA, 24 nt, Human
caugcaaaaaccccuggucagaag

SEQ ID NO: 483620 - RNA, 21 nt, Human
ccaaagugaccacccagagca

SEQ ID NO: 483621 - RNA, 20 nt, Human
ccacgggugacaugcugggu

SEQ ID NO: 483622 - RNA, 22 nt, Human
ccagagcagcccugucaagggg

SEQ ID NO: 483623 - RNA, 18 nt, Human
ccagcugccuccuuucuc

SEQ ID NO: 483624 - RNA, 25 nt, Human
ccccacccgcugccucugugcuuuu

SEQ ID NO: 483625 - RNA, 20 nt, Human
ccccauagauuugaaucggg

SEQ ID NO: 483626 - RNA, 18 nt, Human
cccccaccgaacaggcac

SEQ ID NO: 483627 - RNA, 26 nt, Human
ccccgcagugucuccaaagcccagug

SEQ ID NO: 483628 - RNA, 20 nt, Human
cccgcagugucuccaaagcc

SEQ ID NO: 483629 - RNA, 22 nt, Human
cccuccuguccuacugcagaaa

SEQ ID NO: 483630 - RNA, 23 nt, Human
ccgcugccucugugcuuuugggg

SEQ ID NO: 483631 - RNA, 30 nt, Human
ccggccucaugugccaaggagcccacagcu

SEQ ID NO: 483632 - RNA, 21 nt, Human
ccucugccccgggcaaggguu

SEQ ID NO: 483633 - RNA, 19 nt, Human
ccugcuggccuccuuccuc

SEQ ID NO: 483634 - RNA, 19 nt, Human
cggagcugggcagaaggaa

SEQ ID NO: 483635 - RNA, 21 nt, Human
cugcagcuccugcuucaguag

SEQ ID NO: 483636 - RNA, 19 nt, Human
cugggugggacggagcugg

SEQ ID NO: 483637 - RNA, 19 nt, Human
cugguaaagggugaagaug

SEQ ID NO: 483638 - RNA, 20 nt, Human
cugguaaagggugaagaugu

SEQ ID NO: 483639 - RNA, 25 nt, Human
cuguacacacccaaagugaccaccc

SEQ ID NO: 483640 - RNA, 22 nt, Human
cugugugugaccugcacguggu

SEQ ID NO: 483641 - RNA, 21 nt, Human
gaccacccaggcgccccaccc

SEQ ID NO: 483642 - RNA, 18 nt, Human
gaggaacaggacugcauu

SEQ ID NO: 483643 - RNA, 19 nt, Human
gcaaagcuccuguguugac

SEQ ID NO: 483644 - RNA, 21 nt, Human
gccugggcugaggaacaggac

SEQ ID NO: 483645 - RNA, 18 nt, Human
ggcagaaggaagagccug

SEQ ID NO: 483646 - RNA, 20 nt, Human
ggcgccccacccgcugccuc

SEQ ID NO: 483647 - RNA, 24 nt, Human
ggcuguucagacagcaaagcuccu

SEQ ID NO: 483648 - RNA, 21 nt, Human
gggaaggcaugggaagauguc

SEQ ID NO: 483649 - RNA, 23 nt, Human
gggacggagcugggcagaaggaa

SEQ ID NO: 483650 - RNA, 26 nt, Human
gggcgcugggaggacccaagguucuc

SEQ ID NO: 483651 - RNA, 22 nt, Human
gggcugaggaacaggacugcau

SEQ ID NO: 483652 - RNA, 27 nt, Human
gggcugcugggugggacggagcugggc

SEQ ID NO: 483653 - RNA, 20 nt, Human
ggggcacagacccacugaaa

SEQ ID NO: 483654 - RNA, 18 nt, Human
gggugggacggagcuggg

SEQ ID NO: 483655 - RNA, 21 nt, Human
gugcagggcccuggccuucca

SEQ ID NO: 483656 - RNA, 18 nt, Human
guuccugaggcaucgcag

SEQ ID NO: 483657 - RNA, 21 nt, Human
guucugcacggcacgacucuc

SEQ ID NO: 483658 - RNA, 18 nt, Human
guuuuccagagaaguccg

SEQ ID NO: 483659 - RNA, 22 nt, Human
uaacaggcacacagaagccccc

SEQ ID NO: 483660 - RNA, 20 nt, Human
uagaccccagccagugggga

SEQ ID NO: 483661 - RNA, 19 nt, Human
uccaccacccagaggcuuu

SEQ ID NO: 483662 - RNA, 21 nt, Human
uccaccacccagaggcuuuau

SEQ ID NO: 483663 - RNA, 23 nt, Human
uccccgcagugucuccaaagccc

SEQ ID NO: 483664 - RNA, 18 nt, Human
ucuagggaaggcauggga

SEQ ID NO: 483665 - RNA, 25 nt, Human
ucucagguuugcuuuugcaggagcu

SEQ ID NO: 483666 - RNA, 18 nt, Human
ucucugcgggcugcuggg

SEQ ID NO: 483667 - RNA, 20 nt, Human
ucugggacacccccaccgaa

SEQ ID NO: 483668 - RNA, 24 nt, Human
ucuguaaacuggaguuccugaggc

SEQ ID NO: 483669 - RNA, 21 nt, Human
ugaggaacaggacugcauuaa

SEQ ID NO: 483670 - RNA, 21 nt, Human
ugaggguucaagguuagaccc

SEQ ID NO: 483671 - RNA, 24 nt, Human
ugaggguucaagguuagaccccag

SEQ ID NO: 483672 - RNA, 25 nt, Human
ugcaaaaaccccuggucagaagcgc

SEQ ID NO: 483673 - RNA, 18 nt, Human
ugcagaaacauucucagg

SEQ ID NO: 483674 - RNA, 22 nt, Human
ugccagcugccuccuuucucug

SEQ ID NO: 483675 - RNA, 24 nt, Human
ugcugggugggacggagcugggca

SEQ ID NO: 483676 - RNA, 18 nt, Human
uggaguuccugaggcauc

SEQ ID NO: 483677 - RNA, 19 nt, Human
ugggaagaugucccuccug

SEQ ID NO: 483678 - RNA, 18 nt, Human
ugggacacccccaccgaa

SEQ ID NO: 483679 - RNA, 18 nt, Human
ugggacggagcugggcag

SEQ ID NO: 483680 - RNA, 24 nt, Human
ugggcagaaggaagagccugaagu

SEQ ID NO: 483681 - RNA, 18 nt, Human
ugggugggacggagcugg

SEQ ID NO: 483682 - RNA, 19 nt, Human
uggucacuccaaaagccuu

SEQ ID NO: 483683 - RNA, 24 nt, Human
uguaaaagggaagugcagccccca

SEQ ID NO: 483684 - RNA, 19 nt, Human
ugugugcagggcccuggcc

SEQ ID NO: 483685 - RNA, 20 nt, Human
ugugugcagggcccuggccc

SEQ ID NO: 483686 - RNA, 19 nt, Human
uucacugugugugaccugc

SEQ ID NO: 483687 - RNA, 25 nt, Human
uugacacaucaaaauguaaaaggga

SEQ ID NO: 483688 - RNA, 23 nt, Human
uuuuaugucacguguauuuuacu

SEQ ID NO: 483689 - RNA, 22 nt, Human
aaaaagaaugacaaagaacaau

SEQ ID NO: 483690 - RNA, 19 nt, Human
aaacaaacaaagauaucca

SEQ ID NO: 483691 - RNA, 24 nt, Human
aaacaaacaaagauauccaauucg

SEQ ID NO: 483692 - RNA, 23 nt, Human
aacuaagauacuuucucagacac

SEQ ID NO: 483693 - RNA, 24 nt, Human
aagcagagguugcggugagccgag

SEQ ID NO: 483694 - RNA, 24 nt, Human
aaucacuuuaagccaggaagcaga

SEQ ID NO: 483695 - RNA, 20 nt, Human
acaagagugaaacucugucu

SEQ ID NO: 483696 - RNA, 21 nt, Human
acaagagugaaacucugucuc

SEQ ID NO: 483697 - RNA, 19 nt, Human
accacaccaaauaagcagg

SEQ ID NO: 483698 - RNA, 23 nt, Human
accacaccaaauaagcaggguua

SEQ ID NO: 483699 - RNA, 18 nt, Human
accccauucuucuccaag

SEQ ID NO: 483700 - RNA, 24 nt, Human
acccugccucuacuaaaaauacaa

SEQ ID NO: 483701 - RNA, 24 nt, Human
accugaggucgggaguucaagacc

SEQ ID NO: 483702 - RNA, 25 nt, Human
acuccagccugggcaacaagaguga

SEQ ID NO: 483703 - RNA, 22 nt, Human
acucugucucaaacaaacaaac

SEQ ID NO: 483704 - RNA, 21 nt, Human
acuuugagaggccuagguggg

SEQ ID NO: 483705 - RNA, 23 nt, Human
agagguugcggugagccgagauc

SEQ ID NO: 483706 - RNA, 24 nt, Human
agagguugcggugagccgagaucg

SEQ ID NO: 483707 - RNA, 19 nt, Human
agcagaagcuaguugauuu

SEQ ID NO: 483708 - RNA, 24 nt, Human
agccaggaagcagagguugcggug

SEQ ID NO: 483709 - RNA, 23 nt, Human
agcugggugugguggugcaugcc

SEQ ID NO: 483710 - RNA, 21 nt, Human
aggcaggagaaucacuuuaag

SEQ ID NO: 483711 - RNA, 19 nt, Human
aggcugaggcaggagaauc

SEQ ID NO: 483712 - RNA, 22 nt, Human
aggugggcggaucaccugaggu

SEQ ID NO: 483713 - RNA, 24 nt, Human
aucaccugaggucgggaguucaag

SEQ ID NO: 483714 - RNA, 24 nt, Human
aucgugccauugcacuccagccug

SEQ ID NO: 483715 - RNA, 24 nt, Human
auugcacuccagccugggcaacaa

SEQ ID NO: 483716 - RNA, 24 nt, Human
caaagaacaauucuauuuggcuaa

SEQ ID NO: 483717 - RNA, 23 nt, Human
caacaagagugaaacucugucuc

SEQ ID NO: 483718 - RNA, 23 nt, Human
caccugaggucgggaguucaaga

SEQ ID NO: 483719 - RNA, 23 nt, Human
cacuccagccugggcaacaagag

SEQ ID NO: 483720 - RNA, 24 nt, Human
cacuccagccugggcaacaagagu

SEQ ID NO: 483721 - RNA, 25 nt, Human
cacuccagccugggcaacaagagug

SEQ ID NO: 483722 - RNA, 24 nt, Human
cagccugaccaacauggagaaacc

SEQ ID NO: 483723 - RNA, 24 nt, Human
cagcuacucgagaggcugaggcag

SEQ ID NO: 483724 - RNA, 19 nt, Human
caguggggcaacccagcuc

SEQ ID NO: 483725 - RNA, 19 nt, Human
cauugcacuccagccuggg

SEQ ID NO: 483726 - RNA, 21 nt, Human
cauugcacuccagccugggca

SEQ ID NO: 483727 - RNA, 22 nt, Human
cauugcacuccagccugggcaa

SEQ ID NO: 483728 - RNA, 24 nt, Human
cauugcacuccagccugggcaaca

SEQ ID NO: 483729 - RNA, 20 nt, Human
ccauugcacuccagccuggg

SEQ ID NO: 483730 - RNA, 21 nt, Human
ccauugcacuccagccugggc

SEQ ID NO: 483731 - RNA, 23 nt, Human
ccauugcacuccagccugggcaa

SEQ ID NO: 483732 - RNA, 24 nt, Human
ccauugcacuccagccugggcaac

SEQ ID NO: 483733 - RNA, 21 nt, Human
cccccauucccugggugcaag

SEQ ID NO: 483734 - RNA, 22 nt, Human
cccccauucccugggugcaagu

SEQ ID NO: 483735 - RNA, 23 nt, Human
cccuaaccccauucuucuccaag

SEQ ID NO: 483736 - RNA, 22 nt, Human
ccugaccaacauggagaaaccc

SEQ ID NO: 483737 - RNA, 24 nt, Human
ccugaccaacauggagaaacccug

SEQ ID NO: 483738 - RNA, 22 nt, Human
ccuguaaucccagcuacucgag

SEQ ID NO: 483739 - RNA, 24 nt, Human
cgagaggcugaggcaggagaauca

SEQ ID NO: 483740 - RNA, 24 nt, Human
cgagaucgugccauugcacuccag

SEQ ID NO: 483741 - RNA, 18 nt, Human
cggagcacucucugaucc

SEQ ID NO: 483742 - RNA, 24 nt, Human
cggaucaccugaggucgggaguuc

SEQ ID NO: 483743 - RNA, 22 nt, Human
cuaagcuuuaacaugucaauga

SEQ ID NO: 483744 - RNA, 23 nt, Human
cugucucaaacaaacaaacaaag

SEQ ID NO: 483745 - RNA, 21 nt, Human
gagaaacccugccucuacuaa

SEQ ID NO: 483746 - RNA, 23 nt, Human
gaucaccugaggucgggaguuca

SEQ ID NO: 483747 - RNA, 24 nt, Human
gaucaccugaggucgggaguucaa

SEQ ID NO: 483748 - RNA, 22 nt, Human
gcaggagaaucacuuuaagcca

SEQ ID NO: 483749 - RNA, 22 nt, Human
gccauugcacuccagccugggc

SEQ ID NO: 483750 - RNA, 24 nt, Human
gccauugcacuccagccugggcaa

SEQ ID NO: 483751 - RNA, 18 nt, Human
gccuaguguuggagagug

SEQ ID NO: 483752 - RNA, 23 nt, Human
ggaucaccugaggucgggaguuc

SEQ ID NO: 483753 - RNA, 24 nt, Human
gggugugguggugcaugccuguaa

SEQ ID NO: 483754 - RNA, 21 nt, Human
ggugcaugccuguaaucccag

SEQ ID NO: 483755 - RNA, 24 nt, Human
gguggugcaugccuguaaucccag

SEQ ID NO: 483756 - RNA, 22 nt, Human
guggcuuacacacguaauccca

SEQ ID NO: 483757 - RNA, 19 nt, Human
uaaaaauacaaaauuagcu

SEQ ID NO: 483758 - RNA, 21 nt, Human
uaaccacaccaaauaagcagg

SEQ ID NO: 483759 - RNA, 18 nt, Human
uagagacccuaaccccau

SEQ ID NO: 483760 - RNA, 21 nt, Human
uagagacccuaaccccauucu

SEQ ID NO: 483761 - RNA, 18 nt, Human
uagaucucuggaguuagc

SEQ ID NO: 483762 - RNA, 23 nt, Human
uaggugggcggaucaccugaggu

SEQ ID NO: 483763 - RNA, 19 nt, Human
uaguugauuuaaccacacc

SEQ ID NO: 483764 - RNA, 23 nt, Human
uauuaugaaaucauccuaaugaa

SEQ ID NO: 483765 - RNA, 18 nt, Human
ucaguggcugauauugaa

SEQ ID NO: 483766 - RNA, 23 nt, Human
ucgugccauugcacuccagccug

SEQ ID NO: 483767 - RNA, 19 nt, Human
ugagagaguuuucccauuc

SEQ ID NO: 483768 - RNA, 24 nt, Human
ugagaggccuaggugggcggauca

SEQ ID NO: 483769 - RNA, 22 nt, Human
ugagccgagaucgugccauugc

SEQ ID NO: 483770 - RNA, 19 nt, Human
ugaggcaggagaaucacuu

SEQ ID NO: 483771 - RNA, 24 nt, Human
ugaggcaggagaaucacuuuaagc

SEQ ID NO: 483772 - RNA, 26 nt, Human
ugaggcaggagaaucacuuuaagcca

SEQ ID NO: 483773 - RNA, 19 nt, Human
ugcacuccagccugggcaa

SEQ ID NO: 483774 - RNA, 22 nt, Human
ugcacuccagccugggcaacaa

SEQ ID NO: 483775 - RNA, 22 nt, Human
ugcagauacaagcacagugggg

SEQ ID NO: 483776 - RNA, 19 nt, Human
ugccaaaugauuaauuuua

SEQ ID NO: 483777 - RNA, 24 nt, Human
ugccauugcacuccagccugggca

SEQ ID NO: 483778 - RNA, 21 nt, Human
ugccuguaaucccagcuacuc

SEQ ID NO: 483779 - RNA, 22 nt, Human
ugccuguaaucccagcuacucg

SEQ ID NO: 483780 - RNA, 23 nt, Human
ugccuguaaucccagcuacucga

SEQ ID NO: 483781 - RNA, 18 nt, Human
ugggcacuguggcuuaca

SEQ ID NO: 483782 - RNA, 24 nt, Human
ugggcggaucaccugaggucggga

SEQ ID NO: 483783 - RNA, 21 nt, Human
uggugcaugccuguaauccca

SEQ ID NO: 483784 - RNA, 22 nt, Human
uggugcaugccuguaaucccag

SEQ ID NO: 483785 - RNA, 24 nt, Human
ugguggugcaugccuguaauccca

SEQ ID NO: 483786 - RNA, 23 nt, Human
ugucucauagacccccauucccu

SEQ ID NO: 483787 - RNA, 22 nt, Human
uuagcugggugugguggugcau

SEQ ID NO: 483788 - RNA, 24 nt, Human
uuagcugggugugguggugcaugc

SEQ ID NO: 483789 - RNA, 22 nt, Human
uugacaaagauaccucuggagc

SEQ ID NO: 483790 - RNA, 18 nt, Human
uugcggugagccgagauc

SEQ ID NO: 483791 - RNA, 21 nt, Human
uugcggugagccgagaucgug

SEQ ID NO: 483792 - RNA, 22 nt, Human
uugcggugagccgagaucgugc

SEQ ID NO: 483793 - RNA, 23 nt, Human
uugcggugagccgagaucgugcc

SEQ ID NO: 483794 - RNA, 22 nt, Human
uuugcaauuagagacccuaacc

SEQ ID NO: 483795 - RNA, 19 nt, Human
uuuuuuuuuuuuuuuuuaa

SEQ ID NO: 483796 - RNA, 20 nt, Human
aaacggccccaaugcccggc

SEQ ID NO: 483797 - RNA, 22 nt, Human
acacuggaacaccugcagcugc

SEQ ID NO: 483798 - RNA, 23 nt, Human
acugcagacacaccaggagccug

SEQ ID NO: 483799 - RNA, 23 nt, Human
acugcagacacaccaggagccug

SEQ ID NO: 483800 - RNA, 25 nt, Human
agaacagauccugaaguuacacaga

SEQ ID NO: 483801 - RNA, 18 nt, Human
agcaggcaggcugagggu

SEQ ID NO: 483802 - RNA, 18 nt, Human
agcaggcaggcugagggu

SEQ ID NO: 483803 - RNA, 22 nt, Human
aggcaggcugagggucuuccag

SEQ ID NO: 483804 - RNA, 22 nt, Human
aggcaggcugagggucuuccag

SEQ ID NO: 483805 - RNA, 22 nt, Human
aggcuccggaggacgucaagcc

SEQ ID NO: 483806 - RNA, 18 nt, Human
auacagugcaugcaugua

SEQ ID NO: 483807 - RNA, 20 nt, Human
augcaugcauguauugugug

SEQ ID NO: 483808 - RNA, 23 nt, Human
augcccggcaguccggcugggcc

SEQ ID NO: 483809 - RNA, 22 nt, Human
caaacggccccaaugcccggca

SEQ ID NO: 483810 - RNA, 24 nt, Human
cacuaauacaaugcaugcauguag

SEQ ID NO: 483811 - RNA, 24 nt, Human
cacuaauacaaugcaugcauguag

SEQ ID NO: 483812 - RNA, 25 nt, Human
cagcgcguccuucuccugcaggccc

SEQ ID NO: 483813 - RNA, 25 nt, Human
caggagccaccugcacugcagacac

SEQ ID NO: 483814 - RNA, 25 nt, Human
caggagccaccugcacugcagacac

SEQ ID NO: 483815 - RNA, 20 nt, Human
caggagccugggccgcggag

SEQ ID NO: 483816 - RNA, 20 nt, Human
caggagccugggccgcggag

SEQ ID NO: 483817 - RNA, 24 nt, Human
caggagccugggccgcggagccuc

SEQ ID NO: 483818 - RNA, 24 nt, Human
caggagccugggccgcggagccuc

SEQ ID NO: 483819 - RNA, 23 nt, Human
ccaaugcccggcaguccggcugg

SEQ ID NO: 483820 - RNA, 23 nt, Human
ccaaugcccggcaguccggcugg

SEQ ID NO: 483821 - RNA, 24 nt, Human
ccaggccaagucagcgacggcucg

SEQ ID NO: 483822 - RNA, 24 nt, Human
ccaggccaagucagcgacggcucg

SEQ ID NO: 483823 - RNA, 19 nt, Human
ccccaagcuugcccugggc

SEQ ID NO: 483824 - RNA, 22 nt, Human
ccccaagcuugcccugggcccu

SEQ ID NO: 483825 - RNA, 18 nt, Human
ccccaaugcccggcaguc

SEQ ID NO: 483826 - RNA, 18 nt, Human
ccccaaugcccggcaguc

SEQ ID NO: 483827 - RNA, 19 nt, Human
ccccccgccggcaaggcag

SEQ ID NO: 483828 - RNA, 25 nt, Human
cccccugccgccauccuuucugcau

SEQ ID NO: 483829 - RNA, 21 nt, Human
cccugggcccucggcccggcc

SEQ ID NO: 483830 - RNA, 19 nt, Human
cccuggucggggccugcgc

SEQ ID NO: 483831 - RNA, 19 nt, Human
ccgccugagccugcccucc

SEQ ID NO: 483832 - RNA, 23 nt, Human
ccuccgcaaaaugagugccgcuu

SEQ ID NO: 483833 - RNA, 23 nt, Human
ccuccgcaaaaugagugccgcuu

SEQ ID NO: 483834 - RNA, 24 nt, Human
ccugcacugcagacacaccaggag

SEQ ID NO: 483835 - RNA, 24 nt, Human
ccugcacugcagacacaccaggag

SEQ ID NO: 483836 - RNA, 18 nt, Human
ccugugcacuuccugccu

SEQ ID NO: 483837 - RNA, 21 nt, Human
cgcaaaaugagugccgcuuaa

SEQ ID NO: 483838 - RNA, 21 nt, Human
cgcaaaaugagugccgcuuaa

SEQ ID NO: 483839 - RNA, 22 nt, Human
cgcccaacuccaagcagaggcu

SEQ ID NO: 483840 - RNA, 19 nt, Human
cggccccaaugcccggcag

SEQ ID NO: 483841 - RNA, 19 nt, Human
cggccccaaugcccggcag

SEQ ID NO: 483842 - RNA, 19 nt, Human
cgggacagcacaaggccga

SEQ ID NO: 483843 - RNA, 24 nt, Human
cggggcugcagggagggaggagca

SEQ ID NO: 483844 - RNA, 24 nt, Human
cggggcugcagggagggaggagca

SEQ ID NO: 483845 - RNA, 22 nt, Human
cgugugcauggggguggugagc

SEQ ID NO: 483846 - RNA, 22 nt, Human
cgugugcauggggguggugagc

SEQ ID NO: 483847 - RNA, 22 nt, Human
cgugugcauggggguggugagc

SEQ ID NO: 483848 - RNA, 19 nt, Human
cuccacggccaguagcugc

SEQ ID NO: 483849 - RNA, 19 nt, Human
cugcgccccagggcgucgg

SEQ ID NO: 483850 - RNA, 19 nt, Human
cuggugcagagcugcaaag

SEQ ID NO: 483851 - RNA, 19 nt, Human
cugugcgugcagcuccucc

SEQ ID NO: 483852 - RNA, 20 nt, Human
cuugcccugggcccucggcc

SEQ ID NO: 483853 - RNA, 24 nt, Human
gaacagauccugaaguuacacaga

SEQ ID NO: 483854 - RNA, 24 nt, Human
gaacagauccugaaguuacacaga

SEQ ID NO: 483855 - RNA, 18 nt, Human
gacccucagugagggccc

SEQ ID NO: 483856 - RNA, 23 nt, Human
gagaugcugcccggggcugcagg

SEQ ID NO: 483857 - RNA, 23 nt, Human
gagaugcugcccggggcugcagg

SEQ ID NO: 483858 - RNA, 22 nt, Human
gagcucaggacgagcgucucca

SEQ ID NO: 483859 - RNA, 18 nt, Human
gagcuccugggaccuccu

SEQ ID NO: 483860 - RNA, 25 nt, Human
gcaccagauuccucguuccaggcca

SEQ ID NO: 483861 - RNA, 25 nt, Human
gcaccagauuccucguuccaggcca

SEQ ID NO: 483862 - RNA, 24 nt, Human
gccaccugcacugcagacacacca

SEQ ID NO: 483863 - RNA, 24 nt, Human
gccaccugcacugcagacacacca

SEQ ID NO: 483864 - RNA, 21 nt, Human
gccccaaugcccggcaguccg

SEQ ID NO: 483865 - RNA, 21 nt, Human
gccccaaugcccggcaguccg

SEQ ID NO: 483866 - RNA, 21 nt, Human
gcccggcaguccggcugggcc

SEQ ID NO: 483867 - RNA, 22 nt, Human
gcccugggcccucggcccggcc

SEQ ID NO: 483868 - RNA, 18 nt, Human
gccugggccgcggagccu

SEQ ID NO: 483869 - RNA, 18 nt, Human
gccugggccgcggagccu

SEQ ID NO: 483870 - RNA, 21 nt, Human
gcgcagcgcguccuucuccug

SEQ ID NO: 483871 - RNA, 21 nt, Human
gcgucggcacccccggguggc

SEQ ID NO: 483872 - RNA, 21 nt, Human
gcugcagcucauccgccuucu

SEQ ID NO: 483873 - RNA, 21 nt, Human
ggcaggcugagggucuuccag

SEQ ID NO: 483874 - RNA, 21 nt, Human
ggcaggcugagggucuuccag

SEQ ID NO: 483875 - RNA, 22 nt, Human
ggccggugggugugcccugguc

SEQ ID NO: 483876 - RNA, 21 nt, Human
gggcugcagggagggaggagc

SEQ ID NO: 483877 - RNA, 21 nt, Human
gggcugcagggagggaggagc

SEQ ID NO: 483878 - RNA, 22 nt, Human
ggugaaacagaacagauccuga

SEQ ID NO: 483879 - RNA, 22 nt, Human
ggugaaacagaacagauccuga

SEQ ID NO: 483880 - RNA, 22 nt, Human
ggugaaacagaacagauccuga

SEQ ID NO: 483881 - RNA, 21 nt, Human
guccugggggagugagagcuc

SEQ ID NO: 483882 - RNA, 19 nt, Human
gugaaacagaacagauccu

SEQ ID NO: 483883 - RNA, 19 nt, Human
gugaaacagaacagauccu

SEQ ID NO: 483884 - RNA, 19 nt, Human
gugaaacagaacagauccu

SEQ ID NO: 483885 - RNA, 18 nt, Human
gugcccuggucggggccu

SEQ ID NO: 483886 - RNA, 21 nt, Human
guggugagcacccgcauggcc

SEQ ID NO: 483887 - RNA, 21 nt, Human
guggugagcacccgcauggcc

SEQ ID NO: 483888 - RNA, 21 nt, Human
guggugagcacccgcauggcc

SEQ ID NO: 483889 - RNA, 20 nt, Human
guucucccgguccuccuccc

SEQ ID NO: 483890 - RNA, 24 nt, Human
uacaaugcaugcauguauugugug

SEQ ID NO: 483891 - RNA, 24 nt, Human
uacagugcaugcauguauugugug

SEQ ID NO: 483892 - RNA, 22 nt, Human
ucagugagggccccaagcuugc

SEQ ID NO: 483893 - RNA, 19 nt, Human
uccaggucggagcucagga

SEQ ID NO: 483894 - RNA, 28 nt, Human
uccggaggacgucaagccgcugggcgcg

SEQ ID NO: 483895 - RNA, 24 nt, Human
uccugggggagugagagcuccugg

SEQ ID NO: 483896 - RNA, 21 nt, Human
ucgcccagcucccgcaccugc

SEQ ID NO: 483897 - RNA, 18 nt, Human
ucgggcggcuccccgcug

SEQ ID NO: 483898 - RNA, 20 nt, Human
ucgggcggcuccccgcugcu

SEQ ID NO: 483899 - RNA, 22 nt, Human
ucuccagcugcugccgccugag

SEQ ID NO: 483900 - RNA, 22 nt, Human
ucucuuugaggcgccgccgcuc

SEQ ID NO: 483901 - RNA, 25 nt, Human
ugagggccccaagcuugcccugggc

SEQ ID NO: 483902 - RNA, 19 nt, Human
ugcccggcaguccggcugg

SEQ ID NO: 483903 - RNA, 19 nt, Human
ugccgcuuaacaaacggcc

SEQ ID NO: 483904 - RNA, 19 nt, Human
ugccgcuuaacaaacggcc

SEQ ID NO: 483905 - RNA, 20 nt, Human
uggcaggccgggccgguggg

SEQ ID NO: 483906 - RNA, 26 nt, Human
ugggcccucggcccggccgcccaacu

SEQ ID NO: 483907 - RNA, 21 nt, Human
uggggguuccgcaaaaccugc

SEQ ID NO: 483908 - RNA, 24 nt, Human
uguguuacauggugaaacagaaca

SEQ ID NO: 483909 - RNA, 24 nt, Human
uguguuacauggugaaacagaaca

SEQ ID NO: 483910 - RNA, 24 nt, Human
uguguuacauggugaaacagaaca

SEQ ID NO: 483911 - RNA, 22 nt, Human
uuacacagauggcgugugcaug

SEQ ID NO: 483912 - RNA, 22 nt, Human
uuacacagauggcgugugcaug

SEQ ID NO: 483913 - RNA, 22 nt, Human
uuacacagauggcgugugcaug

SEQ ID NO: 483914 - RNA, 19 nt, Human
uuuuuuuuuuuugcggguc

SEQ ID NO: 483915 - RNA, 19 nt, Human
uuuuuuuuuuuugcggguc

SEQ ID NO: 483916 - RNA, 18 nt, Human
uuuuuuuuuuuuuugcgg

SEQ ID NO: 483917 - RNA, 18 nt, Human
uuuuuuuuuuuuuugcgg

SEQ ID NO: 483918 - RNA, 18 nt, Human
uuuuuuuuuuuuuuuuug

SEQ ID NO: 483919 - RNA, 19 nt, Human
uuuuuuuuuuuuuuuuugc

SEQ ID NO: 483920 - RNA, 21 nt, Human
uuuuuuuuuuuuuuuuugcgg

SEQ ID NO: 483921 - RNA, 21 nt, Human
uuuuuuuuuuuuuuuuugcgg

SEQ ID NO: 483922 - RNA, 22 nt, Human
uuuuuuuuuuuuuuuuugcggg

SEQ ID NO: 483923 - RNA, 23 nt, Human
uuuuuuuuuuuuuuuuugcgggu

SEQ ID NO: 483924 - RNA, 25 nt, Human
uuuuuuuuuuuuuuuuuuuugcggg

SEQ ID NO: 483925 - RNA, 27 nt, Human
uuuuuuuuuuuuuuuuuuuuuuugggg

SEQ ID NO: 483926 - RNA, 20 nt, Human
aaaugcuuuuaaugcucuuc

SEQ ID NO: 483927 - RNA, 21 nt, Human
aacaccccacaccccacaccu

SEQ ID NO: 483928 - RNA, 23 nt, Human
agggaccauccccggcugaagcc

SEQ ID NO: 483929 - RNA, 21 nt, Human
cacaccccacaccugcccccc

SEQ ID NO: 483930 - RNA, 18 nt, Human
caccccacaccccacacc

SEQ ID NO: 483931 - RNA, 18 nt, Human
caccccacaccccacacc

SEQ ID NO: 483932 - RNA, 22 nt, Human
caccccacaccccacaccugcc

SEQ ID NO: 483933 - RNA, 24 nt, Human
caggagauacuugagagggaccau

SEQ ID NO: 483934 - RNA, 23 nt, Human
ccacaccugccccccauaccccu

SEQ ID NO: 483935 - RNA, 21 nt, Human
cccacaccccacaccugcccc

SEQ ID NO: 483936 - RNA, 23 nt, Human
cccacaccccacaccugcccccc

SEQ ID NO: 483937 - RNA, 31 nt, Human
cccacaccccacaccugccccccauaccccu

SEQ ID NO: 483938 - RNA, 22 nt, Human
cccauaccccuuccuccaggag

SEQ ID NO: 483939 - RNA, 24 nt, Human
ccccacaccccacaccugcccccc

SEQ ID NO: 483940 - RNA, 22 nt, Human
ccccacaccugccccccauacc

SEQ ID NO: 483941 - RNA, 21 nt, Human
cccccauaccccuuccuccag

SEQ ID NO: 483942 - RNA, 22 nt, Human
ccccccauaccccuuccuccag

SEQ ID NO: 483943 - RNA, 21 nt, Human
cccgcaaagucuccucaagca

SEQ ID NO: 483944 - RNA, 21 nt, Human
ccuccccgcaaagucuccuca

SEQ ID NO: 483945 - RNA, 23 nt, Human
ccugccccccauaccccuuccuc

SEQ ID NO: 483946 - RNA, 20 nt, Human
cuccagugucugcugccucc

SEQ ID NO: 483947 - RNA, 24 nt, Human
cugccuccuccccgcaaagucucc

SEQ ID NO: 483948 - RNA, 18 nt, Human
cugcugccuccuccccgc

SEQ ID NO: 483949 - RNA, 21 nt, Human
gcaaagucuccucaagcacag

SEQ ID NO: 483950 - RNA, 18 nt, Human
ggacaaggggugcuucca

SEQ ID NO: 483951 - RNA, 23 nt, Human
gguuguugcaauggucauaggag

SEQ ID NO: 483952 - RNA, 21 nt, Human
gucugcugccuccuccccgca

SEQ ID NO: 483953 - RNA, 20 nt, Human
uccccgcaaagucuccucaa

SEQ ID NO: 483954 - RNA, 19 nt, Human
ucuccagugucugcugccu

SEQ ID NO: 483955 - RNA, 18 nt, Human
ucuccucaagcacaggac

SEQ ID NO: 483956 - RNA, 22 nt, Human
ucugcugccuccuccccgcaaa

SEQ ID NO: 483957 - RNA, 19 nt, Human
uggccgggaacaccccaca

SEQ ID NO: 483958 - RNA, 23 nt, Human
uuuuuuuuuuuuuuuuuuccuuu

SEQ ID NO: 483959 - RNA, 25 nt, Human
uuuuuuuuuuuuuuuuuuccuuuuu

SEQ ID NO: 483960 - RNA, 27 nt, Human
uuuuuuuuuuuuuuuuuuccuuuuuaa

SEQ ID NO: 483961 - RNA, 21 nt, Human
aaaaaggacgccuuccgugac

SEQ ID NO: 483962 - RNA, 22 nt, Human
aacccuuugguggggagggggc

SEQ ID NO: 483963 - RNA, 21 nt, Human
aagggaccuggcaggcagggc

SEQ ID NO: 483964 - RNA, 23 nt, Human
acaucauuugguuuccuggugcu

SEQ ID NO: 483965 - RNA, 20 nt, Human
accuggcaggcagggcuggc

SEQ ID NO: 483966 - RNA, 22 nt, Human
aggauggaggggagcuacucag

SEQ ID NO: 483967 - RNA, 22 nt, Human
aggcagggggacaggugcuaag

SEQ ID NO: 483968 - RNA, 23 nt, Human
aggccugcagccaccugcucuaa

SEQ ID NO: 483969 - RNA, 22 nt, Human
agggggccccugaagccucggc

SEQ ID NO: 483970 - RNA, 21 nt, Human
aggguagagcgggcaggaggg

SEQ ID NO: 483971 - RNA, 18 nt, Human
agguggggguuagggugg

SEQ ID NO: 483972 - RNA, 19 nt, Human
auauggcagcgacacacgc

SEQ ID NO: 483973 - RNA, 19 nt, Human
caaggucccuucccgggca

SEQ ID NO: 483974 - RNA, 19 nt, Human
cagcagcaagaggcagggg

SEQ ID NO: 483975 - RNA, 22 nt, Human
caggacagcagcaagaggcagg

SEQ ID NO: 483976 - RNA, 18 nt, Human
caggggccgaggacggag

SEQ ID NO: 483977 - RNA, 18 nt, Human
caguaguagggacuggag

SEQ ID NO: 483978 - RNA, 20 nt, Human
caucauuugguuuccugguc

SEQ ID NO: 483979 - RNA, 22 nt, Human
ccaggccccgccgccgccgccg

SEQ ID NO: 483980 - RNA, 22 nt, Human
ccaguucccauagcaaagagag

SEQ ID NO: 483981 - RNA, 23 nt, Human
ccccaaguggccggcaguggccu

SEQ ID NO: 483982 - RNA, 21 nt, Human
ccccgccgccgccgccgcugc

SEQ ID NO: 483983 - RNA, 26 nt, Human
ccccgccgccgccgccgcugcgcccg

SEQ ID NO: 483984 - RNA, 19 nt, Human
ccccugaagccucggcggg

SEQ ID NO: 483985 - RNA, 21 nt, Human
ccgccgccgccgccgcugcgc

SEQ ID NO: 483986 - RNA, 25 nt, Human
ccgccgccgccgccgcugcgcccgg

SEQ ID NO: 483987 - RNA, 20 nt, Human
ccucggcggggccaccccuc

SEQ ID NO: 483988 - RNA, 20 nt, Human
ccuggccaggcuaccuuccc

SEQ ID NO: 483989 - RNA, 21 nt, Human
cgccgccgccgccgcugcgcc

SEQ ID NO: 483990 - RNA, 22 nt, Human
cggcaacaucguguaaaaaagu

SEQ ID NO: 483991 - RNA, 25 nt, Human
cgggcaggaggggggacgagggcuc

SEQ ID NO: 483992 - RNA, 23 nt, Human
cgucacaguaguagggacuggaa

SEQ ID NO: 483993 - RNA, 21 nt, Human
cguuagcuacaaggaaaaagg

SEQ ID NO: 483994 - RNA, 22 nt, Human
cuuccgugacagauccuugagg

SEQ ID NO: 483995 - RNA, 23 nt, Human
gaaaaaggacgccuuccgugaca

SEQ ID NO: 483996 - RNA, 23 nt, Human
gaccuggcaggcagggcuggcag

SEQ ID NO: 483997 - RNA, 19 nt, Human
gauggaggggagcuacuca

SEQ ID NO: 483998 - RNA, 24 nt, Human
gccuggucgucgaaggggaggccc

SEQ ID NO: 483999 - RNA, 19 nt, Human
gcgggggcggcgggcaggg

SEQ ID NO: 484000 - RNA, 21 nt, Human
ggaccuggcaggcagggcugg

SEQ ID NO: 484001 - RNA, 18 nt, Human
ggagggagaggucccugc

SEQ ID NO: 484002 - RNA, 20 nt, Human
ggcaggaggggggacgaggg

SEQ ID NO: 484003 - RNA, 22 nt, Human
ggccgggagguggggguuaggg

SEQ ID NO: 484004 - RNA, 21 nt, Human
ggccuggucgucgaaggggag

SEQ ID NO: 484005 - RNA, 23 nt, Human
ggccuggucgucgaaggggaggc

SEQ ID NO: 484006 - RNA, 18 nt, Human
gggcaggaggggggacga

SEQ ID NO: 484007 - RNA, 22 nt, Human
gggcaggaggggggacgagggc

SEQ ID NO: 484008 - RNA, 21 nt, Human
gggcggggggggaccugcagg

SEQ ID NO: 484009 - RNA, 22 nt, Human
gggcucggggacaggacagcag

SEQ ID NO: 484010 - RNA, 21 nt, Human
ggggaaagccgcccggcgggg

SEQ ID NO: 484011 - RNA, 23 nt, Human
gggggacaggugcuaagggaccu

SEQ ID NO: 484012 - RNA, 23 nt, Human
ggugcugucaguccgcggggcgg

SEQ ID NO: 484013 - RNA, 24 nt, Human
uaaaaaaagcagcaugucacgucc

SEQ ID NO: 484014 - RNA, 18 nt, Human
uacaaggauggaggggag

SEQ ID NO: 484015 - RNA, 18 nt, Human
uauggcagcgacacacgc

SEQ ID NO: 484016 - RNA, 20 nt, Human
uauuuuuucuuucuuuuucu

SEQ ID NO: 484017 - RNA, 18 nt, Human
uccagcagaugacaagcc

SEQ ID NO: 484018 - RNA, 19 nt, Human
ucccauagcaaagagagcu

SEQ ID NO: 484019 - RNA, 20 nt, Human
ucccuccgggcccaaggccu

SEQ ID NO: 484020 - RNA, 21 nt, Human
ugaggugaacccuuugguggg

SEQ ID NO: 484021 - RNA, 22 nt, Human
ugaggugucugugucugcccca

SEQ ID NO: 484022 - RNA, 22 nt, Human
ugcugucaguccgcggggcggg

SEQ ID NO: 484023 - RNA, 21 nt, Human
uggaaaugccgucacaguagu

SEQ ID NO: 484024 - RNA, 21 nt, Human
uggcaggccccauggcgccug

SEQ ID NO: 484025 - RNA, 24 nt, Human
uggccaggcuaccuucccacugga

SEQ ID NO: 484026 - RNA, 23 nt, Human
uggcucggcccggccggccuggc

SEQ ID NO: 484027 - RNA, 19 nt, Human
uggggagggggccccugaa

SEQ ID NO: 484028 - RNA, 23 nt, Human
uggggagggggccccugaagccu

SEQ ID NO: 484029 - RNA, 20 nt, Human
uuaaaaaaagcagcauguca

SEQ ID NO: 484030 - RNA, 23 nt, Human
uucccauagcaaagagagcugug

SEQ ID NO: 484031 - RNA, 24 nt, Human
uuuggagggagaggucccugcaag

SEQ ID NO: 484032 - RNA, 18 nt, Human
uuuucuuuuuuuggaggg

SEQ ID NO: 484033 - RNA, 21 nt, Human
uuuuuuucuuuuuuuggaggg

SEQ ID NO: 484034 - RNA, 28 nt, Human
aacacuuuauuauguauaauuuguacau

SEQ ID NO: 484035 - RNA, 26 nt, Human
aauacaauuuucaaacaaagcuuccc

SEQ ID NO: 484036 - RNA, 26 nt, Human
acaaagcuucccuucuuuacacaaag

SEQ ID NO: 484037 - RNA, 22 nt, Human
acacacguaucaacaccauaca

SEQ ID NO: 484038 - RNA, 22 nt, Human
acuccagggaggaagguguggu

SEQ ID NO: 484039 - RNA, 20 nt, Human
agggauggggauguauggag

SEQ ID NO: 484040 - RNA, 25 nt, Human
caaagcuucccuucuuuacacaaag

SEQ ID NO: 484041 - RNA, 23 nt, Human
cacacguaucaacaccauacagg

SEQ ID NO: 484042 - RNA, 21 nt, Human
cuucacacacguaucaacacc

SEQ ID NO: 484043 - RNA, 20 nt, Human
gccacauacaaaaauacaau

SEQ ID NO: 484044 - RNA, 24 nt, Human
ggaaaagagcccuuucccuucaga

SEQ ID NO: 484045 - RNA, 19 nt, Human
ggaaaguagagggaugggg

SEQ ID NO: 484046 - RNA, 19 nt, Human
uaaauagauacuucacaca

SEQ ID NO: 484047 - RNA, 22 nt, Human
uaauuauuaaaaacacuuuauu

SEQ ID NO: 484048 - RNA, 27 nt, Human
uagagggauggggauguaugacaacgg

SEQ ID NO: 484049 - RNA, 22 nt, Human
uaucaacaccauacaggcauua

SEQ ID NO: 484050 - RNA, 23 nt, Human
uaucuguugcuuaagccaaacuc

SEQ ID NO: 484051 - RNA, 18 nt, Human
ucuguugcuuaagccaaa

SEQ ID NO: 484052 - RNA, 19 nt, Human
ugaaacagcaggaaaagag

SEQ ID NO: 484053 - RNA, 24 nt, Human
ugccaugccacauacaaaaauaca

SEQ ID NO: 484054 - RNA, 22 nt, Human
uguacaugcuucaauuuguguc

SEQ ID NO: 484055 - RNA, 19 nt, Human
uuacacaaagguacacaag

SEQ ID NO: 484056 - RNA, 22 nt, Human
uucauucugccaugccacauac

SEQ ID NO: 484057 - RNA, 19 nt, Human
uugaaacagcaggaaaaga

SEQ ID NO: 484058 - RNA, 24 nt, Human
uuuauuuuccagguuguaaugaca

SEQ ID NO: 484059 - RNA, 22 nt, Human
aaaaagcaaaaacauuuauugc

SEQ ID NO: 484060 - RNA, 22 nt, Human
aaacaaaaagcaaaaacauuua

SEQ ID NO: 484061 - RNA, 22 nt, Human
aaacaacaucagaacaagaaca

SEQ ID NO: 484062 - RNA, 25 nt, Human
aaauaccaaauggcuauaaagagcu

SEQ ID NO: 484063 - RNA, 24 nt, Human
aacaucagaacaagaacacauaua

SEQ ID NO: 484064 - RNA, 27 nt, Human
aagcaaacaagugcaaucuuucaaaca

SEQ ID NO: 484065 - RNA, 20 nt, Human
acaauaacaucaacaaugac

SEQ ID NO: 484066 - RNA, 22 nt, Human
acgaagcaacaauaacaucaac

SEQ ID NO: 484067 - RNA, 19 nt, Human
agcuuguaaaaaaaaauca

SEQ ID NO: 484068 - RNA, 24 nt, Human
aggaaacaacaucagaacaagaac

SEQ ID NO: 484069 - RNA, 22 nt, Human
aggaaaggaaacaggugaacgu

SEQ ID NO: 484070 - RNA, 22 nt, Human
aggugcagacagucuuauuacc

SEQ ID NO: 484071 - RNA, 24 nt, Human
aguuauaucaaaacacuugguggu

SEQ ID NO: 484072 - RNA, 25 nt, Human
caaacaaaaagcaaaaacagggacc

SEQ ID NO: 484073 - RNA, 23 nt, Human
caaacaaaaagcaaaaacauuua

SEQ ID NO: 484074 - RNA, 20 nt, Human
cacagaacuguccucuugcc

SEQ ID NO: 484075 - RNA, 25 nt, Human
cacagaauguuuauuuacuguuuaa

SEQ ID NO: 484076 - RNA, 22 nt, Human
cagcucaaucguaacaacuugc

SEQ ID NO: 484077 - RNA, 23 nt, Human
caggaaacaacaucagaacaaga

SEQ ID NO: 484078 - RNA, 20 nt, Human
cauugcacauauaagaaaac

SEQ ID NO: 484079 - RNA, 22 nt, Human
cccacauauaguaaaagcaaac

SEQ ID NO: 484080 - RNA, 27 nt, Human
cugucauggagccucagaacuauucug

SEQ ID NO: 484081 - RNA, 20 nt, Human
gaaauaccaaauggcuauaa

SEQ ID NO: 484082 - RNA, 23 nt, Human
gaacacauauaaauuaaaggcau

SEQ ID NO: 484083 - RNA, 21 nt, Human
gagacaaaguguacaaagauu

SEQ ID NO: 484084 - RNA, 23 nt, Human
gagcuuuccaaauauuggaaaua

SEQ ID NO: 484085 - RNA, 19 nt, Human
gugagacaaaguguacaaa

SEQ ID NO: 484086 - RNA, 23 nt, Human
guuauaucaaaacacuugguggu

SEQ ID NO: 484087 - RNA, 18 nt, Human
uaaaacgaagcaacaaua

SEQ ID NO: 484088 - RNA, 19 nt, Human
uaaaacgaagcaacaauaa

SEQ ID NO: 484089 - RNA, 18 nt, Human
uaacaucaacaaugacaa

SEQ ID NO: 484090 - RNA, 21 nt, Human
uaacuuaaaaucacuuacaaa

SEQ ID NO: 484091 - RNA, 21 nt, Human
uagaaaagacuucacaugcaa

SEQ ID NO: 484092 - RNA, 20 nt, Human
uaggaaauaccaaauggcua

SEQ ID NO: 484093 - RNA, 21 nt, Human
uaggaaauaccaaauggcuau

SEQ ID NO: 484094 - RNA, 20 nt, Human
ucaaacaaaaagcaaaaaca

SEQ ID NO: 484095 - RNA, 23 nt, Human
ucauuccacuucauugcacauau

SEQ ID NO: 484096 - RNA, 24 nt, Human
ucuagagacacacaaagguagccu

SEQ ID NO: 484097 - RNA, 25 nt, Human
ugaacagaaaauauauuuuacccca

SEQ ID NO: 484098 - RNA, 21 nt, Human
ugcuuuucucuucuagagaca

SEQ ID NO: 484099 - RNA, 20 nt, Human
ugguggugucacuaaguuaa

SEQ ID NO: 484100 - RNA, 21 nt, Human
ugucauggagccucagaacua

SEQ ID NO: 484101 - RNA, 20 nt, Human
uuaaauggauccacagggua

SEQ ID NO: 484102 - RNA, 20 nt, Human
uuuauauuuacauacacauu

SEQ ID NO: 484103 - RNA, 21 nt, Human
agcaaacacgauagaggagac

SEQ ID NO: 484104 - RNA, 19 nt, Human
aggacccgcgggcgcaggg

SEQ ID NO: 484105 - RNA, 18 nt, Human
aggagcugcaagcccgug

SEQ ID NO: 484106 - RNA, 22 nt, Human
caaacacgauagaggagaccag

SEQ ID NO: 484107 - RNA, 24 nt, Human
caagcccguggccuggccugcuac

SEQ ID NO: 484108 - RNA, 22 nt, Human
cacaacacagccuuggaccaug

SEQ ID NO: 484109 - RNA, 25 nt, Human
cacagccccuggagagggggccagg

SEQ ID NO: 484110 - RNA, 23 nt, Human
caccaaacccacccgcgcccugg

SEQ ID NO: 484111 - RNA, 23 nt, Human
cacccgcgcccugggacgcagcc

SEQ ID NO: 484112 - RNA, 23 nt, Human
caccuccgccagccgccuccacc

SEQ ID NO: 484113 - RNA, 21 nt, Human
cacggccgccgagagcaaggg

SEQ ID NO: 484114 - RNA, 21 nt, Human
cagccgccuccacccgcccca

SEQ ID NO: 484115 - RNA, 19 nt, Human
ccaccuccgccagccgccu

SEQ ID NO: 484116 - RNA, 27 nt, Human
ccagccgccuccacccgccccacacca

SEQ ID NO: 484117 - RNA, 20 nt, Human
cccagccugugccgcccucu

SEQ ID NO: 484118 - RNA, 22 nt, Human
ccccagccuuccaccugugcua

SEQ ID NO: 484119 - RNA, 21 nt, Human
cccccggccaggcgguccccg

SEQ ID NO: 484120 - RNA, 22 nt, Human
cccccgggccccagccuuccac

SEQ ID NO: 484121 - RNA, 23 nt, Human
cccccgggccccagccuuccacc

SEQ ID NO: 484122 - RNA, 20 nt, Human
cccgcccccgggccccagcc

SEQ ID NO: 484123 - RNA, 22 nt, Human
cccgcgcccugggacgcagcca

SEQ ID NO: 484124 - RNA, 24 nt, Human
cccgcgcccugggacgcagccacg

SEQ ID NO: 484125 - RNA, 18 nt, Human
cccggggcgcccuccccu

SEQ ID NO: 484126 - RNA, 20 nt, Human
cccugcacgccgggacgcca

SEQ ID NO: 484127 - RNA, 19 nt, Human
ccgcaggcagacagccugg

SEQ ID NO: 484128 - RNA, 20 nt, Human
ccgcccccgggccccagccu

SEQ ID NO: 484129 - RNA, 20 nt, Human
ccgggccccagccuuccacc

SEQ ID NO: 484130 - RNA, 21 nt, Human
ccgggccugugcgcugcccca

SEQ ID NO: 484131 - RNA, 20 nt, Human
ccuccacccgccccacacca

SEQ ID NO: 484132 - RNA, 19 nt, Human
ccucugaggagaggccugg

SEQ ID NO: 484133 - RNA, 20 nt, Human
ccucugaggagaggccuggg

SEQ ID NO: 484134 - RNA, 20 nt, Human
ccugcuacaugcccugcuuc

SEQ ID NO: 484135 - RNA, 21 nt, Human
ccugugcuagcagccuggggc

SEQ ID NO: 484136 - RNA, 18 nt, Human
ccuugcccagaccucccc

SEQ ID NO: 484137 - RNA, 19 nt, Human
ccuugcccagaccuccccu

SEQ ID NO: 484138 - RNA, 20 nt, Human
ccuugcccagaccuccccug

SEQ ID NO: 484139 - RNA, 19 nt, Human
ccuugugcugcgcccgagc

SEQ ID NO: 484140 - RNA, 21 nt, Human
cgccaggaggaggacacggcc

SEQ ID NO: 484141 - RNA, 23 nt, Human
cgccgggacgccaccuccgccag

SEQ ID NO: 484142 - RNA, 22 nt, Human
cgcgggcaggaggcccagcagg

SEQ ID NO: 484143 - RNA, 21 nt, Human
cggcccggguccaggggccgg

SEQ ID NO: 484144 - RNA, 23 nt, Human
cgggagggcccggccaggcggcg

SEQ ID NO: 484145 - RNA, 19 nt, Human
cggugggcgccccggcccg

SEQ ID NO: 484146 - RNA, 21 nt, Human
cuccgccagccgccuccaccc

SEQ ID NO: 484147 - RNA, 20 nt, Human
cucuggggaaauccgccuca

SEQ ID NO: 484148 - RNA, 18 nt, Human
cugugcugggcccgggcc

SEQ ID NO: 484149 - RNA, 23 nt, Human
cuugcccagaccuccccugccca

SEQ ID NO: 484150 - RNA, 20 nt, Human
cuuggaccaugagcagaagc

SEQ ID NO: 484151 - RNA, 18 nt, Human
cuuggagggggcaggagg

SEQ ID NO: 484152 - RNA, 19 nt, Human
gagcagcagguggggagga

SEQ ID NO: 484153 - RNA, 18 nt, Human
gagcccagccugugccgc

SEQ ID NO: 484154 - RNA, 23 nt, Human
gagcccagccugugccgcccucu

SEQ ID NO: 484155 - RNA, 18 nt, Human
gaggaaggaccgcaggca

SEQ ID NO: 484156 - RNA, 19 nt, Human
gaggagcccccggcagagc

SEQ ID NO: 484157 - RNA, 24 nt, Human
gcacacccucagaggagcugcaag

SEQ ID NO: 484158 - RNA, 28 nt, Human
gcacagccccuggagaggggggaacgcc

SEQ ID NO: 484159 - RNA, 19 nt, Human
gcacggaggagcccccggc

SEQ ID NO: 484160 - RNA, 19 nt, Human
gccagccgccuccacccgc

SEQ ID NO: 484161 - RNA, 24 nt, Human
gcccaacacuguggaucagcaaac

SEQ ID NO: 484162 - RNA, 24 nt, Human
gcccagacgcgcccauccugaggg

SEQ ID NO: 484163 - RNA, 22 nt, Human
gccuccacccgccccacaccac

SEQ ID NO: 484164 - RNA, 18 nt, Human
gccugggccucuaacagc

SEQ ID NO: 484165 - RNA, 19 nt, Human
gcugggcccgggccugugc

SEQ ID NO: 484166 - RNA, 20 nt, Human
gcugggcccgggccugugcg

SEQ ID NO: 484167 - RNA, 23 nt, Human
gcuuauauucugggggugcggug

SEQ ID NO: 484168 - RNA, 21 nt, Human
ggaaacacggggugagacagc

SEQ ID NO: 484169 - RNA, 21 nt, Human
ggagagaggaaaagggagggc

SEQ ID NO: 484170 - RNA, 23 nt, Human
ggaggagagaggaaaagggaggg

SEQ ID NO: 484171 - RNA, 20 nt, Human
ggcccgggcggcgcgggagg

SEQ ID NO: 484172 - RNA, 22 nt, Human
ggcgcagagaacuuaggagaga

SEQ ID NO: 484173 - RNA, 23 nt, Human
gggcaguucugugcugggcccgg

SEQ ID NO: 484174 - RNA, 22 nt, Human
gggcggcgcgggagggcccggc

SEQ ID NO: 484175 - RNA, 19 nt, Human
ggggagcagcaggugggga

SEQ ID NO: 484176 - RNA, 18 nt, Human
ggggccuccacucuggcc

SEQ ID NO: 484177 - RNA, 20 nt, Human
gggggcccugaccuuggucc

SEQ ID NO: 484178 - RNA, 18 nt, Human
gugcgguggggcaggggg

SEQ ID NO: 484179 - RNA, 22 nt, Human
guggaugggcugccugcacagc

SEQ ID NO: 484180 - RNA, 20 nt, Human
ucaccaaacccacccgcgcc

SEQ ID NO: 484181 - RNA, 22 nt, Human
uccccggugggcgccccggccc

SEQ ID NO: 484182 - RNA, 18 nt, Human
uccccugucccuugugcu

SEQ ID NO: 484183 - RNA, 24 nt, Human
ucccgcgcgggcaggaggcccagc

SEQ ID NO: 484184 - RNA, 18 nt, Human
ucccggggcgcccucccc

SEQ ID NO: 484185 - RNA, 20 nt, Human
ucccuggucccggggcgccc

SEQ ID NO: 484186 - RNA, 25 nt, Human
ucucuggggaaauccgccucagcuc

SEQ ID NO: 484187 - RNA, 19 nt, Human
ucuggggaaauccgccuca

SEQ ID NO: 484188 - RNA, 18 nt, Human
ugacacacccacauucac

SEQ ID NO: 484189 - RNA, 19 nt, Human
ugaccuugguccccugucc

SEQ ID NO: 484190 - RNA, 18 nt, Human
ugccacgcugacacaccc

SEQ ID NO: 484191 - RNA, 19 nt, Human
ugccgcccucugaggagag

SEQ ID NO: 484192 - RNA, 18 nt, Human
ugcgguggggcagggggg

SEQ ID NO: 484193 - RNA, 22 nt, Human
ugcgguggggcaggggggcccu

SEQ ID NO: 484194 - RNA, 18 nt, Human
ugcuagcagccuggggcc

SEQ ID NO: 484195 - RNA, 25 nt, Human
uggagcccagccugugccgcccucu

SEQ ID NO: 484196 - RNA, 22 nt, Human
ugggcugccugcacagccccug

SEQ ID NO: 484197 - RNA, 23 nt, Human
ugggggugcgguggggcaggggg

SEQ ID NO: 484198 - RNA, 19 nt, Human
ugugcggggagggcccggg

SEQ ID NO: 484199 - RNA, 23 nt, Human
ugugcggggagggcccgggcggc

SEQ ID NO: 484200 - RNA, 19 nt, Human
uguggaucagcaaacacga

SEQ ID NO: 484201 - RNA, 21 nt, Human
aacaucccacaauguacagga

SEQ ID NO: 484202 - RNA, 18 nt, Human
aagaggccacgugcaauc

SEQ ID NO: 484203 - RNA, 25 nt, Human
aauccacggcauucaucugucccuc

SEQ ID NO: 484204 - RNA, 22 nt, Human
acaauguacaggacagccucac

SEQ ID NO: 484205 - RNA, 19 nt, Human
agagacaacacagggauca

SEQ ID NO: 484206 - RNA, 22 nt, Human
agcaaagggugaccuggcccca

SEQ ID NO: 484207 - RNA, 22 nt, Human
agccaaaaaucccuacagacca

SEQ ID NO: 484208 - RNA, 21 nt, Human
aggcagggugaggggcccugg

SEQ ID NO: 484209 - RNA, 21 nt, Human
aggcagggugaggggcccugg

SEQ ID NO: 484210 - RNA, 22 nt, Human
aggcagggugaggggcccuggc

SEQ ID NO: 484211 - RNA, 23 nt, Human
aggcagggugaggggcccuggcc

SEQ ID NO: 484212 - RNA, 19 nt, Human
aggccucagccucuuucag

SEQ ID NO: 484213 - RNA, 18 nt, Human
aggccuggggcaggaaag

SEQ ID NO: 484214 - RNA, 20 nt, Human
aguagccaacuaagacucca

SEQ ID NO: 484215 - RNA, 18 nt, Human
caaaaaucccuacagacc

SEQ ID NO: 484216 - RNA, 20 nt, Human
cacggcauucaucugucccu

SEQ ID NO: 484217 - RNA, 24 nt, Human
cacuggcagagaaagagcagaccu

SEQ ID NO: 484218 - RNA, 22 nt, Human
cagccucacagcaaagggugac

SEQ ID NO: 484219 - RNA, 18 nt, Human
caggaaagcuuuggggug

SEQ ID NO: 484220 - RNA, 21 nt, Human
caggacagccucacagcaaag

SEQ ID NO: 484221 - RNA, 21 nt, Human
caguagugcagagguuaaucc

SEQ ID NO: 484222 - RNA, 21 nt, Human
cccacaauguacaggacagcc

SEQ ID NO: 484223 - RNA, 22 nt, Human
ccccaguccccaggacccgccc

SEQ ID NO: 484224 - RNA, 19 nt, Human
cccgcccccgccccagggc

SEQ ID NO: 484225 - RNA, 18 nt, Human
cccuggaccagccacugc

SEQ ID NO: 484226 - RNA, 22 nt, Human
ccucaguccgcuuccgggccuc

SEQ ID NO: 484227 - RNA, 22 nt, Human
cucagccucuuucaggccuggg

SEQ ID NO: 484228 - RNA, 24 nt, Human
gaccagccacugcucaagaggcca

SEQ ID NO: 484229 - RNA, 23 nt, Human
gagaaccuuuuuguuuggcacca

SEQ ID NO: 484230 - RNA, 23 nt, Human
gcaaagggugaccuggccccaca

SEQ ID NO: 484231 - RNA, 20 nt, Human
gcccuggaccagccacugcu

SEQ ID NO: 484232 - RNA, 19 nt, Human
ggacagccucacagcaaag

SEQ ID NO: 484233 - RNA, 18 nt, Human
ggccuggggcaggaaagc

SEQ ID NO: 484234 - RNA, 20 nt, Human
ggccuggggcaggaaagcuu

SEQ ID NO: 484235 - RNA, 22 nt, Human
gggaucaugggacacaagucac

SEQ ID NO: 484236 - RNA, 24 nt, Human
gggaucaugggacacaagucacua

SEQ ID NO: 484237 - RNA, 21 nt, Human
gggccucggccgcccgcccca

SEQ ID NO: 484238 - RNA, 22 nt, Human
uaagagccugucugucacuggc

SEQ ID NO: 484239 - RNA, 22 nt, Human
uagccaaaaaucccuacagacc

SEQ ID NO: 484240 - RNA, 23 nt, Human
uaggaaaaauuaacaauuuuuaa

SEQ ID NO: 484241 - RNA, 20 nt, Human
uccccaggacccgcccccgc

SEQ ID NO: 484242 - RNA, 21 nt, Human
uccccaggacccgcccccgcc

SEQ ID NO: 484243 - RNA, 18 nt, Human
ucugucccucuuccucca

SEQ ID NO: 484244 - RNA, 19 nt, Human
ucugucccucuuccuccac

SEQ ID NO: 484245 - RNA, 20 nt, Human
ucuuucaggccuggggcagg

SEQ ID NO: 484246 - RNA, 21 nt, Human
ugaccuggccccacaugucag

SEQ ID NO: 484247 - RNA, 25 nt, Human
ugaccuggccccacaugucaguagg

SEQ ID NO: 484248 - RNA, 23 nt, Human
ugaggcaagggacagugcugaac

SEQ ID NO: 484249 - RNA, 23 nt, Human
ugcaagauaaggcagggugaggg

SEQ ID NO: 484250 - RNA, 21 nt, Human
ugcaauauaggaaaaauuaac

SEQ ID NO: 484251 - RNA, 19 nt, Human
ugcaggaaaguccaggccu

SEQ ID NO: 484252 - RNA, 21 nt, Human
ugcucuagagacaacacaggg

SEQ ID NO: 484253 - RNA, 18 nt, Human
uggcauugaggcaaggga

SEQ ID NO: 484254 - RNA, 24 nt, Human
uggggcaggaaagcuuuggggugg

SEQ ID NO: 484255 - RNA, 21 nt, Human
uguagccaaaaaucccuacag

SEQ ID NO: 484256 - RNA, 25 nt, Human
uuaaucccugcucuagagacaacac

SEQ ID NO: 484257 - RNA, 24 nt, Human
uuacagcuguucagacucuaguag

SEQ ID NO: 484258 - RNA, 21 nt, Human
uuccgggccucggccgcccgc

SEQ ID NO: 484259 - RNA, 20 nt, Human
uugcugaucuaugagcgaua

SEQ ID NO: 484260 - RNA, 21 nt, Human
uuguguguagccaaaaauccc

SEQ ID NO: 484261 - RNA, 27 nt, Human
uuucaggccuggggcaggaaagcuuug

SEQ ID NO: 484262 - RNA, 24 nt, Human
aaaacagauaugaccucucaauau

SEQ ID NO: 484263 - RNA, 18 nt, Human
aaaauccagauacagacc

SEQ ID NO: 484264 - RNA, 18 nt, Human
aaacagaaucacauguuu

SEQ ID NO: 484265 - RNA, 21 nt, Human
aaacagucaauuagaaaaagc

SEQ ID NO: 484266 - RNA, 19 nt, Human
aaacagucgaaucaccaga

SEQ ID NO: 484267 - RNA, 18 nt, Human
aaagaaaaacaggcagac

SEQ ID NO: 484268 - RNA, 19 nt, Human
aaagaaaaacaggcagaca

SEQ ID NO: 484269 - RNA, 20 nt, Human
aaagaaaaacaggcagacaa

SEQ ID NO: 484270 - RNA, 24 nt, Human
aaauagccccauagaaguuagggu

SEQ ID NO: 484271 - RNA, 20 nt, Human
aacaaagccaacuucaauaa

SEQ ID NO: 484272 - RNA, 26 nt, Human
aacauuugcuguaacgagcuaaauac

SEQ ID NO: 484273 - RNA, 25 nt, Human
aacccaacuuuuuuuuuuuuucucc

SEQ ID NO: 484274 - RNA, 20 nt, Human
aacucuguguaagaaguauu

SEQ ID NO: 484275 - RNA, 19 nt, Human
aagaaaacauuugcagaag

SEQ ID NO: 484276 - RNA, 22 nt, Human
aagccaaguuuaagaaccacac

SEQ ID NO: 484277 - RNA, 18 nt, Human
aagugggguccagccacc

SEQ ID NO: 484278 - RNA, 20 nt, Human
aaguuagggugaggaggagg

SEQ ID NO: 484279 - RNA, 20 nt, Human
acccaucaguaauucagaau

SEQ ID NO: 484280 - RNA, 22 nt, Human
accccacaauuauuaacacaga

SEQ ID NO: 484281 - RNA, 20 nt, Human
accccgggccguggcugcug

SEQ ID NO: 484282 - RNA, 18 nt, Human
accuaauucauuguuugg

SEQ ID NO: 484283 - RNA, 24 nt, Human
agaaaaacagauaugaccucucaa

SEQ ID NO: 484284 - RNA, 24 nt, Human
agaaaaagaaaugaaugauaaaga

SEQ ID NO: 484285 - RNA, 25 nt, Human
agaaaaagaaaugaaugauaaagaa

SEQ ID NO: 484286 - RNA, 26 nt, Human
agaaaaagaaaugaaugauaaagaaa

SEQ ID NO: 484287 - RNA, 18 nt, Human
agaaaaagcaauacacca

SEQ ID NO: 484288 - RNA, 20 nt, Human
agaagaaaauuuaaaaaaga

SEQ ID NO: 484289 - RNA, 22 nt, Human
agaccauuuaaaaucccgaucu

SEQ ID NO: 484290 - RNA, 19 nt, Human
agagaagcagggcuucuug

SEQ ID NO: 484291 - RNA, 24 nt, Human
agagaagcagggcuucuugccaca

SEQ ID NO: 484292 - RNA, 19 nt, Human
agaggaccaaaaaaaggga

SEQ ID NO: 484293 - RNA, 22 nt, Human
agcagaggaccaaaaaaaggga

SEQ ID NO: 484294 - RNA, 19 nt, Human
agccaggcgcccugagacc

SEQ ID NO: 484295 - RNA, 18 nt, Human
aggcaaggcagaggccag

SEQ ID NO: 484296 - RNA, 21 nt, Human
aggcccaacucacucuuccuc

SEQ ID NO: 484297 - RNA, 19 nt, Human
agggaucccagauauguuu

SEQ ID NO: 484298 - RNA, 24 nt, Human
agucacgaugauagagacagcccc

SEQ ID NO: 484299 - RNA, 24 nt, Human
auaaagaaaaacagauaugaccuc

SEQ ID NO: 484300 - RNA, 23 nt, Human
aucacaaguuacaaaaacuguaa

SEQ ID NO: 484301 - RNA, 19 nt, Human
augacaagaaaacauuugc

SEQ ID NO: 484302 - RNA, 19 nt, Human
augcacaauuuggaaugaa

SEQ ID NO: 484303 - RNA, 23 nt, Human
auugucuuuuuguuuuuguguga

SEQ ID NO: 484304 - RNA, 21 nt, Human
auuucauagcuaacauucaau

SEQ ID NO: 484305 - RNA, 19 nt, Human
caaaaaaagggaucccaga

SEQ ID NO: 484306 - RNA, 19 nt, Human
caacagcagggaaguccac

SEQ ID NO: 484307 - RNA, 24 nt, Human
caacauacuuuagaaauggauaua

SEQ ID NO: 484308 - RNA, 23 nt, Human
caagaaaacauuugcagaagaaa

SEQ ID NO: 484309 - RNA, 22 nt, Human
caauuuucaaaacagaaucaca

SEQ ID NO: 484310 - RNA, 22 nt, Human
cacaauuuggaaugaauugucu

SEQ ID NO: 484311 - RNA, 19 nt, Human
cacccugauggcaacagca

SEQ ID NO: 484312 - RNA, 21 nt, Human
cagaagaaaauuuaaaaaaga

SEQ ID NO: 484313 - RNA, 25 nt, Human
cagauaaaagguagcuuaauauuca

SEQ ID NO: 484314 - RNA, 24 nt, Human
cagauacagaccauuuaaaauccc

SEQ ID NO: 484315 - RNA, 21 nt, Human
cagcagcaccuugaggacggc

SEQ ID NO: 484316 - RNA, 21 nt, Human
cagccaggcgcccugagaccc

SEQ ID NO: 484317 - RNA, 19 nt, Human
cagccauugguauuuauuu

SEQ ID NO: 484318 - RNA, 21 nt, Human
cagucgaaucaccagaagggc

SEQ ID NO: 484319 - RNA, 19 nt, Human
caucagugaacccaucagg

SEQ ID NO: 484320 - RNA, 23 nt, Human
caucuaaaaccccacaauuauua

SEQ ID NO: 484321 - RNA, 24 nt, Human
caucuaggguaguggcucucaaac

SEQ ID NO: 484322 - RNA, 22 nt, Human
ccaagccgcgcccggccccagc

SEQ ID NO: 484323 - RNA, 23 nt, Human
ccacuuggcucuggauuccagga

SEQ ID NO: 484324 - RNA, 23 nt, Human
cccgccaagccgcgcccggcccc

SEQ ID NO: 484325 - RNA, 20 nt, Human
cccggacacuaggcgcgggg

SEQ ID NO: 484326 - RNA, 21 nt, Human
ccgccaagccgcgcccggccc

SEQ ID NO: 484327 - RNA, 21 nt, Human
ccggccccagcugcgucuccg

SEQ ID NO: 484328 - RNA, 20 nt, Human
ccucccgccaagccgcgccc

SEQ ID NO: 484329 - RNA, 19 nt, Human
ccucuugcaucuuguuacc

SEQ ID NO: 484330 - RNA, 23 nt, Human
ccugcgcggcuccgacgcugcuc

SEQ ID NO: 484331 - RNA, 23 nt, Human
cgcgcccggccccagcugcgucu

SEQ ID NO: 484332 - RNA, 19 nt, Human
cgcgcggcgccgccccagg

SEQ ID NO: 484333 - RNA, 22 nt, Human
cggcagcaacgcgagucaagaa

SEQ ID NO: 484334 - RNA, 23 nt, Human
cucacgcacuggcagccucccuc

SEQ ID NO: 484335 - RNA, 18 nt, Human
cucucaaaccuagcuaaa

SEQ ID NO: 484336 - RNA, 19 nt, Human
cucugaggagcugcugaag

SEQ ID NO: 484337 - RNA, 18 nt, Human
cucuggagguggagccag

SEQ ID NO: 484338 - RNA, 20 nt, Human
cugcagacccucccgccaag

SEQ ID NO: 484339 - RNA, 20 nt, Human
cugcaggucuucagccaggu

SEQ ID NO: 484340 - RNA, 20 nt, Human
cugcgcggcuccgacgcugc

SEQ ID NO: 484341 - RNA, 20 nt, Human
cugcugaaggaugaccuagg

SEQ ID NO: 484342 - RNA, 23 nt, Human
cuguaauuacaaauuacaaagaa

SEQ ID NO: 484343 - RNA, 24 nt, Human
cuguuccauuuaucuccuuccucu

SEQ ID NO: 484344 - RNA, 22 nt, Human
cuugaccucaucauuuaggugg

SEQ ID NO: 484345 - RNA, 19 nt, Human
cuuggcucuggauuccagg

SEQ ID NO: 484346 - RNA, 22 nt, Human
gaaaaacaggcagacaaucuug

SEQ ID NO: 484347 - RNA, 20 nt, Human
gaaaaagcaauacaccaaaa

SEQ ID NO: 484348 - RNA, 22 nt, Human
gaaaagauguucuguacaacau

SEQ ID NO: 484349 - RNA, 19 nt, Human
gaaguuagggugaggagga

SEQ ID NO: 484350 - RNA, 25 nt, Human
gacaagaaaacauuugcagaagaaa

SEQ ID NO: 484351 - RNA, 20 nt, Human
gacgcugcucugucuccccu

SEQ ID NO: 484352 - RNA, 21 nt, Human
gagacaccagcuuaacugugg

SEQ ID NO: 484353 - RNA, 26 nt, Human
gaugauagagacagccacagcugcca

SEQ ID NO: 484354 - RNA, 18 nt, Human
gcacuggcagccucccuc

SEQ ID NO: 484355 - RNA, 19 nt, Human
gccccagcuccgccuggcg

SEQ ID NO: 484356 - RNA, 21 nt, Human
gccccaggcacggaggcggca

SEQ ID NO: 484357 - RNA, 25 nt, Human
gcccugagacccgggcacggcgacg

SEQ ID NO: 484358 - RNA, 18 nt, Human
gccuggcgcucuccuccc

SEQ ID NO: 484359 - RNA, 18 nt, Human
gcgcggcuccgacgcugc

SEQ ID NO: 484360 - RNA, 21 nt, Human
gcgucguuccugcucucacuc

SEQ ID NO: 484361 - RNA, 18 nt, Human
gcugaaggaugaccuagg

SEQ ID NO: 484362 - RNA, 23 nt, Human
ggacagcucugaggagcugcuga

SEQ ID NO: 484363 - RNA, 21 nt, Human
ggcaacagcagggaaguccac

SEQ ID NO: 484364 - RNA, 23 nt, Human
ggccgcucugcgucguuccugcu

SEQ ID NO: 484365 - RNA, 21 nt, Human
ggcuucuugacacggaugccc

SEQ ID NO: 484366 - RNA, 20 nt, Human
guccagccaccagcuccauc

SEQ ID NO: 484367 - RNA, 18 nt, Human
gucuccccuguccagucu

SEQ ID NO: 484368 - RNA, 19 nt, Human
guggcugcuggacagcucc

SEQ ID NO: 484369 - RNA, 21 nt, Human
guggggcaucacagucaggug

SEQ ID NO: 484370 - RNA, 25 nt, Human
guucaugggcuucacagcuguuuuu

SEQ ID NO: 484371 - RNA, 19 nt, Human
guugacuaaugaauucugg

SEQ ID NO: 484372 - RNA, 20 nt, Human
uaaaauccagauacagacca

SEQ ID NO: 484373 - RNA, 23 nt, Human
uaaagaaaaacagauaugaccuc

SEQ ID NO: 484374 - RNA, 20 nt, Human
uaaauggaaaacaguuuuca

SEQ ID NO: 484375 - RNA, 23 nt, Human
uaacgagcuaaauaccaaaagcu

SEQ ID NO: 484376 - RNA, 21 nt, Human
uacaaagaaaaacaggcagac

SEQ ID NO: 484377 - RNA, 24 nt, Human
uacaaagaaaaacaggcagacaau

SEQ ID NO: 484378 - RNA, 23 nt, Human
uagaaguuagggugaggaggagg

SEQ ID NO: 484379 - RNA, 19 nt, Human
uagagacagccacagcugc

SEQ ID NO: 484380 - RNA, 22 nt, Human
uagccauuuucucaucuaaaac

SEQ ID NO: 484381 - RNA, 22 nt, Human
uaggcaaggcagaggccagugg

SEQ ID NO: 484382 - RNA, 21 nt, Human
uaggguaguggcucucaaacc

SEQ ID NO: 484383 - RNA, 23 nt, Human
uauagccauuuucucaucuaaaa

SEQ ID NO: 484384 - RNA, 18 nt, Human
uaucacucuucccuuugg

SEQ ID NO: 484385 - RNA, 19 nt, Human
uaucacucuucccuuuggu

SEQ ID NO: 484386 - RNA, 25 nt, Human
uaucagcagaggaccaaaaaaaggg

SEQ ID NO: 484387 - RNA, 24 nt, Human
ucaauuagaaaaagcaauacacca

SEQ ID NO: 484388 - RNA, 24 nt, Human
ucaguaacaacuuuuagaaaaaga

SEQ ID NO: 484389 - RNA, 23 nt, Human
uccacagucacgaugauagagac

SEQ ID NO: 484390 - RNA, 22 nt, Human
uccagauacagaccauuuaaaa

SEQ ID NO: 484391 - RNA, 23 nt, Human
ucccagaggcuccgaggcugcag

SEQ ID NO: 484392 - RNA, 23 nt, Human
ucuccgaggucggccccgcggac

SEQ ID NO: 484393 - RNA, 20 nt, Human
ugaaaaccccgggccguggc

SEQ ID NO: 484394 - RNA, 20 nt, Human
ugaauggccauaccuaauuc

SEQ ID NO: 484395 - RNA, 22 nt, Human
ugaauugucuuuuuguuuuugu

SEQ ID NO: 484396 - RNA, 27 nt, Human
ugacaagaaaacauuugcagaagaaaa

SEQ ID NO: 484397 - RNA, 24 nt, Human
ugacagugucuuuggaaauagccc

SEQ ID NO: 484398 - RNA, 20 nt, Human
ugacauccucuugcaucuug

SEQ ID NO: 484399 - RNA, 22 nt, Human
ugaguggggagaagcagcagca

SEQ ID NO: 484400 - RNA, 21 nt, Human
ugauaaagaaaaacagauaug

SEQ ID NO: 484401 - RNA, 18 nt, Human
ugauguccagaacccaga

SEQ ID NO: 484402 - RNA, 22 nt, Human
ugcaucuuguuaccuaccaaug

SEQ ID NO: 484403 - RNA, 19 nt, Human
ugcucugucuccccugucc

SEQ ID NO: 484404 - RNA, 27 nt, Human
ugcucugucuccccuguccagucucua

SEQ ID NO: 484405 - RNA, 18 nt, Human
ugcuggacagcucugagg

SEQ ID NO: 484406 - RNA, 27 nt, Human
uggaaaacaguuuucaugacaagaaaa

SEQ ID NO: 484407 - RNA, 18 nt, Human
uggaaauagccccauaga

SEQ ID NO: 484408 - RNA, 20 nt, Human
uggaauucccauaauuaaca

SEQ ID NO: 484409 - RNA, 20 nt, Human
uggacugcguuuugcacauc

SEQ ID NO: 484410 - RNA, 22 nt, Human
uggcugcuggacagcucugagg

SEQ ID NO: 484411 - RNA, 23 nt, Human
ugguaguguuuccaggcuucaac

SEQ ID NO: 484412 - RNA, 24 nt, Human
uggugacuccaagauaaagccaag

SEQ ID NO: 484413 - RNA, 19 nt, Human
ugucuccccuguccagucu

SEQ ID NO: 484414 - RNA, 21 nt, Human
ugucuuuggaaauagccccau

SEQ ID NO: 484415 - RNA, 25 nt, Human
uguuccauuuaucuccuuccucuuu

SEQ ID NO: 484416 - RNA, 21 nt, Human
uguuuaaaaaauuuuguccca

SEQ ID NO: 484417 - RNA, 26 nt, Human
uuaaaaacagucaauuagaaaaagca

SEQ ID NO: 484418 - RNA, 21 nt, Human
uuaacacagaucaaacugcag

SEQ ID NO: 484419 - RNA, 24 nt, Human
uuaaccaucacacaggagaauaaa

SEQ ID NO: 484420 - RNA, 23 nt, Human
uuaagcuauuuuuuuaauaaauu

SEQ ID NO: 484421 - RNA, 23 nt, Human
uuaauaaccucauucaauguaau

SEQ ID NO: 484422 - RNA, 18 nt, Human
uuacuggagcaggacagc

SEQ ID NO: 484423 - RNA, 24 nt, Human
uuagaaaaagcaauacaccaaaaa

SEQ ID NO: 484424 - RNA, 22 nt, Human
uucagccaggcgcccugagacc

SEQ ID NO: 484425 - RNA, 19 nt, Human
uucagccaggugacagcac

SEQ ID NO: 484426 - RNA, 25 nt, Human
uucaugacaagaaaacauuugcaga

SEQ ID NO: 484427 - RNA, 23 nt, Human
uuuccaggcuucaacuguguugu

SEQ ID NO: 484428 - RNA, 27 nt, Human
uuucugguuuucauggacugcguuuug

SEQ ID NO: 484429 - RNA, 18 nt, Human
uuugaaucuccucuggug

SEQ ID NO: 484430 - RNA, 21 nt, Human
uuuuuguuuuugugugaaacu

SEQ ID NO: 484431 - RNA, 22 nt, Human
uuuuuuuuuuuuuuuuuuucag

SEQ ID NO: 484432 - RNA, 22 nt, Human
aaaaaacuuaaagacaggagaa

SEQ ID NO: 484433 - RNA, 24 nt, Human
aaaagaaaaaacuuaaagacagga

SEQ ID NO: 484434 - RNA, 19 nt, Human
aaacuguagccauuaagca

SEQ ID NO: 484435 - RNA, 20 nt, Human
aagacaggagaauaugaaaa

SEQ ID NO: 484436 - RNA, 20 nt, Human
aagagaccaaggcuacaguu

SEQ ID NO: 484437 - RNA, 21 nt, Human
aagcagguuaaacuuguuuua

SEQ ID NO: 484438 - RNA, 21 nt, Human
agaaaagaaaaaacuuaaaga

SEQ ID NO: 484439 - RNA, 22 nt, Human
agaaaagaaaaaacuuaaagac

SEQ ID NO: 484440 - RNA, 20 nt, Human
agagaccaaggcuacaguuu

SEQ ID NO: 484441 - RNA, 23 nt, Human
auaaagcaaggacauuauagucc

SEQ ID NO: 484442 - RNA, 19 nt, Human
augguuaagagaccaaggc

SEQ ID NO: 484443 - RNA, 23 nt, Human
caagauggcagugcugcaagccc

SEQ ID NO: 484444 - RNA, 18 nt, Human
caccccaagccuguacau

SEQ ID NO: 484445 - RNA, 21 nt, Human
cauagaaugaaugcuaugaga

SEQ ID NO: 484446 - RNA, 21 nt, Human
ccauugagaaccccuggcuau

SEQ ID NO: 484447 - RNA, 24 nt, Human
cuuccagggcuuacuagaagucua

SEQ ID NO: 484448 - RNA, 23 nt, Human
cuuguucaguaucuggcuagcua

SEQ ID NO: 484449 - RNA, 21 nt, Human
ggagccaccccaagccuguac

SEQ ID NO: 484450 - RNA, 25 nt, Human
uaagagaccaaggcuacaguuuuca

SEQ ID NO: 484451 - RNA, 23 nt, Human
uaguaaguucaaugagaaaagaa

SEQ ID NO: 484452 - RNA, 20 nt, Human
ucacuggacgaggcuuccug

SEQ ID NO: 484453 - RNA, 24 nt, Human
ucucuaaaaauaugccuacuacuu

SEQ ID NO: 484454 - RNA, 21 nt, Human
ugagaaaagaaaaaacuuaaa

SEQ ID NO: 484455 - RNA, 24 nt, Human
ugggaaggccucagaaucauggcg

SEQ ID NO: 484456 - RNA, 25 nt, Human
uuaaagacaggagaauaugaaaaua

SEQ ID NO: 484457 - RNA, 19 nt, Human
uucacauguaaaaacugua

SEQ ID NO: 484458 - RNA, 21 nt, Human
uucacauguaaaaacuguagc

SEQ ID NO: 484459 - RNA, 19 nt, Human
uuccauagaaugaaugcua

SEQ ID NO: 484460 - RNA, 24 nt, Human
uugaaaauuaacagcaauaucuaa

SEQ ID NO: 484461 - RNA, 24 nt, Human
uuuaccucuaacaaaacuuaugua

SEQ ID NO: 484462 - RNA, 23 nt, Human
uuuccauugagaaccccuggcua

SEQ ID NO: 484463 - RNA, 20 nt, Human
aaacccaauuagaacgacag

SEQ ID NO: 484464 - RNA, 24 nt, Human
aaauuggaggaggcauuuugaaga

SEQ ID NO: 484465 - RNA, 21 nt, Human
aaccaggccucuagguucuuc

SEQ ID NO: 484466 - RNA, 26 nt, Human
aagaaagcaaaccaccacaaaccaaa

SEQ ID NO: 484467 - RNA, 23 nt, Human
aagcaaaccaccacaaaccaaac

SEQ ID NO: 484468 - RNA, 22 nt, Human
aagcaagccugaaccaccaagu

SEQ ID NO: 484469 - RNA, 18 nt, Human
aagcagaaaauaaagaga

SEQ ID NO: 484470 - RNA, 23 nt, Human
acagccugacccccucccacccc

SEQ ID NO: 484471 - RNA, 23 nt, Human
acaugcaggagugcacacaugug

SEQ ID NO: 484472 - RNA, 23 nt, Human
acucacauauauauauacauaua

SEQ ID NO: 484473 - RNA, 19 nt, Human
agacaggagagaagagggg

SEQ ID NO: 484474 - RNA, 22 nt, Human
agagagugguaagaaaggaaca

SEQ ID NO: 484475 - RNA, 23 nt, Human
agagagugguaagaaaggaacaa

SEQ ID NO: 484476 - RNA, 19 nt, Human
agcuagcauucuuacaaaa

SEQ ID NO: 484477 - RNA, 20 nt, Human
agcugcagcuggggcuacgg

SEQ ID NO: 484478 - RNA, 21 nt, Human
aggcaguggccauggcugccu

SEQ ID NO: 484479 - RNA, 23 nt, Human
aggccucuagguucuucucuccc

SEQ ID NO: 484480 - RNA, 25 nt, Human
aggcgccggagcucgguggacagcc

SEQ ID NO: 484481 - RNA, 20 nt, Human
aggcucuuucauugaaccgg

SEQ ID NO: 484482 - RNA, 19 nt, Human
agguucuucucucccugcc

SEQ ID NO: 484483 - RNA, 27 nt, Human
auauauacacauaugugugugugugug

SEQ ID NO: 484484 - RNA, 21 nt, Human
auaugugugugugugugugug

SEQ ID NO: 484485 - RNA, 19 nt, Human
augguaaagaaagcaaacc

SEQ ID NO: 484486 - RNA, 22 nt, Human
augguaaagaaagcaaaccacc

SEQ ID NO: 484487 - RNA, 33 nt, Human
augugugcguguguguauauauauauaugugau

SEQ ID NO: 484488 - RNA, 21 nt, Human
augugugugugugugugugug

SEQ ID NO: 484489 - RNA, 22 nt, Human
augugugugugugugugugugu

SEQ ID NO: 484490 - RNA, 23 nt, Human
auguguguguguguguguguguu

SEQ ID NO: 484491 - RNA, 21 nt, Human
caaaccaaaccucucuuacuc

SEQ ID NO: 484492 - RNA, 22 nt, Human
caaagcaagccugaaccaccaa

SEQ ID NO: 484493 - RNA, 27 nt, Human
caacaagaaaaaagaguaguaggaacc

SEQ ID NO: 484494 - RNA, 27 nt, Human
caagcagaaaauaaagagaagggaccc

SEQ ID NO: 484495 - RNA, 22 nt, Human
cacagccugacccccucccacc

SEQ ID NO: 484496 - RNA, 23 nt, Human
cacagccugacccccucccaccc

SEQ ID NO: 484497 - RNA, 23 nt, Human
cacagccugacccccucccaccc

SEQ ID NO: 484498 - RNA, 24 nt, Human
cacauauauauauacauauauaca

SEQ ID NO: 484499 - RNA, 22 nt, Human
cacauaugugugugugugugua

SEQ ID NO: 484500 - RNA, 22 nt, Human
cacccccgcuuggagaggcacu

SEQ ID NO: 484501 - RNA, 24 nt, Human
cauauauauauacauauauacaca

SEQ ID NO: 484502 - RNA, 25 nt, Human
cauauguguguguguguguauauaa

SEQ ID NO: 484503 - RNA, 20 nt, Human
cauucuuacaaaauuggagg

SEQ ID NO: 484504 - RNA, 19 nt, Human
ccaacgugucggccccagg

SEQ ID NO: 484505 - RNA, 18 nt, Human
ccaauuagaacgacaggc

SEQ ID NO: 484506 - RNA, 19 nt, Human
ccaccgaaaccguggcggg

SEQ ID NO: 484507 - RNA, 23 nt, Human
ccagccgcggcuucuucucgcug

SEQ ID NO: 484508 - RNA, 20 nt, Human
ccaggagagagugguaagaa

SEQ ID NO: 484509 - RNA, 24 nt, Human
cccgccucuuccuucucuuccccc

SEQ ID NO: 484510 - RNA, 19 nt, Human
ccgagugagcggucccucc

SEQ ID NO: 484511 - RNA, 19 nt, Human
ccgccucuuccuucucuuc

SEQ ID NO: 484512 - RNA, 19 nt, Human
ccuucucuuccccccuccu

SEQ ID NO: 484513 - RNA, 21 nt, Human
cucacauauauauauacauau

SEQ ID NO: 484514 - RNA, 22 nt, Human
cuccaucccgugcccagacgcu

SEQ ID NO: 484515 - RNA, 23 nt, Human
cucccaaucgaaucccaaauucg

SEQ ID NO: 484516 - RNA, 19 nt, Human
cucccugcccuggguucua

SEQ ID NO: 484517 - RNA, 18 nt, Human
cucgcugucucucuccuc

SEQ ID NO: 484518 - RNA, 20 nt, Human
cucugcacagccugaccccc

SEQ ID NO: 484519 - RNA, 21 nt, Human
cucugcacagccugacccccu

SEQ ID NO: 484520 - RNA, 20 nt, Human
cuggaucaagggaauugaug

SEQ ID NO: 484521 - RNA, 21 nt, Human
cuuucacuccaucccgugccc

SEQ ID NO: 484522 - RNA, 19 nt, Human
gaaaagacauggcaagcag

SEQ ID NO: 484523 - RNA, 18 nt, Human
gacucgccuuccucgccc

SEQ ID NO: 484524 - RNA, 18 nt, Human
gagaggaaggcaguggcc

SEQ ID NO: 484525 - RNA, 22 nt, Human
gauaauugaacaacaagaaaaa

SEQ ID NO: 484526 - RNA, 24 nt, Human
gaugcaaguauguuccagaaaaga

SEQ ID NO: 484527 - RNA, 21 nt, Human
gcaagcagaaaauaaagagaa

SEQ ID NO: 484528 - RNA, 19 nt, Human
gcagcuggggcuacggucc

SEQ ID NO: 484529 - RNA, 25 nt, Human
gcccgccucuuccuucucuuccccc

SEQ ID NO: 484530 - RNA, 23 nt, Human
gccugacccccucccacccccgc

SEQ ID NO: 484531 - RNA, 20 nt, Human
ggaggaggcauuuugaagau

SEQ ID NO: 484532 - RNA, 23 nt, Human
gguggaugcaaguauguuccaga

SEQ ID NO: 484533 - RNA, 22 nt, Human
guaaagaaagcaaaccaccaca

SEQ ID NO: 484534 - RNA, 22 nt, Human
guauauauauauaugugugugu

SEQ ID NO: 484535 - RNA, 21 nt, Human
gucccaacgugucggccccag

SEQ ID NO: 484536 - RNA, 18 nt, Human
gucucuuccuugucuuga

SEQ ID NO: 484537 - RNA, 21 nt, Human
gugugugugugugugugugug

SEQ ID NO: 484538 - RNA, 23 nt, Human
uaaacuuuuauuucaauuucuuu

SEQ ID NO: 484539 - RNA, 23 nt, Human
uaaagaaagcaaaccaccacaaa

SEQ ID NO: 484540 - RNA, 26 nt, Human
uaaagaaagcaaaccaccacaaacca

SEQ ID NO: 484541 - RNA, 22 nt, Human
uaaucccaggaauaccuagcua

SEQ ID NO: 484542 - RNA, 25 nt, Human
uacaaaauuggaggaggcauuuuga

SEQ ID NO: 484543 - RNA, 19 nt, Human
uacacauaugugugugugu

SEQ ID NO: 484544 - RNA, 19 nt, Human
uacagaacugaacaugcag

SEQ ID NO: 484545 - RNA, 24 nt, Human
uacauauauacacauaugugugug

SEQ ID NO: 484546 - RNA, 22 nt, Human
uagaaacuggaaguacagaacu

SEQ ID NO: 484547 - RNA, 22 nt, Human
uagguucaucagagaggaaggc

SEQ ID NO: 484548 - RNA, 22 nt, Human
uauacauauauacacauaugug

SEQ ID NO: 484549 - RNA, 22 nt, Human
uauacucacauauauauauaca

SEQ ID NO: 484550 - RNA, 22 nt, Human
uauacucacauauauauauaca

SEQ ID NO: 484551 - RNA, 23 nt, Human
uauacucacauauauauauacau

SEQ ID NO: 484552 - RNA, 22 nt, Human
uauauacacauaugugugugug

SEQ ID NO: 484553 - RNA, 24 nt, Human
uauauacacauaugugugugugug

SEQ ID NO: 484554 - RNA, 30 nt, Human
uauauacauauauacacauaugugugugug

SEQ ID NO: 484555 - RNA, 24 nt, Human
uauauacucacauauauauauaca

SEQ ID NO: 484556 - RNA, 23 nt, Human
uauauauacauauauacacauau

SEQ ID NO: 484557 - RNA, 22 nt, Human
uauauauacucacauauauaua

SEQ ID NO: 484558 - RNA, 20 nt, Human
uauauauauacauauauaca

SEQ ID NO: 484559 - RNA, 25 nt, Human
uauauauauacauauauacacauau

SEQ ID NO: 484560 - RNA, 28 nt, Human
uauauauauacauauauacacauaugug

SEQ ID NO: 484561 - RNA, 23 nt, Human
uauauauauaugugugugugugu

SEQ ID NO: 484562 - RNA, 19 nt, Human
uauauauaugugugugugu

SEQ ID NO: 484563 - RNA, 19 nt, Human
uauauauaugugugugugu

SEQ ID NO: 484564 - RNA, 19 nt, Human
uauauauaugugugugugu

SEQ ID NO: 484565 - RNA, 20 nt, Human
uauaugugugcgugugugua

SEQ ID NO: 484566 - RNA, 24 nt, Human
uauaugugugcguguguguauaua

SEQ ID NO: 484567 - RNA, 31 nt, Human
uauaugugugcguguguguauauauauauua

SEQ ID NO: 484568 - RNA, 23 nt, Human
uauaugugugugugugugugugu

SEQ ID NO: 484569 - RNA, 18 nt, Human
uaugugugugugugugug

SEQ ID NO: 484570 - RNA, 23 nt, Human
uaugugugugugugugugugugu

SEQ ID NO: 484571 - RNA, 19 nt, Human
ucaaagcaagccugaacca

SEQ ID NO: 484572 - RNA, 19 nt, Human
ucaaagcaagccugaacca

SEQ ID NO: 484573 - RNA, 26 nt, Human
uccccgcaacagccgcuagcuggacu

SEQ ID NO: 484574 - RNA, 19 nt, Human
ucggagcugcagcuggggc

SEQ ID NO: 484575 - RNA, 23 nt, Human
ucucccugcccuggguucuaugg

SEQ ID NO: 484576 - RNA, 20 nt, Human
ucucuuacucuuuuuacaaa

SEQ ID NO: 484577 - RNA, 19 nt, Human
ucucuugggcuggaucaag

SEQ ID NO: 484578 - RNA, 22 nt, Human
ucuuccuucucuuccccccucc

SEQ ID NO: 484579 - RNA, 23 nt, Human
ucuuccuucucuuccccccuccu

SEQ ID NO: 484580 - RNA, 22 nt, Human
ucuugaauggcgaagucagucu

SEQ ID NO: 484581 - RNA, 21 nt, Human
ugaaaauacucagggucuaag

SEQ ID NO: 484582 - RNA, 23 nt, Human
ugaacagugcauuuuagaaacug

SEQ ID NO: 484583 - RNA, 19 nt, Human
ugaccaaaucaaaagacag

SEQ ID NO: 484584 - RNA, 19 nt, Human
ugacccccucccacccccg

SEQ ID NO: 484585 - RNA, 27 nt, Human
ugcagcaacauauaugugugcgugugu

SEQ ID NO: 484586 - RNA, 18 nt, Human
ugccaccaaagcaaacca

SEQ ID NO: 484587 - RNA, 21 nt, Human
ugccuaagagcucagguucaa

SEQ ID NO: 484588 - RNA, 20 nt, Human
ugccuggucucuugggcugg

SEQ ID NO: 484589 - RNA, 19 nt, Human
uggcugccuggucucuugg

SEQ ID NO: 484590 - RNA, 18 nt, Human
ugggcuggaucaagggaa

SEQ ID NO: 484591 - RNA, 18 nt, Human
ugguggaugcaaguaugu

SEQ ID NO: 484592 - RNA, 20 nt, Human
uguguauauauacucacaua

SEQ ID NO: 484593 - RNA, 20 nt, Human
uguguauauauacucacaua

SEQ ID NO: 484594 - RNA, 24 nt, Human
uguguauauauacucacauauaua

SEQ ID NO: 484595 - RNA, 22 nt, Human
uguguauauauauauaucucag

SEQ ID NO: 484596 - RNA, 24 nt, Human
uguguauauauauauaucucagua

SEQ ID NO: 484597 - RNA, 26 nt, Human
uguguauauauauauaucucaguaua

SEQ ID NO: 484598 - RNA, 19 nt, Human
uguguauauauauauaugu

SEQ ID NO: 484599 - RNA, 19 nt, Human
uguguauauauauauaugu

SEQ ID NO: 484600 - RNA, 23 nt, Human
uguguauauauauauaugugugu

SEQ ID NO: 484601 - RNA, 23 nt, Human
uguguauauauauauaugugugu

SEQ ID NO: 484602 - RNA, 20 nt, Human
ugugugcguguguguauaua

SEQ ID NO: 484603 - RNA, 20 nt, Human
ugugugcguguguguauaua

SEQ ID NO: 484604 - RNA, 18 nt, Human
uguguguauauauauaua

SEQ ID NO: 484605 - RNA, 21 nt, Human
uguguguauauauauauaugu

SEQ ID NO: 484606 - RNA, 24 nt, Human
uguguguauauauauauaugugug

SEQ ID NO: 484607 - RNA, 24 nt, Human
uguguguguauauauacucacaua

SEQ ID NO: 484608 - RNA, 18 nt, Human
uguguguguauauauaua

SEQ ID NO: 484609 - RNA, 23 nt, Human
uguguguguguauauauauauau

SEQ ID NO: 484610 - RNA, 23 nt, Human
uguguguguguguauauauauau

SEQ ID NO: 484611 - RNA, 18 nt, Human
uguguguguguguguaua

SEQ ID NO: 484612 - RNA, 20 nt, Human
uguguguguguguguauaua

SEQ ID NO: 484613 - RNA, 20 nt, Human
uguguguguguguguauaua

SEQ ID NO: 484614 - RNA, 18 nt, Human
ugugugugugugugugug

SEQ ID NO: 484615 - RNA, 18 nt, Human
ugugugugugugugugug

SEQ ID NO: 484616 - RNA, 18 nt, Human
ugugugugugugugugug

SEQ ID NO: 484617 - RNA, 22 nt, Human
uguguguguguguguguguaua

SEQ ID NO: 484618 - RNA, 24 nt, Human
uguguguguguguguguguauaua

SEQ ID NO: 484619 - RNA, 22 nt, Human
ugugugugugugugugugugua

SEQ ID NO: 484620 - RNA, 28 nt, Human
uucgcaguagccagccgcggcuucuucu

SEQ ID NO: 484621 - RNA, 22 nt, Human
uucucgcugucucucuccucug

SEQ ID NO: 484622 - RNA, 20 nt, Human
uucuucggagcugcagcugg

SEQ ID NO: 484623 - RNA, 24 nt, Human
aaacaagcagcuaaaagaagggaa

SEQ ID NO: 484624 - RNA, 22 nt, Human
aaacagcaccaaagagguuucc

SEQ ID NO: 484625 - RNA, 23 nt, Human
aaagcgcguaugccgcgcaccag

SEQ ID NO: 484626 - RNA, 21 nt, Human
aacagcuguaggcacaacuuc

SEQ ID NO: 484627 - RNA, 20 nt, Human
aacuccugacccauuuccuc

SEQ ID NO: 484628 - RNA, 25 nt, Human
aagaaaaaaaaaaaaaaaaccucau

SEQ ID NO: 484629 - RNA, 22 nt, Human
aagaagauccaggaggcaacug

SEQ ID NO: 484630 - RNA, 21 nt, Human
aagcaaagaugggucccaaag

SEQ ID NO: 484631 - RNA, 19 nt, Human
aagggaaugguaggaaacc

SEQ ID NO: 484632 - RNA, 21 nt, Human
aagucacaaaaaugccacgga

SEQ ID NO: 484633 - RNA, 20 nt, Human
acagaaaacaaccagugcca

SEQ ID NO: 484634 - RNA, 21 nt, Human
acagcucucaccccucccucu

SEQ ID NO: 484635 - RNA, 19 nt, Human
acaguacuguccagcuucu

SEQ ID NO: 484636 - RNA, 20 nt, Human
accacaaccagcuccucaga

SEQ ID NO: 484637 - RNA, 25 nt, Human
accagucacccaaacuugaccccag

SEQ ID NO: 484638 - RNA, 22 nt, Human
accauagcgguggggaucaugc

SEQ ID NO: 484639 - RNA, 19 nt, Human
accucacaccuucccuuug

SEQ ID NO: 484640 - RNA, 21 nt, Human
accucauucucaguucuccaa

SEQ ID NO: 484641 - RNA, 18 nt, Human
agaauaaccaacaggaga

SEQ ID NO: 484642 - RNA, 20 nt, Human
agacucagaauaaccaacag

SEQ ID NO: 484643 - RNA, 24 nt, Human
agacucagaauaaccaacaggaga

SEQ ID NO: 484644 - RNA, 18 nt, Human
agaggauuggaagagggc

SEQ ID NO: 484645 - RNA, 19 nt, Human
agggagaguggccuuuuag

SEQ ID NO: 484646 - RNA, 22 nt, Human
agggccaguucaaaacugaacc

SEQ ID NO: 484647 - RNA, 27 nt, Human
aguacuguccagcuucuacccaaagau

SEQ ID NO: 484648 - RNA, 24 nt, Human
auuacuaauauaaaaaaaguuaaa

SEQ ID NO: 484649 - RNA, 20 nt, Human
caacuccugacccauuuccu

SEQ ID NO: 484650 - RNA, 18 nt, Human
cacaacuucgugcccuuu

SEQ ID NO: 484651 - RNA, 18 nt, Human
cacagagagcuccuucca

SEQ ID NO: 484652 - RNA, 19 nt, Human
caccaagcgccucacucau

SEQ ID NO: 484653 - RNA, 23 nt, Human
caccagucacccaaacuugaccc

SEQ ID NO: 484654 - RNA, 18 nt, Human
caccccucccucuugcca

SEQ ID NO: 484655 - RNA, 19 nt, Human
cagagggccugagaagagg

SEQ ID NO: 484656 - RNA, 23 nt, Human
caggaggcaacugaaaggaagca

SEQ ID NO: 484657 - RNA, 20 nt, Human
ccaaaaguccuugucccgcu

SEQ ID NO: 484658 - RNA, 23 nt, Human
ccaaaaguccuugucccgcuugg

SEQ ID NO: 484659 - RNA, 24 nt, Human
ccagugaugcaacaccacucugga

SEQ ID NO: 484660 - RNA, 26 nt, Human
cccaaacuugaccccagguuagacaa

SEQ ID NO: 484661 - RNA, 21 nt, Human
ccgcuaggucacagagagcuc

SEQ ID NO: 484662 - RNA, 21 nt, Human
ccucagggccaguucaaaacu

SEQ ID NO: 484663 - RNA, 18 nt, Human
ccuguucagcagucauuu

SEQ ID NO: 484664 - RNA, 28 nt, Human
cgccucacucauuuuggcaggaaaacuu

SEQ ID NO: 484665 - RNA, 22 nt, Human
cucacaccuucccuuugcugcg

SEQ ID NO: 484666 - RNA, 22 nt, Human
cuccaacagcucucaccccucc

SEQ ID NO: 484667 - RNA, 19 nt, Human
cuccccccaaaaguccuug

SEQ ID NO: 484668 - RNA, 19 nt, Human
gagaagaauggggagggcc

SEQ ID NO: 484669 - RNA, 19 nt, Human
gaggacugucgcaccgcca

SEQ ID NO: 484670 - RNA, 18 nt, Human
gagggcaauacuggggaa

SEQ ID NO: 484671 - RNA, 21 nt, Human
gagggcaauacuggggaacag

SEQ ID NO: 484672 - RNA, 22 nt, Human
gccaauacaacuccugacccau

SEQ ID NO: 484673 - RNA, 19 nt, Human
ggaagaggauuggaagagg

SEQ ID NO: 484674 - RNA, 21 nt, Human
ggaagaggauuggaagagggc

SEQ ID NO: 484675 - RNA, 21 nt, Human
ggggaagaggauuggaagagg

SEQ ID NO: 484676 - RNA, 23 nt, Human
ggggaagaggauuggaagagggc

SEQ ID NO: 484677 - RNA, 19 nt, Human
ggggagggccagggaggca

SEQ ID NO: 484678 - RNA, 22 nt, Human
gggugugucacugacugagggu

SEQ ID NO: 484679 - RNA, 19 nt, Human
uaaaacaagcagcuaaaag

SEQ ID NO: 484680 - RNA, 20 nt, Human
uacugacagagaaacuauga

SEQ ID NO: 484681 - RNA, 21 nt, Human
uaugguaacagcuguaggcac

SEQ ID NO: 484682 - RNA, 20 nt, Human
uauuacuaauauaaaaaaag

SEQ ID NO: 484683 - RNA, 23 nt, Human
ucaaaacugaaccuguucacugc

SEQ ID NO: 484684 - RNA, 21 nt, Human
ucacaccuucccuuugcugcg

SEQ ID NO: 484685 - RNA, 25 nt, Human
ucacccaaacuugaccccagguuag

SEQ ID NO: 484686 - RNA, 19 nt, Human
ucaguucuccaacagcucu

SEQ ID NO: 484687 - RNA, 23 nt, Human
uccaggaggcaacugaaaggaag

SEQ ID NO: 484688 - RNA, 21 nt, Human
ucgcuggaaaacaccacaacc

SEQ ID NO: 484689 - RNA, 21 nt, Human
ugaccccagguuagacaaccu

SEQ ID NO: 484690 - RNA, 22 nt, Human
ugagaaaggcuacaaggggaug

SEQ ID NO: 484691 - RNA, 24 nt, Human
ugaugcaacaccacucuggacccc

SEQ ID NO: 484692 - RNA, 19 nt, Human
ugcaacaccacucuggacc

SEQ ID NO: 484693 - RNA, 21 nt, Human
ugcacaagaaacagcaccaaa

SEQ ID NO: 484694 - RNA, 23 nt, Human
uggaaaacaccacaaccagcucc

SEQ ID NO: 484695 - RNA, 21 nt, Human
uggggagggccagggaggcag

SEQ ID NO: 484696 - RNA, 21 nt, Human
uggggagggccagggaggcag

SEQ ID NO: 484697 - RNA, 20 nt, Human
ugucacagagucaacaggcu

SEQ ID NO: 484698 - RNA, 18 nt, Human
uguugggaagugggaaag

SEQ ID NO: 484699 - RNA, 19 nt, Human
uuaaaaagaaaaaaaaaaa

SEQ ID NO: 484700 - RNA, 22 nt, Human
uuaaaaagaaaaaaaaaaaaaa

SEQ ID NO: 484701 - RNA, 26 nt, Human
uuacucuuuucuucccucgcuggaaa

SEQ ID NO: 484702 - RNA, 24 nt, Human
uuucuauaaaugcuuugaaaaaau

SEQ ID NO: 484703 - RNA, 22 nt, Human
aagcagcagcacaaagggcucc

SEQ ID NO: 484704 - RNA, 20 nt, Human
agaagcagcagcacaaaggg

SEQ ID NO: 484705 - RNA, 21 nt, Human
agagggcaaacaggcucugag

SEQ ID NO: 484706 - RNA, 18 nt, Human
agccauagagaugaaacc

SEQ ID NO: 484707 - RNA, 21 nt, Human
aggaagaaaagggagugcaca

SEQ ID NO: 484708 - RNA, 23 nt, Human
aggaagaaaagggagugcacaga

SEQ ID NO: 484709 - RNA, 21 nt, Human
agugcacagagccaugaagca

SEQ ID NO: 484710 - RNA, 23 nt, Human
caaacaggcucugagccaggccu

SEQ ID NO: 484711 - RNA, 19 nt, Human
cacuaagcacagggucaca

SEQ ID NO: 484712 - RNA, 18 nt, Human
cacugagcaugcugccuu

SEQ ID NO: 484713 - RNA, 18 nt, Human
cacuggagucaucuuagg

SEQ ID NO: 484714 - RNA, 20 nt, Human
cagaacacggggacggggaa

SEQ ID NO: 484715 - RNA, 27 nt, Human
cagaaucagagcccagcagggucgucc

SEQ ID NO: 484716 - RNA, 19 nt, Human
cagagcccagcagaacacg

SEQ ID NO: 484717 - RNA, 22 nt, Human
cagcagcacaaagggcucugcc

SEQ ID NO: 484718 - RNA, 23 nt, Human
cagcagcacaaagggcucugccg

SEQ ID NO: 484719 - RNA, 21 nt, Human
cagcagccucucggucaaagc

SEQ ID NO: 484720 - RNA, 18 nt, Human
caggcucugagccaggcc

SEQ ID NO: 484721 - RNA, 19 nt, Human
caggcucugagccaggccu

SEQ ID NO: 484722 - RNA, 19 nt, Human
cccaggguuggcaggugug

SEQ ID NO: 484723 - RNA, 19 nt, Human
ccucagcuuuagaggccca

SEQ ID NO: 484724 - RNA, 19 nt, Human
ccucugacagccauagaga

SEQ ID NO: 484725 - RNA, 20 nt, Human
ccugccagauaucuucccua

SEQ ID NO: 484726 - RNA, 18 nt, Human
cucugccgagacucugcg

SEQ ID NO: 484727 - RNA, 20 nt, Human
cuggagaggaaauggcacuu

SEQ ID NO: 484728 - RNA, 20 nt, Human
cuuuggggauguuuauugca

SEQ ID NO: 484729 - RNA, 22 nt, Human
gaagaaaagggagugcacagag

SEQ ID NO: 484730 - RNA, 18 nt, Human
gagcuccagcagccucuc

SEQ ID NO: 484731 - RNA, 20 nt, Human
gagggaagucaaggaauguu

SEQ ID NO: 484732 - RNA, 18 nt, Human
gcagguguguggaugguu

SEQ ID NO: 484733 - RNA, 23 nt, Human
ggaagaaaagggagugcacagag

SEQ ID NO: 484734 - RNA, 19 nt, Human
ggcagguguguggaugguu

SEQ ID NO: 484735 - RNA, 22 nt, Human
ggggauacucauugggcagaau

SEQ ID NO: 484736 - RNA, 18 nt, Human
ggguacuggggguggagg

SEQ ID NO: 484737 - RNA, 21 nt, Human
ucagagcccagcagaacacgg

SEQ ID NO: 484738 - RNA, 19 nt, Human
ucauugggcagaaucagag

SEQ ID NO: 484739 - RNA, 18 nt, Human
uccagaagcagcagcacu

SEQ ID NO: 484740 - RNA, 21 nt, Human
uccaggguacuggggguggag

SEQ ID NO: 484741 - RNA, 24 nt, Human
uccauagcaaaaacgauuugagaa

SEQ ID NO: 484742 - RNA, 24 nt, Human
uccauagcaaaaacgauuugagaa

SEQ ID NO: 484743 - RNA, 22 nt, Human
ucccacugagcaugcugccuuc

SEQ ID NO: 484744 - RNA, 24 nt, Human
ucccacugagcaugcugccuuccu

SEQ ID NO: 484745 - RNA, 20 nt, Human
ucccgggaggaagggagacu

SEQ ID NO: 484746 - RNA, 20 nt, Human
ucccugaauucuuuauccac

SEQ ID NO: 484747 - RNA, 21 nt, Human
ugcacagagccaugaagcaac

SEQ ID NO: 484748 - RNA, 21 nt, Human
ugccugccagauaucuucccu

SEQ ID NO: 484749 - RNA, 22 nt, Human
ugcuugaauggguggugcuguu

SEQ ID NO: 484750 - RNA, 19 nt, Human
uggggguggaggggucccc

SEQ ID NO: 484751 - RNA, 26 nt, Human
uguggaugguucccugaauuucaaag

SEQ ID NO: 484752 - RNA, 27 nt, Human
uguggaugguucccugaauuucaaagg

SEQ ID NO: 484753 - RNA, 29 nt, Human
uuuuuuuuuuuuuuuuuuuaacuuugggg

SEQ ID NO: 484754 - RNA, 22 nt, Human
aaaaggccagaaccugcacugc

SEQ ID NO: 484755 - RNA, 23 nt, Human
aaacaucccccagggccugaccc

SEQ ID NO: 484756 - RNA, 24 nt, Human
aaacccugcccuggcucucccagg

SEQ ID NO: 484757 - RNA, 19 nt, Human
aaacgguucuaucucagga

SEQ ID NO: 484758 - RNA, 24 nt, Human
aaagugcugggauuacaggcguga

SEQ ID NO: 484759 - RNA, 21 nt, Human
aacccugcccuggcucuccca

SEQ ID NO: 484760 - RNA, 23 nt, Human
aacucagccuccucaagggggca

SEQ ID NO: 484761 - RNA, 19 nt, Human
aaguagcuggggcuacagg

SEQ ID NO: 484762 - RNA, 19 nt, Human
aagugcugggauuacaggc

SEQ ID NO: 484763 - RNA, 19 nt, Human
aagugcugggauuacaggc

SEQ ID NO: 484764 - RNA, 18 nt, Human
acaggguuucaccauguu

SEQ ID NO: 484765 - RNA, 21 nt, Human
acaggguuucaccauguuggc

SEQ ID NO: 484766 - RNA, 24 nt, Human
acaggguuucaccauguuggccag

SEQ ID NO: 484767 - RNA, 26 nt, Human
acaucccccagggccugaccccacug

SEQ ID NO: 484768 - RNA, 18 nt, Human
accaagcccuggcgugca

SEQ ID NO: 484769 - RNA, 24 nt, Human
accauguuggccaggcuggucucg

SEQ ID NO: 484770 - RNA, 20 nt, Human
acugcaagcucugccucccg

SEQ ID NO: 484771 - RNA, 19 nt, Human
agacaagaggaaaacuuug

SEQ ID NO: 484772 - RNA, 19 nt, Human
agagcuggaggccaguggc

SEQ ID NO: 484773 - RNA, 18 nt, Human
agcugcccucgccccgcc

SEQ ID NO: 484774 - RNA, 18 nt, Human
aggaaaccccgaggccaa

SEQ ID NO: 484775 - RNA, 18 nt, Human
aggcccggccaaugaccu

SEQ ID NO: 484776 - RNA, 23 nt, Human
aggcgugagucacugcgcccggc

SEQ ID NO: 484777 - RNA, 22 nt, Human
aggcugcccaccauuggaaaca

SEQ ID NO: 484778 - RNA, 25 nt, Human
aggcuggagugcaguggcgccaucu

SEQ ID NO: 484779 - RNA, 18 nt, Human
agggagcggcugagucag

SEQ ID NO: 484780 - RNA, 21 nt, Human
agggcugcagcaccccccaca

SEQ ID NO: 484781 - RNA, 22 nt, Human
aguagagacaggguuucaccau

SEQ ID NO: 484782 - RNA, 21 nt, Human
agugcaguggcgccaucucag

SEQ ID NO: 484783 - RNA, 23 nt, Human
auccccgccucugcggacucccg

SEQ ID NO: 484784 - RNA, 25 nt, Human
caaaagacaaggcauggcugacucu

SEQ ID NO: 484785 - RNA, 24 nt, Human
caaagugcugggauuacaggcgug

SEQ ID NO: 484786 - RNA, 25 nt, Human
caacacagucccucauugaaccaaa

SEQ ID NO: 484787 - RNA, 21 nt, Human
caccauguuggccaggcuggu

SEQ ID NO: 484788 - RNA, 24 nt, Human
caccauguuggccaggcuggucuc

SEQ ID NO: 484789 - RNA, 27 nt, Human
caccauguuggccaggcuggucucgaa

SEQ ID NO: 484790 - RNA, 23 nt, Human
cacccagcucccuccagggccag

SEQ ID NO: 484791 - RNA, 23 nt, Human
cacugcaagcucugccucccggg

SEQ ID NO: 484792 - RNA, 21 nt, Human
cagcaccccccacaccugcug

SEQ ID NO: 484793 - RNA, 19 nt, Human
cagcccaagggagcggcug

SEQ ID NO: 484794 - RNA, 24 nt, Human
caggcagggaagcaccaagcccug

SEQ ID NO: 484795 - RNA, 21 nt, Human
caggcgcccgccaccacgccc

SEQ ID NO: 484796 - RNA, 24 nt, Human
caggguuucaccauguuggccagg

SEQ ID NO: 484797 - RNA, 23 nt, Human
cagguuacagcuggagaagaggg

SEQ ID NO: 484798 - RNA, 18 nt, Human
caugaaguccaccacggg

SEQ ID NO: 484799 - RNA, 24 nt, Human
cauguuggccaggcuggucucgaa

SEQ ID NO: 484800 - RNA, 20 nt, Human
ccaaagugcugggauuacag

SEQ ID NO: 484801 - RNA, 22 nt, Human
ccaaagugcugggauuacaggc

SEQ ID NO: 484802 - RNA, 22 nt, Human
ccaaagugcugggauuacaggc

SEQ ID NO: 484803 - RNA, 24 nt, Human
ccaaagugcugggauuacaggcgu

SEQ ID NO: 484804 - RNA, 19 nt, Human
ccagggccaggcagggaag

SEQ ID NO: 484805 - RNA, 19 nt, Human
ccaguggcccggccggggc

SEQ ID NO: 484806 - RNA, 19 nt, Human
ccagugucggcugggaggc

SEQ ID NO: 484807 - RNA, 22 nt, Human
ccagugucggcugggaggccug

SEQ ID NO: 484808 - RNA, 23 nt, Human
ccauuggaaacaucccccagggc

SEQ ID NO: 484809 - RNA, 23 nt, Human
cccaaguagcuggggcuacaggc

SEQ ID NO: 484810 - RNA, 19 nt, Human
cccagccccggcccucggc

SEQ ID NO: 484811 - RNA, 22 nt, Human
cccagccccggcccucggcccc

SEQ ID NO: 484812 - RNA, 22 nt, Human
cccaggcuggagugcaguggcg

SEQ ID NO: 484813 - RNA, 21 nt, Human
cccaguggcccggccggggcg

SEQ ID NO: 484814 - RNA, 20 nt, Human
ccccaccccgguggccccuc

SEQ ID NO: 484815 - RNA, 21 nt, Human
cccccagggccugaccccacu

SEQ ID NO: 484816 - RNA, 20 nt, Human
ccccgcccggcucggcuccc

SEQ ID NO: 484817 - RNA, 25 nt, Human
ccccugaagccaggccacccagcuc

SEQ ID NO: 484818 - RNA, 21 nt, Human
cccgccaccacgcccagcuaa

SEQ ID NO: 484819 - RNA, 23 nt, Human
cccgccucagccucccaaguagc

SEQ ID NO: 484820 - RNA, 18 nt, Human
ccgacccaggaaaccccg

SEQ ID NO: 484821 - RNA, 18 nt, Human
ccgccucugcggacuccc

SEQ ID NO: 484822 - RNA, 19 nt, Human
ccugaccucaagugauccg

SEQ ID NO: 484823 - RNA, 24 nt, Human
ccugaccucaagugauccgcccac

SEQ ID NO: 484824 - RNA, 18 nt, Human
ccuggccccacuauccac

SEQ ID NO: 484825 - RNA, 19 nt, Human
ccuggcuccugucuucccc

SEQ ID NO: 484826 - RNA, 21 nt, Human
ccuguggcccaguggcccggc

SEQ ID NO: 484827 - RNA, 24 nt, Human
cgccucagccucccaaguagcugg

SEQ ID NO: 484828 - RNA, 25 nt, Human
cgcucccagccccggcccucggccc

SEQ ID NO: 484829 - RNA, 20 nt, Human
cggcagccuugcaaaauguc

SEQ ID NO: 484830 - RNA, 22 nt, Human
cggcugagucagccuuagaggc

SEQ ID NO: 484831 - RNA, 21 nt, Human
cggggccugagccagagcccc

SEQ ID NO: 484832 - RNA, 24 nt, Human
cgggggucggggagggguccuuuc

SEQ ID NO: 484833 - RNA, 21 nt, Human
cuaggccucccaaagugcugg

SEQ ID NO: 484834 - RNA, 24 nt, Human
cucaaauaacucagccuccucaag

SEQ ID NO: 484835 - RNA, 24 nt, Human
cucaagugauccgcccaccuaggc

SEQ ID NO: 484836 - RNA, 24 nt, Human
cucacugcaagcucugccucccgg

SEQ ID NO: 484837 - RNA, 22 nt, Human
cucagccucccaaguagcuggg

SEQ ID NO: 484838 - RNA, 23 nt, Human
cucccagccccggcccucggccc

SEQ ID NO: 484839 - RNA, 22 nt, Human
cucccaggucugccagccacgc

SEQ ID NO: 484840 - RNA, 24 nt, Human
cucccgcucggacugcguggccgc

SEQ ID NO: 484841 - RNA, 20 nt, Human
cucugucgcccaggcuggag

SEQ ID NO: 484842 - RNA, 21 nt, Human
cugcacccacucaaacgccga

SEQ ID NO: 484843 - RNA, 19 nt, Human
cugcagcaccccccacacc

SEQ ID NO: 484844 - RNA, 21 nt, Human
cugcaucugacaaauccccgc

SEQ ID NO: 484845 - RNA, 20 nt, Human
cuggcgugcaccugcaccca

SEQ ID NO: 484846 - RNA, 22 nt, Human
cuguauuuuuuuaguagagaca

SEQ ID NO: 484847 - RNA, 22 nt, Human
gaccucaagugauccgcccacc

SEQ ID NO: 484848 - RNA, 19 nt, Human
gacugcguggccgcguggc

SEQ ID NO: 484849 - RNA, 18 nt, Human
gagccccuccuggcccag

SEQ ID NO: 484850 - RNA, 26 nt, Human
gagcuggaggccaguggcugcggggg

SEQ ID NO: 484851 - RNA, 23 nt, Human
gaggccuggaggggucuugccuc

SEQ ID NO: 484852 - RNA, 18 nt, Human
gauuacaggcgugaguca

SEQ ID NO: 484853 - RNA, 22 nt, Human
gauuacaggcgugagucacugc

SEQ ID NO: 484854 - RNA, 22 nt, Human
gauuacaggcgugagucacugc

SEQ ID NO: 484855 - RNA, 18 nt, Human
gcagcucagggcagcugg

SEQ ID NO: 484856 - RNA, 18 nt, Human
gcaugugcggcccgagag

SEQ ID NO: 484857 - RNA, 19 nt, Human
gcccaggcuggagugcagu

SEQ ID NO: 484858 - RNA, 20 nt, Human
gcccaggcuggagugcagug

SEQ ID NO: 484859 - RNA, 22 nt, Human
gccccgcccggcucggcucccg

SEQ ID NO: 484860 - RNA, 21 nt, Human
gccgggucugagacucccccg

SEQ ID NO: 484861 - RNA, 18 nt, Human
gccuaggcaggaaguccc

SEQ ID NO: 484862 - RNA, 19 nt, Human
gcgugcaccugcacccacu

SEQ ID NO: 484863 - RNA, 25 nt, Human
gcucugucgcccaggcuggagugca

SEQ ID NO: 484864 - RNA, 19 nt, Human
gcucuuagcaacacagucc

SEQ ID NO: 484865 - RNA, 22 nt, Human
gcugcagcaccccccacaccug

SEQ ID NO: 484866 - RNA, 20 nt, Human
gcuggagugcaguggcgcca

SEQ ID NO: 484867 - RNA, 18 nt, Human
gcugggaggccuggaggg

SEQ ID NO: 484868 - RNA, 20 nt, Human
gcugggaggccuggaggggu

SEQ ID NO: 484869 - RNA, 23 nt, Human
gcuggucucgaacuccugaccuc

SEQ ID NO: 484870 - RNA, 24 nt, Human
ggacucccgggcacagggccgcuc

SEQ ID NO: 484871 - RNA, 19 nt, Human
ggagaagaggggaaaggug

SEQ ID NO: 484872 - RNA, 18 nt, Human
ggagccccuccuggccca

SEQ ID NO: 484873 - RNA, 22 nt, Human
ggaggccaguggcugcgggggu

SEQ ID NO: 484874 - RNA, 20 nt, Human
ggccccuggccccacuaucc

SEQ ID NO: 484875 - RNA, 24 nt, Human
ggccccuggccccacuauccacag

SEQ ID NO: 484876 - RNA, 24 nt, Human
ggcuggucucgaacuccugaccuc

SEQ ID NO: 484877 - RNA, 21 nt, Human
gggcacagggccgcucccagc

SEQ ID NO: 484878 - RNA, 22 nt, Human
ggguuucaccauguuggccagg

SEQ ID NO: 484879 - RNA, 19 nt, Human
ggucucgaacuccugaccu

SEQ ID NO: 484880 - RNA, 23 nt, Human
ggucuugccucccuuguagucac

SEQ ID NO: 484881 - RNA, 23 nt, Human
guccuggcuccugucuuccccug

SEQ ID NO: 484882 - RNA, 19 nt, Human
gugcaccugcacccacuca

SEQ ID NO: 484883 - RNA, 26 nt, Human
uaauuuucuguauuuuuuuaguagag

SEQ ID NO: 484884 - RNA, 18 nt, Human
uacaagcagcucagggca

SEQ ID NO: 484885 - RNA, 24 nt, Human
uacaggcgcccgccaccacgccca

SEQ ID NO: 484886 - RNA, 19 nt, Human
uacaggcgugagucacugc

SEQ ID NO: 484887 - RNA, 22 nt, Human
uagagacaggguuucaccaugu

SEQ ID NO: 484888 - RNA, 20 nt, Human
uagaggccauucuguggccg

SEQ ID NO: 484889 - RNA, 24 nt, Human
uaguagagacaggguuucaccaug

SEQ ID NO: 484890 - RNA, 26 nt, Human
uaguagagacaggguuucaccauguu

SEQ ID NO: 484891 - RNA, 18 nt, Human
ucacugcaagcucugccu

SEQ ID NO: 484892 - RNA, 18 nt, Human
ucacugcaagcucugccu

SEQ ID NO: 484893 - RNA, 24 nt, Human
ucacugcaagcucugccucccggg

SEQ ID NO: 484894 - RNA, 26 nt, Human
ucagcacccaugaaguccaccacggg

SEQ ID NO: 484895 - RNA, 18 nt, Human
ucagccucccaaguagcu

SEQ ID NO: 484896 - RNA, 20 nt, Human
ucagccucccaaguagcugg

SEQ ID NO: 484897 - RNA, 23 nt, Human
ucagccucccaaguagcuggggc

SEQ ID NO: 484898 - RNA, 19 nt, Human
uccacaggccaggcccggc

SEQ ID NO: 484899 - RNA, 24 nt, Human
ucccaaagugcugggauuacaggc

SEQ ID NO: 484900 - RNA, 24 nt, Human
ucccaaguagcuggggcuacaggc

SEQ ID NO: 484901 - RNA, 22 nt, Human
ucccagccccggcccucggccc

SEQ ID NO: 484902 - RNA, 19 nt, Human
ucccccagggccugacccc

SEQ ID NO: 484903 - RNA, 18 nt, Human
uccccgacccaggaaacc

SEQ ID NO: 484904 - RNA, 19 nt, Human
uccccgacccaggaaaccc

SEQ ID NO: 484905 - RNA, 22 nt, Human
uccccgacccaggaaaccccga

SEQ ID NO: 484906 - RNA, 22 nt, Human
uccugcugccacagcccaaggg

SEQ ID NO: 484907 - RNA, 22 nt, Human
ucgcccaggcuggagugcagug

SEQ ID NO: 484908 - RNA, 26 nt, Human
ucucccgccucagccucccaaguagc

SEQ ID NO: 484909 - RNA, 21 nt, Human
ucucgaacuccugaccucaag

SEQ ID NO: 484910 - RNA, 22 nt, Human
ucugaguccguguggccagggc

SEQ ID NO: 484911 - RNA, 19 nt, Human
ucuggcucugucgcccagg

SEQ ID NO: 484912 - RNA, 23 nt, Human
ucuggcucugucgcccaggcugg

SEQ ID NO: 484913 - RNA, 24 nt, Human
ucuggcucugucgcccaggcugga

SEQ ID NO: 484914 - RNA, 24 nt, Human
ucugucgcccaggcuggagugcag

SEQ ID NO: 484915 - RNA, 22 nt, Human
ucuguggccgagagcuggaggc

SEQ ID NO: 484916 - RNA, 22 nt, Human
ucuugaacuacccggcagccuu

SEQ ID NO: 484917 - RNA, 21 nt, Human
ugaagccaggccacccagcuc

SEQ ID NO: 484918 - RNA, 24 nt, Human
ugaaguccaccacgggucucuggg

SEQ ID NO: 484919 - RNA, 18 nt, Human
ugaccucaagugauccgc

SEQ ID NO: 484920 - RNA, 25 nt, Human
ugagccagagcccccgccuccugcu

SEQ ID NO: 484921 - RNA, 24 nt, Human
ugauccgcccaccuaggccuccca

SEQ ID NO: 484922 - RNA, 19 nt, Human
ugcagcaccccccacaccu

SEQ ID NO: 484923 - RNA, 22 nt, Human
ugcaguggcgccaucucagcuc

SEQ ID NO: 484924 - RNA, 24 nt, Human
ugcccccaacgcucuuagcaacac

SEQ ID NO: 484925 - RNA, 21 nt, Human
ugcccucgccccgcccggcuc

SEQ ID NO: 484926 - RNA, 21 nt, Human
ugcccuggcucucccaggucu

SEQ ID NO: 484927 - RNA, 27 nt, Human
ugcccuggcucucccaggucugccagc

SEQ ID NO: 484928 - RNA, 21 nt, Human
ugccgggucugagacuccccc

SEQ ID NO: 484929 - RNA, 19 nt, Human
ugccucccggguucacgcc

SEQ ID NO: 484930 - RNA, 24 nt, Human
ugcgcccggccccagugacuauuc

SEQ ID NO: 484931 - RNA, 24 nt, Human
ugcugggauuacaggcgugaguca

SEQ ID NO: 484932 - RNA, 18 nt, Human
uggagugcaguggcgcca

SEQ ID NO: 484933 - RNA, 28 nt, Human
uggagugcaguggcgccauccuagcacg

SEQ ID NO: 484934 - RNA, 23 nt, Human
uggagugcaguggcgccaucuca

SEQ ID NO: 484935 - RNA, 28 nt, Human
uggagugcaguggcgccauggcucuagc

SEQ ID NO: 484936 - RNA, 24 nt, Human
uggccaggcuggucucgaacuccu

SEQ ID NO: 484937 - RNA, 21 nt, Human
uggcccaggacugaugggcag

SEQ ID NO: 484938 - RNA, 20 nt, Human
uggccgagagcuggaggcca

SEQ ID NO: 484939 - RNA, 22 nt, Human
uggccugggccggccccuggcc

SEQ ID NO: 484940 - RNA, 24 nt, Human
uggcgccaucucagcucacugcaa

SEQ ID NO: 484941 - RNA, 24 nt, Human
uggcucugucgcccaggcuggagu

SEQ ID NO: 484942 - RNA, 24 nt, Human
uggcugcgggggucggggaggggu

SEQ ID NO: 484943 - RNA, 18 nt, Human
ugggauuacaggcgugag

SEQ ID NO: 484944 - RNA, 18 nt, Human
ugggauuacaggcgugag

SEQ ID NO: 484945 - RNA, 21 nt, Human
ugggauuacaggcgugaguca

SEQ ID NO: 484946 - RNA, 22 nt, Human
ugggauuacaggcgugagucac

SEQ ID NO: 484947 - RNA, 22 nt, Human
ugggauuacaggcgugagucac

SEQ ID NO: 484948 - RNA, 24 nt, Human
ugggauuacaggcgugagucacug

SEQ ID NO: 484949 - RNA, 22 nt, Human
uggggcaauccuucucugaacg

SEQ ID NO: 484950 - RNA, 21 nt, Human
uggggcuacaggcgcccgcca

SEQ ID NO: 484951 - RNA, 22 nt, Human
uggggcuacaggcgcccgccac

SEQ ID NO: 484952 - RNA, 24 nt, Human
uggggcuacaggcgcccgccacca

SEQ ID NO: 484953 - RNA, 21 nt, Human
uggugcugcggcgugcaugug

SEQ ID NO: 484954 - RNA, 19 nt, Human
uggugggacccagugucgg

SEQ ID NO: 484955 - RNA, 21 nt, Human
ugucacacgggccacucagca

SEQ ID NO: 484956 - RNA, 20 nt, Human
uguggugggacccagugucg

SEQ ID NO: 484957 - RNA, 21 nt, Human
uguguguggugggacccagug

SEQ ID NO: 484958 - RNA, 19 nt, Human
uuaagacaagaggaaaacu

SEQ ID NO: 484959 - RNA, 24 nt, Human
uuaguagagacaggguuucaccau

SEQ ID NO: 484960 - RNA, 24 nt, Human
uucacgccauugccauucucccgc

SEQ ID NO: 484961 - RNA, 22 nt, Human
uucuguggccgagagcuggagg

SEQ ID NO: 484962 - RNA, 24 nt, Human
uuucaccauguuggccaggcuggu

SEQ ID NO: 484963 - RNA, 23 nt, Human
uuucuguauuuuuuuaguagaga

SEQ ID NO: 484964 - RNA, 22 nt, Human
uuugcagcagcccucaaauaac

SEQ ID NO: 484965 - RNA, 24 nt, Human
uuugcccccaacgcucuuagcaac

SEQ ID NO: 484966 - RNA, 24 nt, Human
uuuuuaguagagacaggguuucac

SEQ ID NO: 484967 - RNA, 23 nt, Human
uuuuuuaguagagacaggguuuc

SEQ ID NO: 484968 - RNA, 18 nt, Human
cacguucagccucccauc

SEQ ID NO: 484969 - RNA, 24 nt, Human
ucuauaauuuacauuaauaacuca

SEQ ID NO: 484970 - RNA, 25 nt, Human
ucuauaauuuacauuaauaacucau

SEQ ID NO: 484971 - RNA, 22 nt, Human
uugagugguuuuaauccucuuc

SEQ ID NO: 484972 - RNA, 18 nt, Human
acccccuuccagcccuug

SEQ ID NO: 484973 - RNA, 21 nt, Human
agcacaucugggugcccuggc

SEQ ID NO: 484974 - RNA, 21 nt, Human
cgggaaggaccggugcggcug

SEQ ID NO: 484975 - RNA, 21 nt, Human
gggagccucgcgugugccggg

SEQ ID NO: 484976 - RNA, 24 nt, Human
gguuucacaacccccuuccagccc

SEQ ID NO: 484977 - RNA, 21 nt, Human
ucacaacccccuuccagcccu

SEQ ID NO: 484978 - RNA, 23 nt, Human
ugccgggaaggaccggugcggcu

SEQ ID NO: 484979 - RNA, 18 nt, Human
uuuuuuuuuugacagacc

SEQ ID NO: 484980 - RNA, 24 nt, Human
uuuuuuuuuuugacagaccaggcu

SEQ ID NO: 484981 - RNA, 22 nt, Human
uuuuuuuuuuuuuuuuugacag

SEQ ID NO: 484982 - RNA, 20 nt, Human
uuuuuuuuuuuuuuuuuugg

SEQ ID NO: 484983 - RNA, 23 nt, Human
aaacaaaacaacaacaacaacaa

SEQ ID NO: 484984 - RNA, 24 nt, Human
aacaaaacaacaacaacaacaaaa

SEQ ID NO: 484985 - RNA, 20 nt, Human
aagaagagcaacacuugcca

SEQ ID NO: 484986 - RNA, 19 nt, Human
aagcagccgaggauacuaa

SEQ ID NO: 484987 - RNA, 19 nt, Human
aagcagccgaggauacuaa

SEQ ID NO: 484988 - RNA, 24 nt, Human
aaugggggaggcgaguuuauuuuu

SEQ ID NO: 484989 - RNA, 18 nt, Human
acaaaacaacaacaacaa

SEQ ID NO: 484990 - RNA, 21 nt, Human
acaaaacaacaacaacaacaa

SEQ ID NO: 484991 - RNA, 23 nt, Human
acaacaacaacaacaaaacuuua

SEQ ID NO: 484992 - RNA, 19 nt, Human
accccgccccccaccccca

SEQ ID NO: 484993 - RNA, 22 nt, Human
accuuccccauccaaaacaaaa

SEQ ID NO: 484994 - RNA, 18 nt, Human
aggcagaaggauuccaga

SEQ ID NO: 484995 - RNA, 23 nt, Human
caaaacaaaacaacaacaacaac

SEQ ID NO: 484996 - RNA, 22 nt, Human
caaaacaacaacaacaacaaaa

SEQ ID NO: 484997 - RNA, 24 nt, Human
caacaacaaaacuuuaccccuuuc

SEQ ID NO: 484998 - RNA, 21 nt, Human
caacaacaacaaaacuuuacc

SEQ ID NO: 484999 - RNA, 22 nt, Human
caacaacaacaaaacuuuaccc

SEQ ID NO: 485000 - RNA, 26 nt, Human
caacaacaacaacaaaacuuuacccc

SEQ ID NO: 485001 - RNA, 21 nt, Human
caccccgccccccacccccag

SEQ ID NO: 485002 - RNA, 19 nt, Human
caccucuuccucgcacucc

SEQ ID NO: 485003 - RNA, 18 nt, Human
cacguccgccgccgccgc

SEQ ID NO: 485004 - RNA, 19 nt, Human
cacguccgccgccgccgcu

SEQ ID NO: 485005 - RNA, 21 nt, Human
cacguccgccgccgccgcucu

SEQ ID NO: 485006 - RNA, 20 nt, Human
cagccgccccccccguccca

SEQ ID NO: 485007 - RNA, 21 nt, Human
cagccgccccccccgucccag

SEQ ID NO: 485008 - RNA, 19 nt, Human
cagccucuuucucacuccc

SEQ ID NO: 485009 - RNA, 21 nt, Human
cauccaaaacaaaacaacaac

SEQ ID NO: 485010 - RNA, 20 nt, Human
ccagucccgcuccgaagccc

SEQ ID NO: 485011 - RNA, 22 nt, Human
cccagggcugcucgcgccagcc

SEQ ID NO: 485012 - RNA, 26 nt, Human
cccauccaaaacaaaacaacaacaac

SEQ ID NO: 485013 - RNA, 19 nt, Human
ccccagggcugcucgcgcc

SEQ ID NO: 485014 - RNA, 22 nt, Human
ccccccccgucccagucccgcu

SEQ ID NO: 485015 - RNA, 27 nt, Human
ccccccgucccagucccgcuccgaagc

SEQ ID NO: 485016 - RNA, 20 nt, Human
ccccgccccccacccccagg

SEQ ID NO: 485017 - RNA, 19 nt, Human
ccccuccgcgcuguguucc

SEQ ID NO: 485018 - RNA, 19 nt, Human
ccccuuccugccuucgccc

SEQ ID NO: 485019 - RNA, 18 nt, Human
cccggagccccucccggg

SEQ ID NO: 485020 - RNA, 18 nt, Human
ccgcacccgcgguuccgc

SEQ ID NO: 485021 - RNA, 23 nt, Human
ccgcgcuguguucccggagcccc

SEQ ID NO: 485022 - RNA, 18 nt, Human
ccgcggcugcccagccgc

SEQ ID NO: 485023 - RNA, 21 nt, Human
ccgugcgcacguccgccgccu

SEQ ID NO: 485024 - RNA, 23 nt, Human
ccucaggggugccgcggcugccc

SEQ ID NO: 485025 - RNA, 18 nt, Human
ccuccugcccgcacccgc

SEQ ID NO: 485026 - RNA, 22 nt, Human
ccuuccugccuucgcccucucc

SEQ ID NO: 485027 - RNA, 25 nt, Human
cgaggauacuaaguaucuucagcua

SEQ ID NO: 485028 - RNA, 20 nt, Human
cgccgccuccugcccgcacc

SEQ ID NO: 485029 - RNA, 24 nt, Human
cggcccaccccgccccccaccccc

SEQ ID NO: 485030 - RNA, 20 nt, Human
cggucccgcugcugccgccg

SEQ ID NO: 485031 - RNA, 23 nt, Human
cuccccuuccugccuucgcccuc

SEQ ID NO: 485032 - RNA, 27 nt, Human
cucggucccgcugcugccgccgccucc

SEQ ID NO: 485033 - RNA, 22 nt, Human
cuuucucacuccccuuccugcc

SEQ ID NO: 485034 - RNA, 19 nt, Human
gaggauacuaaguaucuuc

SEQ ID NO: 485035 - RNA, 21 nt, Human
gcagccgaggauacuaaguau

SEQ ID NO: 485036 - RNA, 23 nt, Human
gccagccgccccccccgucccag

SEQ ID NO: 485037 - RNA, 22 nt, Human
gcccaccccgccccccaccccc

SEQ ID NO: 485038 - RNA, 20 nt, Human
gccggcccaccccgcccccc

SEQ ID NO: 485039 - RNA, 24 nt, Human
gcuccgaagcccccuccucagcuc

SEQ ID NO: 485040 - RNA, 20 nt, Human
gcucgcgccagccgcccccc

SEQ ID NO: 485041 - RNA, 18 nt, Human
gcugcuuucucgcccucu

SEQ ID NO: 485042 - RNA, 24 nt, Human
ggcuagggagaaagauuucagauu

SEQ ID NO: 485043 - RNA, 20 nt, Human
ggguguguaauauaucagau

SEQ ID NO: 485044 - RNA, 21 nt, Human
guccgccgccgccgcucugga

SEQ ID NO: 485045 - RNA, 22 nt, Human
uaaggugaguccuuucucugcu

SEQ ID NO: 485046 - RNA, 19 nt, Human
uccaaaacaaaacaacaac

SEQ ID NO: 485047 - RNA, 20 nt, Human
uccaaacucgaaaaaaaaag

SEQ ID NO: 485048 - RNA, 22 nt, Human
uccaaacucgaaaaaaaaaggu

SEQ ID NO: 485049 - RNA, 20 nt, Human
ucccacagcuggcgcgcacc

SEQ ID NO: 485050 - RNA, 21 nt, Human
uccccauccaaaacaaaacaa

SEQ ID NO: 485051 - RNA, 23 nt, Human
uccccauccaaaacaaaacaaca

SEQ ID NO: 485052 - RNA, 19 nt, Human
ucccgcugcugccgccgcc

SEQ ID NO: 485053 - RNA, 23 nt, Human
ucccgcugcugccgccgccuccu

SEQ ID NO: 485054 - RNA, 23 nt, Human
ucccgcugcugccgccgccuccu

SEQ ID NO: 485055 - RNA, 20 nt, Human
ucccgggccucaggggugcc

SEQ ID NO: 485056 - RNA, 22 nt, Human
uccgaagcccccuccucagcuc

SEQ ID NO: 485057 - RNA, 21 nt, Human
uccgcgcuguguucccggagc

SEQ ID NO: 485058 - RNA, 18 nt, Human
ucgcgccagccgcccccc

SEQ ID NO: 485059 - RNA, 22 nt, Human
ugccgccgccuccugcccgcac

SEQ ID NO: 485060 - RNA, 22 nt, Human
ugccgcggcugcccagccgcac

SEQ ID NO: 485061 - RNA, 22 nt, Human
ugcucgcgccagccgccccccc

SEQ ID NO: 485062 - RNA, 18 nt, Human
uuacugcaacuggaaugg

SEQ ID NO: 485063 - RNA, 23 nt, Human
uuacugcaacuggaaugggggag

SEQ ID NO: 485064 - RNA, 24 nt, Human
uucgcccucucccugccucccuuc

SEQ ID NO: 485065 - RNA, 21 nt, Human
uuucucgcccucuuaauuuca

SEQ ID NO: 485066 - RNA, 19 nt, Human
uuuuuuuuuaaaccaguca

SEQ ID NO: 485067 - RNA, 21 nt, Human
uuuuuuuuuuuuaaaccaguc

SEQ ID NO: 485068 - RNA, 18 nt, Human
aaaccaauaaaagacauc

SEQ ID NO: 485069 - RNA, 18 nt, Human
agaaaccaauaaaagaca

SEQ ID NO: 485070 - RNA, 27 nt, Human
auauacugaaacagacacacacaaaua

SEQ ID NO: 485071 - RNA, 24 nt, Human
auccacccaugagaaaccaauaaa

SEQ ID NO: 485072 - RNA, 19 nt, Human
caccuggaugaacaucaug

SEQ ID NO: 485073 - RNA, 24 nt, Human
ccaaugaugaaaaaaugaucuucc

SEQ ID NO: 485074 - RNA, 18 nt, Human
cccaugagaaaccaauaa

SEQ ID NO: 485075 - RNA, 20 nt, Human
cuuagaauccauauccaccc

SEQ ID NO: 485076 - RNA, 22 nt, Human
cuuccaauaacucaggaguggg

SEQ ID NO: 485077 - RNA, 20 nt, Human
gacacacacaaauaaucugu

SEQ ID NO: 485078 - RNA, 22 nt, Human
ggucaucccucaccuggaugaa

SEQ ID NO: 485079 - RNA, 21 nt, Human
uaacucaggagugggucaucc

SEQ ID NO: 485080 - RNA, 22 nt, Human
uagaauccauauccacccauga

SEQ ID NO: 485081 - RNA, 23 nt, Human
ucagacaggcuagaauccuuaga

SEQ ID NO: 485082 - RNA, 24 nt, Human
uccauauccacccaugagaaacca

SEQ ID NO: 485083 - RNA, 24 nt, Human
ugagaaaccaauaaaagacaucaa

SEQ ID NO: 485084 - RNA, 23 nt, Human
ugugaaauuuuguauugguucag

SEQ ID NO: 485085 - RNA, 19 nt, Human
aaagcucaaaguaaacggc

SEQ ID NO: 485086 - RNA, 18 nt, Human
aacuugugcugucaguga

SEQ ID NO: 485087 - RNA, 23 nt, Human
aagguugccuugaaacacuuauc

SEQ ID NO: 485088 - RNA, 25 nt, Human
aagucuagacaauaucaagaacuga

SEQ ID NO: 485089 - RNA, 21 nt, Human
acaaaaacugacaauguagua

SEQ ID NO: 485090 - RNA, 20 nt, Human
acacagaaaucuaacacaug

SEQ ID NO: 485091 - RNA, 23 nt, Human
acacuuauccccuuuccccucca

SEQ ID NO: 485092 - RNA, 19 nt, Human
acagaaaucuaacacaugc

SEQ ID NO: 485093 - RNA, 22 nt, Human
acaggcuuaguccuuugugggg

SEQ ID NO: 485094 - RNA, 25 nt, Human
acugucuuaccuccucuaccacccu

SEQ ID NO: 485095 - RNA, 21 nt, Human
acuucauuacuggaaaagaaa

SEQ ID NO: 485096 - RNA, 22 nt, Human
agaacuccuucccuucccacuu

SEQ ID NO: 485097 - RNA, 20 nt, Human
agacaaaaacugacaaugua

SEQ ID NO: 485098 - RNA, 19 nt, Human
agacaauaucaagaacuga

SEQ ID NO: 485099 - RNA, 21 nt, Human
agaccacccgggccccgaaga

SEQ ID NO: 485100 - RNA, 24 nt, Human
agccagguuccucuggcaguccca

SEQ ID NO: 485101 - RNA, 23 nt, Human
aggauuucuuaaaaaauuguuuu

SEQ ID NO: 485102 - RNA, 21 nt, Human
aggcuuaguccuuugugggaa

SEQ ID NO: 485103 - RNA, 18 nt, Human
aguccuuugugggaacag

SEQ ID NO: 485104 - RNA, 21 nt, Human
auaauacaccaguaauagcca

SEQ ID NO: 485105 - RNA, 18 nt, Human
auccccuuuccccuccac

SEQ ID NO: 485106 - RNA, 20 nt, Human
auccccuuuccccuccacug

SEQ ID NO: 485107 - RNA, 22 nt, Human
aucucccuuucuccccucccca

SEQ ID NO: 485108 - RNA, 20 nt, Human
auggugccaaugacauuuuu

SEQ ID NO: 485109 - RNA, 23 nt, Human
caaaaacuacacacaugcuacgc

SEQ ID NO: 485110 - RNA, 24 nt, Human
caaaucauuaguugucuguucuuu

SEQ ID NO: 485111 - RNA, 21 nt, Human
caagccucaagccuguccccu

SEQ ID NO: 485112 - RNA, 24 nt, Human
caauaaguuuaggcagggaacacc

SEQ ID NO: 485113 - RNA, 23 nt, Human
caccaguaauagccaaaaacuac

SEQ ID NO: 485114 - RNA, 19 nt, Human
cacccgggccccgaagagc

SEQ ID NO: 485115 - RNA, 22 nt, Human
cacugggaugggugugcaaacu

SEQ ID NO: 485116 - RNA, 24 nt, Human
cagcuuucugguguaaagggugac

SEQ ID NO: 485117 - RNA, 21 nt, Human
cagcuuuuaaacagucucuca

SEQ ID NO: 485118 - RNA, 20 nt, Human
cagucagaugugacaggggc

SEQ ID NO: 485119 - RNA, 19 nt, Human
cauuacuggaaaagaaagg

SEQ ID NO: 485120 - RNA, 21 nt, Human
cauuuaaacaaaguuuacaca

SEQ ID NO: 485121 - RNA, 22 nt, Human
ccacccucuuccucuuccuaac

SEQ ID NO: 485122 - RNA, 20 nt, Human
ccaguaauagccaaaaacua

SEQ ID NO: 485123 - RNA, 19 nt, Human
cccaauaugaaaguuuaau

SEQ ID NO: 485124 - RNA, 21 nt, Human
ccccgaagagcgccucgugcc

SEQ ID NO: 485125 - RNA, 20 nt, Human
ccccuuuccccuccacuggg

SEQ ID NO: 485126 - RNA, 21 nt, Human
ccccuuuccccuccacuggga

SEQ ID NO: 485127 - RNA, 24 nt, Human
cccuccccaucccucccuccccca

SEQ ID NO: 485128 - RNA, 25 nt, Human
cccuccccaucccucccucccccaa

SEQ ID NO: 485129 - RNA, 21 nt, Human
cccuucccacuugaaacccac

SEQ ID NO: 485130 - RNA, 18 nt, Human
cccuuucuccccucccca

SEQ ID NO: 485131 - RNA, 22 nt, Human
cccuuucuccccuccccauccc

SEQ ID NO: 485132 - RNA, 24 nt, Human
ccguaguccugcaaagccagguuc

SEQ ID NO: 485133 - RNA, 20 nt, Human
ccuccucuaccacccucuuc

SEQ ID NO: 485134 - RNA, 21 nt, Human
ccugcaaagccagguuccucu

SEQ ID NO: 485135 - RNA, 22 nt, Human
ccuuccgcccuaucccgcagcc

SEQ ID NO: 485136 - RNA, 25 nt, Human
cuaacacaugccuaaaagaauuuua

SEQ ID NO: 485137 - RNA, 19 nt, Human
cucacgccuauccaagccu

SEQ ID NO: 485138 - RNA, 19 nt, Human
cuccccaucccucccuccc

SEQ ID NO: 485139 - RNA, 24 nt, Human
cucccuuucuccccuccccauccc

SEQ ID NO: 485140 - RNA, 23 nt, Human
cucucccacacacccaauucugc

SEQ ID NO: 485141 - RNA, 20 nt, Human
cuuuuaaacagucucucaca

SEQ ID NO: 485142 - RNA, 19 nt, Human
gcagggcacagaaacuaua

SEQ ID NO: 485143 - RNA, 24 nt, Human
gcccugggcccucuuccaauucac

SEQ ID NO: 485144 - RNA, 20 nt, Human
gcuuguacuguauacucucc

SEQ ID NO: 485145 - RNA, 22 nt, Human
ggcccugggcccucuuccaauu

SEQ ID NO: 485146 - RNA, 22 nt, Human
gggaacaccuuggcuuauaggu

SEQ ID NO: 485147 - RNA, 20 nt, Human
gucagugacugaacccugcc

SEQ ID NO: 485148 - RNA, 20 nt, Human
gucuguucuuuuccauugcu

SEQ ID NO: 485149 - RNA, 23 nt, Human
uaaaaaugcagaguuaacacuau

SEQ ID NO: 485150 - RNA, 24 nt, Human
uaacacuauugggaagaaggcugu

SEQ ID NO: 485151 - RNA, 23 nt, Human
uaacuuaugaacaggcuuagucc

SEQ ID NO: 485152 - RNA, 25 nt, Human
uaacuuaugaacaggcuuaguccuu

SEQ ID NO: 485153 - RNA, 25 nt, Human
uaauagccaaaaacuacacacaugc

SEQ ID NO: 485154 - RNA, 20 nt, Human
uagcaccucuaaggcagaau

SEQ ID NO: 485155 - RNA, 24 nt, Human
uagccaaaaacuacacacaugcua

SEQ ID NO: 485156 - RNA, 23 nt, Human
uagguuucagacuuucacagcuu

SEQ ID NO: 485157 - RNA, 21 nt, Human
ucaggccccaaauguuaauca

SEQ ID NO: 485158 - RNA, 21 nt, Human
ucauagaaggcccuuugcuuu

SEQ ID NO: 485159 - RNA, 20 nt, Human
uccaucuccaaaauggcaac

SEQ ID NO: 485160 - RNA, 22 nt, Human
ucccacacacccaauucugcaa

SEQ ID NO: 485161 - RNA, 19 nt, Human
ucccccaaauaauacacca

SEQ ID NO: 485162 - RNA, 22 nt, Human
uccccuuuccccuccacuggga

SEQ ID NO: 485163 - RNA, 20 nt, Human
uccgcccuaucccgcagccg

SEQ ID NO: 485164 - RNA, 20 nt, Human
uccuccguaguccugcaaag

SEQ ID NO: 485165 - RNA, 22 nt, Human
ucguaugcgccuccucacgccu

SEQ ID NO: 485166 - RNA, 21 nt, Human
ucucccuuucuccccucccca

SEQ ID NO: 485167 - RNA, 18 nt, Human
ucuguucuuuuccauugc

SEQ ID NO: 485168 - RNA, 19 nt, Human
ucuguucuuuuccauugcu

SEQ ID NO: 485169 - RNA, 22 nt, Human
ucuuaccuccucuaccacccuc

SEQ ID NO: 485170 - RNA, 22 nt, Human
ugaaccacugcccaauaugaaa

SEQ ID NO: 485171 - RNA, 21 nt, Human
ugacaggggcugguacucagg

SEQ ID NO: 485172 - RNA, 23 nt, Human
ugacucaagacagagcauuuugg

SEQ ID NO: 485173 - RNA, 18 nt, Human
ugagaccaaggcuuuuga

SEQ ID NO: 485174 - RNA, 19 nt, Human
ugagaccaaggcuuuugaa

SEQ ID NO: 485175 - RNA, 20 nt, Human
ugaugcuacccaucucccuu

SEQ ID NO: 485176 - RNA, 21 nt, Human
ugucaagacaaguagaacucc

SEQ ID NO: 485177 - RNA, 24 nt, Human
ugucuguucuuuuccauugcuuca

SEQ ID NO: 485178 - RNA, 18 nt, Human
ugucuuaccuccucuacc

SEQ ID NO: 485179 - RNA, 22 nt, Human
uguggguuguggagaugcucuu

SEQ ID NO: 485180 - RNA, 18 nt, Human
uguguguguaugugugug

SEQ ID NO: 485181 - RNA, 19 nt, Human
uguguguguaugugugugu

SEQ ID NO: 485182 - RNA, 22 nt, Human
uguuccagaccacccgggcccc

SEQ ID NO: 485183 - RNA, 24 nt, Human
uuacauuuaaacaaaguuuacaca

SEQ ID NO: 485184 - RNA, 24 nt, Human
uucagugaaacuugugcugucagu

SEQ ID NO: 485185 - RNA, 24 nt, Human
uuggaucaauucagugaaacuugu

SEQ ID NO: 485186 - RNA, 18 nt, Human
uugucuuucccuacuguc

SEQ ID NO: 485187 - RNA, 23 nt, Human
uugugcggcccugggcccucuuc

SEQ ID NO: 485188 - RNA, 23 nt, Human
uuuccccuaucaggccccaaaug

SEQ ID NO: 485189 - RNA, 18 nt, Human
uuuguguguguaugugug

SEQ ID NO: 485190 - RNA, 22 nt, Human
uuuuccauugcuucaccauuuc

SEQ ID NO: 485191 - RNA, 23 nt, Human
aaaaaacccccaacaacucuucc

SEQ ID NO: 485192 - RNA, 21 nt, Human
aaaaacccccaacaacucuuc

SEQ ID NO: 485193 - RNA, 18 nt, Human
aaacucaagauugagccu

SEQ ID NO: 485194 - RNA, 26 nt, Human
aaacugccaacaccucuaaccaucug

SEQ ID NO: 485195 - RNA, 18 nt, Human
aaaggaagcaacuacaga

SEQ ID NO: 485196 - RNA, 24 nt, Human
aaauauauauaaaagaacaaugug

SEQ ID NO: 485197 - RNA, 19 nt, Human
aaccagugcuauggaugca

SEQ ID NO: 485198 - RNA, 19 nt, Human
aacccccaacaacucuucc

SEQ ID NO: 485199 - RNA, 24 nt, Human
aacccccaacaacucuuccaacgc

SEQ ID NO: 485200 - RNA, 21 nt, Human
aauaaaguaaacaauauacag

SEQ ID NO: 485201 - RNA, 23 nt, Human
aaugacuauggacauuuccccca

SEQ ID NO: 485202 - RNA, 20 nt, Human
acacacacacacaaaaaaca

SEQ ID NO: 485203 - RNA, 20 nt, Human
acacacacacacacacaaaa

SEQ ID NO: 485204 - RNA, 23 nt, Human
acacacacacacacacaaaaaac

SEQ ID NO: 485205 - RNA, 31 nt, Human
acacacacacacacacacaaaaaacacguag

SEQ ID NO: 485206 - RNA, 28 nt, Human
acacacacacacacacacacaaaaaaca

SEQ ID NO: 485207 - RNA, 23 nt, Human
acacacacacacacacacacaca

SEQ ID NO: 485208 - RNA, 23 nt, Human
acacacacacacacacacacaca

SEQ ID NO: 485209 - RNA, 23 nt, Human
acacacacacacacacacacaca

SEQ ID NO: 485210 - RNA, 23 nt, Human
acacacacacacacacacacaca

SEQ ID NO: 485211 - RNA, 23 nt, Human
acacacacacacacacacacaca

SEQ ID NO: 485212 - RNA, 28 nt, Human
acacacacacacacacacacacaaaaaa

SEQ ID NO: 485213 - RNA, 21 nt, Human
acagcucaagccacauccgaa

SEQ ID NO: 485214 - RNA, 21 nt, Human
acuugauuuucauuaggaugu

SEQ ID NO: 485215 - RNA, 19 nt, Human
agccgggagcugcgcgcgg

SEQ ID NO: 485216 - RNA, 19 nt, Human
aggaauggcccgcuaggga

SEQ ID NO: 485217 - RNA, 19 nt, Human
agggaagggggaggcgggg

SEQ ID NO: 485218 - RNA, 19 nt, Human
aggggagggaagggggagg

SEQ ID NO: 485219 - RNA, 21 nt, Human
aggggagggaagggggaggcg

SEQ ID NO: 485220 - RNA, 24 nt, Human
caaaaaacccccaacaacucuucc

SEQ ID NO: 485221 - RNA, 24 nt, Human
caaaguaaccagugcuauggaugc

SEQ ID NO: 485222 - RNA, 21 nt, Human
caaggggagggaagggggagg

SEQ ID NO: 485223 - RNA, 25 nt, Human
cacacacacacaaaaaacacguaau

SEQ ID NO: 485224 - RNA, 23 nt, Human
cacacacacacacacaaaaaaca

SEQ ID NO: 485225 - RNA, 20 nt, Human
cacacacacacacacacaca

SEQ ID NO: 485226 - RNA, 20 nt, Human
cacacacacacacacacaca

SEQ ID NO: 485227 - RNA, 20 nt, Human
cacacacacacacacacaca

SEQ ID NO: 485228 - RNA, 20 nt, Human
cacacacacacacacacaca

SEQ ID NO: 485229 - RNA, 20 nt, Human
cacacacacacacacacaca

SEQ ID NO: 485230 - RNA, 20 nt, Human
cacacacacacacacacaca

SEQ ID NO: 485231 - RNA, 22 nt, Human
cacacacacacacacacacaca

SEQ ID NO: 485232 - RNA, 26 nt, Human
cacacacacacacacacacacacaca

SEQ ID NO: 485233 - RNA, 26 nt, Human
cacacacacacacacacacacacaca

SEQ ID NO: 485234 - RNA, 26 nt, Human
cacacacacacacacacacacacaca

SEQ ID NO: 485235 - RNA, 18 nt, Human
caccaguauuuacaauaa

SEQ ID NO: 485236 - RNA, 21 nt, Human
cagcagguccuaaacugccaa

SEQ ID NO: 485237 - RNA, 19 nt, Human
cagcucaagccacauccga

SEQ ID NO: 485238 - RNA, 20 nt, Human
cagugcuauggaugcaaaaa

SEQ ID NO: 485239 - RNA, 33 nt, Human
cauuuuauggauacacacacacacacacacagu

SEQ ID NO: 485240 - RNA, 18 nt, Human
ccacauccgaagggggag

SEQ ID NO: 485241 - RNA, 23 nt, Human
cccaacaacucuuccaacgcuac

SEQ ID NO: 485242 - RNA, 20 nt, Human
cccaaggggagggaaggggg

SEQ ID NO: 485243 - RNA, 24 nt, Human
ccccaacaacucuuccaacgcuac

SEQ ID NO: 485244 - RNA, 23 nt, Human
ccuaaacugccaacaccucuaac

SEQ ID NO: 485245 - RNA, 22 nt, Human
ccuccgagcugcuccgggucgc

SEQ ID NO: 485246 - RNA, 24 nt, Human
cgcccggugguccccaaggggagg

SEQ ID NO: 485247 - RNA, 21 nt, Human
cgcgccuacagcucaagccac

SEQ ID NO: 485248 - RNA, 24 nt, Human
cuaguaaaucaaaaucuaagaccc

SEQ ID NO: 485249 - RNA, 19 nt, Human
cuccgggucgcgggucugc

SEQ ID NO: 485250 - RNA, 22 nt, Human
cucuuccaacgcuacuuucaaa

SEQ ID NO: 485251 - RNA, 19 nt, Human
cugaaccaguaaagcaaac

SEQ ID NO: 485252 - RNA, 19 nt, Human
gagccuccauguaaugaau

SEQ ID NO: 485253 - RNA, 21 nt, Human
gagggaagggggaggcggggc

SEQ ID NO: 485254 - RNA, 23 nt, Human
gauaaaggaagcaacuacagaaa

SEQ ID NO: 485255 - RNA, 20 nt, Human
gcgccuacagcucaagccac

SEQ ID NO: 485256 - RNA, 20 nt, Human
gcgggucugcagcgucuccg

SEQ ID NO: 485257 - RNA, 19 nt, Human
gcuuaaaaacaaaaaaaaa

SEQ ID NO: 485258 - RNA, 21 nt, Human
gggagggaagggggaggcggg

SEQ ID NO: 485259 - RNA, 21 nt, Human
ggugaaugcuuaaaaacaaaa

SEQ ID NO: 485260 - RNA, 23 nt, Human
gucugcagcgucuccggcccucc

SEQ ID NO: 485261 - RNA, 20 nt, Human
gugaaugcuuaaaaacaaaa

SEQ ID NO: 485262 - RNA, 23 nt, Human
uaaagaaaaaacaugcaggucaa

SEQ ID NO: 485263 - RNA, 19 nt, Human
uaaaguaaacaauauacag

SEQ ID NO: 485264 - RNA, 20 nt, Human
uaaaguaaacaauauacagu

SEQ ID NO: 485265 - RNA, 24 nt, Human
uaaugacuauggacauuuccccca

SEQ ID NO: 485266 - RNA, 19 nt, Human
uacaaaguuguucuuccug

SEQ ID NO: 485267 - RNA, 25 nt, Human
uacaaaguuguucuuccuggcuuuu

SEQ ID NO: 485268 - RNA, 20 nt, Human
uacacacacacacacacaca

SEQ ID NO: 485269 - RNA, 25 nt, Human
uacacacacacacacacacacacac

SEQ ID NO: 485270 - RNA, 19 nt, Human
uacagcucaagccacaucc

SEQ ID NO: 485271 - RNA, 23 nt, Human
uaccaugguaucaaauguucuuu

SEQ ID NO: 485272 - RNA, 23 nt, Human
uagaaugguccuuaggcucauga

SEQ ID NO: 485273 - RNA, 19 nt, Human
uagaauuacuuauuucacu

SEQ ID NO: 485274 - RNA, 23 nt, Human
uaguaaaucaaaaucuaagaccc

SEQ ID NO: 485275 - RNA, 18 nt, Human
uagucaauguagcaacag

SEQ ID NO: 485276 - RNA, 23 nt, Human
ucaccgccuccgagcugcuccgg

SEQ ID NO: 485277 - RNA, 19 nt, Human
uccuaaacugccaacaccu

SEQ ID NO: 485278 - RNA, 20 nt, Human
ucugcagcgucuccggcccc

SEQ ID NO: 485279 - RNA, 23 nt, Human
ugaaugcuuaaaaacaaaaaaaa

SEQ ID NO: 485280 - RNA, 19 nt, Human
ugaccggagucuccucagc

SEQ ID NO: 485281 - RNA, 20 nt, Human
ugacuauggacauuuccccc

SEQ ID NO: 485282 - RNA, 21 nt, Human
ugagaacacaaguuuugacug

SEQ ID NO: 485283 - RNA, 24 nt, Human
ugccaacaccucuaaccaucugau

SEQ ID NO: 485284 - RNA, 26 nt, Human
uggauacacacacacacacacacaca

SEQ ID NO: 485285 - RNA, 26 nt, Human
uggauacacacacacacacacacagu

SEQ ID NO: 485286 - RNA, 18 nt, Human
uuaaugaagaggaaauga

SEQ ID NO: 485287 - RNA, 22 nt, Human
uuagaaaagcuguucuuuaaug

SEQ ID NO: 485288 - RNA, 26 nt, Human
uucauuaggauguaguuauuuuguca

SEQ ID NO: 485289 - RNA, 24 nt, Human
uuggauaacauuuugauuacuaca

SEQ ID NO: 485290 - RNA, 20 nt, Human
uuuuauggauacacacacac

SEQ ID NO: 485291 - RNA, 22 nt, Human
uuuuauggauacacacacacac

SEQ ID NO: 485292 - RNA, 31 nt, Human
uuuuauggauacacacacacacacacacaca

SEQ ID NO: 485293 - RNA, 18 nt, Human
uuuuuuuuuuuuuuuuug

SEQ ID NO: 485294 - RNA, 21 nt, Human
uuuuuuuuuuuuuuuuugcau

SEQ ID NO: 485295 - RNA, 24 nt, Human
uuuuuuuuuuuuuuuuuugcauaa

SEQ ID NO: 485296 - RNA, 19 nt, Human
agcccggccggcccgcgcu

SEQ ID NO: 485297 - RNA, 19 nt, Human
cagcccggccggcccgcgc

SEQ ID NO: 485298 - RNA, 20 nt, Human
cccccgccgcgccgccgcuc

SEQ ID NO: 485299 - RNA, 22 nt, Human
cccgccgcgccgccgcucgccc

SEQ ID NO: 485300 - RNA, 24 nt, Human
cccgccgcgccgccgcucgccccg

SEQ ID NO: 485301 - RNA, 25 nt, Human
cccgccgcgccgccgcucgccccgc

SEQ ID NO: 485302 - RNA, 22 nt, Human
cccgcgccgccccggcucccgc

SEQ ID NO: 485303 - RNA, 24 nt, Human
ccgcgccgccccggcucccgcguc

SEQ ID NO: 485304 - RNA, 19 nt, Human
ccgcgccgccgcucgcccc

SEQ ID NO: 485305 - RNA, 18 nt, Human
ccggcgcccagcugccgc

SEQ ID NO: 485306 - RNA, 19 nt, Human
ccggcgcccagcugccgcc

SEQ ID NO: 485307 - RNA, 18 nt, Human
cggccggcccgcgcugcc

SEQ ID NO: 485308 - RNA, 22 nt, Human
cucccgccggcgcccagcugcc

SEQ ID NO: 485309 - RNA, 19 nt, Human
gccgccccggccgaaggcc

SEQ ID NO: 485310 - RNA, 18 nt, Human
gccgccccggcucccgcg

SEQ ID NO: 485311 - RNA, 21 nt, Human
gccggcccgcgcugcccgcgc

SEQ ID NO: 485312 - RNA, 20 nt, Human
gcgcccagcugccgccccgg

SEQ ID NO: 485313 - RNA, 18 nt, Human
gcuagcucccgccggcgc

SEQ ID NO: 485314 - RNA, 19 nt, Human
ugcuagcucccgccggcgc

SEQ ID NO: 485315 - RNA, 26 nt, Human
aagggguggguagaaaggagaggagg

SEQ ID NO: 485316 - RNA, 20 nt, Human
cacaagccaccaccgccgcu

SEQ ID NO: 485317 - RNA, 21 nt, Human
caccacaagccaccaccgccg

SEQ ID NO: 485318 - RNA, 18 nt, Human
caccgccgccgcuucugc

SEQ ID NO: 485319 - RNA, 18 nt, Human
cacgcuaacgucugcccu

SEQ ID NO: 485320 - RNA, 18 nt, Human
ccaccgccgccgcuucug

SEQ ID NO: 485321 - RNA, 23 nt, Human
cccgggauugagagugaucacuc

SEQ ID NO: 485322 - RNA, 18 nt, Human
ccgccgccgcuucugcgc

SEQ ID NO: 485323 - RNA, 20 nt, Human
gccgcaccacaagccaccac

SEQ ID NO: 485324 - RNA, 26 nt, Human
guggagcacagugauaagcacauuuu

SEQ ID NO: 485325 - RNA, 18 nt, Human
uaaggccaccaggucccc

SEQ ID NO: 485326 - RNA, 19 nt, Human
ugaaagacuaaggccacca

SEQ ID NO: 485327 - RNA, 23 nt, Human
ugaggccgcaccacaagccacca

SEQ ID NO: 485328 - RNA, 19 nt, Human
uguggagcacagugauaag

SEQ ID NO: 485329 - RNA, 22 nt, Human
uguggagcacagugauaagcac

SEQ ID NO: 485330 - RNA, 24 nt, Human
uguuuaggauagaaaggggugggu

SEQ ID NO: 485331 - RNA, 18 nt, Human
uuuuuuuuuuuuuuuuug

SEQ ID NO: 485332 - RNA, 19 nt, Human
uuuuuuuuuuuuuuuuugu

SEQ ID NO: 485333 - RNA, 21 nt, Human
uuuuuuuuuuuuuuuuugugg

SEQ ID NO: 485334 - RNA, 25 nt, Human
aaaaaaaaaaaaaaaaaagaaagaa

SEQ ID NO: 485335 - RNA, 22 nt, Human
aaaaaaaaaagaaagaaagaaa

SEQ ID NO: 485336 - RNA, 24 nt, Human
aaaacaacaaaaugacacagaaga

SEQ ID NO: 485337 - RNA, 22 nt, Human
aaaacacaacuucuuuacaaaa

SEQ ID NO: 485338 - RNA, 18 nt, Human
aaacagaagcugcccagg

SEQ ID NO: 485339 - RNA, 23 nt, Human
aaacccacacccccaacuaagcg

SEQ ID NO: 485340 - RNA, 23 nt, Human
aaagaaaaaagaaaaacaaaaga

SEQ ID NO: 485341 - RNA, 24 nt, Human
aaagcauccugggccccagucccu

SEQ ID NO: 485342 - RNA, 20 nt, Human
aaccaaaacaacaaaaugac

SEQ ID NO: 485343 - RNA, 19 nt, Human
aacuacccagccccauccc

SEQ ID NO: 485344 - RNA, 22 nt, Human
aagaaagaaaaaagaaaaacaa

SEQ ID NO: 485345 - RNA, 19 nt, Human
aagaagucucccucuccac

SEQ ID NO: 485346 - RNA, 19 nt, Human
aagcaaaagaggggcuggg

SEQ ID NO: 485347 - RNA, 22 nt, Human
aagcagcaaggguggacgaggg

SEQ ID NO: 485348 - RNA, 23 nt, Human
aagcagcaaggguggacgagggg

SEQ ID NO: 485349 - RNA, 18 nt, Human
aagcgucuucuccacagg

SEQ ID NO: 485350 - RNA, 20 nt, Human
aaggaggcuccacucacccu

SEQ ID NO: 485351 - RNA, 18 nt, Human
aagggggcaagaaaccaa

SEQ ID NO: 485352 - RNA, 20 nt, Human
acaaagccaacacacagggc

SEQ ID NO: 485353 - RNA, 23 nt, Human
accaaaacaacaaaaugacacag

SEQ ID NO: 485354 - RNA, 25 nt, Human
accaaaacaacaaaaugacacagaa

SEQ ID NO: 485355 - RNA, 19 nt, Human
accacauacaaaggcaaca

SEQ ID NO: 485356 - RNA, 19 nt, Human
acccaauacacccauuuca

SEQ ID NO: 485357 - RNA, 24 nt, Human
acccaccccucccccggaaccgcc

SEQ ID NO: 485358 - RNA, 21 nt, Human
acccacgcacaauggagaccc

SEQ ID NO: 485359 - RNA, 25 nt, Human
acccccaacuaagcgucuucuccac

SEQ ID NO: 485360 - RNA, 19 nt, Human
acccggaggaagagggagc

SEQ ID NO: 485361 - RNA, 19 nt, Human
acgcuucgcuccagcuacc

SEQ ID NO: 485362 - RNA, 20 nt, Human
agaaaaaccaccacaaacca

SEQ ID NO: 485363 - RNA, 21 nt, Human
agaagggcaaacuaaagguca

SEQ ID NO: 485364 - RNA, 22 nt, Human
agacaagcaaagcacagggaga

SEQ ID NO: 485365 - RNA, 19 nt, Human
agacccgggaaguggccca

SEQ ID NO: 485366 - RNA, 21 nt, Human
agagagggcugggggcaaggg

SEQ ID NO: 485367 - RNA, 23 nt, Human
agagggaaacagaagcugcccag

SEQ ID NO: 485368 - RNA, 18 nt, Human
agaggggaggaaggaggc

SEQ ID NO: 485369 - RNA, 19 nt, Human
agagggguugugggcagcu

SEQ ID NO: 485370 - RNA, 22 nt, Human
agcauccugggccccagucccu

SEQ ID NO: 485371 - RNA, 19 nt, Human
agccauuugagacaagcaa

SEQ ID NO: 485372 - RNA, 19 nt, Human
agcccccuggccaacccag

SEQ ID NO: 485373 - RNA, 18 nt, Human
agcucccgggggcccgcu

SEQ ID NO: 485374 - RNA, 19 nt, Human
agcucccgggggcccgcug

SEQ ID NO: 485375 - RNA, 18 nt, Human
aggaaagagccagggcug

SEQ ID NO: 485376 - RNA, 23 nt, Human
aggaaggaggcuccacucacccu

SEQ ID NO: 485377 - RNA, 23 nt, Human
aggagggcagggggguggggggc

SEQ ID NO: 485378 - RNA, 18 nt, Human
aggccuccgccccauccu

SEQ ID NO: 485379 - RNA, 19 nt, Human
agggagagagggcuggggg

SEQ ID NO: 485380 - RNA, 21 nt, Human
agggaugggucccaacuuacc

SEQ ID NO: 485381 - RNA, 23 nt, Human
agggaugggucccaacuuaccgu

SEQ ID NO: 485382 - RNA, 23 nt, Human
aggggccauccccccaacucugu

SEQ ID NO: 485383 - RNA, 24 nt, Human
aggggcugggacaagccgggaggc

SEQ ID NO: 485384 - RNA, 18 nt, Human
agggugagaacaaagagg

SEQ ID NO: 485385 - RNA, 23 nt, Human
aggguggggugggagcaagagua

SEQ ID NO: 485386 - RNA, 24 nt, Human
agguugggcugaccacccugagga

SEQ ID NO: 485387 - RNA, 21 nt, Human
aucggcacagacccaccccuc

SEQ ID NO: 485388 - RNA, 22 nt, Human
aucggcacagacccaccccucc

SEQ ID NO: 485389 - RNA, 19 nt, Human
auggagcccaaacccacac

SEQ ID NO: 485390 - RNA, 21 nt, Human
caaacccacacccccaacuaa

SEQ ID NO: 485391 - RNA, 25 nt, Human
caaaccucagcuugccgggaccugc

SEQ ID NO: 485392 - RNA, 24 nt, Human
caacaaaaugacacagaagagugg

SEQ ID NO: 485393 - RNA, 25 nt, Human
caacccagcucccuguuggggcuga

SEQ ID NO: 485394 - RNA, 20 nt, Human
caaccuugaccccccaccug

SEQ ID NO: 485395 - RNA, 18 nt, Human
caacuggaaguuuccacg

SEQ ID NO: 485396 - RNA, 18 nt, Human
caacugggaaaggaacag

SEQ ID NO: 485397 - RNA, 20 nt, Human
caagaaaccaaacugcccac

SEQ ID NO: 485398 - RNA, 21 nt, Human
caagggaggccgauccgugca

SEQ ID NO: 485399 - RNA, 23 nt, Human
caagggaggccgauccgugcaag

SEQ ID NO: 485400 - RNA, 22 nt, Human
caauacacccauuucacagaag

SEQ ID NO: 485401 - RNA, 22 nt, Human
cacaaaccaaaacaacaaaaug

SEQ ID NO: 485402 - RNA, 23 nt, Human
cacaaagccaacacacagggcag

SEQ ID NO: 485403 - RNA, 20 nt, Human
cacagcaaaccuccagaccc

SEQ ID NO: 485404 - RNA, 20 nt, Human
caccacaaaccaaaacaaca

SEQ ID NO: 485405 - RNA, 21 nt, Human
caccacaaaccaaaacaacaa

SEQ ID NO: 485406 - RNA, 24 nt, Human
cacccccaacuaagcgucuucucc

SEQ ID NO: 485407 - RNA, 18 nt, Human
caccccucccccggaacc

SEQ ID NO: 485408 - RNA, 18 nt, Human
cacccggcagccuggggc

SEQ ID NO: 485409 - RNA, 20 nt, Human
cacccucggucccauccacu

SEQ ID NO: 485410 - RNA, 19 nt, Human
cacccucugccaguuccuc

SEQ ID NO: 485411 - RNA, 21 nt, Human
caccugggggagggggucagg

SEQ ID NO: 485412 - RNA, 19 nt, Human
cacugcuggagugaggcac

SEQ ID NO: 485413 - RNA, 20 nt, Human
cagaaaccacccagugggcu

SEQ ID NO: 485414 - RNA, 22 nt, Human
cagcaaaccuccagacccaagc

SEQ ID NO: 485415 - RNA, 23 nt, Human
cagcagaacaaacguacaagaca

SEQ ID NO: 485416 - RNA, 18 nt, Human
cagcagaagcagaccacc

SEQ ID NO: 485417 - RNA, 24 nt, Human
cagcccccgccccaacccugcgag

SEQ ID NO: 485418 - RNA, 23 nt, Human
cagcccccuggccaacccagcuc

SEQ ID NO: 485419 - RNA, 18 nt, Human
cagcgaguggggcagacg

SEQ ID NO: 485420 - RNA, 19 nt, Human
cagcuugccgggaccugca

SEQ ID NO: 485421 - RNA, 25 nt, Human
cagggcuggggcagggcauaggggg

SEQ ID NO: 485422 - RNA, 20 nt, Human
caggggcccagcuucuugcc

SEQ ID NO: 485423 - RNA, 19 nt, Human
caggguagggaggggccga

SEQ ID NO: 485424 - RNA, 20 nt, Human
cagggugagaacaaagaggg

SEQ ID NO: 485425 - RNA, 21 nt, Human
caguccaggccuucaaugccc

SEQ ID NO: 485426 - RNA, 22 nt, Human
cauacaaaggcaacaacacuuc

SEQ ID NO: 485427 - RNA, 19 nt, Human
cauccccccaacucugucc

SEQ ID NO: 485428 - RNA, 20 nt, Human
ccaaacccacacccccaacu

SEQ ID NO: 485429 - RNA, 21 nt, Human
ccaacucuguccaccucacac

SEQ ID NO: 485430 - RNA, 23 nt, Human
ccaacuucugaugcccuggcuga

SEQ ID NO: 485431 - RNA, 25 nt, Human
ccacaaaccaaaacaacaaaaugac

SEQ ID NO: 485432 - RNA, 21 nt, Human
ccacagcaaaccuccagaccc

SEQ ID NO: 485433 - RNA, 20 nt, Human
ccacauacaaaggcaacaac

SEQ ID NO: 485434 - RNA, 18 nt, Human
ccaccccucccccggaac

SEQ ID NO: 485435 - RNA, 18 nt, Human
ccacuccacccagcagca

SEQ ID NO: 485436 - RNA, 19 nt, Human
ccagcagaagcagaccacc

SEQ ID NO: 485437 - RNA, 22 nt, Human
ccagccacccccaggggcccag

SEQ ID NO: 485438 - RNA, 19 nt, Human
ccaggcagcagagggaaac

SEQ ID NO: 485439 - RNA, 19 nt, Human
ccagggccugggcccugcc

SEQ ID NO: 485440 - RNA, 23 nt, Human
ccaggggcccagcuucuugccuc

SEQ ID NO: 485441 - RNA, 22 nt, Human
ccagugacaacccccacccucc

SEQ ID NO: 485442 - RNA, 26 nt, Human
ccagugacaacccccacccucccaaa

SEQ ID NO: 485443 - RNA, 19 nt, Human
cccaacuacccagccccau

SEQ ID NO: 485444 - RNA, 22 nt, Human
cccaauacacccauuucacaga

SEQ ID NO: 485445 - RNA, 20 nt, Human
cccacccucccaaaccucag

SEQ ID NO: 485446 - RNA, 22 nt, Human
cccagccacccccaggggccca

SEQ ID NO: 485447 - RNA, 22 nt, Human
cccaguaccagcaaccuugacc

SEQ ID NO: 485448 - RNA, 22 nt, Human
ccccacccucccaaaccucagc

SEQ ID NO: 485449 - RNA, 23 nt, Human
ccccaggggcccagcuucuugcc

SEQ ID NO: 485450 - RNA, 21 nt, Human
ccccauaggccagagaggcug

SEQ ID NO: 485451 - RNA, 23 nt, Human
ccccaugcuggggcggcaccucc

SEQ ID NO: 485452 - RNA, 27 nt, Human
cccccacccucccaaaccucagcuugc

SEQ ID NO: 485453 - RNA, 20 nt, Human
cccccauaggaaucccacaa

SEQ ID NO: 485454 - RNA, 21 nt, Human
cccccaugggcacugcccacc

SEQ ID NO: 485455 - RNA, 18 nt, Human
ccccccaagccccccucc

SEQ ID NO: 485456 - RNA, 27 nt, Human
cccccgccacccccccauaggaauccc

SEQ ID NO: 485457 - RNA, 19 nt, Human
cccccgccccaacccugcg

SEQ ID NO: 485458 - RNA, 25 nt, Human
cccccgccccaacccugcgaggguc

SEQ ID NO: 485459 - RNA, 19 nt, Human
cccccuggagaaaaucacc

SEQ ID NO: 485460 - RNA, 19 nt, Human
ccccgccacccccccauag

SEQ ID NO: 485461 - RNA, 27 nt, Human
ccccgccacccccccauaggaauccca

SEQ ID NO: 485462 - RNA, 20 nt, Human
ccccuggccaacccagcucc

SEQ ID NO: 485463 - RNA, 19 nt, Human
ccccuuucaggccagggag

SEQ ID NO: 485464 - RNA, 21 nt, Human
cccgccacccccccauaggaa

SEQ ID NO: 485465 - RNA, 21 nt, Human
cccuuugccugccugcccucc

SEQ ID NO: 485466 - RNA, 20 nt, Human
ccuaaggcuggggcuguggc

SEQ ID NO: 485467 - RNA, 21 nt, Human
ccuacccccggcuuucuggga

SEQ ID NO: 485468 - RNA, 20 nt, Human
ccucaaggcggugugccugg

SEQ ID NO: 485469 - RNA, 18 nt, Human
ccuccaggaccuccuggc

SEQ ID NO: 485470 - RNA, 22 nt, Human
ccuccugccuaggcaucugcag

SEQ ID NO: 485471 - RNA, 18 nt, Human
ccugcagcuuggguuagc

SEQ ID NO: 485472 - RNA, 22 nt, Human
ccugcauacaguaggcacucac

SEQ ID NO: 485473 - RNA, 20 nt, Human
ccugccccccaugcuggggc

SEQ ID NO: 485474 - RNA, 23 nt, Human
ccuggccuaaggcuggggcugug

SEQ ID NO: 485475 - RNA, 18 nt, Human
ccuggcucaggggcucga

SEQ ID NO: 485476 - RNA, 21 nt, Human
ccugggccccagucccugccg

SEQ ID NO: 485477 - RNA, 21 nt, Human
ccugguacugggcagcugcuc

SEQ ID NO: 485478 - RNA, 20 nt, Human
ccuugggcgggcccaccggc

SEQ ID NO: 485479 - RNA, 23 nt, Human
cgaauccagaauggagcccaaac

SEQ ID NO: 485480 - RNA, 21 nt, Human
cgccuugggcaagugcauggg

SEQ ID NO: 485481 - RNA, 19 nt, Human
cggcacagacccaccccuc

SEQ ID NO: 485482 - RNA, 18 nt, Human
cggguguggagaucuggg

SEQ ID NO: 485483 - RNA, 24 nt, Human
cuagggcuuuccagaaaccaccca

SEQ ID NO: 485484 - RNA, 21 nt, Human
cucaaaccagagacaccagac

SEQ ID NO: 485485 - RNA, 23 nt, Human
cucacccucggucccauccacuc

SEQ ID NO: 485486 - RNA, 19 nt, Human
cucccccgccaccccccca

SEQ ID NO: 485487 - RNA, 19 nt, Human
cuccuggaguucuagcccc

SEQ ID NO: 485488 - RNA, 21 nt, Human
cuggcccaacuucugaugccc

SEQ ID NO: 485489 - RNA, 22 nt, Human
cuggcccaacuucugaugcccu

SEQ ID NO: 485490 - RNA, 22 nt, Human
cugggccaggaggggaggccug

SEQ ID NO: 485491 - RNA, 20 nt, Human
cuggggcagggcauaggggg

SEQ ID NO: 485492 - RNA, 18 nt, Human
gaacaaacguacaagaca

SEQ ID NO: 485493 - RNA, 22 nt, Human
gaacaaacguacaagacagagu

SEQ ID NO: 485494 - RNA, 20 nt, Human
gagcccaaacccacaccccc

SEQ ID NO: 485495 - RNA, 20 nt, Human
gauucuucagcauccucccc

SEQ ID NO: 485496 - RNA, 21 nt, Human
gcaaaguuuagccagcuggga

SEQ ID NO: 485497 - RNA, 21 nt, Human
gcacaggagagcaggaagcaa

SEQ ID NO: 485498 - RNA, 21 nt, Human
gcagcagaacaaacguacaag

SEQ ID NO: 485499 - RNA, 24 nt, Human
gcagccucccauucuuaggaccaa

SEQ ID NO: 485500 - RNA, 19 nt, Human
gcagguucucguagcaccu

SEQ ID NO: 485501 - RNA, 19 nt, Human
gccccaguaccagcaaccu

SEQ ID NO: 485502 - RNA, 22 nt, Human
gccccagucccugccgcauucc

SEQ ID NO: 485503 - RNA, 21 nt, Human
gcgcuaggguucugaucggcc

SEQ ID NO: 485504 - RNA, 18 nt, Human
ggaagaccccgcccuggc

SEQ ID NO: 485505 - RNA, 23 nt, Human
ggaagaccccgcccuggcccaac

SEQ ID NO: 485506 - RNA, 19 nt, Human
ggacgaggggcccauggag

SEQ ID NO: 485507 - RNA, 25 nt, Human
ggacuugaucaucaccucuucccag

SEQ ID NO: 485508 - RNA, 21 nt, Human
ggagacccgggaaguggccca

SEQ ID NO: 485509 - RNA, 18 nt, Human
ggagagagggcugggggc

SEQ ID NO: 485510 - RNA, 20 nt, Human
ggaggggaggccuggugacu

SEQ ID NO: 485511 - RNA, 20 nt, Human
ggcaagaaaccaaacugccc

SEQ ID NO: 485512 - RNA, 21 nt, Human
ggcacgggugccucagcuccc

SEQ ID NO: 485513 - RNA, 19 nt, Human
ggcaggguagggaggggcc

SEQ ID NO: 485514 - RNA, 18 nt, Human
ggccuaaggcuggggcug

SEQ ID NO: 485515 - RNA, 18 nt, Human
ggccugggagggggcauc

SEQ ID NO: 485516 - RNA, 18 nt, Human
ggcugggggcaagggugg

SEQ ID NO: 485517 - RNA, 19 nt, Human
gggaaguggcccagggcug

SEQ ID NO: 485518 - RNA, 22 nt, Human
gggagaugacggaugccccaac

SEQ ID NO: 485519 - RNA, 24 nt, Human
gggaggcuguggccaggcgcaccc

SEQ ID NO: 485520 - RNA, 19 nt, Human
gggaggggagggcuagggc

SEQ ID NO: 485521 - RNA, 24 nt, Human
gggaggggcaggguggacuggggg

SEQ ID NO: 485522 - RNA, 19 nt, Human
gggaggucucccccauagg

SEQ ID NO: 485523 - RNA, 23 nt, Human
gggcagccggaacgcuucgcucc

SEQ ID NO: 485524 - RNA, 18 nt, Human
gggcaggguagggagggg

SEQ ID NO: 485525 - RNA, 18 nt, Human
gggccccagucccugccg

SEQ ID NO: 485526 - RNA, 18 nt, Human
gggcccccccaagccccc

SEQ ID NO: 485527 - RNA, 21 nt, Human
gggcugggggcaagggugggg

SEQ ID NO: 485528 - RNA, 18 nt, Human
ggggaggggagggcuagg

SEQ ID NO: 485529 - RNA, 20 nt, Human
ggggguuaggaaagagccag

SEQ ID NO: 485530 - RNA, 18 nt, Human
ggucagagugggcaccca

SEQ ID NO: 485531 - RNA, 19 nt, Human
ggugggauguggaaggggc

SEQ ID NO: 485532 - RNA, 18 nt, Human
guccaggccuucaaugcc

SEQ ID NO: 485533 - RNA, 18 nt, Human
guccgacagguugggcug

SEQ ID NO: 485534 - RNA, 24 nt, Human
gucucaaaccagagacaccagacc

SEQ ID NO: 485535 - RNA, 19 nt, Human
gugagaacaaagagggguu

SEQ ID NO: 485536 - RNA, 24 nt, Human
uaaaaccaacaaaaagaagucucc

SEQ ID NO: 485537 - RNA, 23 nt, Human
uaaaggucagagugggcacccag

SEQ ID NO: 485538 - RNA, 18 nt, Human
uaaauagcucuuucuccc

SEQ ID NO: 485539 - RNA, 20 nt, Human
uaccaugcaugggcaggggg

SEQ ID NO: 485540 - RNA, 19 nt, Human
uacuuggguggggaggggg

SEQ ID NO: 485541 - RNA, 26 nt, Human
uagcucuuucucccccgccacccccc

SEQ ID NO: 485542 - RNA, 20 nt, Human
uaggaggagauugggcuuug

SEQ ID NO: 485543 - RNA, 21 nt, Human
uauauguauauuuuauauaua

SEQ ID NO: 485544 - RNA, 24 nt, Human
ucaccagcccccuggagaaaauca

SEQ ID NO: 485545 - RNA, 18 nt, Human
ucacucaccugggggagg

SEQ ID NO: 485546 - RNA, 23 nt, Human
ucagaagcaaaagaggggcuggg

SEQ ID NO: 485547 - RNA, 23 nt, Human
uccaaaaccauuuucaccucuuc

SEQ ID NO: 485548 - RNA, 18 nt, Human
uccacagcaaaccuccag

SEQ ID NO: 485549 - RNA, 19 nt, Human
uccacagcaaaccuccaga

SEQ ID NO: 485550 - RNA, 21 nt, Human
uccacuguccugugugggcga

SEQ ID NO: 485551 - RNA, 19 nt, Human
uccaggccuucaaugcccc

SEQ ID NO: 485552 - RNA, 23 nt, Human
uccagggccugggcccugccuuu

SEQ ID NO: 485553 - RNA, 18 nt, Human
ucccaaaccucagcuugc

SEQ ID NO: 485554 - RNA, 22 nt, Human
uccccauaggccaaagcauccu

SEQ ID NO: 485555 - RNA, 21 nt, Human
uccccccaacucuguccaccu

SEQ ID NO: 485556 - RNA, 22 nt, Human
uccccccaacucuguccaccuc

SEQ ID NO: 485557 - RNA, 20 nt, Human
ucccggggaggggagggcua

SEQ ID NO: 485558 - RNA, 20 nt, Human
ucccuuugagcaagcacggg

SEQ ID NO: 485559 - RNA, 23 nt, Human
uccgacagguugggcugaccacc

SEQ ID NO: 485560 - RNA, 24 nt, Human
uccuaagggccccacagcugccag

SEQ ID NO: 485561 - RNA, 18 nt, Human
uccuccaaagauugcagg

SEQ ID NO: 485562 - RNA, 22 nt, Human
uccuccaggaccuccuggcuca

SEQ ID NO: 485563 - RNA, 21 nt, Human
uccuuugcuucaggcaggcug

SEQ ID NO: 485564 - RNA, 23 nt, Human
uccuuugcuucaggcaggcuggg

SEQ ID NO: 485565 - RNA, 25 nt, Human
ucuccccagccacccccaggggccc

SEQ ID NO: 485566 - RNA, 30 nt, Human
ucucccccgccacccccccauaggaauccu

SEQ ID NO: 485567 - RNA, 21 nt, Human
ucuggaaacaccuguaacugg

SEQ ID NO: 485568 - RNA, 20 nt, Human
ucuugccuccugaagccugc

SEQ ID NO: 485569 - RNA, 23 nt, Human
ugaagagcagcagaacaaacgua

SEQ ID NO: 485570 - RNA, 19 nt, Human
ugaagguccgacagguugg

SEQ ID NO: 485571 - RNA, 25 nt, Human
ugacaacccccacccucccaaaccu

SEQ ID NO: 485572 - RNA, 24 nt, Human
ugacaccagcagcgcuuucugaag

SEQ ID NO: 485573 - RNA, 20 nt, Human
ugacuuccacagcaaaccuc

SEQ ID NO: 485574 - RNA, 18 nt, Human
ugagaacaaagagggguu

SEQ ID NO: 485575 - RNA, 19 nt, Human
ugagcaagcacgggugugg

SEQ ID NO: 485576 - RNA, 21 nt, Human
ugaggagggcagggggguggg

SEQ ID NO: 485577 - RNA, 24 nt, Human
ugagucggggagacccucuccugg

SEQ ID NO: 485578 - RNA, 19 nt, Human
ugauacaauauugaagagc

SEQ ID NO: 485579 - RNA, 18 nt, Human
ugcaaaaaaaaaaaaaaa

SEQ ID NO: 485580 - RNA, 21 nt, Human
ugccaaacaggcaggaagccc

SEQ ID NO: 485581 - RNA, 18 nt, Human
ugccaacgugcuucugag

SEQ ID NO: 485582 - RNA, 19 nt, Human
ugcccuggcugauguggag

SEQ ID NO: 485583 - RNA, 20 nt, Human
ugccucagcucccaggcagc

SEQ ID NO: 485584 - RNA, 24 nt, Human
uggaaacaccuguaacuggcaccc

SEQ ID NO: 485585 - RNA, 20 nt, Human
uggaaagcagcaagggugga

SEQ ID NO: 485586 - RNA, 20 nt, Human
uggaauggggucucccucuc

SEQ ID NO: 485587 - RNA, 21 nt, Human
uggagcccaaacccacacccc

SEQ ID NO: 485588 - RNA, 26 nt, Human
uggagcccaaacccacaccccgaggg

SEQ ID NO: 485589 - RNA, 18 nt, Human
uggagcucaggccagcag

SEQ ID NO: 485590 - RNA, 19 nt, Human
uggauucuucagcauccuc

SEQ ID NO: 485591 - RNA, 21 nt, Human
uggcccagggcuggccagcgg

SEQ ID NO: 485592 - RNA, 20 nt, Human
uggcuccagggccugggccc

SEQ ID NO: 485593 - RNA, 21 nt, Human
uggcucuccuccaggaccucc

SEQ ID NO: 485594 - RNA, 25 nt, Human
ugggaaaggaacagaagggggcaag

SEQ ID NO: 485595 - RNA, 19 nt, Human
ugggaccccaacuacccag

SEQ ID NO: 485596 - RNA, 24 nt, Human
ugggaccccaacuacccagccccc

SEQ ID NO: 485597 - RNA, 24 nt, Human
ugggagcaagaguaugacuucggg

SEQ ID NO: 485598 - RNA, 19 nt, Human
ugggagggggcaucuuugg

SEQ ID NO: 485599 - RNA, 20 nt, Human
ugggagggggcaucuuuggc

SEQ ID NO: 485600 - RNA, 19 nt, Human
ugggcagggggugugcccu

SEQ ID NO: 485601 - RNA, 20 nt, Human
ugggcgggcccaccggccug

SEQ ID NO: 485602 - RNA, 19 nt, Human
uggggaccagauggcccaa

SEQ ID NO: 485603 - RNA, 24 nt, Human
ugggggcaaggguggggugggagc

SEQ ID NO: 485604 - RNA, 20 nt, Human
ugggggccccaguaccagca

SEQ ID NO: 485605 - RNA, 24 nt, Human
uggggucucccucucuaucucggu

SEQ ID NO: 485606 - RNA, 18 nt, Human
uggggugggagcaagagu

SEQ ID NO: 485607 - RNA, 18 nt, Human
uggguuagcucccggggg

SEQ ID NO: 485608 - RNA, 19 nt, Human
ugguagcaguccagccccc

SEQ ID NO: 485609 - RNA, 24 nt, Human
uggucagaagcaaaagaggggcug

SEQ ID NO: 485610 - RNA, 25 nt, Human
uuaaaaccaacaaaaagaagucucc

SEQ ID NO: 485611 - RNA, 31 nt, Human
uuaaaaccaacaaaaagaagucucccucucc

SEQ ID NO: 485612 - RNA, 24 nt, Human
uucacuuuccugucauaaaaucac

SEQ ID NO: 485613 - RNA, 24 nt, Human
uuccccugccccauuccagggugg

SEQ ID NO: 485614 - RNA, 22 nt, Human
uugccugccugcccucccaggg

SEQ ID NO: 485615 - RNA, 26 nt, Human
uugugggcuuuagggugacccguggg

SEQ ID NO: 485616 - RNA, 23 nt, Human
uuugccuggcugacuaccugcau

SEQ ID NO: 485617 - RNA, 24 nt, Human
uuuuaaauuaaaaccaacaaaaag

SEQ ID NO: 485618 - RNA, 24 nt, Human
aaaauauaacucuagagauaaucu

SEQ ID NO: 485619 - RNA, 22 nt, Human
aaucuuuccaacaaaaacugag

SEQ ID NO: 485620 - RNA, 22 nt, Human
acgacagaccauaauacucucc

SEQ ID NO: 485621 - RNA, 20 nt, Human
acgcucacucucuccccugg

SEQ ID NO: 485622 - RNA, 19 nt, Human
agccaaaaggccacauccc

SEQ ID NO: 485623 - RNA, 19 nt, Human
aggaaggagggaugaaagg

SEQ ID NO: 485624 - RNA, 22 nt, Human
aggaaggagggaugaaaggggc

SEQ ID NO: 485625 - RNA, 20 nt, Human
aggggcuggugggguggggg

SEQ ID NO: 485626 - RNA, 18 nt, Human
agggggaggaaggaggga

SEQ ID NO: 485627 - RNA, 23 nt, Human
aucuuuccaacaaaaacugaggg

SEQ ID NO: 485628 - RNA, 21 nt, Human
augaaaggggcugguggggug

SEQ ID NO: 485629 - RNA, 19 nt, Human
cacgcucacucucuccccu

SEQ ID NO: 485630 - RNA, 27 nt, Human
cagcgcacgacagaccauaauacucuc

SEQ ID NO: 485631 - RNA, 26 nt, Human
ccacaucccacccagaaauaaaaauc

SEQ ID NO: 485632 - RNA, 21 nt, Human
ccagccaaaaggccacauccc

SEQ ID NO: 485633 - RNA, 18 nt, Human
ccccuaggccgcuuccag

SEQ ID NO: 485634 - RNA, 18 nt, Human
ccuaggccgcuuccagga

SEQ ID NO: 485635 - RNA, 20 nt, Human
ccuaggccgcuuccaggagc

SEQ ID NO: 485636 - RNA, 21 nt, Human
cgaguuuuuuuuuuuuuuuuu

SEQ ID NO: 485637 - RNA, 20 nt, Human
cuagagauaaucuuuccaac

SEQ ID NO: 485638 - RNA, 22 nt, Human
cuccccugcucuccuccuggac

SEQ ID NO: 485639 - RNA, 21 nt, Human
cuccuccuggacacacccacc

SEQ ID NO: 485640 - RNA, 23 nt, Human
cucgaguuuuuuuuuuuuuuuuu

SEQ ID NO: 485641 - RNA, 22 nt, Human
cucuagagauaaucuuuccaac

SEQ ID NO: 485642 - RNA, 24 nt, Human
gaccagccaaaaggccacauccca

SEQ ID NO: 485643 - RNA, 19 nt, Human
gaggaaggagggaugaaag

SEQ ID NO: 485644 - RNA, 20 nt, Human
gaguuuuuuuuuuuuuuuuu

SEQ ID NO: 485645 - RNA, 24 nt, Human
ggagcagaaaagcagcagccagcg

SEQ ID NO: 485646 - RNA, 19 nt, Human
ggagggaugaaaggggcug

SEQ ID NO: 485647 - RNA, 25 nt, Human
ggggaggaaggagggaugaaagggg

SEQ ID NO: 485648 - RNA, 24 nt, Human
guuuuuuuuuuuuuuuuucgaguu

SEQ ID NO: 485649 - RNA, 20 nt, Human
ucccacccagaaauaaaaau

SEQ ID NO: 485650 - RNA, 18 nt, Human
uccccugcucuccuccug

SEQ ID NO: 485651 - RNA, 25 nt, Human
ucuuuccaacaaaaacugaggggga

SEQ ID NO: 485652 - RNA, 18 nt, Human
ugaaaggggcuggugggg

SEQ ID NO: 485653 - RNA, 23 nt, Human
ugagggggaggaaggagggauga

SEQ ID NO: 485654 - RNA, 18 nt, Human
uggacacacccacccagc

SEQ ID NO: 485655 - RNA, 22 nt, Human
ugguggggugggggugacauca

SEQ ID NO: 485656 - RNA, 18 nt, Human
uuuuuuuuuuuuuuuucg

SEQ ID NO: 485657 - RNA, 19 nt, Human
agcagacuuucucaggccu

SEQ ID NO: 485658 - RNA, 19 nt, Human
agguacuggagagcagacu

SEQ ID NO: 485659 - RNA, 23 nt, Human
auugaugguuguuugcagagcgg

SEQ ID NO: 485660 - RNA, 23 nt, Human
cagcagcagguacuggagagcag

SEQ ID NO: 485661 - RNA, 19 nt, Human
gacuuucucaggccugugg

SEQ ID NO: 485662 - RNA, 19 nt, Human
gagcagacuuucucaggcc

SEQ ID NO: 485663 - RNA, 21 nt, Human
uacuggagagcagacuuucuc

SEQ ID NO: 485664 - RNA, 22 nt, Human
ugaaacagaucagcagcaggua

SEQ ID NO: 485665 - RNA, 19 nt, Human
ugcagagcgguugaccagg

SEQ ID NO: 485666 - RNA, 23 nt, Human
uuuacuuauucucccacuuaaaa

SEQ ID NO: 485667 - RNA, 28 nt, Human
aaccacuuaaaauuagccaaauaucuaa

SEQ ID NO: 485668 - RNA, 18 nt, Human
cacucgcaccgacccggc

SEQ ID NO: 485669 - RNA, 21 nt, Human
cacucugcccagccgaccacu

SEQ ID NO: 485670 - RNA, 19 nt, Human
cacugcucccgggagugga

SEQ ID NO: 485671 - RNA, 18 nt, Human
cagcuggcaucauuaaua

SEQ ID NO: 485672 - RNA, 22 nt, Human
ccgacccggccaaagaauaggc

SEQ ID NO: 485673 - RNA, 24 nt, Human
ccggccaaagaauaggcuggcugc

SEQ ID NO: 485674 - RNA, 19 nt, Human
cgacccggccaaagaauag

SEQ ID NO: 485675 - RNA, 21 nt, Human
cucugcccagccgaccacucg

SEQ ID NO: 485676 - RNA, 22 nt, Human
cugcccagccgaccacucgcac

SEQ ID NO: 485677 - RNA, 22 nt, Human
gccgaccacucgcaccgacccg

SEQ ID NO: 485678 - RNA, 20 nt, Human
gggaucagccugcggcgcca

SEQ ID NO: 485679 - RNA, 24 nt, Human
uaaaaccuaaguuaaaaacuguac

SEQ ID NO: 485680 - RNA, 21 nt, Human
uaaguuaaaaacuguacacca

SEQ ID NO: 485681 - RNA, 20 nt, Human
ucuaagacagauacauauac

SEQ ID NO: 485682 - RNA, 19 nt, Human
ugagugauuuacaucuuag

SEQ ID NO: 485683 - RNA, 21 nt, Human
ugcacucugcccagccgacca

SEQ ID NO: 485684 - RNA, 19 nt, Human
uuuuuuaaguuuuccaaau

SEQ ID NO: 485685 - RNA, 19 nt, Human
aaaaagggcacaaugaagc

SEQ ID NO: 485686 - RNA, 19 nt, Human
aagcacacauccccagggc

SEQ ID NO: 485687 - RNA, 23 nt, Human
acaaaaucaagaguucuaaacca

SEQ ID NO: 485688 - RNA, 25 nt, Human
agcgcuggggaucuucgacgcuguu

SEQ ID NO: 485689 - RNA, 21 nt, Human
ccgagcccgcagcgcugggga

SEQ ID NO: 485690 - RNA, 20 nt, Human
cggcccagggagggacgcgg

SEQ ID NO: 485691 - RNA, 22 nt, Human
cggggaaggcaagagugccagc

SEQ ID NO: 485692 - RNA, 20 nt, Human
gaagcacacauccccagggc

SEQ ID NO: 485693 - RNA, 22 nt, Human
gaagcacacauccccagggccc

SEQ ID NO: 485694 - RNA, 22 nt, Human
ggggaucuucgacgcuguagcc

SEQ ID NO: 485695 - RNA, 20 nt, Human
uaccuuaagaaaaaccaauc

SEQ ID NO: 485696 - RNA, 18 nt, Human
ucuaaaccaauaagaaaa

SEQ ID NO: 485697 - RNA, 18 nt, Human
ugaagcacacauccccag

SEQ ID NO: 485698 - RNA, 18 nt, Human
ugaagcacacauccccag

SEQ ID NO: 485699 - RNA, 19 nt, Human
ugaagcacacauccccagg

SEQ ID NO: 485700 - RNA, 22 nt, Human
uucuaaaccaauaagaaaaagg

SEQ ID NO: 485701 - RNA, 25 nt, Human
uuuuuuuuuuuuuuuuuuaccuuaa

SEQ ID NO: 485702 - RNA, 21 nt, Human
aacauagaauaaauauacccu

SEQ ID NO: 485703 - RNA, 25 nt, Human
aaccaguccacaagaauggcccuca

SEQ ID NO: 485704 - RNA, 25 nt, Human
aagaaacuguaauccaguuccagac

SEQ ID NO: 485705 - RNA, 21 nt, Human
acaccugcaccuccaccaacc

SEQ ID NO: 485706 - RNA, 24 nt, Human
accugcaccuccaccaaccagucc

SEQ ID NO: 485707 - RNA, 22 nt, Human
agacaaauucgaacauagaaua

SEQ ID NO: 485708 - RNA, 22 nt, Human
agacaaauucgaacauagaaua

SEQ ID NO: 485709 - RNA, 20 nt, Human
agagauccaccagcuucacu

SEQ ID NO: 485710 - RNA, 22 nt, Human
agcgggacaaggucagugucuu

SEQ ID NO: 485711 - RNA, 23 nt, Human
aggaguaaggaggcagcagcuag

SEQ ID NO: 485712 - RNA, 22 nt, Human
aguaccaggcccugagccucac

SEQ ID NO: 485713 - RNA, 22 nt, Human
aucgcugauaauuaucaucaca

SEQ ID NO: 485714 - RNA, 18 nt, Human
caaaaucuccuccagcuu

SEQ ID NO: 485715 - RNA, 21 nt, Human
caccuccaccaaccaguccac

SEQ ID NO: 485716 - RNA, 24 nt, Human
caccugcaccuccaccaaccaguc

SEQ ID NO: 485717 - RNA, 22 nt, Human
cacgaggugaguugugcuccuc

SEQ ID NO: 485718 - RNA, 22 nt, Human
caggauguugauuuccaugcug

SEQ ID NO: 485719 - RNA, 18 nt, Human
ccaccaaccaguccacaa

SEQ ID NO: 485720 - RNA, 19 nt, Human
ccaguccacaagaauggcc

SEQ ID NO: 485721 - RNA, 24 nt, Human
ccuccagcuucaacauauccaagg

SEQ ID NO: 485722 - RNA, 23 nt, Human
cgaacauagaauaaauauacccu

SEQ ID NO: 485723 - RNA, 19 nt, Human
cgcagaaaaugguaggcga

SEQ ID NO: 485724 - RNA, 22 nt, Human
cgcagaaaaugguaggcgaugg

SEQ ID NO: 485725 - RNA, 23 nt, Human
cgucuuguccaaggcagggauug

SEQ ID NO: 485726 - RNA, 19 nt, Human
cucaaaggacaccugcacc

SEQ ID NO: 485727 - RNA, 22 nt, Human
cugcaccuccaccaaccagucc

SEQ ID NO: 485728 - RNA, 19 nt, Human
gaagcucagagauacugua

SEQ ID NO: 485729 - RNA, 24 nt, Human
gauguacacaaagucauccacacg

SEQ ID NO: 485730 - RNA, 21 nt, Human
gcccuguggcugcugcuagag

SEQ ID NO: 485731 - RNA, 22 nt, Human
ggaaaagacaaagaaaggaaaa

SEQ ID NO: 485732 - RNA, 24 nt, Human
guugugcuccucaaauuuugcugc

SEQ ID NO: 485733 - RNA, 22 nt, Human
uaaaggcaguggcaccaaggag

SEQ ID NO: 485734 - RNA, 23 nt, Human
uaaguauaaacuguuccucucuc

SEQ ID NO: 485735 - RNA, 22 nt, Human
uaccaggcccugagccucacaa

SEQ ID NO: 485736 - RNA, 19 nt, Human
uagcuuggaagccuucucc

SEQ ID NO: 485737 - RNA, 23 nt, Human
ucaaaagacaaauucgaacauag

SEQ ID NO: 485738 - RNA, 23 nt, Human
ucaaaagacaaauucgaacauag

SEQ ID NO: 485739 - RNA, 22 nt, Human
ucaaaaucuccuccagcuucaa

SEQ ID NO: 485740 - RNA, 24 nt, Human
ucaaagaagaccgggugagaauac

SEQ ID NO: 485741 - RNA, 22 nt, Human
ucaaucagaagaaacuguaauc

SEQ ID NO: 485742 - RNA, 22 nt, Human
ucagcugucugaccaaggggug

SEQ ID NO: 485743 - RNA, 22 nt, Human
uccaccaaccaguccacaagaa

SEQ ID NO: 485744 - RNA, 20 nt, Human
uccaugcugaguaccucaga

SEQ ID NO: 485745 - RNA, 19 nt, Human
ucuuguccaaggcagggau

SEQ ID NO: 485746 - RNA, 26 nt, Human
ugagccucacaaucacaggacccguc

SEQ ID NO: 485747 - RNA, 21 nt, Human
ugagccucacaaucacaguuc

SEQ ID NO: 485748 - RNA, 22 nt, Human
ugauuuccaugcugaguaccuc

SEQ ID NO: 485749 - RNA, 21 nt, Human
ugcaccuccaccaaccagucc

SEQ ID NO: 485750 - RNA, 22 nt, Human
ugcuuagcccuguggcugcugc

SEQ ID NO: 485751 - RNA, 24 nt, Human
uggcugcugcuagaguaccaggcc

SEQ ID NO: 485752 - RNA, 22 nt, Human
ugggaaaagacaaagaaaggaa

SEQ ID NO: 485753 - RNA, 22 nt, Human
ugggaaaagacaaagaaaggaa

SEQ ID NO: 485754 - RNA, 21 nt, Human
uguaauccaguuccagacacc

SEQ ID NO: 485755 - RNA, 22 nt, Human
uguaauccaguuccagacaccu

SEQ ID NO: 485756 - RNA, 25 nt, Human
uguacacaaagucauccacacgagg

SEQ ID NO: 485757 - RNA, 19 nt, Human
ugugcuccucaaauuuugc

SEQ ID NO: 485758 - RNA, 18 nt, Human
uguuccucucucucuuuc

SEQ ID NO: 485759 - RNA, 22 nt, Human
uucaaagaagaccgggugagaa

SEQ ID NO: 485760 - RNA, 24 nt, Human
uucaaucagaagaaacuguaaucc

SEQ ID NO: 485761 - RNA, 26 nt, Human
uucagcugcgucuuguccguccaccg

SEQ ID NO: 485762 - RNA, 25 nt, Human
uucagcugcgucuuguccguccacg

SEQ ID NO: 485763 - RNA, 24 nt, Human
uuggaagccuucuccuggacauag

SEQ ID NO: 485764 - RNA, 18 nt, Human
uuggcgacuucaaagaag

SEQ ID NO: 485765 - RNA, 25 nt, Human
aaacgcacgccuccgcugcaacaga

SEQ ID NO: 485766 - RNA, 24 nt, Human
aacagacagaagagaacguggagc

SEQ ID NO: 485767 - RNA, 24 nt, Human
aaccuauaagcauucaauaaaaaa

SEQ ID NO: 485768 - RNA, 22 nt, Human
aacgcuugcccgcaaccaccug

SEQ ID NO: 485769 - RNA, 18 nt, Human
aagcaaacgcacgccucc

SEQ ID NO: 485770 - RNA, 24 nt, Human
acaacgcuugcccgcaaccaccug

SEQ ID NO: 485771 - RNA, 23 nt, Human
acccacuuauuuaaaaaaaaccu

SEQ ID NO: 485772 - RNA, 24 nt, Human
acggcaguggcggcggcggcgccu

SEQ ID NO: 485773 - RNA, 18 nt, Human
agacagaagagaacgugg

SEQ ID NO: 485774 - RNA, 20 nt, Human
agagggcagcccccugccca

SEQ ID NO: 485775 - RNA, 22 nt, Human
agagggcagcccccugcccagc

SEQ ID NO: 485776 - RNA, 27 nt, Human
aggcggcggcggcgacggcaguggcgg

SEQ ID NO: 485777 - RNA, 24 nt, Human
aguggcggcggcggcgccgggagu

SEQ ID NO: 485778 - RNA, 22 nt, Human
auaaaaaacacuuugcccuguu

SEQ ID NO: 485779 - RNA, 21 nt, Human
auggggcugcuccggccugag

SEQ ID NO: 485780 - RNA, 22 nt, Human
auucaauaaaaaacacuuugcc

SEQ ID NO: 485781 - RNA, 20 nt, Human
caaccaccugcuccacuugg

SEQ ID NO: 485782 - RNA, 21 nt, Human
caaccaccugcuccacuuggu

SEQ ID NO: 485783 - RNA, 18 nt, Human
cagaacaccugcgaggag

SEQ ID NO: 485784 - RNA, 25 nt, Human
ccagaacaccugcgaggagagccac

SEQ ID NO: 485785 - RNA, 18 nt, Human
cccagaacaccugcgagg

SEQ ID NO: 485786 - RNA, 24 nt, Human
cccccugcccagcuggcuaugggc

SEQ ID NO: 485787 - RNA, 22 nt, Human
cccuacaccgcgcuggcggccg

SEQ ID NO: 485788 - RNA, 22 nt, Human
cccugcccagcuggcuaugggg

SEQ ID NO: 485789 - RNA, 20 nt, Human
cccuguuugaugccauccac

SEQ ID NO: 485790 - RNA, 20 nt, Human
ccgcgccugcccccuacacc

SEQ ID NO: 485791 - RNA, 24 nt, Human
ccgcgccugcccccuacaccgcgc

SEQ ID NO: 485792 - RNA, 21 nt, Human
ccgcuccuucgcaucccugug

SEQ ID NO: 485793 - RNA, 21 nt, Human
ccggcaggcggcggcggcgac

SEQ ID NO: 485794 - RNA, 19 nt, Human
ccuccacagcuucaagcuu

SEQ ID NO: 485795 - RNA, 22 nt, Human
ccuccgcugcaacagacagaag

SEQ ID NO: 485796 - RNA, 24 nt, Human
cgacggcaguggcggcggcggcgc

SEQ ID NO: 485797 - RNA, 24 nt, Human
cgaggagagccacgccaccguggc

SEQ ID NO: 485798 - RNA, 27 nt, Human
cgcaaccaccugcuccacuugguacaa

SEQ ID NO: 485799 - RNA, 21 nt, Human
cuccacuugguacaacggagc

SEQ ID NO: 485800 - RNA, 22 nt, Human
cuccuucgcaucccuguggacc

SEQ ID NO: 485801 - RNA, 19 nt, Human
gagcccagaacaccugcga

SEQ ID NO: 485802 - RNA, 23 nt, Human
gcaggcggcggcggcgacggcag

SEQ ID NO: 485803 - RNA, 21 nt, Human
gcccuguuugaugccauccac

SEQ ID NO: 485804 - RNA, 22 nt, Human
gccugaggccagggucuugucc

SEQ ID NO: 485805 - RNA, 26 nt, Human
gcggcgacggcaguggcggcggcggc

SEQ ID NO: 485806 - RNA, 19 nt, Human
gcggcggcggcgacggcag

SEQ ID NO: 485807 - RNA, 21 nt, Human
ggcaguggcggcggcggcgcc

SEQ ID NO: 485808 - RNA, 18 nt, Human
gggcagcccccugcccag

SEQ ID NO: 485809 - RNA, 18 nt, Human
guggcggcggcggcgccg

SEQ ID NO: 485810 - RNA, 19 nt, Human
uaaaaaaaaccuauaagca

SEQ ID NO: 485811 - RNA, 19 nt, Human
uaaaagcaaacgcacgccu

SEQ ID NO: 485812 - RNA, 19 nt, Human
uacaaaacaguucaucaaa

SEQ ID NO: 485813 - RNA, 20 nt, Human
uacaaaacaguucaucaaag

SEQ ID NO: 485814 - RNA, 21 nt, Human
uacaacggagcccagaacacc

SEQ ID NO: 485815 - RNA, 21 nt, Human
uagcagcacuuacaaaacagu

SEQ ID NO: 485816 - RNA, 19 nt, Human
uauagcagcacuuacaaaa

SEQ ID NO: 485817 - RNA, 21 nt, Human
uaucuuuauuaaaaaauggau

SEQ ID NO: 485818 - RNA, 20 nt, Human
uccacuugguacaacggagc

SEQ ID NO: 485819 - RNA, 23 nt, Human
ugcuccacuugguacaacggagc

SEQ ID NO: 485820 - RNA, 20 nt, Human
uggaagaaacacucuuccau

SEQ ID NO: 485821 - RNA, 21 nt, Human
uggagcaggcgcgcaacuguc

SEQ ID NO: 485822 - RNA, 18 nt, Human
uggcggcggcggcgccgg

SEQ ID NO: 485823 - RNA, 19 nt, Human
uggcggcggcggcgccggg

SEQ ID NO: 485824 - RNA, 19 nt, Human
uggugucuggagguggcug

SEQ ID NO: 485825 - RNA, 18 nt, Human
ugucccgcuccuucgcaa

SEQ ID NO: 485826 - RNA, 21 nt, Human
aaaaaaaaaauuccuuaggga

SEQ ID NO: 485827 - RNA, 22 nt, Human
aaacaaacuauacagaagacuu

SEQ ID NO: 485828 - RNA, 21 nt, Human
aaacauugcuaugguauagac

SEQ ID NO: 485829 - RNA, 18 nt, Human
aaacuaaaccuuuguaaa

SEQ ID NO: 485830 - RNA, 18 nt, Human
aacacuggauuaaaggaa

SEQ ID NO: 485831 - RNA, 24 nt, Human
aagaaaauagaaguuuaggucaag

SEQ ID NO: 485832 - RNA, 23 nt, Human
aagauaaacacaguaacacugga

SEQ ID NO: 485833 - RNA, 24 nt, Human
aagcaaccuacaugucaagaaagc

SEQ ID NO: 485834 - RNA, 22 nt, Human
aaggaaaaacauugcuauggua

SEQ ID NO: 485835 - RNA, 19 nt, Human
aaucuaguuuucuaaucua

SEQ ID NO: 485836 - RNA, 22 nt, Human
aaucuuggugaauuccaacuug

SEQ ID NO: 485837 - RNA, 19 nt, Human
aaugaagacaucuuuguaa

SEQ ID NO: 485838 - RNA, 23 nt, Human
aauuucuuugguacucccacugu

SEQ ID NO: 485839 - RNA, 23 nt, Human
acaauggaggaauuuagaaagga

SEQ ID NO: 485840 - RNA, 21 nt, Human
accagcuaccgcucggcucag

SEQ ID NO: 485841 - RNA, 21 nt, Human
accuacaugucaagaaagccc

SEQ ID NO: 485842 - RNA, 23 nt, Human
acuagcaaucuaguuuucuaauc

SEQ ID NO: 485843 - RNA, 21 nt, Human
acuuauccaguccaaaacucc

SEQ ID NO: 485844 - RNA, 21 nt, Human
agagcacagguugaacaccau

SEQ ID NO: 485845 - RNA, 21 nt, Human
aggaaaaacauugcuauggua

SEQ ID NO: 485846 - RNA, 21 nt, Human
aggaaggagccacagcauuua

SEQ ID NO: 485847 - RNA, 19 nt, Human
aguaaccuugggaaugaag

SEQ ID NO: 485848 - RNA, 19 nt, Human
aguuucuucaaagggagaa

SEQ ID NO: 485849 - RNA, 18 nt, Human
auaaagccuuagucacac

SEQ ID NO: 485850 - RNA, 18 nt, Human
auagauaaauuagucacc

SEQ ID NO: 485851 - RNA, 18 nt, Human
auauguacacaauuagug

SEQ ID NO: 485852 - RNA, 22 nt, Human
aucaagauaaacacaguaacac

SEQ ID NO: 485853 - RNA, 20 nt, Human
caagaaccaaauugcacuag

SEQ ID NO: 485854 - RNA, 22 nt, Human
caagauaaacacaguaacacug

SEQ ID NO: 485855 - RNA, 27 nt, Human
caagcaaccuacaugucaagaaagccc

SEQ ID NO: 485856 - RNA, 24 nt, Human
cacaauggaggaauuuagaaagga

SEQ ID NO: 485857 - RNA, 19 nt, Human
cagaauggcaguguaacuu

SEQ ID NO: 485858 - RNA, 18 nt, Human
caguauuaaaagguuaag

SEQ ID NO: 485859 - RNA, 22 nt, Human
caguauuaaaagguuaaguuua

SEQ ID NO: 485860 - RNA, 20 nt, Human
ccaacuuguuugcuuaguua

SEQ ID NO: 485861 - RNA, 22 nt, Human
ccgggccggucccgccccgcac

SEQ ID NO: 485862 - RNA, 20 nt, Human
ccuacaugucaagaaagccc

SEQ ID NO: 485863 - RNA, 21 nt, Human
ccuuuguaaacaaguuuaaau

SEQ ID NO: 485864 - RNA, 22 nt, Human
cuaaaaauaaacaguauuaaaa

SEQ ID NO: 485865 - RNA, 23 nt, Human
gcaaccuacaugucaagaaagcc

SEQ ID NO: 485866 - RNA, 19 nt, Human
gcaaucuaguuuucuaauc

SEQ ID NO: 485867 - RNA, 23 nt, Human
gcacuuauccaguccaaaacucc

SEQ ID NO: 485868 - RNA, 20 nt, Human
gggaaugaagacaucuuugu

SEQ ID NO: 485869 - RNA, 23 nt, Human
guaaaacuuuaguaguucaguga

SEQ ID NO: 485870 - RNA, 21 nt, Human
uaaaaaauguguuauggcaag

SEQ ID NO: 485871 - RNA, 18 nt, Human
uaaaacuuuaguaguuca

SEQ ID NO: 485872 - RNA, 23 nt, Human
uaaacacaguaacacuggauuaa

SEQ ID NO: 485873 - RNA, 22 nt, Human
uacagcaaguuuucaugucuuu

SEQ ID NO: 485874 - RNA, 27 nt, Human
uaggaaggagccacagcauuuaucuug

SEQ ID NO: 485875 - RNA, 19 nt, Human
uauagauaaauuagucacc

SEQ ID NO: 485876 - RNA, 19 nt, Human
uauaguuucuucaaaggga

SEQ ID NO: 485877 - RNA, 22 nt, Human
uaucaagauaaacacaguaaca

SEQ ID NO: 485878 - RNA, 21 nt, Human
ucaagaaagccccaguuagga

SEQ ID NO: 485879 - RNA, 23 nt, Human
ucugauaacaaaauaaacuagca

SEQ ID NO: 485880 - RNA, 26 nt, Human
ugaauuccaacuuguuugcuuaguua

SEQ ID NO: 485881 - RNA, 25 nt, Human
ugauaacaaaauaaacuagcaaucu

SEQ ID NO: 485882 - RNA, 18 nt, Human
uggauuaaaggaaaaaca

SEQ ID NO: 485883 - RNA, 20 nt, Human
uggauuaucugggcuucuug

SEQ ID NO: 485884 - RNA, 23 nt, Human
uggcugggcuggggcugcugcuu

SEQ ID NO: 485885 - RNA, 20 nt, Human
ugguauagacugugguuggc

SEQ ID NO: 485886 - RNA, 21 nt, Human
ugguauagacugugguuggcc

SEQ ID NO: 485887 - RNA, 21 nt, Human
uguaaaacuuuaguaguucag

SEQ ID NO: 485888 - RNA, 25 nt, Human
uguaaacaaguccugcuguuucuuu

SEQ ID NO: 485889 - RNA, 23 nt, Human
uguaaacggcuacuucgucuuga

SEQ ID NO: 485890 - RNA, 21 nt, Human
uuagagcacagguugaacacc

SEQ ID NO: 485891 - RNA, 23 nt, Human
uuagagcacagguugaacaccau

SEQ ID NO: 485892 - RNA, 24 nt, Human
uuaucaagauaaacacaguaacac

SEQ ID NO: 485893 - RNA, 21 nt, Human
uucacaaacauaaauaaagcc

SEQ ID NO: 485894 - RNA, 22 nt, Human
uucacaaacauaaauaaagccu

SEQ ID NO: 485895 - RNA, 23 nt, Human
uuuaaaaacaaacuauacagaag

SEQ ID NO: 485896 - RNA, 20 nt, Human
uuuuccucuucuuggccugg

SEQ ID NO: 485897 - RNA, 21 nt, Human
uuuuuagaaaagcuaauuuaa

SEQ ID NO: 485898 - RNA, 24 nt, Human
uuuuuuuuuuuuuuuuuuacuuuu

SEQ ID NO: 485899 - RNA, 27 nt, Human
uuuuuuuuuuuuuuuuuuuacuuuuaa

SEQ ID NO: 485900 - RNA, 22 nt, Human
aaacuaccuauucccccauuua

SEQ ID NO: 485901 - RNA, 19 nt, Human
acuagcagauuauggauuu

SEQ ID NO: 485902 - RNA, 20 nt, Human
agcauacucacucuucugag

SEQ ID NO: 485903 - RNA, 20 nt, Human
aggaaacuaccuauuccccc

SEQ ID NO: 485904 - RNA, 21 nt, Human
auaaaauauacuacaccagau

SEQ ID NO: 485905 - RNA, 21 nt, Human
auaaaauauacuacaccagau

SEQ ID NO: 485906 - RNA, 23 nt, Human
caaaggcaaauaaaauguaauca

SEQ ID NO: 485907 - RNA, 21 nt, Human
cacccgcccgcggccucgcgg

SEQ ID NO: 485908 - RNA, 21 nt, Human
ccaaaguagcuaaagaucuac

SEQ ID NO: 485909 - RNA, 19 nt, Human
cgcacggacugggcgcagc

SEQ ID NO: 485910 - RNA, 18 nt, Human
cuccuccccaaaguagcu

SEQ ID NO: 485911 - RNA, 21 nt, Human
cuucugagaaggggggagggu

SEQ ID NO: 485912 - RNA, 20 nt, Human
cuugcauacuuccaaucugc

SEQ ID NO: 485913 - RNA, 19 nt, Human
gcccgcggccucgcggucc

SEQ ID NO: 485914 - RNA, 24 nt, Human
gcgggggcuuccaaaccugucucg

SEQ ID NO: 485915 - RNA, 18 nt, Human
ggagacgcgccuccaccc

SEQ ID NO: 485916 - RNA, 23 nt, Human
uaaaauaauaccauaguuugaca

SEQ ID NO: 485917 - RNA, 19 nt, Human
uaaagugccaaugucuaaa

SEQ ID NO: 485918 - RNA, 21 nt, Human
ucaacauuuaucaauuccaua

SEQ ID NO: 485919 - RNA, 18 nt, Human
uccaaucugcuuaaagac

SEQ ID NO: 485920 - RNA, 24 nt, Human
uccccaaaguagcuaaagaucuac

SEQ ID NO: 485921 - RNA, 21 nt, Human
ucucgcaggucggggacccac

SEQ ID NO: 485922 - RNA, 18 nt, Human
ugaauaacaaauagaagg

SEQ ID NO: 485923 - RNA, 20 nt, Human
ugagaaggggggagggugaa

SEQ ID NO: 485924 - RNA, 24 nt, Human
ugaguuuucaacuuacugcacugu

SEQ ID NO: 485925 - RNA, 21 nt, Human
ugcaaaacuagcagauuaugg

SEQ ID NO: 485926 - RNA, 18 nt, Human
ugggcgcagcgggggcuu

SEQ ID NO: 485927 - RNA, 21 nt, Human
uggggcaauaggaaugaaaac

SEQ ID NO: 485928 - RNA, 20 nt, Human
uuaacacaaaucucaauuaa

SEQ ID NO: 485929 - RNA, 22 nt, Human
uucccuccuccccaaaguagcu

SEQ ID NO: 485930 - RNA, 22 nt, Human
aaaaaaaaaaaaagaaagggga

SEQ ID NO: 485931 - RNA, 22 nt, Human
aaaaaaaaaaaagaaaggggaa

SEQ ID NO: 485932 - RNA, 25 nt, Human
aaaaaaaaaaagaaaggggaaaggg

SEQ ID NO: 485933 - RNA, 22 nt, Human
aaaaaaaaaagaaaggggaaag

SEQ ID NO: 485934 - RNA, 23 nt, Human
aaaaaaaaaagaaaggggaaagg

SEQ ID NO: 485935 - RNA, 18 nt, Human
aaaaaagaaaggggaaag

SEQ ID NO: 485936 - RNA, 19 nt, Human
aaaaauaagaaaaagcgag

SEQ ID NO: 485937 - RNA, 25 nt, Human
aaagaaaaaaaaaaaaagaaagggg

SEQ ID NO: 485938 - RNA, 23 nt, Human
aaauaagaaaaagcgagacagag

SEQ ID NO: 485939 - RNA, 19 nt, Human
aagggggggaggggagaaa

SEQ ID NO: 485940 - RNA, 24 nt, Human
acgcugaauuauaauuagccacac

SEQ ID NO: 485941 - RNA, 21 nt, Human
agagcuguaggccucacagug

SEQ ID NO: 485942 - RNA, 19 nt, Human
aggcggggggugagaccgg

SEQ ID NO: 485943 - RNA, 23 nt, Human
aggcggugcgcgcgggacgacuc

SEQ ID NO: 485944 - RNA, 28 nt, Human
cccagcuugcuguagcuaccuucuccuc

SEQ ID NO: 485945 - RNA, 22 nt, Human
cccggggaaagcgccuccgagg

SEQ ID NO: 485946 - RNA, 21 nt, Human
ccggccugaggccgccgccgc

SEQ ID NO: 485947 - RNA, 23 nt, Human
ccggccugaggccgccgccgcuc

SEQ ID NO: 485948 - RNA, 18 nt, Human
ccuccucuuccuccuccu

SEQ ID NO: 485949 - RNA, 20 nt, Human
ccuccucuuccuccuccucc

SEQ ID NO: 485950 - RNA, 21 nt, Human
ccuccucuuccuccuccuccu

SEQ ID NO: 485951 - RNA, 20 nt, Human
ccugcuacccagcuugcugu

SEQ ID NO: 485952 - RNA, 21 nt, Human
cgggacgacucggccaacuga

SEQ ID NO: 485953 - RNA, 19 nt, Human
cuaccuucuccuccucuuc

SEQ ID NO: 485954 - RNA, 22 nt, Human
cucauucccaaaguagucuacc

SEQ ID NO: 485955 - RNA, 22 nt, Human
cuccuccucuuccuccuccucc

SEQ ID NO: 485956 - RNA, 24 nt, Human
cucgccauagggcggcgggggccg

SEQ ID NO: 485957 - RNA, 18 nt, Human
cugcggccgcugggucgg

SEQ ID NO: 485958 - RNA, 20 nt, Human
cuguagcuaccuucuccucc

SEQ ID NO: 485959 - RNA, 19 nt, Human
cuucuccuccucuuccucc

SEQ ID NO: 485960 - RNA, 21 nt, Human
cuuuggaucugccugcuaccc

SEQ ID NO: 485961 - RNA, 19 nt, Human
gagaccggcucugccccug

SEQ ID NO: 485962 - RNA, 19 nt, Human
gaguuuuauuuuuuuuuuc

SEQ ID NO: 485963 - RNA, 20 nt, Human
gccugaggccgccgccgcuc

SEQ ID NO: 485964 - RNA, 21 nt, Human
gcuguagcuaccuucuccucc

SEQ ID NO: 485965 - RNA, 25 nt, Human
ggcgcgggcgcgggcgcuggcgcuc

SEQ ID NO: 485966 - RNA, 27 nt, Human
gggaaaaauaagaaaaagccgguaccc

SEQ ID NO: 485967 - RNA, 18 nt, Human
gggaaaggggggaaaaau

SEQ ID NO: 485968 - RNA, 22 nt, Human
gggccggggagaggcggggggu

SEQ ID NO: 485969 - RNA, 21 nt, Human
gggggugagaccggcucugcc

SEQ ID NO: 485970 - RNA, 19 nt, Human
ggugaaagggggggagggg

SEQ ID NO: 485971 - RNA, 19 nt, Human
uaccuucuccuccucuucc

SEQ ID NO: 485972 - RNA, 24 nt, Human
uagccacacaaauaaugagaguuu

SEQ ID NO: 485973 - RNA, 23 nt, Human
uaguuuacacucaaagguagcac

SEQ ID NO: 485974 - RNA, 22 nt, Human
ucaaagguagcacuuguugaaa

SEQ ID NO: 485975 - RNA, 24 nt, Human
ucccaaaguagucuaccuuaguuu

SEQ ID NO: 485976 - RNA, 23 nt, Human
ucgagcgggacgcacggcugcgg

SEQ ID NO: 485977 - RNA, 19 nt, Human
uuaaauaacgcugaauuau

SEQ ID NO: 485978 - RNA, 24 nt, Human
uuccugauuuugcauguucucauu

SEQ ID NO: 485979 - RNA, 21 nt, Human
uucucauaggcgcgcggaggc

SEQ ID NO: 485980 - RNA, 22 nt, Human
uuuggaucugccugcuacccag

SEQ ID NO: 485981 - RNA, 18 nt, Human
uuuuuuuuuuuuuuuuug

SEQ ID NO: 485982 - RNA, 24 nt, Human
uuuuuuuuuuuuuuuuuggucuuu

SEQ ID NO: 485983 - RNA, 22 nt, Human
aaaagaagagagauucugaaaa

SEQ ID NO: 485984 - RNA, 19 nt, Human
aaaccagaaggcuuagaug

SEQ ID NO: 485985 - RNA, 21 nt, Human
aacauaucacccaacuugaaa

SEQ ID NO: 485986 - RNA, 25 nt, Human
aagaacaaaaagaagggaaaccaac

SEQ ID NO: 485987 - RNA, 23 nt, Human
aagccccagaagccucagaagcc

SEQ ID NO: 485988 - RNA, 20 nt, Human
aagggcuuucuuaguuccac

SEQ ID NO: 485989 - RNA, 20 nt, Human
aagugggugacuuuguugac

SEQ ID NO: 485990 - RNA, 20 nt, Human
aauuccucauacaucagugu

SEQ ID NO: 485991 - RNA, 22 nt, Human
acaaaucugaaaucuugcuuga

SEQ ID NO: 485992 - RNA, 24 nt, Human
agaaauuccucauacaucaguguc

SEQ ID NO: 485993 - RNA, 21 nt, Human
agccauuagaaucuaccaaca

SEQ ID NO: 485994 - RNA, 18 nt, Human
agcccacucccugaauug

SEQ ID NO: 485995 - RNA, 21 nt, Human
agccccagaagccucagaagc

SEQ ID NO: 485996 - RNA, 21 nt, Human
auggaaaagacugaagcccca

SEQ ID NO: 485997 - RNA, 19 nt, Human
caaaugcuaauggucacaa

SEQ ID NO: 485998 - RNA, 23 nt, Human
caaguccaagauggcagucggaa

SEQ ID NO: 485999 - RNA, 18 nt, Human
caauagugggaagugggu

SEQ ID NO: 486000 - RNA, 23 nt, Human
cagaaccuggcugggagagccag

SEQ ID NO: 486001 - RNA, 19 nt, Human
cagaagccucagaagcccc

SEQ ID NO: 486002 - RNA, 24 nt, Human
cagaaggcuuagaugaagaacaaa

SEQ ID NO: 486003 - RNA, 19 nt, Human
caucuucuuucuaccaggg

SEQ ID NO: 486004 - RNA, 21 nt, Human
cauggaaaagacugaagcccc

SEQ ID NO: 486005 - RNA, 23 nt, Human
ccacucccugaauuguuugauuu

SEQ ID NO: 486006 - RNA, 23 nt, Human
cccacagucaccacuacuggguu

SEQ ID NO: 486007 - RNA, 19 nt, Human
ccccagaagccucagaagc

SEQ ID NO: 486008 - RNA, 27 nt, Human
cccccauuucuauuucuccucuucggg

SEQ ID NO: 486009 - RNA, 24 nt, Human
cuacuggguuuaauugguuugugc

SEQ ID NO: 486010 - RNA, 21 nt, Human
cucauacaucagugucuccca

SEQ ID NO: 486011 - RNA, 20 nt, Human
cucucuaucccaaguggcug

SEQ ID NO: 486012 - RNA, 18 nt, Human
cucucugguuccaaggga

SEQ ID NO: 486013 - RNA, 18 nt, Human
cugugccaagagucagaa

SEQ ID NO: 486014 - RNA, 19 nt, Human
cuuaguuccacugccagca

SEQ ID NO: 486015 - RNA, 18 nt, Human
gaaaucacuauuuccaag

SEQ ID NO: 486016 - RNA, 19 nt, Human
gaacaaaaagaagggaaac

SEQ ID NO: 486017 - RNA, 18 nt, Human
gaggcagaugcuggcuac

SEQ ID NO: 486018 - RNA, 23 nt, Human
gccccagaagccucagaagcccc

SEQ ID NO: 486019 - RNA, 23 nt, Human
gcugcaauaaagccauuagaauc

SEQ ID NO: 486020 - RNA, 24 nt, Human
ggaaaagacugaagccccagaagc

SEQ ID NO: 486021 - RNA, 18 nt, Human
ggaauauuugguuuugcu

SEQ ID NO: 486022 - RNA, 23 nt, Human
ggaggguggcggggggggggagg

SEQ ID NO: 486023 - RNA, 21 nt, Human
ggggggggaggugauggaaga

SEQ ID NO: 486024 - RNA, 23 nt, Human
ggggggggggaggugauggaaga

SEQ ID NO: 486025 - RNA, 18 nt, Human
uaaaaauucuuccuaagg

SEQ ID NO: 486026 - RNA, 23 nt, Human
uaauggucacaaaucugaaaucu

SEQ ID NO: 486027 - RNA, 23 nt, Human
uaccaacauaucacccaacuuga

SEQ ID NO: 486028 - RNA, 22 nt, Human
uauuugguuuugcucauucauc

SEQ ID NO: 486029 - RNA, 18 nt, Human
ucacuauuuccaaguucu

SEQ ID NO: 486030 - RNA, 21 nt, Human
ucaugaguucuauguucccca

SEQ ID NO: 486031 - RNA, 20 nt, Human
uccaagagcccaaauccugc

SEQ ID NO: 486032 - RNA, 21 nt, Human
uccaagagcccaaauccugcg

SEQ ID NO: 486033 - RNA, 18 nt, Human
ucccauggcuuaggagcu

SEQ ID NO: 486034 - RNA, 18 nt, Human
ucuaucccaaguggcugu

SEQ ID NO: 486035 - RNA, 18 nt, Human
ucucugguacacuuaguc

SEQ ID NO: 486036 - RNA, 20 nt, Human
ucugaaaaauagucagaaaa

SEQ ID NO: 486037 - RNA, 18 nt, Human
ugaagaacaaaaagaagg

SEQ ID NO: 486038 - RNA, 25 nt, Human
ugcaauaaagccauuagaaucuacc

SEQ ID NO: 486039 - RNA, 30 nt, Human
uggaaaagacugaagccccagaagccucag

SEQ ID NO: 486040 - RNA, 22 nt, Human
uggaagaacagaaauuccucau

SEQ ID NO: 486041 - RNA, 18 nt, Human
uggcagugggaggguggc

SEQ ID NO: 486042 - RNA, 24 nt, Human
uggcagugggaggguggcgggggg

SEQ ID NO: 486043 - RNA, 20 nt, Human
uggcucagugugccuggcag

SEQ ID NO: 486044 - RNA, 18 nt, Human
uggcugggagagccaggc

SEQ ID NO: 486045 - RNA, 19 nt, Human
ugggagugaaggggaggca

SEQ ID NO: 486046 - RNA, 24 nt, Human
ugggugacuuuguugacaaaugcu

SEQ ID NO: 486047 - RNA, 24 nt, Human
ugugccuggcaggucacgccugcu

SEQ ID NO: 486048 - RNA, 25 nt, Human
ugugccuggcaggucacgccugcuu

SEQ ID NO: 486049 - RNA, 20 nt, Human
uugaauggagcccacaguca

SEQ ID NO: 486050 - RNA, 19 nt, Human
uugcugacaaguccaagau

SEQ ID NO: 486051 - RNA, 19 nt, Human
uuggcagugggaggguggc

SEQ ID NO: 486052 - RNA, 20 nt, Human
uugguuugugcaagcaauag

SEQ ID NO: 486053 - RNA, 19 nt, Human
uuuccaaguucuuggcagu

SEQ ID NO: 486054 - RNA, 22 nt, Human
uuuugcucauucaucuucuuuc

SEQ ID NO: 486055 - RNA, 18 nt, Human
uuuuuuuuuuuuuuuuug

SEQ ID NO: 486056 - RNA, 20 nt, Human
uuuuuuuuuuuuuuuuugcu

SEQ ID NO: 486057 - RNA, 22 nt, Human
uuuuuuuuuuuuuuuuugcuga

SEQ ID NO: 486058 - RNA, 19 nt, Human
aaaccaaauccaccccagu

SEQ ID NO: 486059 - RNA, 18 nt, Human
aaacucaagaaucagcaa

SEQ ID NO: 486060 - RNA, 22 nt, Human
aaagaccucucccaccccaccc

SEQ ID NO: 486061 - RNA, 20 nt, Human
aaagaccucucccaccccag

SEQ ID NO: 486062 - RNA, 23 nt, Human
aaauuccuucucauuuaagaagc

SEQ ID NO: 486063 - RNA, 21 nt, Human
aaccuccuccuccuccuucug

SEQ ID NO: 486064 - RNA, 20 nt, Human
aacuuaagagcaaaaggaaa

SEQ ID NO: 486065 - RNA, 19 nt, Human
aacuuccuuuuaaaaaaga

SEQ ID NO: 486066 - RNA, 23 nt, Human
aagaacagaaaaaaaccucucuc

SEQ ID NO: 486067 - RNA, 25 nt, Human
aagaccucucccaccccacccccag

SEQ ID NO: 486068 - RNA, 21 nt, Human
aagcauucagugaaagacagc

SEQ ID NO: 486069 - RNA, 18 nt, Human
aaggcgccccccccaccc

SEQ ID NO: 486070 - RNA, 24 nt, Human
aaguauguuccuagaccucauacc

SEQ ID NO: 486071 - RNA, 19 nt, Human
accagcucugucuccuucu

SEQ ID NO: 486072 - RNA, 21 nt, Human
acccccagcccaggcugugua

SEQ ID NO: 486073 - RNA, 18 nt, Human
accuaaggcgcccccccc

SEQ ID NO: 486074 - RNA, 20 nt, Human
accuccuccuccuccuucug

SEQ ID NO: 486075 - RNA, 20 nt, Human
accucucccaccccaccccc

SEQ ID NO: 486076 - RNA, 21 nt, Human
accucucucucucccuuugaa

SEQ ID NO: 486077 - RNA, 21 nt, Human
accuguacuaugaugguuuua

SEQ ID NO: 486078 - RNA, 20 nt, Human
agaauccucccaacaaccca

SEQ ID NO: 486079 - RNA, 21 nt, Human
agaaugucuuugacuuggccc

SEQ ID NO: 486080 - RNA, 20 nt, Human
agaccucucccaccccaccc

SEQ ID NO: 486081 - RNA, 22 nt, Human
agaccucucccaccccaccccc

SEQ ID NO: 486082 - RNA, 27 nt, Human
agaguaaaccuucugcaacaccaacca

SEQ ID NO: 486083 - RNA, 22 nt, Human
agcccaggcuguguaugaaaac

SEQ ID NO: 486084 - RNA, 18 nt, Human
agcugaaguauguuccua

SEQ ID NO: 486085 - RNA, 18 nt, Human
aggaucucccugcucagc

SEQ ID NO: 486086 - RNA, 22 nt, Human
aggcuucccucaccuauauggg

SEQ ID NO: 486087 - RNA, 24 nt, Human
aguaccuaaggcgccccccccacc

SEQ ID NO: 486088 - RNA, 23 nt, Human
agugcuaucccugaaugaguaac

SEQ ID NO: 486089 - RNA, 18 nt, Human
auagaauccucccaacaa

SEQ ID NO: 486090 - RNA, 23 nt, Human
auauucauuucaaagggagggag

SEQ ID NO: 486091 - RNA, 19 nt, Human
augagaaagaacagaaaaa

SEQ ID NO: 486092 - RNA, 19 nt, Human
caaaccagacccauccuuu

SEQ ID NO: 486093 - RNA, 19 nt, Human
caaauucaaaacagucuca

SEQ ID NO: 486094 - RNA, 23 nt, Human
caagacaaagaccuguuuuaaac

SEQ ID NO: 486095 - RNA, 21 nt, Human
caaggcagcuuauuuccaaau

SEQ ID NO: 486096 - RNA, 21 nt, Human
caagucucucgccugguucua

SEQ ID NO: 486097 - RNA, 22 nt, Human
caauccaucuucuucuugaccu

SEQ ID NO: 486098 - RNA, 19 nt, Human
cacauacauaagaauaugc

SEQ ID NO: 486099 - RNA, 21 nt, Human
caccccacccccagcccaggc

SEQ ID NO: 486100 - RNA, 23 nt, Human
caccccaguucugcugacucugc

SEQ ID NO: 486101 - RNA, 22 nt, Human
caccucuuauuauucugacacc

SEQ ID NO: 486102 - RNA, 20 nt, Human
cacgaauaccucccuccuuc

SEQ ID NO: 486103 - RNA, 21 nt, Human
cacuacacagaauacuaugcc

SEQ ID NO: 486104 - RNA, 21 nt, Human
cacuuacuauucccucaccuu

SEQ ID NO: 486105 - RNA, 18 nt, Human
cagaagcauucagugaaa

SEQ ID NO: 486106 - RNA, 20 nt, Human
caggcuucccucaccuauau

SEQ ID NO: 486107 - RNA, 24 nt, Human
caguagcaccucuuauuauucuga

SEQ ID NO: 486108 - RNA, 19 nt, Human
cagugaaagacagccugga

SEQ ID NO: 486109 - RNA, 24 nt, Human
ccaaaugaauaugucccuuccccc

SEQ ID NO: 486110 - RNA, 22 nt, Human
ccaccccacccccagcccaggc

SEQ ID NO: 486111 - RNA, 19 nt, Human
ccacuacacagaauacuau

SEQ ID NO: 486112 - RNA, 20 nt, Human
cccaaccagcucugucuccu

SEQ ID NO: 486113 - RNA, 24 nt, Human
cccaaccagcucugucuccuucua

SEQ ID NO: 486114 - RNA, 21 nt, Human
cccauccucacgccuugagcu

SEQ ID NO: 486115 - RNA, 18 nt, Human
cccccagcccaggcugug

SEQ ID NO: 486116 - RNA, 23 nt, Human
cccccccacccccauucagucug

SEQ ID NO: 486117 - RNA, 18 nt, Human
cccugaccugagggcugu

SEQ ID NO: 486118 - RNA, 23 nt, Human
ccuaaaccuccuccuccuccuuc

SEQ ID NO: 486119 - RNA, 18 nt, Human
ccucuauaacaguaacuu

SEQ ID NO: 486120 - RNA, 22 nt, Human
ccuuccuccccaugucuuccca

SEQ ID NO: 486121 - RNA, 23 nt, Human
ccuuuggccacagaguaaaccuu

SEQ ID NO: 486122 - RNA, 26 nt, Human
cgccccccccacccccauucagucug

SEQ ID NO: 486123 - RNA, 22 nt, Human
cuaaucuacuuuaaacagaugc

SEQ ID NO: 486124 - RNA, 24 nt, Human
cuauaacaguaacuuccuuuuaaa

SEQ ID NO: 486125 - RNA, 22 nt, Human
cuaugcuacuguugcacucucc

SEQ ID NO: 486126 - RNA, 18 nt, Human
cucaaauuccuucucauu

SEQ ID NO: 486127 - RNA, 25 nt, Human
cucauagaauccucccaacaaccca

SEQ ID NO: 486128 - RNA, 24 nt, Human
cuccacaacuuaagagcaaaagga

SEQ ID NO: 486129 - RNA, 20 nt, Human
cucccuccuucccauccuca

SEQ ID NO: 486130 - RNA, 24 nt, Human
cucccuccuucccauccuuacgaa

SEQ ID NO: 486131 - RNA, 25 nt, Human
cucccuuugaaaugaauauacccaa

SEQ ID NO: 486132 - RNA, 25 nt, Human
cuccucucugacccucacuuccaaa

SEQ ID NO: 486133 - RNA, 23 nt, Human
cucuccacaacuuaagagcaaaa

SEQ ID NO: 486134 - RNA, 18 nt, Human
cucucccaccccaccccc

SEQ ID NO: 486135 - RNA, 22 nt, Human
cugacucugcauccucauaugc

SEQ ID NO: 486136 - RNA, 21 nt, Human
cugcacgaauaccucccuccu

SEQ ID NO: 486137 - RNA, 20 nt, Human
cugguuugucuggagaaggc

SEQ ID NO: 486138 - RNA, 18 nt, Human
cuguucagaucacuaaac

SEQ ID NO: 486139 - RNA, 24 nt, Human
cuuacgaauaccucccuccuuccc

SEQ ID NO: 486140 - RNA, 25 nt, Human
cuuccugcugacagccacaaugcuc

SEQ ID NO: 486141 - RNA, 19 nt, Human
gaaggcgaaaagaaucaga

SEQ ID NO: 486142 - RNA, 21 nt, Human
gacccucacuuccaaaccaaa

SEQ ID NO: 486143 - RNA, 21 nt, Human
gagcaaugccgucaagguucu

SEQ ID NO: 486144 - RNA, 18 nt, Human
gaggguggaguuaaauca

SEQ ID NO: 486145 - RNA, 19 nt, Human
ggcaggauccuucacucca

SEQ ID NO: 486146 - RNA, 24 nt, Human
ggccauccucacccugaccugagg

SEQ ID NO: 486147 - RNA, 25 nt, Human
ggccauccucacccugaccugaggg

SEQ ID NO: 486148 - RNA, 20 nt, Human
gugguugccucauagaaucc

SEQ ID NO: 486149 - RNA, 19 nt, Human
guugguggucuccuugccc

SEQ ID NO: 486150 - RNA, 22 nt, Human
guuugucuggagaaggcaucug

SEQ ID NO: 486151 - RNA, 19 nt, Human
uaagaagcuuccccagcuc

SEQ ID NO: 486152 - RNA, 19 nt, Human
uaaggcgccccccccaccc

SEQ ID NO: 486153 - RNA, 20 nt, Human
uacgaauaccucccuccuuc

SEQ ID NO: 486154 - RNA, 21 nt, Human
uacuagguaaucaauccucac

SEQ ID NO: 486155 - RNA, 19 nt, Human
uacuaugccagauacguag

SEQ ID NO: 486156 - RNA, 20 nt, Human
uagaauccucccaacaaccc

SEQ ID NO: 486157 - RNA, 21 nt, Human
uagccaucccccaaauucaaa

SEQ ID NO: 486158 - RNA, 18 nt, Human
uaugugcacaaucauaug

SEQ ID NO: 486159 - RNA, 19 nt, Human
uaugugcacaaucauauga

SEQ ID NO: 486160 - RNA, 18 nt, Human
ucaagaaucagcaauucu

SEQ ID NO: 486161 - RNA, 21 nt, Human
ucaauccucaccuagaucuca

SEQ ID NO: 486162 - RNA, 22 nt, Human
ucaccuuaccuguacuaugaug

SEQ ID NO: 486163 - RNA, 23 nt, Human
ucagcaauucucugaggcuuucu

SEQ ID NO: 486164 - RNA, 23 nt, Human
ucaguagcaccucuuauuauucu

SEQ ID NO: 486165 - RNA, 28 nt, Human
ucagugaaagacagccuggagucugggg

SEQ ID NO: 486166 - RNA, 21 nt, Human
ucccaccccacccccagccca

SEQ ID NO: 486167 - RNA, 22 nt, Human
uccccagcucucccaggccaca

SEQ ID NO: 486168 - RNA, 23 nt, Human
uccccauagcaagacaaagaccu

SEQ ID NO: 486169 - RNA, 23 nt, Human
ucccugaguaguucucaccacuu

SEQ ID NO: 486170 - RNA, 22 nt, Human
uccuucacuccagauauaaucu

SEQ ID NO: 486171 - RNA, 22 nt, Human
ucucccaccccacccccagccc

SEQ ID NO: 486172 - RNA, 22 nt, Human
ucucccaggccacaagucucuc

SEQ ID NO: 486173 - RNA, 24 nt, Human
ucugacccucacuuccaaaccaaa

SEQ ID NO: 486174 - RNA, 22 nt, Human
ucugcucaucccacuacacaga

SEQ ID NO: 486175 - RNA, 22 nt, Human
ucuuaguuuuucaggcuucccu

SEQ ID NO: 486176 - RNA, 20 nt, Human
ugaaaugaauauacccaaaa

SEQ ID NO: 486177 - RNA, 26 nt, Human
ugaaggcgaaaagaaucagagaacag

SEQ ID NO: 486178 - RNA, 19 nt, Human
ugaccuaaaccuccuccuc

SEQ ID NO: 486179 - RNA, 20 nt, Human
ugacuuggcccagaggguag

SEQ ID NO: 486180 - RNA, 20 nt, Human
ugagaaagaacagaaaaaaa

SEQ ID NO: 486181 - RNA, 18 nt, Human
ugccagauacguaggugg

SEQ ID NO: 486182 - RNA, 18 nt, Human
uggagaauagaucucugg

SEQ ID NO: 486183 - RNA, 18 nt, Human
uggauuauuuuguuuuug

SEQ ID NO: 486184 - RNA, 19 nt, Human
ugggaugggaaggaaaucu

SEQ ID NO: 486185 - RNA, 20 nt, Human
ugucucagcucuucuggcca

SEQ ID NO: 486186 - RNA, 21 nt, Human
ugucuggagaaggcaucugga

SEQ ID NO: 486187 - RNA, 21 nt, Human
ugugcaaaucaaucauauaga

SEQ ID NO: 486188 - RNA, 24 nt, Human
uguucaagcucugcaaaccagacc

SEQ ID NO: 486189 - RNA, 20 nt, Human
uuaaaaaagaccucucccac

SEQ ID NO: 486190 - RNA, 24 nt, Human
uuaaaauaagcuggagaauagauc

SEQ ID NO: 486191 - RNA, 22 nt, Human
uuaguuuuucaggcuucccuca

SEQ ID NO: 486192 - RNA, 18 nt, Human
uucaucaacauauuuuga

SEQ ID NO: 486193 - RNA, 21 nt, Human
uucaugucuuuucuccccaua

SEQ ID NO: 486194 - RNA, 22 nt, Human
uuccuccccaugucuucccaac

SEQ ID NO: 486195 - RNA, 24 nt, Human
uucucauuuaagaagcuuccccag

SEQ ID NO: 486196 - RNA, 24 nt, Human
uucuugaccuaaaccuccuccucc

SEQ ID NO: 486197 - RNA, 18 nt, Human
uugaugcaugugaagggg

SEQ ID NO: 486198 - RNA, 19 nt, Human
uugcuuccugcugacagcc

SEQ ID NO: 486199 - RNA, 22 nt, Human
uuggccacagaguaaaccuucu

SEQ ID NO: 486200 - RNA, 20 nt, Human
uuguccuuccuccccauguc

SEQ ID NO: 486201 - RNA, 22 nt, Human
uuucuguugcuucugguuuguc

SEQ ID NO: 486202 - RNA, 23 nt, Human
uuuuguggguuuuaaggcucaag

SEQ ID NO: 486203 - RNA, 24 nt, Human
aaaaugcuaccuaucagagaccag

SEQ ID NO: 486204 - RNA, 24 nt, Human
aaaaugcugggauuacagguguga

SEQ ID NO: 486205 - RNA, 25 nt, Human
aaacaucuaacauuuuaaacuguac

SEQ ID NO: 486206 - RNA, 22 nt, Human
aaauaauuaucagaagccagca

SEQ ID NO: 486207 - RNA, 26 nt, Human
aaaugcugggauuacaggugugagcc

SEQ ID NO: 486208 - RNA, 19 nt, Human
aacacuagccggccaaucc

SEQ ID NO: 486209 - RNA, 19 nt, Human
aacagcucccagggaaauc

SEQ ID NO: 486210 - RNA, 18 nt, Human
aaccacugaagaacagcc

SEQ ID NO: 486211 - RNA, 18 nt, Human
aaccacugaagaacagcc

SEQ ID NO: 486212 - RNA, 23 nt, Human
aagccaaagccaugcuuuaaaaa

SEQ ID NO: 486213 - RNA, 23 nt, Human
aagccaaagccaugcuuuaaaaa

SEQ ID NO: 486214 - RNA, 19 nt, Human
aaguagcugggauuacagg

SEQ ID NO: 486215 - RNA, 25 nt, Human
aaguagcugggauuacaggcacccg

SEQ ID NO: 486216 - RNA, 20 nt, Human
aagugcuggaaaaugcuacc

SEQ ID NO: 486217 - RNA, 22 nt, Human
aauaagaugcagcuucuagcag

SEQ ID NO: 486218 - RNA, 21 nt, Human
aaucaaaguccaaccaauggu

SEQ ID NO: 486219 - RNA, 19 nt, Human
aaugggaaccacugaagaa

SEQ ID NO: 486220 - RNA, 23 nt, Human
aauuuuuguauuuuuaguagaga

SEQ ID NO: 486221 - RNA, 19 nt, Human
acaaucugaugacuccagc

SEQ ID NO: 486222 - RNA, 19 nt, Human
acacagcccaugagcacgu

SEQ ID NO: 486223 - RNA, 19 nt, Human
acaggcacccgccaccacg

SEQ ID NO: 486224 - RNA, 18 nt, Human
acaguucuuuccuuuuuu

SEQ ID NO: 486225 - RNA, 22 nt, Human
acauuuuuuauuuugcaaagcc

SEQ ID NO: 486226 - RNA, 19 nt, Human
accaacaccuguucugcca

SEQ ID NO: 486227 - RNA, 19 nt, Human
acccaggcuggagugcaau

SEQ ID NO: 486228 - RNA, 25 nt, Human
acccaucuuagcuucccaaaaugcu

SEQ ID NO: 486229 - RNA, 22 nt, Human
accuguucugccauuguccccu

SEQ ID NO: 486230 - RNA, 19 nt, Human
acuguacaauaaaccccaa

SEQ ID NO: 486231 - RNA, 26 nt, Human
agaaaaaaugcaagcugguuguagaa

SEQ ID NO: 486232 - RNA, 26 nt, Human
agaaaaaaugcaagcugguuguagaa

SEQ ID NO: 486233 - RNA, 23 nt, Human
agaacagcucccagggaaaucaa

SEQ ID NO: 486234 - RNA, 25 nt, Human
agacaagagacacucacgacagaga

SEQ ID NO: 486235 - RNA, 26 nt, Human
agacaagagacacucacgacagagaa

SEQ ID NO: 486236 - RNA, 19 nt, Human
agagaucacacagcccaug

SEQ ID NO: 486237 - RNA, 20 nt, Human
agaggaagacagccuuugca

SEQ ID NO: 486238 - RNA, 21 nt, Human
agcaaaaagauauggggagaa

SEQ ID NO: 486239 - RNA, 21 nt, Human
agcaaaaagauauggggagaa

SEQ ID NO: 486240 - RNA, 24 nt, Human
agcaagaaaaaugauguaaccuaa

SEQ ID NO: 486241 - RNA, 24 nt, Human
agcgauucucuugccucagccucc

SEQ ID NO: 486242 - RNA, 18 nt, Human
aggaaaguagaggugacc

SEQ ID NO: 486243 - RNA, 18 nt, Human
aggaaaguagaggugacc

SEQ ID NO: 486244 - RNA, 18 nt, Human
aggcucaggaagagacgg

SEQ ID NO: 486245 - RNA, 18 nt, Human
aggcucaggaagagacgg

SEQ ID NO: 486246 - RNA, 24 nt, Human
agggguuucgccauguuggccagg

SEQ ID NO: 486247 - RNA, 21 nt, Human
aguagagagggguuucgccau

SEQ ID NO: 486248 - RNA, 19 nt, Human
agugauccacccaucuuag

SEQ ID NO: 486249 - RNA, 24 nt, Human
agugcaauggcacgaucucggcuc

SEQ ID NO: 486250 - RNA, 18 nt, Human
aguuaaagcuuacaagaa

SEQ ID NO: 486251 - RNA, 18 nt, Human
aguuaaagcuuacaagaa

SEQ ID NO: 486252 - RNA, 21 nt, Human
aguucuggauugccacuuccu

SEQ ID NO: 486253 - RNA, 24 nt, Human
aguucuuuccuuuuuuuuuuuuuu

SEQ ID NO: 486254 - RNA, 24 nt, Human
aguucuuuccuuuuuuuuuuuuuu

SEQ ID NO: 486255 - RNA, 22 nt, Human
aucaaugggaaccacugaagaa

SEQ ID NO: 486256 - RNA, 22 nt, Human
aucagagaccaccccacccuga

SEQ ID NO: 486257 - RNA, 18 nt, Human
auccacucccuucagccu

SEQ ID NO: 486258 - RNA, 24 nt, Human
caaaagacacugugaucugugacu

SEQ ID NO: 486259 - RNA, 24 nt, Human
caaaaugcugggauuacaggugug

SEQ ID NO: 486260 - RNA, 23 nt, Human
caaagcaaaccgacaguuuccua

SEQ ID NO: 486261 - RNA, 24 nt, Human
caaauuuuuguauuuuuaguagag

SEQ ID NO: 486262 - RNA, 26 nt, Human
caaccacauuaaagaaacggaacaaa

SEQ ID NO: 486263 - RNA, 22 nt, Human
caagcgauucucuugccucagc

SEQ ID NO: 486264 - RNA, 27 nt, Human
caagcgauucucuugccucagccuccc

SEQ ID NO: 486265 - RNA, 24 nt, Human
cacaaauuucagaccccuuuaaaa

SEQ ID NO: 486266 - RNA, 22 nt, Human
cacagcccaugagcacguuaag

SEQ ID NO: 486267 - RNA, 23 nt, Human
cacauuuuuuauuuugcaaagcc

SEQ ID NO: 486268 - RNA, 22 nt, Human
caccaugccuagcccaugacag

SEQ ID NO: 486269 - RNA, 23 nt, Human
cacccaucuuagcuucccaaaau

SEQ ID NO: 486270 - RNA, 21 nt, Human
cacucccuucagccucacucc

SEQ ID NO: 486271 - RNA, 21 nt, Human
cacucccuucagccucacucc

SEQ ID NO: 486272 - RNA, 21 nt, Human
cacugcaaccucugccuccug

SEQ ID NO: 486273 - RNA, 23 nt, Human
cacugcaaccucugccuccuggg

SEQ ID NO: 486274 - RNA, 18 nt, Human
cagaaaaaaugcaagcug

SEQ ID NO: 486275 - RNA, 18 nt, Human
cagaaaaaaugcaagcug

SEQ ID NO: 486276 - RNA, 22 nt, Human
cagagaacagcucccagggaaa

SEQ ID NO: 486277 - RNA, 22 nt, Human
cagcaagaaaaaugauguaacc

SEQ ID NO: 486278 - RNA, 22 nt, Human
cagcaagaaaaaugauguaacc

SEQ ID NO: 486279 - RNA, 25 nt, Human
cagcaagaaaaaugauguaaccuaa

SEQ ID NO: 486280 - RNA, 21 nt, Human
cagcaaugaguuuguacccaa

SEQ ID NO: 486281 - RNA, 18 nt, Human
cagcauuucccaaaggcu

SEQ ID NO: 486282 - RNA, 21 nt, Human
cagcgcauugaucacaccaaa

SEQ ID NO: 486283 - RNA, 21 nt, Human
cagcgcauugaucacaccaaa

SEQ ID NO: 486284 - RNA, 18 nt, Human
cagcuuuggcaaauaagc

SEQ ID NO: 486285 - RNA, 21 nt, Human
caggcacccgccaccacgccu

SEQ ID NO: 486286 - RNA, 24 nt, Human
cauguuggccaggcuggucucaaa

SEQ ID NO: 486287 - RNA, 21 nt, Human
ccaaaaugcugggauuacagg

SEQ ID NO: 486288 - RNA, 21 nt, Human
ccaaaaugcugggauuacagg

SEQ ID NO: 486289 - RNA, 24 nt, Human
ccaaaaugcugggauuacaggugu

SEQ ID NO: 486290 - RNA, 21 nt, Human
ccaagacagcaagaaaaauga

SEQ ID NO: 486291 - RNA, 21 nt, Human
ccaagacagcaagaaaaauga

SEQ ID NO: 486292 - RNA, 23 nt, Human
ccaaguagcugggauuacaggca

SEQ ID NO: 486293 - RNA, 21 nt, Human
ccacaaucugaugacuccagc

SEQ ID NO: 486294 - RNA, 20 nt, Human
ccacauuaaagaaacggaac

SEQ ID NO: 486295 - RNA, 20 nt, Human
ccaccacgccuggcaaauuu

SEQ ID NO: 486296 - RNA, 19 nt, Human
ccacuccuuugcuuugauu

SEQ ID NO: 486297 - RNA, 19 nt, Human
ccacuccuuugcuuugauu

SEQ ID NO: 486298 - RNA, 24 nt, Human
ccacugaagaacagccccuucuau

SEQ ID NO: 486299 - RNA, 24 nt, Human
ccacugaagaacagccccuucuau

SEQ ID NO: 486300 - RNA, 19 nt, Human
ccagcuuuggcaaauaagc

SEQ ID NO: 486301 - RNA, 19 nt, Human
ccauguuggccaggcuggu

SEQ ID NO: 486302 - RNA, 22 nt, Human
ccauguuggccaggcuggucuc

SEQ ID NO: 486303 - RNA, 18 nt, Human
cccaagacagcaagaaaa

SEQ ID NO: 486304 - RNA, 18 nt, Human
cccaagacagcaagaaaa

SEQ ID NO: 486305 - RNA, 21 nt, Human
cccaagacagcaagaaaaaug

SEQ ID NO: 486306 - RNA, 21 nt, Human
cccaagacagcaagaaaaaug

SEQ ID NO: 486307 - RNA, 23 nt, Human
cccaaguagcugggauuacaggc

SEQ ID NO: 486308 - RNA, 24 nt, Human
cccaaguagcugggauuacaggca

SEQ ID NO: 486309 - RNA, 25 nt, Human
cccacaaucugaugacuccagcuca

SEQ ID NO: 486310 - RNA, 25 nt, Human
cccacaaucugaugacuccagcuca

SEQ ID NO: 486311 - RNA, 21 nt, Human
cccaugacaguaccuuccuaa

SEQ ID NO: 486312 - RNA, 24 nt, Human
ccuccuggguucaagcgauucucu

SEQ ID NO: 486313 - RNA, 22 nt, Human
ccucuccaaacagugggccccu

SEQ ID NO: 486314 - RNA, 22 nt, Human
ccucuccaaacagugggccccu

SEQ ID NO: 486315 - RNA, 19 nt, Human
ccucugccuccuggguuca

SEQ ID NO: 486316 - RNA, 20 nt, Human
ccugaauaccauccucucca

SEQ ID NO: 486317 - RNA, 20 nt, Human
ccugaauaccauccucucca

SEQ ID NO: 486318 - RNA, 23 nt, Human
ccugaccucaagugauccaccca

SEQ ID NO: 486319 - RNA, 24 nt, Human
ccugaccucaagugauccacccau

SEQ ID NO: 486320 - RNA, 21 nt, Human
ccugagagugucagguuacca

SEQ ID NO: 486321 - RNA, 21 nt, Human
ccugagagugucagguuacca

SEQ ID NO: 486322 - RNA, 21 nt, Human
ccuggguucaagcgauucucu

SEQ ID NO: 486323 - RNA, 24 nt, Human
cgccauguuggccaggcuggucuc

SEQ ID NO: 486324 - RNA, 27 nt, Human
cgccauguuggccaggcuggucucaaa

SEQ ID NO: 486325 - RNA, 24 nt, Human
cgccuggcaaauuuuuguauuuuu

SEQ ID NO: 486326 - RNA, 24 nt, Human
cgcucugucacccaggcuggagug

SEQ ID NO: 486327 - RNA, 20 nt, Human
cggccagagccugagagcaa

SEQ ID NO: 486328 - RNA, 18 nt, Human
cuagagucaaacgcuaac

SEQ ID NO: 486329 - RNA, 18 nt, Human
cuagagucaaacgcuaac

SEQ ID NO: 486330 - RNA, 24 nt, Human
cucaagugauccacccaucuuagc

SEQ ID NO: 486331 - RNA, 24 nt, Human
cucacugcaaccucugccuccugg

SEQ ID NO: 486332 - RNA, 24 nt, Human
cucagccucccaaguagcugggau

SEQ ID NO: 486333 - RNA, 21 nt, Human
cuccuggguucaagcgauucu

SEQ ID NO: 486334 - RNA, 21 nt, Human
cucgcucugucacccaggcug

SEQ ID NO: 486335 - RNA, 24 nt, Human
cucgcucugucacccaggcuggag

SEQ ID NO: 486336 - RNA, 25 nt, Human
cucugucacccaggcuggagugcaa

SEQ ID NO: 486337 - RNA, 21 nt, Human
cugauccacucccuucagccu

SEQ ID NO: 486338 - RNA, 19 nt, Human
cugcaaccucugccuccug

SEQ ID NO: 486339 - RNA, 23 nt, Human
cugcaaccucugccuccuggguu

SEQ ID NO: 486340 - RNA, 24 nt, Human
cugcaaccucugccuccuggguuc

SEQ ID NO: 486341 - RNA, 23 nt, Human
cugugcuaguuuucaagcaugaa

SEQ ID NO: 486342 - RNA, 23 nt, Human
cugugcuaguuuucaagcaugaa

SEQ ID NO: 486343 - RNA, 22 nt, Human
cuucagccacacauugcucuuc

SEQ ID NO: 486344 - RNA, 22 nt, Human
cuucagccucacuccgggcccc

SEQ ID NO: 486345 - RNA, 22 nt, Human
cuucagccucacuccgggcccc

SEQ ID NO: 486346 - RNA, 24 nt, Human
cuugccucagccucccaaguagcu

SEQ ID NO: 486347 - RNA, 25 nt, Human
cuugccucagccucccaaguagcug

SEQ ID NO: 486348 - RNA, 27 nt, Human
gacaguucuuuccuuuuuuuuuuuuuu

SEQ ID NO: 486349 - RNA, 24 nt, Human
gaccucaagugauccacccaucuu

SEQ ID NO: 486350 - RNA, 24 nt, Human
gagaacagcucccagggaaaucaa

SEQ ID NO: 486351 - RNA, 20 nt, Human
gagagggguuucgccauguu

SEQ ID NO: 486352 - RNA, 21 nt, Human
gagccaccaugccuagcccau

SEQ ID NO: 486353 - RNA, 18 nt, Human
gagggguuucgccauguu

SEQ ID NO: 486354 - RNA, 20 nt, Human
gagggguuucgccauguugg

SEQ ID NO: 486355 - RNA, 24 nt, Human
gagggguuucgccauguuggccag

SEQ ID NO: 486356 - RNA, 18 nt, Human
gauuacaggugugagcca

SEQ ID NO: 486357 - RNA, 21 nt, Human
gauuacaggugugagccacca

SEQ ID NO: 486358 - RNA, 24 nt, Human
gauuacaggugugagccaccaugc

SEQ ID NO: 486359 - RNA, 21 nt, Human
gauucucuugccucagccucc

SEQ ID NO: 486360 - RNA, 22 nt, Human
gcaaauaagcaagauguuucug

SEQ ID NO: 486361 - RNA, 22 nt, Human
gcaaauaagcaagauguuucug

SEQ ID NO: 486362 - RNA, 22 nt, Human
gcaaccucugccuccuggguuc

SEQ ID NO: 486363 - RNA, 23 nt, Human
gcagugcucugauccacucccuu

SEQ ID NO: 486364 - RNA, 23 nt, Human
gcagugcucugauccacucccuu

SEQ ID NO: 486365 - RNA, 18 nt, Human
gccauguuggccaggcug

SEQ ID NO: 486366 - RNA, 25 nt, Human
gccauguuggccaggcuggucucaa

SEQ ID NO: 486367 - RNA, 21 nt, Human
gccucacuccgggccccacaa

SEQ ID NO: 486368 - RNA, 21 nt, Human
gccucacuccgggccccacaa

SEQ ID NO: 486369 - RNA, 20 nt, Human
gccucagccucccaaguagc

SEQ ID NO: 486370 - RNA, 24 nt, Human
gcgauucucuugccucagccuccc

SEQ ID NO: 486371 - RNA, 23 nt, Human
gcucugauccacucccuucagcc

SEQ ID NO: 486372 - RNA, 23 nt, Human
gcucugauccacucccuucagcc

SEQ ID NO: 486373 - RNA, 27 nt, Human
gcucugucacccaggcuggagugcaau

SEQ ID NO: 486374 - RNA, 19 nt, Human
gcugcuuuauccaauuggu

SEQ ID NO: 486375 - RNA, 19 nt, Human
gcuggagugcaauggcacg

SEQ ID NO: 486376 - RNA, 23 nt, Human
gcuggucucaaacuccugaccuc

SEQ ID NO: 486377 - RNA, 19 nt, Human
ggagucucugcaagccgac

SEQ ID NO: 486378 - RNA, 19 nt, Human
ggagucucugcaagccgac

SEQ ID NO: 486379 - RNA, 24 nt, Human
ggauuacaggugugagccaccaug

SEQ ID NO: 486380 - RNA, 19 nt, Human
ggccagagccugagagcaa

SEQ ID NO: 486381 - RNA, 24 nt, Human
ggcuggucucaaacuccugaccuc

SEQ ID NO: 486382 - RNA, 18 nt, Human
gggguuucgccauguugg

SEQ ID NO: 486383 - RNA, 22 nt, Human
gggguuucgccauguuggccag

SEQ ID NO: 486384 - RNA, 23 nt, Human
gggguuucgccauguuggccagg

SEQ ID NO: 486385 - RNA, 18 nt, Human
guagcugggauuacaggc

SEQ ID NO: 486386 - RNA, 24 nt, Human
gucucgcucugucacccaggcugg

SEQ ID NO: 486387 - RNA, 22 nt, Human
gugagccaccaugccuagccca

SEQ ID NO: 486388 - RNA, 24 nt, Human
gugauccacccaucuuagcuuccc

SEQ ID NO: 486389 - RNA, 20 nt, Human
guuuacaugacaguucuuuc

SEQ ID NO: 486390 - RNA, 19 nt, Human
uaaagaaacggaacaaaac

SEQ ID NO: 486391 - RNA, 19 nt, Human
uaagaaaaagagaggcauu

SEQ ID NO: 486392 - RNA, 22 nt, Human
uacaggcacccgccaccacgcc

SEQ ID NO: 486393 - RNA, 22 nt, Human
uacaggugugagccaccaugcc

SEQ ID NO: 486394 - RNA, 22 nt, Human
uacaggugugagccaccaugcc

SEQ ID NO: 486395 - RNA, 23 nt, Human
uacaggugugagccaccaugccu

SEQ ID NO: 486396 - RNA, 24 nt, Human
uacuagaauugccaaaagcaaguu

SEQ ID NO: 486397 - RNA, 18 nt, Human
uacuccuuuaccugguua

SEQ ID NO: 486398 - RNA, 21 nt, Human
uagagagggguuucgccaugu

SEQ ID NO: 486399 - RNA, 22 nt, Human
uagcccaugacaguaccuuccu

SEQ ID NO: 486400 - RNA, 23 nt, Human
uaguagagagggguuucgccaug

SEQ ID NO: 486401 - RNA, 20 nt, Human
uaugguucagccccuucagc

SEQ ID NO: 486402 - RNA, 20 nt, Human
uaugguucagccccuucagc

SEQ ID NO: 486403 - RNA, 24 nt, Human
uauuuugcauuuuaaagagagaua

SEQ ID NO: 486404 - RNA, 24 nt, Human
uauuuugcauuuuaaagagagaua

SEQ ID NO: 486405 - RNA, 18 nt, Human
ucaaaucucucuugaguc

SEQ ID NO: 486406 - RNA, 19 nt, Human
ucaagcgauucucuugccu

SEQ ID NO: 486407 - RNA, 18 nt, Human
ucacccaggcuggagugc

SEQ ID NO: 486408 - RNA, 24 nt, Human
ucacugcaaccucugccuccuggg

SEQ ID NO: 486409 - RNA, 25 nt, Human
ucacugcaaccucugccuccugggu

SEQ ID NO: 486410 - RNA, 27 nt, Human
ucacugcaaccucugccuccuggguuc

SEQ ID NO: 486411 - RNA, 19 nt, Human
ucagccucacuccgggccc

SEQ ID NO: 486412 - RNA, 19 nt, Human
ucagccucacuccgggccc

SEQ ID NO: 486413 - RNA, 18 nt, Human
ucagccucccaaguagcu

SEQ ID NO: 486414 - RNA, 20 nt, Human
ucagccucccaaguagcugg

SEQ ID NO: 486415 - RNA, 20 nt, Human
ucagcuucauuuaucugaac

SEQ ID NO: 486416 - RNA, 20 nt, Human
ucagcuucauuuaucugaac

SEQ ID NO: 486417 - RNA, 19 nt, Human
uccaugcauaccuggccau

SEQ ID NO: 486418 - RNA, 23 nt, Human
ucccaaaaugcugggauuacagg

SEQ ID NO: 486419 - RNA, 24 nt, Human
ucccaaguagcugggauuacaggc

SEQ ID NO: 486420 - RNA, 22 nt, Human
ucccagggaaaucaaagcaaac

SEQ ID NO: 486421 - RNA, 18 nt, Human
ucccuucagccucacucc

SEQ ID NO: 486422 - RNA, 18 nt, Human
ucccuucagccucacucc

SEQ ID NO: 486423 - RNA, 24 nt, Human
uccucauaacaaaagucuucagcc

SEQ ID NO: 486424 - RNA, 24 nt, Human
uccugagagugucagguuaccaug

SEQ ID NO: 486425 - RNA, 24 nt, Human
uccugagagugucagguuaccaug

SEQ ID NO: 486426 - RNA, 24 nt, Human
uccugggagcaaggagucucugca

SEQ ID NO: 486427 - RNA, 24 nt, Human
uccugggagcaaggagucucugca

SEQ ID NO: 486428 - RNA, 21 nt, Human
uccuggguucaagcgauucuc

SEQ ID NO: 486429 - RNA, 24 nt, Human
uccuggguucaagcgauucucuug

SEQ ID NO: 486430 - RNA, 22 nt, Human
ucgccauguuggccaggcuggu

SEQ ID NO: 486431 - RNA, 24 nt, Human
ucgccauguuggccaggcuggucu

SEQ ID NO: 486432 - RNA, 24 nt, Human
ucgcucugucacccaggcuggagu

SEQ ID NO: 486433 - RNA, 21 nt, Human
ucuaacauuuuaaacuguaca

SEQ ID NO: 486434 - RNA, 19 nt, Human
ucuccugggagcaaggagu

SEQ ID NO: 486435 - RNA, 19 nt, Human
ucuccugggagcaaggagu

SEQ ID NO: 486436 - RNA, 19 nt, Human
ucucgcucugucacccagg

SEQ ID NO: 486437 - RNA, 23 nt, Human
ucucgcucugucacccaggcugg

SEQ ID NO: 486438 - RNA, 24 nt, Human
ucucgcucugucacccaggcugga

SEQ ID NO: 486439 - RNA, 26 nt, Human
ucucgcucugucacccaggcuggagu

SEQ ID NO: 486440 - RNA, 27 nt, Human
ucucgcucugucacccaggcuggagug

SEQ ID NO: 486441 - RNA, 24 nt, Human
ucugucacccaggcuggagugcaa

SEQ ID NO: 486442 - RNA, 20 nt, Human
ucuuagcuucccaaaaugcu

SEQ ID NO: 486443 - RNA, 26 nt, Human
ucuugccucagccucccaaguagcug

SEQ ID NO: 486444 - RNA, 21 nt, Human
ucuuuaaaaaaaaaaaaagua

SEQ ID NO: 486445 - RNA, 18 nt, Human
ugaaaugccaggcggaua

SEQ ID NO: 486446 - RNA, 19 nt, Human
ugaagaacagccccuucua

SEQ ID NO: 486447 - RNA, 19 nt, Human
ugaagaacagccccuucua

SEQ ID NO: 486448 - RNA, 19 nt, Human
ugacaauugucaccaacac

SEQ ID NO: 486449 - RNA, 18 nt, Human
ugacaguaccuuccuaac

SEQ ID NO: 486450 - RNA, 19 nt, Human
ugagaaagccugaauacca

SEQ ID NO: 486451 - RNA, 19 nt, Human
ugagaaagccugaauacca

SEQ ID NO: 486452 - RNA, 22 nt, Human
ugagauggagucucgcucuguc

SEQ ID NO: 486453 - RNA, 23 nt, Human
ugauccacccaucuuagcuuccc

SEQ ID NO: 486454 - RNA, 22 nt, Human
ugccucagccucccaaguagcu

SEQ ID NO: 486455 - RNA, 24 nt, Human
ugccucagccucccaaguagcugg

SEQ ID NO: 486456 - RNA, 20 nt, Human
ugcucugauccacucccuuc

SEQ ID NO: 486457 - RNA, 20 nt, Human
ugcucugauccacucccuuc

SEQ ID NO: 486458 - RNA, 24 nt, Human
ugcugggauuacaggugugagcca

SEQ ID NO: 486459 - RNA, 23 nt, Human
uggagugcaauggcacgaucucg

SEQ ID NO: 486460 - RNA, 24 nt, Human
uggagugcaauggcacgaucucgg

SEQ ID NO: 486461 - RNA, 23 nt, Human
uggcaaauaagcaagauguuucu

SEQ ID NO: 486462 - RNA, 23 nt, Human
uggcaaauaagcaagauguuucu

SEQ ID NO: 486463 - RNA, 25 nt, Human
uggcaaauaagcaagauguuucugu

SEQ ID NO: 486464 - RNA, 25 nt, Human
uggcaaauaagcaagauguuucugu

SEQ ID NO: 486465 - RNA, 24 nt, Human
uggccaggcuggucucaaacuccu

SEQ ID NO: 486466 - RNA, 19 nt, Human
uggcuuccauuuuuuuuuc

SEQ ID NO: 486467 - RNA, 21 nt, Human
ugggauuacaggcacccgcca

SEQ ID NO: 486468 - RNA, 22 nt, Human
ugggauuacaggcacccgccac

SEQ ID NO: 486469 - RNA, 24 nt, Human
ugggauuacaggcacccgccacca

SEQ ID NO: 486470 - RNA, 18 nt, Human
ugggauuacaggugugag

SEQ ID NO: 486471 - RNA, 22 nt, Human
ugggauuacaggugugagccac

SEQ ID NO: 486472 - RNA, 23 nt, Human
ugggauuacaggugugagccacc

SEQ ID NO: 486473 - RNA, 24 nt, Human
ugggauuacaggugugagccacca

SEQ ID NO: 486474 - RNA, 25 nt, Human
ugggauuacaggugugagccaccau

SEQ ID NO: 486475 - RNA, 22 nt, Human
ugggcagaaaaaaugcaagcug

SEQ ID NO: 486476 - RNA, 22 nt, Human
ugggcagaaaaaaugcaagcug

SEQ ID NO: 486477 - RNA, 20 nt, Human
uggguucaagcgauucucuu

SEQ ID NO: 486478 - RNA, 23 nt, Human
uggguucaagcgauucucuugcc

SEQ ID NO: 486479 - RNA, 24 nt, Human
uggguucaagcgauucucuugccu

SEQ ID NO: 486480 - RNA, 22 nt, Human
ugguaaagugauaagaaaaaga

SEQ ID NO: 486481 - RNA, 21 nt, Human
uguagaaaaaggaguguaugg

SEQ ID NO: 486482 - RNA, 21 nt, Human
uguagaaaaaggaguguaugg

SEQ ID NO: 486483 - RNA, 21 nt, Human
uguaucaaagggaaaugagag

SEQ ID NO: 486484 - RNA, 20 nt, Human
ugucacccaggcuggagugc

SEQ ID NO: 486485 - RNA, 24 nt, Human
ugugagccaccaugccuagcccau

SEQ ID NO: 486486 - RNA, 19 nt, Human
uguguuggcuuccauuuuu

SEQ ID NO: 486487 - RNA, 21 nt, Human
uuaaacuguacaauaaacccc

SEQ ID NO: 486488 - RNA, 27 nt, Human
uuacaugacaguucuuuccuuuuuuuu

SEQ ID NO: 486489 - RNA, 27 nt, Human
uuacaugacaguucuuuccuuuuuuuu

SEQ ID NO: 486490 - RNA, 21 nt, Human
uuaguagagagggguuucgcc

SEQ ID NO: 486491 - RNA, 23 nt, Human
uuaguagagagggguuucgccau

SEQ ID NO: 486492 - RNA, 24 nt, Human
uuaguagagagggguuucgccaug

SEQ ID NO: 486493 - RNA, 23 nt, Human
uucaagcgauucucuugccucag

SEQ ID NO: 486494 - RNA, 20 nt, Human
uucaugaauauuucugaaaa

SEQ ID NO: 486495 - RNA, 20 nt, Human
uuccauuuuuuuuucuguuu

SEQ ID NO: 486496 - RNA, 19 nt, Human
uucugccauuguccccuuc

SEQ ID NO: 486497 - RNA, 19 nt, Human
uugaucacaccaaaagaag

SEQ ID NO: 486498 - RNA, 19 nt, Human
uugaucacaccaaaagaag

SEQ ID NO: 486499 - RNA, 19 nt, Human
uugccuaaaaugagugaug

SEQ ID NO: 486500 - RNA, 20 nt, Human
uuuaaaaaaaaaaaaaguau

SEQ ID NO: 486501 - RNA, 26 nt, Human
uuuaaaauaauuaucagaagccagca

SEQ ID NO: 486502 - RNA, 24 nt, Human
uuuaguagagagggguuucgccau

SEQ ID NO: 486503 - RNA, 24 nt, Human
uuucgccauguuggccaggcuggu

SEQ ID NO: 486504 - RNA, 23 nt, Human
uuucgccauguuggccaggcugu

SEQ ID NO: 486505 - RNA, 20 nt, Human
uuugaaggacaugagaaagc

SEQ ID NO: 486506 - RNA, 20 nt, Human
uuugaaggacaugagaaagc

SEQ ID NO: 486507 - RNA, 18 nt, Human
uuugcagcaaugaguuug

SEQ ID NO: 486508 - RNA, 22 nt, Human
uuugcagcaaugaguuuguacc

SEQ ID NO: 486509 - RNA, 20 nt, Human
uuugcuggaacuccgcuagg

SEQ ID NO: 486510 - RNA, 21 nt, Human
uuugcuggaacuccgcuaggc

SEQ ID NO: 486511 - RNA, 23 nt, Human
uuuuaaacuguacaauaaacccc

SEQ ID NO: 486512 - RNA, 21 nt, Human
uuuugcauaacaucuaugagu

SEQ ID NO: 486513 - RNA, 21 nt, Human
uuuuuaguagagagggguuuc

SEQ ID NO: 486514 - RNA, 18 nt, Human
uuuuuuuuuuuuuuuuug

SEQ ID NO: 486515 - RNA, 18 nt, Human
uuuuuuuuuuuuuuuuug

SEQ ID NO: 486516 - RNA, 18 nt, Human
aacaguuucuggacuuuc

SEQ ID NO: 486517 - RNA, 25 nt, Human
aacgauggagggagggguucagaga

SEQ ID NO: 486518 - RNA, 30 nt, Human
aagcuguuguuuccucaagggaaaacuuuu

SEQ ID NO: 486519 - RNA, 20 nt, Human
acagugaagaaaacgaugga

SEQ ID NO: 486520 - RNA, 22 nt, Human
acccuccuuggccccuucacuc

SEQ ID NO: 486521 - RNA, 19 nt, Human
acuaucucuggucuuggag

SEQ ID NO: 486522 - RNA, 18 nt, Human
agaacaaagaacaagcuc

SEQ ID NO: 486523 - RNA, 21 nt, Human
agaggacucuucaggccacuc

SEQ ID NO: 486524 - RNA, 18 nt, Human
aggcugugcccggccucg

SEQ ID NO: 486525 - RNA, 22 nt, Human
agggacccugggagaggucccu

SEQ ID NO: 486526 - RNA, 18 nt, Human
agguagcugggauugggg

SEQ ID NO: 486527 - RNA, 22 nt, Human
agugaagaaaacgauggaggga

SEQ ID NO: 486528 - RNA, 18 nt, Human
auggagggagggguucag

SEQ ID NO: 486529 - RNA, 20 nt, Human
cacgccccuugcacucaccc

SEQ ID NO: 486530 - RNA, 24 nt, Human
cacuuucaguuuuugguuuagggg

SEQ ID NO: 486531 - RNA, 25 nt, Human
cagcugccauucccgcuggcuugga

SEQ ID NO: 486532 - RNA, 19 nt, Human
cauucccgcuggcuuggag

SEQ ID NO: 486533 - RNA, 18 nt, Human
cauugguugagguagcug

SEQ ID NO: 486534 - RNA, 19 nt, Human
ccacugucacccuccccgc

SEQ ID NO: 486535 - RNA, 24 nt, Human
cccuucacuccagcaggugggaac

SEQ ID NO: 486536 - RNA, 21 nt, Human
ccuauccccaccccagggacc

SEQ ID NO: 486537 - RNA, 25 nt, Human
ccucaccaagccaagaagucucccc

SEQ ID NO: 486538 - RNA, 19 nt, Human
ccucccaucccaguggagc

SEQ ID NO: 486539 - RNA, 22 nt, Human
ccucccaucccaguggagccaa

SEQ ID NO: 486540 - RNA, 23 nt, Human
ccugagcagcuuuuggcgggggg

SEQ ID NO: 486541 - RNA, 22 nt, Human
ccuucacuccagcaggugggaa

SEQ ID NO: 486542 - RNA, 19 nt, Human
ccuugcacucacccuccuu

SEQ ID NO: 486543 - RNA, 22 nt, Human
ccuugggcggccacugucaccc

SEQ ID NO: 486544 - RNA, 23 nt, Human
ccuugggcggccacugucacccu

SEQ ID NO: 486545 - RNA, 24 nt, Human
cucccaucccaguggagccaagag

SEQ ID NO: 486546 - RNA, 19 nt, Human
cucuggucuuggagauaag

SEQ ID NO: 486547 - RNA, 18 nt, Human
cugagugcaugucauccc

SEQ ID NO: 486548 - RNA, 29 nt, Human
cuggagcagggcuugcacucugaggggag

SEQ ID NO: 486549 - RNA, 18 nt, Human
cuggccugcaggaaacac

SEQ ID NO: 486550 - RNA, 19 nt, Human
cuuggccccuucacuccag

SEQ ID NO: 486551 - RNA, 21 nt, Human
cuuucacuuucaguuuuuggu

SEQ ID NO: 486552 - RNA, 18 nt, Human
cuuugaucacgcggaggc

SEQ ID NO: 486553 - RNA, 22 nt, Human
gacgcggcaagugaggggauga

SEQ ID NO: 486554 - RNA, 25 nt, Human
gaggacagugaagaaaaccgguacc

SEQ ID NO: 486555 - RNA, 21 nt, Human
gagggguucagagaguuuguu

SEQ ID NO: 486556 - RNA, 21 nt, Human
gcagcugccauucccgcuggc

SEQ ID NO: 486557 - RNA, 20 nt, Human
ggccagaagguucauucaga

SEQ ID NO: 486558 - RNA, 21 nt, Human
ggcggccacugucacccuccc

SEQ ID NO: 486559 - RNA, 21 nt, Human
uaggggacaauagccucuguu

SEQ ID NO: 486560 - RNA, 21 nt, Human
ucauccccacucuggagccca

SEQ ID NO: 486561 - RNA, 24 nt, Human
ucccacgccccuugcacucacccu

SEQ ID NO: 486562 - RNA, 18 nt, Human
uccccaccccagggaccc

SEQ ID NO: 486563 - RNA, 18 nt, Human
uccccgccccugacauuu

SEQ ID NO: 486564 - RNA, 20 nt, Human
uccccuguugagagccuggg

SEQ ID NO: 486565 - RNA, 19 nt, Human
ucccugagcagcuuuuggc

SEQ ID NO: 486566 - RNA, 20 nt, Human
ucccuuguccucuccuccca

SEQ ID NO: 486567 - RNA, 21 nt, Human
ucggaagagcuggucugagca

SEQ ID NO: 486568 - RNA, 19 nt, Human
ucuggacuuucacuuucag

SEQ ID NO: 486569 - RNA, 20 nt, Human
ugacaaagaacaaagaacaa

SEQ ID NO: 486570 - RNA, 21 nt, Human
ugacaaagaacaaagaacaag

SEQ ID NO: 486571 - RNA, 25 nt, Human
ugacaaagaacaaagaacaagcucg

SEQ ID NO: 486572 - RNA, 18 nt, Human
ugaccagcugauguccgc

SEQ ID NO: 486573 - RNA, 23 nt, Human
uggacuuucacuuucaguuuuug

SEQ ID NO: 486574 - RNA, 19 nt, Human
uggagggagggguucagag

SEQ ID NO: 486575 - RNA, 23 nt, Human
ugugacaaagaacaaagaacaag

SEQ ID NO: 486576 - RNA, 21 nt, Human
uguugucugucugguguuagc

SEQ ID NO: 486577 - RNA, 23 nt, Human
uuaggggacaauagccucuguuu

SEQ ID NO: 486578 - RNA, 18 nt, Human
uugguugagguagcuggg

SEQ ID NO: 486579 - RNA, 21 nt, Human
uuucuggacuuucacuuucag

SEQ ID NO: 486580 - RNA, 19 nt, Human
aauauccacuucuuccagc

SEQ ID NO: 486581 - RNA, 21 nt, Human
aaucacaaucaccuugauuca

SEQ ID NO: 486582 - RNA, 24 nt, Human
acuccagccauuucaccaucaguc

SEQ ID NO: 486583 - RNA, 23 nt, Human
agaauccuuuaaaguuaccacuu

SEQ ID NO: 486584 - RNA, 24 nt, Human
auacagaauccuuuaaaguuacca

SEQ ID NO: 486585 - RNA, 22 nt, Human
aucacaaucaccuugauucaga

SEQ ID NO: 486586 - RNA, 21 nt, Human
auuuuuauuuuuuauuucuua

SEQ ID NO: 486587 - RNA, 22 nt, Human
auuuuuuauuuuuuuccuguag

SEQ ID NO: 486588 - RNA, 18 nt, Human
caacaacauauauggcau

SEQ ID NO: 486589 - RNA, 20 nt, Human
cagccuacugacagucucug

SEQ ID NO: 486590 - RNA, 18 nt, Human
cagcgggaccuuagugac

SEQ ID NO: 486591 - RNA, 23 nt, Human
caugugagugcagcucaaugagc

SEQ ID NO: 486592 - RNA, 23 nt, Human
cccacaccuuugcucacugcuac

SEQ ID NO: 486593 - RNA, 21 nt, Human
ccuuagugacagccuuuguuc

SEQ ID NO: 486594 - RNA, 23 nt, Human
cucaucauugaugucaaaacuuc

SEQ ID NO: 486595 - RNA, 24 nt, Human
cuccagccauuucaccaucaguca

SEQ ID NO: 486596 - RNA, 18 nt, Human
cugauggugaaacagcug

SEQ ID NO: 486597 - RNA, 21 nt, Human
cuguaguccuuccauaagccu

SEQ ID NO: 486598 - RNA, 19 nt, Human
gcagcucaaugagcagcag

SEQ ID NO: 486599 - RNA, 23 nt, Human
ggaaaccuuucacacccacaccu

SEQ ID NO: 486600 - RNA, 22 nt, Human
ggcagcaguagcaucagcagaa

SEQ ID NO: 486601 - RNA, 20 nt, Human
guaguccuuccauaagccuu

SEQ ID NO: 486602 - RNA, 20 nt, Human
uaauaacaacaaucaauaac

SEQ ID NO: 486603 - RNA, 22 nt, Human
uacaguaggcugaaagaagugg

SEQ ID NO: 486604 - RNA, 22 nt, Human
uagcaugccauucaagaaaaug

SEQ ID NO: 486605 - RNA, 22 nt, Human
uaggcugaaagaaguggauauu

SEQ ID NO: 486606 - RNA, 21 nt, Human
ucaaugagcagcagccucucu

SEQ ID NO: 486607 - RNA, 20 nt, Human
ucacaaagucuguauccuca

SEQ ID NO: 486608 - RNA, 19 nt, Human
ucuagaggcaucugccuca

SEQ ID NO: 486609 - RNA, 18 nt, Human
ucucuacuuaugauacug

SEQ ID NO: 486610 - RNA, 22 nt, Human
ucucuacuuaugauacugaguu

SEQ ID NO: 486611 - RNA, 22 nt, Human
ugacgcaccauuaauagugaaa

SEQ ID NO: 486612 - RNA, 21 nt, Human
ugagaagaaacaucagacaca

SEQ ID NO: 486613 - RNA, 24 nt, Human
ugauugaaagguuacuguccacua

SEQ ID NO: 486614 - RNA, 21 nt, Human
ugcugaacuuuuuuuggaaac

SEQ ID NO: 486615 - RNA, 24 nt, Human
uggaaaccuuucacacccacaccu

SEQ ID NO: 486616 - RNA, 22 nt, Human
uggagccucaucauugauguca

SEQ ID NO: 486617 - RNA, 20 nt, Human
uggguccuccagggaagaug

SEQ ID NO: 486618 - RNA, 19 nt, Human
uguguuuuaaguguuggca

SEQ ID NO: 486619 - RNA, 23 nt, Human
uucagaaucacuccagccauuuc

SEQ ID NO: 486620 - RNA, 23 nt, Human
uucagauauugaguaaaucauug

SEQ ID NO: 486621 - RNA, 23 nt, Human
uucaugcugaacuuuuuuuggaa

SEQ ID NO: 486622 - RNA, 22 nt, Human
uugauguugugccaggcaugca

SEQ ID NO: 486623 - RNA, 24 nt, Human
uuuauuuuuauuuuuuauuucuua

SEQ ID NO: 486624 - RNA, 23 nt, Human
aaccagccucaugugcagagggu

SEQ ID NO: 486625 - RNA, 23 nt, Human
aacuccacuucuccuccacccca

SEQ ID NO: 486626 - RNA, 23 nt, Human
aacuccacuucuccuccacccca

SEQ ID NO: 486627 - RNA, 22 nt, Human
accccaaaaacgagagccauga

SEQ ID NO: 486628 - RNA, 22 nt, Human
agaaaggaagaagacagacuaa

SEQ ID NO: 486629 - RNA, 23 nt, Human
agacuaagcagaccaccugaggg

SEQ ID NO: 486630 - RNA, 18 nt, Human
agauguugguaaaccagc

SEQ ID NO: 486631 - RNA, 21 nt, Human
aucccugggccuagacuucug

SEQ ID NO: 486632 - RNA, 24 nt, Human
cacuucuccuccaccccacgcuga

SEQ ID NO: 486633 - RNA, 26 nt, Human
cagaccaccugagguuuuuagaaucu

SEQ ID NO: 486634 - RNA, 23 nt, Human
cagcuccgggccccacugcgccu

SEQ ID NO: 486635 - RNA, 27 nt, Human
caugaccccaaaaacgagagccaugag

SEQ ID NO: 486636 - RNA, 20 nt, Human
ccaaaccaaaucuuccuucc

SEQ ID NO: 486637 - RNA, 22 nt, Human
ccacugcgccuuuuccuagccc

SEQ ID NO: 486638 - RNA, 19 nt, Human
ccccaaaaacgagagccau

SEQ ID NO: 486639 - RNA, 20 nt, Human
ccccacugcgccuuuuccua

SEQ ID NO: 486640 - RNA, 25 nt, Human
ccccacugcgccuuuuccuagcccu

SEQ ID NO: 486641 - RNA, 21 nt, Human
ccccaugaccccaaaaacgag

SEQ ID NO: 486642 - RNA, 22 nt, Human
ccccugugccccugaacuucca

SEQ ID NO: 486643 - RNA, 24 nt, Human
cccuccccaugaccccaaaaacga

SEQ ID NO: 486644 - RNA, 24 nt, Human
cccugaacuuccaaacuccacuuc

SEQ ID NO: 486645 - RNA, 21 nt, Human
ccuccccaugaccccaaaaac

SEQ ID NO: 486646 - RNA, 20 nt, Human
ccugaacuuccaaacuccac

SEQ ID NO: 486647 - RNA, 24 nt, Human
ccuugagaaaggaagaagacagac

SEQ ID NO: 486648 - RNA, 20 nt, Human
cgucaccaggagaacggaag

SEQ ID NO: 486649 - RNA, 20 nt, Human
cugaccaccggggcgguucc

SEQ ID NO: 486650 - RNA, 22 nt, Human
cugcuggauccccaacuggagc

SEQ ID NO: 486651 - RNA, 21 nt, Human
gacuucugucucccucacuuc

SEQ ID NO: 486652 - RNA, 19 nt, Human
gcgguuccuguaggccacg

SEQ ID NO: 486653 - RNA, 24 nt, Human
gugcucagugaugugaagcacaca

SEQ ID NO: 486654 - RNA, 25 nt, Human
uaaaaccaaaccaaaucuuccuucc

SEQ ID NO: 486655 - RNA, 21 nt, Human
uaagcagaccaccugagguuu

SEQ ID NO: 486656 - RNA, 26 nt, Human
uaagcagaccaccugagguuuuuaga

SEQ ID NO: 486657 - RNA, 18 nt, Human
uagcaacagcgcggcagc

SEQ ID NO: 486658 - RNA, 24 nt, Human
uccaaacuccacuucuccuccacc

SEQ ID NO: 486659 - RNA, 24 nt, Human
uccacuugaguuuccaacauaagg

SEQ ID NO: 486660 - RNA, 25 nt, Human
uccccaugaccccaaaaacgagagc

SEQ ID NO: 486661 - RNA, 22 nt, Human
ucccucagggcaaaaguggcua

SEQ ID NO: 486662 - RNA, 19 nt, Human
ucccugggccuagacuucu

SEQ ID NO: 486663 - RNA, 25 nt, Human
uccgggccccacugcgccuuuuccu

SEQ ID NO: 486664 - RNA, 25 nt, Human
ugaacuuccaaacuccacuucuccu

SEQ ID NO: 486665 - RNA, 20 nt, Human
ugagaauaaaaccaaaccaa

SEQ ID NO: 486666 - RNA, 18 nt, Human
ugagggaguagauguugg

SEQ ID NO: 486667 - RNA, 19 nt, Human
ugagggaguagauguuggu

SEQ ID NO: 486668 - RNA, 23 nt, Human
ugaguuuccaacauaaggacacc

SEQ ID NO: 486669 - RNA, 21 nt, Human
ugccccugaacuuccaaacuc

SEQ ID NO: 486670 - RNA, 24 nt, Human
ugccccugaacuuccaaacuccac

SEQ ID NO: 486671 - RNA, 21 nt, Human
ugccccugugccccugaacuu

SEQ ID NO: 486672 - RNA, 23 nt, Human
uggauccccaacuggagccaucc

SEQ ID NO: 486673 - RNA, 19 nt, Human
ugugcagagggucuccugc

SEQ ID NO: 486674 - RNA, 23 nt, Human
uuauaaauuaauuccaggaacgc

SEQ ID NO: 486675 - RNA, 23 nt, Human
uuuuuuuuuuuuuuuuugggauu

SEQ ID NO: 486676 - RNA, 22 nt, Human
uuuuuuuuuuuuuuuuuuuggg

SEQ ID NO: 486677 - RNA, 24 nt, Human
aaacaacaaacuggaccuggauuc

SEQ ID NO: 486678 - RNA, 18 nt, Human
agccccacuuucccuuuc

SEQ ID NO: 486679 - RNA, 22 nt, Human
aggaaacaacaaacuggaccug

SEQ ID NO: 486680 - RNA, 24 nt, Human
aggcgaaggagcucacguuuguaa

SEQ ID NO: 486681 - RNA, 24 nt, Human
auuuuguauacaaauguguagaaa

SEQ ID NO: 486682 - RNA, 19 nt, Human
caccucucccuuuucuucc

SEQ ID NO: 486683 - RNA, 19 nt, Human
cagaaagaugaaaauccau

SEQ ID NO: 486684 - RNA, 19 nt, Human
cagccccacuuucccuuuc

SEQ ID NO: 486685 - RNA, 19 nt, Human
caugucguuuguccccagg

SEQ ID NO: 486686 - RNA, 24 nt, Human
cccuauuucagaagacugaaauaa

SEQ ID NO: 486687 - RNA, 25 nt, Human
cccuccgacagcugccuuauccugg

SEQ ID NO: 486688 - RNA, 19 nt, Human
cccuuuucuuccuguaucc

SEQ ID NO: 486689 - RNA, 19 nt, Human
ccuggaggaaacaacaaac

SEQ ID NO: 486690 - RNA, 22 nt, Human
ccuguggagaaaugggagauga

SEQ ID NO: 486691 - RNA, 21 nt, Human
cucccuuuucuuccuguaucc

SEQ ID NO: 486692 - RNA, 24 nt, Human
cugccuuauccuggaggaaacaac

SEQ ID NO: 486693 - RNA, 19 nt, Human
gagacuaguccuauccaca

SEQ ID NO: 486694 - RNA, 24 nt, Human
gcccuguggagaaaugggagauga

SEQ ID NO: 486695 - RNA, 18 nt, Human
gcuaccagggcuggagaa

SEQ ID NO: 486696 - RNA, 20 nt, Human
uaacgugugcccacuucccc

SEQ ID NO: 486697 - RNA, 19 nt, Human
uacagccccacuuucccuu

SEQ ID NO: 486698 - RNA, 22 nt, Human
uauucuucuugcauuuggugga

SEQ ID NO: 486699 - RNA, 24 nt, Human
ucaccucucccuuuucuuccugua

SEQ ID NO: 486700 - RNA, 23 nt, Human
ugcccuguggagaaaugggagau

SEQ ID NO: 486701 - RNA, 18 nt, Human
uggagaaaugggagauga

SEQ ID NO: 486702 - RNA, 23 nt, Human
ugggagaugauuuuccccuccga

SEQ ID NO: 486703 - RNA, 18 nt, Human
uucagaagacugaaauaa

SEQ ID NO: 486704 - RNA, 22 nt, Human
uucugccacuuccuaguuaugu

SEQ ID NO: 486705 - RNA, 24 nt, Human
aaaaaaaaaaaaaauagacuccug

SEQ ID NO: 486706 - RNA, 23 nt, Human
aaaaaaauagacuccugugauua

SEQ ID NO: 486707 - RNA, 19 nt, Human
aaaaagacaaaagcaagua

SEQ ID NO: 486708 - RNA, 19 nt, Human
aacacggugaaaccccguc

SEQ ID NO: 486709 - RNA, 20 nt, Human
aacacggugaaaccccgucu

SEQ ID NO: 486710 - RNA, 21 nt, Human
aacacggugaaaccccgucuc

SEQ ID NO: 486711 - RNA, 24 nt, Human
aacagagcgagacucugucucaaa

SEQ ID NO: 486712 - RNA, 21 nt, Human
acagagcgagacucugucuca

SEQ ID NO: 486713 - RNA, 24 nt, Human
acagagcgagacucugucucaaaa

SEQ ID NO: 486714 - RNA, 24 nt, Human
accccgucucuacuaaaaauacaa

SEQ ID NO: 486715 - RNA, 26 nt, Human
acuccugugauuaaaaagacaaaagc

SEQ ID NO: 486716 - RNA, 28 nt, Human
acucugucucaaaaaaaaaaaaaaaaaa

SEQ ID NO: 486717 - RNA, 23 nt, Human
acuguacuccgccuaggcaacag

SEQ ID NO: 486718 - RNA, 24 nt, Human
aggcaggagaaugccaugaacccg

SEQ ID NO: 486719 - RNA, 24 nt, Human
aggcggaucuugcagugagccgag

SEQ ID NO: 486720 - RNA, 19 nt, Human
aggcugaggcaggagaaug

SEQ ID NO: 486721 - RNA, 21 nt, Human
cacggccccucgcgcgcccga

SEQ ID NO: 486722 - RNA, 23 nt, Human
cacuguacuccgccuaggcaaca

SEQ ID NO: 486723 - RNA, 23 nt, Human
ccaccacggccccucgcgcgccc

SEQ ID NO: 486724 - RNA, 19 nt, Human
ccacuguacuccgccuagg

SEQ ID NO: 486725 - RNA, 20 nt, Human
ccacuguacuccgccuaggc

SEQ ID NO: 486726 - RNA, 20 nt, Human
ccccucgcgcgcccgaggag

SEQ ID NO: 486727 - RNA, 22 nt, Human
cccggcuggggccgaggagguc

SEQ ID NO: 486728 - RNA, 18 nt, Human
ccgccaccacggccccuc

SEQ ID NO: 486729 - RNA, 20 nt, Human
ccucgcgcgcccgaggagcg

SEQ ID NO: 486730 - RNA, 23 nt, Human
ccuggcuaacacggugaaacccc

SEQ ID NO: 486731 - RNA, 24 nt, Human
ccuggcuaacacggugaaaccccg

SEQ ID NO: 486732 - RNA, 19 nt, Human
ccuguugucccaguugccc

SEQ ID NO: 486733 - RNA, 24 nt, Human
cgagaccauccuggcuaacacggu

SEQ ID NO: 486734 - RNA, 21 nt, Human
cgagagcaccgagucgagccc

SEQ ID NO: 486735 - RNA, 21 nt, Human
cgagaucaggccacuguacuc

SEQ ID NO: 486736 - RNA, 18 nt, Human
cucaaaaaaaaaaaaaaa

SEQ ID NO: 486737 - RNA, 19 nt, Human
cucugucucaaaaaaaaaa

SEQ ID NO: 486738 - RNA, 18 nt, Human
cuggcuaacacggugaaa

SEQ ID NO: 486739 - RNA, 19 nt, Human
cuugcagugagccgagauc

SEQ ID NO: 486740 - RNA, 26 nt, Human
gaaaucccgggcagcagagccggaga

SEQ ID NO: 486741 - RNA, 20 nt, Human
gagagcaccgagucgagccg

SEQ ID NO: 486742 - RNA, 19 nt, Human
gagcccggcuggggccgag

SEQ ID NO: 486743 - RNA, 25 nt, Human
gagcccggcuggggccgagagcacc

SEQ ID NO: 486744 - RNA, 24 nt, Human
gcaacagagcgagacucugucuca

SEQ ID NO: 486745 - RNA, 23 nt, Human
gccacuguacuccgccuaggcaa

SEQ ID NO: 486746 - RNA, 24 nt, Human
gccacuguacuccgccuaggcaac

SEQ ID NO: 486747 - RNA, 19 nt, Human
gcggaucuugcagugagcc

SEQ ID NO: 486748 - RNA, 24 nt, Human
gcuaacacggugaaaccccgucuc

SEQ ID NO: 486749 - RNA, 21 nt, Human
ggagaaugccaugaacccggg

SEQ ID NO: 486750 - RNA, 18 nt, Human
ggcguggugacgggcgcc

SEQ ID NO: 486751 - RNA, 23 nt, Human
guacuccgccuaggcaacagagc

SEQ ID NO: 486752 - RNA, 22 nt, Human
uaacacggugaaaccccgucuc

SEQ ID NO: 486753 - RNA, 24 nt, Human
uaacacggugaaaccccgucucua

SEQ ID NO: 486754 - RNA, 22 nt, Human
ucaaaaaaaaaaaaaaaaaaaa

SEQ ID NO: 486755 - RNA, 23 nt, Human
ucaaaaaaaaaaaaaaaaaaaaa

SEQ ID NO: 486756 - RNA, 24 nt, Human
ucaaaaaaaaaaaaaaaaaaaaau

SEQ ID NO: 486757 - RNA, 19 nt, Human
uccgggcagugugggcgga

SEQ ID NO: 486758 - RNA, 22 nt, Human
ucucuacuaaaaauacaaaaaa

SEQ ID NO: 486759 - RNA, 23 nt, Human
ucugucucaaaaaaaaaaaaaaa

SEQ ID NO: 486760 - RNA, 24 nt, Human
ugaggcaggagaaugccaugaacc

SEQ ID NO: 486761 - RNA, 25 nt, Human
ugaggcaggagaaugccaugaaccc

SEQ ID NO: 486762 - RNA, 19 nt, Human
ugccaugaacccgggaggc

SEQ ID NO: 486763 - RNA, 21 nt, Human
ugucccaguugcccuggaggc

SEQ ID NO: 486764 - RNA, 24 nt, Human
uguccgggcagugugggcggaugc

SEQ ID NO: 486765 - RNA, 22 nt, Human
uuagcugggcguggugacgggc

SEQ ID NO: 486766 - RNA, 24 nt, Human
uuagcugggcguggugacgggcgc

SEQ ID NO: 486767 - RNA, 18 nt, Human
uugcagugagccgagauc

SEQ ID NO: 486768 - RNA, 23 nt, Human
uugcagugagccgagaucaggcc

SEQ ID NO: 486769 - RNA, 25 nt, Human
uugcagugagccgagaucaggccac

SEQ ID NO: 486770 - RNA, 20 nt, Human
aaaucugccuuuugaaacca

SEQ ID NO: 486771 - RNA, 22 nt, Human
aagcccagaaauucagaggaaa

SEQ ID NO: 486772 - RNA, 25 nt, Human
agaccaagcccagaaauucagagga

SEQ ID NO: 486773 - RNA, 27 nt, Human
caaggaacaccaaggugaucuucuucc

SEQ ID NO: 486774 - RNA, 18 nt, Human
cagaauguugggagaaga

SEQ ID NO: 486775 - RNA, 20 nt, Human
cuggugaucauaauggugcu

SEQ ID NO: 486776 - RNA, 23 nt, Human
gaaauaacagaauguugggagaa

SEQ ID NO: 486777 - RNA, 19 nt, Human
gaccaagcccagaaauuca

SEQ ID NO: 486778 - RNA, 21 nt, Human
uauuuucauuaaauuguuuca

SEQ ID NO: 486779 - RNA, 18 nt, Human
ugggagaagauaaaucug

SEQ ID NO: 486780 - RNA, 19 nt, Human
ugggagaagauaaaucugc

SEQ ID NO: 486781 - RNA, 23 nt, Human
uucaaaaguaucagaaauaacag

SEQ ID NO: 486782 - RNA, 24 nt, Human
aaacuaugguuaccaaacagcuau

SEQ ID NO: 486783 - RNA, 18 nt, Human
acagugucuggaaaagga

SEQ ID NO: 486784 - RNA, 22 nt, Human
cacgcgcagcacaagacgcgcg

SEQ ID NO: 486785 - RNA, 22 nt, Human
cggaagcgagaaugcacuuccc

SEQ ID NO: 486786 - RNA, 22 nt, Human
cgggagggcccaaaagcuugcg

SEQ ID NO: 486787 - RNA, 21 nt, Human
cuacugagacuaauuucacgc

SEQ ID NO: 486788 - RNA, 18 nt, Human
cuggaaaaggauguaaca

SEQ ID NO: 486789 - RNA, 19 nt, Human
cuuaaacccgaagagaaga

SEQ ID NO: 486790 - RNA, 20 nt, Human
cuugcuacauaguuuucuca

SEQ ID NO: 486791 - RNA, 25 nt, Human
gaacaagugaaacuaugguuacuac

SEQ ID NO: 486792 - RNA, 19 nt, Human
gaagagaagauaaagguug

SEQ ID NO: 486793 - RNA, 19 nt, Human
guacccccacgauuacaca

SEQ ID NO: 486794 - RNA, 22 nt, Human
uaacaauaaauaacuguagaug

SEQ ID NO: 486795 - RNA, 22 nt, Human
uacaauaaacguuucuuaaacc

SEQ ID NO: 486796 - RNA, 23 nt, Human
uacaaugaauacaaaagcaguug

SEQ ID NO: 486797 - RNA, 21 nt, Human
uacccccacgauuacacagcu

SEQ ID NO: 486798 - RNA, 20 nt, Human
ucccuuucucgggagggccc

SEQ ID NO: 486799 - RNA, 18 nt, Human
ugucuggaaaaggaugua

SEQ ID NO: 486800 - RNA, 18 nt, Human
aaaauuccacagcuguaa

SEQ ID NO: 486801 - RNA, 28 nt, Human
cacagcuguaauccucaggaucacuuug

SEQ ID NO: 486802 - RNA, 24 nt, Human
cuaaagcaaaacauccuguucacu

SEQ ID NO: 486803 - RNA, 24 nt, Human
gacaaaaauuccacagcuguaauc

SEQ ID NO: 486804 - RNA, 18 nt, Human
gcgcggcguggccgggag

SEQ ID NO: 486805 - RNA, 24 nt, Human
gcuccagcggaggaaaaggaaacg

SEQ ID NO: 486806 - RNA, 22 nt, Human
ggcgcggcguggccgggaggaa

SEQ ID NO: 486807 - RNA, 26 nt, Human
uaaagcaaaacauccuguucacugga

SEQ ID NO: 486808 - RNA, 21 nt, Human
uaacaagguaaguaacauaug

SEQ ID NO: 486809 - RNA, 20 nt, Human
ucagugcaauuuuuaaaaaa

SEQ ID NO: 486810 - RNA, 21 nt, Human
uccagcggaggaaaaggaaac

SEQ ID NO: 486811 - RNA, 21 nt, Human
ugcuccagcggaggaaaagga

SEQ ID NO: 486812 - RNA, 24 nt, Human
uucucuccuuuuuucauaugggaa

SEQ ID NO: 486813 - RNA, 28 nt, Human
uuucagaacuuccaaauuucucauuuga

SEQ ID NO: 486814 - RNA, 23 nt, Human
uuuuaugucacugcugcuaaagc

SEQ ID NO: 486815 - RNA, 22 nt, Human
aaacugcauuuauuguguagaa

SEQ ID NO: 486816 - RNA, 19 nt, Human
agagggagaaaaaaaaaaa

SEQ ID NO: 486817 - RNA, 20 nt, Human
cacaauaguagucagaugua

SEQ ID NO: 486818 - RNA, 21 nt, Human
ggagaaaaaaaaaaagccuua

SEQ ID NO: 486819 - RNA, 21 nt, Human
uucagagggagaaaaaaaaaa

SEQ ID NO: 486820 - RNA, 22 nt, Human
uucagagggagaaaaaaaaaaa

SEQ ID NO: 486821 - RNA, 22 nt, Human
ccuccaguaagaagagaguggg

SEQ ID NO: 486822 - RNA, 18 nt, Human
cuuguaaaaugaaguaac

SEQ ID NO: 486823 - RNA, 18 nt, Human
ggcccuccacucuccccu

SEQ ID NO: 486824 - RNA, 19 nt, Human
gguaagugcacccagcagc

SEQ ID NO: 486825 - RNA, 18 nt, Human
uaagugcacccagcagcc

SEQ ID NO: 486826 - RNA, 20 nt, Human
ucagcggcccuccacucucc

SEQ ID NO: 486827 - RNA, 22 nt, Human
ucuccgagaccgggccgcaaac

SEQ ID NO: 486828 - RNA, 18 nt, Human
ugugauggguggggugcc

SEQ ID NO: 486829 - RNA, 23 nt, Human
uugaagucuuacauuuuauuuaa

SEQ ID NO: 486830 - RNA, 19 nt, Human
uuuuuuuuuuuugaagucu

SEQ ID NO: 486831 - RNA, 18 nt, Human
uuuuuuuuuuuuuuuuug

SEQ ID NO: 486832 - RNA, 21 nt, Human
aaggagaauaagaaaacauca

SEQ ID NO: 486833 - RNA, 22 nt, Human
acaaauacagccuucaccuaca

SEQ ID NO: 486834 - RNA, 20 nt, Human
gccaagaauacaaacacaaa

SEQ ID NO: 486835 - RNA, 26 nt, Human
aaaaaaaacucuuuuuucaaaauaga

SEQ ID NO: 486836 - RNA, 23 nt, Human
aaaagagagaagaaaagaaaaaa

SEQ ID NO: 486837 - RNA, 18 nt, Human
aaagaagaaagggagaag

SEQ ID NO: 486838 - RNA, 23 nt, Human
aaagagaaaaacuaaaccauuuc

SEQ ID NO: 486839 - RNA, 23 nt, Human
aaagggagaaggaaagaaaagag

SEQ ID NO: 486840 - RNA, 19 nt, Human
aagaaagggagaaggaaag

SEQ ID NO: 486841 - RNA, 25 nt, Human
aagagagaagaaaagaaaaaagggg

SEQ ID NO: 486842 - RNA, 21 nt, Human
aagcaaauucuuuggagccca

SEQ ID NO: 486843 - RNA, 24 nt, Human
aaggaaagaaaagagagaagaaaa

SEQ ID NO: 486844 - RNA, 19 nt, Human
aaggagacagcacacccag

SEQ ID NO: 486845 - RNA, 24 nt, Human
aagggaacagaugaagcuucagag

SEQ ID NO: 486846 - RNA, 20 nt, Human
acaaagaucaggugaagaaa

SEQ ID NO: 486847 - RNA, 21 nt, Human
acacagaguccuuuaaaaaua

SEQ ID NO: 486848 - RNA, 20 nt, Human
acaugugacuacuggaaaug

SEQ ID NO: 486849 - RNA, 18 nt, Human
agaaaacaaacaccucca

SEQ ID NO: 486850 - RNA, 21 nt, Human
agaaaagagagaagaaaagaa

SEQ ID NO: 486851 - RNA, 22 nt, Human
agaaagggagaaggaaagaaaa

SEQ ID NO: 486852 - RNA, 19 nt, Human
agaagaaaagaaaaaaggg

SEQ ID NO: 486853 - RNA, 21 nt, Human
agaagaaaagaaaaaagggga

SEQ ID NO: 486854 - RNA, 25 nt, Human
agaagaaagggagaaggaaagaaaa

SEQ ID NO: 486855 - RNA, 24 nt, Human
agacagcacacccagcacccccca

SEQ ID NO: 486856 - RNA, 19 nt, Human
agagaagaaaagaaaaaag

SEQ ID NO: 486857 - RNA, 18 nt, Human
agaggaaaaagagaggga

SEQ ID NO: 486858 - RNA, 18 nt, Human
agaggaaaaagagaggga

SEQ ID NO: 486859 - RNA, 24 nt, Human
agaggaaaaagagagggagggcaa

SEQ ID NO: 486860 - RNA, 23 nt, Human
agaugucacuagacaacuggcag

SEQ ID NO: 486861 - RNA, 24 nt, Human
agcaaauucuuuggagcccauggc

SEQ ID NO: 486862 - RNA, 18 nt, Human
agcagucaugucaagaug

SEQ ID NO: 486863 - RNA, 22 nt, Human
agcuaaagagaaaaacuaaacc

SEQ ID NO: 486864 - RNA, 23 nt, Human
aggaaagaaaagagagaagaaaa

SEQ ID NO: 486865 - RNA, 23 nt, Human
auaaaagaucauuaauuguugac

SEQ ID NO: 486866 - RNA, 20 nt, Human
aucccugcaaccccauagaa

SEQ ID NO: 486867 - RNA, 22 nt, Human
augaagcacauauugcagugcu

SEQ ID NO: 486868 - RNA, 22 nt, Human
auucuucuacgaaaacaaaaca

SEQ ID NO: 486869 - RNA, 26 nt, Human
caaaacaaucacaugugacuacugga

SEQ ID NO: 486870 - RNA, 23 nt, Human
caaaauagaagcaguauucuucu

SEQ ID NO: 486871 - RNA, 23 nt, Human
caaccccauagaaagaaaaaaaa

SEQ ID NO: 486872 - RNA, 20 nt, Human
caagcaucagaugucacuag

SEQ ID NO: 486873 - RNA, 18 nt, Human
cacaugugacuacuggaa

SEQ ID NO: 486874 - RNA, 26 nt, Human
cacuuaaaaaaaauucaccaccuaga

SEQ ID NO: 486875 - RNA, 20 nt, Human
cagcacacccagcacccccc

SEQ ID NO: 486876 - RNA, 24 nt, Human
caggauucggggaucuuaaaaguu

SEQ ID NO: 486877 - RNA, 20 nt, Human
ccacugggcauggggugggu

SEQ ID NO: 486878 - RNA, 22 nt, Human
ccauagagcuaaagagaaaaac

SEQ ID NO: 486879 - RNA, 20 nt, Human
cccauagaaagaaaaaaaac

SEQ ID NO: 486880 - RNA, 19 nt, Human
cccauucccagggaaaucc

SEQ ID NO: 486881 - RNA, 25 nt, Human
ccgugccacuuaaaaaaaauucacc

SEQ ID NO: 486882 - RNA, 23 nt, Human
ccugcaaccccauagaaagaaaa

SEQ ID NO: 486883 - RNA, 24 nt, Human
ccugcaaccccauagaaagaaaaa

SEQ ID NO: 486884 - RNA, 22 nt, Human
cgaaaucccaugaagcacauau

SEQ ID NO: 486885 - RNA, 18 nt, Human
cgggcaccguggggugug

SEQ ID NO: 486886 - RNA, 23 nt, Human
cuccuccugcuggcuguuuucuc

SEQ ID NO: 486887 - RNA, 19 nt, Human
cugcagugacuuaccuagu

SEQ ID NO: 486888 - RNA, 22 nt, Human
cugguguggggcugaggaugug

SEQ ID NO: 486889 - RNA, 20 nt, Human
gaacuagaagagguuccaca

SEQ ID NO: 486890 - RNA, 23 nt, Human
gagaagaaaagaaaaaaggggga

SEQ ID NO: 486891 - RNA, 20 nt, Human
gaggugggaagggaacagau

SEQ ID NO: 486892 - RNA, 19 nt, Human
gcaaacauggauguguaau

SEQ ID NO: 486893 - RNA, 21 nt, Human
gcagugcucucugacucucac

SEQ ID NO: 486894 - RNA, 23 nt, Human
ggagaaaacaaacaccuccaaaa

SEQ ID NO: 486895 - RNA, 23 nt, Human
ggcaaagaagaaagggagaagga

SEQ ID NO: 486896 - RNA, 22 nt, Human
gggaaggagacagcacacccag

SEQ ID NO: 486897 - RNA, 25 nt, Human
gggcaugggguggguuggggugggg

SEQ ID NO: 486898 - RNA, 20 nt, Human
ggguggggugggcaguaggg

SEQ ID NO: 486899 - RNA, 18 nt, Human
gugggcaguagggcuagg

SEQ ID NO: 486900 - RNA, 23 nt, Human
guggguugggguggggugggcag

SEQ ID NO: 486901 - RNA, 18 nt, Human
uaaagagaaaaacuaaac

SEQ ID NO: 486902 - RNA, 23 nt, Human
uacugccccucacauuucucuac

SEQ ID NO: 486903 - RNA, 22 nt, Human
uagaaggcaaagaagaaaggga

SEQ ID NO: 486904 - RNA, 18 nt, Human
uagcuaaaaacauaaagc

SEQ ID NO: 486905 - RNA, 22 nt, Human
uagcuaaaaacauaaagcaaau

SEQ ID NO: 486906 - RNA, 23 nt, Human
uauuuuguuguaucccuggcuca

SEQ ID NO: 486907 - RNA, 21 nt, Human
ucaagcagaaaaagaccgugc

SEQ ID NO: 486908 - RNA, 21 nt, Human
ucacuagacaacuggcagucu

SEQ ID NO: 486909 - RNA, 18 nt, Human
uccacacaaagaucaggu

SEQ ID NO: 486910 - RNA, 19 nt, Human
uccacaggaucccuggcca

SEQ ID NO: 486911 - RNA, 19 nt, Human
ucccagggaaauccaucuu

SEQ ID NO: 486912 - RNA, 22 nt, Human
uccucaaccucugagauggugu

SEQ ID NO: 486913 - RNA, 20 nt, Human
ucucaccccugaaauagagc

SEQ ID NO: 486914 - RNA, 23 nt, Human
ugaaaagcacaguaaauguacug

SEQ ID NO: 486915 - RNA, 19 nt, Human
ugaaauagagcuggugugg

SEQ ID NO: 486916 - RNA, 20 nt, Human
ugaaaugccauagagcuaaa

SEQ ID NO: 486917 - RNA, 18 nt, Human
ugagaccacugggcaugg

SEQ ID NO: 486918 - RNA, 19 nt, Human
ugccugggcuacaguccgc

SEQ ID NO: 486919 - RNA, 26 nt, Human
uggaaauguuaguguuacacagaguc

SEQ ID NO: 486920 - RNA, 20 nt, Human
uggcuugccaccuccucccu

SEQ ID NO: 486921 - RNA, 20 nt, Human
uggcuugccaccuccucccu

SEQ ID NO: 486922 - RNA, 21 nt, Human
ugggaaggagacagcacaccc

SEQ ID NO: 486923 - RNA, 24 nt, Human
ugggaaggagacagcacacccagc

SEQ ID NO: 486924 - RNA, 24 nt, Human
uggggggugugaucagauuucaag

SEQ ID NO: 486925 - RNA, 24 nt, Human
ugggguggggugggcaguagggcu

SEQ ID NO: 486926 - RNA, 18 nt, Human
ugguguggggcugaggau

SEQ ID NO: 486927 - RNA, 20 nt, Human
uguggggcugaggauguggg

SEQ ID NO: 486928 - RNA, 24 nt, Human
uguuguacaccaucccugcaaccc

SEQ ID NO: 486929 - RNA, 26 nt, Human
uucaagcagaaaaagaccgugccacu

SEQ ID NO: 486930 - RNA, 22 nt, Human
uucucccauucccagggaaauc

SEQ ID NO: 486931 - RNA, 23 nt, Human
uuguacaccaucccugcaacccc

SEQ ID NO: 486932 - RNA, 19 nt, Human
uuuagaaggcaaagaagaa

SEQ ID NO: 486933 - RNA, 22 nt, Human
aaaaauuccaauuauacaaggg

SEQ ID NO: 486934 - RNA, 22 nt, Human
aaaugucuucuaagaaccuugg

SEQ ID NO: 486935 - RNA, 19 nt, Human
agaacuguaagaaaaucag

SEQ ID NO: 486936 - RNA, 22 nt, Human
agcuaagaaucaaaaauuccaa

SEQ ID NO: 486937 - RNA, 18 nt, Human
aucagacaguaauuauaa

SEQ ID NO: 486938 - RNA, 21 nt, Human
aucaguucuucagagaacuag

SEQ ID NO: 486939 - RNA, 20 nt, Human
cacucaguacuuuuccucca

SEQ ID NO: 486940 - RNA, 22 nt, Human
uaagaaccuuggaaaaccuaau

SEQ ID NO: 486941 - RNA, 18 nt, Human
uagaacuguaagaaaauc

SEQ ID NO: 486942 - RNA, 18 nt, Human
aacugggcccccagcagg

SEQ ID NO: 486943 - RNA, 23 nt, Human
acauccggggcacccgccgccau

SEQ ID NO: 486944 - RNA, 20 nt, Human
caauuuccucgcugccugag

SEQ ID NO: 486945 - RNA, 25 nt, Human
cauccggggcacccgccgccaucac

SEQ ID NO: 486946 - RNA, 20 nt, Human
cccaccaaacugggccccca

SEQ ID NO: 486947 - RNA, 21 nt, Human
cccgccgccaucacccggaag

SEQ ID NO: 486948 - RNA, 21 nt, Human
ccuccaauuuccucgcugccu

SEQ ID NO: 486949 - RNA, 26 nt, Human
cggaaggcgagguggaaaaaagaaga

SEQ ID NO: 486950 - RNA, 21 nt, Human
gagacacuuggugccuccucc

SEQ ID NO: 486951 - RNA, 23 nt, Human
uccacaaaguccaggaagcggac

SEQ ID NO: 486952 - RNA, 28 nt, Human
uccggggcacccgccgccaucacccgga

SEQ ID NO: 486953 - RNA, 22 nt, Human
uccuccacaaaguccaggaaag

SEQ ID NO: 486954 - RNA, 20 nt, Human
ucgcugccugagacacuugg

SEQ ID NO: 486955 - RNA, 22 nt, Human
ugagacacuuggugccuccucc

SEQ ID NO: 486956 - RNA, 24 nt, Human
uggccuccaauuuccucgcugccu

SEQ ID NO: 486957 - RNA, 18 nt, Human
uuuacacaacuaaaggcu

SEQ ID NO: 486958 - RNA, 21 nt, Human
aagaugauaaaacucauuucu

SEQ ID NO: 486959 - RNA, 21 nt, Human
aagucccuucagcagcagcuc

SEQ ID NO: 486960 - RNA, 19 nt, Human
accacaccgggacugcagu

SEQ ID NO: 486961 - RNA, 22 nt, Human
acccgcggcucgcagggcuccg

SEQ ID NO: 486962 - RNA, 21 nt, Human
acgcaggccgcagaggcacgg

SEQ ID NO: 486963 - RNA, 21 nt, Human
acuccauuguuuuccgaggcc

SEQ ID NO: 486964 - RNA, 20 nt, Human
aggcagggcccccaggccuc

SEQ ID NO: 486965 - RNA, 19 nt, Human
agugucugcacaagccugc

SEQ ID NO: 486966 - RNA, 18 nt, Human
cacagccccuguggucag

SEQ ID NO: 486967 - RNA, 20 nt, Human
caccacaccgggacugcagu

SEQ ID NO: 486968 - RNA, 19 nt, Human
cacgcaggccgcagaggca

SEQ ID NO: 486969 - RNA, 23 nt, Human
cacgcaggccgcagaggcacggu

SEQ ID NO: 486970 - RNA, 21 nt, Human
cagcagcagcuccaucccuga

SEQ ID NO: 486971 - RNA, 24 nt, Human
cagcagcagcuccaucccugagug

SEQ ID NO: 486972 - RNA, 20 nt, Human
cagccccuguggucaggccu

SEQ ID NO: 486973 - RNA, 19 nt, Human
caggcccagcggccaggcc

SEQ ID NO: 486974 - RNA, 20 nt, Human
caggcccagcggccaggccu

SEQ ID NO: 486975 - RNA, 20 nt, Human
caggcuguggggcugggggg

SEQ ID NO: 486976 - RNA, 18 nt, Human
caguagaaaagggucaca

SEQ ID NO: 486977 - RNA, 23 nt, Human
ccaaagcucguggccagggccug

SEQ ID NO: 486978 - RNA, 21 nt, Human
ccaccacaccgggacugcagu

SEQ ID NO: 486979 - RNA, 19 nt, Human
ccacugaauuuggcacagg

SEQ ID NO: 486980 - RNA, 19 nt, Human
ccaggccuggcuggcucac

SEQ ID NO: 486981 - RNA, 22 nt, Human
cccuacaagucccuucagcagc

SEQ ID NO: 486982 - RNA, 21 nt, Human
ccuguggucaggccugugggc

SEQ ID NO: 486983 - RNA, 20 nt, Human
cgcaggacccacagccccuu

SEQ ID NO: 486984 - RNA, 22 nt, Human
cgcccggaaggcagggccccca

SEQ ID NO: 486985 - RNA, 23 nt, Human
cgccuggggcccacccgcggcuc

SEQ ID NO: 486986 - RNA, 23 nt, Human
cucccuacaagucccuucagcag

SEQ ID NO: 486987 - RNA, 21 nt, Human
cugcacgcauguguguaugug

SEQ ID NO: 486988 - RNA, 21 nt, Human
cuguggggcuggggggcuguc

SEQ ID NO: 486989 - RNA, 18 nt, Human
gaggaaaagggcgccaga

SEQ ID NO: 486990 - RNA, 21 nt, Human
gccucucccuacaagucccuu

SEQ ID NO: 486991 - RNA, 18 nt, Human
gcgacagagacgacacag

SEQ ID NO: 486992 - RNA, 23 nt, Human
ggccuggcagguagaccaaggcc

SEQ ID NO: 486993 - RNA, 22 nt, Human
gggacccugugagggggugggg

SEQ ID NO: 486994 - RNA, 18 nt, Human
gggaucaaaguccggccg

SEQ ID NO: 486995 - RNA, 19 nt, Human
gggcagcucgggggcacag

SEQ ID NO: 486996 - RNA, 19 nt, Human
ggggacgcaggacccacag

SEQ ID NO: 486997 - RNA, 21 nt, Human
ggggugggggcagcucggggg

SEQ ID NO: 486998 - RNA, 22 nt, Human
ggggugggggcagcucgggggc

SEQ ID NO: 486999 - RNA, 22 nt, Human
gugggggcagcucgggggcaca

SEQ ID NO: 487000 - RNA, 18 nt, Human
ucaccuuggaggggagga

SEQ ID NO: 487001 - RNA, 19 nt, Human
ucaguccauaggaugaugu

SEQ ID NO: 487002 - RNA, 24 nt, Human
ucccugagugucugcacaagccug

SEQ ID NO: 487003 - RNA, 18 nt, Human
ucccuucagcagcagcuc

SEQ ID NO: 487004 - RNA, 24 nt, Human
ugacgagccucucccuacaagucc

SEQ ID NO: 487005 - RNA, 20 nt, Human
ugagggggugggggcagcuc

SEQ ID NO: 487006 - RNA, 18 nt, Human
ugcacaagccugcacgca

SEQ ID NO: 487007 - RNA, 20 nt, Human
ugccagggcgugugugcagg

SEQ ID NO: 487008 - RNA, 19 nt, Human
ugccccaggguccaggagc

SEQ ID NO: 487009 - RNA, 18 nt, Human
uggcagcugggaggcuca

SEQ ID NO: 487010 - RNA, 22 nt, Human
uggcagcugggaggcucaggcu

SEQ ID NO: 487011 - RNA, 23 nt, Human
uggcagcugggaggcucaggcug

SEQ ID NO: 487012 - RNA, 19 nt, Human
uggcagguagaccaaggcc

SEQ ID NO: 487013 - RNA, 21 nt, Human
ugggagaguccgggagaagcg

SEQ ID NO: 487014 - RNA, 21 nt, Human
uggggggcuguccgcugggag

SEQ ID NO: 487015 - RNA, 18 nt, Human
uguaggggcuggggggcc

SEQ ID NO: 487016 - RNA, 18 nt, Human
uguaggggcuggggggcc

SEQ ID NO: 487017 - RNA, 19 nt, Human
uguaggggcuggggggccg

SEQ ID NO: 487018 - RNA, 31 nt, Human
ugucugcacaagccugcacgcauguguguag

SEQ ID NO: 487019 - RNA, 24 nt, Human
ugugggccacguggagagaagguu

SEQ ID NO: 487020 - RNA, 22 nt, Human
ugugugccagggcgugugugca

SEQ ID NO: 487021 - RNA, 23 nt, Human
uguugacgagccucucccuacaa

SEQ ID NO: 487022 - RNA, 19 nt, Human
uuggaggggaggaagccug

SEQ ID NO: 487023 - RNA, 23 nt, Human
uuuuuuuuuuuuuuuuuuaaacg

SEQ ID NO: 487024 - RNA, 22 nt, Human
aacaacaacaaaauuacuauac

SEQ ID NO: 487025 - RNA, 19 nt, Human
accagcacccaacaacaac

SEQ ID NO: 487026 - RNA, 22 nt, Human
agcacaaaguucggugaaugaa

SEQ ID NO: 487027 - RNA, 20 nt, Human
aggcaacaagccugcaagga

SEQ ID NO: 487028 - RNA, 23 nt, Human
caaaauucuggagcuaccagcac

SEQ ID NO: 487029 - RNA, 24 nt, Human
caacaggcaacaagccugcaagga

SEQ ID NO: 487030 - RNA, 24 nt, Human
cacaauaguggucacaaaauucug

SEQ ID NO: 487031 - RNA, 21 nt, Human
caggucaggacagcucacaca

SEQ ID NO: 487032 - RNA, 20 nt, Human
ccacaauaguggucacaaaa

SEQ ID NO: 487033 - RNA, 20 nt, Human
ccagcacccaacaacaacaa

SEQ ID NO: 487034 - RNA, 20 nt, Human
ccagcgccgugucuuuuucc

SEQ ID NO: 487035 - RNA, 19 nt, Human
ccaggucaggacagcucac

SEQ ID NO: 487036 - RNA, 20 nt, Human
cccacaugauuuuauaaagc

SEQ ID NO: 487037 - RNA, 19 nt, Human
ccccccccccccccuuucc

SEQ ID NO: 487038 - RNA, 21 nt, Human
ccccccccccccccuuuccca

SEQ ID NO: 487039 - RNA, 18 nt, Human
ccccccccccccuuuccc

SEQ ID NO: 487040 - RNA, 19 nt, Human
cccccccuuucccauuuga

SEQ ID NO: 487041 - RNA, 23 nt, Human
cccccccuuucccauuugauucc

SEQ ID NO: 487042 - RNA, 22 nt, Human
ccccccuuucccauuugauucc

SEQ ID NO: 487043 - RNA, 20 nt, Human
cccccuuucccauuugauuc

SEQ ID NO: 487044 - RNA, 21 nt, Human
cccccuuucccauuugauucc

SEQ ID NO: 487045 - RNA, 19 nt, Human
cuagacacauaaaagaaca

SEQ ID NO: 487046 - RNA, 20 nt, Human
gcagagacauuuuacccaca

SEQ ID NO: 487047 - RNA, 22 nt, Human
ggcccccccccccccccuuucc

SEQ ID NO: 487048 - RNA, 24 nt, Human
gugaugcagagacauuuuacccac

SEQ ID NO: 487049 - RNA, 27 nt, Human
uagcauuaacaagugaugcagagacau

SEQ ID NO: 487050 - RNA, 23 nt, Human
uauuggaugaagcuaccauuuua

SEQ ID NO: 487051 - RNA, 19 nt, Human
uccaggucaggacagcucc

SEQ ID NO: 487052 - RNA, 20 nt, Human
ucuuuaaccucuggccagaa

SEQ ID NO: 487053 - RNA, 23 nt, Human
ucuuuuuccuucuuucaacaggc

SEQ ID NO: 487054 - RNA, 21 nt, Human
ugcaagugaaauggaggaaua

SEQ ID NO: 487055 - RNA, 19 nt, Human
uucuucaccaagcaaaggc

SEQ ID NO: 487056 - RNA, 22 nt, Human
uugccagcgccgugucuuuuuc

SEQ ID NO: 487057 - RNA, 27 nt, Human
uuuuccuggaagaauuaugaacugaag

SEQ ID NO: 487058 - RNA, 21 nt, Human
ccugcuuugcuuacaggcuga

SEQ ID NO: 487059 - RNA, 22 nt, Human
ccugcuuugcuuacaggcugag

SEQ ID NO: 487060 - RNA, 18 nt, Human
gggaaccugccaguauug

SEQ ID NO: 487061 - RNA, 22 nt, Human
uccugcuuugcuuacaggcuga

SEQ ID NO: 487062 - RNA, 22 nt, Human
ugggcagagaagaucuggaucc

SEQ ID NO: 487063 - RNA, 24 nt, Human
uggugguuguaacucaguuuccag

SEQ ID NO: 487064 - RNA, 23 nt, Human
uguucuagcagagucaguuucac

SEQ ID NO: 487065 - RNA, 24 nt, Human
uuccugcuuugcuuacaggcugag

SEQ ID NO: 487066 - RNA, 23 nt, Human
uuggugguuguaacucaguuucc

SEQ ID NO: 487067 - RNA, 18 nt, Human
aaagaagagagcugagga

SEQ ID NO: 487068 - RNA, 19 nt, Human
aagaaaccaagcucaggac

SEQ ID NO: 487069 - RNA, 20 nt, Human
aagaaaccaagcucaggacu

SEQ ID NO: 487070 - RNA, 26 nt, Human
agcccccagccccagaggugugauuc

SEQ ID NO: 487071 - RNA, 19 nt, Human
ccaccccugagcaccuccu

SEQ ID NO: 487072 - RNA, 22 nt, Human
ccaccccugagcaccuccuucc

SEQ ID NO: 487073 - RNA, 25 nt, Human
ccccugagcaccuccuuccccugga

SEQ ID NO: 487074 - RNA, 23 nt, Human
cucaggacugggguucccaagga

SEQ ID NO: 487075 - RNA, 21 nt, Human
gagcugaggaaggauucucug

SEQ ID NO: 487076 - RNA, 22 nt, Human
gaggaaggauucucugggugcu

SEQ ID NO: 487077 - RNA, 18 nt, Human
ucucuggauacccacccc

SEQ ID NO: 487078 - RNA, 20 nt, Human
ucucuggauacccaccccug

SEQ ID NO: 487079 - RNA, 19 nt, Human
ugagcaccuccuuccccug

SEQ ID NO: 487080 - RNA, 21 nt, Human
ugggaagaaaccaagcucagg

SEQ ID NO: 487081 - RNA, 24 nt, Human
ugggaagaaaccaagcucaggacu

SEQ ID NO: 487082 - RNA, 25 nt, Human
ugggaagaaaccaagcucaggacug

SEQ ID NO: 487083 - RNA, 20 nt, Human
ugggguucccaaggagcagg

SEQ ID NO: 487084 - RNA, 21 nt, Human
uuuuugguggucacuuaauuu

SEQ ID NO: 487085 - RNA, 19 nt, Human
uuuuuuuuuuuuggugguc

SEQ ID NO: 487086 - RNA, 20 nt, Human
uuuuuuuuuuuuuuuuuggu

SEQ ID NO: 487087 - RNA, 22 nt, Human
uuuuuuuuuuuuuuuuuggugg

SEQ ID NO: 487088 - RNA, 27 nt, Human
acaaaaaaaaaugacacuugucuuuca

SEQ ID NO: 487089 - RNA, 23 nt, Human
acagaagauguguuugcacugau

SEQ ID NO: 487090 - RNA, 22 nt, Human
acccucuacaaaaaaaaaugac

SEQ ID NO: 487091 - RNA, 20 nt, Human
agaauucaaggcaaacugcc

SEQ ID NO: 487092 - RNA, 22 nt, Human
aggacaguauuuuugggugaga

SEQ ID NO: 487093 - RNA, 23 nt, Human
auggguuuaacagaagauguguu

SEQ ID NO: 487094 - RNA, 22 nt, Human
cauuuacaugguauauaucacc

SEQ ID NO: 487095 - RNA, 21 nt, Human
ggaauauucuguguauaccaa

SEQ ID NO: 487096 - RNA, 24 nt, Human
ggguaucccagcugugccaucuuu

SEQ ID NO: 487097 - RNA, 24 nt, Human
gguuggguaucccagcugugccau

SEQ ID NO: 487098 - RNA, 19 nt, Human
ugacauuaagugugggcac

SEQ ID NO: 487099 - RNA, 24 nt, Human
ugacauuaagugugggcacaggaa

SEQ ID NO: 487100 - RNA, 22 nt, Human
uggguuuaacagaagauguguu

SEQ ID NO: 487101 - RNA, 21 nt, Human
uuaaaauuauagauugacauu

SEQ ID NO: 487102 - RNA, 18 nt, Human
uucacguaucucuuuucu

SEQ ID NO: 487103 - RNA, 21 nt, Human
uucuguguauaccaauggguu

SEQ ID NO: 487104 - RNA, 21 nt, Human
uuugcacugauuucuggucaa

SEQ ID NO: 487105 - RNA, 19 nt, Human
agccccucagcccccgccc

SEQ ID NO: 487106 - RNA, 19 nt, Human
cacauuccacaaaggaaca

SEQ ID NO: 487107 - RNA, 20 nt, Human
cagcccccgcccgccggccc

SEQ ID NO: 487108 - RNA, 22 nt, Human
cagccccucagcccccgcccgc

SEQ ID NO: 487109 - RNA, 22 nt, Human
ccacaaaggaacaaaaauguac

SEQ ID NO: 487110 - RNA, 22 nt, Human
cccgcccgccggcccaacgccg

SEQ ID NO: 487111 - RNA, 21 nt, Human
ccgcgcuugacgacagccgca

SEQ ID NO: 487112 - RNA, 20 nt, Human
ccucagcccccgcccgccgg

SEQ ID NO: 487113 - RNA, 18 nt, Human
cgccggcccaacgccgcg

SEQ ID NO: 487114 - RNA, 25 nt, Human
cucagcccccgcccgccggcccaac

SEQ ID NO: 487115 - RNA, 24 nt, Human
uacacaaacacuggaguacaugca

SEQ ID NO: 487116 - RNA, 19 nt, Human
uacaugcaacacauuccac

SEQ ID NO: 487117 - RNA, 22 nt, Human
uacaugcaacacauuccacaaa

SEQ ID NO: 487118 - RNA, 24 nt, Human
ucuccccuauuuuuucaagccaga

SEQ ID NO: 487119 - RNA, 22 nt, Human
ugacgacagccgcaaagccccc

SEQ ID NO: 487120 - RNA, 23 nt, Human
uugacgacagccgcaaagccccc

SEQ ID NO: 487121 - RNA, 26 nt, Human
uuuuuuuuuuuuuuuuaauuauuuuu

SEQ ID NO: 487122 - RNA, 29 nt, Human
uacuaugaaauuuuacauacaugauggaa

SEQ ID NO: 487123 - RNA, 23 nt, Human
ugaaacuaucaggaaguuuuacu

SEQ ID NO: 487124 - RNA, 21 nt, Human
uuuuuuuuuuuuuugcagaua

SEQ ID NO: 487125 - RNA, 18 nt, Human
uuuuuuuuuuuuuuuuug

SEQ ID NO: 487126 - RNA, 19 nt, Human
uuuuuuuuuuuuuuuuugc

SEQ ID NO: 487127 - RNA, 21 nt, Human
uuuuuuuuuuuuuuuuugcag

SEQ ID NO: 487128 - RNA, 19 nt, Human
aaacaaucaaaccaccaga

SEQ ID NO: 487129 - RNA, 20 nt, Human
aaagagacugcauauaggua

SEQ ID NO: 487130 - RNA, 20 nt, Human
aacaauggaagugucaaaaa

SEQ ID NO: 487131 - RNA, 20 nt, Human
aaccaccagaacaugauugu

SEQ ID NO: 487132 - RNA, 20 nt, Human
agaauccaaaacaaacaaac

SEQ ID NO: 487133 - RNA, 21 nt, Human
auaggguuuuuuuuuuuucca

SEQ ID NO: 487134 - RNA, 19 nt, Human
auggaaaauaucuaaauua

SEQ ID NO: 487135 - RNA, 25 nt, Human
auggauaaaacuggugcaaauuggu

SEQ ID NO: 487136 - RNA, 18 nt, Human
caaaacaaacaaacaaaa

SEQ ID NO: 487137 - RNA, 23 nt, Human
caaaacaaacaaacaaaaagacg

SEQ ID NO: 487138 - RNA, 22 nt, Human
caaacaaacaaaaagacguugu

SEQ ID NO: 487139 - RNA, 24 nt, Human
caaaccaccagaacaugauuguac

SEQ ID NO: 487140 - RNA, 24 nt, Human
caauacaaacaaaaaauacagaaa

SEQ ID NO: 487141 - RNA, 24 nt, Human
caccagaacaugauuguacaacag

SEQ ID NO: 487142 - RNA, 22 nt, Human
cagaacacccuagacaauucaa

SEQ ID NO: 487143 - RNA, 21 nt, Human
cagcagcagcggaucucgcac

SEQ ID NO: 487144 - RNA, 23 nt, Human
ccaaaacaaacaaacaaaaagac

SEQ ID NO: 487145 - RNA, 19 nt, Human
cgcuccucuccucagcagc

SEQ ID NO: 487146 - RNA, 22 nt, Human
gaauggaaccuuuguauuguaa

SEQ ID NO: 487147 - RNA, 24 nt, Human
uaaagaauccaaaacaaacaaaca

SEQ ID NO: 487148 - RNA, 24 nt, Human
uaaagagggcacuaaaugagaaua

SEQ ID NO: 487149 - RNA, 24 nt, Human
uacaaacaaaaaauacagaaaugc

SEQ ID NO: 487150 - RNA, 23 nt, Human
uacagaacacccuagacaauuca

SEQ ID NO: 487151 - RNA, 21 nt, Human
uaccauaaaguguaaaaaggg

SEQ ID NO: 487152 - RNA, 19 nt, Human
uagagaagcacaguuugca

SEQ ID NO: 487153 - RNA, 22 nt, Human
uauggcaauuuauccucaauga

SEQ ID NO: 487154 - RNA, 24 nt, Human
ucaaacggauccaacaaacacuga

SEQ ID NO: 487155 - RNA, 21 nt, Human
ucaagaacaaaaaaaaaaaua

SEQ ID NO: 487156 - RNA, 23 nt, Human
uccaaaacaaacaaacaaaaaga

SEQ ID NO: 487157 - RNA, 23 nt, Human
ugaucuauaaaugcauuuccccc

SEQ ID NO: 487158 - RNA, 21 nt, Human
ugcauauagguagaaacaggu

SEQ ID NO: 487159 - RNA, 18 nt, Human
ugcugcuguugacgcucc

SEQ ID NO: 487160 - RNA, 20 nt, Human
uggaauauccuguaaacaau

SEQ ID NO: 487161 - RNA, 23 nt, Human
uuuuuacaauacaaacaaaaaau

SEQ ID NO: 487162 - RNA, 23 nt, Human
aaaaaauacugucaucuuccuau

SEQ ID NO: 487163 - RNA, 20 nt, Human
aaaacauaaaacaugaacaa

SEQ ID NO: 487164 - RNA, 21 nt, Human
aaaacuaaacagauuuaaaau

SEQ ID NO: 487165 - RNA, 25 nt, Human
aaaauaacccuucaaaauaccaaau

SEQ ID NO: 487166 - RNA, 23 nt, Human
aaacagcaggaaaaucuaaauca

SEQ ID NO: 487167 - RNA, 20 nt, Human
aaacuuggauaaacucagug

SEQ ID NO: 487168 - RNA, 19 nt, Human
aaccaugaaaccaugcucu

SEQ ID NO: 487169 - RNA, 19 nt, Human
aacuauucauaacaaaaua

SEQ ID NO: 487170 - RNA, 23 nt, Human
aacugagaaacaaaugcagaaca

SEQ ID NO: 487171 - RNA, 24 nt, Human
aagaggagcuagcagaauguagug

SEQ ID NO: 487172 - RNA, 19 nt, Human
aagguacccuccccuaaua

SEQ ID NO: 487173 - RNA, 20 nt, Human
aaguugcuuucccucuccac

SEQ ID NO: 487174 - RNA, 19 nt, Human
aauacugucaucuuccuau

SEQ ID NO: 487175 - RNA, 24 nt, Human
aauugguuucuuuccucugcuucu

SEQ ID NO: 487176 - RNA, 22 nt, Human
acaacaaccucauacccaaagc

SEQ ID NO: 487177 - RNA, 19 nt, Human
acacacauaauuaugggaa

SEQ ID NO: 487178 - RNA, 19 nt, Human
acacgccccuggcuguggc

SEQ ID NO: 487179 - RNA, 19 nt, Human
acacgccccuggcuguggc

SEQ ID NO: 487180 - RNA, 23 nt, Human
acagauuuaaaauacaaauuuuu

SEQ ID NO: 487181 - RNA, 22 nt, Human
acaggcaacaacaaccucauac

SEQ ID NO: 487182 - RNA, 26 nt, Human
acaggcaacaacaaccucauacccaa

SEQ ID NO: 487183 - RNA, 24 nt, Human
acauauacauguacauacauaugg

SEQ ID NO: 487184 - RNA, 31 nt, Human
acauguacauacauaugacacauauacacag

SEQ ID NO: 487185 - RNA, 23 nt, Human
accaauuuuuauaauaacucaua

SEQ ID NO: 487186 - RNA, 24 nt, Human
accugccauauuuauagugcgagc

SEQ ID NO: 487187 - RNA, 18 nt, Human
acugcaguuacugaaguu

SEQ ID NO: 487188 - RNA, 23 nt, Human
acuucuuggugugucuauguagg

SEQ ID NO: 487189 - RNA, 22 nt, Human
agagacaaaaccauacuaaaac

SEQ ID NO: 487190 - RNA, 26 nt, Human
agcaaacagcaggaaaaucuaaauca

SEQ ID NO: 487191 - RNA, 25 nt, Human
agcaacaaaaacaauaggaaaggga

SEQ ID NO: 487192 - RNA, 21 nt, Human
agcaguccauucuuaagcagc

SEQ ID NO: 487193 - RNA, 18 nt, Human
agcucacagucccgaaca

SEQ ID NO: 487194 - RNA, 18 nt, Human
agcucacagucccgaaca

SEQ ID NO: 487195 - RNA, 24 nt, Human
aggaaaaaaaaacauuuggaauau

SEQ ID NO: 487196 - RNA, 19 nt, Human
aggcaacaacaaccucaua

SEQ ID NO: 487197 - RNA, 21 nt, Human
aggcagcaggcgccgaaggcg

SEQ ID NO: 487198 - RNA, 21 nt, Human
aggcagcaggcgccgaaggcg

SEQ ID NO: 487199 - RNA, 23 nt, Human
aggcgccgaaggcggaggcggcu

SEQ ID NO: 487200 - RNA, 23 nt, Human
aggcgccgaaggcggaggcggcu

SEQ ID NO: 487201 - RNA, 20 nt, Human
aggcggaggcggcuucgggg

SEQ ID NO: 487202 - RNA, 20 nt, Human
aggcggaggcggcuucgggg

SEQ ID NO: 487203 - RNA, 23 nt, Human
aucauacuuacaugaaagggcug

SEQ ID NO: 487204 - RNA, 24 nt, Human
caaaagaaugaacugaccugccau

SEQ ID NO: 487205 - RNA, 20 nt, Human
caacaacaaccucauaccca

SEQ ID NO: 487206 - RNA, 23 nt, Human
caauugguuucuuuccucugcuu

SEQ ID NO: 487207 - RNA, 22 nt, Human
cacauauacacacauaauuaug

SEQ ID NO: 487208 - RNA, 21 nt, Human
cagcaacaaaaacaauaggaa

SEQ ID NO: 487209 - RNA, 18 nt, Human
cagcacagagggaaggca

SEQ ID NO: 487210 - RNA, 18 nt, Human
caggcgccgaaggcggag

SEQ ID NO: 487211 - RNA, 20 nt, Human
caggcgccgaaggcggaggg

SEQ ID NO: 487212 - RNA, 20 nt, Human
caggcgccgaaggcggaggg

SEQ ID NO: 487213 - RNA, 23 nt, Human
cauaugacacauauacacacaua

SEQ ID NO: 487214 - RNA, 18 nt, Human
cauuagagacaaaaccau

SEQ ID NO: 487215 - RNA, 20 nt, Human
cauuagagacaaaaccauac

SEQ ID NO: 487216 - RNA, 21 nt, Human
ccccacugcccaggagccagg

SEQ ID NO: 487217 - RNA, 21 nt, Human
ccccacugcccaggagccagg

SEQ ID NO: 487218 - RNA, 20 nt, Human
cccccaggaugcaaaacuaa

SEQ ID NO: 487219 - RNA, 21 nt, Human
cccccaggaugcaaaacuaac

SEQ ID NO: 487220 - RNA, 21 nt, Human
ccccccaggaugcaaaacuaa

SEQ ID NO: 487221 - RNA, 24 nt, Human
cccccgggggcuuccccacugccc

SEQ ID NO: 487222 - RNA, 24 nt, Human
cccccgggggcuuccccacugccc

SEQ ID NO: 487223 - RNA, 19 nt, Human
cccgaacaacaagccuggc

SEQ ID NO: 487224 - RNA, 19 nt, Human
cccgaacaacaagccuggc

SEQ ID NO: 487225 - RNA, 24 nt, Human
cccgaacaacaagccuggccgagg

SEQ ID NO: 487226 - RNA, 24 nt, Human
cccgaacaacaagccuggccgagg

SEQ ID NO: 487227 - RNA, 22 nt, Human
cccgaucgcgcccguggcuacu

SEQ ID NO: 487228 - RNA, 21 nt, Human
ccgaucgcgcccguggcuacu

SEQ ID NO: 487229 - RNA, 19 nt, Human
cgaacaacaagccuggccg

SEQ ID NO: 487230 - RNA, 19 nt, Human
cgaacaacaagccuggccg

SEQ ID NO: 487231 - RNA, 21 nt, Human
cgccccuggcuguggccgcuc

SEQ ID NO: 487232 - RNA, 21 nt, Human
cgccccuggcuguggccgcuc

SEQ ID NO: 487233 - RNA, 24 nt, Human
cgccgggcgccccggggacauucc

SEQ ID NO: 487234 - RNA, 19 nt, Human
cggggucagcgcgccgggc

SEQ ID NO: 487235 - RNA, 19 nt, Human
cggggucagcgcgccgggc

SEQ ID NO: 487236 - RNA, 22 nt, Human
cucauacccaaagcaggauauc

SEQ ID NO: 487237 - RNA, 20 nt, Human
cuccgccgccgccgcgccug

SEQ ID NO: 487238 - RNA, 20 nt, Human
cuccgccgccgccgcgccug

SEQ ID NO: 487239 - RNA, 26 nt, Human
cugcaugcuguauuuuaaagccccuc

SEQ ID NO: 487240 - RNA, 20 nt, Human
cugcuccgccgccgccgcgc

SEQ ID NO: 487241 - RNA, 20 nt, Human
cugcuccgccgccgccgcgc

SEQ ID NO: 487242 - RNA, 22 nt, Human
cugcugcagcugcugcuccgcc

SEQ ID NO: 487243 - RNA, 22 nt, Human
cugcugcagcugcugcuccgcc

SEQ ID NO: 487244 - RNA, 19 nt, Human
cugcugcuccgccgccgcc

SEQ ID NO: 487245 - RNA, 19 nt, Human
cugcugcuccgccgccgcc

SEQ ID NO: 487246 - RNA, 28 nt, Human
cuggcagcagcugcuccggauccucuuc

SEQ ID NO: 487247 - RNA, 20 nt, Human
cuuagcagcaucuuuuucag

SEQ ID NO: 487248 - RNA, 21 nt, Human
cuuuccccuacuucucaaaug

SEQ ID NO: 487249 - RNA, 20 nt, Human
cuuuuucaguuuuuucucuc

SEQ ID NO: 487250 - RNA, 18 nt, Human
cuuuuuuuuuuuaagggc

SEQ ID NO: 487251 - RNA, 20 nt, Human
cuuuuuuuuuuuaagggcaa

SEQ ID NO: 487252 - RNA, 24 nt, Human
gaaaugaaaccuacaggcuucuga

SEQ ID NO: 487253 - RNA, 19 nt, Human
gacaaaaccauacuaaaac

SEQ ID NO: 487254 - RNA, 19 nt, Human
gaggcagcaggcgccgaag

SEQ ID NO: 487255 - RNA, 22 nt, Human
gcaaacagcaggaaaaucuaaa

SEQ ID NO: 487256 - RNA, 24 nt, Human
gcaaagucuucccccggcuuccaa

SEQ ID NO: 487257 - RNA, 25 nt, Human
gcaaagucuucccccggcuuccaaa

SEQ ID NO: 487258 - RNA, 22 nt, Human
gcaguccauucuuaagcagccu

SEQ ID NO: 487259 - RNA, 26 nt, Human
gcaguguauucuucuacacuuuaaaa

SEQ ID NO: 487260 - RNA, 23 nt, Human
gccgggcgccccggggacauucc

SEQ ID NO: 487261 - RNA, 23 nt, Human
gccgggcgccccggggacauucc

SEQ ID NO: 487262 - RNA, 18 nt, Human
gcugcuccgccgccgccg

SEQ ID NO: 487263 - RNA, 18 nt, Human
gcugcuccgccgccgccg

SEQ ID NO: 487264 - RNA, 23 nt, Human
gcugcugcagcugcugcuccgcc

SEQ ID NO: 487265 - RNA, 23 nt, Human
gcugcugcagcugcugcuccgcc

SEQ ID NO: 487266 - RNA, 24 nt, Human
ggcaacaacaaccucauacccaaa

SEQ ID NO: 487267 - RNA, 19 nt, Human
ggcagccgggaggacuuca

SEQ ID NO: 487268 - RNA, 18 nt, Human
ggcuuccccacugcccag

SEQ ID NO: 487269 - RNA, 21 nt, Human
gggaggcagcaggcgccgaag

SEQ ID NO: 487270 - RNA, 21 nt, Human
gggaggcagcaggcgccgaag

SEQ ID NO: 487271 - RNA, 19 nt, Human
gggcuggcagcagcugcuc

SEQ ID NO: 487272 - RNA, 20 nt, Human
gggcugggucguggccagcu

SEQ ID NO: 487273 - RNA, 20 nt, Human
gggcugggucguggccagcu

SEQ ID NO: 487274 - RNA, 21 nt, Human
gggggcuuccccacugcccag

SEQ ID NO: 487275 - RNA, 20 nt, Human
gguuucuuuccucugcuucu

SEQ ID NO: 487276 - RNA, 19 nt, Human
guggcuacucgagcggcag

SEQ ID NO: 487277 - RNA, 22 nt, Human
guuucacagcacagagggaagg

SEQ ID NO: 487278 - RNA, 21 nt, Human
uaaagcacuucauaugaaucc

SEQ ID NO: 487279 - RNA, 19 nt, Human
uaaauauuaccccuuacca

SEQ ID NO: 487280 - RNA, 21 nt, Human
uaacaaaccugagucaaacau

SEQ ID NO: 487281 - RNA, 18 nt, Human
uaacacuguacauguaaa

SEQ ID NO: 487282 - RNA, 19 nt, Human
uaacuaaacugacuuccca

SEQ ID NO: 487283 - RNA, 20 nt, Human
uaacuaaacugacuucccaa

SEQ ID NO: 487284 - RNA, 21 nt, Human
uaacucaaauuggcucagcaa

SEQ ID NO: 487285 - RNA, 23 nt, Human
uaacuugaaaaaaauacugucau

SEQ ID NO: 487286 - RNA, 21 nt, Human
uaagagaagaacagcuuucac

SEQ ID NO: 487287 - RNA, 19 nt, Human
uaauuuuuagacauauaca

SEQ ID NO: 487288 - RNA, 21 nt, Human
uacacacauaauuaugggaaa

SEQ ID NO: 487289 - RNA, 18 nt, Human
uacgcacgggggagggcu

SEQ ID NO: 487290 - RNA, 18 nt, Human
uacgcacgggggagggcu

SEQ ID NO: 487291 - RNA, 21 nt, Human
uagagacaaaaccauacuaaa

SEQ ID NO: 487292 - RNA, 18 nt, Human
uagcagcaucuuuuucag

SEQ ID NO: 487293 - RNA, 19 nt, Human
uagcuucacacaaauuagu

SEQ ID NO: 487294 - RNA, 24 nt, Human
uagcuuuuuuuuuuuaagggcaau

SEQ ID NO: 487295 - RNA, 21 nt, Human
uauauaauguaacacuguaca

SEQ ID NO: 487296 - RNA, 20 nt, Human
uaugcuagcgugugcagcag

SEQ ID NO: 487297 - RNA, 19 nt, Human
ucaaaccaugugugauuac

SEQ ID NO: 487298 - RNA, 19 nt, Human
ucaaugguugggaguaaag

SEQ ID NO: 487299 - RNA, 21 nt, Human
ucagaagaaauauucagugaa

SEQ ID NO: 487300 - RNA, 24 nt, Human
ucagggcagggcaaagucuucccc

SEQ ID NO: 487301 - RNA, 24 nt, Human
ucagggcagggcaaagucuucccc

SEQ ID NO: 487302 - RNA, 22 nt, Human
uccagagaaaagacacugcuau

SEQ ID NO: 487303 - RNA, 25 nt, Human
ucccaaaagaaugaacugaccugcc

SEQ ID NO: 487304 - RNA, 18 nt, Human
ucccgaacaacaagccug

SEQ ID NO: 487305 - RNA, 18 nt, Human
ucccgaacaacaagccug

SEQ ID NO: 487306 - RNA, 25 nt, Human
ucccucuccacugcucguccagaag

SEQ ID NO: 487307 - RNA, 21 nt, Human
uccuaauuggguuaagaacuc

SEQ ID NO: 487308 - RNA, 22 nt, Human
uccucauagaaaugaaaccuac

SEQ ID NO: 487309 - RNA, 20 nt, Human
ucuacacuuuaaaauagagc

SEQ ID NO: 487310 - RNA, 25 nt, Human
ucucagggcagggcaaagucuuccc

SEQ ID NO: 487311 - RNA, 25 nt, Human
ucucagggcagggcaaagucuuccc

SEQ ID NO: 487312 - RNA, 18 nt, Human
ucuguuuucaagucucuu

SEQ ID NO: 487313 - RNA, 22 nt, Human
ugaagaggagcuagcagaaugu

SEQ ID NO: 487314 - RNA, 21 nt, Human
ugaauucugaucuuucacugc

SEQ ID NO: 487315 - RNA, 19 nt, Human
ugacacauauacacacaua

SEQ ID NO: 487316 - RNA, 24 nt, Human
ugacacauauacacacauaauuaa

SEQ ID NO: 487317 - RNA, 23 nt, Human
ugagaaacaaaugcagaacauca

SEQ ID NO: 487318 - RNA, 24 nt, Human
ugagucaaacauucauucaaaugc

SEQ ID NO: 487319 - RNA, 25 nt, Human
ugagucaaacauucauucaaaugcc

SEQ ID NO: 487320 - RNA, 19 nt, Human
uggaggaggagacuucugg

SEQ ID NO: 487321 - RNA, 19 nt, Human
uggauaaacucaguguaac

SEQ ID NO: 487322 - RNA, 20 nt, Human
uggccgagggaggcagcagg

SEQ ID NO: 487323 - RNA, 20 nt, Human
uggccgagggaggcagcagg

SEQ ID NO: 487324 - RNA, 20 nt, Human
uggcucagcaacaaaaacaa

SEQ ID NO: 487325 - RNA, 26 nt, Human
uggugugucuauguaggcacaugugu

SEQ ID NO: 487326 - RNA, 20 nt, Human
uguaacuaaacugacuuccc

SEQ ID NO: 487327 - RNA, 20 nt, Human
uguacauacauaugacacaa

SEQ ID NO: 487328 - RNA, 19 nt, Human
ugucuuuaaaaguauggaa

SEQ ID NO: 487329 - RNA, 20 nt, Human
ugugucuauguaggcacaug

SEQ ID NO: 487330 - RNA, 22 nt, Human
uuaagggcaauugguuucuuuc

SEQ ID NO: 487331 - RNA, 22 nt, Human
uuaauacagagaacuacuuagc

SEQ ID NO: 487332 - RNA, 18 nt, Human
uuacaggcaacaacaacc

SEQ ID NO: 487333 - RNA, 18 nt, Human
uuagugcucuuuuuaauu

SEQ ID NO: 487334 - RNA, 20 nt, Human
uucaaaauaccaaauucaac

SEQ ID NO: 487335 - RNA, 20 nt, Human
uuccagcaagaaguugcuuu

SEQ ID NO: 487336 - RNA, 19 nt, Human
uucucuccauugauuuaaa

SEQ ID NO: 487337 - RNA, 23 nt, Human
uugaagaggagcuagcagaaugu

SEQ ID NO: 487338 - RNA, 20 nt, Human
uuuaaagccccccaggaugc

SEQ ID NO: 487339 - RNA, 24 nt, Human
uuuuuuuuuuuuuuugugacuugg

SEQ ID NO: 487340 - RNA, 18 nt, Human
uuuuuuuuuuuuuuuuug

SEQ ID NO: 487341 - RNA, 23 nt, Human
uuuuuuuuuuuuuuuuugugacu

SEQ ID NO: 487342 - RNA, 22 nt, Human
aaaccuccaucagauccucaau

SEQ ID NO: 487343 - RNA, 22 nt, Human
aaaggccucugcccucggcuug

SEQ ID NO: 487344 - RNA, 26 nt, Human
aaauagucaagugaagaugauuaagc

SEQ ID NO: 487345 - RNA, 23 nt, Human
aaauuaaaauacaauugcacuua

SEQ ID NO: 487346 - RNA, 19 nt, Human
aacaagaccccucuagccu

SEQ ID NO: 487347 - RNA, 18 nt, Human
aacaaugggcagccuccc

SEQ ID NO: 487348 - RNA, 20 nt, Human
aacacggcaucuuccgucuc

SEQ ID NO: 487349 - RNA, 21 nt, Human
aacagaaaauaaauacauaaa

SEQ ID NO: 487350 - RNA, 19 nt, Human
aacagaguuaacauuacaa

SEQ ID NO: 487351 - RNA, 20 nt, Human
aacauggugaaacccugucu

SEQ ID NO: 487352 - RNA, 21 nt, Human
aacauggugaaacccugucuc

SEQ ID NO: 487353 - RNA, 23 nt, Human
aaccaaacaaugggcagccuccc

SEQ ID NO: 487354 - RNA, 19 nt, Human
aaccgugcgugcccaccgc

SEQ ID NO: 487355 - RNA, 20 nt, Human
aaccgugcgugcccaccgcg

SEQ ID NO: 487356 - RNA, 19 nt, Human
aacgacuugcaacaucuuc

SEQ ID NO: 487357 - RNA, 18 nt, Human
aagaccccucuagccuaa

SEQ ID NO: 487358 - RNA, 21 nt, Human
aagcaaauaccgcauccuuuu

SEQ ID NO: 487359 - RNA, 22 nt, Human
aagcacuuauaagcaguuuuuc

SEQ ID NO: 487360 - RNA, 23 nt, Human
aagcagaucauugucacugagau

SEQ ID NO: 487361 - RNA, 20 nt, Human
aagcagucacagcugaguuu

SEQ ID NO: 487362 - RNA, 23 nt, Human
aagcugcccugcaguaacugggc

SEQ ID NO: 487363 - RNA, 25 nt, Human
aaggggaagaagaggugcccugaga

SEQ ID NO: 487364 - RNA, 20 nt, Human
aagugccccagagaagccag

SEQ ID NO: 487365 - RNA, 18 nt, Human
acaaaggccucugcccuc

SEQ ID NO: 487366 - RNA, 24 nt, Human
acagaaaauaaauacauaaaaaac

SEQ ID NO: 487367 - RNA, 30 nt, Human
acagaaaauaaauacauaaaaaaccuccaa

SEQ ID NO: 487368 - RNA, 22 nt, Human
acagagcuggacccagagccac

SEQ ID NO: 487369 - RNA, 19 nt, Human
acagcacuugguuuaaugu

SEQ ID NO: 487370 - RNA, 26 nt, Human
acaugcaccacagaccagccagcucc

SEQ ID NO: 487371 - RNA, 24 nt, Human
acccugucucuacuaaaaauacag

SEQ ID NO: 487372 - RNA, 22 nt, Human
acgccgaugagggcugucgucc

SEQ ID NO: 487373 - RNA, 21 nt, Human
acggggcugcagcuggcggcc

SEQ ID NO: 487374 - RNA, 24 nt, Human
acugcacuccagccuggacaacaa

SEQ ID NO: 487375 - RNA, 25 nt, Human
acugcacuccagccuggacaacaag

SEQ ID NO: 487376 - RNA, 27 nt, Human
acugcacuccagccuggacaacaagag

SEQ ID NO: 487377 - RNA, 18 nt, Human
acugcccuugcuaugcac

SEQ ID NO: 487378 - RNA, 18 nt, Human
acugcugccggcugggaa

SEQ ID NO: 487379 - RNA, 24 nt, Human
acuugaggucaggaguucgagacc

SEQ ID NO: 487380 - RNA, 24 nt, Human
acuuuugauaauuuugagucccca

SEQ ID NO: 487381 - RNA, 24 nt, Human
agaaaaaggaacgacuugcaacau

SEQ ID NO: 487382 - RNA, 22 nt, Human
agaaagcuucaagagcaccuaa

SEQ ID NO: 487383 - RNA, 23 nt, Human
agaaucagagaaagcguugauuu

SEQ ID NO: 487384 - RNA, 25 nt, Human
agaaucagagaaagcguugauuuuu

SEQ ID NO: 487385 - RNA, 20 nt, Human
agacaguuuuggggaacccg

SEQ ID NO: 487386 - RNA, 19 nt, Human
agacccagagacuuccugg

SEQ ID NO: 487387 - RNA, 20 nt, Human
agacuaaauuuacaacagca

SEQ ID NO: 487388 - RNA, 21 nt, Human
agaguuggaugcuuugaacaa

SEQ ID NO: 487389 - RNA, 23 nt, Human
agaucacuugaggucaggaguuc

SEQ ID NO: 487390 - RNA, 22 nt, Human
agaucgcgccacugcacuccag

SEQ ID NO: 487391 - RNA, 21 nt, Human
agaugcggaggcggcaggacc

SEQ ID NO: 487392 - RNA, 20 nt, Human
agauuaaccccaugaaagac

SEQ ID NO: 487393 - RNA, 22 nt, Human
agcacgauuuucacaacuaccu

SEQ ID NO: 487394 - RNA, 22 nt, Human
agcaggacgcggcucgugggga

SEQ ID NO: 487395 - RNA, 20 nt, Human
agccagggaggacagaagcg

SEQ ID NO: 487396 - RNA, 23 nt, Human
agccgggcgugguggcagacgcc

SEQ ID NO: 487397 - RNA, 22 nt, Human
agccuggccaacauggugaaac

SEQ ID NO: 487398 - RNA, 24 nt, Human
agccuggccaacauggugaaaccc

SEQ ID NO: 487399 - RNA, 21 nt, Human
agcugcaugucagaccagccu

SEQ ID NO: 487400 - RNA, 21 nt, Human
aggacagaaaaaggaacgacu

SEQ ID NO: 487401 - RNA, 20 nt, Human
aggagcccggcccacagcgc

SEQ ID NO: 487402 - RNA, 19 nt, Human
aggagccggaggaggagcc

SEQ ID NO: 487403 - RNA, 24 nt, Human
aggagcugcccgugccugcccugu

SEQ ID NO: 487404 - RNA, 21 nt, Human
aggaggagcccggcccacagc

SEQ ID NO: 487405 - RNA, 22 nt, Human
aggaggagcccggcccacagcg

SEQ ID NO: 487406 - RNA, 20 nt, Human
aggaggcugaggcaggagag

SEQ ID NO: 487407 - RNA, 18 nt, Human
aggagggccugcaggucc

SEQ ID NO: 487408 - RNA, 22 nt, Human
aggcaaaaauggcuuaacaauc

SEQ ID NO: 487409 - RNA, 24 nt, Human
aggcaaaaauggcuuaacaaucau

SEQ ID NO: 487410 - RNA, 23 nt, Human
aggcaacagugagauccagaagc

SEQ ID NO: 487411 - RNA, 26 nt, Human
aggcagaucacuugaggucaggaguu

SEQ ID NO: 487412 - RNA, 22 nt, Human
aggcaggagagucgcuugaacc

SEQ ID NO: 487413 - RNA, 24 nt, Human
aggcaggagagucgcuugaaccug

SEQ ID NO: 487414 - RNA, 26 nt, Human
aggcaggcagaucacuugaggucagg

SEQ ID NO: 487415 - RNA, 22 nt, Human
aggcaggcuggacacacugccg

SEQ ID NO: 487416 - RNA, 21 nt, Human
aggcaggcuggacacacugcu

SEQ ID NO: 487417 - RNA, 18 nt, Human
aggcagggcacccugggc

SEQ ID NO: 487418 - RNA, 21 nt, Human
aggcugaggcaggagagucgc

SEQ ID NO: 487419 - RNA, 24 nt, Human
aggcugaggcaggagagucgcuug

SEQ ID NO: 487420 - RNA, 22 nt, Human
agggcaggggggugucaccagc

SEQ ID NO: 487421 - RNA, 23 nt, Human
aggggaagaagaggugcccugag

SEQ ID NO: 487422 - RNA, 18 nt, Human
aggggaagaguccacucu

SEQ ID NO: 487423 - RNA, 20 nt, Human
aggggugcuuggcugggugc

SEQ ID NO: 487424 - RNA, 23 nt, Human
aggggugcuuggcugggugcggu

SEQ ID NO: 487425 - RNA, 21 nt, Human
agggugagguccuggggcugc

SEQ ID NO: 487426 - RNA, 20 nt, Human
aggugcugcccaagagggag

SEQ ID NO: 487427 - RNA, 20 nt, Human
aguguuuucuucccuuuccu

SEQ ID NO: 487428 - RNA, 24 nt, Human
aucacuugaggucaggaguucgag

SEQ ID NO: 487429 - RNA, 22 nt, Human
aucccagcacuuugggaggcca

SEQ ID NO: 487430 - RNA, 24 nt, Human
aucgcgccacugcacuccagccug

SEQ ID NO: 487431 - RNA, 18 nt, Human
aucucagcccuccaugcu

SEQ ID NO: 487432 - RNA, 22 nt, Human
aucuuauugaagaguagucugc

SEQ ID NO: 487433 - RNA, 18 nt, Human
augcaccacagaccagcc

SEQ ID NO: 487434 - RNA, 19 nt, Human
auggcaaaagcaaauaccg

SEQ ID NO: 487435 - RNA, 22 nt, Human
caaaaacacugacaguuccuau

SEQ ID NO: 487436 - RNA, 24 nt, Human
caacauggugaaacccugucucua

SEQ ID NO: 487437 - RNA, 26 nt, Human
caaccaaacaaugggcagccucccag

SEQ ID NO: 487438 - RNA, 25 nt, Human
caacuucuuagguggaaaaagcaac

SEQ ID NO: 487439 - RNA, 18 nt, Human
caagcccaggcuggacug

SEQ ID NO: 487440 - RNA, 24 nt, Human
caaggcaggcagaucacuugaggu

SEQ ID NO: 487441 - RNA, 26 nt, Human
caaggcaggcagaucacuugagguca

SEQ ID NO: 487442 - RNA, 24 nt, Human
caagugccccagagaagccaggga

SEQ ID NO: 487443 - RNA, 18 nt, Human
cacagaaucagagaaagc

SEQ ID NO: 487444 - RNA, 23 nt, Human
cacagaaucagagaaagcguuga

SEQ ID NO: 487445 - RNA, 20 nt, Human
cacaugcaccacagaccagg

SEQ ID NO: 487446 - RNA, 18 nt, Human
caccagcaugccguuggg

SEQ ID NO: 487447 - RNA, 22 nt, Human
caccagggcggcuccugaagac

SEQ ID NO: 487448 - RNA, 20 nt, Human
caccagguggggaaagcugc

SEQ ID NO: 487449 - RNA, 19 nt, Human
cacccgacagugccuggcg

SEQ ID NO: 487450 - RNA, 25 nt, Human
cacccugaacagagcuggacccaga

SEQ ID NO: 487451 - RNA, 23 nt, Human
caccuguaaucccagcacuuugg

SEQ ID NO: 487452 - RNA, 24 nt, Human
caccuguaaucccagcacuuuggg

SEQ ID NO: 487453 - RNA, 20 nt, Human
cacgaccauggccccgcgcg

SEQ ID NO: 487454 - RNA, 18 nt, Human
cacggcaucuuccgucuc

SEQ ID NO: 487455 - RNA, 24 nt, Human
cacuccagccuggacaacaagagc

SEQ ID NO: 487456 - RNA, 18 nt, Human
cacugcacuccagccugg

SEQ ID NO: 487457 - RNA, 19 nt, Human
cacugcacuccagccugga

SEQ ID NO: 487458 - RNA, 21 nt, Human
cacugcacuccagccuggaca

SEQ ID NO: 487459 - RNA, 24 nt, Human
cacugcacuccagccuggacaaca

SEQ ID NO: 487460 - RNA, 22 nt, Human
cacugugcuggggaggaagugg

SEQ ID NO: 487461 - RNA, 23 nt, Human
cacuugaggucaggaguucgaga

SEQ ID NO: 487462 - RNA, 24 nt, Human
cagaucacuugaggucaggaguuc

SEQ ID NO: 487463 - RNA, 27 nt, Human
cagaucacuugaggucaggaguucgag

SEQ ID NO: 487464 - RNA, 24 nt, Human
cagcacuuugggaggccaaggcag

SEQ ID NO: 487465 - RNA, 25 nt, Human
cagcacuuugggaggccaaggcagg

SEQ ID NO: 487466 - RNA, 18 nt, Human
cagcagcagugggccugc

SEQ ID NO: 487467 - RNA, 22 nt, Human
cagcaggacgcggcucgugggg

SEQ ID NO: 487468 - RNA, 23 nt, Human
cagcaggacgcggcucgugggga

SEQ ID NO: 487469 - RNA, 24 nt, Human
cagcagugggccugccugcucucu

SEQ ID NO: 487470 - RNA, 24 nt, Human
cagcaugccguugggacagucaga

SEQ ID NO: 487471 - RNA, 18 nt, Human
cagccagcucccugggua

SEQ ID NO: 487472 - RNA, 23 nt, Human
cagccucccaguucuucaguccc

SEQ ID NO: 487473 - RNA, 24 nt, Human
cagcuacucaggaggcugaggcag

SEQ ID NO: 487474 - RNA, 21 nt, Human
caggagagaccuuccccgcag

SEQ ID NO: 487475 - RNA, 18 nt, Human
caggcagaucacuugagg

SEQ ID NO: 487476 - RNA, 24 nt, Human
caggcagaucacuugaggucagga

SEQ ID NO: 487477 - RNA, 18 nt, Human
cagggacagaaaaccacu

SEQ ID NO: 487478 - RNA, 26 nt, Human
cagggaggacagaagcgaagggcagg

SEQ ID NO: 487479 - RNA, 21 nt, Human
cagggcuagcucucgcugacu

SEQ ID NO: 487480 - RNA, 23 nt, Human
cagggugagguccuggggcugcu

SEQ ID NO: 487481 - RNA, 19 nt, Human
cagugaaaaaacgaucaga

SEQ ID NO: 487482 - RNA, 21 nt, Human
cauagccccaagugccccaga

SEQ ID NO: 487483 - RNA, 21 nt, Human
ccaaauucuacaaaaagcuaa

SEQ ID NO: 487484 - RNA, 20 nt, Human
ccacagugccccggccggac

SEQ ID NO: 487485 - RNA, 22 nt, Human
ccaccuggucuuacaacaugca

SEQ ID NO: 487486 - RNA, 19 nt, Human
ccacugcacuccagccugg

SEQ ID NO: 487487 - RNA, 19 nt, Human
ccacugcacuccagccugg

SEQ ID NO: 487488 - RNA, 20 nt, Human
ccacugcacuccagccugga

SEQ ID NO: 487489 - RNA, 21 nt, Human
ccacugcacuccagccuggac

SEQ ID NO: 487490 - RNA, 22 nt, Human
ccacugcacuccagccuggaca

SEQ ID NO: 487491 - RNA, 19 nt, Human
ccacugccugucgacaucu

SEQ ID NO: 487492 - RNA, 19 nt, Human
ccagaaagcuucaagagca

SEQ ID NO: 487493 - RNA, 21 nt, Human
ccagaaagcuucaagagcacc

SEQ ID NO: 487494 - RNA, 21 nt, Human
cccaagugccccagagaagcc

SEQ ID NO: 487495 - RNA, 20 nt, Human
cccagagccacacacgcccg

SEQ ID NO: 487496 - RNA, 19 nt, Human
cccaguuuugcagacgcuc

SEQ ID NO: 487497 - RNA, 26 nt, Human
ccccagaaagcuucaagagcaccccg

SEQ ID NO: 487498 - RNA, 19 nt, Human
ccccagagaagccagggag

SEQ ID NO: 487499 - RNA, 21 nt, Human
ccccagcccgcccccaggugc

SEQ ID NO: 487500 - RNA, 21 nt, Human
cccccaggugcccgcagccgg

SEQ ID NO: 487501 - RNA, 21 nt, Human
ccccgcgcgcccgcgcgcccg

SEQ ID NO: 487502 - RNA, 21 nt, Human
ccccgcgcgcccgcgcgcccg

SEQ ID NO: 487503 - RNA, 22 nt, Human
ccccgcgcgcccgcgcgcccgc

SEQ ID NO: 487504 - RNA, 21 nt, Human
ccccgcugccucccgcggccg

SEQ ID NO: 487505 - RNA, 21 nt, Human
ccccucggggcucgccccccc

SEQ ID NO: 487506 - RNA, 20 nt, Human
cccgcgcgcccgccgaggcu

SEQ ID NO: 487507 - RNA, 21 nt, Human
cccgcgcgcccgccgaggcuc

SEQ ID NO: 487508 - RNA, 20 nt, Human
cccgcgcgcccgcgcgcccg

SEQ ID NO: 487509 - RNA, 21 nt, Human
cccgcgcgcccgcgcgcccgc

SEQ ID NO: 487510 - RNA, 24 nt, Human
cccgcggccgccgcaggaccggcg

SEQ ID NO: 487511 - RNA, 20 nt, Human
cccgcugccucccgcggccg

SEQ ID NO: 487512 - RNA, 21 nt, Human
cccgucagggggccacgacca

SEQ ID NO: 487513 - RNA, 23 nt, Human
cccgucagggggccacgaccaug

SEQ ID NO: 487514 - RNA, 25 nt, Human
cccucggggcucgcccccccgccuc

SEQ ID NO: 487515 - RNA, 18 nt, Human
cccuggguaccagagggc

SEQ ID NO: 487516 - RNA, 19 nt, Human
cccuggguaccagagggcu

SEQ ID NO: 487517 - RNA, 18 nt, Human
ccgaggcucccgccagcc

SEQ ID NO: 487518 - RNA, 24 nt, Human
ccgccucaccgggucagugaaaaa

SEQ ID NO: 487519 - RNA, 20 nt, Human
ccgcugccucccgcggccgc

SEQ ID NO: 487520 - RNA, 21 nt, Human
ccgcugcugagaggcuucaau

SEQ ID NO: 487521 - RNA, 23 nt, Human
ccggcagagcccggcgggaggcg

SEQ ID NO: 487522 - RNA, 18 nt, Human
ccggcgccgcagcccucg

SEQ ID NO: 487523 - RNA, 21 nt, Human
ccggcgccgcagcccucgcua

SEQ ID NO: 487524 - RNA, 20 nt, Human
ccgugcgugcccaccgcggc

SEQ ID NO: 487525 - RNA, 22 nt, Human
ccgugcgugcccaccgcggccg

SEQ ID NO: 487526 - RNA, 24 nt, Human
ccgugcgugcccaccgcggccgcg

SEQ ID NO: 487527 - RNA, 21 nt, Human
ccuauaaucccagcuacucag

SEQ ID NO: 487528 - RNA, 22 nt, Human
ccucccgcggccgccgcaggac

SEQ ID NO: 487529 - RNA, 21 nt, Human
ccuccggacugucccugacuu

SEQ ID NO: 487530 - RNA, 19 nt, Human
ccucgcuacagcgccuccu

SEQ ID NO: 487531 - RNA, 20 nt, Human
ccucugaaacuguacugugc

SEQ ID NO: 487532 - RNA, 19 nt, Human
ccucugagccagccagccu

SEQ ID NO: 487533 - RNA, 19 nt, Human
ccugcagguccaggcagcu

SEQ ID NO: 487534 - RNA, 23 nt, Human
ccuggacaacaagagcaagacuc

SEQ ID NO: 487535 - RNA, 18 nt, Human
ccuggagucccacccuga

SEQ ID NO: 487536 - RNA, 22 nt, Human
ccuggccaacauggugaaaccc

SEQ ID NO: 487537 - RNA, 24 nt, Human
ccuggccaacauggugaaacccug

SEQ ID NO: 487538 - RNA, 20 nt, Human
ccuggcuccaguucuagagu

SEQ ID NO: 487539 - RNA, 21 nt, Human
ccugggagaaggagguugcag

SEQ ID NO: 487540 - RNA, 22 nt, Human
ccuggggcugcugcgcacagcc

SEQ ID NO: 487541 - RNA, 20 nt, Human
ccuugugcuggucagacuuc

SEQ ID NO: 487542 - RNA, 20 nt, Human
ccuuuaguguugugaauaau

SEQ ID NO: 487543 - RNA, 21 nt, Human
cgacucuaagucagaauuccu

SEQ ID NO: 487544 - RNA, 24 nt, Human
cgacuugcaacaucuuccaacucu

SEQ ID NO: 487545 - RNA, 24 nt, Human
cgagaccagccuggccaacauggu

SEQ ID NO: 487546 - RNA, 23 nt, Human
cgcagagcggcgcugcggggacg

SEQ ID NO: 487547 - RNA, 24 nt, Human
cgccuauaaucccagcuacucagg

SEQ ID NO: 487548 - RNA, 24 nt, Human
cgcggccggcgcccccagcccgcc

SEQ ID NO: 487549 - RNA, 26 nt, Human
cgggccccauuuuuuuuuuuuuuuuu

SEQ ID NO: 487550 - RNA, 20 nt, Human
cggggcggcgggcgcagagc

SEQ ID NO: 487551 - RNA, 19 nt, Human
cggggcugcagcuggcggc

SEQ ID NO: 487552 - RNA, 23 nt, Human
cggggcugcagcuggcggccgac

SEQ ID NO: 487553 - RNA, 21 nt, Human
cgggucagugaaaaaacgauc

SEQ ID NO: 487554 - RNA, 20 nt, Human
cuauucauuuccagggacag

SEQ ID NO: 487555 - RNA, 23 nt, Human
cucagacccagagacuuccugga

SEQ ID NO: 487556 - RNA, 23 nt, Human
cucccggcacaggcaaaaauggc

SEQ ID NO: 487557 - RNA, 20 nt, Human
cuccuggaauauuuugaguu

SEQ ID NO: 487558 - RNA, 18 nt, Human
cuccuuccuugugcuggc

SEQ ID NO: 487559 - RNA, 20 nt, Human
cugaagucaguuucuccucc

SEQ ID NO: 487560 - RNA, 24 nt, Human
cugacaccuguaaucccagcacuu

SEQ ID NO: 487561 - RNA, 22 nt, Human
cugagacuaaauuuacaacagc

SEQ ID NO: 487562 - RNA, 22 nt, Human
cugagucauuugcuugcaccca

SEQ ID NO: 487563 - RNA, 20 nt, Human
cugcagcuggcggccggagc

SEQ ID NO: 487564 - RNA, 23 nt, Human
cugcaugucagaccagccuggga

SEQ ID NO: 487565 - RNA, 23 nt, Human
cugccccgcugccucccgcggcc

SEQ ID NO: 487566 - RNA, 19 nt, Human
cugcggggacggcgggcgc

SEQ ID NO: 487567 - RNA, 27 nt, Human
cugcuaggccucaggggugucugaguu

SEQ ID NO: 487568 - RNA, 20 nt, Human
cuggaauauuuugaguucug

SEQ ID NO: 487569 - RNA, 24 nt, Human
cuggacacacugcugccggcuggg

SEQ ID NO: 487570 - RNA, 24 nt, Human
cuggacccagagccacacacgccc

SEQ ID NO: 487571 - RNA, 24 nt, Human
cuggccaacauggugaaacccugu

SEQ ID NO: 487572 - RNA, 21 nt, Human
cugugcuuuuucccacuuugc

SEQ ID NO: 487573 - RNA, 20 nt, Human
cuguucucagcagcaguggg

SEQ ID NO: 487574 - RNA, 18 nt, Human
cuguugcaguuuucaguc

SEQ ID NO: 487575 - RNA, 23 nt, Human
cuugaaccugggagaaggagguu

SEQ ID NO: 487576 - RNA, 22 nt, Human
cuugcagugggcaacgggcgug

SEQ ID NO: 487577 - RNA, 18 nt, Human
cuuggcugggugcggugg

SEQ ID NO: 487578 - RNA, 20 nt, Human
cuugugacguggguguggac

SEQ ID NO: 487579 - RNA, 24 nt, Human
cuuuuggugaaaguuugggguugg

SEQ ID NO: 487580 - RNA, 26 nt, Human
gaaaaaccaauaguguguuucuucca

SEQ ID NO: 487581 - RNA, 23 nt, Human
gaacacggcaucuuccgucucuc

SEQ ID NO: 487582 - RNA, 26 nt, Human
gaagaaaaaaaaauuuuuuuaaaaag

SEQ ID NO: 487583 - RNA, 21 nt, Human
gacacacaguuucauguucca

SEQ ID NO: 487584 - RNA, 24 nt, Human
gacaccuguaaucccagcacuuug

SEQ ID NO: 487585 - RNA, 19 nt, Human
gacagaaaaaggaacgacu

SEQ ID NO: 487586 - RNA, 21 nt, Human
gacagaagcgaagggcagggg

SEQ ID NO: 487587 - RNA, 19 nt, Human
gacuugcaacaucuuccaa

SEQ ID NO: 487588 - RNA, 21 nt, Human
gagaggcuucaauugcaccug

SEQ ID NO: 487589 - RNA, 21 nt, Human
gagccggaggaggagcccggc

SEQ ID NO: 487590 - RNA, 20 nt, Human
gagcuguugagucauguggu

SEQ ID NO: 487591 - RNA, 19 nt, Human
gaggagcccggcccacagc

SEQ ID NO: 487592 - RNA, 25 nt, Human
gaggagcccggcccacagcgccugc

SEQ ID NO: 487593 - RNA, 23 nt, Human
gaggaggagcccggcccacagcg

SEQ ID NO: 487594 - RNA, 19 nt, Human
gaggcucccgccagccccg

SEQ ID NO: 487595 - RNA, 19 nt, Human
gagguugcagugagccuag

SEQ ID NO: 487596 - RNA, 24 nt, Human
gaucacuugaggucaggaguucga

SEQ ID NO: 487597 - RNA, 19 nt, Human
gcaacaucuuccaacucug

SEQ ID NO: 487598 - RNA, 20 nt, Human
gcacugccuuucaauuacuu

SEQ ID NO: 487599 - RNA, 20 nt, Human
gcagcagugggccugccugc

SEQ ID NO: 487600 - RNA, 24 nt, Human
gccaacauggugaaacccugucuc

SEQ ID NO: 487601 - RNA, 21 nt, Human
gccacacugucuaagguggcu

SEQ ID NO: 487602 - RNA, 19 nt, Human
gccgcggccggcgccccca

SEQ ID NO: 487603 - RNA, 24 nt, Human
gccgcugcugcguaggcgccgggg

SEQ ID NO: 487604 - RNA, 20 nt, Human
gccuagaucgcgccacugca

SEQ ID NO: 487605 - RNA, 23 nt, Human
gcgcggccgaggcgacggggccg

SEQ ID NO: 487606 - RNA, 18 nt, Human
gcgcugcggggacggcgg

SEQ ID NO: 487607 - RNA, 19 nt, Human
gcggaagcauggagggaaa

SEQ ID NO: 487608 - RNA, 20 nt, Human
gcggcccgcagggccggcgg

SEQ ID NO: 487609 - RNA, 19 nt, Human
gcgggcgccggcagagccc

SEQ ID NO: 487610 - RNA, 25 nt, Human
gcuacagcgccuccugccgcggccg

SEQ ID NO: 487611 - RNA, 18 nt, Human
gcugacaccuguaauccc

SEQ ID NO: 487612 - RNA, 19 nt, Human
gcugcccugcaguaacugg

SEQ ID NO: 487613 - RNA, 24 nt, Human
gcuggcggccggagcugcccgggg

SEQ ID NO: 487614 - RNA, 23 nt, Human
gcuguccucugaaacuguacugu

SEQ ID NO: 487615 - RNA, 22 nt, Human
ggaggaagugggccuaggaggg

SEQ ID NO: 487616 - RNA, 20 nt, Human
ggagguugcagugagccuag

SEQ ID NO: 487617 - RNA, 23 nt, Human
ggagguugcagugagccuagauc

SEQ ID NO: 487618 - RNA, 24 nt, Human
ggagguugcagugagccuagaucg

SEQ ID NO: 487619 - RNA, 18 nt, Human
ggcacaggcaaaaauggc

SEQ ID NO: 487620 - RNA, 23 nt, Human
ggccccauuuuuuuuuuuuuuuu

SEQ ID NO: 487621 - RNA, 25 nt, Human
ggccgcugcugcguaggcgccgggg

SEQ ID NO: 487622 - RNA, 21 nt, Human
ggcugacaccuguaaucccag

SEQ ID NO: 487623 - RNA, 18 nt, Human
gggaaaaaaaaaauccaa

SEQ ID NO: 487624 - RNA, 21 nt, Human
gggaaaaaaaaaauccaaugu

SEQ ID NO: 487625 - RNA, 24 nt, Human
gggaaggagacugcuguccucuga

SEQ ID NO: 487626 - RNA, 18 nt, Human
gggagaaggagguugcag

SEQ ID NO: 487627 - RNA, 19 nt, Human
gggcacccugggcaccacg

SEQ ID NO: 487628 - RNA, 24 nt, Human
gggcugcagcuggcggccggagcu

SEQ ID NO: 487629 - RNA, 18 nt, Human
gggcuggggggccagauc

SEQ ID NO: 487630 - RNA, 21 nt, Human
ggggauggccuuaaaaggggu

SEQ ID NO: 487631 - RNA, 24 nt, Human
gggugcgguggcugacaccuguaa

SEQ ID NO: 487632 - RNA, 24 nt, Human
gguggcagacgccuauaaucccag

SEQ ID NO: 487633 - RNA, 23 nt, Human
gguggcugacaccuguaauccca

SEQ ID NO: 487634 - RNA, 24 nt, Human
gguggcugacaccuguaaucccag

SEQ ID NO: 487635 - RNA, 21 nt, Human
gugaaacccugucucuacuaa

SEQ ID NO: 487636 - RNA, 24 nt, Human
gugguuucaguugggggugagggg

SEQ ID NO: 487637 - RNA, 20 nt, Human
uaacagaguuaacauuacaa

SEQ ID NO: 487638 - RNA, 20 nt, Human
uaagguaccaccuggucuua

SEQ ID NO: 487639 - RNA, 23 nt, Human
uacaacaguauuacaaauaguca

SEQ ID NO: 487640 - RNA, 24 nt, Human
uacaacaguauuacaaauagucaa

SEQ ID NO: 487641 - RNA, 25 nt, Human
uacaacaucagggcugugucaugag

SEQ ID NO: 487642 - RNA, 19 nt, Human
uacaaugauugccaucaca

SEQ ID NO: 487643 - RNA, 19 nt, Human
uaccgcauccuuuucuucc

SEQ ID NO: 487644 - RNA, 20 nt, Human
uaccuggauuauuauuaaug

SEQ ID NO: 487645 - RNA, 20 nt, Human
uacuaguuguguucccuaac

SEQ ID NO: 487646 - RNA, 18 nt, Human
uacuuucuuccaagaaag

SEQ ID NO: 487647 - RNA, 25 nt, Human
uagcaacaaggucuucuauaacaac

SEQ ID NO: 487648 - RNA, 21 nt, Human
uagccccaagugccccagaga

SEQ ID NO: 487649 - RNA, 25 nt, Human
uauuaagcacuuauaagcaguuuuu

SEQ ID NO: 487650 - RNA, 19 nt, Human
ucacaagagcuguggcgcc

SEQ ID NO: 487651 - RNA, 19 nt, Human
ucacgggaaggagacugcu

SEQ ID NO: 487652 - RNA, 18 nt, Human
ucacuuaguccuggcucc

SEQ ID NO: 487653 - RNA, 20 nt, Human
ucagaccauuuccuucuguu

SEQ ID NO: 487654 - RNA, 18 nt, Human
ucagcucagggugagguc

SEQ ID NO: 487655 - RNA, 23 nt, Human
ucagcucagggugagguccuggg

SEQ ID NO: 487656 - RNA, 23 nt, Human
ucagcucuggucacagguuuuua

SEQ ID NO: 487657 - RNA, 22 nt, Human
ucagucccugaaggacagaaaa

SEQ ID NO: 487658 - RNA, 21 nt, Human
ucaguuaaggauguuugcuuu

SEQ ID NO: 487659 - RNA, 22 nt, Human
ucaguuaaggauguuugcuuug

SEQ ID NO: 487660 - RNA, 25 nt, Human
ucaguuaaggauguuugcuuugggu

SEQ ID NO: 487661 - RNA, 20 nt, Human
ucaguugggggugaggggaa

SEQ ID NO: 487662 - RNA, 18 nt, Human
ucauggaaggaaauauga

SEQ ID NO: 487663 - RNA, 21 nt, Human
uccacgcaaggugggccccuc

SEQ ID NO: 487664 - RNA, 20 nt, Human
uccacucucauucauagcaa

SEQ ID NO: 487665 - RNA, 23 nt, Human
uccccagaaagcuucaagagcac

SEQ ID NO: 487666 - RNA, 18 nt, Human
ucccgcggccgccgcagg

SEQ ID NO: 487667 - RNA, 18 nt, Human
ucccugaaggacagaaaa

SEQ ID NO: 487668 - RNA, 21 nt, Human
ucccuggguaccagagggcuu

SEQ ID NO: 487669 - RNA, 23 nt, Human
uccgaagcugggaaaggcagaac

SEQ ID NO: 487670 - RNA, 23 nt, Human
uccgucucucaugaugccgguca

SEQ ID NO: 487671 - RNA, 20 nt, Human
uccugaagacucagcucagg

SEQ ID NO: 487672 - RNA, 20 nt, Human
uccuucagcucuggucacag

SEQ ID NO: 487673 - RNA, 23 nt, Human
ucgacaucucagcccuccaugcu

SEQ ID NO: 487674 - RNA, 23 nt, Human
ucgcgccacugcacuccagccug

SEQ ID NO: 487675 - RNA, 24 nt, Human
ucgcuugaaccugggagaaggagg

SEQ ID NO: 487676 - RNA, 21 nt, Human
ucguggggaccccaggagggc

SEQ ID NO: 487677 - RNA, 23 nt, Human
ucuccuggaauauuuugaguucu

SEQ ID NO: 487678 - RNA, 21 nt, Human
ucuucuauaacaacgacucuu

SEQ ID NO: 487679 - RNA, 18 nt, Human
ucuuugguggaagacaag

SEQ ID NO: 487680 - RNA, 24 nt, Human
ugaaccugggagaaggagguugca

SEQ ID NO: 487681 - RNA, 20 nt, Human
ugaagaguagucugcccaca

SEQ ID NO: 487682 - RNA, 22 nt, Human
ugaauaauacuugaaaagccca

SEQ ID NO: 487683 - RNA, 21 nt, Human
ugacacacaguuucauguucc

SEQ ID NO: 487684 - RNA, 18 nt, Human
ugacacagaaucagagaa

SEQ ID NO: 487685 - RNA, 22 nt, Human
ugagccuagaucgcgccacugc

SEQ ID NO: 487686 - RNA, 24 nt, Human
ugaggcaggagagucgcuugaacc

SEQ ID NO: 487687 - RNA, 25 nt, Human
ugaggcaggagagucgcuugaaccu

SEQ ID NO: 487688 - RNA, 21 nt, Human
ugagucauuugcuugcaccca

SEQ ID NO: 487689 - RNA, 18 nt, Human
ugcaagugcccugauuuc

SEQ ID NO: 487690 - RNA, 21 nt, Human
ugcaguuuucaguccuagagu

SEQ ID NO: 487691 - RNA, 20 nt, Human
ugcauggcacaguuugaaua

SEQ ID NO: 487692 - RNA, 21 nt, Human
ugcccgugccugcccuguucu

SEQ ID NO: 487693 - RNA, 18 nt, Human
ugcccuguucucagcagc

SEQ ID NO: 487694 - RNA, 19 nt, Human
ugcuaugcacaccauccca

SEQ ID NO: 487695 - RNA, 19 nt, Human
uggaaaaagcaacuaaggc

SEQ ID NO: 487696 - RNA, 18 nt, Human
uggaagacaagcagcuug

SEQ ID NO: 487697 - RNA, 19 nt, Human
uggaagacaagcagcuugg

SEQ ID NO: 487698 - RNA, 19 nt, Human
uggaauauuuugaguucug

SEQ ID NO: 487699 - RNA, 20 nt, Human
uggaggcacugccuuucaau

SEQ ID NO: 487700 - RNA, 24 nt, Human
uggccaacauggugaaacccuguc

SEQ ID NO: 487701 - RNA, 27 nt, Human
uggccacgccaggccauucugcucuca

SEQ ID NO: 487702 - RNA, 22 nt, Human
uggcgcggccgaggcgacgggg

SEQ ID NO: 487703 - RNA, 22 nt, Human
uggcggccggagcugcccgggg

SEQ ID NO: 487704 - RNA, 24 nt, Human
uggcggggaaagaguugcuuguuu

SEQ ID NO: 487705 - RNA, 24 nt, Human
uggcugacaccuguaaucccagca

SEQ ID NO: 487706 - RNA, 24 nt, Human
ugggagaaggagguugcagugagc

SEQ ID NO: 487707 - RNA, 24 nt, Human
ugggaggccaaggcaggcagauca

SEQ ID NO: 487708 - RNA, 19 nt, Human
ugggccuaggagggccugc

SEQ ID NO: 487709 - RNA, 21 nt, Human
uggggaaagcugcccugcagu

SEQ ID NO: 487710 - RNA, 21 nt, Human
uggggaccccaggagggcuga

SEQ ID NO: 487711 - RNA, 21 nt, Human
uguagccacuggccaccacuc

SEQ ID NO: 487712 - RNA, 24 nt, Human
ugucuuuggaagaaaaaaaaauuu

SEQ ID NO: 487713 - RNA, 20 nt, Human
ugugguuccagugacacccu

SEQ ID NO: 487714 - RNA, 23 nt, Human
ugugugugugcacacacacaucu

SEQ ID NO: 487715 - RNA, 25 nt, Human
ugugugugugcacacacacaucuag

SEQ ID NO: 487716 - RNA, 18 nt, Human
uguuacagggaaggacuc

SEQ ID NO: 487717 - RNA, 19 nt, Human
uguuacagggaaggacucu

SEQ ID NO: 487718 - RNA, 22 nt, Human
uuaaaagcuggccugaccccac

SEQ ID NO: 487719 - RNA, 19 nt, Human
uuaaaagggguaaggggaa

SEQ ID NO: 487720 - RNA, 22 nt, Human
uuaaccccaugaaagacgccga

SEQ ID NO: 487721 - RNA, 18 nt, Human
uuagccgggcgugguggc

SEQ ID NO: 487722 - RNA, 24 nt, Human
uuagccgggcgugguggcagacgc

SEQ ID NO: 487723 - RNA, 24 nt, Human
uucaagagcaccuaaaaauauuca

SEQ ID NO: 487724 - RNA, 23 nt, Human
uucauggcacagacucugcugug

SEQ ID NO: 487725 - RNA, 23 nt, Human
uucauggcacagacucugcugug

SEQ ID NO: 487726 - RNA, 22 nt, Human
uuccagcacaugggagcuucac

SEQ ID NO: 487727 - RNA, 20 nt, Human
uuccagggacagaaaaccac

SEQ ID NO: 487728 - RNA, 25 nt, Human
uuccuucagcucuggucacagguuu

SEQ ID NO: 487729 - RNA, 20 nt, Human
uugaaccugggagaaggagg

SEQ ID NO: 487730 - RNA, 24 nt, Human
uugaaccugggagaaggagguugc

SEQ ID NO: 487731 - RNA, 22 nt, Human
uugcagugagccuagaucgcgc

SEQ ID NO: 487732 - RNA, 19 nt, Human
uuggaagaaaaaaaaauuu

SEQ ID NO: 487733 - RNA, 23 nt, Human
uuguacauagccccaagugcccc

SEQ ID NO: 487734 - RNA, 21 nt, Human
uuguuuuguuuucaaauugug

SEQ ID NO: 487735 - RNA, 23 nt, Human
uuucaguccuagagucuuccuuc

SEQ ID NO: 487736 - RNA, 18 nt, Human
uuucucacuuaguccugg

SEQ ID NO: 487737 - RNA, 23 nt, Human
uuucugugauccaguccccagug

SEQ ID NO: 487738 - RNA, 21 nt, Human
uuucuguugcaguuuucaguc

SEQ ID NO: 487739 - RNA, 23 nt, Human
uuugguuacuccaggccacagca

SEQ ID NO: 487740 - RNA, 23 nt, Human
uuuucaguccuagagucuuccuu

SEQ ID NO: 487741 - RNA, 21 nt, Human
aagcaccccgccccgugcccg

SEQ ID NO: 487742 - RNA, 21 nt, Human
acccacacccgcaccccccac

SEQ ID NO: 487743 - RNA, 22 nt, Human
acccgcaccccccacccaggcc

SEQ ID NO: 487744 - RNA, 20 nt, Human
acccuaagcaccccgccccg

SEQ ID NO: 487745 - RNA, 21 nt, Human
cacacccgcaccccccaccca

SEQ ID NO: 487746 - RNA, 19 nt, Human
cacccacacccgcaccccc

SEQ ID NO: 487747 - RNA, 19 nt, Human
caccccccacccaggcccc

SEQ ID NO: 487748 - RNA, 21 nt, Human
cacccgcaccccccacccagg

SEQ ID NO: 487749 - RNA, 20 nt, Human
cagccgccgccgccgcccca

SEQ ID NO: 487750 - RNA, 18 nt, Human
ccacccacacccgcaccc

SEQ ID NO: 487751 - RNA, 21 nt, Human
cccacacccgcaccccccacc

SEQ ID NO: 487752 - RNA, 23 nt, Human
ccccgugcccgugcccgugccug

SEQ ID NO: 487753 - RNA, 22 nt, Human
cccgugcccgugccugcagccg

SEQ ID NO: 487754 - RNA, 24 nt, Human
cccuaagcaccccgccccucgggg

SEQ ID NO: 487755 - RNA, 18 nt, Human
ccgcaccccccacccagg

SEQ ID NO: 487756 - RNA, 18 nt, Human
ccgccgccccaggacucg

SEQ ID NO: 487757 - RNA, 23 nt, Human
ccuacacugggacagugggacca

SEQ ID NO: 487758 - RNA, 22 nt, Human
ccugcagccgccgccgccgccc

SEQ ID NO: 487759 - RNA, 21 nt, Human
cuaagcaccccgccccgugcc

SEQ ID NO: 487760 - RNA, 23 nt, Human
cuccgccgcuaggcgcgcgccuc

SEQ ID NO: 487761 - RNA, 19 nt, Human
cuccugcacccuaagcacc

SEQ ID NO: 487762 - RNA, 21 nt, Human
cugcagccgccgccgccgccc

SEQ ID NO: 487763 - RNA, 19 nt, Human
gcagccgccgccgccgccc

SEQ ID NO: 487764 - RNA, 21 nt, Human
gccgcagguccccacccacac

SEQ ID NO: 487765 - RNA, 20 nt, Human
gccugcagccgccgccgccg

SEQ ID NO: 487766 - RNA, 20 nt, Human
gcgcgcgccuccugcacccu

SEQ ID NO: 487767 - RNA, 19 nt, Human
gggacagugggaccaggaa

SEQ ID NO: 487768 - RNA, 18 nt, Human
ucagaacacaucuguugc

SEQ ID NO: 487769 - RNA, 19 nt, Human
ucagaacacaucuguugca

SEQ ID NO: 487770 - RNA, 22 nt, Human
uccccacccacacccgcacccc

SEQ ID NO: 487771 - RNA, 20 nt, Human
uccugcacccuaagcacccc

SEQ ID NO: 487772 - RNA, 25 nt, Human
uccugcacccuaagcaccccgcccc

SEQ ID NO: 487773 - RNA, 19 nt, Human
ugcccgugcccgugccugc

SEQ ID NO: 487774 - RNA, 22 nt, Human
uuguagguucagagaaucagaa

SEQ ID NO: 487775 - RNA, 19 nt, Human
aacacuucuuguguuccag

SEQ ID NO: 487776 - RNA, 24 nt, Human
caacacuaagggccaaacccagug

SEQ ID NO: 487777 - RNA, 25 nt, Human
caacacuaagggccaaacccaguga

SEQ ID NO: 487778 - RNA, 23 nt, Human
cccuucccggaaccucggcuccc

SEQ ID NO: 487779 - RNA, 19 nt, Human
ccggaaccucggcuccccc

SEQ ID NO: 487780 - RNA, 26 nt, Human
ccucaaugccacgacgccauuuccua

SEQ ID NO: 487781 - RNA, 26 nt, Human
cuucccggaaccucggcuccccccca

SEQ ID NO: 487782 - RNA, 18 nt, Human
gaaccucggcuccccccc

SEQ ID NO: 487783 - RNA, 20 nt, Human
gacgccauuuccuacuacga

SEQ ID NO: 487784 - RNA, 22 nt, Human
gcaagcacucaauucucuaaau

SEQ ID NO: 487785 - RNA, 21 nt, Human
gcgagcuuuuccuggagguuc

SEQ ID NO: 487786 - RNA, 22 nt, Human
gcucuggcaugcaagauaaucc

SEQ ID NO: 487787 - RNA, 19 nt, Human
ggagguucuaggagggaug

SEQ ID NO: 487788 - RNA, 30 nt, Human
gucaacacuaagggccaaacccagugaacu

SEQ ID NO: 487789 - RNA, 23 nt, Human
uaggagggaugccccucaauggu

SEQ ID NO: 487790 - RNA, 23 nt, Human
uauuccauuccagcgcucuggca

SEQ ID NO: 487791 - RNA, 18 nt, Human
ucucucuccgcagaaccu

SEQ ID NO: 487792 - RNA, 25 nt, Human
ucuuccgcgagcuuuuccuggaggu

SEQ ID NO: 487793 - RNA, 22 nt, Human
ugcaagcacucaauucucuaaa

SEQ ID NO: 487794 - RNA, 21 nt, Human
ugccacgacgccauuuccuac

SEQ ID NO: 487795 - RNA, 22 nt, Human
ugcuaagccaacuggacuacac

SEQ ID NO: 487796 - RNA, 22 nt, Human
uucccagacugcuuggagccuc

SEQ ID NO: 487797 - RNA, 25 nt, Human
uuuaaaaacagaaaaucagaucagu

SEQ ID NO: 487798 - RNA, 23 nt, Human
uuuccuggagguucuaggaggga

SEQ ID NO: 487799 - RNA, 27 nt, Human
aaaagcacaaaugugcauaguucagaa

SEQ ID NO: 487800 - RNA, 19 nt, Human
aaacuuacaaaaaaagcac

SEQ ID NO: 487801 - RNA, 23 nt, Human
aaagaaaaauaccaaauaaauca

SEQ ID NO: 487802 - RNA, 23 nt, Human
aaagguuuuuuuugucuuuuuua

SEQ ID NO: 487803 - RNA, 23 nt, Human
aaaguacaccuuucacaauaaca

SEQ ID NO: 487804 - RNA, 19 nt, Human
acaaaaaaagcacaaaugu

SEQ ID NO: 487805 - RNA, 18 nt, Human
agcggcggcggagggaca

SEQ ID NO: 487806 - RNA, 23 nt, Human
aggugcaaagacugacagugacc

SEQ ID NO: 487807 - RNA, 18 nt, Human
auaaaaggcuuaugcccc

SEQ ID NO: 487808 - RNA, 21 nt, Human
auaaaaggcuuaugccccuaa

SEQ ID NO: 487809 - RNA, 18 nt, Human
augaauuuaagcaaaggu

SEQ ID NO: 487810 - RNA, 27 nt, Human
augaugugccugaggaaaaacagauac

SEQ ID NO: 487811 - RNA, 21 nt, Human
caaaaaaagcacaaaugugca

SEQ ID NO: 487812 - RNA, 23 nt, Human
caaaaaaagcacaaaugugcaua

SEQ ID NO: 487813 - RNA, 23 nt, Human
caaaaaaagcacaaaugugcaua

SEQ ID NO: 487814 - RNA, 26 nt, Human
cacaaaguacaccuuucacaauaaca

SEQ ID NO: 487815 - RNA, 21 nt, Human
cacaauaacacugaaagcagg

SEQ ID NO: 487816 - RNA, 21 nt, Human
caccgagcaccagagccggcc

SEQ ID NO: 487817 - RNA, 23 nt, Human
cagaagaucugcaagagggccau

SEQ ID NO: 487818 - RNA, 24 nt, Human
cagccgcagagcgcggcgcgggug

SEQ ID NO: 487819 - RNA, 22 nt, Human
cauaaaaggcuuaugccccuaa

SEQ ID NO: 487820 - RNA, 22 nt, Human
ccucccgggucagauccuggcc

SEQ ID NO: 487821 - RNA, 21 nt, Human
cgccggaaacgggagcggcgg

SEQ ID NO: 487822 - RNA, 18 nt, Human
cgggagcggcggcggagg

SEQ ID NO: 487823 - RNA, 19 nt, Human
cgggagcggcggcggaggg

SEQ ID NO: 487824 - RNA, 21 nt, Human
cgggagcggcggcggagggac

SEQ ID NO: 487825 - RNA, 21 nt, Human
cugaaagcaggugcaaagacu

SEQ ID NO: 487826 - RNA, 21 nt, Human
gaaaugagcacaaaguacacc

SEQ ID NO: 487827 - RNA, 20 nt, Human
gagcggcggcggagggacac

SEQ ID NO: 487828 - RNA, 19 nt, Human
gauccuggccaucuccccc

SEQ ID NO: 487829 - RNA, 20 nt, Human
gauccuggccaucucccccg

SEQ ID NO: 487830 - RNA, 21 nt, Human
gcaccagagccggccgggaaa

SEQ ID NO: 487831 - RNA, 20 nt, Human
gccuagagccagccgcagag

SEQ ID NO: 487832 - RNA, 23 nt, Human
gcgcgggugcggccuccucccgg

SEQ ID NO: 487833 - RNA, 25 nt, Human
ggaaacgggagcggcggcggaggga

SEQ ID NO: 487834 - RNA, 23 nt, Human
ggccaucucccccgccggaaacg

SEQ ID NO: 487835 - RNA, 18 nt, Human
gggagcggcggcggaggg

SEQ ID NO: 487836 - RNA, 21 nt, Human
uaaaaguugguccaaacuuac

SEQ ID NO: 487837 - RNA, 22 nt, Human
uagaacagcaugaauuuaagca

SEQ ID NO: 487838 - RNA, 23 nt, Human
ucaagagaaagguuguguuuuau

SEQ ID NO: 487839 - RNA, 23 nt, Human
ucaagagaaagguuguguuuuau

SEQ ID NO: 487840 - RNA, 19 nt, Human
uccaaacuuacaaaaaaag

SEQ ID NO: 487841 - RNA, 24 nt, Human
uccaaacuuacaaaaaaagcacaa

SEQ ID NO: 487842 - RNA, 21 nt, Human
ucccccgccggaaacgggagc

SEQ ID NO: 487843 - RNA, 23 nt, Human
ugaaagcaggugcaaagacugac

SEQ ID NO: 487844 - RNA, 22 nt, Human
ugaaaugagcacaaaguacacc

SEQ ID NO: 487845 - RNA, 25 nt, Human
ugcaagaauacaaaauaaaauuguu

SEQ ID NO: 487846 - RNA, 21 nt, Human
ugccugaggaaaaacagauac

SEQ ID NO: 487847 - RNA, 18 nt, Human
uggagguggggaggggcu

SEQ ID NO: 487848 - RNA, 23 nt, Human
uguaugcaagacccuucuccaca

SEQ ID NO: 487849 - RNA, 18 nt, Human
uuaaaacugcaagaauac

SEQ ID NO: 487850 - RNA, 18 nt, Human
uuacauaaaaguuggucc

SEQ ID NO: 487851 - RNA, 22 nt, Human
uugguccaaacuuacaaaaaaa

SEQ ID NO: 487852 - RNA, 19 nt, Human
aaagcagagacuugaaugg

SEQ ID NO: 487853 - RNA, 23 nt, Human
aagcagguggcggugguagcugg

SEQ ID NO: 487854 - RNA, 26 nt, Human
aagcagguggcggugguagcuggggc

SEQ ID NO: 487855 - RNA, 19 nt, Human
acaguggagaggccaggga

SEQ ID NO: 487856 - RNA, 22 nt, Human
agacgaacagugaaaacagagc

SEQ ID NO: 487857 - RNA, 23 nt, Human
agaguggagacaguggagaggcc

SEQ ID NO: 487858 - RNA, 24 nt, Human
agaguggagacaguggagaggcca

SEQ ID NO: 487859 - RNA, 18 nt, Human
agcagguggcggugguag

SEQ ID NO: 487860 - RNA, 18 nt, Human
agcccagugacgagagcc

SEQ ID NO: 487861 - RNA, 21 nt, Human
cagagcccagugacgagagcc

SEQ ID NO: 487862 - RNA, 23 nt, Human
cagagcccagugacgagagccgg

SEQ ID NO: 487863 - RNA, 18 nt, Human
cagccuggugaccucugc

SEQ ID NO: 487864 - RNA, 23 nt, Human
cagguggcggugguagcuggggc

SEQ ID NO: 487865 - RNA, 20 nt, Human
cagugaaaacagagcccagu

SEQ ID NO: 487866 - RNA, 23 nt, Human
ccagugacgagagccggccccuu

SEQ ID NO: 487867 - RNA, 21 nt, Human
ccccaggcugggccgagcagc

SEQ ID NO: 487868 - RNA, 18 nt, Human
ccccggacccccgggccu

SEQ ID NO: 487869 - RNA, 21 nt, Human
cccggacccccgggccuuugg

SEQ ID NO: 487870 - RNA, 22 nt, Human
cgagagccggccccuuggcugg

SEQ ID NO: 487871 - RNA, 19 nt, Human
cgagauggcaucuaucugu

SEQ ID NO: 487872 - RNA, 19 nt, Human
cgggcgagauggcaucuau

SEQ ID NO: 487873 - RNA, 20 nt, Human
cugauggggggcugcaggca

SEQ ID NO: 487874 - RNA, 21 nt, Human
cuuggcuggggacccucccca

SEQ ID NO: 487875 - RNA, 19 nt, Human
gaagccccuugacucaaag

SEQ ID NO: 487876 - RNA, 19 nt, Human
gcaaguagaggaagucagg

SEQ ID NO: 487877 - RNA, 22 nt, Human
gcagguggcggugguagcuggg

SEQ ID NO: 487878 - RNA, 21 nt, Human
gcagugaagccccuugacuca

SEQ ID NO: 487879 - RNA, 26 nt, Human
gccccuugacucaaagcagagacugg

SEQ ID NO: 487880 - RNA, 27 nt, Human
ggagacaguggagaggccagggagggc

SEQ ID NO: 487881 - RNA, 19 nt, Human
ggagaguggagacagugga

SEQ ID NO: 487882 - RNA, 18 nt, Human
gggccuuuggcauaaugc

SEQ ID NO: 487883 - RNA, 21 nt, Human
gugaagccccuugacucaaag

SEQ ID NO: 487884 - RNA, 20 nt, Human
uagaccagccuggugaccuc

SEQ ID NO: 487885 - RNA, 22 nt, Human
uagaccagccuggugaccucug

SEQ ID NO: 487886 - RNA, 20 nt, Human
ucaaagcagagacuugaauu

SEQ ID NO: 487887 - RNA, 19 nt, Human
uccccggacccccgggccu

SEQ ID NO: 487888 - RNA, 23 nt, Human
uccggcucggguggcggccucgu

SEQ ID NO: 487889 - RNA, 21 nt, Human
ugaagccccuugacucaaagc

SEQ ID NO: 487890 - RNA, 25 nt, Human
ugaccucugcccuuccccggacccc

SEQ ID NO: 487891 - RNA, 19 nt, Human
ugacucaaagcagagacuu

SEQ ID NO: 487892 - RNA, 18 nt, Human
ugcaggcagugaagcccc

SEQ ID NO: 487893 - RNA, 19 nt, Human
ugcugauggggggcugcag

SEQ ID NO: 487894 - RNA, 22 nt, Human
uggaagaucauugcuguuugcc

SEQ ID NO: 487895 - RNA, 24 nt, Human
uggagaguggagacaguggagagg

SEQ ID NO: 487896 - RNA, 18 nt, Human
uuuuuuuuuuuuuuuuug

SEQ ID NO: 487897 - RNA, 22 nt, Human
aaaaaccagaaccccccaggug

SEQ ID NO: 487898 - RNA, 23 nt, Human
aaaaaggccacagacuaaccucc

SEQ ID NO: 487899 - RNA, 21 nt, Human
aaaaaguaaaaaccagaaccc

SEQ ID NO: 487900 - RNA, 18 nt, Human
aacagcaucgccucacag

SEQ ID NO: 487901 - RNA, 21 nt, Human
aacaucugguacaaaggguga

SEQ ID NO: 487902 - RNA, 25 nt, Human
aagcagccgcgucaugacggguuuc

SEQ ID NO: 487903 - RNA, 18 nt, Human
aagccucugacgacacag

SEQ ID NO: 487904 - RNA, 20 nt, Human
aagccucugacgacacaggg

SEQ ID NO: 487905 - RNA, 21 nt, Human
aagcgaauggaaaacagcaca

SEQ ID NO: 487906 - RNA, 23 nt, Human
acagggccugccugcaccacgac

SEQ ID NO: 487907 - RNA, 19 nt, Human
agaagccguggaagcgaau

SEQ ID NO: 487908 - RNA, 27 nt, Human
agacaggcuguauggggguccuucaug

SEQ ID NO: 487909 - RNA, 27 nt, Human
agacaggcuguaugggggucggacccc

SEQ ID NO: 487910 - RNA, 24 nt, Human
agcugacuucacaguaguagauac

SEQ ID NO: 487911 - RNA, 21 nt, Human
aggcagaagccguggaagcga

SEQ ID NO: 487912 - RNA, 19 nt, Human
agggugucacugguccugg

SEQ ID NO: 487913 - RNA, 21 nt, Human
agguggucagcaggacuucug

SEQ ID NO: 487914 - RNA, 21 nt, Human
agugccgacuuggggaagugc

SEQ ID NO: 487915 - RNA, 22 nt, Human
cacagggacgcagggugucacu

SEQ ID NO: 487916 - RNA, 21 nt, Human
caccgccggcucggccagucc

SEQ ID NO: 487917 - RNA, 21 nt, Human
cagaaccccccaggugcccau

SEQ ID NO: 487918 - RNA, 22 nt, Human
cagaaccccccaggugcccauc

SEQ ID NO: 487919 - RNA, 23 nt, Human
cagcacagcugacuucacaguag

SEQ ID NO: 487920 - RNA, 24 nt, Human
cagcaucgccucacagcugugcag

SEQ ID NO: 487921 - RNA, 22 nt, Human
cagcggcgccuccucgccgccc

SEQ ID NO: 487922 - RNA, 18 nt, Human
cagcucccuggccccugg

SEQ ID NO: 487923 - RNA, 20 nt, Human
caggccacagggccugccug

SEQ ID NO: 487924 - RNA, 21 nt, Human
cagggccugccugcaccacga

SEQ ID NO: 487925 - RNA, 20 nt, Human
caggggaagccuggcccaag

SEQ ID NO: 487926 - RNA, 23 nt, Human
cagguaaauuguucaaaaauguu

SEQ ID NO: 487927 - RNA, 23 nt, Human
caguaguagauacuggugacacu

SEQ ID NO: 487928 - RNA, 21 nt, Human
ccagaaccccccaggugccca

SEQ ID NO: 487929 - RNA, 20 nt, Human
ccaguccgucagggcgcgcc

SEQ ID NO: 487930 - RNA, 23 nt, Human
ccagugugcaggaguguguuggg

SEQ ID NO: 487931 - RNA, 26 nt, Human
ccaugcgggggcaggacugguggggg

SEQ ID NO: 487932 - RNA, 18 nt, Human
cccaggagggcagugggg

SEQ ID NO: 487933 - RNA, 23 nt, Human
ccccagaugucugcuuccgaagc

SEQ ID NO: 487934 - RNA, 30 nt, Human
ccccaggugcccauccagcagaaggccccu

SEQ ID NO: 487935 - RNA, 19 nt, Human
cccccgccgcccucagccc

SEQ ID NO: 487936 - RNA, 22 nt, Human
cccccgccgcccucagccccgc

SEQ ID NO: 487937 - RNA, 22 nt, Human
ccccucggcgccgccgcccucc

SEQ ID NO: 487938 - RNA, 22 nt, Human
cccgccgcccucagccccgccc

SEQ ID NO: 487939 - RNA, 24 nt, Human
cccucccagcucgggcggcccgcc

SEQ ID NO: 487940 - RNA, 18 nt, Human
ccgcccccgccgcccuca

SEQ ID NO: 487941 - RNA, 21 nt, Human
ccgccgcccucagccccgccc

SEQ ID NO: 487942 - RNA, 19 nt, Human
ccgccgcccucccagcucg

SEQ ID NO: 487943 - RNA, 22 nt, Human
ccggcagcagcggcgccuccuc

SEQ ID NO: 487944 - RNA, 27 nt, Human
ccggcagcagcggcgccuccucgccgc

SEQ ID NO: 487945 - RNA, 22 nt, Human
ccucacagcugugcagacgaac

SEQ ID NO: 487946 - RNA, 21 nt, Human
ccucccagcucgggcggcccg

SEQ ID NO: 487947 - RNA, 20 nt, Human
cgaagcagccgcgucaugac

SEQ ID NO: 487948 - RNA, 24 nt, Human
cgcccucccagcucgggcggcccg

SEQ ID NO: 487949 - RNA, 21 nt, Human
cgccucacagcugugcagacg

SEQ ID NO: 487950 - RNA, 18 nt, Human
cgucccgacggcgcagag

SEQ ID NO: 487951 - RNA, 20 nt, Human
cucagcccagcaggccacag

SEQ ID NO: 487952 - RNA, 19 nt, Human
cugcuuccgaagcagccgc

SEQ ID NO: 487953 - RNA, 18 nt, Human
cugggccacucagugccg

SEQ ID NO: 487954 - RNA, 23 nt, Human
gaacagauguggucuacugccac

SEQ ID NO: 487955 - RNA, 20 nt, Human
gacccagaaugaacuuaaug

SEQ ID NO: 487956 - RNA, 19 nt, Human
gacgacacagggccacaga

SEQ ID NO: 487957 - RNA, 22 nt, Human
gagacaggcuguaugggggucc

SEQ ID NO: 487958 - RNA, 18 nt, Human
gcacugacgcuggaggcc

SEQ ID NO: 487959 - RNA, 23 nt, Human
gcaggaguguguugggugggucu

SEQ ID NO: 487960 - RNA, 20 nt, Human
gcagugggguggcagggcua

SEQ ID NO: 487961 - RNA, 23 nt, Human
gcaucgccucacagcugugcaga

SEQ ID NO: 487962 - RNA, 20 nt, Human
ggagacaggcuguauggggg

SEQ ID NO: 487963 - RNA, 20 nt, Human
ggaggccaucuccagcuccc

SEQ ID NO: 487964 - RNA, 21 nt, Human
ggagggcagugggguggcagg

SEQ ID NO: 487965 - RNA, 19 nt, Human
ggcagcagcggcgccuccu

SEQ ID NO: 487966 - RNA, 21 nt, Human
ggccgcucuccuccccucggc

SEQ ID NO: 487967 - RNA, 24 nt, Human
gggcaggacugguggggggggggg

SEQ ID NO: 487968 - RNA, 19 nt, Human
gggcagggcggggcggggu

SEQ ID NO: 487969 - RNA, 22 nt, Human
gggccggggccagugugcagga

SEQ ID NO: 487970 - RNA, 20 nt, Human
gggcgccgggccccgcgggu

SEQ ID NO: 487971 - RNA, 18 nt, Human
ggggcaggacuggugggg

SEQ ID NO: 487972 - RNA, 19 nt, Human
ggggcagggcggggcgggg

SEQ ID NO: 487973 - RNA, 19 nt, Human
ggggcagggcggggcgggg

SEQ ID NO: 487974 - RNA, 21 nt, Human
ggggggggggcagggcggggc

SEQ ID NO: 487975 - RNA, 21 nt, Human
gggggggggggggcagggcgg

SEQ ID NO: 487976 - RNA, 25 nt, Human
ggguaucccaguggcugcuucgacc

SEQ ID NO: 487977 - RNA, 30 nt, Human
gggugggagacaggcuguauggggguccuu

SEQ ID NO: 487978 - RNA, 19 nt, Human
gucagcaggacuucugcag

SEQ ID NO: 487979 - RNA, 24 nt, Human
uaaaaaaguaaaaaccagaacccc

SEQ ID NO: 487980 - RNA, 18 nt, Human
uaaaaaccagaacccccc

SEQ ID NO: 487981 - RNA, 21 nt, Human
uaggaaaguuucaggaacuag

SEQ ID NO: 487982 - RNA, 20 nt, Human
ucacaagccucugacgacac

SEQ ID NO: 487983 - RNA, 19 nt, Human
ucagcaggacuucugcagc

SEQ ID NO: 487984 - RNA, 19 nt, Human
ucagcaggacuucugcagc

SEQ ID NO: 487985 - RNA, 26 nt, Human
uccaugacuagguggucagcaggaaa

SEQ ID NO: 487986 - RNA, 24 nt, Human
uccaugggccgcucuccucccccc

SEQ ID NO: 487987 - RNA, 24 nt, Human
uccaugggccgcucuccuccccuc

SEQ ID NO: 487988 - RNA, 20 nt, Human
uccccagaugucugcuuccg

SEQ ID NO: 487989 - RNA, 24 nt, Human
uccccucggcgccgccgcccuccc

SEQ ID NO: 487990 - RNA, 20 nt, Human
ucccucagcccagcaggcca

SEQ ID NO: 487991 - RNA, 23 nt, Human
ucgccgccccguccgcgucgucg

SEQ ID NO: 487992 - RNA, 20 nt, Human
ucuacauuuccuuggacaac

SEQ ID NO: 487993 - RNA, 23 nt, Human
ucuccagcucccuggccccugug

SEQ ID NO: 487994 - RNA, 22 nt, Human
ucucggguugucagggguggga

SEQ ID NO: 487995 - RNA, 21 nt, Human
ugacgacacagggccacagag

SEQ ID NO: 487996 - RNA, 24 nt, Human
ugacgcuggaggccaucuccagcu

SEQ ID NO: 487997 - RNA, 19 nt, Human
uggacaagcugugucugcc

SEQ ID NO: 487998 - RNA, 21 nt, Human
uggcaggaggcagaagccgug

SEQ ID NO: 487999 - RNA, 21 nt, Human
uggcaggaggcagaagccgug

SEQ ID NO: 488000 - RNA, 22 nt, Human
uggcagggcuaggcggugcugg

SEQ ID NO: 488001 - RNA, 19 nt, Human
uggcccaagcuguggacaa

SEQ ID NO: 488002 - RNA, 24 nt, Human
uggcuaaaugaaaaaaaggccaca

SEQ ID NO: 488003 - RNA, 18 nt, Human
ugggggggggggggggca

SEQ ID NO: 488004 - RNA, 19 nt, Human
ugggguggcagggcuaggc

SEQ ID NO: 488005 - RNA, 21 nt, Human
ugggguggcagggcuaggcgg

SEQ ID NO: 488006 - RNA, 22 nt, Human
uggucagcaggacuucugcagc

SEQ ID NO: 488007 - RNA, 24 nt, Human
uggucagcaggacuucugcagcug

SEQ ID NO: 488008 - RNA, 19 nt, Human
ugguccugggccuuugucc

SEQ ID NO: 488009 - RNA, 20 nt, Human
uggugggggggggggggggc

SEQ ID NO: 488010 - RNA, 20 nt, Human
ugucaggggugggagacagg

SEQ ID NO: 488011 - RNA, 23 nt, Human
ugucaggggugggagacaggcug

SEQ ID NO: 488012 - RNA, 26 nt, Human
ugugcaauggcuaaaugaaaaaaagg

SEQ ID NO: 488013 - RNA, 18 nt, Human
ugugcaggaguguguugg

SEQ ID NO: 488014 - RNA, 22 nt, Human
uugucuucuucaucuccauauc

SEQ ID NO: 488015 - RNA, 19 nt, Human
aaguagccacaaucuaaca

SEQ ID NO: 488016 - RNA, 18 nt, Human
accagagacuugugaccc

SEQ ID NO: 488017 - RNA, 23 nt, Human
acucgccugcuggcaacucuggc

SEQ ID NO: 488018 - RNA, 20 nt, Human
agcccccugagguccaugca

SEQ ID NO: 488019 - RNA, 20 nt, Human
agcuucuggccccacagccc

SEQ ID NO: 488020 - RNA, 22 nt, Human
augggucccuuuugguaccaga

SEQ ID NO: 488021 - RNA, 20 nt, Human
caagguggggguccaaguuu

SEQ ID NO: 488022 - RNA, 20 nt, Human
caccugccucuucuccuucc

SEQ ID NO: 488023 - RNA, 25 nt, Human
cagcccccugagguccaugcagccc

SEQ ID NO: 488024 - RNA, 22 nt, Human
cagcuucuggccccacagcccc

SEQ ID NO: 488025 - RNA, 20 nt, Human
ccacaagguggggguccaag

SEQ ID NO: 488026 - RNA, 20 nt, Human
ccaugcagcccugugccagc

SEQ ID NO: 488027 - RNA, 19 nt, Human
cccacagcccccugagguc

SEQ ID NO: 488028 - RNA, 23 nt, Human
cccugcucaccugccucuucucc

SEQ ID NO: 488029 - RNA, 18 nt, Human
cgaaccucuucugcccaa

SEQ ID NO: 488030 - RNA, 22 nt, Human
cucgccugcuggcaacucuggc

SEQ ID NO: 488031 - RNA, 18 nt, Human
cucuucuccuuccugucu

SEQ ID NO: 488032 - RNA, 19 nt, Human
cuggccccacagcccccug

SEQ ID NO: 488033 - RNA, 24 nt, Human
gcccccugagguccaugcagcccu

SEQ ID NO: 488034 - RNA, 20 nt, Human
gccugcuggcaacucuggcu

SEQ ID NO: 488035 - RNA, 22 nt, Human
guagccacaaucuaacaagccc

SEQ ID NO: 488036 - RNA, 25 nt, Human
uaacaagcccugcucaccugccucu

SEQ ID NO: 488037 - RNA, 23 nt, Human
ucagucagccaugggucccuuuu

SEQ ID NO: 488038 - RNA, 23 nt, Human
uccaugcagcccugugccagcca

SEQ ID NO: 488039 - RNA, 20 nt, Human
ugacccuggacucgaaccuc

SEQ ID NO: 488040 - RNA, 20 nt, Human
ugggagggggcuccuuggug

SEQ ID NO: 488041 - RNA, 21 nt, Human
ugggucccuuuugguaccaga

SEQ ID NO: 488042 - RNA, 23 nt, Human
uuggggagcucccaguucuuccc

SEQ ID NO: 488043 - RNA, 22 nt, Human
uuuagacuucauaacaaaaaac

SEQ ID NO: 488044 - RNA, 25 nt, Human
aaaagauggcaagccauuuacaaaa

SEQ ID NO: 488045 - RNA, 25 nt, Human
aacagaaaaaaauauauauauuuca

SEQ ID NO: 488046 - RNA, 18 nt, Human
aacuugccgccuccuacu

SEQ ID NO: 488047 - RNA, 21 nt, Human
aagcaaagucaaaaaucagca

SEQ ID NO: 488048 - RNA, 19 nt, Human
aggaagacggcgaguucgg

SEQ ID NO: 488049 - RNA, 19 nt, Human
caucuuauuaacuacuuau

SEQ ID NO: 488050 - RNA, 21 nt, Human
ccuacuggaagucccgcccca

SEQ ID NO: 488051 - RNA, 23 nt, Human
gcagcuacaagcaaagucaaaaa

SEQ ID NO: 488052 - RNA, 27 nt, Human
uguauaaaaacugaugaagccaacauu

SEQ ID NO: 488053 - RNA, 19 nt, Human
uucaucuuauuaacuacuu

SEQ ID NO: 488054 - RNA, 23 nt, Human
uuuuuuuuuuuuuuuuuuaacag

SEQ ID NO: 488055 - RNA, 21 nt, Human
aaaaaaucuaaagagauaagg

SEQ ID NO: 488056 - RNA, 24 nt, Human
aaaacaaaacaaaacaaaaaaccc

SEQ ID NO: 488057 - RNA, 18 nt, Human
aaaaguucuaauguagca

SEQ ID NO: 488058 - RNA, 19 nt, Human
aaacaaaacaaaacaaaaa

SEQ ID NO: 488059 - RNA, 21 nt, Human
aagaagccuuccagaacagcc

SEQ ID NO: 488060 - RNA, 22 nt, Human
acaaaacaaaacaaaaaacccu

SEQ ID NO: 488061 - RNA, 23 nt, Human
acaaaacaaaacaaaaaacccuu

SEQ ID NO: 488062 - RNA, 26 nt, Human
acaaaagaaaacacaccuuuuugguu

SEQ ID NO: 488063 - RNA, 24 nt, Human
accuuaaaaaaaugaaacacacca

SEQ ID NO: 488064 - RNA, 23 nt, Human
acugcaaaaaacaaaacaaaaca

SEQ ID NO: 488065 - RNA, 22 nt, Human
acugcaauuguuuaggcuauaa

SEQ ID NO: 488066 - RNA, 22 nt, Human
agaaaaaauauacuuuuaagaa

SEQ ID NO: 488067 - RNA, 22 nt, Human
agacauaaauaaaauccuccau

SEQ ID NO: 488068 - RNA, 20 nt, Human
agagacacgaggggcccagg

SEQ ID NO: 488069 - RNA, 21 nt, Human
agcagcaaaggauguuuauag

SEQ ID NO: 488070 - RNA, 26 nt, Human
aggaacacugccuugagaaggcacca

SEQ ID NO: 488071 - RNA, 21 nt, Human
aggaaggagcgcccgacggcg

SEQ ID NO: 488072 - RNA, 19 nt, Human
aggcugcaggcacccccag

SEQ ID NO: 488073 - RNA, 23 nt, Human
agggagcauguggggugaggcgg

SEQ ID NO: 488074 - RNA, 26 nt, Human
caaaacaaaaaacccuuauuuaaacc

SEQ ID NO: 488075 - RNA, 23 nt, Human
caaaacaaaacaaaaaacccuua

SEQ ID NO: 488076 - RNA, 25 nt, Human
caaagagacacgaggggcccagggc

SEQ ID NO: 488077 - RNA, 19 nt, Human
caaccuagccuuaaccuuu

SEQ ID NO: 488078 - RNA, 23 nt, Human
caacuggugccugugaucuacaa

SEQ ID NO: 488079 - RNA, 18 nt, Human
caagaagccuuccagaac

SEQ ID NO: 488080 - RNA, 19 nt, Human
caccaccgaggggcuauga

SEQ ID NO: 488081 - RNA, 24 nt, Human
cacccagggcaggugcaugggcug

SEQ ID NO: 488082 - RNA, 18 nt, Human
cacccccagcucacuccc

SEQ ID NO: 488083 - RNA, 25 nt, Human
cacugcaaaaaacaaaacaaaacaa

SEQ ID NO: 488084 - RNA, 21 nt, Human
cagaaucagcagacagggcag

SEQ ID NO: 488085 - RNA, 19 nt, Human
cagcuucccgccgcugagg

SEQ ID NO: 488086 - RNA, 20 nt, Human
cagcuucccgccgcugagga

SEQ ID NO: 488087 - RNA, 19 nt, Human
caggcacccccagcucacu

SEQ ID NO: 488088 - RNA, 19 nt, Human
caggcguuucucauccagc

SEQ ID NO: 488089 - RNA, 18 nt, Human
ccaccgccgcugccgcca

SEQ ID NO: 488090 - RNA, 25 nt, Human
ccagcgccaccgccgcugccgccag

SEQ ID NO: 488091 - RNA, 20 nt, Human
ccccacugguaaugggcugu

SEQ ID NO: 488092 - RNA, 21 nt, Human
cccccagcucacucccugccu

SEQ ID NO: 488093 - RNA, 23 nt, Human
cccgccggguccucugcucagcc

SEQ ID NO: 488094 - RNA, 24 nt, Human
ccgccagcuucccgccgcugagga

SEQ ID NO: 488095 - RNA, 27 nt, Human
ccgccgcugccgccagcuucccgccgc

SEQ ID NO: 488096 - RNA, 21 nt, Human
ccgcugccgccagcuucccgc

SEQ ID NO: 488097 - RNA, 22 nt, Human
ccgcugccgccagcuucccgcc

SEQ ID NO: 488098 - RNA, 25 nt, Human
ccuagccuuaaccuuuuguuucagc

SEQ ID NO: 488099 - RNA, 21 nt, Human
ccuccacaggggggaggugag

SEQ ID NO: 488100 - RNA, 21 nt, Human
ccuccgugggagccagugcuc

SEQ ID NO: 488101 - RNA, 22 nt, Human
ccugcggcagcacccaugacac

SEQ ID NO: 488102 - RNA, 19 nt, Human
cggcagcacccaugacacu

SEQ ID NO: 488103 - RNA, 19 nt, Human
cggcgcggggcggggcgag

SEQ ID NO: 488104 - RNA, 19 nt, Human
cggcuccugauuuucaccc

SEQ ID NO: 488105 - RNA, 26 nt, Human
cuccugauuuucacccaggucucacu

SEQ ID NO: 488106 - RNA, 20 nt, Human
cugugugcggcuccugauuu

SEQ ID NO: 488107 - RNA, 18 nt, Human
gaaggcaccaccgagggg

SEQ ID NO: 488108 - RNA, 18 nt, Human
gaggucccugaagaccaa

SEQ ID NO: 488109 - RNA, 21 nt, Human
gauucagauuucuuucauucu

SEQ ID NO: 488110 - RNA, 22 nt, Human
gcaccagucuaacagagcagcg

SEQ ID NO: 488111 - RNA, 20 nt, Human
gcagcaaggcugggccgcug

SEQ ID NO: 488112 - RNA, 22 nt, Human
ggacauaaugaagaaguaucac

SEQ ID NO: 488113 - RNA, 21 nt, Human
ggcagcacccaugacacuaca

SEQ ID NO: 488114 - RNA, 23 nt, Human
ggcggcugugagcacucagggcu

SEQ ID NO: 488115 - RNA, 23 nt, Human
guagcagcaaaggauguuuauag

SEQ ID NO: 488116 - RNA, 20 nt, Human
uaaaaaaaugaaacacacca

SEQ ID NO: 488117 - RNA, 20 nt, Human
uaaaaaaaugaaacacacca

SEQ ID NO: 488118 - RNA, 22 nt, Human
uaaaauccuccauaauuuacuc

SEQ ID NO: 488119 - RNA, 21 nt, Human
uaagacaaaauacugcccaaa

SEQ ID NO: 488120 - RNA, 19 nt, Human
uaauaaagugagguuuaca

SEQ ID NO: 488121 - RNA, 18 nt, Human
uaaugggcuguucuggga

SEQ ID NO: 488122 - RNA, 19 nt, Human
uaggaagauguggcugugu

SEQ ID NO: 488123 - RNA, 21 nt, Human
uauaaaaguucuaauguagca

SEQ ID NO: 488124 - RNA, 22 nt, Human
uauagaaaaaauauacuuuuaa

SEQ ID NO: 488125 - RNA, 19 nt, Human
ucacugcaaaaaacaaaac

SEQ ID NO: 488126 - RNA, 20 nt, Human
ucccugaagaccaacuggug

SEQ ID NO: 488127 - RNA, 20 nt, Human
ucucacugcagcgcaggaca

SEQ ID NO: 488128 - RNA, 22 nt, Human
ugaaaaaaucuaaagagauaag

SEQ ID NO: 488129 - RNA, 19 nt, Human
ugaaacacaccaacugcaa

SEQ ID NO: 488130 - RNA, 22 nt, Human
ugacacuacagaucaagggguu

SEQ ID NO: 488131 - RNA, 21 nt, Human
ugagaaacagggagcaugugg

SEQ ID NO: 488132 - RNA, 19 nt, Human
ugagugggacgggccuagg

SEQ ID NO: 488133 - RNA, 24 nt, Human
ugcaaaaaacaaaacaaaacaaaa

SEQ ID NO: 488134 - RNA, 19 nt, Human
ugcccaaaacauguaaaac

SEQ ID NO: 488135 - RNA, 24 nt, Human
ugcucacugcaaaaaacaaaacaa

SEQ ID NO: 488136 - RNA, 21 nt, Human
uggaaggcugcaggcaccccc

SEQ ID NO: 488137 - RNA, 24 nt, Human
uguagugaugcucacugcaaaaaa

SEQ ID NO: 488138 - RNA, 20 nt, Human
uguggggugaggcggggcag

SEQ ID NO: 488139 - RNA, 26 nt, Human
uguggggugaggcggggcaggagugg

SEQ ID NO: 488140 - RNA, 24 nt, Human
uucaccuaucuaaagguaaaagga

SEQ ID NO: 488141 - RNA, 23 nt, Human
uucuagacuucaaccuagccuua

SEQ ID NO: 488142 - RNA, 24 nt, Human
uuuguuucagcaccagucuaacag

SEQ ID NO: 488143 - RNA, 25 nt, Human
uuuuguuucagcaccagucuaacag

SEQ ID NO: 488144 - RNA, 24 nt, Human
uuuuuuuuuuuuuuguuugcugga

SEQ ID NO: 488145 - RNA, 20 nt, Human
uuuuuuuuuuuuuuuuuugg

SEQ ID NO: 488146 - RNA, 22 nt, Human
uuuuuuuuuuuuuuuuuuguuu

SEQ ID NO: 488147 - RNA, 23 nt, Human
aaaaagcagacaaguuagaacaa

SEQ ID NO: 488148 - RNA, 19 nt, Human
aaaagaaauucagaaacua

SEQ ID NO: 488149 - RNA, 18 nt, Human
aaaagcagacaaguuaga

SEQ ID NO: 488150 - RNA, 20 nt, Human
aaacaggcugaucaucaagg

SEQ ID NO: 488151 - RNA, 22 nt, Human
aaacugcuaaaaguuacaucuu

SEQ ID NO: 488152 - RNA, 20 nt, Human
aaauuggacauacaaacacu

SEQ ID NO: 488153 - RNA, 19 nt, Human
aacugcaggagggcaaagu

SEQ ID NO: 488154 - RNA, 19 nt, Human
aacuuguaacauaagcgca

SEQ ID NO: 488155 - RNA, 18 nt, Human
aagcagacaaguuagaac

SEQ ID NO: 488156 - RNA, 21 nt, Human
aagcauuacagaucaaaagcu

SEQ ID NO: 488157 - RNA, 23 nt, Human
aaguagaaggcaggcagcaaauu

SEQ ID NO: 488158 - RNA, 22 nt, Human
aaguuuccauacaaaauugucc

SEQ ID NO: 488159 - RNA, 21 nt, Human
acagcaaugguuuacauaugc

SEQ ID NO: 488160 - RNA, 20 nt, Human
acuacaauuauacuaaaguu

SEQ ID NO: 488161 - RNA, 21 nt, Human
agaaacugcaggagggcaaag

SEQ ID NO: 488162 - RNA, 19 nt, Human
agaaauuaggagaaauuaa

SEQ ID NO: 488163 - RNA, 22 nt, Human
agagaagaaacugcaggagggc

SEQ ID NO: 488164 - RNA, 21 nt, Human
agcaggaggagcagcagcagc

SEQ ID NO: 488165 - RNA, 23 nt, Human
agcgguuggagaggagcauugga

SEQ ID NO: 488166 - RNA, 18 nt, Human
aggcacuuaucauuguua

SEQ ID NO: 488167 - RNA, 21 nt, Human
caagaaacugcaaagaaccac

SEQ ID NO: 488168 - RNA, 19 nt, Human
caaguaaauuggacauaca

SEQ ID NO: 488169 - RNA, 19 nt, Human
caaguuagaacaaacauuu

SEQ ID NO: 488170 - RNA, 23 nt, Human
caaguuuccauacaaaauugucc

SEQ ID NO: 488171 - RNA, 19 nt, Human
cacaggaaaccugcccaga

SEQ ID NO: 488172 - RNA, 21 nt, Human
cagacaaguuagaacaaacau

SEQ ID NO: 488173 - RNA, 26 nt, Human
cagaucaaaagcuguauuuacacuua

SEQ ID NO: 488174 - RNA, 24 nt, Human
caggaggagcagcagcagcgcggc

SEQ ID NO: 488175 - RNA, 21 nt, Human
caucaaucugcaauaauuacc

SEQ ID NO: 488176 - RNA, 21 nt, Human
ccagaaacacaugucugcuaa

SEQ ID NO: 488177 - RNA, 19 nt, Human
ccgggcccggaggggcggg

SEQ ID NO: 488178 - RNA, 25 nt, Human
cggggagagcggagcagccgcgcgg

SEQ ID NO: 488179 - RNA, 20 nt, Human
cucauaaucuccagauagcu

SEQ ID NO: 488180 - RNA, 19 nt, Human
cuccagauagcucuuccau

SEQ ID NO: 488181 - RNA, 23 nt, Human
cugggcgcgccgacccgggcccg

SEQ ID NO: 488182 - RNA, 25 nt, Human
gaacugaaauaaacuuugcaaacua

SEQ ID NO: 488183 - RNA, 19 nt, Human
gacccgggcccggaggggc

SEQ ID NO: 488184 - RNA, 18 nt, Human
gagcagcagcagcgcggc

SEQ ID NO: 488185 - RNA, 21 nt, Human
gauuugagaaguagaaggcag

SEQ ID NO: 488186 - RNA, 21 nt, Human
gcccagaucggcgcuuggagc

SEQ ID NO: 488187 - RNA, 25 nt, Human
ggaaauagagggggaugccgguacc

SEQ ID NO: 488188 - RNA, 19 nt, Human
ggaugcuaugagauggggg

SEQ ID NO: 488189 - RNA, 19 nt, Human
ggcucuucucugaaauuca

SEQ ID NO: 488190 - RNA, 20 nt, Human
gggaugcuaugagauggggg

SEQ ID NO: 488191 - RNA, 22 nt, Human
ggggguugggagcagagaagaa

SEQ ID NO: 488192 - RNA, 23 nt, Human
gguugggagcagagaagaaacug

SEQ ID NO: 488193 - RNA, 22 nt, Human
guugggagcagagaagaaacug

SEQ ID NO: 488194 - RNA, 24 nt, Human
uaaaaaagcagacaaguuagaaca

SEQ ID NO: 488195 - RNA, 20 nt, Human
uaaauuggacauacaaacac

SEQ ID NO: 488196 - RNA, 23 nt, Human
uaacauaagcgcaauacauggga

SEQ ID NO: 488197 - RNA, 18 nt, Human
uaacucagguuucaguga

SEQ ID NO: 488198 - RNA, 18 nt, Human
uacauugcccaccaaccu

SEQ ID NO: 488199 - RNA, 21 nt, Human
uauaaauuuacaagaaacugc

SEQ ID NO: 488200 - RNA, 19 nt, Human
uauuacauugcccaccaac

SEQ ID NO: 488201 - RNA, 22 nt, Human
uccauacaaaauuguccaagaa

SEQ ID NO: 488202 - RNA, 20 nt, Human
ugaaaauucaaaucagcuua

SEQ ID NO: 488203 - RNA, 20 nt, Human
ugaaacaggcugaucaucaa

SEQ ID NO: 488204 - RNA, 23 nt, Human
ugaaauaaacuuugcaaacuaca

SEQ ID NO: 488205 - RNA, 23 nt, Human
ugaaugcuaaaucauacucguuu

SEQ ID NO: 488206 - RNA, 23 nt, Human
ugacaacaacuuguaacauaagc

SEQ ID NO: 488207 - RNA, 19 nt, Human
ugagagacaucaaucugca

SEQ ID NO: 488208 - RNA, 23 nt, Human
ugagggcuauuucaacaccaagu

SEQ ID NO: 488209 - RNA, 18 nt, Human
ugcaaagaggagggggaa

SEQ ID NO: 488210 - RNA, 21 nt, Human
ugcccagaucggcgcuuggag

SEQ ID NO: 488211 - RNA, 19 nt, Human
ugcuuucauaaaacuguaa

SEQ ID NO: 488212 - RNA, 19 nt, Human
uggaaauagagggggaugc

SEQ ID NO: 488213 - RNA, 22 nt, Human
uggagcggggagagcggagcag

SEQ ID NO: 488214 - RNA, 19 nt, Human
uggcaggcugggcgcgccg

SEQ ID NO: 488215 - RNA, 24 nt, Human
uguauaaaagcauuacagaucaaa

SEQ ID NO: 488216 - RNA, 19 nt, Human
uuaagucucaacugugaca

SEQ ID NO: 488217 - RNA, 21 nt, Human
uuacaugugaacugaaauaaa

SEQ ID NO: 488218 - RNA, 21 nt, Human
uuccaccucuaccaaauaccu

SEQ ID NO: 488219 - RNA, 24 nt, Human
uugcaauaccuuacaugugaacug

SEQ ID NO: 488220 - RNA, 19 nt, Human
uuucaacaccaaguaaaua

SEQ ID NO: 488221 - RNA, 25 nt, Human
uuuccaagugcuuagguuuuaugag

SEQ ID NO: 488222 - RNA, 19 nt, Human
uuuccauacaaaauugucc

SEQ ID NO: 488223 - RNA, 22 nt, Human
aacgccgcccagccgcgggggu

SEQ ID NO: 488224 - RNA, 21 nt, Human
aaggggguccgcgggggaaac

SEQ ID NO: 488225 - RNA, 24 nt, Human
aaucccgcaccucugggcuccaaa

SEQ ID NO: 488226 - RNA, 19 nt, Human
acccggcuggagggggagg

SEQ ID NO: 488227 - RNA, 23 nt, Human
acgggcccgcggcccugaacgcc

SEQ ID NO: 488228 - RNA, 23 nt, Human
agaaucccgcaccucugggcucc

SEQ ID NO: 488229 - RNA, 18 nt, Human
agcuggucucuguacagc

SEQ ID NO: 488230 - RNA, 22 nt, Human
aggaggaggaauggaagagucc

SEQ ID NO: 488231 - RNA, 18 nt, Human
agggggagggggcgcggc

SEQ ID NO: 488232 - RNA, 18 nt, Human
aggugcccuuggacgggu

SEQ ID NO: 488233 - RNA, 19 nt, Human
cacccggacgggcccgcgg

SEQ ID NO: 488234 - RNA, 25 nt, Human
caccucugggcuccaaagcugcacc

SEQ ID NO: 488235 - RNA, 20 nt, Human
cagaaaggaugcggguuggg

SEQ ID NO: 488236 - RNA, 21 nt, Human
cagaaucccgcaccucugggc

SEQ ID NO: 488237 - RNA, 24 nt, Human
cagauccugccaggacuaggggcc

SEQ ID NO: 488238 - RNA, 18 nt, Human
cagcaccuggacagcucc

SEQ ID NO: 488239 - RNA, 23 nt, Human
cagcauucucccccaggccagga

SEQ ID NO: 488240 - RNA, 22 nt, Human
cagccgccaagggaggguuggg

SEQ ID NO: 488241 - RNA, 21 nt, Human
cagccgcgccccgacggcagg

SEQ ID NO: 488242 - RNA, 20 nt, Human
cagccgcggggguacccggc

SEQ ID NO: 488243 - RNA, 22 nt, Human
cagccuucuuuccucuuaacuc

SEQ ID NO: 488244 - RNA, 21 nt, Human
cagcgcggccgccgggauguc

SEQ ID NO: 488245 - RNA, 25 nt, Human
ccacccccaucucccauucuaaccc

SEQ ID NO: 488246 - RNA, 21 nt, Human
ccacuugacacauaugaaccc

SEQ ID NO: 488247 - RNA, 23 nt, Human
ccagaggcucugccauucacugg

SEQ ID NO: 488248 - RNA, 19 nt, Human
ccccgacggggcacccgga

SEQ ID NO: 488249 - RNA, 22 nt, Human
ccccggggugcccgcccgcgcc

SEQ ID NO: 488250 - RNA, 22 nt, Human
ccccuagaggaggaggaaugga

SEQ ID NO: 488251 - RNA, 21 nt, Human
cccgcgcccccgucgccgcgu

SEQ ID NO: 488252 - RNA, 19 nt, Human
ccgacucugcaacgccacc

SEQ ID NO: 488253 - RNA, 22 nt, Human
ccgccgggaugucgcccccgac

SEQ ID NO: 488254 - RNA, 19 nt, Human
ccgcgcccccgucgccgcg

SEQ ID NO: 488255 - RNA, 21 nt, Human
ccgcgccccgacggcagggcg

SEQ ID NO: 488256 - RNA, 18 nt, Human
ccggcagauccugccagg

SEQ ID NO: 488257 - RNA, 18 nt, Human
ccuagcaaguccccccuc

SEQ ID NO: 488258 - RNA, 21 nt, Human
ccuccguccagccgccaaggg

SEQ ID NO: 488259 - RNA, 22 nt, Human
ccucugggcuccaaagcugcac

SEQ ID NO: 488260 - RNA, 19 nt, Human
ccuggacagcuccagaguc

SEQ ID NO: 488261 - RNA, 20 nt, Human
ccuggggccccggcgugugc

SEQ ID NO: 488262 - RNA, 21 nt, Human
cgacucugcaacgccaccccc

SEQ ID NO: 488263 - RNA, 18 nt, Human
cgcaccucugggcuccaa

SEQ ID NO: 488264 - RNA, 25 nt, Human
cgccgcccagccgcggggguacccg

SEQ ID NO: 488265 - RNA, 18 nt, Human
cgcgugcggaucaccagg

SEQ ID NO: 488266 - RNA, 21 nt, Human
cggggcuggggcccaggagca

SEQ ID NO: 488267 - RNA, 22 nt, Human
cuagcaaguccccccuccgucc

SEQ ID NO: 488268 - RNA, 22 nt, Human
cuccagcauucucccccaggcc

SEQ ID NO: 488269 - RNA, 21 nt, Human
gaacccuuuuuagccucacaa

SEQ ID NO: 488270 - RNA, 21 nt, Human
gacccgccccuucccgacucu

SEQ ID NO: 488271 - RNA, 22 nt, Human
gacccgccccuucccgacucug

SEQ ID NO: 488272 - RNA, 19 nt, Human
gacucugcaacgccacccc

SEQ ID NO: 488273 - RNA, 24 nt, Human
gagcuggucucuguacagcguccc

SEQ ID NO: 488274 - RNA, 20 nt, Human
gccuucuuuccucuuaacuc

SEQ ID NO: 488275 - RNA, 21 nt, Human
gcgggugagcagccgcgcccc

SEQ ID NO: 488276 - RNA, 23 nt, Human
ggagcauggacgagaggcaccag

SEQ ID NO: 488277 - RNA, 24 nt, Human
ggcaggaaaggggguccgcggggg

SEQ ID NO: 488278 - RNA, 18 nt, Human
ggccuucccuuuccauca

SEQ ID NO: 488279 - RNA, 18 nt, Human
ggcgugugcugggcgggu

SEQ ID NO: 488280 - RNA, 18 nt, Human
gggcaucucagcggcgug

SEQ ID NO: 488281 - RNA, 20 nt, Human
gggcccaggagcauggacga

SEQ ID NO: 488282 - RNA, 18 nt, Human
ggggcuggggcccaggag

SEQ ID NO: 488283 - RNA, 24 nt, Human
ggugggggcaucucagcggcgugg

SEQ ID NO: 488284 - RNA, 26 nt, Human
guuguccuggggccccggcgugugcu

SEQ ID NO: 488285 - RNA, 20 nt, Human
uaagugaacagccuucuuuc

SEQ ID NO: 488286 - RNA, 24 nt, Human
uagcauuuauugaacaccuacuau

SEQ ID NO: 488287 - RNA, 31 nt, Human
uagccucacaacucuucgagguagguucugg

SEQ ID NO: 488288 - RNA, 18 nt, Human
uaggggccuucccuuucc

SEQ ID NO: 488289 - RNA, 19 nt, Human
ucccuccagcauucucccc

SEQ ID NO: 488290 - RNA, 30 nt, Human
uccuggggccccggcgugugcugggcgggg

SEQ ID NO: 488291 - RNA, 22 nt, Human
ucucagcggcgugcucccucca

SEQ ID NO: 488292 - RNA, 20 nt, Human
ucucccccaggccaggauug

SEQ ID NO: 488293 - RNA, 21 nt, Human
ucugggguccuuuccccuucu

SEQ ID NO: 488294 - RNA, 20 nt, Human
ugaacgccgcccagccgcgg

SEQ ID NO: 488295 - RNA, 19 nt, Human
ugaagugacuugcccgagg

SEQ ID NO: 488296 - RNA, 24 nt, Human
ugaggaaacugaggaccagagaag

SEQ ID NO: 488297 - RNA, 20 nt, Human
ugaugggggaaaccuggggu

SEQ ID NO: 488298 - RNA, 22 nt, Human
ugcccgcccgcgcccccgucgc

SEQ ID NO: 488299 - RNA, 24 nt, Human
ugcucccuccagcauucuccccca

SEQ ID NO: 488300 - RNA, 21 nt, Human
uggaagaguccgcuccuagca

SEQ ID NO: 488301 - RNA, 22 nt, Human
ugggcuccaaagcugcaccccu

SEQ ID NO: 488302 - RNA, 22 nt, Human
uggggccccggcgugugcuggg

SEQ ID NO: 488303 - RNA, 21 nt, Human
ugggggaaaccuggggugggg

SEQ ID NO: 488304 - RNA, 25 nt, Human
ugggggaaaccuggggugggggcaa

SEQ ID NO: 488305 - RNA, 20 nt, Human
ugggggagggcaggaaaggg

SEQ ID NO: 488306 - RNA, 20 nt, Human
uggucagaaucccgcaccuc

SEQ ID NO: 488307 - RNA, 19 nt, Human
ugugcugggcgggugagca

SEQ ID NO: 488308 - RNA, 21 nt, Human
uuaguaagugaacagccuucu

SEQ ID NO: 488309 - RNA, 20 nt, Human
uucucugacgacugagcugg

SEQ ID NO: 488310 - RNA, 18 nt, Human
uugcccgaggccaggcag

SEQ ID NO: 488311 - RNA, 21 nt, Human
uugggggagggcaggaaaggg

SEQ ID NO: 488312 - RNA, 23 nt, Human
uuuaauaguaacaaaggcuagca

SEQ ID NO: 488313 - RNA, 23 nt, Human
uuuuuuuuuuuuuuuuuuaauag

SEQ ID NO: 488314 - RNA, 22 nt, Human
aaaaaaacaaaaagccagucac

SEQ ID NO: 488315 - RNA, 22 nt, Human
aaacccaggcccggacagagga

SEQ ID NO: 488316 - RNA, 19 nt, Human
aaggagaggaaucacagug

SEQ ID NO: 488317 - RNA, 27 nt, Human
acaaaaagccagucacagggacccaga

SEQ ID NO: 488318 - RNA, 19 nt, Human
acaacagaaaaaaacaaaa

SEQ ID NO: 488319 - RNA, 24 nt, Human
agaaggaagggagaugugggcagg

SEQ ID NO: 488320 - RNA, 24 nt, Human
agagacaaagauuccuggagagag

SEQ ID NO: 488321 - RNA, 18 nt, Human
agagacacacacaccgac

SEQ ID NO: 488322 - RNA, 18 nt, Human
agccagucacagggaccc

SEQ ID NO: 488323 - RNA, 23 nt, Human
agcuggaggccaguggagccagg

SEQ ID NO: 488324 - RNA, 20 nt, Human
aggaagacgcagggagacua

SEQ ID NO: 488325 - RNA, 21 nt, Human
aggaagggagaugugggcagg

SEQ ID NO: 488326 - RNA, 22 nt, Human
aggaagggagaugugggcagga

SEQ ID NO: 488327 - RNA, 20 nt, Human
aggaggagggaggugagagc

SEQ ID NO: 488328 - RNA, 22 nt, Human
aggccuggggccccugggcugc

SEQ ID NO: 488329 - RNA, 23 nt, Human
agggccagggccagggcaggaaa

SEQ ID NO: 488330 - RNA, 25 nt, Human
agucacagggacccagagagaagga

SEQ ID NO: 488331 - RNA, 23 nt, Human
auggacaacagaaaaaaacaaaa

SEQ ID NO: 488332 - RNA, 23 nt, Human
caacagaaaaaaacaaaaagcca

SEQ ID NO: 488333 - RNA, 23 nt, Human
caagacaaugcccagggcuggga

SEQ ID NO: 488334 - RNA, 20 nt, Human
cacaacauccccugcaggag

SEQ ID NO: 488335 - RNA, 21 nt, Human
cagacacagagcauguguaug

SEQ ID NO: 488336 - RNA, 20 nt, Human
cagcuggaggccaguggagc

SEQ ID NO: 488337 - RNA, 18 nt, Human
caggagacagacacagag

SEQ ID NO: 488338 - RNA, 25 nt, Human
cccagccgccucccccuuuccuuuc

SEQ ID NO: 488339 - RNA, 20 nt, Human
cccaggggaagcugacagcu

SEQ ID NO: 488340 - RNA, 19 nt, Human
ccccccccccgcggugggc

SEQ ID NO: 488341 - RNA, 18 nt, Human
ccccuuccucccucuuuc

SEQ ID NO: 488342 - RNA, 26 nt, Human
cccgccuggaccccguggggcucacu

SEQ ID NO: 488343 - RNA, 23 nt, Human
cccggacagaggagcgugucaca

SEQ ID NO: 488344 - RNA, 19 nt, Human
cccugggaggcaggcuggu

SEQ ID NO: 488345 - RNA, 18 nt, Human
cccuuccucccucuuucc

SEQ ID NO: 488346 - RNA, 18 nt, Human
ccgcugccccccccccgc

SEQ ID NO: 488347 - RNA, 22 nt, Human
ccucccucuuuccccuucccca

SEQ ID NO: 488348 - RNA, 23 nt, Human
ccucccucuuuccccuuccccag

SEQ ID NO: 488349 - RNA, 19 nt, Human
ccuggaccccguggggcuc

SEQ ID NO: 488350 - RNA, 25 nt, Human
ccugggaggcaggcugguucccucu

SEQ ID NO: 488351 - RNA, 22 nt, Human
cgcagggccagggccagggcag

SEQ ID NO: 488352 - RNA, 21 nt, Human
cgccuggaccccguggggcuc

SEQ ID NO: 488353 - RNA, 20 nt, Human
cuccccuuccucccucuuuc

SEQ ID NO: 488354 - RNA, 22 nt, Human
cugguucccucucucagcugga

SEQ ID NO: 488355 - RNA, 24 nt, Human
cuuccucccucuuuccccuucccc

SEQ ID NO: 488356 - RNA, 21 nt, Human
gacagggaggaggccuggggc

SEQ ID NO: 488357 - RNA, 23 nt, Human
gaggagggaggugagagcgaggg

SEQ ID NO: 488358 - RNA, 19 nt, Human
gaggccaguggagccagga

SEQ ID NO: 488359 - RNA, 20 nt, Human
gauggacaacagaaaaaaac

SEQ ID NO: 488360 - RNA, 19 nt, Human
gccccggggaagcaaggag

SEQ ID NO: 488361 - RNA, 18 nt, Human
gcccugggaggcaggcug

SEQ ID NO: 488362 - RNA, 20 nt, Human
gccugugcccgcugcccccc

SEQ ID NO: 488363 - RNA, 22 nt, Human
ggaaacccaggcccggacagag

SEQ ID NO: 488364 - RNA, 21 nt, Human
ggaagcaaggagggacacaag

SEQ ID NO: 488365 - RNA, 19 nt, Human
ggaggagggaggugagagc

SEQ ID NO: 488366 - RNA, 18 nt, Human
ggcacaacauccccugca

SEQ ID NO: 488367 - RNA, 18 nt, Human
ggcaggaaacccaggccc

SEQ ID NO: 488368 - RNA, 19 nt, Human
ggcaggaaacccaggcccg

SEQ ID NO: 488369 - RNA, 18 nt, Human
gggcagcaguggcuggaa

SEQ ID NO: 488370 - RNA, 21 nt, Human
gggcaggagacagacacagag

SEQ ID NO: 488371 - RNA, 23 nt, Human
gggcugggaugcccaggggaagc

SEQ ID NO: 488372 - RNA, 25 nt, Human
uagagauggaggccccuccccuucc

SEQ ID NO: 488373 - RNA, 18 nt, Human
uaugaaauuagagaugga

SEQ ID NO: 488374 - RNA, 22 nt, Human
uauuaugaaauuagagauggag

SEQ ID NO: 488375 - RNA, 26 nt, Human
ucagaacugcagagacaaaacgccac

SEQ ID NO: 488376 - RNA, 19 nt, Human
ucagcuggaggccagugga

SEQ ID NO: 488377 - RNA, 20 nt, Human
uccccagccgccucccccuu

SEQ ID NO: 488378 - RNA, 20 nt, Human
uccccugcaggagggugggc

SEQ ID NO: 488379 - RNA, 23 nt, Human
uccccuuccccagccgccucccc

SEQ ID NO: 488380 - RNA, 18 nt, Human
ucccucucucagcuggag

SEQ ID NO: 488381 - RNA, 23 nt, Human
ucucagcuggaggccaguggagc

SEQ ID NO: 488382 - RNA, 19 nt, Human
ucucucagcuggaggccag

SEQ ID NO: 488383 - RNA, 19 nt, Human
ugagagaucgcagggccag

SEQ ID NO: 488384 - RNA, 21 nt, Human
ugcccugggaggcaggcuggu

SEQ ID NO: 488385 - RNA, 21 nt, Human
uggaaguuucucuugauuuug

SEQ ID NO: 488386 - RNA, 24 nt, Human
uggacaacagaaaaaaacaaaaag

SEQ ID NO: 488387 - RNA, 18 nt, Human
uggcuggaaguuucucuu

SEQ ID NO: 488388 - RNA, 24 nt, Human
ugugagcuucagaacugcagagac

SEQ ID NO: 488389 - RNA, 23 nt, Human
uuccccagccgccucccccuuuc

SEQ ID NO: 488390 - RNA, 20 nt, Human
uucucuugauuuugggaugg

SEQ ID NO: 488391 - RNA, 21 nt, Human
uugauuuugggauggacaaca

SEQ ID NO: 488392 - RNA, 22 nt, Human
aaaauacuuuuauccugaauua

SEQ ID NO: 488393 - RNA, 22 nt, Human
aaauggaagcagaaucauaauc

SEQ ID NO: 488394 - RNA, 22 nt, Human
aaccagguaggaaaaggccaga

SEQ ID NO: 488395 - RNA, 24 nt, Human
aacuuacucauucaaaggcuccua

SEQ ID NO: 488396 - RNA, 22 nt, Human
aagcgucccauucagacauucc

SEQ ID NO: 488397 - RNA, 23 nt, Human
aaugaaagaggcaaguauaagga

SEQ ID NO: 488398 - RNA, 22 nt, Human
accugcuguucccaaguggcug

SEQ ID NO: 488399 - RNA, 24 nt, Human
accugcuguucccaaguggcuggg

SEQ ID NO: 488400 - RNA, 23 nt, Human
acucuauaccauuauauguugcc

SEQ ID NO: 488401 - RNA, 22 nt, Human
agaacagaggacacagcagcug

SEQ ID NO: 488402 - RNA, 23 nt, Human
agaggacacagcagcugggaagg

SEQ ID NO: 488403 - RNA, 25 nt, Human
aggaaaaggccagaucuccuuaaaa

SEQ ID NO: 488404 - RNA, 20 nt, Human
aggaucuuguucuguucaug

SEQ ID NO: 488405 - RNA, 19 nt, Human
aggcugccaguggaagcua

SEQ ID NO: 488406 - RNA, 21 nt, Human
aggguggggggaaagagggau

SEQ ID NO: 488407 - RNA, 20 nt, Human
auaaagcuuucagcauaauc

SEQ ID NO: 488408 - RNA, 18 nt, Human
caguagaugcuacauaac

SEQ ID NO: 488409 - RNA, 18 nt, Human
caugaacuggcaaggcca

SEQ ID NO: 488410 - RNA, 26 nt, Human
cauucaagcgucccauucagacauuc

SEQ ID NO: 488411 - RNA, 20 nt, Human
ccaaagcagaggaagacuga

SEQ ID NO: 488412 - RNA, 18 nt, Human
cccaaagcagaggaagac

SEQ ID NO: 488413 - RNA, 18 nt, Human
ccucugagucaugcuagg

SEQ ID NO: 488414 - RNA, 23 nt, Human
ccugcuguucccaaguggcuggg

SEQ ID NO: 488415 - RNA, 23 nt, Human
cucggaaguagaagguagaacag

SEQ ID NO: 488416 - RNA, 22 nt, Human
gaaaaugcccuagacuguccuc

SEQ ID NO: 488417 - RNA, 18 nt, Human
gggaaaagaagagcaaag

SEQ ID NO: 488418 - RNA, 21 nt, Human
guaccaauacaaagaaaugaa

SEQ ID NO: 488419 - RNA, 18 nt, Human
uaaaguuuuaaaaugaga

SEQ ID NO: 488420 - RNA, 18 nt, Human
uaagaauaacacaauuaa

SEQ ID NO: 488421 - RNA, 20 nt, Human
uaagaauaacacaauuaaau

SEQ ID NO: 488422 - RNA, 21 nt, Human
uaauaguguguccucauccua

SEQ ID NO: 488423 - RNA, 21 nt, Human
uaccaauacaaagaaaugaaa

SEQ ID NO: 488424 - RNA, 22 nt, Human
uacucagacuagaaaacugacu

SEQ ID NO: 488425 - RNA, 24 nt, Human
uauuauaugucaauuauuuaaaau

SEQ ID NO: 488426 - RNA, 23 nt, Human
ucaaaaagaaggagaaaguuuua

SEQ ID NO: 488427 - RNA, 18 nt, Human
ucaauucuccaaaauaga

SEQ ID NO: 488428 - RNA, 19 nt, Human
uccaaaauagacuuuuuuu

SEQ ID NO: 488429 - RNA, 18 nt, Human
ucccaaagcagaggaaga

SEQ ID NO: 488430 - RNA, 27 nt, Human
ucccaaguggcuggguaaucuaugggu

SEQ ID NO: 488431 - RNA, 20 nt, Human
ucccuuccaugaauuauuuc

SEQ ID NO: 488432 - RNA, 20 nt, Human
ucuguucauguauaacucag

SEQ ID NO: 488433 - RNA, 23 nt, Human
ugaaagaggcaaguauaaggagg

SEQ ID NO: 488434 - RNA, 25 nt, Human
ugaacagggaccaauacuguaauga

SEQ ID NO: 488435 - RNA, 19 nt, Human
ugagguaaccagguaggaa

SEQ ID NO: 488436 - RNA, 18 nt, Human
ugcccuagacuguccucu

SEQ ID NO: 488437 - RNA, 21 nt, Human
uggcuguagacuuuuagauau

SEQ ID NO: 488438 - RNA, 21 nt, Human
uguucuguucauguauaacuc

SEQ ID NO: 488439 - RNA, 18 nt, Human
uuaaaguguccaaauagc

SEQ ID NO: 488440 - RNA, 24 nt, Human
uuaacaauaauacauaguuuuaga

SEQ ID NO: 488441 - RNA, 20 nt, Human
uuaaucaauaauacuaucug

SEQ ID NO: 488442 - RNA, 20 nt, Human
uuauaaagcuuucagcauaa

SEQ ID NO: 488443 - RNA, 21 nt, Human
uucuacacauucaagcguccc

SEQ ID NO: 488444 - RNA, 22 nt, Human
uugaaacaugacuauguacccc

SEQ ID NO: 488445 - RNA, 22 nt, Human
uuuuucuucuuuuucagcuucc

SEQ ID NO: 488446 - RNA, 23 nt, Human
aaaaggcacaaaaagccuuuuac

SEQ ID NO: 488447 - RNA, 24 nt, Human
acuaguuuauuucauaaaaauaca

SEQ ID NO: 488448 - RNA, 18 nt, Human
agccuuuuacuuauuuuu

SEQ ID NO: 488449 - RNA, 20 nt, Human
aggcaaagagggugaacugg

SEQ ID NO: 488450 - RNA, 18 nt, Human
ccguuguugcuucugucu

SEQ ID NO: 488451 - RNA, 22 nt, Human
ccuuccgagauuguuaggcaaa

SEQ ID NO: 488452 - RNA, 31 nt, Human
cuaguuuauuucauaaaaauacaaaaauauu

SEQ ID NO: 488453 - RNA, 19 nt, Human
gaaaaggcacaaaaagccu

SEQ ID NO: 488454 - RNA, 24 nt, Human
uaaauuauuauaccuaagaaaagg

SEQ ID NO: 488455 - RNA, 20 nt, Human
uaacauagacaguacuuccc

SEQ ID NO: 488456 - RNA, 22 nt, Human
uauggcaguaauagucauuccu

SEQ ID NO: 488457 - RNA, 24 nt, Human
uauggcaguaauagucauuccuau

SEQ ID NO: 488458 - RNA, 23 nt, Human
uauucauucacaaagacuuacug

SEQ ID NO: 488459 - RNA, 23 nt, Human
ucaauuuuugaaagauuuccucc

SEQ ID NO: 488460 - RNA, 22 nt, Human
ucugcaacuucaguggguuguc

SEQ ID NO: 488461 - RNA, 22 nt, Human
ugaaugaauuaacacaaagaca

SEQ ID NO: 488462 - RNA, 19 nt, Human
ugaauuaacacaaagacau

SEQ ID NO: 488463 - RNA, 20 nt, Human
ugaauuaacacaaagacauu

SEQ ID NO: 488464 - RNA, 20 nt, Human
ugaugugauauauuuuccuu

SEQ ID NO: 488465 - RNA, 18 nt, Human
ugucucgguccuucucuu

SEQ ID NO: 488466 - RNA, 20 nt, Human
ugugauauauuuuccuuccg

SEQ ID NO: 488467 - RNA, 19 nt, Human
uuaaaaaucuguaucauuc

SEQ ID NO: 488468 - RNA, 18 nt, Human
uuccguuguugcuucugu

SEQ ID NO: 488469 - RNA, 22 nt, Human
uuguuuguaacuucaauuuuug

SEQ ID NO: 488470 - RNA, 18 nt, Human
aaagcacccagacggacg

SEQ ID NO: 488471 - RNA, 21 nt, Human
aacccaggcccugagccaaga

SEQ ID NO: 488472 - RNA, 24 nt, Human
aagcgucccuagcaucucggaccc

SEQ ID NO: 488473 - RNA, 20 nt, Human
accaccucccucacucaagc

SEQ ID NO: 488474 - RNA, 21 nt, Human
accccaggagcaccgccugga

SEQ ID NO: 488475 - RNA, 23 nt, Human
acccccaucccagcagguagaac

SEQ ID NO: 488476 - RNA, 20 nt, Human
accccgccgccccaaccugg

SEQ ID NO: 488477 - RNA, 23 nt, Human
acggacguccuucccuaagcucc

SEQ ID NO: 488478 - RNA, 23 nt, Human
agagaagagaacaagaaaagucu

SEQ ID NO: 488479 - RNA, 19 nt, Human
agccaggacccggggcucc

SEQ ID NO: 488480 - RNA, 22 nt, Human
aggagggccucucugugagguc

SEQ ID NO: 488481 - RNA, 19 nt, Human
aggcaggacagaggagccg

SEQ ID NO: 488482 - RNA, 21 nt, Human
caagcgucccuagcaucucuu

SEQ ID NO: 488483 - RNA, 18 nt, Human
caccaaagagaggcugac

SEQ ID NO: 488484 - RNA, 23 nt, Human
caccaaagagaggcugaccccca

SEQ ID NO: 488485 - RNA, 18 nt, Human
caccacaugagcaugggu

SEQ ID NO: 488486 - RNA, 22 nt, Human
caccaccucccucacucaagga

SEQ ID NO: 488487 - RNA, 21 nt, Human
caccaccugcgcccuggaccc

SEQ ID NO: 488488 - RNA, 24 nt, Human
caccaccugcgcccuggaccccgc

SEQ ID NO: 488489 - RNA, 22 nt, Human
caccccaggagcaccgccugga

SEQ ID NO: 488490 - RNA, 18 nt, Human
caggugggcagccaggac

SEQ ID NO: 488491 - RNA, 22 nt, Human
ccaccugcgcccuggaccccgc

SEQ ID NO: 488492 - RNA, 24 nt, Human
ccccagaugcugaagcccgcagcc

SEQ ID NO: 488493 - RNA, 18 nt, Human
ccccgccgccccaaccug

SEQ ID NO: 488494 - RNA, 23 nt, Human
cccgcaggcgcuccgggccucca

SEQ ID NO: 488495 - RNA, 22 nt, Human
cccgccgccccaaccuggcccc

SEQ ID NO: 488496 - RNA, 19 nt, Human
cccuaagcucccucaaccc

SEQ ID NO: 488497 - RNA, 26 nt, Human
cccuaagcucccucaacccaggcccu

SEQ ID NO: 488498 - RNA, 23 nt, Human
ccgccccaaccuggccccagaug

SEQ ID NO: 488499 - RNA, 18 nt, Human
ccgccgccccaaccuggc

SEQ ID NO: 488500 - RNA, 23 nt, Human
ccgccgccccaaccuggccccag

SEQ ID NO: 488501 - RNA, 21 nt, Human
ccggccccgaggugcgcggga

SEQ ID NO: 488502 - RNA, 23 nt, Human
ccggcccggcgcaucggccgcac

SEQ ID NO: 488503 - RNA, 23 nt, Human
ccuacccgcaaccucccucgccu

SEQ ID NO: 488504 - RNA, 21 nt, Human
ccucaacccaggcccugagcc

SEQ ID NO: 488505 - RNA, 19 nt, Human
ccuccuagcaggggguggg

SEQ ID NO: 488506 - RNA, 21 nt, Human
ccuggaccccgccgccccaac

SEQ ID NO: 488507 - RNA, 23 nt, Human
ccuggccccagaugcugaagccc

SEQ ID NO: 488508 - RNA, 24 nt, Human
ccuuccuacccgcaaccucccucg

SEQ ID NO: 488509 - RNA, 20 nt, Human
cgcaggcgcuccgggccucc

SEQ ID NO: 488510 - RNA, 20 nt, Human
cgccgcugcuccagcugcgc

SEQ ID NO: 488511 - RNA, 24 nt, Human
cgcggccucagccuccggcccggc

SEQ ID NO: 488512 - RNA, 18 nt, Human
cgcgggacgcagggggcg

SEQ ID NO: 488513 - RNA, 23 nt, Human
cgcguauccucccugauuugagg

SEQ ID NO: 488514 - RNA, 20 nt, Human
cgggccuccagcugcggucg

SEQ ID NO: 488515 - RNA, 26 nt, Human
cucaacccaggcccugagccgguucc

SEQ ID NO: 488516 - RNA, 23 nt, Human
cugcgcguggcuuccgggaaccu

SEQ ID NO: 488517 - RNA, 20 nt, Human
gagcaccgccuggauggagg

SEQ ID NO: 488518 - RNA, 20 nt, Human
gagcauggguggcaggaggg

SEQ ID NO: 488519 - RNA, 18 nt, Human
gcccuuccuacccgcaac

SEQ ID NO: 488520 - RNA, 20 nt, Human
gcgcgcgcaguccgcccuuc

SEQ ID NO: 488521 - RNA, 23 nt, Human
gcuucuucccuccugggcauggu

SEQ ID NO: 488522 - RNA, 18 nt, Human
ggaaggcuguggauggcu

SEQ ID NO: 488523 - RNA, 23 nt, Human
ggaaggcuguggauggcuucuuc

SEQ ID NO: 488524 - RNA, 18 nt, Human
ggacccggggcuccagcg

SEQ ID NO: 488525 - RNA, 24 nt, Human
ggagaagccagccagcaaacugga

SEQ ID NO: 488526 - RNA, 23 nt, Human
ggagcaccgccuggauggagggg

SEQ ID NO: 488527 - RNA, 21 nt, Human
ggauggcuucuucccuccugg

SEQ ID NO: 488528 - RNA, 18 nt, Human
ggcaggugggcagccagg

SEQ ID NO: 488529 - RNA, 24 nt, Human
ggcuucuucccuccugggcauggu

SEQ ID NO: 488530 - RNA, 19 nt, Human
gggagcauggaccggcccc

SEQ ID NO: 488531 - RNA, 18 nt, Human
gggagcuguguggcacag

SEQ ID NO: 488532 - RNA, 18 nt, Human
gguagacggagaagccag

SEQ ID NO: 488533 - RNA, 21 nt, Human
ggugggcagccaggacccggg

SEQ ID NO: 488534 - RNA, 21 nt, Human
guccuucccuaagcucccuca

SEQ ID NO: 488535 - RNA, 21 nt, Human
uaagcagcuacuauaugccaa

SEQ ID NO: 488536 - RNA, 21 nt, Human
uagaacaacacaugaggaagg

SEQ ID NO: 488537 - RNA, 20 nt, Human
ucagccuccggcccggcgca

SEQ ID NO: 488538 - RNA, 20 nt, Human
ucagccuccggcccggcgca

SEQ ID NO: 488539 - RNA, 26 nt, Human
ucccagccccgcagcgcggccucagc

SEQ ID NO: 488540 - RNA, 21 nt, Human
ucccggcaccccaggagcacc

SEQ ID NO: 488541 - RNA, 18 nt, Human
ucccuaagcucccucaac

SEQ ID NO: 488542 - RNA, 23 nt, Human
ucccucacucaagcgucccuagc

SEQ ID NO: 488543 - RNA, 19 nt, Human
ugaaaggaaaccaagucaa

SEQ ID NO: 488544 - RNA, 25 nt, Human
ugaaaggaaaccaagucaaauagug

SEQ ID NO: 488545 - RNA, 23 nt, Human
ugacgucaccaaagagaggcuga

SEQ ID NO: 488546 - RNA, 22 nt, Human
ugagcaggcagggugugacacu

SEQ ID NO: 488547 - RNA, 18 nt, Human
ugccagccccgcaggcgc

SEQ ID NO: 488548 - RNA, 25 nt, Human
ugcccggucccggcaccccaggagc

SEQ ID NO: 488549 - RNA, 25 nt, Human
ugcgcgggacgcagggggcgcgcgc

SEQ ID NO: 488550 - RNA, 18 nt, Human
ugcugaagcccgcagccg

SEQ ID NO: 488551 - RNA, 21 nt, Human
uggaggaaaagcacccagacg

SEQ ID NO: 488552 - RNA, 21 nt, Human
uggcaggagggccucucugug

SEQ ID NO: 488553 - RNA, 19 nt, Human
uggcuuccgggaaccuccu

SEQ ID NO: 488554 - RNA, 20 nt, Human
ugggaccuccuagcaggggg

SEQ ID NO: 488555 - RNA, 21 nt, Human
ugggcagccaggacccggggc

SEQ ID NO: 488556 - RNA, 25 nt, Human
uguggauggcuucuucccuucaaag

SEQ ID NO: 488557 - RNA, 26 nt, Human
uguggauggcuucuucccuucaaagg

SEQ ID NO: 488558 - RNA, 22 nt, Human
uguggguagacggagaagccag

SEQ ID NO: 488559 - RNA, 22 nt, Human
uugcucuggcugggggcggagg

SEQ ID NO: 488560 - RNA, 20 nt, Human
accgagcccgcgaaaauucu

SEQ ID NO: 488561 - RNA, 22 nt, Human
cccccugcgcccagccugccgg

SEQ ID NO: 488562 - RNA, 23 nt, Human
cccccugcgcccagccugccggc

SEQ ID NO: 488563 - RNA, 21 nt, Human
ccccugcgcccagccugccgg

SEQ ID NO: 488564 - RNA, 21 nt, Human
cccugcgcccagccugccggc

SEQ ID NO: 488565 - RNA, 20 nt, Human
ccgggcgggggcucgccccc

SEQ ID NO: 488566 - RNA, 21 nt, Human
ccgggcgggggcucgcccccu

SEQ ID NO: 488567 - RNA, 20 nt, Human
cgagcccgcgaaaauucuga

SEQ ID NO: 488568 - RNA, 21 nt, Human
cugcgcgccgggcgggggcuc

SEQ ID NO: 488569 - RNA, 19 nt, Human
ucaccgagcccgcgaaaau

SEQ ID NO: 488570 - RNA, 20 nt, Human
ugcugcugcgcgccgggcgg

SEQ ID NO: 488571 - RNA, 21 nt, Human
uguacacaaaacugauuuaau

SEQ ID NO: 488572 - RNA, 19 nt, Human
aaacagcccacagucuccc

SEQ ID NO: 488573 - RNA, 21 nt, Human
aagcuguucacauagcagcuu

SEQ ID NO: 488574 - RNA, 22 nt, Human
acauaaaguugcuucgccccuu

SEQ ID NO: 488575 - RNA, 19 nt, Human
caaugucuccccuuccugu

SEQ ID NO: 488576 - RNA, 19 nt, Human
cacauccucagcgacagcc

SEQ ID NO: 488577 - RNA, 18 nt, Human
caccccagagaccucugc

SEQ ID NO: 488578 - RNA, 26 nt, Human
cagcaacagugcccggggucccgcag

SEQ ID NO: 488579 - RNA, 22 nt, Human
cagcgacagccaagacacagag

SEQ ID NO: 488580 - RNA, 18 nt, Human
cagcuuaucuccaccuuc

SEQ ID NO: 488581 - RNA, 24 nt, Human
cccacagucucccgcagcagcaac

SEQ ID NO: 488582 - RNA, 18 nt, Human
ccccagagaccucugcac

SEQ ID NO: 488583 - RNA, 23 nt, Human
ccccagagaccucugcacuugga

SEQ ID NO: 488584 - RNA, 22 nt, Human
ccucaguggcaggcaaugucuc

SEQ ID NO: 488585 - RNA, 24 nt, Human
ccugcacauccucagcgacagcca

SEQ ID NO: 488586 - RNA, 22 nt, Human
cgccccuugcagcuuaucucca

SEQ ID NO: 488587 - RNA, 23 nt, Human
gcagcagcaacagugcccggggu

SEQ ID NO: 488588 - RNA, 21 nt, Human
gccaagacacagaggccaaug

SEQ ID NO: 488589 - RNA, 24 nt, Human
gccaaugguccccaccccagagac

SEQ ID NO: 488590 - RNA, 19 nt, Human
ggaggauugcccaagucag

SEQ ID NO: 488591 - RNA, 18 nt, Human
ggcaagucggauccccuc

SEQ ID NO: 488592 - RNA, 19 nt, Human
uagcagcuuuaaagagaca

SEQ ID NO: 488593 - RNA, 22 nt, Human
ucaguggcaggcaaugucuccc

SEQ ID NO: 488594 - RNA, 24 nt, Human
ucaguggcaggcaaugucuccccu

SEQ ID NO: 488595 - RNA, 22 nt, Human
ucccgcagcagcaacagugccc

SEQ ID NO: 488596 - RNA, 21 nt, Human
ugacauaaaguugcuucgccc

SEQ ID NO: 488597 - RNA, 18 nt, Human
ugcccugcacauccucag

SEQ ID NO: 488598 - RNA, 24 nt, Human
ugcuucgccccuugcagcuuaucu

SEQ ID NO: 488599 - RNA, 18 nt, Human
uguucacauagcagcuuu

SEQ ID NO: 488600 - RNA, 26 nt, Human
aaccccucuaauccaacccucaucgg

SEQ ID NO: 488601 - RNA, 21 nt, Human
aagaucaccaucaggugccgc

SEQ ID NO: 488602 - RNA, 18 nt, Human
aaggccccaaaacaacag

SEQ ID NO: 488603 - RNA, 18 nt, Human
acaugacacaccaagcac

SEQ ID NO: 488604 - RNA, 22 nt, Human
accaccuacaaaugggcaacau

SEQ ID NO: 488605 - RNA, 22 nt, Human
acucugccauuucaggcugcag

SEQ ID NO: 488606 - RNA, 19 nt, Human
agcaccagacucugccauu

SEQ ID NO: 488607 - RNA, 21 nt, Human
aggcugcagugccuucugucc

SEQ ID NO: 488608 - RNA, 22 nt, Human
auccacaugacacaccaagcac

SEQ ID NO: 488609 - RNA, 18 nt, Human
caccacagcuucuuguag

SEQ ID NO: 488610 - RNA, 22 nt, Human
cacgugcugaugguccuccauc

SEQ ID NO: 488611 - RNA, 19 nt, Human
cacucccgcuaaccaagag

SEQ ID NO: 488612 - RNA, 19 nt, Human
cagcacacucccgcuaacc

SEQ ID NO: 488613 - RNA, 20 nt, Human
cagcacuccacucagggaaa

SEQ ID NO: 488614 - RNA, 25 nt, Human
cagcuucccagccccacuuguuccc

SEQ ID NO: 488615 - RNA, 21 nt, Human
caucuucaucccaaaagcgga

SEQ ID NO: 488616 - RNA, 26 nt, Human
ccaacccaaacacaguuaguccugua

SEQ ID NO: 488617 - RNA, 21 nt, Human
ccacaugacacaccaagcaca

SEQ ID NO: 488618 - RNA, 19 nt, Human
ccaucuuuccuccacuucc

SEQ ID NO: 488619 - RNA, 18 nt, Human
ccccagcacuccacucag

SEQ ID NO: 488620 - RNA, 20 nt, Human
cccgcuaaccaagaggugag

SEQ ID NO: 488621 - RNA, 23 nt, Human
ccuacaaaugggcaacaucuaca

SEQ ID NO: 488622 - RNA, 23 nt, Human
ccuggaccuccuccuucccccag

SEQ ID NO: 488623 - RNA, 21 nt, Human
ccuggauggcagcauugaucu

SEQ ID NO: 488624 - RNA, 19 nt, Human
ccuuguguagaaugggggu

SEQ ID NO: 488625 - RNA, 23 nt, Human
cuauacuaacuagaaggagaauc

SEQ ID NO: 488626 - RNA, 19 nt, Human
cuccacucagggaaaauca

SEQ ID NO: 488627 - RNA, 22 nt, Human
cucccaggaaaacccgugccuc

SEQ ID NO: 488628 - RNA, 21 nt, Human
cugaugguccuccaucuuucc

SEQ ID NO: 488629 - RNA, 24 nt, Human
cugcagugccuucuguccaccagc

SEQ ID NO: 488630 - RNA, 20 nt, Human
cugugccuccuauaagccug

SEQ ID NO: 488631 - RNA, 23 nt, Human
gaaaggccccaaaacaacagccc

SEQ ID NO: 488632 - RNA, 22 nt, Human
gaccuccuccuucccccagcac

SEQ ID NO: 488633 - RNA, 22 nt, Human
gaugcaagagagaauccacaug

SEQ ID NO: 488634 - RNA, 29 nt, Human
gccaaucaccacagcuucuuguagagaac

SEQ ID NO: 488635 - RNA, 19 nt, Human
ggauggcagcauugaucuu

SEQ ID NO: 488636 - RNA, 22 nt, Human
gggaaaaucaauuccaucaaaa

SEQ ID NO: 488637 - RNA, 20 nt, Human
gggggugggggugggggcag

SEQ ID NO: 488638 - RNA, 18 nt, Human
ggggugcggggguggggg

SEQ ID NO: 488639 - RNA, 18 nt, Human
gggugggggugggggcaa

SEQ ID NO: 488640 - RNA, 24 nt, Human
gggugggggugggggcagcacacu

SEQ ID NO: 488641 - RNA, 23 nt, Human
gugccuccuauaagccugguauc

SEQ ID NO: 488642 - RNA, 19 nt, Human
uagaaggagaaucuguggu

SEQ ID NO: 488643 - RNA, 23 nt, Human
uaggacccagacagcagcugggc

SEQ ID NO: 488644 - RNA, 18 nt, Human
uaucaucuucaucccaaa

SEQ ID NO: 488645 - RNA, 18 nt, Human
uaucaugaagaugcaaga

SEQ ID NO: 488646 - RNA, 21 nt, Human
ucaucccaaaagcggagaaga

SEQ ID NO: 488647 - RNA, 19 nt, Human
uccacaugacacaccaagc

SEQ ID NO: 488648 - RNA, 23 nt, Human
uccacaugacacaccaagcacaa

SEQ ID NO: 488649 - RNA, 22 nt, Human
ucccagcuguggagccuaagac

SEQ ID NO: 488650 - RNA, 21 nt, Human
ucggccaaaaauauucuucgu

SEQ ID NO: 488651 - RNA, 21 nt, Human
ucucagaacucugagaguggg

SEQ ID NO: 488652 - RNA, 22 nt, Human
ucuccugccaauccuucauccg

SEQ ID NO: 488653 - RNA, 20 nt, Human
ucugccauuucaggcugcag

SEQ ID NO: 488654 - RNA, 23 nt, Human
ucuguccaccagccaaucgagca

SEQ ID NO: 488655 - RNA, 24 nt, Human
ugccgcuuccuuccuguggcuuuc

SEQ ID NO: 488656 - RNA, 24 nt, Human
ugccuugaaaggccccaaaacaac

SEQ ID NO: 488657 - RNA, 22 nt, Human
ugccuuugagaagguccaggau

SEQ ID NO: 488658 - RNA, 21 nt, Human
ugcgggggugggggugggggc

SEQ ID NO: 488659 - RNA, 18 nt, Human
ugggcaacaucuacacuc

SEQ ID NO: 488660 - RNA, 22 nt, Human
ugggcaacaucuacacuccagu

SEQ ID NO: 488661 - RNA, 22 nt, Human
ugggggugcgggggugggggug

SEQ ID NO: 488662 - RNA, 22 nt, Human
ugggggugggggcagcacacuc

SEQ ID NO: 488663 - RNA, 24 nt, Human
ugugguggugaagagcacgaaguc

SEQ ID NO: 488664 - RNA, 22 nt, Human
uguguagaaugggggugcgggg

SEQ ID NO: 488665 - RNA, 27 nt, Human
uuaccaccuacaaaugggcaacaucua

SEQ ID NO: 488666 - RNA, 20 nt, Human
uuccagucagccuggucuuu

SEQ ID NO: 488667 - RNA, 23 nt, Human
uuccagucagccuggucuuuugc

SEQ ID NO: 488668 - RNA, 19 nt, Human
uucccccagcacuccacuc

SEQ ID NO: 488669 - RNA, 19 nt, Human
uuccuccacuuccgcuuca

SEQ ID NO: 488670 - RNA, 20 nt, Human
uucguggaggccucugugcc

SEQ ID NO: 488671 - RNA, 23 nt, Human
uuuccaucuuccagucagccugg

SEQ ID NO: 488672 - RNA, 20 nt, Human
uuucgccugguagaccacag

SEQ ID NO: 488673 - RNA, 18 nt, Human
uuuuuuuuuuuuuuuuug

SEQ ID NO: 488674 - RNA, 25 nt, Human
uuuuuuuuuuuuuuuuuuuguuuuu

SEQ ID NO: 488675 - RNA, 23 nt, Human
gauuccuuuuuuaaaaucaucuc

SEQ ID NO: 488676 - RNA, 18 nt, Human
uucaaagcaucuauugaa

SEQ ID NO: 488677 - RNA, 20 nt, Human
acuuggaaacaaauuugagg

SEQ ID NO: 488678 - RNA, 19 nt, Human
aggcagggaggcagguggg

SEQ ID NO: 488679 - RNA, 21 nt, Human
aggcagggaggcaggugggcc

SEQ ID NO: 488680 - RNA, 23 nt, Human
agggaggcaggugggccucgguc

SEQ ID NO: 488681 - RNA, 24 nt, Human
agggaggcaggugggccucggucc

SEQ ID NO: 488682 - RNA, 23 nt, Human
aucauccaguucagaaccaaaau

SEQ ID NO: 488683 - RNA, 19 nt, Human
cacggcaggcaccaacacc

SEQ ID NO: 488684 - RNA, 23 nt, Human
cagaaugcguucacggcaggcac

SEQ ID NO: 488685 - RNA, 19 nt, Human
cagggcgaagcaggcaggg

SEQ ID NO: 488686 - RNA, 24 nt, Human
cauagaaagacccaaagguuuuca

SEQ ID NO: 488687 - RNA, 18 nt, Human
ccaaagguuuucaacuug

SEQ ID NO: 488688 - RNA, 23 nt, Human
ccagcgcuguugugauuucuucu

SEQ ID NO: 488689 - RNA, 20 nt, Human
ccucacucuguccccaacca

SEQ ID NO: 488690 - RNA, 21 nt, Human
gaggaccacgggccgcaugcu

SEQ ID NO: 488691 - RNA, 20 nt, Human
gcaacgaccucacucugucc

SEQ ID NO: 488692 - RNA, 20 nt, Human
uccagggcgaagcaggcagg

SEQ ID NO: 488693 - RNA, 23 nt, Human
ugccuagcaaacuagcaauucca

SEQ ID NO: 488694 - RNA, 20 nt, Human
ugggccucgguccgccgcaa

SEQ ID NO: 488695 - RNA, 27 nt, Human
uuuuuuuuuguuuuuuuuuuuuuuuuu

SEQ ID NO: 488696 - RNA, 18 nt, Human
uuuuuuuuuuuuuucuug

SEQ ID NO: 488697 - RNA, 20 nt, Human
uuuuuuuuuuuuuucuugcu

SEQ ID NO: 488698 - RNA, 18 nt, Human
uuuuuuuuuuuuuuuuug

SEQ ID NO: 488699 - RNA, 24 nt, Human
uuuuuuuuuuuuuuuuuucuugcu

SEQ ID NO: 488700 - RNA, 25 nt, Human
uuuuuuuuuuuuuuuuuuguuuuuu

SEQ ID NO: 488701 - RNA, 27 nt, Human
uuuuuuuuuuuuuuuuuuuuuuucuuu

SEQ ID NO: 488702 - RNA, 21 nt, Human
aauuucaauauauuuucuuca

SEQ ID NO: 488703 - RNA, 18 nt, Human
gaaauaccauuauacagg

SEQ ID NO: 488704 - RNA, 19 nt, Human
uagguuucuucucuguuac

SEQ ID NO: 488705 - RNA, 21 nt, Human
uagguuucuucucuguuacag

SEQ ID NO: 488706 - RNA, 24 nt, Human
agaaaacauuuaaggcauaaauaa

SEQ ID NO: 488707 - RNA, 21 nt, Human
aggaaggaauggggaagaaaa

SEQ ID NO: 488708 - RNA, 20 nt, Human
cgagggggaggaaggaaugg

SEQ ID NO: 488709 - RNA, 18 nt, Human
cuucacacaguucgcucc

SEQ ID NO: 488710 - RNA, 22 nt, Human
gggaagaaaacauuuaaggcau

SEQ ID NO: 488711 - RNA, 18 nt, Human
uacuaugcaaaacaaggu

SEQ ID NO: 488712 - RNA, 23 nt, Human
uaugacauuacuacuacaaaaaa

SEQ ID NO: 488713 - RNA, 19 nt, Human
ucacacaguucgcucccag

SEQ ID NO: 488714 - RNA, 18 nt, Human
uccuaccgagggggagga

SEQ ID NO: 488715 - RNA, 22 nt, Human
uggaacaugacugguuguuugc

SEQ ID NO: 488716 - RNA, 22 nt, Human
ugugcaguuaccggcuugaagu

SEQ ID NO: 488717 - RNA, 19 nt, Human
uucacacaguucgcuccca

SEQ ID NO: 488718 - RNA, 19 nt, Human
aaagugcugggguuacagg

SEQ ID NO: 488719 - RNA, 24 nt, Human
aaagugcugggguuacaggcguga

SEQ ID NO: 488720 - RNA, 19 nt, Human
aaggacagaggugcccaca

SEQ ID NO: 488721 - RNA, 19 nt, Human
aagugcugggguuacaggc

SEQ ID NO: 488722 - RNA, 26 nt, Human
aagugcugggguuacaggcgugagcc

SEQ ID NO: 488723 - RNA, 22 nt, Human
acaggugcccaccaccacaccc

SEQ ID NO: 488724 - RNA, 23 nt, Human
acaggugcccaccaccacacccg

SEQ ID NO: 488725 - RNA, 24 nt, Human
accucgugaucugcccaccuuggc

SEQ ID NO: 488726 - RNA, 18 nt, Human
acugcaagcugugccucc

SEQ ID NO: 488727 - RNA, 22 nt, Human
agacccucgggcugugcagccu

SEQ ID NO: 488728 - RNA, 24 nt, Human
agcaaggacagaggugcccacaga

SEQ ID NO: 488729 - RNA, 19 nt, Human
agccaccacacccacccca

SEQ ID NO: 488730 - RNA, 20 nt, Human
aggugugggcagaggccagu

SEQ ID NO: 488731 - RNA, 22 nt, Human
augaaggcccugugaugacaug

SEQ ID NO: 488732 - RNA, 18 nt, Human
augggguuucaccauguu

SEQ ID NO: 488733 - RNA, 20 nt, Human
augggguuucaccauguucg

SEQ ID NO: 488734 - RNA, 24 nt, Human
augggguuucaccauguucgccag

SEQ ID NO: 488735 - RNA, 18 nt, Human
auguucgccaggaugguc

SEQ ID NO: 488736 - RNA, 24 nt, Human
caaagugcugggguuacaggcgug

SEQ ID NO: 488737 - RNA, 22 nt, Human
caauucaggaucaccucuccag

SEQ ID NO: 488738 - RNA, 22 nt, Human
cacaccauucuccugccucagc

SEQ ID NO: 488739 - RNA, 20 nt, Human
cacagagcccccuucacccc

SEQ ID NO: 488740 - RNA, 25 nt, Human
cacaucugccucuggcccucagggg

SEQ ID NO: 488741 - RNA, 18 nt, Human
caccauguucgccaggau

SEQ ID NO: 488742 - RNA, 24 nt, Human
caccauguucgccaggauggucuc

SEQ ID NO: 488743 - RNA, 24 nt, Human
cacccaggcuggagugcgugcagu

SEQ ID NO: 488744 - RNA, 27 nt, Human
cacccccagccacacucccgauggccc

SEQ ID NO: 488745 - RNA, 20 nt, Human
cacccccagccacacucccu

SEQ ID NO: 488746 - RNA, 19 nt, Human
cacuacccaaccccauauu

SEQ ID NO: 488747 - RNA, 20 nt, Human
cacuacccaaccccauauug

SEQ ID NO: 488748 - RNA, 23 nt, Human
cacugcaagcugugccuccuggg

SEQ ID NO: 488749 - RNA, 19 nt, Human
cagagcccccuucaccccc

SEQ ID NO: 488750 - RNA, 21 nt, Human
cagcagcaaggacagaggugc

SEQ ID NO: 488751 - RNA, 19 nt, Human
cagccagagacccucgggc

SEQ ID NO: 488752 - RNA, 21 nt, Human
cagggauguccuacuuguccu

SEQ ID NO: 488753 - RNA, 22 nt, Human
caggggcgcuggggaaaggaag

SEQ ID NO: 488754 - RNA, 21 nt, Human
caggugcccaccaccacaccc

SEQ ID NO: 488755 - RNA, 24 nt, Human
caggugcccaccaccacacccggc

SEQ ID NO: 488756 - RNA, 21 nt, Human
caugaaggggcccaccgcccg

SEQ ID NO: 488757 - RNA, 22 nt, Human
ccaaagugcugggguuacaggc

SEQ ID NO: 488758 - RNA, 22 nt, Human
ccaaagugcugggguuacaggc

SEQ ID NO: 488759 - RNA, 24 nt, Human
ccaaagugcugggguuacaggcgu

SEQ ID NO: 488760 - RNA, 21 nt, Human
ccacacccaccccagucuuuc

SEQ ID NO: 488761 - RNA, 18 nt, Human
ccacaucugccucuggcc

SEQ ID NO: 488762 - RNA, 18 nt, Human
ccaccacacccaccccag

SEQ ID NO: 488763 - RNA, 27 nt, Human
ccacccacacuacccaaccccauauug

SEQ ID NO: 488764 - RNA, 19 nt, Human
ccagucccuucuggaggcu

SEQ ID NO: 488765 - RNA, 19 nt, Human
ccagucuuucuuaaugaca

SEQ ID NO: 488766 - RNA, 23 nt, Human
cccacaucugccucuggcccuca

SEQ ID NO: 488767 - RNA, 19 nt, Human
cccaggccagcgagcuucu

SEQ ID NO: 488768 - RNA, 23 nt, Human
ccccaugaaggggcccaccgccc

SEQ ID NO: 488769 - RNA, 23 nt, Human
cccgcagccagagacccucgggc

SEQ ID NO: 488770 - RNA, 21 nt, Human
ccugcagcccacaucugccuc

SEQ ID NO: 488771 - RNA, 21 nt, Human
ccugccacccacacuacccaa

SEQ ID NO: 488772 - RNA, 21 nt, Human
cgugcaguggugcgaucuucg

SEQ ID NO: 488773 - RNA, 23 nt, Human
cuaauuuuuuguauuuuuaguag

SEQ ID NO: 488774 - RNA, 25 nt, Human
cuacccaaccccauauugccacaga

SEQ ID NO: 488775 - RNA, 24 nt, Human
cucacugcaagcugugccuccugg

SEQ ID NO: 488776 - RNA, 24 nt, Human
cucagccucccuaguagcugggac

SEQ ID NO: 488777 - RNA, 21 nt, Human
cuccuggguucacaccauucu

SEQ ID NO: 488778 - RNA, 24 nt, Human
cucgcucugucacccaggcuggag

SEQ ID NO: 488779 - RNA, 22 nt, Human
cucuggcccugucaugaaggcc

SEQ ID NO: 488780 - RNA, 20 nt, Human
cucugucacccaggcuggag

SEQ ID NO: 488781 - RNA, 22 nt, Human
cucuugaccucgugaucugccc

SEQ ID NO: 488782 - RNA, 21 nt, Human
cugaagcccacgucuguccac

SEQ ID NO: 488783 - RNA, 23 nt, Human
cugccucagccucccuaguagcu

SEQ ID NO: 488784 - RNA, 19 nt, Human
cuggcuggcucuggcccug

SEQ ID NO: 488785 - RNA, 21 nt, Human
gaccucgugaucugcccaccu

SEQ ID NO: 488786 - RNA, 24 nt, Human
gaccucgugaucugcccaccuugg

SEQ ID NO: 488787 - RNA, 18 nt, Human
gagaugggguuucaccau

SEQ ID NO: 488788 - RNA, 24 nt, Human
gagaugggguuucaccauguucgc

SEQ ID NO: 488789 - RNA, 21 nt, Human
gaucuggcuucccuuccccac

SEQ ID NO: 488790 - RNA, 22 nt, Human
gccacagagcccccuucacccc

SEQ ID NO: 488791 - RNA, 18 nt, Human
gcccgcagccagagaccc

SEQ ID NO: 488792 - RNA, 21 nt, Human
gcucugucacccaggcuggag

SEQ ID NO: 488793 - RNA, 24 nt, Human
ggggcccaccgcccgcagccagag

SEQ ID NO: 488794 - RNA, 22 nt, Human
gggguuucaccauguucgccag

SEQ ID NO: 488795 - RNA, 20 nt, Human
ggugagccccaugaaggggc

SEQ ID NO: 488796 - RNA, 18 nt, Human
gguuacaggcgugagcca

SEQ ID NO: 488797 - RNA, 22 nt, Human
gguuacaggcgugagccaccac

SEQ ID NO: 488798 - RNA, 24 nt, Human
gguuucaccauguucgccaggaug

SEQ ID NO: 488799 - RNA, 23 nt, Human
guagagaugggguuucaccaugu

SEQ ID NO: 488800 - RNA, 18 nt, Human
gugcaguggugcgaucuu

SEQ ID NO: 488801 - RNA, 19 nt, Human
uaaugugaauccaccaggu

SEQ ID NO: 488802 - RNA, 24 nt, Human
uaauuuuuuguauuuuuaguagag

SEQ ID NO: 488803 - RNA, 25 nt, Human
uaauuuuuuguauuuuuaguagaga

SEQ ID NO: 488804 - RNA, 24 nt, Human
uacaggcgugagccaccacaccca

SEQ ID NO: 488805 - RNA, 19 nt, Human
uacuuguccugcccagcuu

SEQ ID NO: 488806 - RNA, 22 nt, Human
uagagaugggguuucaccaugu

SEQ ID NO: 488807 - RNA, 24 nt, Human
uaguagagaugggguuucaccaug

SEQ ID NO: 488808 - RNA, 26 nt, Human
uaguagagaugggguuucaccauguu

SEQ ID NO: 488809 - RNA, 23 nt, Human
uaguagcugggacgacaggugcc

SEQ ID NO: 488810 - RNA, 18 nt, Human
ucaaggugugggcagagg

SEQ ID NO: 488811 - RNA, 21 nt, Human
ucacaccauucuccugccuca

SEQ ID NO: 488812 - RNA, 18 nt, Human
ucacccaggcuggagugc

SEQ ID NO: 488813 - RNA, 24 nt, Human
ucacugcaagcugugccuccuggg

SEQ ID NO: 488814 - RNA, 24 nt, Human
ucccaaagugcugggguuacaggc

SEQ ID NO: 488815 - RNA, 24 nt, Human
uccuggguucacaccauucuccug

SEQ ID NO: 488816 - RNA, 24 nt, Human
ucgcucugucacccaggcuggagu

SEQ ID NO: 488817 - RNA, 25 nt, Human
ucuccugccucagccucccuaguag

SEQ ID NO: 488818 - RNA, 19 nt, Human
ucucgcucugucacccagg

SEQ ID NO: 488819 - RNA, 22 nt, Human
ucucgcucugucacccaggcug

SEQ ID NO: 488820 - RNA, 23 nt, Human
ucucgcucugucacccaggcugg

SEQ ID NO: 488821 - RNA, 24 nt, Human
ucucgcucugucacccaggcugga

SEQ ID NO: 488822 - RNA, 20 nt, Human
ucugaagcccacgucugucc

SEQ ID NO: 488823 - RNA, 23 nt, Human
ucuggcccugucaugaaggcccu

SEQ ID NO: 488824 - RNA, 23 nt, Human
ucugucacccaggcuggagugcg

SEQ ID NO: 488825 - RNA, 22 nt, Human
ugaccucgugaucugcccaccu

SEQ ID NO: 488826 - RNA, 22 nt, Human
ugagacggagucucgcucuguc

SEQ ID NO: 488827 - RNA, 24 nt, Human
ugaucugcccaccuuggccuccca

SEQ ID NO: 488828 - RNA, 18 nt, Human
ugccacagagcccccuuc

SEQ ID NO: 488829 - RNA, 20 nt, Human
ugccacagagcccccuucac

SEQ ID NO: 488830 - RNA, 21 nt, Human
ugcccaccaccacacccggcu

SEQ ID NO: 488831 - RNA, 24 nt, Human
ugccucagccucccuaguagcugg

SEQ ID NO: 488832 - RNA, 19 nt, Human
ugccuccuggguucacacc

SEQ ID NO: 488833 - RNA, 18 nt, Human
ugggguuacaggcgugag

SEQ ID NO: 488834 - RNA, 19 nt, Human
ugggguuacaggcgugagc

SEQ ID NO: 488835 - RNA, 22 nt, Human
ugggguuacaggcgugagccac

SEQ ID NO: 488836 - RNA, 23 nt, Human
ugggguuacaggcgugagccacc

SEQ ID NO: 488837 - RNA, 24 nt, Human
ugggguuacaggcgugagccacca

SEQ ID NO: 488838 - RNA, 24 nt, Human
ugggguuucaccauguucgccagg

SEQ ID NO: 488839 - RNA, 20 nt, Human
uggguucacaccauucuccu

SEQ ID NO: 488840 - RNA, 21 nt, Human
uguauuuuuaguagagauggg

SEQ ID NO: 488841 - RNA, 21 nt, Human
ugucaugaaggcccugugaug

SEQ ID NO: 488842 - RNA, 30 nt, Human
ugucaugaaggcccugugaugacauggggg

SEQ ID NO: 488843 - RNA, 19 nt, Human
uguccugcccagcuucucc

SEQ ID NO: 488844 - RNA, 19 nt, Human
uuacaggcgugagccacca

SEQ ID NO: 488845 - RNA, 18 nt, Human
uuaguagagaugggguuu

SEQ ID NO: 488846 - RNA, 22 nt, Human
uuaguagagaugggguuucacc

SEQ ID NO: 488847 - RNA, 24 nt, Human
uuaguagagaugggguuucaccau

SEQ ID NO: 488848 - RNA, 27 nt, Human
uuccccaccagcagcaaggacagaggu

SEQ ID NO: 488849 - RNA, 18 nt, Human
uuggccucccaaagugcu

SEQ ID NO: 488850 - RNA, 23 nt, Human
uuguauuuuuaguagagaugggg

SEQ ID NO: 488851 - RNA, 22 nt, Human
uuuaaugugaauccaccaggug

SEQ ID NO: 488852 - RNA, 19 nt, Human
uuucaccauguucgccagg

SEQ ID NO: 488853 - RNA, 20 nt, Human
uuucaccauguucgccagga

SEQ ID NO: 488854 - RNA, 24 nt, Human
uuuuuaguagagaugggguuucac

SEQ ID NO: 488855 - RNA, 21 nt, Human
uuuuuguauuuuuaguagaga

SEQ ID NO: 488856 - RNA, 24 nt, Human
uuuuuuguauuuuuaguagagaug

SEQ ID NO: 488857 - RNA, 24 nt, Human
uuuuuuuuuuugagacggagucuc

SEQ ID NO: 488858 - RNA, 18 nt, Human
accauuucccaccugccu

SEQ ID NO: 488859 - RNA, 21 nt, Human
agaaggaaaagaaacguugaa

SEQ ID NO: 488860 - RNA, 21 nt, Human
aggaaaagaaacguugaaugu

SEQ ID NO: 488861 - RNA, 22 nt, Human
aggucugcaaagcugcagcagg

SEQ ID NO: 488862 - RNA, 21 nt, Human
augaccaaggcgagcaggggc

SEQ ID NO: 488863 - RNA, 19 nt, Human
cagcugaggucugcaaagc

SEQ ID NO: 488864 - RNA, 18 nt, Human
caggacccaguggguuuc

SEQ ID NO: 488865 - RNA, 26 nt, Human
ccucgccacuuuguuguuuucucucu

SEQ ID NO: 488866 - RNA, 21 nt, Human
ccuucaguuuucaaccauuuc

SEQ ID NO: 488867 - RNA, 18 nt, Human
ccuugcucuuugcuagcc

SEQ ID NO: 488868 - RNA, 24 nt, Human
ccuugcucuuugcuagccuuucuc

SEQ ID NO: 488869 - RNA, 24 nt, Human
cuacccuuucuaacacucucuucc

SEQ ID NO: 488870 - RNA, 24 nt, Human
cuccuuggagacuuauucuuucuu

SEQ ID NO: 488871 - RNA, 24 nt, Human
cuggauuuaaaaauagaaauacca

SEQ ID NO: 488872 - RNA, 23 nt, Human
gacccaguggguuuaaauaguuc

SEQ ID NO: 488873 - RNA, 19 nt, Human
gagggccucgccacuuugu

SEQ ID NO: 488874 - RNA, 20 nt, Human
gaucgccagaugcagugccc

SEQ ID NO: 488875 - RNA, 19 nt, Human
ggcagugcucagagucuga

SEQ ID NO: 488876 - RNA, 18 nt, Human
gggcagugcucagagucu

SEQ ID NO: 488877 - RNA, 24 nt, Human
guccuacccuuucuaacacucucu

SEQ ID NO: 488878 - RNA, 19 nt, Human
gugcuccacggcagccucc

SEQ ID NO: 488879 - RNA, 20 nt, Human
uaaaaggaagcuccuugagc

SEQ ID NO: 488880 - RNA, 24 nt, Human
uaacuauaacaccaucuaccuucc

SEQ ID NO: 488881 - RNA, 19 nt, Human
uagaaauaccauuucccac

SEQ ID NO: 488882 - RNA, 23 nt, Human
uagcaaagggauuuguguuuugc

SEQ ID NO: 488883 - RNA, 21 nt, Human
ucagugcuguacaugaccaag

SEQ ID NO: 488884 - RNA, 18 nt, Human
uccacgugucucaguuuc

SEQ ID NO: 488885 - RNA, 21 nt, Human
ucuaccuucaguuuucaacca

SEQ ID NO: 488886 - RNA, 21 nt, Human
ucugcaaagcugcagcaggcu

SEQ ID NO: 488887 - RNA, 18 nt, Human
ucuggagaugcccagcug

SEQ ID NO: 488888 - RNA, 22 nt, Human
ugaccaaggcgagcaggggcag

SEQ ID NO: 488889 - RNA, 24 nt, Human
ugacugaaccuuacgcuuucacuc

SEQ ID NO: 488890 - RNA, 23 nt, Human
ugcagcaggcugacugaaccuua

SEQ ID NO: 488891 - RNA, 23 nt, Human
ugcccagcugaggucugcaaagc

SEQ ID NO: 488892 - RNA, 19 nt, Human
ugcccuggaguuuccuccc

SEQ ID NO: 488893 - RNA, 24 nt, Human
ugcuucauuccuuucagugcugua

SEQ ID NO: 488894 - RNA, 22 nt, Human
uggguagccuauagcuuuccuu

SEQ ID NO: 488895 - RNA, 19 nt, Human
ugggugaggaaggcucuuc

SEQ ID NO: 488896 - RNA, 19 nt, Human
uguggcaggacccaguggg

SEQ ID NO: 488897 - RNA, 22 nt, Human
uguuuugcccucacauagccua

SEQ ID NO: 488898 - RNA, 21 nt, Human
uuaaggcaguuuugugccggc

SEQ ID NO: 488899 - RNA, 23 nt, Human
uuagcaaagggauuuguguuuug

SEQ ID NO: 488900 - RNA, 24 nt, Human
uuauuguagaaggaaaagaaacgu

SEQ ID NO: 488901 - RNA, 18 nt, Human
uuccuguccucaucugcc

SEQ ID NO: 488902 - RNA, 18 nt, Human
uucuaacacucucuuccu

SEQ ID NO: 488903 - RNA, 22 nt, Human
uucuuuggagauuauaggcugu

SEQ ID NO: 488904 - RNA, 22 nt, Human
uugaauguuuaaaacaaaacca

SEQ ID NO: 488905 - RNA, 20 nt, Human
uuuuguggguuugggugagg

SEQ ID NO: 488906 - RNA, 25 nt, Human
uuuuuuuuuuuuuuuuucacauuuu

SEQ ID NO: 488907 - RNA, 21 nt, Human
aaaaaagaaauacauuaugag

SEQ ID NO: 488908 - RNA, 22 nt, Human
aaaaaagaaauacauuaugaga

SEQ ID NO: 488909 - RNA, 18 nt, Human
aaaacaaaacaaaaaaag

SEQ ID NO: 488910 - RNA, 20 nt, Human
aaaacuguaggaacugcuga

SEQ ID NO: 488911 - RNA, 22 nt, Human
aaaagagauuaagaaaaacagu

SEQ ID NO: 488912 - RNA, 24 nt, Human
aaacaaaaaaagaaaauuagcugg

SEQ ID NO: 488913 - RNA, 20 nt, Human
aacaaaacaaaaaaagaaaa

SEQ ID NO: 488914 - RNA, 20 nt, Human
aacauagugagaccacaucu

SEQ ID NO: 488915 - RNA, 20 nt, Human
aacuuguaauaguugcauug

SEQ ID NO: 488916 - RNA, 22 nt, Human
aagaaaaacaguaagccacugg

SEQ ID NO: 488917 - RNA, 23 nt, Human
aagaaagacaaagaaagaggcaa

SEQ ID NO: 488918 - RNA, 21 nt, Human
aagaaagagagagagagagga

SEQ ID NO: 488919 - RNA, 20 nt, Human
aagaagaaagaaagaaagaa

SEQ ID NO: 488920 - RNA, 22 nt, Human
aagaauaccaagaaggcucaac

SEQ ID NO: 488921 - RNA, 20 nt, Human
aagcacacucuucauauacu

SEQ ID NO: 488922 - RNA, 20 nt, Human
aagcagaccuuucuagggau

SEQ ID NO: 488923 - RNA, 22 nt, Human
aagcaggagcucgacauaaagc

SEQ ID NO: 488924 - RNA, 22 nt, Human
aagcugcguuaguaacagauga

SEQ ID NO: 488925 - RNA, 23 nt, Human
aaguucccccagaugccagccaa

SEQ ID NO: 488926 - RNA, 20 nt, Human
aaugauacaaacagaaaaga

SEQ ID NO: 488927 - RNA, 18 nt, Human
acaaaacaaaaaaagaaa

SEQ ID NO: 488928 - RNA, 23 nt, Human
acaaaacaaaacaaaaaaagaaa

SEQ ID NO: 488929 - RNA, 19 nt, Human
acagugccccuaucuacca

SEQ ID NO: 488930 - RNA, 22 nt, Human
acauaaucaauucccacugugu

SEQ ID NO: 488931 - RNA, 28 nt, Human
acaucucuacaaaacaaaacaaaaaaag

SEQ ID NO: 488932 - RNA, 22 nt, Human
accucaaguuuuauuaaaaaac

SEQ ID NO: 488933 - RNA, 22 nt, Human
agaaaagacauguuagucaaaa

SEQ ID NO: 488934 - RNA, 21 nt, Human
agaaagaaagacaaagaaaga

SEQ ID NO: 488935 - RNA, 19 nt, Human
agaaagaagaaagaaagaa

SEQ ID NO: 488936 - RNA, 22 nt, Human
agaaauagugucccccuccccg

SEQ ID NO: 488937 - RNA, 20 nt, Human
agaagaaaaauaaacugaag

SEQ ID NO: 488938 - RNA, 22 nt, Human
agacaaagaaagaggcaagcaa

SEQ ID NO: 488939 - RNA, 22 nt, Human
agacgccagugaugucuaaacu

SEQ ID NO: 488940 - RNA, 21 nt, Human
agagaaaccgugcugccuggg

SEQ ID NO: 488941 - RNA, 18 nt, Human
agaggcaagcaagcagga

SEQ ID NO: 488942 - RNA, 22 nt, Human
agccugggaaacauagugagac

SEQ ID NO: 488943 - RNA, 18 nt, Human
agcugggcaugguggcuc

SEQ ID NO: 488944 - RNA, 23 nt, Human
agcugggcaugguggcucgugcc

SEQ ID NO: 488945 - RNA, 21 nt, Human
aggaaggaaggaaggaaggaa

SEQ ID NO: 488946 - RNA, 21 nt, Human
aggaaggaaggaaggaaggaa

SEQ ID NO: 488947 - RNA, 21 nt, Human
aggaaggaaggaaggaaggaa

SEQ ID NO: 488948 - RNA, 21 nt, Human
aggaaggaaggaaggaaggaa

SEQ ID NO: 488949 - RNA, 21 nt, Human
aggaaggaaggaaggaaggaa

SEQ ID NO: 488950 - RNA, 21 nt, Human
aggaaggaaggaaggaaggaa

SEQ ID NO: 488951 - RNA, 21 nt, Human
aggaaggaaggaaggaaggaa

SEQ ID NO: 488952 - RNA, 21 nt, Human
aggaaggaaggaaggaaggaa

SEQ ID NO: 488953 - RNA, 21 nt, Human
aggaaggaaggaaggaaggaa

SEQ ID NO: 488954 - RNA, 21 nt, Human
aggaaggaaggaaggaaggaa

SEQ ID NO: 488955 - RNA, 21 nt, Human
aggaaggaaggaaggaaggaa

SEQ ID NO: 488956 - RNA, 21 nt, Human
aggaaggaaggaaggaaggga

SEQ ID NO: 488957 - RNA, 23 nt, Human
aggcauaaucagaccauaaacag

SEQ ID NO: 488958 - RNA, 20 nt, Human
aggcuuccauuaacucuuca

SEQ ID NO: 488959 - RNA, 25 nt, Human
auauucuucucucucuuuuucaacu

SEQ ID NO: 488960 - RNA, 24 nt, Human
aucucuacaaaacaaaacaaaaaa

SEQ ID NO: 488961 - RNA, 21 nt, Human
augaaaaaacauucaaacuaa

SEQ ID NO: 488962 - RNA, 21 nt, Human
augaagucaaaaauauaaaau

SEQ ID NO: 488963 - RNA, 21 nt, Human
auuggugucagccacaguuuc

SEQ ID NO: 488964 - RNA, 18 nt, Human
caaaucaguuucaaaaaa

SEQ ID NO: 488965 - RNA, 21 nt, Human
caagaugauucugaauuauaa

SEQ ID NO: 488966 - RNA, 25 nt, Human
caaucaccaaacccugacgaaaagu

SEQ ID NO: 488967 - RNA, 20 nt, Human
cacaauuugggagagaaacc

SEQ ID NO: 488968 - RNA, 19 nt, Human
cacgccuguaauccuaaca

SEQ ID NO: 488969 - RNA, 21 nt, Human
cagaaagaagaaagaaagaaa

SEQ ID NO: 488970 - RNA, 21 nt, Human
cagaaauagugucccccuccc

SEQ ID NO: 488971 - RNA, 19 nt, Human
cagccacaguuucauccug

SEQ ID NO: 488972 - RNA, 21 nt, Human
cagccagacugcuaaauccaa

SEQ ID NO: 488973 - RNA, 21 nt, Human
caggaauccauccaagaacca

SEQ ID NO: 488974 - RNA, 23 nt, Human
caggcgcaggcucacgccuguaa

SEQ ID NO: 488975 - RNA, 19 nt, Human
caucacacuccggggucag

SEQ ID NO: 488976 - RNA, 20 nt, Human
cauguuaauuuuuuucugaa

SEQ ID NO: 488977 - RNA, 20 nt, Human
cauucugccuagccuguacc

SEQ ID NO: 488978 - RNA, 22 nt, Human
cccacacccgaccgggccucua

SEQ ID NO: 488979 - RNA, 25 nt, Human
ccccacacccgaccgggccucuagc

SEQ ID NO: 488980 - RNA, 24 nt, Human
ccccuaucuaccaagaugauucug

SEQ ID NO: 488981 - RNA, 19 nt, Human
cccuccagggagcggccug

SEQ ID NO: 488982 - RNA, 21 nt, Human
ccucaugugggacucuggcau

SEQ ID NO: 488983 - RNA, 20 nt, Human
ccuguaccaaaauuccagaa

SEQ ID NO: 488984 - RNA, 23 nt, Human
ccuguaccaaaauuccagaaaga

SEQ ID NO: 488985 - RNA, 22 nt, Human
ccugucucauaaaacucagaag

SEQ ID NO: 488986 - RNA, 24 nt, Human
cgaagugggaggacugcuugaggc

SEQ ID NO: 488987 - RNA, 18 nt, Human
cgaccgggccucuagcgg

SEQ ID NO: 488988 - RNA, 18 nt, Human
cgccagugaugucuaaac

SEQ ID NO: 488989 - RNA, 26 nt, Human
cuacaaaacaaaacaaaaaaagaaaa

SEQ ID NO: 488990 - RNA, 23 nt, Human
cuaccaagaugauucugaauuau

SEQ ID NO: 488991 - RNA, 20 nt, Human
cucacgccuguaauccuaac

SEQ ID NO: 488992 - RNA, 24 nt, Human
cucacgccuguaauccuaacacuu

SEQ ID NO: 488993 - RNA, 21 nt, Human
cuccaaggaaucaaacgugau

SEQ ID NO: 488994 - RNA, 20 nt, Human
cucgacaguucaucccucca

SEQ ID NO: 488995 - RNA, 19 nt, Human
cugaauuauaauuccauca

SEQ ID NO: 488996 - RNA, 21 nt, Human
cugcuaaauccaacuccuggu

SEQ ID NO: 488997 - RNA, 21 nt, Human
cuggguaaauuacagguuuac

SEQ ID NO: 488998 - RNA, 22 nt, Human
cuuaaaacaugaagucaaaaau

SEQ ID NO: 488999 - RNA, 24 nt, Human
cuuaaaaccucugcaugucucaga

SEQ ID NO: 489000 - RNA, 18 nt, Human
cuuauaauuuuaaccaca

SEQ ID NO: 489001 - RNA, 22 nt, Human
cuugcauuuuacagaagaaaaa

SEQ ID NO: 489002 - RNA, 22 nt, Human
cuuucuagggauagcagucuca

SEQ ID NO: 489003 - RNA, 20 nt, Human
gaaaaaacauucaaacuaaa

SEQ ID NO: 489004 - RNA, 22 nt, Human
gaaaagaaagaaagacaaagaa

SEQ ID NO: 489005 - RNA, 19 nt, Human
gaagaaacucacuugguac

SEQ ID NO: 489006 - RNA, 18 nt, Human
gaccccuuccacuugcga

SEQ ID NO: 489007 - RNA, 24 nt, Human
gacugcuugaggccgggaguuuaa

SEQ ID NO: 489008 - RNA, 19 nt, Human
gaggacgggagccucgugc

SEQ ID NO: 489009 - RNA, 18 nt, Human
gcccugggccccucgaca

SEQ ID NO: 489010 - RNA, 19 nt, Human
ggaaucaaacgugauuaaa

SEQ ID NO: 489011 - RNA, 18 nt, Human
ggcaaggugagccauucu

SEQ ID NO: 489012 - RNA, 18 nt, Human
ggcucacgccuguaaucc

SEQ ID NO: 489013 - RNA, 20 nt, Human
gggcucgggacaagggacag

SEQ ID NO: 489014 - RNA, 18 nt, Human
gucgcaggaggcggggaa

SEQ ID NO: 489015 - RNA, 22 nt, Human
guggagcacuggguaaauuaca

SEQ ID NO: 489016 - RNA, 23 nt, Human
guucaacucucuuaaugagcuga

SEQ ID NO: 489017 - RNA, 24 nt, Human
uaaaaaaaaacuacauguuucuua

SEQ ID NO: 489018 - RNA, 18 nt, Human
uaaaauaauacuccaggc

SEQ ID NO: 489019 - RNA, 21 nt, Human
uaaccgcgacgaccccuucca

SEQ ID NO: 489020 - RNA, 24 nt, Human
uacaaaacaaaacaaaaaaagaaa

SEQ ID NO: 489021 - RNA, 27 nt, Human
uacagaagaaaaauaaacugaaguaaa

SEQ ID NO: 489022 - RNA, 19 nt, Human
uacauguuucuuaauggac

SEQ ID NO: 489023 - RNA, 21 nt, Human
uacuccaggcauaaucagacc

SEQ ID NO: 489024 - RNA, 19 nt, Human
uaggagcugaucaucuagg

SEQ ID NO: 489025 - RNA, 26 nt, Human
uagugagaccacaucucuacaaaaca

SEQ ID NO: 489026 - RNA, 21 nt, Human
uaguugcauuggcuccaagga

SEQ ID NO: 489027 - RNA, 23 nt, Human
uauaaaauaauacuccaggcaua

SEQ ID NO: 489028 - RNA, 25 nt, Human
ucagcugguuuuguacucuuugcaa

SEQ ID NO: 489029 - RNA, 23 nt, Human
uccagaaagaagaaagaaagaaa

SEQ ID NO: 489030 - RNA, 19 nt, Human
uccauuaacucuucauacu

SEQ ID NO: 489031 - RNA, 18 nt, Human
ucccccagaugccagcca

SEQ ID NO: 489032 - RNA, 21 nt, Human
uccucugaagaagccagugga

SEQ ID NO: 489033 - RNA, 23 nt, Human
ucuaggcacauucugccuagccu

SEQ ID NO: 489034 - RNA, 25 nt, Human
ucucagccagaacaucacugagaac

SEQ ID NO: 489035 - RNA, 18 nt, Human
ucucucucuuuuucaacu

SEQ ID NO: 489036 - RNA, 18 nt, Human
ucuuccagcuuucuguca

SEQ ID NO: 489037 - RNA, 24 nt, Human
ucuuugcacugcaugaaauagcug

SEQ ID NO: 489038 - RNA, 18 nt, Human
ugaagaagccaguggagc

SEQ ID NO: 489039 - RNA, 21 nt, Human
ugacuauuucuuccagcuuuc

SEQ ID NO: 489040 - RNA, 24 nt, Human
ugagaacuuguaauaguugcauug

SEQ ID NO: 489041 - RNA, 21 nt, Human
ugagcugcucauauucuuuau

SEQ ID NO: 489042 - RNA, 20 nt, Human
ugauauccuuucuuauuucu

SEQ ID NO: 489043 - RNA, 24 nt, Human
ugccccuaucuaccaagaugauuc

SEQ ID NO: 489044 - RNA, 23 nt, Human
ugcccugggccccucgacaguuc

SEQ ID NO: 489045 - RNA, 19 nt, Human
uggaccgauugcuuucgag

SEQ ID NO: 489046 - RNA, 21 nt, Human
uggcgcaugcuuuucagcugg

SEQ ID NO: 489047 - RNA, 22 nt, Human
ugggacucuggcaugauugucu

SEQ ID NO: 489048 - RNA, 20 nt, Human
ugggaggacugcuugaggcc

SEQ ID NO: 489049 - RNA, 28 nt, Human
uggggugucaggcaagucagcuuaaaaa

SEQ ID NO: 489050 - RNA, 20 nt, Human
ugguaucaaguaaaacccca

SEQ ID NO: 489051 - RNA, 22 nt, Human
ugguggcucgugccuguagucc

SEQ ID NO: 489052 - RNA, 21 nt, Human
uguacuuaagaauaccaagaa

SEQ ID NO: 489053 - RNA, 18 nt, Human
uguccauaaugaauuuaa

SEQ ID NO: 489054 - RNA, 19 nt, Human
uguggcauuuccugaaggu

SEQ ID NO: 489055 - RNA, 23 nt, Human
uuaaaggcuuccauuaacucuuc

SEQ ID NO: 489056 - RNA, 23 nt, Human
uuaagaauaccaagaaggcucaa

SEQ ID NO: 489057 - RNA, 24 nt, Human
uuagcugggcaugguggcucgugc

SEQ ID NO: 489058 - RNA, 18 nt, Human
uucaggaggccgaagugg

SEQ ID NO: 489059 - RNA, 25 nt, Human
uucauccugaagaaacucacuuggu

SEQ ID NO: 489060 - RNA, 20 nt, Human
uuccauuaacucuucauacu

SEQ ID NO: 489061 - RNA, 24 nt, Human
uucuaccacauuauauuuauuaua

SEQ ID NO: 489062 - RNA, 21 nt, Human
uucuucuaaaguuuuuuuaaa

SEQ ID NO: 489063 - RNA, 25 nt, Human
uuguauaaugguaucuacuuucuuc

SEQ ID NO: 489064 - RNA, 19 nt, Human
uuucuagggauagcagucu

SEQ ID NO: 489065 - RNA, 18 nt, Human
uuuuccauaauccuuuaa

SEQ ID NO: 489066 - RNA, 21 nt, Human
accuggugaugucuggcauca

SEQ ID NO: 489067 - RNA, 25 nt, Human
acugccugucaacuucuacaaccug

SEQ ID NO: 489068 - RNA, 19 nt, Human
agggggcacagggcuaagg

SEQ ID NO: 489069 - RNA, 21 nt, Human
agggggcacagggcuaaggcu

SEQ ID NO: 489070 - RNA, 18 nt, Human
cacugcuuggccccuaca

SEQ ID NO: 489071 - RNA, 23 nt, Human
cagggggcacagggcuaaggcug

SEQ ID NO: 489072 - RNA, 20 nt, Human
ccauggcacugccugucaac

SEQ ID NO: 489073 - RNA, 18 nt, Human
cccagcugggcacugcuu

SEQ ID NO: 489074 - RNA, 25 nt, Human
cccccauggcacugccugucaacuu

SEQ ID NO: 489075 - RNA, 23 nt, Human
cgagugaugguggcagcuguuuc

SEQ ID NO: 489076 - RNA, 21 nt, Human
cugggcacugcuuggccccua

SEQ ID NO: 489077 - RNA, 28 nt, Human
cuggugaugucuggcaucaaccccuccc

SEQ ID NO: 489078 - RNA, 19 nt, Human
gcgagugaugguggcagcu

SEQ ID NO: 489079 - RNA, 20 nt, Human
uauuuuggcuguugccccca

SEQ ID NO: 489080 - RNA, 20 nt, Human
ucccccagcugggcacugcu

SEQ ID NO: 489081 - RNA, 23 nt, Human
uggcagcuguuucagggggcaca

SEQ ID NO: 489082 - RNA, 22 nt, Human
uggccccuacaucauuaccccc

SEQ ID NO: 489083 - RNA, 22 nt, Human
ugggcacugcuuggccccuaca

SEQ ID NO: 489084 - RNA, 24 nt, Human
ugucuggcaucaaccccucccaaa

SEQ ID NO: 489085 - RNA, 18 nt, Human
aaaaaagcaaaaaacccc

SEQ ID NO: 489086 - RNA, 20 nt, Human
aaaaacaacagucacacugg

SEQ ID NO: 489087 - RNA, 26 nt, Human
aaaaaccccaaacccacccccaaaca

SEQ ID NO: 489088 - RNA, 21 nt, Human
aaaaaccccaaacccaccccu

SEQ ID NO: 489089 - RNA, 23 nt, Human
aaaaccccaaacccacccccaaa

SEQ ID NO: 489090 - RNA, 19 nt, Human
aaaagccacccguaugaaa

SEQ ID NO: 489091 - RNA, 19 nt, Human
aaaaggaaagaaagacaaa

SEQ ID NO: 489092 - RNA, 19 nt, Human
aaaccccaaacccaccccc

SEQ ID NO: 489093 - RNA, 20 nt, Human
aaagcaaaaaaccccaaacc

SEQ ID NO: 489094 - RNA, 21 nt, Human
aaagcaaaaaaccccaaaccc

SEQ ID NO: 489095 - RNA, 18 nt, Human
aaccccaaacccaccccc

SEQ ID NO: 489096 - RNA, 29 nt, Human
aagaaaccaaggcauuuagcagugggcac

SEQ ID NO: 489097 - RNA, 29 nt, Human
aagaaagacaaaauauaagggaaaagaaa

SEQ ID NO: 489098 - RNA, 21 nt, Human
aagcaaaaaaccccaaaccca

SEQ ID NO: 489099 - RNA, 23 nt, Human
aagccgaagcccaagcaccggaa

SEQ ID NO: 489100 - RNA, 26 nt, Human
aauuaccccugaauaaacuuuagaca

SEQ ID NO: 489101 - RNA, 20 nt, Human
aauuguguguaugcaugugu

SEQ ID NO: 489102 - RNA, 20 nt, Human
accauuacaacaagcagaac

SEQ ID NO: 489103 - RNA, 19 nt, Human
acccacccccaaacaaaaa

SEQ ID NO: 489104 - RNA, 21 nt, Human
accccaaacccacccccaaac

SEQ ID NO: 489105 - RNA, 23 nt, Human
acccccaaacaaaaacaacaguc

SEQ ID NO: 489106 - RNA, 20 nt, Human
acccccaaacaaaaacaacc

SEQ ID NO: 489107 - RNA, 19 nt, Human
agaacaccaauacuuaaaa

SEQ ID NO: 489108 - RNA, 21 nt, Human
agacaauuacaguugaaaaca

SEQ ID NO: 489109 - RNA, 23 nt, Human
agacuuuugccaauucuaaauuu

SEQ ID NO: 489110 - RNA, 18 nt, Human
agauauuagauguuaacu

SEQ ID NO: 489111 - RNA, 18 nt, Human
agcauauggaacagggag

SEQ ID NO: 489112 - RNA, 21 nt, Human
agccgaagcccaagcaccgga

SEQ ID NO: 489113 - RNA, 18 nt, Human
agcuuccaaauagcugag

SEQ ID NO: 489114 - RNA, 25 nt, Human
aguaauuccuuauuuaucugaaagc

SEQ ID NO: 489115 - RNA, 21 nt, Human
aguucaggacuuccaucaggu

SEQ ID NO: 489116 - RNA, 20 nt, Human
auaaaauggccguuuaaccc

SEQ ID NO: 489117 - RNA, 20 nt, Human
auacaaaaauacaaaauuuc

SEQ ID NO: 489118 - RNA, 18 nt, Human
auguuaacuucuggagaa

SEQ ID NO: 489119 - RNA, 18 nt, Human
auuacaugaacuuuuaaa

SEQ ID NO: 489120 - RNA, 21 nt, Human
auuuccaaguucaggacuucc

SEQ ID NO: 489121 - RNA, 26 nt, Human
caaaaaaccccaaacccacccccaaa

SEQ ID NO: 489122 - RNA, 24 nt, Human
caaaaacaacagucacacuggagg

SEQ ID NO: 489123 - RNA, 24 nt, Human
caaacccacccccaaacaaaaaca

SEQ ID NO: 489124 - RNA, 22 nt, Human
caaaucaauacacagaaacuua

SEQ ID NO: 489125 - RNA, 19 nt, Human
caaauguguggaggaugcu

SEQ ID NO: 489126 - RNA, 21 nt, Human
cacuuuuuuuucuuaaagcau

SEQ ID NO: 489127 - RNA, 22 nt, Human
caucaguaaaauaagaucuuga

SEQ ID NO: 489128 - RNA, 20 nt, Human
caugaugcagggauguccaa

SEQ ID NO: 489129 - RNA, 21 nt, Human
caugauuugcucucucaucua

SEQ ID NO: 489130 - RNA, 25 nt, Human
cauucaccauuacaacaagcagaac

SEQ ID NO: 489131 - RNA, 22 nt, Human
ccaaacccacccccaaacaaaa

SEQ ID NO: 489132 - RNA, 24 nt, Human
ccaaacccacccccaaacaaaaac

SEQ ID NO: 489133 - RNA, 22 nt, Human
ccaagcaccggaauuuucaaug

SEQ ID NO: 489134 - RNA, 23 nt, Human
ccaagcaccggaauuuucaaugc

SEQ ID NO: 489135 - RNA, 19 nt, Human
ccacccccaaacaaaaaca

SEQ ID NO: 489136 - RNA, 22 nt, Human
ccacccguaugaaaggaguaca

SEQ ID NO: 489137 - RNA, 21 nt, Human
cccaaacaaaaacaacaguca

SEQ ID NO: 489138 - RNA, 24 nt, Human
cccaaacccacccccaaacaaaaa

SEQ ID NO: 489139 - RNA, 23 nt, Human
cccaagcaccggaauuuucaaug

SEQ ID NO: 489140 - RNA, 23 nt, Human
ccccaaacaaaaacaacagucac

SEQ ID NO: 489141 - RNA, 18 nt, Human
ccccaaacccacccccaa

SEQ ID NO: 489142 - RNA, 20 nt, Human
ccccaaacccacccccaaac

SEQ ID NO: 489143 - RNA, 24 nt, Human
cccuuuucuuuuuuuaccuacuuu

SEQ ID NO: 489144 - RNA, 21 nt, Human
ccucucagcauuacuuaaucu

SEQ ID NO: 489145 - RNA, 18 nt, Human
ccugccaguguguuuuca

SEQ ID NO: 489146 - RNA, 22 nt, Human
cggaugcggucgcgugcgcgca

SEQ ID NO: 489147 - RNA, 22 nt, Human
cugguaggaggcaaugcuuucu

SEQ ID NO: 489148 - RNA, 21 nt, Human
cuuccaaauagcugagauugc

SEQ ID NO: 489149 - RNA, 23 nt, Human
cuugacccacuaggacuuaugca

SEQ ID NO: 489150 - RNA, 21 nt, Human
cuuuuuuuuuuuuuuuuuugg

SEQ ID NO: 489151 - RNA, 18 nt, Human
gaaagauuaucuacccuu

SEQ ID NO: 489152 - RNA, 21 nt, Human
gaaaguccaaaaucugugcgg

SEQ ID NO: 489153 - RNA, 22 nt, Human
gauacuguuuggugauacuagg

SEQ ID NO: 489154 - RNA, 22 nt, Human
gcaaaaaaccccaaacccaccc

SEQ ID NO: 489155 - RNA, 20 nt, Human
gcaccggaauuuucaaugcu

SEQ ID NO: 489156 - RNA, 19 nt, Human
gcaucaguaaaauaagauc

SEQ ID NO: 489157 - RNA, 19 nt, Human
gcuagaguaaagaacacca

SEQ ID NO: 489158 - RNA, 23 nt, Human
guagaacucuggauacucaauga

SEQ ID NO: 489159 - RNA, 23 nt, Human
uaaaaaaauuguaacaaaaagga

SEQ ID NO: 489160 - RNA, 23 nt, Human
uaaaaucuccucuaaguuauuaa

SEQ ID NO: 489161 - RNA, 21 nt, Human
uaaaauggcacacaaucaagu

SEQ ID NO: 489162 - RNA, 21 nt, Human
uaauuguguguaugcaugugu

SEQ ID NO: 489163 - RNA, 24 nt, Human
uacacagaaacuuaaaggcuaaac

SEQ ID NO: 489164 - RNA, 18 nt, Human
uacauuaacaaaaauagc

SEQ ID NO: 489165 - RNA, 22 nt, Human
uacucugaagccgaagcccaag

SEQ ID NO: 489166 - RNA, 24 nt, Human
uauauaaaauggcacacaaucaag

SEQ ID NO: 489167 - RNA, 23 nt, Human
uaugaacuauuaugaaaauuccc

SEQ ID NO: 489168 - RNA, 18 nt, Human
uauguguguguguauaua

SEQ ID NO: 489169 - RNA, 24 nt, Human
uauuaugaaaauucccauauuggg

SEQ ID NO: 489170 - RNA, 20 nt, Human
ucaaaaaggaaagaaagaca

SEQ ID NO: 489171 - RNA, 19 nt, Human
ucacacuggaggaucaaaa

SEQ ID NO: 489172 - RNA, 24 nt, Human
ucagcauuacuuaaucugcaaauc

SEQ ID NO: 489173 - RNA, 23 nt, Human
uccaagugaguagaaccuaauuu

SEQ ID NO: 489174 - RNA, 23 nt, Human
uccugguagcuuccaaauagcug

SEQ ID NO: 489175 - RNA, 19 nt, Human
ucgcugggugccccagcuu

SEQ ID NO: 489176 - RNA, 22 nt, Human
ucugaaagcauaugccuagucu

SEQ ID NO: 489177 - RNA, 24 nt, Human
ucugaaauauuuacuuuacauuaa

SEQ ID NO: 489178 - RNA, 26 nt, Human
ucugaaauauuuacuuuacauuaaca

SEQ ID NO: 489179 - RNA, 19 nt, Human
ucugaagccgaagcccaag

SEQ ID NO: 489180 - RNA, 18 nt, Human
ucugcaaaucaauacaca

SEQ ID NO: 489181 - RNA, 19 nt, Human
ucugucccuucuuuauucc

SEQ ID NO: 489182 - RNA, 25 nt, Human
ucuuugauuggggaaaaccgggguc

SEQ ID NO: 489183 - RNA, 23 nt, Human
ugaaaauucccauauugggccca

SEQ ID NO: 489184 - RNA, 18 nt, Human
ugaauaaaagagaacagc

SEQ ID NO: 489185 - RNA, 19 nt, Human
ugacaaaaauaagcauaaa

SEQ ID NO: 489186 - RNA, 25 nt, Human
uguaacaaaaaggaguuaucgcauu

SEQ ID NO: 489187 - RNA, 19 nt, Human
uguauagcaagcauuugaa

SEQ ID NO: 489188 - RNA, 18 nt, Human
ugucuaguucugguagga

SEQ ID NO: 489189 - RNA, 19 nt, Human
ugugaaaguccaaaaucug

SEQ ID NO: 489190 - RNA, 23 nt, Human
ugugaaaguccaaaaucugugcg

SEQ ID NO: 489191 - RNA, 24 nt, Human
uguguguauauauuguuuuggaau

SEQ ID NO: 489192 - RNA, 20 nt, Human
uguguguguguauauauugu

SEQ ID NO: 489193 - RNA, 19 nt, Human
uucaaaagauucuccuucc

SEQ ID NO: 489194 - RNA, 24 nt, Human
uucaaaagauucuccuuccaugga

SEQ ID NO: 489195 - RNA, 21 nt, Human
uucaccauuacaacaagcaga

SEQ ID NO: 489196 - RNA, 24 nt, Human
uuccaucaggucacuuuggaggga

SEQ ID NO: 489197 - RNA, 18 nt, Human
uucucugauuuuggcuga

SEQ ID NO: 489198 - RNA, 22 nt, Human
uugcucucucaucuauuuggac

SEQ ID NO: 489199 - RNA, 24 nt, Human
uuggagggacaccucuuaaaauug

SEQ ID NO: 489200 - RNA, 18 nt, Human
uuugacaaaaauaagcau

SEQ ID NO: 489201 - RNA, 25 nt, Human
uuuuuuuuuuuuguacagagccugu

SEQ ID NO: 489202 - RNA, 21 nt, Human
uuuuuuuuuuuuuuuguacag

SEQ ID NO: 489203 - RNA, 21 nt, Human
acccacaggagcagcuccugg

SEQ ID NO: 489204 - RNA, 22 nt, Human
accccaucccucccugucccca

SEQ ID NO: 489205 - RNA, 23 nt, Human
accccaucccucccuguccccag

SEQ ID NO: 489206 - RNA, 18 nt, Human
agcugguucucuggcuca

SEQ ID NO: 489207 - RNA, 23 nt, Human
aggaaggguccccuuuauucaga

SEQ ID NO: 489208 - RNA, 24 nt, Human
caucaacccacaggagcagcuccu

SEQ ID NO: 489209 - RNA, 20 nt, Human
caucagggaccccaucccuc

SEQ ID NO: 489210 - RNA, 27 nt, Human
caucagggaccccaucccucccugucc

SEQ ID NO: 489211 - RNA, 20 nt, Human
ccacccagggccuagggcag

SEQ ID NO: 489212 - RNA, 23 nt, Human
cccagggcugggggccuugggga

SEQ ID NO: 489213 - RNA, 23 nt, Human
ccuccucuguggaaaagagccug

SEQ ID NO: 489214 - RNA, 22 nt, Human
ccugcaagcccccgcuuucugc

SEQ ID NO: 489215 - RNA, 18 nt, Human
cucaggcuucauguccuu

SEQ ID NO: 489216 - RNA, 20 nt, Human
cuuccccauccccagggcug

SEQ ID NO: 489217 - RNA, 24 nt, Human
cuuccccauccccagggcuggggg

SEQ ID NO: 489218 - RNA, 23 nt, Human
gagcagcuccuggaggaagcuaa

SEQ ID NO: 489219 - RNA, 18 nt, Human
gcuucauguccuucccca

SEQ ID NO: 489220 - RNA, 22 nt, Human
ggcccauucacuuucccugcaa

SEQ ID NO: 489221 - RNA, 19 nt, Human
uagcugguucucuggcuca

SEQ ID NO: 489222 - RNA, 24 nt, Human
uagcugguucucuggcucaggcuu

SEQ ID NO: 489223 - RNA, 24 nt, Human
uccccagacaccagugucuucuca

SEQ ID NO: 489224 - RNA, 23 nt, Human
uccccagggcugggggccuuggg

SEQ ID NO: 489225 - RNA, 22 nt, Human
ucugcggugaugagaggccuuu

SEQ ID NO: 489226 - RNA, 24 nt, Human
ugcugccugcucuuuccuccucug

SEQ ID NO: 489227 - RNA, 24 nt, Human
ugggccacaggcccauucacuuuc

SEQ ID NO: 489228 - RNA, 23 nt, Human
uuggggacucuccaucaacccac

SEQ ID NO: 489229 - RNA, 21 nt, Human
acccacaagagcagcucccag

SEQ ID NO: 489230 - RNA, 18 nt, Human
acgcuccaucaacccaca

SEQ ID NO: 489231 - RNA, 20 nt, Human
agagcugguucucuggcuca

SEQ ID NO: 489232 - RNA, 22 nt, Human
agaggaaggguccucuuuauuc

SEQ ID NO: 489233 - RNA, 22 nt, Human
caacccacaagagcagcuccca

SEQ ID NO: 489234 - RNA, 21 nt, Human
cagcagggacucccaucccuc

SEQ ID NO: 489235 - RNA, 21 nt, Human
cagggcaaccugucagggucu

SEQ ID NO: 489236 - RNA, 24 nt, Human
caucaacccacaagagcagcuccc

SEQ ID NO: 489237 - RNA, 24 nt, Human
ccaaugagaggaaggguccucuuu

SEQ ID NO: 489238 - RNA, 20 nt, Human
ccacccggagcccagggcaa

SEQ ID NO: 489239 - RNA, 21 nt, Human
ccagggcuggagcuucgagga

SEQ ID NO: 489240 - RNA, 23 nt, Human
cccagggcuggagcuucgaggac

SEQ ID NO: 489241 - RNA, 19 nt, Human
ccccaggccugugucuccu

SEQ ID NO: 489242 - RNA, 21 nt, Human
cccggagcccagggcaaccug

SEQ ID NO: 489243 - RNA, 25 nt, Human
ccggagcccagggcaaccugucagg

SEQ ID NO: 489244 - RNA, 22 nt, Human
ccuguggugaugagaggccuuu

SEQ ID NO: 489245 - RNA, 18 nt, Human
cuccagauauucagcagg

SEQ ID NO: 489246 - RNA, 25 nt, Human
cucccaucccucccuguccccaggc

SEQ ID NO: 489247 - RNA, 18 nt, Human
cuccucaggacucagagc

SEQ ID NO: 489248 - RNA, 22 nt, Human
gacucccaucccucccuguccc

SEQ ID NO: 489249 - RNA, 23 nt, Human
gacucccaucccucccugucccc

SEQ ID NO: 489250 - RNA, 21 nt, Human
gagcccagggcaaccugucag

SEQ ID NO: 489251 - RNA, 20 nt, Human
gagcugcugugacugucggc

SEQ ID NO: 489252 - RNA, 19 nt, Human
gagcugguucucuggcuca

SEQ ID NO: 489253 - RNA, 19 nt, Human
gaggagcugggcuccagga

SEQ ID NO: 489254 - RNA, 19 nt, Human
gcugggugcuuguggucug

SEQ ID NO: 489255 - RNA, 21 nt, Human
ggcaaccugucagggucucca

SEQ ID NO: 489256 - RNA, 22 nt, Human
ucccaucccucccuguccccag

SEQ ID NO: 489257 - RNA, 20 nt, Human
ucucugcugggugcuugugg

SEQ ID NO: 489258 - RNA, 24 nt, Human
ugggccacaggcccauucacuuuc

SEQ ID NO: 489259 - RNA, 19 nt, Human
ugggugcuuguggucugug

SEQ ID NO: 489260 - RNA, 18 nt, Human
uguggagaggagcugggc

SEQ ID NO: 489261 - RNA, 22 nt, Human
uguggagaggagcugggcucca

SEQ ID NO: 489262 - RNA, 23 nt, Human
uucagauccuuuccuggugaccc

SEQ ID NO: 489263 - RNA, 22 nt, Human
uucccgugagcagaaaaagagc

SEQ ID NO: 489264 - RNA, 20 nt, Human
uuccuggugaccccgggugg

SEQ ID NO: 489265 - RNA, 23 nt, Human
uuccuggugaccccgggugggcc

SEQ ID NO: 489266 - RNA, 24 nt, Human
aaaugcagaaacuacaccaaggcu

SEQ ID NO: 489267 - RNA, 20 nt, Human
aagaauccaguccagucugc

SEQ ID NO: 489268 - RNA, 23 nt, Human
aagugucagcaacugcacaaacu

SEQ ID NO: 489269 - RNA, 20 nt, Human
acauuugacgaauggcugca

SEQ ID NO: 489270 - RNA, 22 nt, Human
accaaaccaaauaaaagagaau

SEQ ID NO: 489271 - RNA, 21 nt, Human
agagaauauuugacauuugac

SEQ ID NO: 489272 - RNA, 23 nt, Human
agagaccccaugaaccaaaccaa

SEQ ID NO: 489273 - RNA, 19 nt, Human
agcagggaaaaauggagug

SEQ ID NO: 489274 - RNA, 22 nt, Human
agcauauuuguuaauuuuugca

SEQ ID NO: 489275 - RNA, 18 nt, Human
aggaucacaccaagaguu

SEQ ID NO: 489276 - RNA, 24 nt, Human
aggcugucaccuaaaugagaguuu

SEQ ID NO: 489277 - RNA, 20 nt, Human
augagccacaugagaagccu

SEQ ID NO: 489278 - RNA, 21 nt, Human
auugugacaaucaggaggauc

SEQ ID NO: 489279 - RNA, 20 nt, Human
cacaucucaggcaugagggu

SEQ ID NO: 489280 - RNA, 22 nt, Human
cacucuucccgaaaugcagaaa

SEQ ID NO: 489281 - RNA, 19 nt, Human
cagcuuauaggucuucagg

SEQ ID NO: 489282 - RNA, 18 nt, Human
caguccagucugcaggug

SEQ ID NO: 489283 - RNA, 19 nt, Human
caucuugggaaaaacuguc

SEQ ID NO: 489284 - RNA, 18 nt, Human
cauuaacacuacugucag

SEQ ID NO: 489285 - RNA, 19 nt, Human
ccaaaccaaauaaaagaga

SEQ ID NO: 489286 - RNA, 19 nt, Human
cccgaaaugcagaaacuac

SEQ ID NO: 489287 - RNA, 23 nt, Human
cccgaaaugcagaaacuacacca

SEQ ID NO: 489288 - RNA, 22 nt, Human
cugcaaaauauagugauagcuc

SEQ ID NO: 489289 - RNA, 23 nt, Human
gaaaugcagaaacuacaccaagg

SEQ ID NO: 489290 - RNA, 24 nt, Human
gaagaauccaguccagucugcagg

SEQ ID NO: 489291 - RNA, 21 nt, Human
gaccccaugaaccaaaccaaa

SEQ ID NO: 489292 - RNA, 20 nt, Human
gccacaggagaaaaugggau

SEQ ID NO: 489293 - RNA, 24 nt, Human
gccuacccauuuuaaucaagcagc

SEQ ID NO: 489294 - RNA, 20 nt, Human
gggcgugagaacaggugagu

SEQ ID NO: 489295 - RNA, 20 nt, Human
gucaguuaccaucauuuugg

SEQ ID NO: 489296 - RNA, 18 nt, Human
gucugcagguggauaaua

SEQ ID NO: 489297 - RNA, 19 nt, Human
uaaaacagggcgugagaac

SEQ ID NO: 489298 - RNA, 20 nt, Human
uaaaaugggaauccaggaac

SEQ ID NO: 489299 - RNA, 22 nt, Human
uacagcauuaucuuaccaaauu

SEQ ID NO: 489300 - RNA, 24 nt, Human
uagauuaaagaaugagccacauga

SEQ ID NO: 489301 - RNA, 25 nt, Human
uauuuguuaauuuuugcaacugagu

SEQ ID NO: 489302 - RNA, 19 nt, Human
ucaagagucagggcaguuu

SEQ ID NO: 489303 - RNA, 18 nt, Human
ucaccaggcugucaccua

SEQ ID NO: 489304 - RNA, 20 nt, Human
ucagaauacuucauauuacu

SEQ ID NO: 489305 - RNA, 24 nt, Human
ucagcaacugcacaaacuccuccc

SEQ ID NO: 489306 - RNA, 21 nt, Human
ucauacauuuauuugaguuuu

SEQ ID NO: 489307 - RNA, 24 nt, Human
ugacuaaacauaaggcauuaacac

SEQ ID NO: 489308 - RNA, 18 nt, Human
ugagaagccuacccauuu

SEQ ID NO: 489309 - RNA, 24 nt, Human
ugaugccacaggagaaaaugggau

SEQ ID NO: 489310 - RNA, 22 nt, Human
ugcagaaacuacaccaaggcug

SEQ ID NO: 489311 - RNA, 23 nt, Human
uggcauuuagcaugacuggcucc

SEQ ID NO: 489312 - RNA, 18 nt, Human
ugggaaaaacuguccaca

SEQ ID NO: 489313 - RNA, 21 nt, Human
ugggaaaaacuguccacagca

SEQ ID NO: 489314 - RNA, 18 nt, Human
ugggcagaauaaaggauc

SEQ ID NO: 489315 - RNA, 22 nt, Human
ugucagcaacugcacaaacucc

SEQ ID NO: 489316 - RNA, 21 nt, Human
uuaaagcagaaaggacuuucu

SEQ ID NO: 489317 - RNA, 19 nt, Human
uugugacaaucaggaggau

SEQ ID NO: 489318 - RNA, 22 nt, Human
uuugaaguaugauccauaggca

SEQ ID NO: 489319 - RNA, 22 nt, Human
uuuuaggaaaguuuugucuguu

SEQ ID NO: 489320 - RNA, 21 nt, Human
aaaaagaaaacacuuaaagaa

SEQ ID NO: 489321 - RNA, 18 nt, Human
aaacagacagugagaaca

SEQ ID NO: 489322 - RNA, 24 nt, Human
aaaugcagaaacuacaccagagcu

SEQ ID NO: 489323 - RNA, 21 nt, Human
aacuucacaaagguaucagcc

SEQ ID NO: 489324 - RNA, 23 nt, Human
aagaagaagcaauuuugaauggu

SEQ ID NO: 489325 - RNA, 24 nt, Human
aagaauuggcaauuuuucaaauaa

SEQ ID NO: 489326 - RNA, 24 nt, Human
acagagcgagauuccaucucaaaa

SEQ ID NO: 489327 - RNA, 20 nt, Human
accacagugaaaccccgucu

SEQ ID NO: 489328 - RNA, 24 nt, Human
accccgucucuacuaaaaauacaa

SEQ ID NO: 489329 - RNA, 24 nt, Human
acugcacuccagccugggcgacag

SEQ ID NO: 489330 - RNA, 26 nt, Human
acugcacuccagccugggcgacagag

SEQ ID NO: 489331 - RNA, 19 nt, Human
agaaaacacuuaaagaauu

SEQ ID NO: 489332 - RNA, 20 nt, Human
agaacuuugggaggcugagg

SEQ ID NO: 489333 - RNA, 23 nt, Human
agacagcagauucucacugaacu

SEQ ID NO: 489334 - RNA, 24 nt, Human
agagaccauaguacauuugaacaa

SEQ ID NO: 489335 - RNA, 24 nt, Human
agccugggcgacagagcgagauuc

SEQ ID NO: 489336 - RNA, 18 nt, Human
agccuugguaauauaacc

SEQ ID NO: 489337 - RNA, 19 nt, Human
agcugauugcaaaugcuuu

SEQ ID NO: 489338 - RNA, 24 nt, Human
aggaagaauaaaaacaacugucug

SEQ ID NO: 489339 - RNA, 18 nt, Human
aggcaggagaauggugug

SEQ ID NO: 489340 - RNA, 24 nt, Human
aggcaggagaauggugugaaccca

SEQ ID NO: 489341 - RNA, 27 nt, Human
aggcaggagaauggugugaacccagga

SEQ ID NO: 489342 - RNA, 20 nt, Human
aggcaggcggaccaugaagu

SEQ ID NO: 489343 - RNA, 24 nt, Human
aggcaggcggaccaugaagucagg

SEQ ID NO: 489344 - RNA, 24 nt, Human
aggcggagcuugcagugaguugag

SEQ ID NO: 489345 - RNA, 19 nt, Human
aggcugaggcaggagaaug

SEQ ID NO: 489346 - RNA, 20 nt, Human
aggcugaggcaggcggacca

SEQ ID NO: 489347 - RNA, 20 nt, Human
aggcugaggcaggcggacca

SEQ ID NO: 489348 - RNA, 24 nt, Human
agucaggagauugagaccacagug

SEQ ID NO: 489349 - RNA, 19 nt, Human
aguccaguggcgugaucuu

SEQ ID NO: 489350 - RNA, 23 nt, Human
aguccaguggcgugaucuuaaag

SEQ ID NO: 489351 - RNA, 24 nt, Human
aucgugccacugcacuccagccug

SEQ ID NO: 489352 - RNA, 18 nt, Human
auguuuuuuuccuucugu

SEQ ID NO: 489353 - RNA, 22 nt, Human
auguuuuuuuccuucuguguuu

SEQ ID NO: 489354 - RNA, 21 nt, Human
auuuuccauaaaucuugaaga

SEQ ID NO: 489355 - RNA, 28 nt, Human
caaauauaacaucccaaucaaagccuug

SEQ ID NO: 489356 - RNA, 24 nt, Human
cacaccuguaaucccagaacuuug

SEQ ID NO: 489357 - RNA, 18 nt, Human
cacagugaaaccccgucu

SEQ ID NO: 489358 - RNA, 19 nt, Human
cacagugaaaccccgucuc

SEQ ID NO: 489359 - RNA, 21 nt, Human
cacagugaaaccccgucucua

SEQ ID NO: 489360 - RNA, 23 nt, Human
caccuguaaucccagaacuuugg

SEQ ID NO: 489361 - RNA, 24 nt, Human
caccuguaaucccagaacuuuggg

SEQ ID NO: 489362 - RNA, 23 nt, Human
cacuccagccugggcgacagagc

SEQ ID NO: 489363 - RNA, 24 nt, Human
cacuccagccugggcgacagagcg

SEQ ID NO: 489364 - RNA, 23 nt, Human
cacuccguuaaucuaucauucuc

SEQ ID NO: 489365 - RNA, 19 nt, Human
cacugcacuccagccuggg

SEQ ID NO: 489366 - RNA, 20 nt, Human
cacugcacuccagccugggc

SEQ ID NO: 489367 - RNA, 22 nt, Human
cacugcacuccagccugggcga

SEQ ID NO: 489368 - RNA, 23 nt, Human
cacugcacuccagccugggcgac

SEQ ID NO: 489369 - RNA, 24 nt, Human
cacugcacuccagccugggcgaca

SEQ ID NO: 489370 - RNA, 24 nt, Human
cagaacuuugggaggcugaggcag

SEQ ID NO: 489371 - RNA, 26 nt, Human
cagaacuuugggaggcugaggcaggc

SEQ ID NO: 489372 - RNA, 21 nt, Human
cagcagauucucacugaacuu

SEQ ID NO: 489373 - RNA, 24 nt, Human
cagcuacucaggaggcugaggcag

SEQ ID NO: 489374 - RNA, 20 nt, Human
ccacugcacuccagccuggg

SEQ ID NO: 489375 - RNA, 20 nt, Human
ccacugcacuccagccuggg

SEQ ID NO: 489376 - RNA, 21 nt, Human
ccacugcacuccagccugggc

SEQ ID NO: 489377 - RNA, 21 nt, Human
ccacugcacuccagccugggc

SEQ ID NO: 489378 - RNA, 23 nt, Human
ccacugcacuccagccugggcga

SEQ ID NO: 489379 - RNA, 24 nt, Human
ccacugcacuccagccugggcgac

SEQ ID NO: 489380 - RNA, 24 nt, Human
ccaugaagucaggagauugagacc

SEQ ID NO: 489381 - RNA, 22 nt, Human
ccugggcgacagagcgagauuc

SEQ ID NO: 489382 - RNA, 19 nt, Human
ccuguagucccagcuacuc

SEQ ID NO: 489383 - RNA, 21 nt, Human
ccuguagucccagcuacucag

SEQ ID NO: 489384 - RNA, 24 nt, Human
cgccuguagucccagcuacucagg

SEQ ID NO: 489385 - RNA, 22 nt, Human
cucacaccuguaaucccagaac

SEQ ID NO: 489386 - RNA, 24 nt, Human
cucacaccuguaaucccagaacuu

SEQ ID NO: 489387 - RNA, 18 nt, Human
cugccugcguguucuccu

SEQ ID NO: 489388 - RNA, 19 nt, Human
cuugaaaugcagaaacuac

SEQ ID NO: 489389 - RNA, 24 nt, Human
cuugcagugaguugagaucgugcc

SEQ ID NO: 489390 - RNA, 22 nt, Human
gaaaaagaaaacacuuaaagaa

SEQ ID NO: 489391 - RNA, 23 nt, Human
gaaaaagaaaacacuuaaagaau

SEQ ID NO: 489392 - RNA, 26 nt, Human
gaaaaagaaaacacuuaaagaauugg

SEQ ID NO: 489393 - RNA, 24 nt, Human
gaagaauaaaaacaacugucugcc

SEQ ID NO: 489394 - RNA, 24 nt, Human
gcacuccagccugggcgacagagc

SEQ ID NO: 489395 - RNA, 22 nt, Human
gcaggagaauggugugaaccca

SEQ ID NO: 489396 - RNA, 24 nt, Human
gcaggcggaccaugaagucaggag

SEQ ID NO: 489397 - RNA, 22 nt, Human
gccacugcacuccagccugggc

SEQ ID NO: 489398 - RNA, 24 nt, Human
gccacugcacuccagccugggcga

SEQ ID NO: 489399 - RNA, 19 nt, Human
gcugggcgcgguggcucac

SEQ ID NO: 489400 - RNA, 24 nt, Human
ggagcuugcagugaguugagaucg

SEQ ID NO: 489401 - RNA, 23 nt, Human
ggcgcgguggcucacaccuguaa

SEQ ID NO: 489402 - RNA, 24 nt, Human
gggcguuguggcaggcgccuguag

SEQ ID NO: 489403 - RNA, 23 nt, Human
gguggcucacaccuguaauccca

SEQ ID NO: 489404 - RNA, 24 nt, Human
gguggcucacaccuguaaucccag

SEQ ID NO: 489405 - RNA, 18 nt, Human
guagggagcaaaaguaaa

SEQ ID NO: 489406 - RNA, 22 nt, Human
guggcaggcgccuguaguccca

SEQ ID NO: 489407 - RNA, 24 nt, Human
uaaaacagacagugagaacaagug

SEQ ID NO: 489408 - RNA, 20 nt, Human
uaaaagagaccauaguacau

SEQ ID NO: 489409 - RNA, 24 nt, Human
uaaagacagcagauucucacugaa

SEQ ID NO: 489410 - RNA, 25 nt, Human
uaaagaugcuguuacugucagccau

SEQ ID NO: 489411 - RNA, 21 nt, Human
uaagguauagauagcuuaaaa

SEQ ID NO: 489412 - RNA, 20 nt, Human
uacauuugaacaaagaguug

SEQ ID NO: 489413 - RNA, 23 nt, Human
uccagccugggcgacagagcgag

SEQ ID NO: 489414 - RNA, 24 nt, Human
uccagccugggcgacagagcgaga

SEQ ID NO: 489415 - RNA, 23 nt, Human
uccaucucaaaaaaaaaaaaaaa

SEQ ID NO: 489416 - RNA, 23 nt, Human
ucgugccacugcacuccagccug

SEQ ID NO: 489417 - RNA, 24 nt, Human
ucucuacuaaaaauacaaaaaauu

SEQ ID NO: 489418 - RNA, 24 nt, Human
ucuugaagaagaagcaauuuugaa

SEQ ID NO: 489419 - RNA, 24 nt, Human
ugaaaugcagaaacuacaccagag

SEQ ID NO: 489420 - RNA, 21 nt, Human
ugaagaagaagcaauuuugaa

SEQ ID NO: 489421 - RNA, 21 nt, Human
ugaauuaccauaaacauauga

SEQ ID NO: 489422 - RNA, 24 nt, Human
ugagaucgugccacugcacuccag

SEQ ID NO: 489423 - RNA, 22 nt, Human
ugaggaagaauaaaaacaacug

SEQ ID NO: 489424 - RNA, 23 nt, Human
ugaggcaggagaauggugugaac

SEQ ID NO: 489425 - RNA, 24 nt, Human
ugaggcaggagaauggugugaacc

SEQ ID NO: 489426 - RNA, 25 nt, Human
ugaggcaggagaauggugugaaccc

SEQ ID NO: 489427 - RNA, 24 nt, Human
ugaggcaggcggaccaugaaguca

SEQ ID NO: 489428 - RNA, 22 nt, Human
ugaguugagaucgugccacugc

SEQ ID NO: 489429 - RNA, 18 nt, Human
ugccugcguguucuccuc

SEQ ID NO: 489430 - RNA, 21 nt, Human
uggcucacaccuguaauccca

SEQ ID NO: 489431 - RNA, 22 nt, Human
uggcucacaccuguaaucccag

SEQ ID NO: 489432 - RNA, 20 nt, Human
ugggaggcugaggcaggcgg

SEQ ID NO: 489433 - RNA, 23 nt, Human
uggugggcaacuucacaaagguc

SEQ ID NO: 489434 - RNA, 24 nt, Human
uguggcaggcgccuguagucccag

SEQ ID NO: 489435 - RNA, 25 nt, Human
uuagccgggcguuguggcaggcgcc

SEQ ID NO: 489436 - RNA, 25 nt, Human
uuccaucucaaaaaaaaaaaaaaau

SEQ ID NO: 489437 - RNA, 22 nt, Human
uugcagugaguugagaucgugc

SEQ ID NO: 489438 - RNA, 18 nt, Human
uuuuuuuuuuuuuuuuug

SEQ ID NO: 489439 - RNA, 24 nt, Human
aaaccagauauucgaauuacaagg

SEQ ID NO: 489440 - RNA, 19 nt, Human
acccaggccucacagcccg

SEQ ID NO: 489441 - RNA, 19 nt, Human
accugcuccucuagcccgc

SEQ ID NO: 489442 - RNA, 19 nt, Human
agccacaagcucuaaaguc

SEQ ID NO: 489443 - RNA, 22 nt, Human
aggccucacagcccgcgaguca

SEQ ID NO: 489444 - RNA, 24 nt, Human
aggcggccuccacuccgagcggcc

SEQ ID NO: 489445 - RNA, 23 nt, Human
aucauuuaaaaccagauauucga

SEQ ID NO: 489446 - RNA, 21 nt, Human
caagcucuaaagucuggaaag

SEQ ID NO: 489447 - RNA, 22 nt, Human
cacagaacagguagaaaugaga

SEQ ID NO: 489448 - RNA, 27 nt, Human
caccuuuaacauucaagccacaagcuc

SEQ ID NO: 489449 - RNA, 19 nt, Human
cagaaaauagccuccaaug

SEQ ID NO: 489450 - RNA, 18 nt, Human
cagcccgcgagucagcga

SEQ ID NO: 489451 - RNA, 21 nt, Human
cauauaccuuaacauuugggg

SEQ ID NO: 489452 - RNA, 24 nt, Human
ccaaaaaaucuucacauguaccug

SEQ ID NO: 489453 - RNA, 19 nt, Human
ccaacacagaacagguaga

SEQ ID NO: 489454 - RNA, 20 nt, Human
cccccaggcggccuccacuc

SEQ ID NO: 489455 - RNA, 18 nt, Human
ccucuaucauuuaaaacc

SEQ ID NO: 489456 - RNA, 19 nt, Human
cgacgguuacgaaaccggc

SEQ ID NO: 489457 - RNA, 19 nt, Human
cuucacauguaccugcucc

SEQ ID NO: 489458 - RNA, 21 nt, Human
gcccgagccgacccaggccuc

SEQ ID NO: 489459 - RNA, 30 nt, Human
ucccuugccaacacagaacagguagaaauu

SEQ ID NO: 489460 - RNA, 19 nt, Human
uccgcccguuccgcagccg

SEQ ID NO: 489461 - RNA, 21 nt, Human
uccgcccguuccgcagccgcg

SEQ ID NO: 489462 - RNA, 22 nt, Human
ucuucacauguaccugcuccuc

SEQ ID NO: 489463 - RNA, 21 nt, Human
ugagagcagggugaucaaugg

SEQ ID NO: 489464 - RNA, 18 nt, Human
ugccaaaaaaucuucaca

SEQ ID NO: 489465 - RNA, 21 nt, Human
uuaacauuugggggauuuuga

SEQ ID NO: 489466 - RNA, 24 nt, Human
uucccacaaaaaccucuaucauuu

SEQ ID NO: 489467 - RNA, 19 nt, Human
uucgaauuacaaggcuaac

SEQ ID NO: 489468 - RNA, 24 nt, Human
uuuaaaaccagauauucgaauuac

SEQ ID NO: 489469 - RNA, 22 nt, Human
accccagagaaaagaccuacaa

SEQ ID NO: 489470 - RNA, 19 nt, Human
cagauuaccagaaggcaaa

SEQ ID NO: 489471 - RNA, 19 nt, Human
gaucuuccuuuucucgccc

SEQ ID NO: 489472 - RNA, 19 nt, Human
gggagugaaaaccuacaga

SEQ ID NO: 489473 - RNA, 22 nt, Human
uacagguacagacagguagggg

SEQ ID NO: 489474 - RNA, 18 nt, Human
uaggaaagggcucagaug

SEQ ID NO: 489475 - RNA, 22 nt, Human
uauugaaggauucuucuuccag

SEQ ID NO: 489476 - RNA, 18 nt, Human
ucucgcccugcucucaga

SEQ ID NO: 489477 - RNA, 19 nt, Human
ugccuggacuaggaaaggg

SEQ ID NO: 489478 - RNA, 21 nt, Human
uggagacuccacgggacugca

SEQ ID NO: 489479 - RNA, 18 nt, Human
aaaaggcaacaugaaaau

SEQ ID NO: 489480 - RNA, 24 nt, Human
aacacucuagcgaucccaauuccu

SEQ ID NO: 489481 - RNA, 28 nt, Human
aaggaaacacagugacauauuacaagau

SEQ ID NO: 489482 - RNA, 23 nt, Human
acaaaccugaguagucacuucca

SEQ ID NO: 489483 - RNA, 22 nt, Human
acagggcacuccccaguucucc

SEQ ID NO: 489484 - RNA, 18 nt, Human
accaccaacaaaaauuau

SEQ ID NO: 489485 - RNA, 21 nt, Human
acccucaucuccggcucccau

SEQ ID NO: 489486 - RNA, 23 nt, Human
agggcgggcgccgggcggggggc

SEQ ID NO: 489487 - RNA, 22 nt, Human
auguacaauacauucaccacca

SEQ ID NO: 489488 - RNA, 23 nt, Human
caaaaauuauuuuaaaaggcaac

SEQ ID NO: 489489 - RNA, 22 nt, Human
caaauauauaccugaguuuagc

SEQ ID NO: 489490 - RNA, 28 nt, Human
caacaugaaaauucuguaaacuggaccc

SEQ ID NO: 489491 - RNA, 24 nt, Human
cacagauacaacagauaauuccag

SEQ ID NO: 489492 - RNA, 21 nt, Human
caccagcaugagagagcagcc

SEQ ID NO: 489493 - RNA, 21 nt, Human
cacccacccuucccacuuuau

SEQ ID NO: 489494 - RNA, 22 nt, Human
cacuaaggaaacacagugacau

SEQ ID NO: 489495 - RNA, 25 nt, Human
cagccuccgcgcgguccucggcggg

SEQ ID NO: 489496 - RNA, 22 nt, Human
cagccugucuuccgggcugaag

SEQ ID NO: 489497 - RNA, 21 nt, Human
caguucuccacauuccagucu

SEQ ID NO: 489498 - RNA, 19 nt, Human
cccaccaguuaggaccccc

SEQ ID NO: 489499 - RNA, 19 nt, Human
cccacgaggagggggcggg

SEQ ID NO: 489500 - RNA, 18 nt, Human
ccccacccacccuuccca

SEQ ID NO: 489501 - RNA, 21 nt, Human
cccccauuucuuccgcauccc

SEQ ID NO: 489502 - RNA, 20 nt, Human
cccgcgccacaacaacaacc

SEQ ID NO: 489503 - RNA, 23 nt, Human
ccgccgcggcagcgccgcagccu

SEQ ID NO: 489504 - RNA, 20 nt, Human
ccgcucggcgagugcaggag

SEQ ID NO: 489505 - RNA, 20 nt, Human
cgaccugggacucccgccgc

SEQ ID NO: 489506 - RNA, 20 nt, Human
cgccgcggcagcgccgcagc

SEQ ID NO: 489507 - RNA, 21 nt, Human
cgccgcggcagcgccgcagcc

SEQ ID NO: 489508 - RNA, 21 nt, Human
cgcugcccgcgcucugcccgc

SEQ ID NO: 489509 - RNA, 20 nt, Human
cggcggccgcccccaguccc

SEQ ID NO: 489510 - RNA, 20 nt, Human
cuaaggaaacacagugacau

SEQ ID NO: 489511 - RNA, 20 nt, Human
cucaggauuuggaaaaguca

SEQ ID NO: 489512 - RNA, 22 nt, Human
cucaggauuuggaaaagucauc

SEQ ID NO: 489513 - RNA, 23 nt, Human
cuccucccgcugcugccgccgcu

SEQ ID NO: 489514 - RNA, 24 nt, Human
cucgcugcccgcgcucugcccgcc

SEQ ID NO: 489515 - RNA, 19 nt, Human
cugaaggcuggcuggccac

SEQ ID NO: 489516 - RNA, 22 nt, Human
cugcccgcgccacaacaacaac

SEQ ID NO: 489517 - RNA, 20 nt, Human
cugcggcggcggccgccccc

SEQ ID NO: 489518 - RNA, 20 nt, Human
cuggcuggccacuaaggaaa

SEQ ID NO: 489519 - RNA, 23 nt, Human
gacccccauuucuuccgcauccc

SEQ ID NO: 489520 - RNA, 20 nt, Human
gagaaacagauggggcuagg

SEQ ID NO: 489521 - RNA, 19 nt, Human
gagcagccugucuuccggg

SEQ ID NO: 489522 - RNA, 24 nt, Human
gagcagucugccuccaauggagac

SEQ ID NO: 489523 - RNA, 20 nt, Human
gaggagggggcggggcugcc

SEQ ID NO: 489524 - RNA, 20 nt, Human
gaguguccuuuuagggcccc

SEQ ID NO: 489525 - RNA, 20 nt, Human
gaucccuggccgaggaccuu

SEQ ID NO: 489526 - RNA, 20 nt, Human
gaugaggacgauucaucuuc

SEQ ID NO: 489527 - RNA, 24 nt, Human
gccccucgcugcccgcgcucugcc

SEQ ID NO: 489528 - RNA, 18 nt, Human
gcggggcugcccgcgcca

SEQ ID NO: 489529 - RNA, 22 nt, Human
gcggggggcggcggcgcggggg

SEQ ID NO: 489530 - RNA, 23 nt, Human
gcucaucaaaguuuaaaagcacc

SEQ ID NO: 489531 - RNA, 18 nt, Human
gcugcugccgccgcucgg

SEQ ID NO: 489532 - RNA, 22 nt, Human
ggaaggaaggaaggccuuuagc

SEQ ID NO: 489533 - RNA, 20 nt, Human
ggagaaacagauggggcuag

SEQ ID NO: 489534 - RNA, 18 nt, Human
gggcgccgggcggggggc

SEQ ID NO: 489535 - RNA, 22 nt, Human
gggcgccgggcggggggcggcg

SEQ ID NO: 489536 - RNA, 25 nt, Human
gggcggggggcggcggcgcgggggc

SEQ ID NO: 489537 - RNA, 25 nt, Human
ggggacagguguucucucccccugg

SEQ ID NO: 489538 - RNA, 25 nt, Human
ggggcggaggggccggacgcggggc

SEQ ID NO: 489539 - RNA, 19 nt, Human
gguggcaaaaucaggaagg

SEQ ID NO: 489540 - RNA, 23 nt, Human
gguguucucucucaggcugacug

SEQ ID NO: 489541 - RNA, 23 nt, Human
gugaagggguggagcaggugaug

SEQ ID NO: 489542 - RNA, 22 nt, Human
uaaaaugguuuccuaucacaga

SEQ ID NO: 489543 - RNA, 19 nt, Human
uacaaaccugaguagucac

SEQ ID NO: 489544 - RNA, 18 nt, Human
uacaauacauucaccacc

SEQ ID NO: 489545 - RNA, 24 nt, Human
uacaauacauucaccaccaacaaa

SEQ ID NO: 489546 - RNA, 24 nt, Human
uagggcugguggcaaaaucaggaa

SEQ ID NO: 489547 - RNA, 25 nt, Human
uauaaucgaguccccgccggagaaa

SEQ ID NO: 489548 - RNA, 18 nt, Human
uauacaaaccugaguagu

SEQ ID NO: 489549 - RNA, 21 nt, Human
uauacccccucccccaaguuu

SEQ ID NO: 489550 - RNA, 18 nt, Human
uauacugaaauauuccua

SEQ ID NO: 489551 - RNA, 21 nt, Human
uauuuuaaaucaccaugacug

SEQ ID NO: 489552 - RNA, 24 nt, Human
uccaagaacuuguucuugauagcu

SEQ ID NO: 489553 - RNA, 23 nt, Human
uccccacccacccuucccacuuu

SEQ ID NO: 489554 - RNA, 25 nt, Human
ucccgcggcugcggcggcggccgcc

SEQ ID NO: 489555 - RNA, 21 nt, Human
ucccgcugcugccgccgcucg

SEQ ID NO: 489556 - RNA, 19 nt, Human
uccgcauccccacccaccc

SEQ ID NO: 489557 - RNA, 19 nt, Human
uccgcauccccacccaccc

SEQ ID NO: 489558 - RNA, 22 nt, Human
uccgcauccccacccacccuuc

SEQ ID NO: 489559 - RNA, 21 nt, Human
uccucccgcugcugccgccgc

SEQ ID NO: 489560 - RNA, 21 nt, Human
ucucaggauuuggaaaaguca

SEQ ID NO: 489561 - RNA, 18 nt, Human
ucucucaggcugacugga

SEQ ID NO: 489562 - RNA, 23 nt, Human
ucuugaguauacccccuccccca

SEQ ID NO: 489563 - RNA, 20 nt, Human
ugaaacacucuagcgauccc

SEQ ID NO: 489564 - RNA, 24 nt, Human
ugcaggagccgagggcgggcgccg

SEQ ID NO: 489565 - RNA, 21 nt, Human
ugccuucuagaucacaguccu

SEQ ID NO: 489566 - RNA, 22 nt, Human
uggcaaaaucaggaagggacac

SEQ ID NO: 489567 - RNA, 27 nt, Human
ugggccaccagcaugagagagcagccu

SEQ ID NO: 489568 - RNA, 18 nt, Human
uggggcuaggggcggagg

SEQ ID NO: 489569 - RNA, 22 nt, Human
uggggcuaggggcggaggggcc

SEQ ID NO: 489570 - RNA, 19 nt, Human
uuagggcccgugacuggcu

SEQ ID NO: 489571 - RNA, 21 nt, Human
uugcuuggggcucauuuccuc

SEQ ID NO: 489572 - RNA, 19 nt, Human
uuuccauugcuuggggcuc

SEQ ID NO: 489573 - RNA, 20 nt, Human
aagcccugaccugagcccag

SEQ ID NO: 489574 - RNA, 21 nt, Human
aagugaccaguaaugccacac

SEQ ID NO: 489575 - RNA, 21 nt, Human
acccccucaccuccaccgcac

SEQ ID NO: 489576 - RNA, 22 nt, Human
acccccucaccuccaccgcacu

SEQ ID NO: 489577 - RNA, 21 nt, Human
acugaaaugagaaggacacug

SEQ ID NO: 489578 - RNA, 22 nt, Human
aggcacgugggaacugggccca

SEQ ID NO: 489579 - RNA, 23 nt, Human
aggccagagcccagccaauggga

SEQ ID NO: 489580 - RNA, 25 nt, Human
aggguggcaagggaaccaagcccug

SEQ ID NO: 489581 - RNA, 23 nt, Human
auggggcagcaagaaggguggca

SEQ ID NO: 489582 - RNA, 24 nt, Human
auggggcagcaagaaggguggcaa

SEQ ID NO: 489583 - RNA, 19 nt, Human
caaaggcucugcacagaca

SEQ ID NO: 489584 - RNA, 20 nt, Human
caaaggcucugcacagacaa

SEQ ID NO: 489585 - RNA, 20 nt, Human
caagcccugaccugagccca

SEQ ID NO: 489586 - RNA, 22 nt, Human
caagugaccaguaaugccacac

SEQ ID NO: 489587 - RNA, 26 nt, Human
cacagacauccacaguauuccacacu

SEQ ID NO: 489588 - RNA, 18 nt, Human
cagacauccacaguauuc

SEQ ID NO: 489589 - RNA, 25 nt, Human
ccaagcccugaccugagcccaguga

SEQ ID NO: 489590 - RNA, 18 nt, Human
cccacagguccaggcuca

SEQ ID NO: 489591 - RNA, 22 nt, Human
cucacccccucaccuccaccgc

SEQ ID NO: 489592 - RNA, 20 nt, Human
cugagcccagugaucaggcc

SEQ ID NO: 489593 - RNA, 18 nt, Human
cugggcccagaaaauucc

SEQ ID NO: 489594 - RNA, 23 nt, Human
gaacugggcccagaaaauuccaa

SEQ ID NO: 489595 - RNA, 23 nt, Human
gaccugagcccagugaucaggcc

SEQ ID NO: 489596 - RNA, 18 nt, Human
gggcccagaaaauuccaa

SEQ ID NO: 489597 - RNA, 19 nt, Human
gguccaggcucacccccuc

SEQ ID NO: 489598 - RNA, 22 nt, Human
uaaaaaaaaagccccacaucuc

SEQ ID NO: 489599 - RNA, 25 nt, Human
uaaaaaguagcaucugguguuaaga

SEQ ID NO: 489600 - RNA, 20 nt, Human
uacaaaaugcuacccagcag

SEQ ID NO: 489601 - RNA, 23 nt, Human
uacccagcagggaaaaagaguca

SEQ ID NO: 489602 - RNA, 21 nt, Human
uauuccacacugccuccccca

SEQ ID NO: 489603 - RNA, 24 nt, Human
ucacccccucaccuccaccgcacu

SEQ ID NO: 489604 - RNA, 18 nt, Human
ucaggccagagcccagcc

SEQ ID NO: 489605 - RNA, 22 nt, Human
uccacaguauuccacacugccu

SEQ ID NO: 489606 - RNA, 23 nt, Human
uccaggcucacccccucaccucc

SEQ ID NO: 489607 - RNA, 21 nt, Human
ucuccgggcaauaaacuacaa

SEQ ID NO: 489608 - RNA, 19 nt, Human
ugagaaggacacugaggca

SEQ ID NO: 489609 - RNA, 18 nt, Human
ugaggcacacaggggaag

SEQ ID NO: 489610 - RNA, 19 nt, Human
ugagguuagacugccacga

SEQ ID NO: 489611 - RNA, 23 nt, Human
ugagguuagacugccacgaaagg

SEQ ID NO: 489612 - RNA, 22 nt, Human
ugcuacccagcagggaaaaaga

SEQ ID NO: 489613 - RNA, 21 nt, Human
uggcaagggaaccaagcccug

SEQ ID NO: 489614 - RNA, 21 nt, Human
ugggcccagaaaauuccaaaa

SEQ ID NO: 489615 - RNA, 21 nt, Human
uggggcagcaagaaggguggc

SEQ ID NO: 489616 - RNA, 24 nt, Human
uuaugauuauuuuauuuaaaaaaa

SEQ ID NO: 489617 - RNA, 26 nt, Human
aaaacaacacuacacacacagagaca

SEQ ID NO: 489618 - RNA, 22 nt, Human
aaaauaugucacucaaagccaa

SEQ ID NO: 489619 - RNA, 20 nt, Human
aaagagaaggaaaaaaguga

SEQ ID NO: 489620 - RNA, 21 nt, Human
aaccagaccagaggugggagg

SEQ ID NO: 489621 - RNA, 19 nt, Human
aacccaaaaacaaggaccc

SEQ ID NO: 489622 - RNA, 20 nt, Human
aagaaaaacacagcagagga

SEQ ID NO: 489623 - RNA, 18 nt, Human
aagagccacaaacucaaa

SEQ ID NO: 489624 - RNA, 21 nt, Human
aagagggggcuucaaguggga

SEQ ID NO: 489625 - RNA, 19 nt, Human
aagcaagaagcagagguac

SEQ ID NO: 489626 - RNA, 23 nt, Human
aagcccccaaaacaguuguaaga

SEQ ID NO: 489627 - RNA, 22 nt, Human
acacacagagacauacacuuug

SEQ ID NO: 489628 - RNA, 24 nt, Human
acagugcccugccuuggcugucag

SEQ ID NO: 489629 - RNA, 22 nt, Human
accaaaaaccuaacaaacagua

SEQ ID NO: 489630 - RNA, 22 nt, Human
accacagccuaaaagaggcugg

SEQ ID NO: 489631 - RNA, 22 nt, Human
acuacacacacagagacauaca

SEQ ID NO: 489632 - RNA, 23 nt, Human
acuacacacacagagacauacac

SEQ ID NO: 489633 - RNA, 20 nt, Human
agaaaaacacagcagaggaa

SEQ ID NO: 489634 - RNA, 19 nt, Human
agaaggaaaaaagugauaa

SEQ ID NO: 489635 - RNA, 25 nt, Human
agacccuguaauaacacuggcacca

SEQ ID NO: 489636 - RNA, 22 nt, Human
agagagaggccaagccaauggc

SEQ ID NO: 489637 - RNA, 24 nt, Human
agaggaagggacugacccucugag

SEQ ID NO: 489638 - RNA, 20 nt, Human
agagggaaaguucugcagcc

SEQ ID NO: 489639 - RNA, 23 nt, Human
agagggaggaacagagagaggcc

SEQ ID NO: 489640 - RNA, 24 nt, Human
agcagagaaacacagcaaagcugg

SEQ ID NO: 489641 - RNA, 21 nt, Human
agcaggagauggccauccaaa

SEQ ID NO: 489642 - RNA, 20 nt, Human
agccaauggcugauacuccg

SEQ ID NO: 489643 - RNA, 20 nt, Human
agccacaaacucaaaagaau

SEQ ID NO: 489644 - RNA, 21 nt, Human
agccaguggccauggcaaaug

SEQ ID NO: 489645 - RNA, 18 nt, Human
agcccaggcacccaagcc

SEQ ID NO: 489646 - RNA, 19 nt, Human
agccuaaaagaggcuggca

SEQ ID NO: 489647 - RNA, 21 nt, Human
agcuauuacucuaagcccaga

SEQ ID NO: 489648 - RNA, 21 nt, Human
aggaagccccugacuugcuga

SEQ ID NO: 489649 - RNA, 18 nt, Human
aggaaggacaggugggga

SEQ ID NO: 489650 - RNA, 22 nt, Human
aggacacccuggcccuuagccc

SEQ ID NO: 489651 - RNA, 21 nt, Human
aggagaggagucagugggggc

SEQ ID NO: 489652 - RNA, 23 nt, Human
aggauaggagaagagaggagagg

SEQ ID NO: 489653 - RNA, 21 nt, Human
aggcagaaaagaggagggugg

SEQ ID NO: 489654 - RNA, 24 nt, Human
agggcuuucaagagccacaaacuc

SEQ ID NO: 489655 - RNA, 23 nt, Human
aggggaguaccugggcagcuccc

SEQ ID NO: 489656 - RNA, 21 nt, Human
agggggcagggccuccccaga

SEQ ID NO: 489657 - RNA, 24 nt, Human
aggggucaucgugacuggggcagg

SEQ ID NO: 489658 - RNA, 22 nt, Human
agguagaagacaaggggguugg

SEQ ID NO: 489659 - RNA, 18 nt, Human
augcucacucacccaaga

SEQ ID NO: 489660 - RNA, 22 nt, Human
caaaacaguuguaagagggggc

SEQ ID NO: 489661 - RNA, 22 nt, Human
caaagggccacaggguggacac

SEQ ID NO: 489662 - RNA, 23 nt, Human
caacacuacacacacagagacau

SEQ ID NO: 489663 - RNA, 19 nt, Human
caagaaaaacacagcagag

SEQ ID NO: 489664 - RNA, 20 nt, Human
caagaaaaacacagcagagg

SEQ ID NO: 489665 - RNA, 25 nt, Human
caagcccccaaaacaguuguaagag

SEQ ID NO: 489666 - RNA, 21 nt, Human
caaguuucacccccaccacau

SEQ ID NO: 489667 - RNA, 23 nt, Human
caauagaaggggggcagaucagg

SEQ ID NO: 489668 - RNA, 23 nt, Human
cacaccgacuguaagugcacagu

SEQ ID NO: 489669 - RNA, 21 nt, Human
caccaaaaaccuaacaaacag

SEQ ID NO: 489670 - RNA, 23 nt, Human
caccaaaccccagcuggagccag

SEQ ID NO: 489671 - RNA, 25 nt, Human
caccaaagcuauuacucuaagccca

SEQ ID NO: 489672 - RNA, 24 nt, Human
caccaccucacuuucugaucuaca

SEQ ID NO: 489673 - RNA, 24 nt, Human
cacccagcccaggcacccaagccc

SEQ ID NO: 489674 - RNA, 20 nt, Human
caccguuaacugcuggucuc

SEQ ID NO: 489675 - RNA, 18 nt, Human
cacuucccuccuucuucc

SEQ ID NO: 489676 - RNA, 21 nt, Human
cagaacuagaauccacaucuu

SEQ ID NO: 489677 - RNA, 23 nt, Human
cagagauuuuacagucagggagg

SEQ ID NO: 489678 - RNA, 24 nt, Human
cagcuagcucucuuucacaaaacc

SEQ ID NO: 489679 - RNA, 25 nt, Human
cagcuguucccuccccgccaacccc

SEQ ID NO: 489680 - RNA, 23 nt, Human
caggggaagaaggcagaaaaaaa

SEQ ID NO: 489681 - RNA, 21 nt, Human
cagguccacggagaaaucuca

SEQ ID NO: 489682 - RNA, 19 nt, Human
cagugcccugccuuggcug

SEQ ID NO: 489683 - RNA, 21 nt, Human
cauccaggaaacccaccaaag

SEQ ID NO: 489684 - RNA, 21 nt, Human
ccaaaaacaaggacccgugcc

SEQ ID NO: 489685 - RNA, 23 nt, Human
ccaaagcuauuacucuaagccca

SEQ ID NO: 489686 - RNA, 19 nt, Human
ccacacccagcccaggcac

SEQ ID NO: 489687 - RNA, 22 nt, Human
ccaccaaaaaccuaacaaacag

SEQ ID NO: 489688 - RNA, 18 nt, Human
ccaccucacuuucugauc

SEQ ID NO: 489689 - RNA, 23 nt, Human
ccagaauuggccaaguugccauc

SEQ ID NO: 489690 - RNA, 20 nt, Human
ccagaggugggaggucacca

SEQ ID NO: 489691 - RNA, 22 nt, Human
ccagcccaggcacccaagcccu

SEQ ID NO: 489692 - RNA, 19 nt, Human
ccagcuagcucucuuucac

SEQ ID NO: 489693 - RNA, 19 nt, Human
ccaggcccugccccacacc

SEQ ID NO: 489694 - RNA, 21 nt, Human
ccaggcccugccccacaccca

SEQ ID NO: 489695 - RNA, 19 nt, Human
ccaggcucuaaccgccagc

SEQ ID NO: 489696 - RNA, 22 nt, Human
cccaaaaacaaggacccgugcc

SEQ ID NO: 489697 - RNA, 24 nt, Human
cccaacuucacauccauccaggaa

SEQ ID NO: 489698 - RNA, 18 nt, Human
cccacacccagcccaggc

SEQ ID NO: 489699 - RNA, 23 nt, Human
cccacacccagcccaggcaccca

SEQ ID NO: 489700 - RNA, 24 nt, Human
cccagaaccuugaguacaaucaaa

SEQ ID NO: 489701 - RNA, 20 nt, Human
ccccacacccagcccaggca

SEQ ID NO: 489702 - RNA, 24 nt, Human
ccccacacccagcccaggcacccc

SEQ ID NO: 489703 - RNA, 23 nt, Human
ccccgccaaccccgggcgggcga

SEQ ID NO: 489704 - RNA, 19 nt, Human
cccugaaaaggguuaccuc

SEQ ID NO: 489705 - RNA, 20 nt, Human
cccugccccacacccagccc

SEQ ID NO: 489706 - RNA, 24 nt, Human
ccgccuccccagcaguggggacuc

SEQ ID NO: 489707 - RNA, 19 nt, Human
ccggccuucucugcugggg

SEQ ID NO: 489708 - RNA, 20 nt, Human
ccggccuucucugcuggggc

SEQ ID NO: 489709 - RNA, 23 nt, Human
ccucccaccaaaaaccuaacaaa

SEQ ID NO: 489710 - RNA, 21 nt, Human
ccuccccagcaguggggacuc

SEQ ID NO: 489711 - RNA, 21 nt, Human
ccuccggccuucucugcuggg

SEQ ID NO: 489712 - RNA, 21 nt, Human
ccucugagcacacagugguug

SEQ ID NO: 489713 - RNA, 22 nt, Human
ccugagcugagaagagaggagc

SEQ ID NO: 489714 - RNA, 18 nt, Human
ccuucuuccaggcucuaa

SEQ ID NO: 489715 - RNA, 20 nt, Human
cgagcagcuguugguaccca

SEQ ID NO: 489716 - RNA, 21 nt, Human
cgccaaccccgggcgggcgag

SEQ ID NO: 489717 - RNA, 18 nt, Human
cuaagcccagauccgacc

SEQ ID NO: 489718 - RNA, 25 nt, Human
cucaaagccaaugagugacagaauc

SEQ ID NO: 489719 - RNA, 19 nt, Human
cucacuuucugaucuacac

SEQ ID NO: 489720 - RNA, 23 nt, Human
cuucaaccuuagagaucacucau

SEQ ID NO: 489721 - RNA, 22 nt, Human
cuuccaggcucuaaccgccagc

SEQ ID NO: 489722 - RNA, 25 nt, Human
cuucugcuccaagcccccaaaacag

SEQ ID NO: 489723 - RNA, 22 nt, Human
gaagcacagauugugcauggag

SEQ ID NO: 489724 - RNA, 22 nt, Human
gaagcuuuaggggucaucguga

SEQ ID NO: 489725 - RNA, 23 nt, Human
gacaauggccacuaaccacagcc

SEQ ID NO: 489726 - RNA, 22 nt, Human
gaggaggcucaagagaacucug

SEQ ID NO: 489727 - RNA, 18 nt, Human
gaguauuuccuggccuug

SEQ ID NO: 489728 - RNA, 20 nt, Human
gcaaagcaagaagcagaggu

SEQ ID NO: 489729 - RNA, 23 nt, Human
gcaacaaaaguugaaagcacgga

SEQ ID NO: 489730 - RNA, 21 nt, Human
gcagaaaagaggaggguggug

SEQ ID NO: 489731 - RNA, 24 nt, Human
gcaugggacaauggccacuaacca

SEQ ID NO: 489732 - RNA, 23 nt, Human
gccccacacccagcccaggcacc

SEQ ID NO: 489733 - RNA, 19 nt, Human
gccuuggcccuagugagac

SEQ ID NO: 489734 - RNA, 21 nt, Human
gccuuggcccuagugagacuc

SEQ ID NO: 489735 - RNA, 24 nt, Human
gccuuguuagcugcuguccuccug

SEQ ID NO: 489736 - RNA, 24 nt, Human
gcuccaagcccccaaaacaguugu

SEQ ID NO: 489737 - RNA, 20 nt, Human
gcuggggcuucacacaccca

SEQ ID NO: 489738 - RNA, 24 nt, Human
gcugugccaggcccugccccacac

SEQ ID NO: 489739 - RNA, 21 nt, Human
gcuucuugacauauccaggga

SEQ ID NO: 489740 - RNA, 21 nt, Human
ggaaaguggguucugggucaa

SEQ ID NO: 489741 - RNA, 20 nt, Human
ggaaauaaaaauaugucacu

SEQ ID NO: 489742 - RNA, 22 nt, Human
ggacucaagaaaaacacagcag

SEQ ID NO: 489743 - RNA, 21 nt, Human
ggaggaacagagagaggccaa

SEQ ID NO: 489744 - RNA, 20 nt, Human
ggaguguaaacauuuucccc

SEQ ID NO: 489745 - RNA, 18 nt, Human
ggcaggggaagaaggcag

SEQ ID NO: 489746 - RNA, 21 nt, Human
ggccacuaaccacagccuaaa

SEQ ID NO: 489747 - RNA, 18 nt, Human
ggcccaugggaggcccaa

SEQ ID NO: 489748 - RNA, 20 nt, Human
ggccgaggggagccggggcc

SEQ ID NO: 489749 - RNA, 22 nt, Human
ggcgggggcuuggccugggugc

SEQ ID NO: 489750 - RNA, 21 nt, Human
ggcuuggccugggugcugagu

SEQ ID NO: 489751 - RNA, 20 nt, Human
gggaggucaccaccucacuc

SEQ ID NO: 489752 - RNA, 19 nt, Human
gggcaaaggaagcuuuagg

SEQ ID NO: 489753 - RNA, 22 nt, Human
gggcagggccuccccagaucuc

SEQ ID NO: 489754 - RNA, 18 nt, Human
gggcuucacacacccagu

SEQ ID NO: 489755 - RNA, 22 nt, Human
ggggaagugagugcaaggacuc

SEQ ID NO: 489756 - RNA, 20 nt, Human
ggggcucuggggccgcccag

SEQ ID NO: 489757 - RNA, 21 nt, Human
ggucaucgugacuggggcagg

SEQ ID NO: 489758 - RNA, 24 nt, Human
ggugacuggggcugaacugggggc

SEQ ID NO: 489759 - RNA, 21 nt, Human
guacagagcagggaauguucu

SEQ ID NO: 489760 - RNA, 23 nt, Human
guaccugggcagcucccaggggc

SEQ ID NO: 489761 - RNA, 19 nt, Human
gucaagccuucugccccuc

SEQ ID NO: 489762 - RNA, 24 nt, Human
gugggcaaagcaagaagcagaggu

SEQ ID NO: 489763 - RNA, 23 nt, Human
uaaaaauaugucacucaaagcca

SEQ ID NO: 489764 - RNA, 18 nt, Human
uaaccagaccagaggugg

SEQ ID NO: 489765 - RNA, 25 nt, Human
uaagugugaaauccagccagcuauu

SEQ ID NO: 489766 - RNA, 21 nt, Human
uacacuacauaaaacuuccca

SEQ ID NO: 489767 - RNA, 20 nt, Human
uacccacccagggcccaggc

SEQ ID NO: 489768 - RNA, 23 nt, Human
uagaaggggggcagaucaggggg

SEQ ID NO: 489769 - RNA, 20 nt, Human
uauugaggaagauccugggu

SEQ ID NO: 489770 - RNA, 21 nt, Human
ucaacccaaaaacaaggaccc

SEQ ID NO: 489771 - RNA, 21 nt, Human
ucaaugagaggaagagggaaa

SEQ ID NO: 489772 - RNA, 20 nt, Human
ucacagccucccaccaaaaa

SEQ ID NO: 489773 - RNA, 19 nt, Human
ucacugagauuagguagca

SEQ ID NO: 489774 - RNA, 21 nt, Human
uccauccaggaaacccaccaa

SEQ ID NO: 489775 - RNA, 18 nt, Human
ucccuccccgccaacccc

SEQ ID NO: 489776 - RNA, 24 nt, Human
ucccugagcugagaagagaggagc

SEQ ID NO: 489777 - RNA, 25 nt, Human
uccgcagacccuguaauaacacugg

SEQ ID NO: 489778 - RNA, 20 nt, Human
ucucgagauucugagcccag

SEQ ID NO: 489779 - RNA, 21 nt, Human
ucugcagccugccuuggcccc

SEQ ID NO: 489780 - RNA, 24 nt, Human
ucugcagccugccuuggcccuagu

SEQ ID NO: 489781 - RNA, 19 nt, Human
ucugcagcugugccaggcc

SEQ ID NO: 489782 - RNA, 21 nt, Human
ugaaagcacggagguagaaau

SEQ ID NO: 489783 - RNA, 23 nt, Human
ugaaagcacggagguagaaaugc

SEQ ID NO: 489784 - RNA, 22 nt, Human
ugacagaagguagaagacaagg

SEQ ID NO: 489785 - RNA, 23 nt, Human
ugagaaaacaggcccaggaaaua

SEQ ID NO: 489786 - RNA, 24 nt, Human
ugagagcaugaggaggcucaagag

SEQ ID NO: 489787 - RNA, 26 nt, Human
ugagcacacagugguugacccacaug

SEQ ID NO: 489788 - RNA, 23 nt, Human
ugaggaggcucaagagaacucug

SEQ ID NO: 489789 - RNA, 18 nt, Human
ugagggacuggaagcaca

SEQ ID NO: 489790 - RNA, 20 nt, Human
ugaggguggagggaagugag

SEQ ID NO: 489791 - RNA, 25 nt, Human
ugaggguggagggaagugaguauuu

SEQ ID NO: 489792 - RNA, 19 nt, Human
ugcagaaggacacccuggc

SEQ ID NO: 489793 - RNA, 19 nt, Human
uggaagcacagauugugca

SEQ ID NO: 489794 - RNA, 20 nt, Human
uggaagcacagauugugcau

SEQ ID NO: 489795 - RNA, 24 nt, Human
ugggaggcgggggcuuggccuggg

SEQ ID NO: 489796 - RNA, 24 nt, Human
ugggaggucaccaccucacuuucu

SEQ ID NO: 489797 - RNA, 18 nt, Human
uggggacuaacagagagg

SEQ ID NO: 489798 - RNA, 22 nt, Human
uggggacucucaacccaaaaac

SEQ ID NO: 489799 - RNA, 26 nt, Human
uggggacucucaacccaaaaagggag

SEQ ID NO: 489800 - RNA, 24 nt, Human
uguaauaacacuggcaccaaaccc

SEQ ID NO: 489801 - RNA, 23 nt, Human
uguugguacccacccagggccca

SEQ ID NO: 489802 - RNA, 24 nt, Human
uuaggggucaucgugacuggggca

SEQ ID NO: 489803 - RNA, 21 nt, Human
uuccuagaggaaggacaggug

SEQ ID NO: 489804 - RNA, 21 nt, Human
uucugaucuacacuuccuaga

SEQ ID NO: 489805 - RNA, 23 nt, Human
uuuauuuuuaaaaagagaaggaa

SEQ ID NO: 489806 - RNA, 19 nt, Human
uuucaaggcaugggacaau

SEQ ID NO: 489807 - RNA, 18 nt, Human
uuucacagucacugagau

SEQ ID NO: 489808 - RNA, 23 nt, Human
uuuuugcaagcagcaucagugca

SEQ ID NO: 489809 - RNA, 24 nt, Human
aaacggaagccaccacaucuucuc

SEQ ID NO: 489810 - RNA, 21 nt, Human
aagaacacaggggaggaagac

SEQ ID NO: 489811 - RNA, 22 nt, Human
aagaacacaggggaggaagaca

SEQ ID NO: 489812 - RNA, 19 nt, Human
aagccacugaaggguuuag

SEQ ID NO: 489813 - RNA, 21 nt, Human
aagcgcagucucggcuuccgu

SEQ ID NO: 489814 - RNA, 21 nt, Human
aaggaccaaagcagaccugca

SEQ ID NO: 489815 - RNA, 22 nt, Human
aagggaaccgggaagccacuga

SEQ ID NO: 489816 - RNA, 23 nt, Human
aaggggccgcggcugggacuggg

SEQ ID NO: 489817 - RNA, 20 nt, Human
acacacaagagcaaaacaca

SEQ ID NO: 489818 - RNA, 23 nt, Human
acagcauccaccuccccaauccu

SEQ ID NO: 489819 - RNA, 24 nt, Human
acaggggaggaagacaucucugga

SEQ ID NO: 489820 - RNA, 21 nt, Human
acccaaagggaaccgggaagc

SEQ ID NO: 489821 - RNA, 23 nt, Human
acccaaagggaaccgggaagcca

SEQ ID NO: 489822 - RNA, 18 nt, Human
agacagacggugaagcuc

SEQ ID NO: 489823 - RNA, 26 nt, Human
agacagacggugaagcucaugguuag

SEQ ID NO: 489824 - RNA, 22 nt, Human
agacagcauccaccuccccaau

SEQ ID NO: 489825 - RNA, 24 nt, Human
agcaauaggguauacugagaagga

SEQ ID NO: 489826 - RNA, 24 nt, Human
agcaugugagccggccgaguccca

SEQ ID NO: 489827 - RNA, 21 nt, Human
aggaagacaucucuggagaaa

SEQ ID NO: 489828 - RNA, 18 nt, Human
aggaagagacagacggug

SEQ ID NO: 489829 - RNA, 21 nt, Human
aggcacugggaaugcaaagcc

SEQ ID NO: 489830 - RNA, 19 nt, Human
aggcaggagcagugggagu

SEQ ID NO: 489831 - RNA, 21 nt, Human
aggcaggcaggggcccuaggg

SEQ ID NO: 489832 - RNA, 23 nt, Human
aggcaggcaggggcccuaggguc

SEQ ID NO: 489833 - RNA, 23 nt, Human
aggcagggagggaguugucugug

SEQ ID NO: 489834 - RNA, 23 nt, Human
aggcaggggcccuaggguccagc

SEQ ID NO: 489835 - RNA, 24 nt, Human
aggccacuggccaggucagcuugg

SEQ ID NO: 489836 - RNA, 18 nt, Human
auugccaggagagggcag

SEQ ID NO: 489837 - RNA, 26 nt, Human
caaacggaagccaccacaaucaacgg

SEQ ID NO: 489838 - RNA, 18 nt, Human
caaagaacacaggggagg

SEQ ID NO: 489839 - RNA, 23 nt, Human
caaagaacacaggggaggaagac

SEQ ID NO: 489840 - RNA, 18 nt, Human
caaggagagcauuccagg

SEQ ID NO: 489841 - RNA, 19 nt, Human
cacccccucuuaaaggggc

SEQ ID NO: 489842 - RNA, 19 nt, Human
cagaagcagcuucggguug

SEQ ID NO: 489843 - RNA, 19 nt, Human
cagagggggcccaauaacc

SEQ ID NO: 489844 - RNA, 21 nt, Human
cagcagaucacucucccaucc

SEQ ID NO: 489845 - RNA, 22 nt, Human
cagcauccaccuccccaauccu

SEQ ID NO: 489846 - RNA, 20 nt, Human
cagccccuaaaucggcuccc

SEQ ID NO: 489847 - RNA, 19 nt, Human
cagccucaguuucggccag

SEQ ID NO: 489848 - RNA, 23 nt, Human
cagcuccuuagucagcugguccu

SEQ ID NO: 489849 - RNA, 23 nt, Human
caggacccaaagggaaccgggaa

SEQ ID NO: 489850 - RNA, 18 nt, Human
caggaugcacccuccuuu

SEQ ID NO: 489851 - RNA, 19 nt, Human
caggggcccuaggguccag

SEQ ID NO: 489852 - RNA, 18 nt, Human
cagggugggcuccccugc

SEQ ID NO: 489853 - RNA, 23 nt, Human
cagggugggcuccccugccccuc

SEQ ID NO: 489854 - RNA, 22 nt, Human
cagugggaguggaaagcggggu

SEQ ID NO: 489855 - RNA, 21 nt, Human
caucagcuccuuuuccaguuu

SEQ ID NO: 489856 - RNA, 22 nt, Human
cauucccacuauacccccuaau

SEQ ID NO: 489857 - RNA, 21 nt, Human
ccaacaaacggaagccaccac

SEQ ID NO: 489858 - RNA, 23 nt, Human
ccaccaacaaacggaagccacca

SEQ ID NO: 489859 - RNA, 18 nt, Human
ccacccccucuuaaaggg

SEQ ID NO: 489860 - RNA, 18 nt, Human
ccaccuccuccaccaaca

SEQ ID NO: 489861 - RNA, 18 nt, Human
ccaccuccuccaccaaca

SEQ ID NO: 489862 - RNA, 18 nt, Human
ccacgccgccgaugcugc

SEQ ID NO: 489863 - RNA, 22 nt, Human
ccacuauacccccuaaucuaga

SEQ ID NO: 489864 - RNA, 18 nt, Human
ccagagccucucucagga

SEQ ID NO: 489865 - RNA, 18 nt, Human
ccaggacccaaagggaac

SEQ ID NO: 489866 - RNA, 18 nt, Human
ccaggcacugggaaugca

SEQ ID NO: 489867 - RNA, 19 nt, Human
ccaucagcuccuuuuccag

SEQ ID NO: 489868 - RNA, 23 nt, Human
ccaucccaguugcugccuuggcg

SEQ ID NO: 489869 - RNA, 21 nt, Human
cccaccucaacuccauucugc

SEQ ID NO: 489870 - RNA, 22 nt, Human
cccagacccacuccuucccggg

SEQ ID NO: 489871 - RNA, 21 nt, Human
ccccaauccuccaucagcucc

SEQ ID NO: 489872 - RNA, 21 nt, Human
ccccaggaaccagauguagcc

SEQ ID NO: 489873 - RNA, 23 nt, Human
ccccagggguggacgaaaggccc

SEQ ID NO: 489874 - RNA, 25 nt, Human
ccccagucucucauccucccgggcu

SEQ ID NO: 489875 - RNA, 23 nt, Human
ccccuaaaucggcucccuuugcc

SEQ ID NO: 489876 - RNA, 23 nt, Human
ccccugcccuccucgggaccuca

SEQ ID NO: 489877 - RNA, 19 nt, Human
cccuaggguccagcgcugc

SEQ ID NO: 489878 - RNA, 19 nt, Human
ccgccgaugcugcccgggc

SEQ ID NO: 489879 - RNA, 20 nt, Human
ccuaggguccagcgcugccc

SEQ ID NO: 489880 - RNA, 19 nt, Human
ccucaagcucggcgccuca

SEQ ID NO: 489881 - RNA, 24 nt, Human
ccucgggaccucagcuucaccauc

SEQ ID NO: 489882 - RNA, 24 nt, Human
ccugccaccuccuccaccaacaaa

SEQ ID NO: 489883 - RNA, 19 nt, Human
ccugcggccucaccagggc

SEQ ID NO: 489884 - RNA, 25 nt, Human
ccugggucaccgggcuccccaggag

SEQ ID NO: 489885 - RNA, 20 nt, Human
ccuucaagaguuuaggguuu

SEQ ID NO: 489886 - RNA, 21 nt, Human
ccuucaagaguuuaggguuuu

SEQ ID NO: 489887 - RNA, 19 nt, Human
cgaaaggcccccagucucu

SEQ ID NO: 489888 - RNA, 18 nt, Human
cgaggccugccaccuccu

SEQ ID NO: 489889 - RNA, 21 nt, Human
cgcccgggaccugccccugcc

SEQ ID NO: 489890 - RNA, 21 nt, Human
cggccgagucccagcaacccc

SEQ ID NO: 489891 - RNA, 18 nt, Human
cucacauugccaggagag

SEQ ID NO: 489892 - RNA, 24 nt, Human
cuccgagacucgcucugaccacgc

SEQ ID NO: 489893 - RNA, 18 nt, Human
cugaacuaaggcaggagc

SEQ ID NO: 489894 - RNA, 25 nt, Human
cugugaccccagccccuaaaucggc

SEQ ID NO: 489895 - RNA, 22 nt, Human
cuuccuguucugccuguggagg

SEQ ID NO: 489896 - RNA, 23 nt, Human
gaagacaucucuggagaaagacu

SEQ ID NO: 489897 - RNA, 23 nt, Human
gaagcgccuccugugaccccagc

SEQ ID NO: 489898 - RNA, 22 nt, Human
gacaaagaacacaggggaggaa

SEQ ID NO: 489899 - RNA, 20 nt, Human
gaccugccccugcccuccuc

SEQ ID NO: 489900 - RNA, 20 nt, Human
gagacaaagaacacagggga

SEQ ID NO: 489901 - RNA, 24 nt, Human
gagacucgcucugaccacgccgcc

SEQ ID NO: 489902 - RNA, 22 nt, Human
gagcagugggaguggaaagcgg

SEQ ID NO: 489903 - RNA, 23 nt, Human
gaggaaaaacucagugaucgccc

SEQ ID NO: 489904 - RNA, 23 nt, Human
gcagcuucggguugcacaggcug

SEQ ID NO: 489905 - RNA, 24 nt, Human
gcauccaccuccccaauccuccau

SEQ ID NO: 489906 - RNA, 26 nt, Human
gcccagccccagggguggacgaaagg

SEQ ID NO: 489907 - RNA, 21 nt, Human
gccuggcuggagcucuggggu

SEQ ID NO: 489908 - RNA, 18 nt, Human
gccugggucaccgggcuc

SEQ ID NO: 489909 - RNA, 25 nt, Human
ggaaagcugggggcuggagggacag

SEQ ID NO: 489910 - RNA, 20 nt, Human
ggaccucagcuucaccaucc

SEQ ID NO: 489911 - RNA, 24 nt, Human
ggacuucggagugucgaggagguu

SEQ ID NO: 489912 - RNA, 20 nt, Human
ggaggggaggaucauggagg

SEQ ID NO: 489913 - RNA, 24 nt, Human
ggaugcacccuccuuuggaagcac

SEQ ID NO: 489914 - RNA, 20 nt, Human
ggcagcgucccuggcgccag

SEQ ID NO: 489915 - RNA, 22 nt, Human
ggccgcggcugggacugggcag

SEQ ID NO: 489916 - RNA, 21 nt, Human
ggcgcuguccaggauuccagu

SEQ ID NO: 489917 - RNA, 20 nt, Human
ggcuggagcucugggguccc

SEQ ID NO: 489918 - RNA, 18 nt, Human
ggcuugaacuggguagga

SEQ ID NO: 489919 - RNA, 23 nt, Human
gggaggggaggaucauggagggc

SEQ ID NO: 489920 - RNA, 23 nt, Human
gggcagaggucuuucaacuuucu

SEQ ID NO: 489921 - RNA, 20 nt, Human
gggcagcagggcguccuugg

SEQ ID NO: 489922 - RNA, 23 nt, Human
gggcuguccucccuggccaugcu

SEQ ID NO: 489923 - RNA, 20 nt, Human
ggggcugggccggaugaggg

SEQ ID NO: 489924 - RNA, 22 nt, Human
gguaggagagcgacgguggugg

SEQ ID NO: 489925 - RNA, 19 nt, Human
gucguugacaaauaugggg

SEQ ID NO: 489926 - RNA, 19 nt, Human
gugagugcugguggcagcu

SEQ ID NO: 489927 - RNA, 20 nt, Human
gugcaaggcagggagggagu

SEQ ID NO: 489928 - RNA, 19 nt, Human
uacaacaacacagcaauag

SEQ ID NO: 489929 - RNA, 20 nt, Human
uacacacaagagcaaaacac

SEQ ID NO: 489930 - RNA, 23 nt, Human
uaccaggacccaaagggaaccgg

SEQ ID NO: 489931 - RNA, 18 nt, Human
ucaagaguuuaggguuuu

SEQ ID NO: 489932 - RNA, 22 nt, Human
ucaaggguuauugagagcuuau

SEQ ID NO: 489933 - RNA, 19 nt, Human
ucaggacaaucaaugccuu

SEQ ID NO: 489934 - RNA, 23 nt, Human
ucaguuugucuccuuagacagca

SEQ ID NO: 489935 - RNA, 20 nt, Human
ucaugggacagaaacugugg

SEQ ID NO: 489936 - RNA, 19 nt, Human
uccaccaacaaacggaagc

SEQ ID NO: 489937 - RNA, 24 nt, Human
uccacuucggcuguguucucuggg

SEQ ID NO: 489938 - RNA, 22 nt, Human
uccccacauuccacuucggcug

SEQ ID NO: 489939 - RNA, 23 nt, Human
uccccaggaaccagauguagccc

SEQ ID NO: 489940 - RNA, 27 nt, Human
ucccccauuucauucccacuauacccc

SEQ ID NO: 489941 - RNA, 18 nt, Human
ucccgggcucuagggccc

SEQ ID NO: 489942 - RNA, 18 nt, Human
ucccucaagcucggcgcc

SEQ ID NO: 489943 - RNA, 21 nt, Human
ucccucaagcucggcgccuca

SEQ ID NO: 489944 - RNA, 19 nt, Human
uccuccaccaacaaacgga

SEQ ID NO: 489945 - RNA, 21 nt, Human
ucgcuagggcccagacuccug

SEQ ID NO: 489946 - RNA, 19 nt, Human
ucuggggucccucaagcuc

SEQ ID NO: 489947 - RNA, 18 nt, Human
ucuggguuacccgccgag

SEQ ID NO: 489948 - RNA, 20 nt, Human
ucuguaccaggacccaaagg

SEQ ID NO: 489949 - RNA, 22 nt, Human
ucuguaccaggacccaaaggga

SEQ ID NO: 489950 - RNA, 23 nt, Human
ucuuucaacuuucuggcuuuagu

SEQ ID NO: 489951 - RNA, 23 nt, Human
ugaaaugacaggucuuuggcugg

SEQ ID NO: 489952 - RNA, 21 nt, Human
ugaaggaagagacagacggug

SEQ ID NO: 489953 - RNA, 19 nt, Human
ugacuccuccccaggaacc

SEQ ID NO: 489954 - RNA, 23 nt, Human
ugacuuggccccugggcccauga

SEQ ID NO: 489955 - RNA, 18 nt, Human
ugagcgucugcccagccc

SEQ ID NO: 489956 - RNA, 23 nt, Human
ugcagagcgaagguagugaagga

SEQ ID NO: 489957 - RNA, 23 nt, Human
ugccaggagagggcagcaaccca

SEQ ID NO: 489958 - RNA, 21 nt, Human
ugcccuccucgggaccucagc

SEQ ID NO: 489959 - RNA, 19 nt, Human
uggacccagacccacuccu

SEQ ID NO: 489960 - RNA, 18 nt, Human
uggaugggggcugggccg

SEQ ID NO: 489961 - RNA, 22 nt, Human
uggccaugcuaaggaaucugua

SEQ ID NO: 489962 - RNA, 18 nt, Human
uggcuggagugagugcug

SEQ ID NO: 489963 - RNA, 19 nt, Human
uggcuggaugggggcuggg

SEQ ID NO: 489964 - RNA, 27 nt, Human
ugggaaugcaaagccgacugagauaug

SEQ ID NO: 489965 - RNA, 22 nt, Human
ugggacagaaacugugggguca

SEQ ID NO: 489966 - RNA, 20 nt, Human
ugggaguggaaagcggggug

SEQ ID NO: 489967 - RNA, 21 nt, Human
ugggcagaagcagcuucgggu

SEQ ID NO: 489968 - RNA, 21 nt, Human
ugggggcuggagggacagucc

SEQ ID NO: 489969 - RNA, 25 nt, Human
ugucaugggacagaaacuguggggu

SEQ ID NO: 489970 - RNA, 24 nt, Human
uguccuucaagaguuuaggguuuu

SEQ ID NO: 489971 - RNA, 20 nt, Human
ugucuggggcaggcacugug

SEQ ID NO: 489972 - RNA, 24 nt, Human
ugugaugaguuccuucuccuacag

SEQ ID NO: 489973 - RNA, 23 nt, Human
ugugcaaggcagggagggggaac

SEQ ID NO: 489974 - RNA, 20 nt, Human
uguggaggauggacauggca

SEQ ID NO: 489975 - RNA, 23 nt, Human
uguucucuggguuacccgccgag

SEQ ID NO: 489976 - RNA, 21 nt, Human
uguugggggagccagagccuc

SEQ ID NO: 489977 - RNA, 21 nt, Human
uuacaacaauggaggaaaaac

SEQ ID NO: 489978 - RNA, 22 nt, Human
uuacagugauaguuacaacaac

SEQ ID NO: 489979 - RNA, 20 nt, Human
uucaauacgugcuuaugaac

SEQ ID NO: 489980 - RNA, 19 nt, Human
uucggccaggcacugggaa

SEQ ID NO: 489981 - RNA, 23 nt, Human
uuguugggucucacaagguccag

SEQ ID NO: 489982 - RNA, 19 nt, Human
uuuccaguuucccccaucc

SEQ ID NO: 489983 - RNA, 29 nt, Human
aaacagaaaggaacauaaaaguaugaggu

SEQ ID NO: 489984 - RNA, 21 nt, Human
aaagaagaaaauaugagaaga

SEQ ID NO: 489985 - RNA, 20 nt, Human
aaaggaacauaaaaguauga

SEQ ID NO: 489986 - RNA, 20 nt, Human
aaaguacaauaaaaauacaa

SEQ ID NO: 489987 - RNA, 24 nt, Human
aacacacaaauauauauugcauaa

SEQ ID NO: 489988 - RNA, 21 nt, Human
aaccaagagggcaucacaaaa

SEQ ID NO: 489989 - RNA, 20 nt, Human
aagaagaaaauaugagaaga

SEQ ID NO: 489990 - RNA, 20 nt, Human
aagaguaguccuuaugcagu

SEQ ID NO: 489991 - RNA, 19 nt, Human
aauaaugaaaugcaagaga

SEQ ID NO: 489992 - RNA, 19 nt, Human
acuccauuguguuaccauu

SEQ ID NO: 489993 - RNA, 23 nt, Human
agaaaauaugagaagaguagucc

SEQ ID NO: 489994 - RNA, 20 nt, Human
agaaaggaacauaaaaguau

SEQ ID NO: 489995 - RNA, 19 nt, Human
aggaaaaccaaacauaucg

SEQ ID NO: 489996 - RNA, 20 nt, Human
agggaauaucaaaucagaug

SEQ ID NO: 489997 - RNA, 22 nt, Human
aucuucauaaaaacgcacugga

SEQ ID NO: 489998 - RNA, 24 nt, Human
auuaauaaacuagccaucuggaaa

SEQ ID NO: 489999 - RNA, 23 nt, Human
caaauucuaucuguuaaaaaaag

SEQ ID NO: 490000 - RNA, 23 nt, Human
caaguuagaaauuuugaccauaa

SEQ ID NO: 490001 - RNA, 23 nt, Human
caguagaaacagaaaggaacaua

SEQ ID NO: 490002 - RNA, 24 nt, Human
caucuacaguagaaacagaaagga

SEQ ID NO: 490003 - RNA, 21 nt, Human
caucuggaaaaugaauacaaa

SEQ ID NO: 490004 - RNA, 23 nt, Human
ccaaaauacuaucugacaaacaa

SEQ ID NO: 490005 - RNA, 18 nt, Human
cccuacucuaagucacau

SEQ ID NO: 490006 - RNA, 21 nt, Human
ccuuuaacacuugaagaaaau

SEQ ID NO: 490007 - RNA, 18 nt, Human
cucuaauuaagguacaac

SEQ ID NO: 490008 - RNA, 21 nt, Human
cugagaaaauuuucaaaauau

SEQ ID NO: 490009 - RNA, 21 nt, Human
cuuuaugaaacauauauugcc

SEQ ID NO: 490010 - RNA, 18 nt, Human
gaaaauaugagaagagua

SEQ ID NO: 490011 - RNA, 20 nt, Human
gaggagaaauauauuuggua

SEQ ID NO: 490012 - RNA, 22 nt, Human
ggguuuuuuuuuuuuuuuugga

SEQ ID NO: 490013 - RNA, 28 nt, Human
guaacuggguuuuuuuuuuuuuuuugga

SEQ ID NO: 490014 - RNA, 19 nt, Human
guuuuuuuuuuuuuuuugg

SEQ ID NO: 490015 - RNA, 23 nt, Human
uaaaagaaacuaaacaagaaggc

SEQ ID NO: 490016 - RNA, 26 nt, Human
uaaaagaaacuaaacaagaaggcuca

SEQ ID NO: 490017 - RNA, 21 nt, Human
uaaaguaacauaucuuaaaug

SEQ ID NO: 490018 - RNA, 22 nt, Human
uaaauguucauaauuaaugacc

SEQ ID NO: 490019 - RNA, 22 nt, Human
uaacaucaccuugcauuuacua

SEQ ID NO: 490020 - RNA, 22 nt, Human
uaacuaaauagaacucagacac

SEQ ID NO: 490021 - RNA, 18 nt, Human
uaaggaaaaacacacaaa

SEQ ID NO: 490022 - RNA, 27 nt, Human
uaagguacaacuuagcagauaaaagaa

SEQ ID NO: 490023 - RNA, 24 nt, Human
uaccauauaacauuaaggaaaaac

SEQ ID NO: 490024 - RNA, 19 nt, Human
uaccuuuaacacuugaaga

SEQ ID NO: 490025 - RNA, 25 nt, Human
uaccuuuaacacuugaagaaaauuc

SEQ ID NO: 490026 - RNA, 20 nt, Human
uagaacucagacacaaggca

SEQ ID NO: 490027 - RNA, 19 nt, Human
uagcagaguugauuaccau

SEQ ID NO: 490028 - RNA, 19 nt, Human
uagucuguuagguaaaggg

SEQ ID NO: 490029 - RNA, 18 nt, Human
uccaaaauacuaucugac

SEQ ID NO: 490030 - RNA, 25 nt, Human
ucccagugaugugaacaggguaccc

SEQ ID NO: 490031 - RNA, 24 nt, Human
ucuacaguagaaacagaaaggaac

SEQ ID NO: 490032 - RNA, 23 nt, Human
ucuaucuguuaaaaaaagccacu

SEQ ID NO: 490033 - RNA, 23 nt, Human
ucuucauaaaaacgcacuggaga

SEQ ID NO: 490034 - RNA, 21 nt, Human
ugaaaaauaucuucaucaaag

SEQ ID NO: 490035 - RNA, 19 nt, Human
ugaaacauauauugcccuc

SEQ ID NO: 490036 - RNA, 18 nt, Human
ugaauacaaauuucaaga

SEQ ID NO: 490037 - RNA, 21 nt, Human
ugacauguguauacaaacaca

SEQ ID NO: 490038 - RNA, 25 nt, Human
ugagaagaguaguccuuaugcagug

SEQ ID NO: 490039 - RNA, 21 nt, Human
ugaguaaaugauaaaucuauu

SEQ ID NO: 490040 - RNA, 26 nt, Human
uguagaacgggugccacagauuuuaa

SEQ ID NO: 490041 - RNA, 25 nt, Human
uguauacaaacacauuuaacauggu

SEQ ID NO: 490042 - RNA, 25 nt, Human
uuagcagauaaaagaaacuaaacaa

SEQ ID NO: 490043 - RNA, 24 nt, Human
uuagucuguuagguaaaggguaaa

SEQ ID NO: 490044 - RNA, 22 nt, Human
uucaucagcacaucaauaauga

SEQ ID NO: 490045 - RNA, 22 nt, Human
uucaucaugccaguagcagagu

SEQ ID NO: 490046 - RNA, 19 nt, Human
uuggcaugucucuucagaa

SEQ ID NO: 490047 - RNA, 25 nt, Human
uuuaagguauggcuuuugggaaauc

SEQ ID NO: 490048 - RNA, 18 nt, Human
uuugauuucuuuuccuag

SEQ ID NO: 490049 - RNA, 24 nt, Human
uuuucaaccagaucuucauaaaaa

SEQ ID NO: 490050 - RNA, 22 nt, Human
uuuuccuagugaaaauguaccu

SEQ ID NO: 490051 - RNA, 24 nt, Human
aaagccauucucagucuacaucca

SEQ ID NO: 490052 - RNA, 26 nt, Human
aagaaaaaccaaguucaauuuaccaa

SEQ ID NO: 490053 - RNA, 20 nt, Human
aagacagcucugucccacca

SEQ ID NO: 490054 - RNA, 21 nt, Human
aagacagcucugucccaccaa

SEQ ID NO: 490055 - RNA, 19 nt, Human
agaaggcuguggagaaacu

SEQ ID NO: 490056 - RNA, 30 nt, Human
aggcggcggagugcgggcgguggcggcggg

SEQ ID NO: 490057 - RNA, 21 nt, Human
aggcuguggagaaacugaguc

SEQ ID NO: 490058 - RNA, 21 nt, Human
agugcagagggcucccuuaga

SEQ ID NO: 490059 - RNA, 19 nt, Human
caagacauccgcccacagc

SEQ ID NO: 490060 - RNA, 18 nt, Human
caauacccgacugugcug

SEQ ID NO: 490061 - RNA, 18 nt, Human
cagaaggaagacagcucu

SEQ ID NO: 490062 - RNA, 22 nt, Human
cagaaggacaggugagucucac

SEQ ID NO: 490063 - RNA, 20 nt, Human
cagcaauacccgacugugcu

SEQ ID NO: 490064 - RNA, 19 nt, Human
caggggucuccuucccucc

SEQ ID NO: 490065 - RNA, 26 nt, Human
ccaaaauaucuguauuaucuauaaaa

SEQ ID NO: 490066 - RNA, 22 nt, Human
ccaccaacccuauagcagaaca

SEQ ID NO: 490067 - RNA, 22 nt, Human
ccagaaggacaggugagucuca

SEQ ID NO: 490068 - RNA, 26 nt, Human
cggcggcggcgcggggaggggugcuc

SEQ ID NO: 490069 - RNA, 18 nt, Human
cgggcagaggcggcggag

SEQ ID NO: 490070 - RNA, 19 nt, Human
cgggcagaggcggcggagu

SEQ ID NO: 490071 - RNA, 20 nt, Human
cgggcgguggcggcggcggc

SEQ ID NO: 490072 - RNA, 21 nt, Human
cuacagacuccuugaggagga

SEQ ID NO: 490073 - RNA, 22 nt, Human
cucaaagccauucucagucuac

SEQ ID NO: 490074 - RNA, 22 nt, Human
cuuauucuguggccuccuuucc

SEQ ID NO: 490075 - RNA, 18 nt, Human
cuucccuccccucuugcc

SEQ ID NO: 490076 - RNA, 23 nt, Human
cuuguaucacacaggcuggagaa

SEQ ID NO: 490077 - RNA, 22 nt, Human
gacaggugagucucaccuaggc

SEQ ID NO: 490078 - RNA, 21 nt, Human
gacuccuugaggaggaguaag

SEQ ID NO: 490079 - RNA, 19 nt, Human
gagccugcaggggucuccu

SEQ ID NO: 490080 - RNA, 22 nt, Human
gaggcggcggagugcgggcggu

SEQ ID NO: 490081 - RNA, 22 nt, Human
gaugcugggaaagaaaaaccaa

SEQ ID NO: 490082 - RNA, 32 nt, Human
gcggagugcgggcgguggcggcggcggcgacg

SEQ ID NO: 490083 - RNA, 25 nt, Human
gcggcggagugcgggcgguggcggc

SEQ ID NO: 490084 - RNA, 28 nt, Human
gcggcggagugcgggcgguggcggcggc

SEQ ID NO: 490085 - RNA, 18 nt, Human
gcgggcagaggcggcgga

SEQ ID NO: 490086 - RNA, 22 nt, Human
ggaaagaaaaaccaaguucaau

SEQ ID NO: 490087 - RNA, 18 nt, Human
ggaguaagaccccagaag

SEQ ID NO: 490088 - RNA, 25 nt, Human
ggagugcgggcgguggcggcggcgg

SEQ ID NO: 490089 - RNA, 18 nt, Human
guggcggcggcggcgcgg

SEQ ID NO: 490090 - RNA, 24 nt, Human
uccacgaugcugggaaagaaaaac

SEQ ID NO: 490091 - RNA, 23 nt, Human
ucccuccccucuugccuguucug

SEQ ID NO: 490092 - RNA, 21 nt, Human
uccgcccacagcagugagaag

SEQ ID NO: 490093 - RNA, 22 nt, Human
ucuacauccacgaugcugggaa

SEQ ID NO: 490094 - RNA, 21 nt, Human
ucucaagguggguggagggag

SEQ ID NO: 490095 - RNA, 19 nt, Human
ucuccagaagugcuuaguu

SEQ ID NO: 490096 - RNA, 22 nt, Human
ucuccagaagugcuuaguuuuu

SEQ ID NO: 490097 - RNA, 23 nt, Human
ucugccuggucagagccugcaca

SEQ ID NO: 490098 - RNA, 23 nt, Human
ugaaguuucagaauaagcagcuu

SEQ ID NO: 490099 - RNA, 22 nt, Human
ugcgggcagaggcggcggagug

SEQ ID NO: 490100 - RNA, 19 nt, Human
ugcugggaaagaaaaacca

SEQ ID NO: 490101 - RNA, 23 nt, Human
uggccuccuuuccacuacagacu

SEQ ID NO: 490102 - RNA, 21 nt, Human
uggcggcggcggcgcggggag

SEQ ID NO: 490103 - RNA, 22 nt, Human
uguggagaaacugaguccuccc

SEQ ID NO: 490104 - RNA, 23 nt, Human
uucucagucuacauccacgaugc

SEQ ID NO: 490105 - RNA, 22 nt, Human
aaaaaauuacuuucaaucccac

SEQ ID NO: 490106 - RNA, 26 nt, Human
aaaacaacaacaacaaaaaaacaaac

SEQ ID NO: 490107 - RNA, 23 nt, Human
aaacaacaacaacaaaaaaacaa

SEQ ID NO: 490108 - RNA, 18 nt, Human
aaauaugucagaaaugaa

SEQ ID NO: 490109 - RNA, 20 nt, Human
aacaaagcgagacuccaucu

SEQ ID NO: 490110 - RNA, 22 nt, Human
aacaacaacaaaaaaacaaacu

SEQ ID NO: 490111 - RNA, 19 nt, Human
aacacggugaaaccccguc

SEQ ID NO: 490112 - RNA, 20 nt, Human
aacacggugaaaccccgucu

SEQ ID NO: 490113 - RNA, 21 nt, Human
aacacggugaaaccccgucuc

SEQ ID NO: 490114 - RNA, 18 nt, Human
aacugcuugaacccggga

SEQ ID NO: 490115 - RNA, 24 nt, Human
acaaagcgagacuccaucucaaaa

SEQ ID NO: 490116 - RNA, 21 nt, Human
acaacaacaacaaaaaaacaa

SEQ ID NO: 490117 - RNA, 23 nt, Human
accccgucucuacuaaaauacaa

SEQ ID NO: 490118 - RNA, 21 nt, Human
acgucuguaauccuagcacuu

SEQ ID NO: 490119 - RNA, 26 nt, Human
acuaaaauacaaaaaauuagcugguc

SEQ ID NO: 490120 - RNA, 18 nt, Human
acugcccuccagucuggg

SEQ ID NO: 490121 - RNA, 23 nt, Human
acugcccuccagucugggcaaca

SEQ ID NO: 490122 - RNA, 20 nt, Human
agacaaaugcacagaaguau

SEQ ID NO: 490123 - RNA, 21 nt, Human
agacaaaugcacagaaguauu

SEQ ID NO: 490124 - RNA, 24 nt, Human
agagguugcagugagccgagaucg

SEQ ID NO: 490125 - RNA, 22 nt, Human
agccugggcaacacggugaaac

SEQ ID NO: 490126 - RNA, 24 nt, Human
agccugggcaacacggugaaaccc

SEQ ID NO: 490127 - RNA, 21 nt, Human
aggcagaacugcuugaacccg

SEQ ID NO: 490128 - RNA, 21 nt, Human
aggcagagguugcagugagcc

SEQ ID NO: 490129 - RNA, 24 nt, Human
aggcagagguugcagugagccgag

SEQ ID NO: 490130 - RNA, 21 nt, Human
aggcugaggcagaacugcuug

SEQ ID NO: 490131 - RNA, 24 nt, Human
agucugggcaacaaagcgagacuc

SEQ ID NO: 490132 - RNA, 24 nt, Human
aucgcgccacugcccuccagucug

SEQ ID NO: 490133 - RNA, 27 nt, Human
caaaaaaacaaacuaaauauagaaaua

SEQ ID NO: 490134 - RNA, 23 nt, Human
caacaacaaaaaaacaaacuaaa

SEQ ID NO: 490135 - RNA, 21 nt, Human
caacaacaacaaaaaaacaaa

SEQ ID NO: 490136 - RNA, 24 nt, Human
caacacggugaaaccccgucucua

SEQ ID NO: 490137 - RNA, 24 nt, Human
caccuuuagucacagcuacuuggg

SEQ ID NO: 490138 - RNA, 24 nt, Human
cacugcccuccagucugggcaaca

SEQ ID NO: 490139 - RNA, 24 nt, Human
cagcuacuugggaggcugaggcag

SEQ ID NO: 490140 - RNA, 21 nt, Human
ccacugcccuccagucugggc

SEQ ID NO: 490141 - RNA, 23 nt, Human
ccacugcccuccagucugggcaa

SEQ ID NO: 490142 - RNA, 24 nt, Human
ccacugcccuccagucugggcaac

SEQ ID NO: 490143 - RNA, 23 nt, Human
ccugggcaacacggugaaacccc

SEQ ID NO: 490144 - RNA, 24 nt, Human
ccugggcaacacggugaaaccccg

SEQ ID NO: 490145 - RNA, 20 nt, Human
ccuuuagucacagcuacuug

SEQ ID NO: 490146 - RNA, 18 nt, Human
cgcgccacugcccuccag

SEQ ID NO: 490147 - RNA, 24 nt, Human
cgggaggcagagguugcagugagc

SEQ ID NO: 490148 - RNA, 18 nt, Human
cgucuguaauccuagcac

SEQ ID NO: 490149 - RNA, 23 nt, Human
cgucuguaauccuagcacuucgg

SEQ ID NO: 490150 - RNA, 21 nt, Human
cuaaccacaacuguacuacaa

SEQ ID NO: 490151 - RNA, 23 nt, Human
cugaggcagaacugcuugaaccc

SEQ ID NO: 490152 - RNA, 24 nt, Human
cugcuugaacccgggaggcagagg

SEQ ID NO: 490153 - RNA, 28 nt, Human
gaaaaaaauuacuuucaaucccacuaca

SEQ ID NO: 490154 - RNA, 23 nt, Human
gagaucgcgccacugcccuccag

SEQ ID NO: 490155 - RNA, 22 nt, Human
gcgugcaccuuuagucacagcu

SEQ ID NO: 490156 - RNA, 18 nt, Human
gggcauggcggcgugcac

SEQ ID NO: 490157 - RNA, 21 nt, Human
gguggcuuacgucuguaaucc

SEQ ID NO: 490158 - RNA, 24 nt, Human
gguggcuuacgucuguaauccuag

SEQ ID NO: 490159 - RNA, 22 nt, Human
guucugagagcagccugggcaa

SEQ ID NO: 490160 - RNA, 19 nt, Human
guugcagugagccgagauc

SEQ ID NO: 490161 - RNA, 21 nt, Human
guugcagugagccgagaucgc

SEQ ID NO: 490162 - RNA, 24 nt, Human
uacgucuguaauccuagcacuucg

SEQ ID NO: 490163 - RNA, 24 nt, Human
uagcacuucgguaggccgaggcgg

SEQ ID NO: 490164 - RNA, 24 nt, Human
uccagucugggcaacaaagcgaga

SEQ ID NO: 490165 - RNA, 20 nt, Human
ucgcgccacugcccuccagu

SEQ ID NO: 490166 - RNA, 21 nt, Human
ucucuacuaaaauacaaaaaa

SEQ ID NO: 490167 - RNA, 22 nt, Human
ugagccgagaucgcgccacugc

SEQ ID NO: 490168 - RNA, 21 nt, Human
ugaggcagaacugcuugaacc

SEQ ID NO: 490169 - RNA, 26 nt, Human
ugccagaaauguaaaauaugucagaa

SEQ ID NO: 490170 - RNA, 26 nt, Human
ugccugagcucaggaguucugagagc

SEQ ID NO: 490171 - RNA, 24 nt, Human
uggacagacaaaugcacagaagua

SEQ ID NO: 490172 - RNA, 24 nt, Human
uggacugccugagcucaggaguuc

SEQ ID NO: 490173 - RNA, 19 nt, Human
uggcuuacgucuguaaucc

SEQ ID NO: 490174 - RNA, 24 nt, Human
uggcuuacgucuguaauccuagca

SEQ ID NO: 490175 - RNA, 18 nt, Human
ugggaggcugaggcagaa

SEQ ID NO: 490176 - RNA, 18 nt, Human
ugggaggcugaggcagaa

SEQ ID NO: 490177 - RNA, 19 nt, Human
uuagcugggcauggcggcg

SEQ ID NO: 490178 - RNA, 19 nt, Human
uugcagugagccgagaucg

SEQ ID NO: 490179 - RNA, 22 nt, Human
uugcagugagccgagaucgcgc

SEQ ID NO: 490180 - RNA, 18 nt, Human
uugggaggcugaggcaga

SEQ ID NO: 490181 - RNA, 19 nt, Human
aaacagaauccacaguaaa

SEQ ID NO: 490182 - RNA, 18 nt, Human
ccacaaucgccgccucug

SEQ ID NO: 490183 - RNA, 18 nt, Human
ccugggcagcucagcagc

SEQ ID NO: 490184 - RNA, 19 nt, Human
gaaccgacaccucaaucuc

SEQ ID NO: 490185 - RNA, 23 nt, Human
ucaguuacuguuacuucaugauc

SEQ ID NO: 490186 - RNA, 19 nt, Human
ugucggagccccgcccccg

SEQ ID NO: 490187 - RNA, 21 nt, Human
uuuuugaaaaugccacagggu

SEQ ID NO: 490188 - RNA, 22 nt, Human
uuuuuuuugaaaaugccacagg

SEQ ID NO: 490189 - RNA, 18 nt, Human
uuuuuuuuuuuuuuuuug

SEQ ID NO: 490190 - RNA, 19 nt, Human
aaacaccccacggcccuca

SEQ ID NO: 490191 - RNA, 18 nt, Human
aacacagcucagccaggc

SEQ ID NO: 490192 - RNA, 21 nt, Human
accugcagacgccucccccac

SEQ ID NO: 490193 - RNA, 23 nt, Human
agagaucaggcccagggccuggg

SEQ ID NO: 490194 - RNA, 27 nt, Human
agagcccccccauccacgggucccuuc

SEQ ID NO: 490195 - RNA, 29 nt, Human
agcagguggggccagguggccucaggacc

SEQ ID NO: 490196 - RNA, 22 nt, Human
agcugcccaccgugcuggcccc

SEQ ID NO: 490197 - RNA, 22 nt, Human
aggaaggagauaggugaaaaau

SEQ ID NO: 490198 - RNA, 21 nt, Human
aggcaaggcugggagagggcu

SEQ ID NO: 490199 - RNA, 24 nt, Human
agggaggggcagguuggcugggug

SEQ ID NO: 490200 - RNA, 23 nt, Human
agggcuuguccagggcuccccug

SEQ ID NO: 490201 - RNA, 23 nt, Human
aggggccgggaccuguguggaua

SEQ ID NO: 490202 - RNA, 20 nt, Human
agguggggggagggcggggc

SEQ ID NO: 490203 - RNA, 21 nt, Human
augccggggccggggccggga

SEQ ID NO: 490204 - RNA, 21 nt, Human
caaggcugggagagggcuggg

SEQ ID NO: 490205 - RNA, 24 nt, Human
caccacugucggcgagcaccgugc

SEQ ID NO: 490206 - RNA, 19 nt, Human
cacccaaacaccccacggc

SEQ ID NO: 490207 - RNA, 24 nt, Human
caccgugcuggccccaagcagggc

SEQ ID NO: 490208 - RNA, 24 nt, Human
cauagccccgugacacacaacagg

SEQ ID NO: 490209 - RNA, 22 nt, Human
cauccacggguccccuccgucc

SEQ ID NO: 490210 - RNA, 22 nt, Human
ccacccaaacaccccacggccc

SEQ ID NO: 490211 - RNA, 23 nt, Human
ccaccuacaugccccacgcaagg

SEQ ID NO: 490212 - RNA, 22 nt, Human
ccagggcuccccuggaacacag

SEQ ID NO: 490213 - RNA, 22 nt, Human
ccccagggccacuccugccucu

SEQ ID NO: 490214 - RNA, 24 nt, Human
cccccaggugaccugcagacgccu

SEQ ID NO: 490215 - RNA, 18 nt, Human
ccccccaggugaccugca

SEQ ID NO: 490216 - RNA, 22 nt, Human
cccccccauccacggguccccu

SEQ ID NO: 490217 - RNA, 24 nt, Human
cccgccgcacucgcucagcgaccg

SEQ ID NO: 490218 - RNA, 26 nt, Human
cccgccgcacucgcucagcgaccgcg

SEQ ID NO: 490219 - RNA, 20 nt, Human
cccgcgcaggccgcccgccg

SEQ ID NO: 490220 - RNA, 18 nt, Human
cccgggcggccucagccc

SEQ ID NO: 490221 - RNA, 26 nt, Human
ccgcccgccgccgccgccccugcgcc

SEQ ID NO: 490222 - RNA, 19 nt, Human
ccgccgccgccccugcgcc

SEQ ID NO: 490223 - RNA, 18 nt, Human
ccgccgccgccgccccug

SEQ ID NO: 490224 - RNA, 20 nt, Human
ccggggccggggccgggagc

SEQ ID NO: 490225 - RNA, 18 nt, Human
ccgugguccuccagccgc

SEQ ID NO: 490226 - RNA, 23 nt, Human
ccucaggacgccagagccccccc

SEQ ID NO: 490227 - RNA, 23 nt, Human
ccucccccaccuacaugccccac

SEQ ID NO: 490228 - RNA, 22 nt, Human
ccugcagacgccucccccaccu

SEQ ID NO: 490229 - RNA, 19 nt, Human
ccuugagguuccagagaag

SEQ ID NO: 490230 - RNA, 25 nt, Human
cgccgguuccgcauucccgccgcac

SEQ ID NO: 490231 - RNA, 21 nt, Human
cgggacccccagggccacucc

SEQ ID NO: 490232 - RNA, 22 nt, Human
cucggaaacccccucccugccu

SEQ ID NO: 490233 - RNA, 24 nt, Human
cucugcgcugaggccuggaaguuc

SEQ ID NO: 490234 - RNA, 24 nt, Human
cugcccaccgugcuggccccaagc

SEQ ID NO: 490235 - RNA, 22 nt, Human
cugcgcugaggccuggaaguuc

SEQ ID NO: 490236 - RNA, 18 nt, Human
cuggccccaagcagggcu

SEQ ID NO: 490237 - RNA, 19 nt, Human
cuggccccaagcagggcuc

SEQ ID NO: 490238 - RNA, 22 nt, Human
gacaccacugucggcgagcacc

SEQ ID NO: 490239 - RNA, 18 nt, Human
gagcccccccauccacgg

SEQ ID NO: 490240 - RNA, 21 nt, Human
gaggccuggaaguucccacag

SEQ ID NO: 490241 - RNA, 19 nt, Human
gauaggugaaaaauaaaua

SEQ ID NO: 490242 - RNA, 22 nt, Human
gcagguggggccagguggccuc

SEQ ID NO: 490243 - RNA, 22 nt, Human
gccacguguggugggacggcag

SEQ ID NO: 490244 - RNA, 20 nt, Human
gccgcccgccgccgccgccc

SEQ ID NO: 490245 - RNA, 19 nt, Human
gcugggcgcagaggccacg

SEQ ID NO: 490246 - RNA, 20 nt, Human
ggacccccagggccacuccu

SEQ ID NO: 490247 - RNA, 18 nt, Human
ggagauaggugaaaaaua

SEQ ID NO: 490248 - RNA, 20 nt, Human
ggagcccuggagcccggccu

SEQ ID NO: 490249 - RNA, 21 nt, Human
ggagcccuggagcccggccug

SEQ ID NO: 490250 - RNA, 22 nt, Human
ggagguggggggagggcggggc

SEQ ID NO: 490251 - RNA, 22 nt, Human
ggcagguuggcugggugugguc

SEQ ID NO: 490252 - RNA, 22 nt, Human
ggccugggcugccugccuugag

SEQ ID NO: 490253 - RNA, 27 nt, Human
ggcgcagaggccacguguggugggacg

SEQ ID NO: 490254 - RNA, 24 nt, Human
ggcugggccccccaggugaccugc

SEQ ID NO: 490255 - RNA, 21 nt, Human
gggccggggccgggagcguca

SEQ ID NO: 490256 - RNA, 23 nt, Human
gggcggcggaugccuggccucgg

SEQ ID NO: 490257 - RNA, 25 nt, Human
gggcugggccccccaggugaccugc

SEQ ID NO: 490258 - RNA, 21 nt, Human
gugggacggcagccugcuggc

SEQ ID NO: 490259 - RNA, 21 nt, Human
ucagcccgcgcgccgguuccg

SEQ ID NO: 490260 - RNA, 24 nt, Human
uccacccaaacaccccacggcccu

SEQ ID NO: 490261 - RNA, 22 nt, Human
uccccaaggguucagacaccac

SEQ ID NO: 490262 - RNA, 23 nt, Human
ucggaaacccccucccugccuau

SEQ ID NO: 490263 - RNA, 19 nt, Human
ugaccugcagacgccuccc

SEQ ID NO: 490264 - RNA, 22 nt, Human
ugaccugcagacgccuccccca

SEQ ID NO: 490265 - RNA, 22 nt, Human
ugaccugcagacgccuccccca

SEQ ID NO: 490266 - RNA, 18 nt, Human
ugagggcuuguccagggc

SEQ ID NO: 490267 - RNA, 18 nt, Human
ugccagagccacauuuua

SEQ ID NO: 490268 - RNA, 19 nt, Human
ugcccgggacccccagggc

SEQ ID NO: 490269 - RNA, 22 nt, Human
ugcccgggacccccagggccac

SEQ ID NO: 490270 - RNA, 23 nt, Human
ugcccugaggagcagguggggcc

SEQ ID NO: 490271 - RNA, 22 nt, Human
ugccggggccggggccgggagc

SEQ ID NO: 490272 - RNA, 21 nt, Human
ugcgcccgcgaugccgaugcc

SEQ ID NO: 490273 - RNA, 21 nt, Human
uggaacacagcucagccaggc

SEQ ID NO: 490274 - RNA, 18 nt, Human
uggagguggggggagggc

SEQ ID NO: 490275 - RNA, 20 nt, Human
uggagguggggggagggcgg

SEQ ID NO: 490276 - RNA, 24 nt, Human
uggagguggggggagggcggggcg

SEQ ID NO: 490277 - RNA, 19 nt, Human
uggggggagggcggggcgg

SEQ ID NO: 490278 - RNA, 24 nt, Human
uggugggacggcagccugcuggcc

SEQ ID NO: 490279 - RNA, 24 nt, Human
uguggauaauccacccaaacaccc

SEQ ID NO: 490280 - RNA, 25 nt, Human
uuccaggaugcgacacggggcggcg

SEQ ID NO: 490281 - RNA, 21 nt, Human
uuuaaccaugccagagccaca

SEQ ID NO: 490282 - RNA, 24 nt, Human
aaagggcugggauuaugggcauga

SEQ ID NO: 490283 - RNA, 19 nt, Human
aagacagaggaaaggaaca

SEQ ID NO: 490284 - RNA, 20 nt, Human
aagaugccacuugcaugaug

SEQ ID NO: 490285 - RNA, 24 nt, Human
aagaugccacuugcaugaugcugu

SEQ ID NO: 490286 - RNA, 19 nt, Human
aagcaaagagagaacaucc

SEQ ID NO: 490287 - RNA, 21 nt, Human
aagcaaagagagaacauccag

SEQ ID NO: 490288 - RNA, 20 nt, Human
aaggaaagucccauacaaug

SEQ ID NO: 490289 - RNA, 21 nt, Human
accagauccucagauccccga

SEQ ID NO: 490290 - RNA, 18 nt, Human
accauguccagcuaauuu

SEQ ID NO: 490291 - RNA, 18 nt, Human
acggagaaucagagaguc

SEQ ID NO: 490292 - RNA, 25 nt, Human
acuauguugcccaggcucuucucga

SEQ ID NO: 490293 - RNA, 18 nt, Human
acucugucacccaggcua

SEQ ID NO: 490294 - RNA, 23 nt, Human
acucugucacccaggcuaaguaa

SEQ ID NO: 490295 - RNA, 19 nt, Human
agacaaguaaacuggcccu

SEQ ID NO: 490296 - RNA, 21 nt, Human
agauuuuuuuuuuuuuugaga

SEQ ID NO: 490297 - RNA, 24 nt, Human
agggcugggauuaugggcaugagc

SEQ ID NO: 490298 - RNA, 21 nt, Human
aguagcugggacuacaggcau

SEQ ID NO: 490299 - RNA, 25 nt, Human
aguagcugggacuacaggcauucau

SEQ ID NO: 490300 - RNA, 21 nt, Human
auccuccugccucagcuuccc

SEQ ID NO: 490301 - RNA, 19 nt, Human
augaugcugugggugccuu

SEQ ID NO: 490302 - RNA, 18 nt, Human
auggggucucacuauguu

SEQ ID NO: 490303 - RNA, 19 nt, Human
auggggucucacuauguug

SEQ ID NO: 490304 - RNA, 24 nt, Human
auuuuuuuuuuuuuugagauaggg

SEQ ID NO: 490305 - RNA, 24 nt, Human
caaagggcugggauuaugggcaug

SEQ ID NO: 490306 - RNA, 19 nt, Human
caacagaguucacaggugg

SEQ ID NO: 490307 - RNA, 22 nt, Human
caaguaaacuggcccuuaaugc

SEQ ID NO: 490308 - RNA, 21 nt, Human
cacaacccagcaaguguccuu

SEQ ID NO: 490309 - RNA, 20 nt, Human
cacaaggaguuccagguguu

SEQ ID NO: 490310 - RNA, 25 nt, Human
cacuauguugcccaggcucuucucg

SEQ ID NO: 490311 - RNA, 31 nt, Human
cacuauguugcccaggcucuucucgaacucc

SEQ ID NO: 490312 - RNA, 18 nt, Human
cacucugucacccaggcu

SEQ ID NO: 490313 - RNA, 21 nt, Human
cacucugucacccaggcuaag

SEQ ID NO: 490314 - RNA, 24 nt, Human
cacuguagccaugaccucccuggc

SEQ ID NO: 490315 - RNA, 26 nt, Human
cagauccccgagguggguugcgggga

SEQ ID NO: 490316 - RNA, 20 nt, Human
caguggcagccaguuccuca

SEQ ID NO: 490317 - RNA, 18 nt, Human
cauugcaaugccuccauu

SEQ ID NO: 490318 - RNA, 24 nt, Human
cauugcuuauccuuugauuggggg

SEQ ID NO: 490319 - RNA, 24 nt, Human
ccaaagggcugggauuaugggcau

SEQ ID NO: 490320 - RNA, 18 nt, Human
ccacagcuucaguccugg

SEQ ID NO: 490321 - RNA, 18 nt, Human
ccagagccagaggagaua

SEQ ID NO: 490322 - RNA, 22 nt, Human
cccauggcccgugcgcuccgcc

SEQ ID NO: 490323 - RNA, 19 nt, Human
cccggccgcggcgccucag

SEQ ID NO: 490324 - RNA, 19 nt, Human
cccgugcgcuccgcccggc

SEQ ID NO: 490325 - RNA, 20 nt, Human
cccgugcgcuccgcccggca

SEQ ID NO: 490326 - RNA, 22 nt, Human
cccuggcucaagugauccucuc

SEQ ID NO: 490327 - RNA, 23 nt, Human
cccuggcucaagugauccucuca

SEQ ID NO: 490328 - RNA, 24 nt, Human
ccggaguagcugggacuacaggca

SEQ ID NO: 490329 - RNA, 19 nt, Human
ccucccagcuccuuggguc

SEQ ID NO: 490330 - RNA, 23 nt, Human
ccucccagcuccuugggucucca

SEQ ID NO: 490331 - RNA, 26 nt, Human
ccuccugccucagcuucccaaagggc

SEQ ID NO: 490332 - RNA, 24 nt, Human
ccugccucagcuucccaaagggcu

SEQ ID NO: 490333 - RNA, 24 nt, Human
cgcucugucacccaggcuggaaug

SEQ ID NO: 490334 - RNA, 20 nt, Human
cggcccggcgggcucagcgg

SEQ ID NO: 490335 - RNA, 18 nt, Human
cucaagugauccucucac

SEQ ID NO: 490336 - RNA, 23 nt, Human
cucugucacccaggcuggaaugc

SEQ ID NO: 490337 - RNA, 26 nt, Human
gaaaaugcacauuuucaaggugcuuc

SEQ ID NO: 490338 - RNA, 22 nt, Human
gacuacaggcauucauuaccau

SEQ ID NO: 490339 - RNA, 20 nt, Human
gaguagcugggacuacaggc

SEQ ID NO: 490340 - RNA, 18 nt, Human
gauuaugggcaugagcca

SEQ ID NO: 490341 - RNA, 18 nt, Human
gauuaugggcaugagcca

SEQ ID NO: 490342 - RNA, 22 nt, Human
gauuaugggcaugagccaucac

SEQ ID NO: 490343 - RNA, 21 nt, Human
gcaaacuucuucccacaagga

SEQ ID NO: 490344 - RNA, 20 nt, Human
gcaaagagagaacauccagu

SEQ ID NO: 490345 - RNA, 20 nt, Human
gcacaacccagcaagugucc

SEQ ID NO: 490346 - RNA, 24 nt, Human
gccucagcuucccaaagggcuggg

SEQ ID NO: 490347 - RNA, 19 nt, Human
gcuggaaugcaauggcgca

SEQ ID NO: 490348 - RNA, 22 nt, Human
ggagagggacccggccgcggcg

SEQ ID NO: 490349 - RNA, 23 nt, Human
ggauuaugggcaugagccaucac

SEQ ID NO: 490350 - RNA, 20 nt, Human
ggcaugagccaucacaccca

SEQ ID NO: 490351 - RNA, 18 nt, Human
ggcgccucagccaggccu

SEQ ID NO: 490352 - RNA, 21 nt, Human
gggcacugauggugggcagcc

SEQ ID NO: 490353 - RNA, 22 nt, Human
gggcacugauggugggcagcca

SEQ ID NO: 490354 - RNA, 19 nt, Human
gggcagccagggccgaggu

SEQ ID NO: 490355 - RNA, 18 nt, Human
gggggaggaggggauaga

SEQ ID NO: 490356 - RNA, 22 nt, Human
ggggucucacuauguugcccag

SEQ ID NO: 490357 - RNA, 22 nt, Human
gggucucacuauguugcccagg

SEQ ID NO: 490358 - RNA, 24 nt, Human
ggugcuuccagagccagaggagau

SEQ ID NO: 490359 - RNA, 21 nt, Human
gguugcggggaaggcccaggg

SEQ ID NO: 490360 - RNA, 22 nt, Human
uaaagccacagcuucaguccug

SEQ ID NO: 490361 - RNA, 24 nt, Human
uacacccaacagaguucacaggug

SEQ ID NO: 490362 - RNA, 22 nt, Human
uagagauggggucucacuaugu

SEQ ID NO: 490363 - RNA, 22 nt, Human
uagcagaguacacccaacagag

SEQ ID NO: 490364 - RNA, 24 nt, Human
uagggucucacucugucacccagg

SEQ ID NO: 490365 - RNA, 19 nt, Human
uauguugcccaggcucuuc

SEQ ID NO: 490366 - RNA, 24 nt, Human
uauguugcccaggcucuucucgaa

SEQ ID NO: 490367 - RNA, 20 nt, Human
ucacccaggcuggaaugcaa

SEQ ID NO: 490368 - RNA, 19 nt, Human
ucaccucccuaucugggca

SEQ ID NO: 490369 - RNA, 18 nt, Human
ucaggaaggacacaggcu

SEQ ID NO: 490370 - RNA, 19 nt, Human
ucaguccuggcagaguuca

SEQ ID NO: 490371 - RNA, 18 nt, Human
uccauuucagaugugaga

SEQ ID NO: 490372 - RNA, 19 nt, Human
ucccaaagggcugggauua

SEQ ID NO: 490373 - RNA, 24 nt, Human
ucccaaagggcugggauuaugggc

SEQ ID NO: 490374 - RNA, 25 nt, Human
uccccagaacuuagcagaguacacc

SEQ ID NO: 490375 - RNA, 24 nt, Human
ucccuggcucaagugauccucuca

SEQ ID NO: 490376 - RNA, 24 nt, Human
uccggaguagcugggacuacaggc

SEQ ID NO: 490377 - RNA, 20 nt, Human
uccuugggucuccauugaag

SEQ ID NO: 490378 - RNA, 19 nt, Human
ucucacuauguugcccagg

SEQ ID NO: 490379 - RNA, 26 nt, Human
ucucacuauguugcccaggcucuucu

SEQ ID NO: 490380 - RNA, 27 nt, Human
ucucacuauguugcccaggcucuucuc

SEQ ID NO: 490381 - RNA, 19 nt, Human
ucucacucugucacccagg

SEQ ID NO: 490382 - RNA, 23 nt, Human
ucucacucugucacccaggcuaa

SEQ ID NO: 490383 - RNA, 25 nt, Human
ucucacucugucacccaggcuaagu

SEQ ID NO: 490384 - RNA, 19 nt, Human
ucucgaacuccuggucuca

SEQ ID NO: 490385 - RNA, 19 nt, Human
ucucgcucugucacccagg

SEQ ID NO: 490386 - RNA, 23 nt, Human
ucucgcucugucacccaggcugg

SEQ ID NO: 490387 - RNA, 24 nt, Human
ucucgcucugucacccaggcugga

SEQ ID NO: 490388 - RNA, 26 nt, Human
ucucgcucugucacccaggcuggaau

SEQ ID NO: 490389 - RNA, 27 nt, Human
ucucgcucugucacccaggcuggaaug

SEQ ID NO: 490390 - RNA, 20 nt, Human
ucugucacccaggcuaagua

SEQ ID NO: 490391 - RNA, 24 nt, Human
ucugucacccaggcuggaaugcaa

SEQ ID NO: 490392 - RNA, 22 nt, Human
ugagauagggucucacucuguc

SEQ ID NO: 490393 - RNA, 22 nt, Human
ugauacggagucucgcucuguc

SEQ ID NO: 490394 - RNA, 23 nt, Human
ugccaggaauggcugcugacugc

SEQ ID NO: 490395 - RNA, 24 nt, Human
ugcccaggcucuucucgaacuccu

SEQ ID NO: 490396 - RNA, 24 nt, Human
ugccucagcuucccaaagggcugg

SEQ ID NO: 490397 - RNA, 23 nt, Human
ugcucuguuucucuaacauuuca

SEQ ID NO: 490398 - RNA, 22 nt, Human
ugcugacugcggggcacugaug

SEQ ID NO: 490399 - RNA, 25 nt, Human
uggcagaguucacugccaggaaugg

SEQ ID NO: 490400 - RNA, 25 nt, Human
uggcgcaaucucacugcgcccggaa

SEQ ID NO: 490401 - RNA, 18 nt, Human
uggcucaagugauccucu

SEQ ID NO: 490402 - RNA, 19 nt, Human
ugggacuacaggcauucau

SEQ ID NO: 490403 - RNA, 22 nt, Human
ugggacuacaggcauucauuaa

SEQ ID NO: 490404 - RNA, 24 nt, Human
ugggacuacaggcauucauuacca

SEQ ID NO: 490405 - RNA, 18 nt, Human
ugggauuaugggcaugag

SEQ ID NO: 490406 - RNA, 19 nt, Human
ugggauuaugggcaugagc

SEQ ID NO: 490407 - RNA, 21 nt, Human
ugggauuaugggcaugagcca

SEQ ID NO: 490408 - RNA, 22 nt, Human
ugggauuaugggcaugagccau

SEQ ID NO: 490409 - RNA, 23 nt, Human
ugggauuaugggcaugagccauc

SEQ ID NO: 490410 - RNA, 24 nt, Human
ugggauuaugggcaugagccauca

SEQ ID NO: 490411 - RNA, 24 nt, Human
uggggucucacuauguugcccagg

SEQ ID NO: 490412 - RNA, 25 nt, Human
ugggucagauguuuagcagaaugcc

SEQ ID NO: 490413 - RNA, 26 nt, Human
ugggugccuuuucauugcaaugccuc

SEQ ID NO: 490414 - RNA, 24 nt, Human
uguagagauggggucucacuaugu

SEQ ID NO: 490415 - RNA, 18 nt, Human
ugucacccaggcuaagua

SEQ ID NO: 490416 - RNA, 18 nt, Human
uguccggaguagcuggga

SEQ ID NO: 490417 - RNA, 19 nt, Human
uuaaugcacaacccagcaa

SEQ ID NO: 490418 - RNA, 24 nt, Human
uuaccauguccagcuaauuuuuuu

SEQ ID NO: 490419 - RNA, 22 nt, Human
uucacugccaggaauggcugcu

SEQ ID NO: 490420 - RNA, 24 nt, Human
uucaucuaugcaccagauccucag

SEQ ID NO: 490421 - RNA, 19 nt, Human
uucccacaaggaguuccag

SEQ ID NO: 490422 - RNA, 19 nt, Human
uucugcguggugcuugaag

SEQ ID NO: 490423 - RNA, 23 nt, Human
uugaagcaaagagagaacaucca

SEQ ID NO: 490424 - RNA, 24 nt, Human
uuguagagauggggucucacuaug

SEQ ID NO: 490425 - RNA, 18 nt, Human
uuuguagagauggggucu

SEQ ID NO: 490426 - RNA, 24 nt, Human
uuuguagagauggggucucacuau

SEQ ID NO: 490427 - RNA, 22 nt, Human
uuuuuuuuuugaaggcaagacu

SEQ ID NO: 490428 - RNA, 23 nt, Human
uuuuuuuuuugagauagggucuc

SEQ ID NO: 490429 - RNA, 23 nt, Human
uuuuuuuuuuuugagauaggguc

SEQ ID NO: 490430 - RNA, 26 nt, Human
uuuuuuuuuuuugagauagggucuca

SEQ ID NO: 490431 - RNA, 20 nt, Human
agcuugccugcuguggggcc

SEQ ID NO: 490432 - RNA, 22 nt, Human
aggcacuuucugucccaggaag

SEQ ID NO: 490433 - RNA, 22 nt, Human
agggggaaggaggagagggacc

SEQ ID NO: 490434 - RNA, 23 nt, Human
augagggggaaggaggagaggga

SEQ ID NO: 490435 - RNA, 19 nt, Human
caauucuuuccccaagggg

SEQ ID NO: 490436 - RNA, 21 nt, Human
ccuggaggccgggccccuggg

SEQ ID NO: 490437 - RNA, 18 nt, Human
cucagcuugccugcugug

SEQ ID NO: 490438 - RNA, 21 nt, Human
cuggggaugcagguggaggca

SEQ ID NO: 490439 - RNA, 22 nt, Human
gaaggggagaugagggggaagg

SEQ ID NO: 490440 - RNA, 20 nt, Human
gagggggaaggaggagaggg

SEQ ID NO: 490441 - RNA, 20 nt, Human
gaugagggggaaggaggaga

SEQ ID NO: 490442 - RNA, 24 nt, Human
gaugagggggaaggaggagaggga

SEQ ID NO: 490443 - RNA, 18 nt, Human
gcagguggaggcacuuuc

SEQ ID NO: 490444 - RNA, 21 nt, Human
gcccuggaggccgggccccug

SEQ ID NO: 490445 - RNA, 20 nt, Human
ggaagggaggcaggcgcggg

SEQ ID NO: 490446 - RNA, 21 nt, Human
ggggaaagggguguccuagga

SEQ ID NO: 490447 - RNA, 24 nt, Human
gggggcacaauucuuuccccaagg

SEQ ID NO: 490448 - RNA, 18 nt, Human
uggcggggaagggaggca

SEQ ID NO: 490449 - RNA, 20 nt, Human
uggcggggaagggaggcagg

SEQ ID NO: 490450 - RNA, 22 nt, Human
uggcggggaagggaggcaggcg

SEQ ID NO: 490451 - RNA, 19 nt, Human
uggggccagcgggcccugg

SEQ ID NO: 490452 - RNA, 19 nt, Human
aaggugccuccggaggagg

SEQ ID NO: 490453 - RNA, 19 nt, Human
aaguggcuugugacaugag

SEQ ID NO: 490454 - RNA, 21 nt, Human
accagccgacuggccuuagcc

SEQ ID NO: 490455 - RNA, 22 nt, Human
acccgacgaugcagcacccccc

SEQ ID NO: 490456 - RNA, 19 nt, Human
acgcagggccgcggccggg

SEQ ID NO: 490457 - RNA, 23 nt, Human
acgugaggcuucaagagacucag

SEQ ID NO: 490458 - RNA, 23 nt, Human
agacagagguuccccaggugggg

SEQ ID NO: 490459 - RNA, 21 nt, Human
agacccgccagcaggggccug

SEQ ID NO: 490460 - RNA, 23 nt, Human
agagccccucccgcccagcaccc

SEQ ID NO: 490461 - RNA, 25 nt, Human
agcaggcaagagaguuggggggccg

SEQ ID NO: 490462 - RNA, 18 nt, Human
agccacguggccuuggga

SEQ ID NO: 490463 - RNA, 25 nt, Human
aggcaagagaguuggggggccgggu

SEQ ID NO: 490464 - RNA, 23 nt, Human
aggcccugcaauaugagccgaaa

SEQ ID NO: 490465 - RNA, 20 nt, Human
aggggccuggggcaagaggc

SEQ ID NO: 490466 - RNA, 22 nt, Human
agggggaggcuggucaggggca

SEQ ID NO: 490467 - RNA, 20 nt, Human
caagagacucaguguggggc

SEQ ID NO: 490468 - RNA, 22 nt, Human
caagagaguuggggggccgggu

SEQ ID NO: 490469 - RNA, 20 nt, Human
cacacgcagggccgcggccg

SEQ ID NO: 490470 - RNA, 22 nt, Human
cacagagaaaagacgcaagaca

SEQ ID NO: 490471 - RNA, 18 nt, Human
cacaggcccugaggacac

SEQ ID NO: 490472 - RNA, 21 nt, Human
cacaggcccugaggacacagg

SEQ ID NO: 490473 - RNA, 18 nt, Human
cacuggggcugccaggua

SEQ ID NO: 490474 - RNA, 22 nt, Human
cagcaggggccuggggcaagag

SEQ ID NO: 490475 - RNA, 19 nt, Human
cagcauugcauagugacca

SEQ ID NO: 490476 - RNA, 23 nt, Human
cagccacguggccuugggacgcc

SEQ ID NO: 490477 - RNA, 24 nt, Human
cagccuggaugcuggggucacuaa

SEQ ID NO: 490478 - RNA, 25 nt, Human
cagccuggaugcuggggucacuaag

SEQ ID NO: 490479 - RNA, 25 nt, Human
caggagggagccagcuaacagguca

SEQ ID NO: 490480 - RNA, 21 nt, Human
caggccagagccccucccgcc

SEQ ID NO: 490481 - RNA, 22 nt, Human
caggccccugaaaaggggugac

SEQ ID NO: 490482 - RNA, 21 nt, Human
caggcccugaggacacaggga

SEQ ID NO: 490483 - RNA, 23 nt, Human
cagggcugaggacccaggccaga

SEQ ID NO: 490484 - RNA, 21 nt, Human
caggucaguguucugggcaga

SEQ ID NO: 490485 - RNA, 20 nt, Human
ccacagagaaaagacgcaag

SEQ ID NO: 490486 - RNA, 20 nt, Human
ccacugugcccucagggagc

SEQ ID NO: 490487 - RNA, 21 nt, Human
ccagcacccgcgacgccagcc

SEQ ID NO: 490488 - RNA, 22 nt, Human
ccaggccccugaaaagggguga

SEQ ID NO: 490489 - RNA, 18 nt, Human
cccagcacccgcgacgcc

SEQ ID NO: 490490 - RNA, 19 nt, Human
ccccucccgcccagcaccc

SEQ ID NO: 490491 - RNA, 23 nt, Human
ccccugaaaaggggugaccugaa

SEQ ID NO: 490492 - RNA, 20 nt, Human
ccgggaugcggcuggggcug

SEQ ID NO: 490493 - RNA, 18 nt, Human
cgaaagaccccuggaccc

SEQ ID NO: 490494 - RNA, 23 nt, Human
cgaaagaccccuggacccaaggg

SEQ ID NO: 490495 - RNA, 18 nt, Human
cggaggaggccgggaugc

SEQ ID NO: 490496 - RNA, 19 nt, Human
cggcagccgcgccggcccg

SEQ ID NO: 490497 - RNA, 19 nt, Human
cggcgccccagcacugggg

SEQ ID NO: 490498 - RNA, 21 nt, Human
cggcuggggcugucuggcacg

SEQ ID NO: 490499 - RNA, 22 nt, Human
cgggguggcagcugcccggccu

SEQ ID NO: 490500 - RNA, 20 nt, Human
cucaagaguccacagagaaa

SEQ ID NO: 490501 - RNA, 18 nt, Human
cucagggagccuccccag

SEQ ID NO: 490502 - RNA, 24 nt, Human
cugcaauaugagccgaaagacccc

SEQ ID NO: 490503 - RNA, 21 nt, Human
cuggggcugucuggcacgggg

SEQ ID NO: 490504 - RNA, 22 nt, Human
cuggggcugucuggcacgggga

SEQ ID NO: 490505 - RNA, 20 nt, Human
cuuuaugcgcaggcucuggg

SEQ ID NO: 490506 - RNA, 23 nt, Human
gaccgcggcgccgagcggcagcc

SEQ ID NO: 490507 - RNA, 26 nt, Human
gaggcggggccaagcucacacaggga

SEQ ID NO: 490508 - RNA, 21 nt, Human
gagugggggaggcccugccuc

SEQ ID NO: 490509 - RNA, 24 nt, Human
gcagggccgcggccgggugggcgc

SEQ ID NO: 490510 - RNA, 18 nt, Human
gcccucgcucuccuccug

SEQ ID NO: 490511 - RNA, 20 nt, Human
gcgccagggacuucggggca

SEQ ID NO: 490512 - RNA, 18 nt, Human
gcgccgagcggcagccgc

SEQ ID NO: 490513 - RNA, 19 nt, Human
gcgccgagcggcagccgcg

SEQ ID NO: 490514 - RNA, 24 nt, Human
gcucaggcguccucaagaguccac

SEQ ID NO: 490515 - RNA, 19 nt, Human
ggaugcuggggucacuaag

SEQ ID NO: 490516 - RNA, 20 nt, Human
ggccacccuuucugcccugg

SEQ ID NO: 490517 - RNA, 20 nt, Human
ggcccucgcucuccuccugg

SEQ ID NO: 490518 - RNA, 22 nt, Human
ggccuuagccugaccugcgcug

SEQ ID NO: 490519 - RNA, 20 nt, Human
gggcagaaguggggcacgaa

SEQ ID NO: 490520 - RNA, 20 nt, Human
gggccgaguaccaggagaaa

SEQ ID NO: 490521 - RNA, 20 nt, Human
gggccgcggccgggugggcg

SEQ ID NO: 490522 - RNA, 18 nt, Human
ggggaaggggugcgugaa

SEQ ID NO: 490523 - RNA, 20 nt, Human
ggggaggcuggucaggggca

SEQ ID NO: 490524 - RNA, 18 nt, Human
ggggcgucgggccgggcg

SEQ ID NO: 490525 - RNA, 21 nt, Human
gggugugcaggagggagccag

SEQ ID NO: 490526 - RNA, 24 nt, Human
guaacacaggcccugaggacacag

SEQ ID NO: 490527 - RNA, 19 nt, Human
ucacaggcagcaggcaaga

SEQ ID NO: 490528 - RNA, 27 nt, Human
ucagacgaggccuauagcaaacccacu

SEQ ID NO: 490529 - RNA, 24 nt, Human
uccacagagaaaagacgcaagaca

SEQ ID NO: 490530 - RNA, 18 nt, Human
ucccgcccagcacccgcg

SEQ ID NO: 490531 - RNA, 19 nt, Human
ucccuggaugggccacccu

SEQ ID NO: 490532 - RNA, 23 nt, Human
ucgcucuccuccugggcgagcag

SEQ ID NO: 490533 - RNA, 21 nt, Human
ugacaugagcaacccaggccc

SEQ ID NO: 490534 - RNA, 21 nt, Human
ugaccugcgcugaguggggga

SEQ ID NO: 490535 - RNA, 20 nt, Human
ugcccugggaggaggcucug

SEQ ID NO: 490536 - RNA, 20 nt, Human
ugcggcuggggcugucuggc

SEQ ID NO: 490537 - RNA, 21 nt, Human
uggacccaagggggaggcugg

SEQ ID NO: 490538 - RNA, 19 nt, Human
uggcaaaguggcuuuaugc

SEQ ID NO: 490539 - RNA, 24 nt, Human
uggcaggcccugcaauaugagccg

SEQ ID NO: 490540 - RNA, 20 nt, Human
ugggaggaggcucuggggug

SEQ ID NO: 490541 - RNA, 23 nt, Human
ugggcagaaguggggcacgaagu

SEQ ID NO: 490542 - RNA, 19 nt, Human
uggggcaagaggcggggcc

SEQ ID NO: 490543 - RNA, 24 nt, Human
ugggggaggcccugccucccugcc

SEQ ID NO: 490544 - RNA, 24 nt, Human
uuuggggaaggggugcgugaaggc

SEQ ID NO: 490545 - RNA, 24 nt, Human
aaaaaaaagaccggaaaccacuga

SEQ ID NO: 490546 - RNA, 22 nt, Human
aaagcaauaaauuacaaggccc

SEQ ID NO: 490547 - RNA, 22 nt, Human
aacccacccccugcccacccug

SEQ ID NO: 490548 - RNA, 20 nt, Human
aacgcccuccccacgccccu

SEQ ID NO: 490549 - RNA, 18 nt, Human
aagaagauucacaccacu

SEQ ID NO: 490550 - RNA, 23 nt, Human
acagacacaacccgagagcaccc

SEQ ID NO: 490551 - RNA, 21 nt, Human
accacugccuccaaggagaug

SEQ ID NO: 490552 - RNA, 20 nt, Human
acccaguuuguggggaaggg

SEQ ID NO: 490553 - RNA, 19 nt, Human
accccaaaacgcccucccc

SEQ ID NO: 490554 - RNA, 26 nt, Human
accccaaaacgcccuccccacgcccc

SEQ ID NO: 490555 - RNA, 19 nt, Human
acccccaccccaacccacc

SEQ ID NO: 490556 - RNA, 21 nt, Human
acccccaccccaacccacccc

SEQ ID NO: 490557 - RNA, 19 nt, Human
acccccugcccacccuggg

SEQ ID NO: 490558 - RNA, 24 nt, Human
acccucccagccaccucgaauccu

SEQ ID NO: 490559 - RNA, 18 nt, Human
acccugggcuuccccuac

SEQ ID NO: 490560 - RNA, 19 nt, Human
accuccccuuccgcgaacc

SEQ ID NO: 490561 - RNA, 25 nt, Human
acgcccuccccacgccccugcccgc

SEQ ID NO: 490562 - RNA, 22 nt, Human
agaaaaaaaaaaaaaaaaaaag

SEQ ID NO: 490563 - RNA, 24 nt, Human
agacacaacccgagagcaccccca

SEQ ID NO: 490564 - RNA, 18 nt, Human
agacccagagcaauccga

SEQ ID NO: 490565 - RNA, 19 nt, Human
agaccggaaaccacugaca

SEQ ID NO: 490566 - RNA, 25 nt, Human
agagcacccccaccccaacccaccc

SEQ ID NO: 490567 - RNA, 19 nt, Human
agcacccccaccccaaccc

SEQ ID NO: 490568 - RNA, 19 nt, Human
aggcagggcugggccaggu

SEQ ID NO: 490569 - RNA, 19 nt, Human
aguguggaaacaauggaga

SEQ ID NO: 490570 - RNA, 27 nt, Human
aguuuguggggaaggggcagggggccu

SEQ ID NO: 490571 - RNA, 18 nt, Human
caaccaccucuggcccug

SEQ ID NO: 490572 - RNA, 19 nt, Human
caaggcccccgcagcccuc

SEQ ID NO: 490573 - RNA, 25 nt, Human
caagucccggggcuagcccuccccu

SEQ ID NO: 490574 - RNA, 24 nt, Human
caccccaacccacccccugcccac

SEQ ID NO: 490575 - RNA, 22 nt, Human
cacccccaccccaacccacccc

SEQ ID NO: 490576 - RNA, 23 nt, Human
cacccccaccccaacccaccccc

SEQ ID NO: 490577 - RNA, 22 nt, Human
cacccccaugagcagcaggggu

SEQ ID NO: 490578 - RNA, 22 nt, Human
cacccccugcccacccugggcu

SEQ ID NO: 490579 - RNA, 24 nt, Human
caccucgaauccucucagcccugg

SEQ ID NO: 490580 - RNA, 19 nt, Human
cacuuccucuuuaauugcu

SEQ ID NO: 490581 - RNA, 19 nt, Human
cagagcaauccgagugugg

SEQ ID NO: 490582 - RNA, 19 nt, Human
cagcagggguccugccccu

SEQ ID NO: 490583 - RNA, 23 nt, Human
caggaccgggucuucuuuccgcc

SEQ ID NO: 490584 - RNA, 21 nt, Human
caggcucuugguuccccccgg

SEQ ID NO: 490585 - RNA, 19 nt, Human
cagugggagggaggggcug

SEQ ID NO: 490586 - RNA, 20 nt, Human
caucccuucucccucccaag

SEQ ID NO: 490587 - RNA, 22 nt, Human
cauguccaagcgccuaggagcc

SEQ ID NO: 490588 - RNA, 25 nt, Human
ccacccccaugagcagcaggggucc

SEQ ID NO: 490589 - RNA, 22 nt, Human
ccagaaaaaaaaaaaaaaaaaa

SEQ ID NO: 490590 - RNA, 23 nt, Human
ccagaaaaaaaaaaaaaaaaaaa

SEQ ID NO: 490591 - RNA, 21 nt, Human
ccagugggagggaggggcugg

SEQ ID NO: 490592 - RNA, 19 nt, Human
ccaucccuucucccuccca

SEQ ID NO: 490593 - RNA, 21 nt, Human
ccauguacuaaacccucccuc

SEQ ID NO: 490594 - RNA, 19 nt, Human
ccauguuggggaacaaagc

SEQ ID NO: 490595 - RNA, 22 nt, Human
cccaccccaacccacccccugc

SEQ ID NO: 490596 - RNA, 21 nt, Human
cccaccucucuccccucccca

SEQ ID NO: 490597 - RNA, 24 nt, Human
cccaccucucuccccuccccaauu

SEQ ID NO: 490598 - RNA, 18 nt, Human
ccccaaaacgcccucccc

SEQ ID NO: 490599 - RNA, 18 nt, Human
ccccaaaacgcccucccc

SEQ ID NO: 490600 - RNA, 20 nt, Human
ccccaaaccucagaaggccc

SEQ ID NO: 490601 - RNA, 21 nt, Human
ccccaaaccucagaaggcccc

SEQ ID NO: 490602 - RNA, 22 nt, Human
ccccaagucccggggcuagccc

SEQ ID NO: 490603 - RNA, 24 nt, Human
cccccaaaccucagaaggccccuu

SEQ ID NO: 490604 - RNA, 19 nt, Human
cccccaccccaacccaccc

SEQ ID NO: 490605 - RNA, 21 nt, Human
cccccauccccauguugggga

SEQ ID NO: 490606 - RNA, 28 nt, Human
cccccaugagcagcagggguccugcccu

SEQ ID NO: 490607 - RNA, 22 nt, Human
cccccggacucuuuagcuucca

SEQ ID NO: 490608 - RNA, 21 nt, Human
ccccgcagcccucuuagcccg

SEQ ID NO: 490609 - RNA, 21 nt, Human
ccccuagggggcacaagcggg

SEQ ID NO: 490610 - RNA, 18 nt, Human
ccccugcccacccugggc

SEQ ID NO: 490611 - RNA, 22 nt, Human
ccccugcccacccugggcuucc

SEQ ID NO: 490612 - RNA, 26 nt, Human
ccccugcccacccugggcuuccccua

SEQ ID NO: 490613 - RNA, 19 nt, Human
ccccugcccgcccccaucc

SEQ ID NO: 490614 - RNA, 20 nt, Human
ccccugcccgcccccauccc

SEQ ID NO: 490615 - RNA, 21 nt, Human
cccuaccccaaaacgcccucc

SEQ ID NO: 490616 - RNA, 24 nt, Human
cccuaccccaaaacgcccucccca

SEQ ID NO: 490617 - RNA, 23 nt, Human
cccucccagccaccucgaauccu

SEQ ID NO: 490618 - RNA, 23 nt, Human
cccuccccacgccccugcccgcc

SEQ ID NO: 490619 - RNA, 24 nt, Human
ccuaggagcccguaccgcugggga

SEQ ID NO: 490620 - RNA, 20 nt, Human
ccucccaagauaguaguggg

SEQ ID NO: 490621 - RNA, 19 nt, Human
ccuccccacgccccugccc

SEQ ID NO: 490622 - RNA, 18 nt, Human
ccuccccuuccgcgaacc

SEQ ID NO: 490623 - RNA, 23 nt, Human
ccugcuccaucccuucucccucc

SEQ ID NO: 490624 - RNA, 30 nt, Human
ccuugcccccaccucucuccccuccccaag

SEQ ID NO: 490625 - RNA, 23 nt, Human
cgagagcacccccaccccaaccc

SEQ ID NO: 490626 - RNA, 24 nt, Human
cgagagcacccccaccccaaccca

SEQ ID NO: 490627 - RNA, 21 nt, Human
cgccccaggagccagccuggg

SEQ ID NO: 490628 - RNA, 19 nt, Human
cgugggggcugugcccucg

SEQ ID NO: 490629 - RNA, 20 nt, Human
cuaaacccucccucuggcgu

SEQ ID NO: 490630 - RNA, 24 nt, Human
cuagcccucccauguacuaaaccc

SEQ ID NO: 490631 - RNA, 23 nt, Human
cucguuggggagagggaggugag

SEQ ID NO: 490632 - RNA, 21 nt, Human
cuugccaggcuaacaaccacc

SEQ ID NO: 490633 - RNA, 19 nt, Human
gaaagaauaaugggggagg

SEQ ID NO: 490634 - RNA, 21 nt, Human
gaccggaaaccacugacacag

SEQ ID NO: 490635 - RNA, 22 nt, Human
gagcaauccgaguguggaaaca

SEQ ID NO: 490636 - RNA, 21 nt, Human
gagggggcguguugagcuggg

SEQ ID NO: 490637 - RNA, 22 nt, Human
gcagcccucuuagcccgcuccu

SEQ ID NO: 490638 - RNA, 25 nt, Human
gcccaagggcuggguuggcugaggg

SEQ ID NO: 490639 - RNA, 21 nt, Human
gcccacccugggcuuccccua

SEQ ID NO: 490640 - RNA, 23 nt, Human
gcccuacagcccccaaaccucag

SEQ ID NO: 490641 - RNA, 18 nt, Human
gcccuugcccccuucacu

SEQ ID NO: 490642 - RNA, 24 nt, Human
gcgaaccccgagcggguagaccca

SEQ ID NO: 490643 - RNA, 24 nt, Human
gcugagggaggcagggcugggcca

SEQ ID NO: 490644 - RNA, 18 nt, Human
gcuuccccuaccccaaaa

SEQ ID NO: 490645 - RNA, 22 nt, Human
ggaaacaauggagagggggccg

SEQ ID NO: 490646 - RNA, 23 nt, Human
ggagagggggcguguugagcugg

SEQ ID NO: 490647 - RNA, 21 nt, Human
ggagcugcuccagugggaggg

SEQ ID NO: 490648 - RNA, 25 nt, Human
ggaggcagggcugggcccccaaggg

SEQ ID NO: 490649 - RNA, 21 nt, Human
gggcggggugcggaucggaga

SEQ ID NO: 490650 - RNA, 23 nt, Human
ggguaggaagugcucccgugggg

SEQ ID NO: 490651 - RNA, 20 nt, Human
ggguccugccccucgcugcc

SEQ ID NO: 490652 - RNA, 21 nt, Human
gguaggaagugcucccguggg

SEQ ID NO: 490653 - RNA, 23 nt, Human
gguuggcugagggaggcagggcu

SEQ ID NO: 490654 - RNA, 18 nt, Human
guuugugucuucuggaag

SEQ ID NO: 490655 - RNA, 21 nt, Human
uaccccaaaacgcccucccca

SEQ ID NO: 490656 - RNA, 22 nt, Human
uaccccaaaacgcccuccccac

SEQ ID NO: 490657 - RNA, 23 nt, Human
uaccccagaucaccacgggcgcu

SEQ ID NO: 490658 - RNA, 23 nt, Human
uaccgcuggggaccuccccuucc

SEQ ID NO: 490659 - RNA, 20 nt, Human
uacuaaacccucccucuggc

SEQ ID NO: 490660 - RNA, 26 nt, Human
uagcccucccauguacuaaacccucc

SEQ ID NO: 490661 - RNA, 20 nt, Human
uaggaagugcucccgugggg

SEQ ID NO: 490662 - RNA, 25 nt, Human
uaguagugggagggacccaggcucu

SEQ ID NO: 490663 - RNA, 21 nt, Human
ucacggucacagacacaaccc

SEQ ID NO: 490664 - RNA, 22 nt, Human
ucccucuggcguggcgucgccc

SEQ ID NO: 490665 - RNA, 18 nt, Human
uccgcccuaucacccagu

SEQ ID NO: 490666 - RNA, 23 nt, Human
uccgcgaaccccgagcggguaga

SEQ ID NO: 490667 - RNA, 22 nt, Human
uccucucagcccuggcugggag

SEQ ID NO: 490668 - RNA, 21 nt, Human
ucgaauccucucagcccuggc

SEQ ID NO: 490669 - RNA, 20 nt, Human
ucgcugcccuugcccccuuc

SEQ ID NO: 490670 - RNA, 19 nt, Human
ucuggagcugcuccagugg

SEQ ID NO: 490671 - RNA, 18 nt, Human
ugagggaggcagggcugg

SEQ ID NO: 490672 - RNA, 18 nt, Human
ugccaggcuaacaaccac

SEQ ID NO: 490673 - RNA, 18 nt, Human
ugcccggcccgcgugggg

SEQ ID NO: 490674 - RNA, 18 nt, Human
ugcccggcccgcgugggg

SEQ ID NO: 490675 - RNA, 20 nt, Human
ugcccuugcccccuucacug

SEQ ID NO: 490676 - RNA, 20 nt, Human
ugcuccaucccuucucccuc

SEQ ID NO: 490677 - RNA, 22 nt, Human
uggagagggggcguguugagcc

SEQ ID NO: 490678 - RNA, 24 nt, Human
uggagagggggcguguugagcugg

SEQ ID NO: 490679 - RNA, 20 nt, Human
uggcugagggaggcagggcu

SEQ ID NO: 490680 - RNA, 24 nt, Human
uggcugagggaggcagggcugggc

SEQ ID NO: 490681 - RNA, 20 nt, Human
ugggagaggucacgggggug

SEQ ID NO: 490682 - RNA, 18 nt, Human
ugggagggacccaggcuc

SEQ ID NO: 490683 - RNA, 20 nt, Human
uggggaaggggcagggggcc

SEQ ID NO: 490684 - RNA, 22 nt, Human
uggggagagggaggugaguuug

SEQ ID NO: 490685 - RNA, 25 nt, Human
ugggggaggggucccacuguagggg

SEQ ID NO: 490686 - RNA, 21 nt, Human
uguggggaaggggcagggggc

SEQ ID NO: 490687 - RNA, 24 nt, Human
uuacaaggcccccgcagcccucuu

SEQ ID NO: 490688 - RNA, 23 nt, Human
uuguggggaaggggcagggggcc

SEQ ID NO: 490689 - RNA, 20 nt, Human
aagccaguauucucccugga

SEQ ID NO: 490690 - RNA, 22 nt, Human
aagccaguauucucccuggaca

SEQ ID NO: 490691 - RNA, 24 nt, Human
acuaacacauccaccucggcaaaa

SEQ ID NO: 490692 - RNA, 22 nt, Human
agaagaaaggcgcgggcggagc

SEQ ID NO: 490693 - RNA, 25 nt, Human
agaagaaaggcgcgggcggagcagg

SEQ ID NO: 490694 - RNA, 25 nt, Human
agagauggaauccaaguguuccguu

SEQ ID NO: 490695 - RNA, 24 nt, Human
agcagccauuaaagcccaggcagc

SEQ ID NO: 490696 - RNA, 18 nt, Human
agcuacaacugauuugac

SEQ ID NO: 490697 - RNA, 19 nt, Human
aggaagagggaggggaugc

SEQ ID NO: 490698 - RNA, 22 nt, Human
aggcccgucgcucucuccugug

SEQ ID NO: 490699 - RNA, 23 nt, Human
aggcgccgcgcccggagccgcgc

SEQ ID NO: 490700 - RNA, 19 nt, Human
agggaggggaugcgacggg

SEQ ID NO: 490701 - RNA, 23 nt, Human
auugcaaucacaucguggcaauc

SEQ ID NO: 490702 - RNA, 20 nt, Human
caaagggccgaggcccgucg

SEQ ID NO: 490703 - RNA, 21 nt, Human
caaauauauuuucacacaucu

SEQ ID NO: 490704 - RNA, 23 nt, Human
caacugauuugacacacaccauc

SEQ ID NO: 490705 - RNA, 22 nt, Human
caaggguccugcgccaugugcu

SEQ ID NO: 490706 - RNA, 23 nt, Human
cacaccaucauaggggcuucaaa

SEQ ID NO: 490707 - RNA, 21 nt, Human
cauaggggcuucaaaccugac

SEQ ID NO: 490708 - RNA, 26 nt, Human
caucaaagggccgaggcccgucgcuc

SEQ ID NO: 490709 - RNA, 21 nt, Human
cccccgccgccgccgccccgc

SEQ ID NO: 490710 - RNA, 22 nt, Human
cccccgccgccgccgccccgcg

SEQ ID NO: 490711 - RNA, 21 nt, Human
cccccgcgcgagcccgccgcg

SEQ ID NO: 490712 - RNA, 19 nt, Human
cccccggggagccgggccc

SEQ ID NO: 490713 - RNA, 22 nt, Human
cccccggggagccgggcccgcc

SEQ ID NO: 490714 - RNA, 22 nt, Human
ccccgcgcgagcccgccgcgcg

SEQ ID NO: 490715 - RNA, 22 nt, Human
ccccugggcaguguggccgcgc

SEQ ID NO: 490716 - RNA, 19 nt, Human
cccgccgcgcgccgcccgc

SEQ ID NO: 490717 - RNA, 21 nt, Human
cccgccgcgcgccgcccgccg

SEQ ID NO: 490718 - RNA, 19 nt, Human
cccgcgcgagcccgccgcg

SEQ ID NO: 490719 - RNA, 20 nt, Human
cccgcgcgagcccgccgcgg

SEQ ID NO: 490720 - RNA, 24 nt, Human
cccgcgggccgccgagcccggggc

SEQ ID NO: 490721 - RNA, 19 nt, Human
ccgcccggcgcgccggggc

SEQ ID NO: 490722 - RNA, 21 nt, Human
ccgcccggggggagcgcgccc

SEQ ID NO: 490723 - RNA, 18 nt, Human
ccgccgccgccccgcgcc

SEQ ID NO: 490724 - RNA, 20 nt, Human
ccgccgccgccccgcgcccc

SEQ ID NO: 490725 - RNA, 25 nt, Human
ccgccgccgccgccccgcgccccgg

SEQ ID NO: 490726 - RNA, 21 nt, Human
ccgccgcgcgccgcccgccga

SEQ ID NO: 490727 - RNA, 21 nt, Human
ccgccgcgcuccgagcgccgg

SEQ ID NO: 490728 - RNA, 22 nt, Human
ccgcgcgccccccgccgccgcc

SEQ ID NO: 490729 - RNA, 25 nt, Human
ccgcgcgccccccgccgccgccgcc

SEQ ID NO: 490730 - RNA, 18 nt, Human
ccgcgcgcugcguacugc

SEQ ID NO: 490731 - RNA, 21 nt, Human
ccggggggagcgcgcccccau

SEQ ID NO: 490732 - RNA, 22 nt, Human
ccuccccucccccucgcguccc

SEQ ID NO: 490733 - RNA, 18 nt, Human
ccugagccgcagccgccu

SEQ ID NO: 490734 - RNA, 22 nt, Human
cgaaauauacucgaaaugcuau

SEQ ID NO: 490735 - RNA, 23 nt, Human
cgagcgccggggccgagggccga

SEQ ID NO: 490736 - RNA, 24 nt, Human
cgaggcccgucgcucucuccugug

SEQ ID NO: 490737 - RNA, 22 nt, Human
cgccccgcgccccggggcccgc

SEQ ID NO: 490738 - RNA, 23 nt, Human
cgccgcagcccccggggagccgg

SEQ ID NO: 490739 - RNA, 25 nt, Human
cgccgccccgcgccccggggcccgc

SEQ ID NO: 490740 - RNA, 20 nt, Human
cgccgcccggcgcgccgggg

SEQ ID NO: 490741 - RNA, 19 nt, Human
cgccggggcccccgcgcga

SEQ ID NO: 490742 - RNA, 25 nt, Human
cgccuccccucccccucgcgucccc

SEQ ID NO: 490743 - RNA, 19 nt, Human
cggcgcgccggggcccccg

SEQ ID NO: 490744 - RNA, 19 nt, Human
cgggaagaacucggcugua

SEQ ID NO: 490745 - RNA, 18 nt, Human
cuccuggccguggcgugg

SEQ ID NO: 490746 - RNA, 29 nt, Human
cuccuuguuccucgccuccccucccccuu

SEQ ID NO: 490747 - RNA, 21 nt, Human
cucuuacagucggaaaaaaac

SEQ ID NO: 490748 - RNA, 20 nt, Human
cugagccgcagccgccuucc

SEQ ID NO: 490749 - RNA, 21 nt, Human
cugcagucucccggccgccuc

SEQ ID NO: 490750 - RNA, 27 nt, Human
cuggccguggcguggguccggcccggg

SEQ ID NO: 490751 - RNA, 27 nt, Human
cuucaaaccugacaaacucugugcuug

SEQ ID NO: 490752 - RNA, 20 nt, Human
gaaaaaaacagccuuuugug

SEQ ID NO: 490753 - RNA, 22 nt, Human
gacugaaaaauuaaacagauac

SEQ ID NO: 490754 - RNA, 21 nt, Human
gagagugggugggcgggaggg

SEQ ID NO: 490755 - RNA, 19 nt, Human
gagcagccauuaaagccca

SEQ ID NO: 490756 - RNA, 18 nt, Human
gagcccggggcgccgcag

SEQ ID NO: 490757 - RNA, 21 nt, Human
gagggagguggccaccaggaa

SEQ ID NO: 490758 - RNA, 23 nt, Human
gccccccgccgccgccgccccgc

SEQ ID NO: 490759 - RNA, 19 nt, Human
gccccgaaggaggcuugcu

SEQ ID NO: 490760 - RNA, 21 nt, Human
gccccggggcccgcgggcccc

SEQ ID NO: 490761 - RNA, 22 nt, Human
gccgcagccgccuuccagcccu

SEQ ID NO: 490762 - RNA, 18 nt, Human
gccgcgcccggagccgcg

SEQ ID NO: 490763 - RNA, 18 nt, Human
gcgccggggcccccgcgc

SEQ ID NO: 490764 - RNA, 23 nt, Human
gcgcgggcggagcaggcgcgggg

SEQ ID NO: 490765 - RNA, 19 nt, Human
gcggcgagcaggcgggcac

SEQ ID NO: 490766 - RNA, 19 nt, Human
gcgggugcggccggccccg

SEQ ID NO: 490767 - RNA, 22 nt, Human
ggagcagccauuaaagcccagg

SEQ ID NO: 490768 - RNA, 21 nt, Human
ggcuugaaagaacaugucugg

SEQ ID NO: 490769 - RNA, 27 nt, Human
gggcaguguggccgcgcugcucugggc

SEQ ID NO: 490770 - RNA, 20 nt, Human
gggcggagcaggcgcggggc

SEQ ID NO: 490771 - RNA, 18 nt, Human
ggggaguuuaugaaaagg

SEQ ID NO: 490772 - RNA, 19 nt, Human
ggggugagagugggugggc

SEQ ID NO: 490773 - RNA, 18 nt, Human
gggugagagugggugggc

SEQ ID NO: 490774 - RNA, 20 nt, Human
gguuuugugauuuuguuuga

SEQ ID NO: 490775 - RNA, 23 nt, Human
guuuggggugagagugggugggc

SEQ ID NO: 490776 - RNA, 27 nt, Human
uaaauacauaacacagaagccugugug

SEQ ID NO: 490777 - RNA, 21 nt, Human
uaacacagaagccugugugac

SEQ ID NO: 490778 - RNA, 19 nt, Human
uacuaugugcucaacugcc

SEQ ID NO: 490779 - RNA, 21 nt, Human
uacugcgccgcccggcgcgcc

SEQ ID NO: 490780 - RNA, 21 nt, Human
uagcugaauuugugguuuccu

SEQ ID NO: 490781 - RNA, 19 nt, Human
uauuuuucccauuuuguuu

SEQ ID NO: 490782 - RNA, 21 nt, Human
ucaucaaagggccgaggcccg

SEQ ID NO: 490783 - RNA, 20 nt, Human
uccccucccccucgcguccc

SEQ ID NO: 490784 - RNA, 25 nt, Human
ucccuugugccaccaggacaagggu

SEQ ID NO: 490785 - RNA, 19 nt, Human
uccucgccuccccuccccc

SEQ ID NO: 490786 - RNA, 19 nt, Human
uccugagccgcagccgccu

SEQ ID NO: 490787 - RNA, 18 nt, Human
ucucccuggacagauuag

SEQ ID NO: 490788 - RNA, 19 nt, Human
ugaaagaacaugucuggga

SEQ ID NO: 490789 - RNA, 23 nt, Human
ugacaaacucugugcuugcuucu

SEQ ID NO: 490790 - RNA, 20 nt, Human
ugacuuccugagccgcagcc

SEQ ID NO: 490791 - RNA, 21 nt, Human
ugagagugggugggcgggagg

SEQ ID NO: 490792 - RNA, 21 nt, Human
ugcggccggccccgaaggagg

SEQ ID NO: 490793 - RNA, 28 nt, Human
ugcgggaagaacucggcugaucagugga

SEQ ID NO: 490794 - RNA, 22 nt, Human
uggccgggacgcgcggccggcg

SEQ ID NO: 490795 - RNA, 21 nt, Human
uggcguggguccgcgcgcugc

SEQ ID NO: 490796 - RNA, 18 nt, Human
uggggugagagugggugg

SEQ ID NO: 490797 - RNA, 21 nt, Human
uggggugagagugggugggcg

SEQ ID NO: 490798 - RNA, 22 nt, Human
uguuuggggugagagugggugg

SEQ ID NO: 490799 - RNA, 22 nt, Human
uuaaagcccaggcagccgccgc

SEQ ID NO: 490800 - RNA, 21 nt, Human
uucaaaccugacaaacucugu

SEQ ID NO: 490801 - RNA, 24 nt, Human
uucuuauuuauuuuucccauuuug

SEQ ID NO: 490802 - RNA, 22 nt, Human
uugacacacaccaucauagggg

SEQ ID NO: 490803 - RNA, 20 nt, Human
uuuaugccgucgagcuccuc

SEQ ID NO: 490804 - RNA, 19 nt, Human
accuuagggcagagggcua

SEQ ID NO: 490805 - RNA, 22 nt, Human
agcucaaauccccaacucuccu

SEQ ID NO: 490806 - RNA, 21 nt, Human
aucccucaucccucucugcug

SEQ ID NO: 490807 - RNA, 21 nt, Human
cagcacccccaacuuggugcc

SEQ ID NO: 490808 - RNA, 30 nt, Human
caucauacacacacacaucaaauauguaca

SEQ ID NO: 490809 - RNA, 20 nt, Human
caugggacucacagaucacc

SEQ ID NO: 490810 - RNA, 21 nt, Human
cccaacuuggugccguccucu

SEQ ID NO: 490811 - RNA, 23 nt, Human
ccccaacuuggugccguccucuu

SEQ ID NO: 490812 - RNA, 18 nt, Human
ccccucugcccucuuccu

SEQ ID NO: 490813 - RNA, 21 nt, Human
ccuuggcuucguccucucagc

SEQ ID NO: 490814 - RNA, 21 nt, Human
cuccucccuaauuuccuuggc

SEQ ID NO: 490815 - RNA, 27 nt, Human
cucucugcugcagcucaaauccccaac

SEQ ID NO: 490816 - RNA, 18 nt, Human
cugcagggaggagggucu

SEQ ID NO: 490817 - RNA, 21 nt, Human
cuggccccucugcccucuucc

SEQ ID NO: 490818 - RNA, 25 nt, Human
cuggccccucugcccucuuccuggg

SEQ ID NO: 490819 - RNA, 18 nt, Human
cuguuucaggaugaaggc

SEQ ID NO: 490820 - RNA, 21 nt, Human
cuuccuguuucaggaugaagg

SEQ ID NO: 490821 - RNA, 24 nt, Human
ggaguccuucuggccccucugccc

SEQ ID NO: 490822 - RNA, 18 nt, Human
ggcuucguccucucagca

SEQ ID NO: 490823 - RNA, 23 nt, Human
gucucuuucauccagcaccccca

SEQ ID NO: 490824 - RNA, 21 nt, Human
uauuccaauguacaaaguuua

SEQ ID NO: 490825 - RNA, 23 nt, Human
uccagcacccccaacuuggugcc

SEQ ID NO: 490826 - RNA, 22 nt, Human
ucccucaucccucucugcugca

SEQ ID NO: 490827 - RNA, 21 nt, Human
ucccucucugcugcagcucaa

SEQ ID NO: 490828 - RNA, 24 nt, Human
ucccuuugacucuccucccuaauu

SEQ ID NO: 490829 - RNA, 25 nt, Human
ucccuuugacucuccucccuaauuu

SEQ ID NO: 490830 - RNA, 24 nt, Human
uccucacaggcaccuccgaagggu

SEQ ID NO: 490831 - RNA, 19 nt, Human
uccuugaucccuuugacuc

SEQ ID NO: 490832 - RNA, 25 nt, Human
ucucugugucuguucccacagugcc

SEQ ID NO: 490833 - RNA, 23 nt, Human
ucuuccuguuucaggaugaaggc

SEQ ID NO: 490834 - RNA, 21 nt, Human
ugaggggcuggcacuaggagg

SEQ ID NO: 490835 - RNA, 20 nt, Human
ugaucccuuugacucuccuc

SEQ ID NO: 490836 - RNA, 23 nt, Human
uuccaauguacaaaguuuacaug

SEQ ID NO: 490837 - RNA, 24 nt, Human
uuccaauguacaaaguuuacaugg

SEQ ID NO: 490838 - RNA, 22 nt, Human
aaaaagccaaaggcacguaaaa

SEQ ID NO: 490839 - RNA, 21 nt, Human
aaaaguaugauaacagaugaa

SEQ ID NO: 490840 - RNA, 19 nt, Human
aaacuaaguaugaauacac

SEQ ID NO: 490841 - RNA, 20 nt, Human
aaagagggacccggaggugc

SEQ ID NO: 490842 - RNA, 22 nt, Human
aagcacaaagaaaggucgccgg

SEQ ID NO: 490843 - RNA, 25 nt, Human
aauccccaaaacccauaaaguucaa

SEQ ID NO: 490844 - RNA, 22 nt, Human
acaaaaaggcuuagguguuaaa

SEQ ID NO: 490845 - RNA, 19 nt, Human
acaaagaaaggucgccgga

SEQ ID NO: 490846 - RNA, 20 nt, Human
acaaagaaaggucgccggac

SEQ ID NO: 490847 - RNA, 20 nt, Human
acaagaaaauccccaaaacc

SEQ ID NO: 490848 - RNA, 24 nt, Human
acagaaaaguuuuaacacuggaga

SEQ ID NO: 490849 - RNA, 18 nt, Human
acagggcauaacagguaa

SEQ ID NO: 490850 - RNA, 21 nt, Human
accuuuuaccccaaaggaaaa

SEQ ID NO: 490851 - RNA, 25 nt, Human
acugugguuaguuuguuuuuguacc

SEQ ID NO: 490852 - RNA, 18 nt, Human
aggacugaaccugcggag

SEQ ID NO: 490853 - RNA, 20 nt, Human
agggcggggcggcgcggggc

SEQ ID NO: 490854 - RNA, 24 nt, Human
agguaaaaaaauacuuuguaagaa

SEQ ID NO: 490855 - RNA, 24 nt, Human
auauuuuaacuuuaaaaauaacuu

SEQ ID NO: 490856 - RNA, 18 nt, Human
caaaacugcaaauacagc

SEQ ID NO: 490857 - RNA, 19 nt, Human
caaccaggacaaaccggcc

SEQ ID NO: 490858 - RNA, 24 nt, Human
caagaaaauccccaaaacccauaa

SEQ ID NO: 490859 - RNA, 18 nt, Human
caauccuggccaagccag

SEQ ID NO: 490860 - RNA, 22 nt, Human
caccccggacucccgcacuaaa

SEQ ID NO: 490861 - RNA, 21 nt, Human
cacgcacauacacagcuuaca

SEQ ID NO: 490862 - RNA, 21 nt, Human
ccaaugccuccugaaaauggg

SEQ ID NO: 490863 - RNA, 21 nt, Human
ccaccccccaguaggcgacuu

SEQ ID NO: 490864 - RNA, 20 nt, Human
cccaaaggaaaaaaguuggc

SEQ ID NO: 490865 - RNA, 19 nt, Human
cccaacacaaaacugcaaa

SEQ ID NO: 490866 - RNA, 18 nt, Human
ccccagcgccacccccca

SEQ ID NO: 490867 - RNA, 24 nt, Human
ccccggacucccgcacuaaaacuc

SEQ ID NO: 490868 - RNA, 18 nt, Human
cccgcagggaagcgaggc

SEQ ID NO: 490869 - RNA, 19 nt, Human
cccucccggccgcgguacc

SEQ ID NO: 490870 - RNA, 19 nt, Human
ccgcaccccggacucccgc

SEQ ID NO: 490871 - RNA, 19 nt, Human
ccgcugaggaucccagccg

SEQ ID NO: 490872 - RNA, 23 nt, Human
ccuggccaagccagauuucuugu

SEQ ID NO: 490873 - RNA, 19 nt, Human
ccugugcccuggcccgggg

SEQ ID NO: 490874 - RNA, 24 nt, Human
ccugugcccuggcccggggccaac

SEQ ID NO: 490875 - RNA, 24 nt, Human
cgacucccuaagcacaaagaaagg

SEQ ID NO: 490876 - RNA, 26 nt, Human
cgcauuauccgcuccgagacggcgug

SEQ ID NO: 490877 - RNA, 18 nt, Human
cgcccgggugcacgggga

SEQ ID NO: 490878 - RNA, 24 nt, Human
cgcugaggaucccagccgcugccc

SEQ ID NO: 490879 - RNA, 24 nt, Human
cggcgcggggacucacuggggcgg

SEQ ID NO: 490880 - RNA, 23 nt, Human
cggcggcgcggggacucacuggg

SEQ ID NO: 490881 - RNA, 20 nt, Human
cggggcggccggacgcgagg

SEQ ID NO: 490882 - RNA, 20 nt, Human
cgugaaggcgccccaggccg

SEQ ID NO: 490883 - RNA, 19 nt, Human
cuaagcaauauauagaaaa

SEQ ID NO: 490884 - RNA, 18 nt, Human
cuccgcccgcaccccgga

SEQ ID NO: 490885 - RNA, 27 nt, Human
cucgugcgcccaccucucccgauccca

SEQ ID NO: 490886 - RNA, 18 nt, Human
cugcggagggcggggcgg

SEQ ID NO: 490887 - RNA, 21 nt, Human
cuucaacugugguuaguuugu

SEQ ID NO: 490888 - RNA, 22 nt, Human
cuugaaguaccuauguaaugca

SEQ ID NO: 490889 - RNA, 24 nt, Human
cuuuacaauccguuauugguugcu

SEQ ID NO: 490890 - RNA, 22 nt, Human
cuuuuuauuguguugcuugaag

SEQ ID NO: 490891 - RNA, 25 nt, Human
gaacaucaccaaugccuccugaaaa

SEQ ID NO: 490892 - RNA, 18 nt, Human
gaagaaaaaaaaacuaag

SEQ ID NO: 490893 - RNA, 24 nt, Human
gaaguuccuuaaugugacucgcuc

SEQ ID NO: 490894 - RNA, 20 nt, Human
gaauacacuuuuccaaacac

SEQ ID NO: 490895 - RNA, 19 nt, Human
gaccuagcugugcgagugg

SEQ ID NO: 490896 - RNA, 19 nt, Human
gcaagcgggagaaagggcc

SEQ ID NO: 490897 - RNA, 21 nt, Human
gcaauaaaaagccaaaggcac

SEQ ID NO: 490898 - RNA, 18 nt, Human
gcacaaagaaaggucgcc

SEQ ID NO: 490899 - RNA, 25 nt, Human
gcgcggggacucacuggggcggggc

SEQ ID NO: 490900 - RNA, 25 nt, Human
gcgcggggcggggccggcggcgcgg

SEQ ID NO: 490901 - RNA, 20 nt, Human
gcggcgcggggacucacugg

SEQ ID NO: 490902 - RNA, 20 nt, Human
gcucagcccuucauagcuag

SEQ ID NO: 490903 - RNA, 21 nt, Human
ggccgguggccgggucuccgg

SEQ ID NO: 490904 - RNA, 18 nt, Human
gggcggcgcggggcgggg

SEQ ID NO: 490905 - RNA, 21 nt, Human
ggggacucacuggggcggggc

SEQ ID NO: 490906 - RNA, 19 nt, Human
gucaccguuggacccucgg

SEQ ID NO: 490907 - RNA, 18 nt, Human
gugcacggggacaauagg

SEQ ID NO: 490908 - RNA, 24 nt, Human
uaaaaagccaaaggcacguaaaaa

SEQ ID NO: 490909 - RNA, 25 nt, Human
uaacagaugaagaaaaaaaaacuaa

SEQ ID NO: 490910 - RNA, 24 nt, Human
uaacagguaaaaaaauacuuugua

SEQ ID NO: 490911 - RNA, 22 nt, Human
uaagaacuacaagaaaaucccc

SEQ ID NO: 490912 - RNA, 21 nt, Human
uacaauggaaucccaauggaa

SEQ ID NO: 490913 - RNA, 20 nt, Human
uacagcuccggaagcccuuc

SEQ ID NO: 490914 - RNA, 23 nt, Human
uaccccaaaggaaaaaaguuggc

SEQ ID NO: 490915 - RNA, 22 nt, Human
uaccuauauuuccaaauaacau

SEQ ID NO: 490916 - RNA, 18 nt, Human
uagaaaacccaacacaaa

SEQ ID NO: 490917 - RNA, 26 nt, Human
uagaaaagagucuacaaaaaggcuua

SEQ ID NO: 490918 - RNA, 19 nt, Human
uaguuuguuuuuguaccuu

SEQ ID NO: 490919 - RNA, 19 nt, Human
uaugauaacagaugaagaa

SEQ ID NO: 490920 - RNA, 19 nt, Human
uauguaaugcaaguaugua

SEQ ID NO: 490921 - RNA, 20 nt, Human
uauuguguugcuugaaguac

SEQ ID NO: 490922 - RNA, 21 nt, Human
uauuguguugcuugaaguacc

SEQ ID NO: 490923 - RNA, 24 nt, Human
uauuuuagaaaacccaacacaaaa

SEQ ID NO: 490924 - RNA, 19 nt, Human
ucacuggggcggggcggag

SEQ ID NO: 490925 - RNA, 20 nt, Human
uccagucuugaccacaacca

SEQ ID NO: 490926 - RNA, 21 nt, Human
ucccagccgcugccccgggcc

SEQ ID NO: 490927 - RNA, 23 nt, Human
ucccagccgcugccccgggccuc

SEQ ID NO: 490928 - RNA, 19 nt, Human
ucccgaucccaacaggccg

SEQ ID NO: 490929 - RNA, 24 nt, Human
ucccgcgggcgcacgcaaucccug

SEQ ID NO: 490930 - RNA, 19 nt, Human
uccgggcuagccccgcgcu

SEQ ID NO: 490931 - RNA, 25 nt, Human
ucgugcgcccaccucucccgauccc

SEQ ID NO: 490932 - RNA, 19 nt, Human
ucucaaguggcuucagaag

SEQ ID NO: 490933 - RNA, 22 nt, Human
ucugcaauaaaaagccaaaggc

SEQ ID NO: 490934 - RNA, 26 nt, Human
ugaaaaugggcucugacucacuuccu

SEQ ID NO: 490935 - RNA, 26 nt, Human
ugacccgcagggaagcgaggccaccu

SEQ ID NO: 490936 - RNA, 22 nt, Human
ugagauggggucaaagagaacc

SEQ ID NO: 490937 - RNA, 25 nt, Human
ugauaacagaugaagaaaaaaaaac

SEQ ID NO: 490938 - RNA, 25 nt, Human
ugccccgggccucccgcgggcgcac

SEQ ID NO: 490939 - RNA, 18 nt, Human
ugccugugucuuaccaac

SEQ ID NO: 490940 - RNA, 21 nt, Human
ugccuuuacacuuuacaaucc

SEQ ID NO: 490941 - RNA, 22 nt, Human
ugcgaguggcgggcggugaccc

SEQ ID NO: 490942 - RNA, 19 nt, Human
ugcuauaaaguuccgugaa

SEQ ID NO: 490943 - RNA, 21 nt, Human
ugcugccgcccgggugcacgg

SEQ ID NO: 490944 - RNA, 18 nt, Human
uggcccggggccaaccgg

SEQ ID NO: 490945 - RNA, 20 nt, Human
uggcuucgaaaugagauggg

SEQ ID NO: 490946 - RNA, 23 nt, Human
uggggucaaagagaaccuuccug

SEQ ID NO: 490947 - RNA, 24 nt, Human
ugugagccgaacaucaccaaugcc

SEQ ID NO: 490948 - RNA, 23 nt, Human
uuaaaaguaugauaacagaugaa

SEQ ID NO: 490949 - RNA, 22 nt, Human
uuaaagagggacccggagguga

SEQ ID NO: 490950 - RNA, 19 nt, Human
uugaccacaaccaggacaa

SEQ ID NO: 490951 - RNA, 20 nt, Human
uugcaagcgggagaaagggc

SEQ ID NO: 490952 - RNA, 23 nt, Human
uuuuuuuuuuuuuuuuuaucauu

SEQ ID NO: 490953 - RNA, 22 nt, Human
aaaaaaaaaaaaaaaaaaggac

SEQ ID NO: 490954 - RNA, 26 nt, Human
aaaaaaaaggacuuccucaacaaugu

SEQ ID NO: 490955 - RNA, 25 nt, Human
aaaaaggacuuccucaacaauguaa

SEQ ID NO: 490956 - RNA, 25 nt, Human
aaaacaugauguuccuauauaccaa

SEQ ID NO: 490957 - RNA, 24 nt, Human
aaaggacuuccucaacaauguaaa

SEQ ID NO: 490958 - RNA, 25 nt, Human
aaucacauggcauuuuuuucugcau

SEQ ID NO: 490959 - RNA, 18 nt, Human
acaguaauuucccuucuu

SEQ ID NO: 490960 - RNA, 21 nt, Human
agacaguaauuucccuucuuu

SEQ ID NO: 490961 - RNA, 23 nt, Human
caggauaguuagggcguguuacc

SEQ ID NO: 490962 - RNA, 27 nt, Human
caguaauuucccuucuuuuguagguuu

SEQ ID NO: 490963 - RNA, 21 nt, Human
cauggcauuuuuuucugcaug

SEQ ID NO: 490964 - RNA, 20 nt, Human
ccaucacaguauuauucuga

SEQ ID NO: 490965 - RNA, 21 nt, Human
cccaucacaguauuauucuga

SEQ ID NO: 490966 - RNA, 21 nt, Human
ccccuagaaauaucgccuccg

SEQ ID NO: 490967 - RNA, 21 nt, Human
ccucaacaauguaaagauagg

SEQ ID NO: 490968 - RNA, 24 nt, Human
gucaacauuagaacucuccaccac

SEQ ID NO: 490969 - RNA, 18 nt, Human
guuuuuguggcuggugcu

SEQ ID NO: 490970 - RNA, 24 nt, Human
uaauaaagaauaaaaguuauacaa

SEQ ID NO: 490971 - RNA, 18 nt, Human
ucacaagcuagugggaug

SEQ ID NO: 490972 - RNA, 18 nt, Human
ucaguggaccacauuuuc

SEQ ID NO: 490973 - RNA, 24 nt, Human
ucuccaccacugcggaucuggcuc

SEQ ID NO: 490974 - RNA, 20 nt, Human
ugagaagacacuaaacaagg

SEQ ID NO: 490975 - RNA, 23 nt, Human
ugagaagacacuaaacaaggaug

SEQ ID NO: 490976 - RNA, 21 nt, Human
ugagcaauuaaaaaaaaaaaa

SEQ ID NO: 490977 - RNA, 22 nt, Human
ugagcaauuaaaaaaaaaaaaa

SEQ ID NO: 490978 - RNA, 18 nt, Human
ugcuuacccugaccccaa

SEQ ID NO: 490979 - RNA, 22 nt, Human
uggcccaaacccugcaugacaa

SEQ ID NO: 490980 - RNA, 21 nt, Human
uggcuggugcuuacccugacc

SEQ ID NO: 490981 - RNA, 23 nt, Human
uguuacuaaaagacaaugauuug

SEQ ID NO: 490982 - RNA, 19 nt, Human
uguuacuuucuuuccugca

SEQ ID NO: 490983 - RNA, 20 nt, Human
uuaaaaaaaaaaaaaaaaaa

SEQ ID NO: 490984 - RNA, 24 nt, Human
uucuuauccacccccauucuccuu

SEQ ID NO: 490985 - RNA, 33 nt, Human
uucuugagcaauuaaaaaaaaaaaaaaaaaaaa

SEQ ID NO: 490986 - RNA, 24 nt, Human
uuuucaguggaccacauuuucuua

SEQ ID NO: 490987 - RNA, 20 nt, Human
uuuuuuuuuuuuucagugga

SEQ ID NO: 490988 - RNA, 22 nt, Human
uuuuuuuuuuuuuuuucagugg

SEQ ID NO: 490989 - RNA, 22 nt, Human
uuuuuuuuuuuuuuuuuuucag

SEQ ID NO: 490990 - RNA, 20 nt, Human
aaacaaaacugcguuacaga

SEQ ID NO: 490991 - RNA, 24 nt, Human
aaagugcugggauuacaggcguga

SEQ ID NO: 490992 - RNA, 18 nt, Human
aacuuuuuuuguuguuga

SEQ ID NO: 490993 - RNA, 22 nt, Human
aagaggccagugcccccaagug

SEQ ID NO: 490994 - RNA, 19 nt, Human
aagcugcccuuucaccuga

SEQ ID NO: 490995 - RNA, 22 nt, Human
aaggacaaaucuggaccacgug

SEQ ID NO: 490996 - RNA, 26 nt, Human
aaggacaaaucuggaccacguguaca

SEQ ID NO: 490997 - RNA, 19 nt, Human
aagugcugggauuacaggc

SEQ ID NO: 490998 - RNA, 19 nt, Human
aagugcugggauuacaggc

SEQ ID NO: 490999 - RNA, 26 nt, Human
aagugcugggauuacaggcgugagcc

SEQ ID NO: 491000 - RNA, 19 nt, Human
aauaaauauagagaacuca

SEQ ID NO: 491001 - RNA, 18 nt, Human
aaucuggaccacguguac

SEQ ID NO: 491002 - RNA, 20 nt, Human
aaugccauuuucuaaucuug

SEQ ID NO: 491003 - RNA, 22 nt, Human
accacuucccaaaacuuggcca

SEQ ID NO: 491004 - RNA, 18 nt, Human
accauguugggcaggcug

SEQ ID NO: 491005 - RNA, 18 nt, Human
accauuaaagcugcccuu

SEQ ID NO: 491006 - RNA, 25 nt, Human
acccgccucggccucccaaagugcu

SEQ ID NO: 491007 - RNA, 18 nt, Human
accgcgcccagccgggaa

SEQ ID NO: 491008 - RNA, 22 nt, Human
accuccaccucuuggguucaag

SEQ ID NO: 491009 - RNA, 18 nt, Human
acgagguuucaccauguu

SEQ ID NO: 491010 - RNA, 20 nt, Human
acgagguuucaccauguugg

SEQ ID NO: 491011 - RNA, 25 nt, Human
acgccgaggggcgccggaccguuag

SEQ ID NO: 491012 - RNA, 18 nt, Human
acggauacacacuaaaca

SEQ ID NO: 491013 - RNA, 23 nt, Human
acucagugugaagaaaagacaag

SEQ ID NO: 491014 - RNA, 22 nt, Human
agaacagacgccaaggucaugc

SEQ ID NO: 491015 - RNA, 21 nt, Human
agacaaaagacagacauccga

SEQ ID NO: 491016 - RNA, 22 nt, Human
agacaaaagacagacauccgag

SEQ ID NO: 491017 - RNA, 19 nt, Human
agacagacauccgagacgc

SEQ ID NO: 491018 - RNA, 20 nt, Human
agagccacucaggaaccagc

SEQ ID NO: 491019 - RNA, 24 nt, Human
agauaaucaaccacuucccaaaac

SEQ ID NO: 491020 - RNA, 24 nt, Human
agauguucaauaaauauagagaac

SEQ ID NO: 491021 - RNA, 19 nt, Human
agauuacaggcgugcgcca

SEQ ID NO: 491022 - RNA, 20 nt, Human
agcacuucugauuuuuuuuu

SEQ ID NO: 491023 - RNA, 22 nt, Human
agccagucuggaagagcagccc

SEQ ID NO: 491024 - RNA, 20 nt, Human
aggccccagcagccuucccg

SEQ ID NO: 491025 - RNA, 25 nt, Human
aggcuggagugcaguggcgcaaucu

SEQ ID NO: 491026 - RNA, 24 nt, Human
aggugauccacccgccucggccuc

SEQ ID NO: 491027 - RNA, 22 nt, Human
agguguggaggccccagcagcc

SEQ ID NO: 491028 - RNA, 19 nt, Human
aguagcugagauuacaggc

SEQ ID NO: 491029 - RNA, 23 nt, Human
agugcaguggcgcaaucuuggcu

SEQ ID NO: 491030 - RNA, 24 nt, Human
agugcaguggcgcaaucuuggcuc

SEQ ID NO: 491031 - RNA, 18 nt, Human
agugcugggauuacaggc

SEQ ID NO: 491032 - RNA, 24 nt, Human
agugugaagaaaagacaaggacaa

SEQ ID NO: 491033 - RNA, 19 nt, Human
aucaaugccaggaaauucu

SEQ ID NO: 491034 - RNA, 23 nt, Human
auuauugaaccauuuggcuugca

SEQ ID NO: 491035 - RNA, 20 nt, Human
auuguuaguggguuuugggg

SEQ ID NO: 491036 - RNA, 21 nt, Human
caaaacuuggccacaaaccgu

SEQ ID NO: 491037 - RNA, 21 nt, Human
caaacggccacggccccgcuc

SEQ ID NO: 491038 - RNA, 26 nt, Human
caaacuccugaccuuaggugauccaa

SEQ ID NO: 491039 - RNA, 24 nt, Human
caaagugcugggauuacaggcgug

SEQ ID NO: 491040 - RNA, 18 nt, Human
caaaguuuaagccgcaua

SEQ ID NO: 491041 - RNA, 19 nt, Human
caacccgcagaugcguaca

SEQ ID NO: 491042 - RNA, 23 nt, Human
caagcccggcuguguuaagcacu

SEQ ID NO: 491043 - RNA, 20 nt, Human
caagcgauucuccugccuca

SEQ ID NO: 491044 - RNA, 22 nt, Human
caagcgauucuccugccucagc

SEQ ID NO: 491045 - RNA, 22 nt, Human
cacacgguaccgcaacagcagu

SEQ ID NO: 491046 - RNA, 22 nt, Human
cacacugccagcuuccagagcu

SEQ ID NO: 491047 - RNA, 20 nt, Human
cacacugccggcugcacagg

SEQ ID NO: 491048 - RNA, 19 nt, Human
cacaggcaggcacagccag

SEQ ID NO: 491049 - RNA, 19 nt, Human
caccagagccacucaggaa

SEQ ID NO: 491050 - RNA, 24 nt, Human
caccauguugggcaggcugaucuc

SEQ ID NO: 491051 - RNA, 23 nt, Human
cacccgccucggccucccaaagu

SEQ ID NO: 491052 - RNA, 25 nt, Human
cacggccccgcuccuuacagaucaa

SEQ ID NO: 491053 - RNA, 22 nt, Human
cagagccuaucuagcgggaaug

SEQ ID NO: 491054 - RNA, 24 nt, Human
cagaugcguacagaacugaaaaug

SEQ ID NO: 491055 - RNA, 21 nt, Human
caggcugaucucaaacuccug

SEQ ID NO: 491056 - RNA, 27 nt, Human
caucguggcuucgagacaaaagacaga

SEQ ID NO: 491057 - RNA, 24 nt, Human
cauuucagaucaaauaaugccauu

SEQ ID NO: 491058 - RNA, 20 nt, Human
ccaaaacuuggccacaaacc

SEQ ID NO: 491059 - RNA, 22 nt, Human
ccaaagugcugggauuacaggc

SEQ ID NO: 491060 - RNA, 22 nt, Human
ccaaagugcugggauuacaggc

SEQ ID NO: 491061 - RNA, 24 nt, Human
ccaaagugcugggauuacaggcgu

SEQ ID NO: 491062 - RNA, 22 nt, Human
ccacggauggccagcuuccucc

SEQ ID NO: 491063 - RNA, 21 nt, Human
ccacucaggaaccagccaugc

SEQ ID NO: 491064 - RNA, 19 nt, Human
ccaucguggcuucgagaca

SEQ ID NO: 491065 - RNA, 21 nt, Human
cccacccggcagcaugaggaa

SEQ ID NO: 491066 - RNA, 24 nt, Human
ccccaagugagcagcugcauccgc

SEQ ID NO: 491067 - RNA, 21 nt, Human
cccccaagugagcagcugcau

SEQ ID NO: 491068 - RNA, 18 nt, Human
cccgcggaucaccugaag

SEQ ID NO: 491069 - RNA, 18 nt, Human
ccgcaaccuccaccucuu

SEQ ID NO: 491070 - RNA, 24 nt, Human
ccgcaaccuccaccucuuggguuc

SEQ ID NO: 491071 - RNA, 23 nt, Human
ccucaggcccagauggugugacc

SEQ ID NO: 491072 - RNA, 19 nt, Human
ccuccaccucuuggguuca

SEQ ID NO: 491073 - RNA, 19 nt, Human
ccuccugacugcccccaag

SEQ ID NO: 491074 - RNA, 25 nt, Human
ccucuguugcccaggcuggagugca

SEQ ID NO: 491075 - RNA, 24 nt, Human
ccucuuggguucaagcgauucucc

SEQ ID NO: 491076 - RNA, 22 nt, Human
ccugaccuuaggugauccaccc

SEQ ID NO: 491077 - RNA, 24 nt, Human
cgccucggccucccaaagugcugg

SEQ ID NO: 491078 - RNA, 20 nt, Human
cuaagaggccagugccccca

SEQ ID NO: 491079 - RNA, 21 nt, Human
cuaguagcugagauuacaggc

SEQ ID NO: 491080 - RNA, 23 nt, Human
cuaguagcugagauuacaggcgu

SEQ ID NO: 491081 - RNA, 24 nt, Human
cucaccgcaaccuccaccucuugg

SEQ ID NO: 491082 - RNA, 19 nt, Human
cuccaaacggccacggccc

SEQ ID NO: 491083 - RNA, 24 nt, Human
cucccucuguugcccaggcuggag

SEQ ID NO: 491084 - RNA, 20 nt, Human
cucuguugcccaggcuggag

SEQ ID NO: 491085 - RNA, 20 nt, Human
cugaaaaugccaaauaugua

SEQ ID NO: 491086 - RNA, 19 nt, Human
cugcaaaacccacccggca

SEQ ID NO: 491087 - RNA, 21 nt, Human
cuuaaaucuuugguuucuuuc

SEQ ID NO: 491088 - RNA, 20 nt, Human
cuucugauuuuuuuuucccu

SEQ ID NO: 491089 - RNA, 18 nt, Human
gaaaucacuaagggagcu

SEQ ID NO: 491090 - RNA, 18 nt, Human
gaaaucagagccuaucua

SEQ ID NO: 491091 - RNA, 25 nt, Human
gaacagacgccaaggucaugcuccc

SEQ ID NO: 491092 - RNA, 24 nt, Human
gaccuuaggugauccacccgccuc

SEQ ID NO: 491093 - RNA, 18 nt, Human
gagcuucugcaaaaccca

SEQ ID NO: 491094 - RNA, 20 nt, Human
gaucaccugaagcagggcca

SEQ ID NO: 491095 - RNA, 18 nt, Human
gauuacaggcgugagcca

SEQ ID NO: 491096 - RNA, 22 nt, Human
gauuacaggcgugagccaccgc

SEQ ID NO: 491097 - RNA, 22 nt, Human
gauuacaggcgugagccaccgc

SEQ ID NO: 491098 - RNA, 18 nt, Human
gauuacaggcgugcgcca

SEQ ID NO: 491099 - RNA, 20 nt, Human
gcacagguugcugggcacag

SEQ ID NO: 491100 - RNA, 19 nt, Human
gcaccagggagccacaaag

SEQ ID NO: 491101 - RNA, 20 nt, Human
gccaguguaugggaaacuuu

SEQ ID NO: 491102 - RNA, 20 nt, Human
gccauccuuucacucagacu

SEQ ID NO: 491103 - RNA, 19 nt, Human
gcccaggcuggagugcagu

SEQ ID NO: 491104 - RNA, 20 nt, Human
gcccaggcuggagugcagug

SEQ ID NO: 491105 - RNA, 19 nt, Human
gccgaggggcgccggaccg

SEQ ID NO: 491106 - RNA, 19 nt, Human
gcggcgggcggcgggcggc

SEQ ID NO: 491107 - RNA, 23 nt, Human
gcggcgggcggcgggcggcgggc

SEQ ID NO: 491108 - RNA, 19 nt, Human
gcuggagugcaguggcgca

SEQ ID NO: 491109 - RNA, 23 nt, Human
ggagucucccucuguugcccagg

SEQ ID NO: 491110 - RNA, 25 nt, Human
ggaucaccugaagcagggccacggc

SEQ ID NO: 491111 - RNA, 19 nt, Human
ggcaggccaguguauggga

SEQ ID NO: 491112 - RNA, 19 nt, Human
ggcccagauggugugaccu

SEQ ID NO: 491113 - RNA, 18 nt, Human
ggcccgggcggcgggcgg

SEQ ID NO: 491114 - RNA, 19 nt, Human
ggcgggcggcgggcggcgg

SEQ ID NO: 491115 - RNA, 19 nt, Human
ggcuuaaaaggacaagaug

SEQ ID NO: 491116 - RNA, 20 nt, Human
ggguucaagcgauucuccug

SEQ ID NO: 491117 - RNA, 18 nt, Human
guagcugagauuacaggc

SEQ ID NO: 491118 - RNA, 24 nt, Human
gugauccacccgccucggccuccc

SEQ ID NO: 491119 - RNA, 18 nt, Human
uaaaacuagccuuucuaa

SEQ ID NO: 491120 - RNA, 20 nt, Human
uaaaacucuaaaguacaggu

SEQ ID NO: 491121 - RNA, 23 nt, Human
uaaauaguuuucacacuuuccca

SEQ ID NO: 491122 - RNA, 27 nt, Human
uaacaguaacaaacuugccagugcuuu

SEQ ID NO: 491123 - RNA, 19 nt, Human
uaaccguaaacgaagagga

SEQ ID NO: 491124 - RNA, 24 nt, Human
uaaguuguguauuuuuaguagaga

SEQ ID NO: 491125 - RNA, 20 nt, Human
uaaugugguccauaaaaacc

SEQ ID NO: 491126 - RNA, 24 nt, Human
uaauuaucuuaaauaguuuucaca

SEQ ID NO: 491127 - RNA, 18 nt, Human
uacagacaucaucuacgu

SEQ ID NO: 491128 - RNA, 24 nt, Human
uacaggcgugagccaccgcgccca

SEQ ID NO: 491129 - RNA, 19 nt, Human
uaccucaggcccagauggu

SEQ ID NO: 491130 - RNA, 20 nt, Human
uagaaagagaaugaggccau

SEQ ID NO: 491131 - RNA, 22 nt, Human
uagagacgagguuucaccaugu

SEQ ID NO: 491132 - RNA, 24 nt, Human
uagcaaagggcugcuggcaggugu

SEQ ID NO: 491133 - RNA, 24 nt, Human
uaguagagacgagguuucaccaug

SEQ ID NO: 491134 - RNA, 25 nt, Human
uaguagagacgagguuucaccaugu

SEQ ID NO: 491135 - RNA, 24 nt, Human
uaguagcugagauuacaggcgugc

SEQ ID NO: 491136 - RNA, 19 nt, Human
uaguggguuuuggggcagg

SEQ ID NO: 491137 - RNA, 26 nt, Human
uauaaagcauugguauuugacauuuu

SEQ ID NO: 491138 - RNA, 18 nt, Human
uauagagaacucagugug

SEQ ID NO: 491139 - RNA, 19 nt, Human
ucaagcgauucuccugccu

SEQ ID NO: 491140 - RNA, 23 nt, Human
ucaccgcaaccuccaccucuugg

SEQ ID NO: 491141 - RNA, 24 nt, Human
ucaccgcaaccuccaccucuuggg

SEQ ID NO: 491142 - RNA, 21 nt, Human
ucagacacacgguaccgcaac

SEQ ID NO: 491143 - RNA, 21 nt, Human
ucaggcccagauggugugacc

SEQ ID NO: 491144 - RNA, 22 nt, Human
ucaggcccagauggugugaccu

SEQ ID NO: 491145 - RNA, 19 nt, Human
uccagagggcccacagcag

SEQ ID NO: 491146 - RNA, 24 nt, Human
ucccaaagugcugggauuacaggc

SEQ ID NO: 491147 - RNA, 20 nt, Human
ucccucuguugcccaggcug

SEQ ID NO: 491148 - RNA, 24 nt, Human
ucccucuguugcccaggcuggagu

SEQ ID NO: 491149 - RNA, 19 nt, Human
uccgcugagaguaagcggc

SEQ ID NO: 491150 - RNA, 19 nt, Human
ucgagacaaaagacagaca

SEQ ID NO: 491151 - RNA, 20 nt, Human
ucgccgccgugaugaggcag

SEQ ID NO: 491152 - RNA, 18 nt, Human
ucggccucccaaagugcu

SEQ ID NO: 491153 - RNA, 22 nt, Human
ucucaaacauuucagaucaaau

SEQ ID NO: 491154 - RNA, 23 nt, Human
ucucccucuguugcccaggcugg

SEQ ID NO: 491155 - RNA, 24 nt, Human
ucucccucuguugcccaggcugga

SEQ ID NO: 491156 - RNA, 18 nt, Human
ucugaaaggcugccccgg

SEQ ID NO: 491157 - RNA, 21 nt, Human
ucugaaaggcugccccggaaa

SEQ ID NO: 491158 - RNA, 18 nt, Human
ucuguugcccaggcugga

SEQ ID NO: 491159 - RNA, 24 nt, Human
ucuguugcccaggcuggagugcag

SEQ ID NO: 491160 - RNA, 24 nt, Human
ucuuggguucaagcgauucuccug

SEQ ID NO: 491161 - RNA, 25 nt, Human
ugaaaucacuaagggagcuucugca

SEQ ID NO: 491162 - RNA, 21 nt, Human
ugaacaugaaaugcuuccucu

SEQ ID NO: 491163 - RNA, 21 nt, Human
ugaaggcaaagauaaucaacc

SEQ ID NO: 491164 - RNA, 19 nt, Human
ugacaccaggcacacugcc

SEQ ID NO: 491165 - RNA, 24 nt, Human
ugaccuuaggugauccacccgccu

SEQ ID NO: 491166 - RNA, 18 nt, Human
ugagauuacaggcgugcg

SEQ ID NO: 491167 - RNA, 21 nt, Human
ugagauuacaggcgugcgcca

SEQ ID NO: 491168 - RNA, 18 nt, Human
ugaugaggcaggugugga

SEQ ID NO: 491169 - RNA, 21 nt, Human
ugcagaggaaaccagcgaucc

SEQ ID NO: 491170 - RNA, 22 nt, Human
ugcagaggaaaccagcgaucca

SEQ ID NO: 491171 - RNA, 23 nt, Human
ugcaguggcgcaaucuuggcuca

SEQ ID NO: 491172 - RNA, 18 nt, Human
ugccagugcuuuacacac

SEQ ID NO: 491173 - RNA, 18 nt, Human
ugcccaggcuggagugca

SEQ ID NO: 491174 - RNA, 21 nt, Human
ugcccaggcuggagugcagug

SEQ ID NO: 491175 - RNA, 22 nt, Human
ugcccaggcuggagugcagugg

SEQ ID NO: 491176 - RNA, 24 nt, Human
ugcccaggcuggagugcaguggcg

SEQ ID NO: 491177 - RNA, 24 nt, Human
ugccucagcgucccuaguagcuga

SEQ ID NO: 491178 - RNA, 24 nt, Human
ugcugggauuacaggcgugagcca

SEQ ID NO: 491179 - RNA, 20 nt, Human
ugcuucaaaauauaaaucaa

SEQ ID NO: 491180 - RNA, 24 nt, Human
uggagucucccucuguugcccagg

SEQ ID NO: 491181 - RNA, 23 nt, Human
uggagugcaguggcgcaaucuug

SEQ ID NO: 491182 - RNA, 24 nt, Human
uggagugcaguggcgcaaucuugg

SEQ ID NO: 491183 - RNA, 22 nt, Human
uggcccgggcggcgggcggcgg

SEQ ID NO: 491184 - RNA, 19 nt, Human
ugggauuacaggcgugagc

SEQ ID NO: 491185 - RNA, 21 nt, Human
ugggauuacaggcgugagcca

SEQ ID NO: 491186 - RNA, 22 nt, Human
ugggauuacaggcgugagccac

SEQ ID NO: 491187 - RNA, 23 nt, Human
ugggauuacaggcgugagccacc

SEQ ID NO: 491188 - RNA, 24 nt, Human
ugggauuacaggcgugagccaccg

SEQ ID NO: 491189 - RNA, 23 nt, Human
uggguucaagcgauucuccugcc

SEQ ID NO: 491190 - RNA, 24 nt, Human
uggucgccggagcccuugcgcugc

SEQ ID NO: 491191 - RNA, 18 nt, Human
uguaaggaucaagcagcg

SEQ ID NO: 491192 - RNA, 18 nt, Human
uguauuuuuaguagagac

SEQ ID NO: 491193 - RNA, 23 nt, Human
ugucagacacacgguaccgcaac

SEQ ID NO: 491194 - RNA, 24 nt, Human
uuaaacgugaaaucacuaagggag

SEQ ID NO: 491195 - RNA, 22 nt, Human
uuaacaguaacaaacuugccaa

SEQ ID NO: 491196 - RNA, 22 nt, Human
uuagcggccccugcaguggccc

SEQ ID NO: 491197 - RNA, 24 nt, Human
uuaguagagacgagguuucaccau

SEQ ID NO: 491198 - RNA, 19 nt, Human
uuaguggguuuuggggcag

SEQ ID NO: 491199 - RNA, 21 nt, Human
uucaagcgauucuccugccuc

SEQ ID NO: 491200 - RNA, 23 nt, Human
uucaagcgauucuccugccucag

SEQ ID NO: 491201 - RNA, 24 nt, Human
uucaagcgauucuccugccucagc

SEQ ID NO: 491202 - RNA, 19 nt, Human
uucacacuuucccaguuug

SEQ ID NO: 491203 - RNA, 18 nt, Human
uucaggaacgaagucaaa

SEQ ID NO: 491204 - RNA, 19 nt, Human
uucaggaacgaagucaaac

SEQ ID NO: 491205 - RNA, 20 nt, Human
uucccaguuacucaagauug

SEQ ID NO: 491206 - RNA, 24 nt, Human
uucccggcgcuggcguggaggccc

SEQ ID NO: 491207 - RNA, 23 nt, Human
uucucauauuucaaacaaaacug

SEQ ID NO: 491208 - RNA, 21 nt, Human
uugaaaccagcaagauuagaa

SEQ ID NO: 491209 - RNA, 21 nt, Human
uugguuucuuuccaaccagga

SEQ ID NO: 491210 - RNA, 21 nt, Human
uuucaccauguugggcaggcu

SEQ ID NO: 491211 - RNA, 22 nt, Human
uuugguuucuuuccaaccagga

SEQ ID NO: 491212 - RNA, 24 nt, Human
uuuuuaguagagacgagguuucac

SEQ ID NO: 491213 - RNA, 19 nt, Human
aacccacccccuccucccc

SEQ ID NO: 491214 - RNA, 22 nt, Human
aagccauccucccaucucaucc

SEQ ID NO: 491215 - RNA, 18 nt, Human
aauagcugggauuacaag

SEQ ID NO: 491216 - RNA, 19 nt, Human
acacucucucuuuuuuuuu

SEQ ID NO: 491217 - RNA, 18 nt, Human
acccacccccuccucccc

SEQ ID NO: 491218 - RNA, 18 nt, Human
agccauccucccaucuca

SEQ ID NO: 491219 - RNA, 19 nt, Human
agcggggugcgcuggcuug

SEQ ID NO: 491220 - RNA, 22 nt, Human
agcugggauuacaaguaugggc

SEQ ID NO: 491221 - RNA, 22 nt, Human
aucagugccuugcccagccuug

SEQ ID NO: 491222 - RNA, 26 nt, Human
aucucauccuucccaauagcugggau

SEQ ID NO: 491223 - RNA, 21 nt, Human
caaaccucuggccucaagcca

SEQ ID NO: 491224 - RNA, 24 nt, Human
caaaccucuggccucaagccaucc

SEQ ID NO: 491225 - RNA, 25 nt, Human
caauagcugggauuacaaguauggg

SEQ ID NO: 491226 - RNA, 20 nt, Human
cacacucucucuuuuuuuua

SEQ ID NO: 491227 - RNA, 19 nt, Human
cacccccuccuccccggca

SEQ ID NO: 491228 - RNA, 20 nt, Human
cacgcugcuguucacccaga

SEQ ID NO: 491229 - RNA, 19 nt, Human
cacucucucuuuuuuuuuu

SEQ ID NO: 491230 - RNA, 21 nt, Human
cacuguguugcccuggcuggu

SEQ ID NO: 491231 - RNA, 20 nt, Human
cagaggcugccccgggucug

SEQ ID NO: 491232 - RNA, 18 nt, Human
cagugccuugcccagccu

SEQ ID NO: 491233 - RNA, 23 nt, Human
caucucauccuucccaauagcug

SEQ ID NO: 491234 - RNA, 22 nt, Human
cccaauagcugggauuacaagu

SEQ ID NO: 491235 - RNA, 19 nt, Human
ccccuccuccccggcacag

SEQ ID NO: 491236 - RNA, 21 nt, Human
ccucccaucucauccuuccca

SEQ ID NO: 491237 - RNA, 25 nt, Human
ccucccaucucauccuucccaauag

SEQ ID NO: 491238 - RNA, 19 nt, Human
ccucuggccucaagccauc

SEQ ID NO: 491239 - RNA, 27 nt, Human
ccucuggccucaagccauccucccauc

SEQ ID NO: 491240 - RNA, 18 nt, Human
cgaacccacccccuccuc

SEQ ID NO: 491241 - RNA, 20 nt, Human
cgggaaagguggguguggua

SEQ ID NO: 491242 - RNA, 20 nt, Human
cggucucaaaccucuggccu

SEQ ID NO: 491243 - RNA, 19 nt, Human
cucaagccauccucccauc

SEQ ID NO: 491244 - RNA, 25 nt, Human
cuuuuuuuuuuuuuuuuuuugagaa

SEQ ID NO: 491245 - RNA, 19 nt, Human
gaaggggucucacuguguu

SEQ ID NO: 491246 - RNA, 18 nt, Human
gauuacaaguaugggcca

SEQ ID NO: 491247 - RNA, 18 nt, Human
gauuacaaguaugggcca

SEQ ID NO: 491248 - RNA, 22 nt, Human
gauuacaaguaugggccaucau

SEQ ID NO: 491249 - RNA, 24 nt, Human
ggacugggcagggagucagcgggg

SEQ ID NO: 491250 - RNA, 24 nt, Human
ggauuacaaguaugggccaucaug

SEQ ID NO: 491251 - RNA, 21 nt, Human
ggcagggagucagcggggugc

SEQ ID NO: 491252 - RNA, 18 nt, Human
ggccgggaaaggugggug

SEQ ID NO: 491253 - RNA, 22 nt, Human
gggucucacuguguugcccugg

SEQ ID NO: 491254 - RNA, 21 nt, Human
gugugggcacagcaggcugac

SEQ ID NO: 491255 - RNA, 22 nt, Human
uacaaguaugggccaucaugcc

SEQ ID NO: 491256 - RNA, 23 nt, Human
uacaaguaugggccaucaugccu

SEQ ID NO: 491257 - RNA, 19 nt, Human
ucagcgaacccacccccuc

SEQ ID NO: 491258 - RNA, 21 nt, Human
ucccaucucauccuucccaau

SEQ ID NO: 491259 - RNA, 19 nt, Human
ucucacuguguugcccugg

SEQ ID NO: 491260 - RNA, 20 nt, Human
ucucacuguguugcccuggc

SEQ ID NO: 491261 - RNA, 18 nt, Human
ucuuuuuuuuuuuuuuuu

SEQ ID NO: 491262 - RNA, 24 nt, Human
ugaaggaaucaacuucuggacgga

SEQ ID NO: 491263 - RNA, 23 nt, Human
ugagaaggggucucacuguguug

SEQ ID NO: 491264 - RNA, 23 nt, Human
ugaguaaauucuuaauaaaugcu

SEQ ID NO: 491265 - RNA, 19 nt, Human
ugccccgggucuguccagc

SEQ ID NO: 491266 - RNA, 18 nt, Human
uggaguuuggacugggca

SEQ ID NO: 491267 - RNA, 23 nt, Human
uggaguuuggacugggcagggag

SEQ ID NO: 491268 - RNA, 20 nt, Human
uggccucaagccauccuccc

SEQ ID NO: 491269 - RNA, 21 nt, Human
uggccucaagccauccuccca

SEQ ID NO: 491270 - RNA, 19 nt, Human
uggcuugggccgggaaagg

SEQ ID NO: 491271 - RNA, 19 nt, Human
uggcuugggccgggaaagg

SEQ ID NO: 491272 - RNA, 21 nt, Human
ugggauuacaaguaugggcca

SEQ ID NO: 491273 - RNA, 21 nt, Human
ugggauuacaaguaugggcca

SEQ ID NO: 491274 - RNA, 22 nt, Human
ugggauuacaaguaugggccau

SEQ ID NO: 491275 - RNA, 23 nt, Human
ugggauuacaaguaugggccauc

SEQ ID NO: 491276 - RNA, 24 nt, Human
ugggauuacaaguaugggccauca

SEQ ID NO: 491277 - RNA, 21 nt, Human
ugugugugggcacagcaggcu

SEQ ID NO: 491278 - RNA, 21 nt, Human
uguguugcccuggcuggucgg

SEQ ID NO: 491279 - RNA, 28 nt, Human
uguguugcccuggcuggucggucucaaa

SEQ ID NO: 491280 - RNA, 21 nt, Human
uuagugggugugugugggcac

SEQ ID NO: 491281 - RNA, 18 nt, Human
uuugagaaggggucucac

SEQ ID NO: 491282 - RNA, 23 nt, Human
uuuuuuuuuuuugagaagggguc

SEQ ID NO: 491283 - RNA, 28 nt, Human
uuuuuuuuuuuugagaaggggucucaac

SEQ ID NO: 491284 - RNA, 18 nt, Human
uuuuuuuuuuuuuuuuug

SEQ ID NO: 491285 - RNA, 25 nt, Human
uuuuuuuuuuuuuuuuugagaaggg

SEQ ID NO: 491286 - RNA, 24 nt, Human
aaacuaaacucaagugucaaauaa

SEQ ID NO: 491287 - RNA, 23 nt, Human
aaagaacacuuccaaacggcuaa

SEQ ID NO: 491288 - RNA, 25 nt, Human
aaagaacuguaauaucaaagaacac

SEQ ID NO: 491289 - RNA, 20 nt, Human
aauagcauuaacacacaucc

SEQ ID NO: 491290 - RNA, 24 nt, Human
aggcaaaauggcaggugcucaaag

SEQ ID NO: 491291 - RNA, 24 nt, Human
caaagaacacuuccaaacggcuaa

SEQ ID NO: 491292 - RNA, 23 nt, Human
caacacagguguaacaugugcuu

SEQ ID NO: 491293 - RNA, 18 nt, Human
cacuggguuuauaaaaga

SEQ ID NO: 491294 - RNA, 21 nt, Human
ccagugcaggaguucacuggg

SEQ ID NO: 491295 - RNA, 26 nt, Human
ccgcugccgguuguuagggggagccc

SEQ ID NO: 491296 - RNA, 18 nt, Human
cuaaaauaggcucaaggu

SEQ ID NO: 491297 - RNA, 20 nt, Human
cucaaaagccagauuucaca

SEQ ID NO: 491298 - RNA, 21 nt, Human
cucaaaagccagauuucacac

SEQ ID NO: 491299 - RNA, 19 nt, Human
gcucuuguuuugcuuuuga

SEQ ID NO: 491300 - RNA, 22 nt, Human
ggaaacgaugcaaggcaaaaug

SEQ ID NO: 491301 - RNA, 19 nt, Human
ggaguccgcugccgguugu

SEQ ID NO: 491302 - RNA, 18 nt, Human
uaaaagagaaaacuaaac

SEQ ID NO: 491303 - RNA, 18 nt, Human
uaaaauaggcucaagguc

SEQ ID NO: 491304 - RNA, 20 nt, Human
uaagauccuuuucuucacgc

SEQ ID NO: 491305 - RNA, 21 nt, Human
uaucaaagaacacuuccaaac

SEQ ID NO: 491306 - RNA, 25 nt, Human
ucacaccauggcaggcagugggaac

SEQ ID NO: 491307 - RNA, 23 nt, Human
ucucaaaagccagauuucacacc

SEQ ID NO: 491308 - RNA, 18 nt, Human
ugcuuguggcaacacagg

SEQ ID NO: 491309 - RNA, 19 nt, Human
ugcuuguggcaacacaggu

SEQ ID NO: 491310 - RNA, 21 nt, Human
ugucaaauaaaaacuggagcc

SEQ ID NO: 491311 - RNA, 21 nt, Human
uuaacacacauccaaaugcca

SEQ ID NO: 491312 - RNA, 19 nt, Human
uucuguguuuguggauaug

SEQ ID NO: 491313 - RNA, 24 nt, Human
uucuucacgcuugugugcucuugu

SEQ ID NO: 491314 - RNA, 21 nt, Human
uuguuuugcuuuugagaauua

SEQ ID NO: 491315 - RNA, 20 nt, Human
aaaauucaggccuccaccuc

SEQ ID NO: 491316 - RNA, 23 nt, Human
aaguuuccagccaggcucccaca

SEQ ID NO: 491317 - RNA, 22 nt, Human
accucaaaccucaucaagucaa

SEQ ID NO: 491318 - RNA, 18 nt, Human
agccaggcucccacaaac

SEQ ID NO: 491319 - RNA, 18 nt, Human
aggugccauccagccccg

SEQ ID NO: 491320 - RNA, 28 nt, Human
aucgccaucuuuuccccuuguaccucaa

SEQ ID NO: 491321 - RNA, 19 nt, Human
caaaauucaggccuccacc

SEQ ID NO: 491322 - RNA, 25 nt, Human
caacauggggacuguguucuugaug

SEQ ID NO: 491323 - RNA, 18 nt, Human
cagccaggcucccacaaa

SEQ ID NO: 491324 - RNA, 19 nt, Human
ccaagacuucugcccaccu

SEQ ID NO: 491325 - RNA, 20 nt, Human
ccacccccacacaccaaacc

SEQ ID NO: 491326 - RNA, 20 nt, Human
ccagccuggcagcacuccug

SEQ ID NO: 491327 - RNA, 21 nt, Human
ccagccuggcagcacuccugu

SEQ ID NO: 491328 - RNA, 18 nt, Human
cccacaaacauuacugca

SEQ ID NO: 491329 - RNA, 23 nt, Human
ccccaagacuucugcccaccucc

SEQ ID NO: 491330 - RNA, 26 nt, Human
ccccaagacuucugcccaccucccac

SEQ ID NO: 491331 - RNA, 28 nt, Human
ccccaagacuucugcccaccucccaccc

SEQ ID NO: 491332 - RNA, 23 nt, Human
ccccacacaccaaaccuuccccu

SEQ ID NO: 491333 - RNA, 27 nt, Human
ccccacacaccaaaccuuccccugcua

SEQ ID NO: 491334 - RNA, 22 nt, Human
ccccgacggcgauggaggugga

SEQ ID NO: 491335 - RNA, 23 nt, Human
ccgggguccggccggccccuccc

SEQ ID NO: 491336 - RNA, 23 nt, Human
ccucaaaccucaucaagucaagc

SEQ ID NO: 491337 - RNA, 19 nt, Human
ccucaucaagucaagcucu

SEQ ID NO: 491338 - RNA, 23 nt, Human
ccucaucaagucaagcucugcag

SEQ ID NO: 491339 - RNA, 21 nt, Human
ccuccaccucgcgggcucccg

SEQ ID NO: 491340 - RNA, 21 nt, Human
ccucccacccccacacaccaa

SEQ ID NO: 491341 - RNA, 22 nt, Human
ccucccacccccacacaccaaa

SEQ ID NO: 491342 - RNA, 23 nt, Human
ccucccccgacggcgauggaggu

SEQ ID NO: 491343 - RNA, 22 nt, Human
ccuccuugcccuucaguguucc

SEQ ID NO: 491344 - RNA, 23 nt, Human
cggcagugaccccgggguccggc

SEQ ID NO: 491345 - RNA, 21 nt, Human
cucccacccccacacaccaaa

SEQ ID NO: 491346 - RNA, 23 nt, Human
cucccacccccacacaccaaacc

SEQ ID NO: 491347 - RNA, 22 nt, Human
cuccuugcccuucaguguucca

SEQ ID NO: 491348 - RNA, 24 nt, Human
cugagaaccuccuuugcccauucc

SEQ ID NO: 491349 - RNA, 22 nt, Human
cugcauuuucccccucaacaug

SEQ ID NO: 491350 - RNA, 26 nt, Human
cugcccaccucccacccccacacacc

SEQ ID NO: 491351 - RNA, 19 nt, Human
cuuugcccauuccucccca

SEQ ID NO: 491352 - RNA, 22 nt, Human
cuuugcccauuccuccccaaga

SEQ ID NO: 491353 - RNA, 24 nt, Human
gacuucugcccaccucccaccccc

SEQ ID NO: 491354 - RNA, 19 nt, Human
gaggugccauccagccccg

SEQ ID NO: 491355 - RNA, 21 nt, Human
gcagugaccccgggguccggc

SEQ ID NO: 491356 - RNA, 24 nt, Human
gcccaccucccacccccacacacc

SEQ ID NO: 491357 - RNA, 19 nt, Human
gcggagcgcggggcccggc

SEQ ID NO: 491358 - RNA, 22 nt, Human
gcgggcucccggggcaaggccc

SEQ ID NO: 491359 - RNA, 20 nt, Human
ggcccggccgccucucuuca

SEQ ID NO: 491360 - RNA, 21 nt, Human
ggccggggcggagcgcggggc

SEQ ID NO: 491361 - RNA, 18 nt, Human
uacagccccugaggugcc

SEQ ID NO: 491362 - RNA, 23 nt, Human
uaccucaaaccucaucaagucaa

SEQ ID NO: 491363 - RNA, 20 nt, Human
uaggccggggcggagcgcgg

SEQ ID NO: 491364 - RNA, 18 nt, Human
uaggucccuggaugggac

SEQ ID NO: 491365 - RNA, 23 nt, Human
uccaccucgcgggcucccggggc

SEQ ID NO: 491366 - RNA, 19 nt, Human
uccccaagacuucugccca

SEQ ID NO: 491367 - RNA, 27 nt, Human
ucccccgacggcgauggagguggaggc

SEQ ID NO: 491368 - RNA, 19 nt, Human
uccccugcuacuuucucuu

SEQ ID NO: 491369 - RNA, 19 nt, Human
ucgccaucuuuuccccuug

SEQ ID NO: 491370 - RNA, 21 nt, Human
ucggcagugaccccggggucc

SEQ ID NO: 491371 - RNA, 23 nt, Human
ucucuuaggucccuggaugggac

SEQ ID NO: 491372 - RNA, 21 nt, Human
ugaggugccauccagccccga

SEQ ID NO: 491373 - RNA, 24 nt, Human
ugcauuuucccccucaacaugggg

SEQ ID NO: 491374 - RNA, 23 nt, Human
ugccauccagccccgaccugcuc

SEQ ID NO: 491375 - RNA, 20 nt, Human
uuccucggcagugaccccgg

SEQ ID NO: 491376 - RNA, 22 nt, Human
uucugcccaccucccaccccca

SEQ ID NO: 491377 - RNA, 21 nt, Human
uuuuuuuuuuuucccaaccuc

SEQ ID NO: 491378 - RNA, 25 nt, Human
aaaaaaaaaagaccuugcugggaaa

SEQ ID NO: 491379 - RNA, 24 nt, Human
aacaggauuaagcugcucuugauu

SEQ ID NO: 491380 - RNA, 23 nt, Human
aacggcaaagcucuagggagaga

SEQ ID NO: 491381 - RNA, 19 nt, Human
agggagagaccauagagcc

SEQ ID NO: 491382 - RNA, 22 nt, Human
caauguagaaaaaaaaaagacc

SEQ ID NO: 491383 - RNA, 20 nt, Human
cagcagccgccuccaacggc

SEQ ID NO: 491384 - RNA, 24 nt, Human
cagcagccgccuccaacggcaaag

SEQ ID NO: 491385 - RNA, 23 nt, Human
ccaacuuuuauuuuauuuauuca

SEQ ID NO: 491386 - RNA, 22 nt, Human
cucacaagaccgcagcagccgc

SEQ ID NO: 491387 - RNA, 21 nt, Human
ggucaaacucacaagaccgca

SEQ ID NO: 491388 - RNA, 22 nt, Human
uaagcugcucuugauuuagccc

SEQ ID NO: 491389 - RNA, 22 nt, Human
ugaugagaaacacuguaaaaca

SEQ ID NO: 491390 - RNA, 23 nt, Human
uguaaacaggauuaagcugcucu

SEQ ID NO: 491391 - RNA, 26 nt, Human
uguaaacaggauuaagcugcucuuga

SEQ ID NO: 491392 - RNA, 22 nt, Human
uucaauguagaaaaaaaaaaga

SEQ ID NO: 491393 - RNA, 24 nt, Human
uucacagacgcacaaaaagcucac

SEQ ID NO: 491394 - RNA, 20 nt, Human
uugcugccgcucgacgcugg

SEQ ID NO: 491395 - RNA, 19 nt, Human
aaaccgaaagccuggaagc

SEQ ID NO: 491396 - RNA, 20 nt, Human
aaagaaaccgaaagccugga

SEQ ID NO: 491397 - RNA, 18 nt, Human
aaagauccucccaccuca

SEQ ID NO: 491398 - RNA, 24 nt, Human
aaagugcugggauuacagguguga

SEQ ID NO: 491399 - RNA, 21 nt, Human
aacacagguacccacacccac

SEQ ID NO: 491400 - RNA, 23 nt, Human
aagaaaccgaaagccuggaagcg

SEQ ID NO: 491401 - RNA, 20 nt, Human
aagagaugggaucuugcuau

SEQ ID NO: 491402 - RNA, 24 nt, Human
aagugaucugcccuccuuggccuc

SEQ ID NO: 491403 - RNA, 18 nt, Human
aagugcugggauuacagg

SEQ ID NO: 491404 - RNA, 19 nt, Human
aagugcugggauuacaggu

SEQ ID NO: 491405 - RNA, 26 nt, Human
aagugcugggauuacaggugugagcc

SEQ ID NO: 491406 - RNA, 23 nt, Human
acagcguuuaccauguuggccag

SEQ ID NO: 491407 - RNA, 23 nt, Human
accauguuggccaggcuggucuc

SEQ ID NO: 491408 - RNA, 24 nt, Human
accauguuggccaggcuggucucg

SEQ ID NO: 491409 - RNA, 18 nt, Human
acccacacccacacccag

SEQ ID NO: 491410 - RNA, 25 nt, Human
accccuagcuccgggagucccuuuu

SEQ ID NO: 491411 - RNA, 23 nt, Human
accucagccucccaaguaacugg

SEQ ID NO: 491412 - RNA, 23 nt, Human
accuccucccgugguccuuguug

SEQ ID NO: 491413 - RNA, 24 nt, Human
agccuggaagcggacuuggugcug

SEQ ID NO: 491414 - RNA, 19 nt, Human
aggccgaguccccaccccu

SEQ ID NO: 491415 - RNA, 21 nt, Human
agguacccacacccacaccca

SEQ ID NO: 491416 - RNA, 24 nt, Human
agugaucugcccuccuuggccucc

SEQ ID NO: 491417 - RNA, 24 nt, Human
caaagugcugggauuacaggugug

SEQ ID NO: 491418 - RNA, 22 nt, Human
cacagguacccacacccacacc

SEQ ID NO: 491419 - RNA, 24 nt, Human
cacagguacccacacccacaccca

SEQ ID NO: 491420 - RNA, 21 nt, Human
caccccuagcuccgggagucc

SEQ ID NO: 491421 - RNA, 27 nt, Human
caccucagccucccaaguaacugggaa

SEQ ID NO: 491422 - RNA, 18 nt, Human
cagcaugcuaugacccug

SEQ ID NO: 491423 - RNA, 23 nt, Human
cagcguuuaccauguuggccagg

SEQ ID NO: 491424 - RNA, 18 nt, Human
cagguacccacacccaca

SEQ ID NO: 491425 - RNA, 21 nt, Human
cagguacccacacccacaccc

SEQ ID NO: 491426 - RNA, 23 nt, Human
caugcuaugacccugaacuccug

SEQ ID NO: 491427 - RNA, 24 nt, Human
cauguuggccaggcuggucucgaa

SEQ ID NO: 491428 - RNA, 19 nt, Human
cauuuuuacuagggacagc

SEQ ID NO: 491429 - RNA, 20 nt, Human
ccaaagugcugggauuacag

SEQ ID NO: 491430 - RNA, 21 nt, Human
ccaaagugcugggauuacagg

SEQ ID NO: 491431 - RNA, 21 nt, Human
ccaaagugcugggauuacagg

SEQ ID NO: 491432 - RNA, 24 nt, Human
ccaaagugcugggauuacaggugu

SEQ ID NO: 491433 - RNA, 18 nt, Human
ccaaguaacugggaacac

SEQ ID NO: 491434 - RNA, 20 nt, Human
cccaccucagccucccaagu

SEQ ID NO: 491435 - RNA, 23 nt, Human
cccuagacgccgggaaggcgcac

SEQ ID NO: 491436 - RNA, 21 nt, Human
ccgcugccaccucagccuucg

SEQ ID NO: 491437 - RNA, 18 nt, Human
ccuacaccuccucccgug

SEQ ID NO: 491438 - RNA, 24 nt, Human
ccugaccugaagugaucugcccuc

SEQ ID NO: 491439 - RNA, 21 nt, Human
ccuggaagcggacuuggugcu

SEQ ID NO: 491440 - RNA, 21 nt, Human
cgcggccggacucuccugccc

SEQ ID NO: 491441 - RNA, 23 nt, Human
cggcgcuucucuccuacaccucc

SEQ ID NO: 491442 - RNA, 19 nt, Human
cucccgugguccuuguugu

SEQ ID NO: 491443 - RNA, 23 nt, Human
cuccuggguucaaaagauccucc

SEQ ID NO: 491444 - RNA, 24 nt, Human
cucuccugccgcugccaccucagc

SEQ ID NO: 491445 - RNA, 23 nt, Human
gaacuccugaccugaagugaucu

SEQ ID NO: 491446 - RNA, 18 nt, Human
gauuacaggugugagcca

SEQ ID NO: 491447 - RNA, 21 nt, Human
gauuacaggugugagccacua

SEQ ID NO: 491448 - RNA, 22 nt, Human
gauuacaggugugagccacuac

SEQ ID NO: 491449 - RNA, 19 nt, Human
gcggccggacucuccugcc

SEQ ID NO: 491450 - RNA, 21 nt, Human
ggcgaucgcuguucgcggcgc

SEQ ID NO: 491451 - RNA, 20 nt, Human
gguacccacacccacaccca

SEQ ID NO: 491452 - RNA, 19 nt, Human
ggucucgaacuccugaccu

SEQ ID NO: 491453 - RNA, 26 nt, Human
guccuuguugucucagcugucacugg

SEQ ID NO: 491454 - RNA, 24 nt, Human
gugagccacuacgcccagccuuuu

SEQ ID NO: 491455 - RNA, 24 nt, Human
uaauuuuugcauuuuuacuaggga

SEQ ID NO: 491456 - RNA, 24 nt, Human
uacaggugugagccacuacgccca

SEQ ID NO: 491457 - RNA, 21 nt, Human
uaccauguuggccaggcuggu

SEQ ID NO: 491458 - RNA, 27 nt, Human
uaccauguuggccaggcuggucucgaa

SEQ ID NO: 491459 - RNA, 21 nt, Human
uacccacacccacacccagcu

SEQ ID NO: 491460 - RNA, 23 nt, Human
uacccacacccacacccagcuaa

SEQ ID NO: 491461 - RNA, 19 nt, Human
uacgcccagccuuuugguu

SEQ ID NO: 491462 - RNA, 23 nt, Human
uagacuagggaagcucacaaggg

SEQ ID NO: 491463 - RNA, 28 nt, Human
uaggcacaaucacagcaugcuaugaccc

SEQ ID NO: 491464 - RNA, 21 nt, Human
uagggacagcguuuaccaugu

SEQ ID NO: 491465 - RNA, 18 nt, Human
uauauugcccagguuggu

SEQ ID NO: 491466 - RNA, 19 nt, Human
uauauugcccagguuggua

SEQ ID NO: 491467 - RNA, 22 nt, Human
uauggcuugguuucgcgauugu

SEQ ID NO: 491468 - RNA, 23 nt, Human
uauugcccagguugguaugcagu

SEQ ID NO: 491469 - RNA, 19 nt, Human
ucacugugugaggccgagu

SEQ ID NO: 491470 - RNA, 23 nt, Human
ucccaaagugcugggauuacagg

SEQ ID NO: 491471 - RNA, 27 nt, Human
uccucccaccucagccucccaaguaac

SEQ ID NO: 491472 - RNA, 21 nt, Human
uccuggguucaaaagauccuc

SEQ ID NO: 491473 - RNA, 24 nt, Human
uccuggguucaaaagauccuccca

SEQ ID NO: 491474 - RNA, 21 nt, Human
uccuuggccucccaaagugcu

SEQ ID NO: 491475 - RNA, 21 nt, Human
ucucgaacuccugaccugaag

SEQ ID NO: 491476 - RNA, 20 nt, Human
ucucuccuacaccuccuccc

SEQ ID NO: 491477 - RNA, 23 nt, Human
ucuugcuauauugcccagguugg

SEQ ID NO: 491478 - RNA, 24 nt, Human
ucuugcuauauugcccagguuggu

SEQ ID NO: 491479 - RNA, 25 nt, Human
ugaacuccuggguucaaaagauccu

SEQ ID NO: 491480 - RNA, 20 nt, Human
ugaccugaagugaucugccc

SEQ ID NO: 491481 - RNA, 22 nt, Human
ugaccugaagugaucugcccuc

SEQ ID NO: 491482 - RNA, 18 nt, Human
ugaggccgaguccccacc

SEQ ID NO: 491483 - RNA, 24 nt, Human
ugaucugcccuccuuggccuccca

SEQ ID NO: 491484 - RNA, 21 nt, Human
ugcaguacagcuccgggccag

SEQ ID NO: 491485 - RNA, 22 nt, Human
ugcaguggcuauucguaggcac

SEQ ID NO: 491486 - RNA, 24 nt, Human
ugcugggauuacaggugugagcca

SEQ ID NO: 491487 - RNA, 21 nt, Human
uggaagcggacuuggugcugg

SEQ ID NO: 491488 - RNA, 24 nt, Human
uggccaggcuggucucgaacuccu

SEQ ID NO: 491489 - RNA, 24 nt, Human
ugggaacacagguacccacaccca

SEQ ID NO: 491490 - RNA, 24 nt, Human
ugggaucuugcuauauugcccagg

SEQ ID NO: 491491 - RNA, 18 nt, Human
ugggauuacaggugugag

SEQ ID NO: 491492 - RNA, 19 nt, Human
ugggauuacaggugugagc

SEQ ID NO: 491493 - RNA, 21 nt, Human
ugggauuacaggugugagcca

SEQ ID NO: 491494 - RNA, 22 nt, Human
ugggauuacaggugugagccac

SEQ ID NO: 491495 - RNA, 22 nt, Human
ugggauuacaggugugagccac

SEQ ID NO: 491496 - RNA, 23 nt, Human
ugggauuacaggugugagccacu

SEQ ID NO: 491497 - RNA, 24 nt, Human
ugggauuacaggugugagccacua

SEQ ID NO: 491498 - RNA, 20 nt, Human
uggguucaaaagauccuccc

SEQ ID NO: 491499 - RNA, 21 nt, Human
uggugcugggcgaucgcuguu

SEQ ID NO: 491500 - RNA, 21 nt, Human
ugucacuggacaaaaguccaa

SEQ ID NO: 491501 - RNA, 19 nt, Human
uucaaaagauccucccacc

SEQ ID NO: 491502 - RNA, 24 nt, Human
uucaaaagauccucccaccucagc

SEQ ID NO: 491503 - RNA, 18 nt, Human
uuccagugggggaguucg

SEQ ID NO: 491504 - RNA, 22 nt, Human
uuuuuuuuuuuuuaaagagaug

SEQ ID NO: 491505 - RNA, 22 nt, Human
aaaaaaagaaaaggaaagaaaa

SEQ ID NO: 491506 - RNA, 23 nt, Human
aaaaaagcagcagaaggaaugca

SEQ ID NO: 491507 - RNA, 19 nt, Human
aaaaagcagcagaaggaau

SEQ ID NO: 491508 - RNA, 21 nt, Human
aaaaauacccccaucccaaaa

SEQ ID NO: 491509 - RNA, 23 nt, Human
aaaacaaaugaacaaaaauaccc

SEQ ID NO: 491510 - RNA, 29 nt, Human
aaacaaaaacaaacccaccccaagucugg

SEQ ID NO: 491511 - RNA, 24 nt, Human
aaacaaaugaacaaaaauaccccc

SEQ ID NO: 491512 - RNA, 25 nt, Human
aaacagggcaaaaacaaaugaacaa

SEQ ID NO: 491513 - RNA, 30 nt, Human
aaagaaaaggaaagaaaaaacaaaaacaaa

SEQ ID NO: 491514 - RNA, 26 nt, Human
aacaaaaacaaacccaccccaagucu

SEQ ID NO: 491515 - RNA, 19 nt, Human
aacuucagcuaccgccccc

SEQ ID NO: 491516 - RNA, 23 nt, Human
aagaaaaaacaaaaacaaaccca

SEQ ID NO: 491517 - RNA, 22 nt, Human
aagaaaaggaaagaaaaaacaa

SEQ ID NO: 491518 - RNA, 24 nt, Human
aagaaaaggaaagaaaaaacaaaa

SEQ ID NO: 491519 - RNA, 22 nt, Human
aaggagaaacuaagggauggug

SEQ ID NO: 491520 - RNA, 21 nt, Human
aagucugucuuuucucaaacu

SEQ ID NO: 491521 - RNA, 18 nt, Human
aagugcuguugcugacag

SEQ ID NO: 491522 - RNA, 23 nt, Human
acaaaaacaaacccaccccaagu

SEQ ID NO: 491523 - RNA, 21 nt, Human
acagggcaaaaacaaaugaac

SEQ ID NO: 491524 - RNA, 22 nt, Human
accccaagucugucuuuucuca

SEQ ID NO: 491525 - RNA, 19 nt, Human
aggagaaacuaagggaugg

SEQ ID NO: 491526 - RNA, 19 nt, Human
agggcacugacgcuuccuc

SEQ ID NO: 491527 - RNA, 21 nt, Human
cacuggcccagcccugggugc

SEQ ID NO: 491528 - RNA, 21 nt, Human
cagggcacugacgcuuccucc

SEQ ID NO: 491529 - RNA, 23 nt, Human
ccaguacuauuuauuuggaaguc

SEQ ID NO: 491530 - RNA, 21 nt, Human
cccaaaaaagcagcagaagga

SEQ ID NO: 491531 - RNA, 23 nt, Human
cccaaaaaagcagcagaaggaau

SEQ ID NO: 491532 - RNA, 24 nt, Human
cccaaaaaagcagcagaaggaaug

SEQ ID NO: 491533 - RNA, 20 nt, Human
ccuccaggauucgaguccac

SEQ ID NO: 491534 - RNA, 21 nt, Human
cgacuucccuuucccuuuauu

SEQ ID NO: 491535 - RNA, 25 nt, Human
cggagcuaugcguaaaaaaagaaaa

SEQ ID NO: 491536 - RNA, 22 nt, Human
cugacgcuuccuccaagccuug

SEQ ID NO: 491537 - RNA, 22 nt, Human
cuugcugcaugggcgcucaucc

SEQ ID NO: 491538 - RNA, 24 nt, Human
gaaaaaacaaaaacaaacccaccc

SEQ ID NO: 491539 - RNA, 23 nt, Human
gaaaaggaaagaaaaaacaaaaa

SEQ ID NO: 491540 - RNA, 22 nt, Human
ggagagcgagcugggaucucca

SEQ ID NO: 491541 - RNA, 19 nt, Human
ggaugguguggccuccggc

SEQ ID NO: 491542 - RNA, 22 nt, Human
ggcccagcccugggugcagcca

SEQ ID NO: 491543 - RNA, 25 nt, Human
gggugcagccagcucuugcggggcg

SEQ ID NO: 491544 - RNA, 21 nt, Human
uaaaaaaagaaaaggaaagaa

SEQ ID NO: 491545 - RNA, 26 nt, Human
ucaaaacagggcaaaaacaaaugaac

SEQ ID NO: 491546 - RNA, 22 nt, Human
ucccuuuauuuccuccuccagg

SEQ ID NO: 491547 - RNA, 23 nt, Human
ucccuuuauuuccuccuccagga

SEQ ID NO: 491548 - RNA, 22 nt, Human
ugaacaaaaauacccccauccc

SEQ ID NO: 491549 - RNA, 23 nt, Human
ugacaguggggagagcgagcugg

SEQ ID NO: 491550 - RNA, 27 nt, Human
ugacaguggggagagcgagcugggauc

SEQ ID NO: 491551 - RNA, 18 nt, Human
uggggagagcgagcuggg

SEQ ID NO: 491552 - RNA, 21 nt, Human
uggggagagcgagcugggauc

SEQ ID NO: 491553 - RNA, 24 nt, Human
uuaaccauuuucccugccucucca

SEQ ID NO: 491554 - RNA, 25 nt, Human
uuccuccaagccuugcugcaugggc

SEQ ID NO: 491555 - RNA, 25 nt, Human
uuuauuuggaagucugcgccauggu

SEQ ID NO: 491556 - RNA, 21 nt, Human
uuuuuuuuuugaaaugaccag

SEQ ID NO: 491557 - RNA, 23 nt, Human
aaauucgauuguagaaaaacauc

SEQ ID NO: 491558 - RNA, 22 nt, Human
aacuacuuaaacuccaagacag

SEQ ID NO: 491559 - RNA, 19 nt, Human
aacuauuaaaaaacuguuc

SEQ ID NO: 491560 - RNA, 21 nt, Human
aagaaaacuccccaggugacu

SEQ ID NO: 491561 - RNA, 18 nt, Human
aagaaaagcggagacagc

SEQ ID NO: 491562 - RNA, 19 nt, Human
acgcauugaccuuuaccuc

SEQ ID NO: 491563 - RNA, 21 nt, Human
acuauguaugcauuacaagau

SEQ ID NO: 491564 - RNA, 18 nt, Human
acuugcugggaacauccu

SEQ ID NO: 491565 - RNA, 18 nt, Human
agcccaccucucagaauc

SEQ ID NO: 491566 - RNA, 26 nt, Human
agucaguauuucuugcauauuuaagg

SEQ ID NO: 491567 - RNA, 20 nt, Human
auauaccuacuaucuaacaa

SEQ ID NO: 491568 - RNA, 22 nt, Human
caacaaauguguuagcugaaaa

SEQ ID NO: 491569 - RNA, 22 nt, Human
cagaaucgcgguaacaaaccuc

SEQ ID NO: 491570 - RNA, 25 nt, Human
cagccaagaguauuacaacaagaga

SEQ ID NO: 491571 - RNA, 20 nt, Human
cauccuagcuccuacccacc

SEQ ID NO: 491572 - RNA, 19 nt, Human
cgauuguagaaaaacaucc

SEQ ID NO: 491573 - RNA, 20 nt, Human
cgguaacaaaccucaccucc

SEQ ID NO: 491574 - RNA, 19 nt, Human
cucacuaacucuuuuucaa

SEQ ID NO: 491575 - RNA, 22 nt, Human
cuccuacccaccacucuauuac

SEQ ID NO: 491576 - RNA, 21 nt, Human
gaggcacuguagccuuuuuuu

SEQ ID NO: 491577 - RNA, 19 nt, Human
ggagggacuaaaagcccac

SEQ ID NO: 491578 - RNA, 18 nt, Human
gggaacauccuuugugag

SEQ ID NO: 491579 - RNA, 24 nt, Human
uaacagccaagaguauuacaacaa

SEQ ID NO: 491580 - RNA, 22 nt, Human
uacaacaagagaauauaaaaac

SEQ ID NO: 491581 - RNA, 23 nt, Human
uacagaaaaauuaguacuagaag

SEQ ID NO: 491582 - RNA, 22 nt, Human
uccuagcuccuacccaccacuc

SEQ ID NO: 491583 - RNA, 23 nt, Human
ucuuaugaccauguuaagcaacu

SEQ ID NO: 491584 - RNA, 18 nt, Human
ugaaagaaaagcggagac

SEQ ID NO: 491585 - RNA, 21 nt, Human
ugaaagaaaagcggagacagc

SEQ ID NO: 491586 - RNA, 23 nt, Human
ugaaagaaaagcggagacagcac

SEQ ID NO: 491587 - RNA, 22 nt, Human
ugaugugcugauuauagcuaag

SEQ ID NO: 491588 - RNA, 28 nt, Human
uguaugcauuacaagaugaauaugcaua

SEQ ID NO: 491589 - RNA, 18 nt, Human
ugugggguuagggagaug

SEQ ID NO: 491590 - RNA, 19 nt, Human
uuaaaaaacuguucaauag

SEQ ID NO: 491591 - RNA, 19 nt, Human
uuaaacaacuugcugggaa

SEQ ID NO: 491592 - RNA, 20 nt, Human
uuaaauugaacagagagaag

SEQ ID NO: 491593 - RNA, 21 nt, Human
uuaugaagaaaacuccccagg

SEQ ID NO: 491594 - RNA, 20 nt, Human
uuccauaacagccaagagua

SEQ ID NO: 491595 - RNA, 24 nt, Human
uuuaacaacuugcugggaauuuaa

SEQ ID NO: 491596 - RNA, 18 nt, Human
aaaacaaacaaaaacccc

SEQ ID NO: 491597 - RNA, 24 nt, Human
aaaacaaacaaaaaccccaaagaa

SEQ ID NO: 491598 - RNA, 19 nt, Human
aaaauaagaacuccugaau

SEQ ID NO: 491599 - RNA, 24 nt, Human
aaaguguugggauuacaggcauga

SEQ ID NO: 491600 - RNA, 20 nt, Human
aaccugccaucccuuucaaa

SEQ ID NO: 491601 - RNA, 21 nt, Human
aacuauuaaaaacugcaagcu

SEQ ID NO: 491602 - RNA, 30 nt, Human
aagacaaauaaacuggaucaaccaagggac

SEQ ID NO: 491603 - RNA, 21 nt, Human
aagcuagucucaaacuccugg

SEQ ID NO: 491604 - RNA, 21 nt, Human
aaguguugggauuacaggcau

SEQ ID NO: 491605 - RNA, 26 nt, Human
aaguguugggauuacaggcaugagcc

SEQ ID NO: 491606 - RNA, 20 nt, Human
aauaaaaaauuuccaaaagu

SEQ ID NO: 491607 - RNA, 18 nt, Human
aauagcugggauuacagg

SEQ ID NO: 491608 - RNA, 21 nt, Human
aaugauucucgugccucagcc

SEQ ID NO: 491609 - RNA, 20 nt, Human
acaaaaaccccaaagaacuc

SEQ ID NO: 491610 - RNA, 24 nt, Human
acaacagaguucacaucacccuga

SEQ ID NO: 491611 - RNA, 19 nt, Human
acaccacugcccugacagg

SEQ ID NO: 491612 - RNA, 22 nt, Human
acagagacauagaaaacaacaa

SEQ ID NO: 491613 - RNA, 19 nt, Human
acaguaauuuuuuuuccuu

SEQ ID NO: 491614 - RNA, 21 nt, Human
acauagaaaacaacaaaaugu

SEQ ID NO: 491615 - RNA, 22 nt, Human
acccacagcuccagcuuuccuc

SEQ ID NO: 491616 - RNA, 20 nt, Human
acccugcagugccucccaaa

SEQ ID NO: 491617 - RNA, 23 nt, Human
accugaccaaagucacagccacc

SEQ ID NO: 491618 - RNA, 21 nt, Human
accuggacagcugaaaugauc

SEQ ID NO: 491619 - RNA, 24 nt, Human
accugggcuggagugcaguggcau

SEQ ID NO: 491620 - RNA, 20 nt, Human
acuacacuaucagaacagca

SEQ ID NO: 491621 - RNA, 20 nt, Human
acucacucugucgcccagga

SEQ ID NO: 491622 - RNA, 21 nt, Human
acucugucgcccaggaugcag

SEQ ID NO: 491623 - RNA, 18 nt, Human
acuuuuugaguucucaac

SEQ ID NO: 491624 - RNA, 24 nt, Human
agaaaacaaucccuaauccaaaac

SEQ ID NO: 491625 - RNA, 20 nt, Human
agacugcuggguacugugag

SEQ ID NO: 491626 - RNA, 18 nt, Human
agcaaccacauuucuaaa

SEQ ID NO: 491627 - RNA, 20 nt, Human
agccaguguggcaacugaca

SEQ ID NO: 491628 - RNA, 18 nt, Human
agccuccugaguagcuag

SEQ ID NO: 491629 - RNA, 20 nt, Human
agcuagucucaaacuccugg

SEQ ID NO: 491630 - RNA, 24 nt, Human
agcuagucucaaacuccugguccc

SEQ ID NO: 491631 - RNA, 25 nt, Human
aggaaaaauggaggagaccgguacc

SEQ ID NO: 491632 - RNA, 25 nt, Human
aggcuggagugcaguggugugaucu

SEQ ID NO: 491633 - RNA, 18 nt, Human
aguagcugggacuacagg

SEQ ID NO: 491634 - RNA, 18 nt, Human
aguagcugggauuacagg

SEQ ID NO: 491635 - RNA, 19 nt, Human
agugcaguggcaugaucuc

SEQ ID NO: 491636 - RNA, 21 nt, Human
agugcaguggcaugaucucag

SEQ ID NO: 491637 - RNA, 23 nt, Human
agugcaguggcaugaucucagcu

SEQ ID NO: 491638 - RNA, 23 nt, Human
agugcaguggugugaucuuggcu

SEQ ID NO: 491639 - RNA, 24 nt, Human
agugcaguggugugaucuuggcuc

SEQ ID NO: 491640 - RNA, 24 nt, Human
agugcgguggcgcgaucucugcuc

SEQ ID NO: 491641 - RNA, 21 nt, Human
auacagagacauagaaaacaa

SEQ ID NO: 491642 - RNA, 18 nt, Human
auagcugggauuacaggu

SEQ ID NO: 491643 - RNA, 20 nt, Human
auauuuuuugguagagaugg

SEQ ID NO: 491644 - RNA, 28 nt, Human
auccaggcaacaacagaguucacaucac

SEQ ID NO: 491645 - RNA, 20 nt, Human
augacaaaauguucgguggc

SEQ ID NO: 491646 - RNA, 25 nt, Human
augggguuucacuauguuggccaag

SEQ ID NO: 491647 - RNA, 21 nt, Human
auuccccugccucagccuccc

SEQ ID NO: 491648 - RNA, 25 nt, Human
auuuuuauauuuuuugguagagaug

SEQ ID NO: 491649 - RNA, 23 nt, Human
caaaaaauaaaaaauuuccaaaa

SEQ ID NO: 491650 - RNA, 19 nt, Human
caaacaaaaaccccaaaga

SEQ ID NO: 491651 - RNA, 19 nt, Human
caaacaaaaaccccaaaga

SEQ ID NO: 491652 - RNA, 20 nt, Human
caaacaaaaaccccaaagaa

SEQ ID NO: 491653 - RNA, 24 nt, Human
caaaguguugggauuacaggcaug

SEQ ID NO: 491654 - RNA, 25 nt, Human
caaaugauucucgugccucagccga

SEQ ID NO: 491655 - RNA, 22 nt, Human
caacaaacaugacaaaauguuc

SEQ ID NO: 491656 - RNA, 20 nt, Human
caaccuccaccuccuggguu

SEQ ID NO: 491657 - RNA, 24 nt, Human
caaccuccaccuccuggguuuaag

SEQ ID NO: 491658 - RNA, 21 nt, Human
caaucccuaauccaaaaccgg

SEQ ID NO: 491659 - RNA, 21 nt, Human
cacaccaaacagugcuacuca

SEQ ID NO: 491660 - RNA, 20 nt, Human
cacagcuccagcuuuccucu

SEQ ID NO: 491661 - RNA, 23 nt, Human
caccacugcccugacaggcugcc

SEQ ID NO: 491662 - RNA, 20 nt, Human
caccugaccaaagucacagc

SEQ ID NO: 491663 - RNA, 21 nt, Human
cacuauguuggccaagcuagu

SEQ ID NO: 491664 - RNA, 24 nt, Human
cacuauguuggccaagcuagucuc

SEQ ID NO: 491665 - RNA, 21 nt, Human
cacucacucugucgcccagga

SEQ ID NO: 491666 - RNA, 24 nt, Human
cacucugucgcccaggaugcagug

SEQ ID NO: 491667 - RNA, 23 nt, Human
cacugcaaucuccguguccuggg

SEQ ID NO: 491668 - RNA, 22 nt, Human
cacugcaugcagcugacacaua

SEQ ID NO: 491669 - RNA, 23 nt, Human
cacuguagccucugccuccuggg

SEQ ID NO: 491670 - RNA, 23 nt, Human
cagagacauagaaaacaacaaaa

SEQ ID NO: 491671 - RNA, 24 nt, Human
cagagugcuggaggaaaaauggag

SEQ ID NO: 491672 - RNA, 20 nt, Human
cagaguucacaucacccuga

SEQ ID NO: 491673 - RNA, 22 nt, Human
cagcaaagaaaugacuaaaaga

SEQ ID NO: 491674 - RNA, 24 nt, Human
cagcaggcacuggucccacuuccu

SEQ ID NO: 491675 - RNA, 23 nt, Human
cagcccauauuacaguagguagg

SEQ ID NO: 491676 - RNA, 24 nt, Human
cagccgaauagcugggauuacagg

SEQ ID NO: 491677 - RNA, 19 nt, Human
cagccuccugaguagcuag

SEQ ID NO: 491678 - RNA, 23 nt, Human
cagcucacuguagccucugccuc

SEQ ID NO: 491679 - RNA, 24 nt, Human
caggguacucucauguacuaacug

SEQ ID NO: 491680 - RNA, 22 nt, Human
caugacaaaauguucgguggcc

SEQ ID NO: 491681 - RNA, 21 nt, Human
ccaaagaacucuggcucuuaa

SEQ ID NO: 491682 - RNA, 23 nt, Human
ccaaaguguugggauuacaggca

SEQ ID NO: 491683 - RNA, 24 nt, Human
ccaaaguguugggauuacaggcau

SEQ ID NO: 491684 - RNA, 21 nt, Human
ccacauuucuaaaccuuuuca

SEQ ID NO: 491685 - RNA, 24 nt, Human
ccaccuccuggguuuaagcgacuc

SEQ ID NO: 491686 - RNA, 18 nt, Human
ccaguccaugaaguuugc

SEQ ID NO: 491687 - RNA, 23 nt, Human
ccaucucagccuccugaguagcu

SEQ ID NO: 491688 - RNA, 24 nt, Human
cccaaaguguugggauuacaggca

SEQ ID NO: 491689 - RNA, 19 nt, Human
cccaggcuggagugcagug

SEQ ID NO: 491690 - RNA, 18 nt, Human
ccccaaagaacucuggcu

SEQ ID NO: 491691 - RNA, 20 nt, Human
ccccaaagaacucuggcucu

SEQ ID NO: 491692 - RNA, 33 nt, Human
ccccaaagaacucuggcucuuaaaggaccagga

SEQ ID NO: 491693 - RNA, 19 nt, Human
ccccacccacagcuccagc

SEQ ID NO: 491694 - RNA, 20 nt, Human
ccccccgccccucaagacca

SEQ ID NO: 491695 - RNA, 22 nt, Human
ccccccgccccucaagaccaaa

SEQ ID NO: 491696 - RNA, 19 nt, Human
ccccgccccucaagaccaa

SEQ ID NO: 491697 - RNA, 20 nt, Human
ccccgccccucaagaccaaa

SEQ ID NO: 491698 - RNA, 24 nt, Human
ccccgccccucaagaccaaaauua

SEQ ID NO: 491699 - RNA, 23 nt, Human
cccgaguagcugggacuacaggc

SEQ ID NO: 491700 - RNA, 24 nt, Human
cccgaguagcugggacuacaggca

SEQ ID NO: 491701 - RNA, 23 nt, Human
cccgaguagcugggauuacaggu

SEQ ID NO: 491702 - RNA, 24 nt, Human
cccgaguagcugggauuacaggug

SEQ ID NO: 491703 - RNA, 24 nt, Human
cccucugucaccugggcuggagug

SEQ ID NO: 491704 - RNA, 24 nt, Human
cccugccucagccucccgaguagc

SEQ ID NO: 491705 - RNA, 21 nt, Human
ccgaauagcugggauuacagg

SEQ ID NO: 491706 - RNA, 21 nt, Human
ccgaauagcugggauuacagg

SEQ ID NO: 491707 - RNA, 23 nt, Human
ccgaauagcugggauuacaggug

SEQ ID NO: 491708 - RNA, 24 nt, Human
ccgaauagcugggauuacaggugu

SEQ ID NO: 491709 - RNA, 21 nt, Human
ccgaguagcugggauuacagg

SEQ ID NO: 491710 - RNA, 25 nt, Human
ccgguacuuaucuaccacauccagc

SEQ ID NO: 491711 - RNA, 28 nt, Human
ccucagccgaauagcugggauuacaggu

SEQ ID NO: 491712 - RNA, 23 nt, Human
ccucccaguugauacaauguccc

SEQ ID NO: 491713 - RNA, 24 nt, Human
ccuccuggguugaagugauucucc

SEQ ID NO: 491714 - RNA, 22 nt, Human
ccuccuggguuuaagcgacucu

SEQ ID NO: 491715 - RNA, 24 nt, Human
ccucugccuccuggguugaaguga

SEQ ID NO: 491716 - RNA, 20 nt, Human
ccugaggcauauaacugccu

SEQ ID NO: 491717 - RNA, 19 nt, Human
ccugcagugccucccaaag

SEQ ID NO: 491718 - RNA, 24 nt, Human
ccugccucacccucccgaguagcu

SEQ ID NO: 491719 - RNA, 20 nt, Human
ccuggguucaaaugauucuc

SEQ ID NO: 491720 - RNA, 18 nt, Human
ccuggguuuaagcgacuc

SEQ ID NO: 491721 - RNA, 24 nt, Human
ccuucucucacuacucuaguaugc

SEQ ID NO: 491722 - RNA, 20 nt, Human
ccuuuuucuuugagagaguc

SEQ ID NO: 491723 - RNA, 25 nt, Human
cgaauagcugggauuacaggugugc

SEQ ID NO: 491724 - RNA, 19 nt, Human
cgccucccggauucacgcc

SEQ ID NO: 491725 - RNA, 22 nt, Human
cuaaugccaugccagaaccaaa

SEQ ID NO: 491726 - RNA, 23 nt, Human
cuacugauccacaaguacagaaa

SEQ ID NO: 491727 - RNA, 18 nt, Human
cucacucugucgcccagg

SEQ ID NO: 491728 - RNA, 24 nt, Human
cucacugcaagacccgccucccgg

SEQ ID NO: 491729 - RNA, 24 nt, Human
cucacugcaaucuccguguccugg

SEQ ID NO: 491730 - RNA, 24 nt, Human
cucacuguagccucugccuccugg

SEQ ID NO: 491731 - RNA, 24 nt, Human
cucagccucccgaguagcugggac

SEQ ID NO: 491732 - RNA, 21 nt, Human
cucagccuccugaguagcuag

SEQ ID NO: 491733 - RNA, 24 nt, Human
cucccucugucaccugggcuggag

SEQ ID NO: 491734 - RNA, 23 nt, Human
cuccugaguagcuagaauauagg

SEQ ID NO: 491735 - RNA, 24 nt, Human
cucgcuuugucggcgaggcuggag

SEQ ID NO: 491736 - RNA, 24 nt, Human
cucguucuguugcccaggcuggag

SEQ ID NO: 491737 - RNA, 22 nt, Human
cucucaguagaaugagccccau

SEQ ID NO: 491738 - RNA, 26 nt, Human
cucucccaucucagccuccugaguag

SEQ ID NO: 491739 - RNA, 24 nt, Human
cugcaagacccgccucccggauuc

SEQ ID NO: 491740 - RNA, 21 nt, Human
cugccucacccucccgaguaa

SEQ ID NO: 491741 - RNA, 23 nt, Human
cugccucagccucccgaguagcu

SEQ ID NO: 491742 - RNA, 24 nt, Human
cuggagugcaguggcaugaucuca

SEQ ID NO: 491743 - RNA, 23 nt, Human
cuggaucaaccaagagauggcca

SEQ ID NO: 491744 - RNA, 19 nt, Human
cuguugcccaggcuggagu

SEQ ID NO: 491745 - RNA, 19 nt, Human
cuuagauuuuugggacagc

SEQ ID NO: 491746 - RNA, 21 nt, Human
cuuccugcugagccccaccuc

SEQ ID NO: 491747 - RNA, 23 nt, Human
gaaaacaaucccuaauccaaaac

SEQ ID NO: 491748 - RNA, 24 nt, Human
gaauauaggcauaugccaccauac

SEQ ID NO: 491749 - RNA, 20 nt, Human
gagaugggguuucacuaugu

SEQ ID NO: 491750 - RNA, 24 nt, Human
gagaugggguuucacuauguuggc

SEQ ID NO: 491751 - RNA, 20 nt, Human
gaguagcugggacuacaggc

SEQ ID NO: 491752 - RNA, 27 nt, Human
gaguagcugggacuacaggcaccccag

SEQ ID NO: 491753 - RNA, 24 nt, Human
gaguagcugggauuacaggugcug

SEQ ID NO: 491754 - RNA, 18 nt, Human
gauuacaggcaugagcca

SEQ ID NO: 491755 - RNA, 23 nt, Human
gauuacaggcaugagccacugca

SEQ ID NO: 491756 - RNA, 26 nt, Human
gauuacaggcaugagccacugcaugc

SEQ ID NO: 491757 - RNA, 20 nt, Human
gccaguccaugaaguuugcu

SEQ ID NO: 491758 - RNA, 24 nt, Human
gcccaggcuggagugcaguggugu

SEQ ID NO: 491759 - RNA, 22 nt, Human
gcgaggcuggagugcgguggcg

SEQ ID NO: 491760 - RNA, 21 nt, Human
gcuccagcuuuccucucacuc

SEQ ID NO: 491761 - RNA, 19 nt, Human
gcuggagugcaguggcaug

SEQ ID NO: 491762 - RNA, 19 nt, Human
ggaaaacaaacaaaaaccc

SEQ ID NO: 491763 - RNA, 24 nt, Human
ggaaaacaaacaaaaaccccaaag

SEQ ID NO: 491764 - RNA, 22 nt, Human
ggauuacaggcaugagccacug

SEQ ID NO: 491765 - RNA, 24 nt, Human
ggcuggagugcaguggcaugaucu

SEQ ID NO: 491766 - RNA, 22 nt, Human
ggcuggagugcaguggugugau

SEQ ID NO: 491767 - RNA, 18 nt, Human
gggguuucacuauguugg

SEQ ID NO: 491768 - RNA, 22 nt, Human
gggguuucacuauguuggccaa

SEQ ID NO: 491769 - RNA, 18 nt, Human
ggguuucacuauguuggc

SEQ ID NO: 491770 - RNA, 22 nt, Human
ggguuucacuauguuggccaag

SEQ ID NO: 491771 - RNA, 18 nt, Human
guaauuccucccaaagug

SEQ ID NO: 491772 - RNA, 18 nt, Human
guagagaugggguuucac

SEQ ID NO: 491773 - RNA, 18 nt, Human
guagagaugggguuucac

SEQ ID NO: 491774 - RNA, 22 nt, Human
guagagaugggguuucacuaug

SEQ ID NO: 491775 - RNA, 19 nt, Human
gugauucuccugccucacc

SEQ ID NO: 491776 - RNA, 21 nt, Human
guggaaguggugugagauguu

SEQ ID NO: 491777 - RNA, 20 nt, Human
guuuuuuuuuuuuaccccuu

SEQ ID NO: 491778 - RNA, 22 nt, Human
uaaaaacugcaagcuaauguua

SEQ ID NO: 491779 - RNA, 23 nt, Human
uaaaaacugcaagcuaauguuac

SEQ ID NO: 491780 - RNA, 25 nt, Human
uaaaugcuagugcuuuuuaaugggg

SEQ ID NO: 491781 - RNA, 23 nt, Human
uaacaaaacauuugguuuguauu

SEQ ID NO: 491782 - RNA, 25 nt, Human
uaagaaauaaguaucaugcucucaa

SEQ ID NO: 491783 - RNA, 21 nt, Human
uaagacaaauaaacuggauca

SEQ ID NO: 491784 - RNA, 18 nt, Human
uaagacagaaucucguuc

SEQ ID NO: 491785 - RNA, 22 nt, Human
uaagacagaaucucguucuguu

SEQ ID NO: 491786 - RNA, 25 nt, Human
uaauuuuuauauuuuuugguagaga

SEQ ID NO: 491787 - RNA, 24 nt, Human
uacaaaaucaagagacuaaaacag

SEQ ID NO: 491788 - RNA, 18 nt, Human
uacaaauuaaaaauuuug

SEQ ID NO: 491789 - RNA, 21 nt, Human
uacaauguccacagauguuuc

SEQ ID NO: 491790 - RNA, 20 nt, Human
uacagagagggaaaacauga

SEQ ID NO: 491791 - RNA, 20 nt, Human
uacaggcaugagccacugca

SEQ ID NO: 491792 - RNA, 21 nt, Human
uacuuagauuuuugggacagc

SEQ ID NO: 491793 - RNA, 22 nt, Human
uagagaugggguuucacuaugu

SEQ ID NO: 491794 - RNA, 18 nt, Human
uagcaucuuaucacuauu

SEQ ID NO: 491795 - RNA, 19 nt, Human
uagcccugcugaaaacaaa

SEQ ID NO: 491796 - RNA, 28 nt, Human
uagcuuuucuguuuuuuuuuuuuuuuuu

SEQ ID NO: 491797 - RNA, 24 nt, Human
uauguuggccaagcuagucucaaa

SEQ ID NO: 491798 - RNA, 23 nt, Human
uauuauggcuuugccacaccacu

SEQ ID NO: 491799 - RNA, 19 nt, Human
uauucuugcccaagacuug

SEQ ID NO: 491800 - RNA, 22 nt, Human
ucaccugggcuggagugcagug

SEQ ID NO: 491801 - RNA, 25 nt, Human
ucacuauaauacuuagauuuuuggg

SEQ ID NO: 491802 - RNA, 24 nt, Human
ucacugcaagacccgccucccgga

SEQ ID NO: 491803 - RNA, 20 nt, Human
ucacugcaaucuccgugucc

SEQ ID NO: 491804 - RNA, 24 nt, Human
ucacugcaaucuccguguccuggg

SEQ ID NO: 491805 - RNA, 24 nt, Human
ucacuguagccucugccuccuggg

SEQ ID NO: 491806 - RNA, 25 nt, Human
ucacuguagccucugccuccugggu

SEQ ID NO: 491807 - RNA, 23 nt, Human
ucagccucccgaguagcugggac

SEQ ID NO: 491808 - RNA, 24 nt, Human
ucauuucaaccuccaccuccuggg

SEQ ID NO: 491809 - RNA, 22 nt, Human
uccaggcaacaacagaguucac

SEQ ID NO: 491810 - RNA, 18 nt, Human
ucccaaagagcagagugc

SEQ ID NO: 491811 - RNA, 24 nt, Human
ucccaaaguguugggauuacaggc

SEQ ID NO: 491812 - RNA, 19 nt, Human
uccccacccacagcuccag

SEQ ID NO: 491813 - RNA, 24 nt, Human
uccccugccucagccucccgagua

SEQ ID NO: 491814 - RNA, 24 nt, Human
ucccgaguagcugggacuacaggc

SEQ ID NO: 491815 - RNA, 23 nt, Human
ucccgaguagcugggauuacagg

SEQ ID NO: 491816 - RNA, 24 nt, Human
ucccgaguagcugggauuacaggu

SEQ ID NO: 491817 - RNA, 22 nt, Human
ucccggauucacgccauucccc

SEQ ID NO: 491818 - RNA, 20 nt, Human
ucccucugucaccugggcug

SEQ ID NO: 491819 - RNA, 24 nt, Human
ucccucugucaccugggcuggagu

SEQ ID NO: 491820 - RNA, 23 nt, Human
uccugaguagcuagaauauaggc

SEQ ID NO: 491821 - RNA, 23 nt, Human
uccugcugagccccaccucugac

SEQ ID NO: 491822 - RNA, 19 nt, Human
uccuggguucaaaugauuc

SEQ ID NO: 491823 - RNA, 21 nt, Human
uccuggguucaaaugauucuc

SEQ ID NO: 491824 - RNA, 24 nt, Human
uccuggguugaagugauucuccug

SEQ ID NO: 491825 - RNA, 19 nt, Human
uccuggguuuaagcgacuc

SEQ ID NO: 491826 - RNA, 21 nt, Human
uccuggguuuaagcgacucuc

SEQ ID NO: 491827 - RNA, 22 nt, Human
ucucaaaaaauaaaaaauuucc

SEQ ID NO: 491828 - RNA, 23 nt, Human
ucucccucugucaccugggcugg

SEQ ID NO: 491829 - RNA, 24 nt, Human
ucucccucugucaccugggcugga

SEQ ID NO: 491830 - RNA, 24 nt, Human
ucucgcuuugucggcgaggcugga

SEQ ID NO: 491831 - RNA, 22 nt, Human
ucucguucuguugcccaggcug

SEQ ID NO: 491832 - RNA, 23 nt, Human
ucucguucuguugcccaggcugg

SEQ ID NO: 491833 - RNA, 24 nt, Human
ucucguucuguugcccaggcugga

SEQ ID NO: 491834 - RNA, 18 nt, Human
ucugccuccuggguugaa

SEQ ID NO: 491835 - RNA, 24 nt, Human
ucugucaccugggcuggagugcag

SEQ ID NO: 491836 - RNA, 18 nt, Human
ucuguugcccaggcugga

SEQ ID NO: 491837 - RNA, 19 nt, Human
ucuguugcccaggcuggag

SEQ ID NO: 491838 - RNA, 24 nt, Human
ucuguugcccaggcuggagugcag

SEQ ID NO: 491839 - RNA, 20 nt, Human
ugaaauuuucuggguagcca

SEQ ID NO: 491840 - RNA, 24 nt, Human
ugaaauuuucuggguagccagugu

SEQ ID NO: 491841 - RNA, 22 nt, Human
ugacaggccagcccauauuaca

SEQ ID NO: 491842 - RNA, 23 nt, Human
ugacuaaaagacagguguuuuuu

SEQ ID NO: 491843 - RNA, 24 nt, Human
ugagaaaacaaucccuaauccagc

SEQ ID NO: 491844 - RNA, 18 nt, Human
ugagaauaaguaaaaaaa

SEQ ID NO: 491845 - RNA, 18 nt, Human
ugagacagagucucacuc

SEQ ID NO: 491846 - RNA, 26 nt, Human
ugagacagagucucacucacucuguc

SEQ ID NO: 491847 - RNA, 23 nt, Human
ugagagagucucccucugucacc

SEQ ID NO: 491848 - RNA, 23 nt, Human
ugaggcauauaacugccucccug

SEQ ID NO: 491849 - RNA, 22 nt, Human
ugaggcauauaacugccugaaa

SEQ ID NO: 491850 - RNA, 20 nt, Human
ugaguucucaacauguugga

SEQ ID NO: 491851 - RNA, 21 nt, Human
ugaguuggaugaguccccccg

SEQ ID NO: 491852 - RNA, 19 nt, Human
ugauacaauguccacagau

SEQ ID NO: 491853 - RNA, 21 nt, Human
ugaugaacuauuaaaaacugc

SEQ ID NO: 491854 - RNA, 22 nt, Human
ugcaguggcaugaucucagcuc

SEQ ID NO: 491855 - RNA, 22 nt, Human
ugcaguggugugaucuuggcuc

SEQ ID NO: 491856 - RNA, 20 nt, Human
ugccacaccacugcccugac

SEQ ID NO: 491857 - RNA, 18 nt, Human
ugccagaaccaaaggcua

SEQ ID NO: 491858 - RNA, 19 nt, Human
ugccagaaccaaaggcuaa

SEQ ID NO: 491859 - RNA, 18 nt, Human
ugcccaggcuggagugca

SEQ ID NO: 491860 - RNA, 21 nt, Human
ugcccaggcuggagugcagug

SEQ ID NO: 491861 - RNA, 24 nt, Human
ugcccaggcuggagugcaguggug

SEQ ID NO: 491862 - RNA, 22 nt, Human
ugcccugacaggcugccugagg

SEQ ID NO: 491863 - RNA, 21 nt, Human
ugccucacccucccgaguagc

SEQ ID NO: 491864 - RNA, 24 nt, Human
ugccucacccucccgaguagcugg

SEQ ID NO: 491865 - RNA, 28 nt, Human
ugccucacccucccgaguagcugggauu

SEQ ID NO: 491866 - RNA, 24 nt, Human
ugccucagccucccgaguagcugg

SEQ ID NO: 491867 - RNA, 19 nt, Human
ugccugaaauuuucugggu

SEQ ID NO: 491868 - RNA, 22 nt, Human
ugcugugguacgaucucagcuc

SEQ ID NO: 491869 - RNA, 20 nt, Human
ugcuuuuuaaugggggaaaa

SEQ ID NO: 491870 - RNA, 21 nt, Human
uggaggaaaaauggaggagac

SEQ ID NO: 491871 - RNA, 19 nt, Human
uggagugcaguggcaugau

SEQ ID NO: 491872 - RNA, 24 nt, Human
uggagugcaguggcaugaucucag

SEQ ID NO: 491873 - RNA, 19 nt, Human
uggagugcaguggugugau

SEQ ID NO: 491874 - RNA, 23 nt, Human
uggagugcaguggugugaucuug

SEQ ID NO: 491875 - RNA, 24 nt, Human
uggagugcaguggugugaucuugg

SEQ ID NO: 491876 - RNA, 22 nt, Human
uggagugcgguggcgcgaucuc

SEQ ID NO: 491877 - RNA, 18 nt, Human
uggcaugaucucagcuca

SEQ ID NO: 491878 - RNA, 18 nt, Human
ugggacuacaggcacccc

SEQ ID NO: 491879 - RNA, 19 nt, Human
ugggacuacaggcacccca

SEQ ID NO: 491880 - RNA, 18 nt, Human
ugggauuacaggcaugag

SEQ ID NO: 491881 - RNA, 19 nt, Human
ugggauuacaggcaugagc

SEQ ID NO: 491882 - RNA, 21 nt, Human
ugggauuacaggcaugagcca

SEQ ID NO: 491883 - RNA, 22 nt, Human
ugggauuacaggcaugagccac

SEQ ID NO: 491884 - RNA, 22 nt, Human
ugggauuacaggcaugagccac

SEQ ID NO: 491885 - RNA, 24 nt, Human
ugggauuacaggcaugagccacug

SEQ ID NO: 491886 - RNA, 24 nt, Human
ugggauuacaggcaugagccacug

SEQ ID NO: 491887 - RNA, 19 nt, Human
ugggauuacaggugcuggu

SEQ ID NO: 491888 - RNA, 18 nt, Human
ugggauuacaggugugca

SEQ ID NO: 491889 - RNA, 20 nt, Human
ugggauuacaggugugcaac

SEQ ID NO: 491890 - RNA, 24 nt, Human
ugggguuucacuauguuggccaag

SEQ ID NO: 491891 - RNA, 24 nt, Human
ugguacgaucucagcucacuguag

SEQ ID NO: 491892 - RNA, 23 nt, Human
ugguagagaugggguuucacuau

SEQ ID NO: 491893 - RNA, 24 nt, Human
ugguagagaugggguuucacuaug

SEQ ID NO: 491894 - RNA, 18 nt, Human
uggucaagaaaaagaggg

SEQ ID NO: 491895 - RNA, 21 nt, Human
uguagcaaauaucuuuaggcc

SEQ ID NO: 491896 - RNA, 20 nt, Human
ugucaccugggcuggagugc

SEQ ID NO: 491897 - RNA, 26 nt, Human
ugugaauguuuuguagcuuuucuguu

SEQ ID NO: 491898 - RNA, 18 nt, Human
ugugaguuggaugagucc

SEQ ID NO: 491899 - RNA, 19 nt, Human
uguuccccacccacagcuc

SEQ ID NO: 491900 - RNA, 19 nt, Human
uuaaaacuaauuuagcaac

SEQ ID NO: 491901 - RNA, 21 nt, Human
uuaagagacaucuuguaauga

SEQ ID NO: 491902 - RNA, 23 nt, Human
uucaaaugauucucgugccucag

SEQ ID NO: 491903 - RNA, 19 nt, Human
uuccccacccacagcucca

SEQ ID NO: 491904 - RNA, 19 nt, Human
uuccccugccucagccucc

SEQ ID NO: 491905 - RNA, 20 nt, Human
uucuggguagccaguguggc

SEQ ID NO: 491906 - RNA, 24 nt, Human
uugcccaggcuggagugcaguggu

SEQ ID NO: 491907 - RNA, 24 nt, Human
uugguagagaugggguuucacuau

SEQ ID NO: 491908 - RNA, 20 nt, Human
uuuaagacagaaucucguuc

SEQ ID NO: 491909 - RNA, 20 nt, Human
uuuauauuuuuugguagaga

SEQ ID NO: 491910 - RNA, 23 nt, Human
uuucaaccuccaccuccuggguu

SEQ ID NO: 491911 - RNA, 21 nt, Human
uuucacuauguuggccaagcu

SEQ ID NO: 491912 - RNA, 21 nt, Human
uuucuggguagccaguguggc

SEQ ID NO: 491913 - RNA, 24 nt, Human
uuugucggcgaggcuggagugcgg

SEQ ID NO: 491914 - RNA, 23 nt, Human
uuuuguaauucacuucauucauu

SEQ ID NO: 491915 - RNA, 21 nt, Human
uuuuuauauuuuuugguagag

SEQ ID NO: 491916 - RNA, 24 nt, Human
uuuuugguagagaugggguuucac

SEQ ID NO: 491917 - RNA, 23 nt, Human
uuuuuugguagagaugggguuuc

SEQ ID NO: 491918 - RNA, 20 nt, Human
uuuuuuuuuuugagacagag

SEQ ID NO: 491919 - RNA, 26 nt, Human
uuuuuuuuuuuugagacagagucuca

SEQ ID NO: 491920 - RNA, 18 nt, Human
uuuuuuuuuuuuuuuuug

SEQ ID NO: 491921 - RNA, 21 nt, Human
aaaaauaaauagaucacuuca

SEQ ID NO: 491922 - RNA, 22 nt, Human
aaaaguuaguguuuuaugaagg

SEQ ID NO: 491923 - RNA, 21 nt, Human
aaaauaacaaaaacugaagua

SEQ ID NO: 491924 - RNA, 18 nt, Human
aaacauuugagcugccga

SEQ ID NO: 491925 - RNA, 24 nt, Human
aacacugugaaauccuuugcuuau

SEQ ID NO: 491926 - RNA, 23 nt, Human
aacucauaggcaccaucuucccu

SEQ ID NO: 491927 - RNA, 20 nt, Human
aaugacacugauuucccuca

SEQ ID NO: 491928 - RNA, 22 nt, Human
aauuuuuaauaaccauaaaagc

SEQ ID NO: 491929 - RNA, 18 nt, Human
acaauguucccuuagaug

SEQ ID NO: 491930 - RNA, 21 nt, Human
agaaauagagcauacguccuc

SEQ ID NO: 491931 - RNA, 21 nt, Human
agagaacagagcagagcagau

SEQ ID NO: 491932 - RNA, 21 nt, Human
caaaaaauaacaaaaacugaa

SEQ ID NO: 491933 - RNA, 23 nt, Human
caacaaaaaauaacaaaaacuga

SEQ ID NO: 491934 - RNA, 21 nt, Human
caacuuuaccgauggagauga

SEQ ID NO: 491935 - RNA, 22 nt, Human
caccacuucucuccaccuuccc

SEQ ID NO: 491936 - RNA, 23 nt, Human
caccacuucucuccaccuuccca

SEQ ID NO: 491937 - RNA, 23 nt, Human
caccacuucucuccaccuuccca

SEQ ID NO: 491938 - RNA, 23 nt, Human
cagaauucccagcaucagaccau

SEQ ID NO: 491939 - RNA, 19 nt, Human
cagccaaaaguuauucagg

SEQ ID NO: 491940 - RNA, 25 nt, Human
caggagccucuggcacauaaggucc

SEQ ID NO: 491941 - RNA, 23 nt, Human
ccacuucucuccaccuucccaac

SEQ ID NO: 491942 - RNA, 19 nt, Human
ccccaccacuucucuccac

SEQ ID NO: 491943 - RNA, 21 nt, Human
ccccaccacuucucuccaccu

SEQ ID NO: 491944 - RNA, 24 nt, Human
ccccccaccacuucucuccaccuu

SEQ ID NO: 491945 - RNA, 22 nt, Human
cccccccaccacuucucuccac

SEQ ID NO: 491946 - RNA, 24 nt, Human
cucauaggcaccaucuucccugaa

SEQ ID NO: 491947 - RNA, 19 nt, Human
cuucccaacuuuaccgaug

SEQ ID NO: 491948 - RNA, 21 nt, Human
cuuuaacaaauuuuggugaag

SEQ ID NO: 491949 - RNA, 22 nt, Human
gacuaaaaugcaacaaaaaaua

SEQ ID NO: 491950 - RNA, 24 nt, Human
gacuuugcucagaaacuuuugagu

SEQ ID NO: 491951 - RNA, 22 nt, Human
gagccucuggcacauaaggucc

SEQ ID NO: 491952 - RNA, 18 nt, Human
gcccccccaccacuucuc

SEQ ID NO: 491953 - RNA, 21 nt, Human
ggaaaaucaguaucauaagag

SEQ ID NO: 491954 - RNA, 23 nt, Human
gguuuaauccugcugaauaaagu

SEQ ID NO: 491955 - RNA, 20 nt, Human
gucuugucuaucaugaucuc

SEQ ID NO: 491956 - RNA, 23 nt, Human
guuccauucaugagcuuccucca

SEQ ID NO: 491957 - RNA, 25 nt, Human
uaaaacaucaacugcucauuuugua

SEQ ID NO: 491958 - RNA, 28 nt, Human
uaaaauaaagaaauaacuucccaaagug

SEQ ID NO: 491959 - RNA, 24 nt, Human
uaacaaaaacugaaguagaaacug

SEQ ID NO: 491960 - RNA, 18 nt, Human
uaagguccacaagggcag

SEQ ID NO: 491961 - RNA, 21 nt, Human
uaccuagaacacugugaaauc

SEQ ID NO: 491962 - RNA, 20 nt, Human
uagcaaugcccccccaccac

SEQ ID NO: 491963 - RNA, 24 nt, Human
uagcacaacagccaaaaguuauuc

SEQ ID NO: 491964 - RNA, 23 nt, Human
uaucauaagagucgcacaucuca

SEQ ID NO: 491965 - RNA, 24 nt, Human
uaucaugaucucacauuaaaucug

SEQ ID NO: 491966 - RNA, 22 nt, Human
uaugaccuauauccuggggugc

SEQ ID NO: 491967 - RNA, 25 nt, Human
uaugguggucaggagccucuggcac

SEQ ID NO: 491968 - RNA, 22 nt, Human
ucaacugcucauuuuguaauga

SEQ ID NO: 491969 - RNA, 26 nt, Human
ucagaccaugcauauagaagcacuuu

SEQ ID NO: 491970 - RNA, 21 nt, Human
ucagagcaaaugguacugaag

SEQ ID NO: 491971 - RNA, 20 nt, Human
uccaccuucccaacuuuacc

SEQ ID NO: 491972 - RNA, 22 nt, Human
ucccaaagugucuacuuugaag

SEQ ID NO: 491973 - RNA, 20 nt, Human
ucccugaagaaaaaaucauc

SEQ ID NO: 491974 - RNA, 20 nt, Human
uccuuuguccacugcuccau

SEQ ID NO: 491975 - RNA, 21 nt, Human
ucucaaguuuugguuucaaau

SEQ ID NO: 491976 - RNA, 20 nt, Human
ugaagaaagugaauauaaug

SEQ ID NO: 491977 - RNA, 22 nt, Human
ugaagaaagugaauauaaugac

SEQ ID NO: 491978 - RNA, 18 nt, Human
ugacuuugcucagaaacu

SEQ ID NO: 491979 - RNA, 23 nt, Human
ugagagaacagagcagagcagau

SEQ ID NO: 491980 - RNA, 24 nt, Human
ugauaaguagcaaugccccccucu

SEQ ID NO: 491981 - RNA, 19 nt, Human
ugauugucuuaaugccaca

SEQ ID NO: 491982 - RNA, 19 nt, Human
ugccuaauuucuugcacuc

SEQ ID NO: 491983 - RNA, 18 nt, Human
uguguucucaaguuuugg

SEQ ID NO: 491984 - RNA, 24 nt, Human
uguuuuguucacugaugauuccca

SEQ ID NO: 491985 - RNA, 18 nt, Human
uuacucaaaucugcagaa

SEQ ID NO: 491986 - RNA, 22 nt, Human
uucacagaacauuagaaagaag

SEQ ID NO: 491987 - RNA, 19 nt, Human
uuccaugaaggcagggauu

SEQ ID NO: 491988 - RNA, 22 nt, Human
uuggguguguucucaaguuuug

SEQ ID NO: 491989 - RNA, 24 nt, Human
uuggguguguucucaaguuuuggu

SEQ ID NO: 491990 - RNA, 22 nt, Human
aacacaacugucggaauaaacu

SEQ ID NO: 491991 - RNA, 24 nt, Human
aggaagagcucccccugcauuggg

SEQ ID NO: 491992 - RNA, 18 nt, Human
cagcggcccuuccucucu

SEQ ID NO: 491993 - RNA, 21 nt, Human
ccagacaguucccaggaguga

SEQ ID NO: 491994 - RNA, 24 nt, Human
ccaggagugaggcuggucuuuccu

SEQ ID NO: 491995 - RNA, 21 nt, Human
cccuugguccaggaagagcuc

SEQ ID NO: 491996 - RNA, 20 nt, Human
cuuucugaaggccgggcagu

SEQ ID NO: 491997 - RNA, 25 nt, Human
cuuuuuauucuaacagcacuggggg

SEQ ID NO: 491998 - RNA, 22 nt, Human
gcagugcacagcggcccuuccu

SEQ ID NO: 491999 - RNA, 23 nt, Human
ggccgggcagugcacagcggccc

SEQ ID NO: 492000 - RNA, 20 nt, Human
ggggggcccagccuaccugc

SEQ ID NO: 492001 - RNA, 21 nt, Human
ucccuugguccaggaagagcu

SEQ ID NO: 492002 - RNA, 20 nt, Human
ugaggcuggucuuuccuggc

SEQ ID NO: 492003 - RNA, 22 nt, Human
ugccagacaguucccaggagug

SEQ ID NO: 492004 - RNA, 22 nt, Human
uggcacaacacaacugucggaa

SEQ ID NO: 492005 - RNA, 19 nt, Human
ugggugaaugagcggcucc

SEQ ID NO: 492006 - RNA, 22 nt, Human
uguugggugaaugagcggcucc

SEQ ID NO: 492007 - RNA, 24 nt, Human
uugggugaaugagcggcuccuccc

SEQ ID NO: 492008 - RNA, 20 nt, Human
aaccuggccagagucagcgg

SEQ ID NO: 492009 - RNA, 22 nt, Human
agaagccuuuauugugggagga

SEQ ID NO: 492010 - RNA, 18 nt, Human
aggggccuuugaggaaga

SEQ ID NO: 492011 - RNA, 18 nt, Human
agugagacagggagugag

SEQ ID NO: 492012 - RNA, 21 nt, Human
cuuugaggaagaggaguccug

SEQ ID NO: 492013 - RNA, 26 nt, Human
gaugcaguuccccuuccucccuccag

SEQ ID NO: 492014 - RNA, 18 nt, Human
gcacgggaaccuggccag

SEQ ID NO: 492015 - RNA, 19 nt, Human
ggggccuuugaggaagagg

SEQ ID NO: 492016 - RNA, 22 nt, Human
gggggaggggccuuugaggaag

SEQ ID NO: 492017 - RNA, 23 nt, Human
gucuccgugggggagugagacag

SEQ ID NO: 492018 - RNA, 18 nt, Human
gugguccuugggaccccc

SEQ ID NO: 492019 - RNA, 20 nt, Human
uauugugggaggaucggggu

SEQ ID NO: 492020 - RNA, 20 nt, Human
uggaaggcuggggggaggga

SEQ ID NO: 492021 - RNA, 23 nt, Human
ugggaggaucgggguguccuagg

SEQ ID NO: 492022 - RNA, 18 nt, Human
ugugggaggaucggggug

SEQ ID NO: 492023 - RNA, 19 nt, Human
uguuggacgcggcacggga

SEQ ID NO: 492024 - RNA, 18 nt, Human
uuccccuuccucccucca

SEQ ID NO: 492025 - RNA, 19 nt, Human
uugaggaagaggaguccuc

SEQ ID NO: 492026 - RNA, 20 nt, Human
aacccggccggagucagcgg

SEQ ID NO: 492027 - RNA, 22 nt, Human
agaagccuuuauugugggagga

SEQ ID NO: 492028 - RNA, 18 nt, Human
aggaagaggaggccugga

SEQ ID NO: 492029 - RNA, 23 nt, Human
aggggccuuugaggaagaggagg

SEQ ID NO: 492030 - RNA, 18 nt, Human
agugagacagggagugag

SEQ ID NO: 492031 - RNA, 19 nt, Human
cgggaugggcuuggaaggc

SEQ ID NO: 492032 - RNA, 21 nt, Human
cuccgugggggagugagacag

SEQ ID NO: 492033 - RNA, 21 nt, Human
cuuugaggaagaggaggccug

SEQ ID NO: 492034 - RNA, 25 nt, Human
gagggccccgggagucgggaugggc

SEQ ID NO: 492035 - RNA, 18 nt, Human
gcacgggaacccggccgg

SEQ ID NO: 492036 - RNA, 20 nt, Human
gccuuugaggaagaggaggc

SEQ ID NO: 492037 - RNA, 26 nt, Human
gcuggggggaggggccuuugaggaag

SEQ ID NO: 492038 - RNA, 19 nt, Human
ggggccuuugaggaagagg

SEQ ID NO: 492039 - RNA, 18 nt, Human
gugguccuugggaccccc

SEQ ID NO: 492040 - RNA, 20 nt, Human
uauugugggaggaucggggu

SEQ ID NO: 492041 - RNA, 18 nt, Human
uccccuuccucccuccag

SEQ ID NO: 492042 - RNA, 19 nt, Human
ugagggccccgggagucgg

SEQ ID NO: 492043 - RNA, 20 nt, Human
uggaaggcuggggggaggga

SEQ ID NO: 492044 - RNA, 21 nt, Human
ugggcuuggaaggcugggggg

SEQ ID NO: 492045 - RNA, 18 nt, Human
ugugggaggaucggggug

SEQ ID NO: 492046 - RNA, 19 nt, Human
uguuggacgcggcacggga

SEQ ID NO: 492047 - RNA, 18 nt, Human
uuccccuuccucccucca

SEQ ID NO: 492048 - RNA, 22 nt, Human
aagagguagacaaggccagggg

SEQ ID NO: 492049 - RNA, 23 nt, Human
accucgggguugugggggcggca

SEQ ID NO: 492050 - RNA, 23 nt, Human
aggagguuguaggaugcuggggu

SEQ ID NO: 492051 - RNA, 24 nt, Human
agggaguaggguguaggaaggccu

SEQ ID NO: 492052 - RNA, 18 nt, Human
aucucagagacucagucg

SEQ ID NO: 492053 - RNA, 21 nt, Human
cagcggagcgccccagcccuc

SEQ ID NO: 492054 - RNA, 20 nt, Human
ccccagcccucuccucucac

SEQ ID NO: 492055 - RNA, 22 nt, Human
ccuauggugggguccugggagc

SEQ ID NO: 492056 - RNA, 22 nt, Human
ccucgggguugugggggcggca

SEQ ID NO: 492057 - RNA, 23 nt, Human
cggcaaggccaccaggagguugu

SEQ ID NO: 492058 - RNA, 24 nt, Human
cucgacacuaacccuucggggggc

SEQ ID NO: 492059 - RNA, 19 nt, Human
cugccucguguaccuggcu

SEQ ID NO: 492060 - RNA, 19 nt, Human
gacccgagcaaagugcugg

SEQ ID NO: 492061 - RNA, 22 nt, Human
gagcucgacacuaacccuucgg

SEQ ID NO: 492062 - RNA, 23 nt, Human
gaggcggagaccacggugaagug

SEQ ID NO: 492063 - RNA, 23 nt, Human
gcggagcgccccagcccucuccu

SEQ ID NO: 492064 - RNA, 24 nt, Human
ggcaagagguagacaaggccaggg

SEQ ID NO: 492065 - RNA, 19 nt, Human
uccugggagccaggaggag

SEQ ID NO: 492066 - RNA, 20 nt, Human
uccugggagccaggaggagg

SEQ ID NO: 492067 - RNA, 20 nt, Human
uccugggagccaggaggagg

SEQ ID NO: 492068 - RNA, 18 nt, Human
ucucacugguccagcgcc

SEQ ID NO: 492069 - RNA, 24 nt, Human
ugccuauggugggguccugggagc

SEQ ID NO: 492070 - RNA, 22 nt, Human
ugccucguguaccuggcuuuau

SEQ ID NO: 492071 - RNA, 21 nt, Human
uggcuuuauaccucgggguug

SEQ ID NO: 492072 - RNA, 21 nt, Human
ugggagccaggaggaggccgu

SEQ ID NO: 492073 - RNA, 21 nt, Human
ugggguccugggagccaggag

SEQ ID NO: 492074 - RNA, 22 nt, Human
uggugggguccugggagccagg

SEQ ID NO: 492075 - RNA, 19 nt, Human
accccaguccucuccccuc

SEQ ID NO: 492076 - RNA, 18 nt, Human
aggccagggaggcacagg

SEQ ID NO: 492077 - RNA, 27 nt, Human
cagcggagcaccccaguccucuccccu

SEQ ID NO: 492078 - RNA, 18 nt, Human
caguccucuccccucagu

SEQ ID NO: 492079 - RNA, 20 nt, Human
ccuaugguggggucuuggga

SEQ ID NO: 492080 - RNA, 21 nt, Human
ccucugagacucagucgucga

SEQ ID NO: 492081 - RNA, 23 nt, Human
cggugaagugaccucugagacuc

SEQ ID NO: 492082 - RNA, 22 nt, Human
gagaaguagacaaggccaggga

SEQ ID NO: 492083 - RNA, 23 nt, Human
gaggcggagaccacggugaagug

SEQ ID NO: 492084 - RNA, 20 nt, Human
ggugcguccccugccuggug

SEQ ID NO: 492085 - RNA, 20 nt, Human
uaggaugcuggagugagcug

SEQ ID NO: 492086 - RNA, 24 nt, Human
ugccuaugguggggucuugggaac

SEQ ID NO: 492087 - RNA, 21 nt, Human
ugguggggucuugggaaccag

SEQ ID NO: 492088 - RNA, 22 nt, Human
aagagguagacaaggccagggg

SEQ ID NO: 492089 - RNA, 23 nt, Human
accucgggguugugggggcggca

SEQ ID NO: 492090 - RNA, 24 nt, Human
agggaguaggguguaggaaggccu

SEQ ID NO: 492091 - RNA, 21 nt, Human
cagcggagcgccccagcccuc

SEQ ID NO: 492092 - RNA, 20 nt, Human
ccccagcccucuccucucac

SEQ ID NO: 492093 - RNA, 22 nt, Human
ccuauggugggguccugggagc

SEQ ID NO: 492094 - RNA, 22 nt, Human
ccucgggguugugggggcggca

SEQ ID NO: 492095 - RNA, 23 nt, Human
cggcaaggccaccaggagguugu

SEQ ID NO: 492096 - RNA, 24 nt, Human
cucgacacuaacccuucggggggc

SEQ ID NO: 492097 - RNA, 19 nt, Human
cugccucguguaccuggcu

SEQ ID NO: 492098 - RNA, 22 nt, Human
gagcucgacacuaacccuucgg

SEQ ID NO: 492099 - RNA, 23 nt, Human
gaggcggagaccacggugaagug

SEQ ID NO: 492100 - RNA, 23 nt, Human
gcggagcgccccagcccucuccu

SEQ ID NO: 492101 - RNA, 24 nt, Human
ggcaagagguagacaaggccaggg

SEQ ID NO: 492102 - RNA, 23 nt, Human
ggguccugggagccaggaggagg

SEQ ID NO: 492103 - RNA, 19 nt, Human
uccugggagccaggaggag

SEQ ID NO: 492104 - RNA, 20 nt, Human
uccugggagccaggaggagg

SEQ ID NO: 492105 - RNA, 18 nt, Human
ucucacugguccagcgcc

SEQ ID NO: 492106 - RNA, 20 nt, Human
ugaccucagagacucagucg

SEQ ID NO: 492107 - RNA, 24 nt, Human
ugccuauggugggguccugggagc

SEQ ID NO: 492108 - RNA, 19 nt, Human
uggcuuuaaaccucggggu

SEQ ID NO: 492109 - RNA, 21 nt, Human
ugggagccaggaggaggccgu

SEQ ID NO: 492110 - RNA, 21 nt, Human
ugggguccugggagccaggag

SEQ ID NO: 492111 - RNA, 22 nt, Human
uggugggguccugggagccagg

SEQ ID NO: 492112 - RNA, 22 nt, Human
uguaggaugcuggagugagcuc

SEQ ID NO: 492113 - RNA, 26 nt, Human
aaaacccagggagaggaggcaaggau

SEQ ID NO: 492114 - RNA, 20 nt, Human
aagggguccgggccaggagg

SEQ ID NO: 492115 - RNA, 24 nt, Human
aaugcaggguuuaagggguccggg

SEQ ID NO: 492116 - RNA, 22 nt, Human
accaguagguggccggccuaga

SEQ ID NO: 492117 - RNA, 21 nt, Human
acucccucacgacccccgcca

SEQ ID NO: 492118 - RNA, 25 nt, Human
aggcagaugggcggucaaccggugg

SEQ ID NO: 492119 - RNA, 22 nt, Human
aggcagcguacuccuauugcgc

SEQ ID NO: 492120 - RNA, 21 nt, Human
cagcgacccgcgaaccugcac

SEQ ID NO: 492121 - RNA, 18 nt, Human
cccaagaccccucaggcg

SEQ ID NO: 492122 - RNA, 22 nt, Human
cccccaagaccccucaggcgcc

SEQ ID NO: 492123 - RNA, 22 nt, Human
cccccgccagcgacccgcgaac

SEQ ID NO: 492124 - RNA, 22 nt, Human
ccgcagccccaccaggcacuga

SEQ ID NO: 492125 - RNA, 19 nt, Human
ccgcucccggcgcacuccc

SEQ ID NO: 492126 - RNA, 22 nt, Human
ccuagagcccccaagaccccuc

SEQ ID NO: 492127 - RNA, 27 nt, Human
ccugcacagaccacucggcggcguccc

SEQ ID NO: 492128 - RNA, 23 nt, Human
cgccucccaggcagcguacuccu

SEQ ID NO: 492129 - RNA, 20 nt, Human
cggacacacgggcaccgggc

SEQ ID NO: 492130 - RNA, 19 nt, Human
cuggaaugcaggguuuaag

SEQ ID NO: 492131 - RNA, 18 nt, Human
gagcccccaagaccccuc

SEQ ID NO: 492132 - RNA, 24 nt, Human
gaguggaggaacggacacacgggc

SEQ ID NO: 492133 - RNA, 24 nt, Human
gccccaugcgucgucuccgcugca

SEQ ID NO: 492134 - RNA, 19 nt, Human
gccuagagcccccaagacc

SEQ ID NO: 492135 - RNA, 18 nt, Human
ggagaggaggcaaggaug

SEQ ID NO: 492136 - RNA, 23 nt, Human
uaacaaaacccagggagaggagg

SEQ ID NO: 492137 - RNA, 22 nt, Human
uagagcccccaagaccccucag

SEQ ID NO: 492138 - RNA, 20 nt, Human
ucccaggcagcguacuccua

SEQ ID NO: 492139 - RNA, 19 nt, Human
uccgcagccccaccaggca

SEQ ID NO: 492140 - RNA, 25 nt, Human
ugaacaugucgacggggacaguccc

SEQ ID NO: 492141 - RNA, 22 nt, Human
aaaaccugccagaauuucuaga

SEQ ID NO: 492142 - RNA, 24 nt, Human
aaaaggaagaaagaggagcaaggg

SEQ ID NO: 492143 - RNA, 18 nt, Human
aaaaugccaaucuugaaa

SEQ ID NO: 492144 - RNA, 22 nt, Human
aaacagagaucauuuccugaac

SEQ ID NO: 492145 - RNA, 23 nt, Human
aaacagagaucauuuccugaaca

SEQ ID NO: 492146 - RNA, 21 nt, Human
aacaggauggaaaacauuucu

SEQ ID NO: 492147 - RNA, 18 nt, Human
aaccacacaaucaacaca

SEQ ID NO: 492148 - RNA, 23 nt, Human
aacgagagcacuacucuaggcau

SEQ ID NO: 492149 - RNA, 20 nt, Human
aagaaaaggaagaaagagga

SEQ ID NO: 492150 - RNA, 18 nt, Human
aagaaagaggagcaaggg

SEQ ID NO: 492151 - RNA, 21 nt, Human
aagaagaaagccaacaaagaa

SEQ ID NO: 492152 - RNA, 22 nt, Human
aagcucuaguccaaguuuccag

SEQ ID NO: 492153 - RNA, 26 nt, Human
aauaaauacaaaaaugaaccacacaa

SEQ ID NO: 492154 - RNA, 21 nt, Human
aaucaugguuucagggauuug

SEQ ID NO: 492155 - RNA, 28 nt, Human
aaucucugaagucaaauggccaguuuga

SEQ ID NO: 492156 - RNA, 19 nt, Human
acaauccauguuaaaaacc

SEQ ID NO: 492157 - RNA, 23 nt, Human
acagaaucaagaagaaagccaac

SEQ ID NO: 492158 - RNA, 19 nt, Human
acagaauggacuaugcccc

SEQ ID NO: 492159 - RNA, 19 nt, Human
accacacaaucaacacaua

SEQ ID NO: 492160 - RNA, 19 nt, Human
accacacaaucaacacaua

SEQ ID NO: 492161 - RNA, 24 nt, Human
accacagagagcccuuacaaagac

SEQ ID NO: 492162 - RNA, 20 nt, Human
accccggagaugccuucaaa

SEQ ID NO: 492163 - RNA, 22 nt, Human
agagcgaaaccagagacgcauc

SEQ ID NO: 492164 - RNA, 22 nt, Human
aggaggaggauccgucgcugcc

SEQ ID NO: 492165 - RNA, 22 nt, Human
aucaagaagaaagccaacaaag

SEQ ID NO: 492166 - RNA, 21 nt, Human
aucacacuaacacuauauagu

SEQ ID NO: 492167 - RNA, 21 nt, Human
auggcaacaggguaaaaaagc

SEQ ID NO: 492168 - RNA, 20 nt, Human
augguugccugcaaauucuu

SEQ ID NO: 492169 - RNA, 23 nt, Human
auuaaacaugguugccugcaaau

SEQ ID NO: 492170 - RNA, 24 nt, Human
caaagcagcauaugccucuuagac

SEQ ID NO: 492171 - RNA, 19 nt, Human
caccuuguaagaaaugauu

SEQ ID NO: 492172 - RNA, 18 nt, Human
caguucgagcaggcuaaa

SEQ ID NO: 492173 - RNA, 22 nt, Human
ccaaguaauuaaguaaucucac

SEQ ID NO: 492174 - RNA, 24 nt, Human
ccacagagagcccuuacaaagacu

SEQ ID NO: 492175 - RNA, 20 nt, Human
cccccacagaaucaagaaga

SEQ ID NO: 492176 - RNA, 24 nt, Human
ccgucgcugccgccgucgccgccg

SEQ ID NO: 492177 - RNA, 22 nt, Human
cgaaaccagagacgcaucaaau

SEQ ID NO: 492178 - RNA, 19 nt, Human
cuaaaacaaucauucugcu

SEQ ID NO: 492179 - RNA, 25 nt, Human
cuacaccuccaaagcagcauaugcc

SEQ ID NO: 492180 - RNA, 26 nt, Human
cuagacuauucaccuagauaaacuca

SEQ ID NO: 492181 - RNA, 20 nt, Human
cucuauaauaaagagaaaac

SEQ ID NO: 492182 - RNA, 27 nt, Human
cugcaaaauuccccuuggccaguaacu

SEQ ID NO: 492183 - RNA, 22 nt, Human
cugcuggucuccucauacaugu

SEQ ID NO: 492184 - RNA, 24 nt, Human
cuuauaaaauagaaaaaagcugcu

SEQ ID NO: 492185 - RNA, 22 nt, Human
cuucagggaacaaaaguuccau

SEQ ID NO: 492186 - RNA, 18 nt, Human
cuucuaaaaucuaccauc

SEQ ID NO: 492187 - RNA, 24 nt, Human
cuuuuuuucacuuuggcuuuuucu

SEQ ID NO: 492188 - RNA, 18 nt, Human
gaaaagaaaaggaagaaa

SEQ ID NO: 492189 - RNA, 26 nt, Human
gaaaggaaaagaaaaggaagaaagag

SEQ ID NO: 492190 - RNA, 21 nt, Human
gaacaguuugaaucacaugga

SEQ ID NO: 492191 - RNA, 22 nt, Human
gacgaggcccggccggaaagga

SEQ ID NO: 492192 - RNA, 22 nt, Human
gagcaggcuaaaacaaucauuc

SEQ ID NO: 492193 - RNA, 18 nt, Human
gagcccuuacaaagacua

SEQ ID NO: 492194 - RNA, 22 nt, Human
gaggagcaagggaauaagggag

SEQ ID NO: 492195 - RNA, 24 nt, Human
gcuacaaaauacaacaauaagccu

SEQ ID NO: 492196 - RNA, 18 nt, Human
ggaaaggaaaagaaaagg

SEQ ID NO: 492197 - RNA, 22 nt, Human
ggaggacauacuaucaauacuu

SEQ ID NO: 492198 - RNA, 23 nt, Human
ggaucgaggccgccguuagggaa

SEQ ID NO: 492199 - RNA, 23 nt, Human
ggccggaaaggaaaagaaaagga

SEQ ID NO: 492200 - RNA, 21 nt, Human
guggggaaauaguuucugggc

SEQ ID NO: 492201 - RNA, 22 nt, Human
uaacaccaagacauagaaaaaa

SEQ ID NO: 492202 - RNA, 21 nt, Human
uaacuagcuucagggaacaaa

SEQ ID NO: 492203 - RNA, 21 nt, Human
uaacuggaaauagcauuuuuu

SEQ ID NO: 492204 - RNA, 26 nt, Human
uacaaaauacaacaauaagccuuuaa

SEQ ID NO: 492205 - RNA, 22 nt, Human
uacacccccacagaaucaagaa

SEQ ID NO: 492206 - RNA, 24 nt, Human
uacuuagcagggaauggucuccag

SEQ ID NO: 492207 - RNA, 19 nt, Human
uagcagggaauggucucca

SEQ ID NO: 492208 - RNA, 24 nt, Human
uagcagggaauggucuccagagcc

SEQ ID NO: 492209 - RNA, 18 nt, Human
uagcuucuaaaaucuacc

SEQ ID NO: 492210 - RNA, 19 nt, Human
uaguaagagacuaaaaucc

SEQ ID NO: 492211 - RNA, 20 nt, Human
uaguuucugggcuugcaccc

SEQ ID NO: 492212 - RNA, 26 nt, Human
uauacacauugcaaaacuauucugcg

SEQ ID NO: 492213 - RNA, 23 nt, Human
uauuagugcaaauuaauacccaa

SEQ ID NO: 492214 - RNA, 22 nt, Human
ucaaaucaguaguaacuacuaa

SEQ ID NO: 492215 - RNA, 20 nt, Human
ucaaauggccaguuugacaa

SEQ ID NO: 492216 - RNA, 23 nt, Human
ucacuacaccuccaaaggggccc

SEQ ID NO: 492217 - RNA, 20 nt, Human
ucauuuaacgguagcuggag

SEQ ID NO: 492218 - RNA, 21 nt, Human
uccauaaucaaugaagaaaca

SEQ ID NO: 492219 - RNA, 21 nt, Human
uccccacaacaggauggaaaa

SEQ ID NO: 492220 - RNA, 19 nt, Human
uccgucgcugccgccgucg

SEQ ID NO: 492221 - RNA, 21 nt, Human
ucgcugccgccgucgccgccg

SEQ ID NO: 492222 - RNA, 21 nt, Human
ucuaguccaaguuuccagcug

SEQ ID NO: 492223 - RNA, 24 nt, Human
ucuaugauaguguggguggagaua

SEQ ID NO: 492224 - RNA, 19 nt, Human
ucugcuagggaucugaaga

SEQ ID NO: 492225 - RNA, 20 nt, Human
ucugggcuugcacccgauuu

SEQ ID NO: 492226 - RNA, 24 nt, Human
ucugucagccaaaaaaagauuacu

SEQ ID NO: 492227 - RNA, 23 nt, Human
ugaaccacacaaucaacacauaa

SEQ ID NO: 492228 - RNA, 24 nt, Human
ugaagaaacauuaauaccaaaucc

SEQ ID NO: 492229 - RNA, 18 nt, Human
ugauacuuagcagggaau

SEQ ID NO: 492230 - RNA, 22 nt, Human
ugaucacaauggugguaaccuc

SEQ ID NO: 492231 - RNA, 19 nt, Human
ugaucugucagccaaaaaa

SEQ ID NO: 492232 - RNA, 22 nt, Human
ugauuguguaucuuuuuguauu

SEQ ID NO: 492233 - RNA, 24 nt, Human
ugcuacaaaauacaacaauaagcc

SEQ ID NO: 492234 - RNA, 25 nt, Human
ugcuauaaaacucaauuauuccuag

SEQ ID NO: 492235 - RNA, 23 nt, Human
uggcauugacguugaaagauuuu

SEQ ID NO: 492236 - RNA, 18 nt, Human
ugggccaucuaaaguuuu

SEQ ID NO: 492237 - RNA, 24 nt, Human
uggucuccagagcgaaaccagaga

SEQ ID NO: 492238 - RNA, 20 nt, Human
uggugccaggaagucaugcc

SEQ ID NO: 492239 - RNA, 18 nt, Human
ugguugccugcaaauucu

SEQ ID NO: 492240 - RNA, 20 nt, Human
uguaccaccagaggcaaagc

SEQ ID NO: 492241 - RNA, 21 nt, Human
uguuauacacccccacagaau

SEQ ID NO: 492242 - RNA, 21 nt, Human
uuaauaccaaauccccacaac

SEQ ID NO: 492243 - RNA, 21 nt, Human
uucagcuuggagaucuugcca

SEQ ID NO: 492244 - RNA, 18 nt, Human
uuccacuaucccuuccuu

SEQ ID NO: 492245 - RNA, 24 nt, Human
uucuuccaugcacaaacauuucag

SEQ ID NO: 492246 - RNA, 24 nt, Human
uugcacccgauuuucccuguggug

SEQ ID NO: 492247 - RNA, 23 nt, Human
uuguuaugaaucaaaugaacaug

SEQ ID NO: 492248 - RNA, 21 nt, Human
uuucuagaggaaguaaacgca

SEQ ID NO: 492249 - RNA, 21 nt, Human
uuucugggcuugcacccgauu

SEQ ID NO: 492250 - RNA, 18 nt, Human
uuugcuuuauaccauugg

SEQ ID NO: 492251 - RNA, 18 nt, Human
uuuguauucugaaaauag

SEQ ID NO: 492252 - RNA, 18 nt, Human
aacauuuucacuucugcc

SEQ ID NO: 492253 - RNA, 23 nt, Human
aaccaagaaaaauacgaagcuuc

SEQ ID NO: 492254 - RNA, 22 nt, Human
aaccaguauaaguagagacgca

SEQ ID NO: 492255 - RNA, 23 nt, Human
aagaggacaagaugggaaggaca

SEQ ID NO: 492256 - RNA, 24 nt, Human
aagcaaaccaguauaaguagagac

SEQ ID NO: 492257 - RNA, 22 nt, Human
acgacaaacgcacgcauggacc

SEQ ID NO: 492258 - RNA, 25 nt, Human
acucccuccacugagaaaaagacaa

SEQ ID NO: 492259 - RNA, 18 nt, Human
agacaaaccaacccaagu

SEQ ID NO: 492260 - RNA, 23 nt, Human
agacaaaccaacccaagugguac

SEQ ID NO: 492261 - RNA, 18 nt, Human
agacagaguaaaugcucu

SEQ ID NO: 492262 - RNA, 19 nt, Human
agagccccucacacuuuuc

SEQ ID NO: 492263 - RNA, 18 nt, Human
aggaagcaaagacaaacc

SEQ ID NO: 492264 - RNA, 23 nt, Human
aggaagcaaagacaaaccaaccc

SEQ ID NO: 492265 - RNA, 21 nt, Human
caaacaaacacuagagacuuu

SEQ ID NO: 492266 - RNA, 24 nt, Human
caaacaaacacuagagacuuuagu

SEQ ID NO: 492267 - RNA, 25 nt, Human
caccaaggaaagcugucaaauaaug

SEQ ID NO: 492268 - RNA, 18 nt, Human
caccacacgcaggcuccg

SEQ ID NO: 492269 - RNA, 22 nt, Human
caccacacgcaggcuccgggac

SEQ ID NO: 492270 - RNA, 20 nt, Human
cacgcuugcccccuccuccg

SEQ ID NO: 492271 - RNA, 28 nt, Human
cacuucugccaccacccuuuaugcaguc

SEQ ID NO: 492272 - RNA, 23 nt, Human
cagaguaaaugcucucucaaauc

SEQ ID NO: 492273 - RNA, 18 nt, Human
cagcagggaacuccacuc

SEQ ID NO: 492274 - RNA, 21 nt, Human
cagguccauacacucccucca

SEQ ID NO: 492275 - RNA, 19 nt, Human
ccaacccaagugguacuga

SEQ ID NO: 492276 - RNA, 20 nt, Human
ccacggaaaaacagccacau

SEQ ID NO: 492277 - RNA, 19 nt, Human
ccacugagaaaaagacaaa

SEQ ID NO: 492278 - RNA, 22 nt, Human
ccagguccauacacucccucca

SEQ ID NO: 492279 - RNA, 23 nt, Human
ccagguccauacacucccuccac

SEQ ID NO: 492280 - RNA, 24 nt, Human
ccauuucagcagcaguuucaucca

SEQ ID NO: 492281 - RNA, 18 nt, Human
cccacuccaaaccccagg

SEQ ID NO: 492282 - RNA, 23 nt, Human
cccuccacugagaaaaagacaaa

SEQ ID NO: 492283 - RNA, 22 nt, Human
ccgcgccugcuguuccuucccc

SEQ ID NO: 492284 - RNA, 22 nt, Human
cuccaaaccccaggaaugaccc

SEQ ID NO: 492285 - RNA, 22 nt, Human
cucccuccacugagaaaaagac

SEQ ID NO: 492286 - RNA, 20 nt, Human
cuguuccuuccccacgugaa

SEQ ID NO: 492287 - RNA, 23 nt, Human
cuuacacgacaaacgcacgcaug

SEQ ID NO: 492288 - RNA, 21 nt, Human
gaaaaagacaaauggcuuagg

SEQ ID NO: 492289 - RNA, 19 nt, Human
gacauuuuuauuuucccua

SEQ ID NO: 492290 - RNA, 18 nt, Human
gaggacaagaugggaagg

SEQ ID NO: 492291 - RNA, 20 nt, Human
gaggggcuugcacacacuug

SEQ ID NO: 492292 - RNA, 19 nt, Human
gauguuuccagccaaguga

SEQ ID NO: 492293 - RNA, 22 nt, Human
gcaaagacaaaccaacccaagu

SEQ ID NO: 492294 - RNA, 18 nt, Human
gcagugugugcuaggggc

SEQ ID NO: 492295 - RNA, 23 nt, Human
ggaagcaaagacaaaccaaccca

SEQ ID NO: 492296 - RNA, 21 nt, Human
ggaggucacauguagcugagu

SEQ ID NO: 492297 - RNA, 18 nt, Human
ggcaaccucaccaagcug

SEQ ID NO: 492298 - RNA, 24 nt, Human
ggucuuuuggcaucuugcucugcu

SEQ ID NO: 492299 - RNA, 23 nt, Human
guacugugcguuguauuucuuca

SEQ ID NO: 492300 - RNA, 24 nt, Human
gugaaaccaagaaaaauacgaagc

SEQ ID NO: 492301 - RNA, 19 nt, Human
uaaaugagacagugcaugu

SEQ ID NO: 492302 - RNA, 22 nt, Human
uauagaacuaauagaggaauaa

SEQ ID NO: 492303 - RNA, 19 nt, Human
uaugcagucuggcacauag

SEQ ID NO: 492304 - RNA, 19 nt, Human
ucaaggacgugguguagga

SEQ ID NO: 492305 - RNA, 22 nt, Human
ucagcagcaguuucauccacag

SEQ ID NO: 492306 - RNA, 19 nt, Human
uccacugagaaaaagacaa

SEQ ID NO: 492307 - RNA, 23 nt, Human
uccccacgugaagagccccucac

SEQ ID NO: 492308 - RNA, 19 nt, Human
uccuaaaaauuggaaccau

SEQ ID NO: 492309 - RNA, 23 nt, Human
ucuucauucucuggcaggcuggg

SEQ ID NO: 492310 - RNA, 26 nt, Human
ugaaaccaagaaaaauacgaagcuuc

SEQ ID NO: 492311 - RNA, 20 nt, Human
ugagaaaaagacaaauggcu

SEQ ID NO: 492312 - RNA, 21 nt, Human
ugagcaaacaaacacuagaga

SEQ ID NO: 492313 - RNA, 18 nt, Human
ugaggagcuugcccacca

SEQ ID NO: 492314 - RNA, 20 nt, Human
ugaggggcuugcacacacuu

SEQ ID NO: 492315 - RNA, 24 nt, Human
ugccaccacccuuuaugcagucug

SEQ ID NO: 492316 - RNA, 21 nt, Human
uggcaggcugggaguccaagg

SEQ ID NO: 492317 - RNA, 20 nt, Human
uggggccagguccauacacu

SEQ ID NO: 492318 - RNA, 24 nt, Human
uggguaagcagauuccuaaaaauu

SEQ ID NO: 492319 - RNA, 21 nt, Human
uggucuuuuggcaucuugcuc

SEQ ID NO: 492320 - RNA, 24 nt, Human
ugucuugaguucugaggggcuugc

SEQ ID NO: 492321 - RNA, 22 nt, Human
uguuaaggcaugcagugugugc

SEQ ID NO: 492322 - RNA, 19 nt, Human
uuaaguauccuuuaucuca

SEQ ID NO: 492323 - RNA, 18 nt, Human
uuagaagaaugccuggaa

SEQ ID NO: 492324 - RNA, 21 nt, Human
uucccccacuccaaaccccag

SEQ ID NO: 492325 - RNA, 20 nt, Human
uugauguuuccagccaagug

SEQ ID NO: 492326 - RNA, 19 nt, Human
uuucaagacuccccuauuc

SEQ ID NO: 492327 - RNA, 23 nt, Human
uuuucacuucugccaccacccuu

SEQ ID NO: 492328 - RNA, 23 nt, Human
aaaagcaacacaggaccaaaagc

SEQ ID NO: 492329 - RNA, 23 nt, Human
aaaggcugaaaugcuuuguaaag

SEQ ID NO: 492330 - RNA, 22 nt, Human
aacacaggaccaaaagcaucca

SEQ ID NO: 492331 - RNA, 24 nt, Human
aacuucugagagaagagcugaaaa

SEQ ID NO: 492332 - RNA, 22 nt, Human
aagcccaaguuuaaaaaccaua

SEQ ID NO: 492333 - RNA, 19 nt, Human
aaggauaguuuguguccac

SEQ ID NO: 492334 - RNA, 22 nt, Human
aaggauaguuuguguccaccaa

SEQ ID NO: 492335 - RNA, 21 nt, Human
aaguagauuuuuguuuucagu

SEQ ID NO: 492336 - RNA, 25 nt, Human
aauuagccaauuuuaccgucauuua

SEQ ID NO: 492337 - RNA, 23 nt, Human
acaagccaugcuaacacugagcc

SEQ ID NO: 492338 - RNA, 22 nt, Human
acacaggaccaaaagcauccaa

SEQ ID NO: 492339 - RNA, 21 nt, Human
acaggaccaaaagcauccaac

SEQ ID NO: 492340 - RNA, 21 nt, Human
acauagcugcagacagacucu

SEQ ID NO: 492341 - RNA, 18 nt, Human
acuaggaaucugcauaua

SEQ ID NO: 492342 - RNA, 18 nt, Human
acuccuaacauuuuccuu

SEQ ID NO: 492343 - RNA, 22 nt, Human
acucugcugccucaagauguaa

SEQ ID NO: 492344 - RNA, 23 nt, Human
agacaaaauauacuuuauuguga

SEQ ID NO: 492345 - RNA, 21 nt, Human
agagaagagcugaaaaaaaug

SEQ ID NO: 492346 - RNA, 21 nt, Human
agcacaagccaugcuaacacu

SEQ ID NO: 492347 - RNA, 25 nt, Human
agcugaacuucugagagaagagcug

SEQ ID NO: 492348 - RNA, 23 nt, Human
agugaaggagaccugggaaaaga

SEQ ID NO: 492349 - RNA, 22 nt, Human
aguucuaaaaacccugagcggc

SEQ ID NO: 492350 - RNA, 19 nt, Human
auaagagaucuaggccuuu

SEQ ID NO: 492351 - RNA, 24 nt, Human
auuguguaaugucauaaauuuggg

SEQ ID NO: 492352 - RNA, 23 nt, Human
caacacaggaccaaaagcauccc

SEQ ID NO: 492353 - RNA, 22 nt, Human
cacaggaccaaaagcauccaac

SEQ ID NO: 492354 - RNA, 26 nt, Human
cauaaaacacacuuuuucacucuaac

SEQ ID NO: 492355 - RNA, 23 nt, Human
cauccaacuauuacuuuauuuau

SEQ ID NO: 492356 - RNA, 24 nt, Human
ccagcaguucugucccaucucaga

SEQ ID NO: 492357 - RNA, 26 nt, Human
cccaaguuuaaaaaccauacuccuaa

SEQ ID NO: 492358 - RNA, 23 nt, Human
ccccucggccacccgagucucca

SEQ ID NO: 492359 - RNA, 23 nt, Human
cccucggccacccgagucuccag

SEQ ID NO: 492360 - RNA, 21 nt, Human
cgacagaaauauuucacuaau

SEQ ID NO: 492361 - RNA, 18 nt, Human
cggguuucaacaguaugc

SEQ ID NO: 492362 - RNA, 22 nt, Human
cuaaccaacagcccaguggcaa

SEQ ID NO: 492363 - RNA, 23 nt, Human
cuaaccaacagcccaguggcaaa

SEQ ID NO: 492364 - RNA, 18 nt, Human
cuccaacaagaauauggc

SEQ ID NO: 492365 - RNA, 19 nt, Human
cuugucgcucuucagcugg

SEQ ID NO: 492366 - RNA, 23 nt, Human
gagagaagagcugaaaaaaaugc

SEQ ID NO: 492367 - RNA, 23 nt, Human
gaggaacuuaacuguacucagaa

SEQ ID NO: 492368 - RNA, 24 nt, Human
ggcaaauuuccuuucuagacaaag

SEQ ID NO: 492369 - RNA, 22 nt, Human
ggcaugcuacuaggaaucugca

SEQ ID NO: 492370 - RNA, 20 nt, Human
guaaagcaguauuuuuagac

SEQ ID NO: 492371 - RNA, 24 nt, Human
guugcuucauuucccccuuuucua

SEQ ID NO: 492372 - RNA, 20 nt, Human
uaaaaaccauacuccuaaca

SEQ ID NO: 492373 - RNA, 19 nt, Human
uaaaagcaacacaggacca

SEQ ID NO: 492374 - RNA, 25 nt, Human
uaaaagcaacacaggaccaaaagca

SEQ ID NO: 492375 - RNA, 22 nt, Human
uaacuaggaauggugacaucuu

SEQ ID NO: 492376 - RNA, 19 nt, Human
uaggaggaacuuaacugua

SEQ ID NO: 492377 - RNA, 19 nt, Human
uauggcugaaguucuaaaa

SEQ ID NO: 492378 - RNA, 26 nt, Human
ucaaaaaaucaaugcaaaacugaggg

SEQ ID NO: 492379 - RNA, 23 nt, Human
ucaauuuaguuuaagagaugaaa

SEQ ID NO: 492380 - RNA, 19 nt, Human
ucagugaaggagaccuggg

SEQ ID NO: 492381 - RNA, 22 nt, Human
uccaacaagaauauggcacacc

SEQ ID NO: 492382 - RNA, 21 nt, Human
uccaccagaagcaaauacuag

SEQ ID NO: 492383 - RNA, 23 nt, Human
ucccuuuguaugugaggguacaa

SEQ ID NO: 492384 - RNA, 22 nt, Human
uccgcaguucauuaauccgacu

SEQ ID NO: 492385 - RNA, 19 nt, Human
ucuaaaaacccugagcggc

SEQ ID NO: 492386 - RNA, 22 nt, Human
ucucuucucugaagcuagcaaa

SEQ ID NO: 492387 - RNA, 18 nt, Human
ucuuugggccaagacuga

SEQ ID NO: 492388 - RNA, 23 nt, Human
ugaaauaacuggguuuaaaaaaa

SEQ ID NO: 492389 - RNA, 22 nt, Human
ugaaugcacauugacauucugu

SEQ ID NO: 492390 - RNA, 24 nt, Human
ugagagaagagcugaaaaaaaugc

SEQ ID NO: 492391 - RNA, 20 nt, Human
ugauggaaacuauuaggcuc

SEQ ID NO: 492392 - RNA, 23 nt, Human
ugcaguaucauaccuacuuaauc

SEQ ID NO: 492393 - RNA, 24 nt, Human
ugcauaauauucucucuacacacu

SEQ ID NO: 492394 - RNA, 21 nt, Human
ugcaugaaugcacauugacau

SEQ ID NO: 492395 - RNA, 23 nt, Human
ugccucaagauguaaacauaggg

SEQ ID NO: 492396 - RNA, 23 nt, Human
ugcuaacacugagccuuuagcgc

SEQ ID NO: 492397 - RNA, 23 nt, Human
uggaaaauacaaaauuuaaaaaa

SEQ ID NO: 492398 - RNA, 21 nt, Human
ugggccaagacugacaaggaa

SEQ ID NO: 492399 - RNA, 24 nt, Human
ugguaugaagccccucggccaccu

SEQ ID NO: 492400 - RNA, 23 nt, Human
uguaaugucauaaauuuggggcu

SEQ ID NO: 492401 - RNA, 19 nt, Human
uguaugugaggguacaaag

SEQ ID NO: 492402 - RNA, 26 nt, Human
uuaacggcaucugcauaauauucucu

SEQ ID NO: 492403 - RNA, 18 nt, Human
uucaacuguuuucuaaau

SEQ ID NO: 492404 - RNA, 20 nt, Human
uuuaagagaugaaaaaaaac

SEQ ID NO: 492405 - RNA, 22 nt, Human
uuuaguuuaagagaugaaaaaa

SEQ ID NO: 492406 - RNA, 19 nt, Human
aaacuuuacacauggccuc

SEQ ID NO: 492407 - RNA, 21 nt, Human
aaauguaaaguauccaccuug

SEQ ID NO: 492408 - RNA, 24 nt, Human
aaccucaaaucuuacucccaguac

SEQ ID NO: 492409 - RNA, 23 nt, Human
acaaccaaacauauaaccuucuu

SEQ ID NO: 492410 - RNA, 21 nt, Human
acgaauugcgccgcgcucccc

SEQ ID NO: 492411 - RNA, 23 nt, Human
acgaauugcgccgcgcuccccgc

SEQ ID NO: 492412 - RNA, 19 nt, Human
agaugccgggaggccgccc

SEQ ID NO: 492413 - RNA, 21 nt, Human
aggcaggaaaacgaugaucau

SEQ ID NO: 492414 - RNA, 19 nt, Human
auaaaacccaaacugacua

SEQ ID NO: 492415 - RNA, 23 nt, Human
cacaaaaagacucacuaacuuca

SEQ ID NO: 492416 - RNA, 19 nt, Human
cauaauaaugguuuaagga

SEQ ID NO: 492417 - RNA, 19 nt, Human
cccagccgcuccccuuccu

SEQ ID NO: 492418 - RNA, 20 nt, Human
ccccccgcgggccgacgaau

SEQ ID NO: 492419 - RNA, 21 nt, Human
ccgcgggccgacgaauugcgc

SEQ ID NO: 492420 - RNA, 23 nt, Human
ccucacguuacauauaugaagcc

SEQ ID NO: 492421 - RNA, 18 nt, Human
cgacgaggggaagcggcg

SEQ ID NO: 492422 - RNA, 18 nt, Human
cgccgcgcuccccgcggg

SEQ ID NO: 492423 - RNA, 20 nt, Human
cgccgcgcuccccgcgggcc

SEQ ID NO: 492424 - RNA, 23 nt, Human
cgccgcgcuccccgcgggccuca

SEQ ID NO: 492425 - RNA, 18 nt, Human
cugucacagagaggaaau

SEQ ID NO: 492426 - RNA, 20 nt, Human
cuuaagcauuauguugagug

SEQ ID NO: 492427 - RNA, 23 nt, Human
gaaacacaacagagaggggaggc

SEQ ID NO: 492428 - RNA, 25 nt, Human
gaaggacaauuuuaauuucgucuuc

SEQ ID NO: 492429 - RNA, 22 nt, Human
gcgccgcgcuccccgcgggccu

SEQ ID NO: 492430 - RNA, 27 nt, Human
gcuaaaaugucuuuuccccccgaaaca

SEQ ID NO: 492431 - RNA, 18 nt, Human
gguucugucacagagagg

SEQ ID NO: 492432 - RNA, 18 nt, Human
uaaaacccaaacugacua

SEQ ID NO: 492433 - RNA, 21 nt, Human
uaaaacccaaacugacuaaau

SEQ ID NO: 492434 - RNA, 22 nt, Human
uaacacaaaaagacucacuaac

SEQ ID NO: 492435 - RNA, 22 nt, Human
uaacaugaaauuaaaucaguaa

SEQ ID NO: 492436 - RNA, 25 nt, Human
uaacaugaaauuaaaucaguaacuu

SEQ ID NO: 492437 - RNA, 26 nt, Human
uaacaugaaauuaaaucaguaacuuu

SEQ ID NO: 492438 - RNA, 18 nt, Human
uacacauggccucaaaac

SEQ ID NO: 492439 - RNA, 19 nt, Human
uauuuuggaguaacacaaa

SEQ ID NO: 492440 - RNA, 19 nt, Human
ucaagccgggcggacgagc

SEQ ID NO: 492441 - RNA, 22 nt, Human
ucgccgcgaagaugccgggagg

SEQ ID NO: 492442 - RNA, 19 nt, Human
ugaguggucaucuaaaaaa

SEQ ID NO: 492443 - RNA, 19 nt, Human
ugauaaaacccaaacugac

SEQ ID NO: 492444 - RNA, 20 nt, Human
ugcugauuccagcuuuaaaa

SEQ ID NO: 492445 - RNA, 18 nt, Human
uguguacauaacaauaug

SEQ ID NO: 492446 - RNA, 22 nt, Human
uguguugguucauaucaaaucc

SEQ ID NO: 492447 - RNA, 24 nt, Human
uugcgccgcgcuccccgcgggccu

SEQ ID NO: 492448 - RNA, 20 nt, Human
uuucaacuacaaaccgugaa

SEQ ID NO: 492449 - RNA, 20 nt, Human
agcggcagccagggugggca

SEQ ID NO: 492450 - RNA, 21 nt, Human
ccagcucagucuuccaagggc

SEQ ID NO: 492451 - RNA, 21 nt, Human
ccagggugggcaguggguacc

SEQ ID NO: 492452 - RNA, 25 nt, Human
gacuguacagccuugcugugggggg

SEQ ID NO: 492453 - RNA, 23 nt, Human
gcuggcuuggggcugguucugcu

SEQ ID NO: 492454 - RNA, 21 nt, Human
gggcaggguucccucccgggg

SEQ ID NO: 492455 - RNA, 23 nt, Human
gggcaguggguaccagcacugcc

SEQ ID NO: 492456 - RNA, 18 nt, Human
ucccggggcccuguuggg

SEQ ID NO: 492457 - RNA, 20 nt, Human
uggccaagccagcggauggc

SEQ ID NO: 492458 - RNA, 23 nt, Human
uggcugugggggucccagcucag

SEQ ID NO: 492459 - RNA, 19 nt, Human
uggcuuggggcugguucug

SEQ ID NO: 492460 - RNA, 18 nt, Human
uggguaccagcacugcca

SEQ ID NO: 492461 - RNA, 19 nt, Human
ugugggggguugggggcag

SEQ ID NO: 492462 - RNA, 24 nt, Human
uguugggguucccgccccgggggg

SEQ ID NO: 492463 - RNA, 19 nt, Human
uugggggcaggguucccuc

SEQ ID NO: 492464 - RNA, 19 nt, Human
aaccucugccucuggcuuc

SEQ ID NO: 492465 - RNA, 24 nt, Human
aacuccagcucuccauucuaacac

SEQ ID NO: 492466 - RNA, 24 nt, Human
acccaggcuggaguucaguggcgu

SEQ ID NO: 492467 - RNA, 18 nt, Human
acucugucacccaggcug

SEQ ID NO: 492468 - RNA, 25 nt, Human
acucugucacccaggcuggaguuca

SEQ ID NO: 492469 - RNA, 21 nt, Human
agcccucuccaggccuuguau

SEQ ID NO: 492470 - RNA, 18 nt, Human
aguagcugggauuacagg

SEQ ID NO: 492471 - RNA, 20 nt, Human
aguucaguggcgugaucccg

SEQ ID NO: 492472 - RNA, 24 nt, Human
aguucaguggcgugaucccggcuc

SEQ ID NO: 492473 - RNA, 23 nt, Human
caagaaacaaaguguagaaaugc

SEQ ID NO: 492474 - RNA, 20 nt, Human
caagguaggaauggggugca

SEQ ID NO: 492475 - RNA, 19 nt, Human
cacacagcacuauucugaa

SEQ ID NO: 492476 - RNA, 24 nt, Human
caccuuuguuguacugggcucagg

SEQ ID NO: 492477 - RNA, 22 nt, Human
cacucugucacccaggcuggag

SEQ ID NO: 492478 - RNA, 23 nt, Human
cacucugucacccaggcuggagu

SEQ ID NO: 492479 - RNA, 23 nt, Human
cagcacuauucugaacgaacucc

SEQ ID NO: 492480 - RNA, 20 nt, Human
cagucuccugaguagcuggg

SEQ ID NO: 492481 - RNA, 24 nt, Human
cauugcaaccucugccucuggcuu

SEQ ID NO: 492482 - RNA, 21 nt, Human
ccagcgaauucccaggugggg

SEQ ID NO: 492483 - RNA, 21 nt, Human
cccccagucucaaguggugcu

SEQ ID NO: 492484 - RNA, 23 nt, Human
ccugaguagcugggauuacaggc

SEQ ID NO: 492485 - RNA, 23 nt, Human
ccugaguagcugggauuacaggc

SEQ ID NO: 492486 - RNA, 20 nt, Human
cuauucugaacgaacuccag

SEQ ID NO: 492487 - RNA, 24 nt, Human
cucacucugucacccaggcuggag

SEQ ID NO: 492488 - RNA, 23 nt, Human
cucagucuccugaguagcuggga

SEQ ID NO: 492489 - RNA, 23 nt, Human
cucauugcaaccucugccucugg

SEQ ID NO: 492490 - RNA, 22 nt, Human
cucccugagggcccccaacagc

SEQ ID NO: 492491 - RNA, 22 nt, Human
cugaguagcugggauuacaggc

SEQ ID NO: 492492 - RNA, 20 nt, Human
cugcagugcuccaucucugg

SEQ ID NO: 492493 - RNA, 23 nt, Human
cuggcuucaagcaauucucugcc

SEQ ID NO: 492494 - RNA, 20 nt, Human
gaaaaugcauuaauugggag

SEQ ID NO: 492495 - RNA, 25 nt, Human
gaguagcugggauuacaggcgccca

SEQ ID NO: 492496 - RNA, 24 nt, Human
gccucagucuccugaguagcuggg

SEQ ID NO: 492497 - RNA, 20 nt, Human
gcuucaagcaauucucugcc

SEQ ID NO: 492498 - RNA, 23 nt, Human
gcuucaagcaauucucugccuca

SEQ ID NO: 492499 - RNA, 21 nt, Human
ggagacaagagucucacucug

SEQ ID NO: 492500 - RNA, 22 nt, Human
ggcuggaguucaguggcgugau

SEQ ID NO: 492501 - RNA, 24 nt, Human
ggcuucaagcaauucucugccuca

SEQ ID NO: 492502 - RNA, 18 nt, Human
guagcugggauuacaggc

SEQ ID NO: 492503 - RNA, 18 nt, Human
uacuccaugcugccccca

SEQ ID NO: 492504 - RNA, 19 nt, Human
uagaaaugcuauacacaau

SEQ ID NO: 492505 - RNA, 20 nt, Human
uagaaaugcuauacacaaug

SEQ ID NO: 492506 - RNA, 22 nt, Human
uauaaguugcagggugcaccgu

SEQ ID NO: 492507 - RNA, 26 nt, Human
uaucaguaggaaaugaaaaugcauua

SEQ ID NO: 492508 - RNA, 26 nt, Human
ucaccagguguggggaggggcuugag

SEQ ID NO: 492509 - RNA, 24 nt, Human
ucacucugucacccaggcuggagu

SEQ ID NO: 492510 - RNA, 23 nt, Human
ucagguauaaguugcagggugca

SEQ ID NO: 492511 - RNA, 23 nt, Human
ucagucuccugaguagcugggau

SEQ ID NO: 492512 - RNA, 22 nt, Human
ucauugcaaccucugccucugg

SEQ ID NO: 492513 - RNA, 23 nt, Human
ucccugagggcccccaacagccc

SEQ ID NO: 492514 - RNA, 24 nt, Human
uccugaguagcugggauuacaggc

SEQ ID NO: 492515 - RNA, 23 nt, Human
ucucacucugucacccaggcugg

SEQ ID NO: 492516 - RNA, 24 nt, Human
ucucacucugucacccaggcugga

SEQ ID NO: 492517 - RNA, 26 nt, Human
ucucacucugucacccaggcuggagu

SEQ ID NO: 492518 - RNA, 27 nt, Human
ucucacucugucacccaggcuggaguu

SEQ ID NO: 492519 - RNA, 24 nt, Human
ucugccucagucuccugaguagcu

SEQ ID NO: 492520 - RNA, 23 nt, Human
ucugccucuggcuucaagcaauu

SEQ ID NO: 492521 - RNA, 18 nt, Human
ucugucacccaggcugga

SEQ ID NO: 492522 - RNA, 18 nt, Human
ugcaaccucugccucugg

SEQ ID NO: 492523 - RNA, 22 nt, Human
ugccaaggaccaagaaacaaag

SEQ ID NO: 492524 - RNA, 26 nt, Human
ugccaaggaccaagaaacaaagugua

SEQ ID NO: 492525 - RNA, 22 nt, Human
ugcccccagucucaaguggugc

SEQ ID NO: 492526 - RNA, 20 nt, Human
ugccucagucuccugaguaa

SEQ ID NO: 492527 - RNA, 23 nt, Human
ugccucagucuccugaguagcug

SEQ ID NO: 492528 - RNA, 24 nt, Human
ugccucagucuccugaguagcugg

SEQ ID NO: 492529 - RNA, 22 nt, Human
ugccucuggcuucaagcaauuc

SEQ ID NO: 492530 - RNA, 19 nt, Human
uggaguucaguggcgugau

SEQ ID NO: 492531 - RNA, 24 nt, Human
uggaguucaguggcgugaucccgg

SEQ ID NO: 492532 - RNA, 23 nt, Human
uggcuucaagcaauucucugccu

SEQ ID NO: 492533 - RNA, 19 nt, Human
ugggauuacaggcgcccac

SEQ ID NO: 492534 - RNA, 21 nt, Human
ugggauuacaggcgcccacug

SEQ ID NO: 492535 - RNA, 24 nt, Human
ugggauuacaggcgcccacugcca

SEQ ID NO: 492536 - RNA, 22 nt, Human
uugcaaccucugccucuggcuu

SEQ ID NO: 492537 - RNA, 23 nt, Human
uugcaaccucugccucuggcuuc

SEQ ID NO: 492538 - RNA, 18 nt, Human
uugccuucaccaaggcag

SEQ ID NO: 492539 - RNA, 28 nt, Human
uuuuuuuuuuuuuuuuuuuuuuuggggg

SEQ ID NO: 492540 - RNA, 20 nt, Human
cagccgcugccucgcagagc

SEQ ID NO: 492541 - RNA, 20 nt, Human
cccacaggguccgcagucaa

SEQ ID NO: 492542 - RNA, 19 nt, Human
cucgcagagcugcccgggc

SEQ ID NO: 492543 - RNA, 21 nt, Human
gggcagaaggcggguccgcgg

SEQ ID NO: 492544 - RNA, 24 nt, Human
uccgcagucaaagaaucgcugaac

SEQ ID NO: 492545 - RNA, 23 nt, Human
ugagggcagaaggcggguccgcg

SEQ ID NO: 492546 - RNA, 24 nt, Human
ugagggcagaaggcggguccgcgg

SEQ ID NO: 492547 - RNA, 19 nt, Human
ugcugagggcagaaggcgg

SEQ ID NO: 492548 - RNA, 18 nt, Human
aaaacccugauacaaagc

SEQ ID NO: 492549 - RNA, 18 nt, Human
aaaagaucaggguugaag

SEQ ID NO: 492550 - RNA, 18 nt, Human
aaaaucccagggaggcag

SEQ ID NO: 492551 - RNA, 21 nt, Human
aaagcaguggccagagaggcc

SEQ ID NO: 492552 - RNA, 20 nt, Human
aaccagaagagagggaaacc

SEQ ID NO: 492553 - RNA, 23 nt, Human
aaccuaggagcaggacacuaaga

SEQ ID NO: 492554 - RNA, 22 nt, Human
aagagaagacuggaagacaaaa

SEQ ID NO: 492555 - RNA, 24 nt, Human
aagcggaagcucucccuggcggca

SEQ ID NO: 492556 - RNA, 23 nt, Human
acccagcgaggcagacaggaucu

SEQ ID NO: 492557 - RNA, 18 nt, Human
accccauaagcucccacc

SEQ ID NO: 492558 - RNA, 21 nt, Human
agcagcucccaccugaaccca

SEQ ID NO: 492559 - RNA, 22 nt, Human
agcuuugcuccuccagguucuc

SEQ ID NO: 492560 - RNA, 23 nt, Human
aggcagacaggaucugaaucaag

SEQ ID NO: 492561 - RNA, 20 nt, Human
aucaagcuuugcuccuccag

SEQ ID NO: 492562 - RNA, 22 nt, Human
aucacacaggcccaugccaaca

SEQ ID NO: 492563 - RNA, 19 nt, Human
caaagcaguggccagagag

SEQ ID NO: 492564 - RNA, 21 nt, Human
caacauuuccuuucuccucuc

SEQ ID NO: 492565 - RNA, 23 nt, Human
caacugaaacuguuuauugaaac

SEQ ID NO: 492566 - RNA, 24 nt, Human
caccccacuucccuuaucucccac

SEQ ID NO: 492567 - RNA, 20 nt, Human
caccccauaagcucccaccc

SEQ ID NO: 492568 - RNA, 21 nt, Human
caccccauaagcucccaccca

SEQ ID NO: 492569 - RNA, 18 nt, Human
cagccagccacugcgauc

SEQ ID NO: 492570 - RNA, 21 nt, Human
caggacacuaagagaagacug

SEQ ID NO: 492571 - RNA, 23 nt, Human
caguccuucugccccaccacccc

SEQ ID NO: 492572 - RNA, 25 nt, Human
caucacuguccuggccaagcagcca

SEQ ID NO: 492573 - RNA, 20 nt, Human
ccaccccauaagcucccacc

SEQ ID NO: 492574 - RNA, 23 nt, Human
ccaccugaacccaucaguccccg

SEQ ID NO: 492575 - RNA, 21 nt, Human
ccacugcgaucuaggagugaa

SEQ ID NO: 492576 - RNA, 20 nt, Human
ccagaagagagggaaaccua

SEQ ID NO: 492577 - RNA, 19 nt, Human
ccagagaggccugggaaga

SEQ ID NO: 492578 - RNA, 23 nt, Human
ccagcagcucccaccugaaccca

SEQ ID NO: 492579 - RNA, 25 nt, Human
ccaucugggacaugucccuggucac

SEQ ID NO: 492580 - RNA, 18 nt, Human
cccaccuauacucuucca

SEQ ID NO: 492581 - RNA, 20 nt, Human
cccagcagcucccaccugaa

SEQ ID NO: 492582 - RNA, 21 nt, Human
cccauaagcucccacccagga

SEQ ID NO: 492583 - RNA, 23 nt, Human
ccccaccaccccauaagcuccca

SEQ ID NO: 492584 - RNA, 21 nt, Human
ccccauaagcucccacccagg

SEQ ID NO: 492585 - RNA, 21 nt, Human
ccucucaccccacuucccuua

SEQ ID NO: 492586 - RNA, 20 nt, Human
ccuucugccccaccacccug

SEQ ID NO: 492587 - RNA, 23 nt, Human
cgaggcagacaggaucugaauca

SEQ ID NO: 492588 - RNA, 20 nt, Human
cgcgccgccagucgccgccc

SEQ ID NO: 492589 - RNA, 21 nt, Human
cgcgccgccagucgccgcccu

SEQ ID NO: 492590 - RNA, 19 nt, Human
cggaaggaaacgaguugua

SEQ ID NO: 492591 - RNA, 21 nt, Human
cggcaucacuguccuggccaa

SEQ ID NO: 492592 - RNA, 21 nt, Human
cuagggaaaucaaaaguaaaa

SEQ ID NO: 492593 - RNA, 23 nt, Human
cucagaaacucccaaacccucuu

SEQ ID NO: 492594 - RNA, 27 nt, Human
cuggucaccaagcggaagcucucccug

SEQ ID NO: 492595 - RNA, 21 nt, Human
gaaaaacccugauacaaagca

SEQ ID NO: 492596 - RNA, 22 nt, Human
gaauaccugggagaagaaccag

SEQ ID NO: 492597 - RNA, 18 nt, Human
gcaguggccagagaggcc

SEQ ID NO: 492598 - RNA, 19 nt, Human
gcccgccuguccaccugcc

SEQ ID NO: 492599 - RNA, 22 nt, Human
ggaucugaaucaagcuuugcuc

SEQ ID NO: 492600 - RNA, 23 nt, Human
ggggaccugccaaggacccagcg

SEQ ID NO: 492601 - RNA, 20 nt, Human
uaagagaagacuggaagaca

SEQ ID NO: 492602 - RNA, 21 nt, Human
uaaggaaugggagugaaaagg

SEQ ID NO: 492603 - RNA, 20 nt, Human
uacaaaagcgugaaaaaccc

SEQ ID NO: 492604 - RNA, 20 nt, Human
uacaaagcaguggccagaga

SEQ ID NO: 492605 - RNA, 23 nt, Human
uaggagcaggacacuaagagaag

SEQ ID NO: 492606 - RNA, 26 nt, Human
ucacccagcagcucccaccugaaccc

SEQ ID NO: 492607 - RNA, 19 nt, Human
uccauuagacuaaagcuaa

SEQ ID NO: 492608 - RNA, 23 nt, Human
ucccugccucacccagcagcucc

SEQ ID NO: 492609 - RNA, 22 nt, Human
ucccuggucaccaagcggaagc

SEQ ID NO: 492610 - RNA, 20 nt, Human
ucccuuaucucccaccuaua

SEQ ID NO: 492611 - RNA, 22 nt, Human
ucgcggagcuguccuugcccgc

SEQ ID NO: 492612 - RNA, 22 nt, Human
ucuacaaaagcgugaaaaaccc

SEQ ID NO: 492613 - RNA, 18 nt, Human
ugccaaggacccagcgag

SEQ ID NO: 492614 - RNA, 22 nt, Human
ugccagccugccuccccggggc

SEQ ID NO: 492615 - RNA, 18 nt, Human
ugccucacccagcagcuc

SEQ ID NO: 492616 - RNA, 18 nt, Human
ugggaagagaauaccugg

SEQ ID NO: 492617 - RNA, 21 nt, Human
uuaaugcauuccucacagccc

SEQ ID NO: 492618 - RNA, 22 nt, Human
uucccugccucacccagcagcu

SEQ ID NO: 492619 - RNA, 23 nt, Human
uucccugccucacccagcagcuc

SEQ ID NO: 492620 - RNA, 19 nt, Human
uugcccgccuguccaccug

SEQ ID NO: 492621 - RNA, 20 nt, Human
uuuccuuucuccucucaccc

SEQ ID NO: 492622 - RNA, 18 nt, Human
aaaacauaugaugaccuu

SEQ ID NO: 492623 - RNA, 25 nt, Human
aaaagguggaagccuuaaggccaga

SEQ ID NO: 492624 - RNA, 24 nt, Human
aaacaucugaaaguagggagaaga

SEQ ID NO: 492625 - RNA, 18 nt, Human
aacaggagcaauuagaaa

SEQ ID NO: 492626 - RNA, 22 nt, Human
aaucucagagguugcuucuuuc

SEQ ID NO: 492627 - RNA, 19 nt, Human
acaauucugagucugguac

SEQ ID NO: 492628 - RNA, 23 nt, Human
acagcaugucacaauacggcacu

SEQ ID NO: 492629 - RNA, 21 nt, Human
acauucaccaucaugggaaac

SEQ ID NO: 492630 - RNA, 21 nt, Human
accacuggaaucucagagguu

SEQ ID NO: 492631 - RNA, 23 nt, Human
acccacagacagccugacccagg

SEQ ID NO: 492632 - RNA, 22 nt, Human
acugugccucuacucaaaucac

SEQ ID NO: 492633 - RNA, 19 nt, Human
agagacaagugagacucaa

SEQ ID NO: 492634 - RNA, 21 nt, Human
agcaagcaaugaaaaggugga

SEQ ID NO: 492635 - RNA, 19 nt, Human
aggguuucuucucuuuccu

SEQ ID NO: 492636 - RNA, 23 nt, Human
aucaucuuuucuaacaaacuggc

SEQ ID NO: 492637 - RNA, 21 nt, Human
cacaauucugagucugguacu

SEQ ID NO: 492638 - RNA, 22 nt, Human
cagaaaaacaggagcaauuaga

SEQ ID NO: 492639 - RNA, 22 nt, Human
cagaagcuaugaauuccccaag

SEQ ID NO: 492640 - RNA, 21 nt, Human
cagcaagcaaugaaaaggugg

SEQ ID NO: 492641 - RNA, 26 nt, Human
caggccccgcugcccggccgcugcga

SEQ ID NO: 492642 - RNA, 25 nt, Human
cagucccccccagaaaauuaaucac

SEQ ID NO: 492643 - RNA, 21 nt, Human
ccaaccacuucauacccacag

SEQ ID NO: 492644 - RNA, 21 nt, Human
cccacacaccacuggaaucuc

SEQ ID NO: 492645 - RNA, 18 nt, Human
ccccagaaaauuaaucac

SEQ ID NO: 492646 - RNA, 22 nt, Human
cccccacacaccacuggaaucu

SEQ ID NO: 492647 - RNA, 23 nt, Human
ccccccagaaaauuaaucaccaa

SEQ ID NO: 492648 - RNA, 19 nt, Human
cccgcugcccggccgcugc

SEQ ID NO: 492649 - RNA, 18 nt, Human
ccgccgggccccgcgucc

SEQ ID NO: 492650 - RNA, 20 nt, Human
ccgccgggccccgcgucccc

SEQ ID NO: 492651 - RNA, 19 nt, Human
ccgcgccgccgggccccgc

SEQ ID NO: 492652 - RNA, 18 nt, Human
ccgcugcccggccgcugc

SEQ ID NO: 492653 - RNA, 23 nt, Human
ccucggggcgcgucccaggcccc

SEQ ID NO: 492654 - RNA, 20 nt, Human
ccugcgccgccccgcuccuc

SEQ ID NO: 492655 - RNA, 21 nt, Human
ccuugaagugcagccaaagcu

SEQ ID NO: 492656 - RNA, 21 nt, Human
cggccgcugcgaugcggggcc

SEQ ID NO: 492657 - RNA, 22 nt, Human
cgggccccgcgucccagucccc

SEQ ID NO: 492658 - RNA, 20 nt, Human
cgucccaggccccgcugccc

SEQ ID NO: 492659 - RNA, 22 nt, Human
cuagagccuugaagugcagcca

SEQ ID NO: 492660 - RNA, 22 nt, Human
cugcugaacugagucaguucgu

SEQ ID NO: 492661 - RNA, 19 nt, Human
cuggacauuaacgaaaaag

SEQ ID NO: 492662 - RNA, 25 nt, Human
cuuuccuuucucuuuguuuagucuu

SEQ ID NO: 492663 - RNA, 21 nt, Human
gaaucgccaagucaaaacuuu

SEQ ID NO: 492664 - RNA, 26 nt, Human
gaaucgccaagucaaaacuuucuaac

SEQ ID NO: 492665 - RNA, 18 nt, Human
gaaucucagagguugcuu

SEQ ID NO: 492666 - RNA, 21 nt, Human
gaucuugcccccacacaccac

SEQ ID NO: 492667 - RNA, 20 nt, Human
gcagccaaagcucacaaguc

SEQ ID NO: 492668 - RNA, 23 nt, Human
gguugcuucuuucuccuuuccau

SEQ ID NO: 492669 - RNA, 19 nt, Human
gucaaaacuuucuaacuuc

SEQ ID NO: 492670 - RNA, 24 nt, Human
guugcuucuuucuccuuuccaucu

SEQ ID NO: 492671 - RNA, 23 nt, Human
uaaaacuacugaagcacacuuua

SEQ ID NO: 492672 - RNA, 23 nt, Human
uaaagcaaauugugugaaaauac

SEQ ID NO: 492673 - RNA, 20 nt, Human
uaacucuuguuguucacucu

SEQ ID NO: 492674 - RNA, 18 nt, Human
uaaggccagaagcuauga

SEQ ID NO: 492675 - RNA, 21 nt, Human
uacccagaaaaacaggagcaa

SEQ ID NO: 492676 - RNA, 22 nt, Human
uacuuucuggaguagccaauac

SEQ ID NO: 492677 - RNA, 22 nt, Human
uauccaguuaccaagguauuca

SEQ ID NO: 492678 - RNA, 23 nt, Human
ucaccaaaaauaauccucgugcc

SEQ ID NO: 492679 - RNA, 19 nt, Human
ucccaaccacuucauaccc

SEQ ID NO: 492680 - RNA, 23 nt, Human
ucccccccagaaaauuaaucacc

SEQ ID NO: 492681 - RNA, 20 nt, Human
uccuuucucuuuguuuaguc

SEQ ID NO: 492682 - RNA, 22 nt, Human
ucgccaagucaaaacuuucuaa

SEQ ID NO: 492683 - RNA, 18 nt, Human
ucggggcgcgucccaggc

SEQ ID NO: 492684 - RNA, 21 nt, Human
ucucucagagacaagugagac

SEQ ID NO: 492685 - RNA, 21 nt, Human
ucugguacugguggucugcug

SEQ ID NO: 492686 - RNA, 20 nt, Human
ucuucucuuuccuuucucuu

SEQ ID NO: 492687 - RNA, 19 nt, Human
ucuuucuccuuuccaucuu

SEQ ID NO: 492688 - RNA, 25 nt, Human
ugaaaagguggaagccuuaaggcca

SEQ ID NO: 492689 - RNA, 18 nt, Human
ugaaaguagggagaagaa

SEQ ID NO: 492690 - RNA, 22 nt, Human
ugaaguuagagaugggauacag

SEQ ID NO: 492691 - RNA, 22 nt, Human
ugcagccaaagcucacaagucc

SEQ ID NO: 492692 - RNA, 26 nt, Human
uggaagagagcacccaguguugggcu

SEQ ID NO: 492693 - RNA, 25 nt, Human
uuagagaauacuuucaauguucucu

SEQ ID NO: 492694 - RNA, 24 nt, Human
uucaaaaugcuccucuaucacaau

SEQ ID NO: 492695 - RNA, 21 nt, Human
uucaguuuccaucagaucuug

SEQ ID NO: 492696 - RNA, 22 nt, Human
uucucccaaccacuucauaccc

SEQ ID NO: 492697 - RNA, 18 nt, Human
uuggaacauaugaugaag

SEQ ID NO: 492698 - RNA, 24 nt, Human
uuuguuuagucuucguucucuuuu

SEQ ID NO: 492699 - RNA, 20 nt, Human
uuuuuuuuuuuuuuuuuugg

SEQ ID NO: 492700 - RNA, 21 nt, Human
uuuuuuuuuuuuuuuuuuguc

SEQ ID NO: 492701 - RNA, 18 nt, Human
acaaaccggaaaaccaug

SEQ ID NO: 492702 - RNA, 19 nt, Human
aguuacuagaaaacgacaa

SEQ ID NO: 492703 - RNA, 24 nt, Human
auuuggaguaauggaauuugaagu

SEQ ID NO: 492704 - RNA, 19 nt, Human
ccucugccgccacucgugc

SEQ ID NO: 492705 - RNA, 21 nt, Human
gccucugccgccacucgugcc

SEQ ID NO: 492706 - RNA, 22 nt, Human
uagaaagacauuaaaugucaga

SEQ ID NO: 492707 - RNA, 20 nt, Human
ucaguggagaacgccggauc

SEQ ID NO: 492708 - RNA, 24 nt, Human
uugauacagaaugacaaggcuuau

SEQ ID NO: 492709 - RNA, 20 nt, Human
aaagaggaaccacgaaggug

SEQ ID NO: 492710 - RNA, 22 nt, Human
aaccccagcacguggccaguau

SEQ ID NO: 492711 - RNA, 22 nt, Human
aagguucuuguauucucacugc

SEQ ID NO: 492712 - RNA, 20 nt, Human
acaaggccagggaugguggg

SEQ ID NO: 492713 - RNA, 18 nt, Human
acacgaugaaauccaccc

SEQ ID NO: 492714 - RNA, 20 nt, Human
accuagugcucccagacuca

SEQ ID NO: 492715 - RNA, 24 nt, Human
acucugaguuccugagccccacaa

SEQ ID NO: 492716 - RNA, 21 nt, Human
agacccgagggguggccuggu

SEQ ID NO: 492717 - RNA, 18 nt, Human
agcaggaaggacaagucc

SEQ ID NO: 492718 - RNA, 19 nt, Human
aggaaggaagggcaggcug

SEQ ID NO: 492719 - RNA, 23 nt, Human
aggaggguguggaggcaagaagc

SEQ ID NO: 492720 - RNA, 26 nt, Human
aggcaagaagcaggaaggagggaccc

SEQ ID NO: 492721 - RNA, 23 nt, Human
aggcagugugagagaaauccagg

SEQ ID NO: 492722 - RNA, 19 nt, Human
aggccagggauggugggga

SEQ ID NO: 492723 - RNA, 22 nt, Human
auucaagacagaauuacucuga

SEQ ID NO: 492724 - RNA, 21 nt, Human
caaagugggagugaaugucag

SEQ ID NO: 492725 - RNA, 19 nt, Human
caagaagcaggaaggacaa

SEQ ID NO: 492726 - RNA, 21 nt, Human
cacccucaaagagcaguucca

SEQ ID NO: 492727 - RNA, 25 nt, Human
cagagcucggccucucagagaccgc

SEQ ID NO: 492728 - RNA, 18 nt, Human
ccagcccagcuguagcuc

SEQ ID NO: 492729 - RNA, 21 nt, Human
ccaggcaaucacuguguccac

SEQ ID NO: 492730 - RNA, 22 nt, Human
cccugcaccuccagccauucac

SEQ ID NO: 492731 - RNA, 26 nt, Human
ccuccuggcccugcaccuccagccau

SEQ ID NO: 492732 - RNA, 19 nt, Human
ccucgccuccuccuggccc

SEQ ID NO: 492733 - RNA, 21 nt, Human
ccuggcccugcaccuccagcc

SEQ ID NO: 492734 - RNA, 22 nt, Human
cucagagaccgcugcaggcccu

SEQ ID NO: 492735 - RNA, 25 nt, Human
cuccuggcccugcaccuccagccau

SEQ ID NO: 492736 - RNA, 21 nt, Human
cugaagcacaagacccgaggg

SEQ ID NO: 492737 - RNA, 23 nt, Human
cugcaggcccugccucgccuccu

SEQ ID NO: 492738 - RNA, 24 nt, Human
cugcccaacuggauggaaaauaaa

SEQ ID NO: 492739 - RNA, 23 nt, Human
cugguucugaacagagaccagag

SEQ ID NO: 492740 - RNA, 21 nt, Human
cuguagcucugggccuggaac

SEQ ID NO: 492741 - RNA, 24 nt, Human
cugugugcgcauuccaucaggaag

SEQ ID NO: 492742 - RNA, 20 nt, Human
gacccgagggguggccuggu

SEQ ID NO: 492743 - RNA, 18 nt, Human
gcaaagaggaaccacgaa

SEQ ID NO: 492744 - RNA, 22 nt, Human
gcagagaacagcauugacuuca

SEQ ID NO: 492745 - RNA, 19 nt, Human
gcccugccucgccuccucc

SEQ ID NO: 492746 - RNA, 20 nt, Human
gcccugccucgccuccuccu

SEQ ID NO: 492747 - RNA, 24 nt, Human
gcugaagcacaagacccgaggggu

SEQ ID NO: 492748 - RNA, 20 nt, Human
ggaagucccaggcaaucacu

SEQ ID NO: 492749 - RNA, 21 nt, Human
ggcccaccuagccuuucccug

SEQ ID NO: 492750 - RNA, 18 nt, Human
ggcuguuggacgcggugg

SEQ ID NO: 492751 - RNA, 26 nt, Human
gguguggaggcaagaagcaggaagga

SEQ ID NO: 492752 - RNA, 18 nt, Human
uagucuugagcccagccu

SEQ ID NO: 492753 - RNA, 22 nt, Human
ucaagacagaauuacucugaga

SEQ ID NO: 492754 - RNA, 21 nt, Human
uccaacuucaacaucugugac

SEQ ID NO: 492755 - RNA, 18 nt, Human
uccaguuuguggaagucc

SEQ ID NO: 492756 - RNA, 24 nt, Human
ucccagcccagcuguagcucuggg

SEQ ID NO: 492757 - RNA, 23 nt, Human
ucccaggcaaucacuguguccac

SEQ ID NO: 492758 - RNA, 27 nt, Human
ucuccugcaaagaggaaccacgaaggu

SEQ ID NO: 492759 - RNA, 27 nt, Human
ucuccuggcuaauaauaaauauccagg

SEQ ID NO: 492760 - RNA, 28 nt, Human
ucuuacagugcacacacaugcucccagc

SEQ ID NO: 492761 - RNA, 25 nt, Human
ugaauaggcagugugagagaaaucc

SEQ ID NO: 492762 - RNA, 18 nt, Human
ugagagaaauccaggaug

SEQ ID NO: 492763 - RNA, 24 nt, Human
ugagagaaauccaggauggcugcu

SEQ ID NO: 492764 - RNA, 20 nt, Human
ugagggaaaaggaagcacag

SEQ ID NO: 492765 - RNA, 19 nt, Human
ugaucaaagcaguccacgg

SEQ ID NO: 492766 - RNA, 19 nt, Human
ugcaaagaggaaccacgaa

SEQ ID NO: 492767 - RNA, 22 nt, Human
ugcaaagaggaaccacgaaggu

SEQ ID NO: 492768 - RNA, 22 nt, Human
ugcacacacaugcucccagccc

SEQ ID NO: 492769 - RNA, 23 nt, Human
uggaaaauaaaagguucuuguau

SEQ ID NO: 492770 - RNA, 18 nt, Human
uggaggaaggaagggcag

SEQ ID NO: 492771 - RNA, 21 nt, Human
ugugagagaaauccaggaugg

SEQ ID NO: 492772 - RNA, 18 nt, Human
uucaacaucugugaccuc

SEQ ID NO: 492773 - RNA, 24 nt, Human
uucaagacagaauuacucugagaa

SEQ ID NO: 492774 - RNA, 24 nt, Human
uuccagggcugcuuucuccuggcu

SEQ ID NO: 492775 - RNA, 21 nt, Human
agaaagaccugauaccuacug

SEQ ID NO: 492776 - RNA, 24 nt, Human
agcuccgugggcgcuccugcucgu

SEQ ID NO: 492777 - RNA, 18 nt, Human
cacugagacuucuguggg

SEQ ID NO: 492778 - RNA, 21 nt, Human
cauagaaagaccugauaccua

SEQ ID NO: 492779 - RNA, 22 nt, Human
ccagcguacauuuccccugccc

SEQ ID NO: 492780 - RNA, 24 nt, Human
cuuauguucuggcacugagacuuc

SEQ ID NO: 492781 - RNA, 19 nt, Human
gacuucuguggguaccugu

SEQ ID NO: 492782 - RNA, 18 nt, Human
uacugggaccagacaggg

SEQ ID NO: 492783 - RNA, 19 nt, Human
ugagcugcauagaaagacc

SEQ ID NO: 492784 - RNA, 22 nt, Human
uggcacugagacuucugugggu

SEQ ID NO: 492785 - RNA, 22 nt, Human
ugggaccagacagggggcacag

SEQ ID NO: 492786 - RNA, 18 nt, Human
uuuauugguaaucugccc

SEQ ID NO: 492787 - RNA, 24 nt, Human
augaaguuaaaauauaauuuucau

SEQ ID NO: 492788 - RNA, 18 nt, Human
aaagugcugggauuacaa

SEQ ID NO: 492789 - RNA, 24 nt, Human
aaagugcugggauuacaagcauga

SEQ ID NO: 492790 - RNA, 23 nt, Human
aacaauccucucaacguccagga

SEQ ID NO: 492791 - RNA, 24 nt, Human
aaccagacuuccaacagugcucug

SEQ ID NO: 492792 - RNA, 18 nt, Human
aaggguccaccuuccagc

SEQ ID NO: 492793 - RNA, 19 nt, Human
aagugcugggauuacaagc

SEQ ID NO: 492794 - RNA, 21 nt, Human
aagugcugggauuacaagcau

SEQ ID NO: 492795 - RNA, 18 nt, Human
acaagcaugagucaccgu

SEQ ID NO: 492796 - RNA, 18 nt, Human
acaagcauuuuccccgcu

SEQ ID NO: 492797 - RNA, 22 nt, Human
acaccggaaccgcucauugcca

SEQ ID NO: 492798 - RNA, 19 nt, Human
agagaaaaggggcucuaga

SEQ ID NO: 492799 - RNA, 20 nt, Human
agagaccuccccacaacugg

SEQ ID NO: 492800 - RNA, 22 nt, Human
agccccugccagcagagaaaag

SEQ ID NO: 492801 - RNA, 24 nt, Human
aggaaagugggguggucagaaagg

SEQ ID NO: 492802 - RNA, 18 nt, Human
agggaagcagaugaaacu

SEQ ID NO: 492803 - RNA, 18 nt, Human
aggucuuugcggaugucc

SEQ ID NO: 492804 - RNA, 24 nt, Human
agugcugggauuacaagcaugagu

SEQ ID NO: 492805 - RNA, 19 nt, Human
aguucccagggaagcagau

SEQ ID NO: 492806 - RNA, 21 nt, Human
aucuccuucugcauccugucg

SEQ ID NO: 492807 - RNA, 19 nt, Human
augccgcaagauuccauac

SEQ ID NO: 492808 - RNA, 20 nt, Human
augggguuuuuccauguugg

SEQ ID NO: 492809 - RNA, 24 nt, Human
caaacaauuugacuguugugcaaa

SEQ ID NO: 492810 - RNA, 24 nt, Human
caaagugcugggauuacaagcaug

SEQ ID NO: 492811 - RNA, 24 nt, Human
caacacuguuucugcugccacugu

SEQ ID NO: 492812 - RNA, 19 nt, Human
caccaacagcgccaagggu

SEQ ID NO: 492813 - RNA, 22 nt, Human
caccggaaccgcucauugccaa

SEQ ID NO: 492814 - RNA, 20 nt, Human
caccguguuggcguacaggu

SEQ ID NO: 492815 - RNA, 23 nt, Human
caccguguuggcguacaggucuu

SEQ ID NO: 492816 - RNA, 22 nt, Human
cacuucaugauggaguugaagg

SEQ ID NO: 492817 - RNA, 23 nt, Human
caggugauccgccugccuugccc

SEQ ID NO: 492818 - RNA, 19 nt, Human
ccaaagugcugggauuaca

SEQ ID NO: 492819 - RNA, 24 nt, Human
ccaaagugcugggauuacaagcau

SEQ ID NO: 492820 - RNA, 18 nt, Human
ccaacagugcucugggcc

SEQ ID NO: 492821 - RNA, 24 nt, Human
ccaaggguccaccuuccagcagau

SEQ ID NO: 492822 - RNA, 22 nt, Human
ccaauggugaugaccuggccuu

SEQ ID NO: 492823 - RNA, 24 nt, Human
ccaccaacagcgccaaggguccac

SEQ ID NO: 492824 - RNA, 18 nt, Human
ccagcagagaaaaggggc

SEQ ID NO: 492825 - RNA, 20 nt, Human
ccagggcggugaucuccuuc

SEQ ID NO: 492826 - RNA, 19 nt, Human
ccauguuggugaggcuggu

SEQ ID NO: 492827 - RNA, 21 nt, Human
cccugccagcagagaaaaggg

SEQ ID NO: 492828 - RNA, 21 nt, Human
cccugggcugcugucucaggg

SEQ ID NO: 492829 - RNA, 22 nt, Human
ccgccgccaccaacagcgccaa

SEQ ID NO: 492830 - RNA, 22 nt, Human
ccgccucgucgccccuagcugc

SEQ ID NO: 492831 - RNA, 24 nt, Human
ccuccccacaacuggggcaaaggc

SEQ ID NO: 492832 - RNA, 22 nt, Human
ccuccggacaccggaaccgcuc

SEQ ID NO: 492833 - RNA, 19 nt, Human
ccucgucgccccuagcugc

SEQ ID NO: 492834 - RNA, 20 nt, Human
ccucgucgccccuagcugcc

SEQ ID NO: 492835 - RNA, 18 nt, Human
ccugaccucaggugaucc

SEQ ID NO: 492836 - RNA, 21 nt, Human
ccugaccucaggugauccgcc

SEQ ID NO: 492837 - RNA, 23 nt, Human
ccugaccucaggugauccgccug

SEQ ID NO: 492838 - RNA, 20 nt, Human
ccugcugggaugaggauaaa

SEQ ID NO: 492839 - RNA, 18 nt, Human
ccuggucugaauaugaag

SEQ ID NO: 492840 - RNA, 23 nt, Human
cgccagggcggugaucuccuucu

SEQ ID NO: 492841 - RNA, 23 nt, Human
cgccucgucgccccuagcugcca

SEQ ID NO: 492842 - RNA, 23 nt, Human
cucacacuucacagcugucuccg

SEQ ID NO: 492843 - RNA, 26 nt, Human
cuccugaccucaggugauccgccugc

SEQ ID NO: 492844 - RNA, 20 nt, Human
cucguggaugccgcaagauu

SEQ ID NO: 492845 - RNA, 21 nt, Human
cucugcccugacaaccucagc

SEQ ID NO: 492846 - RNA, 23 nt, Human
cugccagcagacaaagaaccuca

SEQ ID NO: 492847 - RNA, 22 nt, Human
cugcccugacaaccucagccug

SEQ ID NO: 492848 - RNA, 24 nt, Human
cugccuugcccucccaaagugcug

SEQ ID NO: 492849 - RNA, 21 nt, Human
cuggggcaaaggccguggagg

SEQ ID NO: 492850 - RNA, 22 nt, Human
cuucacagcugucuccgccgcc

SEQ ID NO: 492851 - RNA, 18 nt, Human
cuuccaacagugcucugg

SEQ ID NO: 492852 - RNA, 19 nt, Human
gaagcaccugcccugggcc

SEQ ID NO: 492853 - RNA, 18 nt, Human
gacacaagcauuuucccc

SEQ ID NO: 492854 - RNA, 23 nt, Human
gacagcaccguguuggcguacag

SEQ ID NO: 492855 - RNA, 23 nt, Human
gaccucaggugauccgccugccu

SEQ ID NO: 492856 - RNA, 24 nt, Human
gagaugggguuuuuccauguuggu

SEQ ID NO: 492857 - RNA, 18 nt, Human
gauuacaagcaugaguca

SEQ ID NO: 492858 - RNA, 24 nt, Human
gauuacaagcaugagucaccgugc

SEQ ID NO: 492859 - RNA, 18 nt, Human
gcacagagaccuccccac

SEQ ID NO: 492860 - RNA, 22 nt, Human
gcgacacaagcauuuuccccgc

SEQ ID NO: 492861 - RNA, 23 nt, Human
gcgccagggcggugaucuccuuc

SEQ ID NO: 492862 - RNA, 23 nt, Human
gcuggucucaaacuccugaccuc

SEQ ID NO: 492863 - RNA, 24 nt, Human
ggauuacaagcaugagucaccgug

SEQ ID NO: 492864 - RNA, 19 nt, Human
ggcugcugucucagggcag

SEQ ID NO: 492865 - RNA, 24 nt, Human
ggcuggucucaaacuccugaccuc

SEQ ID NO: 492866 - RNA, 18 nt, Human
gggcaaaggccguggagg

SEQ ID NO: 492867 - RNA, 21 nt, Human
ggggacucuaaccagacuucc

SEQ ID NO: 492868 - RNA, 18 nt, Human
gggguuuuuccauguugg

SEQ ID NO: 492869 - RNA, 18 nt, Human
gggguuuuuccauguugg

SEQ ID NO: 492870 - RNA, 22 nt, Human
guggucucguggaugccgcaag

SEQ ID NO: 492871 - RNA, 24 nt, Human
uaguagagaugggguuuuuccaug

SEQ ID NO: 492872 - RNA, 21 nt, Human
uaucucuguuguucucgagga

SEQ ID NO: 492873 - RNA, 21 nt, Human
ucaccauguuucuucucccca

SEQ ID NO: 492874 - RNA, 22 nt, Human
ucacuaagccuggagugccugu

SEQ ID NO: 492875 - RNA, 24 nt, Human
uccaacagugcucugggccccuua

SEQ ID NO: 492876 - RNA, 21 nt, Human
uccauacccaggaaggaaggc

SEQ ID NO: 492877 - RNA, 18 nt, Human
ucccaaagugcugggauu

SEQ ID NO: 492878 - RNA, 24 nt, Human
ucccaaagugcugggauuacaagc

SEQ ID NO: 492879 - RNA, 24 nt, Human
uccccacaacuggggcaaaggccg

SEQ ID NO: 492880 - RNA, 22 nt, Human
uccgccgccaccaacagcgcca

SEQ ID NO: 492881 - RNA, 22 nt, Human
ucugaauaugaagcaccugccc

SEQ ID NO: 492882 - RNA, 18 nt, Human
ugaagcaccugcccuggg

SEQ ID NO: 492883 - RNA, 20 nt, Human
ugaauaugaagcaccugccc

SEQ ID NO: 492884 - RNA, 18 nt, Human
ugaccucaggugauccgc

SEQ ID NO: 492885 - RNA, 24 nt, Human
ugaccucaggugauccgccugccu

SEQ ID NO: 492886 - RNA, 24 nt, Human
ugccuugcccucccaaagugcugg

SEQ ID NO: 492887 - RNA, 24 nt, Human
ugcugggauuacaagcaugaguca

SEQ ID NO: 492888 - RNA, 24 nt, Human
uggaacagcgccuccggacaccgg

SEQ ID NO: 492889 - RNA, 20 nt, Human
uggccaggccgguucuuuuu

SEQ ID NO: 492890 - RNA, 19 nt, Human
uggcccaccaaaggcgaca

SEQ ID NO: 492891 - RNA, 21 nt, Human
ugggauuacaagcaugaguca

SEQ ID NO: 492892 - RNA, 22 nt, Human
ugggauuacaagcaugagucac

SEQ ID NO: 492893 - RNA, 23 nt, Human
ugggauuacaagcaugagucacc

SEQ ID NO: 492894 - RNA, 24 nt, Human
ugggauuacaagcaugagucaccg

SEQ ID NO: 492895 - RNA, 23 nt, Human
ugggccccuuaguaaguucccag

SEQ ID NO: 492896 - RNA, 19 nt, Human
ugggguuuuuccauguugg

SEQ ID NO: 492897 - RNA, 20 nt, Human
ugguaaacaaagccccugcc

SEQ ID NO: 492898 - RNA, 22 nt, Human
ugguaaacaaagccccugccag

SEQ ID NO: 492899 - RNA, 24 nt, Human
uggugaggcuggucucaaacuccu

SEQ ID NO: 492900 - RNA, 21 nt, Human
uggugcugggcgccagggcgg

SEQ ID NO: 492901 - RNA, 22 nt, Human
uguccccaccuucagcucucug

SEQ ID NO: 492902 - RNA, 21 nt, Human
uguuucugcugccacugucac

SEQ ID NO: 492903 - RNA, 18 nt, Human
uuagccuaaacagugagc

SEQ ID NO: 492904 - RNA, 21 nt, Human
uuagccuaaacagugagcugg

SEQ ID NO: 492905 - RNA, 18 nt, Human
uuaguagagaugggguuu

SEQ ID NO: 492906 - RNA, 18 nt, Human
uuaguagagaugggguuu

SEQ ID NO: 492907 - RNA, 24 nt, Human
uuaguagagaugggguuuuuccau

SEQ ID NO: 492908 - RNA, 23 nt, Human
uuaucucuguuguucucgaggaa

SEQ ID NO: 492909 - RNA, 24 nt, Human
uuccauguuggugaggcuggucuc

SEQ ID NO: 492910 - RNA, 22 nt, Human
uucugcugccacugucacuaag

SEQ ID NO: 492911 - RNA, 26 nt, Human
uugaagguggucucguggaugccgca

SEQ ID NO: 492912 - RNA, 22 nt, Human
uugugauguacccaacuaacca

SEQ ID NO: 492913 - RNA, 20 nt, Human
uuucugcugccacugucacu

SEQ ID NO: 492914 - RNA, 27 nt, Human
uuucuuaucucuguuguucucgaggaa

SEQ ID NO: 492915 - RNA, 21 nt, Human
uuuuuaguagagaugggguuu

SEQ ID NO: 492916 - RNA, 22 nt, Human
uuuuuuaguagagaugggguuu

SEQ ID NO: 492917 - RNA, 24 nt, Human
uuuuuuuuuuuuuuaguagagaug

SEQ ID NO: 492918 - RNA, 23 nt, Human
uuuuuuuuuuuuuuuuaguagag

SEQ ID NO: 492919 - RNA, 18 nt, Human
ccgcagcuuccccaauag

SEQ ID NO: 492920 - RNA, 18 nt, Human
gugaagcaggacaaagug

SEQ ID NO: 492921 - RNA, 22 nt, Human
uauauagaacucugcacacuuu

SEQ ID NO: 492922 - RNA, 19 nt, Human
ucaaaggaacuaauccagc

SEQ ID NO: 492923 - RNA, 20 nt, Human
ucaaaggaacuaauccagca

SEQ ID NO: 492924 - RNA, 18 nt, Human
ugaagcaggacaaagugc

SEQ ID NO: 492925 - RNA, 20 nt, Human
uggggagguccgugaagcag

SEQ ID NO: 492926 - RNA, 23 nt, Human
acucuaaaauucgacagaguaaa

SEQ ID NO: 492927 - RNA, 22 nt, Human
agaggauuuacuauguuaaaac

SEQ ID NO: 492928 - RNA, 19 nt, Human
caccuccagcuuuaccguc

SEQ ID NO: 492929 - RNA, 22 nt, Human
ccuccaugaagugugugcacuu

SEQ ID NO: 492930 - RNA, 24 nt, Human
cgggagccugguaggcuucgagca

SEQ ID NO: 492931 - RNA, 23 nt, Human
cucaaauuacuuucucaucuucc

SEQ ID NO: 492932 - RNA, 28 nt, Human
cucaaauuacuuucucaucuuccuaauu

SEQ ID NO: 492933 - RNA, 21 nt, Human
gaaaaggagucccuccaugaa

SEQ ID NO: 492934 - RNA, 22 nt, Human
uacagugugucccgcuccaugg

SEQ ID NO: 492935 - RNA, 18 nt, Human
ucucaaauuacuuucuca

SEQ ID NO: 492936 - RNA, 20 nt, Human
uggauacugaauacaacagc

SEQ ID NO: 492937 - RNA, 22 nt, Human
uguuaaaacguucaugucccaa

SEQ ID NO: 492938 - RNA, 20 nt, Human
uuucuggagaaaaaucagua

SEQ ID NO: 492939 - RNA, 18 nt, Human
aaaaacuaucuccaugcc

SEQ ID NO: 492940 - RNA, 21 nt, Human
aaaaacuaucuccaugccccc

SEQ ID NO: 492941 - RNA, 25 nt, Human
aaacaccacacauauacagcaaaac

SEQ ID NO: 492942 - RNA, 22 nt, Human
aaacacuacaguauguaaaaac

SEQ ID NO: 492943 - RNA, 21 nt, Human
aacuacaaccaucuuucccag

SEQ ID NO: 492944 - RNA, 22 nt, Human
aacucaguugaaccgaagcuaa

SEQ ID NO: 492945 - RNA, 18 nt, Human
acaacacaauacaacaca

SEQ ID NO: 492946 - RNA, 24 nt, Human
acccucuuuaggacaauauuacug

SEQ ID NO: 492947 - RNA, 21 nt, Human
agccacacacacaaaaaaucu

SEQ ID NO: 492948 - RNA, 18 nt, Human
auauucuaaagaaagaga

SEQ ID NO: 492949 - RNA, 21 nt, Human
caaaacgaaacucaguugaac

SEQ ID NO: 492950 - RNA, 27 nt, Human
caaacaccacacauauacagcaaaaca

SEQ ID NO: 492951 - RNA, 21 nt, Human
caaagaguagucuaaagagca

SEQ ID NO: 492952 - RNA, 19 nt, Human
caacagagaagacugucca

SEQ ID NO: 492953 - RNA, 22 nt, Human
cacaacacaauacaacacaaga

SEQ ID NO: 492954 - RNA, 19 nt, Human
cacauauacagcaaaacac

SEQ ID NO: 492955 - RNA, 18 nt, Human
cacauucaaaagugaggc

SEQ ID NO: 492956 - RNA, 26 nt, Human
caccaagaauguauauaguaagccaa

SEQ ID NO: 492957 - RNA, 22 nt, Human
caugcauguuaaugagcagguu

SEQ ID NO: 492958 - RNA, 21 nt, Human
ccaugcccccaucucuccguu

SEQ ID NO: 492959 - RNA, 21 nt, Human
cccaagaaaccuacagaaaua

SEQ ID NO: 492960 - RNA, 18 nt, Human
cuucccuguucccugucc

SEQ ID NO: 492961 - RNA, 24 nt, Human
ggccauauggagguuuccauggaa

SEQ ID NO: 492962 - RNA, 21 nt, Human
gggaaguccucauuugcaacc

SEQ ID NO: 492963 - RNA, 24 nt, Human
guaaaaaccuaacacagcacaaca

SEQ ID NO: 492964 - RNA, 24 nt, Human
uaaaaaccuaacacagcacaaagu

SEQ ID NO: 492965 - RNA, 20 nt, Human
uaaagacaacuacaaccauc

SEQ ID NO: 492966 - RNA, 22 nt, Human
uauauagaaaggccauauggag

SEQ ID NO: 492967 - RNA, 25 nt, Human
uaucuuguaaacaaaauaguaaggu

SEQ ID NO: 492968 - RNA, 22 nt, Human
uccauuuggggagggaaguccu

SEQ ID NO: 492969 - RNA, 18 nt, Human
ucccaaguaccaguuucu

SEQ ID NO: 492970 - RNA, 18 nt, Human
uccuccaguacguaaaaa

SEQ ID NO: 492971 - RNA, 22 nt, Human
ucuccaugcccccaucucuccg

SEQ ID NO: 492972 - RNA, 21 nt, Human
ucugugaucaacagagaagac

SEQ ID NO: 492973 - RNA, 19 nt, Human
ugaaagcaaaauuaaaauc

SEQ ID NO: 492974 - RNA, 18 nt, Human
ugcauuuggaaaauggca

SEQ ID NO: 492975 - RNA, 24 nt, Human
ugcccccaucucuccguuugauuu

SEQ ID NO: 492976 - RNA, 23 nt, Human
ugucauguucuuaagcacauaau

SEQ ID NO: 492977 - RNA, 20 nt, Human
uugcuggcuggcagguuugc

SEQ ID NO: 492978 - RNA, 21 nt, Human
uuuaugaugugagagggucug

SEQ ID NO: 492979 - RNA, 21 nt, Human
uuuauggucauguucugcuuu

SEQ ID NO: 492980 - RNA, 18 nt, Human
uuuuaaaugucaguccca

SEQ ID NO: 492981 - RNA, 19 nt, Human
uuuuaaaugucagucccaa

SEQ ID NO: 492982 - RNA, 19 nt, Human
uuuuauggucauguucugc

SEQ ID NO: 492983 - RNA, 21 nt, Human
aaauggcccacagggaaaggc

SEQ ID NO: 492984 - RNA, 18 nt, Human
accuggcucacugcaugc

SEQ ID NO: 492985 - RNA, 22 nt, Human
agccacugaguaggguaccacc

SEQ ID NO: 492986 - RNA, 19 nt, Human
agcuggauucacugcccag

SEQ ID NO: 492987 - RNA, 18 nt, Human
agcugggcuccagcggag

SEQ ID NO: 492988 - RNA, 18 nt, Human
agggggcuucccugguca

SEQ ID NO: 492989 - RNA, 28 nt, Human
caccuggcucacugcaugcacgugugcg

SEQ ID NO: 492990 - RNA, 21 nt, Human
cagaagugacaggauacggug

SEQ ID NO: 492991 - RNA, 18 nt, Human
caggagccugggagcaag

SEQ ID NO: 492992 - RNA, 19 nt, Human
caggagccugggagcaagg

SEQ ID NO: 492993 - RNA, 22 nt, Human
caggagccugggagcaagggcu

SEQ ID NO: 492994 - RNA, 18 nt, Human
caggcaggagccugggag

SEQ ID NO: 492995 - RNA, 18 nt, Human
cagggggcuucccugguc

SEQ ID NO: 492996 - RNA, 20 nt, Human
ccaaauggcccacagggaaa

SEQ ID NO: 492997 - RNA, 22 nt, Human
ccacagggaaaggcuggggaaa

SEQ ID NO: 492998 - RNA, 21 nt, Human
cccucuuggcuuaucaggggg

SEQ ID NO: 492999 - RNA, 21 nt, Human
ccggccccugccccgcggcac

SEQ ID NO: 493000 - RNA, 19 nt, Human
ccggcggcgccggcgcccc

SEQ ID NO: 493001 - RNA, 18 nt, Human
ccugggagcaagggcugu

SEQ ID NO: 493002 - RNA, 25 nt, Human
cgcggcccggccccugccccgcggc

SEQ ID NO: 493003 - RNA, 18 nt, Human
cggccgagagcccgacag

SEQ ID NO: 493004 - RNA, 21 nt, Human
cggcgccccgcgcgcucucug

SEQ ID NO: 493005 - RNA, 24 nt, Human
cggcggcccgugcuccgccagcgc

SEQ ID NO: 493006 - RNA, 18 nt, Human
cgggaggagcggguggcc

SEQ ID NO: 493007 - RNA, 22 nt, Human
cucccucacauccagaagugac

SEQ ID NO: 493008 - RNA, 23 nt, Human
gaguaggguaccaccuggguccu

SEQ ID NO: 493009 - RNA, 19 nt, Human
gcccacagggaaaggcugg

SEQ ID NO: 493010 - RNA, 19 nt, Human
gcggcgccggcgccccgcg

SEQ ID NO: 493011 - RNA, 18 nt, Human
ggaaaggcuggggaaaag

SEQ ID NO: 493012 - RNA, 21 nt, Human
ggaauggggacgcagcaguuc

SEQ ID NO: 493013 - RNA, 23 nt, Human
ggagccugggagcaagggcugug

SEQ ID NO: 493014 - RNA, 23 nt, Human
ggcccucuuggcuuaucaggggg

SEQ ID NO: 493015 - RNA, 22 nt, Human
ggcucacugcaugcacgugugc

SEQ ID NO: 493016 - RNA, 19 nt, Human
gugcagcugaugcaccugg

SEQ ID NO: 493017 - RNA, 26 nt, Human
uaaccauccuccccuucugucccucc

SEQ ID NO: 493018 - RNA, 22 nt, Human
ucccuccaggaggcagggagga

SEQ ID NO: 493019 - RNA, 22 nt, Human
ucccuggucauccuccagcagc

SEQ ID NO: 493020 - RNA, 20 nt, Human
ucucugcguccggaaugggg

SEQ ID NO: 493021 - RNA, 22 nt, Human
ucugugaccggggcuggccuac

SEQ ID NO: 493022 - RNA, 21 nt, Human
ugaccggggcuggccuacaca

SEQ ID NO: 493023 - RNA, 18 nt, Human
ugaguaggguaccaccug

SEQ ID NO: 493024 - RNA, 19 nt, Human
ugauuguccggggcgacuc

SEQ ID NO: 493025 - RNA, 18 nt, Human
ugcaugcacgugugcgcg

SEQ ID NO: 493026 - RNA, 19 nt, Human
uggauucacugcccaguac

SEQ ID NO: 493027 - RNA, 21 nt, Human
ugggagcaagggcugugcugg

SEQ ID NO: 493028 - RNA, 20 nt, Human
uucacugcccaguacuuguc

SEQ ID NO: 493029 - RNA, 22 nt, Human
uuuaaccggcggcgccggcgcc

SEQ ID NO: 493030 - RNA, 26 nt, Human
aaacaaugaaauccacaagaaauuac

SEQ ID NO: 493031 - RNA, 18 nt, Human
aaaggaaaacgagccugg

SEQ ID NO: 493032 - RNA, 23 nt, Human
acagcaaauggcuacauuccaga

SEQ ID NO: 493033 - RNA, 19 nt, Human
acagccggcaccgcuggcc

SEQ ID NO: 493034 - RNA, 18 nt, Human
agaaucuuguuucccaga

SEQ ID NO: 493035 - RNA, 22 nt, Human
agaaucuuguuucccagauaac

SEQ ID NO: 493036 - RNA, 21 nt, Human
agcagcuccccuccuggccuc

SEQ ID NO: 493037 - RNA, 26 nt, Human
agccggcaccgcuggccaccggcgcg

SEQ ID NO: 493038 - RNA, 18 nt, Human
agcuacaggaaaucuaga

SEQ ID NO: 493039 - RNA, 18 nt, Human
agcuccccuccuggccuc

SEQ ID NO: 493040 - RNA, 24 nt, Human
agcugucacugcaaucuuccucug

SEQ ID NO: 493041 - RNA, 18 nt, Human
agcuucuggcaggagcag

SEQ ID NO: 493042 - RNA, 19 nt, Human
agcuucuggcaggagcagc

SEQ ID NO: 493043 - RNA, 21 nt, Human
agcuucuggcaggagcagcuc

SEQ ID NO: 493044 - RNA, 23 nt, Human
aggaaaucuagaacaaaaucaaa

SEQ ID NO: 493045 - RNA, 19 nt, Human
aggcaaaacaaugaaaucc

SEQ ID NO: 493046 - RNA, 25 nt, Human
aggcaaaacaaugaaauccacaaga

SEQ ID NO: 493047 - RNA, 27 nt, Human
aggcaaaacaaugaaauccacaagaaa

SEQ ID NO: 493048 - RNA, 20 nt, Human
auggcuccggccgcggggaa

SEQ ID NO: 493049 - RNA, 24 nt, Human
auugcaccaggcugcccauggaca

SEQ ID NO: 493050 - RNA, 21 nt, Human
cacagacuccgaggcagcgcu

SEQ ID NO: 493051 - RNA, 21 nt, Human
caccagcgccgucugcccucg

SEQ ID NO: 493052 - RNA, 21 nt, Human
cagcgccgucugcccucgugc

SEQ ID NO: 493053 - RNA, 18 nt, Human
caggggacgcgacgggca

SEQ ID NO: 493054 - RNA, 19 nt, Human
cauggcacugggcuucggc

SEQ ID NO: 493055 - RNA, 20 nt, Human
ccaacccuuccugcacaugc

SEQ ID NO: 493056 - RNA, 19 nt, Human
ccagcuucuggcaggagca

SEQ ID NO: 493057 - RNA, 26 nt, Human
ccagucagccaggaaggucccacagc

SEQ ID NO: 493058 - RNA, 25 nt, Human
cccagauaacagcaaauggcuacau

SEQ ID NO: 493059 - RNA, 19 nt, Human
cccuucguggcugaagaau

SEQ ID NO: 493060 - RNA, 25 nt, Human
ccgcgggcagucauggcacugggcu

SEQ ID NO: 493061 - RNA, 22 nt, Human
ccuguuagaaucuuguuuccca

SEQ ID NO: 493062 - RNA, 23 nt, Human
ccuuccugcacaugcuccuccug

SEQ ID NO: 493063 - RNA, 25 nt, Human
cgagccuggggcccugguggcugca

SEQ ID NO: 493064 - RNA, 23 nt, Human
cgccacacgaucgaccaccagcg

SEQ ID NO: 493065 - RNA, 19 nt, Human
cgccauggagcacggcguu

SEQ ID NO: 493066 - RNA, 21 nt, Human
cgccauggagcacggcguucc

SEQ ID NO: 493067 - RNA, 19 nt, Human
cgcggggaacguccuccgg

SEQ ID NO: 493068 - RNA, 26 nt, Human
cggggagcuggaggaaggagcugggg

SEQ ID NO: 493069 - RNA, 18 nt, Human
cuaaaccaaggagaguaa

SEQ ID NO: 493070 - RNA, 22 nt, Human
cucacugggccuccucucaggu

SEQ ID NO: 493071 - RNA, 23 nt, Human
cuccuggugugguuugugggugg

SEQ ID NO: 493072 - RNA, 25 nt, Human
cugcacaugcuccuccuggagccua

SEQ ID NO: 493073 - RNA, 18 nt, Human
cuggucaucggggggcag

SEQ ID NO: 493074 - RNA, 22 nt, Human
cugucacugcaaucuuccucug

SEQ ID NO: 493075 - RNA, 24 nt, Human
cuuccugcacaugcuccuccugga

SEQ ID NO: 493076 - RNA, 22 nt, Human
gaaaagaauuuuucaaaaaugu

SEQ ID NO: 493077 - RNA, 21 nt, Human
gagccuggggcccugguggcu

SEQ ID NO: 493078 - RNA, 20 nt, Human
gagcuggaggaaggagcugg

SEQ ID NO: 493079 - RNA, 23 nt, Human
gcaaaacaaugaaauccacaaga

SEQ ID NO: 493080 - RNA, 22 nt, Human
gcagaugcacauccaucccuuc

SEQ ID NO: 493081 - RNA, 21 nt, Human
gccuccuggugugguuugugg

SEQ ID NO: 493082 - RNA, 19 nt, Human
gcuccuggucaucgggggg

SEQ ID NO: 493083 - RNA, 24 nt, Human
ggacugggccgucgcacacgccag

SEQ ID NO: 493084 - RNA, 25 nt, Human
ggacugggccgucgcacacgccagc

SEQ ID NO: 493085 - RNA, 21 nt, Human
ggagcuggaggaaggagcugg

SEQ ID NO: 493086 - RNA, 22 nt, Human
ggcaaaacaaugaaauccacaa

SEQ ID NO: 493087 - RNA, 23 nt, Human
ggcaaaacaaugaaauccacaag

SEQ ID NO: 493088 - RNA, 20 nt, Human
ggcagaugcacauccauccc

SEQ ID NO: 493089 - RNA, 22 nt, Human
ggcagaugcacauccaucccuu

SEQ ID NO: 493090 - RNA, 18 nt, Human
ggcccugguggcugcagc

SEQ ID NO: 493091 - RNA, 19 nt, Human
gggcagaugcacauccauc

SEQ ID NO: 493092 - RNA, 22 nt, Human
gggcagaugcacauccaucccu

SEQ ID NO: 493093 - RNA, 19 nt, Human
ggggucgggcuccaugcuc

SEQ ID NO: 493094 - RNA, 20 nt, Human
gggucgggcuccaugcucug

SEQ ID NO: 493095 - RNA, 23 nt, Human
ggugcggggagcuggaggaagga

SEQ ID NO: 493096 - RNA, 25 nt, Human
ggugugaaaugaaaugauggagugg

SEQ ID NO: 493097 - RNA, 18 nt, Human
gucagggccggugggugc

SEQ ID NO: 493098 - RNA, 19 nt, Human
gucccacagccggcaccgc

SEQ ID NO: 493099 - RNA, 18 nt, Human
gugaaaugaaaugaugga

SEQ ID NO: 493100 - RNA, 18 nt, Human
gugcaggguucuuccaag

SEQ ID NO: 493101 - RNA, 20 nt, Human
guggcucuccacaaguggag

SEQ ID NO: 493102 - RNA, 21 nt, Human
uaaaauaacugaacuaagggc

SEQ ID NO: 493103 - RNA, 23 nt, Human
uaaaauaacugaacuaagggcca

SEQ ID NO: 493104 - RNA, 18 nt, Human
uacauuuuaacaauucac

SEQ ID NO: 493105 - RNA, 19 nt, Human
uauaaaggaaaacgagccu

SEQ ID NO: 493106 - RNA, 20 nt, Human
uauuugaaggcaaaacaaug

SEQ ID NO: 493107 - RNA, 19 nt, Human
ucacugcaaucuuccucug

SEQ ID NO: 493108 - RNA, 20 nt, Human
uccagaaaaaaaauaucaac

SEQ ID NO: 493109 - RNA, 24 nt, Human
uccagaaaaaaaauaucaacuuau

SEQ ID NO: 493110 - RNA, 19 nt, Human
uccauggcuccggccgcgg

SEQ ID NO: 493111 - RNA, 26 nt, Human
ucccacagccggcaccgcuggccacc

SEQ ID NO: 493112 - RNA, 26 nt, Human
uccugcacaugcuccuccuggagccu

SEQ ID NO: 493113 - RNA, 19 nt, Human
uccuggagccuaggaggag

SEQ ID NO: 493114 - RNA, 20 nt, Human
uccuggagccuaggaggagg

SEQ ID NO: 493115 - RNA, 20 nt, Human
uccuggccuccccucccuuc

SEQ ID NO: 493116 - RNA, 24 nt, Human
ucguggcugaagaauuuacucggg

SEQ ID NO: 493117 - RNA, 23 nt, Human
ucuggcaggagcagcuccccucc

SEQ ID NO: 493118 - RNA, 18 nt, Human
ucuuaggcugguuuccug

SEQ ID NO: 493119 - RNA, 21 nt, Human
ugaaaaguuggaagauuuugc

SEQ ID NO: 493120 - RNA, 25 nt, Human
ugaaaaguuggaagauuuugcaucc

SEQ ID NO: 493121 - RNA, 18 nt, Human
uggaaggcgcuggcuggg

SEQ ID NO: 493122 - RNA, 21 nt, Human
uggagcacggcguucccacug

SEQ ID NO: 493123 - RNA, 24 nt, Human
uggaguggaaggcgcuggcugggg

SEQ ID NO: 493124 - RNA, 24 nt, Human
uggcaggagcagcuccccuccugg

SEQ ID NO: 493125 - RNA, 20 nt, Human
uucucaaacucgggcccauu

SEQ ID NO: 493126 - RNA, 21 nt, Human
uucuguacaaaugaauggaau

SEQ ID NO: 493127 - RNA, 31 nt, Human
uuggguugaaaaguuggaagauuuugcaucc

SEQ ID NO: 493128 - RNA, 19 nt, Human
uuuuuuuuuuuucuuuaaa

SEQ ID NO: 493129 - RNA, 23 nt, Human
aaaaacacgcucucuucaccucc

SEQ ID NO: 493130 - RNA, 19 nt, Human
aaaaugcugugguuuuccc

SEQ ID NO: 493131 - RNA, 26 nt, Human
aacuugcccuucucccuugaaacuuu

SEQ ID NO: 493132 - RNA, 23 nt, Human
aagacaacaguugaaaacuguau

SEQ ID NO: 493133 - RNA, 19 nt, Human
aaggagcgacuaacuuggc

SEQ ID NO: 493134 - RNA, 19 nt, Human
acauuggaagguuucuuuu

SEQ ID NO: 493135 - RNA, 20 nt, Human
accccagagcaccugucgga

SEQ ID NO: 493136 - RNA, 22 nt, Human
aggaagggcccgggcagcaugg

SEQ ID NO: 493137 - RNA, 19 nt, Human
aggcggaagccaaggugcc

SEQ ID NO: 493138 - RNA, 23 nt, Human
agugcugaaagcugcucagggcc

SEQ ID NO: 493139 - RNA, 18 nt, Human
caagggagcagcaugucc

SEQ ID NO: 493140 - RNA, 21 nt, Human
caccccagagcaccugucgga

SEQ ID NO: 493141 - RNA, 25 nt, Human
caccccagagcaccugucggagacc

SEQ ID NO: 493142 - RNA, 22 nt, Human
cagaagagucaccccagagcac

SEQ ID NO: 493143 - RNA, 19 nt, Human
caggagggcgggcugcggc

SEQ ID NO: 493144 - RNA, 23 nt, Human
caggcucuguagggucuuggagg

SEQ ID NO: 493145 - RNA, 24 nt, Human
ccacgagcccugcccagcgcucac

SEQ ID NO: 493146 - RNA, 21 nt, Human
ccagaugacauggcaaagcua

SEQ ID NO: 493147 - RNA, 20 nt, Human
ccagcagcaggauauugugu

SEQ ID NO: 493148 - RNA, 25 nt, Human
cccccggggcucuggggagggucuc

SEQ ID NO: 493149 - RNA, 23 nt, Human
ccccgccccgcgccgaacccgga

SEQ ID NO: 493150 - RNA, 20 nt, Human
cccgcgccgaacccggaacc

SEQ ID NO: 493151 - RNA, 24 nt, Human
ccgggcagcaugagggagcggcgc

SEQ ID NO: 493152 - RNA, 25 nt, Human
ccuccacaaauacagauugcugcuu

SEQ ID NO: 493153 - RNA, 23 nt, Human
cgucccuucccucagggggcugu

SEQ ID NO: 493154 - RNA, 23 nt, Human
cucuucaccuccagugcugaaag

SEQ ID NO: 493155 - RNA, 19 nt, Human
cugugguuuucccagcagc

SEQ ID NO: 493156 - RNA, 20 nt, Human
gaagauaagcaccaaaccua

SEQ ID NO: 493157 - RNA, 22 nt, Human
gaagauaagcaccaaaccuauu

SEQ ID NO: 493158 - RNA, 24 nt, Human
gagcaagacaacaguugaaaaagg

SEQ ID NO: 493159 - RNA, 18 nt, Human
gagcccugcccagcgcuc

SEQ ID NO: 493160 - RNA, 19 nt, Human
gagcggcgcguccugggac

SEQ ID NO: 493161 - RNA, 22 nt, Human
gcccagcgcucaccaggagggc

SEQ ID NO: 493162 - RNA, 22 nt, Human
gccccgcgccgaacccggaacc

SEQ ID NO: 493163 - RNA, 18 nt, Human
gcccugggcuuggggccc

SEQ ID NO: 493164 - RNA, 19 nt, Human
gcccugggcuuggggccgu

SEQ ID NO: 493165 - RNA, 23 nt, Human
gccgaacccggaaccggcugcgc

SEQ ID NO: 493166 - RNA, 20 nt, Human
gcucggggccgcggucacuc

SEQ ID NO: 493167 - RNA, 20 nt, Human
gcucggggccgcggucacuc

SEQ ID NO: 493168 - RNA, 20 nt, Human
gcuuggggccguggucacuc

SEQ ID NO: 493169 - RNA, 19 nt, Human
ggaggaagggcccgggcag

SEQ ID NO: 493170 - RNA, 21 nt, Human
ggagggcgggcugcggccccc

SEQ ID NO: 493171 - RNA, 22 nt, Human
ggagggcgggcugcggcccccg

SEQ ID NO: 493172 - RNA, 24 nt, Human
ggagggucucacucagaggguaaa

SEQ ID NO: 493173 - RNA, 19 nt, Human
guacaaaagagcaaaacug

SEQ ID NO: 493174 - RNA, 22 nt, Human
guccugggaccugccuccagcc

SEQ ID NO: 493175 - RNA, 19 nt, Human
uaaaaaauagauaaaaugc

SEQ ID NO: 493176 - RNA, 21 nt, Human
uacaaacaaggauaacaggug

SEQ ID NO: 493177 - RNA, 21 nt, Human
uaugcuuauucuuucaaauac

SEQ ID NO: 493178 - RNA, 27 nt, Human
ucccucagggggcugugaaaacaccuu

SEQ ID NO: 493179 - RNA, 25 nt, Human
ucggagacccugcgucccuucccuc

SEQ ID NO: 493180 - RNA, 21 nt, Human
ugagaagaagcaaaaaaguua

SEQ ID NO: 493181 - RNA, 20 nt, Human
ugcucccuucuccugaaaca

SEQ ID NO: 493182 - RNA, 21 nt, Human
ugcucccuucuccugaaacaa

SEQ ID NO: 493183 - RNA, 22 nt, Human
uuaauaaacagaagcauaugcu

SEQ ID NO: 493184 - RNA, 21 nt, Human
uuccaagaaucaaaauuucaa

SEQ ID NO: 493185 - RNA, 20 nt, Human
uuccugaaaacagacuuccg

SEQ ID NO: 493186 - RNA, 21 nt, Human
uuccugagaagaagcaaaaaa

SEQ ID NO: 493187 - RNA, 23 nt, Human
aaaaacggagacaguuaaaagga

SEQ ID NO: 493188 - RNA, 21 nt, Human
aaaaagaaauaaaaaaucagc

SEQ ID NO: 493189 - RNA, 30 nt, Human
aaacaacaggucucaguguauuguaaacaa

SEQ ID NO: 493190 - RNA, 18 nt, Human
aaacagaagcaaggacuc

SEQ ID NO: 493191 - RNA, 20 nt, Human
aaacagaagcaaggacucaa

SEQ ID NO: 493192 - RNA, 20 nt, Human
aagaaaaaaacggagacagu

SEQ ID NO: 493193 - RNA, 20 nt, Human
aagccagaagccaggaggaa

SEQ ID NO: 493194 - RNA, 18 nt, Human
aaugaagaaaccacucua

SEQ ID NO: 493195 - RNA, 20 nt, Human
acaaaccauuccuucccuau

SEQ ID NO: 493196 - RNA, 18 nt, Human
acugccggaacuugucca

SEQ ID NO: 493197 - RNA, 20 nt, Human
agaaauaaaaaaucagcuug

SEQ ID NO: 493198 - RNA, 19 nt, Human
agcaaacagaagcaaggac

SEQ ID NO: 493199 - RNA, 18 nt, Human
aggaaagaaaaagugucu

SEQ ID NO: 493200 - RNA, 23 nt, Human
aggaaagaaaaagugucucccac

SEQ ID NO: 493201 - RNA, 19 nt, Human
auauauauauauauauaua

SEQ ID NO: 493202 - RNA, 19 nt, Human
auauauauauauauauaua

SEQ ID NO: 493203 - RNA, 19 nt, Human
auauauauauauauauaua

SEQ ID NO: 493204 - RNA, 19 nt, Human
auauauauauauauauaua

SEQ ID NO: 493205 - RNA, 23 nt, Human
aucacagcuucuaagauccaaca

SEQ ID NO: 493206 - RNA, 21 nt, Human
augaacugccggaacuugucc

SEQ ID NO: 493207 - RNA, 22 nt, Human
augaguuuccuuuucuguaaag

SEQ ID NO: 493208 - RNA, 23 nt, Human
augcaucuggugcuggcuaauaa

SEQ ID NO: 493209 - RNA, 22 nt, Human
augguaauaaaaugcaauuuuc

SEQ ID NO: 493210 - RNA, 25 nt, Human
auguaggccaacuugugcucucuug

SEQ ID NO: 493211 - RNA, 26 nt, Human
auuuucuuuuccuccaguguucaguu

SEQ ID NO: 493212 - RNA, 21 nt, Human
caaaaaaaaagaaauaaaaaa

SEQ ID NO: 493213 - RNA, 18 nt, Human
cacacaaaacaacagguc

SEQ ID NO: 493214 - RNA, 19 nt, Human
cacacaaaacaacaggucu

SEQ ID NO: 493215 - RNA, 18 nt, Human
caccgcacaaucaagggc

SEQ ID NO: 493216 - RNA, 21 nt, Human
cagcuucuaagauccaacacc

SEQ ID NO: 493217 - RNA, 19 nt, Human
caguguucaguugcuccuc

SEQ ID NO: 493218 - RNA, 18 nt, Human
caugaaugaagaaaccac

SEQ ID NO: 493219 - RNA, 25 nt, Human
cauuucuucuuauggaagccagaag

SEQ ID NO: 493220 - RNA, 23 nt, Human
ccuaucuccucuccugccuucug

SEQ ID NO: 493221 - RNA, 20 nt, Human
ccucuccugccuucugauau

SEQ ID NO: 493222 - RNA, 21 nt, Human
cuucugaggagaaaauguggu

SEQ ID NO: 493223 - RNA, 20 nt, Human
gaguuuccuuuucuguaaag

SEQ ID NO: 493224 - RNA, 21 nt, Human
ggccgaauggucgaaauaaga

SEQ ID NO: 493225 - RNA, 23 nt, Human
ggggaaaauaugacacgauauuu

SEQ ID NO: 493226 - RNA, 24 nt, Human
gguaauaaaaugcaauuuucagaa

SEQ ID NO: 493227 - RNA, 18 nt, Human
ggugaucgaguagaacug

SEQ ID NO: 493228 - RNA, 25 nt, Human
ggugcaacuggguuacuuuugcagg

SEQ ID NO: 493229 - RNA, 23 nt, Human
guaggccaacuugugcucucuug

SEQ ID NO: 493230 - RNA, 21 nt, Human
gugcaucugagccaucacagc

SEQ ID NO: 493231 - RNA, 19 nt, Human
uaaaaagcccaacagagag

SEQ ID NO: 493232 - RNA, 22 nt, Human
uaaaaggacaaccaaaaagaua

SEQ ID NO: 493233 - RNA, 21 nt, Human
uaaacaccaucaaaaccucca

SEQ ID NO: 493234 - RNA, 24 nt, Human
uaacauugauaagcguguuggcca

SEQ ID NO: 493235 - RNA, 23 nt, Human
uaagcagacuauaacucacaagg

SEQ ID NO: 493236 - RNA, 23 nt, Human
uacaucacgauaucaccagucug

SEQ ID NO: 493237 - RNA, 19 nt, Human
uagaaacuagagcccugcu

SEQ ID NO: 493238 - RNA, 19 nt, Human
uagagcccugcugauaggc

SEQ ID NO: 493239 - RNA, 25 nt, Human
uagcaaaaacuuccaucccacuaga

SEQ ID NO: 493240 - RNA, 19 nt, Human
uagcugguuauccucagcc

SEQ ID NO: 493241 - RNA, 19 nt, Human
uauauauauauauauauau

SEQ ID NO: 493242 - RNA, 19 nt, Human
uauauauauauauauauau

SEQ ID NO: 493243 - RNA, 18 nt, Human
ucaaugccugacauucag

SEQ ID NO: 493244 - RNA, 23 nt, Human
ucacaauauauauauauauauau

SEQ ID NO: 493245 - RNA, 23 nt, Human
ucagaagcaucuuggugaucgag

SEQ ID NO: 493246 - RNA, 22 nt, Human
ucagacacuucacagggugcaa

SEQ ID NO: 493247 - RNA, 22 nt, Human
ucagcaggccugaaauucugca

SEQ ID NO: 493248 - RNA, 27 nt, Human
ucagugccugacagaaucagcauuugg

SEQ ID NO: 493249 - RNA, 24 nt, Human
uccaacaccgcacaaucaagggcu

SEQ ID NO: 493250 - RNA, 22 nt, Human
uccuagaaacuagagcccugcu

SEQ ID NO: 493251 - RNA, 19 nt, Human
ucggaggcuuucucaucuc

SEQ ID NO: 493252 - RNA, 24 nt, Human
ucuaaaaacuucaucagcaggccu

SEQ ID NO: 493253 - RNA, 24 nt, Human
ucuauguuuaaaacaagccggggc

SEQ ID NO: 493254 - RNA, 24 nt, Human
ucucccacaauccuucucugggag

SEQ ID NO: 493255 - RNA, 25 nt, Human
ucucccacaauccuucucugggagu

SEQ ID NO: 493256 - RNA, 24 nt, Human
ucuucuuauggaagccagaagcug

SEQ ID NO: 493257 - RNA, 28 nt, Human
ucuuuucuuuucugguccauuuuauuuu

SEQ ID NO: 493258 - RNA, 21 nt, Human
ugagcaaacagaagcaaggac

SEQ ID NO: 493259 - RNA, 24 nt, Human
ugcauuuuuaaauaaaagaaaaaa

SEQ ID NO: 493260 - RNA, 25 nt, Human
ugcauuuuuaaauaaaagaaaaaaa

SEQ ID NO: 493261 - RNA, 24 nt, Human
ugccggaacuuguccacccuuuuu

SEQ ID NO: 493262 - RNA, 22 nt, Human
uggauauggcaucaauuugaug

SEQ ID NO: 493263 - RNA, 24 nt, Human
uggcagauggauugaucuuucaca

SEQ ID NO: 493264 - RNA, 22 nt, Human
uguaaacaccaucaaaaccucc

SEQ ID NO: 493265 - RNA, 22 nt, Human
uucacaauauauauauauauau

SEQ ID NO: 493266 - RNA, 18 nt, Human
uucacaugaaugaagaaa

SEQ ID NO: 493267 - RNA, 21 nt, Human
uucagugccugacagaaucag

SEQ ID NO: 493268 - RNA, 18 nt, Human
uuccuagaaacuagagcc

SEQ ID NO: 493269 - RNA, 25 nt, Human
uuguccacccuuuuugcuagaggca

SEQ ID NO: 493270 - RNA, 23 nt, Human
uuucacaauauauauauauauau

SEQ ID NO: 493271 - RNA, 27 nt, Human
uuuucacaugaaugaagaaaccacucu

SEQ ID NO: 493272 - RNA, 24 nt, Human
uuuuucuccauuucuucuuaugga

SEQ ID NO: 493273 - RNA, 21 nt, Human
aggaaaacaaaaccaggucca

SEQ ID NO: 493274 - RNA, 21 nt, Human
caaaaccagguccaaucuaug

SEQ ID NO: 493275 - RNA, 24 nt, Human
caacaagucaacagcugcaggaaa

SEQ ID NO: 493276 - RNA, 22 nt, Human
caacagcugcaggaaaacaaaa

SEQ ID NO: 493277 - RNA, 19 nt, Human
caggccccaggcagcaagg

SEQ ID NO: 493278 - RNA, 18 nt, Human
gaggaagucaggaaaggc

SEQ ID NO: 493279 - RNA, 20 nt, Human
ucuaagaggaagucaggaaa

SEQ ID NO: 493280 - RNA, 23 nt, Human
ucuaugaucuaagaggaagucag

SEQ ID NO: 493281 - RNA, 18 nt, Human
uggcaaggggaaucccac

SEQ ID NO: 493282 - RNA, 21 nt, Human
uuauuguacuucagggcaaca

SEQ ID NO: 493283 - RNA, 19 nt, Human
uuggaagagagauccaaag

SEQ ID NO: 493284 - RNA, 22 nt, Human
aacacagcaaaggagaccaucu

SEQ ID NO: 493285 - RNA, 18 nt, Human
accauuauaaagaauaag

SEQ ID NO: 493286 - RNA, 19 nt, Human
agccucauugaaagacaaa

SEQ ID NO: 493287 - RNA, 23 nt, Human
caacacaaaagagcgagaagaau

SEQ ID NO: 493288 - RNA, 18 nt, Human
cacacacgcaugugugug

SEQ ID NO: 493289 - RNA, 27 nt, Human
caccaacacugaugauuuaucuuuaau

SEQ ID NO: 493290 - RNA, 24 nt, Human
caucuucauuccaaaucuacaagg

SEQ ID NO: 493291 - RNA, 25 nt, Human
ccaacacugaugauuuaucuuuaau

SEQ ID NO: 493292 - RNA, 20 nt, Human
uaaaccaacacaaaagagcu

SEQ ID NO: 493293 - RNA, 24 nt, Human
uauaugcacacacgcaugugugug

SEQ ID NO: 493294 - RNA, 25 nt, Human
uauaugcacacacgcaugugugugg

SEQ ID NO: 493295 - RNA, 18 nt, Human
ugaaagacaaaaaagaug

SEQ ID NO: 493296 - RNA, 23 nt, Human
ugaaagacaaaaaagaugugcaa

SEQ ID NO: 493297 - RNA, 21 nt, Human
ugcacacacgcaugugugugu

SEQ ID NO: 493298 - RNA, 23 nt, Human
uucuucauaaaccaacacaaaag

SEQ ID NO: 493299 - RNA, 20 nt, Human
accacagaaaggccugcagg

SEQ ID NO: 493300 - RNA, 25 nt, Human
agaaaggccugcaggagccagauug

SEQ ID NO: 493301 - RNA, 20 nt, Human
agaccacagaaaggccugca

SEQ ID NO: 493302 - RNA, 19 nt, Human
agcuggacuggaggggcuu

SEQ ID NO: 493303 - RNA, 21 nt, Human
agugaaaggggcagcccagga

SEQ ID NO: 493304 - RNA, 21 nt, Human
agugauccugggcccagccuc

SEQ ID NO: 493305 - RNA, 23 nt, Human
ccaaagauuuauuuugcaaguga

SEQ ID NO: 493306 - RNA, 21 nt, Human
ccugggcccagccucaaagcu

SEQ ID NO: 493307 - RNA, 20 nt, Human
gaaggcaaggcugagagcag

SEQ ID NO: 493308 - RNA, 21 nt, Human
gcccagccucaaagcuggacu

SEQ ID NO: 493309 - RNA, 21 nt, Human
ggagccagauugcggccccca

SEQ ID NO: 493310 - RNA, 24 nt, Human
gggcagcccaggagacccagaaaa

SEQ ID NO: 493311 - RNA, 19 nt, Human
ugaaaggggcagcccagga

SEQ ID NO: 493312 - RNA, 18 nt, Human
ugauccugggcccagccu

SEQ ID NO: 493313 - RNA, 20 nt, Human
ugcggcccccaggaaaaccc

SEQ ID NO: 493314 - RNA, 26 nt, Human
aaacaagagaugaaauaaagggaccc

SEQ ID NO: 493315 - RNA, 19 nt, Human
aagcagcugcucccuggga

SEQ ID NO: 493316 - RNA, 19 nt, Human
aagccuggucacaguguuc

SEQ ID NO: 493317 - RNA, 24 nt, Human
acacagucgccaucuacaaaagcc

SEQ ID NO: 493318 - RNA, 20 nt, Human
acacuccaucaggaggaagg

SEQ ID NO: 493319 - RNA, 23 nt, Human
acucgauccacgccccacaccac

SEQ ID NO: 493320 - RNA, 24 nt, Human
agaggcccaaagagcuaggucaag

SEQ ID NO: 493321 - RNA, 25 nt, Human
agaggguaaaggagcagcuucugga

SEQ ID NO: 493322 - RNA, 24 nt, Human
aggcagaggccaccuugcacgcag

SEQ ID NO: 493323 - RNA, 26 nt, Human
caaguaacacugcuuacucuugcugu

SEQ ID NO: 493324 - RNA, 22 nt, Human
cacacugcccccguggccacgc

SEQ ID NO: 493325 - RNA, 21 nt, Human
cacaggauccgacacuccagg

SEQ ID NO: 493326 - RNA, 24 nt, Human
cacccaaagccuccugccacagga

SEQ ID NO: 493327 - RNA, 20 nt, Human
cagcaggaggggagagcucu

SEQ ID NO: 493328 - RNA, 21 nt, Human
cagcuacacucgauccacgcc

SEQ ID NO: 493329 - RNA, 20 nt, Human
caggagaggcccaaagagcu

SEQ ID NO: 493330 - RNA, 24 nt, Human
caggcagaggccaccuugcacgca

SEQ ID NO: 493331 - RNA, 24 nt, Human
caguagugagccacccaaagccuc

SEQ ID NO: 493332 - RNA, 29 nt, Human
ccaaagccuccugccacaggagcaguagg

SEQ ID NO: 493333 - RNA, 19 nt, Human
ccacaguggcggccuuggc

SEQ ID NO: 493334 - RNA, 18 nt, Human
ccacccaaagccuccugc

SEQ ID NO: 493335 - RNA, 21 nt, Human
ccagugaugagguggauggag

SEQ ID NO: 493336 - RNA, 22 nt, Human
ccaucuacaaaagccuggucac

SEQ ID NO: 493337 - RNA, 20 nt, Human
cccaaagagcuaggucaagc

SEQ ID NO: 493338 - RNA, 20 nt, Human
cccaaagccuccugccacag

SEQ ID NO: 493339 - RNA, 22 nt, Human
cccaaauaugaaaugccuucuc

SEQ ID NO: 493340 - RNA, 21 nt, Human
ccccacaccacauacaggcug

SEQ ID NO: 493341 - RNA, 19 nt, Human
cccguggccacgcauggcu

SEQ ID NO: 493342 - RNA, 22 nt, Human
cccguggccacgcauggcuguc

SEQ ID NO: 493343 - RNA, 18 nt, Human
cccugggaggggagcggg

SEQ ID NO: 493344 - RNA, 21 nt, Human
cccuugggagugagcaccguc

SEQ ID NO: 493345 - RNA, 22 nt, Human
cguggccacgcauggcugucug

SEQ ID NO: 493346 - RNA, 21 nt, Human
cucacaggauccgacacucca

SEQ ID NO: 493347 - RNA, 21 nt, Human
cucgauccacgccccacacca

SEQ ID NO: 493348 - RNA, 19 nt, Human
cugcugccuccccaugcag

SEQ ID NO: 493349 - RNA, 26 nt, Human
cugcugccuccccaugcaguccagug

SEQ ID NO: 493350 - RNA, 18 nt, Human
gacuuugcaguacaucuc

SEQ ID NO: 493351 - RNA, 23 nt, Human
gagccacccaaagccuccugcca

SEQ ID NO: 493352 - RNA, 21 nt, Human
gcaggagaggcccaaagagcu

SEQ ID NO: 493353 - RNA, 22 nt, Human
gccacccaaagccuccugccac

SEQ ID NO: 493354 - RNA, 20 nt, Human
gcugcuccagagcaauccag

SEQ ID NO: 493355 - RNA, 23 nt, Human
ggcccaaagagcuaggucaagca

SEQ ID NO: 493356 - RNA, 18 nt, Human
gggaggggagcgggagac

SEQ ID NO: 493357 - RNA, 22 nt, Human
gggcaggagaggcccaaagagc

SEQ ID NO: 493358 - RNA, 21 nt, Human
gguaaaggagcagcuucugga

SEQ ID NO: 493359 - RNA, 19 nt, Human
uacaggcugcugucuccca

SEQ ID NO: 493360 - RNA, 23 nt, Human
uacucacaggauccgacacucca

SEQ ID NO: 493361 - RNA, 18 nt, Human
uagugagccacccaaagc

SEQ ID NO: 493362 - RNA, 20 nt, Human
uagugagccacccaaagccu

SEQ ID NO: 493363 - RNA, 22 nt, Human
ucacacugcccccguggccacg

SEQ ID NO: 493364 - RNA, 24 nt, Human
ucacaggauccgacacuccaggca

SEQ ID NO: 493365 - RNA, 19 nt, Human
ucaguagugagccacccaa

SEQ ID NO: 493366 - RNA, 18 nt, Human
uccacgccccacaccaca

SEQ ID NO: 493367 - RNA, 20 nt, Human
uccagugaugagguggaugg

SEQ ID NO: 493368 - RNA, 23 nt, Human
uccucacacugcccccguggcca

SEQ ID NO: 493369 - RNA, 22 nt, Human
ucguaaacaagagaugaaauaa

SEQ ID NO: 493370 - RNA, 22 nt, Human
ugacuggaaaccuuagccccca

SEQ ID NO: 493371 - RNA, 27 nt, Human
ugacuggaaaccuuagcccccaaauau

SEQ ID NO: 493372 - RNA, 22 nt, Human
ugacuggcgacuuugcaguaca

SEQ ID NO: 493373 - RNA, 21 nt, Human
uggaaaccuuagcccccaaau

SEQ ID NO: 493374 - RNA, 22 nt, Human
uugcacuauauuucgucuuccc

SEQ ID NO: 493375 - RNA, 26 nt, Human
uuucacagcuacacucgauccacgcc

SEQ ID NO: 493376 - RNA, 22 nt, Human
aggcugcgcuccgcucccuucg

SEQ ID NO: 493377 - RNA, 21 nt, Human
ccaagguccugcccuggaggc

SEQ ID NO: 493378 - RNA, 21 nt, Human
ccccaggccaggcugcgcucc

SEQ ID NO: 493379 - RNA, 23 nt, Human
ccccaggccaggcugcgcuccgc

SEQ ID NO: 493380 - RNA, 22 nt, Human
ccggccgcgcucggcuccucuu

SEQ ID NO: 493381 - RNA, 23 nt, Human
ccggccugggcuucuccggucau

SEQ ID NO: 493382 - RNA, 21 nt, Human
ccuccaagguccugcccugga

SEQ ID NO: 493383 - RNA, 19 nt, Human
ccuucggacgggcucgguu

SEQ ID NO: 493384 - RNA, 19 nt, Human
gccgcgcucggcuccucuu

SEQ ID NO: 493385 - RNA, 21 nt, Human
ggagaaauccaaggaguggga

SEQ ID NO: 493386 - RNA, 23 nt, Human
ggccccaggccaggcugcgcucc

SEQ ID NO: 493387 - RNA, 22 nt, Human
gggcucagcccagucgccaggg

SEQ ID NO: 493388 - RNA, 22 nt, Human
ucggacgggcucgguuccuucc

SEQ ID NO: 493389 - RNA, 21 nt, Human
ucgguuccuuccggccgcgcu

SEQ ID NO: 493390 - RNA, 24 nt, Human
ucguuguuccucccuccaaggucc

SEQ ID NO: 493391 - RNA, 23 nt, Human
ucugcucguuguuccucccucca

SEQ ID NO: 493392 - RNA, 21 nt, Human
uggaggcuccaggagaaaucc

SEQ ID NO: 493393 - RNA, 20 nt, Human
uguguuacauacacagcacg

SEQ ID NO: 493394 - RNA, 23 nt, Human
aaaaaaacagacacaaaaaguga

SEQ ID NO: 493395 - RNA, 23 nt, Human
aaaaaacagacacaaaaagugau

SEQ ID NO: 493396 - RNA, 20 nt, Human
aaaaaagaacacccugugac

SEQ ID NO: 493397 - RNA, 24 nt, Human
aaaaacccaccaaguagcaacauc

SEQ ID NO: 493398 - RNA, 26 nt, Human
aaaaagaacacccugugacaaagaua

SEQ ID NO: 493399 - RNA, 19 nt, Human
aaaacaaccuucugaccac

SEQ ID NO: 493400 - RNA, 21 nt, Human
aaacaaccuucugaccaccgc

SEQ ID NO: 493401 - RNA, 22 nt, Human
aaacagacacaaaaagugaugc

SEQ ID NO: 493402 - RNA, 25 nt, Human
aaacagacacaaaaagugaugcucg

SEQ ID NO: 493403 - RNA, 22 nt, Human
aaacaguaaauuaaguuccccu

SEQ ID NO: 493404 - RNA, 19 nt, Human
aaacaguaucuuacuaauu

SEQ ID NO: 493405 - RNA, 20 nt, Human
aaaccacguuuuggcugaug

SEQ ID NO: 493406 - RNA, 21 nt, Human
aaauaaaaagguuaagcaacc

SEQ ID NO: 493407 - RNA, 22 nt, Human
aaaucaugaaauccauuuuaac

SEQ ID NO: 493408 - RNA, 23 nt, Human
aacaaugauagcaaagcauaguc

SEQ ID NO: 493409 - RNA, 18 nt, Human
aacaccaccuacaauaca

SEQ ID NO: 493410 - RNA, 20 nt, Human
aacaguaaauuaaguucccc

SEQ ID NO: 493411 - RNA, 26 nt, Human
aaccuugcccuccucacaagcugugc

SEQ ID NO: 493412 - RNA, 25 nt, Human
aagaaagcaauacaagaacaaaacc

SEQ ID NO: 493413 - RNA, 22 nt, Human
aagaacaaaacccaaauacuuu

SEQ ID NO: 493414 - RNA, 25 nt, Human
aagaggagacagaauaacaccagaa

SEQ ID NO: 493415 - RNA, 21 nt, Human
aaguagcaacaucuaugcaaa

SEQ ID NO: 493416 - RNA, 20 nt, Human
aauaaucacaguucaaaaac

SEQ ID NO: 493417 - RNA, 20 nt, Human
aauaugaaaacauuucccuc

SEQ ID NO: 493418 - RNA, 20 nt, Human
aaucacaguucaaaaacuaa

SEQ ID NO: 493419 - RNA, 23 nt, Human
aaucauauaauuucacaauuaaa

SEQ ID NO: 493420 - RNA, 20 nt, Human
acaaagaaagcuuuggcuga

SEQ ID NO: 493421 - RNA, 18 nt, Human
acaaagaagaggagacag

SEQ ID NO: 493422 - RNA, 19 nt, Human
acaaagaagaggagacaga

SEQ ID NO: 493423 - RNA, 23 nt, Human
acuaaaagggguuaccauaaauc

SEQ ID NO: 493424 - RNA, 19 nt, Human
acuccguuacucauuuucu

SEQ ID NO: 493425 - RNA, 29 nt, Human
agaaaaaaaaaaaaacagacacaaaaagg

SEQ ID NO: 493426 - RNA, 18 nt, Human
agacuagagaaaguuagg

SEQ ID NO: 493427 - RNA, 23 nt, Human
agagucccaguaguugccaaaua

SEQ ID NO: 493428 - RNA, 24 nt, Human
aggaagaagacaacccgguaagaa

SEQ ID NO: 493429 - RNA, 21 nt, Human
aggagcucaacaaauacuagu

SEQ ID NO: 493430 - RNA, 19 nt, Human
aggccugaagugcuuggca

SEQ ID NO: 493431 - RNA, 23 nt, Human
agguuaaaaaaaucuuuccauaa

SEQ ID NO: 493432 - RNA, 21 nt, Human
aguagauuuauuuuauguaga

SEQ ID NO: 493433 - RNA, 22 nt, Human
auacuaccacagauaacaaacc

SEQ ID NO: 493434 - RNA, 18 nt, Human
auaggaaaaaaauauuau

SEQ ID NO: 493435 - RNA, 24 nt, Human
caaaaucagugcuggagccaggaa

SEQ ID NO: 493436 - RNA, 19 nt, Human
caaaauuaguggaaaacac

SEQ ID NO: 493437 - RNA, 23 nt, Human
cacaguucaaaaacuaaagugaa

SEQ ID NO: 493438 - RNA, 19 nt, Human
caccacaguuuucucccag

SEQ ID NO: 493439 - RNA, 18 nt, Human
cagaacuaagcucgaacg

SEQ ID NO: 493440 - RNA, 20 nt, Human
cagaauaacaccagaacuaa

SEQ ID NO: 493441 - RNA, 18 nt, Human
cagcaccugcgccgccuc

SEQ ID NO: 493442 - RNA, 23 nt, Human
caggcaaauauggaauauacuga

SEQ ID NO: 493443 - RNA, 22 nt, Human
cauugcacgccgugggacuccg

SEQ ID NO: 493444 - RNA, 26 nt, Human
ccaagaaaaaaaaaaaaacagacaca

SEQ ID NO: 493445 - RNA, 23 nt, Human
ccacacugccuucccccuuugaa

SEQ ID NO: 493446 - RNA, 26 nt, Human
cccaacccuuggacaguucucuagga

SEQ ID NO: 493447 - RNA, 19 nt, Human
cccccgagccggccgggag

SEQ ID NO: 493448 - RNA, 23 nt, Human
ccggcgccuccccucgggcgccu

SEQ ID NO: 493449 - RNA, 22 nt, Human
ccuccccucgggcgccuucucc

SEQ ID NO: 493450 - RNA, 18 nt, Human
cgagccggccgggagccg

SEQ ID NO: 493451 - RNA, 23 nt, Human
cgccgccuccgaaacgcgaucug

SEQ ID NO: 493452 - RNA, 24 nt, Human
cgucacaaccuugcccuccucaca

SEQ ID NO: 493453 - RNA, 18 nt, Human
cucguggaugucauaacu

SEQ ID NO: 493454 - RNA, 27 nt, Human
cuggaaacaguaaauuaaguuccccuu

SEQ ID NO: 493455 - RNA, 24 nt, Human
cuuacuaauauauucuagcuguac

SEQ ID NO: 493456 - RNA, 21 nt, Human
cuucauaaaaaagaacacccu

SEQ ID NO: 493457 - RNA, 22 nt, Human
cuuccagcauaauuccauugug

SEQ ID NO: 493458 - RNA, 25 nt, Human
gaaaaaaaaaaaaacagacacaaaa

SEQ ID NO: 493459 - RNA, 22 nt, Human
gaacaauuuaagguacaaaaca

SEQ ID NO: 493460 - RNA, 18 nt, Human
gaacacccugugacaaag

SEQ ID NO: 493461 - RNA, 19 nt, Human
gacagaaauaaaaaaauuc

SEQ ID NO: 493462 - RNA, 19 nt, Human
gauagaauaaaaccaccaa

SEQ ID NO: 493463 - RNA, 21 nt, Human
gaucuguccggcgccuccccu

SEQ ID NO: 493464 - RNA, 18 nt, Human
gcugaacuugaccgacau

SEQ ID NO: 493465 - RNA, 20 nt, Human
ggaaaaaauucucaccacaa

SEQ ID NO: 493466 - RNA, 20 nt, Human
ggagccaggaagagaauuug

SEQ ID NO: 493467 - RNA, 23 nt, Human
ggagccaggaagagaauuuggau

SEQ ID NO: 493468 - RNA, 19 nt, Human
ggaggaggauggagcucga

SEQ ID NO: 493469 - RNA, 23 nt, Human
ggcgccuucucccccgagccggc

SEQ ID NO: 493470 - RNA, 20 nt, Human
guagaacuuuuauuuggaaa

SEQ ID NO: 493471 - RNA, 21 nt, Human
guuuacagcaccugcgccgcc

SEQ ID NO: 493472 - RNA, 24 nt, Human
uaaaaaaauucauguugaaacuga

SEQ ID NO: 493473 - RNA, 21 nt, Human
uaaaacaaccuucugaccacc

SEQ ID NO: 493474 - RNA, 24 nt, Human
uaacugacagaaauaaaaaaauuc

SEQ ID NO: 493475 - RNA, 22 nt, Human
uaagacaggauuaugguuugca

SEQ ID NO: 493476 - RNA, 24 nt, Human
uaagacaggauuaugguuugcagu

SEQ ID NO: 493477 - RNA, 20 nt, Human
uaagcucgaacgucacaacc

SEQ ID NO: 493478 - RNA, 18 nt, Human
uaagguacaaaacaaaga

SEQ ID NO: 493479 - RNA, 19 nt, Human
uaagguacaaaacaaagaa

SEQ ID NO: 493480 - RNA, 25 nt, Human
uaauguucauuuucucacuucaaaa

SEQ ID NO: 493481 - RNA, 20 nt, Human
uacaaagucuucagcuuugg

SEQ ID NO: 493482 - RNA, 19 nt, Human
uacaguuuuaaauaagaca

SEQ ID NO: 493483 - RNA, 18 nt, Human
uaccacagauaacaaacc

SEQ ID NO: 493484 - RNA, 19 nt, Human
uaccacagauaacaaaccc

SEQ ID NO: 493485 - RNA, 19 nt, Human
uacuaugaauauuaaucca

SEQ ID NO: 493486 - RNA, 22 nt, Human
uagcuguacaaacaugccuguu

SEQ ID NO: 493487 - RNA, 19 nt, Human
uauaacaguauaccaauaa

SEQ ID NO: 493488 - RNA, 21 nt, Human
uaugaaguuagaaggcaucuu

SEQ ID NO: 493489 - RNA, 19 nt, Human
uaugcaaacacaccgaaua

SEQ ID NO: 493490 - RNA, 21 nt, Human
uauuaauccaagccaaaagaa

SEQ ID NO: 493491 - RNA, 19 nt, Human
uauuauuagcacuuuagag

SEQ ID NO: 493492 - RNA, 21 nt, Human
uauugaggaaagguaacaaug

SEQ ID NO: 493493 - RNA, 18 nt, Human
uauuugaagguuauucug

SEQ ID NO: 493494 - RNA, 22 nt, Human
uauuuuauuugaagguuauucu

SEQ ID NO: 493495 - RNA, 28 nt, Human
ucaccaagccaguucucagagacuguau

SEQ ID NO: 493496 - RNA, 23 nt, Human
ucgagcgcugaacuugaccgaca

SEQ ID NO: 493497 - RNA, 18 nt, Human
ucucugggcaaauaggag

SEQ ID NO: 493498 - RNA, 24 nt, Human
ugaaaaacguauacuucuguuuaa

SEQ ID NO: 493499 - RNA, 19 nt, Human
ugaaaaucuuaaugucucc

SEQ ID NO: 493500 - RNA, 23 nt, Human
ugaaagaaagcaauacaagaaca

SEQ ID NO: 493501 - RNA, 20 nt, Human
ugaacuaaaagggguuacca

SEQ ID NO: 493502 - RNA, 19 nt, Human
ugaacuugaccgacaugua

SEQ ID NO: 493503 - RNA, 23 nt, Human
ugaagugcuuggcauuuuauauu

SEQ ID NO: 493504 - RNA, 20 nt, Human
ugaaucauaucuuaaugggg

SEQ ID NO: 493505 - RNA, 18 nt, Human
ugacagaaggagaauauc

SEQ ID NO: 493506 - RNA, 25 nt, Human
ugacaguagacuagagaaaguuagg

SEQ ID NO: 493507 - RNA, 24 nt, Human
ugacucgugagguucaaaaggacc

SEQ ID NO: 493508 - RNA, 24 nt, Human
ugagaaaaagguaaaagcagucaa

SEQ ID NO: 493509 - RNA, 19 nt, Human
ugagauuauuauuagcacu

SEQ ID NO: 493510 - RNA, 21 nt, Human
ugagggaaaaucaugaaaucc

SEQ ID NO: 493511 - RNA, 20 nt, Human
ugcacgccgugggacuccgu

SEQ ID NO: 493512 - RNA, 18 nt, Human
ugcaugacucucuuuaaa

SEQ ID NO: 493513 - RNA, 22 nt, Human
ugcucuucaggaagaagacaac

SEQ ID NO: 493514 - RNA, 24 nt, Human
ugcucuucaggaagaagacaaccc

SEQ ID NO: 493515 - RNA, 20 nt, Human
uggagcacaacugccagaaa

SEQ ID NO: 493516 - RNA, 21 nt, Human
uggcugaugacaaagaagagg

SEQ ID NO: 493517 - RNA, 19 nt, Human
ugggacuccguuacucauu

SEQ ID NO: 493518 - RNA, 21 nt, Human
ugugcauacggagaaaaaccc

SEQ ID NO: 493519 - RNA, 23 nt, Human
ugugcauacggagaaaaacccac

SEQ ID NO: 493520 - RNA, 22 nt, Human
uguguuuugcauuuugagcacc

SEQ ID NO: 493521 - RNA, 25 nt, Human
uguuuuaguuucugacuuaaagguu

SEQ ID NO: 493522 - RNA, 27 nt, Human
uuaaaugcuuagaaaagcacaccaaca

SEQ ID NO: 493523 - RNA, 25 nt, Human
uugaaagaaagcaauacaagaacaa

SEQ ID NO: 493524 - RNA, 19 nt, Human
uuuuucuuuugaggggcug

SEQ ID NO: 493525 - RNA, 23 nt, Human
aaaaaauaacaaauaauaaaggg

SEQ ID NO: 493526 - RNA, 21 nt, Human
aaaauaacaaauaauaaaggg

SEQ ID NO: 493527 - RNA, 24 nt, Human
aacaaauaauaaagggguuauggc

SEQ ID NO: 493528 - RNA, 23 nt, Human
aacaauugaaaaaauucuguuaa

SEQ ID NO: 493529 - RNA, 21 nt, Human
aagcaagggaagacuuauggc

SEQ ID NO: 493530 - RNA, 20 nt, Human
acagcacaugauauaugaag

SEQ ID NO: 493531 - RNA, 23 nt, Human
cagcaucaaccugccuuaaugcu

SEQ ID NO: 493532 - RNA, 28 nt, Human
cauguuuauuucaaaauagcuuuggaag

SEQ ID NO: 493533 - RNA, 19 nt, Human
uacagcacaugauauauga

SEQ ID NO: 493534 - RNA, 23 nt, Human
uagcuuuggaagauacaagcaag

SEQ ID NO: 493535 - RNA, 24 nt, Human
uauuucaaaauagcuuuggaagau

SEQ ID NO: 493536 - RNA, 21 nt, Human
ucuuugguugucucuucagcu

SEQ ID NO: 493537 - RNA, 19 nt, Human
uggaaaacaauugaaaaaa

SEQ ID NO: 493538 - RNA, 18 nt, Human
uggaagauacaagcaagg

SEQ ID NO: 493539 - RNA, 24 nt, Human
uggcaaagcaaugcaaauaaaaaa

SEQ ID NO: 493540 - RNA, 18 nt, Human
aagaacucuuuauuuggu

SEQ ID NO: 493541 - RNA, 20 nt, Human
accacaccguugcgcuuugc

SEQ ID NO: 493542 - RNA, 20 nt, Human
acccccugcgcgcaucgccu

SEQ ID NO: 493543 - RNA, 23 nt, Human
acuucgagggugcgcguuugggg

SEQ ID NO: 493544 - RNA, 19 nt, Human
agaagaacaaggcguaagg

SEQ ID NO: 493545 - RNA, 23 nt, Human
agaauuacaaaauucuggaacca

SEQ ID NO: 493546 - RNA, 19 nt, Human
agacagaaaggagccacca

SEQ ID NO: 493547 - RNA, 19 nt, Human
agagaagcugaaagaugaa

SEQ ID NO: 493548 - RNA, 19 nt, Human
agagagggaccacauugau

SEQ ID NO: 493549 - RNA, 18 nt, Human
aggagccaccauuuucua

SEQ ID NO: 493550 - RNA, 22 nt, Human
agugacuauucaccuggucuca

SEQ ID NO: 493551 - RNA, 26 nt, Human
agugucaaucccaaaccccgaacaac

SEQ ID NO: 493552 - RNA, 18 nt, Human
aucacacuuaaugaaaua

SEQ ID NO: 493553 - RNA, 25 nt, Human
augccauaaaaauaaauauuagaac

SEQ ID NO: 493554 - RNA, 24 nt, Human
caaaauucuggaaccaagucaaug

SEQ ID NO: 493555 - RNA, 26 nt, Human
cagaaaggagccaccauuuucuaucu

SEQ ID NO: 493556 - RNA, 25 nt, Human
cagaacccucagagagcugcuucuc

SEQ ID NO: 493557 - RNA, 18 nt, Human
caucuuuguuuagugggc

SEQ ID NO: 493558 - RNA, 24 nt, Human
ccagugucaaucccaaaccccgaa

SEQ ID NO: 493559 - RNA, 22 nt, Human
ccccgaacaaccaucuuuguuu

SEQ ID NO: 493560 - RNA, 18 nt, Human
ccccugcgcgcaucgccu

SEQ ID NO: 493561 - RNA, 22 nt, Human
cccgagcccagcugcccgaccc

SEQ ID NO: 493562 - RNA, 23 nt, Human
cccgccgcccgagcccagcugcc

SEQ ID NO: 493563 - RNA, 26 nt, Human
cccugcgcgcaucgccuucggccggg

SEQ ID NO: 493564 - RNA, 24 nt, Human
ccgcccgagcccagcugcccgacc

SEQ ID NO: 493565 - RNA, 19 nt, Human
ccgccugccgcgccugugc

SEQ ID NO: 493566 - RNA, 24 nt, Human
ccuacucccgccgcccgagcccag

SEQ ID NO: 493567 - RNA, 23 nt, Human
ccugcgcgcaucgccuucggccg

SEQ ID NO: 493568 - RNA, 19 nt, Human
ccuggaucacagcagcagc

SEQ ID NO: 493569 - RNA, 20 nt, Human
cgacucugacucugcagccu

SEQ ID NO: 493570 - RNA, 18 nt, Human
cgcccgagcccagcugcc

SEQ ID NO: 493571 - RNA, 22 nt, Human
cgcccugguccuggaucacagc

SEQ ID NO: 493572 - RNA, 20 nt, Human
cguggaugugcggggcugga

SEQ ID NO: 493573 - RNA, 22 nt, Human
cucaagcaaacccucaucaaug

SEQ ID NO: 493574 - RNA, 19 nt, Human
cucacuccauuauuagcac

SEQ ID NO: 493575 - RNA, 21 nt, Human
cucccugccgggcccuacucc

SEQ ID NO: 493576 - RNA, 20 nt, Human
cugcagccucccugccuccc

SEQ ID NO: 493577 - RNA, 20 nt, Human
cugccgggcccuacucccgc

SEQ ID NO: 493578 - RNA, 19 nt, Human
cugccucccugccgggccc

SEQ ID NO: 493579 - RNA, 19 nt, Human
cugccucccugccgggccc

SEQ ID NO: 493580 - RNA, 23 nt, Human
cugccucccugccgggcccuacu

SEQ ID NO: 493581 - RNA, 20 nt, Human
gacugaaguuaggggguccc

SEQ ID NO: 493582 - RNA, 24 nt, Human
gagccggugcgcccugguccugga

SEQ ID NO: 493583 - RNA, 21 nt, Human
gauuucguaguuccuuuccuu

SEQ ID NO: 493584 - RNA, 25 nt, Human
gcaagagagggaccacauugauuuc

SEQ ID NO: 493585 - RNA, 18 nt, Human
gccgcgccugugccgcgc

SEQ ID NO: 493586 - RNA, 19 nt, Human
gccgggcccuacucccgcc

SEQ ID NO: 493587 - RNA, 21 nt, Human
gcgcccugguccuggaucaca

SEQ ID NO: 493588 - RNA, 18 nt, Human
gcuuugcuucucuucccc

SEQ ID NO: 493589 - RNA, 20 nt, Human
ggcgcagcccgcgacucuga

SEQ ID NO: 493590 - RNA, 20 nt, Human
ggcgcgguggcagcagcagg

SEQ ID NO: 493591 - RNA, 21 nt, Human
ggcgcgguggcagcagcaggu

SEQ ID NO: 493592 - RNA, 23 nt, Human
ggggacugaaguuaggggguccc

SEQ ID NO: 493593 - RNA, 19 nt, Human
ggugaaagaaauaaaagga

SEQ ID NO: 493594 - RNA, 19 nt, Human
gugcuugucuccacacuga

SEQ ID NO: 493595 - RNA, 23 nt, Human
uaaaaauaaauauuagaacaguu

SEQ ID NO: 493596 - RNA, 21 nt, Human
uaaaauacuuuugcacacugu

SEQ ID NO: 493597 - RNA, 18 nt, Human
uaaggcacaugucuugca

SEQ ID NO: 493598 - RNA, 23 nt, Human
uacuuuugcacacuguaaauuuc

SEQ ID NO: 493599 - RNA, 21 nt, Human
uauacauuacauugacuagau

SEQ ID NO: 493600 - RNA, 22 nt, Human
uaucaaacacuuaugcaaaggu

SEQ ID NO: 493601 - RNA, 22 nt, Human
ucaaaagagcauguauugaaaa

SEQ ID NO: 493602 - RNA, 23 nt, Human
ucaaacacuuaugcaaagguaaa

SEQ ID NO: 493603 - RNA, 19 nt, Human
ucagagagcugcuucucau

SEQ ID NO: 493604 - RNA, 24 nt, Human
uccagugucaaucccaaaccccga

SEQ ID NO: 493605 - RNA, 18 nt, Human
ucuggaaccaagucaaug

SEQ ID NO: 493606 - RNA, 18 nt, Human
ugaaagaaauaaaaggaa

SEQ ID NO: 493607 - RNA, 20 nt, Human
ugaaauagcuucuuauuucu

SEQ ID NO: 493608 - RNA, 20 nt, Human
ugaaguuugggugcauccuu

SEQ ID NO: 493609 - RNA, 23 nt, Human
ugagaagaacaaggcguaagcau

SEQ ID NO: 493610 - RNA, 20 nt, Human
ugauaacaacuuuaucugca

SEQ ID NO: 493611 - RNA, 25 nt, Human
ugcaacuaucugccuccagugucaa

SEQ ID NO: 493612 - RNA, 19 nt, Human
ugcccagggcgcagcccgc

SEQ ID NO: 493613 - RNA, 21 nt, Human
ugcccagggcgcagcccgcga

SEQ ID NO: 493614 - RNA, 18 nt, Human
ugcguggagcgagggcgg

SEQ ID NO: 493615 - RNA, 19 nt, Human
uggaaccaagucaaugagu

SEQ ID NO: 493616 - RNA, 22 nt, Human
uggagcgagggcggccucugcc

SEQ ID NO: 493617 - RNA, 19 nt, Human
ugggugcauccuuuagcaa

SEQ ID NO: 493618 - RNA, 21 nt, Human
ugguacuauauuugugugugu

SEQ ID NO: 493619 - RNA, 20 nt, Human
ugguccuggaucacagcagc

SEQ ID NO: 493620 - RNA, 24 nt, Human
ugugcggggcuggaguucaagacu

SEQ ID NO: 493621 - RNA, 21 nt, Human
uguugcguggagcgagggcgg

SEQ ID NO: 493622 - RNA, 23 nt, Human
uuagcaaaauaagcaugucucac

SEQ ID NO: 493623 - RNA, 20 nt, Human
uuccuaaaaugucugugugc

SEQ ID NO: 493624 - RNA, 19 nt, Human
uugaaguuugaaguuuggg

SEQ ID NO: 493625 - RNA, 19 nt, Human
uuuaaucaaaagagcaugu

SEQ ID NO: 493626 - RNA, 24 nt, Human
uuucacacgauuucguaguuccuu

SEQ ID NO: 493627 - RNA, 22 nt, Human
uuuuuuuuuuuuuuuucuucag

SEQ ID NO: 493628 - RNA, 20 nt, Human
aaaaacugauuaaaauuuga

SEQ ID NO: 493629 - RNA, 21 nt, Human
aaaaagacaaacugacuuugg

SEQ ID NO: 493630 - RNA, 20 nt, Human
aaacaaaagauuacagcagc

SEQ ID NO: 493631 - RNA, 22 nt, Human
aaagaugagaggcacaaaaaga

SEQ ID NO: 493632 - RNA, 23 nt, Human
aagauuacagcagcaagccacca

SEQ ID NO: 493633 - RNA, 24 nt, Human
acaaaaacauaaaaaaaauguucc

SEQ ID NO: 493634 - RNA, 22 nt, Human
acaggcaaggcccaaacaccgg

SEQ ID NO: 493635 - RNA, 21 nt, Human
agaggcacaaaaagacaaacu

SEQ ID NO: 493636 - RNA, 25 nt, Human
agccaccacuucacacaguauuaaa

SEQ ID NO: 493637 - RNA, 19 nt, Human
aggcaaggcccaaacaccg

SEQ ID NO: 493638 - RNA, 24 nt, Human
aggcccaaacaccgggaacggcaa

SEQ ID NO: 493639 - RNA, 20 nt, Human
aguaacacaacaacaaaaca

SEQ ID NO: 493640 - RNA, 18 nt, Human
caaaaagacaaacugacu

SEQ ID NO: 493641 - RNA, 20 nt, Human
caaagaaauacugcaauuau

SEQ ID NO: 493642 - RNA, 22 nt, Human
caacaaaacaaaagauuacagc

SEQ ID NO: 493643 - RNA, 19 nt, Human
caaggcccaaacaccggga

SEQ ID NO: 493644 - RNA, 21 nt, Human
cacaaaccuuuuaagucuaca

SEQ ID NO: 493645 - RNA, 18 nt, Human
caccgucacaggcaaggc

SEQ ID NO: 493646 - RNA, 19 nt, Human
cagcagcaagccaccacuu

SEQ ID NO: 493647 - RNA, 19 nt, Human
caggcaaggcccaaacacc

SEQ ID NO: 493648 - RNA, 18 nt, Human
caguaacacaacaacaaa

SEQ ID NO: 493649 - RNA, 23 nt, Human
cauagaaaaaacugcagagcuuc

SEQ ID NO: 493650 - RNA, 21 nt, Human
ccacuucacacaguauuaaaa

SEQ ID NO: 493651 - RNA, 20 nt, Human
ccuaauguuaacccugaaau

SEQ ID NO: 493652 - RNA, 21 nt, Human
cugaaaugccacauucaguaa

SEQ ID NO: 493653 - RNA, 23 nt, Human
cugaaaugccacauucaguaaca

SEQ ID NO: 493654 - RNA, 24 nt, Human
cugcaauuaugguuaugggcuacu

SEQ ID NO: 493655 - RNA, 19 nt, Human
gaaaugccacauucaguaa

SEQ ID NO: 493656 - RNA, 18 nt, Human
gaaccuaauguuaacccu

SEQ ID NO: 493657 - RNA, 18 nt, Human
gcaagaggaugcguuugc

SEQ ID NO: 493658 - RNA, 22 nt, Human
gcaagccaccacuucacacagu

SEQ ID NO: 493659 - RNA, 18 nt, Human
gccucuucaaguauagga

SEQ ID NO: 493660 - RNA, 21 nt, Human
ggaaauaauguaauagccuuc

SEQ ID NO: 493661 - RNA, 21 nt, Human
ggacacaacuaugguuccuac

SEQ ID NO: 493662 - RNA, 27 nt, Human
gggaacggcaagaggaugccgguaccc

SEQ ID NO: 493663 - RNA, 22 nt, Human
guaacacaacaacaaaacaaaa

SEQ ID NO: 493664 - RNA, 24 nt, Human
guaauagccuuccuuccaucuccc

SEQ ID NO: 493665 - RNA, 21 nt, Human
uaacacaacaacaaaacaaaa

SEQ ID NO: 493666 - RNA, 23 nt, Human
uaacacaacaacaaaacaaaaga

SEQ ID NO: 493667 - RNA, 28 nt, Human
uaacacaacaacaaaacaaaagauuaca

SEQ ID NO: 493668 - RNA, 21 nt, Human
uaacagagaaauacaaagaaa

SEQ ID NO: 493669 - RNA, 22 nt, Human
uaaccaaauugauaccucugua

SEQ ID NO: 493670 - RNA, 20 nt, Human
uaacuaaagguuuuaagagg

SEQ ID NO: 493671 - RNA, 25 nt, Human
uaagaacacaaauccaugaaaaaac

SEQ ID NO: 493672 - RNA, 18 nt, Human
uacauaacacaaaagaaa

SEQ ID NO: 493673 - RNA, 18 nt, Human
uacuauacuaccucagaa

SEQ ID NO: 493674 - RNA, 22 nt, Human
uagaaaaaacugcagagcuuca

SEQ ID NO: 493675 - RNA, 23 nt, Human
uagucucuaaaucaguaacaauu

SEQ ID NO: 493676 - RNA, 23 nt, Human
uaugguuccuaccaguagggaga

SEQ ID NO: 493677 - RNA, 19 nt, Human
uccacaaaccuuuuaaguc

SEQ ID NO: 493678 - RNA, 26 nt, Human
ucccacauagaaaaaacugcagagcu

SEQ ID NO: 493679 - RNA, 21 nt, Human
uccuauaacaucauacugcuu

SEQ ID NO: 493680 - RNA, 24 nt, Human
ucuguaaucuuauuuauguuuccu

SEQ ID NO: 493681 - RNA, 23 nt, Human
ugcagagcuucaucucuuccuua

SEQ ID NO: 493682 - RNA, 18 nt, Human
uggcuuuuaagaaccuaa

SEQ ID NO: 493683 - RNA, 21 nt, Human
uuaacauguaauagucauaaa

SEQ ID NO: 493684 - RNA, 23 nt, Human
uucaaguacuguaagaacacaaa

SEQ ID NO: 493685 - RNA, 24 nt, Human
uugcuuuacuaauuauggaauaau

SEQ ID NO: 493686 - RNA, 20 nt, Human
aagagauagcaaguguucgg

SEQ ID NO: 493687 - RNA, 19 nt, Human
agcccgcgccuggcgcugg

SEQ ID NO: 493688 - RNA, 19 nt, Human
agguggagggagaggcugg

SEQ ID NO: 493689 - RNA, 21 nt, Human
augaaacagcagcagcaagag

SEQ ID NO: 493690 - RNA, 23 nt, Human
cagcagcagcaagagauagcaag

SEQ ID NO: 493691 - RNA, 22 nt, Human
cccgccgccgccaccgagcgca

SEQ ID NO: 493692 - RNA, 22 nt, Human
ccuuccaugaaacagcagcagc

SEQ ID NO: 493693 - RNA, 18 nt, Human
cgggcccgcacggcggag

SEQ ID NO: 493694 - RNA, 18 nt, Human
gagaggcuggcggccggg

SEQ ID NO: 493695 - RNA, 19 nt, Human
ggagaggcuggcggccggg

SEQ ID NO: 493696 - RNA, 21 nt, Human
gggcagggagagguggaggga

SEQ ID NO: 493697 - RNA, 18 nt, Human
gguggagggagaggcugg

SEQ ID NO: 493698 - RNA, 19 nt, Human
uagcaaguguucggaaguc

SEQ ID NO: 493699 - RNA, 21 nt, Human
uagcaaguguucggaagucuc

SEQ ID NO: 493700 - RNA, 19 nt, Human
uaucuccuuccaugaaaca

SEQ ID NO: 493701 - RNA, 20 nt, Human
uccugcgacugccgggcugg

SEQ ID NO: 493702 - RNA, 20 nt, Human
ugaaacagcagcagcaagag

SEQ ID NO: 493703 - RNA, 24 nt, Human
ugaaauagguauaacacuuaaaua

SEQ ID NO: 493704 - RNA, 20 nt, Human
ugggggcagggagaggugga

SEQ ID NO: 493705 - RNA, 21 nt, Human
ugggggcagggagagguggga

SEQ ID NO: 493706 - RNA, 19 nt, Human
uuuuuuuuuuuuuuuuuaa

SEQ ID NO: 493707 - RNA, 27 nt, Human
cagugaguuuacuuucagauggaauuc

SEQ ID NO: 493708 - RNA, 18 nt, Human
ugcuugaggaguauagag

SEQ ID NO: 493709 - RNA, 27 nt, Human
aaaaaaagauaaugaaaugagaagagg

SEQ ID NO: 493710 - RNA, 20 nt, Human
aaaaauaucugaacagucaa

SEQ ID NO: 493711 - RNA, 24 nt, Human
aaacuaguuccauaaagcauuuua

SEQ ID NO: 493712 - RNA, 20 nt, Human
aacaugcuuauacaagaggu

SEQ ID NO: 493713 - RNA, 19 nt, Human
aacauggugaaccccgucu

SEQ ID NO: 493714 - RNA, 20 nt, Human
aacauggugaaccccgucuc

SEQ ID NO: 493715 - RNA, 21 nt, Human
aaccccgucucuacuaaaaaa

SEQ ID NO: 493716 - RNA, 20 nt, Human
aagagauaaugaaggccagg

SEQ ID NO: 493717 - RNA, 22 nt, Human
aagccauagagggcucuaaaac

SEQ ID NO: 493718 - RNA, 18 nt, Human
aaggccuuaaagccauag

SEQ ID NO: 493719 - RNA, 24 nt, Human
aaucacuugaaccugggaggcgga

SEQ ID NO: 493720 - RNA, 20 nt, Human
aaugcuuauuuuuaaauuuc

SEQ ID NO: 493721 - RNA, 20 nt, Human
acaguagaaaaauaucugaa

SEQ ID NO: 493722 - RNA, 25 nt, Human
accccgucucuacuaaaaaauacaa

SEQ ID NO: 493723 - RNA, 18 nt, Human
accgcaauccagccuggg

SEQ ID NO: 493724 - RNA, 20 nt, Human
acgcuaaaagcgggcagugc

SEQ ID NO: 493725 - RNA, 24 nt, Human
acugaaucgagcuguuuauaagaa

SEQ ID NO: 493726 - RNA, 23 nt, Human
agaagcucuucaaaaucgacugu

SEQ ID NO: 493727 - RNA, 23 nt, Human
agaauaccucgaaagaauaccac

SEQ ID NO: 493728 - RNA, 22 nt, Human
agaaucacuugaaccugggagg

SEQ ID NO: 493729 - RNA, 23 nt, Human
agacgcuaaaagcgggcagugcu

SEQ ID NO: 493730 - RNA, 18 nt, Human
agaggaacagaggaacag

SEQ ID NO: 493731 - RNA, 22 nt, Human
agaggaacagaggggaaugucc

SEQ ID NO: 493732 - RNA, 24 nt, Human
agaggaacagaggggaauguccug

SEQ ID NO: 493733 - RNA, 23 nt, Human
agccuggccaacauggugaaccc

SEQ ID NO: 493734 - RNA, 23 nt, Human
aggaauuuaaagcaaagaacagu

SEQ ID NO: 493735 - RNA, 24 nt, Human
aggaugaggcaggagaaucacuug

SEQ ID NO: 493736 - RNA, 22 nt, Human
aggcaggagaaucacuugaacc

SEQ ID NO: 493737 - RNA, 24 nt, Human
aggcaggagaaucacuugaaccug

SEQ ID NO: 493738 - RNA, 22 nt, Human
aggcagguggaucaguugaggg

SEQ ID NO: 493739 - RNA, 24 nt, Human
aggcaugguggcucacgccuguaa

SEQ ID NO: 493740 - RNA, 24 nt, Human
aggcggagguugcagugagcugag

SEQ ID NO: 493741 - RNA, 18 nt, Human
aggcugaggcagguggau

SEQ ID NO: 493742 - RNA, 24 nt, Human
aggcugaggcagguggaucaguug

SEQ ID NO: 493743 - RNA, 25 nt, Human
agggggcaggagaagagaggaacag

SEQ ID NO: 493744 - RNA, 23 nt, Human
caacauggugaaccccgucucua

SEQ ID NO: 493745 - RNA, 21 nt, Human
caagagggacagaaaacacca

SEQ ID NO: 493746 - RNA, 24 nt, Human
caagagggacagaaaacaccagug

SEQ ID NO: 493747 - RNA, 23 nt, Human
caccgcaauccagccugggcaac

SEQ ID NO: 493748 - RNA, 18 nt, Human
cacgccuguaaucccagc

SEQ ID NO: 493749 - RNA, 19 nt, Human
cacgccuguaaucccagcu

SEQ ID NO: 493750 - RNA, 23 nt, Human
cacgccuguaaucccggcggcac

SEQ ID NO: 493751 - RNA, 27 nt, Human
cacgccuguaaucccggcggcacuuug

SEQ ID NO: 493752 - RNA, 21 nt, Human
cacuugaaccugggaggcgga

SEQ ID NO: 493753 - RNA, 20 nt, Human
caggcugguuuuuaaagcac

SEQ ID NO: 493754 - RNA, 20 nt, Human
cauagagggcucuaaaacua

SEQ ID NO: 493755 - RNA, 22 nt, Human
ccaccgcaauccagccugggca

SEQ ID NO: 493756 - RNA, 22 nt, Human
ccgcaauccagccugggcaacu

SEQ ID NO: 493757 - RNA, 22 nt, Human
ccuggccaacauggugaacccc

SEQ ID NO: 493758 - RNA, 23 nt, Human
ccuggccaacauggugaaccccg

SEQ ID NO: 493759 - RNA, 19 nt, Human
ccugggaggcggagguugc

SEQ ID NO: 493760 - RNA, 21 nt, Human
ccuguaaucccagcuacucag

SEQ ID NO: 493761 - RNA, 22 nt, Human
ccuguaaucccagcuacucagg

SEQ ID NO: 493762 - RNA, 19 nt, Human
ccugucgaggaggggcugc

SEQ ID NO: 493763 - RNA, 24 nt, Human
cgccuguaaucccagcuacucagg

SEQ ID NO: 493764 - RNA, 21 nt, Human
cgccuguaaucccggcggcac

SEQ ID NO: 493765 - RNA, 26 nt, Human
cgccuguaaucccggcggcacuuugg

SEQ ID NO: 493766 - RNA, 27 nt, Human
cgccuguaaucccggcggcacuuuggg

SEQ ID NO: 493767 - RNA, 20 nt, Human
cgcgcgggugcccgcagccg

SEQ ID NO: 493768 - RNA, 24 nt, Human
cggcacuuugggaggcugaggcag

SEQ ID NO: 493769 - RNA, 26 nt, Human
cggcacuuugggaggcugaggcaggu

SEQ ID NO: 493770 - RNA, 19 nt, Human
cgggugcccgcagccggcg

SEQ ID NO: 493771 - RNA, 20 nt, Human
cuaaacuauaaauuuagcua

SEQ ID NO: 493772 - RNA, 19 nt, Human
cuacuaaaaaauacaaaaa

SEQ ID NO: 493773 - RNA, 27 nt, Human
cucacgccuguaaucccggcggcacuu

SEQ ID NO: 493774 - RNA, 21 nt, Human
cucuacuaaaaaauacaaaaa

SEQ ID NO: 493775 - RNA, 18 nt, Human
cugcagggugggccuguc

SEQ ID NO: 493776 - RNA, 25 nt, Human
cuuaagacaaaaauucaaauguaac

SEQ ID NO: 493777 - RNA, 24 nt, Human
gaaggccaggcaugguggcucacg

SEQ ID NO: 493778 - RNA, 23 nt, Human
gagacaagccuggccaacauggu

SEQ ID NO: 493779 - RNA, 23 nt, Human
gagacaguggaguggguccaggg

SEQ ID NO: 493780 - RNA, 21 nt, Human
gagguugcagugagcugagac

SEQ ID NO: 493781 - RNA, 24 nt, Human
gaucaguugagguuaggaguuuga

SEQ ID NO: 493782 - RNA, 19 nt, Human
gauuugauaauuuaacuug

SEQ ID NO: 493783 - RNA, 23 nt, Human
gcacuuugggaggcugaggcagg

SEQ ID NO: 493784 - RNA, 23 nt, Human
gcaggagaaucacuugaaccugg

SEQ ID NO: 493785 - RNA, 18 nt, Human
gccaacauggugaacccc

SEQ ID NO: 493786 - RNA, 23 nt, Human
gccaacauggugaaccccgucuc

SEQ ID NO: 493787 - RNA, 22 nt, Human
gccaccgcaauccagccugggc

SEQ ID NO: 493788 - RNA, 22 nt, Human
gccucugcaguuuggagcugca

SEQ ID NO: 493789 - RNA, 22 nt, Human
ggagguugcagugagcugagac

SEQ ID NO: 493790 - RNA, 23 nt, Human
ggagguugcagugagcugagaca

SEQ ID NO: 493791 - RNA, 24 nt, Human
ggagguugcagugagcugagacag

SEQ ID NO: 493792 - RNA, 21 nt, Human
ggcacacgccuguaaucccag

SEQ ID NO: 493793 - RNA, 23 nt, Human
ggcaugguggcacacgccuguaa

SEQ ID NO: 493794 - RNA, 19 nt, Human
gggaauguccuggguggca

SEQ ID NO: 493795 - RNA, 24 nt, Human
gggacagaaaacaccagugguugc

SEQ ID NO: 493796 - RNA, 19 nt, Human
gggcaacugagugagaauc

SEQ ID NO: 493797 - RNA, 26 nt, Human
gggcagugcuguguuuacuuagagac

SEQ ID NO: 493798 - RNA, 24 nt, Human
gguggcacacgccuguaaucccag

SEQ ID NO: 493799 - RNA, 24 nt, Human
gguggcucacgccuguaaucccgg

SEQ ID NO: 493800 - RNA, 18 nt, Human
gugaagaagugaagacgc

SEQ ID NO: 493801 - RNA, 18 nt, Human
gugccaggaauuuaaagc

SEQ ID NO: 493802 - RNA, 24 nt, Human
guugcagugagcugagacagcgcc

SEQ ID NO: 493803 - RNA, 20 nt, Human
uaacuuggaauuuuucugug

SEQ ID NO: 493804 - RNA, 18 nt, Human
uaagacaaaaauucaaau

SEQ ID NO: 493805 - RNA, 20 nt, Human
uaagacaaaaauucaaaugu

SEQ ID NO: 493806 - RNA, 26 nt, Human
uaccuaaacuauaaauuuagcuaaaa

SEQ ID NO: 493807 - RNA, 18 nt, Human
uaugauagguuuucucuu

SEQ ID NO: 493808 - RNA, 19 nt, Human
ucaaugaacaagagggaca

SEQ ID NO: 493809 - RNA, 24 nt, Human
ucacuugaaccugggaggcggagg

SEQ ID NO: 493810 - RNA, 25 nt, Human
ucacuugaaccugggaggcggaggu

SEQ ID NO: 493811 - RNA, 24 nt, Human
uccagccugggcaacugagugaga

SEQ ID NO: 493812 - RNA, 23 nt, Human
uccucgccaggcugguuuuuaaa

SEQ ID NO: 493813 - RNA, 19 nt, Human
uccuggguggcagaacugu

SEQ ID NO: 493814 - RNA, 22 nt, Human
uccuggguggcagaacuguccu

SEQ ID NO: 493815 - RNA, 25 nt, Human
ucucuuauagacaguaaaaagaagu

SEQ ID NO: 493816 - RNA, 23 nt, Human
ucugcaguuuggagcugcaaugg

SEQ ID NO: 493817 - RNA, 24 nt, Human
ucugcaguuuggagcugcaauggc

SEQ ID NO: 493818 - RNA, 24 nt, Human
ucugucuuuaaaaaaaaaaaaaag

SEQ ID NO: 493819 - RNA, 24 nt, Human
ucuuuaaaaaaaaaaaaaagauaa

SEQ ID NO: 493820 - RNA, 24 nt, Human
ugaaccugggaggcggagguugca

SEQ ID NO: 493821 - RNA, 25 nt, Human
ugagaagagccaaacauuuacccua

SEQ ID NO: 493822 - RNA, 20 nt, Human
ugaggcaggagaaucacuug

SEQ ID NO: 493823 - RNA, 24 nt, Human
ugaggcaggagaaucacuugaacc

SEQ ID NO: 493824 - RNA, 25 nt, Human
ugaggcaggagaaucacuugaaccu

SEQ ID NO: 493825 - RNA, 26 nt, Human
ugaggcagguggaucaguugagguua

SEQ ID NO: 493826 - RNA, 22 nt, Human
ugcaauggcugccaguaucggc

SEQ ID NO: 493827 - RNA, 23 nt, Human
ugcaauggcugccaguaucggcu

SEQ ID NO: 493828 - RNA, 21 nt, Human
ugcagggugggccugucgagg

SEQ ID NO: 493829 - RNA, 21 nt, Human
ugccugagcugcagggugggc

SEQ ID NO: 493830 - RNA, 21 nt, Human
uggaguggguccagggcuguc

SEQ ID NO: 493831 - RNA, 24 nt, Human
uggaucaguugagguuaggaguuu

SEQ ID NO: 493832 - RNA, 21 nt, Human
uggcacacgccuguaauccca

SEQ ID NO: 493833 - RNA, 20 nt, Human
uggcucacgccuguaauccc

SEQ ID NO: 493834 - RNA, 23 nt, Human
uggcucacgccuguaaucccggc

SEQ ID NO: 493835 - RNA, 29 nt, Human
ugggaggcggagguugcagugacaacggu

SEQ ID NO: 493836 - RNA, 24 nt, Human
ugggaggcggagguugcagugagc

SEQ ID NO: 493837 - RNA, 24 nt, Human
ugggaggcugaggcagguggauca

SEQ ID NO: 493838 - RNA, 23 nt, Human
ugggcaacugagugagaaucugu

SEQ ID NO: 493839 - RNA, 24 nt, Human
ugguggcacacgccuguaauccca

SEQ ID NO: 493840 - RNA, 23 nt, Human
ugguggcucacgccuguaauccc

SEQ ID NO: 493841 - RNA, 19 nt, Human
uguaaucccagcuacucag

SEQ ID NO: 493842 - RNA, 18 nt, Human
uguccucgccaggcuggu

SEQ ID NO: 493843 - RNA, 19 nt, Human
ugucugggucgcuuucccu

SEQ ID NO: 493844 - RNA, 20 nt, Human
uucauuuuuaaaaaagagau

SEQ ID NO: 493845 - RNA, 24 nt, Human
uugaaccugggaggcggagguugc

SEQ ID NO: 493846 - RNA, 19 nt, Human
uugcagugagcugagacag

SEQ ID NO: 493847 - RNA, 22 nt, Human
uugcagugagcugagacagcgc

SEQ ID NO: 493848 - RNA, 25 nt, Human
uugggaggcugaggcagguggauca

SEQ ID NO: 493849 - RNA, 18 nt, Human
uuggugccugagcugcag

SEQ ID NO: 493850 - RNA, 22 nt, Human
uuuuuuuuuaguacaacaugcu

SEQ ID NO: 493851 - RNA, 24 nt, Human
aaaccaaucacccgagcaaccuug

SEQ ID NO: 493852 - RNA, 24 nt, Human
aacagcaccacugcccccgcuacc

SEQ ID NO: 493853 - RNA, 23 nt, Human
aaccugaaauauauauugaggaa

SEQ ID NO: 493854 - RNA, 22 nt, Human
aagccaguaaaccaaucacccg

SEQ ID NO: 493855 - RNA, 23 nt, Human
agaguuuuguguucuuuuucuuu

SEQ ID NO: 493856 - RNA, 24 nt, Human
agcugggauuacaagcaucugcua

SEQ ID NO: 493857 - RNA, 20 nt, Human
aggaccagaaaaccaagucu

SEQ ID NO: 493858 - RNA, 19 nt, Human
agggaaggccucaacaaca

SEQ ID NO: 493859 - RNA, 20 nt, Human
aggggguuuuaucacauugg

SEQ ID NO: 493860 - RNA, 24 nt, Human
aggggguuuuaucacauuggucag

SEQ ID NO: 493861 - RNA, 21 nt, Human
aguagcugggauuacaagcau

SEQ ID NO: 493862 - RNA, 20 nt, Human
agugcaguugugcgaucucg

SEQ ID NO: 493863 - RNA, 24 nt, Human
aucucuuauaggaaagaugaagac

SEQ ID NO: 493864 - RNA, 22 nt, Human
augccugagccucuugaguagc

SEQ ID NO: 493865 - RNA, 23 nt, Human
augccugagccucuugaguagcu

SEQ ID NO: 493866 - RNA, 20 nt, Human
caacagaccagaauuccaau

SEQ ID NO: 493867 - RNA, 21 nt, Human
caagucuugaaagaaggacuu

SEQ ID NO: 493868 - RNA, 18 nt, Human
cacauuggucaggcuggu

SEQ ID NO: 493869 - RNA, 23 nt, Human
cacugcagccuccaccuuuuggg

SEQ ID NO: 493870 - RNA, 18 nt, Human
cacugcccccgcuaccgc

SEQ ID NO: 493871 - RNA, 28 nt, Human
cagaaaaccaagucuugaaagaaggacc

SEQ ID NO: 493872 - RNA, 22 nt, Human
cauugucaacaaccugaaauau

SEQ ID NO: 493873 - RNA, 18 nt, Human
ccaacagaccagaauucc

SEQ ID NO: 493874 - RNA, 22 nt, Human
ccacugcccccgcuaccgccug

SEQ ID NO: 493875 - RNA, 19 nt, Human
cccaugcuagacauuagag

SEQ ID NO: 493876 - RNA, 20 nt, Human
ccucuccccgccgccgugac

SEQ ID NO: 493877 - RNA, 19 nt, Human
cgccuuaagggaaauaauc

SEQ ID NO: 493878 - RNA, 18 nt, Human
cggggcccccggccgagc

SEQ ID NO: 493879 - RNA, 19 nt, Human
cucacugcagccuccaccu

SEQ ID NO: 493880 - RNA, 24 nt, Human
cucacugcagccuccaccuuuugg

SEQ ID NO: 493881 - RNA, 23 nt, Human
cuccccgccgccgugacccucgu

SEQ ID NO: 493882 - RNA, 21 nt, Human
cucuccccgccgccgugaccc

SEQ ID NO: 493883 - RNA, 23 nt, Human
cugaaaaugcugguagaugcaau

SEQ ID NO: 493884 - RNA, 24 nt, Human
cugagccucuugaguagcugggau

SEQ ID NO: 493885 - RNA, 23 nt, Human
cugcagccuccaccuuuuggguu

SEQ ID NO: 493886 - RNA, 22 nt, Human
cugugugcauuguuccuuaccc

SEQ ID NO: 493887 - RNA, 23 nt, Human
cuucuuuuuuuuaaaaaacaaag

SEQ ID NO: 493888 - RNA, 24 nt, Human
gagaucaguuuugugcgaagccag

SEQ ID NO: 493889 - RNA, 25 nt, Human
gaguagcugggauuacaagcaucug

SEQ ID NO: 493890 - RNA, 24 nt, Human
gauuacaagcaucugcuaccaugc

SEQ ID NO: 493891 - RNA, 22 nt, Human
gcagccuccaccuuuuggguuc

SEQ ID NO: 493892 - RNA, 24 nt, Human
ggggguuuuaucacauuggucagg

SEQ ID NO: 493893 - RNA, 22 nt, Human
gggguuuuaucacauuggucag

SEQ ID NO: 493894 - RNA, 23 nt, Human
gggguuuuaucacauuggucagg

SEQ ID NO: 493895 - RNA, 20 nt, Human
ggguucaagagauucucaug

SEQ ID NO: 493896 - RNA, 18 nt, Human
guagcugggauuacaagc

SEQ ID NO: 493897 - RNA, 18 nt, Human
guuccuuacccaucguag

SEQ ID NO: 493898 - RNA, 20 nt, Human
uaaaccaaucacccgagcaa

SEQ ID NO: 493899 - RNA, 21 nt, Human
uaagauaggcuugauuuguua

SEQ ID NO: 493900 - RNA, 24 nt, Human
uaauuuuugucuuuuuaguagaga

SEQ ID NO: 493901 - RNA, 21 nt, Human
uacaucuucauuggcauuuca

SEQ ID NO: 493902 - RNA, 18 nt, Human
uacuagagaguucuacuc

SEQ ID NO: 493903 - RNA, 22 nt, Human
uagcaauuggaacugaaaaugc

SEQ ID NO: 493904 - RNA, 26 nt, Human
uagggaaggccucaacaacaggugua

SEQ ID NO: 493905 - RNA, 21 nt, Human
uauaggaaagaugaagaccaa

SEQ ID NO: 493906 - RNA, 21 nt, Human
ucacccgagcaaccuuggccc

SEQ ID NO: 493907 - RNA, 18 nt, Human
ucacugcagccuccaccu

SEQ ID NO: 493908 - RNA, 23 nt, Human
ucacugcagccuccaccuuuugg

SEQ ID NO: 493909 - RNA, 24 nt, Human
ucacugcagccuccaccuuuuggg

SEQ ID NO: 493910 - RNA, 25 nt, Human
ucacugcagccuccaccuuuugggu

SEQ ID NO: 493911 - RNA, 25 nt, Human
uccauggacacgccaugguuccaga

SEQ ID NO: 493912 - RNA, 22 nt, Human
uccccgccgccgugacccucgu

SEQ ID NO: 493913 - RNA, 25 nt, Human
uccccgccgccgugacccucguggg

SEQ ID NO: 493914 - RNA, 19 nt, Human
ucgcggcuccaccucuccc

SEQ ID NO: 493915 - RNA, 21 nt, Human
ucgcggcuccaccucuccccg

SEQ ID NO: 493916 - RNA, 23 nt, Human
ucgugggagcgcggcuggaaaau

SEQ ID NO: 493917 - RNA, 24 nt, Human
ucuugaguagcugggauuacaagc

SEQ ID NO: 493918 - RNA, 20 nt, Human
ucuugcuuugucgcccaggg

SEQ ID NO: 493919 - RNA, 24 nt, Human
ucuugcuuugucgcccagggugaa

SEQ ID NO: 493920 - RNA, 19 nt, Human
ugaagugcaguugugcgau

SEQ ID NO: 493921 - RNA, 19 nt, Human
ugaguaguucccaugcuag

SEQ ID NO: 493922 - RNA, 23 nt, Human
ugcagaagaggccaucgccuuaa

SEQ ID NO: 493923 - RNA, 23 nt, Human
ugcauuguuccuuacccaucgua

SEQ ID NO: 493924 - RNA, 22 nt, Human
ugccugagccucuugaguagcu

SEQ ID NO: 493925 - RNA, 19 nt, Human
ugcgaagccaguaaaccaa

SEQ ID NO: 493926 - RNA, 21 nt, Human
uggcaaggggcaccgaggacu

SEQ ID NO: 493927 - RNA, 18 nt, Human
ugggauuacaagcaucug

SEQ ID NO: 493928 - RNA, 22 nt, Human
ugggauuacaagcaucugcuac

SEQ ID NO: 493929 - RNA, 24 nt, Human
ugggauuacaagcaucugcuacca

SEQ ID NO: 493930 - RNA, 18 nt, Human
ugucaacaaccugaaaua

SEQ ID NO: 493931 - RNA, 21 nt, Human
uguuacuggucuuaaugaggg

SEQ ID NO: 493932 - RNA, 23 nt, Human
uuaguagagacaggggguuuuau

SEQ ID NO: 493933 - RNA, 19 nt, Human
uuauuccaacuucuccuuc

SEQ ID NO: 493934 - RNA, 24 nt, Human
uugaaggucuuuuauccauauugg

SEQ ID NO: 493935 - RNA, 18 nt, Human
uuggaacugaaaaugcug

SEQ ID NO: 493936 - RNA, 19 nt, Human
uuggaacugaaaaugcugg

SEQ ID NO: 493937 - RNA, 18 nt, Human
uuucucuucuucuucuuu

SEQ ID NO: 493938 - RNA, 24 nt, Human
uuugucgcccagggugaagugcag

SEQ ID NO: 493939 - RNA, 24 nt, Human
uuuuggguucaagagauucucaug

SEQ ID NO: 493940 - RNA, 22 nt, Human
uuuugucuuuuuaguagagaca

SEQ ID NO: 493941 - RNA, 23 nt, Human
uuuuuaguagagacaggggguuu

SEQ ID NO: 493942 - RNA, 20 nt, Human
uuuuugucuuuuuaguagag

SEQ ID NO: 493943 - RNA, 22 nt, Human
aacaaauauggugucuguaaau

SEQ ID NO: 493944 - RNA, 22 nt, Human
aacacacagacacgagaaaccu

SEQ ID NO: 493945 - RNA, 18 nt, Human
acacacagacacgagaaa

SEQ ID NO: 493946 - RNA, 18 nt, Human
acugagaaacagcaucca

SEQ ID NO: 493947 - RNA, 19 nt, Human
agaagccaaacacacagaa

SEQ ID NO: 493948 - RNA, 21 nt, Human
agacaugcacaagaaaucaag

SEQ ID NO: 493949 - RNA, 22 nt, Human
agccaaacacacagacacgaga

SEQ ID NO: 493950 - RNA, 24 nt, Human
aucaaggaugcaauaguucacaaa

SEQ ID NO: 493951 - RNA, 23 nt, Human
auguagccaucaguuuuagcaga

SEQ ID NO: 493952 - RNA, 24 nt, Human
cacgagaaaccugaccugauacug

SEQ ID NO: 493953 - RNA, 23 nt, Human
cagagacaugcacaagaaaucaa

SEQ ID NO: 493954 - RNA, 23 nt, Human
cauucuugucuuuagaagccaaa

SEQ ID NO: 493955 - RNA, 23 nt, Human
ccgugggugcugcccaaucaggg

SEQ ID NO: 493956 - RNA, 21 nt, Human
ccuuuccuuguggcagggaau

SEQ ID NO: 493957 - RNA, 24 nt, Human
cuaaugugcaagaaaguccucuuu

SEQ ID NO: 493958 - RNA, 20 nt, Human
gacacgagaaaccugaccug

SEQ ID NO: 493959 - RNA, 21 nt, Human
gccaaacacacagacacgaga

SEQ ID NO: 493960 - RNA, 21 nt, Human
uaaaacuaacaaucaguguau

SEQ ID NO: 493961 - RNA, 20 nt, Human
uacugagaaacagcauccac

SEQ ID NO: 493962 - RNA, 18 nt, Human
uccuuuccuuguggcagg

SEQ ID NO: 493963 - RNA, 18 nt, Human
ucugaacauaaaagaaaa

SEQ ID NO: 493964 - RNA, 19 nt, Human
ugagaaacagcauccacug

SEQ ID NO: 493965 - RNA, 23 nt, Human
ugagaaacagcauccacuggagg

SEQ ID NO: 493966 - RNA, 18 nt, Human
ugcagaacaaauauggug

SEQ ID NO: 493967 - RNA, 19 nt, Human
ugggggacuugggugggaa

SEQ ID NO: 493968 - RNA, 22 nt, Human
ugggugcugcccaaucagggca

SEQ ID NO: 493969 - RNA, 22 nt, Human
uucccagaguucaccugucaca

SEQ ID NO: 493970 - RNA, 24 nt, Human
uuuuuaguguggcuugauguuaau

SEQ ID NO: 493971 - RNA, 23 nt, Human
aaaaagcacagacaacauaaccc

SEQ ID NO: 493972 - RNA, 20 nt, Human
aacuaaggggaaaaugaguu

SEQ ID NO: 493973 - RNA, 19 nt, Human
aagcacagacaacauaacc

SEQ ID NO: 493974 - RNA, 23 nt, Human
aagcacagacaacauaaccccua

SEQ ID NO: 493975 - RNA, 23 nt, Human
aagcuaaaaauaaaaagcacaga

SEQ ID NO: 493976 - RNA, 18 nt, Human
agacaacauaaccccuaa

SEQ ID NO: 493977 - RNA, 21 nt, Human
caacauaaccccuaaauuaua

SEQ ID NO: 493978 - RNA, 24 nt, Human
cacuaauauauauaugacuauuuc

SEQ ID NO: 493979 - RNA, 22 nt, Human
ccccuaaauuauagaugaacaa

SEQ ID NO: 493980 - RNA, 19 nt, Human
ccuacccuugaaauuuugg

SEQ ID NO: 493981 - RNA, 24 nt, Human
cuaaaaauaaaaagcacagacaac

SEQ ID NO: 493982 - RNA, 24 nt, Human
gacauucauuugaagcuaaaaaua

SEQ ID NO: 493983 - RNA, 19 nt, Human
guauuuuguuaucuguacu

SEQ ID NO: 493984 - RNA, 22 nt, Human
uaaauuuuaccaguaaagugua

SEQ ID NO: 493985 - RNA, 18 nt, Human
uauuucuuccaucuuccu

SEQ ID NO: 493986 - RNA, 24 nt, Human
ucuuccaucuuccuacccuugaaa

SEQ ID NO: 493987 - RNA, 23 nt, Human
ugaaauuuuggaucuucugcuua

SEQ ID NO: 493988 - RNA, 21 nt, Human
uguuuugccuuuuuuguuuua

SEQ ID NO: 493989 - RNA, 21 nt, Human
uguuuuguuuugccuuuuuug

SEQ ID NO: 493990 - RNA, 21 nt, Human
uuaauuucuacccagauagca

SEQ ID NO: 493991 - RNA, 22 nt, Human
aaaacacccagcacauccugcg

SEQ ID NO: 493992 - RNA, 20 nt, Human
aaacaaaagcaaaaacacag

SEQ ID NO: 493993 - RNA, 25 nt, Human
aaacaaaagcaaaaacacagccaug

SEQ ID NO: 493994 - RNA, 27 nt, Human
aaacacccagcacauccugcguuaagc

SEQ ID NO: 493995 - RNA, 19 nt, Human
aaacauccacgcgcuugug

SEQ ID NO: 493996 - RNA, 20 nt, Human
aaacccggccagggaacugu

SEQ ID NO: 493997 - RNA, 19 nt, Human
aaagcaccugauccaugac

SEQ ID NO: 493998 - RNA, 23 nt, Human
aaaugcugggauuacagguauga

SEQ ID NO: 493999 - RNA, 24 nt, Human
aacguccuggggccaucguggugc

SEQ ID NO: 494000 - RNA, 25 nt, Human
aagcaaaaacacagccaugaaacaa

SEQ ID NO: 494001 - RNA, 22 nt, Human
aagcaaacccaccaacucagga

SEQ ID NO: 494002 - RNA, 25 nt, Human
aagcaauccucccaccuuggccucc

SEQ ID NO: 494003 - RNA, 19 nt, Human
aagcacaggcuccucugag

SEQ ID NO: 494004 - RNA, 20 nt, Human
aagcacaggcuccucugagg

SEQ ID NO: 494005 - RNA, 23 nt, Human
aagcgguuccgcggccccggcgc

SEQ ID NO: 494006 - RNA, 23 nt, Human
aagcuucacaagcaaacccacca

SEQ ID NO: 494007 - RNA, 22 nt, Human
aaggacccuccagggcccucau

SEQ ID NO: 494008 - RNA, 20 nt, Human
aauggcagaagacgcagacc

SEQ ID NO: 494009 - RNA, 18 nt, Human
aauuuauaaacagguccc

SEQ ID NO: 494010 - RNA, 22 nt, Human
aauuucucuccccuuagcucuc

SEQ ID NO: 494011 - RNA, 21 nt, Human
acagagacccagcagcucaaa

SEQ ID NO: 494012 - RNA, 24 nt, Human
acagaggagaagccagggcuggcc

SEQ ID NO: 494013 - RNA, 21 nt, Human
accaaauaaagcaggaggucu

SEQ ID NO: 494014 - RNA, 18 nt, Human
accaaggccuggaacguu

SEQ ID NO: 494015 - RNA, 18 nt, Human
accgcaccuggccucuac

SEQ ID NO: 494016 - RNA, 23 nt, Human
acgcugcugugucucaccaaggc

SEQ ID NO: 494017 - RNA, 18 nt, Human
acugcagcgaguugacag

SEQ ID NO: 494018 - RNA, 24 nt, Human
acuucaccauccagacaagaaacg

SEQ ID NO: 494019 - RNA, 22 nt, Human
agaaaauaaaaaaaacccaaga

SEQ ID NO: 494020 - RNA, 25 nt, Human
agacaagcuggaacagaggagaagc

SEQ ID NO: 494021 - RNA, 21 nt, Human
agacuccaccggcggccccga

SEQ ID NO: 494022 - RNA, 22 nt, Human
agagcugggcagcccucggcaa

SEQ ID NO: 494023 - RNA, 19 nt, Human
agaggagaagccagggcug

SEQ ID NO: 494024 - RNA, 19 nt, Human
agaggagaagccagggcug

SEQ ID NO: 494025 - RNA, 22 nt, Human
agcaaccaacuggcugacuccu

SEQ ID NO: 494026 - RNA, 18 nt, Human
agcaauggggcugggagc

SEQ ID NO: 494027 - RNA, 20 nt, Human
agccaccgcaccuggccucu

SEQ ID NO: 494028 - RNA, 20 nt, Human
agccaugagaaucuaaggcg

SEQ ID NO: 494029 - RNA, 18 nt, Human
agccugugagcauuggac

SEQ ID NO: 494030 - RNA, 18 nt, Human
agcguuuccaggagacgg

SEQ ID NO: 494031 - RNA, 22 nt, Human
agcuaggccugugaggauggca

SEQ ID NO: 494032 - RNA, 22 nt, Human
agcugagauggagacuucaggg

SEQ ID NO: 494033 - RNA, 18 nt, Human
agcugccuuuugccucca

SEQ ID NO: 494034 - RNA, 25 nt, Human
agcugggcagcccucggcaaacccu

SEQ ID NO: 494035 - RNA, 18 nt, Human
aggaaacauguuagggcc

SEQ ID NO: 494036 - RNA, 21 nt, Human
aggaaacauguuagggccugu

SEQ ID NO: 494037 - RNA, 19 nt, Human
aggaaaccagaagcagagc

SEQ ID NO: 494038 - RNA, 22 nt, Human
aggaccugggagggagcagggg

SEQ ID NO: 494039 - RNA, 19 nt, Human
aggaggaauucaggcacug

SEQ ID NO: 494040 - RNA, 18 nt, Human
aggagggagcagugggga

SEQ ID NO: 494041 - RNA, 28 nt, Human
aggcaaaauagcaaaagaaaagggaccc

SEQ ID NO: 494042 - RNA, 18 nt, Human
aggccccugcccacccag

SEQ ID NO: 494043 - RNA, 23 nt, Human
aggcccgagccggcuagcggcgg

SEQ ID NO: 494044 - RNA, 20 nt, Human
aggcccuaguauaggagagg

SEQ ID NO: 494045 - RNA, 20 nt, Human
aggccuggcuggaaauggaa

SEQ ID NO: 494046 - RNA, 21 nt, Human
aggcuggucuccaacucuugg

SEQ ID NO: 494047 - RNA, 18 nt, Human
agggaacugugucauguc

SEQ ID NO: 494048 - RNA, 18 nt, Human
agggaccacagcugcuuc

SEQ ID NO: 494049 - RNA, 18 nt, Human
aguggggaggcuggggaa

SEQ ID NO: 494050 - RNA, 24 nt, Human
aguggggaggcuggggaagaacgg

SEQ ID NO: 494051 - RNA, 24 nt, Human
auaaaagcccgaaacaaaacaccc

SEQ ID NO: 494052 - RNA, 24 nt, Human
auccagcuucuucucagggagggg

SEQ ID NO: 494053 - RNA, 20 nt, Human
augaaacaagaaagacacca

SEQ ID NO: 494054 - RNA, 19 nt, Human
augaacggagugugugaau

SEQ ID NO: 494055 - RNA, 21 nt, Human
augguguacauguauguaugu

SEQ ID NO: 494056 - RNA, 22 nt, Human
augucuguagccuuggaaacac

SEQ ID NO: 494057 - RNA, 19 nt, Human
auguggaugggucagagga

SEQ ID NO: 494058 - RNA, 22 nt, Human
auucuugguaccauccucagag

SEQ ID NO: 494059 - RNA, 21 nt, Human
caaaaacacagccaugaaaca

SEQ ID NO: 494060 - RNA, 22 nt, Human
caaaaagacagugugcaggacc

SEQ ID NO: 494061 - RNA, 24 nt, Human
caaaagcaaaaacacagccaugaa

SEQ ID NO: 494062 - RNA, 24 nt, Human
caaaaugcagcccucuggguuuac

SEQ ID NO: 494063 - RNA, 23 nt, Human
caaacccaccaacucaggagccc

SEQ ID NO: 494064 - RNA, 22 nt, Human
caaagcaggcccugacugcugg

SEQ ID NO: 494065 - RNA, 24 nt, Human
caaauaaagcaggaggucugacug

SEQ ID NO: 494066 - RNA, 22 nt, Human
caacccauucaugaaaacgcug

SEQ ID NO: 494067 - RNA, 19 nt, Human
caacucaggagcccuggau

SEQ ID NO: 494068 - RNA, 22 nt, Human
caagccaauggcagaagacgca

SEQ ID NO: 494069 - RNA, 23 nt, Human
cacaccacacuguccuuccccaa

SEQ ID NO: 494070 - RNA, 24 nt, Human
caccaagccauaaauaaaagcccg

SEQ ID NO: 494071 - RNA, 24 nt, Human
caccauguugcccaggcuggucuc

SEQ ID NO: 494072 - RNA, 27 nt, Human
caccauguugcccaggcuggucuccaa

SEQ ID NO: 494073 - RNA, 23 nt, Human
caccauuucaaaacauccugccu

SEQ ID NO: 494074 - RNA, 19 nt, Human
caccgcaccuggccucuac

SEQ ID NO: 494075 - RNA, 18 nt, Human
cacucauugcugaauggu

SEQ ID NO: 494076 - RNA, 18 nt, Human
cacuuggcuugugcaggc

SEQ ID NO: 494077 - RNA, 21 nt, Human
cagaaacaaaagcaaaaacac

SEQ ID NO: 494078 - RNA, 24 nt, Human
cagacuucaccauccagacaagaa

SEQ ID NO: 494079 - RNA, 21 nt, Human
cagagacccagcagcucaaau

SEQ ID NO: 494080 - RNA, 22 nt, Human
cagaucaacaagagagaaacca

SEQ ID NO: 494081 - RNA, 19 nt, Human
cagaucuuaaacaacgucc

SEQ ID NO: 494082 - RNA, 24 nt, Human
cagccauccagucuucugcuccug

SEQ ID NO: 494083 - RNA, 18 nt, Human
cagccgcaaggaugugga

SEQ ID NO: 494084 - RNA, 21 nt, Human
cagcgagccugcgagaggucc

SEQ ID NO: 494085 - RNA, 25 nt, Human
caggagcccuggauuucagcagaaa

SEQ ID NO: 494086 - RNA, 21 nt, Human
caggaggcgcugcccgcucau

SEQ ID NO: 494087 - RNA, 21 nt, Human
cagggaccacagcugcuucug

SEQ ID NO: 494088 - RNA, 23 nt, Human
caugagcuaggccugugaggaug

SEQ ID NO: 494089 - RNA, 19 nt, Human
cauguugcccaggcugguc

SEQ ID NO: 494090 - RNA, 24 nt, Human
cauguugcccaggcuggucuccaa

SEQ ID NO: 494091 - RNA, 20 nt, Human
ccaaaugcugggauuacagg

SEQ ID NO: 494092 - RNA, 20 nt, Human
ccaaaugcugggauuacagg

SEQ ID NO: 494093 - RNA, 21 nt, Human
ccaaaugcugggauuacaggu

SEQ ID NO: 494094 - RNA, 18 nt, Human
ccaacucuugggcucaag

SEQ ID NO: 494095 - RNA, 22 nt, Human
ccaauagucacaccacacuguc

SEQ ID NO: 494096 - RNA, 23 nt, Human
ccagcaaagcaccugauccauga

SEQ ID NO: 494097 - RNA, 23 nt, Human
ccauuucaaaacauccugccugc

SEQ ID NO: 494098 - RNA, 24 nt, Human
cccaaaugcugggauuacagguau

SEQ ID NO: 494099 - RNA, 20 nt, Human
cccagcaaagcaccugaucc

SEQ ID NO: 494100 - RNA, 21 nt, Human
ccccaaaccccaaggguuccc

SEQ ID NO: 494101 - RNA, 22 nt, Human
ccccaaaugcugggauuacagg

SEQ ID NO: 494102 - RNA, 23 nt, Human
ccccagucccagcccccccgacc

SEQ ID NO: 494103 - RNA, 20 nt, Human
ccccggcgcccgcgcggccc

SEQ ID NO: 494104 - RNA, 21 nt, Human
cccgacccuccgcggcugggg

SEQ ID NO: 494105 - RNA, 22 nt, Human
cccgugagcugccuuuugccuc

SEQ ID NO: 494106 - RNA, 26 nt, Human
cccuccacuaacuacucccaaggacc

SEQ ID NO: 494107 - RNA, 18 nt, Human
cccugcccacccaggaag

SEQ ID NO: 494108 - RNA, 22 nt, Human
cccuggggccgccgcuuuggcu

SEQ ID NO: 494109 - RNA, 18 nt, Human
ccgccgagacuccaccgg

SEQ ID NO: 494110 - RNA, 21 nt, Human
ccguccugcgcagcgagccug

SEQ ID NO: 494111 - RNA, 22 nt, Human
ccguugggucugggugugaugg

SEQ ID NO: 494112 - RNA, 19 nt, Human
ccuaggccugcucaggagg

SEQ ID NO: 494113 - RNA, 25 nt, Human
ccucaaaugccaccuuugacaccca

SEQ ID NO: 494114 - RNA, 22 nt, Human
ccucaggccuccacugcuugga

SEQ ID NO: 494115 - RNA, 23 nt, Human
ccuccuguccucucccucugcca

SEQ ID NO: 494116 - RNA, 24 nt, Human
ccucucuauggggaccugagaauc

SEQ ID NO: 494117 - RNA, 20 nt, Human
ccucuuggcccuaccccaga

SEQ ID NO: 494118 - RNA, 18 nt, Human
ccugcccucgaaauaauc

SEQ ID NO: 494119 - RNA, 20 nt, Human
ccugccuggcgcccuccccg

SEQ ID NO: 494120 - RNA, 20 nt, Human
ccuggugggacuucuccccc

SEQ ID NO: 494121 - RNA, 22 nt, Human
ccuuguccuagaagcuucacaa

SEQ ID NO: 494122 - RNA, 21 nt, Human
cgaaacaaaacacccagcaca

SEQ ID NO: 494123 - RNA, 19 nt, Human
cgccgagacuccaccggcg

SEQ ID NO: 494124 - RNA, 18 nt, Human
cgcugcggggccggucgg

SEQ ID NO: 494125 - RNA, 20 nt, Human
cggcgccagaggcugagcag

SEQ ID NO: 494126 - RNA, 18 nt, Human
cggcgccaggcgggcgcc

SEQ ID NO: 494127 - RNA, 22 nt, Human
cggcuagcggcggcggauuccu

SEQ ID NO: 494128 - RNA, 18 nt, Human
cgggcuucucaggggagg

SEQ ID NO: 494129 - RNA, 24 nt, Human
cguccuggggccaucguggugcug

SEQ ID NO: 494130 - RNA, 22 nt, Human
cuagccccuccuccaaggaccc

SEQ ID NO: 494131 - RNA, 24 nt, Human
cuauaugcugggccgcagaacucc

SEQ ID NO: 494132 - RNA, 20 nt, Human
cucaagcaauccucccaccu

SEQ ID NO: 494133 - RNA, 24 nt, Human
cucaagcaauccucccaccuuggc

SEQ ID NO: 494134 - RNA, 20 nt, Human
cucaagcccucaggccucca

SEQ ID NO: 494135 - RNA, 21 nt, Human
cucaggaggcugcaacccguu

SEQ ID NO: 494136 - RNA, 23 nt, Human
cuccagggcccucauccauuccu

SEQ ID NO: 494137 - RNA, 18 nt, Human
cuccccagucccagcccc

SEQ ID NO: 494138 - RNA, 20 nt, Human
cuccgggcaggugggcaccu

SEQ ID NO: 494139 - RNA, 26 nt, Human
cuccucuaccacccaggccaagaauc

SEQ ID NO: 494140 - RNA, 24 nt, Human
cuccuggggaaggcuccuccuccu

SEQ ID NO: 494141 - RNA, 25 nt, Human
cucuugggcucaagcaauccuccca

SEQ ID NO: 494142 - RNA, 22 nt, Human
cugacugcuggggcugccagcc

SEQ ID NO: 494143 - RNA, 19 nt, Human
cugagccauuucuauaugc

SEQ ID NO: 494144 - RNA, 23 nt, Human
cugcaaaucucugcugcucugga

SEQ ID NO: 494145 - RNA, 23 nt, Human
cugcaguucugaauccacuguuc

SEQ ID NO: 494146 - RNA, 18 nt, Human
cugccaggagccaagugc

SEQ ID NO: 494147 - RNA, 19 nt, Human
cugccuugaggacacagcc

SEQ ID NO: 494148 - RNA, 20 nt, Human
cugcgcagcgagccugcgag

SEQ ID NO: 494149 - RNA, 23 nt, Human
cugcugguuuuccccagccuccc

SEQ ID NO: 494150 - RNA, 19 nt, Human
cugcugugucucaccaagg

SEQ ID NO: 494151 - RNA, 18 nt, Human
cugcuucugccugccagg

SEQ ID NO: 494152 - RNA, 23 nt, Human
cuggcugacuccuguccacgagg

SEQ ID NO: 494153 - RNA, 21 nt, Human
cuggcugcgccuuguccuaga

SEQ ID NO: 494154 - RNA, 19 nt, Human
cuggucuccaacucuuggg

SEQ ID NO: 494155 - RNA, 23 nt, Human
cuucugggccugccagaaacauc

SEQ ID NO: 494156 - RNA, 21 nt, Human
cuugccaacaggcccgggccu

SEQ ID NO: 494157 - RNA, 18 nt, Human
cuuguaagcucuggauac

SEQ ID NO: 494158 - RNA, 20 nt, Human
gaaacaaaagcaaaaacaca

SEQ ID NO: 494159 - RNA, 19 nt, Human
gaaacauccuggccccacg

SEQ ID NO: 494160 - RNA, 19 nt, Human
gaagcuugccaacaggccc

SEQ ID NO: 494161 - RNA, 20 nt, Human
gacacagccauccagucuuc

SEQ ID NO: 494162 - RNA, 21 nt, Human
gacagcaauggggcugggagc

SEQ ID NO: 494163 - RNA, 21 nt, Human
gaccacagcugcuucugccug

SEQ ID NO: 494164 - RNA, 21 nt, Human
gacccagcuugccgucuucag

SEQ ID NO: 494165 - RNA, 19 nt, Human
gacugcuggggcugccagc

SEQ ID NO: 494166 - RNA, 18 nt, Human
gagcagaaugagcuacau

SEQ ID NO: 494167 - RNA, 19 nt, Human
gagcaguggggaggcuggg

SEQ ID NO: 494168 - RNA, 19 nt, Human
gagcugccuuuugccucca

SEQ ID NO: 494169 - RNA, 24 nt, Human
gagcugggcagcccucggcaaacc

SEQ ID NO: 494170 - RNA, 21 nt, Human
gagcugugcgucuucuccggg

SEQ ID NO: 494171 - RNA, 18 nt, Human
gauuacagguaugagcca

SEQ ID NO: 494172 - RNA, 22 nt, Human
gauuacagguaugagccaccgc

SEQ ID NO: 494173 - RNA, 23 nt, Human
gauuacagguaugagccaccgca

SEQ ID NO: 494174 - RNA, 21 nt, Human
gcaacuucgcuuuccuccugg

SEQ ID NO: 494175 - RNA, 21 nt, Human
gcaggggaaggcuucuggcag

SEQ ID NO: 494176 - RNA, 19 nt, Human
gcccagaguaagaaggagg

SEQ ID NO: 494177 - RNA, 20 nt, Human
gccccaggggaauacacuuc

SEQ ID NO: 494178 - RNA, 22 nt, Human
gccccuccuccaaggacccacc

SEQ ID NO: 494179 - RNA, 19 nt, Human
gcccucggcaaacccuugc

SEQ ID NO: 494180 - RNA, 18 nt, Human
gcccuggauuucagcaga

SEQ ID NO: 494181 - RNA, 19 nt, Human
gccugcagggucuccaggc

SEQ ID NO: 494182 - RNA, 21 nt, Human
gcuccuuguaagcucuggaua

SEQ ID NO: 494183 - RNA, 18 nt, Human
gcugggccgcagaacuca

SEQ ID NO: 494184 - RNA, 22 nt, Human
gcuuccacucagccccaauuuc

SEQ ID NO: 494185 - RNA, 21 nt, Human
ggacacaucuucccuccccca

SEQ ID NO: 494186 - RNA, 23 nt, Human
ggagggagcaguggggaggcugg

SEQ ID NO: 494187 - RNA, 22 nt, Human
ggagguggcugcccccucccca

SEQ ID NO: 494188 - RNA, 21 nt, Human
ggauggaggcgcugcggggcc

SEQ ID NO: 494189 - RNA, 18 nt, Human
ggcaaggacaucugggac

SEQ ID NO: 494190 - RNA, 21 nt, Human
ggcagaguggggacagccugu

SEQ ID NO: 494191 - RNA, 21 nt, Human
ggccugccuaggccugcucag

SEQ ID NO: 494192 - RNA, 20 nt, Human
gggagcaguggggaggcugg

SEQ ID NO: 494193 - RNA, 20 nt, Human
ggggaaagguggggccgugg

SEQ ID NO: 494194 - RNA, 20 nt, Human
ggggaccugagaauccugcc

SEQ ID NO: 494195 - RNA, 20 nt, Human
ggggagggggggcauccugg

SEQ ID NO: 494196 - RNA, 19 nt, Human
gggugacuccaaccauauc

SEQ ID NO: 494197 - RNA, 18 nt, Human
guccuuccccaaacccca

SEQ ID NO: 494198 - RNA, 21 nt, Human
gugcauguauugcagaaggac

SEQ ID NO: 494199 - RNA, 25 nt, Human
uaaaaaaaacccaagaguggagacc

SEQ ID NO: 494200 - RNA, 18 nt, Human
uaaauaagucaaguaggc

SEQ ID NO: 494201 - RNA, 23 nt, Human
uaacaccaaauaaagcaggaggu

SEQ ID NO: 494202 - RNA, 21 nt, Human
uaacucggugaccaccugcgg

SEQ ID NO: 494203 - RNA, 21 nt, Human
uacagaaaaacccugugggca

SEQ ID NO: 494204 - RNA, 21 nt, Human
uacagaaacaaaagcaaaaac

SEQ ID NO: 494205 - RNA, 22 nt, Human
uacagguaugagccaccgcacc

SEQ ID NO: 494206 - RNA, 23 nt, Human
uaccauggcaguguaugcuguga

SEQ ID NO: 494207 - RNA, 22 nt, Human
uaccccagaugaggccuggcug

SEQ ID NO: 494208 - RNA, 22 nt, Human
uagcaagggacaagcccuacag

SEQ ID NO: 494209 - RNA, 20 nt, Human
ucaacccaaaaugcagcccu

SEQ ID NO: 494210 - RNA, 24 nt, Human
ucaagcaauccucccaccuuggcc

SEQ ID NO: 494211 - RNA, 19 nt, Human
ucacucaggacccagcuug

SEQ ID NO: 494212 - RNA, 25 nt, Human
ucagcccuugagaucuggcuucgcu

SEQ ID NO: 494213 - RNA, 22 nt, Human
ucaggugggggacacccuuguc

SEQ ID NO: 494214 - RNA, 20 nt, Human
ucccagcccccccgaccucc

SEQ ID NO: 494215 - RNA, 19 nt, Human
uccccaaaugcugggauua

SEQ ID NO: 494216 - RNA, 23 nt, Human
uccccaaaugcugggauuacagg

SEQ ID NO: 494217 - RNA, 26 nt, Human
uccccagucccagcccccccgaccuc

SEQ ID NO: 494218 - RNA, 22 nt, Human
uccccggccgccgagacuccac

SEQ ID NO: 494219 - RNA, 24 nt, Human
uccgcaauuaacccuggggccgcc

SEQ ID NO: 494220 - RNA, 18 nt, Human
uccgggcaggugggcacc

SEQ ID NO: 494221 - RNA, 18 nt, Human
uccucgggccagccuugg

SEQ ID NO: 494222 - RNA, 20 nt, Human
uccuggguuugaggugggag

SEQ ID NO: 494223 - RNA, 21 nt, Human
uccuguccucucccucugcca

SEQ ID NO: 494224 - RNA, 24 nt, Human
ucuaccacccaggccaagaaucaa

SEQ ID NO: 494225 - RNA, 23 nt, Human
ucucaccauguugcccaggcugg

SEQ ID NO: 494226 - RNA, 26 nt, Human
ucucaccauguugcccaggcuggucu

SEQ ID NO: 494227 - RNA, 27 nt, Human
ucucaccauguugcccaggcuggucuc

SEQ ID NO: 494228 - RNA, 23 nt, Human
ucuccaacucuugggcucaagca

SEQ ID NO: 494229 - RNA, 23 nt, Human
ucuccgggcaggugggcaccuug

SEQ ID NO: 494230 - RNA, 23 nt, Human
ucuccucuaccacccaggccaag

SEQ ID NO: 494231 - RNA, 20 nt, Human
ucuggccugcagggucucca

SEQ ID NO: 494232 - RNA, 23 nt, Human
ucuggccugcagggucuccaggc

SEQ ID NO: 494233 - RNA, 22 nt, Human
ucuugggcucaagcaauccucc

SEQ ID NO: 494234 - RNA, 20 nt, Human
ugaaacaagaaagacaccaa

SEQ ID NO: 494235 - RNA, 23 nt, Human
ugaaacaagaaagacaccaagcc

SEQ ID NO: 494236 - RNA, 19 nt, Human
ugaaguugccaauucugcu

SEQ ID NO: 494237 - RNA, 18 nt, Human
ugaaugacuggaguccac

SEQ ID NO: 494238 - RNA, 21 nt, Human
ugacagcaauggggcugggag

SEQ ID NO: 494239 - RNA, 18 nt, Human
ugaccugucucaaacacc

SEQ ID NO: 494240 - RNA, 20 nt, Human
ugacugcuggggcugccagc

SEQ ID NO: 494241 - RNA, 19 nt, Human
ugaggugggaguggggaag

SEQ ID NO: 494242 - RNA, 21 nt, Human
ugaggugggaguggggaaggc

SEQ ID NO: 494243 - RNA, 22 nt, Human
ugaguucugcuccuggguuuga

SEQ ID NO: 494244 - RNA, 18 nt, Human
ugcagaaggacaaaagcc

SEQ ID NO: 494245 - RNA, 19 nt, Human
ugccaggccugaggcagcc

SEQ ID NO: 494246 - RNA, 24 nt, Human
ugcccaggcuggucuccaacucuu

SEQ ID NO: 494247 - RNA, 28 nt, Human
ugcccaggcuggucuccaacucuugggc

SEQ ID NO: 494248 - RNA, 18 nt, Human
ugcgagagguccugccug

SEQ ID NO: 494249 - RNA, 24 nt, Human
ugcugggauuacagguaugagcca

SEQ ID NO: 494250 - RNA, 20 nt, Human
ugcuggggcugccagcucuc

SEQ ID NO: 494251 - RNA, 22 nt, Human
ugcugugucucaccaaggccug

SEQ ID NO: 494252 - RNA, 21 nt, Human
ugcuuccaucuucuccauccc

SEQ ID NO: 494253 - RNA, 21 nt, Human
uggaaaaagaggcccggccac

SEQ ID NO: 494254 - RNA, 20 nt, Human
uggaagaggcgcuccuacag

SEQ ID NO: 494255 - RNA, 22 nt, Human
uggaagggaagcggcgccaggc

SEQ ID NO: 494256 - RNA, 18 nt, Human
uggaggcgcugcggggcc

SEQ ID NO: 494257 - RNA, 22 nt, Human
uggauacugaguucugcuccug

SEQ ID NO: 494258 - RNA, 20 nt, Human
uggaugggucagaggaggua

SEQ ID NO: 494259 - RNA, 21 nt, Human
uggcaaggacaucugggacga

SEQ ID NO: 494260 - RNA, 23 nt, Human
uggcaguagcucccaggcugagg

SEQ ID NO: 494261 - RNA, 31 nt, Human
uggcugcccccuccccagucccagccccccc

SEQ ID NO: 494262 - RNA, 24 nt, Human
uggcugcgccuuguccuagaagcu

SEQ ID NO: 494263 - RNA, 22 nt, Human
uggcuggagcgcuggcuggggg

SEQ ID NO: 494264 - RNA, 21 nt, Human
uggcuucuaugcacaucuggu

SEQ ID NO: 494265 - RNA, 27 nt, Human
uggcuuugagauucaucccacaugggg

SEQ ID NO: 494266 - RNA, 21 nt, Human
ugggaauggggaugggagggg

SEQ ID NO: 494267 - RNA, 19 nt, Human
ugggauuacagguaugagc

SEQ ID NO: 494268 - RNA, 22 nt, Human
ugggauuacagguaugagccac

SEQ ID NO: 494269 - RNA, 23 nt, Human
ugggauuacagguaugagccacc

SEQ ID NO: 494270 - RNA, 24 nt, Human
ugggauuacagguaugagccaccg

SEQ ID NO: 494271 - RNA, 21 nt, Human
uggggaggcuggggaagaacg

SEQ ID NO: 494272 - RNA, 22 nt, Human
uggggaggcuggggaagaacgg

SEQ ID NO: 494273 - RNA, 18 nt, Human
ugggucagaggagguagc

SEQ ID NO: 494274 - RNA, 19 nt, Human
ugggugugauggcccucaa

SEQ ID NO: 494275 - RNA, 22 nt, Human
ugguguccauauuacucaaccc

SEQ ID NO: 494276 - RNA, 21 nt, Human
uguaugguguacauguaugua

SEQ ID NO: 494277 - RNA, 19 nt, Human
uguccaggaaaccagaagc

SEQ ID NO: 494278 - RNA, 20 nt, Human
ugucugcauagaugugugug

SEQ ID NO: 494279 - RNA, 23 nt, Human
ugucuguggccauggcaaggaca

SEQ ID NO: 494280 - RNA, 21 nt, Human
ugugaccugucucaaacaccc

SEQ ID NO: 494281 - RNA, 20 nt, Human
ugugcaggaccugggaggga

SEQ ID NO: 494282 - RNA, 23 nt, Human
uguggaacggcgccagaggcuga

SEQ ID NO: 494283 - RNA, 22 nt, Human
uguggccugccacguggccacc

SEQ ID NO: 494284 - RNA, 22 nt, Human
ugugggguuuggucagcagcug

SEQ ID NO: 494285 - RNA, 18 nt, Human
ugugugcacuugugccuu

SEQ ID NO: 494286 - RNA, 19 nt, Human
uguuuauuuucaagugcau

SEQ ID NO: 494287 - RNA, 22 nt, Human
uuaagcacaggcuccucugagg

SEQ ID NO: 494288 - RNA, 21 nt, Human
uucagagcugguguuccuuug

SEQ ID NO: 494289 - RNA, 20 nt, Human
uuccgcggccccggcgcccg

SEQ ID NO: 494290 - RNA, 19 nt, Human
uucucaggggagggggggc

SEQ ID NO: 494291 - RNA, 20 nt, Human
uuucagagcugguguuccuu

SEQ ID NO: 494292 - RNA, 24 nt, Human
uuucuuuccccugcccugcccucg

SEQ ID NO: 494293 - RNA, 25 nt, Human
uuuggcuggagcgcuggcugggggc

SEQ ID NO: 494294 - RNA, 22 nt, Human
aaagaagaagagcaauacccug

SEQ ID NO: 494295 - RNA, 24 nt, Human
acagauggcagcuucacaggucaa

SEQ ID NO: 494296 - RNA, 22 nt, Human
agagauguaggcaaggcucaga

SEQ ID NO: 494297 - RNA, 22 nt, Human
agcaauacccuguuucacuggu

SEQ ID NO: 494298 - RNA, 24 nt, Human
agggguggggagacugcuugaggu

SEQ ID NO: 494299 - RNA, 20 nt, Human
agguuccccagucuguuuuc

SEQ ID NO: 494300 - RNA, 19 nt, Human
caccagguggcagcaaagc

SEQ ID NO: 494301 - RNA, 24 nt, Human
cagacaggaagaucaagaaaagaa

SEQ ID NO: 494302 - RNA, 20 nt, Human
cagagaaagugacugaggcu

SEQ ID NO: 494303 - RNA, 25 nt, Human
caggaagaucaagaaaagaagaaga

SEQ ID NO: 494304 - RNA, 20 nt, Human
ccagacaggaagaucaagaa

SEQ ID NO: 494305 - RNA, 19 nt, Human
cccaggcacccugugaacu

SEQ ID NO: 494306 - RNA, 26 nt, Human
cccccagacuggaggcauccuggccu

SEQ ID NO: 494307 - RNA, 18 nt, Human
cccugugaacuuaagagc

SEQ ID NO: 494308 - RNA, 22 nt, Human
ccuccaggccacaaagucucug

SEQ ID NO: 494309 - RNA, 19 nt, Human
gaaaaugcuggugagcucu

SEQ ID NO: 494310 - RNA, 18 nt, Human
gaagcaaaugaggaagca

SEQ ID NO: 494311 - RNA, 21 nt, Human
gagcaauacccuguuucacug

SEQ ID NO: 494312 - RNA, 20 nt, Human
gcauccaaccuuguucccac

SEQ ID NO: 494313 - RNA, 21 nt, Human
gcauccaaccuuguucccacu

SEQ ID NO: 494314 - RNA, 18 nt, Human
ggagaagcaaaugaggaa

SEQ ID NO: 494315 - RNA, 18 nt, Human
ggcugggagaagcaaaug

SEQ ID NO: 494316 - RNA, 22 nt, Human
guguggacacaacucacacuca

SEQ ID NO: 494317 - RNA, 26 nt, Human
uaauaggccuccaggccacaaagucu

SEQ ID NO: 494318 - RNA, 18 nt, Human
uaggccuccaggccacaa

SEQ ID NO: 494319 - RNA, 19 nt, Human
ucagugugauacccacaga

SEQ ID NO: 494320 - RNA, 24 nt, Human
ucccccagacuggaggcauccugg

SEQ ID NO: 494321 - RNA, 20 nt, Human
uggaaaaugcuggugagcuc

SEQ ID NO: 494322 - RNA, 20 nt, Human
uggacacaaaaguccuucug

SEQ ID NO: 494323 - RNA, 20 nt, Human
ugggagaagcaaaugaggaa

SEQ ID NO: 494324 - RNA, 25 nt, Human
ugggagaagcaaaugaggaagcugg

SEQ ID NO: 494325 - RNA, 25 nt, Human
uggugagcucuuuggugaaagaucc

SEQ ID NO: 494326 - RNA, 23 nt, Human
ugugauacccacagacauguagu

SEQ ID NO: 494327 - RNA, 23 nt, Human
uguucccacuuccuuccuugaau

SEQ ID NO: 494328 - RNA, 20 nt, Human
uuaguauuaacagauggcag

SEQ ID NO: 494329 - RNA, 28 nt, Human
uuauggaucaauuccacugauacugugu

SEQ ID NO: 494330 - RNA, 20 nt, Human
uucccacuuccuuccuugaa

SEQ ID NO: 494331 - RNA, 24 nt, Human
uuccuugaauccacugggaacucc

SEQ ID NO: 494332 - RNA, 23 nt, Human
uuucacuggugggaugugcugcu

SEQ ID NO: 494333 - RNA, 21 nt, Human
uuuuuuuuuuuuuucuuauuu

SEQ ID NO: 494334 - RNA, 25 nt, Human
uuuuuuuuuuuuuuucuuauuuggg

SEQ ID NO: 494335 - RNA, 21 nt, Human
accaccuccuucuguuuuguc

SEQ ID NO: 494336 - RNA, 21 nt, Human
accggcagcaggcggacagac

SEQ ID NO: 494337 - RNA, 24 nt, Human
auggcagcggcggcggcggcagca

SEQ ID NO: 494338 - RNA, 24 nt, Human
caagggaaccuccccccuggcucg

SEQ ID NO: 494339 - RNA, 25 nt, Human
caagggaaccuccccccuggcucgu

SEQ ID NO: 494340 - RNA, 22 nt, Human
caccacacgggcaggagagaac

SEQ ID NO: 494341 - RNA, 22 nt, Human
cacguucuucccucaucgucca

SEQ ID NO: 494342 - RNA, 20 nt, Human
cagccucucccucagccaag

SEQ ID NO: 494343 - RNA, 18 nt, Human
caguucucagccucuccc

SEQ ID NO: 494344 - RNA, 19 nt, Human
ccaaggaaugaggaaacag

SEQ ID NO: 494345 - RNA, 22 nt, Human
ccaaggcaauggcuaagggagu

SEQ ID NO: 494346 - RNA, 18 nt, Human
ccaggaugaggagccagg

SEQ ID NO: 494347 - RNA, 21 nt, Human
ccccgagagcaccaccuccuu

SEQ ID NO: 494348 - RNA, 24 nt, Human
cccgggcucgggaaaguucucccc

SEQ ID NO: 494349 - RNA, 18 nt, Human
ccggggccugcugccucc

SEQ ID NO: 494350 - RNA, 23 nt, Human
ccucagagcccuguugcucccag

SEQ ID NO: 494351 - RNA, 21 nt, Human
ccugcagcuaauuaaaaccgc

SEQ ID NO: 494352 - RNA, 23 nt, Human
ccuggcuucccuccucagccucc

SEQ ID NO: 494353 - RNA, 19 nt, Human
cgccucugccccccacccg

SEQ ID NO: 494354 - RNA, 22 nt, Human
cggccccggccagcugcggcgc

SEQ ID NO: 494355 - RNA, 25 nt, Human
cguggggaccugucccugugccugg

SEQ ID NO: 494356 - RNA, 23 nt, Human
cucagagcccuguugcucccagg

SEQ ID NO: 494357 - RNA, 24 nt, Human
cucaucguccacaccaggcgucca

SEQ ID NO: 494358 - RNA, 22 nt, Human
cuccccucagcugcccagagga

SEQ ID NO: 494359 - RNA, 19 nt, Human
cuccucagccuccuggccu

SEQ ID NO: 494360 - RNA, 22 nt, Human
cuccuggccucgggaacucauc

SEQ ID NO: 494361 - RNA, 22 nt, Human
cucugcaccgggcgcuggucuc

SEQ ID NO: 494362 - RNA, 24 nt, Human
cugcuucugggccuggacgcuccc

SEQ ID NO: 494363 - RNA, 24 nt, Human
gaaaccaugugcuuuauuuggaac

SEQ ID NO: 494364 - RNA, 20 nt, Human
gaacucaucugcucgucgcc

SEQ ID NO: 494365 - RNA, 20 nt, Human
gaauggagccaggcacugcc

SEQ ID NO: 494366 - RNA, 20 nt, Human
gagcccuggcuucccuccuc

SEQ ID NO: 494367 - RNA, 23 nt, Human
gagccuacagcccagucccccga

SEQ ID NO: 494368 - RNA, 20 nt, Human
gaggaugcccgggagcacag

SEQ ID NO: 494369 - RNA, 23 nt, Human
gaggaugcccgggagcacaggug

SEQ ID NO: 494370 - RNA, 21 nt, Human
gcagcagcggggacucugcac

SEQ ID NO: 494371 - RNA, 24 nt, Human
gcccagucccccgagagcaccacc

SEQ ID NO: 494372 - RNA, 20 nt, Human
gccgcgguggcagcagcggg

SEQ ID NO: 494373 - RNA, 18 nt, Human
gccuucugccgcgguggc

SEQ ID NO: 494374 - RNA, 21 nt, Human
gcgcuggucucugagcccugg

SEQ ID NO: 494375 - RNA, 27 nt, Human
gcggcagcaaacucugggacgaguccc

SEQ ID NO: 494376 - RNA, 23 nt, Human
gcggcggcagcaaacucugggac

SEQ ID NO: 494377 - RNA, 18 nt, Human
ggaccugucccugugccu

SEQ ID NO: 494378 - RNA, 25 nt, Human
ggaugaggagccagggacaggagga

SEQ ID NO: 494379 - RNA, 19 nt, Human
ggcgccucugccccccacc

SEQ ID NO: 494380 - RNA, 21 nt, Human
gggaaaguucucuguccggug

SEQ ID NO: 494381 - RNA, 23 nt, Human
gggcgcuggucucugagcccugg

SEQ ID NO: 494382 - RNA, 27 nt, Human
gggcggccccggccagcugcggcgccc

SEQ ID NO: 494383 - RNA, 25 nt, Human
uacagcccagucccccgagagcacc

SEQ ID NO: 494384 - RNA, 20 nt, Human
uacaggccaggggcuggggu

SEQ ID NO: 494385 - RNA, 20 nt, Human
uagaaaagcugcaaaccacg

SEQ ID NO: 494386 - RNA, 19 nt, Human
uccaggggugucugcccag

SEQ ID NO: 494387 - RNA, 19 nt, Human
ucccccgagagcaccaccu

SEQ ID NO: 494388 - RNA, 23 nt, Human
ucccccgagagcaccaccuccuu

SEQ ID NO: 494389 - RNA, 18 nt, Human
uccccucagcugcccaga

SEQ ID NO: 494390 - RNA, 20 nt, Human
ucccggcugagggcucccgg

SEQ ID NO: 494391 - RNA, 27 nt, Human
ucccuguggccguggggaccugucccu

SEQ ID NO: 494392 - RNA, 19 nt, Human
ucugcucgucgccgaucga

SEQ ID NO: 494393 - RNA, 20 nt, Human
ugaggaaacagguacaggcc

SEQ ID NO: 494394 - RNA, 25 nt, Human
ugcccaguucucagccucucccuca

SEQ ID NO: 494395 - RNA, 21 nt, Human
ugccucccacagcgauggcuc

SEQ ID NO: 494396 - RNA, 21 nt, Human
ugccuggcuccaggcagcaug

SEQ ID NO: 494397 - RNA, 18 nt, Human
uggcagcggcggcggcgg

SEQ ID NO: 494398 - RNA, 19 nt, Human
uggcuaagggagugcggga

SEQ ID NO: 494399 - RNA, 21 nt, Human
uggcucaggggucaccucuug

SEQ ID NO: 494400 - RNA, 19 nt, Human
uggcugcagcugcuucugg

SEQ ID NO: 494401 - RNA, 19 nt, Human
uggcuucccuccucagccu

SEQ ID NO: 494402 - RNA, 22 nt, Human
ugggagagaggcugcuauggca

SEQ ID NO: 494403 - RNA, 23 nt, Human
uggggcucuucuugauuucagcu

SEQ ID NO: 494404 - RNA, 23 nt, Human
uggucucugagcccuggcuuccc

SEQ ID NO: 494405 - RNA, 21 nt, Human
ugucagacuaguucuucccug

SEQ ID NO: 494406 - RNA, 21 nt, Human
ugucggcugagcuccaggggu

SEQ ID NO: 494407 - RNA, 23 nt, Human
uucccugcgcgcggcucucgcuu

SEQ ID NO: 494408 - RNA, 22 nt, Human
uuugcucuggaaaccaugugcu

SEQ ID NO: 494409 - RNA, 22 nt, Human
uuuuuuuuuuuuuugcucugga

SEQ ID NO: 494410 - RNA, 23 nt, Human
uuuuuuuuuuuuuuuugcucugg

SEQ ID NO: 494411 - RNA, 20 nt, Human
uuuuuuuuuuuuuuuuugcu

SEQ ID NO: 494412 - RNA, 24 nt, Human
uuuuuuuuuuuuuuuuugcucugg

SEQ ID NO: 494413 - RNA, 20 nt, Human
uuuuuuuuuuuuuuuuuugg

SEQ ID NO: 494414 - RNA, 26 nt, Human
aaaaaaaaaaaacaaaacacaaaagg

SEQ ID NO: 494415 - RNA, 30 nt, Human
aaaaaaagaacaaaacaaaacaaacaaaaa

SEQ ID NO: 494416 - RNA, 22 nt, Human
aaaaaaccuacguggccaugcu

SEQ ID NO: 494417 - RNA, 22 nt, Human
aaaacacaaaagguagaaucug

SEQ ID NO: 494418 - RNA, 22 nt, Human
aaaacagacuaaacacacuccc

SEQ ID NO: 494419 - RNA, 27 nt, Human
aaaaccaucuccacccacauaacacag

SEQ ID NO: 494420 - RNA, 22 nt, Human
aaacaaaacaguaaugaaagaa

SEQ ID NO: 494421 - RNA, 18 nt, Human
aaacaaacaaaaaaccuc

SEQ ID NO: 494422 - RNA, 21 nt, Human
aaacagacuaaacacacuccc

SEQ ID NO: 494423 - RNA, 19 nt, Human
aaacaggaauaaugagaca

SEQ ID NO: 494424 - RNA, 23 nt, Human
aaacaguaaugaaagaaugaaaa

SEQ ID NO: 494425 - RNA, 21 nt, Human
aacaaaaaaccuacguggcca

SEQ ID NO: 494426 - RNA, 24 nt, Human
aacacaaaagguagaaucugugga

SEQ ID NO: 494427 - RNA, 22 nt, Human
aacacacucccgauacacauaa

SEQ ID NO: 494428 - RNA, 21 nt, Human
aacagagugagacuccgucuc

SEQ ID NO: 494429 - RNA, 22 nt, Human
aacucuggaaagcucuccugaa

SEQ ID NO: 494430 - RNA, 23 nt, Human
aagauugcgccacugcauuccag

SEQ ID NO: 494431 - RNA, 18 nt, Human
aagcaggucugcuacaua

SEQ ID NO: 494432 - RNA, 24 nt, Human
aaguggagguuaaagugagccaag

SEQ ID NO: 494433 - RNA, 27 nt, Human
aauaaaacagacuaaacacacucccga

SEQ ID NO: 494434 - RNA, 24 nt, Human
aauugcuugaaccagggaagugga

SEQ ID NO: 494435 - RNA, 21 nt, Human
acaaaacaaaacaaacaaaaa

SEQ ID NO: 494436 - RNA, 23 nt, Human
acaaaacaaaacaaacaaaaaac

SEQ ID NO: 494437 - RNA, 18 nt, Human
acaaaacaaacaaaaaac

SEQ ID NO: 494438 - RNA, 21 nt, Human
acaaaacaaacaaaaaaccua

SEQ ID NO: 494439 - RNA, 27 nt, Human
acaaaacaguaaugaaagaaugaaaac

SEQ ID NO: 494440 - RNA, 23 nt, Human
acagagugagacuccgucucaaa

SEQ ID NO: 494441 - RNA, 24 nt, Human
acagagugagacuccgucucaaaa

SEQ ID NO: 494442 - RNA, 24 nt, Human
accccgucucuacuaaaaauacaa

SEQ ID NO: 494443 - RNA, 26 nt, Human
acgacggcggcggcagacgaguccuu

SEQ ID NO: 494444 - RNA, 22 nt, Human
acggcgacgacggcggcggcuu

SEQ ID NO: 494445 - RNA, 24 nt, Human
acugcauuccagccuggguaacag

SEQ ID NO: 494446 - RNA, 26 nt, Human
acugcauuccagccuggguaacagag

SEQ ID NO: 494447 - RNA, 23 nt, Human
agaaauggcagagcucugaacaa

SEQ ID NO: 494448 - RNA, 27 nt, Human
agaacaaaacaaaacaaacaaaaaaga

SEQ ID NO: 494449 - RNA, 21 nt, Human
agacaaugaugaaacagcuau

SEQ ID NO: 494450 - RNA, 27 nt, Human
agacaggaugaaaggaacaaaaccaaa

SEQ ID NO: 494451 - RNA, 18 nt, Human
agauacaaaggauaaaac

SEQ ID NO: 494452 - RNA, 23 nt, Human
agccacauaccucacugugccuu

SEQ ID NO: 494453 - RNA, 18 nt, Human
agccggcgccgccgccgc

SEQ ID NO: 494454 - RNA, 24 nt, Human
agccuggguaacagagugagacuc

SEQ ID NO: 494455 - RNA, 23 nt, Human
agcugggcgugguggugugugcc

SEQ ID NO: 494456 - RNA, 24 nt, Human
agcugggcuugcauggugaaaccc

SEQ ID NO: 494457 - RNA, 20 nt, Human
aggaauguucacguuuucug

SEQ ID NO: 494458 - RNA, 21 nt, Human
aggaugaaaggaacaaaacca

SEQ ID NO: 494459 - RNA, 22 nt, Human
aggcaggggaauugcuugaacc

SEQ ID NO: 494460 - RNA, 24 nt, Human
aggcaggggaauugcuugaaccag

SEQ ID NO: 494461 - RNA, 18 nt, Human
aguaaggaauauaaaaau

SEQ ID NO: 494462 - RNA, 21 nt, Human
aucaccuucuuguucagaaag

SEQ ID NO: 494463 - RNA, 22 nt, Human
augaaaaccaucuccacccaca

SEQ ID NO: 494464 - RNA, 22 nt, Human
augagcaucaggcuauuuacaa

SEQ ID NO: 494465 - RNA, 24 nt, Human
caaaaaaacuagcugggcguggug

SEQ ID NO: 494466 - RNA, 24 nt, Human
caaaacaaacaaaaaaccuacgug

SEQ ID NO: 494467 - RNA, 19 nt, Human
caaaacaguaaugaaagaa

SEQ ID NO: 494468 - RNA, 23 nt, Human
caaaggauaaaacaaaacaguaa

SEQ ID NO: 494469 - RNA, 25 nt, Human
caaaggcaaacacugaucaccuucu

SEQ ID NO: 494470 - RNA, 19 nt, Human
caagaaauggcagagcucu

SEQ ID NO: 494471 - RNA, 23 nt, Human
caagaagagaaaaugccaaaucc

SEQ ID NO: 494472 - RNA, 22 nt, Human
cacaacagaacauuuaccagag

SEQ ID NO: 494473 - RNA, 19 nt, Human
cacugcauuccagccuggg

SEQ ID NO: 494474 - RNA, 22 nt, Human
cacugcauuccagccuggguaa

SEQ ID NO: 494475 - RNA, 23 nt, Human
cacugcauuccagccuggguaac

SEQ ID NO: 494476 - RNA, 24 nt, Human
cacugcauuccagccuggguaaca

SEQ ID NO: 494477 - RNA, 20 nt, Human
cagccuggguaacagaguga

SEQ ID NO: 494478 - RNA, 28 nt, Human
cagcuaaaacaggaauaaugagaagacc

SEQ ID NO: 494479 - RNA, 18 nt, Human
caucagguacauuucaag

SEQ ID NO: 494480 - RNA, 18 nt, Human
cauggugaaaccccgucu

SEQ ID NO: 494481 - RNA, 19 nt, Human
cauggugaaaccccgucuc

SEQ ID NO: 494482 - RNA, 21 nt, Human
cauggugaaaccccgucucua

SEQ ID NO: 494483 - RNA, 24 nt, Human
cauuccagccuggguaacagagug

SEQ ID NO: 494484 - RNA, 20 nt, Human
ccacugcauuccagccuggg

SEQ ID NO: 494485 - RNA, 20 nt, Human
ccacugcauuccagccuggg

SEQ ID NO: 494486 - RNA, 21 nt, Human
ccacugcauuccagccugggu

SEQ ID NO: 494487 - RNA, 22 nt, Human
ccacugcauuccagccugggua

SEQ ID NO: 494488 - RNA, 24 nt, Human
ccacugcauuccagccuggguaac

SEQ ID NO: 494489 - RNA, 21 nt, Human
cccacauaacacagacaggau

SEQ ID NO: 494490 - RNA, 20 nt, Human
ccccaaaacacaugagcacc

SEQ ID NO: 494491 - RNA, 19 nt, Human
cccccgagccgcccgcagg

SEQ ID NO: 494492 - RNA, 22 nt, Human
cccccgagccgcccgcaggccc

SEQ ID NO: 494493 - RNA, 23 nt, Human
cccccgagccgcccgcaggcccc

SEQ ID NO: 494494 - RNA, 20 nt, Human
cccccgccgccgcggccugc

SEQ ID NO: 494495 - RNA, 21 nt, Human
ccccgagccgcccgcaggccc

SEQ ID NO: 494496 - RNA, 19 nt, Human
ccccgccgccgcggccugc

SEQ ID NO: 494497 - RNA, 21 nt, Human
ccccgcgccggcgcuuuguuc

SEQ ID NO: 494498 - RNA, 21 nt, Human
ccccgcgcgcccucagcccgg

SEQ ID NO: 494499 - RNA, 18 nt, Human
cccgcaggccccgcgccg

SEQ ID NO: 494500 - RNA, 19 nt, Human
cccgcccccgccgccgcgg

SEQ ID NO: 494501 - RNA, 22 nt, Human
cccugcccgcguccuccggcug

SEQ ID NO: 494502 - RNA, 19 nt, Human
ccgcaggccccgcgcgccc

SEQ ID NO: 494503 - RNA, 19 nt, Human
ccgccgccgccgccgcagg

SEQ ID NO: 494504 - RNA, 24 nt, Human
ccgccgccgccgccgcaggccccg

SEQ ID NO: 494505 - RNA, 18 nt, Human
ccgccgccgccgccgccg

SEQ ID NO: 494506 - RNA, 18 nt, Human
ccgccgccgccgccgccg

SEQ ID NO: 494507 - RNA, 18 nt, Human
ccgccgccgccgccgccg

SEQ ID NO: 494508 - RNA, 18 nt, Human
ccgccgccgccgccgccg

SEQ ID NO: 494509 - RNA, 21 nt, Human
ccgccgccgccgccgccgcag

SEQ ID NO: 494510 - RNA, 24 nt, Human
ccgccgccgccgccgccgccgccg

SEQ ID NO: 494511 - RNA, 24 nt, Human
ccgccgccgccgccgccgccgccg

SEQ ID NO: 494512 - RNA, 22 nt, Human
ccgccgccgccgcgggcccgcc

SEQ ID NO: 494513 - RNA, 19 nt, Human
ccgccgccgcggccugcgc

SEQ ID NO: 494514 - RNA, 21 nt, Human
ccgccgcgcccaucgcggccc

SEQ ID NO: 494515 - RNA, 19 nt, Human
ccgccgcggccugcgccuu

SEQ ID NO: 494516 - RNA, 28 nt, Human
ccgccgggccgccgccgccgccgccggc

SEQ ID NO: 494517 - RNA, 19 nt, Human
ccgcgcccaucgcggcccc

SEQ ID NO: 494518 - RNA, 18 nt, Human
ccgcgccggcgcuuuguc

SEQ ID NO: 494519 - RNA, 24 nt, Human
ccgcgcgcccucagcccgcugccc

SEQ ID NO: 494520 - RNA, 22 nt, Human
ccgcggaggccagcccgcccua

SEQ ID NO: 494521 - RNA, 22 nt, Human
ccggcgccgccgccgcagcugc

SEQ ID NO: 494522 - RNA, 22 nt, Human
ccgucucaaaaaaagaacaaaa

SEQ ID NO: 494523 - RNA, 24 nt, Human
ccuccggcuggcugggcucgguuc

SEQ ID NO: 494524 - RNA, 22 nt, Human
ccuggguaacagagugagacuc

SEQ ID NO: 494525 - RNA, 21 nt, Human
ccuguaaucccagcuacucgg

SEQ ID NO: 494526 - RNA, 20 nt, Human
ccuuuaagaggggaccaugc

SEQ ID NO: 494527 - RNA, 20 nt, Human
cgccacugcauuccagccug

SEQ ID NO: 494528 - RNA, 20 nt, Human
cgccccuugcuuuaaaaccu

SEQ ID NO: 494529 - RNA, 18 nt, Human
cgccgccgccgccgcagg

SEQ ID NO: 494530 - RNA, 19 nt, Human
cgccgccgccgccgcgggc

SEQ ID NO: 494531 - RNA, 21 nt, Human
cgccgccgccgccgcgggccc

SEQ ID NO: 494532 - RNA, 25 nt, Human
cgccgccgccgccgcgggcccgccg

SEQ ID NO: 494533 - RNA, 28 nt, Human
cggcccccgagccgcccgcaggccccuc

SEQ ID NO: 494534 - RNA, 19 nt, Human
cggcgcgcgcuagcggcgg

SEQ ID NO: 494535 - RNA, 26 nt, Human
cggcucgggcgcgagguggcggcggg

SEQ ID NO: 494536 - RNA, 19 nt, Human
cgggcagcgccgccgccgc

SEQ ID NO: 494537 - RNA, 18 nt, Human
cguagccggcgccgccgc

SEQ ID NO: 494538 - RNA, 18 nt, Human
cuacguggccagcugggc

SEQ ID NO: 494539 - RNA, 25 nt, Human
cuacguggccaugcugagcagaguu

SEQ ID NO: 494540 - RNA, 24 nt, Human
cuagcugggcgugguggugugugc

SEQ ID NO: 494541 - RNA, 25 nt, Human
cucaaaaaaagaacaaaacaaaaca

SEQ ID NO: 494542 - RNA, 19 nt, Human
cuccggcuggcugggcucg

SEQ ID NO: 494543 - RNA, 21 nt, Human
cucgcgcgcggggacgcgggg

SEQ ID NO: 494544 - RNA, 25 nt, Human
cugcaaauaaaacagacuaaacaca

SEQ ID NO: 494545 - RNA, 20 nt, Human
cuguguacaucagauuuauu

SEQ ID NO: 494546 - RNA, 21 nt, Human
gaacaaaacaaaacaaacaaa

SEQ ID NO: 494547 - RNA, 22 nt, Human
gaacaaaacaaaacaaacaaaa

SEQ ID NO: 494548 - RNA, 18 nt, Human
gaaguggagguuaaagug

SEQ ID NO: 494549 - RNA, 24 nt, Human
gagaacagccacauaccucacugu

SEQ ID NO: 494550 - RNA, 18 nt, Human
gagcaaagggucucaaaa

SEQ ID NO: 494551 - RNA, 22 nt, Human
gagcaccaaaauugucaaagaa

SEQ ID NO: 494552 - RNA, 23 nt, Human
gagguuaaagugagccaagauug

SEQ ID NO: 494553 - RNA, 24 nt, Human
gcauuccagccuggguaacagagu

SEQ ID NO: 494554 - RNA, 19 nt, Human
gccacugcauuccagccug

SEQ ID NO: 494555 - RNA, 24 nt, Human
gccacugcauuccagccuggguaa

SEQ ID NO: 494556 - RNA, 18 nt, Human
gcccccgccgccgcggcc

SEQ ID NO: 494557 - RNA, 25 nt, Human
gccgcgaggcccggcccgggcagcg

SEQ ID NO: 494558 - RNA, 19 nt, Human
gcgccgccgccgcagcugc

SEQ ID NO: 494559 - RNA, 24 nt, Human
gcuugcauggugaaaccccgucuc

SEQ ID NO: 494560 - RNA, 20 nt, Human
ggagguuaaagugagccaag

SEQ ID NO: 494561 - RNA, 20 nt, Human
ggcagacgaguccgggcucc

SEQ ID NO: 494562 - RNA, 18 nt, Human
ggcccgccgcgcccaucg

SEQ ID NO: 494563 - RNA, 22 nt, Human
ggccgaaugaacuaccacgaga

SEQ ID NO: 494564 - RNA, 27 nt, Human
ggcgcgagguggcggcggcuccucccu

SEQ ID NO: 494565 - RNA, 23 nt, Human
ggcgugguggugugugccuguaa

SEQ ID NO: 494566 - RNA, 20 nt, Human
ggcuugcauggugaaacccc

SEQ ID NO: 494567 - RNA, 21 nt, Human
ggucaagaagagaaaaugccc

SEQ ID NO: 494568 - RNA, 24 nt, Human
gguggugugugccuguaaucccag

SEQ ID NO: 494569 - RNA, 25 nt, Human
guaauacaauucuucagcuaaaaca

SEQ ID NO: 494570 - RNA, 22 nt, Human
gucucaaaaaaagaacaaaaca

SEQ ID NO: 494571 - RNA, 20 nt, Human
guggccaugcugagcagagu

SEQ ID NO: 494572 - RNA, 23 nt, Human
guggugugugccuguaaucccag

SEQ ID NO: 494573 - RNA, 24 nt, Human
guggugugugccuguaaucccagc

SEQ ID NO: 494574 - RNA, 20 nt, Human
gugugccuguaaucccagcu

SEQ ID NO: 494575 - RNA, 24 nt, Human
uaaaacaaaacaguaaugaaagaa

SEQ ID NO: 494576 - RNA, 23 nt, Human
uaaaacagacuaaacacacuccc

SEQ ID NO: 494577 - RNA, 26 nt, Human
uaaacacacucccgauacacauaaau

SEQ ID NO: 494578 - RNA, 23 nt, Human
uaacacagacaggaugaaaggaa

SEQ ID NO: 494579 - RNA, 23 nt, Human
uaacagagugagacuccgucuca

SEQ ID NO: 494580 - RNA, 22 nt, Human
uaagaggggaccaugcccggcg

SEQ ID NO: 494581 - RNA, 24 nt, Human
uaaugagacaaaaugguucugaaa

SEQ ID NO: 494582 - RNA, 24 nt, Human
uaauuaaaaacgucuuuuccagca

SEQ ID NO: 494583 - RNA, 21 nt, Human
uacaaaaaaacuagcugggcg

SEQ ID NO: 494584 - RNA, 23 nt, Human
uacaauucuucagcuaaaacagg

SEQ ID NO: 494585 - RNA, 20 nt, Human
uacauaauguucagcaagaa

SEQ ID NO: 494586 - RNA, 26 nt, Human
uaccacgagaacagccacauaccuca

SEQ ID NO: 494587 - RNA, 20 nt, Human
uaccaugaggggaaaugauc

SEQ ID NO: 494588 - RNA, 18 nt, Human
uagaaucuguggaauguu

SEQ ID NO: 494589 - RNA, 22 nt, Human
uaggccgaaugaacuaccacga

SEQ ID NO: 494590 - RNA, 26 nt, Human
uauguguguguguuucagucugugua

SEQ ID NO: 494591 - RNA, 23 nt, Human
uauuaaggcacauuugaucugag

SEQ ID NO: 494592 - RNA, 26 nt, Human
ucaaaaaaagaacaaaacaaaacaaa

SEQ ID NO: 494593 - RNA, 19 nt, Human
ucagcccgcugcccccgcc

SEQ ID NO: 494594 - RNA, 19 nt, Human
ucaucagguacauuucaag

SEQ ID NO: 494595 - RNA, 23 nt, Human
ucauuucacuuuuguccccaaaa

SEQ ID NO: 494596 - RNA, 19 nt, Human
uccagccuggguaacagag

SEQ ID NO: 494597 - RNA, 23 nt, Human
uccagccuggguaacagagugag

SEQ ID NO: 494598 - RNA, 24 nt, Human
uccagccuggguaacagagugaga

SEQ ID NO: 494599 - RNA, 23 nt, Human
uccccaaaacacaugagcaccaa

SEQ ID NO: 494600 - RNA, 22 nt, Human
uccccaacguuuugauuagggu

SEQ ID NO: 494601 - RNA, 21 nt, Human
uccgcacgcccgcccccgccg

SEQ ID NO: 494602 - RNA, 26 nt, Human
uccgcacgcccgcccccgccgccgcg

SEQ ID NO: 494603 - RNA, 21 nt, Human
ucguagccggcgccgccgccg

SEQ ID NO: 494604 - RNA, 25 nt, Human
ucucuacuaaaaauacaaaaaaacu

SEQ ID NO: 494605 - RNA, 21 nt, Human
ucugaaaaguacaauagaaaa

SEQ ID NO: 494606 - RNA, 28 nt, Human
ucuucagcuaaaacaggaauaaugagac

SEQ ID NO: 494607 - RNA, 18 nt, Human
ugaaaaguacaauagaaa

SEQ ID NO: 494608 - RNA, 22 nt, Human
ugaaaaguacaauagaaaaaua

SEQ ID NO: 494609 - RNA, 18 nt, Human
ugaaaggaacaaaaccaa

SEQ ID NO: 494610 - RNA, 22 nt, Human
ugaaaggaacaaaaccaaauac

SEQ ID NO: 494611 - RNA, 19 nt, Human
ugaagacaaugaugaaaca

SEQ ID NO: 494612 - RNA, 22 nt, Human
ugagccaagauugcgccacugc

SEQ ID NO: 494613 - RNA, 21 nt, Human
ugcauggugaaaccccgucuc

SEQ ID NO: 494614 - RNA, 18 nt, Human
ugccauaggacuggagca

SEQ ID NO: 494615 - RNA, 23 nt, Human
ugccuguaaucccagcuacucgg

SEQ ID NO: 494616 - RNA, 24 nt, Human
ugccuguaaucccagcuacucggg

SEQ ID NO: 494617 - RNA, 18 nt, Human
uggcagagcucugaacaa

SEQ ID NO: 494618 - RNA, 24 nt, Human
ugguggugugugccuguaauccca

SEQ ID NO: 494619 - RNA, 21 nt, Human
uggugugugccuguaauccca

SEQ ID NO: 494620 - RNA, 21 nt, Human
ugucaaagaacacuuaauauu

SEQ ID NO: 494621 - RNA, 25 nt, Human
uguucaaaggcaaacacugaucacc

SEQ ID NO: 494622 - RNA, 25 nt, Human
uuaaaaaaguuuuguucaucaggua

SEQ ID NO: 494623 - RNA, 20 nt, Human
uucagaaagcucaaucuuaa

SEQ ID NO: 494624 - RNA, 20 nt, Human
uucgcacggcgccugucccc

SEQ ID NO: 494625 - RNA, 24 nt, Human
uugcauggugaaaccccgucucua

SEQ ID NO: 494626 - RNA, 23 nt, Human
uugcgccacugcauuccagccug

SEQ ID NO: 494627 - RNA, 24 nt, Human
uugcuugaaccagggaaguggagg

SEQ ID NO: 494628 - RNA, 23 nt, Human
uuucugccauaggacuggagcaa

SEQ ID NO: 494629 - RNA, 20 nt, Human
aaaaguuaaaaguugacacu

SEQ ID NO: 494630 - RNA, 20 nt, Human
aaacaaauauucaaacaagu

SEQ ID NO: 494631 - RNA, 26 nt, Human
aagcaaaugaauuuugucaccaaggg

SEQ ID NO: 494632 - RNA, 26 nt, Human
aauacacaaagugaaaaacuauuaga

SEQ ID NO: 494633 - RNA, 27 nt, Human
aauguacaucuuaaauacauauacaca

SEQ ID NO: 494634 - RNA, 21 nt, Human
acauauacacacaacaacaug

SEQ ID NO: 494635 - RNA, 22 nt, Human
accauacuacauuaaccagccc

SEQ ID NO: 494636 - RNA, 19 nt, Human
agaaaaaaacacagguaga

SEQ ID NO: 494637 - RNA, 22 nt, Human
agaaaaaaacacagguagacuu

SEQ ID NO: 494638 - RNA, 22 nt, Human
agcaaaauaaaggaauauucac

SEQ ID NO: 494639 - RNA, 26 nt, Human
aggagguagaauuuauucuucaagaa

SEQ ID NO: 494640 - RNA, 20 nt, Human
aggcaaaugugucgugaugg

SEQ ID NO: 494641 - RNA, 19 nt, Human
auauacacacaacaacaug

SEQ ID NO: 494642 - RNA, 22 nt, Human
auuuccaacauguauagcaaca

SEQ ID NO: 494643 - RNA, 22 nt, Human
caacaugauuuaugaaagccaa

SEQ ID NO: 494644 - RNA, 30 nt, Human
cacuuugucuuacgcccaaaaguuaaaagg

SEQ ID NO: 494645 - RNA, 22 nt, Human
cagauuagauugcaagcaaaug

SEQ ID NO: 494646 - RNA, 22 nt, Human
cagccuuuuuagaaaaaaacac

SEQ ID NO: 494647 - RNA, 20 nt, Human
cccucccucucaucaucaag

SEQ ID NO: 494648 - RNA, 22 nt, Human
ccgaggcuugcgaguccuccuu

SEQ ID NO: 494649 - RNA, 22 nt, Human
ccucucaucaucaagcagcaaa

SEQ ID NO: 494650 - RNA, 23 nt, Human
cgggagggcaagcggccucaggu

SEQ ID NO: 494651 - RNA, 24 nt, Human
gcccaaaaguuaaaaguugacacu

SEQ ID NO: 494652 - RNA, 23 nt, Human
uaaaacaaauauucaaacaagua

SEQ ID NO: 494653 - RNA, 26 nt, Human
uaaaaugccuauuacuugagguuuuc

SEQ ID NO: 494654 - RNA, 21 nt, Human
uaaccagcccucaccacaguc

SEQ ID NO: 494655 - RNA, 23 nt, Human
uaccauacuacauuaaccagccc

SEQ ID NO: 494656 - RNA, 20 nt, Human
uagaaaaaaacacagguaga

SEQ ID NO: 494657 - RNA, 22 nt, Human
uagaaaaaaacacagguagacu

SEQ ID NO: 494658 - RNA, 18 nt, Human
uagaagcacagauacaca

SEQ ID NO: 494659 - RNA, 19 nt, Human
uagagguccacaguccuuu

SEQ ID NO: 494660 - RNA, 25 nt, Human
uaguagaaauguaguuucuguucau

SEQ ID NO: 494661 - RNA, 25 nt, Human
uauacacacaacaacaugauuuaug

SEQ ID NO: 494662 - RNA, 27 nt, Human
uauaccauacuacauuaaccagcccuc

SEQ ID NO: 494663 - RNA, 23 nt, Human
ucaagcagcaaaauaaaggaaua

SEQ ID NO: 494664 - RNA, 18 nt, Human
ucaugggggaaaaacaca

SEQ ID NO: 494665 - RNA, 22 nt, Human
ucucugaaacccuuggggcaag

SEQ ID NO: 494666 - RNA, 20 nt, Human
ucucuuugauauuauuaaau

SEQ ID NO: 494667 - RNA, 23 nt, Human
ugaaaaacuauuagaauauaaaa

SEQ ID NO: 494668 - RNA, 23 nt, Human
ugacaagacaugaaagauuguuu

SEQ ID NO: 494669 - RNA, 30 nt, Human
ugacugaugucugaagaaugguuucauggg

SEQ ID NO: 494670 - RNA, 26 nt, Human
ugagcagccuuuuuagaaaaaaacac

SEQ ID NO: 494671 - RNA, 22 nt, Human
ugcaagcaaaugaauuuuguca

SEQ ID NO: 494672 - RNA, 21 nt, Human
ugccaggaagagaaccuguuc

SEQ ID NO: 494673 - RNA, 25 nt, Human
ugucugaagaaugguuucauggggg

SEQ ID NO: 494674 - RNA, 23 nt, Human
uuacagauaaaggagugcagacc

SEQ ID NO: 494675 - RNA, 23 nt, Human
uuacuugagguuuucuucucugu

SEQ ID NO: 494676 - RNA, 24 nt, Human
uuacuugagguuuucuucucugua

SEQ ID NO: 494677 - RNA, 24 nt, Human
uuauucuucaagaaauagaacuug

SEQ ID NO: 494678 - RNA, 18 nt, Human
uugcgaguccuccuucuc

SEQ ID NO: 494679 - RNA, 23 nt, Human
uuuggggacagugaacaagugac

SEQ ID NO: 494680 - RNA, 21 nt, Human
aaacggagcaaugacaacagc

SEQ ID NO: 494681 - RNA, 20 nt, Human
aaagguucuuggacagggug

SEQ ID NO: 494682 - RNA, 23 nt, Human
agcaaugacaacagcagugagga

SEQ ID NO: 494683 - RNA, 18 nt, Human
aggcuugaccuuggccac

SEQ ID NO: 494684 - RNA, 22 nt, Human
caaugacaacagcagugaggag

SEQ ID NO: 494685 - RNA, 18 nt, Human
cacaggcuugaccuuggc

SEQ ID NO: 494686 - RNA, 19 nt, Human
ccuuggccacagcucagca

SEQ ID NO: 494687 - RNA, 22 nt, Human
cgagggccgccccugcccgggg

SEQ ID NO: 494688 - RNA, 19 nt, Human
cgccgccucgugccgaauu

SEQ ID NO: 494689 - RNA, 19 nt, Human
cucgccucgagacgccgcc

SEQ ID NO: 494690 - RNA, 21 nt, Human
cugacaacgagggccgccccu

SEQ ID NO: 494691 - RNA, 23 nt, Human
cuugaccuuggccacagcucagc

SEQ ID NO: 494692 - RNA, 21 nt, Human
gacagggugccaggacacacg

SEQ ID NO: 494693 - RNA, 27 nt, Human
gagaggcccugacaacgagggccgccc

SEQ ID NO: 494694 - RNA, 22 nt, Human
gaggcugcacagcgccagcucc

SEQ ID NO: 494695 - RNA, 20 nt, Human
ggagcaaugacaacagcagu

SEQ ID NO: 494696 - RNA, 19 nt, Human
uacaaacacaaacggagca

SEQ ID NO: 494697 - RNA, 19 nt, Human
ucgccucgagacgccgccu

SEQ ID NO: 494698 - RNA, 21 nt, Human
ugacaacagcagugaggagag

SEQ ID NO: 494699 - RNA, 20 nt, Human
ugccaggacacacgcugggg

SEQ ID NO: 494700 - RNA, 24 nt, Human
uggcaacacaggcuugaccuuggc

SEQ ID NO: 494701 - RNA, 21 nt, Human
ugggccagcuuggcccgcacu

SEQ ID NO: 494702 - RNA, 25 nt, Human
uucuuggacagggugccaggacaca

SEQ ID NO: 494703 - RNA, 21 nt, Human
uugaccuuggccacagcucaa

SEQ ID NO: 494704 - RNA, 18 nt, Human
uuuuuuuuuuuuaggguc

SEQ ID NO: 494705 - RNA, 30 nt, Human
uuuuuuuuuuuuuuuuuuuuuuuuuagggg

SEQ ID NO: 494706 - RNA, 21 nt, Human
aacuaaccugaguccagcccc

SEQ ID NO: 494707 - RNA, 21 nt, Human
aagcucugaaggucacacgcu

SEQ ID NO: 494708 - RNA, 21 nt, Human
aaggccugcaccacccuccag

SEQ ID NO: 494709 - RNA, 21 nt, Human
aaguugggagggcagaggggg

SEQ ID NO: 494710 - RNA, 22 nt, Human
acccgggaggagauaaccuucc

SEQ ID NO: 494711 - RNA, 20 nt, Human
cacaguaagaaauauugcac

SEQ ID NO: 494712 - RNA, 20 nt, Human
cacccuccagcuugcagccc

SEQ ID NO: 494713 - RNA, 19 nt, Human
cagccccucagcugccccc

SEQ ID NO: 494714 - RNA, 20 nt, Human
cagccccucagcugcccccc

SEQ ID NO: 494715 - RNA, 26 nt, Human
cagccccucuggggaaaaaagggguu

SEQ ID NO: 494716 - RNA, 21 nt, Human
cccacauacuguccauguccu

SEQ ID NO: 494717 - RNA, 24 nt, Human
ccccacccccaaacuaaccugagu

SEQ ID NO: 494718 - RNA, 25 nt, Human
ccccacccccaaacuaaccugaguc

SEQ ID NO: 494719 - RNA, 20 nt, Human
cccccuauuccacaggcgcc

SEQ ID NO: 494720 - RNA, 21 nt, Human
ccccucagcugccccccagca

SEQ ID NO: 494721 - RNA, 26 nt, Human
ccccugcagccccucagcugcccccc

SEQ ID NO: 494722 - RNA, 22 nt, Human
ccucauuccgccccaaacugga

SEQ ID NO: 494723 - RNA, 20 nt, Human
ccucccuguggcccaaggcc

SEQ ID NO: 494724 - RNA, 23 nt, Human
ccugcaccacccuccagcuugca

SEQ ID NO: 494725 - RNA, 21 nt, Human
ccuguggcaaagugcaggagc

SEQ ID NO: 494726 - RNA, 22 nt, Human
cuccagguuauguacaggggcu

SEQ ID NO: 494727 - RNA, 19 nt, Human
cugcccccacauacugucc

SEQ ID NO: 494728 - RNA, 20 nt, Human
cuugcagcccucacaggagc

SEQ ID NO: 494729 - RNA, 19 nt, Human
gaggagcaggccucauucc

SEQ ID NO: 494730 - RNA, 25 nt, Human
gcaaagugcaggagcccccaccccc

SEQ ID NO: 494731 - RNA, 22 nt, Human
gcaggagcccccacccccaaac

SEQ ID NO: 494732 - RNA, 18 nt, Human
gccccaaacuggagagga

SEQ ID NO: 494733 - RNA, 21 nt, Human
gcucugaaggucacacgcucc

SEQ ID NO: 494734 - RNA, 18 nt, Human
gcuuggaggagggagacu

SEQ ID NO: 494735 - RNA, 22 nt, Human
gcuuggaggagggagacugccc

SEQ ID NO: 494736 - RNA, 21 nt, Human
ggaaggggguauuuacaagag

SEQ ID NO: 494737 - RNA, 22 nt, Human
ggagccauuuugcauaaaguga

SEQ ID NO: 494738 - RNA, 19 nt, Human
ggcuuggaggagggagacu

SEQ ID NO: 494739 - RNA, 21 nt, Human
guccagccccucuggggaaaa

SEQ ID NO: 494740 - RNA, 24 nt, Human
guucuggggaagggggcaagggca

SEQ ID NO: 494741 - RNA, 24 nt, Human
uaaagugaaaagcucugaagguca

SEQ ID NO: 494742 - RNA, 24 nt, Human
uacaacccaaguugggagggcaga

SEQ ID NO: 494743 - RNA, 18 nt, Human
uacuguccauguccugag

SEQ ID NO: 494744 - RNA, 26 nt, Human
uccacaggcgccucccuguggcccaa

SEQ ID NO: 494745 - RNA, 22 nt, Human
uccugcccccacauacugucca

SEQ ID NO: 494746 - RNA, 23 nt, Human
ucugaaggucacacgcuccaggu

SEQ ID NO: 494747 - RNA, 21 nt, Human
ucuggggaagggggcaagggc

SEQ ID NO: 494748 - RNA, 23 nt, Human
ugaggggguacuauaaguccugg

SEQ ID NO: 494749 - RNA, 22 nt, Human
ugaguccagccccucuggggaa

SEQ ID NO: 494750 - RNA, 22 nt, Human
uggcccaaggccugcaccaccc

SEQ ID NO: 494751 - RNA, 24 nt, Human
uggcuuuacccgggaggagauaac

SEQ ID NO: 494752 - RNA, 22 nt, Human
uuacccgggaggagauaaccuu

SEQ ID NO: 494753 - RNA, 24 nt, Human
uucuuagaaaguacaacccaaguu

SEQ ID NO: 494754 - RNA, 27 nt, Human
aacggcuucgugguguggagcuuggcg

SEQ ID NO: 494755 - RNA, 28 nt, Human
aagacagaucucaagguaaagucagaga

SEQ ID NO: 494756 - RNA, 21 nt, Human
aagcgugcugcucaccggccu

SEQ ID NO: 494757 - RNA, 18 nt, Human
accugagccuggagacuc

SEQ ID NO: 494758 - RNA, 25 nt, Human
acggggcgcgggugggccggcuggu

SEQ ID NO: 494759 - RNA, 19 nt, Human
agcagcagucaggcuggga

SEQ ID NO: 494760 - RNA, 19 nt, Human
agcagcagucaggcuggga

SEQ ID NO: 494761 - RNA, 19 nt, Human
agcucugauuucaguugca

SEQ ID NO: 494762 - RNA, 18 nt, Human
aggacaguggggaaauug

SEQ ID NO: 494763 - RNA, 23 nt, Human
aggcacagccuuccugcugcugg

SEQ ID NO: 494764 - RNA, 22 nt, Human
aggggaucagaggacagugggg

SEQ ID NO: 494765 - RNA, 20 nt, Human
caaaaugaacacaaucccug

SEQ ID NO: 494766 - RNA, 20 nt, Human
caagaugccugggggacauc

SEQ ID NO: 494767 - RNA, 22 nt, Human
caaggauccuuguagggucccc

SEQ ID NO: 494768 - RNA, 25 nt, Human
caagguaaagucagagagggcuguc

SEQ ID NO: 494769 - RNA, 24 nt, Human
caaucccugcuuuccugccaagga

SEQ ID NO: 494770 - RNA, 19 nt, Human
cacgccgcucuuuguggcc

SEQ ID NO: 494771 - RNA, 18 nt, Human
cagccugcacgggggcga

SEQ ID NO: 494772 - RNA, 23 nt, Human
cagcuuccccacuuuuuuucugu

SEQ ID NO: 494773 - RNA, 20 nt, Human
caguaugcuggggaguuuag

SEQ ID NO: 494774 - RNA, 19 nt, Human
caucgugcuugccuucggc

SEQ ID NO: 494775 - RNA, 24 nt, Human
cccccagcuuccccacuuuuuuuc

SEQ ID NO: 494776 - RNA, 19 nt, Human
cccggcccuggcccgccgc

SEQ ID NO: 494777 - RNA, 20 nt, Human
cccggcccuggcccgccgcc

SEQ ID NO: 494778 - RNA, 21 nt, Human
ccgccgccugcugcuggcggu

SEQ ID NO: 494779 - RNA, 23 nt, Human
ccgccgucuaccgccaccugugg

SEQ ID NO: 494780 - RNA, 19 nt, Human
ccgcuggggcuccgggcgg

SEQ ID NO: 494781 - RNA, 22 nt, Human
ccggagaguuccuucccuggaa

SEQ ID NO: 494782 - RNA, 25 nt, Human
ccuggcccgccgccugguccccugg

SEQ ID NO: 494783 - RNA, 21 nt, Human
cgccgguccacgccgccgccc

SEQ ID NO: 494784 - RNA, 23 nt, Human
cgccgguccacgccgccgcccac

SEQ ID NO: 494785 - RNA, 20 nt, Human
cgcugcuggggcugccuggc

SEQ ID NO: 494786 - RNA, 25 nt, Human
cgucccggccgccgucuaccgccac

SEQ ID NO: 494787 - RNA, 23 nt, Human
cgugugcgcgcucagcauguacg

SEQ ID NO: 494788 - RNA, 22 nt, Human
cucacgccgcucuuuguggccu

SEQ ID NO: 494789 - RNA, 24 nt, Human
cucacugacagugaaacccucaaa

SEQ ID NO: 494790 - RNA, 20 nt, Human
cucucacuuuucuccuuuug

SEQ ID NO: 494791 - RNA, 23 nt, Human
cucuuuguggccuuccugaccgg

SEQ ID NO: 494792 - RNA, 24 nt, Human
cugacagugaaacccucaaaauga

SEQ ID NO: 494793 - RNA, 24 nt, Human
cugcagguccugaaauuugaugcu

SEQ ID NO: 494794 - RNA, 22 nt, Human
cuggccgcccuguugcucgccg

SEQ ID NO: 494795 - RNA, 22 nt, Human
cugucauagucuuugcaguggg

SEQ ID NO: 494796 - RNA, 22 nt, Human
cuugaucuuggccuuucagggc

SEQ ID NO: 494797 - RNA, 21 nt, Human
gaaagaacagcauucuucagg

SEQ ID NO: 494798 - RNA, 20 nt, Human
gaucaagaugccugggggac

SEQ ID NO: 494799 - RNA, 20 nt, Human
gauucugggggcagaagcuc

SEQ ID NO: 494800 - RNA, 18 nt, Human
gcaggggauguccuuuga

SEQ ID NO: 494801 - RNA, 19 nt, Human
gccaagcgugcugcucacc

SEQ ID NO: 494802 - RNA, 19 nt, Human
gccucggcugcgcagcccg

SEQ ID NO: 494803 - RNA, 21 nt, Human
gcgcugcuggggcugccuggc

SEQ ID NO: 494804 - RNA, 18 nt, Human
gcucacgccgcucuuugu

SEQ ID NO: 494805 - RNA, 19 nt, Human
gcuugugcugcaccuggcg

SEQ ID NO: 494806 - RNA, 24 nt, Human
ggacaggaggcauugguaggggau

SEQ ID NO: 494807 - RNA, 21 nt, Human
ggcaacggcuucguggugugg

SEQ ID NO: 494808 - RNA, 22 nt, Human
ggccugcucagccugcagcgcu

SEQ ID NO: 494809 - RNA, 19 nt, Human
ggcggcacggggcgcgggu

SEQ ID NO: 494810 - RNA, 24 nt, Human
gggaacgagacacugcugagcugg

SEQ ID NO: 494811 - RNA, 18 nt, Human
gggcaggggauguccuuu

SEQ ID NO: 494812 - RNA, 22 nt, Human
ggggcuccgggcggcacggggc

SEQ ID NO: 494813 - RNA, 19 nt, Human
ggucccccagcuuccccac

SEQ ID NO: 494814 - RNA, 26 nt, Human
gucacacuuaggucaucuucucucac

SEQ ID NO: 494815 - RNA, 19 nt, Human
gucgguuggaaugauucug

SEQ ID NO: 494816 - RNA, 18 nt, Human
guggagcuuggcgggcug

SEQ ID NO: 494817 - RNA, 22 nt, Human
gugguucucuccugugcugggg

SEQ ID NO: 494818 - RNA, 20 nt, Human
uaccgccaccuguggaggga

SEQ ID NO: 494819 - RNA, 23 nt, Human
uagcuucuggugcgcuguguccc

SEQ ID NO: 494820 - RNA, 20 nt, Human
uaggaaagaacagcauucuu

SEQ ID NO: 494821 - RNA, 19 nt, Human
uagggucccccagcuuccc

SEQ ID NO: 494822 - RNA, 28 nt, Human
ucaagguaaagucagagagggcugucau

SEQ ID NO: 494823 - RNA, 19 nt, Human
ucacacuuaggucaucuuc

SEQ ID NO: 494824 - RNA, 21 nt, Human
ucacacuuaggucaucuucuc

SEQ ID NO: 494825 - RNA, 24 nt, Human
uccagagcugccugcugcagucac

SEQ ID NO: 494826 - RNA, 24 nt, Human
ucccccagcuuccccacuuuuuuu

SEQ ID NO: 494827 - RNA, 22 nt, Human
ucccugcuuuccugccaaggau

SEQ ID NO: 494828 - RNA, 20 nt, Human
ucccuggaacuucugggcug

SEQ ID NO: 494829 - RNA, 24 nt, Human
uccugcugcuggcggcgcugcugg

SEQ ID NO: 494830 - RNA, 19 nt, Human
uccuuggucggaggagggg

SEQ ID NO: 494831 - RNA, 20 nt, Human
uccuuggucggaggaggggc

SEQ ID NO: 494832 - RNA, 22 nt, Human
ucgccgguccacgccgccgccc

SEQ ID NO: 494833 - RNA, 21 nt, Human
ucuggcuggccgcccuguugc

SEQ ID NO: 494834 - RNA, 20 nt, Human
ucuucucucacuuuucuccu

SEQ ID NO: 494835 - RNA, 21 nt, Human
ugaaagguucugucacgaggg

SEQ ID NO: 494836 - RNA, 27 nt, Human
ugacagugaaacccucaaaaugaacac

SEQ ID NO: 494837 - RNA, 21 nt, Human
ugagccuggagacucugaccg

SEQ ID NO: 494838 - RNA, 21 nt, Human
ugagcgccaucgugcuugccu

SEQ ID NO: 494839 - RNA, 18 nt, Human
ugaggcguuaugcugaaa

SEQ ID NO: 494840 - RNA, 18 nt, Human
ugauggacaguugcaugg

SEQ ID NO: 494841 - RNA, 20 nt, Human
ugcggggcgcccgcuggggc

SEQ ID NO: 494842 - RNA, 18 nt, Human
ugcugcuggcggcgcugc

SEQ ID NO: 494843 - RNA, 19 nt, Human
ugcugcuggcggcgcugcu

SEQ ID NO: 494844 - RNA, 24 nt, Human
ugcuggggaguuuagggacaggag

SEQ ID NO: 494845 - RNA, 20 nt, Human
uggaagcugagacucucacu

SEQ ID NO: 494846 - RNA, 25 nt, Human
uggacaguugcauggaagcugagac

SEQ ID NO: 494847 - RNA, 23 nt, Human
uggcgccucggcugcgcagcccg

SEQ ID NO: 494848 - RNA, 22 nt, Human
uggcggucuggcuggccgcccu

SEQ ID NO: 494849 - RNA, 25 nt, Human
uggcggucuggcuggccgcccuguu

SEQ ID NO: 494850 - RNA, 21 nt, Human
ugggggcagaagcucagagcc

SEQ ID NO: 494851 - RNA, 23 nt, Human
ugggggcagaagcucagagcccc

SEQ ID NO: 494852 - RNA, 18 nt, Human
ugucaucaguaugcuggg

SEQ ID NO: 494853 - RNA, 20 nt, Human
ugucccagcucugauuucag

SEQ ID NO: 494854 - RNA, 23 nt, Human
uucauuuuccagagcugccugcu

SEQ ID NO: 494855 - RNA, 22 nt, Human
uuccugcugcuggcggcgcugc

SEQ ID NO: 494856 - RNA, 18 nt, Human
uuccuggcgccucggcug

SEQ ID NO: 494857 - RNA, 22 nt, Human
uucgcgggccacaggcacagcc

SEQ ID NO: 494858 - RNA, 26 nt, Human
uuuuccagagcugccugccggaaauc

SEQ ID NO: 494859 - RNA, 23 nt, Human
aaacaagcaaauucacgaaaaca

SEQ ID NO: 494860 - RNA, 25 nt, Human
aaacaagcaaauucacgaaaacaga

SEQ ID NO: 494861 - RNA, 21 nt, Human
aagcaaauucacgaaaacaga

SEQ ID NO: 494862 - RNA, 25 nt, Human
acaauggcugucacaugaaaugagg

SEQ ID NO: 494863 - RNA, 18 nt, Human
accaugcaaaaagaagag

SEQ ID NO: 494864 - RNA, 18 nt, Human
agagguagaugugggugc

SEQ ID NO: 494865 - RNA, 19 nt, Human
agagguagaugugggugcu

SEQ ID NO: 494866 - RNA, 23 nt, Human
caaacaagcaaauucacgaaaac

SEQ ID NO: 494867 - RNA, 24 nt, Human
caaacaagcaaauucacgaaaaca

SEQ ID NO: 494868 - RNA, 24 nt, Human
caaauucacgaaaacagaagugcu

SEQ ID NO: 494869 - RNA, 22 nt, Human
caguuugugcaucagucucaca

SEQ ID NO: 494870 - RNA, 18 nt, Human
ccauuuauauguaugaac

SEQ ID NO: 494871 - RNA, 19 nt, Human
cucagauccagugaccgug

SEQ ID NO: 494872 - RNA, 22 nt, Human
gacaguuugugcaucagucuca

SEQ ID NO: 494873 - RNA, 19 nt, Human
gcaaauucacgaaaacaga

SEQ ID NO: 494874 - RNA, 21 nt, Human
gggcaaaaccaugcaaaaaga

SEQ ID NO: 494875 - RNA, 24 nt, Human
uaccaguggccaauuucuuguguu

SEQ ID NO: 494876 - RNA, 24 nt, Human
uauauugguuauuugaucuucagc

SEQ ID NO: 494877 - RNA, 24 nt, Human
uaugaucaaggcuugccuaugucc

SEQ ID NO: 494878 - RNA, 21 nt, Human
uauguaugaacuaugaucaag

SEQ ID NO: 494879 - RNA, 20 nt, Human
ugacucuggaaugcgguccc

SEQ ID NO: 494880 - RNA, 21 nt, Human
ugacucuggaaugcggucccc

SEQ ID NO: 494881 - RNA, 24 nt, Human
uggagcaaggccaagaaauaugcu

SEQ ID NO: 494882 - RNA, 28 nt, Human
ugggcaaaaccaugcaaaaagaagagga

SEQ ID NO: 494883 - RNA, 21 nt, Human
uuaaaugaaguacaguugaag

SEQ ID NO: 494884 - RNA, 26 nt, Human
uucaccaccauuuauauguaugaacu

SEQ ID NO: 494885 - RNA, 19 nt, Human
uuucuuuauuucaccacca

SEQ ID NO: 494886 - RNA, 24 nt, Human
caagcucuggccagaagaccccaa

SEQ ID NO: 494887 - RNA, 19 nt, Human
cagagaaggcugagcagca

SEQ ID NO: 494888 - RNA, 19 nt, Human
ccaggaggggcagagaagg

SEQ ID NO: 494889 - RNA, 21 nt, Human
cccacgaaugacagauuccca

SEQ ID NO: 494890 - RNA, 18 nt, Human
ccccgcccaccccaccgg

SEQ ID NO: 494891 - RNA, 18 nt, Human
ccccgcccaccccaccgg

SEQ ID NO: 494892 - RNA, 19 nt, Human
cccgcccaccccaccggaa

SEQ ID NO: 494893 - RNA, 20 nt, Human
ccuggagaggccauggggcu

SEQ ID NO: 494894 - RNA, 19 nt, Human
cggcacuggguccuaggca

SEQ ID NO: 494895 - RNA, 20 nt, Human
cuggagaggccauggggcug

SEQ ID NO: 494896 - RNA, 27 nt, Human
gaagaccccaaggucugauccuggggu

SEQ ID NO: 494897 - RNA, 23 nt, Human
gaagccccgcccaccccaccgga

SEQ ID NO: 494898 - RNA, 22 nt, Human
gacaagcucuggccagaagacc

SEQ ID NO: 494899 - RNA, 20 nt, Human
gagcagcaccacguggggcu

SEQ ID NO: 494900 - RNA, 23 nt, Human
gccccgcccaccccaccggaaac

SEQ ID NO: 494901 - RNA, 18 nt, Human
ggggcuggccgcggguug

SEQ ID NO: 494902 - RNA, 21 nt, Human
ggguugugggcaugagcacgc

SEQ ID NO: 494903 - RNA, 20 nt, Human
guggaaggagccaguguccg

SEQ ID NO: 494904 - RNA, 23 nt, Human
uauccguagaaggagacgcgaag

SEQ ID NO: 494905 - RNA, 19 nt, Human
uccacagauauccguagaa

SEQ ID NO: 494906 - RNA, 24 nt, Human
ucccaggaggggcagagaaggcug

SEQ ID NO: 494907 - RNA, 21 nt, Human
ucugaagcacccacgaaugac

SEQ ID NO: 494908 - RNA, 21 nt, Human
ugaagcacccacgaaugacag

SEQ ID NO: 494909 - RNA, 18 nt, Human
ugagacguggaaggagcc

SEQ ID NO: 494910 - RNA, 21 nt, Human
ugagcacgccuggagaggcca

SEQ ID NO: 494911 - RNA, 21 nt, Human
uggaaggagccaguguccgca

SEQ ID NO: 494912 - RNA, 20 nt, Human
uuuuuuuuuuuuuuucugcu

SEQ ID NO: 494913 - RNA, 24 nt, Human
uuuuuuuuuuuuuuuuuuucuggg

SEQ ID NO: 494914 - RNA, 24 nt, Human
aaaaagaaaaagauucaguuccua

SEQ ID NO: 494915 - RNA, 21 nt, Human
aaagugucaucugcccuaaaa

SEQ ID NO: 494916 - RNA, 20 nt, Human
aacagagcaagacuccaucu

SEQ ID NO: 494917 - RNA, 19 nt, Human
aacauggugaaaccccguc

SEQ ID NO: 494918 - RNA, 20 nt, Human
aacauggugaaaccccgucu

SEQ ID NO: 494919 - RNA, 21 nt, Human
aacauggugaaaccccgucuc

SEQ ID NO: 494920 - RNA, 19 nt, Human
aacccuuggaucacauggg

SEQ ID NO: 494921 - RNA, 18 nt, Human
aaucaaacuccauccugu

SEQ ID NO: 494922 - RNA, 24 nt, Human
aaugacaagacaaaggcauacaga

SEQ ID NO: 494923 - RNA, 18 nt, Human
aauugcuugaacccggga

SEQ ID NO: 494924 - RNA, 23 nt, Human
acaccacugcacuccagcugggc

SEQ ID NO: 494925 - RNA, 22 nt, Human
acagaccccagggaaauaccca

SEQ ID NO: 494926 - RNA, 24 nt, Human
acagagcaagacuccaucucaaaa

SEQ ID NO: 494927 - RNA, 24 nt, Human
accacugcacuccagcugggcaac

SEQ ID NO: 494928 - RNA, 24 nt, Human
accccgucucuacuaaaaauacaa

SEQ ID NO: 494929 - RNA, 18 nt, Human
acccuuggaucacauggg

SEQ ID NO: 494930 - RNA, 23 nt, Human
acugcacuccagcugggcaacag

SEQ ID NO: 494931 - RNA, 23 nt, Human
acugcacuccagcugggcaacag

SEQ ID NO: 494932 - RNA, 25 nt, Human
agacaaaggcauacagaccccaggg

SEQ ID NO: 494933 - RNA, 20 nt, Human
agacagagguugcaguaagc

SEQ ID NO: 494934 - RNA, 24 nt, Human
agacagagguugcaguaagcugag

SEQ ID NO: 494935 - RNA, 21 nt, Human
agaccccagggaaauacccag

SEQ ID NO: 494936 - RNA, 24 nt, Human
agagguugcaguaagcugagauca

SEQ ID NO: 494937 - RNA, 24 nt, Human
agaugggagaauugcuugaacccg

SEQ ID NO: 494938 - RNA, 19 nt, Human
agccugggcaacaugguga

SEQ ID NO: 494939 - RNA, 22 nt, Human
agccugggcaacauggugaaac

SEQ ID NO: 494940 - RNA, 24 nt, Human
agccugggcaacauggugaaaccc

SEQ ID NO: 494941 - RNA, 23 nt, Human
agcugggcaacagagcaagacuc

SEQ ID NO: 494942 - RNA, 18 nt, Human
agcugggccagguguggu

SEQ ID NO: 494943 - RNA, 19 nt, Human
agcugggccagguguggug

SEQ ID NO: 494944 - RNA, 23 nt, Human
aggaguucgagaccagccugggc

SEQ ID NO: 494945 - RNA, 25 nt, Human
aggcccuagguucuuuacucuagcu

SEQ ID NO: 494946 - RNA, 24 nt, Human
aggcugagaugggagaauugcuug

SEQ ID NO: 494947 - RNA, 18 nt, Human
agggauacacuguccagc

SEQ ID NO: 494948 - RNA, 24 nt, Human
aggugugguggugugugccuguaa

SEQ ID NO: 494949 - RNA, 23 nt, Human
aucacaccacugcacuccagcug

SEQ ID NO: 494950 - RNA, 21 nt, Human
auccagcacuuugggaggcca

SEQ ID NO: 494951 - RNA, 22 nt, Human
caaaaaagaauuagcugggcca

SEQ ID NO: 494952 - RNA, 26 nt, Human
caaacuuaaaaaaaaaauacaaaccc

SEQ ID NO: 494953 - RNA, 22 nt, Human
caacauggugaaaccccgucuc

SEQ ID NO: 494954 - RNA, 24 nt, Human
caacauggugaaaccccgucucua

SEQ ID NO: 494955 - RNA, 23 nt, Human
caagacaaaggcauacagacccc

SEQ ID NO: 494956 - RNA, 23 nt, Human
caagacggguggaucaccugagc

SEQ ID NO: 494957 - RNA, 26 nt, Human
caagacggguggaucaccugagcuca

SEQ ID NO: 494958 - RNA, 19 nt, Human
cacaugggggcuucuggga

SEQ ID NO: 494959 - RNA, 22 nt, Human
cacuccagcugggcaacagagc

SEQ ID NO: 494960 - RNA, 18 nt, Human
cacugcacuccagcuggg

SEQ ID NO: 494961 - RNA, 20 nt, Human
cacugcacuccagcugggca

SEQ ID NO: 494962 - RNA, 21 nt, Human
cacugcacuccagcugggcaa

SEQ ID NO: 494963 - RNA, 23 nt, Human
cacugcacuccagcugggcaaca

SEQ ID NO: 494964 - RNA, 20 nt, Human
cagcacuuugggaggccaag

SEQ ID NO: 494965 - RNA, 26 nt, Human
cagcacuuugggaggccaagacgggu

SEQ ID NO: 494966 - RNA, 18 nt, Human
cagcccagguccaggccc

SEQ ID NO: 494967 - RNA, 18 nt, Human
cauguacauacaaauaug

SEQ ID NO: 494968 - RNA, 19 nt, Human
ccacugcacuccagcuggg

SEQ ID NO: 494969 - RNA, 20 nt, Human
ccacugcacuccagcugggc

SEQ ID NO: 494970 - RNA, 23 nt, Human
ccauccuugcagaaaagagccua

SEQ ID NO: 494971 - RNA, 21 nt, Human
ccccagggaaauacccaguuc

SEQ ID NO: 494972 - RNA, 19 nt, Human
ccccguauucuucccccuc

SEQ ID NO: 494973 - RNA, 22 nt, Human
ccccguauucuucccccucacc

SEQ ID NO: 494974 - RNA, 21 nt, Human
ccgggcacaguggccuaugcc

SEQ ID NO: 494975 - RNA, 23 nt, Human
ccugggcaacauggugaaacccc

SEQ ID NO: 494976 - RNA, 24 nt, Human
ccugggcaacauggugaaaccccg

SEQ ID NO: 494977 - RNA, 19 nt, Human
ccuguaauccagcacuuug

SEQ ID NO: 494978 - RNA, 21 nt, Human
ccuguaaucccagcuacucag

SEQ ID NO: 494979 - RNA, 23 nt, Human
cgaaaaagguccaaaucacugcu

SEQ ID NO: 494980 - RNA, 24 nt, Human
cgagaccagccugggcaacauggu

SEQ ID NO: 494981 - RNA, 24 nt, Human
cggguggaucaccugagcucagga

SEQ ID NO: 494982 - RNA, 20 nt, Human
cuaaaagcaaaugacaagac

SEQ ID NO: 494983 - RNA, 21 nt, Human
cuacuaaaaauacaaaaaaga

SEQ ID NO: 494984 - RNA, 18 nt, Human
cucaggaggcugagaugg

SEQ ID NO: 494985 - RNA, 21 nt, Human
cuccugaaaugggucaagaaa

SEQ ID NO: 494986 - RNA, 20 nt, Human
cugacauugauuugaggaaa

SEQ ID NO: 494987 - RNA, 22 nt, Human
cugagcucaggaguucgagacc

SEQ ID NO: 494988 - RNA, 21 nt, Human
cuuggaucacaugggggcuuc

SEQ ID NO: 494989 - RNA, 19 nt, Human
cuuuacucuagcuaccccc

SEQ ID NO: 494990 - RNA, 23 nt, Human
gagaucacaccacugcacuccag

SEQ ID NO: 494991 - RNA, 24 nt, Human
gagaugggagaauugcuugaaccc

SEQ ID NO: 494992 - RNA, 24 nt, Human
gaucaccugagcucaggaguucga

SEQ ID NO: 494993 - RNA, 22 nt, Human
gccaggugugguggugugugcc

SEQ ID NO: 494994 - RNA, 23 nt, Human
gccaggugugguggugugugccc

SEQ ID NO: 494995 - RNA, 18 nt, Human
gccuguaauccagcacuu

SEQ ID NO: 494996 - RNA, 23 nt, Human
gccuguaauccagcacuuuggga

SEQ ID NO: 494997 - RNA, 20 nt, Human
gcugagaucacaccacugca

SEQ ID NO: 494998 - RNA, 22 nt, Human
ggaguucgagaccagccugggc

SEQ ID NO: 494999 - RNA, 18 nt, Human
ggaucacaugggggcuuc

SEQ ID NO: 495000 - RNA, 23 nt, Human
ggcacaguggccuaugccuguaa

SEQ ID NO: 495001 - RNA, 18 nt, Human
gggcuucugggaaccccc

SEQ ID NO: 495002 - RNA, 22 nt, Human
ggguggaucaccugagcucagg

SEQ ID NO: 495003 - RNA, 24 nt, Human
gguggugugugccuguaaucccag

SEQ ID NO: 495004 - RNA, 24 nt, Human
guggugugugccuguaaucccagc

SEQ ID NO: 495005 - RNA, 25 nt, Human
uaaaaaaaaaauacaaacccuugga

SEQ ID NO: 495006 - RNA, 26 nt, Human
uaaaaaaaaaauacaaacccuuggau

SEQ ID NO: 495007 - RNA, 21 nt, Human
uaaaagcaaaugacaagacaa

SEQ ID NO: 495008 - RNA, 25 nt, Human
uaagcugagaucacaccaaucaacg

SEQ ID NO: 495009 - RNA, 24 nt, Human
uaauccagcacuuugggaggccaa

SEQ ID NO: 495010 - RNA, 21 nt, Human
uacucucccaccaauaccagc

SEQ ID NO: 495011 - RNA, 19 nt, Human
uagcuacccccuauuucuu

SEQ ID NO: 495012 - RNA, 23 nt, Human
uagcuacccccuauuucuuuggu

SEQ ID NO: 495013 - RNA, 24 nt, Human
uaucaggauaaaggagagggcucc

SEQ ID NO: 495014 - RNA, 22 nt, Human
ucacaccacugcacuccagcug

SEQ ID NO: 495015 - RNA, 20 nt, Human
ucaccugagcucaggaguuc

SEQ ID NO: 495016 - RNA, 24 nt, Human
ucaggccgggcacaguggccuaug

SEQ ID NO: 495017 - RNA, 18 nt, Human
ucucaaaaaauaaaaaga

SEQ ID NO: 495018 - RNA, 22 nt, Human
ucucuacuaaaaauacaaaaaa

SEQ ID NO: 495019 - RNA, 20 nt, Human
ugaaaugggucaagaaagaa

SEQ ID NO: 495020 - RNA, 18 nt, Human
ugagaucacaccacugca

SEQ ID NO: 495021 - RNA, 20 nt, Human
ugcagaaaagagccuaaaau

SEQ ID NO: 495022 - RNA, 21 nt, Human
ugcagaaaagagccuaaaauu

SEQ ID NO: 495023 - RNA, 23 nt, Human
ugccuguaauccagcacuuuggg

SEQ ID NO: 495024 - RNA, 24 nt, Human
ugccuguaaucccagcuacucagg

SEQ ID NO: 495025 - RNA, 24 nt, Human
uggaucaccugagcucaggaguuc

SEQ ID NO: 495026 - RNA, 19 nt, Human
uggccuaugccuguaaucc

SEQ ID NO: 495027 - RNA, 19 nt, Human
uggccuaugccuguaaucc

SEQ ID NO: 495028 - RNA, 23 nt, Human
uggccuaugccuguaauccagca

SEQ ID NO: 495029 - RNA, 21 nt, Human
ugggaaaaagugucaucugcc

SEQ ID NO: 495030 - RNA, 20 nt, Human
ugggaacccccguauucuuc

SEQ ID NO: 495031 - RNA, 24 nt, Human
ugggaggccaagacggguggauca

SEQ ID NO: 495032 - RNA, 24 nt, Human
ugguauugucaaaagacaagauuc

SEQ ID NO: 495033 - RNA, 24 nt, Human
ugguggugugugccuguaauccca

SEQ ID NO: 495034 - RNA, 21 nt, Human
uggugugugccuguaauccca

SEQ ID NO: 495035 - RNA, 22 nt, Human
uggugugugccuguaaucccag

SEQ ID NO: 495036 - RNA, 24 nt, Human
uggugugugccuguaaucccagcu

SEQ ID NO: 495037 - RNA, 30 nt, Human
uuagcugggccaggugugguggugugugcc

SEQ ID NO: 495038 - RNA, 19 nt, Human
uugcaguaagcugagauca

SEQ ID NO: 495039 - RNA, 20 nt, Human
uugcaguaagcugagaucac

SEQ ID NO: 495040 - RNA, 24 nt, Human
uugcuugaacccgggagacagagg

SEQ ID NO: 495041 - RNA, 21 nt, Human
uuugaggaaagagaaggggca

SEQ ID NO: 495042 - RNA, 21 nt, Human
uagaaagacaacaguauauaa

SEQ ID NO: 495043 - RNA, 24 nt, Human
ucuuucuucucuacuucuccuccu

SEQ ID NO: 495044 - RNA, 19 nt, Human
aagcagccccugaccgagc

SEQ ID NO: 495045 - RNA, 21 nt, Human
aagcgcggagcucggugagcc

SEQ ID NO: 495046 - RNA, 20 nt, Human
acagacccuuuuuuucccuu

SEQ ID NO: 495047 - RNA, 26 nt, Human
acgccgccgccaccgcuaccgcgaac

SEQ ID NO: 495048 - RNA, 18 nt, Human
agcccccagccccuggca

SEQ ID NO: 495049 - RNA, 18 nt, Human
agccccuggcacgcacgc

SEQ ID NO: 495050 - RNA, 18 nt, Human
aggcggcggagcccccag

SEQ ID NO: 495051 - RNA, 19 nt, Human
caccgcacagugccgcgcc

SEQ ID NO: 495052 - RNA, 25 nt, Human
caccgcgccgcgccgccgcugcacc

SEQ ID NO: 495053 - RNA, 19 nt, Human
cagcgcccgcggccgcgcc

SEQ ID NO: 495054 - RNA, 21 nt, Human
ccaagcagccccugaccgagc

SEQ ID NO: 495055 - RNA, 20 nt, Human
ccagccccuggcacgcacgc

SEQ ID NO: 495056 - RNA, 24 nt, Human
ccccggggcgccugggaaaagccc

SEQ ID NO: 495057 - RNA, 22 nt, Human
cccgaccccggggcgccuggga

SEQ ID NO: 495058 - RNA, 19 nt, Human
cccgcaccgcgccgcgccg

SEQ ID NO: 495059 - RNA, 23 nt, Human
ccgcagcuucggcgccggacucc

SEQ ID NO: 495060 - RNA, 24 nt, Human
ccgcagcuucggcgccggacuccg

SEQ ID NO: 495061 - RNA, 26 nt, Human
ccgccgccaccgcuaccgcgaaccgg

SEQ ID NO: 495062 - RNA, 20 nt, Human
ccgcgccgcgccgccgcugc

SEQ ID NO: 495063 - RNA, 26 nt, Human
ccggggcgguggcgguggcggccuuu

SEQ ID NO: 495064 - RNA, 19 nt, Human
cgcacacggcagcagacug

SEQ ID NO: 495065 - RNA, 24 nt, Human
cgcacagugccgcgccaagcagcc

SEQ ID NO: 495066 - RNA, 25 nt, Human
cgcccgcagcuucggcgccggacuc

SEQ ID NO: 495067 - RNA, 20 nt, Human
cgcgccgccgcugcaccgca

SEQ ID NO: 495068 - RNA, 21 nt, Human
cggcgccggacuccggggcgg

SEQ ID NO: 495069 - RNA, 21 nt, Human
cggggcgguggcgguggcggc

SEQ ID NO: 495070 - RNA, 21 nt, Human
cguuggccacccgaccccggg

SEQ ID NO: 495071 - RNA, 28 nt, Human
cuccggggcgguggcgguggggcaaauc

SEQ ID NO: 495072 - RNA, 22 nt, Human
cugcaccgcacagugccgcgcc

SEQ ID NO: 495073 - RNA, 26 nt, Human
gacagacccuuuuuuucccuuuuuuu

SEQ ID NO: 495074 - RNA, 19 nt, Human
gccugggaaaagcccgcac

SEQ ID NO: 495075 - RNA, 24 nt, Human
gcggagcucggugagccgcaagag

SEQ ID NO: 495076 - RNA, 27 nt, Human
gcgguggcgguggcggccaccgcgcuc

SEQ ID NO: 495077 - RNA, 21 nt, Human
gcuaccgcgaaccggucgcgc

SEQ ID NO: 495078 - RNA, 20 nt, Human
ggcgcuggggacccggcucc

SEQ ID NO: 495079 - RNA, 20 nt, Human
ggggcgguggcgguggcggc

SEQ ID NO: 495080 - RNA, 20 nt, Human
gugccgcgccaagcagcccc

SEQ ID NO: 495081 - RNA, 18 nt, Human
uauuccuccaucuuuagg

SEQ ID NO: 495082 - RNA, 23 nt, Human
ugaugcugccagcuggagcuguu

SEQ ID NO: 495083 - RNA, 22 nt, Human
ugcccgcccgcccgcccgcagc

SEQ ID NO: 495084 - RNA, 18 nt, Human
ugcccuggagagagggaa

SEQ ID NO: 495085 - RNA, 29 nt, Human
uggcgguggcggccaccgcgcucccuucu

SEQ ID NO: 495086 - RNA, 20 nt, Human
ugggaaaagcccgcaccgcg

SEQ ID NO: 495087 - RNA, 21 nt, Human
uggggacccggcucucaagcc

SEQ ID NO: 495088 - RNA, 22 nt, Human
uucccggcgcuggggacccggc

SEQ ID NO: 495089 - RNA, 24 nt, Human
uucccggcgcuggggacccggcuc

SEQ ID NO: 495090 - RNA, 20 nt, Human
uuuuucccuuuuuuuuucuc

SEQ ID NO: 495091 - RNA, 19 nt, Human
uuuuuuuuuuuuuuuuugu

SEQ ID NO: 495092 - RNA, 26 nt, Human
uuuuuuuuuuuuuuuuuuuuuugggg

SEQ ID NO: 495093 - RNA, 21 nt, Human
aaaaaaaugaagcgagauggc

SEQ ID NO: 495094 - RNA, 20 nt, Human
aaaaaucugugaaauguuug

SEQ ID NO: 495095 - RNA, 22 nt, Human
aaaagaccaaguuagcuagaua

SEQ ID NO: 495096 - RNA, 19 nt, Human
aaacaaaaacaggaaaaaa

SEQ ID NO: 495097 - RNA, 30 nt, Human
aaacaaaaacaggaaaaaaaguggcagcaa

SEQ ID NO: 495098 - RNA, 21 nt, Human
aaacaaacaacgaaaaagacc

SEQ ID NO: 495099 - RNA, 24 nt, Human
aaacaaacaacgaaaaagaccaag

SEQ ID NO: 495100 - RNA, 20 nt, Human
aaacaggaaaaaaaguggca

SEQ ID NO: 495101 - RNA, 24 nt, Human
aaacaggaaaaaaaguggcagggu

SEQ ID NO: 495102 - RNA, 22 nt, Human
aaagugaacaguaugacuuucc

SEQ ID NO: 495103 - RNA, 25 nt, Human
aacaaacaacgaaaaagaccaagga

SEQ ID NO: 495104 - RNA, 20 nt, Human
aacaguuuggcccacaucug

SEQ ID NO: 495105 - RNA, 23 nt, Human
aagcuuucaacacaguaguaucu

SEQ ID NO: 495106 - RNA, 21 nt, Human
aaggcuacaaaaacgaaacaa

SEQ ID NO: 495107 - RNA, 27 nt, Human
acaacgaaaaagaccaaguuagcuaga

SEQ ID NO: 495108 - RNA, 22 nt, Human
acauagaggggaccuuccuggc

SEQ ID NO: 495109 - RNA, 24 nt, Human
acgacauuccacacccuauuauca

SEQ ID NO: 495110 - RNA, 18 nt, Human
agacagaaacaaaauaaa

SEQ ID NO: 495111 - RNA, 22 nt, Human
agacagaaacaaaauaaaaauc

SEQ ID NO: 495112 - RNA, 24 nt, Human
agacagaaacaaaauaaaaaucug

SEQ ID NO: 495113 - RNA, 21 nt, Human
auccacaagauuaagcaguuu

SEQ ID NO: 495114 - RNA, 18 nt, Human
auguuuuguacaaaaaua

SEQ ID NO: 495115 - RNA, 19 nt, Human
caaaaauacugucaaaauu

SEQ ID NO: 495116 - RNA, 24 nt, Human
cacaagauuaagcaguuugccaag

SEQ ID NO: 495117 - RNA, 22 nt, Human
cacugacgacauuccacacccu

SEQ ID NO: 495118 - RNA, 19 nt, Human
caucuacaaaauccacaag

SEQ ID NO: 495119 - RNA, 24 nt, Human
caucuacaaaauccacaagauuaa

SEQ ID NO: 495120 - RNA, 21 nt, Human
caugcaaccaacuaaugcaau

SEQ ID NO: 495121 - RNA, 19 nt, Human
ccagaacaguuuggcccac

SEQ ID NO: 495122 - RNA, 21 nt, Human
ccaucuacaaaauccacaaga

SEQ ID NO: 495123 - RNA, 21 nt, Human
cgaaaaagaccaaguuagcua

SEQ ID NO: 495124 - RNA, 18 nt, Human
cgccgaggucucgcagcg

SEQ ID NO: 495125 - RNA, 18 nt, Human
gaaacaaaaacaggaaaa

SEQ ID NO: 495126 - RNA, 21 nt, Human
gcuccgaagaccgagggcggg

SEQ ID NO: 495127 - RNA, 20 nt, Human
ggaguaaaaacaaacaacga

SEQ ID NO: 495128 - RNA, 24 nt, Human
ggcuacaaaaacgaaacaaaaaca

SEQ ID NO: 495129 - RNA, 22 nt, Human
gggguuugauuucuuucgccgg

SEQ ID NO: 495130 - RNA, 22 nt, Human
uacaaaaacgaaacaaaaacag

SEQ ID NO: 495131 - RNA, 20 nt, Human
uacugugucuaagggaaugu

SEQ ID NO: 495132 - RNA, 24 nt, Human
uauuagcacagugucaaaaauguu

SEQ ID NO: 495133 - RNA, 20 nt, Human
ucacgccgaagaaguugggg

SEQ ID NO: 495134 - RNA, 18 nt, Human
uccaguuuagcauauuuu

SEQ ID NO: 495135 - RNA, 26 nt, Human
ugaaaccaucuacaaaauccacaaga

SEQ ID NO: 495136 - RNA, 24 nt, Human
ugaaagugaacaguaugacuuucc

SEQ ID NO: 495137 - RNA, 26 nt, Human
ugauccagaacaguuuggcccacauc

SEQ ID NO: 495138 - RNA, 22 nt, Human
ugcuccgaagaccgagggcggg

SEQ ID NO: 495139 - RNA, 21 nt, Human
uggcaaauuaaaauagaauaa

SEQ ID NO: 495140 - RNA, 20 nt, Human
uggggcagauucggagccgu

SEQ ID NO: 495141 - RNA, 19 nt, Human
uggggggggcggcgggggg

SEQ ID NO: 495142 - RNA, 22 nt, Human
uggggguggggggggcggcggg

SEQ ID NO: 495143 - RNA, 18 nt, Human
uguacucaaaugcauagu

SEQ ID NO: 495144 - RNA, 21 nt, Human
ugucaaaauuuccuaaaaagc

SEQ ID NO: 495145 - RNA, 20 nt, Human
uguuucuuuuaauucacgcc

SEQ ID NO: 495146 - RNA, 19 nt, Human
uuaaaaauuagucuguacu

SEQ ID NO: 495147 - RNA, 23 nt, Human
uuaaaaccaauuuguacaaguuu

SEQ ID NO: 495148 - RNA, 23 nt, Human
uuccaaguucucaaaccuuucaa

SEQ ID NO: 495149 - RNA, 24 nt, Human
uucgaaguucaugcaaccaacuaa

SEQ ID NO: 495150 - RNA, 19 nt, Human
uugaaagugaacaguauga

SEQ ID NO: 495151 - RNA, 24 nt, Human
uuggcccacaucuguuuaaucuuc

SEQ ID NO: 495152 - RNA, 19 nt, Human
uuugcgaauucugcuccga

SEQ ID NO: 495153 - RNA, 24 nt, Human
uuuguacaaaaauacugucaaaau

SEQ ID NO: 495154 - RNA, 25 nt, Human
uuuuuuuuuuuuuuucuuaacuuuu

SEQ ID NO: 495155 - RNA, 22 nt, Human
acuccuaaaaagcauuagcaga

SEQ ID NO: 495156 - RNA, 21 nt, Human
agcugcugcugcuguugcugg

SEQ ID NO: 495157 - RNA, 19 nt, Human
cagacuccuaaaaagcauu

SEQ ID NO: 495158 - RNA, 19 nt, Human
ccaggcaggccaggguaca

SEQ ID NO: 495159 - RNA, 23 nt, Human
ccugugguggggacugcuggagc

SEQ ID NO: 495160 - RNA, 19 nt, Human
cggggccugugguggggac

SEQ ID NO: 495161 - RNA, 22 nt, Human
cugcugcuggagcugcugcugc

SEQ ID NO: 495162 - RNA, 19 nt, Human
cugcuggagcugcugcugc

SEQ ID NO: 495163 - RNA, 22 nt, Human
cuguugcuggagcugcugcugc

SEQ ID NO: 495164 - RNA, 20 nt, Human
gagcugcugcugcugcuggc

SEQ ID NO: 495165 - RNA, 21 nt, Human
gccaggguacagggagguccc

SEQ ID NO: 495166 - RNA, 25 nt, Human
gccaggguacagggaggucccucua

SEQ ID NO: 495167 - RNA, 20 nt, Human
gcugcugcugcuguugcugg

SEQ ID NO: 495168 - RNA, 20 nt, Human
gcugcugcuguaacugcugg

SEQ ID NO: 495169 - RNA, 18 nt, Human
gcugcuggagcugcugcu

SEQ ID NO: 495170 - RNA, 21 nt, Human
gugacugcugcugcugcaauu

SEQ ID NO: 495171 - RNA, 19 nt, Human
ugaguaaaaacaugaacca

SEQ ID NO: 495172 - RNA, 21 nt, Human
ugcagugacugcugcugcugc

SEQ ID NO: 495173 - RNA, 21 nt, Human
ugcugcugcaauugcugcugc

SEQ ID NO: 495174 - RNA, 21 nt, Human
ugcugcugcugcaauugcugc

SEQ ID NO: 495175 - RNA, 18 nt, Human
ugcugcugcuguaacugc

SEQ ID NO: 495176 - RNA, 23 nt, Human
ugcugcugcuguaacugcuggag

SEQ ID NO: 495177 - RNA, 21 nt, Human
ugcugcuguugcuggagcugc

SEQ ID NO: 495178 - RNA, 28 nt, Human
ugcuguugcuggagcugcugcugcugcc

SEQ ID NO: 495179 - RNA, 24 nt, Human
uugcugcugcuggagcugcugcug

SEQ ID NO: 495180 - RNA, 28 nt, Human
uugcugcugcuggagcugcugcugcugu

SEQ ID NO: 495181 - RNA, 19 nt, Human
uugcuggagcugcugcugc

SEQ ID NO: 495182 - RNA, 22 nt, Human
aaaaaacucaguugguugaaac

SEQ ID NO: 495183 - RNA, 21 nt, Human
aaagugucagugcagacacuu

SEQ ID NO: 495184 - RNA, 21 nt, Human
aacaaaacaccccacaaauaa

SEQ ID NO: 495185 - RNA, 21 nt, Human
aacucaguugguugaaacuga

SEQ ID NO: 495186 - RNA, 21 nt, Human
aacuuccucagaccaccgccg

SEQ ID NO: 495187 - RNA, 20 nt, Human
aagaaaaaacucaguugguu

SEQ ID NO: 495188 - RNA, 18 nt, Human
aagaaaaaaguauucugu

SEQ ID NO: 495189 - RNA, 19 nt, Human
aagagaacacaagucuggg

SEQ ID NO: 495190 - RNA, 22 nt, Human
aagagaacacaagucuggguaa

SEQ ID NO: 495191 - RNA, 22 nt, Human
aauaaauagaaaagauauacaa

SEQ ID NO: 495192 - RNA, 20 nt, Human
accccacaaauaauaaaaac

SEQ ID NO: 495193 - RNA, 21 nt, Human
agaaaagauauacaaagugga

SEQ ID NO: 495194 - RNA, 18 nt, Human
agagaacacaagucuggg

SEQ ID NO: 495195 - RNA, 23 nt, Human
agcuacucaaaacaaaacacccc

SEQ ID NO: 495196 - RNA, 19 nt, Human
agguaggauuagcuuucca

SEQ ID NO: 495197 - RNA, 18 nt, Human
auagaacuuccucagacc

SEQ ID NO: 495198 - RNA, 19 nt, Human
auagaacuuccucagacca

SEQ ID NO: 495199 - RNA, 20 nt, Human
caaaagaggccacgaaacua

SEQ ID NO: 495200 - RNA, 22 nt, Human
caaaagcaaagcuaaaauucau

SEQ ID NO: 495201 - RNA, 24 nt, Human
caaauaauaaaaaccccauucccu

SEQ ID NO: 495202 - RNA, 18 nt, Human
caaggcaaacauacauuu

SEQ ID NO: 495203 - RNA, 24 nt, Human
cacgaaacuacagacuacugacga

SEQ ID NO: 495204 - RNA, 22 nt, Human
caggguaguauuauaaccuguu

SEQ ID NO: 495205 - RNA, 22 nt, Human
cagguacacggaauaaaagucc

SEQ ID NO: 495206 - RNA, 21 nt, Human
caucaaucaacaggcagucca

SEQ ID NO: 495207 - RNA, 18 nt, Human
cccacaaauaauaaaaac

SEQ ID NO: 495208 - RNA, 19 nt, Human
cgccgccgcagucugcacc

SEQ ID NO: 495209 - RNA, 20 nt, Human
gaacauaguaaacuagcuga

SEQ ID NO: 495210 - RNA, 22 nt, Human
gaaugacauuuguucaguauga

SEQ ID NO: 495211 - RNA, 22 nt, Human
gacuuuugaaaauauaucauua

SEQ ID NO: 495212 - RNA, 21 nt, Human
gcauuucauaaaauaucuguu

SEQ ID NO: 495213 - RNA, 19 nt, Human
gccaacuccagaccuaaga

SEQ ID NO: 495214 - RNA, 24 nt, Human
guagaggacaacucuugccauaac

SEQ ID NO: 495215 - RNA, 23 nt, Human
uaaaauucauucacugugguuaa

SEQ ID NO: 495216 - RNA, 19 nt, Human
uaaacuagaaugacauuug

SEQ ID NO: 495217 - RNA, 24 nt, Human
uaaacuagaaugacauuuguucag

SEQ ID NO: 495218 - RNA, 20 nt, Human
uaagcauguacuuaaguguc

SEQ ID NO: 495219 - RNA, 19 nt, Human
uacacggaauaaaaguccu

SEQ ID NO: 495220 - RNA, 21 nt, Human
uacacggaauaaaaguccuac

SEQ ID NO: 495221 - RNA, 19 nt, Human
uagaaaagauauacaaagu

SEQ ID NO: 495222 - RNA, 23 nt, Human
uagaaaagauauacaaaguggaa

SEQ ID NO: 495223 - RNA, 24 nt, Human
uagcuuuccaauguagaggacaac

SEQ ID NO: 495224 - RNA, 19 nt, Human
uaucuaaacuagaaugaca

SEQ ID NO: 495225 - RNA, 18 nt, Human
uaugaaaaaacaagggca

SEQ ID NO: 495226 - RNA, 18 nt, Human
uauguuauagggaagaaa

SEQ ID NO: 495227 - RNA, 26 nt, Human
uauucaaggaacauaguaaacuagcu

SEQ ID NO: 495228 - RNA, 26 nt, Human
ucaagggacaugacuuaacagugaag

SEQ ID NO: 495229 - RNA, 26 nt, Human
ucugagaaaggccaaaaaaaagaaaa

SEQ ID NO: 495230 - RNA, 21 nt, Human
ugacaaaauuuaccuuucuua

SEQ ID NO: 495231 - RNA, 22 nt, Human
ugaccccaguuauaaucaaaag

SEQ ID NO: 495232 - RNA, 22 nt, Human
ugacuaagcaugugaucuucac

SEQ ID NO: 495233 - RNA, 23 nt, Human
ugagaaaggccaaaaaaaagaaa

SEQ ID NO: 495234 - RNA, 27 nt, Human
uggaaugaacauagaaaugacuaagca

SEQ ID NO: 495235 - RNA, 28 nt, Human
uggccaacuccagaccuaagagcaauau

SEQ ID NO: 495236 - RNA, 20 nt, Human
ugucaaaaaccucaagucaa

SEQ ID NO: 495237 - RNA, 22 nt, Human
uguuauagggaagaaaacaagu

SEQ ID NO: 495238 - RNA, 20 nt, Human
uuaaaccacuaaauguggca

SEQ ID NO: 495239 - RNA, 18 nt, Human
uucaaaauggcauauuuu

SEQ ID NO: 495240 - RNA, 18 nt, Human
uucacugugguuaaacug

SEQ ID NO: 495241 - RNA, 25 nt, Human
uucuuggugaccccaguuauaauca

SEQ ID NO: 495242 - RNA, 21 nt, Human
aaccaaaugcagaagcagaga

SEQ ID NO: 495243 - RNA, 23 nt, Human
aaccaaccaaaugcagaagcaga

SEQ ID NO: 495244 - RNA, 21 nt, Human
aacugcucuuuaagaggggac

SEQ ID NO: 495245 - RNA, 23 nt, Human
aaggguccccccaacccaccuuu

SEQ ID NO: 495246 - RNA, 23 nt, Human
acaaacgcaguaugcacgcuccu

SEQ ID NO: 495247 - RNA, 25 nt, Human
acacaaacgcaguaugcacgcuccu

SEQ ID NO: 495248 - RNA, 22 nt, Human
agaaagaaaaggguccccccaa

SEQ ID NO: 495249 - RNA, 19 nt, Human
agagaacgacacgcacacc

SEQ ID NO: 495250 - RNA, 18 nt, Human
agagggaagggagauaca

SEQ ID NO: 495251 - RNA, 22 nt, Human
agccauuaaagaacaauacagc

SEQ ID NO: 495252 - RNA, 19 nt, Human
agggaagggagauacagca

SEQ ID NO: 495253 - RNA, 18 nt, Human
aggggacacaugggaaaa

SEQ ID NO: 495254 - RNA, 24 nt, Human
augaaaagccaccuguuauucaca

SEQ ID NO: 495255 - RNA, 22 nt, Human
caaccaaaugcagaagcagaga

SEQ ID NO: 495256 - RNA, 20 nt, Human
caagacagccauuaaagaac

SEQ ID NO: 495257 - RNA, 23 nt, Human
caccaugagggaggcagcccuca

SEQ ID NO: 495258 - RNA, 21 nt, Human
cacgcuccuugccgacagggc

SEQ ID NO: 495259 - RNA, 19 nt, Human
cagaagcagagaacuuaaa

SEQ ID NO: 495260 - RNA, 18 nt, Human
cagcucagagggaaggga

SEQ ID NO: 495261 - RNA, 24 nt, Human
caugaaaagccaccuguuauucac

SEQ ID NO: 495262 - RNA, 19 nt, Human
cauucagaaccgccuggau

SEQ ID NO: 495263 - RNA, 20 nt, Human
ccagacaggauuucugaggu

SEQ ID NO: 495264 - RNA, 21 nt, Human
ccagccagacaggauuucuga

SEQ ID NO: 495265 - RNA, 20 nt, Human
cccaccuuuuuuuuuuuuuc

SEQ ID NO: 495266 - RNA, 20 nt, Human
cccaggggcuucuccccucc

SEQ ID NO: 495267 - RNA, 20 nt, Human
ccggcaguggggacagaggg

SEQ ID NO: 495268 - RNA, 22 nt, Human
cggcaguggggacagagggcac

SEQ ID NO: 495269 - RNA, 20 nt, Human
cggccagaacaaaaaaaaaa

SEQ ID NO: 495270 - RNA, 23 nt, Human
cggccagaacaaaaaaaaaagua

SEQ ID NO: 495271 - RNA, 19 nt, Human
cggcccgggaaacuugcag

SEQ ID NO: 495272 - RNA, 18 nt, Human
cuuucaaagaaagaccca

SEQ ID NO: 495273 - RNA, 19 nt, Human
cuuuuuuuuuuuuuuacuu

SEQ ID NO: 495274 - RNA, 21 nt, Human
gaaaaggguccccccaaccca

SEQ ID NO: 495275 - RNA, 20 nt, Human
gagcgagcgcggcgcgcggc

SEQ ID NO: 495276 - RNA, 23 nt, Human
gagcugacagcuaugagcuuuaa

SEQ ID NO: 495277 - RNA, 21 nt, Human
gaggggacaagaaauuggggg

SEQ ID NO: 495278 - RNA, 18 nt, Human
gcagcccucaagcagcgg

SEQ ID NO: 495279 - RNA, 26 nt, Human
gcagcggauuccuuucaaagaaagac

SEQ ID NO: 495280 - RNA, 21 nt, Human
gccagaacaaaaaaaaaagua

SEQ ID NO: 495281 - RNA, 19 nt, Human
gcgcggcgcgcggcccggg

SEQ ID NO: 495282 - RNA, 18 nt, Human
gcgggcugggaggcgagc

SEQ ID NO: 495283 - RNA, 22 nt, Human
ggacaagaaauugggggguagg

SEQ ID NO: 495284 - RNA, 18 nt, Human
ggacuuuaaauccgcgcc

SEQ ID NO: 495285 - RNA, 18 nt, Human
ggccgcgggcugggaggc

SEQ ID NO: 495286 - RNA, 19 nt, Human
ggcgagcgagcgcggcgcg

SEQ ID NO: 495287 - RNA, 21 nt, Human
ggcgcggcggcggcucgggcc

SEQ ID NO: 495288 - RNA, 19 nt, Human
ggcugggaggcgagcgagc

SEQ ID NO: 495289 - RNA, 24 nt, Human
ggcugggaggcgagcgagcgcggc

SEQ ID NO: 495290 - RNA, 21 nt, Human
gggacagagggcaccgggaaa

SEQ ID NO: 495291 - RNA, 21 nt, Human
uacacaaacgcaguaugcacg

SEQ ID NO: 495292 - RNA, 24 nt, Human
uacacaaacgcaguaugcacgcuc

SEQ ID NO: 495293 - RNA, 22 nt, Human
uagaaagaaaagggucccccca

SEQ ID NO: 495294 - RNA, 18 nt, Human
ucacaggggcugcgcuuc

SEQ ID NO: 495295 - RNA, 19 nt, Human
ucagaaccgccuggaugcu

SEQ ID NO: 495296 - RNA, 20 nt, Human
ucagagcugacagcuaugag

SEQ ID NO: 495297 - RNA, 19 nt, Human
ucggccagaacaaaaaaaa

SEQ ID NO: 495298 - RNA, 24 nt, Human
ucggccagaacaaaaaaaaaagua

SEQ ID NO: 495299 - RNA, 19 nt, Human
ugauaucacagaugcguca

SEQ ID NO: 495300 - RNA, 23 nt, Human
ugcuuugcauaguuaccucugau

SEQ ID NO: 495301 - RNA, 18 nt, Human
uggaagacaagugagaga

SEQ ID NO: 495302 - RNA, 23 nt, Human
uucaaaguggaagacaagugaga

SEQ ID NO: 495303 - RNA, 23 nt, Human
uugggggguaggggacacauggg

SEQ ID NO: 495304 - RNA, 22 nt, Human
uuuaagccuuuaucauuuuucu

SEQ ID NO: 495305 - RNA, 18 nt, Human
agcagcacuuucccucac

SEQ ID NO: 495306 - RNA, 20 nt, Human
cagcagcacuuucccucaac

SEQ ID NO: 495307 - RNA, 22 nt, Human
ccaccgcggcggagcaccgccc

SEQ ID NO: 495308 - RNA, 26 nt, Human
cgcgucugcagacccagcagcagcac

SEQ ID NO: 495309 - RNA, 18 nt, Human
cuggcugccugaguaggu

SEQ ID NO: 495310 - RNA, 24 nt, Human
gcgaagcgauagcaaccgccaccg

SEQ ID NO: 495311 - RNA, 20 nt, Human
gcggagcaccgcccuccccu

SEQ ID NO: 495312 - RNA, 25 nt, Human
gcgucugcagacccagcagcagcac

SEQ ID NO: 495313 - RNA, 22 nt, Human
gcuggcugccugaguagguucu

SEQ ID NO: 495314 - RNA, 24 nt, Human
uacagaaauauguuuaauacuuag

SEQ ID NO: 495315 - RNA, 23 nt, Human
uagcaaccgccaccgcggcggag

SEQ ID NO: 495316 - RNA, 22 nt, Human
ucccucaacucuucucagcugg

SEQ ID NO: 495317 - RNA, 21 nt, Human
ugccugaguagguucugcgaa

SEQ ID NO: 495318 - RNA, 22 nt, Human
uuuuuuggaagaauacagaaau

SEQ ID NO: 495319 - RNA, 18 nt, Human
uuuuuuuuuuuuuuuuug

SEQ ID NO: 495320 - RNA, 18 nt, Human
cccugauuuguacgggac

SEQ ID NO: 495321 - RNA, 22 nt, Human
cucgggggugggcucggaggca

SEQ ID NO: 495322 - RNA, 20 nt, Human
gcgagcucgggggugggcuc

SEQ ID NO: 495323 - RNA, 18 nt, Human
ucagugggcgagaaggag

SEQ ID NO: 495324 - RNA, 25 nt, Human
ucgauaaaagcagcagcccuaauuu

SEQ ID NO: 495325 - RNA, 21 nt, Human
ucugcuagggcgccgggcugg

SEQ ID NO: 495326 - RNA, 18 nt, Human
uugaagcugucccugauu

SEQ ID NO: 495327 - RNA, 21 nt, Human
uuuuauggucacauuuaggcu

SEQ ID NO: 495328 - RNA, 18 nt, Human
uuuuuuuuuuuuuucucg

SEQ ID NO: 495329 - RNA, 21 nt, Human
uuuuuuuuuuuuuuucucgau

SEQ ID NO: 495330 - RNA, 24 nt, Human
uuuuuuuuuuuuuuuuuucucgau

SEQ ID NO: 495331 - RNA, 24 nt, Human
uuuuuuuuuuuuuuuuuuucucgu

SEQ ID NO: 495332 - RNA, 22 nt, Human
uuuuuuuuuuuuuuuuuuuucu

SEQ ID NO: 495333 - RNA, 24 nt, Human
aaagauuugacgauccccagauaa

SEQ ID NO: 495334 - RNA, 23 nt, Human
aaccacguccagcccaggcaaca

SEQ ID NO: 495335 - RNA, 24 nt, Human
agacaaaaccacguccagcccagg

SEQ ID NO: 495336 - RNA, 19 nt, Human
agagaaaaacugacuggaa

SEQ ID NO: 495337 - RNA, 22 nt, Human
cagcagacaaaaccacguccag

SEQ ID NO: 495338 - RNA, 24 nt, Human
cagcagacaaaaccacguccagcc

SEQ ID NO: 495339 - RNA, 23 nt, Human
caggcacuuaagagaaaaacuga

SEQ ID NO: 495340 - RNA, 18 nt, Human
ccagcccaggcaacaacu

SEQ ID NO: 495341 - RNA, 23 nt, Human
cgcugcagaaaaugaaacgagag

SEQ ID NO: 495342 - RNA, 22 nt, Human
gcagcagacaaaaccacgucca

SEQ ID NO: 495343 - RNA, 23 nt, Human
gcagcagacaaaaccacguccag

SEQ ID NO: 495344 - RNA, 20 nt, Human
guugcugugaagaauacagc

SEQ ID NO: 495345 - RNA, 19 nt, Human
uauauacacauauacauua

SEQ ID NO: 495346 - RNA, 21 nt, Human
uauauacacauauacauuaaa

SEQ ID NO: 495347 - RNA, 24 nt, Human
ugaacaaaaguaaacuguuucagu

SEQ ID NO: 495348 - RNA, 20 nt, Human
ugacuggaagaacuuuuauc

SEQ ID NO: 495349 - RNA, 18 nt, Human
uuucucaaguauucacug

SEQ ID NO: 495350 - RNA, 22 nt, Human
uuucucaaguauucacugaaua

SEQ ID NO: 495351 - RNA, 21 nt, Human
aaaguggcagaugaccucauc

SEQ ID NO: 495352 - RNA, 24 nt, Human
aagacccuucacccagaaauagag

SEQ ID NO: 495353 - RNA, 22 nt, Human
aaggaguagaugaaggaggagg

SEQ ID NO: 495354 - RNA, 19 nt, Human
accaagacccuucacccag

SEQ ID NO: 495355 - RNA, 20 nt, Human
agaccccucggugcacuccc

SEQ ID NO: 495356 - RNA, 18 nt, Human
aggaggaggaggggaugu

SEQ ID NO: 495357 - RNA, 18 nt, Human
aggcaaggggagagacug

SEQ ID NO: 495358 - RNA, 23 nt, Human
aggcaaggggagagacugggggc

SEQ ID NO: 495359 - RNA, 19 nt, Human
agggaacagggaggagggg

SEQ ID NO: 495360 - RNA, 24 nt, Human
agggaggaagggaacagggaggag

SEQ ID NO: 495361 - RNA, 19 nt, Human
agggcaucaucgcgcccgu

SEQ ID NO: 495362 - RNA, 23 nt, Human
aggugguaucuucuacagaaagu

SEQ ID NO: 495363 - RNA, 26 nt, Human
auucaauaaauauuuauuauaauuaa

SEQ ID NO: 495364 - RNA, 18 nt, Human
caaggaguagaugaagga

SEQ ID NO: 495365 - RNA, 20 nt, Human
caccuggaaauccucgcaga

SEQ ID NO: 495366 - RNA, 23 nt, Human
cagaagguggccccgucgggcac

SEQ ID NO: 495367 - RNA, 18 nt, Human
cagaugaccucaucuucc

SEQ ID NO: 495368 - RNA, 23 nt, Human
cagcucagcuccccgcgccccgg

SEQ ID NO: 495369 - RNA, 20 nt, Human
cagggaggagggggucaggu

SEQ ID NO: 495370 - RNA, 21 nt, Human
ccaagacccuucacccagaaa

SEQ ID NO: 495371 - RNA, 20 nt, Human
ccaccaagacccuucaccca

SEQ ID NO: 495372 - RNA, 29 nt, Human
ccaccaagacccuucacccagaaauagag

SEQ ID NO: 495373 - RNA, 18 nt, Human
ccacuggguaguuggugc

SEQ ID NO: 495374 - RNA, 23 nt, Human
cccaccaccaagacccuucaccc

SEQ ID NO: 495375 - RNA, 18 nt, Human
ccccgcgccccggcaccu

SEQ ID NO: 495376 - RNA, 21 nt, Human
ccccucggugcacuccacugg

SEQ ID NO: 495377 - RNA, 21 nt, Human
cccgcgccccggcaccuggaa

SEQ ID NO: 495378 - RNA, 22 nt, Human
cccgcgccccggcaccuggaaa

SEQ ID NO: 495379 - RNA, 20 nt, Human
ccucgcagaagguggccccg

SEQ ID NO: 495380 - RNA, 19 nt, Human
ccugcaggcagcucagcuc

SEQ ID NO: 495381 - RNA, 20 nt, Human
cuccagaauaggcaagggga

SEQ ID NO: 495382 - RNA, 21 nt, Human
cuggucuuugacagagcaggg

SEQ ID NO: 495383 - RNA, 21 nt, Human
gaacaaggaguagaugaagga

SEQ ID NO: 495384 - RNA, 19 nt, Human
gaagggaacagggaggagg

SEQ ID NO: 495385 - RNA, 22 nt, Human
gaccucaucuuccacuguccac

SEQ ID NO: 495386 - RNA, 23 nt, Human
gaggaagggaacagggaggaggg

SEQ ID NO: 495387 - RNA, 23 nt, Human
gaggaggaggaggaggaggggau

SEQ ID NO: 495388 - RNA, 18 nt, Human
gcagcucagcuccccgcg

SEQ ID NO: 495389 - RNA, 23 nt, Human
gcaggcagcucagcuccccgcgc

SEQ ID NO: 495390 - RNA, 19 nt, Human
gcucagcuccccgcgcccc

SEQ ID NO: 495391 - RNA, 18 nt, Human
ggaaauccucgcagaagg

SEQ ID NO: 495392 - RNA, 25 nt, Human
ggaggaagggaacagggaggagggg

SEQ ID NO: 495393 - RNA, 21 nt, Human
ggaggaggaggaggaggaggg

SEQ ID NO: 495394 - RNA, 23 nt, Human
ggguccagggguguuccccaggu

SEQ ID NO: 495395 - RNA, 18 nt, Human
ggugggcacggcuuggua

SEQ ID NO: 495396 - RNA, 22 nt, Human
uauagaauuucuguuccgauga

SEQ ID NO: 495397 - RNA, 20 nt, Human
uccuaaaugaagggcucccg

SEQ ID NO: 495398 - RNA, 25 nt, Human
ucggugcacuccacuggguaguugg

SEQ ID NO: 495399 - RNA, 26 nt, Human
ucuguuccgaugaugauuccagggag

SEQ ID NO: 495400 - RNA, 19 nt, Human
ugaaggaggaggaggagga

SEQ ID NO: 495401 - RNA, 23 nt, Human
uggaauuguaaacaccguaucca

SEQ ID NO: 495402 - RNA, 24 nt, Human
uggcguggaggaucacaaaguuau

SEQ ID NO: 495403 - RNA, 20 nt, Human
ugggguccuggccgaugccu

SEQ ID NO: 495404 - RNA, 22 nt, Human
ugggguccuggccgaugccugg

SEQ ID NO: 495405 - RNA, 23 nt, Human
ugggguggugggaguaggugggc

SEQ ID NO: 495406 - RNA, 25 nt, Human
ugggguggugggaguaggugggcac

SEQ ID NO: 495407 - RNA, 18 nt, Human
uguccacagggcacaggg

SEQ ID NO: 495408 - RNA, 19 nt, Human
uucuacagaaaguuggagu

SEQ ID NO: 495409 - RNA, 20 nt, Human
uugacagagcagggguuuuu

SEQ ID NO: 495410 - RNA, 19 nt, Human
uuggaguggcgucuggucu

SEQ ID NO: 495411 - RNA, 20 nt, Human
aacaauagcagaucauaccc

SEQ ID NO: 495412 - RNA, 20 nt, Human
acagcaaaugaauggauauc

SEQ ID NO: 495413 - RNA, 21 nt, Human
agcugucccagaaccggacuc

SEQ ID NO: 495414 - RNA, 20 nt, Human
auaacaauagcagaucauaa

SEQ ID NO: 495415 - RNA, 20 nt, Human
auggcggcggcgacggcagc

SEQ ID NO: 495416 - RNA, 22 nt, Human
caccacugucuccagcuguccc

SEQ ID NO: 495417 - RNA, 22 nt, Human
cagaaccggacucuuccugcca

SEQ ID NO: 495418 - RNA, 23 nt, Human
cagaaccggacucuuccugccau

SEQ ID NO: 495419 - RNA, 22 nt, Human
cagcaaaugaauggauauuucu

SEQ ID NO: 495420 - RNA, 21 nt, Human
caguguuuauagaucaaccca

SEQ ID NO: 495421 - RNA, 19 nt, Human
ccuacgcugcggugccgaa

SEQ ID NO: 495422 - RNA, 19 nt, Human
gcaaauucauaaaugcuga

SEQ ID NO: 495423 - RNA, 27 nt, Human
gcggcggcgacggcagcggugguagca

SEQ ID NO: 495424 - RNA, 22 nt, Human
ggcggcgacggcagcgguggua

SEQ ID NO: 495425 - RNA, 24 nt, Human
uaaaugaacauuugcaauuuuaaa

SEQ ID NO: 495426 - RNA, 25 nt, Human
uaacaauagcagaucauacccuggu

SEQ ID NO: 495427 - RNA, 22 nt, Human
uacaagcuaauuaccacauccu

SEQ ID NO: 495428 - RNA, 20 nt, Human
uagaucaacccaaauauuac

SEQ ID NO: 495429 - RNA, 18 nt, Human
uagcagaucauacccugg

SEQ ID NO: 495430 - RNA, 20 nt, Human
uaguacagcaaaugaaugga

SEQ ID NO: 495431 - RNA, 27 nt, Human
uauuucagucaccaccacugucuccag

SEQ ID NO: 495432 - RNA, 18 nt, Human
ucaccaccacugucucca

SEQ ID NO: 495433 - RNA, 24 nt, Human
uggcggcggcgacggcagcggugg

SEQ ID NO: 495434 - RNA, 22 nt, Human
uucagucaccaccacugucucc

SEQ ID NO: 495435 - RNA, 21 nt, Human
uuccugccaucaaaauggcgg

SEQ ID NO: 495436 - RNA, 20 nt, Human
uucgcaaaauagcuuuccuu

SEQ ID NO: 495437 - RNA, 23 nt, Human
uugcaauuuuaaaaucccaaauc

SEQ ID NO: 495438 - RNA, 19 nt, Human
uuuuuuuuuuuuuuuuugu

SEQ ID NO: 495439 - RNA, 27 nt, Human
uuuuuuuuuuuuuuuuuuuuuuugggg

SEQ ID NO: 495440 - RNA, 19 nt, Human
aaaaaucuguugaaaggau

SEQ ID NO: 495441 - RNA, 19 nt, Human
aagaagaaaaaaguaauag

SEQ ID NO: 495442 - RNA, 18 nt, Human
aauaaccucuuauauaca

SEQ ID NO: 495443 - RNA, 24 nt, Human
aauagauaaaaguucugagagaga

SEQ ID NO: 495444 - RNA, 18 nt, Human
acacagugggacagaaau

SEQ ID NO: 495445 - RNA, 19 nt, Human
acaccuaucaauuucuuuc

SEQ ID NO: 495446 - RNA, 19 nt, Human
agacagcacaguguuuugu

SEQ ID NO: 495447 - RNA, 21 nt, Human
agaggaggaggaggaggaggu

SEQ ID NO: 495448 - RNA, 23 nt, Human
agaggaggaggaggaggaggugg

SEQ ID NO: 495449 - RNA, 18 nt, Human
aggaggaggaggaggagg

SEQ ID NO: 495450 - RNA, 26 nt, Human
aggaggagguggaggaggagggaccc

SEQ ID NO: 495451 - RNA, 23 nt, Human
aggaggagguggaggagggggac

SEQ ID NO: 495452 - RNA, 18 nt, Human
agggauagacagcacagu

SEQ ID NO: 495453 - RNA, 18 nt, Human
agguacuagaauuuacau

SEQ ID NO: 495454 - RNA, 19 nt, Human
agguggaggaggaggcggc

SEQ ID NO: 495455 - RNA, 21 nt, Human
augagacacagugggacagaa

SEQ ID NO: 495456 - RNA, 20 nt, Human
caacaaaaaugaaaaaaagc

SEQ ID NO: 495457 - RNA, 31 nt, Human
caacaaaaaugaaaaaaagcgagacaaaaga

SEQ ID NO: 495458 - RNA, 21 nt, Human
caguauccaagcaaagaaaaa

SEQ ID NO: 495459 - RNA, 26 nt, Human
cauacucauaagaagaaaaaaguaau

SEQ ID NO: 495460 - RNA, 21 nt, Human
ccacaaccuccucugcuccag

SEQ ID NO: 495461 - RNA, 27 nt, Human
ccaccgccacaaccuccucugcuccag

SEQ ID NO: 495462 - RNA, 20 nt, Human
ccgccgccgcuuucuccagc

SEQ ID NO: 495463 - RNA, 20 nt, Human
ccgcuuucuccagccaccgc

SEQ ID NO: 495464 - RNA, 21 nt, Human
cgccacaaccuccucugcucc

SEQ ID NO: 495465 - RNA, 18 nt, Human
cucccaugugagccucua

SEQ ID NO: 495466 - RNA, 23 nt, Human
cucccaugugagccucuaccaug

SEQ ID NO: 495467 - RNA, 18 nt, Human
gagagagaagcaaccuau

SEQ ID NO: 495468 - RNA, 23 nt, Human
gagauuaacaagggugaggacaa

SEQ ID NO: 495469 - RNA, 22 nt, Human
gauuuauuuuggaaucacagua

SEQ ID NO: 495470 - RNA, 21 nt, Human
ggagguggaggaggaggcggc

SEQ ID NO: 495471 - RNA, 23 nt, Human
ggagguggaggaggaggcggcgg

SEQ ID NO: 495472 - RNA, 22 nt, Human
gguacaacaauuaugacauuug

SEQ ID NO: 495473 - RNA, 24 nt, Human
uaaagcgcccggguaucaccggcc

SEQ ID NO: 495474 - RNA, 24 nt, Human
uaagaagaaaaaaguaauagauaa

SEQ ID NO: 495475 - RNA, 18 nt, Human
uagaagagguccaauggc

SEQ ID NO: 495476 - RNA, 20 nt, Human
uagaagagguccaauggcuu

SEQ ID NO: 495477 - RNA, 23 nt, Human
uagaguaaaccauucugagucuc

SEQ ID NO: 495478 - RNA, 20 nt, Human
uccaggaggagaggaggagg

SEQ ID NO: 495479 - RNA, 23 nt, Human
ucuauaaugagacacagugggac

SEQ ID NO: 495480 - RNA, 18 nt, Human
ugaaaaaaagcgagacaa

SEQ ID NO: 495481 - RNA, 22 nt, Human
ugagccucuaccaugugcccag

SEQ ID NO: 495482 - RNA, 25 nt, Human
ugagccucuaccaugugcccaguuu

SEQ ID NO: 495483 - RNA, 23 nt, Human
ugccucagaaguuuaucaauaac

SEQ ID NO: 495484 - RNA, 22 nt, Human
ugcuuguggacauuuuauucac

SEQ ID NO: 495485 - RNA, 18 nt, Human
uggaggaggaggcggcgg

SEQ ID NO: 495486 - RNA, 23 nt, Human
ugugagccucuaccaugugccca

SEQ ID NO: 495487 - RNA, 19 nt, Human
uguucagaagugaaaucca

SEQ ID NO: 495488 - RNA, 23 nt, Human
uguucagaagugaaauccauauu

SEQ ID NO: 495489 - RNA, 24 nt, Human
uuacaccuaucaauuucuuucuuc

SEQ ID NO: 495490 - RNA, 20 nt, Human
uucaauagguacaacaauua

SEQ ID NO: 495491 - RNA, 27 nt, Human
uuucuugagauuaacaagggugaggac

SEQ ID NO: 495492 - RNA, 23 nt, Human
aaaaauguucauugaaugccucc

SEQ ID NO: 495493 - RNA, 23 nt, Human
aaugaagaaaauaauacagagga

SEQ ID NO: 495494 - RNA, 24 nt, Human
acagguauuucauccuaauccuca

SEQ ID NO: 495495 - RNA, 19 nt, Human
agcaccauuugaguuugca

SEQ ID NO: 495496 - RNA, 22 nt, Human
aggugggcgggaugagguggug

SEQ ID NO: 495497 - RNA, 18 nt, Human
auaagaguaaaggaagga

SEQ ID NO: 495498 - RNA, 25 nt, Human
augaagaaaauaauacagaggaaau

SEQ ID NO: 495499 - RNA, 18 nt, Human
caggugggcgggaugagg

SEQ ID NO: 495500 - RNA, 19 nt, Human
cauuggucccaguuuacag

SEQ ID NO: 495501 - RNA, 23 nt, Human
cauuuuuauuuuauaucgugagg

SEQ ID NO: 495502 - RNA, 20 nt, Human
cccacacaggugggcgggau

SEQ ID NO: 495503 - RNA, 23 nt, Human
gaaaauaauacagaggaaauaac

SEQ ID NO: 495504 - RNA, 20 nt, Human
gaagaaaauaauacagagga

SEQ ID NO: 495505 - RNA, 22 nt, Human
gaagaaaauaauacagaggaaa

SEQ ID NO: 495506 - RNA, 21 nt, Human
gaaggagagucagugggucuc

SEQ ID NO: 495507 - RNA, 21 nt, Human
ggcauaagaguaaaggaagga

SEQ ID NO: 495508 - RNA, 22 nt, Human
uaacaacaacuaaaccuuuggc

SEQ ID NO: 495509 - RNA, 22 nt, Human
uacuagaauuuuucccccacaa

SEQ ID NO: 495510 - RNA, 24 nt, Human
ucaaauaaucaaaauacuagaauu

SEQ ID NO: 495511 - RNA, 20 nt, Human
ucagugggucucucccuuuu

SEQ ID NO: 495512 - RNA, 22 nt, Human
ucccccacaagaaugaugggac

SEQ ID NO: 495513 - RNA, 21 nt, Human
ugauucacuggucaagagcuc

SEQ ID NO: 495514 - RNA, 19 nt, Human
uggaggaggagacgcggug

SEQ ID NO: 495515 - RNA, 21 nt, Human
uggauuaucaucggcuggaaa

SEQ ID NO: 495516 - RNA, 24 nt, Human
uggcacugccuaggcacuuucaca

SEQ ID NO: 495517 - RNA, 20 nt, Human
uggcuggcacugccuaggca

SEQ ID NO: 495518 - RNA, 23 nt, Human
uugaaugccuccuauuuggcugg

SEQ ID NO: 495519 - RNA, 19 nt, Human
uuggucccaguuuacagaa

SEQ ID NO: 495520 - RNA, 19 nt, Human
uuucacagguauuucaucc

SEQ ID NO: 495521 - RNA, 20 nt, Human
uuugccacacauuuuuguug

SEQ ID NO: 495522 - RNA, 19 nt, Human
uuuguugcuguaagauuca

SEQ ID NO: 495523 - RNA, 19 nt, Human
acaugggaugaauuuuaag

SEQ ID NO: 495524 - RNA, 19 nt, Human
ccaugaguguuuuuauuua

SEQ ID NO: 495525 - RNA, 22 nt, Human
cuugaagauuuuuuucuucguu

SEQ ID NO: 495526 - RNA, 23 nt, Human
gaagauuuuuuucuucguuaagg

SEQ ID NO: 495527 - RNA, 23 nt, Human
uagaugauuuuaauuucuugaug

SEQ ID NO: 495528 - RNA, 22 nt, Human
uauccaugaguguuuuuauuua

SEQ ID NO: 495529 - RNA, 18 nt, Human
uauuugcucuccuuuacu

SEQ ID NO: 495530 - RNA, 21 nt, Human
uccuuuacuuacauuguuuug

SEQ ID NO: 495531 - RNA, 25 nt, Human
ucucuaguuauuccuggcucaaaug

SEQ ID NO: 495532 - RNA, 21 nt, Human
ucuucuaggucuacuugaaga

SEQ ID NO: 495533 - RNA, 20 nt, Human
ugaguguuuuuauuuaauca

SEQ ID NO: 495534 - RNA, 20 nt, Human
ugggaugaauuuuaagauuc

SEQ ID NO: 495535 - RNA, 18 nt, Human
aaaacaaauaagggcuua

SEQ ID NO: 495536 - RNA, 18 nt, Human
aacaaaaagguaguuuag

SEQ ID NO: 495537 - RNA, 20 nt, Human
aagagcucugagggcaucac

SEQ ID NO: 495538 - RNA, 23 nt, Human
aagagcucugagggcaucacuga

SEQ ID NO: 495539 - RNA, 21 nt, Human
aagcaauaagcuuacagcagc

SEQ ID NO: 495540 - RNA, 22 nt, Human
aaugcuuuauacaaauuccuau

SEQ ID NO: 495541 - RNA, 19 nt, Human
aauucaaucaauaaaguug

SEQ ID NO: 495542 - RNA, 25 nt, Human
acaccuuauuaggaagauauaaaac

SEQ ID NO: 495543 - RNA, 22 nt, Human
acagagcacaaacaugucagac

SEQ ID NO: 495544 - RNA, 22 nt, Human
accaaugccaacacccuuucca

SEQ ID NO: 495545 - RNA, 20 nt, Human
accugggggaacagcaugca

SEQ ID NO: 495546 - RNA, 24 nt, Human
acugguagagagaggaaggcacug

SEQ ID NO: 495547 - RNA, 24 nt, Human
acugguagagagaggaaggcacug

SEQ ID NO: 495548 - RNA, 22 nt, Human
agaagaguaaaugauauuugac

SEQ ID NO: 495549 - RNA, 23 nt, Human
agacgaaaaagaaaauauaccaa

SEQ ID NO: 495550 - RNA, 25 nt, Human
agagaccaaugaaacacaaaacaaa

SEQ ID NO: 495551 - RNA, 21 nt, Human
agagcacaaacaugucagaca

SEQ ID NO: 495552 - RNA, 22 nt, Human
agccagcugagcaaauaaagac

SEQ ID NO: 495553 - RNA, 18 nt, Human
agcuaacagcaagagcuc

SEQ ID NO: 495554 - RNA, 20 nt, Human
aggcagugaaucacaugaag

SEQ ID NO: 495555 - RNA, 22 nt, Human
agguggcugggccccgcggagg

SEQ ID NO: 495556 - RNA, 19 nt, Human
auauauacauaucuauaua

SEQ ID NO: 495557 - RNA, 23 nt, Human
aucuauguauguggcaaaagcca

SEQ ID NO: 495558 - RNA, 20 nt, Human
augaagguacguguguaggu

SEQ ID NO: 495559 - RNA, 18 nt, Human
augauuacucaaugggaa

SEQ ID NO: 495560 - RNA, 23 nt, Human
auggaacagagcacaaacauguc

SEQ ID NO: 495561 - RNA, 22 nt, Human
caaacagaccacaccuuauuag

SEQ ID NO: 495562 - RNA, 22 nt, Human
caaacaugucagacacagcuga

SEQ ID NO: 495563 - RNA, 18 nt, Human
caaaggcacccaaagcua

SEQ ID NO: 495564 - RNA, 25 nt, Human
caaaggcacccaaagcuaaugaaga

SEQ ID NO: 495565 - RNA, 22 nt, Human
caagacucaaauccaggucucc

SEQ ID NO: 495566 - RNA, 21 nt, Human
caaugaaacacaaaacaaaua

SEQ ID NO: 495567 - RNA, 22 nt, Human
cacaaaacaaauaagggcuuaa

SEQ ID NO: 495568 - RNA, 22 nt, Human
cacaacaucacugugagguggg

SEQ ID NO: 495569 - RNA, 23 nt, Human
caccaaugccaacacccuuucca

SEQ ID NO: 495570 - RNA, 21 nt, Human
caccgcuuacagaugaagcaa

SEQ ID NO: 495571 - RNA, 25 nt, Human
cacgcaugaagaauugaaagaauuc

SEQ ID NO: 495572 - RNA, 22 nt, Human
cagaaagucuagcacuuuguuc

SEQ ID NO: 495573 - RNA, 21 nt, Human
cagacuggaaaaguaagagca

SEQ ID NO: 495574 - RNA, 18 nt, Human
cagggauugugugggaag

SEQ ID NO: 495575 - RNA, 24 nt, Human
ccaaugaaacacaaaacaaauaag

SEQ ID NO: 495576 - RNA, 22 nt, Human
cccacaacaucacugugaggug

SEQ ID NO: 495577 - RNA, 27 nt, Human
cccauuacaucuguuuagccacagaaa

SEQ ID NO: 495578 - RNA, 18 nt, Human
ccgcggaggaaguuaagg

SEQ ID NO: 495579 - RNA, 22 nt, Human
ccucuucuaacugguuaaguau

SEQ ID NO: 495580 - RNA, 23 nt, Human
cgcaugaagaauugaaagaauuc

SEQ ID NO: 495581 - RNA, 21 nt, Human
cggacucccgaagguggcugg

SEQ ID NO: 495582 - RNA, 21 nt, Human
cuaguaucaacauaaugagaa

SEQ ID NO: 495583 - RNA, 21 nt, Human
cuccagaaagucuagcacuuu

SEQ ID NO: 495584 - RNA, 25 nt, Human
cuccagacaccaaugccaacacccu

SEQ ID NO: 495585 - RNA, 22 nt, Human
gaacagagcacaaacaugucag

SEQ ID NO: 495586 - RNA, 23 nt, Human
gaacagagcacaaacaugucaga

SEQ ID NO: 495587 - RNA, 21 nt, Human
gagcaccccuucccccaauug

SEQ ID NO: 495588 - RNA, 22 nt, Human
gauacuagaagcugcgguugcu

SEQ ID NO: 495589 - RNA, 18 nt, Human
gccauacucacugcagaa

SEQ ID NO: 495590 - RNA, 23 nt, Human
ggucauuuugggccauaaaauuu

SEQ ID NO: 495591 - RNA, 25 nt, Human
ggucauuuugggccauaaaauuuuu

SEQ ID NO: 495592 - RNA, 21 nt, Human
guuaaguaucauuaucucaau

SEQ ID NO: 495593 - RNA, 23 nt, Human
guuuuguucaguggaaauagacu

SEQ ID NO: 495594 - RNA, 23 nt, Human
guuuuguucaguggaaauagacu

SEQ ID NO: 495595 - RNA, 23 nt, Human
uaaaauaaguauaugaaaagggc

SEQ ID NO: 495596 - RNA, 21 nt, Human
uaaaauggaacagagcacaaa

SEQ ID NO: 495597 - RNA, 21 nt, Human
uaaauuacaaaaccacacuua

SEQ ID NO: 495598 - RNA, 23 nt, Human
uaacuuccaaaagcauauauucu

SEQ ID NO: 495599 - RNA, 22 nt, Human
uaagugacuugcuuacagcuac

SEQ ID NO: 495600 - RNA, 23 nt, Human
uaaugaagaagaguaaaugauau

SEQ ID NO: 495601 - RNA, 20 nt, Human
uacaauacccaaaauucuaa

SEQ ID NO: 495602 - RNA, 19 nt, Human
uagccacagaaagcaucgg

SEQ ID NO: 495603 - RNA, 21 nt, Human
uauauauacauaucuauauau

SEQ ID NO: 495604 - RNA, 23 nt, Human
uauauauacauaucuauauauau

SEQ ID NO: 495605 - RNA, 23 nt, Human
uauuaugauucaaaaaucucccu

SEQ ID NO: 495606 - RNA, 21 nt, Human
uauuugucaccagauuaucac

SEQ ID NO: 495607 - RNA, 22 nt, Human
ucagaguacagggauugugugg

SEQ ID NO: 495608 - RNA, 21 nt, Human
ucagugacuucuucagugucu

SEQ ID NO: 495609 - RNA, 22 nt, Human
uccuagcagcgucagcugccag

SEQ ID NO: 495610 - RNA, 18 nt, Human
uccucaauucuuucccuu

SEQ ID NO: 495611 - RNA, 22 nt, Human
uccucauaagacacaguggcug

SEQ ID NO: 495612 - RNA, 20 nt, Human
ucuuguggcaaaggcaccca

SEQ ID NO: 495613 - RNA, 19 nt, Human
ugaaaagcaacaccaaaac

SEQ ID NO: 495614 - RNA, 26 nt, Human
ugaaacacaaaacaaauaagggcuua

SEQ ID NO: 495615 - RNA, 19 nt, Human
ugaaauagcauucuguaca

SEQ ID NO: 495616 - RNA, 22 nt, Human
ugaaauguguuagauucaggag

SEQ ID NO: 495617 - RNA, 19 nt, Human
ugagaauaguauuuuacug

SEQ ID NO: 495618 - RNA, 18 nt, Human
ugauuuguaauaaauucu

SEQ ID NO: 495619 - RNA, 21 nt, Human
ugcagaaagauuugccuccaa

SEQ ID NO: 495620 - RNA, 26 nt, Human
ugcagaaagauuugccuccaaaguuc

SEQ ID NO: 495621 - RNA, 22 nt, Human
ugcuaugggucagaguacaggg

SEQ ID NO: 495622 - RNA, 21 nt, Human
ugcucaaacacagacggugau

SEQ ID NO: 495623 - RNA, 22 nt, Human
uggaaauagacugguagagaga

SEQ ID NO: 495624 - RNA, 22 nt, Human
uggaaauagacugguagagaga

SEQ ID NO: 495625 - RNA, 25 nt, Human
uggaaauagacugguagagagagga

SEQ ID NO: 495626 - RNA, 22 nt, Human
uggaacagagcacaaacauguc

SEQ ID NO: 495627 - RNA, 21 nt, Human
uggaaggcacacuaaaauuua

SEQ ID NO: 495628 - RNA, 20 nt, Human
uggacaaauauuuucaaagc

SEQ ID NO: 495629 - RNA, 19 nt, Human
uggauacuagaagcugcgg

SEQ ID NO: 495630 - RNA, 24 nt, Human
uggauacuagaagcugcgguugcu

SEQ ID NO: 495631 - RNA, 19 nt, Human
uggcaaaggcacccaaagc

SEQ ID NO: 495632 - RNA, 24 nt, Human
uggcugggccccgcggaggaaguu

SEQ ID NO: 495633 - RNA, 24 nt, Human
uguauauauacauaucuauauaua

SEQ ID NO: 495634 - RNA, 18 nt, Human
uguggcaaaggcacccaa

SEQ ID NO: 495635 - RNA, 20 nt, Human
uguuaaaauggaacagagca

SEQ ID NO: 495636 - RNA, 18 nt, Human
uguuacauauguauauau

SEQ ID NO: 495637 - RNA, 19 nt, Human
uguuacauauguauauaua

SEQ ID NO: 495638 - RNA, 21 nt, Human
uguuuagccacagaaagcauc

SEQ ID NO: 495639 - RNA, 21 nt, Human
uuaagccauguuuagcacuga

SEQ ID NO: 495640 - RNA, 18 nt, Human
uuaaggcaagaaacccau

SEQ ID NO: 495641 - RNA, 25 nt, Human
uuaauauucacacuaccucuucuaa

SEQ ID NO: 495642 - RNA, 22 nt, Human
uuaauuccucaauucuuucccu

SEQ ID NO: 495643 - RNA, 18 nt, Human
uucagugucucagccagc

SEQ ID NO: 495644 - RNA, 18 nt, Human
uugcaggugggcaacccg

SEQ ID NO: 495645 - RNA, 22 nt, Human
uuggaaggcacacuaaaauuua

SEQ ID NO: 495646 - RNA, 24 nt, Human
uuggauuuaccaacacguaggcuu

SEQ ID NO: 495647 - RNA, 21 nt, Human
uuuacuucacugucucaucac

SEQ ID NO: 495648 - RNA, 22 nt, Human
uuuuuuuuuuuuuuuuuccuuu

SEQ ID NO: 495649 - RNA, 25 nt, Human
agaacacuuacauccauacaaucaa

SEQ ID NO: 495650 - RNA, 18 nt, Human
auccauacaaucaacaga

SEQ ID NO: 495651 - RNA, 21 nt, Human
uaagaacacuuacauccauac

SEQ ID NO: 495652 - RNA, 21 nt, Human
uagaaagccacaacagaaaau

SEQ ID NO: 495653 - RNA, 24 nt, Human
aaagugcugggauuacaggcauga

SEQ ID NO: 495654 - RNA, 22 nt, Human
aagagcaguucuuggccuggag

SEQ ID NO: 495655 - RNA, 26 nt, Human
aagcagccugaagucugcgguugagg

SEQ ID NO: 495656 - RNA, 19 nt, Human
aagcccaggaggauggcgg

SEQ ID NO: 495657 - RNA, 22 nt, Human
aaguaauccacccaccucagcc

SEQ ID NO: 495658 - RNA, 19 nt, Human
aagugcugggauuacaggc

SEQ ID NO: 495659 - RNA, 21 nt, Human
aagugcugggauuacaggcau

SEQ ID NO: 495660 - RNA, 26 nt, Human
aagugcugggauuacaggcaugagcc

SEQ ID NO: 495661 - RNA, 18 nt, Human
acaggguuucaccauguu

SEQ ID NO: 495662 - RNA, 23 nt, Human
acaggguuucaccauguuggcca

SEQ ID NO: 495663 - RNA, 24 nt, Human
acaggguuucaccauguuggccag

SEQ ID NO: 495664 - RNA, 24 nt, Human
accaaagugcugggauuacaggca

SEQ ID NO: 495665 - RNA, 24 nt, Human
accauguuggccaggcugguuuug

SEQ ID NO: 495666 - RNA, 21 nt, Human
acccccgccccaucaccuucc

SEQ ID NO: 495667 - RNA, 21 nt, Human
accucagccuaccaaagugcu

SEQ ID NO: 495668 - RNA, 24 nt, Human
aggcagccgcucacucuuaucuuc

SEQ ID NO: 495669 - RNA, 25 nt, Human
agggggaggggcagaaccccuaggg

SEQ ID NO: 495670 - RNA, 25 nt, Human
agggggaggggcagaaccccuaggg

SEQ ID NO: 495671 - RNA, 18 nt, Human
agguccgucuccacuuuc

SEQ ID NO: 495672 - RNA, 21 nt, Human
aggugagcaugaggaguggga

SEQ ID NO: 495673 - RNA, 19 nt, Human
aguaauccacccaccucag

SEQ ID NO: 495674 - RNA, 18 nt, Human
agugcugggauuacaggc

SEQ ID NO: 495675 - RNA, 19 nt, Human
augcaggacccuggggggc

SEQ ID NO: 495676 - RNA, 19 nt, Human
augcaggacccuggggggc

SEQ ID NO: 495677 - RNA, 24 nt, Human
auuggagaggagauuagaugagga

SEQ ID NO: 495678 - RNA, 24 nt, Human
caaagugcugggauuacaggcaug

SEQ ID NO: 495679 - RNA, 19 nt, Human
caagaggccgaggaagccc

SEQ ID NO: 495680 - RNA, 26 nt, Human
cacagcccagaacccagggucagaag

SEQ ID NO: 495681 - RNA, 21 nt, Human
caccauguuggccaggcuggu

SEQ ID NO: 495682 - RNA, 24 nt, Human
caccauguuggccaggcugguuuu

SEQ ID NO: 495683 - RNA, 31 nt, Human
caccauguuggccaggcugguuuugaacucc

SEQ ID NO: 495684 - RNA, 23 nt, Human
cacccaccucagccuaccaaagu

SEQ ID NO: 495685 - RNA, 24 nt, Human
caccucagccuaccaaagugcugg

SEQ ID NO: 495686 - RNA, 19 nt, Human
cagccucagccucugccug

SEQ ID NO: 495687 - RNA, 19 nt, Human
cagccucagccucugccug

SEQ ID NO: 495688 - RNA, 24 nt, Human
caggguuucaccauguuggccagg

SEQ ID NO: 495689 - RNA, 18 nt, Human
caugagccaccaugcccc

SEQ ID NO: 495690 - RNA, 18 nt, Human
caugagccaccaugcccc

SEQ ID NO: 495691 - RNA, 24 nt, Human
cauguuggccaggcugguuuugaa

SEQ ID NO: 495692 - RNA, 22 nt, Human
ccaaagugcugggauuacaggc

SEQ ID NO: 495693 - RNA, 23 nt, Human
ccaaagugcugggauuacaggca

SEQ ID NO: 495694 - RNA, 24 nt, Human
ccaaagugcugggauuacaggcau

SEQ ID NO: 495695 - RNA, 19 nt, Human
ccagggucagaagaugagg

SEQ ID NO: 495696 - RNA, 18 nt, Human
cccagaacccagggucag

SEQ ID NO: 495697 - RNA, 19 nt, Human
ccccagagagggggagggg

SEQ ID NO: 495698 - RNA, 19 nt, Human
ccccagagagggggagggg

SEQ ID NO: 495699 - RNA, 18 nt, Human
ccccaucaccuuccccca

SEQ ID NO: 495700 - RNA, 19 nt, Human
ccccgccccaucaccuucc

SEQ ID NO: 495701 - RNA, 21 nt, Human
ccccgccccaucaccuucccc

SEQ ID NO: 495702 - RNA, 22 nt, Human
ccccgccccaucaccuuccccc

SEQ ID NO: 495703 - RNA, 19 nt, Human
ccccugagguuacuauagg

SEQ ID NO: 495704 - RNA, 22 nt, Human
ccguccccuucacagcccagaa

SEQ ID NO: 495705 - RNA, 24 nt, Human
ccugaccucaaguaauccacccac

SEQ ID NO: 495706 - RNA, 21 nt, Human
ccugcucugugggucucucuc

SEQ ID NO: 495707 - RNA, 18 nt, Human
cggcuaaggaggguuguc

SEQ ID NO: 495708 - RNA, 18 nt, Human
cggcuaaggaggguuguc

SEQ ID NO: 495709 - RNA, 19 nt, Human
cggggccguggccggggcg

SEQ ID NO: 495710 - RNA, 19 nt, Human
cggggcguggccggccccu

SEQ ID NO: 495711 - RNA, 22 nt, Human
cggggcuacgggagcggggcga

SEQ ID NO: 495712 - RNA, 18 nt, Human
cgugcacugugugugugc

SEQ ID NO: 495713 - RNA, 24 nt, Human
cuaacucugcuccccagcuaggau

SEQ ID NO: 495714 - RNA, 26 nt, Human
cucaaguaauccacccaccucagccu

SEQ ID NO: 495715 - RNA, 20 nt, Human
cuggaggggccaugagagug

SEQ ID NO: 495716 - RNA, 22 nt, Human
cuuaucuucgaagucccuccca

SEQ ID NO: 495717 - RNA, 22 nt, Human
gaagucccucccacaccuggcc

SEQ ID NO: 495718 - RNA, 24 nt, Human
gaccucaaguaauccacccaccuc

SEQ ID NO: 495719 - RNA, 20 nt, Human
gagagugcaagacacggggc

SEQ ID NO: 495720 - RNA, 21 nt, Human
gagcaguucuuggccuggagg

SEQ ID NO: 495721 - RNA, 21 nt, Human
gaggguuguccaggcaggcug

SEQ ID NO: 495722 - RNA, 22 nt, Human
gaggguuguccaggcaggcugg

SEQ ID NO: 495723 - RNA, 19 nt, Human
gaugaggcaggggugagca

SEQ ID NO: 495724 - RNA, 18 nt, Human
gauuacaggcaugagcca

SEQ ID NO: 495725 - RNA, 21 nt, Human
gauuacaggcaugagccacca

SEQ ID NO: 495726 - RNA, 24 nt, Human
gauuacaggcaugagccaccaugc

SEQ ID NO: 495727 - RNA, 22 nt, Human
gcagccugaagucugcgguuga

SEQ ID NO: 495728 - RNA, 19 nt, Human
gcaugagccaccaugcccc

SEQ ID NO: 495729 - RNA, 18 nt, Human
gccccaucaccuuccccc

SEQ ID NO: 495730 - RNA, 23 nt, Human
gcuccaggcccccaauguuggug

SEQ ID NO: 495731 - RNA, 23 nt, Human
gcugguuuugaacuccugaccuc

SEQ ID NO: 495732 - RNA, 21 nt, Human
ggaggggcagaaccccuaggg

SEQ ID NO: 495733 - RNA, 21 nt, Human
ggaggggcagaaccccuaggg

SEQ ID NO: 495734 - RNA, 24 nt, Human
ggauuacaggcaugagccaccaug

SEQ ID NO: 495735 - RNA, 20 nt, Human
ggccccggccagguccccuc

SEQ ID NO: 495736 - RNA, 21 nt, Human
ggccguggccggggcggggcu

SEQ ID NO: 495737 - RNA, 18 nt, Human
ggcugcggcuaaggaggg

SEQ ID NO: 495738 - RNA, 18 nt, Human
ggcugcggcuaaggaggg

SEQ ID NO: 495739 - RNA, 24 nt, Human
ggcugguuuugaacuccugaccuc

SEQ ID NO: 495740 - RNA, 18 nt, Human
gggaugcaggacccuggg

SEQ ID NO: 495741 - RNA, 18 nt, Human
gggaugcaggacccuggg

SEQ ID NO: 495742 - RNA, 18 nt, Human
ggggcguggccggccccu

SEQ ID NO: 495743 - RNA, 22 nt, Human
ggguuucaccauguuggccagg

SEQ ID NO: 495744 - RNA, 23 nt, Human
uaaggaggguuguccaggcaggc

SEQ ID NO: 495745 - RNA, 25 nt, Human
uaaggaggguuguccaggcaggcug

SEQ ID NO: 495746 - RNA, 25 nt, Human
uaaggaggguuguccaggcaggcug

SEQ ID NO: 495747 - RNA, 23 nt, Human
uacaggcaugagccaccaugccc

SEQ ID NO: 495748 - RNA, 22 nt, Human
uagagacaggguuucaccaugu

SEQ ID NO: 495749 - RNA, 23 nt, Human
uagcaagaggccgaggaagccca

SEQ ID NO: 495750 - RNA, 24 nt, Human
uaguagagacaggguuucaccaug

SEQ ID NO: 495751 - RNA, 26 nt, Human
uaguagagacaggguuucaccauguu

SEQ ID NO: 495752 - RNA, 21 nt, Human
uauacacaauacaaacgugcg

SEQ ID NO: 495753 - RNA, 21 nt, Human
uccacccaccucagccuacca

SEQ ID NO: 495754 - RNA, 21 nt, Human
uccgucuccacuuucugccuc

SEQ ID NO: 495755 - RNA, 18 nt, Human
uccugcucugugggucuc

SEQ ID NO: 495756 - RNA, 24 nt, Human
ugaacuccugaccucaaguaaucc

SEQ ID NO: 495757 - RNA, 23 nt, Human
ugaccucaaguaauccacccacc

SEQ ID NO: 495758 - RNA, 18 nt, Human
ugagcagguguccaugca

SEQ ID NO: 495759 - RNA, 19 nt, Human
ugaggagugggaauuggag

SEQ ID NO: 495760 - RNA, 22 nt, Human
ugaggagugggaauuggagagg

SEQ ID NO: 495761 - RNA, 23 nt, Human
ugagguuacuauaggggaauggg

SEQ ID NO: 495762 - RNA, 23 nt, Human
ugccucccuccugcucugugggu

SEQ ID NO: 495763 - RNA, 21 nt, Human
ugcgguggccgccagcuuggc

SEQ ID NO: 495764 - RNA, 24 nt, Human
uggaaggggcugcggcuaaggagg

SEQ ID NO: 495765 - RNA, 24 nt, Human
uggaaggggcugcggcuaaggagg

SEQ ID NO: 495766 - RNA, 18 nt, Human
uggcacuguggacgugca

SEQ ID NO: 495767 - RNA, 22 nt, Human
uggccagccccuacugggagcu

SEQ ID NO: 495768 - RNA, 24 nt, Human
uggccaggcugguuuugaacuccu

SEQ ID NO: 495769 - RNA, 22 nt, Human
uggccguggccagccccuacug

SEQ ID NO: 495770 - RNA, 18 nt, Human
ugggaauuggagaggaga

SEQ ID NO: 495771 - RNA, 19 nt, Human
ugggaugcaggacccuggg

SEQ ID NO: 495772 - RNA, 19 nt, Human
ugggaugcaggacccuggg

SEQ ID NO: 495773 - RNA, 18 nt, Human
ugggauuacaggcaugag

SEQ ID NO: 495774 - RNA, 22 nt, Human
ugggauuacaggcaugagccac

SEQ ID NO: 495775 - RNA, 23 nt, Human
ugggauuacaggcaugagccacc

SEQ ID NO: 495776 - RNA, 24 nt, Human
ugggauuacaggcaugagccacca

SEQ ID NO: 495777 - RNA, 25 nt, Human
ugggauuacaggcaugagccaccau

SEQ ID NO: 495778 - RNA, 20 nt, Human
uggggggcuggugccccaga

SEQ ID NO: 495779 - RNA, 20 nt, Human
uggggggcuggugccccaga

SEQ ID NO: 495780 - RNA, 25 nt, Human
uggggggcuggugccccagagaggg

SEQ ID NO: 495781 - RNA, 25 nt, Human
uggggggcuggugccccagagaggg

SEQ ID NO: 495782 - RNA, 22 nt, Human
uguccaggcaggcuggggugga

SEQ ID NO: 495783 - RNA, 22 nt, Human
uguccaggcaggcuggggugga

SEQ ID NO: 495784 - RNA, 20 nt, Human
uguggagggccccugcggug

SEQ ID NO: 495785 - RNA, 23 nt, Human
ugugggucucucugcuuccuggc

SEQ ID NO: 495786 - RNA, 23 nt, Human
uuaguagagacaggguuucacca

SEQ ID NO: 495787 - RNA, 24 nt, Human
uuaguagagacaggguuucaccau

SEQ ID NO: 495788 - RNA, 23 nt, Human
uucacagcccagaacccaggguc

SEQ ID NO: 495789 - RNA, 21 nt, Human
uucgaagucccucccacaccu

SEQ ID NO: 495790 - RNA, 22 nt, Human
uugcagccaggagaucugggga

SEQ ID NO: 495791 - RNA, 24 nt, Human
uuucaccauguuggccaggcuggu

SEQ ID NO: 495792 - RNA, 21 nt, Human
uuuugaacuccugaccucaag

SEQ ID NO: 495793 - RNA, 24 nt, Human
uuuuuaguagagacaggguuucac

SEQ ID NO: 495794 - RNA, 24 nt, Human
uuuuugggauuuuuaguagagaca

SEQ ID NO: 495795 - RNA, 18 nt, Human
uuuuuuuuuuuuuuuuug

SEQ ID NO: 495796 - RNA, 24 nt, Human
uuuuuuuuuuuuuuuuuuuuuggg

SEQ ID NO: 495797 - RNA, 23 nt, Human
aaaacagaaaccacaaagaagga

SEQ ID NO: 495798 - RNA, 18 nt, Human
aaacagaaaccacaaaga

SEQ ID NO: 495799 - RNA, 19 nt, Human
aacaaagcagagaggaaca

SEQ ID NO: 495800 - RNA, 18 nt, Human
aacagaaaccacaaagaa

SEQ ID NO: 495801 - RNA, 19 nt, Human
aacccguccauccacucug

SEQ ID NO: 495802 - RNA, 19 nt, Human
aagaacaaagcagagagga

SEQ ID NO: 495803 - RNA, 25 nt, Human
aagccaguccugaugcgcaagccag

SEQ ID NO: 495804 - RNA, 22 nt, Human
aagcgggugaggcagagagucc

SEQ ID NO: 495805 - RNA, 18 nt, Human
acaaaacagaaaccacaa

SEQ ID NO: 495806 - RNA, 21 nt, Human
acaaaacagaaaccacaaaga

SEQ ID NO: 495807 - RNA, 20 nt, Human
acaaagcagagaggaacaga

SEQ ID NO: 495808 - RNA, 21 nt, Human
acaaagcagagaggaacagag

SEQ ID NO: 495809 - RNA, 22 nt, Human
acaaagcagagaggaacagagu

SEQ ID NO: 495810 - RNA, 23 nt, Human
acaaagcagagaggaacagagug

SEQ ID NO: 495811 - RNA, 18 nt, Human
accacaaagaaggaagag

SEQ ID NO: 495812 - RNA, 23 nt, Human
accccaggacuuccaagggugaa

SEQ ID NO: 495813 - RNA, 19 nt, Human
acccugucacuuccguccc

SEQ ID NO: 495814 - RNA, 23 nt, Human
accugagccgccucucuggcccc

SEQ ID NO: 495815 - RNA, 20 nt, Human
acucugcacuucccaggcag

SEQ ID NO: 495816 - RNA, 19 nt, Human
agaaaccacaaagaaggaa

SEQ ID NO: 495817 - RNA, 20 nt, Human
agaggcugaaggcugcugcc

SEQ ID NO: 495818 - RNA, 21 nt, Human
agaugcaggcagacagagugg

SEQ ID NO: 495819 - RNA, 22 nt, Human
agcaccuucgccccuccccucu

SEQ ID NO: 495820 - RNA, 18 nt, Human
agcaggaggcggccuugg

SEQ ID NO: 495821 - RNA, 20 nt, Human
agcaggaggcggccuuggga

SEQ ID NO: 495822 - RNA, 22 nt, Human
agcucaguccagggaagaacaa

SEQ ID NO: 495823 - RNA, 18 nt, Human
aggcagacagagugggga

SEQ ID NO: 495824 - RNA, 21 nt, Human
aggcaggugggugggcaaggc

SEQ ID NO: 495825 - RNA, 21 nt, Human
aggccuacccgcaacagagga

SEQ ID NO: 495826 - RNA, 21 nt, Human
aggcugaggggauccggcugu

SEQ ID NO: 495827 - RNA, 24 nt, Human
augcaggcagaucccaaagucagg

SEQ ID NO: 495828 - RNA, 19 nt, Human
caaggcacagucccagagg

SEQ ID NO: 495829 - RNA, 20 nt, Human
caccacacccugucacuucc

SEQ ID NO: 495830 - RNA, 19 nt, Human
cacccugucacuuccgucc

SEQ ID NO: 495831 - RNA, 22 nt, Human
caccgaugcaggcagaucccaa

SEQ ID NO: 495832 - RNA, 24 nt, Human
caccuuugcaccgugagucaggag

SEQ ID NO: 495833 - RNA, 19 nt, Human
cacuccaccaccacacccu

SEQ ID NO: 495834 - RNA, 19 nt, Human
cagaucccaaagucagggu

SEQ ID NO: 495835 - RNA, 21 nt, Human
cagcuccccacuccaccacca

SEQ ID NO: 495836 - RNA, 19 nt, Human
caggagauaaagccagucc

SEQ ID NO: 495837 - RNA, 22 nt, Human
cagucuccaggggcccugggcu

SEQ ID NO: 495838 - RNA, 24 nt, Human
caguggcccguggcagggcccucc

SEQ ID NO: 495839 - RNA, 24 nt, Human
ccacacccugucacuuccgucccu

SEQ ID NO: 495840 - RNA, 22 nt, Human
cccacuccaccaccacacccug

SEQ ID NO: 495841 - RNA, 19 nt, Human
ccccacuccaccaccacaa

SEQ ID NO: 495842 - RNA, 21 nt, Human
ccccacuccaccaccacaccc

SEQ ID NO: 495843 - RNA, 18 nt, Human
ccccuccccucuaaaccc

SEQ ID NO: 495844 - RNA, 21 nt, Human
cccuccccaauauccagagga

SEQ ID NO: 495845 - RNA, 24 nt, Human
cccucccccaccacugcccaaacc

SEQ ID NO: 495846 - RNA, 23 nt, Human
cccugggcugaagcgggugaggc

SEQ ID NO: 495847 - RNA, 23 nt, Human
ccucagccauacuccugggcgcg

SEQ ID NO: 495848 - RNA, 22 nt, Human
ccucccccaccacugcccaaaa

SEQ ID NO: 495849 - RNA, 25 nt, Human
ccuccucccugccacccucccaggc

SEQ ID NO: 495850 - RNA, 18 nt, Human
ccucuaaacccguccauc

SEQ ID NO: 495851 - RNA, 18 nt, Human
ccugaggccacagagcug

SEQ ID NO: 495852 - RNA, 24 nt, Human
ccugcgcugagcucaguccaggga

SEQ ID NO: 495853 - RNA, 20 nt, Human
ccugggcgcggguuucggug

SEQ ID NO: 495854 - RNA, 22 nt, Human
ccugggcugaagcgggugaggc

SEQ ID NO: 495855 - RNA, 18 nt, Human
cgacagcugccccucgug

SEQ ID NO: 495856 - RNA, 24 nt, Human
cgaugcaggcagaucccaaaguca

SEQ ID NO: 495857 - RNA, 21 nt, Human
cuccccacuccaccaccacac

SEQ ID NO: 495858 - RNA, 21 nt, Human
cucccccaccacugcccaaac

SEQ ID NO: 495859 - RNA, 20 nt, Human
cugcugccuuccugccuggc

SEQ ID NO: 495860 - RNA, 23 nt, Human
gaagcgggugaggcagagagucc

SEQ ID NO: 495861 - RNA, 19 nt, Human
gacucuguucuugcuagca

SEQ ID NO: 495862 - RNA, 23 nt, Human
gaggggauccggcugugggggcc

SEQ ID NO: 495863 - RNA, 20 nt, Human
gcagagaggaacagagugga

SEQ ID NO: 495864 - RNA, 18 nt, Human
gccagagaggcugaaggc

SEQ ID NO: 495865 - RNA, 22 nt, Human
gccagcuccccacuccaccacc

SEQ ID NO: 495866 - RNA, 21 nt, Human
gcccccucccccaccacugcc

SEQ ID NO: 495867 - RNA, 20 nt, Human
gcccguggcagggcccuccu

SEQ ID NO: 495868 - RNA, 24 nt, Human
gcccguggcagggcccuccugggg

SEQ ID NO: 495869 - RNA, 20 nt, Human
gccugcgcugagcucagucc

SEQ ID NO: 495870 - RNA, 26 nt, Human
ggaagaacaaagcagagaggaacaga

SEQ ID NO: 495871 - RNA, 19 nt, Human
ggccacagagcugggcaac

SEQ ID NO: 495872 - RNA, 20 nt, Human
gggauccggcugugggggcc

SEQ ID NO: 495873 - RNA, 24 nt, Human
gggcaaccugagccgccucucugg

SEQ ID NO: 495874 - RNA, 18 nt, Human
ggggauccggcugugggg

SEQ ID NO: 495875 - RNA, 22 nt, Human
gggugaggcagagaguccugag

SEQ ID NO: 495876 - RNA, 21 nt, Human
ggugaggcagagaguccugag

SEQ ID NO: 495877 - RNA, 20 nt, Human
gugggccagagaggcugaag

SEQ ID NO: 495878 - RNA, 19 nt, Human
uacagcaccuucgccccuc

SEQ ID NO: 495879 - RNA, 23 nt, Human
ucaguccagggaagaacaaagca

SEQ ID NO: 495880 - RNA, 18 nt, Human
uccaagggugaagcuguc

SEQ ID NO: 495881 - RNA, 19 nt, Human
uccaagggugaagcugucc

SEQ ID NO: 495882 - RNA, 23 nt, Human
uccccacuccaccaccacacccu

SEQ ID NO: 495883 - RNA, 22 nt, Human
uccccagcagccaguggcccgu

SEQ ID NO: 495884 - RNA, 21 nt, Human
ucccugccacccucccaggcu

SEQ ID NO: 495885 - RNA, 24 nt, Human
uccucccugccacccucccaggcu

SEQ ID NO: 495886 - RNA, 18 nt, Human
uccuggccagcagaagcc

SEQ ID NO: 495887 - RNA, 18 nt, Human
uccuuggaaggggcagag

SEQ ID NO: 495888 - RNA, 19 nt, Human
ucuccaggggcccugggcu

SEQ ID NO: 495889 - RNA, 18 nt, Human
ugaggccacagagcuggg

SEQ ID NO: 495890 - RNA, 21 nt, Human
ugaggggauccggcugugggg

SEQ ID NO: 495891 - RNA, 25 nt, Human
ugaggggauccggcugugggggccg

SEQ ID NO: 495892 - RNA, 20 nt, Human
ugccacccucccaggcucau

SEQ ID NO: 495893 - RNA, 24 nt, Human
ugcccaaaccuguuuacagcacug

SEQ ID NO: 495894 - RNA, 24 nt, Human
uggaaggggcagaggacucagagg

SEQ ID NO: 495895 - RNA, 22 nt, Human
ugggaaguuguccgagugggcc

SEQ ID NO: 495896 - RNA, 24 nt, Human
uuacagugaugaauagcucuucuu

SEQ ID NO: 495897 - RNA, 18 nt, Human
uuuuuuuuuuuuuuccug

SEQ ID NO: 495898 - RNA, 28 nt, Human
aaacaaaagguacgaacccaucccaaag

SEQ ID NO: 495899 - RNA, 20 nt, Human
aaacagcagagccuaaguga

SEQ ID NO: 495900 - RNA, 18 nt, Human
agcagcaggaacucuugg

SEQ ID NO: 495901 - RNA, 18 nt, Human
agcaggaggcagaaacaa

SEQ ID NO: 495902 - RNA, 22 nt, Human
agccagcacagcaagcagccuc

SEQ ID NO: 495903 - RNA, 20 nt, Human
agcccagcccccagcagcag

SEQ ID NO: 495904 - RNA, 21 nt, Human
agcugcacugcgaaggagauc

SEQ ID NO: 495905 - RNA, 22 nt, Human
aggaaacagaggucagaaguuc

SEQ ID NO: 495906 - RNA, 21 nt, Human
aggcagaaacaaaagguacga

SEQ ID NO: 495907 - RNA, 24 nt, Human
aggcagaaacaaaagguacgaacc

SEQ ID NO: 495908 - RNA, 26 nt, Human
aggcagaaacaaaagguacgaaccca

SEQ ID NO: 495909 - RNA, 20 nt, Human
agggugagaaacagcagagc

SEQ ID NO: 495910 - RNA, 18 nt, Human
agggugcaguguuggagg

SEQ ID NO: 495911 - RNA, 22 nt, Human
agguacgaacccaucccaaagc

SEQ ID NO: 495912 - RNA, 29 nt, Human
auagcaggaggcagaaacaaaagggaccc

SEQ ID NO: 495913 - RNA, 23 nt, Human
augucaagauccagaaucucaaa

SEQ ID NO: 495914 - RNA, 24 nt, Human
caagcagccuccgcauuaguucca

SEQ ID NO: 495915 - RNA, 19 nt, Human
cacugccacuucuggaugg

SEQ ID NO: 495916 - RNA, 20 nt, Human
cagaaucucaaagcaucccc

SEQ ID NO: 495917 - RNA, 18 nt, Human
cagcaagcagccuccgca

SEQ ID NO: 495918 - RNA, 18 nt, Human
cagcagcagcaggaacuc

SEQ ID NO: 495919 - RNA, 18 nt, Human
cauccccucuuuggcucc

SEQ ID NO: 495920 - RNA, 20 nt, Human
ccaagggugagaaacagcag

SEQ ID NO: 495921 - RNA, 20 nt, Human
ccagcacagcaagcagccuc

SEQ ID NO: 495922 - RNA, 18 nt, Human
cggaggaaacagagguca

SEQ ID NO: 495923 - RNA, 22 nt, Human
gaaacaaaagguacgaacccau

SEQ ID NO: 495924 - RNA, 21 nt, Human
gaaacagaggucagaaguucc

SEQ ID NO: 495925 - RNA, 21 nt, Human
gacgaggggggcagggcagaa

SEQ ID NO: 495926 - RNA, 30 nt, Human
gcaguccuuuguuaacagaucauuuguuuu

SEQ ID NO: 495927 - RNA, 26 nt, Human
gcugcacugcgaaggagauccucgug

SEQ ID NO: 495928 - RNA, 20 nt, Human
ggaggaaacagaggucagaa

SEQ ID NO: 495929 - RNA, 21 nt, Human
gggggcagcuguccagugaca

SEQ ID NO: 495930 - RNA, 22 nt, Human
gggggucuacauagcugggacc

SEQ ID NO: 495931 - RNA, 24 nt, Human
gucaagauccagaaucucaaagca

SEQ ID NO: 495932 - RNA, 22 nt, Human
uaagaugggcaugucaagaucc

SEQ ID NO: 495933 - RNA, 19 nt, Human
uacgaacccaucccaaagc

SEQ ID NO: 495934 - RNA, 23 nt, Human
uaggauggggggcagcuguccag

SEQ ID NO: 495935 - RNA, 22 nt, Human
uauccucagucaaaagaaaaau

SEQ ID NO: 495936 - RNA, 19 nt, Human
ucaggacggaggaaacaga

SEQ ID NO: 495937 - RNA, 22 nt, Human
ucaggacggaggaaacagaggu

SEQ ID NO: 495938 - RNA, 20 nt, Human
uccagaaucucaaagcaucc

SEQ ID NO: 495939 - RNA, 24 nt, Human
uccaucauccaagggugagaaaca

SEQ ID NO: 495940 - RNA, 23 nt, Human
ucccaaagcuguugggcacugcc

SEQ ID NO: 495941 - RNA, 21 nt, Human
ucucaaagcauccccucuuug

SEQ ID NO: 495942 - RNA, 19 nt, Human
ugagagucugagucaacac

SEQ ID NO: 495943 - RNA, 19 nt, Human
ugagucaacaccuuggcuc

SEQ ID NO: 495944 - RNA, 21 nt, Human
ugcaaagccagcacagcaagc

SEQ ID NO: 495945 - RNA, 19 nt, Human
ugcacuaacaaaacaugcu

SEQ ID NO: 495946 - RNA, 18 nt, Human
uggcuccaucauccaagg

SEQ ID NO: 495947 - RNA, 21 nt, Human
ugggaccuggcccuggggggu

SEQ ID NO: 495948 - RNA, 20 nt, Human
uguuaacagaucauuuguuu

SEQ ID NO: 495949 - RNA, 19 nt, Human
uuuuuuuuuuuuuuuuugc

SEQ ID NO: 495950 - RNA, 25 nt, Human
uuuuuuuuuuuuuuuuuugcacuaa

SEQ ID NO: 495951 - RNA, 23 nt, Human
uuuuuuuuuuuuuuuuuuuuggg

SEQ ID NO: 495952 - RNA, 21 nt, Human
aaaagaaaacuugagguggag

SEQ ID NO: 495953 - RNA, 21 nt, Human
aaagcacacucucccucuuuu

SEQ ID NO: 495954 - RNA, 19 nt, Human
aacacugggggcgccgggc

SEQ ID NO: 495955 - RNA, 20 nt, Human
aacacugggggcgccgggcg

SEQ ID NO: 495956 - RNA, 20 nt, Human
aacggcacccccccaccccc

SEQ ID NO: 495957 - RNA, 20 nt, Human
aagcacacucucccucuuuu

SEQ ID NO: 495958 - RNA, 20 nt, Human
acccaaagagacaaaaaggg

SEQ ID NO: 495959 - RNA, 21 nt, Human
acccuacaguaaaacaaacga

SEQ ID NO: 495960 - RNA, 19 nt, Human
agccccaggcccuuucagg

SEQ ID NO: 495961 - RNA, 19 nt, Human
caacggcacccccccaccc

SEQ ID NO: 495962 - RNA, 23 nt, Human
caacggcacccccccacccccaa

SEQ ID NO: 495963 - RNA, 20 nt, Human
cacccccccacccccaaccc

SEQ ID NO: 495964 - RNA, 23 nt, Human
cacccccccacccccaacccaag

SEQ ID NO: 495965 - RNA, 19 nt, Human
cacugggggcgccgggcgg

SEQ ID NO: 495966 - RNA, 19 nt, Human
cagccccacaaaagaaaac

SEQ ID NO: 495967 - RNA, 21 nt, Human
ccagugaagcgauggccucgc

SEQ ID NO: 495968 - RNA, 21 nt, Human
cccaagaggacuauacaugga

SEQ ID NO: 495969 - RNA, 24 nt, Human
cccaccaacggcacccccccaccc

SEQ ID NO: 495970 - RNA, 23 nt, Human
cccauagccugucaggcuggggc

SEQ ID NO: 495971 - RNA, 18 nt, Human
ccccacccccaacccaag

SEQ ID NO: 495972 - RNA, 25 nt, Human
cccccaacccaagaggacuauacau

SEQ ID NO: 495973 - RNA, 25 nt, Human
ccccccacccccaacccaagaggac

SEQ ID NO: 495974 - RNA, 23 nt, Human
cccccccacccccaacccaagag

SEQ ID NO: 495975 - RNA, 20 nt, Human
cccuccggcaucaaggcucc

SEQ ID NO: 495976 - RNA, 23 nt, Human
ccgaaggccaggcgguucccucc

SEQ ID NO: 495977 - RNA, 19 nt, Human
ccgcccucagaaaacacug

SEQ ID NO: 495978 - RNA, 19 nt, Human
ccuccgggcgcucucggcg

SEQ ID NO: 495979 - RNA, 18 nt, Human
cggcacccccccaccccc

SEQ ID NO: 495980 - RNA, 19 nt, Human
cucucccaccaacggcacc

SEQ ID NO: 495981 - RNA, 21 nt, Human
cugcccacaggcugagcucag

SEQ ID NO: 495982 - RNA, 19 nt, Human
gagcucagccccaggcccu

SEQ ID NO: 495983 - RNA, 22 nt, Human
gccccaggcccuuucaggcauc

SEQ ID NO: 495984 - RNA, 21 nt, Human
gcggcacagggaguaggauac

SEQ ID NO: 495985 - RNA, 19 nt, Human
ggcgguucccuccgggcgc

SEQ ID NO: 495986 - RNA, 24 nt, Human
guggaguuuuccggucacccaaag

SEQ ID NO: 495987 - RNA, 22 nt, Human
uaaaacaaacgacacuuggggg

SEQ ID NO: 495988 - RNA, 23 nt, Human
uaaaacaaacgacacuugggggg

SEQ ID NO: 495989 - RNA, 19 nt, Human
ucacccaaagagacaaaaa

SEQ ID NO: 495990 - RNA, 21 nt, Human
ucacccaaagagacaaaaagg

SEQ ID NO: 495991 - RNA, 21 nt, Human
ucccaccaacggcaccccccc

SEQ ID NO: 495992 - RNA, 23 nt, Human
ucccaccaacggcacccccccac

SEQ ID NO: 495993 - RNA, 24 nt, Human
ucccaccaacggcacccccccacc

SEQ ID NO: 495994 - RNA, 21 nt, Human
uccccgaaggccaggcgguuc

SEQ ID NO: 495995 - RNA, 22 nt, Human
ugagcucagccccaggcccuuu

SEQ ID NO: 495996 - RNA, 21 nt, Human
ugcagggacagagugaccagg

SEQ ID NO: 495997 - RNA, 18 nt, Human
ugggggcgccgggcggga

SEQ ID NO: 495998 - RNA, 18 nt, Human
aaagcaaauagaacacau

SEQ ID NO: 495999 - RNA, 26 nt, Human
aaagccccuugacaaaauaucugcuu

SEQ ID NO: 496000 - RNA, 22 nt, Human
aacuuuuuuuguuguuguuuuu

SEQ ID NO: 496001 - RNA, 18 nt, Human
aagcaaaugaaaaccaag

SEQ ID NO: 496002 - RNA, 23 nt, Human
aaugucauuuugaaguaaauggc

SEQ ID NO: 496003 - RNA, 24 nt, Human
acacaagaaaaaaaaagccucugg

SEQ ID NO: 496004 - RNA, 20 nt, Human
accuucuucaacccuaucca

SEQ ID NO: 496005 - RNA, 26 nt, Human
agaaaaaaaaagccucugggagaaga

SEQ ID NO: 496006 - RNA, 18 nt, Human
agaucacacuuuuaucuu

SEQ ID NO: 496007 - RNA, 18 nt, Human
auauauccauacauauau

SEQ ID NO: 496008 - RNA, 25 nt, Human
augaaaaccaagacauauuuuucug

SEQ ID NO: 496009 - RNA, 20 nt, Human
caaaaugcaucauucuucuu

SEQ ID NO: 496010 - RNA, 19 nt, Human
cccuugacaaaauaucugc

SEQ ID NO: 496011 - RNA, 21 nt, Human
ccucugggagaagaggauaaa

SEQ ID NO: 496012 - RNA, 20 nt, Human
gcagucuuuagcaaugucau

SEQ ID NO: 496013 - RNA, 21 nt, Human
ggaauaaacagaaaaauacag

SEQ ID NO: 496014 - RNA, 19 nt, Human
uaaaaaacagcauaucaga

SEQ ID NO: 496015 - RNA, 22 nt, Human
uaaagcaaauagaacacauuca

SEQ ID NO: 496016 - RNA, 19 nt, Human
uaagcuagacagacgucga

SEQ ID NO: 496017 - RNA, 18 nt, Human
uacaaugcugauuaaagc

SEQ ID NO: 496018 - RNA, 21 nt, Human
uacacaagaaaaaaaaagccu

SEQ ID NO: 496019 - RNA, 21 nt, Human
uacauaaugcuaugucgugga

SEQ ID NO: 496020 - RNA, 23 nt, Human
uagaaaaauguacaauuuauuaa

SEQ ID NO: 496021 - RNA, 23 nt, Human
uagccagcuggacuccggaacug

SEQ ID NO: 496022 - RNA, 19 nt, Human
uauaguaaaguuaaaaaaa

SEQ ID NO: 496023 - RNA, 22 nt, Human
ucacuuuuucuuagaucacacu

SEQ ID NO: 496024 - RNA, 23 nt, Human
ucuucaacccuauccaugauuuc

SEQ ID NO: 496025 - RNA, 23 nt, Human
ugaaaaccaagacauauuuuucu

SEQ ID NO: 496026 - RNA, 21 nt, Human
ugccacagaagagaacaguuu

SEQ ID NO: 496027 - RNA, 18 nt, Human
ugucaaaaugcaucauuc

SEQ ID NO: 496028 - RNA, 25 nt, Human
uucaaauuggauugucaguuucauc

SEQ ID NO: 496029 - RNA, 21 nt, Human
uucacagaacaaaaaugacaa

SEQ ID NO: 496030 - RNA, 23 nt, Human
uugaagcaggguucucugugcca

SEQ ID NO: 496031 - RNA, 21 nt, Human
uuuuuuuuuuuuuugcaaaua

SEQ ID NO: 496032 - RNA, 21 nt, Human
uuuuuuuuuuuuuuuuugcaa

SEQ ID NO: 496033 - RNA, 23 nt, Human
uuuuuuuuuuuuuuuuugcaaau

SEQ ID NO: 496034 - RNA, 27 nt, Human
uuuuuuuuuuuuuuuuuuuuuuugggg

SEQ ID NO: 496035 - RNA, 19 nt, Human
agagcagcuauggaaggag

SEQ ID NO: 496036 - RNA, 19 nt, Human
cugcugagccauguugcca

SEQ ID NO: 496037 - RNA, 22 nt, Human
uagagcagcuauggaaggagac

SEQ ID NO: 496038 - RNA, 19 nt, Human
uauggaaggagacuacaca

SEQ ID NO: 496039 - RNA, 18 nt, Human
aaaaucuggugagaucca

SEQ ID NO: 496040 - RNA, 23 nt, Human
aaaaugaggcaaauguagcaaaa

SEQ ID NO: 496041 - RNA, 22 nt, Human
aaaccaaauacugcauguccuc

SEQ ID NO: 496042 - RNA, 19 nt, Human
aaccaaauacugcaugucc

SEQ ID NO: 496043 - RNA, 19 nt, Human
aaccaagaagagaagacag

SEQ ID NO: 496044 - RNA, 21 nt, Human
aaccaagaagagaagacagac

SEQ ID NO: 496045 - RNA, 23 nt, Human
aagagaagacagacuugucagaa

SEQ ID NO: 496046 - RNA, 22 nt, Human
aagcagccuuaaaaaagaaaau

SEQ ID NO: 496047 - RNA, 23 nt, Human
acaacaaaccuccacgacaugag

SEQ ID NO: 496048 - RNA, 20 nt, Human
accugggugaugaaauaauc

SEQ ID NO: 496049 - RNA, 24 nt, Human
acuaagcagccuuaaaaaagaaaa

SEQ ID NO: 496050 - RNA, 22 nt, Human
acucugucuuggcuccgugucc

SEQ ID NO: 496051 - RNA, 20 nt, Human
agaaaaccaaauacugcaug

SEQ ID NO: 496052 - RNA, 21 nt, Human
agaaauaauggaugggcuuga

SEQ ID NO: 496053 - RNA, 24 nt, Human
agaaauaauggaugggcuugagac

SEQ ID NO: 496054 - RNA, 19 nt, Human
aggaagccccagggauggg

SEQ ID NO: 496055 - RNA, 18 nt, Human
aggagauuuuuggaaggc

SEQ ID NO: 496056 - RNA, 24 nt, Human
aggagggagaggagccgaaaaaaa

SEQ ID NO: 496057 - RNA, 25 nt, Human
aggcagagcaaaggaagccccaggg

SEQ ID NO: 496058 - RNA, 26 nt, Human
agguaggaggagggagagggggaccc

SEQ ID NO: 496059 - RNA, 24 nt, Human
auaaacacaaagaagggaauaaca

SEQ ID NO: 496060 - RNA, 23 nt, Human
auaaagacacaugcacacgaaug

SEQ ID NO: 496061 - RNA, 19 nt, Human
auccuuagcaaacauggga

SEQ ID NO: 496062 - RNA, 18 nt, Human
auucaggagauuuuugga

SEQ ID NO: 496063 - RNA, 24 nt, Human
cacaaagaagggaauaacagacac

SEQ ID NO: 496064 - RNA, 19 nt, Human
cacgacaugaguuuaccua

SEQ ID NO: 496065 - RNA, 23 nt, Human
cacuggagucuacuugagggcgg

SEQ ID NO: 496066 - RNA, 23 nt, Human
cacuuugucuuuuaggaaguuca

SEQ ID NO: 496067 - RNA, 18 nt, Human
cagaaaaccaaauacugc

SEQ ID NO: 496068 - RNA, 22 nt, Human
cagagcccggauucaggagauu

SEQ ID NO: 496069 - RNA, 20 nt, Human
ccagaaaggccacaccggua

SEQ ID NO: 496070 - RNA, 22 nt, Human
cccuaagaaggugcaguggagg

SEQ ID NO: 496071 - RNA, 18 nt, Human
cccucucuuucuuucucc

SEQ ID NO: 496072 - RNA, 24 nt, Human
cccucucuuucuuucuccucagga

SEQ ID NO: 496073 - RNA, 22 nt, Human
ccuccacgacaugaguuuaccu

SEQ ID NO: 496074 - RNA, 21 nt, Human
ccucccucucuuucuuucucc

SEQ ID NO: 496075 - RNA, 18 nt, Human
ccugagacuaacguagag

SEQ ID NO: 496076 - RNA, 23 nt, Human
ccuguagccagaaaggccggggc

SEQ ID NO: 496077 - RNA, 20 nt, Human
cguguggggcggugggugug

SEQ ID NO: 496078 - RNA, 23 nt, Human
cucccucucuuucuuucuccuca

SEQ ID NO: 496079 - RNA, 18 nt, Human
cucucucucuuuuucucu

SEQ ID NO: 496080 - RNA, 18 nt, Human
cucucucuuuuucucucc

SEQ ID NO: 496081 - RNA, 21 nt, Human
cuuagcaaacaugggaacaga

SEQ ID NO: 496082 - RNA, 21 nt, Human
cuuuguaaauucugggaagag

SEQ ID NO: 496083 - RNA, 21 nt, Human
gaaggcaccuuccaaaauccc

SEQ ID NO: 496084 - RNA, 18 nt, Human
gaagguaggaggagggag

SEQ ID NO: 496085 - RNA, 21 nt, Human
gagccgaaaaaaacaauauua

SEQ ID NO: 496086 - RNA, 24 nt, Human
gauuuuuggaaggcaccuuccaaa

SEQ ID NO: 496087 - RNA, 19 nt, Human
gcagagcaaaggaagcccc

SEQ ID NO: 496088 - RNA, 23 nt, Human
gcgguggguguggccauguucuu

SEQ ID NO: 496089 - RNA, 21 nt, Human
gcucuuccuucuuuacacauu

SEQ ID NO: 496090 - RNA, 22 nt, Human
ggcuugagacaggaaagugugg

SEQ ID NO: 496091 - RNA, 19 nt, Human
gguaugaaaccaagaagag

SEQ ID NO: 496092 - RNA, 21 nt, Human
gguggguguggccauguucuu

SEQ ID NO: 496093 - RNA, 24 nt, Human
uaaaaaaugaggcaaauguagcaa

SEQ ID NO: 496094 - RNA, 22 nt, Human
uaaacacaaagaagggaauaac

SEQ ID NO: 496095 - RNA, 19 nt, Human
uaaguuucaugacuugaaa

SEQ ID NO: 496096 - RNA, 21 nt, Human
uacaacaaaccuccacgacau

SEQ ID NO: 496097 - RNA, 18 nt, Human
uacccccgaaagcuaaaa

SEQ ID NO: 496098 - RNA, 20 nt, Human
uagauuggauagagaaaaug

SEQ ID NO: 496099 - RNA, 18 nt, Human
uaucagaguaacaaauac

SEQ ID NO: 496100 - RNA, 25 nt, Human
uccaaaauccccuucuuugcuagac

SEQ ID NO: 496101 - RNA, 27 nt, Human
uccaaaauccccuucuuugcuagacuc

SEQ ID NO: 496102 - RNA, 24 nt, Human
ucccucucuuucuuucuccucagg

SEQ ID NO: 496103 - RNA, 20 nt, Human
ucucucucucucuuuuucuc

SEQ ID NO: 496104 - RNA, 24 nt, Human
ucucucucuuuuucucucccuccc

SEQ ID NO: 496105 - RNA, 18 nt, Human
uggauagagaaaauguga

SEQ ID NO: 496106 - RNA, 20 nt, Human
uggauagagaaaaugugaua

SEQ ID NO: 496107 - RNA, 24 nt, Human
uggccauguucuugcucuuccuuc

SEQ ID NO: 496108 - RNA, 25 nt, Human
ugggaacagaaaaccaaauacugca

SEQ ID NO: 496109 - RNA, 24 nt, Human
ugucagaagcuagaaagaagagga

SEQ ID NO: 496110 - RNA, 19 nt, Human
uguggccauguucuugcuc

SEQ ID NO: 496111 - RNA, 21 nt, Human
uuaggcacugggcuuaauacc

SEQ ID NO: 496112 - RNA, 21 nt, Human
uugggcaggagauaagaacgg

SEQ ID NO: 496113 - RNA, 23 nt, Human
uuuuucucucucuuugguuuuuu

SEQ ID NO: 496114 - RNA, 18 nt, Human
aaugccaaacauccucuc

SEQ ID NO: 496115 - RNA, 25 nt, Human
acaaaccaaaacuaucuccaaacaa

SEQ ID NO: 496116 - RNA, 22 nt, Human
acaggaugugcagacugauuaa

SEQ ID NO: 496117 - RNA, 21 nt, Human
accacucuggcauaaagcaac

SEQ ID NO: 496118 - RNA, 22 nt, Human
caaacuagguaaauguggguca

SEQ ID NO: 496119 - RNA, 24 nt, Human
caauagcaaugaagcugcuacaua

SEQ ID NO: 496120 - RNA, 19 nt, Human
cacuuuguccccgcgucuc

SEQ ID NO: 496121 - RNA, 23 nt, Human
cacuuuuauucuaaauucaaaga

SEQ ID NO: 496122 - RNA, 20 nt, Human
caggaugaaaaaauauuuaa

SEQ ID NO: 496123 - RNA, 24 nt, Human
cucauuuuuauuauagaacuacca

SEQ ID NO: 496124 - RNA, 18 nt, Human
cuguacaaaccaaaacua

SEQ ID NO: 496125 - RNA, 18 nt, Human
gaaagaauauaauguugc

SEQ ID NO: 496126 - RNA, 22 nt, Human
guaaaauaugcugcaauauaau

SEQ ID NO: 496127 - RNA, 24 nt, Human
gucauauacaacacuuucaauugu

SEQ ID NO: 496128 - RNA, 20 nt, Human
gucugaaagaauauaauguu

SEQ ID NO: 496129 - RNA, 21 nt, Human
uaaaauaugcugcaauauaau

SEQ ID NO: 496130 - RNA, 19 nt, Human
uacaaugccaaacauccuc

SEQ ID NO: 496131 - RNA, 20 nt, Human
uaucuccaaacaacuaaaac

SEQ ID NO: 496132 - RNA, 20 nt, Human
ucaaacaaccauacagaaac

SEQ ID NO: 496133 - RNA, 19 nt, Human
ucaauagcaauguaugcau

SEQ ID NO: 496134 - RNA, 27 nt, Human
ucggcagugacagcucagauguccaag

SEQ ID NO: 496135 - RNA, 19 nt, Human
ugacacaaacuagguaaaa

SEQ ID NO: 496136 - RNA, 21 nt, Human
ugagguaacuucaaaguugcu

SEQ ID NO: 496137 - RNA, 24 nt, Human
ugagguaacuucaaaguugcuucu

SEQ ID NO: 496138 - RNA, 24 nt, Human
uguaugcauaagaaauuuugugaa

SEQ ID NO: 496139 - RNA, 24 nt, Human
ugugcagacugauuaaaguucagg

SEQ ID NO: 496140 - RNA, 20 nt, Human
uguugauagaaucaaacaac

SEQ ID NO: 496141 - RNA, 23 nt, Human
uucaggaugaaaaaauauuuaaa

SEQ ID NO: 496142 - RNA, 18 nt, Human
uuugauaaaacccauuau

SEQ ID NO: 496143 - RNA, 22 nt, Human
aaacaguauuuuucauauucuu

SEQ ID NO: 496144 - RNA, 22 nt, Human
aagcaaagggcaaaagauugug

SEQ ID NO: 496145 - RNA, 18 nt, Human
acaguuuuuauuuuccuu

SEQ ID NO: 496146 - RNA, 23 nt, Human
caauugaucuugagcucuuccua

SEQ ID NO: 496147 - RNA, 21 nt, Human
ccuccugccuccuguagaguc

SEQ ID NO: 496148 - RNA, 22 nt, Human
ccuccugccuccuguagagucc

SEQ ID NO: 496149 - RNA, 23 nt, Human
cucuuccuagagcugauuuuaaa

SEQ ID NO: 496150 - RNA, 20 nt, Human
gaaauguuucuaaggagcag

SEQ ID NO: 496151 - RNA, 18 nt, Human
gacucuuuucucaauuuu

SEQ ID NO: 496152 - RNA, 21 nt, Human
gcuacauucucaucucugacc

SEQ ID NO: 496153 - RNA, 21 nt, Human
gggcaaaagauugugaugcuu

SEQ ID NO: 496154 - RNA, 23 nt, Human
guagaguccacaauacuuguaga

SEQ ID NO: 496155 - RNA, 22 nt, Human
uaacugcagacaucuguuuagc

SEQ ID NO: 496156 - RNA, 20 nt, Human
uaaugagugcuucuucauuu

SEQ ID NO: 496157 - RNA, 18 nt, Human
uaucagaaauaaacucau

SEQ ID NO: 496158 - RNA, 19 nt, Human
uaucagaaauaaacucaug

SEQ ID NO: 496159 - RNA, 28 nt, Human
ucauuuaaaaauaauauaaucuggucac

SEQ ID NO: 496160 - RNA, 20 nt, Human
ucucaucucugaccaugagg

SEQ ID NO: 496161 - RNA, 21 nt, Human
ugacgcagaaaauucuagaug

SEQ ID NO: 496162 - RNA, 19 nt, Human
ugagcucuuccuagagcug

SEQ ID NO: 496163 - RNA, 20 nt, Human
uggacugagucagaccugga

SEQ ID NO: 496164 - RNA, 22 nt, Human
uggcuaauagaaaauacagagu

SEQ ID NO: 496165 - RNA, 18 nt, Human
uuuuuuuuuuuuuuuuug

SEQ ID NO: 496166 - RNA, 20 nt, Human
uuuuuuuuuuuuuuuuuggu

SEQ ID NO: 496167 - RNA, 24 nt, Human
aaaaaaaccaagcggguacucaaa

SEQ ID NO: 496168 - RNA, 26 nt, Human
aaaaaaaccccgaaaaacaaaacaaa

SEQ ID NO: 496169 - RNA, 24 nt, Human
aaaaaaccccgaaaaacaaaacaa

SEQ ID NO: 496170 - RNA, 21 nt, Human
aaaaacaggagaauauccaaa

SEQ ID NO: 496171 - RNA, 23 nt, Human
aaaaaccaagcggguacucaaac

SEQ ID NO: 496172 - RNA, 22 nt, Human
aaaaauacauuucuauuuccuc

SEQ ID NO: 496173 - RNA, 23 nt, Human
aaaacaaaacaaaaacaugcaga

SEQ ID NO: 496174 - RNA, 20 nt, Human
aaaaccccgaaaaacaaaac

SEQ ID NO: 496175 - RNA, 21 nt, Human
aaaaccccgaaaaacaaaaca

SEQ ID NO: 496176 - RNA, 20 nt, Human
aaacaaaacaaaaacaugca

SEQ ID NO: 496177 - RNA, 19 nt, Human
aaagacaacagaacuguau

SEQ ID NO: 496178 - RNA, 24 nt, Human
aaauacacacucaccauaacuaua

SEQ ID NO: 496179 - RNA, 22 nt, Human
aaaugcuaucuacaugcaacuc

SEQ ID NO: 496180 - RNA, 25 nt, Human
aauaaaaacaggagaauauccaaaa

SEQ ID NO: 496181 - RNA, 23 nt, Human
acaaaacaaaaacaugcagagug

SEQ ID NO: 496182 - RNA, 22 nt, Human
acacaacagaaguuaacaugcc

SEQ ID NO: 496183 - RNA, 18 nt, Human
accccgaaaaacaaaaca

SEQ ID NO: 496184 - RNA, 19 nt, Human
acuacaguaaauacacacu

SEQ ID NO: 496185 - RNA, 21 nt, Human
acuagaauagagagcuuucca

SEQ ID NO: 496186 - RNA, 21 nt, Human
acugaaguaaaacacaaaagg

SEQ ID NO: 496187 - RNA, 20 nt, Human
acugcauguucgugcaaaau

SEQ ID NO: 496188 - RNA, 25 nt, Human
agaaauaaaugcuaucuacaugcaa

SEQ ID NO: 496189 - RNA, 21 nt, Human
aggcaaaaguaaaaaucuauc

SEQ ID NO: 496190 - RNA, 18 nt, Human
agucugguuuugcuuuug

SEQ ID NO: 496191 - RNA, 22 nt, Human
aguucuuuccucuuguuagccc

SEQ ID NO: 496192 - RNA, 18 nt, Human
auacagauugcucaagga

SEQ ID NO: 496193 - RNA, 20 nt, Human
auagaauaucugcaucuaca

SEQ ID NO: 496194 - RNA, 25 nt, Human
aucagauuauuuccauuaugucaau

SEQ ID NO: 496195 - RNA, 20 nt, Human
augaauggcacagggcaaaa

SEQ ID NO: 496196 - RNA, 24 nt, Human
auucaaaacacaacagaaguuaac

SEQ ID NO: 496197 - RNA, 22 nt, Human
auucacuggaaagaacaaaccu

SEQ ID NO: 496198 - RNA, 24 nt, Human
caaaacaaaaacaugcagagugcu

SEQ ID NO: 496199 - RNA, 21 nt, Human
caaaauacaauuucugcucua

SEQ ID NO: 496200 - RNA, 21 nt, Human
caacagauguacaaauagcaa

SEQ ID NO: 496201 - RNA, 21 nt, Human
caacauuacggcuugaggagu

SEQ ID NO: 496202 - RNA, 23 nt, Human
caccauaacuauaacuuaguccc

SEQ ID NO: 496203 - RNA, 22 nt, Human
cacccacuaaaaccacugcaaa

SEQ ID NO: 496204 - RNA, 25 nt, Human
caccgccccacgccccccgcggcac

SEQ ID NO: 496205 - RNA, 21 nt, Human
cacugaaguaaaacacaaaag

SEQ ID NO: 496206 - RNA, 20 nt, Human
cagacuccaaucuccucacu

SEQ ID NO: 496207 - RNA, 24 nt, Human
cagauccauucagacuccaaucuc

SEQ ID NO: 496208 - RNA, 20 nt, Human
cagcaaguucauccuccugu

SEQ ID NO: 496209 - RNA, 21 nt, Human
cagcaauauacuggugcugau

SEQ ID NO: 496210 - RNA, 20 nt, Human
cagcuccucagcaccgcccc

SEQ ID NO: 496211 - RNA, 19 nt, Human
caggugcccaucaguuucu

SEQ ID NO: 496212 - RNA, 24 nt, Human
caucaaaaaagggaaguuuuauca

SEQ ID NO: 496213 - RNA, 22 nt, Human
cauugcaccucaaaaguucugc

SEQ ID NO: 496214 - RNA, 24 nt, Human
ccaaaaaaaaaccaagcggguacu

SEQ ID NO: 496215 - RNA, 19 nt, Human
ccaaaggaaugaacaaucc

SEQ ID NO: 496216 - RNA, 21 nt, Human
ccaauaauggaugcuccccuc

SEQ ID NO: 496217 - RNA, 20 nt, Human
cccaaaggaaugaacaaucc

SEQ ID NO: 496218 - RNA, 25 nt, Human
cccaaguugccacuauuuaaaaagu

SEQ ID NO: 496219 - RNA, 21 nt, Human
ccccgaaaaacaaaacaaaaa

SEQ ID NO: 496220 - RNA, 22 nt, Human
ccccgaaaaacaaaacaaaaac

SEQ ID NO: 496221 - RNA, 22 nt, Human
cccgcggcacucugagccagcc

SEQ ID NO: 496222 - RNA, 21 nt, Human
ccgaaaaacaaaacaaaaaca

SEQ ID NO: 496223 - RNA, 20 nt, Human
ccucagcaccgccccacgcc

SEQ ID NO: 496224 - RNA, 21 nt, Human
ccugauaaagucguggcuacu

SEQ ID NO: 496225 - RNA, 20 nt, Human
cgaaaaacaaaacaaaaaca

SEQ ID NO: 496226 - RNA, 24 nt, Human
cgaaaaacaaaacaaaaacaugca

SEQ ID NO: 496227 - RNA, 24 nt, Human
cggcacucugagccagccgcagcc

SEQ ID NO: 496228 - RNA, 19 nt, Human
cggcucggcugcgcuccgc

SEQ ID NO: 496229 - RNA, 23 nt, Human
cggcugcgcuccgcgaacggcga

SEQ ID NO: 496230 - RNA, 19 nt, Human
cuagaauagagagcuuucc

SEQ ID NO: 496231 - RNA, 25 nt, Human
cuaucuacaaagcaauauagcaaaa

SEQ ID NO: 496232 - RNA, 23 nt, Human
cucagaaucucuuggaaaacaga

SEQ ID NO: 496233 - RNA, 24 nt, Human
cucuacaggaaggaguagccuguu

SEQ ID NO: 496234 - RNA, 18 nt, Human
cugauacaguagcaaucc

SEQ ID NO: 496235 - RNA, 22 nt, Human
cuggugcugauguuccaaagau

SEQ ID NO: 496236 - RNA, 20 nt, Human
cuugaggaaggucuugagaa

SEQ ID NO: 496237 - RNA, 19 nt, Human
cuuucauuugccuguucaa

SEQ ID NO: 496238 - RNA, 22 nt, Human
cuuugaauuaaaugcuuaaauu

SEQ ID NO: 496239 - RNA, 19 nt, Human
gaaaaacaaaacaaaaaca

SEQ ID NO: 496240 - RNA, 18 nt, Human
gaaaacgcucacucccuc

SEQ ID NO: 496241 - RNA, 21 nt, Human
gaauaucugcaucuacaucaa

SEQ ID NO: 496242 - RNA, 18 nt, Human
gaauggacacaaugguga

SEQ ID NO: 496243 - RNA, 19 nt, Human
gacaucucuuuuacaaacg

SEQ ID NO: 496244 - RNA, 19 nt, Human
gcaauccuuucauauacuc

SEQ ID NO: 496245 - RNA, 23 nt, Human
gcgagggcugcugcugcugcugc

SEQ ID NO: 496246 - RNA, 22 nt, Human
ggaaaagcguauucuuagggga

SEQ ID NO: 496247 - RNA, 22 nt, Human
gggcugcugcugcugcugcugc

SEQ ID NO: 496248 - RNA, 18 nt, Human
ggguaggggagguagcca

SEQ ID NO: 496249 - RNA, 20 nt, Human
gugaauggacacaaugguga

SEQ ID NO: 496250 - RNA, 18 nt, Human
uaaaaaaaaccccgaaaa

SEQ ID NO: 496251 - RNA, 20 nt, Human
uaaaaaaaaccccgaaaaac

SEQ ID NO: 496252 - RNA, 25 nt, Human
uaaaaaaaaccccgaaaaacaaaac

SEQ ID NO: 496253 - RNA, 23 nt, Human
uaaaaaguaggugaagaaugaua

SEQ ID NO: 496254 - RNA, 24 nt, Human
uaaaagacaacagaacuguauaga

SEQ ID NO: 496255 - RNA, 25 nt, Human
uaaaagcccacauguaccaauaaug

SEQ ID NO: 496256 - RNA, 25 nt, Human
uaaagaaaauacuccaauucuguuc

SEQ ID NO: 496257 - RNA, 21 nt, Human
uaaauacauagcaaaguuuua

SEQ ID NO: 496258 - RNA, 22 nt, Human
uaaauauuucuuguaccaugca

SEQ ID NO: 496259 - RNA, 22 nt, Human
uaaauugaaacaauauuucuga

SEQ ID NO: 496260 - RNA, 19 nt, Human
uaacugaauagugcaucuu

SEQ ID NO: 496261 - RNA, 21 nt, Human
uaagauaacuacuauaccuug

SEQ ID NO: 496262 - RNA, 25 nt, Human
uaaggcaaagaaucuuccugagcca

SEQ ID NO: 496263 - RNA, 23 nt, Human
uaauuaccaaaaaaaaaccaagc

SEQ ID NO: 496264 - RNA, 20 nt, Human
uacaggaaggaguagccugu

SEQ ID NO: 496265 - RNA, 24 nt, Human
uaccaaaaaaaaaccaagcgggua

SEQ ID NO: 496266 - RNA, 18 nt, Human
uaccaauaauggaugcuc

SEQ ID NO: 496267 - RNA, 21 nt, Human
uagcuaagucaacuaaaaauc

SEQ ID NO: 496268 - RNA, 30 nt, Human
uagcuaagucaacuaaaaaucaguuauguu

SEQ ID NO: 496269 - RNA, 18 nt, Human
uaggggaagacaugaaga

SEQ ID NO: 496270 - RNA, 23 nt, Human
uaggggagguagccaggguaaag

SEQ ID NO: 496271 - RNA, 18 nt, Human
uagucacaaucacagucu

SEQ ID NO: 496272 - RNA, 22 nt, Human
uauccaaaaugaaaauauuuga

SEQ ID NO: 496273 - RNA, 23 nt, Human
uauccaggauagacuaaauugaa

SEQ ID NO: 496274 - RNA, 24 nt, Human
uauguaguguugcucaacagaugu

SEQ ID NO: 496275 - RNA, 23 nt, Human
ucaaaaaaugcaguauacuuaua

SEQ ID NO: 496276 - RNA, 24 nt, Human
ucaauuaaaaaaaaccccgaaaaa

SEQ ID NO: 496277 - RNA, 25 nt, Human
ucaauuaaaaaaaaccccgaaaaac

SEQ ID NO: 496278 - RNA, 18 nt, Human
ucacaaucacagucuuug

SEQ ID NO: 496279 - RNA, 21 nt, Human
ucaccagaaagaaucccaagu

SEQ ID NO: 496280 - RNA, 18 nt, Human
uccaaagauaaaagaaaa

SEQ ID NO: 496281 - RNA, 19 nt, Human
uccaauucuguucaacauu

SEQ ID NO: 496282 - RNA, 19 nt, Human
ucuaaagugaaaaguuugu

SEQ ID NO: 496283 - RNA, 22 nt, Human
ucugucuucaucaaaaucacaa

SEQ ID NO: 496284 - RNA, 24 nt, Human
ucuuguuagcccuccaccucgcac

SEQ ID NO: 496285 - RNA, 21 nt, Human
ucuuucuuuuauauaggaugg

SEQ ID NO: 496286 - RNA, 22 nt, Human
ucuuucuuuuauauaggaugga

SEQ ID NO: 496287 - RNA, 18 nt, Human
ugaaccagauaaaucaua

SEQ ID NO: 496288 - RNA, 20 nt, Human
ugaaccagauaaaucauaca

SEQ ID NO: 496289 - RNA, 21 nt, Human
ugaacugucuaccaugaaaac

SEQ ID NO: 496290 - RNA, 19 nt, Human
ugaauagugcaucuuccuu

SEQ ID NO: 496291 - RNA, 23 nt, Human
ugagaaaacgcucacucccucua

SEQ ID NO: 496292 - RNA, 24 nt, Human
ugagaaauagcacuuccuauacaa

SEQ ID NO: 496293 - RNA, 18 nt, Human
ugcugcugcugcuucugc

SEQ ID NO: 496294 - RNA, 19 nt, Human
uggaaagaacaaaccucac

SEQ ID NO: 496295 - RNA, 20 nt, Human
uggagugucuccaaauuaaa

SEQ ID NO: 496296 - RNA, 21 nt, Human
uggagugucuccaaauuaaag

SEQ ID NO: 496297 - RNA, 22 nt, Human
uggaugcuccccucucuuugaa

SEQ ID NO: 496298 - RNA, 21 nt, Human
ugggguuaaagcauguugcug

SEQ ID NO: 496299 - RNA, 20 nt, Human
uggguuuaagggcacagaaa

SEQ ID NO: 496300 - RNA, 21 nt, Human
ugucuccaaauuaaagagagg

SEQ ID NO: 496301 - RNA, 22 nt, Human
uguuggaaaauuuaacuccagg

SEQ ID NO: 496302 - RNA, 22 nt, Human
uuaaaaaaaaccccgaaaaaca

SEQ ID NO: 496303 - RNA, 19 nt, Human
uuagagggauggccaggug

SEQ ID NO: 496304 - RNA, 24 nt, Human
uuauuuuuuaauacaauagcugcc

SEQ ID NO: 496305 - RNA, 24 nt, Human
uucaaaaugaauuuucaucacugu

SEQ ID NO: 496306 - RNA, 20 nt, Human
uucagaaucaccagaaagaa

SEQ ID NO: 496307 - RNA, 25 nt, Human
uuccaaagauaaaagaaaauacagu

SEQ ID NO: 496308 - RNA, 23 nt, Human
uuccuuagguuaauuucuguguu

SEQ ID NO: 496309 - RNA, 21 nt, Human
uugacuauuuauaaaggaugg

SEQ ID NO: 496310 - RNA, 21 nt, Human
uugcugggucguccuuuuuac

SEQ ID NO: 496311 - RNA, 21 nt, Human
uuuccauuucauuugacuaac

SEQ ID NO: 496312 - RNA, 19 nt, Human
uuugacaaacccacccuuc

SEQ ID NO: 496313 - RNA, 24 nt, Human
uuugaguuucaaaaugaauuuuca

SEQ ID NO: 496314 - RNA, 23 nt, Human
aaaaaccacucauugguaagcac

SEQ ID NO: 496315 - RNA, 22 nt, Human
aacacugcuccccuccccuccc

SEQ ID NO: 496316 - RNA, 23 nt, Human
aagcaaaccccauggcugguaga

SEQ ID NO: 496317 - RNA, 19 nt, Human
aagcaagcaaaccccaugg

SEQ ID NO: 496318 - RNA, 20 nt, Human
aagcagcuuggagaaacugg

SEQ ID NO: 496319 - RNA, 22 nt, Human
aaguagugagacugaagcugug

SEQ ID NO: 496320 - RNA, 23 nt, Human
acaggcuacaguugaaucaggca

SEQ ID NO: 496321 - RNA, 22 nt, Human
acccaucucuccuccucccacu

SEQ ID NO: 496322 - RNA, 21 nt, Human
accuggcaguugagucagauu

SEQ ID NO: 496323 - RNA, 18 nt, Human
acucccauccacuuucuc

SEQ ID NO: 496324 - RNA, 23 nt, Human
acuccuaagcaagcaaaccccuu

SEQ ID NO: 496325 - RNA, 21 nt, Human
acucucucugucuccccuaau

SEQ ID NO: 496326 - RNA, 18 nt, Human
acucuuuugucuucaccc

SEQ ID NO: 496327 - RNA, 19 nt, Human
acugcuccccuccccuccc

SEQ ID NO: 496328 - RNA, 23 nt, Human
agaagaagcuaguggcaauccca

SEQ ID NO: 496329 - RNA, 19 nt, Human
agagaggaggguagaaaag

SEQ ID NO: 496330 - RNA, 20 nt, Human
agccagcucgguacuccucc

SEQ ID NO: 496331 - RNA, 22 nt, Human
agggacagcaugggccaggugc

SEQ ID NO: 496332 - RNA, 18 nt, Human
agguauggacagagagga

SEQ ID NO: 496333 - RNA, 21 nt, Human
agugguugaguccuucugcag

SEQ ID NO: 496334 - RNA, 24 nt, Human
aucaugagagaaggccuuuuuaaa

SEQ ID NO: 496335 - RNA, 23 nt, Human
auccacuuucucauagcucaaaa

SEQ ID NO: 496336 - RNA, 22 nt, Human
caacuacuccuaagcaagcaaa

SEQ ID NO: 496337 - RNA, 25 nt, Human
cacagucaaacccaggccuguaauc

SEQ ID NO: 496338 - RNA, 19 nt, Human
cacccaucucuccuccucc

SEQ ID NO: 496339 - RNA, 21 nt, Human
cagaugggucuacauuuuucu

SEQ ID NO: 496340 - RNA, 23 nt, Human
cagcaagaugaggcuugauuaua

SEQ ID NO: 496341 - RNA, 19 nt, Human
cagcaccugggccagcacu

SEQ ID NO: 496342 - RNA, 20 nt, Human
cagcaccugggccagcacuc

SEQ ID NO: 496343 - RNA, 18 nt, Human
cagcacucugcgcuccug

SEQ ID NO: 496344 - RNA, 23 nt, Human
cagcagcagcagcgcagcauucc

SEQ ID NO: 496345 - RNA, 20 nt, Human
cagcggggauggggcaaaau

SEQ ID NO: 496346 - RNA, 19 nt, Human
caggucgugggagcaacaa

SEQ ID NO: 496347 - RNA, 22 nt, Human
ccagaugcucacaugaaaagga

SEQ ID NO: 496348 - RNA, 20 nt, Human
ccagggaacaucgaggcuca

SEQ ID NO: 496349 - RNA, 18 nt, Human
ccauggcugguagacccc

SEQ ID NO: 496350 - RNA, 19 nt, Human
cccagcggggcuccucuuc

SEQ ID NO: 496351 - RNA, 19 nt, Human
cccaugauaccagcaagau

SEQ ID NO: 496352 - RNA, 21 nt, Human
cccgagcagcggggucugaga

SEQ ID NO: 496353 - RNA, 22 nt, Human
cccgggccggggaggcgccacc

SEQ ID NO: 496354 - RNA, 18 nt, Human
cccuccccucccauccca

SEQ ID NO: 496355 - RNA, 18 nt, Human
ccgggccggggaggcgcc

SEQ ID NO: 496356 - RNA, 18 nt, Human
ccuguaaucaccucugaa

SEQ ID NO: 496357 - RNA, 20 nt, Human
ccuucugcagcggggauggg

SEQ ID NO: 496358 - RNA, 22 nt, Human
cgcccggggcuaccgucccggg

SEQ ID NO: 496359 - RNA, 21 nt, Human
cgccucaaggcagugauacag

SEQ ID NO: 496360 - RNA, 22 nt, Human
cgguguuuaauuuuucacaaaa

SEQ ID NO: 496361 - RNA, 19 nt, Human
cuacuccuaagcaagcaaa

SEQ ID NO: 496362 - RNA, 22 nt, Human
cucaagugacuuuccagucugg

SEQ ID NO: 496363 - RNA, 24 nt, Human
cucauagcucaaaaaccacucauu

SEQ ID NO: 496364 - RNA, 21 nt, Human
cuccuccucccacucccaucc

SEQ ID NO: 496365 - RNA, 18 nt, Human
cugcagcaccugggccag

SEQ ID NO: 496366 - RNA, 19 nt, Human
cugcagcaccugggccagc

SEQ ID NO: 496367 - RNA, 19 nt, Human
cugcuccccuccccuccca

SEQ ID NO: 496368 - RNA, 23 nt, Human
gacacccaaguccauagccagcu

SEQ ID NO: 496369 - RNA, 22 nt, Human
gaccccguggguauuuuggcau

SEQ ID NO: 496370 - RNA, 24 nt, Human
gaugccaccaguccaagacuuaga

SEQ ID NO: 496371 - RNA, 20 nt, Human
gccaauuuccuuuucuggca

SEQ ID NO: 496372 - RNA, 27 nt, Human
ggagcgaagccgggaggaggcggggaa

SEQ ID NO: 496373 - RNA, 18 nt, Human
ggagucuuaggggagugg

SEQ ID NO: 496374 - RNA, 19 nt, Human
gggcuccucuucagggcgg

SEQ ID NO: 496375 - RNA, 19 nt, Human
gguacuccuccauucacuc

SEQ ID NO: 496376 - RNA, 20 nt, Human
uaagaaggaugaagauggcg

SEQ ID NO: 496377 - RNA, 19 nt, Human
uacccauuacaggcuacag

SEQ ID NO: 496378 - RNA, 20 nt, Human
uagugcccaauaaccagagu

SEQ ID NO: 496379 - RNA, 24 nt, Human
ucaacacugcuccccuccccuccc

SEQ ID NO: 496380 - RNA, 23 nt, Human
ucaccucugaaacaacuacuccu

SEQ ID NO: 496381 - RNA, 22 nt, Human
ucagggcgguguuuaauuuuuc

SEQ ID NO: 496382 - RNA, 19 nt, Human
uccacuuucucauagcuca

SEQ ID NO: 496383 - RNA, 20 nt, Human
ucccaugauaccagcaagau

SEQ ID NO: 496384 - RNA, 18 nt, Human
uccuaagcaagcaaaccc

SEQ ID NO: 496385 - RNA, 22 nt, Human
uccuccucccacucccauccac

SEQ ID NO: 496386 - RNA, 21 nt, Human
ucucaagugacuuuccagucu

SEQ ID NO: 496387 - RNA, 19 nt, Human
ucuccaacacugacugacc

SEQ ID NO: 496388 - RNA, 18 nt, Human
ucucuccuccucccacuc

SEQ ID NO: 496389 - RNA, 24 nt, Human
ucucuuucuaagaaggaugaagau

SEQ ID NO: 496390 - RNA, 21 nt, Human
ucugcagcaccugggccagca

SEQ ID NO: 496391 - RNA, 18 nt, Human
ucugcagcggggaugggg

SEQ ID NO: 496392 - RNA, 22 nt, Human
ugacugaccccaaacaugcuga

SEQ ID NO: 496393 - RNA, 25 nt, Human
ugacugaccccaaacaugcugagcu

SEQ ID NO: 496394 - RNA, 23 nt, Human
ugagcccagaucaggcuggccgg

SEQ ID NO: 496395 - RNA, 20 nt, Human
ugagcccagaucaggcuggg

SEQ ID NO: 496396 - RNA, 22 nt, Human
ugauauuggcagaagaagcuag

SEQ ID NO: 496397 - RNA, 20 nt, Human
ugauuauaaaaagugcgccu

SEQ ID NO: 496398 - RNA, 20 nt, Human
ugcagcaccugggccagcac

SEQ ID NO: 496399 - RNA, 18 nt, Human
ugcccggaggugucacag

SEQ ID NO: 496400 - RNA, 20 nt, Human
ugcccggaggugucacagga

SEQ ID NO: 496401 - RNA, 20 nt, Human
uggccuuguagguauggaca

SEQ ID NO: 496402 - RNA, 20 nt, Human
uggcugguagaccccguggg

SEQ ID NO: 496403 - RNA, 27 nt, Human
ugucuucacccaucucuccuccuccca

SEQ ID NO: 496404 - RNA, 21 nt, Human
ugugggcucuccaacacugac

SEQ ID NO: 496405 - RNA, 19 nt, Human
uucacccaucucuccuccu

SEQ ID NO: 496406 - RNA, 28 nt, Human
uucaccuggcaguugagucccgaguacg

SEQ ID NO: 496407 - RNA, 28 nt, Human
uuguccuuggccuuguaggucgguuccg

SEQ ID NO: 496408 - RNA, 24 nt, Human
uugucuucacccaucucuccuccu

SEQ ID NO: 496409 - RNA, 21 nt, Human
uuugccagacacccaagucca

SEQ ID NO: 496410 - RNA, 29 nt, Human
uuuguccuuggccuuguaggucgguuccg

SEQ ID NO: 496411 - RNA, 18 nt, Human
uuuucuggcagggccugg

SEQ ID NO: 496412 - RNA, 18 nt, Human
uuuuuuuuuuuuucaccu

SEQ ID NO: 496413 - RNA, 26 nt, Human
uuuuuuuuuuuuucaccuggcaguug

SEQ ID NO: 496414 - RNA, 24 nt, Human
uuuuuuuuuuuuuuuucaccugau

SEQ ID NO: 496415 - RNA, 22 nt, Human
uuuuuuuuuuuuuuuuucaccu

SEQ ID NO: 496416 - RNA, 24 nt, Human
uuuuuuuuuuuuuuuuucaccugg

SEQ ID NO: 496417 - RNA, 19 nt, Human
aaauguccuucuuuacacc

SEQ ID NO: 496418 - RNA, 18 nt, Human
aaccucaagcaucuucuc

SEQ ID NO: 496419 - RNA, 21 nt, Human
agaagaaaaacaggcucucaa

SEQ ID NO: 496420 - RNA, 20 nt, Human
agagaagaaaaacaggcucu

SEQ ID NO: 496421 - RNA, 19 nt, Human
auaagacagaaaacagccc

SEQ ID NO: 496422 - RNA, 27 nt, Human
augaaauuguguguguguguguguggu

SEQ ID NO: 496423 - RNA, 21 nt, Human
caagagguccccucaccagug

SEQ ID NO: 496424 - RNA, 19 nt, Human
caccagugcuuuaaaauaa

SEQ ID NO: 496425 - RNA, 23 nt, Human
cacuccuuaaaaucuaaccucaa

SEQ ID NO: 496426 - RNA, 24 nt, Human
cucaagcaucuucucuggcacugc

SEQ ID NO: 496427 - RNA, 24 nt, Human
gaccaguuuuuuaaaaauugaagg

SEQ ID NO: 496428 - RNA, 21 nt, Human
gagguccccucaccagugcuu

SEQ ID NO: 496429 - RNA, 21 nt, Human
gugugugugugugugugugug

SEQ ID NO: 496430 - RNA, 21 nt, Human
gugugugugugugugugugug

SEQ ID NO: 496431 - RNA, 24 nt, Human
uaaaauguccuucuuuacacccuc

SEQ ID NO: 496432 - RNA, 25 nt, Human
uaaaauguccuucuuuacacccuuc

SEQ ID NO: 496433 - RNA, 25 nt, Human
uaaccucaagcaucuucucuggcac

SEQ ID NO: 496434 - RNA, 23 nt, Human
uaggugugucucauuuuguaauu

SEQ ID NO: 496435 - RNA, 24 nt, Human
uauaugaaugaaauugugugugug

SEQ ID NO: 496436 - RNA, 20 nt, Human
uaugaaugaaauugugugug

SEQ ID NO: 496437 - RNA, 22 nt, Human
ucuguguaugaucauccaggaa

SEQ ID NO: 496438 - RNA, 26 nt, Human
ugaaauugugugugugugugugugug

SEQ ID NO: 496439 - RNA, 22 nt, Human
ugcaauaccauauaugaaugaa

SEQ ID NO: 496440 - RNA, 18 nt, Human
ugugugugugugugugug

SEQ ID NO: 496441 - RNA, 18 nt, Human
ugugugugugugugugug

SEQ ID NO: 496442 - RNA, 18 nt, Human
ugugugugugugugugug

SEQ ID NO: 496443 - RNA, 18 nt, Human
ugugugugugugugugug

SEQ ID NO: 496444 - RNA, 18 nt, Human
ugugugugugugugugug

SEQ ID NO: 496445 - RNA, 18 nt, Human
ugugugugugugugugug

SEQ ID NO: 496446 - RNA, 18 nt, Human
ugugugugugugugugug

SEQ ID NO: 496447 - RNA, 18 nt, Human
ugugugugugugugugug

SEQ ID NO: 496448 - RNA, 18 nt, Human
ugugugugugugugugug

SEQ ID NO: 496449 - RNA, 18 nt, Human
ugugugugugugugugug

SEQ ID NO: 496450 - RNA, 20 nt, Human
ugugugugugugugugugug

SEQ ID NO: 496451 - RNA, 21 nt, Human
ugugugugugugugugugugu

SEQ ID NO: 496452 - RNA, 21 nt, Human
ugugugugugugugugugugu

SEQ ID NO: 496453 - RNA, 21 nt, Human
ugugugugugugugugugugu

SEQ ID NO: 496454 - RNA, 21 nt, Human
ugugugugugugugugugugu

SEQ ID NO: 496455 - RNA, 21 nt, Human
ugugugugugugugugugugu

SEQ ID NO: 496456 - RNA, 21 nt, Human
ugugugugugugugugugugu

SEQ ID NO: 496457 - RNA, 21 nt, Human
ugugugugugugugugugugu

SEQ ID NO: 496458 - RNA, 21 nt, Human
ugugugugugugugugugugu

SEQ ID NO: 496459 - RNA, 21 nt, Human
ugugugugugugugugugugu

SEQ ID NO: 496460 - RNA, 21 nt, Human
ugugugugugugugugugugu

SEQ ID NO: 496461 - RNA, 21 nt, Human
ugugugugugugugugugugu

SEQ ID NO: 496462 - RNA, 21 nt, Human
ugugugugugugugugugugu

SEQ ID NO: 496463 - RNA, 21 nt, Human
ugugugugugugugugugugu

SEQ ID NO: 496464 - RNA, 21 nt, Human
ugugugugugugugugugugu

SEQ ID NO: 496465 - RNA, 21 nt, Human
ugugugugugugugugugugu

SEQ ID NO: 496466 - RNA, 21 nt, Human
ugugugugugugugugugugu

SEQ ID NO: 496467 - RNA, 21 nt, Human
ugugugugugugugugugugu

SEQ ID NO: 496468 - RNA, 22 nt, Human
ugugugugugugugugugugug

SEQ ID NO: 496469 - RNA, 22 nt, Human
ugugugugugugugugugugug

SEQ ID NO: 496470 - RNA, 22 nt, Human
ugugugugugugugugugugug

SEQ ID NO: 496471 - RNA, 22 nt, Human
ugugugugugugugugugugug

SEQ ID NO: 496472 - RNA, 22 nt, Human
ugugugugugugugugugugug

SEQ ID NO: 496473 - RNA, 22 nt, Human
ugugugugugugugugugugug

SEQ ID NO: 496474 - RNA, 22 nt, Human
ugugugugugugugugugugug

SEQ ID NO: 496475 - RNA, 23 nt, Human
uguguguguguguguguguguug

SEQ ID NO: 496476 - RNA, 19 nt, Human
uguuuucguauccuugcuc

SEQ ID NO: 496477 - RNA, 23 nt, Human
uucucuggcacugcggugcccaa

SEQ ID NO: 496478 - RNA, 23 nt, Human
uuuaaaauaucaagauaggugug

SEQ ID NO: 496479 - RNA, 18 nt, Human
aaggaccucaugauuggg

SEQ ID NO: 496480 - RNA, 25 nt, Human
agacgccgacagggggugggggcgg

SEQ ID NO: 496481 - RNA, 22 nt, Human
agagaaggggacgaggcccaga

SEQ ID NO: 496482 - RNA, 18 nt, Human
aggauuugagauccccuc

SEQ ID NO: 496483 - RNA, 22 nt, Human
aggcaagggagacagagagaag

SEQ ID NO: 496484 - RNA, 18 nt, Human
aggggacgaggcccagac

SEQ ID NO: 496485 - RNA, 19 nt, Human
aggggcaguguuuguuaau

SEQ ID NO: 496486 - RNA, 22 nt, Human
agucaugcugaguuuggggaca

SEQ ID NO: 496487 - RNA, 23 nt, Human
aucugcucugagggguuggggau

SEQ ID NO: 496488 - RNA, 19 nt, Human
caaggaccucaugauuggg

SEQ ID NO: 496489 - RNA, 24 nt, Human
cagcgcuggggaccaaaguggaga

SEQ ID NO: 496490 - RNA, 22 nt, Human
cauggggucuguauuugggggu

SEQ ID NO: 496491 - RNA, 24 nt, Human
cauuggggucuucuaggggcugua

SEQ ID NO: 496492 - RNA, 21 nt, Human
ccaggacuguuuuggugucug

SEQ ID NO: 496493 - RNA, 23 nt, Human
ccagguccgcccuggacccccug

SEQ ID NO: 496494 - RNA, 25 nt, Human
ccauaccaggcacaaggaccucaug

SEQ ID NO: 496495 - RNA, 22 nt, Human
ccccagguccgcccuggacccc

SEQ ID NO: 496496 - RNA, 19 nt, Human
cccuggacccccugggccu

SEQ ID NO: 496497 - RNA, 21 nt, Human
ccgcccuggacccccugggcc

SEQ ID NO: 496498 - RNA, 22 nt, Human
ccucaugauuggguuuccuggg

SEQ ID NO: 496499 - RNA, 23 nt, Human
ccuguaauuagcacuuccaggac

SEQ ID NO: 496500 - RNA, 21 nt, Human
ccuucagguucucccucgagc

SEQ ID NO: 496501 - RNA, 20 nt, Human
cgacagggggugggggcgga

SEQ ID NO: 496502 - RNA, 20 nt, Human
cgagggcuggcuaacagggg

SEQ ID NO: 496503 - RNA, 19 nt, Human
cgcccuggacccccugggc

SEQ ID NO: 496504 - RNA, 20 nt, Human
cgcuggggaccaaaguggag

SEQ ID NO: 496505 - RNA, 19 nt, Human
cucuuggaauuuggugucu

SEQ ID NO: 496506 - RNA, 20 nt, Human
cugcucugagggguugggga

SEQ ID NO: 496507 - RNA, 23 nt, Human
cugugggccauguggggugggcu

SEQ ID NO: 496508 - RNA, 24 nt, Human
gacagcgcuggggaccaaagugga

SEQ ID NO: 496509 - RNA, 21 nt, Human
gagaugcuaguggggacucug

SEQ ID NO: 496510 - RNA, 24 nt, Human
gagggguuggggauagggacuagc

SEQ ID NO: 496511 - RNA, 23 nt, Human
gagucaugcugaguuuggggaca

SEQ ID NO: 496512 - RNA, 19 nt, Human
gcccuggacccccugggcc

SEQ ID NO: 496513 - RNA, 21 nt, Human
gcccuggacccccugggccuu

SEQ ID NO: 496514 - RNA, 19 nt, Human
gcuggggaccaaaguggag

SEQ ID NO: 496515 - RNA, 18 nt, Human
ggaaaucuguuaaucugg

SEQ ID NO: 496516 - RNA, 25 nt, Human
ggaaaucuguuaaucugggaaucug

SEQ ID NO: 496517 - RNA, 18 nt, Human
ggagacagagagaagggg

SEQ ID NO: 496518 - RNA, 22 nt, Human
ggagaugcuaguggggacucug

SEQ ID NO: 496519 - RNA, 19 nt, Human
ggaggcaagggagacagag

SEQ ID NO: 496520 - RNA, 18 nt, Human
ggccagcacaggagcugg

SEQ ID NO: 496521 - RNA, 18 nt, Human
gggccauguggggugggc

SEQ ID NO: 496522 - RNA, 20 nt, Human
gggcugguuaugguggguuu

SEQ ID NO: 496523 - RNA, 20 nt, Human
ggggacgaggcccagacgcc

SEQ ID NO: 496524 - RNA, 23 nt, Human
ggggauagggacuagccugaagg

SEQ ID NO: 496525 - RNA, 25 nt, Human
gggggcgggugcagaguugggggca

SEQ ID NO: 496526 - RNA, 21 nt, Human
ggguuucuugagggugcagag

SEQ ID NO: 496527 - RNA, 21 nt, Human
gugcagaggguaggaagacuu

SEQ ID NO: 496528 - RNA, 20 nt, Human
guuugggauccccagagucc

SEQ ID NO: 496529 - RNA, 20 nt, Human
uaagggcuucagggugacca

SEQ ID NO: 496530 - RNA, 23 nt, Human
uauccugacugcagucuccucca

SEQ ID NO: 496531 - RNA, 20 nt, Human
ucagggaaucucuuucuggg

SEQ ID NO: 496532 - RNA, 19 nt, Human
ucagggccuuggggccuuc

SEQ ID NO: 496533 - RNA, 25 nt, Human
uccagggaugggaauuccugugugg

SEQ ID NO: 496534 - RNA, 21 nt, Human
ucccuuagggcuggggcucuu

SEQ ID NO: 496535 - RNA, 24 nt, Human
ucuccaguuuccagggaugggaau

SEQ ID NO: 496536 - RNA, 19 nt, Human
ucuucuugagggauaagac

SEQ ID NO: 496537 - RNA, 22 nt, Human
ucuuugucagguguccagggcc

SEQ ID NO: 496538 - RNA, 25 nt, Human
ugaaugucuguuacucuuuugcuuu

SEQ ID NO: 496539 - RNA, 21 nt, Human
ugacaugaaugucuguuacuc

SEQ ID NO: 496540 - RNA, 18 nt, Human
ugacauggggucuguauu

SEQ ID NO: 496541 - RNA, 19 nt, Human
ugagaggacugauguuaaa

SEQ ID NO: 496542 - RNA, 21 nt, Human
ugagggcacaggggaguuugg

SEQ ID NO: 496543 - RNA, 18 nt, Human
ugaguuuggggacaugca

SEQ ID NO: 496544 - RNA, 20 nt, Human
ugcuaguggggacucugucu

SEQ ID NO: 496545 - RNA, 23 nt, Human
ugcugugggguccuuugaggcca

SEQ ID NO: 496546 - RNA, 23 nt, Human
ugggagccuggaaugcauauccu

SEQ ID NO: 496547 - RNA, 21 nt, Human
ugggauuggauuuucaaauuu

SEQ ID NO: 496548 - RNA, 27 nt, Human
uggggaacaaugacaugaaugucuggc

SEQ ID NO: 496549 - RNA, 24 nt, Human
uggggauagggacuagccugaagg

SEQ ID NO: 496550 - RNA, 18 nt, Human
uggggccuuccauuuauu

SEQ ID NO: 496551 - RNA, 22 nt, Human
uggggugggcuucauacaaggc

SEQ ID NO: 496552 - RNA, 18 nt, Human
uggggugucggugucagg

SEQ ID NO: 496553 - RNA, 18 nt, Human
uggugucuguaaauuagg

SEQ ID NO: 496554 - RNA, 19 nt, Human
uguaaugcauuauguggag

SEQ ID NO: 496555 - RNA, 19 nt, Human
ugugggagcaauggggugu

SEQ ID NO: 496556 - RNA, 19 nt, Human
ugugggguccuuugaggcc

SEQ ID NO: 496557 - RNA, 22 nt, Human
uuccagggaugggaauuccugu

SEQ ID NO: 496558 - RNA, 22 nt, Human
uuccagggaugggaauuccugu

SEQ ID NO: 496559 - RNA, 24 nt, Human
uuccagggaugggaauuccuguga

SEQ ID NO: 496560 - RNA, 22 nt, Human
uugagggguuggaaucuaaggg

SEQ ID NO: 496561 - RNA, 23 nt, Human
uuggggugauauggaaaucuguu

SEQ ID NO: 496562 - RNA, 18 nt, Human
uuuggggacaugcaguga

SEQ ID NO: 496563 - RNA, 20 nt, Human
uuugucagguguccagggcc

SEQ ID NO: 496564 - RNA, 19 nt, Human
uuuguuaaugaaggaaguc

SEQ ID NO: 496565 - RNA, 21 nt, Human
aaaaacacaaaaagaugagug

SEQ ID NO: 496566 - RNA, 20 nt, Human
aacccccacccccuacacuc

SEQ ID NO: 496567 - RNA, 24 nt, Human
acucaacuaauugucaaccagaaa

SEQ ID NO: 496568 - RNA, 18 nt, Human
agaacccccacccccuac

SEQ ID NO: 496569 - RNA, 18 nt, Human
aggauggacccgagaugg

SEQ ID NO: 496570 - RNA, 25 nt, Human
aggccaugauggaaagugggaggug

SEQ ID NO: 496571 - RNA, 25 nt, Human
auaaguccuuugacucauaaggccu

SEQ ID NO: 496572 - RNA, 19 nt, Human
aucuugacaaaguguaaaa

SEQ ID NO: 496573 - RNA, 19 nt, Human
augcauguccauauccauu

SEQ ID NO: 496574 - RNA, 24 nt, Human
cacagucuauucucucugaagcuu

SEQ ID NO: 496575 - RNA, 23 nt, Human
caggaccuauaauuuuaaacuuc

SEQ ID NO: 496576 - RNA, 18 nt, Human
cccccacccccuacacuc

SEQ ID NO: 496577 - RNA, 18 nt, Human
cguaaaugaaaaugaaaa

SEQ ID NO: 496578 - RNA, 20 nt, Human
cuagaacccccacccccuac

SEQ ID NO: 496579 - RNA, 21 nt, Human
cuagaacccccacccccuaca

SEQ ID NO: 496580 - RNA, 22 nt, Human
cuagaacccccacccccuacac

SEQ ID NO: 496581 - RNA, 22 nt, Human
cucuggcauuaacauucacagu

SEQ ID NO: 496582 - RNA, 23 nt, Human
gaaaauucgaaggccccccacaa

SEQ ID NO: 496583 - RNA, 19 nt, Human
gagugaguuaacagagcug

SEQ ID NO: 496584 - RNA, 24 nt, Human
gccuagaacccccacccccuacac

SEQ ID NO: 496585 - RNA, 22 nt, Human
gucuauucucucugaagcuugc

SEQ ID NO: 496586 - RNA, 20 nt, Human
uaaaugcauguccauaucca

SEQ ID NO: 496587 - RNA, 22 nt, Human
uagccuagaacccccacccccu

SEQ ID NO: 496588 - RNA, 23 nt, Human
ucaggccaugauggaaaguggga

SEQ ID NO: 496589 - RNA, 21 nt, Human
ucgaaggccccccacaacuau

SEQ ID NO: 496590 - RNA, 20 nt, Human
ucguuuuuguuuauuggcuu

SEQ ID NO: 496591 - RNA, 21 nt, Human
ucucucugaagcuugcuaccu

SEQ ID NO: 496592 - RNA, 22 nt, Human
ugacucauaaggccuucagcca

SEQ ID NO: 496593 - RNA, 22 nt, Human
ugccucuggcaaaucuuggcca

SEQ ID NO: 496594 - RNA, 23 nt, Human
ugcuucauuauaccucucuggca

SEQ ID NO: 496595 - RNA, 25 nt, Human
uguuaaacaggaccuauaauuuuaa

SEQ ID NO: 496596 - RNA, 21 nt, Human
uuccucuuccuccaggguuca

SEQ ID NO: 496597 - RNA, 25 nt, Human
uuuauaaaccuacuguaccaaucac

SEQ ID NO: 496598 - RNA, 19 nt, Human
uuuugccuuuucguuuuug

SEQ ID NO: 496599 - RNA, 23 nt, Human
uuuuuuuuugccuuuucguuuuu

SEQ ID NO: 496600 - RNA, 19 nt, Human
uuuuuuuuuuuuuuuugcc

SEQ ID NO: 496601 - RNA, 18 nt, Human
uuuuuuuuuuuuuuuuug

SEQ ID NO: 496602 - RNA, 25 nt, Human
uuuuuuuuuuuuuuuuuugccuuuu

SEQ ID NO: 496603 - RNA, 25 nt, Human
aagucacacaaauaaaaucugaaau

SEQ ID NO: 496604 - RNA, 21 nt, Human
acaaauggaugaaacauucug

SEQ ID NO: 496605 - RNA, 21 nt, Human
accaaaagacaaguccaugaa

SEQ ID NO: 496606 - RNA, 24 nt, Human
accaacuccaucuuuugguccaca

SEQ ID NO: 496607 - RNA, 19 nt, Human
auaaaaaccaacuccaucu

SEQ ID NO: 496608 - RNA, 25 nt, Human
aucaccucucauuaaggcugcaccc

SEQ ID NO: 496609 - RNA, 24 nt, Human
aucacuuugauugcagaauaucac

SEQ ID NO: 496610 - RNA, 20 nt, Human
caaaggaaaacggaggggaa

SEQ ID NO: 496611 - RNA, 21 nt, Human
caaccucagguucccagcagc

SEQ ID NO: 496612 - RNA, 23 nt, Human
cacaaauggaugaaacauucugu

SEQ ID NO: 496613 - RNA, 18 nt, Human
cacagcagugaacaagaa

SEQ ID NO: 496614 - RNA, 23 nt, Human
cacuugggugccaggagaaggga

SEQ ID NO: 496615 - RNA, 20 nt, Human
cacuuugauugcagaauauc

SEQ ID NO: 496616 - RNA, 22 nt, Human
cagcuccguuggcaaggcuggg

SEQ ID NO: 496617 - RNA, 19 nt, Human
cagcuuaggaaucaccucu

SEQ ID NO: 496618 - RNA, 20 nt, Human
caguccucagacaaaauaca

SEQ ID NO: 496619 - RNA, 24 nt, Human
ccagccccugcucgggcggccgag

SEQ ID NO: 496620 - RNA, 21 nt, Human
ccgccugaccugaggagugag

SEQ ID NO: 496621 - RNA, 23 nt, Human
ccgcugcguuuucuacgccgccc

SEQ ID NO: 496622 - RNA, 23 nt, Human
ccucagguucccagcagcuuagg

SEQ ID NO: 496623 - RNA, 19 nt, Human
ccuccgacgccaagccgcc

SEQ ID NO: 496624 - RNA, 24 nt, Human
ccugccgccccuuugacaaccuca

SEQ ID NO: 496625 - RNA, 22 nt, Human
cgccaagccgcccaaaccuccc

SEQ ID NO: 496626 - RNA, 19 nt, Human
cgcccaaaccucccgagcg

SEQ ID NO: 496627 - RNA, 22 nt, Human
cgcccaaaccucccgagcgcag

SEQ ID NO: 496628 - RNA, 21 nt, Human
cgccugaccugaggagugagc

SEQ ID NO: 496629 - RNA, 20 nt, Human
cggccgagggcuccgcggcg

SEQ ID NO: 496630 - RNA, 19 nt, Human
cucccggcuagaggaacug

SEQ ID NO: 496631 - RNA, 24 nt, Human
cugaaauggagguuggaaacucag

SEQ ID NO: 496632 - RNA, 20 nt, Human
cugagacagacaggcugaaa

SEQ ID NO: 496633 - RNA, 20 nt, Human
cuggaauuucuaagucacac

SEQ ID NO: 496634 - RNA, 19 nt, Human
gacagacaggcugaaaugg

SEQ ID NO: 496635 - RNA, 23 nt, Human
gcacagcagugaacaagauaccc

SEQ ID NO: 496636 - RNA, 23 nt, Human
gcccgcggccccuucugcagcca

SEQ ID NO: 496637 - RNA, 22 nt, Human
ggguggggcucuccuccgacgc

SEQ ID NO: 496638 - RNA, 22 nt, Human
uaaaacauaaaccccaugacaa

SEQ ID NO: 496639 - RNA, 28 nt, Human
uaaaccccaugacaaaggaaaacggagg

SEQ ID NO: 496640 - RNA, 21 nt, Human
uaaaguagcacagcagugaac

SEQ ID NO: 496641 - RNA, 19 nt, Human
uacaucauuauaccauucu

SEQ ID NO: 496642 - RNA, 20 nt, Human
uacaucauuauaccauucua

SEQ ID NO: 496643 - RNA, 19 nt, Human
uacucauguaaaguagcac

SEQ ID NO: 496644 - RNA, 20 nt, Human
uagcacagcagugaacaaga

SEQ ID NO: 496645 - RNA, 23 nt, Human
uauaccauucuaaaccugguauc

SEQ ID NO: 496646 - RNA, 20 nt, Human
uccaaccaaaagacaagucc

SEQ ID NO: 496647 - RNA, 24 nt, Human
ucgggggccagccacggcggugcc

SEQ ID NO: 496648 - RNA, 18 nt, Human
ugaggagugagcuccgcc

SEQ ID NO: 496649 - RNA, 22 nt, Human
ugauugcagaauaucacuggaa

SEQ ID NO: 496650 - RNA, 18 nt, Human
ugguccacaaauggauga

SEQ ID NO: 496651 - RNA, 20 nt, Human
uuuucagcuccuccaaccuc

SEQ ID NO: 496652 - RNA, 23 nt, Human
uuuuuuuuuugacauuuguuucu

SEQ ID NO: 496653 - RNA, 25 nt, Human
aaggugccccugcucucacuuucug

SEQ ID NO: 496654 - RNA, 22 nt, Human
acuagagugcaguggcuauuca

SEQ ID NO: 496655 - RNA, 24 nt, Human
agcugggauuacaagugcccgcca

SEQ ID NO: 496656 - RNA, 21 nt, Human
agguccagcucauagcaguuc

SEQ ID NO: 496657 - RNA, 18 nt, Human
aguagcugggauuacaag

SEQ ID NO: 496658 - RNA, 20 nt, Human
caaccuuaaacuccugggcu

SEQ ID NO: 496659 - RNA, 22 nt, Human
caagcaauucuccugccucagc

SEQ ID NO: 496660 - RNA, 21 nt, Human
caagugcccgccaccacgccu

SEQ ID NO: 496661 - RNA, 19 nt, Human
cacagcuaucagguccagc

SEQ ID NO: 496662 - RNA, 22 nt, Human
caccacgccuggucugccaaua

SEQ ID NO: 496663 - RNA, 19 nt, Human
ccccaggagcugccugggc

SEQ ID NO: 496664 - RNA, 21 nt, Human
ccucagccuugggaguagcug

SEQ ID NO: 496665 - RNA, 23 nt, Human
ccugccucagccuugggaguagc

SEQ ID NO: 496666 - RNA, 23 nt, Human
ccugggcucaagcaauucuccug

SEQ ID NO: 496667 - RNA, 24 nt, Human
cucaagcaauucuccugccucagc

SEQ ID NO: 496668 - RNA, 21 nt, Human
cucacuuucugcacagcuauc

SEQ ID NO: 496669 - RNA, 24 nt, Human
cucagccuugggaguagcugggau

SEQ ID NO: 496670 - RNA, 21 nt, Human
cuccugggcucaagcaauucu

SEQ ID NO: 496671 - RNA, 23 nt, Human
cuccugggcucaagcaauucucc

SEQ ID NO: 496672 - RNA, 23 nt, Human
cucucacuuucugcacagcuauc

SEQ ID NO: 496673 - RNA, 23 nt, Human
cugccucagccuugggaguagcu

SEQ ID NO: 496674 - RNA, 21 nt, Human
cuuacguagaaaaggugcccc

SEQ ID NO: 496675 - RNA, 18 nt, Human
cuucucaguugggucaag

SEQ ID NO: 496676 - RNA, 22 nt, Human
gggcucaagcaauucuccugcc

SEQ ID NO: 496677 - RNA, 18 nt, Human
guagcugggauuacaagu

SEQ ID NO: 496678 - RNA, 24 nt, Human
uaaacuccugggcucaagcaauuc

SEQ ID NO: 496679 - RNA, 22 nt, Human
uacaagugcccgccaccacgcc

SEQ ID NO: 496680 - RNA, 23 nt, Human
uauguuccccagacuagagugca

SEQ ID NO: 496681 - RNA, 21 nt, Human
uccacugccccaggagcugcc

SEQ ID NO: 496682 - RNA, 21 nt, Human
uccugggcucaagcaauucuc

SEQ ID NO: 496683 - RNA, 22 nt, Human
uccugggcucaagcaauucucc

SEQ ID NO: 496684 - RNA, 24 nt, Human
uccugggcucaagcaauucuccug

SEQ ID NO: 496685 - RNA, 22 nt, Human
ucuccugccucagccuugggag

SEQ ID NO: 496686 - RNA, 21 nt, Human
ugaccuuucuguuacagcuug

SEQ ID NO: 496687 - RNA, 21 nt, Human
ugggauuacaagugcccgcca

SEQ ID NO: 496688 - RNA, 22 nt, Human
ugggauuacaagugcccgccac

SEQ ID NO: 496689 - RNA, 24 nt, Human
ugggauuacaagugcccgccacca

SEQ ID NO: 496690 - RNA, 24 nt, Human
ugggcucaagcaauucuccugccu

SEQ ID NO: 496691 - RNA, 22 nt, Human
uguuccccagacuagagugcag

SEQ ID NO: 496692 - RNA, 32 nt, Human
uuuuuuuuuuuugagauggcaggggucucaac

SEQ ID NO: 496693 - RNA, 25 nt, Human
uuuuuuuuuuuuugagauggcaggg

SEQ ID NO: 496694 - RNA, 23 nt, Human
aagccugcgccaggaaucucugg

SEQ ID NO: 496695 - RNA, 24 nt, Human
acaauaaacgggguggauuccaaa

SEQ ID NO: 496696 - RNA, 23 nt, Human
accucacuguguggccucaacuc

SEQ ID NO: 496697 - RNA, 20 nt, Human
agaaaugcugagucccaggc

SEQ ID NO: 496698 - RNA, 23 nt, Human
agggagcccaguguuuucacuuu

SEQ ID NO: 496699 - RNA, 18 nt, Human
agggcugggacucugcag

SEQ ID NO: 496700 - RNA, 18 nt, Human
augcuggaacugucuaug

SEQ ID NO: 496701 - RNA, 19 nt, Human
cacaaggacagcgguccag

SEQ ID NO: 496702 - RNA, 19 nt, Human
cacuguguggccucaacuc

SEQ ID NO: 496703 - RNA, 21 nt, Human
cagacugaaggcuccuagggg

SEQ ID NO: 496704 - RNA, 21 nt, Human
cagccgggcucuuccucuguc

SEQ ID NO: 496705 - RNA, 22 nt, Human
cagccgggcucuuccucugucc

SEQ ID NO: 496706 - RNA, 20 nt, Human
cauagcucugacaaccugcu

SEQ ID NO: 496707 - RNA, 19 nt, Human
caugguggcugaaagcugg

SEQ ID NO: 496708 - RNA, 20 nt, Human
ccacacguuuacuuuuaaaa

SEQ ID NO: 496709 - RNA, 26 nt, Human
ccagcugcccccucuaaugcuuuucu

SEQ ID NO: 496710 - RNA, 19 nt, Human
cccacagacuccacauagc

SEQ ID NO: 496711 - RNA, 21 nt, Human
ccuccggaagcacaguagucc

SEQ ID NO: 496712 - RNA, 25 nt, Human
ccuggccucgaacucgcgaaccggc

SEQ ID NO: 496713 - RNA, 19 nt, Human
ccugucuggacucucacag

SEQ ID NO: 496714 - RNA, 20 nt, Human
ccugucuggacucucacagu

SEQ ID NO: 496715 - RNA, 24 nt, Human
cgaaaggcccccgccucacucuga

SEQ ID NO: 496716 - RNA, 18 nt, Human
cggcugccccugccaccc

SEQ ID NO: 496717 - RNA, 20 nt, Human
cgggguggauuccaaacguc

SEQ ID NO: 496718 - RNA, 22 nt, Human
cucagcucugaccuucucugac

SEQ ID NO: 496719 - RNA, 21 nt, Human
cuccacauagcucugacaacc

SEQ ID NO: 496720 - RNA, 24 nt, Human
cuccuaggggauuccagcaccacc

SEQ ID NO: 496721 - RNA, 23 nt, Human
cucugacaaccugcuuuccugaa

SEQ ID NO: 496722 - RNA, 21 nt, Human
cugagucccaggccggggccc

SEQ ID NO: 496723 - RNA, 18 nt, Human
cugugaugcuggaacugu

SEQ ID NO: 496724 - RNA, 21 nt, Human
gaaaggcccccgccucacucu

SEQ ID NO: 496725 - RNA, 23 nt, Human
gaacucgcgaaccggcagcucaa

SEQ ID NO: 496726 - RNA, 22 nt, Human
gagcuuguccagcugcccccuc

SEQ ID NO: 496727 - RNA, 21 nt, Human
gagucccaggccggggcccug

SEQ ID NO: 496728 - RNA, 22 nt, Human
gcacaguaguccccguguguca

SEQ ID NO: 496729 - RNA, 22 nt, Human
gccucguuccuggguccuuuca

SEQ ID NO: 496730 - RNA, 20 nt, Human
gcucuguuucucccagacug

SEQ ID NO: 496731 - RNA, 24 nt, Human
ggagcuuguccagcugcccccucu

SEQ ID NO: 496732 - RNA, 18 nt, Human
guugggagcuuguccagc

SEQ ID NO: 496733 - RNA, 22 nt, Human
uaaaaugcccuuuccgcaagga

SEQ ID NO: 496734 - RNA, 23 nt, Human
uagcucugacaaccugcuuuccu

SEQ ID NO: 496735 - RNA, 21 nt, Human
uaggggauuccagcaccacca

SEQ ID NO: 496736 - RNA, 18 nt, Human
uaucagaaaugcugaguc

SEQ ID NO: 496737 - RNA, 18 nt, Human
ucacucagcucugaccuu

SEQ ID NO: 496738 - RNA, 21 nt, Human
ucccagacugaaggcuccuag

SEQ ID NO: 496739 - RNA, 22 nt, Human
ucccaggccggggcccugcccc

SEQ ID NO: 496740 - RNA, 19 nt, Human
ucucacaguugcaggucuc

SEQ ID NO: 496741 - RNA, 22 nt, Human
ucucccagacugaaggcuccua

SEQ ID NO: 496742 - RNA, 26 nt, Human
ucuggcucuguuucucccagacugaa

SEQ ID NO: 496743 - RNA, 27 nt, Human
ugcccccucuaaugcuuuucuccucca

SEQ ID NO: 496744 - RNA, 22 nt, Human
ugccugcugagcuccuauucgu

SEQ ID NO: 496745 - RNA, 20 nt, Human
ugcuuccugucuggacucuc

SEQ ID NO: 496746 - RNA, 18 nt, Human
ugcuuuccugaacgccuc

SEQ ID NO: 496747 - RNA, 19 nt, Human
uggagcggcugccccugcc

SEQ ID NO: 496748 - RNA, 19 nt, Human
uggaggagcucccaggaag

SEQ ID NO: 496749 - RNA, 24 nt, Human
uggguacuuggaggagcucccagg

SEQ ID NO: 496750 - RNA, 25 nt, Human
uggguccuuucacccaccagaccuc

SEQ ID NO: 496751 - RNA, 23 nt, Human
ugucuggacucucacaguugcag

SEQ ID NO: 496752 - RNA, 23 nt, Human
uuccucugucccaugugauaucc

SEQ ID NO: 496753 - RNA, 21 nt, Human
uuccugaacgccucguuccug

SEQ ID NO: 496754 - RNA, 22 nt, Human
uuccuggguccuuucacccacc

SEQ ID NO: 496755 - RNA, 23 nt, Human
uugcaggucucuucuucugguuc

SEQ ID NO: 496756 - RNA, 19 nt, Human
aacaaacccuggccugccc

SEQ ID NO: 496757 - RNA, 21 nt, Human
aacccacccccucggcaacgc

SEQ ID NO: 496758 - RNA, 21 nt, Human
acagacagcgccuccacaaac

SEQ ID NO: 496759 - RNA, 21 nt, Human
acccccgcccaacccaccccc

SEQ ID NO: 496760 - RNA, 26 nt, Human
agagggacagacagcgccuccacaaa

SEQ ID NO: 496761 - RNA, 22 nt, Human
agcgccuccacaaacaaacccu

SEQ ID NO: 496762 - RNA, 21 nt, Human
agggaggggaggcgagggggc

SEQ ID NO: 496763 - RNA, 20 nt, Human
aggggggcccggccccaccc

SEQ ID NO: 496764 - RNA, 21 nt, Human
caaacaaacccuggccugccc

SEQ ID NO: 496765 - RNA, 27 nt, Human
caacccacccccucggcaacgcugcau

SEQ ID NO: 496766 - RNA, 19 nt, Human
cacccccgcccaacccacc

SEQ ID NO: 496767 - RNA, 21 nt, Human
cacccccgcccaacccacccc

SEQ ID NO: 496768 - RNA, 22 nt, Human
cacccccgcccaacccaccccc

SEQ ID NO: 496769 - RNA, 23 nt, Human
cagacagcgccuccacaaacaaa

SEQ ID NO: 496770 - RNA, 22 nt, Human
ccacaaacaaacccuggccugc

SEQ ID NO: 496771 - RNA, 20 nt, Human
ccagacuguguuaaagggcg

SEQ ID NO: 496772 - RNA, 19 nt, Human
cccaguggugcugggcugg

SEQ ID NO: 496773 - RNA, 26 nt, Human
cccccucggcaacgcugcaucagcuu

SEQ ID NO: 496774 - RNA, 22 nt, Human
ccccgcccaacccacccccucg

SEQ ID NO: 496775 - RNA, 18 nt, Human
ccccucggcaacgcugca

SEQ ID NO: 496776 - RNA, 22 nt, Human
cccgcccaacccacccccucgg

SEQ ID NO: 496777 - RNA, 21 nt, Human
cccggccccacccccgcccaa

SEQ ID NO: 496778 - RNA, 22 nt, Human
cccggccccacccccgcccaac

SEQ ID NO: 496779 - RNA, 21 nt, Human
cccugaccugaggcgggccuc

SEQ ID NO: 496780 - RNA, 19 nt, Human
cccuggccugccccggccc

SEQ ID NO: 496781 - RNA, 21 nt, Human
ccucccaccgccccggccuga

SEQ ID NO: 496782 - RNA, 23 nt, Human
ccugaucuguccagggaaagggc

SEQ ID NO: 496783 - RNA, 21 nt, Human
cggcaacgcugcaucagcuuc

SEQ ID NO: 496784 - RNA, 18 nt, Human
gagccggagcaggugagg

SEQ ID NO: 496785 - RNA, 23 nt, Human
gagccggagcaggugaggaccag

SEQ ID NO: 496786 - RNA, 19 nt, Human
gccccacccccgcccaacc

SEQ ID NO: 496787 - RNA, 21 nt, Human
gccuccacaaacaaacccugg

SEQ ID NO: 496788 - RNA, 19 nt, Human
gcuggaaacacagagggac

SEQ ID NO: 496789 - RNA, 22 nt, Human
ggaaacacagagggacagaggg

SEQ ID NO: 496790 - RNA, 18 nt, Human
ggccccacccccgcccaa

SEQ ID NO: 496791 - RNA, 20 nt, Human
gggacagagggacagacagc

SEQ ID NO: 496792 - RNA, 24 nt, Human
gggagugugguagggggacgaggg

SEQ ID NO: 496793 - RNA, 18 nt, Human
gggcccggccccaccccc

SEQ ID NO: 496794 - RNA, 18 nt, Human
gggcgacagggaggggag

SEQ ID NO: 496795 - RNA, 19 nt, Human
ggguaguggucgccaggag

SEQ ID NO: 496796 - RNA, 21 nt, Human
ggucuaggagggggagugugg

SEQ ID NO: 496797 - RNA, 19 nt, Human
uaggagggggaguguggua

SEQ ID NO: 496798 - RNA, 21 nt, Human
uccacaaacaaacccuggccu

SEQ ID NO: 496799 - RNA, 21 nt, Human
ucgccaggagccggagcaggu

SEQ ID NO: 496800 - RNA, 18 nt, Human
ugcugggcuggcagggcg

SEQ ID NO: 496801 - RNA, 22 nt, Human
uuuuuugaguuuaaguuaaaca

SEQ ID NO: 496802 - RNA, 24 nt, Human
uuuuuuuuuuuuuuuuuugaguuu

SEQ ID NO: 496803 - RNA, 20 nt, Human
uuuuuuuuuuuuuuuuuugg

SEQ ID NO: 496804 - RNA, 21 nt, Human
aaaacugaaccaaaauaaugu

SEQ ID NO: 496805 - RNA, 18 nt, Human
aucugauucuucuccuaa

SEQ ID NO: 496806 - RNA, 24 nt, Human
ccuuuaauaucagacuguagagac

SEQ ID NO: 496807 - RNA, 23 nt, Human
ggaaaagcuguauauacaagaca

SEQ ID NO: 496808 - RNA, 26 nt, Human
guuacaauuauauacaugaucugauu

SEQ ID NO: 496809 - RNA, 25 nt, Human
uaaaaaacugaaccaaaagacaagu

SEQ ID NO: 496810 - RNA, 23 nt, Human
uaauguacauuuuaucucuaaac

SEQ ID NO: 496811 - RNA, 21 nt, Human
uacaagacagcaauaugacag

SEQ ID NO: 496812 - RNA, 21 nt, Human
uauauacaagacagcaauaug

SEQ ID NO: 496813 - RNA, 23 nt, Human
uccaaugccuuuaauaucagacu

SEQ ID NO: 496814 - RNA, 24 nt, Human
ucuccuaaaggcuucucugaccau

SEQ ID NO: 496815 - RNA, 18 nt, Human
ugauauccaagauagauc

SEQ ID NO: 496816 - RNA, 21 nt, Human
ugugucauuaaaguccauaua

SEQ ID NO: 496817 - RNA, 23 nt, Human
uguuacaauuauauacaugaucu

SEQ ID NO: 496818 - RNA, 23 nt, Human
uuaaaaaacugaaccaaaauaau

SEQ ID NO: 496819 - RNA, 23 nt, Human
uuaaaguccauauaacaucuucc

SEQ ID NO: 496820 - RNA, 23 nt, Human
uucucugaccauguaugauaucc

SEQ ID NO: 496821 - RNA, 24 nt, Human
uuuaaagaauuuauuuucccauuu

SEQ ID NO: 496822 - RNA, 22 nt, Human
aagcagcagcgggcgguggccc

SEQ ID NO: 496823 - RNA, 19 nt, Human
agagaggggcucgcaggcg

SEQ ID NO: 496824 - RNA, 20 nt, Human
agaggggcucgcaggcggcc

SEQ ID NO: 496825 - RNA, 24 nt, Human
agcagcagcgggcgguggcccugg

SEQ ID NO: 496826 - RNA, 22 nt, Human
agccagggggacacaggcgggg

SEQ ID NO: 496827 - RNA, 18 nt, Human
aggccuccuucugcccaa

SEQ ID NO: 496828 - RNA, 18 nt, Human
agggggacacaggcgggg

SEQ ID NO: 496829 - RNA, 19 nt, Human
caaaagcagcagcgggcgg

SEQ ID NO: 496830 - RNA, 21 nt, Human
cacugcagggcaaagggggac

SEQ ID NO: 496831 - RNA, 20 nt, Human
cagcacaaaagcagcagcgg

SEQ ID NO: 496832 - RNA, 19 nt, Human
cagcagcgggcgguggccc

SEQ ID NO: 496833 - RNA, 21 nt, Human
caggccccggagcgcaaaggg

SEQ ID NO: 496834 - RNA, 21 nt, Human
cccaccggcccucaaccugcu

SEQ ID NO: 496835 - RNA, 18 nt, Human
ccccggagcgcaaagccu

SEQ ID NO: 496836 - RNA, 19 nt, Human
ccggcccucaaccugcugc

SEQ ID NO: 496837 - RNA, 21 nt, Human
ccucaaccugcugcucucaga

SEQ ID NO: 496838 - RNA, 18 nt, Human
ccuccgagcugcugccca

SEQ ID NO: 496839 - RNA, 19 nt, Human
ccuccuucugcccaagguc

SEQ ID NO: 496840 - RNA, 20 nt, Human
ccugcgucuccugcaccucg

SEQ ID NO: 496841 - RNA, 22 nt, Human
ccuuccucccagggggaggcag

SEQ ID NO: 496842 - RNA, 19 nt, Human
cugcucucagagcucgugg

SEQ ID NO: 496843 - RNA, 20 nt, Human
gagccuccgagcugcugccc

SEQ ID NO: 496844 - RNA, 19 nt, Human
gagcgcagccagggggaca

SEQ ID NO: 496845 - RNA, 25 nt, Human
gcagcagcgggcgguggcccugaag

SEQ ID NO: 496846 - RNA, 19 nt, Human
gccccggagcgcaaagccu

SEQ ID NO: 496847 - RNA, 18 nt, Human
ggucugaaggcagagagg

SEQ ID NO: 496848 - RNA, 19 nt, Human
uauuuagaucaaugcgggg

SEQ ID NO: 496849 - RNA, 25 nt, Human
ucagagcgcagccagggggacacag

SEQ ID NO: 496850 - RNA, 25 nt, Human
ucagagcucgugguccagagugcag

SEQ ID NO: 496851 - RNA, 25 nt, Human
ucuccugcaccucgcggagccuccg

SEQ ID NO: 496852 - RNA, 19 nt, Human
ugaaggcagagaggggcuc

SEQ ID NO: 496853 - RNA, 19 nt, Human
ugguccagagugcaggcag

SEQ ID NO: 496854 - RNA, 21 nt, Human
aagcagcugagacuccuaugc

SEQ ID NO: 496855 - RNA, 24 nt, Human
acuugaaaagaugucccucccagg

SEQ ID NO: 496856 - RNA, 20 nt, Human
agagagaggcacuccacaau

SEQ ID NO: 496857 - RNA, 21 nt, Human
agggauugaguuaggggaguu

SEQ ID NO: 496858 - RNA, 18 nt, Human
aucccaucucagguggcu

SEQ ID NO: 496859 - RNA, 25 nt, Human
cagcugagacuccuaugcugcagcc

SEQ ID NO: 496860 - RNA, 19 nt, Human
cccucucucaccaugcccc

SEQ ID NO: 496861 - RNA, 26 nt, Human
ccuaugcugcagccccguccuagaga

SEQ ID NO: 496862 - RNA, 21 nt, Human
ccucucucaccaugccccaac

SEQ ID NO: 496863 - RNA, 20 nt, Human
ccugcuaagacccucucuca

SEQ ID NO: 496864 - RNA, 22 nt, Human
ccugcuaagacccucucucacc

SEQ ID NO: 496865 - RNA, 24 nt, Human
ccuggaccuggauguaagcagcug

SEQ ID NO: 496866 - RNA, 22 nt, Human
cucaccaugccccaacacagcc

SEQ ID NO: 496867 - RNA, 20 nt, Human
gauuccucagucuggagagg

SEQ ID NO: 496868 - RNA, 19 nt, Human
guaucccaucucagguggc

SEQ ID NO: 496869 - RNA, 22 nt, Human
ucagucuggagaggaaaggaag

SEQ ID NO: 496870 - RNA, 19 nt, Human
uccacaaucagaacucuga

SEQ ID NO: 496871 - RNA, 21 nt, Human
uccacaaucagaacucugauu

SEQ ID NO: 496872 - RNA, 23 nt, Human
ugagacuccuaugcugcagcccc

SEQ ID NO: 496873 - RNA, 25 nt, Human
uggcugggccauuagugccauuucc

SEQ ID NO: 496874 - RNA, 18 nt, Human
uuuuuuuuuuuuuuuuug

SEQ ID NO: 496875 - RNA, 31 nt, Human; identical to SEQ ID NO: 314735

SEQ ID NO: 496876 - RNA, 22 nt, Human
aaaccgagguggccgggggcac

SEQ ID NO: 496877 - RNA, 21 nt, Human
aagcaaagcagcagggcuccu

SEQ ID NO: 496878 - RNA, 18 nt, Human
aagcagcagggcuccugg

SEQ ID NO: 496879 - RNA, 21 nt, Human
aagcagcagggcuccuggggg

SEQ ID NO: 496880 - RNA, 18 nt, Human
acacaguaccccccaucc

SEQ ID NO: 496881 - RNA, 22 nt, Human
acaugcacuaguuuggaaaaaa

SEQ ID NO: 496882 - RNA, 22 nt, Human
accaagcaaagcagcagggcuc

SEQ ID NO: 496883 - RNA, 25 nt, Human
accccgcaccccacaccaaauuagg

SEQ ID NO: 496884 - RNA, 23 nt, Human
acccgcuccuccuucuccacccc

SEQ ID NO: 496885 - RNA, 20 nt, Human
acccggcagcgggcgcgcgc

SEQ ID NO: 496886 - RNA, 18 nt, Human
acccggcgggaagagccc

SEQ ID NO: 496887 - RNA, 19 nt, Human
acccggggacccgcuccuc

SEQ ID NO: 496888 - RNA, 23 nt, Human
agaccugagcaggggcuggggcg

SEQ ID NO: 496889 - RNA, 22 nt, Human
agcacagccaccaguguccuca

SEQ ID NO: 496890 - RNA, 23 nt, Human
agcaggggcuggggcggggcugg

SEQ ID NO: 496891 - RNA, 21 nt, Human
agcagugcggcccaggacccu

SEQ ID NO: 496892 - RNA, 21 nt, Human
agcccggggcgggagcggcag

SEQ ID NO: 496893 - RNA, 24 nt, Human
agcggccgggaggggcccggggga

SEQ ID NO: 496894 - RNA, 21 nt, Human
agcugcugucggaggaggagu

SEQ ID NO: 496895 - RNA, 25 nt, Human
aggagagaacaggcuguuuuggaaa

SEQ ID NO: 496896 - RNA, 28 nt, Human
aggcagcggcagcaacuaagauggcggc

SEQ ID NO: 496897 - RNA, 22 nt, Human
aggggcccgggggacuguaucc

SEQ ID NO: 496898 - RNA, 21 nt, Human
aggggcuggggcggggcuggg

SEQ ID NO: 496899 - RNA, 19 nt, Human
aucguggacccuugggacu

SEQ ID NO: 496900 - RNA, 20 nt, Human
augcacuaguuuggaaaaaa

SEQ ID NO: 496901 - RNA, 23 nt, Human
auggcagggggugcucuggggag

SEQ ID NO: 496902 - RNA, 19 nt, Human
caaaaugauugcccaccug

SEQ ID NO: 496903 - RNA, 21 nt, Human
caccaagcaaagcagcagggc

SEQ ID NO: 496904 - RNA, 19 nt, Human
caccccacaccaaauuagg

SEQ ID NO: 496905 - RNA, 22 nt, Human
caccuacuggccgaaaugacuu

SEQ ID NO: 496906 - RNA, 23 nt, Human
cacuagcacaaaggacacaagga

SEQ ID NO: 496907 - RNA, 22 nt, Human
cagcaacuaagauggcggcggc

SEQ ID NO: 496908 - RNA, 18 nt, Human
cagcacagcuagaggccu

SEQ ID NO: 496909 - RNA, 22 nt, Human
cagggaccccgcaccccacacc

SEQ ID NO: 496910 - RNA, 22 nt, Human
caguagagguguugagaggggu

SEQ ID NO: 496911 - RNA, 18 nt, Human
cagugcggcccaggaccc

SEQ ID NO: 496912 - RNA, 22 nt, Human
cauagcacagccaccagugucc

SEQ ID NO: 496913 - RNA, 20 nt, Human
cauguaacuaagagcaaagu

SEQ ID NO: 496914 - RNA, 18 nt, Human
ccacacauagcacagcca

SEQ ID NO: 496915 - RNA, 21 nt, Human
ccacaccaaauuaggaacagg

SEQ ID NO: 496916 - RNA, 19 nt, Human
ccaccaagcaaagcagcag

SEQ ID NO: 496917 - RNA, 23 nt, Human
ccaccaguguccucagaacuagc

SEQ ID NO: 496918 - RNA, 19 nt, Human
ccagccauacucagaccug

SEQ ID NO: 496919 - RNA, 21 nt, Human
ccagucccggguuacacuagc

SEQ ID NO: 496920 - RNA, 21 nt, Human
ccccacaccaaauuaggaaca

SEQ ID NO: 496921 - RNA, 21 nt, Human
cccccagaaccucgggguccu

SEQ ID NO: 496922 - RNA, 22 nt, Human
ccccgccuggagcgcgcgcccg

SEQ ID NO: 496923 - RNA, 24 nt, Human
cccgaggacucauccuucccaccc

SEQ ID NO: 496924 - RNA, 21 nt, Human
cccgcuccgccgaggagcgca

SEQ ID NO: 496925 - RNA, 24 nt, Human
cccuacgcgcgcucccgggcuccu

SEQ ID NO: 496926 - RNA, 22 nt, Human
ccgagcccgucggccccgccug

SEQ ID NO: 496927 - RNA, 18 nt, Human
ccgccgccgccgccgccg

SEQ ID NO: 496928 - RNA, 21 nt, Human
ccgccgccgccgccgccguga

SEQ ID NO: 496929 - RNA, 18 nt, Human
ccgccgccgccgugacgc

SEQ ID NO: 496930 - RNA, 21 nt, Human
ccgcuccuccuucuccacccc

SEQ ID NO: 496931 - RNA, 18 nt, Human
ccucaacuccgcgucccu

SEQ ID NO: 496932 - RNA, 20 nt, Human
ccuccugccgucuccaaaaa

SEQ ID NO: 496933 - RNA, 21 nt, Human
ccucgggguccucgucucccc

SEQ ID NO: 496934 - RNA, 25 nt, Human
ccucgggguccucgucuccccagua

SEQ ID NO: 496935 - RNA, 22 nt, Human
ccugagcaggggcuggggcggg

SEQ ID NO: 496936 - RNA, 26 nt, Human
ccuggccgcagauggagagccucaac

SEQ ID NO: 496937 - RNA, 24 nt, Human
ccuucccacccgcuccgccgagga

SEQ ID NO: 496938 - RNA, 20 nt, Human
cgaccaggcagagggugggc

SEQ ID NO: 496939 - RNA, 19 nt, Human
cgacgcgaggcgcgcgcgc

SEQ ID NO: 496940 - RNA, 21 nt, Human
cgacgcgaggcgcgcgcgcgg

SEQ ID NO: 496941 - RNA, 19 nt, Human
cgagguggccgggggcacg

SEQ ID NO: 496942 - RNA, 20 nt, Human
cgccccccagaaccucgggg

SEQ ID NO: 496943 - RNA, 20 nt, Human
cgccccccagaaccucgggg

SEQ ID NO: 496944 - RNA, 23 nt, Human
cgccgccgccgccgccgugacgc

SEQ ID NO: 496945 - RNA, 19 nt, Human
cgccgugacgcugggccgc

SEQ ID NO: 496946 - RNA, 22 nt, Human
cgccuccgagcccgucggcccc

SEQ ID NO: 496947 - RNA, 23 nt, Human
cgcgcgcggcggacccugggagc

SEQ ID NO: 496948 - RNA, 20 nt, Human
cggagggagcgcgcgcggcg

SEQ ID NO: 496949 - RNA, 18 nt, Human
cggcagggaggcgcgcgg

SEQ ID NO: 496950 - RNA, 18 nt, Human
cggcggacccugggagcg

SEQ ID NO: 496951 - RNA, 21 nt, Human
cguucugaguacggaucgcuc

SEQ ID NO: 496952 - RNA, 21 nt, Human
cuacacaguaccccccauccu

SEQ ID NO: 496953 - RNA, 19 nt, Human
cuagaggccuguggccccc

SEQ ID NO: 496954 - RNA, 19 nt, Human
cucaacuccgcgucccuac

SEQ ID NO: 496955 - RNA, 19 nt, Human
cucagaccugagcaggggc

SEQ ID NO: 496956 - RNA, 19 nt, Human
cuccugggggagagggauu

SEQ ID NO: 496957 - RNA, 23 nt, Human
cucgggguccucgucuccuaagg

SEQ ID NO: 496958 - RNA, 19 nt, Human
cucucccucuggggucugg

SEQ ID NO: 496959 - RNA, 24 nt, Human
cucucggggcucuaggggccuggg

SEQ ID NO: 496960 - RNA, 21 nt, Human
cugcacacggugagaccaggc

SEQ ID NO: 496961 - RNA, 21 nt, Human
cuggccgcagauggagagccu

SEQ ID NO: 496962 - RNA, 19 nt, Human
cuggggccagcugcuccga

SEQ ID NO: 496963 - RNA, 21 nt, Human
cuggggcggggcugggcgggg

SEQ ID NO: 496964 - RNA, 27 nt, Human
cuggggcggggcugggcggggugggcc

SEQ ID NO: 496965 - RNA, 18 nt, Human
gaccccgcaccccacacc

SEQ ID NO: 496966 - RNA, 20 nt, Human
gacccgcuccuccuucucca

SEQ ID NO: 496967 - RNA, 21 nt, Human
gacccgcuccuccuucuccac

SEQ ID NO: 496968 - RNA, 24 nt, Human
gacccgcuccuccuucuccacccc

SEQ ID NO: 496969 - RNA, 23 nt, Human
gacucauccuucccacccgcucc

SEQ ID NO: 496970 - RNA, 20 nt, Human
gacuucgggccaugcgucuc

SEQ ID NO: 496971 - RNA, 20 nt, Human
gagcccgugcucagagcucc

SEQ ID NO: 496972 - RNA, 18 nt, Human
gagcggccgggaggggcc

SEQ ID NO: 496973 - RNA, 20 nt, Human
gaggaggaguguggaaaagg

SEQ ID NO: 496974 - RNA, 24 nt, Human
gaguguggaaaaggggccagggac

SEQ ID NO: 496975 - RNA, 26 nt, Human
gcaaagcagcagggcuccugggggag

SEQ ID NO: 496976 - RNA, 18 nt, Human
gccacugcccagggagcu

SEQ ID NO: 496977 - RNA, 21 nt, Human
gccacugcccagggagcugcu

SEQ ID NO: 496978 - RNA, 22 nt, Human
gccgcagauggagagccucaac

SEQ ID NO: 496979 - RNA, 19 nt, Human
gccgccgccgccgccgccg

SEQ ID NO: 496980 - RNA, 18 nt, Human
gccgugacgcugggccgc

SEQ ID NO: 496981 - RNA, 22 nt, Human
gccucucccucuggggucuggg

SEQ ID NO: 496982 - RNA, 24 nt, Human
gccuggagcgcgcgcccgcggggg

SEQ ID NO: 496983 - RNA, 18 nt, Human
gccuggggccagcugcuc

SEQ ID NO: 496984 - RNA, 19 nt, Human
gcgcggcggacccugggag

SEQ ID NO: 496985 - RNA, 19 nt, Human
gcggacccggcagcgggcg

SEQ ID NO: 496986 - RNA, 19 nt, Human
gcggcgggaggggcgggga

SEQ ID NO: 496987 - RNA, 22 nt, Human
gcggggcugggcggggugggcc

SEQ ID NO: 496988 - RNA, 18 nt, Human
ggacgcggcgcccucccc

SEQ ID NO: 496989 - RNA, 20 nt, Human
ggagcugcugucggaggagg

SEQ ID NO: 496990 - RNA, 26 nt, Human
ggaggccccugugcgagccggauggc

SEQ ID NO: 496991 - RNA, 24 nt, Human
ggagugagcauguuuuacccuuug

SEQ ID NO: 496992 - RNA, 18 nt, Human
ggccgggugagcgguacc

SEQ ID NO: 496993 - RNA, 20 nt, Human
gggagggaggacccggcggg

SEQ ID NO: 496994 - RNA, 24 nt, Human
gggcggggcugggcggggugggcc

SEQ ID NO: 496995 - RNA, 23 nt, Human
gggcgggguggcggcgggagggg

SEQ ID NO: 496996 - RNA, 24 nt, Human
gggcgggguggcggcgggaggggc

SEQ ID NO: 496997 - RNA, 18 nt, Human
gggcucuaggggccuggg

SEQ ID NO: 496998 - RNA, 21 nt, Human
gggcugggcggggugggccuc

SEQ ID NO: 496999 - RNA, 20 nt, Human
gggcuggggcggggcugggc

SEQ ID NO: 497000 - RNA, 18 nt, Human
ggggagaggagcggaggg

SEQ ID NO: 497001 - RNA, 23 nt, Human
ggggaggagagaggagagaacag

SEQ ID NO: 497002 - RNA, 21 nt, Human
ggggcuggggcggggcugggc

SEQ ID NO: 497003 - RNA, 19 nt, Human
gggggcgggguggcggcgg

SEQ ID NO: 497004 - RNA, 22 nt, Human
gggguggcggcgggaggggcgg

SEQ ID NO: 497005 - RNA, 21 nt, Human
gggucuggggagggaggaccc

SEQ ID NO: 497006 - RNA, 20 nt, Human
gggugggagugagcauguuu

SEQ ID NO: 497007 - RNA, 21 nt, Human
ggucugcaggacaccucucag

SEQ ID NO: 497008 - RNA, 18 nt, Human
guggcccccgacucccag

SEQ ID NO: 497009 - RNA, 23 nt, Human
uaagcauaaaccacaaggcugca

SEQ ID NO: 497010 - RNA, 21 nt, Human
uaaggccgggugagcgguacc

SEQ ID NO: 497011 - RNA, 22 nt, Human
uacacaguaccccccauccugg

SEQ ID NO: 497012 - RNA, 22 nt, Human
uagcacagccaccaguguccuc

SEQ ID NO: 497013 - RNA, 21 nt, Human
uagcagucagggucacagaac

SEQ ID NO: 497014 - RNA, 18 nt, Human
uaggggccuggggccagc

SEQ ID NO: 497015 - RNA, 21 nt, Human
uauuaaaaagucaguuaauca

SEQ ID NO: 497016 - RNA, 21 nt, Human
uccucgucuccccaguagagg

SEQ ID NO: 497017 - RNA, 22 nt, Human
uccugcccuaccaccaagcaaa

SEQ ID NO: 497018 - RNA, 22 nt, Human
ucgggguccucgucuccccagu

SEQ ID NO: 497019 - RNA, 24 nt, Human
ucuccugcccuaccaccaagcaaa

SEQ ID NO: 497020 - RNA, 23 nt, Human
ucucucucggguccggcgagggu

SEQ ID NO: 497021 - RNA, 20 nt, Human
ucuggggaggagagaggagg

SEQ ID NO: 497022 - RNA, 18 nt, Human
ucuggggagggaggaccc

SEQ ID NO: 497023 - RNA, 25 nt, Human
ugaaggcagcggcagcaacuaagau

SEQ ID NO: 497024 - RNA, 18 nt, Human
ugagaccaggccacugcc

SEQ ID NO: 497025 - RNA, 19 nt, Human
ugagaccaggccacugccc

SEQ ID NO: 497026 - RNA, 21 nt, Human
ugagaggggucacgaaagggg

SEQ ID NO: 497027 - RNA, 18 nt, Human
ugaguauacacaucugcg

SEQ ID NO: 497028 - RNA, 26 nt, Human
ugauggcagggggugcucuggggagg

SEQ ID NO: 497029 - RNA, 21 nt, Human
ugcccagggagcugcugucgg

SEQ ID NO: 497030 - RNA, 22 nt, Human
ugcggcccaggacccuugucac

SEQ ID NO: 497031 - RNA, 20 nt, Human
uggcagggggugcucugggg

SEQ ID NO: 497032 - RNA, 19 nt, Human
uggcccccgacucccagcc

SEQ ID NO: 497033 - RNA, 18 nt, Human
uggggaggagagaggaga

SEQ ID NO: 497034 - RNA, 24 nt, Human
uggggagggaggacccggcgggac

SEQ ID NO: 497035 - RNA, 20 nt, Human
uggggcggggcugggcgggg

SEQ ID NO: 497036 - RNA, 22 nt, Human
uggggcggggcugggcggggug

SEQ ID NO: 497037 - RNA, 18 nt, Human
ugucaacgagcccagcug

SEQ ID NO: 497038 - RNA, 19 nt, Human
uucaaccccccugauggca

SEQ ID NO: 497039 - RNA, 23 nt, Human
aaaggcucuccaagcuggggaac

SEQ ID NO: 497040 - RNA, 18 nt, Human
aagcaaccuggagucagc

SEQ ID NO: 497041 - RNA, 22 nt, Human
aagggaccauaaggcugagugg

SEQ ID NO: 497042 - RNA, 24 nt, Human
acaaacauguucucagagcuucgu

SEQ ID NO: 497043 - RNA, 18 nt, Human
acuccacccaccaugaag

SEQ ID NO: 497044 - RNA, 21 nt, Human
acuuagggcagaaguggaggc

SEQ ID NO: 497045 - RNA, 20 nt, Human
agaagaaagaagaagcugca

SEQ ID NO: 497046 - RNA, 22 nt, Human
agaccaguuacuauagaaacaa

SEQ ID NO: 497047 - RNA, 21 nt, Human
agagggaagauaggagauaag

SEQ ID NO: 497048 - RNA, 19 nt, Human
agcagaagaaagaagaagc

SEQ ID NO: 497049 - RNA, 20 nt, Human
aggaggagugaaggaugggg

SEQ ID NO: 497050 - RNA, 18 nt, Human
aggauggagauggaaaag

SEQ ID NO: 497051 - RNA, 20 nt, Human
agugaaggauggggacagag

SEQ ID NO: 497052 - RNA, 27 nt, Human
aguuacuauagaaacaauucucuucac

SEQ ID NO: 497053 - RNA, 20 nt, Human
auagaaacaauucucuucac

SEQ ID NO: 497054 - RNA, 20 nt, Human
auagacaugggcauacacug

SEQ ID NO: 497055 - RNA, 18 nt, Human
aucagacccugcuugugg

SEQ ID NO: 497056 - RNA, 20 nt, Human
augaagccuacguuugaccu

SEQ ID NO: 497057 - RNA, 22 nt, Human
augagcagaagaaagaagaagc

SEQ ID NO: 497058 - RNA, 24 nt, Human
caaaggcaaacucugcagacaggu

SEQ ID NO: 497059 - RNA, 21 nt, Human
cacagguugugcauguuagga

SEQ ID NO: 497060 - RNA, 19 nt, Human
cacccccacuccacccacc

SEQ ID NO: 497061 - RNA, 20 nt, Human
cacccccacuccacccacca

SEQ ID NO: 497062 - RNA, 20 nt, Human
cagccacccccacuccaccc

SEQ ID NO: 497063 - RNA, 20 nt, Human
caggaugcuggggaacuuag

SEQ ID NO: 497064 - RNA, 18 nt, Human
caggcucagauagcucug

SEQ ID NO: 497065 - RNA, 18 nt, Human
cagggagugcccaaggcu

SEQ ID NO: 497066 - RNA, 20 nt, Human
ccacaaaagaucacagacca

SEQ ID NO: 497067 - RNA, 19 nt, Human
ccacccccacuccacccac

SEQ ID NO: 497068 - RNA, 23 nt, Human
cccagccacccccacuccaccca

SEQ ID NO: 497069 - RNA, 24 nt, Human
cccagccacccccacuccacccac

SEQ ID NO: 497070 - RNA, 21 nt, Human
ccccacuccacccaccaugaa

SEQ ID NO: 497071 - RNA, 20 nt, Human
ccccagggccuuggggacuc

SEQ ID NO: 497072 - RNA, 21 nt, Human
ccccauggaugaaacacaggg

SEQ ID NO: 497073 - RNA, 21 nt, Human
ccuacguuugaccucauuagc

SEQ ID NO: 497074 - RNA, 18 nt, Human
ccuggagucagcauagga

SEQ ID NO: 497075 - RNA, 22 nt, Human
ccuguguggaaugccuccuggg

SEQ ID NO: 497076 - RNA, 23 nt, Human
ccuuggggacucugagccugggg

SEQ ID NO: 497077 - RNA, 27 nt, Human
ccuuuuaugagcagaagaaagaagaag

SEQ ID NO: 497078 - RNA, 22 nt, Human
cuagggaccagcucugugccug

SEQ ID NO: 497079 - RNA, 22 nt, Human
cucagaaagaagcaaggggaaa

SEQ ID NO: 497080 - RNA, 19 nt, Human
cucaggguccccucugucc

SEQ ID NO: 497081 - RNA, 20 nt, Human
cuccugggcccugugguucu

SEQ ID NO: 497082 - RNA, 25 nt, Human
cugggcccugugguucuguuugcug

SEQ ID NO: 497083 - RNA, 19 nt, Human
cuucacagguugugcaugu

SEQ ID NO: 497084 - RNA, 26 nt, Human
gaaaaaacaaaggcaaacucugcaga

SEQ ID NO: 497085 - RNA, 18 nt, Human
gaagcuggagaaggccuu

SEQ ID NO: 497086 - RNA, 24 nt, Human
gacaaagaggaaucagacauucga

SEQ ID NO: 497087 - RNA, 22 nt, Human
gacuguccuuguuguguguugu

SEQ ID NO: 497088 - RNA, 20 nt, Human
gagccuggggaggugaguga

SEQ ID NO: 497089 - RNA, 21 nt, Human
gagugacacaaaggugggccu

SEQ ID NO: 497090 - RNA, 23 nt, Human
gaugaaacacagggagugcccag

SEQ ID NO: 497091 - RNA, 22 nt, Human
gauugcaaauaugcuucuaauu

SEQ ID NO: 497092 - RNA, 19 nt, Human
gcaggcucagauagcucug

SEQ ID NO: 497093 - RNA, 22 nt, Human
gccccuggcaggguagcugcau

SEQ ID NO: 497094 - RNA, 21 nt, Human
gcuggagaaggccuucccaga

SEQ ID NO: 497095 - RNA, 24 nt, Human
ggaggugagugacacaaagguggg

SEQ ID NO: 497096 - RNA, 22 nt, Human
ggcagugccuguguggaaugcc

SEQ ID NO: 497097 - RNA, 19 nt, Human
gggcccugugguucuguuu

SEQ ID NO: 497098 - RNA, 19 nt, Human
ggugugagcuugaggagga

SEQ ID NO: 497099 - RNA, 19 nt, Human
gugaguuggaaccccaggg

SEQ ID NO: 497100 - RNA, 24 nt, Human
gugggcuccaggaagcuggagaag

SEQ ID NO: 497101 - RNA, 18 nt, Human
guuguguccuuguugucc

SEQ ID NO: 497102 - RNA, 22 nt, Human
uaauacaugcagaaagcgugua

SEQ ID NO: 497103 - RNA, 19 nt, Human
uacaggacaaagucuaccc

SEQ ID NO: 497104 - RNA, 23 nt, Human
uagguuuucagauauauuugccc

SEQ ID NO: 497105 - RNA, 20 nt, Human
uaucaaaaaaagaaagaaau

SEQ ID NO: 497106 - RNA, 20 nt, Human
uaucaaaaaaagaaagaaau

SEQ ID NO: 497107 - RNA, 29 nt, Human
uaucaaaaaaagaaagaaauuagguuuuc

SEQ ID NO: 497108 - RNA, 22 nt, Human
uauggccucagaaagaagcaag

SEQ ID NO: 497109 - RNA, 22 nt, Human
ucaaaaaaagaaagaaauuagg

SEQ ID NO: 497110 - RNA, 23 nt, Human
ucacagaccaguuacuauagaaa

SEQ ID NO: 497111 - RNA, 22 nt, Human
ucagacccugcuuguggccaag

SEQ ID NO: 497112 - RNA, 22 nt, Human
uccacccaccaugaagccuacg

SEQ ID NO: 497113 - RNA, 20 nt, Human
ucccugcaggaaaaaacaaa

SEQ ID NO: 497114 - RNA, 23 nt, Human
ucccugcaggaaaaaacaaaggc

SEQ ID NO: 497115 - RNA, 23 nt, Human
uccuuguugugacuguccuuguu

SEQ ID NO: 497116 - RNA, 22 nt, Human
ugacuguccuuguuguguguug

SEQ ID NO: 497117 - RNA, 19 nt, Human
ugacuguccuuguuguguu

SEQ ID NO: 497118 - RNA, 18 nt, Human
ugagccuggggaggugag

SEQ ID NO: 497119 - RNA, 20 nt, Human
ugagccuggggaggugagug

SEQ ID NO: 497120 - RNA, 19 nt, Human
ugaggaggagugaaggaug

SEQ ID NO: 497121 - RNA, 20 nt, Human
ugaggaggagugaaggaugg

SEQ ID NO: 497122 - RNA, 18 nt, Human
ugagugccccuggcaggg

SEQ ID NO: 497123 - RNA, 23 nt, Human
ugcaggaaaaaacaaaggcaaac

SEQ ID NO: 497124 - RNA, 22 nt, Human
ugccucaacaaggacuuuccuu

SEQ ID NO: 497125 - RNA, 18 nt, Human
ugcugggcuucuuggaac

SEQ ID NO: 497126 - RNA, 25 nt, Human
uggagucagcauaggagaaccuacu

SEQ ID NO: 497127 - RNA, 23 nt, Human
uggccucagaaagaagcaagggg

SEQ ID NO: 497128 - RNA, 25 nt, Human
uggggacucugagccuggggaggug

SEQ ID NO: 497129 - RNA, 20 nt, Human
uggugugagcuugaggagga

SEQ ID NO: 497130 - RNA, 19 nt, Human
ugugguucuguuugcugag

SEQ ID NO: 497131 - RNA, 20 nt, Human
uguguggaaugccuccuggg

SEQ ID NO: 497132 - RNA, 22 nt, Human
uguguguuguguuguguccuuu

SEQ ID NO: 497133 - RNA, 20 nt, Human
uucccugcaggaaaaaacaa

SEQ ID NO: 497134 - RNA, 22 nt, Human
uucuguuugcugagugccccug

SEQ ID NO: 497135 - RNA, 23 nt, Human
uugcaaauaugcuucuaauuccu

SEQ ID NO: 497136 - RNA, 23 nt, Human
uuguguccuuguuguccuuguug

SEQ ID NO: 497137 - RNA, 24 nt, Human
aaacuagaaaaagaucuagaaguu

SEQ ID NO: 497138 - RNA, 22 nt, Human
aacccagccagccccagugcaa

SEQ ID NO: 497139 - RNA, 21 nt, Human
acacacacacacauacacaca

SEQ ID NO: 497140 - RNA, 22 nt, Human
acacauacacacaaggccguga

SEQ ID NO: 497141 - RNA, 24 nt, Human
acaccaggucacggaggaggggcc

SEQ ID NO: 497142 - RNA, 18 nt, Human
acaggacaagaaaggaag

SEQ ID NO: 497143 - RNA, 21 nt, Human
acaggacaagaaaggaaggaa

SEQ ID NO: 497144 - RNA, 23 nt, Human
accaggucacggaggaggggccg

SEQ ID NO: 497145 - RNA, 23 nt, Human
acccaaccccccgccccugcccc

SEQ ID NO: 497146 - RNA, 21 nt, Human
acccccagccccagccccagc

SEQ ID NO: 497147 - RNA, 23 nt, Human
acccccagccccagccccagccc

SEQ ID NO: 497148 - RNA, 21 nt, Human
acucauuucaguccugauccc

SEQ ID NO: 497149 - RNA, 20 nt, Human
acucucccagaacacaggau

SEQ ID NO: 497150 - RNA, 21 nt, Human
agaaaggaaggaaguuggaaa

SEQ ID NO: 497151 - RNA, 25 nt, Human
agaaaggaaggaaguuggaaaggag

SEQ ID NO: 497152 - RNA, 21 nt, Human
agaaaguccuucucccauguc

SEQ ID NO: 497153 - RNA, 18 nt, Human
agcugagggagcccugca

SEQ ID NO: 497154 - RNA, 22 nt, Human
aggaggggccggggcugcagga

SEQ ID NO: 497155 - RNA, 21 nt, Human
aggauggggagaaaggagaga

SEQ ID NO: 497156 - RNA, 23 nt, Human
agggaaggggagaggagaggguu

SEQ ID NO: 497157 - RNA, 20 nt, Human
agggagaaauggggucccca

SEQ ID NO: 497158 - RNA, 19 nt, Human
agggagcaguggugggcug

SEQ ID NO: 497159 - RNA, 24 nt, Human
agggagggggcagagaggggcagg

SEQ ID NO: 497160 - RNA, 18 nt, Human
agggggcagcugccauug

SEQ ID NO: 497161 - RNA, 23 nt, Human
aguggugggcugugagaaggaag

SEQ ID NO: 497162 - RNA, 18 nt, Human
aucccacccccagcccca

SEQ ID NO: 497163 - RNA, 19 nt, Human
aucgucacccucuccccaa

SEQ ID NO: 497164 - RNA, 20 nt, Human
auggagacagggaacuucag

SEQ ID NO: 497165 - RNA, 19 nt, Human
caaccccccgccccugccc

SEQ ID NO: 497166 - RNA, 20 nt, Human
caaccccccgccccugcccc

SEQ ID NO: 497167 - RNA, 20 nt, Human
caagccccaacuugaggcca

SEQ ID NO: 497168 - RNA, 18 nt, Human
caaggggcacaccaggag

SEQ ID NO: 497169 - RNA, 26 nt, Human
cacacacacacacacacacauacaca

SEQ ID NO: 497170 - RNA, 20 nt, Human
cacacacacacacacacaua

SEQ ID NO: 497171 - RNA, 22 nt, Human
cacacacacacacacacauaca

SEQ ID NO: 497172 - RNA, 26 nt, Human
cacacacacacacacacauacacaca

SEQ ID NO: 497173 - RNA, 19 nt, Human
cacacacacacacacauac

SEQ ID NO: 497174 - RNA, 21 nt, Human
cacacccaaccccccgccccu

SEQ ID NO: 497175 - RNA, 19 nt, Human
cacauacacacaaggccgu

SEQ ID NO: 497176 - RNA, 20 nt, Human
caccacacccaaccccccgc

SEQ ID NO: 497177 - RNA, 22 nt, Human
caccagggcagaauucccccuc

SEQ ID NO: 497178 - RNA, 21 nt, Human
cacccaaccccccgccccugc

SEQ ID NO: 497179 - RNA, 22 nt, Human
cacccccagccccagccccagc

SEQ ID NO: 497180 - RNA, 20 nt, Human
cacccggggcccccacgucc

SEQ ID NO: 497181 - RNA, 21 nt, Human
cacccggggcccccacguccc

SEQ ID NO: 497182 - RNA, 23 nt, Human
cagaaaguccuucucccaugucu

SEQ ID NO: 497183 - RNA, 22 nt, Human
cagagaggggcaggaauggagc

SEQ ID NO: 497184 - RNA, 21 nt, Human
cagcccacuuuccaacccagc

SEQ ID NO: 497185 - RNA, 19 nt, Human
cagcccagaagugagggau

SEQ ID NO: 497186 - RNA, 25 nt, Human
cagccccagccccagccauugcaaa

SEQ ID NO: 497187 - RNA, 23 nt, Human
cagcugagggagcccugcagagg

SEQ ID NO: 497188 - RNA, 18 nt, Human
cagggacgaugguccagc

SEQ ID NO: 497189 - RNA, 25 nt, Human
cagggcggacuccagagggcccgcu

SEQ ID NO: 497190 - RNA, 33 nt, Human
caugacgaugccucacacacacacacacacagu

SEQ ID NO: 497191 - RNA, 23 nt, Human
cauuggggguagaaaggcagcug

SEQ ID NO: 497192 - RNA, 24 nt, Human
cauuucaguccugaucccuucacu

SEQ ID NO: 497193 - RNA, 23 nt, Human
ccaacucauuucaguccugaucc

SEQ ID NO: 497194 - RNA, 26 nt, Human
ccagcccacuuuccaacccagccagc

SEQ ID NO: 497195 - RNA, 24 nt, Human
ccaggagcaugacagcccagaagu

SEQ ID NO: 497196 - RNA, 22 nt, Human
cccagacugaaauggaaaugag

SEQ ID NO: 497197 - RNA, 24 nt, Human
cccagacugaaauggaaaugaggu

SEQ ID NO: 497198 - RNA, 24 nt, Human
cccagccccagccccagccauugc

SEQ ID NO: 497199 - RNA, 26 nt, Human
cccagccccagccccagccauugcaa

SEQ ID NO: 497200 - RNA, 25 nt, Human
cccagccccagccccagccccagcc

SEQ ID NO: 497201 - RNA, 23 nt, Human
ccccaggacaugacgaugccuca

SEQ ID NO: 497202 - RNA, 18 nt, Human
cccccacguccccucccg

SEQ ID NO: 497203 - RNA, 19 nt, Human
cccccacguccccucccgu

SEQ ID NO: 497204 - RNA, 22 nt, Human
cccccacguccccucccguccc

SEQ ID NO: 497205 - RNA, 19 nt, Human
cccccagccccagccccag

SEQ ID NO: 497206 - RNA, 22 nt, Human
cccccagccccagccccagccc

SEQ ID NO: 497207 - RNA, 23 nt, Human
cccccagccccagccccagccuu

SEQ ID NO: 497208 - RNA, 22 nt, Human
ccccccgccccugccccaggac

SEQ ID NO: 497209 - RNA, 24 nt, Human
ccccucccucaccacacccaaccc

SEQ ID NO: 497210 - RNA, 18 nt, Human
cccguccccgcagccugg

SEQ ID NO: 497211 - RNA, 23 nt, Human
cccuaggauauguccccucccuc

SEQ ID NO: 497212 - RNA, 18 nt, Human
cccucaccacacccaacc

SEQ ID NO: 497213 - RNA, 20 nt, Human
ccgccccugccccaggacau

SEQ ID NO: 497214 - RNA, 21 nt, Human
ccucacacacacacacacaca

SEQ ID NO: 497215 - RNA, 22 nt, Human
ccucccucaccacacccaaccc

SEQ ID NO: 497216 - RNA, 18 nt, Human
ccucucucccucuugguc

SEQ ID NO: 497217 - RNA, 19 nt, Human
ccuucacucugcacuucuc

SEQ ID NO: 497218 - RNA, 23 nt, Human
cguccccgcagccuggccacacu

SEQ ID NO: 497219 - RNA, 23 nt, Human
cuagaaguuuccugagauccuga

SEQ ID NO: 497220 - RNA, 21 nt, Human
cucacacacacacacacacac

SEQ ID NO: 497221 - RNA, 18 nt, Human
cucaccacacccaacccc

SEQ ID NO: 497222 - RNA, 24 nt, Human
cucaccacacccaaccccccgccc

SEQ ID NO: 497223 - RNA, 25 nt, Human
cucccucaccacacccaaccccccg

SEQ ID NO: 497224 - RNA, 18 nt, Human
cugaaguccagcccacuu

SEQ ID NO: 497225 - RNA, 20 nt, Human
cuuauccuccucccaacuca

SEQ ID NO: 497226 - RNA, 23 nt, Human
gaaagggaagggauagauuaagg

SEQ ID NO: 497227 - RNA, 18 nt, Human
gaaggggagaggagaggg

SEQ ID NO: 497228 - RNA, 18 nt, Human
gaaggggagaggagaggg

SEQ ID NO: 497229 - RNA, 18 nt, Human
gaccucaggacugcaagg

SEQ ID NO: 497230 - RNA, 18 nt, Human
gacuccagagggcccgcu

SEQ ID NO: 497231 - RNA, 22 nt, Human
gagaaggcccugggaaagggaa

SEQ ID NO: 497232 - RNA, 19 nt, Human
gagggggaaaagcuuccca

SEQ ID NO: 497233 - RNA, 19 nt, Human
gcacaccaggagcaugaca

SEQ ID NO: 497234 - RNA, 21 nt, Human
gcagagaggggcaggaaugga

SEQ ID NO: 497235 - RNA, 18 nt, Human
gccagccccagugcaagg

SEQ ID NO: 497236 - RNA, 23 nt, Human
gccccagccccagccccagccuu

SEQ ID NO: 497237 - RNA, 23 nt, Human
ggaggggcagggcggacuccaga

SEQ ID NO: 497238 - RNA, 21 nt, Human
ggccgggggaggggcagggcg

SEQ ID NO: 497239 - RNA, 19 nt, Human
gggaaacaggacaagaaag

SEQ ID NO: 497240 - RNA, 23 nt, Human
gggauggggggccgggggagggg

SEQ ID NO: 497241 - RNA, 21 nt, Human
gggcaggaauggagcagagga

SEQ ID NO: 497242 - RNA, 23 nt, Human
gucacggaggaggggccggggcu

SEQ ID NO: 497243 - RNA, 20 nt, Human
uaagagaagcagggacgaug

SEQ ID NO: 497244 - RNA, 18 nt, Human
uagaaguuuccugagauc

SEQ ID NO: 497245 - RNA, 19 nt, Human
uaggauauguccccucccu

SEQ ID NO: 497246 - RNA, 26 nt, Human
uauguccccucccucaccacacccaa

SEQ ID NO: 497247 - RNA, 21 nt, Human
ucacacacacacacacacaca

SEQ ID NO: 497248 - RNA, 24 nt, Human
ucaccacacccaaccccccgcccc

SEQ ID NO: 497249 - RNA, 20 nt, Human
uccacccccuauaggagcac

SEQ ID NO: 497250 - RNA, 21 nt, Human
ucccacccccagccccagccc

SEQ ID NO: 497251 - RNA, 21 nt, Human
ucccacccccagccccagccu

SEQ ID NO: 497252 - RNA, 20 nt, Human
uccccagacugaaauggaaa

SEQ ID NO: 497253 - RNA, 21 nt, Human
uccccagacugaaauggaaau

SEQ ID NO: 497254 - RNA, 18 nt, Human
ucucccagaacacaggau

SEQ ID NO: 497255 - RNA, 20 nt, Human
ucuccuauagcaggguagac

SEQ ID NO: 497256 - RNA, 19 nt, Human
ucucuguguucccagaaag

SEQ ID NO: 497257 - RNA, 19 nt, Human
ucugaagccucucucccuc

SEQ ID NO: 497258 - RNA, 22 nt, Human
ucuggagugucuguuucaccag

SEQ ID NO: 497259 - RNA, 19 nt, Human
ugaaaacccuaggauaugu

SEQ ID NO: 497260 - RNA, 20 nt, Human
ugaaaggaggacugguucug

SEQ ID NO: 497261 - RNA, 23 nt, Human
ugaagaggaggggaucacuaucu

SEQ ID NO: 497262 - RNA, 21 nt, Human
ugagaaggcccugggaaaggg

SEQ ID NO: 497263 - RNA, 18 nt, Human
ugaggacaagaaaucagc

SEQ ID NO: 497264 - RNA, 18 nt, Human
ugagguggggcgaucaua

SEQ ID NO: 497265 - RNA, 20 nt, Human
ugcacucacgacaacauuga

SEQ ID NO: 497266 - RNA, 18 nt, Human
ugcagagggggaaaagcu

SEQ ID NO: 497267 - RNA, 18 nt, Human
ugccccaggacaugacga

SEQ ID NO: 497268 - RNA, 27 nt, Human
ugccucacacacacacacacacacagu

SEQ ID NO: 497269 - RNA, 29 nt, Human
ugccucacacacacacacacacacauaca

SEQ ID NO: 497270 - RNA, 22 nt, Human
ugcguggggagagguguaggcc

SEQ ID NO: 497271 - RNA, 21 nt, Human
ugcuaagggggcagcugccau

SEQ ID NO: 497272 - RNA, 23 nt, Human
uggaaacaaccugcccugggggu

SEQ ID NO: 497273 - RNA, 18 nt, Human
uggaaaggagggagaaau

SEQ ID NO: 497274 - RNA, 21 nt, Human
uggaaaggagggagaaauggg

SEQ ID NO: 497275 - RNA, 31 nt, Human
uguccccucccucaccacacccaaccccccc

SEQ ID NO: 497276 - RNA, 18 nt, Human
uuacaggaggcggguggu

SEQ ID NO: 497277 - RNA, 24 nt, Human
uuauauauguacacccggggcccc

SEQ ID NO: 497278 - RNA, 31 nt, Human
uucaaucccacccccagccccagccccagcc

SEQ ID NO: 497279 - RNA, 21 nt, Human
uuccaacccagccagccccag

SEQ ID NO: 497280 - RNA, 19 nt, Human
uucucccagccaagcccca

SEQ ID NO: 497281 - RNA, 19 nt, Human
uugaaacuagaaaaagauc

SEQ ID NO: 497282 - RNA, 18 nt, Human
uugcuuauccuccuccca

SEQ ID NO: 497283 - RNA, 21 nt, Human
uuuuccacccccuauaggagc

SEQ ID NO: 497284 - RNA, 18 nt, Human
aggguccccaccccccac

SEQ ID NO: 497285 - RNA, 19 nt, Human
caccccccaccgcaccccc

SEQ ID NO: 497286 - RNA, 23 nt, Human
caccccccaccgcacccccuacc

SEQ ID NO: 497287 - RNA, 25 nt, Human
caccccccaccgcacccccuacccc

SEQ ID NO: 497288 - RNA, 21 nt, Human
cacccccuacccccaccggcu

SEQ ID NO: 497289 - RNA, 18 nt, Human
cagccggcggggacuggg

SEQ ID NO: 497290 - RNA, 21 nt, Human
cagcuccuccaccaccccacc

SEQ ID NO: 497291 - RNA, 21 nt, Human
ccaagagccggagggucccca

SEQ ID NO: 497292 - RNA, 22 nt, Human
ccaccccccaccgcacccccua

SEQ ID NO: 497293 - RNA, 21 nt, Human
ccaccgcacccccuaccccca

SEQ ID NO: 497294 - RNA, 23 nt, Human
cccaagagccggaggguccccac

SEQ ID NO: 497295 - RNA, 23 nt, Human
cccaccgcacccccuacccccac

SEQ ID NO: 497296 - RNA, 23 nt, Human
ccccaagagccggaggguccccu

SEQ ID NO: 497297 - RNA, 19 nt, Human
ccccaccgcacccccuacc

SEQ ID NO: 497298 - RNA, 19 nt, Human
ccccaccggcuccuucccc

SEQ ID NO: 497299 - RNA, 21 nt, Human
ccccaccggcuccuucccccg

SEQ ID NO: 497300 - RNA, 21 nt, Human
cccccaagagccggagggucc

SEQ ID NO: 497301 - RNA, 24 nt, Human
cccccaagagccggagggucccca

SEQ ID NO: 497302 - RNA, 24 nt, Human
cccccaagagccggaggguccccc

SEQ ID NO: 497303 - RNA, 22 nt, Human
ccccccaccgcacccccuaccc

SEQ ID NO: 497304 - RNA, 20 nt, Human
ccccuacccccaccggcucc

SEQ ID NO: 497305 - RNA, 22 nt, Human
ccgcacccccuacccccaccgg

SEQ ID NO: 497306 - RNA, 24 nt, Human
ccgcacccccuacccccaccggcu

SEQ ID NO: 497307 - RNA, 18 nt, Human
ccgcucagcagccggcgg

SEQ ID NO: 497308 - RNA, 22 nt, Human
ccuccaccaccccacccgcuca

SEQ ID NO: 497309 - RNA, 21 nt, Human
cuccuucccccgugccggccu

SEQ ID NO: 497310 - RNA, 20 nt, Human
gacccccaagagccggaggg

SEQ ID NO: 497311 - RNA, 23 nt, Human
gcagcuccuccaccaccccaccc

SEQ ID NO: 497312 - RNA, 22 nt, Human
gcggggacugggacccccaaga

SEQ ID NO: 497313 - RNA, 22 nt, Human
uccccaccccccaccgcacccc

SEQ ID NO: 497314 - RNA, 18 nt, Human
ucugcagcuccuccacca

SEQ ID NO: 497315 - RNA, 23 nt, Human
ugggacccccaagagccggaggg

SEQ ID NO: 497316 - RNA, 21 nt, Human
aagcaaacuaaaggaagaaca

SEQ ID NO: 497317 - RNA, 19 nt, Human
aagucagccgagggcacag

SEQ ID NO: 497318 - RNA, 25 nt, Human
acaaagaacuacuaauguaccauga

SEQ ID NO: 497319 - RNA, 19 nt, Human
acauacuuuccugcaacug

SEQ ID NO: 497320 - RNA, 23 nt, Human
agcuaacauacuuuccugcaacu

SEQ ID NO: 497321 - RNA, 26 nt, Human
agugcaaaagcaaacuaaaggaagaa

SEQ ID NO: 497322 - RNA, 22 nt, Human
auccuuuuuuauuucaggauuu

SEQ ID NO: 497323 - RNA, 18 nt, Human
caaacuaaaggaagaaca

SEQ ID NO: 497324 - RNA, 22 nt, Human
caaccuccaggguggaaaccaa

SEQ ID NO: 497325 - RNA, 18 nt, Human
cacagggugucagcaacc

SEQ ID NO: 497326 - RNA, 22 nt, Human
cacagggugucagcaaccucca

SEQ ID NO: 497327 - RNA, 19 nt, Human
caggucccagaugaagaga

SEQ ID NO: 497328 - RNA, 18 nt, Human
caugaaauguaauacaua

SEQ ID NO: 497329 - RNA, 22 nt, Human
ccuccaggguggaaaccaaccc

SEQ ID NO: 497330 - RNA, 18 nt, Human
cugugccaccggcuggaa

SEQ ID NO: 497331 - RNA, 20 nt, Human
guucccgcuguuacugucau

SEQ ID NO: 497332 - RNA, 24 nt, Human
uaccaugaaauguaauacauauua

SEQ ID NO: 497333 - RNA, 21 nt, Human
uagaacauagacaccuaggug

SEQ ID NO: 497334 - RNA, 18 nt, Human
uaggaugcauuagaucuu

SEQ ID NO: 497335 - RNA, 24 nt, Human
uauagcuaacauacuuuccugcaa

SEQ ID NO: 497336 - RNA, 27 nt, Human
ucccgcuguuacugucauuccuaagau

SEQ ID NO: 497337 - RNA, 21 nt, Human
ugagugcugcccccuggaggc

SEQ ID NO: 497338 - RNA, 21 nt, Human
ugugauagaacauagacaccu

SEQ ID NO: 497339 - RNA, 21 nt, Human
uuaauagcuaagccauucaac

SEQ ID NO: 497340 - RNA, 21 nt, Human
uuucaggauuuccagguccca

SEQ ID NO: 497341 - RNA, 23 nt, Human
uuuuuuuuuuuucaaaaaaguca

SEQ ID NO: 497342 - RNA, 19 nt, Human
augaggaacagaaacaaaa

SEQ ID NO: 497343 - RNA, 21 nt, Human
caugauuuaaugaggaacaga

SEQ ID NO: 497344 - RNA, 24 nt, Human
uacccuuuagccugaugacagcuu

SEQ ID NO: 497345 - RNA, 22 nt, Human
ucauuggcguccucuggcaagc

SEQ ID NO: 497346 - RNA, 20 nt, Human
ucugcagcuucaauacccuu

SEQ ID NO: 497347 - RNA, 23 nt, Human
ugauuguugguguuucaaacuuc

SEQ ID NO: 497348 - RNA, 18 nt, Human
ugguguuucaaacuucau

SEQ ID NO: 497349 - RNA, 26 nt, Human
aaagacuguaaucagucucuaaauaa

SEQ ID NO: 497350 - RNA, 20 nt, Human
aaagcaaacuggcugaagaa

SEQ ID NO: 497351 - RNA, 19 nt, Human
aaagcacacaaacacacag

SEQ ID NO: 497352 - RNA, 27 nt, Human
aaauaaaagcaaacuggcugaagaaaa

SEQ ID NO: 497353 - RNA, 22 nt, Human
acaauacaaagugaacuuugau

SEQ ID NO: 497354 - RNA, 19 nt, Human
acaauauauauauaucaca

SEQ ID NO: 497355 - RNA, 26 nt, Human
agagcacaauauauauauaucacaaa

SEQ ID NO: 497356 - RNA, 18 nt, Human
aucuuugaaagcacacaa

SEQ ID NO: 497357 - RNA, 23 nt, Human
caauauauauauaucacaaacca

SEQ ID NO: 497358 - RNA, 19 nt, Human
caggguacaauacaaagug

SEQ ID NO: 497359 - RNA, 18 nt, Human
ccauacacacugucccca

SEQ ID NO: 497360 - RNA, 19 nt, Human
uaccauacacacugucccc

SEQ ID NO: 497361 - RNA, 23 nt, Human
uaucacaaaccaaaucacacucu

SEQ ID NO: 497362 - RNA, 19 nt, Human
ucaaaaauaaaagcaaacu

SEQ ID NO: 497363 - RNA, 19 nt, Human
uccacauccgggagcuagu

SEQ ID NO: 497364 - RNA, 21 nt, Human
uccccagauaaauaaaauccc

SEQ ID NO: 497365 - RNA, 20 nt, Human
uccccagcuucuccacaucc

SEQ ID NO: 497366 - RNA, 21 nt, Human
uccucccacgccuucucccca

SEQ ID NO: 497367 - RNA, 22 nt, Human
uccucccacgccuucuccccag

SEQ ID NO: 497368 - RNA, 20 nt, Human
ugaaagcacacaaacacaca

SEQ ID NO: 497369 - RNA, 18 nt, Human
ugagaaagacuguaauca

SEQ ID NO: 497370 - RNA, 24 nt, Human
uugaugauguucuuacuugcauuu

SEQ ID NO: 497371 - RNA, 18 nt, Human
agaaggaggccuuccugu

SEQ ID NO: 497372 - RNA, 24 nt, Human
auacugaauucucuugauuguaca

SEQ ID NO: 497373 - RNA, 24 nt, Human
cauuucuauucccuucugaaguuu

SEQ ID NO: 497374 - RNA, 19 nt, Human
ccaguuuucauuccaguca

SEQ ID NO: 497375 - RNA, 26 nt, Human
ccucuggggaccuuucgucccaguuu

SEQ ID NO: 497376 - RNA, 20 nt, Human
ccucuugaaacagggcgagc

SEQ ID NO: 497377 - RNA, 22 nt, Human
ccuuccuguuaacccaacucca

SEQ ID NO: 497378 - RNA, 20 nt, Human
cggcgcggaaggagggcagu

SEQ ID NO: 497379 - RNA, 21 nt, Human
cugcuaguuguccuugaagcu

SEQ ID NO: 497380 - RNA, 24 nt, Human
cuugaagcucuuuuaucucaacag

SEQ ID NO: 497381 - RNA, 21 nt, Human
cuuguaccaaguuuagcagca

SEQ ID NO: 497382 - RNA, 20 nt, Human
gacaaauauacugaauucuc

SEQ ID NO: 497383 - RNA, 21 nt, Human
gagaagacagaacuccaccag

SEQ ID NO: 497384 - RNA, 20 nt, Human
gcaguugcccggcucgcggg

SEQ ID NO: 497385 - RNA, 19 nt, Human
gcucaguuuuccucggcuc

SEQ ID NO: 497386 - RNA, 18 nt, Human
ggcaguugcccggcucgc

SEQ ID NO: 497387 - RNA, 20 nt, Human
uagucugcuaguuguccuug

SEQ ID NO: 497388 - RNA, 18 nt, Human
uccaccagucccuauggg

SEQ ID NO: 497389 - RNA, 21 nt, Human
uccuguuaacccaacuccacc

SEQ ID NO: 497390 - RNA, 18 nt, Human
ucggcucucaggccuacc

SEQ ID NO: 497391 - RNA, 21 nt, Human
ucugaggcccacgcucaguuu

SEQ ID NO: 497392 - RNA, 20 nt, Human
ucugcuaguuguccuugaag

SEQ ID NO: 497393 - RNA, 21 nt, Human
ugacaaauauacugaauucuc

SEQ ID NO: 497394 - RNA, 21 nt, Human
ugagaagacagaacuccaccg

SEQ ID NO: 497395 - RNA, 24 nt, Human
ugccuugacuucuuucugaggccc

SEQ ID NO: 497396 - RNA, 18 nt, Human
ugcuggccauuguuucuu

SEQ ID NO: 497397 - RNA, 20 nt, Human
ugggacaaccacgagaaccu

SEQ ID NO: 497398 - RNA, 22 nt, Human
ugucuaaaauuugccucugggg

SEQ ID NO: 497399 - RNA, 21 nt, Human
uuagagacuuucaguggacuu

SEQ ID NO: 497400 - RNA, 24 nt, Human
uuagcagcaagaggauacuuccuu

SEQ ID NO: 497401 - RNA, 20 nt, Human
aacaaugauggcugcgaucc

SEQ ID NO: 497402 - RNA, 20 nt, Human
aaccuggacaccaaccaaca

SEQ ID NO: 497403 - RNA, 21 nt, Human
aagcaggcgcacuuugucaga

SEQ ID NO: 497404 - RNA, 19 nt, Human
aagcccagagagcaucaag

SEQ ID NO: 497405 - RNA, 24 nt, Human
aaggggccaaaaccaccacaucaa

SEQ ID NO: 497406 - RNA, 23 nt, Human
aagguucuucuuccuccucuuuu

SEQ ID NO: 497407 - RNA, 22 nt, Human
aaguuucaagcuagaggauaua

SEQ ID NO: 497408 - RNA, 18 nt, Human
aaugauggcugcgauccc

SEQ ID NO: 497409 - RNA, 19 nt, Human
acaaaccuggacaccaacc

SEQ ID NO: 497410 - RNA, 21 nt, Human
acaaaccuggacaccaaccaa

SEQ ID NO: 497411 - RNA, 22 nt, Human
acagugccacaaaccuggacac

SEQ ID NO: 497412 - RNA, 18 nt, Human
accaccauaauaggaagc

SEQ ID NO: 497413 - RNA, 25 nt, Human
accuuccucaguagauccuuuauca

SEQ ID NO: 497414 - RNA, 19 nt, Human
acugaaacaucaagaguuc

SEQ ID NO: 497415 - RNA, 19 nt, Human
acugccgccucaacaaagc

SEQ ID NO: 497416 - RNA, 19 nt, Human
aggaaucuucaccacagca

SEQ ID NO: 497417 - RNA, 22 nt, Human
aggcaaagguucuucuuccucc

SEQ ID NO: 497418 - RNA, 19 nt, Human
auaauaggaagcauccaca

SEQ ID NO: 497419 - RNA, 24 nt, Human
aucaagaguucuguagccccagcu

SEQ ID NO: 497420 - RNA, 21 nt, Human
aucaccccaacgaaccuccau

SEQ ID NO: 497421 - RNA, 20 nt, Human
aucgcucuuuccaucuugug

SEQ ID NO: 497422 - RNA, 18 nt, Human
caaaccuggacaccaacc

SEQ ID NO: 497423 - RNA, 21 nt, Human
caaagcaggcgcacuuuguca

SEQ ID NO: 497424 - RNA, 19 nt, Human
caacagaauacucccguuc

SEQ ID NO: 497425 - RNA, 18 nt, Human
caccuuccucaguagauc

SEQ ID NO: 497426 - RNA, 20 nt, Human
cacuuugucagauuuccacu

SEQ ID NO: 497427 - RNA, 23 nt, Human
cagagagacaucccacugaccca

SEQ ID NO: 497428 - RNA, 20 nt, Human
cagcaaaggggccaaaacca

SEQ ID NO: 497429 - RNA, 23 nt, Human
cagcaaaggggccaaaaccacca

SEQ ID NO: 497430 - RNA, 24 nt, Human
caggaguagcaguaacaccaaaau

SEQ ID NO: 497431 - RNA, 21 nt, Human
caucaaagaaacccggucaua

SEQ ID NO: 497432 - RNA, 19 nt, Human
ccacaucaaaccgaucccc

SEQ ID NO: 497433 - RNA, 25 nt, Human
ccaccacaucaaaccgauccccagg

SEQ ID NO: 497434 - RNA, 19 nt, Human
ccgccucaacaaagcccag

SEQ ID NO: 497435 - RNA, 23 nt, Human
ccucaguagauccuuuaucaccc

SEQ ID NO: 497436 - RNA, 23 nt, Human
ccuccauucuuuuaauuccucca

SEQ ID NO: 497437 - RNA, 18 nt, Human
cucgaauauccauuucgc

SEQ ID NO: 497438 - RNA, 24 nt, Human
cuggacaccaaccaacagaauacu

SEQ ID NO: 497439 - RNA, 21 nt, Human
cuugcaccuuccucaguagau

SEQ ID NO: 497440 - RNA, 19 nt, Human
gaggaggcugguguguggg

SEQ ID NO: 497441 - RNA, 19 nt, Human
gcugguguguggguuuggg

SEQ ID NO: 497442 - RNA, 21 nt, Human
ggccaaaaccaccacaucaaa

SEQ ID NO: 497443 - RNA, 20 nt, Human
guauauuugugugugugugu

SEQ ID NO: 497444 - RNA, 20 nt, Human
gugcaggggggggugguggu

SEQ ID NO: 497445 - RNA, 20 nt, Human
guguguguguaaggccucuu

SEQ ID NO: 497446 - RNA, 21 nt, Human
guuuuucuucuuggucuuccu

SEQ ID NO: 497447 - RNA, 19 nt, Human
uaaacuugagcaaaaguuu

SEQ ID NO: 497448 - RNA, 19 nt, Human
uaagccuuugugcucacaa

SEQ ID NO: 497449 - RNA, 23 nt, Human
uaccaggaugcuccaaucgcucu

SEQ ID NO: 497450 - RNA, 23 nt, Human
uauguauagaaaauuguauauuu

SEQ ID NO: 497451 - RNA, 22 nt, Human
ucaacaaagcccagagagcauc

SEQ ID NO: 497452 - RNA, 19 nt, Human
ucauuugauaagccuuugu

SEQ ID NO: 497453 - RNA, 25 nt, Human
uccccaggaguagcaguaacaccaa

SEQ ID NO: 497454 - RNA, 19 nt, Human
uccucuguuucuucaggaa

SEQ ID NO: 497455 - RNA, 25 nt, Human
ucgaccaccauaauaggaagcauug

SEQ ID NO: 497456 - RNA, 18 nt, Human
ucucuagccuugcaccuu

SEQ ID NO: 497457 - RNA, 18 nt, Human
ucuucuuccuccucuuuu

SEQ ID NO: 497458 - RNA, 23 nt, Human
ugaaauguucgccuucucccuuc

SEQ ID NO: 497459 - RNA, 23 nt, Human
ugaauguguggacacaugacuuu

SEQ ID NO: 497460 - RNA, 19 nt, Human
ugaggaggcuggugugugg

SEQ ID NO: 497461 - RNA, 20 nt, Human
ugcaggggggggugguggug

SEQ ID NO: 497462 - RNA, 26 nt, Human
ugccacaaaccuggacaccaaccaac

SEQ ID NO: 497463 - RNA, 19 nt, Human
ugcucacagagagacaucc

SEQ ID NO: 497464 - RNA, 25 nt, Human
uggaacagugccacaaaccuggaca

SEQ ID NO: 497465 - RNA, 19 nt, Human
uggcugugacaauuaauga

SEQ ID NO: 497466 - RNA, 19 nt, Human
uggugguuuuucuucuugg

SEQ ID NO: 497467 - RNA, 20 nt, Human
uggugguuuuucuucuuggu

SEQ ID NO: 497468 - RNA, 22 nt, Human
uguauauuugugugugugugua

SEQ ID NO: 497469 - RNA, 19 nt, Human
uguucgccuucucccuucc

SEQ ID NO: 497470 - RNA, 21 nt, Human
uuagugucauuugauaagccu

SEQ ID NO: 497471 - RNA, 21 nt, Human
uuccucaguagauccuuuauc

SEQ ID NO: 497472 - RNA, 22 nt, Human
uuuaugcaccggcccucaucuc

SEQ ID NO: 497473 - RNA, 22 nt, Human
uuugaaauuuccauuaagagca

SEQ ID NO: 497474 - RNA, 23 nt, Human
cacagaaaggucauugcagucag

SEQ ID NO: 497475 - RNA, 18 nt, Human
ccaauacagaaggaaaga

SEQ ID NO: 497476 - RNA, 20 nt, Human
cgaauggauucuauucugac

SEQ ID NO: 497477 - RNA, 23 nt, Human
ucuauucugaccaauacagaagg

SEQ ID NO: 497478 - RNA, 19 nt, Human
aaacuugccaccaguucug

SEQ ID NO: 497479 - RNA, 22 nt, Human
aaaugcaggaagcuggugagcc

SEQ ID NO: 497480 - RNA, 19 nt, Human
aaccuaagaguccagagaa

SEQ ID NO: 497481 - RNA, 21 nt, Human
aacucccaagcaauuccagac

SEQ ID NO: 497482 - RNA, 22 nt, Human
aagcaggggcaaaggggaaaga

SEQ ID NO: 497483 - RNA, 22 nt, Human
aaggccccgacuucugcuuuuc

SEQ ID NO: 497484 - RNA, 20 nt, Human
acaggcggcacuugcagcag

SEQ ID NO: 497485 - RNA, 20 nt, Human
agccacgcaggaagaagcuu

SEQ ID NO: 497486 - RNA, 21 nt, Human
agccaugagcaauucucuccu

SEQ ID NO: 497487 - RNA, 21 nt, Human
agcccccagcccugcuggccc

SEQ ID NO: 497488 - RNA, 23 nt, Human
aggcacugguggcugggagugcu

SEQ ID NO: 497489 - RNA, 18 nt, Human
agggagcugucccuggac

SEQ ID NO: 497490 - RNA, 19 nt, Human
auggcaacagagggauggc

SEQ ID NO: 497491 - RNA, 26 nt, Human
caacucccaagcaauuccagacguuc

SEQ ID NO: 497492 - RNA, 22 nt, Human
cacgccuccaaggccccgacuu

SEQ ID NO: 497493 - RNA, 21 nt, Human
cacucucuucacucuucuuga

SEQ ID NO: 497494 - RNA, 20 nt, Human
cagcagcuccaggcccuacc

SEQ ID NO: 497495 - RNA, 19 nt, Human
cagcugccugucuguuggu

SEQ ID NO: 497496 - RNA, 23 nt, Human
cagcugccugucuguuggucacu

SEQ ID NO: 497497 - RNA, 24 nt, Human
ccaacucccaagcaauuccagacg

SEQ ID NO: 497498 - RNA, 27 nt, Human
ccaacucccaagcaauuccagacguuc

SEQ ID NO: 497499 - RNA, 20 nt, Human
ccagcccugcuggcccucgg

SEQ ID NO: 497500 - RNA, 22 nt, Human
cccccaggugaacagaucuccg

SEQ ID NO: 497501 - RNA, 21 nt, Human
ccccgacuaagacucccuaga

SEQ ID NO: 497502 - RNA, 23 nt, Human
ccccuccauggcccccaggugaa

SEQ ID NO: 497503 - RNA, 20 nt, Human
cccgacuucugcuuuucuug

SEQ ID NO: 497504 - RNA, 18 nt, Human
cccugcuggcccucgggg

SEQ ID NO: 497505 - RNA, 20 nt, Human
cccugcuggcccucggggaa

SEQ ID NO: 497506 - RNA, 20 nt, Human
cccuggacuuccuggggccc

SEQ ID NO: 497507 - RNA, 19 nt, Human
ccgauggcgaggcaggaca

SEQ ID NO: 497508 - RNA, 20 nt, Human
ccuggggcccaugagagcuc

SEQ ID NO: 497509 - RNA, 21 nt, Human
cgacuaagacucccuagaaac

SEQ ID NO: 497510 - RNA, 26 nt, Human
cgacuaagacucccuagaaacggcac

SEQ ID NO: 497511 - RNA, 20 nt, Human
cuagugaugagaccucuccc

SEQ ID NO: 497512 - RNA, 18 nt, Human
cuccaggcccuaccugga

SEQ ID NO: 497513 - RNA, 20 nt, Human
cucuccucccucuggccuca

SEQ ID NO: 497514 - RNA, 28 nt, Human
cugcugcucuccggagcccccagcccug

SEQ ID NO: 497515 - RNA, 19 nt, Human
cugucccuggacuuccugg

SEQ ID NO: 497516 - RNA, 20 nt, Human
gagcaauucucuccucccuc

SEQ ID NO: 497517 - RNA, 21 nt, Human
gcugucccuggacuuccuggg

SEQ ID NO: 497518 - RNA, 18 nt, Human
ggagcccccagcccugcu

SEQ ID NO: 497519 - RNA, 23 nt, Human
gggcaggcugagaaggacguggg

SEQ ID NO: 497520 - RNA, 22 nt, Human
ggggaagccaaucaagcugaug

SEQ ID NO: 497521 - RNA, 23 nt, Human
uaccuggacccgaggggaaaguc

SEQ ID NO: 497522 - RNA, 18 nt, Human
uagaaacggcacguccuc

SEQ ID NO: 497523 - RNA, 22 nt, Human
uccacacacagagcugggauga

SEQ ID NO: 497524 - RNA, 18 nt, Human
uccaggcccuaccuggac

SEQ ID NO: 497525 - RNA, 20 nt, Human
ucccucuggccucaguuucc

SEQ ID NO: 497526 - RNA, 21 nt, Human
uccggagcccccagcccugcu

SEQ ID NO: 497527 - RNA, 21 nt, Human
uccuggggcccaugagagcuc

SEQ ID NO: 497528 - RNA, 21 nt, Human
ucuagugaugagaccucuccc

SEQ ID NO: 497529 - RNA, 18 nt, Human
ucuccggagcccccagcc

SEQ ID NO: 497530 - RNA, 20 nt, Human
ucugugagauggggagaauc

SEQ ID NO: 497531 - RNA, 22 nt, Human
ugagaaggacgugggccaggua

SEQ ID NO: 497532 - RNA, 22 nt, Human
ugagaaggacgugggccaggua

SEQ ID NO: 497533 - RNA, 21 nt, Human
ugagauggggagaaucuuuga

SEQ ID NO: 497534 - RNA, 21 nt, Human
ugagcaauucucuccucccuc

SEQ ID NO: 497535 - RNA, 24 nt, Human
ugggaugaagcaggggcaaagggg

SEQ ID NO: 497536 - RNA, 18 nt, Human
uggggcccaugagagcuc

SEQ ID NO: 497537 - RNA, 23 nt, Human
uggguccccccuccauggccccc

SEQ ID NO: 497538 - RNA, 22 nt, Human
uggugagccccgacuaagacuc

SEQ ID NO: 497539 - RNA, 25 nt, Human
uuaguggguccccccuccauggccc

SEQ ID NO: 497540 - RNA, 18 nt, Human
uucagcuucuuuugguuc

SEQ ID NO: 497541 - RNA, 21 nt, Human
uuccuugucugugagaugggg

SEQ ID NO: 497542 - RNA, 18 nt, Human
uucuucggcuauuucuag

SEQ ID NO: 497543 - RNA, 18 nt, Human
uucuuggugccgcgcugc

SEQ ID NO: 497544 - RNA, 23 nt, Human
uucuuggugccgcgcugcuuccu

SEQ ID NO: 497545 - RNA, 24 nt, Human
uuggucacuguugucgagggcagg

SEQ ID NO: 497546 - RNA, 20 nt, Human
uuuaguggguccccccucca

SEQ ID NO: 497547 - RNA, 19 nt, Human
aggagcggggagcggcgcc

SEQ ID NO: 497548 - RNA, 24 nt, Human
cgccguugccagcggagaaaggcg

SEQ ID NO: 497549 - RNA, 21 nt, Human
gaggaggagcggggagcggcg

SEQ ID NO: 497550 - RNA, 19 nt, Human
aaguagcccucauguaaaa

SEQ ID NO: 497551 - RNA, 20 nt, Human
aauaaagaacaccuguacag

SEQ ID NO: 497552 - RNA, 21 nt, Human
acuacuucccacccugaacag

SEQ ID NO: 497553 - RNA, 18 nt, Human
agaacugccaaggaacug

SEQ ID NO: 497554 - RNA, 18 nt, Human
agaguuucuucuuuggca

SEQ ID NO: 497555 - RNA, 22 nt, Human
aggcagaggggucagcucgggg

SEQ ID NO: 497556 - RNA, 19 nt, Human
agggagaggguggcacaaa

SEQ ID NO: 497557 - RNA, 20 nt, Human
cacccugaacagaauccagg

SEQ ID NO: 497558 - RNA, 21 nt, Human
cagagguuggaggauuugggg

SEQ ID NO: 497559 - RNA, 28 nt, Human
cagcucugccagcucgaaucagcuccug

SEQ ID NO: 497560 - RNA, 23 nt, Human
caggagcuagagugcuggccagg

SEQ ID NO: 497561 - RNA, 20 nt, Human
cauguaaaauaaagaacacc

SEQ ID NO: 497562 - RNA, 20 nt, Human
cccacccugaacagaaucca

SEQ ID NO: 497563 - RNA, 23 nt, Human
cccucauguaaaauaaagaacac

SEQ ID NO: 497564 - RNA, 27 nt, Human
cugaacagaauccagggaugcucuguc

SEQ ID NO: 497565 - RNA, 19 nt, Human
ggcagggcuguggccccag

SEQ ID NO: 497566 - RNA, 27 nt, Human
gggagaacugccaaggaacuggagggg

SEQ ID NO: 497567 - RNA, 21 nt, Human
gggcagggcuguggccccaga

SEQ ID NO: 497568 - RNA, 18 nt, Human
guaaaauaaagaacaccu

SEQ ID NO: 497569 - RNA, 19 nt, Human
ucagaagcugggguugagg

SEQ ID NO: 497570 - RNA, 21 nt, Human
ucuguccuggacacgucagaa

SEQ ID NO: 497571 - RNA, 19 nt, Human
uggcaagggagaggguggc

SEQ ID NO: 497572 - RNA, 25 nt, Human
ugguuugggggagaacugccaagga

SEQ ID NO: 497573 - RNA, 20 nt, Human
uguggccccagagguuggag

SEQ ID NO: 497574 - RNA, 20 nt, Human
uucccacccugaacagaauc

SEQ ID NO: 497575 - RNA, 21 nt, Human
uuggaggauuuggggggagag

SEQ ID NO: 497576 - RNA, 21 nt, Human
aaacauaguaaguuucaaagc

SEQ ID NO: 497577 - RNA, 23 nt, Human
aagaggccaccaaagaguccauu

SEQ ID NO: 497578 - RNA, 20 nt, Human
aagcugaucccucucuuuuc

SEQ ID NO: 497579 - RNA, 23 nt, Human
aagcugaucccucucuuuuccug

SEQ ID NO: 497580 - RNA, 20 nt, Human
aaguuucaaagcaaauugug

SEQ ID NO: 497581 - RNA, 18 nt, Human
acacugcggugacaggaa

SEQ ID NO: 497582 - RNA, 22 nt, Human
acuacagaagaaaaauaagcaa

SEQ ID NO: 497583 - RNA, 22 nt, Human
agaaaagaauagcucaugccug

SEQ ID NO: 497584 - RNA, 23 nt, Human
agaaaguuaggauuuuagcugaa

SEQ ID NO: 497585 - RNA, 24 nt, Human
agaauaaacauaguaaguuucaaa

SEQ ID NO: 497586 - RNA, 24 nt, Human
agagcccuuucccaguuaagaccc

SEQ ID NO: 497587 - RNA, 21 nt, Human
agagguugauguugagucugg

SEQ ID NO: 497588 - RNA, 19 nt, Human
aguuugaaagacauccaga

SEQ ID NO: 497589 - RNA, 24 nt, Human
aucccucucuuuuccuggugucag

SEQ ID NO: 497590 - RNA, 18 nt, Human
auccgauuuggcauggag

SEQ ID NO: 497591 - RNA, 19 nt, Human
auuagcuuaucaaucugug

SEQ ID NO: 497592 - RNA, 25 nt, Human
caccaaagaguccauuaaacagcca

SEQ ID NO: 497593 - RNA, 20 nt, Human
cagacaaaauacuuuucaaa

SEQ ID NO: 497594 - RNA, 18 nt, Human
cagcaaggacgaggccau

SEQ ID NO: 497595 - RNA, 21 nt, Human
caguuuucuguuacugugcuc

SEQ ID NO: 497596 - RNA, 21 nt, Human
caugccugcccuaagaggcaa

SEQ ID NO: 497597 - RNA, 22 nt, Human
cccacagccuauagauucaaaa

SEQ ID NO: 497598 - RNA, 20 nt, Human
ccugcccuaagaggcaacac

SEQ ID NO: 497599 - RNA, 19 nt, Human
ccuuaaagaggccaccaaa

SEQ ID NO: 497600 - RNA, 22 nt, Human
cguaccgacucucuccgaucua

SEQ ID NO: 497601 - RNA, 23 nt, Human
cugaagcuaguuugaaagacauc

SEQ ID NO: 497602 - RNA, 21 nt, Human
cuuaagaguggccugccccuc

SEQ ID NO: 497603 - RNA, 25 nt, Human
gaacacaacugagguguuaccacac

SEQ ID NO: 497604 - RNA, 20 nt, Human
gcccuaagaggcaacaccac

SEQ ID NO: 497605 - RNA, 18 nt, Human
gcuuuuuacaagucuguu

SEQ ID NO: 497606 - RNA, 19 nt, Human
gggauaugauguggucaca

SEQ ID NO: 497607 - RNA, 20 nt, Human
guggauccgauuuggcaugg

SEQ ID NO: 497608 - RNA, 23 nt, Human
uaaacauaguaaguuucaaagca

SEQ ID NO: 497609 - RNA, 20 nt, Human
uacaagucuguuuucuguua

SEQ ID NO: 497610 - RNA, 21 nt, Human
uacagcacgucaaguuuuaaa

SEQ ID NO: 497611 - RNA, 19 nt, Human
uaccuugccuuaauagauu

SEQ ID NO: 497612 - RNA, 22 nt, Human
uagaauaaacauaguaaguuuc

SEQ ID NO: 497613 - RNA, 23 nt, Human
uaugcaauaccacacacugcggu

SEQ ID NO: 497614 - RNA, 22 nt, Human
uauuacaguguaucuuauccaa

SEQ ID NO: 497615 - RNA, 21 nt, Human
uauugauugagccauagggga

SEQ ID NO: 497616 - RNA, 21 nt, Human
ucaaagcaaauuguguauacc

SEQ ID NO: 497617 - RNA, 19 nt, Human
uccacuacagaagaaaaau

SEQ ID NO: 497618 - RNA, 23 nt, Human
uccagacaaaauacuuuucaaaa

SEQ ID NO: 497619 - RNA, 23 nt, Human
uccgaucuaaauucucuaaacau

SEQ ID NO: 497620 - RNA, 25 nt, Human
ucucuuuuccuggugucaggagaac

SEQ ID NO: 497621 - RNA, 21 nt, Human
ucuguuauaaacagcaaggac

SEQ ID NO: 497622 - RNA, 20 nt, Human
ucuuauaucccuuugggagg

SEQ ID NO: 497623 - RNA, 19 nt, Human
ugaaagacauccagacaaa

SEQ ID NO: 497624 - RNA, 27 nt, Human
ugaaauaucauuaauuagcauuaaaaa

SEQ ID NO: 497625 - RNA, 22 nt, Human
ugaagcugaucccucucuuuuc

SEQ ID NO: 497626 - RNA, 23 nt, Human
ugacaggaagaaaaaaacauuuc

SEQ ID NO: 497627 - RNA, 26 nt, Human
ugacaggaagaaaaaaacauuucaaa

SEQ ID NO: 497628 - RNA, 19 nt, Human
ugcaauaccacacacugcg

SEQ ID NO: 497629 - RNA, 20 nt, Human
ugcaauaccacacacugcgg

SEQ ID NO: 497630 - RNA, 22 nt, Human
ugucaccgaaagcagucucugu

SEQ ID NO: 497631 - RNA, 19 nt, Human
ugugaaaccagaggaucug

SEQ ID NO: 497632 - RNA, 20 nt, Human
ugugaaaccagaggaucuga

SEQ ID NO: 497633 - RNA, 23 nt, Human
ugugaaaccagaggaucugacga

SEQ ID NO: 497634 - RNA, 23 nt, Human
uguggucacagacuccagaaaga

SEQ ID NO: 497635 - RNA, 20 nt, Human
uuaaauaauaucugaagcua

SEQ ID NO: 497636 - RNA, 27 nt, Human
uuaagacccuuuccccuucuguucucc

SEQ ID NO: 497637 - RNA, 24 nt, Human
uuaccacacagagcccuuucccag

SEQ ID NO: 497638 - RNA, 28 nt, Human
uucaaaaaugaaacccacagccuauaga

SEQ ID NO: 497639 - RNA, 18 nt, Human
uucacauccacuacagaa

SEQ ID NO: 497640 - RNA, 19 nt, Human
uuugggaggcccccaaucc

SEQ ID NO: 497641 - RNA, 24 nt, Human
aaacuguugggauuacagguguga

SEQ ID NO: 497642 - RNA, 24 nt, Human
aaagcucugggggaaauucuuggu

SEQ ID NO: 497643 - RNA, 22 nt, Human
aaaggcaucucuagcuccaaag

SEQ ID NO: 497644 - RNA, 21 nt, Human
aacucuuuguaggucugagac

SEQ ID NO: 497645 - RNA, 25 nt, Human
aaggcaucucuagcuccaaagucuu

SEQ ID NO: 497646 - RNA, 24 nt, Human
aagugauccacccgccucggucuu

SEQ ID NO: 497647 - RNA, 21 nt, Human
aagugcaguggugugaucuca

SEQ ID NO: 497648 - RNA, 25 nt, Human
aauuucacacacccagugaaugcug

SEQ ID NO: 497649 - RNA, 18 nt, Human
acaagaauaaauacauua

SEQ ID NO: 497650 - RNA, 18 nt, Human
accauguuggccaggcug

SEQ ID NO: 497651 - RNA, 21 nt, Human
acccaaagaacaaagaagagc

SEQ ID NO: 497652 - RNA, 22 nt, Human
acccgccucggucuuccaaacu

SEQ ID NO: 497653 - RNA, 22 nt, Human
accugcucuggguuguugggga

SEQ ID NO: 497654 - RNA, 18 nt, Human
acuguugggauuacaggu

SEQ ID NO: 497655 - RNA, 21 nt, Human
agaaggacaaaugcaugaaag

SEQ ID NO: 497656 - RNA, 22 nt, Human
agagcagguguugggacuggau

SEQ ID NO: 497657 - RNA, 18 nt, Human
agauggaagggaaggcag

SEQ ID NO: 497658 - RNA, 19 nt, Human
agcaguggcuugagccugg

SEQ ID NO: 497659 - RNA, 21 nt, Human
aggacaaaugcaugaaaaaga

SEQ ID NO: 497660 - RNA, 20 nt, Human
aggcaagagcagguguuggg

SEQ ID NO: 497661 - RNA, 18 nt, Human
aggcaggcaccccggggc

SEQ ID NO: 497662 - RNA, 20 nt, Human
aggcauuuucauuuuauuua

SEQ ID NO: 497663 - RNA, 21 nt, Human
agggaggggaguggugacagg

SEQ ID NO: 497664 - RNA, 20 nt, Human
agggaggguuuuggaggaag

SEQ ID NO: 497665 - RNA, 26 nt, Human
aggggucccagaguggcauugucagc

SEQ ID NO: 497666 - RNA, 21 nt, Human
agguguugggacuggaugacu

SEQ ID NO: 497667 - RNA, 21 nt, Human
agguguugggacuggaugacu

SEQ ID NO: 497668 - RNA, 19 nt, Human
aguaggagacagaucagaa

SEQ ID NO: 497669 - RNA, 19 nt, Human
agugcaguggugugaucuc

SEQ ID NO: 497670 - RNA, 21 nt, Human
agugcaguggugugaucucag

SEQ ID NO: 497671 - RNA, 23 nt, Human
agugcaguggugugaucucagcu

SEQ ID NO: 497672 - RNA, 24 nt, Human
agugcaguggugugaucucagcuc

SEQ ID NO: 497673 - RNA, 24 nt, Human
aguggugugaucucagcucacugc

SEQ ID NO: 497674 - RNA, 23 nt, Human
auggggguuucaccauguuggcc

SEQ ID NO: 497675 - RNA, 26 nt, Human
auucugaagacaaauuucacuuacuu

SEQ ID NO: 497676 - RNA, 20 nt, Human
auuucacacacccagugaau

SEQ ID NO: 497677 - RNA, 23 nt, Human
caagacgauaggucuccuauggc

SEQ ID NO: 497678 - RNA, 20 nt, Human
caagcgauucuccugccuca

SEQ ID NO: 497679 - RNA, 22 nt, Human
caagcgauucuccugccucagc

SEQ ID NO: 497680 - RNA, 19 nt, Human
caagggguguggugaaguc

SEQ ID NO: 497681 - RNA, 19 nt, Human
caaguuccaagacgauagg

SEQ ID NO: 497682 - RNA, 18 nt, Human
cacacgagcgccggcagc

SEQ ID NO: 497683 - RNA, 21 nt, Human
caccauguuggccaggcuggu

SEQ ID NO: 497684 - RNA, 24 nt, Human
caccauguuggccaggcuggucuc

SEQ ID NO: 497685 - RNA, 27 nt, Human
caccauguuggccaggcuggucucaaa

SEQ ID NO: 497686 - RNA, 18 nt, Human
cacugcaaccucugccuc

SEQ ID NO: 497687 - RNA, 21 nt, Human
cacugcaaccucugccuccca

SEQ ID NO: 497688 - RNA, 20 nt, Human
cagaacauucugucaccugu

SEQ ID NO: 497689 - RNA, 21 nt, Human
cagaagccgggucaggcacac

SEQ ID NO: 497690 - RNA, 20 nt, Human
cagcaguggcuugagccugg

SEQ ID NO: 497691 - RNA, 19 nt, Human
cagcuaggggugaagagau

SEQ ID NO: 497692 - RNA, 20 nt, Human
cagcugaucugcuagggugu

SEQ ID NO: 497693 - RNA, 25 nt, Human
caggagagauggggguuucaccaug

SEQ ID NO: 497694 - RNA, 22 nt, Human
caggggacccaaagaacaaaga

SEQ ID NO: 497695 - RNA, 21 nt, Human
cauacugccccaggcugcugg

SEQ ID NO: 497696 - RNA, 21 nt, Human
cauagacccucugaaguccaa

SEQ ID NO: 497697 - RNA, 24 nt, Human
cauguuggccaggcuggucucaaa

SEQ ID NO: 497698 - RNA, 19 nt, Human
ccaaaacagaugugucccu

SEQ ID NO: 497699 - RNA, 21 nt, Human
ccaaacuguugggauuacagg

SEQ ID NO: 497700 - RNA, 21 nt, Human
ccaaacuguugggauuacagg

SEQ ID NO: 497701 - RNA, 21 nt, Human
ccaaacuguugggauuacagg

SEQ ID NO: 497702 - RNA, 24 nt, Human
ccaaacuguugggauuacaggugu

SEQ ID NO: 497703 - RNA, 33 nt, Human
ccaaagcucuggaauuucacacacccagugagg

SEQ ID NO: 497704 - RNA, 25 nt, Human
ccagucacuaacaguuuucugugcu

SEQ ID NO: 497705 - RNA, 20 nt, Human
ccauccccugaacuaaucuu

SEQ ID NO: 497706 - RNA, 23 nt, Human
cccagguucaagcgauucuccug

SEQ ID NO: 497707 - RNA, 19 nt, Human
ccccaggcugcuggaaccc

SEQ ID NO: 497708 - RNA, 21 nt, Human
ccccggugcccccgaagcccg

SEQ ID NO: 497709 - RNA, 24 nt, Human
ccccugaacuaaucuucagaccuc

SEQ ID NO: 497710 - RNA, 24 nt, Human
ccccugaguuaacaguuccugugg

SEQ ID NO: 497711 - RNA, 21 nt, Human
cccgaguagcugggacuacau

SEQ ID NO: 497712 - RNA, 18 nt, Human
cccuggggugauggaccc

SEQ ID NO: 497713 - RNA, 25 nt, Human
ccggcagccacgggaaguggauccc

SEQ ID NO: 497714 - RNA, 30 nt, Human
ccggcagccacgggaaguggauccccucuu

SEQ ID NO: 497715 - RNA, 19 nt, Human
ccuaggaugaagugcagug

SEQ ID NO: 497716 - RNA, 24 nt, Human
ccucccagguucaagcgauucucc

SEQ ID NO: 497717 - RNA, 25 nt, Human
ccuccuacuccagccucccaugugc

SEQ ID NO: 497718 - RNA, 23 nt, Human
ccucugaaguccaacuauggacc

SEQ ID NO: 497719 - RNA, 22 nt, Human
ccugacuucaagugauccaccc

SEQ ID NO: 497720 - RNA, 18 nt, Human
ccugccccaacuucagga

SEQ ID NO: 497721 - RNA, 18 nt, Human
ccugugaaugacucaaug

SEQ ID NO: 497722 - RNA, 19 nt, Human
cgauugaagacugcugauu

SEQ ID NO: 497723 - RNA, 24 nt, Human
cucacugcaaccucugccucccag

SEQ ID NO: 497724 - RNA, 24 nt, Human
cucacugcaaccucugccucccag

SEQ ID NO: 497725 - RNA, 24 nt, Human
cucagccucccgaguagcugggac

SEQ ID NO: 497726 - RNA, 21 nt, Human
cucccaguugggucucucugc

SEQ ID NO: 497727 - RNA, 26 nt, Human
cucugcucccuguuccuucucuucca

SEQ ID NO: 497728 - RNA, 23 nt, Human
cugcaaccucugccucccagguu

SEQ ID NO: 497729 - RNA, 24 nt, Human
cugcaaccucugccucccagguuc

SEQ ID NO: 497730 - RNA, 23 nt, Human
cugccucagccucccgaguagcu

SEQ ID NO: 497731 - RNA, 23 nt, Human
cugcucccuguuccuucucuucc

SEQ ID NO: 497732 - RNA, 23 nt, Human
cuguagucuuccccggugccccc

SEQ ID NO: 497733 - RNA, 19 nt, Human
cugugcgaggcgauggcca

SEQ ID NO: 497734 - RNA, 18 nt, Human
gaaaaagaagaaugauuc

SEQ ID NO: 497735 - RNA, 18 nt, Human
gaaagguuugggaauggu

SEQ ID NO: 497736 - RNA, 23 nt, Human
gaaccccugaguuaacaguuccu

SEQ ID NO: 497737 - RNA, 24 nt, Human
gacuucaagugauccacccgccuc

SEQ ID NO: 497738 - RNA, 23 nt, Human
gaggaaggggagggaagcuggau

SEQ ID NO: 497739 - RNA, 20 nt, Human
gaggccuugggggaagcaga

SEQ ID NO: 497740 - RNA, 20 nt, Human
gaguagcugggacuacaugc

SEQ ID NO: 497741 - RNA, 18 nt, Human
gauuacaggugugagcca

SEQ ID NO: 497742 - RNA, 22 nt, Human
gauuacaggugugagccaccgc

SEQ ID NO: 497743 - RNA, 22 nt, Human
gauuacaggugugagccaccgc

SEQ ID NO: 497744 - RNA, 21 nt, Human
gauucuccugccucagccucc

SEQ ID NO: 497745 - RNA, 20 nt, Human
gccucagccucccgaguagc

SEQ ID NO: 497746 - RNA, 24 nt, Human
gcgauucuccugccucagccuccc

SEQ ID NO: 497747 - RNA, 21 nt, Human
gcggcagcgagguguacagcc

SEQ ID NO: 497748 - RNA, 21 nt, Human
gcuugagccugguggccucag

SEQ ID NO: 497749 - RNA, 18 nt, Human
ggacccaaagaacaaaga

SEQ ID NO: 497750 - RNA, 22 nt, Human
ggagacagagucucgcucuguu

SEQ ID NO: 497751 - RNA, 24 nt, Human
ggagacagaucagaaagggagaua

SEQ ID NO: 497752 - RNA, 23 nt, Human
ggagccaaaacagaugugucccu

SEQ ID NO: 497753 - RNA, 20 nt, Human
ggaugaagugcaguggugug

SEQ ID NO: 497754 - RNA, 22 nt, Human
ggccagcccgugccgcgaacac

SEQ ID NO: 497755 - RNA, 24 nt, Human
ggcuggucucaaacuccugacuuc

SEQ ID NO: 497756 - RNA, 18 nt, Human
ggcuugagccugguggcc

SEQ ID NO: 497757 - RNA, 18 nt, Human
gggaagcagaugauggga

SEQ ID NO: 497758 - RNA, 18 nt, Human
gggagggaagcuggaugg

SEQ ID NO: 497759 - RNA, 28 nt, Human
gggcacucuuugguuugucccguccccg

SEQ ID NO: 497760 - RNA, 23 nt, Human
ggggaagcagaugaugggagggu

SEQ ID NO: 497761 - RNA, 19 nt, Human
ggggguuucaccauguugg

SEQ ID NO: 497762 - RNA, 24 nt, Human
ggggguuucaccauguuggccagg

SEQ ID NO: 497763 - RNA, 22 nt, Human
gggguuucaccauguuggccag

SEQ ID NO: 497764 - RNA, 23 nt, Human
gggguuucaccauguuggccagg

SEQ ID NO: 497765 - RNA, 19 nt, Human
ggguguggggaggugggag

SEQ ID NO: 497766 - RNA, 19 nt, Human
ggucagcugggcaagaagc

SEQ ID NO: 497767 - RNA, 21 nt, Human
gguguggggaggugggaggga

SEQ ID NO: 497768 - RNA, 21 nt, Human
gguucugagucgaacuggagg

SEQ ID NO: 497769 - RNA, 24 nt, Human
gugauccacccgccucggucuucc

SEQ ID NO: 497770 - RNA, 24 nt, Human
guuccuucucuuccagagcagaau

SEQ ID NO: 497771 - RNA, 21 nt, Human
uaaagaguaggagacagauca

SEQ ID NO: 497772 - RNA, 21 nt, Human
uacacucagcugaucugcuag

SEQ ID NO: 497773 - RNA, 23 nt, Human
uacaggugugagccaccgcgccc

SEQ ID NO: 497774 - RNA, 18 nt, Human
uacccaacauugagggcu

SEQ ID NO: 497775 - RNA, 26 nt, Human
uacgagaagucaugcacugcugagcc

SEQ ID NO: 497776 - RNA, 18 nt, Human
uagaaaguuaacauuuug

SEQ ID NO: 497777 - RNA, 18 nt, Human
uagggugugccgagaauu

SEQ ID NO: 497778 - RNA, 19 nt, Human
ucacugcaaccucugccuc

SEQ ID NO: 497779 - RNA, 24 nt, Human
ucacugcaaccucugccucccagg

SEQ ID NO: 497780 - RNA, 25 nt, Human
ucacugcaaccucugccucccaggu

SEQ ID NO: 497781 - RNA, 23 nt, Human
ucagccucccgaguagcugggac

SEQ ID NO: 497782 - RNA, 27 nt, Human
ucagcucacugcaaccucugccuccca

SEQ ID NO: 497783 - RNA, 22 nt, Human
uccaaacuguugggauuacagg

SEQ ID NO: 497784 - RNA, 22 nt, Human
ucccagaguggcauugucagcu

SEQ ID NO: 497785 - RNA, 21 nt, Human
ucccagguucaagcgauucuc

SEQ ID NO: 497786 - RNA, 24 nt, Human
ucccagguucaagcgauucuccug

SEQ ID NO: 497787 - RNA, 21 nt, Human
ucccaugagauuauguaucuu

SEQ ID NO: 497788 - RNA, 21 nt, Human
ucccaugugccugucugccaa

SEQ ID NO: 497789 - RNA, 23 nt, Human
uccccggugcccccgaagcccgg

SEQ ID NO: 497790 - RNA, 18 nt, Human
uccccugaacuaaucuuc

SEQ ID NO: 497791 - RNA, 18 nt, Human
ucccgaguagcugggacu

SEQ ID NO: 497792 - RNA, 18 nt, Human
ucggucuuccaaacuguu

SEQ ID NO: 497793 - RNA, 21 nt, Human
ucuaacaggaaaccagucacu

SEQ ID NO: 497794 - RNA, 24 nt, Human
ucuccugccucagccucccgagua

SEQ ID NO: 497795 - RNA, 22 nt, Human
ucucgaacugcccaguauccac

SEQ ID NO: 497796 - RNA, 18 nt, Human
ucucgcucuguugccuag

SEQ ID NO: 497797 - RNA, 19 nt, Human
ucucgcucuguugccuagg

SEQ ID NO: 497798 - RNA, 19 nt, Human
ucucgcucuguugccuagg

SEQ ID NO: 497799 - RNA, 19 nt, Human
ucucgcucuguugccuagg

SEQ ID NO: 497800 - RNA, 20 nt, Human
ucucgcucuguugccuagga

SEQ ID NO: 497801 - RNA, 24 nt, Human
ucucgcucuguugccuaggaugaa

SEQ ID NO: 497802 - RNA, 24 nt, Human
ucucuggcucccaguugggucucu

SEQ ID NO: 497803 - RNA, 24 nt, Human
ucugcucccuguuccuucucuucc

SEQ ID NO: 497804 - RNA, 18 nt, Human
ucuggaaaaaacauacaa

SEQ ID NO: 497805 - RNA, 23 nt, Human
ucuggguuguuggggaagagggg

SEQ ID NO: 497806 - RNA, 24 nt, Human
ucuguugccuaggaugaagugcag

SEQ ID NO: 497807 - RNA, 23 nt, Human
ucuuucuuuuuuuuuuuugaggg

SEQ ID NO: 497808 - RNA, 19 nt, Human
ugaagugcaguggugugau

SEQ ID NO: 497809 - RNA, 19 nt, Human
ugaagugcaguggugugau

SEQ ID NO: 497810 - RNA, 28 nt, Human
ugaagugcaguggugugauggcucuagc

SEQ ID NO: 497811 - RNA, 18 nt, Human
ugaaugcuggcuuugccc

SEQ ID NO: 497812 - RNA, 21 nt, Human
ugacuucaagugauccacccg

SEQ ID NO: 497813 - RNA, 24 nt, Human
ugacuucaagugauccacccgccu

SEQ ID NO: 497814 - RNA, 20 nt, Human
ugagccucaggccaggccag

SEQ ID NO: 497815 - RNA, 22 nt, Human
ugaguacuugacugagaacauc

SEQ ID NO: 497816 - RNA, 24 nt, Human
ugagucccacuucuuuaaagcucu

SEQ ID NO: 497817 - RNA, 24 nt, Human
ugaguuaacaguuccuguggguaa

SEQ ID NO: 497818 - RNA, 21 nt, Human
ugcacuuaagaccugaaguuc

SEQ ID NO: 497819 - RNA, 22 nt, Human
ugcagucagacaucucuuuucc

SEQ ID NO: 497820 - RNA, 22 nt, Human
ugcaguggugugaucucagcuc

SEQ ID NO: 497821 - RNA, 21 nt, Human
ugccaucuggugguuaugcuu

SEQ ID NO: 497822 - RNA, 24 nt, Human
ugccuaggaugaagugcaguggug

SEQ ID NO: 497823 - RNA, 24 nt, Human
ugccucagccucccgaguagcugg

SEQ ID NO: 497824 - RNA, 20 nt, Human
uggaaaaaacauacaagaau

SEQ ID NO: 497825 - RNA, 21 nt, Human
uggaaaaaacauacaagaaua

SEQ ID NO: 497826 - RNA, 25 nt, Human
uggaaaaggcaucucuagcuccaaa

SEQ ID NO: 497827 - RNA, 23 nt, Human
uggaccccaaguuaagaaccccu

SEQ ID NO: 497828 - RNA, 24 nt, Human
uggaccccaaguuaagaaccccuu

SEQ ID NO: 497829 - RNA, 19 nt, Human
uggaggaaggggagggaag

SEQ ID NO: 497830 - RNA, 21 nt, Human
uggaggaaggggagggaagcu

SEQ ID NO: 497831 - RNA, 18 nt, Human
uggagguaacgagggaaa

SEQ ID NO: 497832 - RNA, 21 nt, Human
uggauucucccccaaagcucu

SEQ ID NO: 497833 - RNA, 24 nt, Human
uggccaggcuggucucaaacuccu

SEQ ID NO: 497834 - RNA, 24 nt, Human
uggcuaaacuugcuuucagcacug

SEQ ID NO: 497835 - RNA, 21 nt, Human
ugggagggaggguuuuggagg

SEQ ID NO: 497836 - RNA, 19 nt, Human
ugggauuacaggugugagc

SEQ ID NO: 497837 - RNA, 21 nt, Human
ugggauuacaggugugagcca

SEQ ID NO: 497838 - RNA, 22 nt, Human
ugggauuacaggugugagccac

SEQ ID NO: 497839 - RNA, 23 nt, Human
ugggauuacaggugugagccacc

SEQ ID NO: 497840 - RNA, 24 nt, Human
ugggauuacaggugugagccaccg

SEQ ID NO: 497841 - RNA, 18 nt, Human
uggggaggugggagggag

SEQ ID NO: 497842 - RNA, 19 nt, Human
uggggaggugggagggagg

SEQ ID NO: 497843 - RNA, 21 nt, Human
ugggggaagcagaugauggga

SEQ ID NO: 497844 - RNA, 23 nt, Human
ugggggaagcagaugaugggagg

SEQ ID NO: 497845 - RNA, 24 nt, Human
uggugugaucucagcucacugcaa

SEQ ID NO: 497846 - RNA, 23 nt, Human
ugguuugucauggcuaaacuugc

SEQ ID NO: 497847 - RNA, 24 nt, Human
uguaguaagggggugggagaagga

SEQ ID NO: 497848 - RNA, 19 nt, Human
uguggggaggugggaggga

SEQ ID NO: 497849 - RNA, 18 nt, Human
uguguuagaaaguuaaca

SEQ ID NO: 497850 - RNA, 26 nt, Human
uguuauggccaugucaagguucugag

SEQ ID NO: 497851 - RNA, 22 nt, Human
uguucaaaacucaccauuuauu

SEQ ID NO: 497852 - RNA, 20 nt, Human
uguucuggaggaaagaaugg

SEQ ID NO: 497853 - RNA, 21 nt, Human
uuaaacuuuuuuuuuaaccug

SEQ ID NO: 497854 - RNA, 21 nt, Human
uucaagcgauucuccugccuc

SEQ ID NO: 497855 - RNA, 23 nt, Human
uucaagcgauucuccugccucag

SEQ ID NO: 497856 - RNA, 24 nt, Human
uucaagcgauucuccugccucagc

SEQ ID NO: 497857 - RNA, 23 nt, Human
uucaagugauccacccgccucgg

SEQ ID NO: 497858 - RNA, 22 nt, Human
uuccccggugcccccgaagccc

SEQ ID NO: 497859 - RNA, 22 nt, Human
uuccuguguaacucccacugaa

SEQ ID NO: 497860 - RNA, 19 nt, Human
uucuuggugggugccagcc

SEQ ID NO: 497861 - RNA, 23 nt, Human
uuggaauaaaguacacucagcug

SEQ ID NO: 497862 - RNA, 21 nt, Human
uugggauuacaggugugagcc

SEQ ID NO: 497863 - RNA, 21 nt, Human
uugggucucucugcucccugu

SEQ ID NO: 497864 - RNA, 25 nt, Human
uuuaaccugaagaaaaucuuugugg

SEQ ID NO: 497865 - RNA, 24 nt, Human
uuucaccauguuggccaggcuggu

SEQ ID NO: 497866 - RNA, 18 nt, Human
uuuggaggaaggggaggg

SEQ ID NO: 497867 - RNA, 21 nt, Human
uuuggaggaaggggagggaag

SEQ ID NO: 497868 - RNA, 22 nt, Human
aagggcacaaggucuuuggucu

SEQ ID NO: 497869 - RNA, 20 nt, Human
aaucuugaacgccaugcccc

SEQ ID NO: 497870 - RNA, 20 nt, Human
accacugagcucagagaggu

SEQ ID NO: 497871 - RNA, 28 nt, Human
agacagaacaacuuaaaacucugcaaaa

SEQ ID NO: 497872 - RNA, 22 nt, Human
agacagggccgggcccucggga

SEQ ID NO: 497873 - RNA, 20 nt, Human
agagugcagcuagaaggucc

SEQ ID NO: 497874 - RNA, 25 nt, Human
agcagcaucuuggguuaacaagagc

SEQ ID NO: 497875 - RNA, 22 nt, Human
agcuugcacuccacaucacgug

SEQ ID NO: 497876 - RNA, 22 nt, Human
aggcaggaggcacagaggggac

SEQ ID NO: 497877 - RNA, 19 nt, Human
agguggucucggcccacgg

SEQ ID NO: 497878 - RNA, 21 nt, Human
aucacguguuuacugaaaaag

SEQ ID NO: 497879 - RNA, 23 nt, Human
cacacaguacagagugcagcuag

SEQ ID NO: 497880 - RNA, 22 nt, Human
cacguguuuacugaaaaagccc

SEQ ID NO: 497881 - RNA, 23 nt, Human
cagacagaacaacuuaaaacucu

SEQ ID NO: 497882 - RNA, 22 nt, Human
cagcccaucagggucacaucag

SEQ ID NO: 497883 - RNA, 24 nt, Human
caggaugaagucaacuugccucuu

SEQ ID NO: 497884 - RNA, 20 nt, Human
caucagggucacaucauggg

SEQ ID NO: 497885 - RNA, 24 nt, Human
caucucucguuuccauuccucccu

SEQ ID NO: 497886 - RNA, 26 nt, Human
caucuuggguuaacaagagcaaggac

SEQ ID NO: 497887 - RNA, 21 nt, Human
caugggcagacagggccgggc

SEQ ID NO: 497888 - RNA, 18 nt, Human
ccacagugaugacagacu

SEQ ID NO: 497889 - RNA, 18 nt, Human
ccacccccgagccacccu

SEQ ID NO: 497890 - RNA, 20 nt, Human
ccauuccucccucacugucc

SEQ ID NO: 497891 - RNA, 18 nt, Human
cccaaaguucccuccuuu

SEQ ID NO: 497892 - RNA, 20 nt, Human
cccagggacaggggaggagg

SEQ ID NO: 497893 - RNA, 18 nt, Human
ccccaaaguucccuccuu

SEQ ID NO: 497894 - RNA, 22 nt, Human
ccccaugggcccagggacaggg

SEQ ID NO: 497895 - RNA, 23 nt, Human
cccccgagccacccuugcccccg

SEQ ID NO: 497896 - RNA, 19 nt, Human
ccccgagccacccuugccc

SEQ ID NO: 497897 - RNA, 19 nt, Human
ccgagccacccuugccccc

SEQ ID NO: 497898 - RNA, 19 nt, Human
ccuccuuuaaaaacacggg

SEQ ID NO: 497899 - RNA, 25 nt, Human
cgagaucgacggugaugcccacugg

SEQ ID NO: 497900 - RNA, 21 nt, Human
cggggaggagggcuggcuggc

SEQ ID NO: 497901 - RNA, 18 nt, Human
cgggugcagccagcgcgg

SEQ ID NO: 497902 - RNA, 21 nt, Human
cucaaaauaccacugagcuca

SEQ ID NO: 497903 - RNA, 22 nt, Human
cucccucacuguccuccuccgc

SEQ ID NO: 497904 - RNA, 30 nt, Human
cuccuccgcggcuccugggaagggcacaaa

SEQ ID NO: 497905 - RNA, 19 nt, Human
cugacccuggcuguacagg

SEQ ID NO: 497906 - RNA, 18 nt, Human
cuggaaugacaggaugaa

SEQ ID NO: 497907 - RNA, 21 nt, Human
gaaaaaauaaacaugauucua

SEQ ID NO: 497908 - RNA, 20 nt, Human
gaagggcacaaggucuuugg

SEQ ID NO: 497909 - RNA, 19 nt, Human
gaaugacaggaugaaguca

SEQ ID NO: 497910 - RNA, 22 nt, Human
gacccagggaggugggcgacga

SEQ ID NO: 497911 - RNA, 20 nt, Human
gaugcccacuggggcacaga

SEQ ID NO: 497912 - RNA, 21 nt, Human
gcaaaagacacuuuaaaaaca

SEQ ID NO: 497913 - RNA, 22 nt, Human
gccacugccgggccccaugggc

SEQ ID NO: 497914 - RNA, 18 nt, Human
gccaugccccggcugcca

SEQ ID NO: 497915 - RNA, 18 nt, Human
gcucacaccagugaaguc

SEQ ID NO: 497916 - RNA, 22 nt, Human
gcuccugggaagggcacaaggu

SEQ ID NO: 497917 - RNA, 21 nt, Human
ggacaggggaggagggacagu

SEQ ID NO: 497918 - RNA, 22 nt, Human
ggaggagggacaguuggcuccc

SEQ ID NO: 497919 - RNA, 18 nt, Human
ggcuggcagaccccaggc

SEQ ID NO: 497920 - RNA, 23 nt, Human
gggaaagggguacaguuaaacau

SEQ ID NO: 497921 - RNA, 19 nt, Human
gggcgggugcgggccuggg

SEQ ID NO: 497922 - RNA, 23 nt, Human
gggcuggcuggcagaccccaggc

SEQ ID NO: 497923 - RNA, 22 nt, Human
ggguacagcauggcggacaagc

SEQ ID NO: 497924 - RNA, 23 nt, Human
guaaauccagguggucucggccc

SEQ ID NO: 497925 - RNA, 25 nt, Human
guuaacaagagcaaggacccaggga

SEQ ID NO: 497926 - RNA, 23 nt, Human
uaaaaacacgggucuagaaaugc

SEQ ID NO: 497927 - RNA, 21 nt, Human
uaccacugagcucagagaggu

SEQ ID NO: 497928 - RNA, 20 nt, Human
uagcagcaucuuggguuaac

SEQ ID NO: 497929 - RNA, 20 nt, Human
uagugggaaggggaggagcu

SEQ ID NO: 497930 - RNA, 24 nt, Human
uccaaaaucuugaacgccaugccc

SEQ ID NO: 497931 - RNA, 19 nt, Human
ucccugggaggaggagcag

SEQ ID NO: 497932 - RNA, 21 nt, Human
ucccugggaggaggagcaggg

SEQ ID NO: 497933 - RNA, 19 nt, Human
uccuuuaaaaacacggguc

SEQ ID NO: 497934 - RNA, 22 nt, Human
ucucguuuccauuccucccuca

SEQ ID NO: 497935 - RNA, 19 nt, Human
ugacaggaugaagucaacu

SEQ ID NO: 497936 - RNA, 21 nt, Human
ugaggcaggaggcacagagcc

SEQ ID NO: 497937 - RNA, 22 nt, Human
ugaggcaggaggcacagagccc

SEQ ID NO: 497938 - RNA, 25 nt, Human
ugauaaaaauuccuuagggugggag

SEQ ID NO: 497939 - RNA, 21 nt, Human
ugauaaaagggagagcugaaa

SEQ ID NO: 497940 - RNA, 19 nt, Human
ugccgggccccaugggccc

SEQ ID NO: 497941 - RNA, 21 nt, Human
uggcagguucugcaguaacac

SEQ ID NO: 497942 - RNA, 19 nt, Human
ugggaagggcacaaggucu

SEQ ID NO: 497943 - RNA, 24 nt, Human
ugggagcaaaaucacauucccaag

SEQ ID NO: 497944 - RNA, 20 nt, Human
ugggaggaggagcaggggcu

SEQ ID NO: 497945 - RNA, 21 nt, Human
ugggaggaggagcaggggcug

SEQ ID NO: 497946 - RNA, 22 nt, Human
ugggaggaggagcaggggcugg

SEQ ID NO: 497947 - RNA, 18 nt, Human
uggucucaggauguugca

SEQ ID NO: 497948 - RNA, 24 nt, Human
uucaucuccaaaaucuugaacgcc

SEQ ID NO: 497949 - RNA, 20 nt, Human
uuccugagggaaagggguac

SEQ ID NO: 497950 - RNA, 18 nt, Human
uuuuuuuuuuuuuuuuug

SEQ ID NO: 497951 - RNA, 23 nt, Human
uuuuuuuuuuuuuuuuuugguuu

SEQ ID NO: 497952 - RNA, 21 nt, Human
aaagcaaacaaauagagguca

SEQ ID NO: 497953 - RNA, 23 nt, Human
aacuacaagggccaucuaaaacg

SEQ ID NO: 497954 - RNA, 21 nt, Human
aagcagaaaggggcccucagc

SEQ ID NO: 497955 - RNA, 25 nt, Human
acaaaggcaguaacugcacucacaa

SEQ ID NO: 497956 - RNA, 18 nt, Human
acguggccuggaggggau

SEQ ID NO: 497957 - RNA, 20 nt, Human
agaggauccaccugguucau

SEQ ID NO: 497958 - RNA, 23 nt, Human
agcuucugguuuggcacauggga

SEQ ID NO: 497959 - RNA, 24 nt, Human
aggccaucgaucugaacccccagc

SEQ ID NO: 497960 - RNA, 19 nt, Human
agggagggagcagggcuac

SEQ ID NO: 497961 - RNA, 21 nt, Human
agggcagggccggcugaagga

SEQ ID NO: 497962 - RNA, 20 nt, Human
aucuaaaacguggccuggag

SEQ ID NO: 497963 - RNA, 21 nt, Human
cacugcucucugcacaucacg

SEQ ID NO: 497964 - RNA, 19 nt, Human
cagaaaggacaacauggac

SEQ ID NO: 497965 - RNA, 21 nt, Human
cagaacacgggaacugacaac

SEQ ID NO: 497966 - RNA, 24 nt, Human
cagagaagcagaaaggggcccuca

SEQ ID NO: 497967 - RNA, 27 nt, Human
cagcuacucuccuggggggaggauccc

SEQ ID NO: 497968 - RNA, 21 nt, Human
caucuguuccccagaucuggg

SEQ ID NO: 497969 - RNA, 23 nt, Human
cauggacaaggccaucgaucuga

SEQ ID NO: 497970 - RNA, 21 nt, Human
ccacacaaaggcaguaacugc

SEQ ID NO: 497971 - RNA, 22 nt, Human
ccacacaaaggcaguaacugca

SEQ ID NO: 497972 - RNA, 23 nt, Human
ccagcagcgauagguuggcaaag

SEQ ID NO: 497973 - RNA, 21 nt, Human
cccacgugcucaucuguuccc

SEQ ID NO: 497974 - RNA, 21 nt, Human
cccgcaacuacaagggccauc

SEQ ID NO: 497975 - RNA, 27 nt, Human
cccgcaacuacaagggccaucuaaaac

SEQ ID NO: 497976 - RNA, 21 nt, Human
ccggcagcgcagcacgcccuu

SEQ ID NO: 497977 - RNA, 19 nt, Human
ccucagcaccacuaggcca

SEQ ID NO: 497978 - RNA, 23 nt, Human
ccucccaggcaugaccucuucuc

SEQ ID NO: 497979 - RNA, 21 nt, Human
cgaugcagcaugacgaucccu

SEQ ID NO: 497980 - RNA, 18 nt, Human
cgcacugucccugccccg

SEQ ID NO: 497981 - RNA, 19 nt, Human
cgcacugucccugccccgg

SEQ ID NO: 497982 - RNA, 20 nt, Human
cucagaacacgggaacugac

SEQ ID NO: 497983 - RNA, 23 nt, Human
cugcagggaggcuguggggaggu

SEQ ID NO: 497984 - RNA, 23 nt, Human
gagaagcagaaaggggcccucag

SEQ ID NO: 497985 - RNA, 20 nt, Human
gagaggauucgaugcagcau

SEQ ID NO: 497986 - RNA, 20 nt, Human
gagggcagggccggcugaag

SEQ ID NO: 497987 - RNA, 22 nt, Human
gaguggcaacucagcagguggg

SEQ ID NO: 497988 - RNA, 19 nt, Human
gaucccuuccucccaggca

SEQ ID NO: 497989 - RNA, 18 nt, Human
gcaguggagcuucugguu

SEQ ID NO: 497990 - RNA, 21 nt, Human
gccuggaggggaugggggcag

SEQ ID NO: 497991 - RNA, 22 nt, Human
ggagagaggauucgaugcagca

SEQ ID NO: 497992 - RNA, 20 nt, Human
ggcagagaagcagaaagggg

SEQ ID NO: 497993 - RNA, 22 nt, Human
ggggagguguggagcaggugca

SEQ ID NO: 497994 - RNA, 19 nt, Human
guucaugaacccucccuca

SEQ ID NO: 497995 - RNA, 21 nt, Human
uaaagaggauccaccugguuc

SEQ ID NO: 497996 - RNA, 24 nt, Human
uaggccagcucucagaaucagaag

SEQ ID NO: 497997 - RNA, 24 nt, Human
uauaacaaaaacuuuuuuuuuuuu

SEQ ID NO: 497998 - RNA, 20 nt, Human
ucagcucacuccagcucccc

SEQ ID NO: 497999 - RNA, 21 nt, Human
ucaucuguuccccagaucugg

SEQ ID NO: 498000 - RNA, 23 nt, Human
ucaugaacccucccucacugcuc

SEQ ID NO: 498001 - RNA, 18 nt, Human
uccggcagcgcagcacgc

SEQ ID NO: 498002 - RNA, 24 nt, Human
ucgcuguaggggucgccgccgccg

SEQ ID NO: 498003 - RNA, 21 nt, Human
ugaacccucccucacugcucu

SEQ ID NO: 498004 - RNA, 22 nt, Human
ugacaacacugcgaguggcaac

SEQ ID NO: 498005 - RNA, 19 nt, Human
ugaggacacccaggacccg

SEQ ID NO: 498006 - RNA, 21 nt, Human
ugccagcagcgauagguuggc

SEQ ID NO: 498007 - RNA, 18 nt, Human
ugcccuggugacuccugu

SEQ ID NO: 498008 - RNA, 21 nt, Human
uggagggcugugcccugguga

SEQ ID NO: 498009 - RNA, 19 nt, Human
uggcacaugggaaaggcug

SEQ ID NO: 498010 - RNA, 19 nt, Human
uggcacaugggaaaggcug

SEQ ID NO: 498011 - RNA, 19 nt, Human
ugggcagagaagcagaaag

SEQ ID NO: 498012 - RNA, 19 nt, Human
uggggcgcaugcgcugaaa

SEQ ID NO: 498013 - RNA, 20 nt, Human
ugguucaugaacccucccuc

SEQ ID NO: 498014 - RNA, 25 nt, Human
uguggggagguguggagcaggugca

SEQ ID NO: 498015 - RNA, 25 nt, Human
uucugguuuggcacaugggaaaggc

SEQ ID NO: 498016 - RNA, 26 nt, Human
uuuaaagaggauccaccugguucaug

SEQ ID NO: 498017 - RNA, 20 nt, Human
aaaaggaagaacccagacaa

SEQ ID NO: 498018 - RNA, 20 nt, Human
aaaggccugagacccugccu

SEQ ID NO: 498019 - RNA, 19 nt, Human
aaagggccaguuguccaaa

SEQ ID NO: 498020 - RNA, 19 nt, Human
aacccugucuucccuuccc

SEQ ID NO: 498021 - RNA, 22 nt, Human
aacccuuccucuuuuauaguuu

SEQ ID NO: 498022 - RNA, 22 nt, Human
aagaacccagacaaaucaccuc

SEQ ID NO: 498023 - RNA, 24 nt, Human
aagacacaagagucauaacaacaa

SEQ ID NO: 498024 - RNA, 21 nt, Human
aagcugcaugccuuuaggagg

SEQ ID NO: 498025 - RNA, 19 nt, Human
aagcugcuggacgaccagg

SEQ ID NO: 498026 - RNA, 22 nt, Human
aauaaaucacaaaaauauacaa

SEQ ID NO: 498027 - RNA, 20 nt, Human
aauaaggggucugggaaaaa

SEQ ID NO: 498028 - RNA, 23 nt, Human
accaccuucucuccaggcuucca

SEQ ID NO: 498029 - RNA, 24 nt, Human
accagggcaggaauucacaugagg

SEQ ID NO: 498030 - RNA, 18 nt, Human
acccaggagcucguggcc

SEQ ID NO: 498031 - RNA, 21 nt, Human
acccccaagagggacugaagc

SEQ ID NO: 498032 - RNA, 25 nt, Human
agaggaggagggccagccaguuggu

SEQ ID NO: 498033 - RNA, 18 nt, Human
agauguugcccaggcugu

SEQ ID NO: 498034 - RNA, 19 nt, Human
agcaagcugcuccuguaca

SEQ ID NO: 498035 - RNA, 21 nt, Human
agccuugccagccacagagga

SEQ ID NO: 498036 - RNA, 20 nt, Human
agcucgaggcaagcuggugg

SEQ ID NO: 498037 - RNA, 22 nt, Human
agcugucuuccucccaacagau

SEQ ID NO: 498038 - RNA, 22 nt, Human
aggagaccucagacuggccagg

SEQ ID NO: 498039 - RNA, 23 nt, Human
aggaggaagggagagcucccuga

SEQ ID NO: 498040 - RNA, 22 nt, Human
aggaggagggccagccaguugg

SEQ ID NO: 498041 - RNA, 21 nt, Human
aggcaagcugguggacuugug

SEQ ID NO: 498042 - RNA, 21 nt, Human
agugggugggccaguuccagg

SEQ ID NO: 498043 - RNA, 20 nt, Human
auguccucuugucuccaccc

SEQ ID NO: 498044 - RNA, 20 nt, Human
caaaggccugagacccugcc

SEQ ID NO: 498045 - RNA, 20 nt, Human
caaaggccugagacccugcc

SEQ ID NO: 498046 - RNA, 23 nt, Human
caacaaaacuccccgagagucaa

SEQ ID NO: 498047 - RNA, 18 nt, Human
caacacagaugcccuccc

SEQ ID NO: 498048 - RNA, 18 nt, Human
caacacagaugcccuccc

SEQ ID NO: 498049 - RNA, 19 nt, Human
caacagauaagccuccacu

SEQ ID NO: 498050 - RNA, 24 nt, Human
caacgcagaugcugaugacugaca

SEQ ID NO: 498051 - RNA, 21 nt, Human
caagacaaucccugguccuaa

SEQ ID NO: 498052 - RNA, 18 nt, Human
cacagcuacccaggagcu

SEQ ID NO: 498053 - RNA, 26 nt, Human
caccucagagcuacucagaggucccu

SEQ ID NO: 498054 - RNA, 19 nt, Human
caccuggagagcagggcac

SEQ ID NO: 498055 - RNA, 19 nt, Human
cacuagggaacaaaagucu

SEQ ID NO: 498056 - RNA, 20 nt, Human
cagacaaaucaccuccaaca

SEQ ID NO: 498057 - RNA, 21 nt, Human
cagacaaaucaccuccaacac

SEQ ID NO: 498058 - RNA, 21 nt, Human
cagagcucuuaguacaguacu

SEQ ID NO: 498059 - RNA, 18 nt, Human
cagaguuucaccugccag

SEQ ID NO: 498060 - RNA, 18 nt, Human
cagaguuucaccugccag

SEQ ID NO: 498061 - RNA, 21 nt, Human
cagcugagucccgacucacca

SEQ ID NO: 498062 - RNA, 19 nt, Human
cagcuuccaaaaggacuug

SEQ ID NO: 498063 - RNA, 22 nt, Human
caguaaaaaacagccuuugcuu

SEQ ID NO: 498064 - RNA, 21 nt, Human
caguggaaggaccaacaugga

SEQ ID NO: 498065 - RNA, 19 nt, Human
cagugggugggccaguucc

SEQ ID NO: 498066 - RNA, 22 nt, Human
caguuccuucuggaaccaaaag

SEQ ID NO: 498067 - RNA, 24 nt, Human
cauaacgccaaaauaaaucacaaa

SEQ ID NO: 498068 - RNA, 21 nt, Human
caugggugucaccaccuucuc

SEQ ID NO: 498069 - RNA, 22 nt, Human
ccaacacagaugcccucccgcc

SEQ ID NO: 498070 - RNA, 20 nt, Human
ccaccuucucuccaggcuuc

SEQ ID NO: 498071 - RNA, 19 nt, Human
ccacugcccccccuaucca

SEQ ID NO: 498072 - RNA, 21 nt, Human
ccacugcccccccuauccagg

SEQ ID NO: 498073 - RNA, 28 nt, Human
cccacauguccucuugucuccaccccca

SEQ ID NO: 498074 - RNA, 23 nt, Human
cccaccaaugucuuuugcucuac

SEQ ID NO: 498075 - RNA, 18 nt, Human
cccacuggggaggccccc

SEQ ID NO: 498076 - RNA, 21 nt, Human
cccccccuauccagggcugga

SEQ ID NO: 498077 - RNA, 20 nt, Human
cccccgcagggugggcaggg

SEQ ID NO: 498078 - RNA, 19 nt, Human
cccccuauccagggcugga

SEQ ID NO: 498079 - RNA, 23 nt, Human
cccugaucacagcuacccaggag

SEQ ID NO: 498080 - RNA, 18 nt, Human
cccugucacaaagggcca

SEQ ID NO: 498081 - RNA, 23 nt, Human
cccuucccaaaaugauauuuaaa

SEQ ID NO: 498082 - RNA, 21 nt, Human
ccucagguucacggugcugcc

SEQ ID NO: 498083 - RNA, 22 nt, Human
ccucccaacagauaagccucca

SEQ ID NO: 498084 - RNA, 23 nt, Human
ccuggagagcagggcacuugggg

SEQ ID NO: 498085 - RNA, 18 nt, Human
ccuggcagucagggcugu

SEQ ID NO: 498086 - RNA, 18 nt, Human
cgccaaaauaaaucacaa

SEQ ID NO: 498087 - RNA, 20 nt, Human
cgcuaggaucacacguguga

SEQ ID NO: 498088 - RNA, 28 nt, Human
cggaggaggaggaggaggaggaagggag

SEQ ID NO: 498089 - RNA, 19 nt, Human
cgugugagaaagaggggcu

SEQ ID NO: 498090 - RNA, 19 nt, Human
cuccugagguuccauaagu

SEQ ID NO: 498091 - RNA, 19 nt, Human
cugcacccaguggaaggac

SEQ ID NO: 498092 - RNA, 18 nt, Human
cugcccccccuauccagg

SEQ ID NO: 498093 - RNA, 20 nt, Human
cugcugcacccaguggaagg

SEQ ID NO: 498094 - RNA, 23 nt, Human
cugcugcacccaguggaaggacc

SEQ ID NO: 498095 - RNA, 18 nt, Human
cugcuggacgaccagguc

SEQ ID NO: 498096 - RNA, 21 nt, Human
cuggaguuuugcagcagggcc

SEQ ID NO: 498097 - RNA, 21 nt, Human
cuggcagaggccagauccccc

SEQ ID NO: 498098 - RNA, 19 nt, Human
cugggaucccaccuccgga

SEQ ID NO: 498099 - RNA, 22 nt, Human
cugucaccugccuacccauuug

SEQ ID NO: 498100 - RNA, 21 nt, Human
cuucccgggacaagaaacccu

SEQ ID NO: 498101 - RNA, 22 nt, Human
cuugccagccacagaggagagg

SEQ ID NO: 498102 - RNA, 22 nt, Human
gaaagaggggcugcaagcugca

SEQ ID NO: 498103 - RNA, 20 nt, Human
gaauaaauaauaaucaggcg

SEQ ID NO: 498104 - RNA, 18 nt, Human
gacaaaucaccuccaaca

SEQ ID NO: 498105 - RNA, 19 nt, Human
gagaucagauugcuggaga

SEQ ID NO: 498106 - RNA, 18 nt, Human
gagcucgaggcaagcugg

SEQ ID NO: 498107 - RNA, 21 nt, Human
gaggucacuguggaggugugu

SEQ ID NO: 498108 - RNA, 23 nt, Human
gaucccaccuccggaggaggagg

SEQ ID NO: 498109 - RNA, 19 nt, Human
gauguugcccaggcuguag

SEQ ID NO: 498110 - RNA, 22 nt, Human
gcagcugaucuccaugccauuu

SEQ ID NO: 498111 - RNA, 19 nt, Human
gcagucagggcugucagga

SEQ ID NO: 498112 - RNA, 23 nt, Human
gccacagaggagaggacauaaag

SEQ ID NO: 498113 - RNA, 18 nt, Human
gcucgaggcaagcuggug

SEQ ID NO: 498114 - RNA, 23 nt, Human
gcuggagauguugcccaggcugu

SEQ ID NO: 498115 - RNA, 21 nt, Human
ggaaggccugcagaguuucac

SEQ ID NO: 498116 - RNA, 18 nt, Human
gggaagaggcaccagggc

SEQ ID NO: 498117 - RNA, 23 nt, Human
gggcagggccuggggagcagggg

SEQ ID NO: 498118 - RNA, 18 nt, Human
gggccagggaagaggagg

SEQ ID NO: 498119 - RNA, 18 nt, Human
ggggagcaggggugagca

SEQ ID NO: 498120 - RNA, 21 nt, Human
guaaaaaacagccuuugcuua

SEQ ID NO: 498121 - RNA, 24 nt, Human
gucauaacaacaaaacuccccgag

SEQ ID NO: 498122 - RNA, 22 nt, Human
gucccacagccuccccaacccu

SEQ ID NO: 498123 - RNA, 22 nt, Human
gugagcaccaccagcacgccgg

SEQ ID NO: 498124 - RNA, 19 nt, Human
uaacagguucccucucuuc

SEQ ID NO: 498125 - RNA, 18 nt, Human
uaaguggguggauaaggc

SEQ ID NO: 498126 - RNA, 20 nt, Human
uacagcgcaggugcucaggc

SEQ ID NO: 498127 - RNA, 21 nt, Human
uacaguacuacuaacuucagc

SEQ ID NO: 498128 - RNA, 19 nt, Human
uacucagaggucccuggca

SEQ ID NO: 498129 - RNA, 21 nt, Human
uaggcugggggccaucuggcu

SEQ ID NO: 498130 - RNA, 21 nt, Human
uaguacaguacuacuaacuuc

SEQ ID NO: 498131 - RNA, 20 nt, Human
ucacguugaccaagcugcug

SEQ ID NO: 498132 - RNA, 20 nt, Human
ucacuguggaggugugugca

SEQ ID NO: 498133 - RNA, 22 nt, Human
ucaggcagcugaucuccaugcc

SEQ ID NO: 498134 - RNA, 19 nt, Human
uccagggcuggacagugcc

SEQ ID NO: 498135 - RNA, 23 nt, Human
ucccccacuagggaacaaaaguc

SEQ ID NO: 498136 - RNA, 24 nt, Human
ucccgcggcucacguugaccaagc

SEQ ID NO: 498137 - RNA, 18 nt, Human
ucccgggacaagaaaccc

SEQ ID NO: 498138 - RNA, 24 nt, Human
ucccuggcagaggccagauccccc

SEQ ID NO: 498139 - RNA, 21 nt, Human
uccguugcuucccgggacaag

SEQ ID NO: 498140 - RNA, 23 nt, Human
ucuauggcuaggagaccucagac

SEQ ID NO: 498141 - RNA, 20 nt, Human
ugacaaaagacacaagaguc

SEQ ID NO: 498142 - RNA, 21 nt, Human
ugagucccgacucaccaggag

SEQ ID NO: 498143 - RNA, 21 nt, Human
ugaugacccucugugagaagg

SEQ ID NO: 498144 - RNA, 21 nt, Human
ugcacagaggucacuguggag

SEQ ID NO: 498145 - RNA, 21 nt, Human
ugcacccaguggaaggaccaa

SEQ ID NO: 498146 - RNA, 21 nt, Human
ugcaccugccccuuuugcuuc

SEQ ID NO: 498147 - RNA, 24 nt, Human
ugcagaguuucaccugccaggcuc

SEQ ID NO: 498148 - RNA, 24 nt, Human
ugcagaguuucaccugccaggcuc

SEQ ID NO: 498149 - RNA, 23 nt, Human
ugcccaggcuguagccguacagc

SEQ ID NO: 498150 - RNA, 22 nt, Human
ugcucuaccuggcagucagggc

SEQ ID NO: 498151 - RNA, 19 nt, Human
uggaguuuugcagcagggc

SEQ ID NO: 498152 - RNA, 19 nt, Human
uggggugaggaaaggagug

SEQ ID NO: 498153 - RNA, 19 nt, Human
ugucaccaccuucucucca

SEQ ID NO: 498154 - RNA, 21 nt, Human
uguccaaagggccagauggga

SEQ ID NO: 498155 - RNA, 21 nt, Human
uguccucuugucuccaccccc

SEQ ID NO: 498156 - RNA, 20 nt, Human
ugucuucccuucccaaaaug

SEQ ID NO: 498157 - RNA, 24 nt, Human
uucagucagacaggcuaucuaucc

SEQ ID NO: 498158 - RNA, 20 nt, Human
uuccucccaacagauaagcc

SEQ ID NO: 498159 - RNA, 20 nt, Human
uugcccaggcuguagccgua

SEQ ID NO: 498160 - RNA, 19 nt, Human
uuggaugcccuuugcaaag

SEQ ID NO: 498161 - RNA, 22 nt, Human
uuggucccacagccuccccaac

SEQ ID NO: 498162 - RNA, 18 nt, Human
acaguaccggaggcaauc

SEQ ID NO: 498163 - RNA, 20 nt, Human
uuccucacaguaccggaggc

SEQ ID NO: 498164 - RNA, 19 nt, Human
aaaagaguccucacccaca

SEQ ID NO: 498165 - RNA, 23 nt, Human
aaaaugucccucacuggggaggg

SEQ ID NO: 498166 - RNA, 23 nt, Human
aaacagccccauacugaggaaca

SEQ ID NO: 498167 - RNA, 24 nt, Human
aaacagccccauacugaggaacaa

SEQ ID NO: 498168 - RNA, 26 nt, Human
aaaccaaaaggaaauaacacuccuaa

SEQ ID NO: 498169 - RNA, 28 nt, Human
aaagaagcuaauaccaagaaggcuuaga

SEQ ID NO: 498170 - RNA, 24 nt, Human
aacagccccauacugaggaacaag

SEQ ID NO: 498171 - RNA, 18 nt, Human
aacccaaagaagcuaaua

SEQ ID NO: 498172 - RNA, 18 nt, Human
aagaagggaacaucuggc

SEQ ID NO: 498173 - RNA, 21 nt, Human
aaggaaguuaccuggaaccca

SEQ ID NO: 498174 - RNA, 26 nt, Human
aaggagcuuuaguccaagggaagacc

SEQ ID NO: 498175 - RNA, 29 nt, Human
acaaagaagggaacaucuggcaaacaguu

SEQ ID NO: 498176 - RNA, 19 nt, Human
agaaacagccccauacuga

SEQ ID NO: 498177 - RNA, 20 nt, Human
agaagaagacuucugagaua

SEQ ID NO: 498178 - RNA, 22 nt, Human
agacagggcugaaugccaagua

SEQ ID NO: 498179 - RNA, 18 nt, Human
agaccaggggagcccugg

SEQ ID NO: 498180 - RNA, 19 nt, Human
agagaccagccccaguucu

SEQ ID NO: 498181 - RNA, 20 nt, Human
agagauuggagaggaauuaa

SEQ ID NO: 498182 - RNA, 22 nt, Human
agagauuggagaggaauuaaca

SEQ ID NO: 498183 - RNA, 22 nt, Human
agagauuugggggcagaaggca

SEQ ID NO: 498184 - RNA, 23 nt, Human
agaggucaucccucagacaaguc

SEQ ID NO: 498185 - RNA, 24 nt, Human
agaugccgaaagcugugaagagcu

SEQ ID NO: 498186 - RNA, 21 nt, Human
aggaacccaaaacuucaagag

SEQ ID NO: 498187 - RNA, 22 nt, Human
aggaaguuaccuggaacccaga

SEQ ID NO: 498188 - RNA, 23 nt, Human
aggacagggcugguaccuuaccc

SEQ ID NO: 498189 - RNA, 20 nt, Human
aggagcgucuuuauuuuaaa

SEQ ID NO: 498190 - RNA, 19 nt, Human
agggcagggaacccuggag

SEQ ID NO: 498191 - RNA, 22 nt, Human
agggcccucaccugggcagggg

SEQ ID NO: 498192 - RNA, 21 nt, Human
agggcgugugugugugugugu

SEQ ID NO: 498193 - RNA, 18 nt, Human
aggggaggagggggcagc

SEQ ID NO: 498194 - RNA, 19 nt, Human
aggggaggagggggcagcc

SEQ ID NO: 498195 - RNA, 22 nt, Human
agucacuuacuguaaagacaga

SEQ ID NO: 498196 - RNA, 19 nt, Human
auugcccucuuccccucca

SEQ ID NO: 498197 - RNA, 26 nt, Human
caccugggcagggggaucagcaugcg

SEQ ID NO: 498198 - RNA, 22 nt, Human
cagaacuuugcaaugcuggaaa

SEQ ID NO: 498199 - RNA, 21 nt, Human
cagaaggcaguacccaagaga

SEQ ID NO: 498200 - RNA, 23 nt, Human
cagaauacacucaaaaagguuuu

SEQ ID NO: 498201 - RNA, 18 nt, Human
cagagcaggacagucaug

SEQ ID NO: 498202 - RNA, 20 nt, Human
cagcaugcgggggaaggggg

SEQ ID NO: 498203 - RNA, 23 nt, Human
cagccccauacugaggaacaaga

SEQ ID NO: 498204 - RNA, 22 nt, Human
cagcccucgcccccgggccccc

SEQ ID NO: 498205 - RNA, 21 nt, Human
cagggggaucagcaugcgggg

SEQ ID NO: 498206 - RNA, 22 nt, Human
caucccucagacaagucaggag

SEQ ID NO: 498207 - RNA, 24 nt, Human
caucccucagacaagucaggagac

SEQ ID NO: 498208 - RNA, 18 nt, Human
caugugacuagcagcaac

SEQ ID NO: 498209 - RNA, 18 nt, Human
ccagcauagugucuggcc

SEQ ID NO: 498210 - RNA, 20 nt, Human
ccaggguggggcugagagga

SEQ ID NO: 498211 - RNA, 19 nt, Human
cccauacugaggaacaaga

SEQ ID NO: 498212 - RNA, 21 nt, Human
cccggcccccucccugcuucc

SEQ ID NO: 498213 - RNA, 19 nt, Human
cccucccugcuuccuggga

SEQ ID NO: 498214 - RNA, 19 nt, Human
ccucaccugggcaggggga

SEQ ID NO: 498215 - RNA, 20 nt, Human
ccucccggcccccucccugc

SEQ ID NO: 498216 - RNA, 22 nt, Human
ccucccugcuuccugggagagg

SEQ ID NO: 498217 - RNA, 21 nt, Human
ccugggauccacgggccgcuc

SEQ ID NO: 498218 - RNA, 21 nt, Human
cgugugugugugugugugugu

SEQ ID NO: 498219 - RNA, 22 nt, Human
cuaacccaaagaagcuaauacc

SEQ ID NO: 498220 - RNA, 23 nt, Human
cuaacccaaagaagcuaauacca

SEQ ID NO: 498221 - RNA, 21 nt, Human
cucccugcuuccugggagagg

SEQ ID NO: 498222 - RNA, 24 nt, Human
cugcccagcauagugucuggccga

SEQ ID NO: 498223 - RNA, 20 nt, Human
cuggccaacaggggacccca

SEQ ID NO: 498224 - RNA, 18 nt, Human
cuucaagagaggagcguc

SEQ ID NO: 498225 - RNA, 18 nt, Human
cuuggggccucccuccag

SEQ ID NO: 498226 - RNA, 24 nt, Human
gaaaauuccuagagcauggaguac

SEQ ID NO: 498227 - RNA, 22 nt, Human
gaacuuugcaaugcuggaaaca

SEQ ID NO: 498228 - RNA, 19 nt, Human
gagaugccgaaagcuguga

SEQ ID NO: 498229 - RNA, 23 nt, Human
gagauuugggggcagaaggcagu

SEQ ID NO: 498230 - RNA, 23 nt, Human
gagccaaucugcacucauggagg

SEQ ID NO: 498231 - RNA, 25 nt, Human
gcaaugcuggaaacacucuauuugc

SEQ ID NO: 498232 - RNA, 27 nt, Human
gcggagauugcccucuuccccuccagg

SEQ ID NO: 498233 - RNA, 22 nt, Human
gcugguaaaaacccagagacau

SEQ ID NO: 498234 - RNA, 18 nt, Human
ggaaaacgacggcgagca

SEQ ID NO: 498235 - RNA, 20 nt, Human
ggaaauaacacuccuaaccc

SEQ ID NO: 498236 - RNA, 25 nt, Human
ggagaagaaagauuggggguggggg

SEQ ID NO: 498237 - RNA, 21 nt, Human
ggcagaaggcaguacccaaga

SEQ ID NO: 498238 - RNA, 27 nt, Human
gggcagagguggcuaggagaggucauc

SEQ ID NO: 498239 - RNA, 23 nt, Human
gggcgugugugugugugugugug

SEQ ID NO: 498240 - RNA, 18 nt, Human
ggggaggggaggaggggg

SEQ ID NO: 498241 - RNA, 18 nt, Human
gggguggguagagggagg

SEQ ID NO: 498242 - RNA, 21 nt, Human
gggguggguagagggaggggc

SEQ ID NO: 498243 - RNA, 18 nt, Human
ggguagagggaggggccg

SEQ ID NO: 498244 - RNA, 19 nt, Human
guaaagacagaaacagccc

SEQ ID NO: 498245 - RNA, 19 nt, Human
guggcuuggggccucccuc

SEQ ID NO: 498246 - RNA, 20 nt, Human
guguguguguguguguaagc

SEQ ID NO: 498247 - RNA, 21 nt, Human
gugugugugugugugugugug

SEQ ID NO: 498248 - RNA, 20 nt, Human
uacaaugaaaagcacaguuc

SEQ ID NO: 498249 - RNA, 19 nt, Human
uaccuuagggccugacagc

SEQ ID NO: 498250 - RNA, 18 nt, Human
uacuguaaagacagaaac

SEQ ID NO: 498251 - RNA, 23 nt, Human
uacuguaaagacagaaacagccc

SEQ ID NO: 498252 - RNA, 22 nt, Human
uagaacaagaagcccauaaagg

SEQ ID NO: 498253 - RNA, 18 nt, Human
uagaagggacucaaacca

SEQ ID NO: 498254 - RNA, 22 nt, Human
uagaccaucagggcaggaaccc

SEQ ID NO: 498255 - RNA, 20 nt, Human
uagagcauggaguaccuucc

SEQ ID NO: 498256 - RNA, 26 nt, Human
uaggagaagaaagauugggggugggg

SEQ ID NO: 498257 - RNA, 18 nt, Human
uaggagagauuggagagg

SEQ ID NO: 498258 - RNA, 21 nt, Human
uaggagaggucaucccucaga

SEQ ID NO: 498259 - RNA, 22 nt, Human
uaguccaagggaagacauaccu

SEQ ID NO: 498260 - RNA, 21 nt, Human
ucaauacagagggaagucaca

SEQ ID NO: 498261 - RNA, 19 nt, Human
ucagagcaggacagucaug

SEQ ID NO: 498262 - RNA, 22 nt, Human
ucagggagacauagaccaucag

SEQ ID NO: 498263 - RNA, 26 nt, Human
ucaugcagacagggcugaaugccaag

SEQ ID NO: 498264 - RNA, 18 nt, Human
uccaagggaagacauacc

SEQ ID NO: 498265 - RNA, 24 nt, Human
ucccucacuggggaggggaggagg

SEQ ID NO: 498266 - RNA, 19 nt, Human
ucccugcuuccugggagag

SEQ ID NO: 498267 - RNA, 20 nt, Human
ugaaaagcacaguucccugg

SEQ ID NO: 498268 - RNA, 22 nt, Human
ugaaaagcacaguucccuggga

SEQ ID NO: 498269 - RNA, 20 nt, Human
ugaacaucugaaauguggca

SEQ ID NO: 498270 - RNA, 18 nt, Human
ugagguaggugggacugg

SEQ ID NO: 498271 - RNA, 21 nt, Human
ugaugacugggauggaggcaa

SEQ ID NO: 498272 - RNA, 25 nt, Human
ugccucugacucaggaaguggaaaa

SEQ ID NO: 498273 - RNA, 24 nt, Human
ugcuaggagagauuggagaggaau

SEQ ID NO: 498274 - RNA, 19 nt, Human
uggaacccagagaagacug

SEQ ID NO: 498275 - RNA, 21 nt, Human
uggaggcauuagcccuggaaa

SEQ ID NO: 498276 - RNA, 25 nt, Human
uggcaaacagugcuauccaacagaa

SEQ ID NO: 498277 - RNA, 21 nt, Human
uggcagcucacagagaagggc

SEQ ID NO: 498278 - RNA, 24 nt, Human
uggcugguaaaaacccagagacau

SEQ ID NO: 498279 - RNA, 18 nt, Human
uggcuuggggccucccuc

SEQ ID NO: 498280 - RNA, 21 nt, Human
uggcuuggggccucccuccag

SEQ ID NO: 498281 - RNA, 24 nt, Human
ugggacugguaaagagaagaagca

SEQ ID NO: 498282 - RNA, 21 nt, Human
ugggagaagacagaaaucuua

SEQ ID NO: 498283 - RNA, 22 nt, Human
ugggagaagacagaaaucuuac

SEQ ID NO: 498284 - RNA, 18 nt, Human
ugggcagggggaucagca

SEQ ID NO: 498285 - RNA, 22 nt, Human
uggggaggggaggagggggcag

SEQ ID NO: 498286 - RNA, 22 nt, Human
uggguagagggaggggccggug

SEQ ID NO: 498287 - RNA, 20 nt, Human
ugugcagggcagggaacccu

SEQ ID NO: 498288 - RNA, 22 nt, Human
ugugcagggcagggaacccugg

SEQ ID NO: 498289 - RNA, 22 nt, Human
uguguguguguguguguaagcu

SEQ ID NO: 498290 - RNA, 18 nt, Human
ugugugugugugugugug

SEQ ID NO: 498291 - RNA, 18 nt, Human
ugugugugugugugugug

SEQ ID NO: 498292 - RNA, 18 nt, Human
ugugugugugugugugug

SEQ ID NO: 498293 - RNA, 18 nt, Human
ugugugugugugugugug

SEQ ID NO: 498294 - RNA, 18 nt, Human
ugugugugugugugugug

SEQ ID NO: 498295 - RNA, 18 nt, Human
ugugugugugugugugug

SEQ ID NO: 498296 - RNA, 18 nt, Human
ugugugugugugugugug

SEQ ID NO: 498297 - RNA, 18 nt, Human
ugugugugugugugugug

SEQ ID NO: 498298 - RNA, 21 nt, Human
ugugugugugugugugugugu

SEQ ID NO: 498299 - RNA, 21 nt, Human
ugugugugugugugugugugu

SEQ ID NO: 498300 - RNA, 21 nt, Human
ugugugugugugugugugugu

SEQ ID NO: 498301 - RNA, 21 nt, Human
ugugugugugugugugugugu

SEQ ID NO: 498302 - RNA, 21 nt, Human
ugugugugugugugugugugu

SEQ ID NO: 498303 - RNA, 21 nt, Human
ugugugugugugugugugugu

SEQ ID NO: 498304 - RNA, 21 nt, Human
ugugugugugugugugugugu

SEQ ID NO: 498305 - RNA, 21 nt, Human
ugugugugugugugugugugu

SEQ ID NO: 498306 - RNA, 21 nt, Human
ugugugugugugugugugugu

SEQ ID NO: 498307 - RNA, 21 nt, Human
ugugugugugugugugugugu

SEQ ID NO: 498308 - RNA, 21 nt, Human
ugugugugugugugugugugu

SEQ ID NO: 498309 - RNA, 21 nt, Human
ugugugugugugugugugugu

SEQ ID NO: 498310 - RNA, 21 nt, Human
ugugugugugugugugugugu

SEQ ID NO: 498311 - RNA, 22 nt, Human
ugugugugugugugugugugua

SEQ ID NO: 498312 - RNA, 22 nt, Human
ugugugugugugugugugugug

SEQ ID NO: 498313 - RNA, 22 nt, Human
ugugugugugugugugugugug

SEQ ID NO: 498314 - RNA, 22 nt, Human
ugugugugugugugugugugug

SEQ ID NO: 498315 - RNA, 22 nt, Human
ugugugugugugugugugugug

SEQ ID NO: 498316 - RNA, 22 nt, Human
ugugugugugugugugugugug

SEQ ID NO: 498317 - RNA, 23 nt, Human
uuacauacuuuuuugugugccuc

SEQ ID NO: 498318 - RNA, 21 nt, Human
uuagagucagggagacauaga

SEQ ID NO: 498319 - RNA, 19 nt, Human
uuccugggagagggggaug

SEQ ID NO: 498320 - RNA, 18 nt, Human
uugggggugggggaaaac

SEQ ID NO: 498321 - RNA, 22 nt, Human
uuugcaaugcuggaaacacucu

SEQ ID NO: 498322 - RNA, 26 nt, Human
aaacauucaacagugucacucaaaug

SEQ ID NO: 498323 - RNA, 19 nt, Human
aaacguccagaaacuacag

SEQ ID NO: 498324 - RNA, 19 nt, Human
aaccagguuucuguuugcu

SEQ ID NO: 498325 - RNA, 23 nt, Human
aagaaagagguacauuuccuugu

SEQ ID NO: 498326 - RNA, 18 nt, Human
acagaggagaaggacuga

SEQ ID NO: 498327 - RNA, 19 nt, Human
agccaaaaaauuuuucucc

SEQ ID NO: 498328 - RNA, 22 nt, Human
auaaagagaugguaaugacccu

SEQ ID NO: 498329 - RNA, 18 nt, Human
auaagagaugagaaggga

SEQ ID NO: 498330 - RNA, 21 nt, Human
augguaaaacaaaaaagauuc

SEQ ID NO: 498331 - RNA, 23 nt, Human
caauacugcacaaacguccagaa

SEQ ID NO: 498332 - RNA, 30 nt, Human
cacaaucaaguccuugccaucaacuugccc

SEQ ID NO: 498333 - RNA, 23 nt, Human
cagagugggacaaauccugcauu

SEQ ID NO: 498334 - RNA, 19 nt, Human
cagauggccccagagcagu

SEQ ID NO: 498335 - RNA, 24 nt, Human
cagcacugaaagcuaaaauguagg

SEQ ID NO: 498336 - RNA, 20 nt, Human
cagcagcaaaaguuuauaau

SEQ ID NO: 498337 - RNA, 21 nt, Human
caguuacuacuacagaugaau

SEQ ID NO: 498338 - RNA, 18 nt, Human
ccccagagcagugcuauc

SEQ ID NO: 498339 - RNA, 20 nt, Human
ccuugccucgcuuuucccuc

SEQ ID NO: 498340 - RNA, 20 nt, Human
cuccacgggcugccgcgucc

SEQ ID NO: 498341 - RNA, 24 nt, Human
cuccuuaugaacucuuuagcaauc

SEQ ID NO: 498342 - RNA, 23 nt, Human
gacuccacgggcugccgcguccu

SEQ ID NO: 498343 - RNA, 20 nt, Human
gaucagauggccccagagca

SEQ ID NO: 498344 - RNA, 26 nt, Human
gcuaaaauguaggacuuugacgaccc

SEQ ID NO: 498345 - RNA, 23 nt, Human
gcucccgauggugaucagauggc

SEQ ID NO: 498346 - RNA, 20 nt, Human
ggagaaggacugaagaaaug

SEQ ID NO: 498347 - RNA, 24 nt, Human
ggaugcuaggaccacugcuuuccc

SEQ ID NO: 498348 - RNA, 19 nt, Human
guaaaacaaaaaagauucc

SEQ ID NO: 498349 - RNA, 20 nt, Human
guuugcuuuucuccugucuu

SEQ ID NO: 498350 - RNA, 22 nt, Human
uaaaaaggcauuuuuagaaaca

SEQ ID NO: 498351 - RNA, 27 nt, Human
uaaaacaaaaaagauuccgacagagga

SEQ ID NO: 498352 - RNA, 19 nt, Human
uaauuuaagggagaaggaa

SEQ ID NO: 498353 - RNA, 18 nt, Human
uacuucucaccuccuuau

SEQ ID NO: 498354 - RNA, 20 nt, Human
ucaaaaccgggccugauugc

SEQ ID NO: 498355 - RNA, 24 nt, Human
ucaacuugccaaaagaauuaaaaa

SEQ ID NO: 498356 - RNA, 25 nt, Human
ucaauacugcacaaacguccagaaa

SEQ ID NO: 498357 - RNA, 27 nt, Human
ucuccugucuuuucaauacugcacaaa

SEQ ID NO: 498358 - RNA, 24 nt, Human
ucuuuagcaaucggccaguuacua

SEQ ID NO: 498359 - RNA, 22 nt, Human
ugaagaaagagguacauuuccu

SEQ ID NO: 498360 - RNA, 18 nt, Human
ugaagaaaugacuuacau

SEQ ID NO: 498361 - RNA, 22 nt, Human
ugagaagggagcuguggguggu

SEQ ID NO: 498362 - RNA, 20 nt, Human
ugauuuuuuuuucucuccuu

SEQ ID NO: 498363 - RNA, 23 nt, Human
ugcaauaaugauaagcugaauac

SEQ ID NO: 498364 - RNA, 28 nt, Human
ugccucgcuuuucccucagccgacucca

SEQ ID NO: 498365 - RNA, 25 nt, Human
ugccuugccucgcuuuucccucagc

SEQ ID NO: 498366 - RNA, 30 nt, Human
ugcuuucccccaugcauuuagcaaucucaa

SEQ ID NO: 498367 - RNA, 25 nt, Human
ugggacaaauccugcauuuucuaau

SEQ ID NO: 498368 - RNA, 21 nt, Human
ugguaaaacaaaaaagauucc

SEQ ID NO: 498369 - RNA, 18 nt, Human
uuaauucugaagaaagag

SEQ ID NO: 498370 - RNA, 19 nt, Human
uuaauucugaagaaagagg

SEQ ID NO: 498371 - RNA, 21 nt, Human
uuaauucugaagaaagaggua

SEQ ID NO: 498372 - RNA, 23 nt, Human
uuagcgucagguuauaaccaggu

SEQ ID NO: 498373 - RNA, 22 nt, Human
uucagaacauaagagaugagaa

SEQ ID NO: 498374 - RNA, 20 nt, Human
uuucuaaguauugagacugc

SEQ ID NO: 498375 - RNA, 24 nt, Human
uuugcucccgauggugaucagaug

SEQ ID NO: 498376 - RNA, 21 nt, Human
aagcaacagcagccauuuccc

SEQ ID NO: 498377 - RNA, 21 nt, Human
cccagaagcaacagcagccau

SEQ ID NO: 498378 - RNA, 20 nt, Human
uggcccagaagcaacagcag

SEQ ID NO: 498379 - RNA, 19 nt, Human
uuagccuagacauuuuaag

SEQ ID NO: 498380 - RNA, 24 nt, Human
aaaaggaccacccaguuacagcac

SEQ ID NO: 498381 - RNA, 19 nt, Human
aaaggaccacccaguuaca

SEQ ID NO: 498382 - RNA, 22 nt, Human
aaaggaccacccaguuacagca

SEQ ID NO: 498383 - RNA, 20 nt, Human
aaccuaacaaccaacugaga

SEQ ID NO: 498384 - RNA, 18 nt, Human
aagaaaacauuuugaagc

SEQ ID NO: 498385 - RNA, 19 nt, Human
aagagaaaauauacucaaa

SEQ ID NO: 498386 - RNA, 20 nt, Human
aaggagcaccaaugggaguc

SEQ ID NO: 498387 - RNA, 22 nt, Human
acaaaauauaccuaaagacuua

SEQ ID NO: 498388 - RNA, 21 nt, Human
acagagcagccuacacaugcc

SEQ ID NO: 498389 - RNA, 22 nt, Human
accaaaucucuccauuauuuac

SEQ ID NO: 498390 - RNA, 21 nt, Human
accaaugggagucagaaaaga

SEQ ID NO: 498391 - RNA, 18 nt, Human
acgugaaacagggaaaua

SEQ ID NO: 498392 - RNA, 23 nt, Human
acuuguugcccaaaaucuuuggg

SEQ ID NO: 498393 - RNA, 19 nt, Human
acuuuauacucaaggaacu

SEQ ID NO: 498394 - RNA, 25 nt, Human
agaaaagaacucuggaguucuccca

SEQ ID NO: 498395 - RNA, 22 nt, Human
agagaaaauauacucaaaucca

SEQ ID NO: 498396 - RNA, 21 nt, Human
agagcagccuacacaugccaa

SEQ ID NO: 498397 - RNA, 18 nt, Human
agaugccaagcaucaaaa

SEQ ID NO: 498398 - RNA, 18 nt, Human
agaugccaagcaucaaaa

SEQ ID NO: 498399 - RNA, 21 nt, Human
agcacucggcggcgguggcgg

SEQ ID NO: 498400 - RNA, 21 nt, Human
agcacucggcggcgguggcgg

SEQ ID NO: 498401 - RNA, 27 nt, Human
agcacucggcggcgguggcgguggcga

SEQ ID NO: 498402 - RNA, 22 nt, Human
agcuaagaucaagaaaaaacaa

SEQ ID NO: 498403 - RNA, 18 nt, Human
agucagaaaagaacucug

SEQ ID NO: 498404 - RNA, 23 nt, Human
auaaaaccuauauacaagcaugu

SEQ ID NO: 498405 - RNA, 20 nt, Human
auagagacagcacucggcgg

SEQ ID NO: 498406 - RNA, 20 nt, Human
auagagacagcacucggcgg

SEQ ID NO: 498407 - RNA, 22 nt, Human
auggaauaaaaauaagcagauc

SEQ ID NO: 498408 - RNA, 22 nt, Human
caaaacagcuuuaaugcuuucu

SEQ ID NO: 498409 - RNA, 22 nt, Human
caaagcacugaagaaugacaug

SEQ ID NO: 498410 - RNA, 22 nt, Human
caacaaaucaagagcaucauaa

SEQ ID NO: 498411 - RNA, 21 nt, Human
caaccuaacaaccaacugaga

SEQ ID NO: 498412 - RNA, 24 nt, Human
caaguauauuaaauuaaggccaaa

SEQ ID NO: 498413 - RNA, 18 nt, Human
cagagcagccuacacaug

SEQ ID NO: 498414 - RNA, 24 nt, Human
cauuacacuccucagguaauuuua

SEQ ID NO: 498415 - RNA, 19 nt, Human
ccccauagacaccucucgc

SEQ ID NO: 498416 - RNA, 19 nt, Human
ccccauagacaccucucgc

SEQ ID NO: 498417 - RNA, 20 nt, Human
cgagcaggagcugcgccgca

SEQ ID NO: 498418 - RNA, 20 nt, Human
cgagcaggagcugcgccgca

SEQ ID NO: 498419 - RNA, 19 nt, Human
cggcggcgguggcgguggc

SEQ ID NO: 498420 - RNA, 19 nt, Human
cggcggcgguggcgguggc

SEQ ID NO: 498421 - RNA, 19 nt, Human
cggcggcgguggcgguggc

SEQ ID NO: 498422 - RNA, 18 nt, Human
cggcgguggcgguggcgg

SEQ ID NO: 498423 - RNA, 18 nt, Human
cggcgguggcgguggcgg

SEQ ID NO: 498424 - RNA, 21 nt, Human
cgguggcgguggcgguggcgg

SEQ ID NO: 498425 - RNA, 21 nt, Human
cgguggcgguggcgguggcgg

SEQ ID NO: 498426 - RNA, 25 nt, Human
cuauaaaaucuucaaagcacugaag

SEQ ID NO: 498427 - RNA, 25 nt, Human
cuauauacaagcauguguguagcuc

SEQ ID NO: 498428 - RNA, 27 nt, Human
cucccaguuccuucugaacuacauuuc

SEQ ID NO: 498429 - RNA, 25 nt, Human
cuccucaguaguuucuugucuuuuu

SEQ ID NO: 498430 - RNA, 22 nt, Human
cuccuccuccuccuccucgcca

SEQ ID NO: 498431 - RNA, 21 nt, Human
cucggcggcgguggcgguggc

SEQ ID NO: 498432 - RNA, 23 nt, Human
cuuaaaaggggucaugcuagaag

SEQ ID NO: 498433 - RNA, 21 nt, Human
gaaggguguaaagcugguuug

SEQ ID NO: 498434 - RNA, 22 nt, Human
gaaugcguuuuuuuuuuucuuu

SEQ ID NO: 498435 - RNA, 19 nt, Human
gacgugaaacagggaaaua

SEQ ID NO: 498436 - RNA, 19 nt, Human
gaguagauaauggguucau

SEQ ID NO: 498437 - RNA, 26 nt, Human
gaucaagaaaaaacaaauuuucugau

SEQ ID NO: 498438 - RNA, 27 nt, Human
gaucaagaaaaaacaaauuuucugaua

SEQ ID NO: 498439 - RNA, 25 nt, Human
gcggcagcgggugccccauagacac

SEQ ID NO: 498440 - RNA, 25 nt, Human
gcggcagcgggugccccauagacac

SEQ ID NO: 498441 - RNA, 20 nt, Human
gcggcgguggcgguggcggu

SEQ ID NO: 498442 - RNA, 20 nt, Human
gcggcgguggcgguggcggu

SEQ ID NO: 498443 - RNA, 23 nt, Human
gcggcgguggcgguggcgguggc

SEQ ID NO: 498444 - RNA, 23 nt, Human
gcggcgguggcgguggcgguggc

SEQ ID NO: 498445 - RNA, 20 nt, Human
gcgguagcggcggcggcagc

SEQ ID NO: 498446 - RNA, 20 nt, Human
gcgguagcggcggcggcagc

SEQ ID NO: 498447 - RNA, 20 nt, Human
gcgguggcgguagcggcggc

SEQ ID NO: 498448 - RNA, 20 nt, Human
gcgguggcgguagcggcggc

SEQ ID NO: 498449 - RNA, 20 nt, Human
gcgguggcgguggcgguagc

SEQ ID NO: 498450 - RNA, 20 nt, Human
gcgguggcgguggcgguagc

SEQ ID NO: 498451 - RNA, 20 nt, Human
gcgguggcgguggcgguggc

SEQ ID NO: 498452 - RNA, 20 nt, Human
gcgguggcgguggcgguggc

SEQ ID NO: 498453 - RNA, 24 nt, Human
gcgguggcgguggcgguggcggua

SEQ ID NO: 498454 - RNA, 24 nt, Human
gcgguggcgguggcgguggcggua

SEQ ID NO: 498455 - RNA, 20 nt, Human
gcugcgccgcaccgugcugc

SEQ ID NO: 498456 - RNA, 22 nt, Human
ggcagcgggugccccauagaca

SEQ ID NO: 498457 - RNA, 22 nt, Human
ggcagcgggugccccauagaca

SEQ ID NO: 498458 - RNA, 20 nt, Human
ggcggcgguggcgguggcgg

SEQ ID NO: 498459 - RNA, 20 nt, Human
ggcggcgguggcgguggcgg

SEQ ID NO: 498460 - RNA, 20 nt, Human
ggcggcgguggcgguggcgg

SEQ ID NO: 498461 - RNA, 20 nt, Human
ggcggcgguggcgguggcgg

SEQ ID NO: 498462 - RNA, 19 nt, Human
ggcgguggcgguggcggug

SEQ ID NO: 498463 - RNA, 19 nt, Human
ggcgguggcgguggcggug

SEQ ID NO: 498464 - RNA, 23 nt, Human
ggcgguggcgguggcgguggcgg

SEQ ID NO: 498465 - RNA, 23 nt, Human
ggcgguggcgguggcgguggcgg

SEQ ID NO: 498466 - RNA, 26 nt, Human
ggcuacaaaauuuaaaaaaaaaaaaa

SEQ ID NO: 498467 - RNA, 20 nt, Human
gguagcggcggcggcagcgg

SEQ ID NO: 498468 - RNA, 20 nt, Human
gguagcggcggcggcagcgg

SEQ ID NO: 498469 - RNA, 25 nt, Human
gguggcgguggcgguggcgguagcg

SEQ ID NO: 498470 - RNA, 21 nt, Human
gucaugcuagaauaaaccuaa

SEQ ID NO: 498471 - RNA, 20 nt, Human
guggcgguagcggcggcggc

SEQ ID NO: 498472 - RNA, 20 nt, Human
guggcgguagcggcggcggc

SEQ ID NO: 498473 - RNA, 23 nt, Human
guggcgguagcggcggcggcagc

SEQ ID NO: 498474 - RNA, 23 nt, Human
guggcgguagcggcggcggcagc

SEQ ID NO: 498475 - RNA, 20 nt, Human
guggcgguggcgguagcggc

SEQ ID NO: 498476 - RNA, 23 nt, Human
guggcgguggcgguagcggcggc

SEQ ID NO: 498477 - RNA, 24 nt, Human
guggcgguggcgguagcggcggcg

SEQ ID NO: 498478 - RNA, 20 nt, Human
guggcgguggcgguggcggu

SEQ ID NO: 498479 - RNA, 20 nt, Human
guggcgguggcgguggcggu

SEQ ID NO: 498480 - RNA, 23 nt, Human
guggcgguggcgguggcgguagc

SEQ ID NO: 498481 - RNA, 21 nt, Human
uaaaaaggaccacccaguuac

SEQ ID NO: 498482 - RNA, 23 nt, Human
uaaaagagccugaguucuucucu

SEQ ID NO: 498483 - RNA, 21 nt, Human
uaaaauaacuguagcuucaac

SEQ ID NO: 498484 - RNA, 25 nt, Human
uaagaucaagaaaaaacaaauuuuc

SEQ ID NO: 498485 - RNA, 18 nt, Human
uaauggguucauuuaguu

SEQ ID NO: 498486 - RNA, 22 nt, Human
uaaugucuaagagaaaauauac

SEQ ID NO: 498487 - RNA, 21 nt, Human
uaauuugguacaaaauauacc

SEQ ID NO: 498488 - RNA, 28 nt, Human
uacaaaauauaccuaaagaccggggccc

SEQ ID NO: 498489 - RNA, 26 nt, Human
uacacaaaaaaaauaagcauuacacu

SEQ ID NO: 498490 - RNA, 21 nt, Human
uaccguaaagucuuccuacac

SEQ ID NO: 498491 - RNA, 20 nt, Human
uagaaacugacagacacuag

SEQ ID NO: 498492 - RNA, 24 nt, Human
uagaaggagcaccaaugggaguca

SEQ ID NO: 498493 - RNA, 20 nt, Human
uagagacagcacucggcggc

SEQ ID NO: 498494 - RNA, 20 nt, Human
uagagacagcacucggcggc

SEQ ID NO: 498495 - RNA, 23 nt, Human
uagccuguuuucucaccugagaa

SEQ ID NO: 498496 - RNA, 25 nt, Human
uagcuucaacaucuugaguaccagu

SEQ ID NO: 498497 - RNA, 26 nt, Human
uaguagguacuuguugcccaaaaucu

SEQ ID NO: 498498 - RNA, 20 nt, Human
uauauacaagcaugugugua

SEQ ID NO: 498499 - RNA, 22 nt, Human
uauuugaucccuucggaauuca

SEQ ID NO: 498500 - RNA, 20 nt, Human
uauuuuguuguuuuguaccc

SEQ ID NO: 498501 - RNA, 24 nt, Human
ucaagagcaucauaagaauggcua

SEQ ID NO: 498502 - RNA, 21 nt, Human
ucacaaauucuuuggcuauga

SEQ ID NO: 498503 - RNA, 21 nt, Human
ucacaaauucuuuggcuauga

SEQ ID NO: 498504 - RNA, 24 nt, Human
ucagaaacacucucuaaagugcaa

SEQ ID NO: 498505 - RNA, 20 nt, Human
ucagcuauauauauauauau

SEQ ID NO: 498506 - RNA, 21 nt, Human
ucauaugguaucucuaauuau

SEQ ID NO: 498507 - RNA, 23 nt, Human
uccacagcgaauuuuuccaaaag

SEQ ID NO: 498508 - RNA, 22 nt, Human
uccaucauuucgggguagaguu

SEQ ID NO: 498509 - RNA, 21 nt, Human
uccuccuccuccuccucgcca

SEQ ID NO: 498510 - RNA, 27 nt, Human
uccuccuccuccuccucgccauagaga

SEQ ID NO: 498511 - RNA, 27 nt, Human
uccuccuccuccuccucgccauagaga

SEQ ID NO: 498512 - RNA, 21 nt, Human
ucgcugaaucgacaguuugcc

SEQ ID NO: 498513 - RNA, 24 nt, Human
ugaaaggggggggaaagguacugu

SEQ ID NO: 498514 - RNA, 18 nt, Human
ugaaggguguaaagcugg

SEQ ID NO: 498515 - RNA, 19 nt, Human
ugaguaccaguuuccuggc

SEQ ID NO: 498516 - RNA, 18 nt, Human
ugauaaaacagguuuaga

SEQ ID NO: 498517 - RNA, 19 nt, Human
ugaugcaacuacuacguug

SEQ ID NO: 498518 - RNA, 21 nt, Human
ugauugaaguguagguaacac

SEQ ID NO: 498519 - RNA, 20 nt, Human
ugcugcgccgucgcuuuucg

SEQ ID NO: 498520 - RNA, 20 nt, Human
uggaauaaaaauaagcagug

SEQ ID NO: 498521 - RNA, 19 nt, Human
uggcauagugagggcacaa

SEQ ID NO: 498522 - RNA, 19 nt, Human
uggcauagugagggcacaa

SEQ ID NO: 498523 - RNA, 21 nt, Human
uggucuggucacauauucugc

SEQ ID NO: 498524 - RNA, 22 nt, Human
ugguuucugaugcaacuacuac

SEQ ID NO: 498525 - RNA, 20 nt, Human
uguaaagcugguuugaaaau

SEQ ID NO: 498526 - RNA, 21 nt, Human
uguaaaguuggcagauuuuuc

SEQ ID NO: 498527 - RNA, 21 nt, Human
ugucacacacgcuugcuaaca

SEQ ID NO: 498528 - RNA, 18 nt, Human
ugugacucauaugguauc

SEQ ID NO: 498529 - RNA, 25 nt, Human
uuaguacugaaaggcagacaauaaa

SEQ ID NO: 498530 - RNA, 20 nt, Human
uuccugaaggguguaaagcu

SEQ ID NO: 498531 - RNA, 19 nt, Human
uucuuuggcuaugaucuac

SEQ ID NO: 498532 - RNA, 19 nt, Human
uucuuuggcuaugaucuac

SEQ ID NO: 498533 - RNA, 21 nt, Human
uugcccaaaaucuuuggccac

SEQ ID NO: 498534 - RNA, 24 nt, Human
uuggagauuugcuaauauuacuga

SEQ ID NO: 498535 - RNA, 22 nt, Human
uuuaaaaaaaaaaaaaggguaa

SEQ ID NO: 498536 - RNA, 20 nt, Human
uuugcacaaccaauuuuccu

SEQ ID NO: 498537 - RNA, 23 nt, Human
uuuuaucagcuauauauauauau

SEQ ID NO: 498538 - RNA, 25 nt, Human
uuuuaucagcuauauauauauauau

SEQ ID NO: 498539 - RNA, 21 nt, Human
uuuuuuuuuuuacuuagcaaa

SEQ ID NO: 498540 - RNA, 22 nt, Human
uuuuuuuuuuuuacuuagcaaa

SEQ ID NO: 498541 - RNA, 18 nt, Human
uuuuuuuuuuuuuuacuu

SEQ ID NO: 498542 - RNA, 30 nt, Human
aaaagaaaaagaaugacaacagguaagagg

SEQ ID NO: 498543 - RNA, 19 nt, Human
aaaauacaacagacaugac

SEQ ID NO: 498544 - RNA, 19 nt, Human
aaaccugaauggcacaaug

SEQ ID NO: 498545 - RNA, 20 nt, Human
aaagagagacuacaaaagug

SEQ ID NO: 498546 - RNA, 18 nt, Human
aacagacaugacccaaaa

SEQ ID NO: 498547 - RNA, 24 nt, Human
acaacucaagaacccaaauuaucu

SEQ ID NO: 498548 - RNA, 18 nt, Human
acgaagccacaaagcuac

SEQ ID NO: 498549 - RNA, 22 nt, Human
acggcagccccuggcccggagc

SEQ ID NO: 498550 - RNA, 25 nt, Human
acggcggcgacggcagccccuggcc

SEQ ID NO: 498551 - RNA, 20 nt, Human
acuaguuuccuucaggauca

SEQ ID NO: 498552 - RNA, 22 nt, Human
agacuuaaaagaugcuucagug

SEQ ID NO: 498553 - RNA, 25 nt, Human
agagauuagcaacaaauuuaaaaga

SEQ ID NO: 498554 - RNA, 19 nt, Human
agaggcuaccugaggggaa

SEQ ID NO: 498555 - RNA, 22 nt, Human
agccccuggcccggagcucuuu

SEQ ID NO: 498556 - RNA, 20 nt, Human
aggaaacgcgagcguggugg

SEQ ID NO: 498557 - RNA, 22 nt, Human
aggaggaaacgcgagcguggug

SEQ ID NO: 498558 - RNA, 20 nt, Human
aggcaaccagagaggagagg

SEQ ID NO: 498559 - RNA, 19 nt, Human
agguacagugugcucaaaa

SEQ ID NO: 498560 - RNA, 22 nt, Human
agguggggaguggaggccugga

SEQ ID NO: 498561 - RNA, 20 nt, Human
augauucuuacuccuccauu

SEQ ID NO: 498562 - RNA, 19 nt, Human
auucauucacuugagugaa

SEQ ID NO: 498563 - RNA, 19 nt, Human
caaaacaacucaagaaccc

SEQ ID NO: 498564 - RNA, 21 nt, Human
caacagacaugacccaaaaau

SEQ ID NO: 498565 - RNA, 22 nt, Human
caacccauuaccuaagaacacc

SEQ ID NO: 498566 - RNA, 22 nt, Human
cacaauggaacacagacuuaaa

SEQ ID NO: 498567 - RNA, 19 nt, Human
cacccugcagagccuggcg

SEQ ID NO: 498568 - RNA, 21 nt, Human
cacgcuugcggaagacggccc

SEQ ID NO: 498569 - RNA, 21 nt, Human
cagcacagagcaauucauuuc

SEQ ID NO: 498570 - RNA, 18 nt, Human
cagcacaguaagcaccac

SEQ ID NO: 498571 - RNA, 21 nt, Human
cagcacaguaagcaccacucu

SEQ ID NO: 498572 - RNA, 21 nt, Human
cagcagaaagcccgucaucuc

SEQ ID NO: 498573 - RNA, 21 nt, Human
caggaucaaauccaggauauu

SEQ ID NO: 498574 - RNA, 23 nt, Human
caggcacacaggcgaagggcaag

SEQ ID NO: 498575 - RNA, 22 nt, Human
caguaaaauuguuugcuuuuca

SEQ ID NO: 498576 - RNA, 25 nt, Human
cauucuggaguucucaugaaugaag

SEQ ID NO: 498577 - RNA, 23 nt, Human
ccaaaacaacucaagaacccaaa

SEQ ID NO: 498578 - RNA, 24 nt, Human
ccacaggaauaaaaaacacuggga

SEQ ID NO: 498579 - RNA, 23 nt, Human
cccacaggaauaaaaaacacugg

SEQ ID NO: 498580 - RNA, 20 nt, Human
cccauaagcuuuuaaaaugc

SEQ ID NO: 498581 - RNA, 22 nt, Human
ccccugcgacuccgugcguguu

SEQ ID NO: 498582 - RNA, 26 nt, Human
cccgacggcggcgacggcagccccuu

SEQ ID NO: 498583 - RNA, 19 nt, Human
cccgccugcggcccucuuc

SEQ ID NO: 498584 - RNA, 26 nt, Human
cccuggcccggagcucuuuucccucu

SEQ ID NO: 498585 - RNA, 19 nt, Human
ccgugcguguucgcucugc

SEQ ID NO: 498586 - RNA, 23 nt, Human
ccgugcguguucgcucugccugu

SEQ ID NO: 498587 - RNA, 20 nt, Human
ccugagcuuccuaccccagu

SEQ ID NO: 498588 - RNA, 19 nt, Human
cgacagggcccgcgaagcg

SEQ ID NO: 498589 - RNA, 22 nt, Human
cgcgcaggagcagaaguaacag

SEQ ID NO: 498590 - RNA, 19 nt, Human
cggaagacggcccgccugc

SEQ ID NO: 498591 - RNA, 22 nt, Human
cggagcucuuuucccucuaccc

SEQ ID NO: 498592 - RNA, 18 nt, Human
cucaguaucuacaaccca

SEQ ID NO: 498593 - RNA, 20 nt, Human
cucuaccccggaucugcucc

SEQ ID NO: 498594 - RNA, 21 nt, Human
cugagaaucagaguaagaauc

SEQ ID NO: 498595 - RNA, 20 nt, Human
cuggaagcccucacagcuca

SEQ ID NO: 498596 - RNA, 21 nt, Human
cuggaguucucaugaaugaag

SEQ ID NO: 498597 - RNA, 21 nt, Human
cuggcgggcugacuccccgac

SEQ ID NO: 498598 - RNA, 24 nt, Human
gaccaucugaaaucacauuacuga

SEQ ID NO: 498599 - RNA, 20 nt, Human
gaguuuuuuuuuuuuuuuuu

SEQ ID NO: 498600 - RNA, 20 nt, Human
gaguuuuuuuuuuuuuuuuu

SEQ ID NO: 498601 - RNA, 25 nt, Human
gcccgcuccucccccuuugcgcgcc

SEQ ID NO: 498602 - RNA, 19 nt, Human
ggaagacucaguaucuaca

SEQ ID NO: 498603 - RNA, 20 nt, Human
ggcagccccuggcccggagc

SEQ ID NO: 498604 - RNA, 28 nt, Human
ggcccggagcucuuuucccucuacccca

SEQ ID NO: 498605 - RNA, 22 nt, Human
ggcgacggcagcggcuccaacc

SEQ ID NO: 498606 - RNA, 19 nt, Human
gggaaggaagcacaaaagg

SEQ ID NO: 498607 - RNA, 20 nt, Human
gggaguggaggccuggaagc

SEQ ID NO: 498608 - RNA, 23 nt, Human
guuuuuuuuuuuuuuuuuuuggg

SEQ ID NO: 498609 - RNA, 22 nt, Human
uaaaaaacacugggaaggggua

SEQ ID NO: 498610 - RNA, 21 nt, Human
uaaaaacaucuuuugucuuca

SEQ ID NO: 498611 - RNA, 20 nt, Human
uaaaacaaaagucuuucugc

SEQ ID NO: 498612 - RNA, 23 nt, Human
uaaaagaugcuucaguggucaac

SEQ ID NO: 498613 - RNA, 19 nt, Human
uaaagacacauuccuguua

SEQ ID NO: 498614 - RNA, 18 nt, Human
uaagaacaccauuuuguu

SEQ ID NO: 498615 - RNA, 21 nt, Human
uacagugugcucaaaagaagc

SEQ ID NO: 498616 - RNA, 19 nt, Human
uacugaaaauacaacagac

SEQ ID NO: 498617 - RNA, 25 nt, Human
uagcaacaaauuuaaaagaaaaaga

SEQ ID NO: 498618 - RNA, 24 nt, Human
ucaacacucauucuggaguucuca

SEQ ID NO: 498619 - RNA, 19 nt, Human
ucagaaaaggaaaggaaga

SEQ ID NO: 498620 - RNA, 30 nt, Human
ucagaaaaggaaaggaagacucaguaucuu

SEQ ID NO: 498621 - RNA, 25 nt, Human
ucagcacagagcaauucauuuccuc

SEQ ID NO: 498622 - RNA, 21 nt, Human
uccaaaacaacucaagaaccc

SEQ ID NO: 498623 - RNA, 23 nt, Human
uccauacuguagucauucaaaaa

SEQ ID NO: 498624 - RNA, 19 nt, Human
ucccccuuugcgcgccccu

SEQ ID NO: 498625 - RNA, 22 nt, Human
ucccuggaagcccucacagcuc

SEQ ID NO: 498626 - RNA, 21 nt, Human
uccgugcguguucgcucugcc

SEQ ID NO: 498627 - RNA, 24 nt, Human
uccgugcguguucgcucugccugu

SEQ ID NO: 498628 - RNA, 25 nt, Human
uccgugcguguucgcucugccugug

SEQ ID NO: 498629 - RNA, 19 nt, Human
ucgcucugcuuuuucauau

SEQ ID NO: 498630 - RNA, 19 nt, Human
ucuaccccggaucugcucc

SEQ ID NO: 498631 - RNA, 25 nt, Human
ucuuaaauaccagcuuauaauacuu

SEQ ID NO: 498632 - RNA, 23 nt, Human
ucuuuugucuucaguaaaacaaa

SEQ ID NO: 498633 - RNA, 23 nt, Human
ugaaaucacauuacugaaaauac

SEQ ID NO: 498634 - RNA, 22 nt, Human
ugacagcaaaccugaauggcac

SEQ ID NO: 498635 - RNA, 24 nt, Human
ugagagaacuagucucgaguuuuu

SEQ ID NO: 498636 - RNA, 18 nt, Human
ugaggaaagcaaaugucc

SEQ ID NO: 498637 - RNA, 20 nt, Human
ugaggaaagcaaauguccuc

SEQ ID NO: 498638 - RNA, 25 nt, Human
ugaggggaaggaagcacaaaaggga

SEQ ID NO: 498639 - RNA, 23 nt, Human
ugcguguucgcucugccugugag

SEQ ID NO: 498640 - RNA, 21 nt, Human
ugcuuuuucauauucuucugg

SEQ ID NO: 498641 - RNA, 21 nt, Human
uggaagcccucacagcucagc

SEQ ID NO: 498642 - RNA, 21 nt, Human
uggaaggaaaaguagagaaau

SEQ ID NO: 498643 - RNA, 21 nt, Human
uggaguagagaagugggagaa

SEQ ID NO: 498644 - RNA, 22 nt, Human
uggaugcugguggcaggaggca

SEQ ID NO: 498645 - RNA, 22 nt, Human
uggcacaauggaacacagacuu

SEQ ID NO: 498646 - RNA, 18 nt, Human
uggcaggaggcaaccaga

SEQ ID NO: 498647 - RNA, 23 nt, Human
uggcgacggcagcggcuccaacc

SEQ ID NO: 498648 - RNA, 22 nt, Human
uggcgggcugacgagcuggcgg

SEQ ID NO: 498649 - RNA, 18 nt, Human
uggugggacuggcuccag

SEQ ID NO: 498650 - RNA, 22 nt, Human
uggugggacuggcuccaggcac

SEQ ID NO: 498651 - RNA, 24 nt, Human
ugugaggaaagcaaauguccucga

SEQ ID NO: 498652 - RNA, 22 nt, Human
uuaaauaccagcuuauaauacu

SEQ ID NO: 498653 - RNA, 23 nt, Human
uucagcacagagcaauucauuuc

SEQ ID NO: 498654 - RNA, 20 nt, Human
uuccauuuucccuggaagcc

SEQ ID NO: 498655 - RNA, 20 nt, Human
uucccuggaagcccucacag

SEQ ID NO: 498656 - RNA, 23 nt, Human
uugaauuacaaagcuacuuuuaa

SEQ ID NO: 498657 - RNA, 23 nt, Human
uuuacaagcaucuuaaauaccag

SEQ ID NO: 498658 - RNA, 18 nt, Human
uuuacagugcaagccaga

SEQ ID NO: 498659 - RNA, 19 nt, Human
uuuuuuuuuuuuuugccag

SEQ ID NO: 498660 - RNA, 21 nt, Human
uuuuuuuuuuuuuugccagug

SEQ ID NO: 498661 - RNA, 22 nt, Human
uuuuuuuuuuuuuuuuugccag

SEQ ID NO: 498662 - RNA, 20 nt, Human
uuuuuuuuuuuuuuuuuugg

SEQ ID NO: 498663 - RNA, 22 nt, Human
acccugacuucccaagagaaca

SEQ ID NO: 498664 - RNA, 22 nt, Human
accuuaauccucaucauagcau

SEQ ID NO: 498665 - RNA, 19 nt, Human
aggcagagagaagaccugg

SEQ ID NO: 498666 - RNA, 20 nt, Human
caagaccccucucucucuuc

SEQ ID NO: 498667 - RNA, 20 nt, Human
caagagaacaacccauucuu

SEQ ID NO: 498668 - RNA, 21 nt, Human
caaggccaggcugucuuccag

SEQ ID NO: 498669 - RNA, 21 nt, Human
caccuuaauccucaucauagc

SEQ ID NO: 498670 - RNA, 19 nt, Human
cagcaaaaagggguccgug

SEQ ID NO: 498671 - RNA, 21 nt, Human
cagcaaaaagggguccguguc

SEQ ID NO: 498672 - RNA, 21 nt, Human
cagucccaacacucaucagca

SEQ ID NO: 498673 - RNA, 23 nt, Human
ccaacacucaucagcaaaaaggg

SEQ ID NO: 498674 - RNA, 19 nt, Human
ccucaguggcaagggugac

SEQ ID NO: 498675 - RNA, 25 nt, Human
ccuucagauuccacugagcuugucu

SEQ ID NO: 498676 - RNA, 21 nt, Human
cgcuuuggcuccugguggucu

SEQ ID NO: 498677 - RNA, 18 nt, Human
cguggcccuaccuaucca

SEQ ID NO: 498678 - RNA, 21 nt, Human
cugggccuggaggcucgcuuu

SEQ ID NO: 498679 - RNA, 23 nt, Human
gacugugugcaggugggcaaggc

SEQ ID NO: 498680 - RNA, 24 nt, Human
gagcuugucuagaaggcuuugggu

SEQ ID NO: 498681 - RNA, 20 nt, Human
ggcugggcacugggagcugc

SEQ ID NO: 498682 - RNA, 18 nt, Human
gggcacugggagcugccg

SEQ ID NO: 498683 - RNA, 23 nt, Human
guggucucuggaggaugcaggca

SEQ ID NO: 498684 - RNA, 19 nt, Human
uacugacccugucccaggc

SEQ ID NO: 498685 - RNA, 18 nt, Human
ucaacaccuuaauccuca

SEQ ID NO: 498686 - RNA, 18 nt, Human
uccaucccaucugauacc

SEQ ID NO: 498687 - RNA, 24 nt, Human
ucccaggccuuuuugugucucgcc

SEQ ID NO: 498688 - RNA, 21 nt, Human
ugacaauuaggcagagagaag

SEQ ID NO: 498689 - RNA, 22 nt, Human
ugacuuguacugacccuguccc

SEQ ID NO: 498690 - RNA, 24 nt, Human
ugaguuguuuaaauugggaagagg

SEQ ID NO: 498691 - RNA, 18 nt, Human
ugcugggccuggaggcuc

SEQ ID NO: 498692 - RNA, 23 nt, Human
uggaggaugcaggcaugaagccu

SEQ ID NO: 498693 - RNA, 20 nt, Human
ugggcacugggagcugccgg

SEQ ID NO: 498694 - RNA, 20 nt, Human
uggguggcugggcacuggga

SEQ ID NO: 498695 - RNA, 18 nt, Human
uguacugacccuguccca

SEQ ID NO: 498696 - RNA, 22 nt, Human
ugucauuuaucucugaaagagg

SEQ ID NO: 498697 - RNA, 18 nt, Human
uguccucucccaggaccu

SEQ ID NO: 498698 - RNA, 22 nt, Human
ugugcaggugggcaaggggaac

SEQ ID NO: 498699 - RNA, 20 nt, Human
uucucccaagucccucauug

SEQ ID NO: 498700 - RNA, 19 nt, Human
uugcugggccuggaggcuc

SEQ ID NO: 498701 - RNA, 18 nt, Human
uuguacugacccuguccc

SEQ ID NO: 498702 - RNA, 28 nt, Human
aaaaaccaaagagaaaccugauggauaa

SEQ ID NO: 498703 - RNA, 22 nt, Human
aagcuaaagcaaacaaaagcaa

SEQ ID NO: 498704 - RNA, 24 nt, Human
aguaauauuuccccccuaaccucc

SEQ ID NO: 498705 - RNA, 22 nt, Human
agucacuagaaucuucuguguc

SEQ ID NO: 498706 - RNA, 24 nt, Human
auggaccacaucacugaagcauuu

SEQ ID NO: 498707 - RNA, 20 nt, Human
caccauguauagucccaagu

SEQ ID NO: 498708 - RNA, 26 nt, Human
cacucuauucaccgcuguuaccaagc

SEQ ID NO: 498709 - RNA, 23 nt, Human
cauuuuucauauguccugcuggu

SEQ ID NO: 498710 - RNA, 19 nt, Human
ccaaagggaaaaugaaaaa

SEQ ID NO: 498711 - RNA, 20 nt, Human
ccaagcuaaagcaaacaaaa

SEQ ID NO: 498712 - RNA, 23 nt, Human
ccccccuaaccuccuguaaguuc

SEQ ID NO: 498713 - RNA, 25 nt, Human
ccucuccguuuacaaaaaccaaaga

SEQ ID NO: 498714 - RNA, 18 nt, Human
cuaaagcaaacaaaagca

SEQ ID NO: 498715 - RNA, 21 nt, Human
cuagaaucuucugugucucaa

SEQ ID NO: 498716 - RNA, 19 nt, Human
cucaauguguuuaacagcu

SEQ ID NO: 498717 - RNA, 24 nt, Human
gucacuagaaucuucugugucuca

SEQ ID NO: 498718 - RNA, 22 nt, Human
uaauggaccacaucacugaagc

SEQ ID NO: 498719 - RNA, 24 nt, Human
uaccaagcuaaagcaaacaaaagc

SEQ ID NO: 498720 - RNA, 21 nt, Human
uacuuaacaaauggauggcac

SEQ ID NO: 498721 - RNA, 23 nt, Human
ucacuagaaucuucugugucuca

SEQ ID NO: 498722 - RNA, 22 nt, Human
ugaagcauuuuucauauguccu

SEQ ID NO: 498723 - RNA, 19 nt, Human
uggauggcacacacucgga

SEQ ID NO: 498724 - RNA, 21 nt, Human
uuaccaagcuaaagcaaacaa

SEQ ID NO: 498725 - RNA, 18 nt, Human
uucugugucucaaugugu

SEQ ID NO: 498726 - RNA, 22 nt, Human
aaaaauuucucccauacaauca

SEQ ID NO: 498727 - RNA, 22 nt, Human
aacaaaacagucuaucuuccag

SEQ ID NO: 498728 - RNA, 20 nt, Human
acuuuuuuuuuucuuugcaa

SEQ ID NO: 498729 - RNA, 22 nt, Human
aggcagaaccaagccguaugga

SEQ ID NO: 498730 - RNA, 23 nt, Human
aguagaucuuaccagggaaaugu

SEQ ID NO: 498731 - RNA, 23 nt, Human
auacuuuuuuuuuucuuugcaaa

SEQ ID NO: 498732 - RNA, 18 nt, Human
aucagguggaacaaaaca

SEQ ID NO: 498733 - RNA, 23 nt, Human
augauuugcuuucaaaaaacucu

SEQ ID NO: 498734 - RNA, 23 nt, Human
caggcagaaccaagccguaugga

SEQ ID NO: 498735 - RNA, 23 nt, Human
ccacuuucuaaggucaaaaauuu

SEQ ID NO: 498736 - RNA, 21 nt, Human
cccauacaaucagguggaaca

SEQ ID NO: 498737 - RNA, 25 nt, Human
uaauauaccauagauauuuacagga

SEQ ID NO: 498738 - RNA, 20 nt, Human
uacagaaugauuugcuuuca

SEQ ID NO: 498739 - RNA, 24 nt, Human
uacuuuuuuuuuucuuugcaaaca

SEQ ID NO: 498740 - RNA, 19 nt, Human
ucccagcugggacugcaag

SEQ ID NO: 498741 - RNA, 19 nt, Human
ugauuugcuuucaaaaaac

SEQ ID NO: 498742 - RNA, 21 nt, Human
ugcaaacaagucuguauuaag

SEQ ID NO: 498743 - RNA, 22 nt, Human
ugcagcugggagauaaugggac

SEQ ID NO: 498744 - RNA, 20 nt, Human
ugcugugcguccaggcagaa

SEQ ID NO: 498745 - RNA, 19 nt, Human
uggaaugucuaugcagcug

SEQ ID NO: 498746 - RNA, 23 nt, Human
uucucccauacaaucagguggaa

SEQ ID NO: 498747 - RNA, 22 nt, Human
aaacaaaaggaggggggcaggg

SEQ ID NO: 498748 - RNA, 21 nt, Human
aaacagccaggagccugggga

SEQ ID NO: 498749 - RNA, 26 nt, Human
aaacagccaggagccuggggaaacag

SEQ ID NO: 498750 - RNA, 18 nt, Human
aaccccaugaggcuucuc

SEQ ID NO: 498751 - RNA, 22 nt, Human
aaggaggggggcaggggacagc

SEQ ID NO: 498752 - RNA, 23 nt, Human
acaaaacaaaaggaggggggcag

SEQ ID NO: 498753 - RNA, 25 nt, Human
acaaaacaaaaggaggggggcaggg

SEQ ID NO: 498754 - RNA, 26 nt, Human
acaaaacaaaaggaggggggcagggg

SEQ ID NO: 498755 - RNA, 25 nt, Human
acccacccuucccucccucucuccu

SEQ ID NO: 498756 - RNA, 23 nt, Human
agaaaggaccuaugucaacccca

SEQ ID NO: 498757 - RNA, 22 nt, Human
agacacuuugcaacaaaaaaua

SEQ ID NO: 498758 - RNA, 24 nt, Human
agagagacacuuugcaacaaaaaa

SEQ ID NO: 498759 - RNA, 19 nt, Human
aggaguagagggcuggcua

SEQ ID NO: 498760 - RNA, 19 nt, Human
auagaguuucucuagagag

SEQ ID NO: 498761 - RNA, 22 nt, Human
auauaaagaauaugaccuccug

SEQ ID NO: 498762 - RNA, 20 nt, Human
aucuccccuacacucuguug

SEQ ID NO: 498763 - RNA, 21 nt, Human
cacccuucccucccucucucc

SEQ ID NO: 498764 - RNA, 20 nt, Human
cacucccacacaucuguccc

SEQ ID NO: 498765 - RNA, 18 nt, Human
cagaccgcucucuccucc

SEQ ID NO: 498766 - RNA, 21 nt, Human
cagauaaacagccaggagccu

SEQ ID NO: 498767 - RNA, 21 nt, Human
cagccuccuccccccauaccc

SEQ ID NO: 498768 - RNA, 21 nt, Human
caggagccuggggaaacaggg

SEQ ID NO: 498769 - RNA, 23 nt, Human
caggggacagccaucaagcccuc

SEQ ID NO: 498770 - RNA, 20 nt, Human
caugaggcuucuccuuuggg

SEQ ID NO: 498771 - RNA, 21 nt, Human
caugaggcuucuccuuugggg

SEQ ID NO: 498772 - RNA, 24 nt, Human
ccaaacuugaugggggggggaugg

SEQ ID NO: 498773 - RNA, 31 nt, Human
ccaagcgcucugucucuccucucucuuuucc

SEQ ID NO: 498774 - RNA, 22 nt, Human
ccacccuucccucccucucucc

SEQ ID NO: 498775 - RNA, 25 nt, Human
ccauacccucugcagcccugcacuc

SEQ ID NO: 498776 - RNA, 20 nt, Human
cccaccaaacuugauggggg

SEQ ID NO: 498777 - RNA, 20 nt, Human
cccggcagccgccucccugu

SEQ ID NO: 498778 - RNA, 24 nt, Human
ccgccucccugugaacggcuccgg

SEQ ID NO: 498779 - RNA, 18 nt, Human
ccuccagcugaguggaag

SEQ ID NO: 498780 - RNA, 22 nt, Human
ccuccagcugaguggaagcaaa

SEQ ID NO: 498781 - RNA, 21 nt, Human
ccucccucucuccuuucgccc

SEQ ID NO: 498782 - RNA, 20 nt, Human
ccucucuccuuucgccccca

SEQ ID NO: 498783 - RNA, 19 nt, Human
ccuuacccacccuucccuc

SEQ ID NO: 498784 - RNA, 21 nt, Human
ccuuacccacccuucccuccc

SEQ ID NO: 498785 - RNA, 21 nt, Human
ccuuacccacccuucccuccc

SEQ ID NO: 498786 - RNA, 22 nt, Human
ccuugggucccaucuguagcuc

SEQ ID NO: 498787 - RNA, 24 nt, Human
cggagguacuaaggugcuaaacug

SEQ ID NO: 498788 - RNA, 19 nt, Human
cuaaagcaagugaagcagc

SEQ ID NO: 498789 - RNA, 21 nt, Human
cuccuccuuacccacccuucc

SEQ ID NO: 498790 - RNA, 18 nt, Human
cucucuccuccuuaccca

SEQ ID NO: 498791 - RNA, 19 nt, Human
cucuugagccuccagcuga

SEQ ID NO: 498792 - RNA, 25 nt, Human
cugacggucccggcagccgccuccc

SEQ ID NO: 498793 - RNA, 23 nt, Human
cugcauuauuuucucuacguugc

SEQ ID NO: 498794 - RNA, 21 nt, Human
cuggaauuggucccagaagcc

SEQ ID NO: 498795 - RNA, 18 nt, Human
gaagaucuucagggcagg

SEQ ID NO: 498796 - RNA, 21 nt, Human
gagcagagccagcuaagagga

SEQ ID NO: 498797 - RNA, 19 nt, Human
gaggcaggacugggggaau

SEQ ID NO: 498798 - RNA, 18 nt, Human
gcuagggcucgaguucug

SEQ ID NO: 498799 - RNA, 25 nt, Human
gcucugucucuccucucucuuuucc

SEQ ID NO: 498800 - RNA, 22 nt, Human
ggaacagagauggcagaaagga

SEQ ID NO: 498801 - RNA, 23 nt, Human
ggagccuggggaaacagggauga

SEQ ID NO: 498802 - RNA, 20 nt, Human
ggcaggggggaggcuggggg

SEQ ID NO: 498803 - RNA, 25 nt, Human
ggcuagggcucgaguucuggcuugg

SEQ ID NO: 498804 - RNA, 28 nt, Human
gggaaacagggaugagaagggcauuggg

SEQ ID NO: 498805 - RNA, 20 nt, Human
ggggaaacagggaugagaag

SEQ ID NO: 498806 - RNA, 21 nt, Human
gggggagaggcaggacugggg

SEQ ID NO: 498807 - RNA, 23 nt, Human
ggggggcaggggacagccaucaa

SEQ ID NO: 498808 - RNA, 19 nt, Human
guguacaaaacaaaaggag

SEQ ID NO: 498809 - RNA, 22 nt, Human
uaaagcaagugaagcagcggag

SEQ ID NO: 498810 - RNA, 22 nt, Human
uaagaggagccaaaugucccug

SEQ ID NO: 498811 - RNA, 23 nt, Human
uaagaggagccaaaugucccuga

SEQ ID NO: 498812 - RNA, 23 nt, Human
uaaucccugacagcagcuggaac

SEQ ID NO: 498813 - RNA, 24 nt, Human
uacaaaacaaaaggaggggggcag

SEQ ID NO: 498814 - RNA, 23 nt, Human
uacccucugcagcccugcacucc

SEQ ID NO: 498815 - RNA, 18 nt, Human
uaggaugggggagaggca

SEQ ID NO: 498816 - RNA, 22 nt, Human
ucccuugggucccaucuguagc

SEQ ID NO: 498817 - RNA, 19 nt, Human
uccuuacccacccuucccu

SEQ ID NO: 498818 - RNA, 20 nt, Human
uccuuuggggcagauaaaca

SEQ ID NO: 498819 - RNA, 18 nt, Human
ucuccucucucuuuucuc

SEQ ID NO: 498820 - RNA, 20 nt, Human
ucucucuuuucucucucucc

SEQ ID NO: 498821 - RNA, 23 nt, Human
ucucucuuuucucucucucucuc

SEQ ID NO: 498822 - RNA, 18 nt, Human
ucugucccugcugauagu

SEQ ID NO: 498823 - RNA, 18 nt, Human
ucugucucuccucucucu

SEQ ID NO: 498824 - RNA, 21 nt, Human
ucugucucuccucucucuuuu

SEQ ID NO: 498825 - RNA, 22 nt, Human
ucuugagccuccagcugagugg

SEQ ID NO: 498826 - RNA, 24 nt, Human
ugaagcagcggagguacuaaggug

SEQ ID NO: 498827 - RNA, 20 nt, Human
ugacagcagcuggaacagag

SEQ ID NO: 498828 - RNA, 18 nt, Human
ugaggccucuuggucucu

SEQ ID NO: 498829 - RNA, 19 nt, Human
ugauaggaugggggagagg

SEQ ID NO: 498830 - RNA, 23 nt, Human
ugcagcagaccgcucucuccucc

SEQ ID NO: 498831 - RNA, 21 nt, Human
uggaacagagauggcagaaag

SEQ ID NO: 498832 - RNA, 19 nt, Human
uggcagaaaggaccuaugu

SEQ ID NO: 498833 - RNA, 21 nt, Human
uggcuaaagcaagugaagcag

SEQ ID NO: 498834 - RNA, 22 nt, Human
uggcuugggcuccaagcucucc

SEQ ID NO: 498835 - RNA, 19 nt, Human
ugggcaggcacaaaggcca

SEQ ID NO: 498836 - RNA, 21 nt, Human
ugggcuccaagcucuccuccu

SEQ ID NO: 498837 - RNA, 22 nt, Human
uggggcagauaaacagccagga

SEQ ID NO: 498838 - RNA, 28 nt, Human
uuagcagccuccuccccccauacccucu

SEQ ID NO: 498839 - RNA, 18 nt, Human
uucucucucucucucucu

SEQ ID NO: 498840 - RNA, 24 nt, Human
uugcagcagaccgcucucuccucc

SEQ ID NO: 498841 - RNA, 21 nt, Human
uuuagcagccuccucccccca

SEQ ID NO: 498842 - RNA, 23 nt, Human
uuugccaauugagcuuuucuuuu

SEQ ID NO: 498843 - RNA, 22 nt, Human
uuuuuuuuuuuuuugccaauug

SEQ ID NO: 498844 - RNA, 22 nt, Human
uuuuuuuuuuuuuuuuugccaa

SEQ ID NO: 498845 - RNA, 23 nt, Human
uuuuuuuuuuuuuuuuugccaau

SEQ ID NO: 498846 - RNA, 20 nt, Human
uuuuuuuuuuuuuuuuuugg

SEQ ID NO: 498847 - RNA, 18 nt, Human
aaagaaggcagacacaaa

SEQ ID NO: 498848 - RNA, 18 nt, Human
aaaguuuuccagccacac

SEQ ID NO: 498849 - RNA, 26 nt, Human
aagaaggcagacacaaaagaacacag

SEQ ID NO: 498850 - RNA, 27 nt, Human
aagcagguacaaggccccuaaaagcaa

SEQ ID NO: 498851 - RNA, 22 nt, Human
aagugaaagaauacagacucaa

SEQ ID NO: 498852 - RNA, 23 nt, Human
aauauuuaauugaaccacucagu

SEQ ID NO: 498853 - RNA, 22 nt, Human
acagacucaaacaauaugccca

SEQ ID NO: 498854 - RNA, 21 nt, Human
acucagucgguacugaaacag

SEQ ID NO: 498855 - RNA, 26 nt, Human
agaaggcagacacaaaagaacacagg

SEQ ID NO: 498856 - RNA, 23 nt, Human
agaauacagacucaaacaauaug

SEQ ID NO: 498857 - RNA, 18 nt, Human
aggcagacacaaaagaac

SEQ ID NO: 498858 - RNA, 22 nt, Human
aggguugaaaggcugaugaacu

SEQ ID NO: 498859 - RNA, 23 nt, Human
agugacaguggcuccuuggggcu

SEQ ID NO: 498860 - RNA, 24 nt, Human
auacagacucaaacaauaugccca

SEQ ID NO: 498861 - RNA, 21 nt, Human
augaagcagguacaaggcccc

SEQ ID NO: 498862 - RNA, 21 nt, Human
augcccacauauguacaguua

SEQ ID NO: 498863 - RNA, 21 nt, Human
auuucaucaucuuaauuucuc

SEQ ID NO: 498864 - RNA, 22 nt, Human
caaacauacaugguauagccac

SEQ ID NO: 498865 - RNA, 18 nt, Human
cagacacaaaagaacaca

SEQ ID NO: 498866 - RNA, 20 nt, Human
cagguaucauuucauuuauu

SEQ ID NO: 498867 - RNA, 26 nt, Human
caucaaaacaaaaaaguuuuccagga

SEQ ID NO: 498868 - RNA, 18 nt, Human
ccacucagucgguacuga

SEQ ID NO: 498869 - RNA, 21 nt, Human
ccccuaaaagcaauuggugag

SEQ ID NO: 498870 - RNA, 20 nt, Human
gaaagaaggcagacacaaaa

SEQ ID NO: 498871 - RNA, 19 nt, Human
gaaggaauacuacucagua

SEQ ID NO: 498872 - RNA, 21 nt, Human
gaaggcagacacaaaagaacc

SEQ ID NO: 498873 - RNA, 18 nt, Human
gccuguguuagugagacc

SEQ ID NO: 498874 - RNA, 23 nt, Human
gcuagauuucaaaccugauuuua

SEQ ID NO: 498875 - RNA, 23 nt, Human
uaacagccagaaucauuacaugc

SEQ ID NO: 498876 - RNA, 24 nt, Human
uaauaagugaaaguacaaacauac

SEQ ID NO: 498877 - RNA, 21 nt, Human
uacaucaaagugaaagaauac

SEQ ID NO: 498878 - RNA, 22 nt, Human
uacaugcuuaacaauacaugca

SEQ ID NO: 498879 - RNA, 20 nt, Human
uaggagauuuuagagaaauu

SEQ ID NO: 498880 - RNA, 20 nt, Human
uaugcccacauauguacagu

SEQ ID NO: 498881 - RNA, 24 nt, Human
uauuacaucaacacaauucugcuu

SEQ ID NO: 498882 - RNA, 20 nt, Human
ucaaagugaaagaauacaga

SEQ ID NO: 498883 - RNA, 25 nt, Human
ucuccauacuagcaauuagcagcua

SEQ ID NO: 498884 - RNA, 24 nt, Human
ugaugcaugaaagaaggcagacac

SEQ ID NO: 498885 - RNA, 20 nt, Human
ugcucaugauaguuucuuca

SEQ ID NO: 498886 - RNA, 26 nt, Human
uucaaaauguauuugaaaaucaaaga

SEQ ID NO: 498887 - RNA, 18 nt, Human
uugaugcaugaaagaagg

SEQ ID NO: 498888 - RNA, 23 nt, Human
uuggggcugaggguugaaaggcu

SEQ ID NO: 498889 - RNA, 24 nt, Human
uuuuaaagcuacaguaauuuuaaa

SEQ ID NO: 498890 - RNA, 22 nt, Human
uuuuuuuuuuuuuuuuccucuu

SEQ ID NO: 498891 - RNA, 25 nt, Human
uuuuuuuuuuuuuuuuuccucuuaa

SEQ ID NO: 498892 - RNA, 21 nt, Human
aaaagucuaagcagguaaaag

SEQ ID NO: 498893 - RNA, 20 nt, Human
aagaauucguuaucucaguc

SEQ ID NO: 498894 - RNA, 23 nt, Human
aagaauucguuaucucagucucu

SEQ ID NO: 498895 - RNA, 25 nt, Human
aagcauauacacaaagauaauauga

SEQ ID NO: 498896 - RNA, 28 nt, Human
aagugacauaucaagaaauuaaaaacac

SEQ ID NO: 498897 - RNA, 22 nt, Human
aaugccucuuuugcucccauuu

SEQ ID NO: 498898 - RNA, 21 nt, Human
acaaagaucaaauuuugaaca

SEQ ID NO: 498899 - RNA, 18 nt, Human
acacacaccacaaaagcu

SEQ ID NO: 498900 - RNA, 25 nt, Human
agcacaaaaauacaaaacaaagauc

SEQ ID NO: 498901 - RNA, 24 nt, Human
caaaacaaagaucaaauuuugaac

SEQ ID NO: 498902 - RNA, 18 nt, Human
caacaaggugcugucucc

SEQ ID NO: 498903 - RNA, 19 nt, Human
cacaaugucuaguuuuuaa

SEQ ID NO: 498904 - RNA, 18 nt, Human
caccuuuguguagaaucu

SEQ ID NO: 498905 - RNA, 20 nt, Human
cacugcuccugcugucccuu

SEQ ID NO: 498906 - RNA, 22 nt, Human
cacugcuccugcugucccuugc

SEQ ID NO: 498907 - RNA, 21 nt, Human
cauauacacaaagauaauaug

SEQ ID NO: 498908 - RNA, 27 nt, Human
cauuaaacaacccaguuaccuuuucuu

SEQ ID NO: 498909 - RNA, 18 nt, Human
cccccacaucugcuuaac

SEQ ID NO: 498910 - RNA, 19 nt, Human
ccccggagccgcuuucucu

SEQ ID NO: 498911 - RNA, 19 nt, Human
cccuuuccugucuuaucag

SEQ ID NO: 498912 - RNA, 18 nt, Human
ccgccgccgucgccacga

SEQ ID NO: 498913 - RNA, 22 nt, Human
ccgccgucgccacgaauccccu

SEQ ID NO: 498914 - RNA, 21 nt, Human
cgccacgaauccccuucccgc

SEQ ID NO: 498915 - RNA, 19 nt, Human
cucagugacuaccuccuag

SEQ ID NO: 498916 - RNA, 21 nt, Human
cucccauuuugugagcuccug

SEQ ID NO: 498917 - RNA, 18 nt, Human
cugucaagagcuuuccuu

SEQ ID NO: 498918 - RNA, 19 nt, Human
gaaaacuugaccuauguca

SEQ ID NO: 498919 - RNA, 23 nt, Human
gaaaagacuauaguaauaaaaaa

SEQ ID NO: 498920 - RNA, 23 nt, Human
gaaacugacaauucagugaauaa

SEQ ID NO: 498921 - RNA, 25 nt, Human
gccaccggcggaaagagacgcaaaa

SEQ ID NO: 498922 - RNA, 18 nt, Human
gcccugcaccgccuggcg

SEQ ID NO: 498923 - RNA, 18 nt, Human
gccgccgccgucgccacg

SEQ ID NO: 498924 - RNA, 23 nt, Human
gcugucccuugccgccgccgucg

SEQ ID NO: 498925 - RNA, 19 nt, Human
gggaggaacagaagugaca

SEQ ID NO: 498926 - RNA, 20 nt, Human
gucccuugccgccgccgucg

SEQ ID NO: 498927 - RNA, 28 nt, Human
gucccuugccgccgccgucgccacgaau

SEQ ID NO: 498928 - RNA, 19 nt, Human
uaaaaaaauaaacuagcau

SEQ ID NO: 498929 - RNA, 21 nt, Human
uaaacaaagaucucaaaggua

SEQ ID NO: 498930 - RNA, 26 nt, Human
uaaacugaaaacacuucacaugaaau

SEQ ID NO: 498931 - RNA, 22 nt, Human
uaacagucaugaugaaauaucc

SEQ ID NO: 498932 - RNA, 26 nt, Human
uacaaaacaaagaucaaauuuugaac

SEQ ID NO: 498933 - RNA, 25 nt, Human
uacagagaaggaaccaaauucuagc

SEQ ID NO: 498934 - RNA, 18 nt, Human
uaccgggacccgccccug

SEQ ID NO: 498935 - RNA, 19 nt, Human
uagcacaaaaauacaaaac

SEQ ID NO: 498936 - RNA, 23 nt, Human
uaguaauaaaaaaauucaauuuc

SEQ ID NO: 498937 - RNA, 23 nt, Human
uauaaaaaaggacuguuaugaaa

SEQ ID NO: 498938 - RNA, 19 nt, Human
uauaauagugccacaugag

SEQ ID NO: 498939 - RNA, 19 nt, Human
uaucucagucucuucaagg

SEQ ID NO: 498940 - RNA, 19 nt, Human
uaugcaaauauucugacac

SEQ ID NO: 498941 - RNA, 21 nt, Human
ucaagaaauuaaaaacacaaa

SEQ ID NO: 498942 - RNA, 20 nt, Human
ucaagagcuuuccuuuuuuu

SEQ ID NO: 498943 - RNA, 22 nt, Human
ucagaagccuuaauuauucucu

SEQ ID NO: 498944 - RNA, 21 nt, Human
ucagugacuaccuccuagagc

SEQ ID NO: 498945 - RNA, 27 nt, Human
uccgacggccgcgcugacagcaccacu

SEQ ID NO: 498946 - RNA, 23 nt, Human
ucguauuuuuuauuacucacaau

SEQ ID NO: 498947 - RNA, 21 nt, Human
ucucuaccacacacaccacaa

SEQ ID NO: 498948 - RNA, 21 nt, Human
ugaaaacacuucacaugaaau

SEQ ID NO: 498949 - RNA, 22 nt, Human
ugaaauaucccuuuccugucuu

SEQ ID NO: 498950 - RNA, 23 nt, Human
ugaaggaaacugacaauucagug

SEQ ID NO: 498951 - RNA, 22 nt, Human
ugaauaacuaaacugaaaacac

SEQ ID NO: 498952 - RNA, 24 nt, Human
ugcccugcccccacaucugcuuaa

SEQ ID NO: 498953 - RNA, 21 nt, Human
ugggaaacaacugucaagagc

SEQ ID NO: 498954 - RNA, 18 nt, Human
uguagaaucucuggcaac

SEQ ID NO: 498955 - RNA, 24 nt, Human
uuaauuauucucuaccacacacac

SEQ ID NO: 498956 - RNA, 18 nt, Human
uucaaaggaggagcggcc

SEQ ID NO: 498957 - RNA, 20 nt, Human
uugaaaagacuauaguaaua

SEQ ID NO: 498958 - RNA, 19 nt, Human
uuuaaccaggagaccauac

SEQ ID NO: 498959 - RNA, 23 nt, Human
aaaagaccagagcaaccccaaua

SEQ ID NO: 498960 - RNA, 21 nt, Human
aaaaugacugacuccaaagag

SEQ ID NO: 498961 - RNA, 20 nt, Human
aaauaacaugaaaccaacuu

SEQ ID NO: 498962 - RNA, 23 nt, Human
aaccacgggcaagucaugccacc

SEQ ID NO: 498963 - RNA, 20 nt, Human
aacccaaagaaagaagcaau

SEQ ID NO: 498964 - RNA, 22 nt, Human
aacccccgaccucaagugaucu

SEQ ID NO: 498965 - RNA, 24 nt, Human
aaguagcugggauuacaggcaugu

SEQ ID NO: 498966 - RNA, 21 nt, Human
aagugaucacaauuuagaagc

SEQ ID NO: 498967 - RNA, 18 nt, Human
aagugcugggauuacagg

SEQ ID NO: 498968 - RNA, 19 nt, Human
aagugcugggauuacaggc

SEQ ID NO: 498969 - RNA, 19 nt, Human
aagugcugggauuacaggc

SEQ ID NO: 498970 - RNA, 23 nt, Human
aagugcugggauuacaggcguga

SEQ ID NO: 498971 - RNA, 22 nt, Human
aaugugaaaacccaaagaaaga

SEQ ID NO: 498972 - RNA, 23 nt, Human
acuauacacauccaacaaacauu

SEQ ID NO: 498973 - RNA, 24 nt, Human
acugucucugucacccaggcugga

SEQ ID NO: 498974 - RNA, 22 nt, Human
acuugacagcaaagcuccaugg

SEQ ID NO: 498975 - RNA, 24 nt, Human
agacagcugaggaugccuaaauca

SEQ ID NO: 498976 - RNA, 22 nt, Human
agccaagcagcaaucaccgaga

SEQ ID NO: 498977 - RNA, 24 nt, Human
agcgauuuuccugccucagccucc

SEQ ID NO: 498978 - RNA, 21 nt, Human
agcucacuggaaccuucuaaa

SEQ ID NO: 498979 - RNA, 25 nt, Human
aggcuggagugcaguggcgugaucu

SEQ ID NO: 498980 - RNA, 18 nt, Human
agggaugggaauaugggg

SEQ ID NO: 498981 - RNA, 23 nt, Human
aguagcugggauuacaggcaugu

SEQ ID NO: 498982 - RNA, 18 nt, Human
agucaaaguuuggguucu

SEQ ID NO: 498983 - RNA, 26 nt, Human
agugaucugcccaccucggucuuccu

SEQ ID NO: 498984 - RNA, 23 nt, Human
agugcaguggcgugaucuuggcu

SEQ ID NO: 498985 - RNA, 24 nt, Human
agugcaguggcgugaucuuggcuc

SEQ ID NO: 498986 - RNA, 24 nt, Human
auagaacacagaaugcaauccucc

SEQ ID NO: 498987 - RNA, 21 nt, Human
caacacaguccugacuguucc

SEQ ID NO: 498988 - RNA, 22 nt, Human
caagcagcaaucaccgagaaua

SEQ ID NO: 498989 - RNA, 22 nt, Human
caagcgauuuuccugccucagc

SEQ ID NO: 498990 - RNA, 22 nt, Human
cacccagccuggaaguaaggac

SEQ ID NO: 498991 - RNA, 24 nt, Human
cacccaggcuggagugcaguggcg

SEQ ID NO: 498992 - RNA, 18 nt, Human
caccuggaaaagacucca

SEQ ID NO: 498993 - RNA, 21 nt, Human
cacuauguugaccaggcuggu

SEQ ID NO: 498994 - RNA, 22 nt, Human
cacuauguugaccaggcugguc

SEQ ID NO: 498995 - RNA, 21 nt, Human
cacugcaaucugugccuccug

SEQ ID NO: 498996 - RNA, 23 nt, Human
cacugcaaucugugccuccuggg

SEQ ID NO: 498997 - RNA, 24 nt, Human
cagagaacacugcaaagcugccau

SEQ ID NO: 498998 - RNA, 27 nt, Human
cagcaaaucgucuccuccaaagcaauc

SEQ ID NO: 498999 - RNA, 26 nt, Human
cagcagagagcuugccauaauccccu

SEQ ID NO: 499000 - RNA, 22 nt, Human
cagcucacuggaaccuucuaaa

SEQ ID NO: 499001 - RNA, 25 nt, Human
caugaagaaaaggaaccaaaaauga

SEQ ID NO: 499002 - RNA, 18 nt, Human
ccaaagaaagaagcaaua

SEQ ID NO: 499003 - RNA, 23 nt, Human
ccaaguagcugggauuacaggca

SEQ ID NO: 499004 - RNA, 24 nt, Human
ccaaguagcugggauuacaggcau

SEQ ID NO: 499005 - RNA, 25 nt, Human
ccaaucacaaaaaacagacagcuga

SEQ ID NO: 499006 - RNA, 25 nt, Human
ccagagguuccauucucccaacuga

SEQ ID NO: 499007 - RNA, 18 nt, Human
ccagcaugaggaggccuu

SEQ ID NO: 499008 - RNA, 19 nt, Human
ccaggcuggucgcaaaccc

SEQ ID NO: 499009 - RNA, 19 nt, Human
ccauuucaggaccuggcua

SEQ ID NO: 499010 - RNA, 23 nt, Human
cccaaguagcugggauuacaggc

SEQ ID NO: 499011 - RNA, 24 nt, Human
cccaaguagcugggauuacaggca

SEQ ID NO: 499012 - RNA, 21 nt, Human
cccaggcuggagugcaguggc

SEQ ID NO: 499013 - RNA, 19 nt, Human
cccgaccucaagugaucug

SEQ ID NO: 499014 - RNA, 24 nt, Human
cccgaccucaagugaucugcccac

SEQ ID NO: 499015 - RNA, 22 nt, Human
ccuaagugcugggauuacaggc

SEQ ID NO: 499016 - RNA, 24 nt, Human
ccuaagugcugggauuacaggcgu

SEQ ID NO: 499017 - RNA, 23 nt, Human
ccugccucagccucccaaguagc

SEQ ID NO: 499018 - RNA, 24 nt, Human
ccugccucagccucccaaguagcu

SEQ ID NO: 499019 - RNA, 23 nt, Human
ccuggguucaagcgauuuuccug

SEQ ID NO: 499020 - RNA, 24 nt, Human
cgaagaaaccaagcuggcuuucug

SEQ ID NO: 499021 - RNA, 18 nt, Human
cgaccucaagugaucugc

SEQ ID NO: 499022 - RNA, 23 nt, Human
cgagaauaauaaagugggugcca

SEQ ID NO: 499023 - RNA, 19 nt, Human
cgcauccuuccagcugcag

SEQ ID NO: 499024 - RNA, 22 nt, Human
cgcucgcauccuuccagcugca

SEQ ID NO: 499025 - RNA, 24 nt, Human
cuaagugcugggauuacaggcgug

SEQ ID NO: 499026 - RNA, 19 nt, Human
cuagaugaggaaaaugacu

SEQ ID NO: 499027 - RNA, 25 nt, Human
cucaagugaucugcccaccucgguc

SEQ ID NO: 499028 - RNA, 24 nt, Human
cucacugcaaucugugccuccugg

SEQ ID NO: 499029 - RNA, 24 nt, Human
cucagccucccaaguagcugggau

SEQ ID NO: 499030 - RNA, 19 nt, Human
cuccaccacagauuuagag

SEQ ID NO: 499031 - RNA, 19 nt, Human
cucugucacccaggcugga

SEQ ID NO: 499032 - RNA, 23 nt, Human
cucugucacccaggcuggagugc

SEQ ID NO: 499033 - RNA, 23 nt, Human
cugaacacagcagagagcuugcc

SEQ ID NO: 499034 - RNA, 21 nt, Human
cugcccaaccagcugcacaac

SEQ ID NO: 499035 - RNA, 23 nt, Human
cugucucugucacccaggcugga

SEQ ID NO: 499036 - RNA, 24 nt, Human
cugucucugucacccaggcuggag

SEQ ID NO: 499037 - RNA, 21 nt, Human
gaaaacccaaagaaagaagca

SEQ ID NO: 499038 - RNA, 25 nt, Human
gaagaaaccaagcuggcuuucuggg

SEQ ID NO: 499039 - RNA, 24 nt, Human
gaccucaagugaucugcccaccuc

SEQ ID NO: 499040 - RNA, 22 nt, Human
gagaaaaaaauuagggauggga

SEQ ID NO: 499041 - RNA, 20 nt, Human
gagaauaauaaagugggugc

SEQ ID NO: 499042 - RNA, 19 nt, Human
gaucaagugcccaaguuug

SEQ ID NO: 499043 - RNA, 22 nt, Human
gaucugcccaccucggucuucc

SEQ ID NO: 499044 - RNA, 23 nt, Human
gaucugcccaccucggucuuccu

SEQ ID NO: 499045 - RNA, 22 nt, Human
gaucugccgccucagccacucc

SEQ ID NO: 499046 - RNA, 18 nt, Human
gauuacaggcaugugcca

SEQ ID NO: 499047 - RNA, 24 nt, Human
gauuacaggcaugugccaccaugc

SEQ ID NO: 499048 - RNA, 19 nt, Human
gauuacaggcgugaguuac

SEQ ID NO: 499049 - RNA, 23 nt, Human
gauuacaggcgugaguuacggca

SEQ ID NO: 499050 - RNA, 21 nt, Human
gcaaaucgucuccuccaaagc

SEQ ID NO: 499051 - RNA, 19 nt, Human
gccuuuguuggaugagcuu

SEQ ID NO: 499052 - RNA, 24 nt, Human
gcgauuuuccugccucagccuccc

SEQ ID NO: 499053 - RNA, 19 nt, Human
gcuggagugcaguggcgug

SEQ ID NO: 499054 - RNA, 23 nt, Human
gcuggucgcaaacccccgaccuc

SEQ ID NO: 499055 - RNA, 24 nt, Human
ggauuacaggcaugugccaccaug

SEQ ID NO: 499056 - RNA, 22 nt, Human
ggcuggagugcaguggcgugau

SEQ ID NO: 499057 - RNA, 25 nt, Human
guacuuucaaaaaagaccagagcaa

SEQ ID NO: 499058 - RNA, 18 nt, Human
guagcugggauuacaggc

SEQ ID NO: 499059 - RNA, 24 nt, Human
gugaucugcccaccucggucuucc

SEQ ID NO: 499060 - RNA, 20 nt, Human
uaacaugaaaccaacuugac

SEQ ID NO: 499061 - RNA, 22 nt, Human
uaacuuggggcacauugcuucu

SEQ ID NO: 499062 - RNA, 24 nt, Human
uaagugcugggauuacaggcguga

SEQ ID NO: 499063 - RNA, 18 nt, Human
uaauuuuuguauuuuuag

SEQ ID NO: 499064 - RNA, 22 nt, Human
uacaggcaugugccaccaugcc

SEQ ID NO: 499065 - RNA, 23 nt, Human
uacuuuccacgaagaaaccaagc

SEQ ID NO: 499066 - RNA, 28 nt, Human
uagaaaggaaucucccugaacacagcag

SEQ ID NO: 499067 - RNA, 22 nt, Human
uaggacaagaucagaauuccag

SEQ ID NO: 499068 - RNA, 24 nt, Human
uaggacaagaucagaauuccagcc

SEQ ID NO: 499069 - RNA, 20 nt, Human
uauacacauccaacaaacau

SEQ ID NO: 499070 - RNA, 23 nt, Human
uauguugaccaggcuggucgcaa

SEQ ID NO: 499071 - RNA, 23 nt, Human
uauguugaccaggcuggucgcaa

SEQ ID NO: 499072 - RNA, 24 nt, Human
uauguugaccaggcuggucgcaaa

SEQ ID NO: 499073 - RNA, 20 nt, Human
ucaaaguuuggguucuuauc

SEQ ID NO: 499074 - RNA, 19 nt, Human
ucaagcgauuuuccugccu

SEQ ID NO: 499075 - RNA, 18 nt, Human
ucacaaaaaacagacagc

SEQ ID NO: 499076 - RNA, 24 nt, Human
ucacccaggcuggagugcaguggc

SEQ ID NO: 499077 - RNA, 24 nt, Human
ucacugcaaucugugccuccuggg

SEQ ID NO: 499078 - RNA, 25 nt, Human
ucacugcaaucugugccuccugggu

SEQ ID NO: 499079 - RNA, 24 nt, Human
ucacuggaaccuucuaaaauggca

SEQ ID NO: 499080 - RNA, 21 nt, Human
ucagaagcuaggacaagauca

SEQ ID NO: 499081 - RNA, 20 nt, Human
ucagccucccaaguagcugg

SEQ ID NO: 499082 - RNA, 20 nt, Human
ucaguagccucuugaagccu

SEQ ID NO: 499083 - RNA, 18 nt, Human
ucaguuccuaggcuaugc

SEQ ID NO: 499084 - RNA, 21 nt, Human
uccaaggucagaagcuaggac

SEQ ID NO: 499085 - RNA, 23 nt, Human
uccaaggucagaagcuaggacaa

SEQ ID NO: 499086 - RNA, 24 nt, Human
ucccaaguagcugggauuacaggc

SEQ ID NO: 499087 - RNA, 23 nt, Human
uccuaagugcugggauuacaggc

SEQ ID NO: 499088 - RNA, 24 nt, Human
uccuaagugcugggauuacaggcg

SEQ ID NO: 499089 - RNA, 21 nt, Human
uccuggguucaagcgauuuuc

SEQ ID NO: 499090 - RNA, 24 nt, Human
uccuggguucaagcgauuuuccug

SEQ ID NO: 499091 - RNA, 20 nt, Human
uccuugcaacucuauauauu

SEQ ID NO: 499092 - RNA, 19 nt, Human
ucuaaaauggcaaagacac

SEQ ID NO: 499093 - RNA, 31 nt, Human
ucucacugucucugucacccaggcuggaguu

SEQ ID NO: 499094 - RNA, 23 nt, Human
ucucugucacccaggcuggagug

SEQ ID NO: 499095 - RNA, 23 nt, Human
ucuguacuuucaaaaaagaccag

SEQ ID NO: 499096 - RNA, 24 nt, Human
ucugucacccaggcuggagugcag

SEQ ID NO: 499097 - RNA, 23 nt, Human
ugaaaacccaaagaaagaagcaa

SEQ ID NO: 499098 - RNA, 22 nt, Human
ugaaauaacaugaaaccaacuu

SEQ ID NO: 499099 - RNA, 25 nt, Human
ugaaauaacaugaaaccaagggagc

SEQ ID NO: 499100 - RNA, 19 nt, Human
ugaagccuacagaagugac

SEQ ID NO: 499101 - RNA, 21 nt, Human
ugaauauaacauagaacacag

SEQ ID NO: 499102 - RNA, 21 nt, Human
ugaccaggcuggucgcaaacc

SEQ ID NO: 499103 - RNA, 26 nt, Human
ugaccaggcuggucgcaaaccccgug

SEQ ID NO: 499104 - RNA, 23 nt, Human
ugacugacuccaaagaguccuug

SEQ ID NO: 499105 - RNA, 21 nt, Human
ugagguucaugaagaaaagga

SEQ ID NO: 499106 - RNA, 24 nt, Human
ugagugcuuuguccaaggucagaa

SEQ ID NO: 499107 - RNA, 19 nt, Human
ugcaccuggaaaagacucc

SEQ ID NO: 499108 - RNA, 22 nt, Human
ugcaguggcgugaucuuggcuc

SEQ ID NO: 499109 - RNA, 26 nt, Human
ugccagcucugcccaaccagcugcac

SEQ ID NO: 499110 - RNA, 21 nt, Human
ugccauugauauuucaguagc

SEQ ID NO: 499111 - RNA, 19 nt, Human
ugcccaucauccucuucaa

SEQ ID NO: 499112 - RNA, 24 nt, Human
ugccucagccucccaaguagcugg

SEQ ID NO: 499113 - RNA, 18 nt, Human
ugcugggauuacaggcgu

SEQ ID NO: 499114 - RNA, 21 nt, Human
uggaaaagacuccaccacaga

SEQ ID NO: 499115 - RNA, 19 nt, Human
uggagugcaguggcgugau

SEQ ID NO: 499116 - RNA, 23 nt, Human
uggagugcaguggcgugaucuug

SEQ ID NO: 499117 - RNA, 24 nt, Human
uggagugcaguggcgugaucuugg

SEQ ID NO: 499118 - RNA, 18 nt, Human
ugggauuacaggcaugug

SEQ ID NO: 499119 - RNA, 21 nt, Human
ugggauuacaggcaugugcca

SEQ ID NO: 499120 - RNA, 22 nt, Human
ugggauuacaggcaugugccac

SEQ ID NO: 499121 - RNA, 24 nt, Human
ugggauuacaggcaugugccacca

SEQ ID NO: 499122 - RNA, 18 nt, Human
ugggauuacaggcgugag

SEQ ID NO: 499123 - RNA, 18 nt, Human
ugggauuacaggcgugag

SEQ ID NO: 499124 - RNA, 18 nt, Human
ugggauuacaggcgugag

SEQ ID NO: 499125 - RNA, 21 nt, Human
ugggauuacaggcgugaguua

SEQ ID NO: 499126 - RNA, 22 nt, Human
ugggauuacaggcgugaguuac

SEQ ID NO: 499127 - RNA, 23 nt, Human
ugggauuacaggcgugaguuacg

SEQ ID NO: 499128 - RNA, 24 nt, Human
ugggauuacaggcgugaguuacgg

SEQ ID NO: 499129 - RNA, 25 nt, Human
ugggauuacaggcgugaguuacggc

SEQ ID NO: 499130 - RNA, 23 nt, Human
ugggguccacuauguugaccagg

SEQ ID NO: 499131 - RNA, 23 nt, Human
uggguucaagcgauuuuccugcc

SEQ ID NO: 499132 - RNA, 24 nt, Human
uggguucaagcgauuuuccugccu

SEQ ID NO: 499133 - RNA, 22 nt, Human
uggguucuuauccuccgcaagu

SEQ ID NO: 499134 - RNA, 19 nt, Human
uggucgcaaacccccgacc

SEQ ID NO: 499135 - RNA, 21 nt, Human
ugucacccaggcuggagugca

SEQ ID NO: 499136 - RNA, 23 nt, Human
ugugaaaacccaaagaaagaagc

SEQ ID NO: 499137 - RNA, 21 nt, Human
uuauauccugcaccacacaua

SEQ ID NO: 499138 - RNA, 23 nt, Human
uucaaaaaagaccagagcaaccc

SEQ ID NO: 499139 - RNA, 21 nt, Human
uucaagcgauuuuccugccuc

SEQ ID NO: 499140 - RNA, 23 nt, Human
uucaagcgauuuuccugccucag

SEQ ID NO: 499141 - RNA, 24 nt, Human
uucaagcgauuuuccugccucagc

SEQ ID NO: 499142 - RNA, 18 nt, Human
uuccaaaggaagauucug

SEQ ID NO: 499143 - RNA, 19 nt, Human
uuccaaaggaagauucugg

SEQ ID NO: 499144 - RNA, 25 nt, Human
uuccagccuccucaguuccuaggcu

SEQ ID NO: 499145 - RNA, 23 nt, Human
uuccguuuuuuaacgaaagagaa

SEQ ID NO: 499146 - RNA, 20 nt, Human
uuggaauauuggaauaacaa

SEQ ID NO: 499147 - RNA, 22 nt, Human
uuggcucacugcaaucugugcc

SEQ ID NO: 499148 - RNA, 27 nt, Human
uuuccaaucacaaaaaacagacagcug

SEQ ID NO: 499149 - RNA, 22 nt, Human
uuucugggaagaaugccagagg

SEQ ID NO: 499150 - RNA, 24 nt, Human
uuuguaaguucuguuuccaaucac

SEQ ID NO: 499151 - RNA, 20 nt, Human
uuuuuguauuuuuaguaaag

SEQ ID NO: 499152 - RNA, 21 nt, Human
aaaaaaaaccuucaaaaaucc

SEQ ID NO: 499153 - RNA, 19 nt, Human
aaaaagacagaugcccuga

SEQ ID NO: 499154 - RNA, 19 nt, Human
aaaaagagucuccacccuc

SEQ ID NO: 499155 - RNA, 18 nt, Human
aaacaggauuuucaugua

SEQ ID NO: 499156 - RNA, 26 nt, Human
aaacugacaccacugcuuuugucuca

SEQ ID NO: 499157 - RNA, 20 nt, Human
aaagaacaacuuggaaagau

SEQ ID NO: 499158 - RNA, 18 nt, Human
aaagaacuguaaacgcag

SEQ ID NO: 499159 - RNA, 19 nt, Human
aaagacguacacugcucua

SEQ ID NO: 499160 - RNA, 21 nt, Human
aaagacguacacugcucuauc

SEQ ID NO: 499161 - RNA, 24 nt, Human
aaagcagcaauucuauguucauag

SEQ ID NO: 499162 - RNA, 19 nt, Human
aaaggcaaaaaugucuaca

SEQ ID NO: 499163 - RNA, 19 nt, Human
aaauagauaaguuacaaug

SEQ ID NO: 499164 - RNA, 23 nt, Human
aacaaaaagacagaugcccugaa

SEQ ID NO: 499165 - RNA, 20 nt, Human
aaccuaagaguuucacugag

SEQ ID NO: 499166 - RNA, 18 nt, Human
aacuaucaccagguaaua

SEQ ID NO: 499167 - RNA, 24 nt, Human
aacuguaucccguugaugcacuaa

SEQ ID NO: 499168 - RNA, 26 nt, Human
aacuguaucccguugaugcacuaacu

SEQ ID NO: 499169 - RNA, 23 nt, Human
aagcggcaggcuuugaugcagaa

SEQ ID NO: 499170 - RNA, 21 nt, Human
aagggcucgcgcucaggcagg

SEQ ID NO: 499171 - RNA, 20 nt, Human
aaucauuuacaagccacaaa

SEQ ID NO: 499172 - RNA, 21 nt, Human
aaugagaggacacggacaaaa

SEQ ID NO: 499173 - RNA, 21 nt, Human
acacacacacacacacacaca

SEQ ID NO: 499174 - RNA, 22 nt, Human
acacacacacagcaaaagcuag

SEQ ID NO: 499175 - RNA, 21 nt, Human
acacaucgcuaacaagcaaga

SEQ ID NO: 499176 - RNA, 22 nt, Human
acauacaaaucauuuacaagcc

SEQ ID NO: 499177 - RNA, 26 nt, Human
acaugacaucuucuguggcuguaccu

SEQ ID NO: 499178 - RNA, 25 nt, Human
accacugcuuuugucucauucaagu

SEQ ID NO: 499179 - RNA, 19 nt, Human
accagguaauauacaguac

SEQ ID NO: 499180 - RNA, 19 nt, Human
accuguaaaugagaauuuc

SEQ ID NO: 499181 - RNA, 21 nt, Human
acugcgugcuuggagcuaggc

SEQ ID NO: 499182 - RNA, 20 nt, Human
acuuggaaagaugaggaggu

SEQ ID NO: 499183 - RNA, 23 nt, Human
agacugcgugcuuggagcuaggc

SEQ ID NO: 499184 - RNA, 23 nt, Human
agagguagcggcggcgacagcgg

SEQ ID NO: 499185 - RNA, 19 nt, Human
agcaagcggcaggcuuuga

SEQ ID NO: 499186 - RNA, 20 nt, Human
agcagcucuggguuccagga

SEQ ID NO: 499187 - RNA, 18 nt, Human
aggaggggaauuauuuga

SEQ ID NO: 499188 - RNA, 19 nt, Human
aggcggcggcaacagggag

SEQ ID NO: 499189 - RNA, 20 nt, Human
agguagcggcggcgacagcg

SEQ ID NO: 499190 - RNA, 21 nt, Human
auaacagagauagaagaggaa

SEQ ID NO: 499191 - RNA, 19 nt, Human
aucugaccuguaaaugaga

SEQ ID NO: 499192 - RNA, 18 nt, Human
auucacaaucugcaguua

SEQ ID NO: 499193 - RNA, 20 nt, Human
caaaacaggaagaaaaggug

SEQ ID NO: 499194 - RNA, 19 nt, Human
caaaugagaggacacggac

SEQ ID NO: 499195 - RNA, 21 nt, Human
caacacaaacaugcaauuccc

SEQ ID NO: 499196 - RNA, 18 nt, Human
caacaccucccccaagcc

SEQ ID NO: 499197 - RNA, 19 nt, Human
caacuaucaccagguaaua

SEQ ID NO: 499198 - RNA, 20 nt, Human
cacacacacacacacacaca

SEQ ID NO: 499199 - RNA, 20 nt, Human
cacacacacacacacacaca

SEQ ID NO: 499200 - RNA, 25 nt, Human
cacacacacagcaaaagcuaaauca

SEQ ID NO: 499201 - RNA, 24 nt, Human
cacacggcauguucucucuuugca

SEQ ID NO: 499202 - RNA, 19 nt, Human
cacagcaaaagcuaaauca

SEQ ID NO: 499203 - RNA, 21 nt, Human
cacagcaaaagcuaaaucauc

SEQ ID NO: 499204 - RNA, 21 nt, Human
caccucccccaagccucgcgg

SEQ ID NO: 499205 - RNA, 20 nt, Human
cacggacaaaaaaguaacaa

SEQ ID NO: 499206 - RNA, 19 nt, Human
cacugcucuaucugaccug

SEQ ID NO: 499207 - RNA, 21 nt, Human
cagacacaucgcuaacaagca

SEQ ID NO: 499208 - RNA, 20 nt, Human
caggauuauaaacugacacc

SEQ ID NO: 499209 - RNA, 20 nt, Human
cauagagcaagcggcaggcu

SEQ ID NO: 499210 - RNA, 23 nt, Human
caucaggauuauaaacugacacc

SEQ ID NO: 499211 - RNA, 18 nt, Human
ccauacagacucauuucc

SEQ ID NO: 499212 - RNA, 24 nt, Human
ccgcugugcuaacuaaaggcacac

SEQ ID NO: 499213 - RNA, 20 nt, Human
ccucauggcuccucauggcu

SEQ ID NO: 499214 - RNA, 19 nt, Human
ccugaaucagacacaucgc

SEQ ID NO: 499215 - RNA, 20 nt, Human
cgccagcgccgguggggcuc

SEQ ID NO: 499216 - RNA, 20 nt, Human
cggcauagagcaagcggcag

SEQ ID NO: 499217 - RNA, 18 nt, Human
cucguauuccgcuguccg

SEQ ID NO: 499218 - RNA, 19 nt, Human
cugcaggcucgucugcgcc

SEQ ID NO: 499219 - RNA, 21 nt, Human
gagaauuucaacaccuccccc

SEQ ID NO: 499220 - RNA, 25 nt, Human
gaggcggcggcaacagggagaggua

SEQ ID NO: 499221 - RNA, 19 nt, Human
gaggggaauuauuugaauc

SEQ ID NO: 499222 - RNA, 22 nt, Human
gcaaaacaggaagaaaagguga

SEQ ID NO: 499223 - RNA, 20 nt, Human
gcaaaagauaaacugcccgc

SEQ ID NO: 499224 - RNA, 19 nt, Human
gcaacgcuggaagaaacac

SEQ ID NO: 499225 - RNA, 24 nt, Human
gcacacacacacacacacacacag

SEQ ID NO: 499226 - RNA, 21 nt, Human
gcagggcgcgccgccagcgcc

SEQ ID NO: 499227 - RNA, 18 nt, Human
gccagcgccgguggggcu

SEQ ID NO: 499228 - RNA, 18 nt, Human
gcgcggcgcgugaucucu

SEQ ID NO: 499229 - RNA, 21 nt, Human
gcggcaacagggagagguagc

SEQ ID NO: 499230 - RNA, 21 nt, Human
gcggcgcggcgcgugaucucu

SEQ ID NO: 499231 - RNA, 25 nt, Human
gcggcggcgacagcggcuucccggc

SEQ ID NO: 499232 - RNA, 26 nt, Human
gcggcggcgacagcggcuucccggcg

SEQ ID NO: 499233 - RNA, 20 nt, Human
ggagaagcuggugcucggug

SEQ ID NO: 499234 - RNA, 24 nt, Human
ggaggggaauuauuugaaucgugg

SEQ ID NO: 499235 - RNA, 21 nt, Human
ggccaaagaacuguaaacgca

SEQ ID NO: 499236 - RNA, 24 nt, Human
ggccaaagaacuguaaacgcagua

SEQ ID NO: 499237 - RNA, 19 nt, Human
gguagcggcggcgacagcg

SEQ ID NO: 499238 - RNA, 25 nt, Human
guagcggcggcgacagcggcuuccc

SEQ ID NO: 499239 - RNA, 23 nt, Human
guauaacagagauagaagaggaa

SEQ ID NO: 499240 - RNA, 18 nt, Human
guccgcucgggcuccacc

SEQ ID NO: 499241 - RNA, 19 nt, Human
gugaaaagcaacuaucacc

SEQ ID NO: 499242 - RNA, 20 nt, Human
gugauaaucaaauaaugaaa

SEQ ID NO: 499243 - RNA, 22 nt, Human
guggggcucaggaggcuccucu

SEQ ID NO: 499244 - RNA, 21 nt, Human
guuuaugccuucaaacuccuc

SEQ ID NO: 499245 - RNA, 19 nt, Human
uaaaagcagcaauucuaug

SEQ ID NO: 499246 - RNA, 18 nt, Human
uaaacugcccgcucgaaa

SEQ ID NO: 499247 - RNA, 19 nt, Human
uaaauagauaaguuacaau

SEQ ID NO: 499248 - RNA, 19 nt, Human
uaacuaaaggcacacggca

SEQ ID NO: 499249 - RNA, 18 nt, Human
uacaacacaaacaugcaa

SEQ ID NO: 499250 - RNA, 18 nt, Human
uaccucacacaaacugag

SEQ ID NO: 499251 - RNA, 20 nt, Human
uagcaaaagauaaacugccc

SEQ ID NO: 499252 - RNA, 24 nt, Human
uaguaaaaagagucuccacccucc

SEQ ID NO: 499253 - RNA, 22 nt, Human
uauaaauagauaaguuacaaug

SEQ ID NO: 499254 - RNA, 19 nt, Human
uauaacagagauagaagag

SEQ ID NO: 499255 - RNA, 21 nt, Human
uauacaacacaaacaugcaau

SEQ ID NO: 499256 - RNA, 24 nt, Human
uauacaguacaugacaucuucugu

SEQ ID NO: 499257 - RNA, 18 nt, Human
uauagcaaaagauaaacu

SEQ ID NO: 499258 - RNA, 22 nt, Human
uaugccuucaaacuccucaauu

SEQ ID NO: 499259 - RNA, 20 nt, Human
ucaaaacugaggcuccucau

SEQ ID NO: 499260 - RNA, 22 nt, Human
uccccaaguaacuguuuaugcc

SEQ ID NO: 499261 - RNA, 18 nt, Human
uccgagcuuacagcggca

SEQ ID NO: 499262 - RNA, 19 nt, Human
ucgcggcgcggcgcgugau

SEQ ID NO: 499263 - RNA, 22 nt, Human
ucggagaagcuggugcucggug

SEQ ID NO: 499264 - RNA, 25 nt, Human
ucuaugccccggcguauaacagaga

SEQ ID NO: 499265 - RNA, 24 nt, Human
ucugcaauuugguauaaauguuag

SEQ ID NO: 499266 - RNA, 22 nt, Human
ucugcaguuaaaauauaaaagc

SEQ ID NO: 499267 - RNA, 23 nt, Human
ugaaaaaaguucauacuaaauau

SEQ ID NO: 499268 - RNA, 22 nt, Human
ugagaauuucaacaccuccccc

SEQ ID NO: 499269 - RNA, 24 nt, Human
ugagaggacacggacaaaaaagua

SEQ ID NO: 499270 - RNA, 19 nt, Human
ugaggagauuccauuuggu

SEQ ID NO: 499271 - RNA, 19 nt, Human
ugcagcuuuuguuaacaaa

SEQ ID NO: 499272 - RNA, 23 nt, Human
uggaaagaugaggaggugagggg

SEQ ID NO: 499273 - RNA, 19 nt, Human
uggaagaaacaccucagaa

SEQ ID NO: 499274 - RNA, 22 nt, Human
ugggaagggucagagacugggc

SEQ ID NO: 499275 - RNA, 22 nt, Human
uguuagugugucuaaaacaagg

SEQ ID NO: 499276 - RNA, 22 nt, Human
uuaaccuaagaguuucacugag

SEQ ID NO: 499277 - RNA, 25 nt, Human
uuaacugcuuaaccuaagaguuuca

SEQ ID NO: 499278 - RNA, 19 nt, Human
uuacauaagacauuucucu

SEQ ID NO: 499279 - RNA, 24 nt, Human
uucauagucuugcaaauguuuucc

SEQ ID NO: 499280 - RNA, 19 nt, Human
uuggcuccuagaaacugaa

SEQ ID NO: 499281 - RNA, 20 nt, Human
uuuaugccuucaaacuccuc

SEQ ID NO: 499282 - RNA, 33 nt, Human
uuuggaaggcacacacacacacacacacacagu

SEQ ID NO: 499283 - RNA, 18 nt, Human
uuuucgcaaauccccaag

SEQ ID NO: 499284 - RNA, 23 nt, Human
aaaaaauaaaaacaccgagguac

SEQ ID NO: 499285 - RNA, 24 nt, Human
aaaagaccacagaaaaagcaccau

SEQ ID NO: 499286 - RNA, 18 nt, Human
aaauaaaaacaccgaggu

SEQ ID NO: 499287 - RNA, 27 nt, Human
aagcauguaacaaaauuuugagcauga

SEQ ID NO: 499288 - RNA, 18 nt, Human
acaaaagcauuaagcaca

SEQ ID NO: 499289 - RNA, 26 nt, Human
acaacaccgaacaacaggcaauccac

SEQ ID NO: 499290 - RNA, 20 nt, Human
accacagaaaaagcaccaug

SEQ ID NO: 499291 - RNA, 19 nt, Human
agcuaugagauaggaaaca

SEQ ID NO: 499292 - RNA, 22 nt, Human
cacaacaccgaacaacaggcaa

SEQ ID NO: 499293 - RNA, 19 nt, Human
cagaaaaagcaccaugccu

SEQ ID NO: 499294 - RNA, 22 nt, Human
cagaaaaagcaccaugccuagg

SEQ ID NO: 499295 - RNA, 22 nt, Human
cagggggacagguauguuccag

SEQ ID NO: 499296 - RNA, 24 nt, Human
cagggggacagguauguuccaggc

SEQ ID NO: 499297 - RNA, 20 nt, Human
cagucagcuaaaaauaacaa

SEQ ID NO: 499298 - RNA, 21 nt, Human
ccacagaaaaagcaccaugcc

SEQ ID NO: 499299 - RNA, 20 nt, Human
cuaugagauaggaaacauga

SEQ ID NO: 499300 - RNA, 24 nt, Human
cuuuuugucuaaaauguuuuuaau

SEQ ID NO: 499301 - RNA, 20 nt, Human
gaaacaugaaagucacaugg

SEQ ID NO: 499302 - RNA, 19 nt, Human
gagcauuagcuuuauuucc

SEQ ID NO: 499303 - RNA, 22 nt, Human
gaugcaaaagaccacagaaaaa

SEQ ID NO: 499304 - RNA, 26 nt, Human
gugaaauggaaaaugaaggcauacaa

SEQ ID NO: 499305 - RNA, 23 nt, Human
uaaaaacaccgagguacuuaagu

SEQ ID NO: 499306 - RNA, 20 nt, Human
uaagaaaaaaaaaauaaaaa

SEQ ID NO: 499307 - RNA, 21 nt, Human
uaagaaacacucuaaucuuau

SEQ ID NO: 499308 - RNA, 19 nt, Human
uaauguuaauuuugaccau

SEQ ID NO: 499309 - RNA, 23 nt, Human
uaauuaauacucuuucuuagcac

SEQ ID NO: 499310 - RNA, 21 nt, Human
uagagcauuagcuuuauuucc

SEQ ID NO: 499311 - RNA, 20 nt, Human
uauauggacaugcacauaua

SEQ ID NO: 499312 - RNA, 25 nt, Human
ucacaacaccgaacaacaggcaauc

SEQ ID NO: 499313 - RNA, 20 nt, Human
ucaggaguuuuccuuuucuu

SEQ ID NO: 499314 - RNA, 21 nt, Human
uccauuagcuuugcuacaaug

SEQ ID NO: 499315 - RNA, 22 nt, Human
uccauuagcuuugcuacaauga

SEQ ID NO: 499316 - RNA, 23 nt, Human
ugaauaacaagcauguaacaaaa

SEQ ID NO: 499317 - RNA, 23 nt, Human
ugacaaggaugaaauauuucaaa

SEQ ID NO: 499318 - RNA, 23 nt, Human
ugagauaggaaacaugaaaguca

SEQ ID NO: 499319 - RNA, 20 nt, Human
ugagaugcaaaagaccacag

SEQ ID NO: 499320 - RNA, 21 nt, Human
ugagaugcaaaagaccacaga

SEQ ID NO: 499321 - RNA, 22 nt, Human
ugcauggaggcugaaugugaaa

SEQ ID NO: 499322 - RNA, 23 nt, Human
ugcccuuuaucaaggcugagaca

SEQ ID NO: 499323 - RNA, 21 nt, Human
ugcggucgcagccagcugagu

SEQ ID NO: 499324 - RNA, 18 nt, Human
uguacaaaacuuuauuau

SEQ ID NO: 499325 - RNA, 20 nt, Human
uguacaaugaaacuuuuugu

SEQ ID NO: 499326 - RNA, 18 nt, Human
uuaagcacaauacacaaa

SEQ ID NO: 499327 - RNA, 23 nt, Human
uuacagucagcuaaaaauaacaa

SEQ ID NO: 499328 - RNA, 18 nt, Human
uuuuuuuuuuucaggccu

SEQ ID NO: 499329 - RNA, 23 nt, Human
uuuuuuuuuuuuuuuuuuucagg

SEQ ID NO: 499330 - RNA, 26 nt, Human
aaaguuaaaaaaagauaaaacauauc

SEQ ID NO: 499331 - RNA, 21 nt, Human
aaccgagcaggagaccggccc

SEQ ID NO: 499332 - RNA, 21 nt, Human
aaguccgcccgccgcgccgcc

SEQ ID NO: 499333 - RNA, 21 nt, Human
agaccggcccccgcucccuca

SEQ ID NO: 499334 - RNA, 20 nt, Human
aggaaggaggacgagcggug

SEQ ID NO: 499335 - RNA, 21 nt, Human
agggaaaagaagggaagagaa

SEQ ID NO: 499336 - RNA, 22 nt, Human
agggaaggaaaagggaaaagaa

SEQ ID NO: 499337 - RNA, 21 nt, Human
caccuccgcuaccgccgccau

SEQ ID NO: 499338 - RNA, 23 nt, Human
caggagaccggcccccgcucccu

SEQ ID NO: 499339 - RNA, 24 nt, Human
ccccgcucccucagcugcgccgga

SEQ ID NO: 499340 - RNA, 19 nt, Human
cccgccgcgccgccgccgc

SEQ ID NO: 499341 - RNA, 20 nt, Human
cccgccgcgccgccgccgcg

SEQ ID NO: 499342 - RNA, 18 nt, Human
ccgccgccgccgucgccg

SEQ ID NO: 499343 - RNA, 21 nt, Human
ccgccgcgccgccgccgcgcc

SEQ ID NO: 499344 - RNA, 22 nt, Human
ccgccgcgccgccgccgcgccu

SEQ ID NO: 499345 - RNA, 20 nt, Human
ccgcgccgccgccgcgccug

SEQ ID NO: 499346 - RNA, 18 nt, Human
ccggaggaggcgcccagu

SEQ ID NO: 499347 - RNA, 22 nt, Human
ccuccgcuaccgccgccaucuu

SEQ ID NO: 499348 - RNA, 19 nt, Human
cgccgcgccgccgccgcgc

SEQ ID NO: 499349 - RNA, 21 nt, Human
cggccgcugagucccgcgucc

SEQ ID NO: 499350 - RNA, 21 nt, Human
cugcguugcgcccggcgcugc

SEQ ID NO: 499351 - RNA, 23 nt, Human
gagaaaauccggccgcugagucc

SEQ ID NO: 499352 - RNA, 26 nt, Human
gccgucagccgccgccgccgucgccg

SEQ ID NO: 499353 - RNA, 20 nt, Human
gcggagcgaggaaggaggac

SEQ ID NO: 499354 - RNA, 19 nt, Human
gcguugcgcccggcgcugc

SEQ ID NO: 499355 - RNA, 20 nt, Human
ggaaggaaaagggaaaagaa

SEQ ID NO: 499356 - RNA, 18 nt, Human
gggacgaaguccgcccgc

SEQ ID NO: 499357 - RNA, 22 nt, Human
guccacucacaccuccgcuacc

SEQ ID NO: 499358 - RNA, 22 nt, Human
uccgcuaccgccgccaucuucc

SEQ ID NO: 499359 - RNA, 21 nt, Human
ucgaugccaauuucaaauagg

SEQ ID NO: 499360 - RNA, 19 nt, Human
ugaccccugcguugcgccc

SEQ ID NO: 499361 - RNA, 19 nt, Human
ugcccgcuccggugugggg

SEQ ID NO: 499362 - RNA, 22 nt, Human
ugggggggagcaggaggaggga

SEQ ID NO: 499363 - RNA, 23 nt, Human
uuucaacaacuaaauuuuaguau

SEQ ID NO: 499364 - RNA, 20 nt, Human
aaacaagacacaaagcuaga

SEQ ID NO: 499365 - RNA, 21 nt, Human
aagacccauguaaccuggcga

SEQ ID NO: 499366 - RNA, 20 nt, Human
aagcacaaaaagaguauuua

SEQ ID NO: 499367 - RNA, 22 nt, Human
aagcacaaaaagaguauuuauc

SEQ ID NO: 499368 - RNA, 22 nt, Human
aaggauggauaacaauaacugu

SEQ ID NO: 499369 - RNA, 23 nt, Human
aaggcuugggguuaaagcauuuc

SEQ ID NO: 499370 - RNA, 24 nt, Human
agacacaaagcuagaagggacccc

SEQ ID NO: 499371 - RNA, 20 nt, Human
agagaacaacucauuugaca

SEQ ID NO: 499372 - RNA, 19 nt, Human
agagcaugaugauggaggc

SEQ ID NO: 499373 - RNA, 21 nt, Human
agcaaauaccaagagaacaac

SEQ ID NO: 499374 - RNA, 20 nt, Human
aggaaaaaaaggauggauaa

SEQ ID NO: 499375 - RNA, 21 nt, Human
augaugauggaggcuccauac

SEQ ID NO: 499376 - RNA, 22 nt, Human
auggucugaaacaagacacaaa

SEQ ID NO: 499377 - RNA, 23 nt, Human
auguaaccuggcgaguuauuggg

SEQ ID NO: 499378 - RNA, 23 nt, Human
caacaaggagaacuuccaaguau

SEQ ID NO: 499379 - RNA, 22 nt, Human
caucacaaaagagcaugaugau

SEQ ID NO: 499380 - RNA, 23 nt, Human
caucacaaaagagcaugaugaug

SEQ ID NO: 499381 - RNA, 21 nt, Human
cauuccacauggucugaaaca

SEQ ID NO: 499382 - RNA, 19 nt, Human
cccauauaaaggcuugggg

SEQ ID NO: 499383 - RNA, 19 nt, Human
cccauguaaccuggcgagu

SEQ ID NO: 499384 - RNA, 21 nt, Human
ccccauauaaaggcuuggggu

SEQ ID NO: 499385 - RNA, 19 nt, Human
ccucagaaaagggucuccc

SEQ ID NO: 499386 - RNA, 20 nt, Human
cuaaccaucaacaaccuucc

SEQ ID NO: 499387 - RNA, 21 nt, Human
cuaaccaucaacaaccuuccu

SEQ ID NO: 499388 - RNA, 23 nt, Human
cugagauuaaggugugagccuac

SEQ ID NO: 499389 - RNA, 23 nt, Human
gaaaagggucucccagaaaugcc

SEQ ID NO: 499390 - RNA, 22 nt, Human
gaagucccccauauaaaggcuu

SEQ ID NO: 499391 - RNA, 19 nt, Human
gacacaaagcuagaagucc

SEQ ID NO: 499392 - RNA, 25 nt, Human
gagcaugaugauggaggcuccauac

SEQ ID NO: 499393 - RNA, 22 nt, Human
gaugguagagcaaauaccaaga

SEQ ID NO: 499394 - RNA, 22 nt, Human
ggucacaggaaaauagcaaaua

SEQ ID NO: 499395 - RNA, 21 nt, Human
uagaagucccccauauaaagg

SEQ ID NO: 499396 - RNA, 21 nt, Human
uagaucagaagcacaaaaaga

SEQ ID NO: 499397 - RNA, 23 nt, Human
uaguaauuaaaauucucucucaa

SEQ ID NO: 499398 - RNA, 22 nt, Human
ucagaagcacaaaaagaguauu

SEQ ID NO: 499399 - RNA, 19 nt, Human
ucagaucaaauguaguaca

SEQ ID NO: 499400 - RNA, 19 nt, Human
ucccccauauaaaggcuug

SEQ ID NO: 499401 - RNA, 25 nt, Human
ucuagggagagaugguagagcaaau

SEQ ID NO: 499402 - RNA, 24 nt, Human
ucucccagaaaugccaaauaaaca

SEQ ID NO: 499403 - RNA, 18 nt, Human
ugggccagggcagguuag

SEQ ID NO: 499404 - RNA, 24 nt, Human
uuaaaauucucucucaagacccuu

SEQ ID NO: 499405 - RNA, 19 nt, Human
uuuagcauuuucuagcuau

SEQ ID NO: 499406 - RNA, 23 nt, Human
uuuuucuuuugauuucaagagcu

SEQ ID NO: 499407 - RNA, 19 nt, Human
aaaaauuucuuucucaacu

SEQ ID NO: 499408 - RNA, 25 nt, Human
aaaacaaaaacaaaaacaaaaauaa

SEQ ID NO: 499409 - RNA, 25 nt, Human
aaaacaaaugagcacuaaaaaaccc

SEQ ID NO: 499410 - RNA, 23 nt, Human
aaaagacuagaaggcaccguaac

SEQ ID NO: 499411 - RNA, 20 nt, Human
aaacaaaaacaaaaauaaca

SEQ ID NO: 499412 - RNA, 19 nt, Human
aaacaaaugagcacuaaaa

SEQ ID NO: 499413 - RNA, 19 nt, Human
aaacaagugcaagagccag

SEQ ID NO: 499414 - RNA, 25 nt, Human
aaacacuagcugucaauuuuuuuuc

SEQ ID NO: 499415 - RNA, 25 nt, Human
aaacacuagcugucaauuuuuuuuc

SEQ ID NO: 499416 - RNA, 19 nt, Human
aaaggagagaaaaauaggc

SEQ ID NO: 499417 - RNA, 23 nt, Human
aacaaaaauaacccgggccucac

SEQ ID NO: 499418 - RNA, 18 nt, Human
aacacugugaaaccccuc

SEQ ID NO: 499419 - RNA, 19 nt, Human
aacacugugaaaccccucu

SEQ ID NO: 499420 - RNA, 20 nt, Human
aacacugugaaaccccucuc

SEQ ID NO: 499421 - RNA, 23 nt, Human
aagaagcagggcaggcacagaug

SEQ ID NO: 499422 - RNA, 20 nt, Human
aagcagggcaggcacagaug

SEQ ID NO: 499423 - RNA, 22 nt, Human
aagccgaaaccacauaaucugg

SEQ ID NO: 499424 - RNA, 18 nt, Human
aaucacuugaacccggga

SEQ ID NO: 499425 - RNA, 18 nt, Human
aaugacaaaaaaaaaaaa

SEQ ID NO: 499426 - RNA, 18 nt, Human
aaugacaaaaaaaaaaaa

SEQ ID NO: 499427 - RNA, 23 nt, Human
acagaaagcacucugccuuucuu

SEQ ID NO: 499428 - RNA, 25 nt, Human
acagaagcaacaacaagaagcaggg

SEQ ID NO: 499429 - RNA, 18 nt, Human
acagagugagacccuguc

SEQ ID NO: 499430 - RNA, 21 nt, Human
acagagugagacccuguccca

SEQ ID NO: 499431 - RNA, 23 nt, Human
acagagugagacccugucucaaa

SEQ ID NO: 499432 - RNA, 24 nt, Human
acagagugagacccugucucaaaa

SEQ ID NO: 499433 - RNA, 23 nt, Human
acauacacacauaauacauaaaa

SEQ ID NO: 499434 - RNA, 24 nt, Human
accacccugcccaacacugugaaa

SEQ ID NO: 499435 - RNA, 23 nt, Human
accccucucuacuaaaaauacaa

SEQ ID NO: 499436 - RNA, 18 nt, Human
acccugucccauacauac

SEQ ID NO: 499437 - RNA, 23 nt, Human
accuaagcccaggaggucaaagc

SEQ ID NO: 499438 - RNA, 18 nt, Human
accuguauucccagcacu

SEQ ID NO: 499439 - RNA, 24 nt, Human
acgccacugcacuccagccugggc

SEQ ID NO: 499440 - RNA, 24 nt, Human
acgccacugcacuccagccugggc

SEQ ID NO: 499441 - RNA, 18 nt, Human
acggaacccaggaacacu

SEQ ID NO: 499442 - RNA, 24 nt, Human
acuccagccugggcaacagaguga

SEQ ID NO: 499443 - RNA, 24 nt, Human
acugcacuccagccugggcaacag

SEQ ID NO: 499444 - RNA, 24 nt, Human
acugcacuccagccugggcaacag

SEQ ID NO: 499445 - RNA, 18 nt, Human
agaaagcacucugccuuu

SEQ ID NO: 499446 - RNA, 19 nt, Human
agacuagaaggcaccguaa

SEQ ID NO: 499447 - RNA, 24 nt, Human
agacugaggcaggaggguugcuug

SEQ ID NO: 499448 - RNA, 20 nt, Human
agccaggugugguggcauac

SEQ ID NO: 499449 - RNA, 22 nt, Human
agccugggcaacagagugagac

SEQ ID NO: 499450 - RNA, 24 nt, Human
agccugggcaacauagcaagaccc

SEQ ID NO: 499451 - RNA, 22 nt, Human
agccugggugacagagugagac

SEQ ID NO: 499452 - RNA, 18 nt, Human
aggaaaaaaauuguaaaa

SEQ ID NO: 499453 - RNA, 20 nt, Human
aggaaaaaaauuguaaaaga

SEQ ID NO: 499454 - RNA, 20 nt, Human
aggaaaaaaauuguaaaaga

SEQ ID NO: 499455 - RNA, 23 nt, Human
aggaguucaagaccagccugggc

SEQ ID NO: 499456 - RNA, 18 nt, Human
aggcaggagaaucacuug

SEQ ID NO: 499457 - RNA, 24 nt, Human
aggcaggagaaucacuugaacccg

SEQ ID NO: 499458 - RNA, 23 nt, Human
aggcaggaggguugcuugaggcc

SEQ ID NO: 499459 - RNA, 20 nt, Human
aggccuguucuggcagcagg

SEQ ID NO: 499460 - RNA, 24 nt, Human
aggcuaaggcaggagaaucacuug

SEQ ID NO: 499461 - RNA, 22 nt, Human
agggagcccaucuaucuccaga

SEQ ID NO: 499462 - RNA, 24 nt, Human
aggguugcuugaggccaggaguuc

SEQ ID NO: 499463 - RNA, 26 nt, Human
agguagguggaucacuugaggccaga

SEQ ID NO: 499464 - RNA, 22 nt, Human
aggugcaguggcucccaccugg

SEQ ID NO: 499465 - RNA, 24 nt, Human
aguggcucccaccuggaaucccag

SEQ ID NO: 499466 - RNA, 18 nt, Human
auauuuuguacaaaaaua

SEQ ID NO: 499467 - RNA, 18 nt, Human
auauuuuguacaaaaaua

SEQ ID NO: 499468 - RNA, 24 nt, Human
aucacgccacugcacuccagccug

SEQ ID NO: 499469 - RNA, 18 nt, Human
augaaaaucagcauauca

SEQ ID NO: 499470 - RNA, 21 nt, Human
augacaaaaaaaaaaaaagga

SEQ ID NO: 499471 - RNA, 18 nt, Human
caaaaauaacaugggugg

SEQ ID NO: 499472 - RNA, 23 nt, Human
caaaacaaaaacaaaaacaaaaa

SEQ ID NO: 499473 - RNA, 21 nt, Human
caaaugagcacuaaaaaaccc

SEQ ID NO: 499474 - RNA, 19 nt, Human
caacaacaagaagcagggc

SEQ ID NO: 499475 - RNA, 26 nt, Human
caacaacaagaagcagggcaggcaca

SEQ ID NO: 499476 - RNA, 22 nt, Human
caacaagaagcagggcaggcac

SEQ ID NO: 499477 - RNA, 22 nt, Human
caacagagugagacccugucuc

SEQ ID NO: 499478 - RNA, 19 nt, Human
caacauagcaagacccugu

SEQ ID NO: 499479 - RNA, 24 nt, Human
caacauagcaagacccuguuucua

SEQ ID NO: 499480 - RNA, 22 nt, Human
cacaaugaaaaucagcauauca

SEQ ID NO: 499481 - RNA, 22 nt, Human
cacaaugaaaaucagcauauca

SEQ ID NO: 499482 - RNA, 24 nt, Human
cacaccuguauucccagcacuuug

SEQ ID NO: 499483 - RNA, 24 nt, Human
caccgcacgcccaugguagccgcg

SEQ ID NO: 499484 - RNA, 19 nt, Human
caccuguauucccagcacu

SEQ ID NO: 499485 - RNA, 24 nt, Human
caccuguauucccagcacuuuggg

SEQ ID NO: 499486 - RNA, 22 nt, Human
cacggaucaacaaaaauaaccc

SEQ ID NO: 499487 - RNA, 20 nt, Human
cacuaaaaaacccaauggcg

SEQ ID NO: 499488 - RNA, 22 nt, Human
cacuccagccugggcaacagag

SEQ ID NO: 499489 - RNA, 24 nt, Human
cacuccagccugggcaacagagug

SEQ ID NO: 499490 - RNA, 18 nt, Human
cacugcacuccagccugg

SEQ ID NO: 499491 - RNA, 19 nt, Human
cacugcacuccagccuggg

SEQ ID NO: 499492 - RNA, 21 nt, Human
cacugcacuccagccugggca

SEQ ID NO: 499493 - RNA, 23 nt, Human
cacugcacuccagccugggcaac

SEQ ID NO: 499494 - RNA, 24 nt, Human
cacugcacuccagccugggcaaca

SEQ ID NO: 499495 - RNA, 22 nt, Human
cacuugaggccagaaguuugaa

SEQ ID NO: 499496 - RNA, 18 nt, Human
cagaggccaaaacugugg

SEQ ID NO: 499497 - RNA, 19 nt, Human
cagaggccaaaacuguggu

SEQ ID NO: 499498 - RNA, 18 nt, Human
cagagugagacccugucc

SEQ ID NO: 499499 - RNA, 24 nt, Human
cagcacuuugcaagacugaggcag

SEQ ID NO: 499500 - RNA, 23 nt, Human
cagcacuuugggaaacuagguag

SEQ ID NO: 499501 - RNA, 20 nt, Human
cagccugggugacagaguga

SEQ ID NO: 499502 - RNA, 25 nt, Human
cauagcaagacccuguuucuacaaa

SEQ ID NO: 499503 - RNA, 18 nt, Human
caugacccaaaguggacu

SEQ ID NO: 499504 - RNA, 23 nt, Human
caugacccaaaguggacugcaga

SEQ ID NO: 499505 - RNA, 22 nt, Human
cauuccagccugggugacagag

SEQ ID NO: 499506 - RNA, 24 nt, Human
cauuccagccugggugacagagug

SEQ ID NO: 499507 - RNA, 22 nt, Human
ccaacacugugaaaccccucuc

SEQ ID NO: 499508 - RNA, 20 nt, Human
ccacugcacuccagccuggg

SEQ ID NO: 499509 - RNA, 20 nt, Human
ccacugcacuccagccuggg

SEQ ID NO: 499510 - RNA, 21 nt, Human
ccacugcacuccagccugggc

SEQ ID NO: 499511 - RNA, 22 nt, Human
ccacugcacuccagccugggca

SEQ ID NO: 499512 - RNA, 23 nt, Human
ccacugcacuccagccugggcaa

SEQ ID NO: 499513 - RNA, 24 nt, Human
ccacugcacuccagccugggcaac

SEQ ID NO: 499514 - RNA, 19 nt, Human
ccagagugaggauguaaaa

SEQ ID NO: 499515 - RNA, 23 nt, Human
ccagcaccaaaaaugggcucacg

SEQ ID NO: 499516 - RNA, 18 nt, Human
ccaggaggucaaagcugc

SEQ ID NO: 499517 - RNA, 18 nt, Human
ccaguuauccggcugucc

SEQ ID NO: 499518 - RNA, 22 nt, Human
cccaaaguggacugcagagcac

SEQ ID NO: 499519 - RNA, 24 nt, Human
cccaccuggaaucccagcacuuug

SEQ ID NO: 499520 - RNA, 19 nt, Human
cccagcaccaaaaaugggc

SEQ ID NO: 499521 - RNA, 25 nt, Human
cccauacauacacacauaauacaua

SEQ ID NO: 499522 - RNA, 24 nt, Human
cccauggccaugaccccaguuauc

SEQ ID NO: 499523 - RNA, 20 nt, Human
ccccuguggucccagcuacg

SEQ ID NO: 499524 - RNA, 21 nt, Human
cccgggauguggggguugcag

SEQ ID NO: 499525 - RNA, 20 nt, Human
cccugucucaaaacaaaaac

SEQ ID NO: 499526 - RNA, 19 nt, Human
cccuguggucccagcuacg

SEQ ID NO: 499527 - RNA, 19 nt, Human
ccgcgcgccggccgucugc

SEQ ID NO: 499528 - RNA, 20 nt, Human
ccgcgcuccccgcgcucccc

SEQ ID NO: 499529 - RNA, 22 nt, Human
ccugggcaacauagcaagaccc

SEQ ID NO: 499530 - RNA, 20 nt, Human
ccugggugacagagugagac

SEQ ID NO: 499531 - RNA, 19 nt, Human
ccuguucuggcagcagggc

SEQ ID NO: 499532 - RNA, 19 nt, Human
cgaccaaugauaaccuuuu

SEQ ID NO: 499533 - RNA, 24 nt, Human
cgagaucacgccacugcacuccag

SEQ ID NO: 499534 - RNA, 25 nt, Human
cgagcggcugcucaccgcacgccca

SEQ ID NO: 499535 - RNA, 19 nt, Human
cgccgccgccggcccgcgc

SEQ ID NO: 499536 - RNA, 20 nt, Human
cgccggcccgcgcuccccgc

SEQ ID NO: 499537 - RNA, 19 nt, Human
cgcucagggcggccagcag

SEQ ID NO: 499538 - RNA, 24 nt, Human
cgcuuguauucccagcuaccuggg

SEQ ID NO: 499539 - RNA, 23 nt, Human
cggcuguccagcuuuccaauuuu

SEQ ID NO: 499540 - RNA, 24 nt, Human
cgggauguggggguugcagugagc

SEQ ID NO: 499541 - RNA, 22 nt, Human
cgguaaaaugacaaaaaaaaaa

SEQ ID NO: 499542 - RNA, 22 nt, Human
cgguaaaaugacaaaaaaaaaa

SEQ ID NO: 499543 - RNA, 21 nt, Human
cguaacaucuaacaccuuucu

SEQ ID NO: 499544 - RNA, 20 nt, Human
cgucauuccagccuggguga

SEQ ID NO: 499545 - RNA, 21 nt, Human
cgucauuccagccugggugac

SEQ ID NO: 499546 - RNA, 23 nt, Human
cgucauuccagccugggugacag

SEQ ID NO: 499547 - RNA, 23 nt, Human
cuagcugucaauuuuuuuucagu

SEQ ID NO: 499548 - RNA, 23 nt, Human
cuagcugucaauuuuuuuucagu

SEQ ID NO: 499549 - RNA, 26 nt, Human
cuagguagguggaucacuugaggcca

SEQ ID NO: 499550 - RNA, 21 nt, Human
cucaaaacaaaaacaaaaaca

SEQ ID NO: 499551 - RNA, 27 nt, Human
cugaaaaauaguagcauuugucuguga

SEQ ID NO: 499552 - RNA, 18 nt, Human
cuggcagcagggcuccug

SEQ ID NO: 499553 - RNA, 18 nt, Human
cuggcuccuauaaauaaa

SEQ ID NO: 499554 - RNA, 22 nt, Human
cugucucaaaacaaaaacaaaa

SEQ ID NO: 499555 - RNA, 20 nt, Human
cuucccauaacucaacgacc

SEQ ID NO: 499556 - RNA, 20 nt, Human
cuucccauaacucaacgacc

SEQ ID NO: 499557 - RNA, 24 nt, Human
cuucgucauuccagccugggugac

SEQ ID NO: 499558 - RNA, 19 nt, Human
gaaaucguuccacugcccu

SEQ ID NO: 499559 - RNA, 31 nt, Human
gaagucgucccgagcggcugcucaccgcacu

SEQ ID NO: 499560 - RNA, 21 nt, Human
gacagaaaugacagaagcaac

SEQ ID NO: 499561 - RNA, 21 nt, Human
gagaacccagcaccaaaaaug

SEQ ID NO: 499562 - RNA, 19 nt, Human
gagcacuaaaaaacccaau

SEQ ID NO: 499563 - RNA, 23 nt, Human
gagccaggugcaguggcucccac

SEQ ID NO: 499564 - RNA, 21 nt, Human
gagcgcucagggcggccagca

SEQ ID NO: 499565 - RNA, 24 nt, Human
gagcggcugcucaccgcacgccca

SEQ ID NO: 499566 - RNA, 24 nt, Human
gaucaccuaagcccaggaggucaa

SEQ ID NO: 499567 - RNA, 24 nt, Human
gaucacuugaggccagaaguuuga

SEQ ID NO: 499568 - RNA, 23 nt, Human
gcacuccagccugggcaacagag

SEQ ID NO: 499569 - RNA, 24 nt, Human
gcacuccagccugggcaacagagu

SEQ ID NO: 499570 - RNA, 22 nt, Human
gcagcaagcaugacccaaagug

SEQ ID NO: 499571 - RNA, 23 nt, Human
gcaggagaaucacuugaacccgg

SEQ ID NO: 499572 - RNA, 22 nt, Human
gccacugcacuccagccugggc

SEQ ID NO: 499573 - RNA, 24 nt, Human
gccacugcacuccagccugggcaa

SEQ ID NO: 499574 - RNA, 22 nt, Human
gccaugaccccaguuauccggc

SEQ ID NO: 499575 - RNA, 19 nt, Human
gcccaacacugugaaaccc

SEQ ID NO: 499576 - RNA, 22 nt, Human
gcccauggccaugaccccagga

SEQ ID NO: 499577 - RNA, 20 nt, Human
gccgagaucacgccacugca

SEQ ID NO: 499578 - RNA, 22 nt, Human
gccgccggcccgcgcuccccgc

SEQ ID NO: 499579 - RNA, 22 nt, Human
ggaaaacauugauuaaaagauc

SEQ ID NO: 499580 - RNA, 22 nt, Human
ggaggccuguucuggcagcagg

SEQ ID NO: 499581 - RNA, 18 nt, Human
ggauggaucuuggacugg

SEQ ID NO: 499582 - RNA, 21 nt, Human
ggcacuguuuacacaguauau

SEQ ID NO: 499583 - RNA, 21 nt, Human
ggcacuguuuacacaguauau

SEQ ID NO: 499584 - RNA, 21 nt, Human
gggaaacuagguagguggauc

SEQ ID NO: 499585 - RNA, 18 nt, Human
ggggacaaaacguggugg

SEQ ID NO: 499586 - RNA, 20 nt, Human
ggggguugcagugagccgag

SEQ ID NO: 499587 - RNA, 19 nt, Human
gggguugcagugagccgag

SEQ ID NO: 499588 - RNA, 21 nt, Human
gggguugcagugagccgagau

SEQ ID NO: 499589 - RNA, 22 nt, Human
gggguugcagugagccgagauc

SEQ ID NO: 499590 - RNA, 23 nt, Human
gggguugcagugagccgagauca

SEQ ID NO: 499591 - RNA, 23 nt, Human
ggguugcuugaggccaggaguuc

SEQ ID NO: 499592 - RNA, 19 nt, Human
ggugaugcaauuagaaagg

SEQ ID NO: 499593 - RNA, 20 nt, Human
gguugcagugagccgagauc

SEQ ID NO: 499594 - RNA, 24 nt, Human
gguugcuugaggccaggaguucaa

SEQ ID NO: 499595 - RNA, 27 nt, Human
guauggaggccuguucuucgucguguc

SEQ ID NO: 499596 - RNA, 25 nt, Human
guggcauaccccuguggucccagcu

SEQ ID NO: 499597 - RNA, 23 nt, Human
gugguucacaccuguauucccag

SEQ ID NO: 499598 - RNA, 19 nt, Human
guugcagugagccgagauc

SEQ ID NO: 499599 - RNA, 24 nt, Human
guuuaugaaaacaagaugugaaga

SEQ ID NO: 499600 - RNA, 19 nt, Human
guuugaaaccacccugccc

SEQ ID NO: 499601 - RNA, 18 nt, Human
uaaaagacaaauauuuug

SEQ ID NO: 499602 - RNA, 18 nt, Human
uaaaagacaaauauuuug

SEQ ID NO: 499603 - RNA, 19 nt, Human
uaaaagacaaauauuuugu

SEQ ID NO: 499604 - RNA, 18 nt, Human
uaaaaugacaaaaaaaaa

SEQ ID NO: 499605 - RNA, 18 nt, Human
uaaaaugacaaaaaaaaa

SEQ ID NO: 499606 - RNA, 19 nt, Human
uaacucaacgaccaaugau

SEQ ID NO: 499607 - RNA, 19 nt, Human
uaacucaacgaccaaugau

SEQ ID NO: 499608 - RNA, 20 nt, Human
uaaggcaggagaaucacuug

SEQ ID NO: 499609 - RNA, 24 nt, Human
uaaggcaggagaaucacuugaacc

SEQ ID NO: 499610 - RNA, 22 nt, Human
uacauacacacauaauacauaa

SEQ ID NO: 499611 - RNA, 25 nt, Human
uagaaggcaccguaacaucuaacac

SEQ ID NO: 499612 - RNA, 24 nt, Human
uagaauagcgguugggucaaagga

SEQ ID NO: 499613 - RNA, 20 nt, Human
uagcauuugucugugaaguu

SEQ ID NO: 499614 - RNA, 22 nt, Human
uagccaggugugguggcauacc

SEQ ID NO: 499615 - RNA, 24 nt, Human
uagguggaucacuugaggccagaa

SEQ ID NO: 499616 - RNA, 21 nt, Human
uaugaaaacaagaugugaaga

SEQ ID NO: 499617 - RNA, 21 nt, Human
uaugugauucaguccaugugc

SEQ ID NO: 499618 - RNA, 21 nt, Human
uaugugauucaguccaugugc

SEQ ID NO: 499619 - RNA, 24 nt, Human
ucaaaagacuagaaggcaccguaa

SEQ ID NO: 499620 - RNA, 23 nt, Human
ucacaccuguauucccagcacuu

SEQ ID NO: 499621 - RNA, 23 nt, Human
ucacgccacugcacuccagccug

SEQ ID NO: 499622 - RNA, 18 nt, Human
uccacauguugauggagc

SEQ ID NO: 499623 - RNA, 23 nt, Human
uccagccugggcaacagagugag

SEQ ID NO: 499624 - RNA, 24 nt, Human
uccagccugggcaacagagugaga

SEQ ID NO: 499625 - RNA, 19 nt, Human
uccagccugggugacagag

SEQ ID NO: 499626 - RNA, 23 nt, Human
uccagccugggugacagagugag

SEQ ID NO: 499627 - RNA, 24 nt, Human
uccagccugggugacagagugaga

SEQ ID NO: 499628 - RNA, 23 nt, Human
uccagcuuuccaauuuuuguagu

SEQ ID NO: 499629 - RNA, 23 nt, Human
uccauugcuguuccucucuagug

SEQ ID NO: 499630 - RNA, 22 nt, Human
ucccucgccgccgccggcccgc

SEQ ID NO: 499631 - RNA, 23 nt, Human
uccucccucgccgccgccggcua

SEQ ID NO: 499632 - RNA, 20 nt, Human
ucgccgccgccggcccgcgc

SEQ ID NO: 499633 - RNA, 19 nt, Human
ucgucauuccagccugggu

SEQ ID NO: 499634 - RNA, 21 nt, Human
ucucccugucuuuuucgcaaa

SEQ ID NO: 499635 - RNA, 21 nt, Human
ucucuacuaaaaauacaaaaa

SEQ ID NO: 499636 - RNA, 19 nt, Human
ugaaaaucagcauaucacc

SEQ ID NO: 499637 - RNA, 19 nt, Human
ugaaaaucagcauaucacc

SEQ ID NO: 499638 - RNA, 22 nt, Human
ugacaaaaaaaaaaaaaggaaa

SEQ ID NO: 499639 - RNA, 20 nt, Human
ugacagaaaugacagaagca

SEQ ID NO: 499640 - RNA, 19 nt, Human
ugacagaagcaacaacaag

SEQ ID NO: 499641 - RNA, 20 nt, Human
ugacccaaaguggacugcag

SEQ ID NO: 499642 - RNA, 21 nt, Human
ugagaacccagcaccaaaaau

SEQ ID NO: 499643 - RNA, 22 nt, Human
ugagccgagaucacgccacugc

SEQ ID NO: 499644 - RNA, 23 nt, Human
ugagcgucccugcacgaggccca

SEQ ID NO: 499645 - RNA, 19 nt, Human
ugaggcaggaggguugcuu

SEQ ID NO: 499646 - RNA, 21 nt, Human
ugaggcaggaggguugcuuga

SEQ ID NO: 499647 - RNA, 24 nt, Human
ugaggcaggaggguugcuugaggc

SEQ ID NO: 499648 - RNA, 25 nt, Human
ugaggcaggaggguugcuugaggcc

SEQ ID NO: 499649 - RNA, 19 nt, Human
ugauggagcuaaccgaggg

SEQ ID NO: 499650 - RNA, 19 nt, Human
ugcccagcauaaaucaacc

SEQ ID NO: 499651 - RNA, 22 nt, Human
uggacugcagagcacaagccga

SEQ ID NO: 499652 - RNA, 23 nt, Human
uggaggccuguucuggcagcagg

SEQ ID NO: 499653 - RNA, 23 nt, Human
uggaucacuugaggccagaaguu

SEQ ID NO: 499654 - RNA, 24 nt, Human
uggaucacuugaggccagaaguuu

SEQ ID NO: 499655 - RNA, 27 nt, Human
uggaucacuugaggccagaaguuugaa

SEQ ID NO: 499656 - RNA, 24 nt, Human
uggcguuuagagagagacacaugc

SEQ ID NO: 499657 - RNA, 24 nt, Human
ugggaggcuaaggcaggagaauca

SEQ ID NO: 499658 - RNA, 20 nt, Human
ugggauuuuagaaauguaug

SEQ ID NO: 499659 - RNA, 20 nt, Human
ugggauuuuagaaauguaug

SEQ ID NO: 499660 - RNA, 21 nt, Human
ugggcaacagagugagacccu

SEQ ID NO: 499661 - RNA, 24 nt, Human
ugggcaacagagugagacccuguc

SEQ ID NO: 499662 - RNA, 22 nt, Human
uggggccacacacuggggguug

SEQ ID NO: 499663 - RNA, 22 nt, Human
uggguagaauuaaaucugacag

SEQ ID NO: 499664 - RNA, 22 nt, Human
uggguagaauuaaaucugacag

SEQ ID NO: 499665 - RNA, 20 nt, Human
ugggucaaaggagagaaaaa

SEQ ID NO: 499666 - RNA, 21 nt, Human
ugggugacagagugagacccu

SEQ ID NO: 499667 - RNA, 20 nt, Human
uggguggggccacacacugg

SEQ ID NO: 499668 - RNA, 23 nt, Human
uggguggggccacacacuggggg

SEQ ID NO: 499669 - RNA, 23 nt, Human
uggugguucacaccuguauuccc

SEQ ID NO: 499670 - RNA, 22 nt, Human
ugguucacaccuguauucccag

SEQ ID NO: 499671 - RNA, 24 nt, Human
ugguucacaccuguauucccagca

SEQ ID NO: 499672 - RNA, 19 nt, Human
ugucccauacauacacaca

SEQ ID NO: 499673 - RNA, 25 nt, Human
ugucucaaaacaaaaacaaaaacaa

SEQ ID NO: 499674 - RNA, 22 nt, Human
ugucuucugagggcuggcuccu

SEQ ID NO: 499675 - RNA, 19 nt, Human
ugugaagacuugucuucac

SEQ ID NO: 499676 - RNA, 22 nt, Human
uuaaaagaucacagaaagcacu

SEQ ID NO: 499677 - RNA, 23 nt, Human
uuagccaggugugguggcauacc

SEQ ID NO: 499678 - RNA, 19 nt, Human
uucccauaacucaacgacc

SEQ ID NO: 499679 - RNA, 19 nt, Human
uucccauaacucaacgacc

SEQ ID NO: 499680 - RNA, 19 nt, Human
uugagagcugaaaauuugc

SEQ ID NO: 499681 - RNA, 19 nt, Human
uugagagcugaaaauuugc

SEQ ID NO: 499682 - RNA, 22 nt, Human
uugaggccaggaguucaagacc

SEQ ID NO: 499683 - RNA, 18 nt, Human
uugcagugagccgagauc

SEQ ID NO: 499684 - RNA, 20 nt, Human
uugcagugagccgagaucac

SEQ ID NO: 499685 - RNA, 21 nt, Human
uugcagugagccgagaucacg

SEQ ID NO: 499686 - RNA, 23 nt, Human
uugcuugaggccaggaguucaag

SEQ ID NO: 499687 - RNA, 18 nt, Human
uugggucaaaggagagaa

SEQ ID NO: 499688 - RNA, 18 nt, Human
uuuauuaguaccauuauu

SEQ ID NO: 499689 - RNA, 20 nt, Human
uuuguacaaaaauacaaagu

SEQ ID NO: 499690 - RNA, 20 nt, Human
uuuguacaaaaauacaaagu

SEQ ID NO: 499691 - RNA, 22 nt, Human
aggaagaaaauaguaauuggga

SEQ ID NO: 499692 - RNA, 19 nt, Human
cugccugaagagcugggaa

SEQ ID NO: 499693 - RNA, 19 nt, Human
gcacugccugaagagcugg

SEQ ID NO: 499694 - RNA, 22 nt, Human
ugagcaugugggcauagcuggg

SEQ ID NO: 499695 - RNA, 21 nt, Human
aaaaaaucuaaaguuaacaaa

SEQ ID NO: 499696 - RNA, 19 nt, Human
aagaugaaucuugaacuca

SEQ ID NO: 499697 - RNA, 26 nt, Human
aaguguaucauguaucuucauagcuu

SEQ ID NO: 499698 - RNA, 21 nt, Human
acaaaaugagaacuguuucaa

SEQ ID NO: 499699 - RNA, 19 nt, Human
acaggauucugaagaugaa

SEQ ID NO: 499700 - RNA, 22 nt, Human
acugugccuggggacaaucuuu

SEQ ID NO: 499701 - RNA, 25 nt, Human
agccaagcgauaaauauaagcaacc

SEQ ID NO: 499702 - RNA, 23 nt, Human
agccauccaauaaauugaaaaua

SEQ ID NO: 499703 - RNA, 18 nt, Human
aggagguggggggugaaa

SEQ ID NO: 499704 - RNA, 21 nt, Human
aggagguggggggugaaaaga

SEQ ID NO: 499705 - RNA, 23 nt, Human
aggauaguuguacaaaguguauc

SEQ ID NO: 499706 - RNA, 19 nt, Human
aguuucuccuucuaaaagg

SEQ ID NO: 499707 - RNA, 18 nt, Human
caaacacuauucuacaug

SEQ ID NO: 499708 - RNA, 19 nt, Human
caaccaaugguacauauaa

SEQ ID NO: 499709 - RNA, 19 nt, Human
cacacuauuggaaaaaauc

SEQ ID NO: 499710 - RNA, 21 nt, Human
cagaguaaaugaacuaagggc

SEQ ID NO: 499711 - RNA, 23 nt, Human
cauggcaagcccuccacugccag

SEQ ID NO: 499712 - RNA, 24 nt, Human
ccaagcgauaaauauaagcaacca

SEQ ID NO: 499713 - RNA, 19 nt, Human
ccccagugauucagauacu

SEQ ID NO: 499714 - RNA, 22 nt, Human
cgacagcacaaguuaauauguc

SEQ ID NO: 499715 - RNA, 20 nt, Human
cgccgcugcaccguccggac

SEQ ID NO: 499716 - RNA, 22 nt, Human
gagguggggggugaaaagagag

SEQ ID NO: 499717 - RNA, 18 nt, Human
gugauucagauacugugc

SEQ ID NO: 499718 - RNA, 22 nt, Human
guggggggugaaaagagagcau

SEQ ID NO: 499719 - RNA, 22 nt, Human
uaaguuacaacaaacaacuuca

SEQ ID NO: 499720 - RNA, 22 nt, Human
uacugacaggcuccauccagau

SEQ ID NO: 499721 - RNA, 21 nt, Human
ucaguuaaauauuuauugaac

SEQ ID NO: 499722 - RNA, 22 nt, Human
ucauaauccccagugauucaga

SEQ ID NO: 499723 - RNA, 19 nt, Human
uccaaagggcagaacuuga

SEQ ID NO: 499724 - RNA, 22 nt, Human
uccaaagggcagaacuugagcc

SEQ ID NO: 499725 - RNA, 23 nt, Human
uccaaagggcagaacuugagccc

SEQ ID NO: 499726 - RNA, 24 nt, Human
ugacaaacacuauucuacaugaaa

SEQ ID NO: 499727 - RNA, 19 nt, Human
ugagucacuagaaaacuaa

SEQ ID NO: 499728 - RNA, 26 nt, Human
uggaaaaaaucuaaaguuaacaaacu

SEQ ID NO: 499729 - RNA, 20 nt, Human
uggacaaaauguauauagua

SEQ ID NO: 499730 - RNA, 19 nt, Human
uggcaagcccuccacugcc

SEQ ID NO: 499731 - RNA, 18 nt, Human
uggucuauuuguuccuca

SEQ ID NO: 499732 - RNA, 23 nt, Human
uguucuccaaagagggugaauca

SEQ ID NO: 499733 - RNA, 23 nt, Human
uuacaacaaacaacuucaaauau

SEQ ID NO: 499734 - RNA, 21 nt, Human
uucuacaugaaacaggaaauc

SEQ ID NO: 499735 - RNA, 20 nt, Human
uuggaaaaaaucuaaaguua

SEQ ID NO: 499736 - RNA, 24 nt, Human
uuuaucacauaguaaggaaugcug

SEQ ID NO: 499737 - RNA, 21 nt, Human
uuuuuuuuuuuuuuuuuucag

SEQ ID NO: 499738 - RNA, 22 nt, Human
agauguuggaguccaguaagcc

SEQ ID NO: 499739 - RNA, 22 nt, Human
cacaagauuuaaggaugccaga

SEQ ID NO: 499740 - RNA, 24 nt, Human
cagauucuauauaagcaugaaaga

SEQ ID NO: 499741 - RNA, 19 nt, Human
cccauaccuaaauuaacug

SEQ ID NO: 499742 - RNA, 21 nt, Human
cuaccaggcuccgaggggcag

SEQ ID NO: 499743 - RNA, 20 nt, Human
gggcuuguggcccacuacca

SEQ ID NO: 499744 - RNA, 27 nt, Human
uaaauuaacuguaaagcuucaaggacc

SEQ ID NO: 499745 - RNA, 22 nt, Human
uaagacaaaagacaaacuauaa

SEQ ID NO: 499746 - RNA, 19 nt, Human
ugaggacagcauucagaac

SEQ ID NO: 499747 - RNA, 23 nt, Human
ugaggacagcauucagaacuguu

SEQ ID NO: 499748 - RNA, 19 nt, Human
uggcccacuaccaggcucc

SEQ ID NO: 499749 - RNA, 24 nt, Human
uggcugaaaaguauucagcaugaa

SEQ ID NO: 499750 - RNA, 24 nt, Human
uggcugaaaaguauucagcauuau

SEQ ID NO: 499751 - RNA, 27 nt, Human
uucagaacuguuaagacaaaagacaaa

SEQ ID NO: 499752 - RNA, 22 nt, Human
aaaaagcuuucaaaacaucuga

SEQ ID NO: 499753 - RNA, 20 nt, Human
aaaacaucugaguuagcuua

SEQ ID NO: 499754 - RNA, 18 nt, Human
acccugaaauauauggga

SEQ ID NO: 499755 - RNA, 19 nt, Human
acccugaaauauaugggaa

SEQ ID NO: 499756 - RNA, 22 nt, Human
auaaugucuucuuuaaacggaa

SEQ ID NO: 499757 - RNA, 21 nt, Human
caccucuguuuaaagaaaaag

SEQ ID NO: 499758 - RNA, 18 nt, Human
gagaggcaugaagcacuu

SEQ ID NO: 499759 - RNA, 24 nt, Human
uaaaugcuuguacuuccugcucua

SEQ ID NO: 499760 - RNA, 19 nt, Human
uaaguuuuacaugacuaca

SEQ ID NO: 499761 - RNA, 18 nt, Human
uagaauaaccacauuugg

SEQ ID NO: 499762 - RNA, 19 nt, Human
uuuuuggcucauuucucca

SEQ ID NO: 499763 - RNA, 20 nt, Human
uuuuuuuuuggcucauuucu

SEQ ID NO: 499764 - RNA, 18 nt, Human
uuuuuuuuuuuuuuuuug

SEQ ID NO: 499765 - RNA, 21 nt, Human
uuuuuuuuuuuuuuuuuggcu

SEQ ID NO: 499766 - RNA, 22 nt, Human
uuuuuuuuuuuuuuuuuuuggc

SEQ ID NO: 499767 - RNA, 21 nt, Human
cagagcaccuuauacuucuaa

SEQ ID NO: 499768 - RNA, 21 nt, Human
ccuccgcaccacgggaacaaa

SEQ ID NO: 499769 - RNA, 23 nt, Human
cuacaaccaagacgcaacuuuac

SEQ ID NO: 499770 - RNA, 18 nt, Human
guaaaguacuucucagag

SEQ ID NO: 499771 - RNA, 19 nt, Human
uaaaguacuucucagagac

SEQ ID NO: 499772 - RNA, 22 nt, Human
ucagauuuuggguaacugguuu

SEQ ID NO: 499773 - RNA, 22 nt, Human
uccgggugugggccuugacccu

SEQ ID NO: 499774 - RNA, 24 nt, Human
uuaggacacuucagagcaccuuau

SEQ ID NO: 499775 - RNA, 25 nt, Human
uuccgggugugggccuugacccucc

SEQ ID NO: 499776 - RNA, 23 nt, Human
uuuaaaguguuacuugaauauuu

SEQ ID NO: 499777 - RNA, 22 nt, Human
aaaacagaaaguaccaacaaaa

SEQ ID NO: 499778 - RNA, 28 nt, Human
aaacagaaaguaccaacaaaagggaccc

SEQ ID NO: 499779 - RNA, 21 nt, Human
aaggaaacaagggagagagca

SEQ ID NO: 499780 - RNA, 19 nt, Human
aaucuauauacccuucccu

SEQ ID NO: 499781 - RNA, 21 nt, Human
aaucuauauacccuucccuuc

SEQ ID NO: 499782 - RNA, 19 nt, Human
accccacauccccagggag

SEQ ID NO: 499783 - RNA, 22 nt, Human
agacuggcucccagaauucuca

SEQ ID NO: 499784 - RNA, 19 nt, Human
agagaggaaaagaaaugac

SEQ ID NO: 499785 - RNA, 22 nt, Human
agagcuggaagcuucgaccucc

SEQ ID NO: 499786 - RNA, 24 nt, Human
agaggcaggcaggcagcugggacc

SEQ ID NO: 499787 - RNA, 19 nt, Human
agcuggaagcuucgaccuc

SEQ ID NO: 499788 - RNA, 22 nt, Human
aggaaaagaaaugacuguagug

SEQ ID NO: 499789 - RNA, 26 nt, Human
aggcaggcagcugggaccccacaucc

SEQ ID NO: 499790 - RNA, 18 nt, Human
aggcaggcaggcagcugg

SEQ ID NO: 499791 - RNA, 22 nt, Human
aggcaggcaggcagcugggacc

SEQ ID NO: 499792 - RNA, 20 nt, Human
aggggaggugaagggucaug

SEQ ID NO: 499793 - RNA, 28 nt, Human
augaagucacaaaaaacagaaaguacca

SEQ ID NO: 499794 - RNA, 24 nt, Human
auggcagcggggagcaauggaaca

SEQ ID NO: 499795 - RNA, 24 nt, Human
caaugacauguaaugaacagggac

SEQ ID NO: 499796 - RNA, 24 nt, Human
cacaaaaaacagaaaguaccaaca

SEQ ID NO: 499797 - RNA, 18 nt, Human
caccaaacucacaaaagg

SEQ ID NO: 499798 - RNA, 21 nt, Human
cagaaaguaccaacaaaaaca

SEQ ID NO: 499799 - RNA, 19 nt, Human
cagaaggcucucugaggac

SEQ ID NO: 499800 - RNA, 18 nt, Human
cagcugggaccccacauc

SEQ ID NO: 499801 - RNA, 19 nt, Human
cagcugggaccccacaucc

SEQ ID NO: 499802 - RNA, 22 nt, Human
cagcuguuccaagccuuuccug

SEQ ID NO: 499803 - RNA, 18 nt, Human
cccaccuacucaaugaca

SEQ ID NO: 499804 - RNA, 22 nt, Human
ccccaccaaacucacaaaagga

SEQ ID NO: 499805 - RNA, 18 nt, Human
ccccagggaggaaacgac

SEQ ID NO: 499806 - RNA, 25 nt, Human
ccggcagcuguuccaagccuuuccu

SEQ ID NO: 499807 - RNA, 23 nt, Human
ccgggcggggccgccgcuccguc

SEQ ID NO: 499808 - RNA, 21 nt, Human
ccuuccccaccaaacucacaa

SEQ ID NO: 499809 - RNA, 22 nt, Human
cucaggauguccagagcuggaa

SEQ ID NO: 499810 - RNA, 22 nt, Human
cugccaccucccugaagagucg

SEQ ID NO: 499811 - RNA, 21 nt, Human
cugggaccccacauccccagg

SEQ ID NO: 499812 - RNA, 19 nt, Human
gacuguagugugacaggau

SEQ ID NO: 499813 - RNA, 23 nt, Human
gagauggccagggccaagaaaga

SEQ ID NO: 499814 - RNA, 19 nt, Human
gcagacuggcucccagaau

SEQ ID NO: 499815 - RNA, 24 nt, Human
gcuccgucaccuccggcagcuguu

SEQ ID NO: 499816 - RNA, 25 nt, Human
gcuccgucaccuccggcagcuguuc

SEQ ID NO: 499817 - RNA, 23 nt, Human
ggaaacaagggagagagcauggc

SEQ ID NO: 499818 - RNA, 25 nt, Human
ggaacacaugaagucacaaaaaaca

SEQ ID NO: 499819 - RNA, 18 nt, Human
ggacagaugcugagcucu

SEQ ID NO: 499820 - RNA, 22 nt, Human
gggacagaugcugagcucuuaa

SEQ ID NO: 499821 - RNA, 21 nt, Human
gggagagagcauggcagcggg

SEQ ID NO: 499822 - RNA, 24 nt, Human
gggcccuauggcucuucagaggcu

SEQ ID NO: 499823 - RNA, 24 nt, Human
gguggcagaaaaaacgccuguggg

SEQ ID NO: 499824 - RNA, 19 nt, Human
ggugggggcccuauggcuc

SEQ ID NO: 499825 - RNA, 22 nt, Human
gugggggcccuauggcucuuca

SEQ ID NO: 499826 - RNA, 21 nt, Human
uacauuugacuccucccuaga

SEQ ID NO: 499827 - RNA, 23 nt, Human
uaccaacaaaaacaugaccuaca

SEQ ID NO: 499828 - RNA, 23 nt, Human
uagagaaggugugaucuauguuu

SEQ ID NO: 499829 - RNA, 23 nt, Human
uaggaacuggggaucaggcaugc

SEQ ID NO: 499830 - RNA, 23 nt, Human
uauacccuucccuuccccaccaa

SEQ ID NO: 499831 - RNA, 18 nt, Human
uauauagauauaugcaua

SEQ ID NO: 499832 - RNA, 20 nt, Human
uauauagauauaugcauaua

SEQ ID NO: 499833 - RNA, 19 nt, Human
ucagaggcugcucaauagg

SEQ ID NO: 499834 - RNA, 22 nt, Human
uccagcgcaccgggcggggccg

SEQ ID NO: 499835 - RNA, 18 nt, Human
ucccaggacccaagggcc

SEQ ID NO: 499836 - RNA, 19 nt, Human
ucccaggacccaagggcca

SEQ ID NO: 499837 - RNA, 18 nt, Human
ucuaggaugaacauguca

SEQ ID NO: 499838 - RNA, 26 nt, Human
ucuaggaugaacauguccagugacuc

SEQ ID NO: 499839 - RNA, 19 nt, Human
ucucagggugugaguaaag

SEQ ID NO: 499840 - RNA, 23 nt, Human
ugaccuacauuugacuccucccu

SEQ ID NO: 499841 - RNA, 21 nt, Human
ugcauauauaccuuuuuuuuu

SEQ ID NO: 499842 - RNA, 23 nt, Human
ugcgucauauuauauauagauau

SEQ ID NO: 499843 - RNA, 24 nt, Human
uggcagacuggcucccagaauucu

SEQ ID NO: 499844 - RNA, 19 nt, Human
ugggaccccacauccccag

SEQ ID NO: 499845 - RNA, 20 nt, Human
ugggaccccacauccccagg

SEQ ID NO: 499846 - RNA, 19 nt, Human
ugggggacuugggcucagg

SEQ ID NO: 499847 - RNA, 20 nt, Human
ugggggacuugggcucagga

SEQ ID NO: 499848 - RNA, 21 nt, Human
uguaaugaacagggacagaug

SEQ ID NO: 499849 - RNA, 20 nt, Human
uguccagagcuggaagcuuc

SEQ ID NO: 499850 - RNA, 24 nt, Human
uguccagagcuggaagcuucgacc

SEQ ID NO: 499851 - RNA, 22 nt, Human
uguggguuaugcuccagacaga

SEQ ID NO: 499852 - RNA, 18 nt, Human
uuuuuuuuuaauacaauc

SEQ ID NO: 499853 - RNA, 18 nt, Human
uuuuuuuuuuuuuuuuug

SEQ ID NO: 499854 - RNA, 19 nt, Human
uuuuuuuuuuuuuuuuugu

SEQ ID NO: 499855 - RNA, 24 nt, Human
aaaaaaaaaaaauuaaaauauaac

SEQ ID NO: 499856 - RNA, 27 nt, Human
aaaaaaaaaaauuaaaauauaaccuga

SEQ ID NO: 499857 - RNA, 19 nt, Human
aaaaacugggagggagaca

SEQ ID NO: 499858 - RNA, 21 nt, Human
aacaaggaaugaggcaggaga

SEQ ID NO: 499859 - RNA, 24 nt, Human
aagaaccuccuggagggaagcuga

SEQ ID NO: 499860 - RNA, 23 nt, Human
aagcugagcagugucugacccug

SEQ ID NO: 499861 - RNA, 25 nt, Human
aagggaacaacuggggaaggaggga

SEQ ID NO: 499862 - RNA, 23 nt, Human
aaucagaaccuguacaaaaaaaa

SEQ ID NO: 499863 - RNA, 18 nt, Human
acacaccgaaaacaaggc

SEQ ID NO: 499864 - RNA, 23 nt, Human
acacagcccagcaucacgucccu

SEQ ID NO: 499865 - RNA, 23 nt, Human
agcaaaagaaaaacugggaggga

SEQ ID NO: 499866 - RNA, 20 nt, Human
agcgcaucuugacgccuggc

SEQ ID NO: 499867 - RNA, 20 nt, Human
aggcaggagagggaaagcag

SEQ ID NO: 499868 - RNA, 19 nt, Human
agggagugggugaggggga

SEQ ID NO: 499869 - RNA, 21 nt, Human
agggcucugggucaucagcca

SEQ ID NO: 499870 - RNA, 18 nt, Human
aggggcaucgaugccacc

SEQ ID NO: 499871 - RNA, 20 nt, Human
agggggaguaacaguuuuuc

SEQ ID NO: 499872 - RNA, 25 nt, Human
aggguggggaggcgcuggugagggg

SEQ ID NO: 499873 - RNA, 20 nt, Human
agguagagaggggaggaaau

SEQ ID NO: 499874 - RNA, 19 nt, Human
augaggcaggagagggaaa

SEQ ID NO: 499875 - RNA, 19 nt, Human
cacagcccagcaucacguc

SEQ ID NO: 499876 - RNA, 23 nt, Human
cacagcccagcaucacgucccuc

SEQ ID NO: 499877 - RNA, 23 nt, Human
cagaagcagcaacagguccuuca

SEQ ID NO: 499878 - RNA, 18 nt, Human
cagcagacccacagcacc

SEQ ID NO: 499879 - RNA, 19 nt, Human
caggagagggaaagcagcg

SEQ ID NO: 499880 - RNA, 21 nt, Human
caggagagggaaagcagcgca

SEQ ID NO: 499881 - RNA, 18 nt, Human
caggguggggaggcgcug

SEQ ID NO: 499882 - RNA, 19 nt, Human
caucagccaaggaggggug

SEQ ID NO: 499883 - RNA, 26 nt, Human
caucccuacccaggugcagccaggag

SEQ ID NO: 499884 - RNA, 18 nt, Human
ccaccaucccuacccagg

SEQ ID NO: 499885 - RNA, 21 nt, Human
cccacagcacccucugucugu

SEQ ID NO: 499886 - RNA, 18 nt, Human
ccugacccaggccuggug

SEQ ID NO: 499887 - RNA, 21 nt, Human
ccuugguguccccuccccacc

SEQ ID NO: 499888 - RNA, 25 nt, Human
cuggagaggagugcccccuccucaa

SEQ ID NO: 499889 - RNA, 21 nt, Human
cuggcucggccucccggcgcc

SEQ ID NO: 499890 - RNA, 23 nt, Human
gaaaagacagaagcagcaacagg

SEQ ID NO: 499891 - RNA, 18 nt, Human
gaaccauuucugccaccc

SEQ ID NO: 499892 - RNA, 20 nt, Human
gaacgccaagccggaaggaa

SEQ ID NO: 499893 - RNA, 23 nt, Human
gaacuggagcugccaacaaggaa

SEQ ID NO: 499894 - RNA, 22 nt, Human
gaaucagaaccuguacaaaaaa

SEQ ID NO: 499895 - RNA, 21 nt, Human
gagcaaaagaaaaacugggag

SEQ ID NO: 499896 - RNA, 23 nt, Human
gaguaacaguuuuucuggaacag

SEQ ID NO: 499897 - RNA, 21 nt, Human
gcagcaggaagaguggccagg

SEQ ID NO: 499898 - RNA, 22 nt, Human
gcccuuacacagagacaagaac

SEQ ID NO: 499899 - RNA, 20 nt, Human
ggaaggagggagugggugag

SEQ ID NO: 499900 - RNA, 21 nt, Human
ggaaggagggagugggugagg

SEQ ID NO: 499901 - RNA, 27 nt, Human
ggcagcaggaagaguggccaggagaga

SEQ ID NO: 499902 - RNA, 20 nt, Human
ggccuggugagugccagcug

SEQ ID NO: 499903 - RNA, 24 nt, Human
gggaaggagggagugggugagggg

SEQ ID NO: 499904 - RNA, 21 nt, Human
gggagugggugagggggagua

SEQ ID NO: 499905 - RNA, 19 nt, Human
gggccuacacaccgaaaac

SEQ ID NO: 499906 - RNA, 23 nt, Human
gguagagaggggaggaaaugggc

SEQ ID NO: 499907 - RNA, 24 nt, Human
guggagcaaaagaaaaacugggag

SEQ ID NO: 499908 - RNA, 23 nt, Human
uaaccagccugacaaaaugacgu

SEQ ID NO: 499909 - RNA, 19 nt, Human
uacacaccgaaaacaaggc

SEQ ID NO: 499910 - RNA, 21 nt, Human
uagucgcuggcucggccuccc

SEQ ID NO: 499911 - RNA, 26 nt, Human
ucagaaccuguacaaaaaaaaaaaaa

SEQ ID NO: 499912 - RNA, 22 nt, Human
ucagagggcucugggucaucag

SEQ ID NO: 499913 - RNA, 19 nt, Human
uccacggccugaacuggag

SEQ ID NO: 499914 - RNA, 19 nt, Human
ucccugggggcugguuaaa

SEQ ID NO: 499915 - RNA, 21 nt, Human
ucccugggggcugguuaaagc

SEQ ID NO: 499916 - RNA, 24 nt, Human
ucgaugccaccaucccuacccagg

SEQ ID NO: 499917 - RNA, 21 nt, Human
ucgcuggcucggccucccggc

SEQ ID NO: 499918 - RNA, 21 nt, Human
ucucuggccuugaaaucuguc

SEQ ID NO: 499919 - RNA, 21 nt, Human
ucugccacccagcagacccac

SEQ ID NO: 499920 - RNA, 18 nt, Human
ugaaaagacagaagcagc

SEQ ID NO: 499921 - RNA, 19 nt, Human
ugaaaagacagaagcagca

SEQ ID NO: 499922 - RNA, 19 nt, Human
ugaaacuguucaaguucag

SEQ ID NO: 499923 - RNA, 18 nt, Human
ugaagggaacaacugggg

SEQ ID NO: 499924 - RNA, 25 nt, Human
ugacguggagcaaaagaaaaacugg

SEQ ID NO: 499925 - RNA, 18 nt, Human
ugcagguagagaggggag

SEQ ID NO: 499926 - RNA, 23 nt, Human
ugccuccggcuuauaaccagccu

SEQ ID NO: 499927 - RNA, 19 nt, Human
uggagcaaaagaaaaacug

SEQ ID NO: 499928 - RNA, 20 nt, Human
ugggggcugguuaaagcugc

SEQ ID NO: 499929 - RNA, 18 nt, Human
ugggugagggggaguaac

SEQ ID NO: 499930 - RNA, 18 nt, Human
uguacaaaaaaaaaaaaa

SEQ ID NO: 499931 - RNA, 20 nt, Human
acuauaguucucagaaacaa

SEQ ID NO: 499932 - RNA, 22 nt, Human
cuucuuuucuucaugauucucu

SEQ ID NO: 499933 - RNA, 20 nt, Human
gaaaacaucagauauccaag

SEQ ID NO: 499934 - RNA, 26 nt, Human
gaaauaacaaaaacuuuuguccaagg

SEQ ID NO: 499935 - RNA, 23 nt, Human
uauccaagccauauuacuauagu

SEQ ID NO: 499936 - RNA, 19 nt, Human
ucagauauccaagccauau

SEQ ID NO: 499937 - RNA, 19 nt, Human
uucuucaugauucucucuc

SEQ ID NO: 499938 - RNA, 18 nt, Human
uuuguauuugaaaacauc

SEQ ID NO: 499939 - RNA, 22 nt, Human
aaaaaacaacccagagaaaaau

SEQ ID NO: 499940 - RNA, 18 nt, Human
aaaauaccacagucuggg

SEQ ID NO: 499941 - RNA, 23 nt, Human
aaacagaaacgaugaucuuugac

SEQ ID NO: 499942 - RNA, 20 nt, Human
aaacgggaggaucacugagc

SEQ ID NO: 499943 - RNA, 23 nt, Human
aaacgggaggaucacugagccca

SEQ ID NO: 499944 - RNA, 24 nt, Human
aaagaaaaacauguauauaaaaga

SEQ ID NO: 499945 - RNA, 22 nt, Human
aaagugcuggcugauuuugcuu

SEQ ID NO: 499946 - RNA, 22 nt, Human
aaaugcccagccuuaauuuauu

SEQ ID NO: 499947 - RNA, 19 nt, Human
aacuugaacaaggcuggug

SEQ ID NO: 499948 - RNA, 19 nt, Human
aagcaaccacuucguugaa

SEQ ID NO: 499949 - RNA, 19 nt, Human
aauaccacagucugggugg

SEQ ID NO: 499950 - RNA, 27 nt, Human
acagacauacagacuguagcacucucu

SEQ ID NO: 499951 - RNA, 24 nt, Human
acauccuuugauggaagcaacacc

SEQ ID NO: 499952 - RNA, 19 nt, Human
accaaauuguuuuuucucc

SEQ ID NO: 499953 - RNA, 25 nt, Human
accucacacuucccaagggccccac

SEQ ID NO: 499954 - RNA, 18 nt, Human
agccagcugugguggugc

SEQ ID NO: 499955 - RNA, 21 nt, Human
agccuggcgacauagugagac

SEQ ID NO: 499956 - RNA, 24 nt, Human
agcuacuuggaaggcugagguggg

SEQ ID NO: 499957 - RNA, 23 nt, Human
agcugugguggugcacaccugua

SEQ ID NO: 499958 - RNA, 22 nt, Human
aggagaaaaugggccuggugaa

SEQ ID NO: 499959 - RNA, 24 nt, Human
aggcugagguggguggauugcuug

SEQ ID NO: 499960 - RNA, 18 nt, Human
aggcugcuauaacaaaau

SEQ ID NO: 499961 - RNA, 22 nt, Human
agguggguggauugcuugaggc

SEQ ID NO: 499962 - RNA, 24 nt, Human
aguggcucacaccuguaaucccag

SEQ ID NO: 499963 - RNA, 23 nt, Human
aguuuugggggauuuuuuugggg

SEQ ID NO: 499964 - RNA, 18 nt, Human
auacagacuguagcacuc

SEQ ID NO: 499965 - RNA, 22 nt, Human
aucccauucaugagggcuccac

SEQ ID NO: 499966 - RNA, 20 nt, Human
augaccucacacuucccaag

SEQ ID NO: 499967 - RNA, 21 nt, Human
auucugauccugaacuccacc

SEQ ID NO: 499968 - RNA, 20 nt, Human
caaaacagaaacgaugaucu

SEQ ID NO: 499969 - RNA, 20 nt, Human
caaacaaaugcccagccuua

SEQ ID NO: 499970 - RNA, 24 nt, Human
caaaccuuuggcuuuauccuaucu

SEQ ID NO: 499971 - RNA, 25 nt, Human
caaauaauccacaacuuaguacauc

SEQ ID NO: 499972 - RNA, 24 nt, Human
caaauacucucauguuuccaauua

SEQ ID NO: 499973 - RNA, 25 nt, Human
caacacugcagaguuuaaaaaaaaa

SEQ ID NO: 499974 - RNA, 24 nt, Human
caauuucacaaauaauccacaacu

SEQ ID NO: 499975 - RNA, 20 nt, Human
cacaacuuaguacauccuuu

SEQ ID NO: 499976 - RNA, 21 nt, Human
cacacagcauuuauuuuguaa

SEQ ID NO: 499977 - RNA, 27 nt, Human
cacacagcauuuauuuuguaagauuaa

SEQ ID NO: 499978 - RNA, 24 nt, Human
cacaccuguaaucccagcacuuug

SEQ ID NO: 499979 - RNA, 24 nt, Human
cacaccuguagucccagcuacuug

SEQ ID NO: 499980 - RNA, 27 nt, Human
cacccauuaucacccacaauucaaaac

SEQ ID NO: 499981 - RNA, 19 nt, Human
caccuguaaucccagcacu

SEQ ID NO: 499982 - RNA, 24 nt, Human
caccuguaaucccagcacuuuggg

SEQ ID NO: 499983 - RNA, 23 nt, Human
caccuguagucccagcuacuugg

SEQ ID NO: 499984 - RNA, 18 nt, Human
cacuccggaaucaccugg

SEQ ID NO: 499985 - RNA, 24 nt, Human
cagcacuuugggaagucgaaacgg

SEQ ID NO: 499986 - RNA, 24 nt, Human
cagccuggcgacauagugagacuu

SEQ ID NO: 499987 - RNA, 21 nt, Human
cagcuacuuggaaggcugagg

SEQ ID NO: 499988 - RNA, 24 nt, Human
cagcuacuuggaaggcugaggugg

SEQ ID NO: 499989 - RNA, 19 nt, Human
cauaaggcacugaucccau

SEQ ID NO: 499990 - RNA, 20 nt, Human
ccacaauucaaaacagaaac

SEQ ID NO: 499991 - RNA, 25 nt, Human
cccauuaucacccacaauucaaaac

SEQ ID NO: 499992 - RNA, 21 nt, Human
ccggaacuaaaaaaagcaacc

SEQ ID NO: 499993 - RNA, 19 nt, Human
ccuggcgacauagugagac

SEQ ID NO: 499994 - RNA, 21 nt, Human
ccuguagucccagcuacuugg

SEQ ID NO: 499995 - RNA, 21 nt, Human
cgaaacgggaggaucacugag

SEQ ID NO: 499996 - RNA, 25 nt, Human
cgaaacgggaggaucacugagccca

SEQ ID NO: 499997 - RNA, 18 nt, Human
cggaaucaccugggagcu

SEQ ID NO: 499998 - RNA, 22 nt, Human
cucacaccuguaaucccagcac

SEQ ID NO: 499999 - RNA, 24 nt, Human
cucacaccuguaaucccagcacuu

SEQ ID NO: 500000 - RNA, 23 nt, Human
cucaugaccucacacuucccaag

SEQ ID NO: 500001 - RNA, 20 nt, Human
cucccacccauuaucaccca

SEQ ID NO: 500002 - RNA, 23 nt, Human
cugcagaguuuaaaaaaaaaaaa

SEQ ID NO: 500003 - RNA, 20 nt, Human
cuggguggcuuauaaacauc

SEQ ID NO: 500004 - RNA, 19 nt, Human
cuucccaagggccccaccu

SEQ ID NO: 500005 - RNA, 21 nt, Human
cuugguccauaaacugaaaaa

SEQ ID NO: 500006 - RNA, 30 nt, Human
gacacagacauacagacuguagcacucucu

SEQ ID NO: 500007 - RNA, 21 nt, Human
gacuguagcacucucccaccc

SEQ ID NO: 500008 - RNA, 19 nt, Human
gaggaucacugagcccagg

SEQ ID NO: 500009 - RNA, 24 nt, Human
gagguggguggauugcuugaggcu

SEQ ID NO: 500010 - RNA, 19 nt, Human
gaucaaagugcuggcugau

SEQ ID NO: 500011 - RNA, 22 nt, Human
gcagaguuuaaaaaaaaaaaaa

SEQ ID NO: 500012 - RNA, 21 nt, Human
gcccugucuccaaaaaacaua

SEQ ID NO: 500013 - RNA, 23 nt, Human
gcuaggagguccaggcugcagug

SEQ ID NO: 500014 - RNA, 21 nt, Human
gcugauuuugcuugugaaggg

SEQ ID NO: 500015 - RNA, 20 nt, Human
gcugcagugaguugugaccc

SEQ ID NO: 500016 - RNA, 24 nt, Human
ggaacuaaaaaaagcaaccacuuc

SEQ ID NO: 500017 - RNA, 25 nt, Human
ggagguccaggcugcagugaguugu

SEQ ID NO: 500018 - RNA, 20 nt, Human
ggauuuuuuugggggggagg

SEQ ID NO: 500019 - RNA, 18 nt, Human
ggcagaaaaaacaacccg

SEQ ID NO: 500020 - RNA, 24 nt, Human
gguggugcacaccuguagucccag

SEQ ID NO: 500021 - RNA, 18 nt, Human
gugaaguggcucacaccu

SEQ ID NO: 500022 - RNA, 19 nt, Human
gugacccggccuggacaaa

SEQ ID NO: 500023 - RNA, 19 nt, Human
gugcuggcugauuuugcuu

SEQ ID NO: 500024 - RNA, 23 nt, Human
guggugcacaccuguagucccag

SEQ ID NO: 500025 - RNA, 21 nt, Human
guuuaaaaaaaaaaaaacaaa

SEQ ID NO: 500026 - RNA, 24 nt, Human
uacuuggaaggcugaggugggugg

SEQ ID NO: 500027 - RNA, 18 nt, Human
uagcucaggggcuugcag

SEQ ID NO: 500028 - RNA, 23 nt, Human
uaucuaauuucaaacaaaugccc

SEQ ID NO: 500029 - RNA, 26 nt, Human
uauuaacaaaauucacauuguacaaa

SEQ ID NO: 500030 - RNA, 21 nt, Human
ucaaacaaaugcccagccuua

SEQ ID NO: 500031 - RNA, 24 nt, Human
ucacucaauuacauaaauucacuc

SEQ ID NO: 500032 - RNA, 23 nt, Human
uccaaaaaacauaaaauaaaaua

SEQ ID NO: 500033 - RNA, 23 nt, Human
uccacuacccuucaaagccagac

SEQ ID NO: 500034 - RNA, 19 nt, Human
ucccaagggccccaccuuc

SEQ ID NO: 500035 - RNA, 22 nt, Human
ucuuauaaucuagcucaggggc

SEQ ID NO: 500036 - RNA, 23 nt, Human
ugagcccaggaguuagagaccag

SEQ ID NO: 500037 - RNA, 23 nt, Human
ugagguggguggauugcuugagg

SEQ ID NO: 500038 - RNA, 24 nt, Human
ugagguggguggauugcuugaggc

SEQ ID NO: 500039 - RNA, 21 nt, Human
ugauccugaacuccacccuaa

SEQ ID NO: 500040 - RNA, 18 nt, Human
ugauucguagacuuucac

SEQ ID NO: 500041 - RNA, 20 nt, Human
ugauucguagacuuucacuc

SEQ ID NO: 500042 - RNA, 24 nt, Human
ugcagaguuuaaaaaaaaaaaaac

SEQ ID NO: 500043 - RNA, 23 nt, Human
ugcuauaacaaaauaccacaguc

SEQ ID NO: 500044 - RNA, 22 nt, Human
uggaaggcugagguggguggau

SEQ ID NO: 500045 - RNA, 24 nt, Human
uggaaggcugagguggguggauug

SEQ ID NO: 500046 - RNA, 21 nt, Human
uggcagaaaaaacaacccaga

SEQ ID NO: 500047 - RNA, 25 nt, Human
uggccaaucucaaauacucucaugu

SEQ ID NO: 500048 - RNA, 21 nt, Human
uggcucacaccuguaauccca

SEQ ID NO: 500049 - RNA, 24 nt, Human
uggcucacaccuguaaucccagca

SEQ ID NO: 500050 - RNA, 23 nt, Human
uggcuuuauccuaucuaauuuca

SEQ ID NO: 500051 - RNA, 18 nt, Human
uggugcacaccuguaguc

SEQ ID NO: 500052 - RNA, 24 nt, Human
ugguggugcacaccuguaguccca

SEQ ID NO: 500053 - RNA, 21 nt, Human
uguacaaaaguacaacgauaa

SEQ ID NO: 500054 - RNA, 27 nt, Human
uguccacuacccuucaaagccagaccc

SEQ ID NO: 500055 - RNA, 23 nt, Human
ugugguucuuucccagaagcauc

SEQ ID NO: 500056 - RNA, 23 nt, Human
uuacaaaccauccacaacuuguu

SEQ ID NO: 500057 - RNA, 21 nt, Human
uuagagaccagccuggcgaca

SEQ ID NO: 500058 - RNA, 23 nt, Human
uucauaaauuacuuaaaaauuug

SEQ ID NO: 500059 - RNA, 23 nt, Human
uugaacaaggcuggugaccuguu

SEQ ID NO: 500060 - RNA, 25 nt, Human
uugaaguuuuaggagaaaaugggcc

SEQ ID NO: 500061 - RNA, 18 nt, Human
uugcuugaggcuaggagg

SEQ ID NO: 500062 - RNA, 24 nt, Human
uugcuugaggcuaggagguccagg

SEQ ID NO: 500063 - RNA, 20 nt, Human
uuggaaggcugaggugggug

SEQ ID NO: 500064 - RNA, 22 nt, Human
uuugcuguaacuugaacaaggc

SEQ ID NO: 500065 - RNA, 21 nt, Human
uuuuauagacaggcaaaacug

SEQ ID NO: 500066 - RNA, 27 nt, Human
aagccggagguggaggaggagggaccc

SEQ ID NO: 500067 - RNA, 21 nt, Human
aaggagcuggaggagccgggg

SEQ ID NO: 500068 - RNA, 19 nt, Human
acccugcuggaggcccugc

SEQ ID NO: 500069 - RNA, 19 nt, Human
agaggaggaaggagcugga

SEQ ID NO: 500070 - RNA, 23 nt, Human
agaggaggaaggagcuggaggag

SEQ ID NO: 500071 - RNA, 19 nt, Human
aggaggaggaggaagagga

SEQ ID NO: 500072 - RNA, 20 nt, Human
augggaggugaguggauggg

SEQ ID NO: 500073 - RNA, 24 nt, Human
cagugaucccccaaaagccggagg

SEQ ID NO: 500074 - RNA, 20 nt, Human
ccggagguggaggaggagga

SEQ ID NO: 500075 - RNA, 18 nt, Human
ccuuuuuuuuuuuuuuuu

SEQ ID NO: 500076 - RNA, 18 nt, Human
cugcuggaggcccugcgg

SEQ ID NO: 500077 - RNA, 18 nt, Human
gaaggagcuggaggagcc

SEQ ID NO: 500078 - RNA, 18 nt, Human
gaggaagaggaggaagga

SEQ ID NO: 500079 - RNA, 19 nt, Human
gaggaggaaggagcuggag

SEQ ID NO: 500080 - RNA, 18 nt, Human
ggaggaggaagaggagga

SEQ ID NO: 500081 - RNA, 18 nt, Human
ggaggaggaggaagagga

SEQ ID NO: 500082 - RNA, 19 nt, Human
uauuaugauuuuuuucucu

SEQ ID NO: 500083 - RNA, 22 nt, Human
ucccccaaaagccggaggugga

SEQ ID NO: 500084 - RNA, 21 nt, Human
ugaucccccaaaagccggagg

SEQ ID NO: 500085 - RNA, 23 nt, Human
uggaggaggaggaggaagaggag

SEQ ID NO: 500086 - RNA, 21 nt, Human
ugggaggugaguggaugggug

SEQ ID NO: 500087 - RNA, 19 nt, Human
ugggugugaauggcugacc

SEQ ID NO: 500088 - RNA, 18 nt, Human
uuuuaccagaaaauaaag

SEQ ID NO: 500089 - RNA, 22 nt, Human
uuuuuuuuuuuuuuuuaccaga

SEQ ID NO: 500090 - RNA, 22 nt, Human
uuuuuuuuuuuuuuuuuaccag

SEQ ID NO: 500091 - RNA, 18 nt, Human
agagcccacccucccgcc

SEQ ID NO: 500092 - RNA, 23 nt, Human
aggaacagugaggaaagcugggc

SEQ ID NO: 500093 - RNA, 24 nt, Human
agggagcagagggcugggcagugg

SEQ ID NO: 500094 - RNA, 22 nt, Human
cccgccuccucuggggagggag

SEQ ID NO: 500095 - RNA, 21 nt, Human
cccucccgccuccucugggga

SEQ ID NO: 500096 - RNA, 23 nt, Human
ccucagaggcucugggcagccag

SEQ ID NO: 500097 - RNA, 19 nt, Human
ccucuggggagggagcaga

SEQ ID NO: 500098 - RNA, 21 nt, Human
cgacccgcuggcagaagcuga

SEQ ID NO: 500099 - RNA, 20 nt, Human
cggccugggccugggacggg

SEQ ID NO: 500100 - RNA, 22 nt, Human
cugaccccugcgcugccucaga

SEQ ID NO: 500101 - RNA, 20 nt, Human
cuggggagggagcagagggc

SEQ ID NO: 500102 - RNA, 18 nt, Human
gagggagcagagggcugg

SEQ ID NO: 500103 - RNA, 23 nt, Human
gccugggacggguggggguggga

SEQ ID NO: 500104 - RNA, 18 nt, Human
gccugggcguagacaucc

SEQ ID NO: 500105 - RNA, 22 nt, Human
gcgcugccucagaggcucuggg

SEQ ID NO: 500106 - RNA, 21 nt, Human
gcugcggcaccggcuucgggc

SEQ ID NO: 500107 - RNA, 19 nt, Human
ggaggagaugaagguggcg

SEQ ID NO: 500108 - RNA, 21 nt, Human
ggccugggacgggugggggug

SEQ ID NO: 500109 - RNA, 22 nt, Human
ggccugggacgggugggggugg

SEQ ID NO: 500110 - RNA, 22 nt, Human
gggccugggacgggugggggug

SEQ ID NO: 500111 - RNA, 19 nt, Human
gggcgcuggcuucggccug

SEQ ID NO: 500112 - RNA, 21 nt, Human
gggggcugcggcaccggcuuc

SEQ ID NO: 500113 - RNA, 23 nt, Human
uagagcccacccucccgccuccu

SEQ ID NO: 500114 - RNA, 24 nt, Human
uagcccggugcgacccgcuggcag

SEQ ID NO: 500115 - RNA, 20 nt, Human
uccacaggaacagugaggaa

SEQ ID NO: 500116 - RNA, 23 nt, Human
ugaggaaagcugggcgcuggcuu

SEQ ID NO: 500117 - RNA, 22 nt, Human
ugccucagaggcucugggcagc

SEQ ID NO: 500118 - RNA, 24 nt, Human
ugccucagaggcucugggcagcca

SEQ ID NO: 500119 - RNA, 19 nt, Human
ugggacggguggggguggg

SEQ ID NO: 500120 - RNA, 18 nt, Human
ugggcaguggucggggag

SEQ ID NO: 500121 - RNA, 20 nt, Human
ugggcaguggucggggagau

SEQ ID NO: 500122 - RNA, 21 nt, Human
ugggccugggacggguggggg

SEQ ID NO: 500123 - RNA, 19 nt, Human
ugggcgcuggcuucggccu

SEQ ID NO: 500124 - RNA, 19 nt, Human
uggggagggagcagagggc

SEQ ID NO: 500125 - RNA, 22 nt, Human
uggggagggagcagagggcugg

SEQ ID NO: 500126 - RNA, 25 nt, Human
uuuuuuuuuuuuuuuuggcuuuuag

SEQ ID NO: 500127 - RNA, 20 nt, Human
uuuuuuuuuuuuuuuuuugg

SEQ ID NO: 500128 - RNA, 25 nt, Human
uuuuuuuuuuuuuuuuuuggcuuuu

SEQ ID NO: 500129 - RNA, 25 nt, Human
agucauuccccaucaagugaacaua

SEQ ID NO: 500130 - RNA, 24 nt, Human
auauacauacauauauacauauau

SEQ ID NO: 500131 - RNA, 22 nt, Human
cagaauuaaaaaaaaaagcaac

SEQ ID NO: 500132 - RNA, 19 nt, Human
cggcacuuaacccgcugcu

SEQ ID NO: 500133 - RNA, 21 nt, Human
gucauuccccaucaagugaac

SEQ ID NO: 500134 - RNA, 24 nt, Human
guuaucuauauccacuuagguaca

SEQ ID NO: 500135 - RNA, 31 nt, Human
uaaaacauaaaacuagaauuuaacaagcaaa

SEQ ID NO: 500136 - RNA, 19 nt, Human
uaaauauacauacauauau

SEQ ID NO: 500137 - RNA, 20 nt, Human
uaaauauauacaugaugcua

SEQ ID NO: 500138 - RNA, 20 nt, Human
uaauggaaaauaacuguuua

SEQ ID NO: 500139 - RNA, 21 nt, Human
uaauggaaaauaacuguuuag

SEQ ID NO: 500140 - RNA, 24 nt, Human
uacauacauauauacauauauaca

SEQ ID NO: 500141 - RNA, 21 nt, Human
uacauauauacauauauacag

SEQ ID NO: 500142 - RNA, 21 nt, Human
uagaaaauaucaauauuauca

SEQ ID NO: 500143 - RNA, 23 nt, Human
uauacagauauacaguacacagu

SEQ ID NO: 500144 - RNA, 22 nt, Human
uauacaguacacaguucuguuu

SEQ ID NO: 500145 - RNA, 20 nt, Human
uauacauauauacagauaua

SEQ ID NO: 500146 - RNA, 24 nt, Human
uauauacauauauacagauauaca

SEQ ID NO: 500147 - RNA, 20 nt, Human
ucaauccuacagaauuaaaa

SEQ ID NO: 500148 - RNA, 21 nt, Human
ugaauaguggucccgcacuca

SEQ ID NO: 500149 - RNA, 22 nt, Human
ugcuacuagaaauauugaagga

SEQ ID NO: 500150 - RNA, 21 nt, Human
uggaaaauaacuguuuagaaa

SEQ ID NO: 500151 - RNA, 23 nt, Human
uguaucuuguuguccuugguuuc

SEQ ID NO: 500152 - RNA, 26 nt, Human
uuguacuuuuuugcuacuuuuuugua

SEQ ID NO: 500153 - RNA, 28 nt, Human
uuuauauuacagugaaaacauuuuauca

SEQ ID NO: 500154 - RNA, 19 nt, Human
uuucuggacuuccuuaaau

SEQ ID NO: 500155 - RNA, 24 nt, Human
uuucugugugaaauagaggaaguu

SEQ ID NO: 500156 - RNA, 21 nt, Human
aaaaacagaaaaagagcuaua

SEQ ID NO: 500157 - RNA, 21 nt, Human
aaaaagaagaucaaagaaaga

SEQ ID NO: 500158 - RNA, 24 nt, Human
aaaacagaaaaagagcuauaucaa

SEQ ID NO: 500159 - RNA, 21 nt, Human
aaaacgaaaugagcaaggaaa

SEQ ID NO: 500160 - RNA, 23 nt, Human
aaaagaaaaagaagaucaaagaa

SEQ ID NO: 500161 - RNA, 24 nt, Human
aacaaaacaaaacgauccuuuuga

SEQ ID NO: 500162 - RNA, 19 nt, Human
aagaaaaagaagaucaaag

SEQ ID NO: 500163 - RNA, 21 nt, Human
aagaaaaagaagaucaaagaa

SEQ ID NO: 500164 - RNA, 25 nt, Human
aagugaacccugaaauacucccucc

SEQ ID NO: 500165 - RNA, 22 nt, Human
acacaggaagcaggguccagga

SEQ ID NO: 500166 - RNA, 18 nt, Human
acagaagcuuccugaacc

SEQ ID NO: 500167 - RNA, 20 nt, Human
acagaagcuuccugaaccua

SEQ ID NO: 500168 - RNA, 25 nt, Human
acccugggccucucucccuaacgau

SEQ ID NO: 500169 - RNA, 20 nt, Human
agaaaaagaagaucaaagaa

SEQ ID NO: 500170 - RNA, 24 nt, Human
agaaaaagaagaucaaagaaagag

SEQ ID NO: 500171 - RNA, 23 nt, Human
agaaaaagagcuauaucaaaugu

SEQ ID NO: 500172 - RNA, 23 nt, Human
agaaaagaaaaagaagaucaaag

SEQ ID NO: 500173 - RNA, 25 nt, Human
agaaaagaaaaagaagaucaaagaa

SEQ ID NO: 500174 - RNA, 22 nt, Human
agcaaggaaaaacagaaaaaga

SEQ ID NO: 500175 - RNA, 23 nt, Human
agcaaggaaaaacagaaaaagag

SEQ ID NO: 500176 - RNA, 22 nt, Human
aggaaaaacagaaaaagagccg

SEQ ID NO: 500177 - RNA, 23 nt, Human
agggggagaaaagaaaaagaaga

SEQ ID NO: 500178 - RNA, 18 nt, Human
aggggugguguggcgggg

SEQ ID NO: 500179 - RNA, 19 nt, Human
aggggugguguggcggggg

SEQ ID NO: 500180 - RNA, 18 nt, Human
augaaggcugcaggcacc

SEQ ID NO: 500181 - RNA, 20 nt, Human
caacccuucggcccaagcca

SEQ ID NO: 500182 - RNA, 19 nt, Human
caacucugggcucagaccu

SEQ ID NO: 500183 - RNA, 23 nt, Human
cacccugggccucucucccuaac

SEQ ID NO: 500184 - RNA, 22 nt, Human
cagaaaaagagcuauaucaaau

SEQ ID NO: 500185 - RNA, 19 nt, Human
cagcucacagcuagcgcgg

SEQ ID NO: 500186 - RNA, 23 nt, Human
cagcuccuggcccagcugccccu

SEQ ID NO: 500187 - RNA, 19 nt, Human
caggaaaacugagauggca

SEQ ID NO: 500188 - RNA, 24 nt, Human
caugaagaaccaagccaaucucac

SEQ ID NO: 500189 - RNA, 19 nt, Human
cauggcuucuuuucucccc

SEQ ID NO: 500190 - RNA, 23 nt, Human
ccaaaacgaaaugagcaaggaaa

SEQ ID NO: 500191 - RNA, 23 nt, Human
ccaccgagcaauccugccuaugc

SEQ ID NO: 500192 - RNA, 27 nt, Human
ccaguccccacccugggccucucuccc

SEQ ID NO: 500193 - RNA, 18 nt, Human
cccaaaacgaaaugagca

SEQ ID NO: 500194 - RNA, 24 nt, Human
ccuaugcuggacaugcaucuuagg

SEQ ID NO: 500195 - RNA, 25 nt, Human
ccugaaauacucccuccgucaacuc

SEQ ID NO: 500196 - RNA, 20 nt, Human
cucccuggugggcugguggg

SEQ ID NO: 500197 - RNA, 22 nt, Human
gaagagaaaugccaggaaaagg

SEQ ID NO: 500198 - RNA, 19 nt, Human
gacacaggguggcgggcgc

SEQ ID NO: 500199 - RNA, 23 nt, Human
gaccgugcagcaaagccacugcc

SEQ ID NO: 500200 - RNA, 21 nt, Human
gagggggagaaaagaaaaaga

SEQ ID NO: 500201 - RNA, 21 nt, Human
gauccguucccagcucuccuu

SEQ ID NO: 500202 - RNA, 18 nt, Human
gaugagggagcccggggc

SEQ ID NO: 500203 - RNA, 22 nt, Human
gcaaggggugguguggcggggg

SEQ ID NO: 500204 - RNA, 24 nt, Human
gcacagcuccuggcccagcugccc

SEQ ID NO: 500205 - RNA, 19 nt, Human
gcagaccucgucgcgugga

SEQ ID NO: 500206 - RNA, 22 nt, Human
gcuuuuggggugcugugagccc

SEQ ID NO: 500207 - RNA, 20 nt, Human
ggaaagcaacgugaggucau

SEQ ID NO: 500208 - RNA, 23 nt, Human
ggaaauuucggucaagagggugg

SEQ ID NO: 500209 - RNA, 22 nt, Human
ggaagcaggguccaggaaaacu

SEQ ID NO: 500210 - RNA, 18 nt, Human
ggaggugggaugagggag

SEQ ID NO: 500211 - RNA, 20 nt, Human
ggaugagggagcccggggca

SEQ ID NO: 500212 - RNA, 21 nt, Human
ggccggcgguccucucccccg

SEQ ID NO: 500213 - RNA, 21 nt, Human
gggaaggugggggcuguggac

SEQ ID NO: 500214 - RNA, 21 nt, Human
gggagccccugaagugaaccc

SEQ ID NO: 500215 - RNA, 18 nt, Human
gggcuggcggcgguggcg

SEQ ID NO: 500216 - RNA, 21 nt, Human
ggggugguguggcgggggcug

SEQ ID NO: 500217 - RNA, 20 nt, Human
gggugguguggcgggggcug

SEQ ID NO: 500218 - RNA, 21 nt, Human
guggaagagaaaugccaggaa

SEQ ID NO: 500219 - RNA, 27 nt, Human
uaaaaacaaaacaaaacgauccuuuug

SEQ ID NO: 500220 - RNA, 19 nt, Human
uaaggcaaauuuuaucucu

SEQ ID NO: 500221 - RNA, 18 nt, Human
uaagggaagcgggaaggu

SEQ ID NO: 500222 - RNA, 18 nt, Human
uacaaucccaauacagua

SEQ ID NO: 500223 - RNA, 23 nt, Human
uagaacaaaaaagagggggagaa

SEQ ID NO: 500224 - RNA, 23 nt, Human
ucaaaaugacuuuucuuuagaac

SEQ ID NO: 500225 - RNA, 23 nt, Human
ucacuaggcagaccucgucgcgu

SEQ ID NO: 500226 - RNA, 19 nt, Human
ucagaccgugcagcaaagc

SEQ ID NO: 500227 - RNA, 19 nt, Human
ucagucugagccggaccua

SEQ ID NO: 500228 - RNA, 23 nt, Human
ucauggcuucuuuucucccuggu

SEQ ID NO: 500229 - RNA, 18 nt, Human
uccggggcggccgagcgc

SEQ ID NO: 500230 - RNA, 19 nt, Human
uccguucccagcucuccuu

SEQ ID NO: 500231 - RNA, 23 nt, Human
ucucccuaacgaucuugucgcuu

SEQ ID NO: 500232 - RNA, 23 nt, Human
ucuuuaaaaacaaaacaaaacga

SEQ ID NO: 500233 - RNA, 19 nt, Human
ucuuuagaacaaaaaagag

SEQ ID NO: 500234 - RNA, 19 nt, Human
ugaacccugaaauacuccc

SEQ ID NO: 500235 - RNA, 19 nt, Human
ugagauggcaaaauaggcc

SEQ ID NO: 500236 - RNA, 19 nt, Human
ugagccggaccuaaccuuc

SEQ ID NO: 500237 - RNA, 18 nt, Human
ugccaggaaaagggguca

SEQ ID NO: 500238 - RNA, 21 nt, Human
uggacacaggguggcgggcgc

SEQ ID NO: 500239 - RNA, 22 nt, Human
uggcccagcugccccucagugg

SEQ ID NO: 500240 - RNA, 18 nt, Human
uggcggcgguggcgacgg

SEQ ID NO: 500241 - RNA, 19 nt, Human
uggcggcgguggcgacggc

SEQ ID NO: 500242 - RNA, 21 nt, Human
ugggagccccugaagugaacc

SEQ ID NO: 500243 - RNA, 22 nt, Human
uggggugcugugagcccagggc

SEQ ID NO: 500244 - RNA, 18 nt, Human
ugguguggcgggggcugg

SEQ ID NO: 500245 - RNA, 19 nt, Human
ugguguggcgggggcuggg

SEQ ID NO: 500246 - RNA, 20 nt, Human
ugucugagugcagagauguu

SEQ ID NO: 500247 - RNA, 24 nt, Human
uucccaguccccacccugggccuc

SEQ ID NO: 500248 - RNA, 24 nt, Human
uuuagaacaaaaaagagggggaga

SEQ ID NO: 500249 - RNA, 22 nt, Human
uuucagaccgugcagcaaagcc

SEQ ID NO: 500250 - RNA, 24 nt, Human
uuuggcaaggggugguguggcggg

SEQ ID NO: 500251 - RNA, 24 nt, Human
aaaaaaauaccaaggucuacaaca

SEQ ID NO: 500252 - RNA, 19 nt, Human
aaacaggacacaaaacuga

SEQ ID NO: 500253 - RNA, 24 nt, Human
aaagauuuuccaggaaugaacuga

SEQ ID NO: 500254 - RNA, 20 nt, Human
aaauaccacaaccaccacca

SEQ ID NO: 500255 - RNA, 22 nt, Human
aaauggaaaguuucccuugauu

SEQ ID NO: 500256 - RNA, 20 nt, Human
aacuuugaacacuacuggca

SEQ ID NO: 500257 - RNA, 22 nt, Human
aagcuaguguaaaauuaaccug

SEQ ID NO: 500258 - RNA, 24 nt, Human
aauacucuccauuggcuuugcuug

SEQ ID NO: 500259 - RNA, 21 nt, Human
aaucccuucugccacugugug

SEQ ID NO: 500260 - RNA, 21 nt, Human
acaaccaccaccacacacaau

SEQ ID NO: 500261 - RNA, 20 nt, Human
acacugacaacagaagcaaa

SEQ ID NO: 500262 - RNA, 23 nt, Human
accacaaccaccaccacacacaa

SEQ ID NO: 500263 - RNA, 21 nt, Human
acuggcaucucauuuacaaag

SEQ ID NO: 500264 - RNA, 20 nt, Human
acuuauaucaagucuuugca

SEQ ID NO: 500265 - RNA, 19 nt, Human
agaaaacugaacaugcccu

SEQ ID NO: 500266 - RNA, 18 nt, Human
auaaaaaggaauauuuau

SEQ ID NO: 500267 - RNA, 20 nt, Human
auacuggauacuugcuuucu

SEQ ID NO: 500268 - RNA, 21 nt, Human
augagagaugcaucagugagc

SEQ ID NO: 500269 - RNA, 18 nt, Human
caaacauucagcaugaag

SEQ ID NO: 500270 - RNA, 23 nt, Human
caacacacugacaacagaagcaa

SEQ ID NO: 500271 - RNA, 18 nt, Human
caagaaauaacuguaaau

SEQ ID NO: 500272 - RNA, 19 nt, Human
caccacacacaauaaagac

SEQ ID NO: 500273 - RNA, 20 nt, Human
cacugugugcgugcgugugu

SEQ ID NO: 500274 - RNA, 20 nt, Human
cacuugaaaaccauuaaaaa

SEQ ID NO: 500275 - RNA, 18 nt, Human
cagcacgaaugggcugcu

SEQ ID NO: 500276 - RNA, 18 nt, Human
cagcaguacucgguuugc

SEQ ID NO: 500277 - RNA, 26 nt, Human
cauacaaaucaucaaaacauuucagu

SEQ ID NO: 500278 - RNA, 18 nt, Human
caugugcaggaugugcag

SEQ ID NO: 500279 - RNA, 22 nt, Human
ccacaaccaccaccacacacaa

SEQ ID NO: 500280 - RNA, 30 nt, Human
ccaccaccacacacaauaaagaccaucucc

SEQ ID NO: 500281 - RNA, 19 nt, Human
ccagguggagcugaccuau

SEQ ID NO: 500282 - RNA, 26 nt, Human
cccaaaccuccauccucucuguuuac

SEQ ID NO: 500283 - RNA, 22 nt, Human
ccccaaaccuccauccucucug

SEQ ID NO: 500284 - RNA, 18 nt, Human
cccuucugccacugugug

SEQ ID NO: 500285 - RNA, 24 nt, Human
ccucaacccaucaccuagguauua

SEQ ID NO: 500286 - RNA, 19 nt, Human
ccucacaaacccuagcuca

SEQ ID NO: 500287 - RNA, 20 nt, Human
ccugcuggugccacagcagg

SEQ ID NO: 500288 - RNA, 20 nt, Human
ccuguaguucgaggugcugu

SEQ ID NO: 500289 - RNA, 22 nt, Human
ccuuccguagcauugaugagag

SEQ ID NO: 500290 - RNA, 21 nt, Human
cgccccaaaccuccauccucu

SEQ ID NO: 500291 - RNA, 19 nt, Human
cugaaaacacuccaaauac

SEQ ID NO: 500292 - RNA, 18 nt, Human
cuggugccacagcagggu

SEQ ID NO: 500293 - RNA, 18 nt, Human
gacagaaaggggaggaag

SEQ ID NO: 500294 - RNA, 21 nt, Human
gcguguguguguuugugcgug

SEQ ID NO: 500295 - RNA, 21 nt, Human
gcugcuguggaacccuguuuc

SEQ ID NO: 500296 - RNA, 19 nt, Human
gcuguccuaggauccuuau

SEQ ID NO: 500297 - RNA, 19 nt, Human
ggcugcuguggaacccugu

SEQ ID NO: 500298 - RNA, 19 nt, Human
guaguacagacacugaaaa

SEQ ID NO: 500299 - RNA, 22 nt, Human
guaguacagacacugaaaacac

SEQ ID NO: 500300 - RNA, 23 nt, Human
gucucuggcaauucgcacuccag

SEQ ID NO: 500301 - RNA, 20 nt, Human
gugauucugaauagcaugaa

SEQ ID NO: 500302 - RNA, 19 nt, Human
gugcaggaugugcagguuu

SEQ ID NO: 500303 - RNA, 23 nt, Human
guuuagaaacacaaaucacauac

SEQ ID NO: 500304 - RNA, 22 nt, Human
uaaaccccgcaugcauuagcuc

SEQ ID NO: 500305 - RNA, 21 nt, Human
uaacccaaaggaaggaacuga

SEQ ID NO: 500306 - RNA, 24 nt, Human
uaaccugagcuuccugcuggugcc

SEQ ID NO: 500307 - RNA, 25 nt, Human
uacaacaguaguacagacacugaaa

SEQ ID NO: 500308 - RNA, 20 nt, Human
uacaagugauucugaauagc

SEQ ID NO: 500309 - RNA, 21 nt, Human
uaccacaaccaccaccacaca

SEQ ID NO: 500310 - RNA, 20 nt, Human
uagaaacacaaaucacauac

SEQ ID NO: 500311 - RNA, 21 nt, Human
uagaaacacaaaucacauaca

SEQ ID NO: 500312 - RNA, 21 nt, Human
uagaagacacugauguguuau

SEQ ID NO: 500313 - RNA, 19 nt, Human
uauuuaaagacaaccaauu

SEQ ID NO: 500314 - RNA, 23 nt, Human
ucaacacacugacaacagaagca

SEQ ID NO: 500315 - RNA, 27 nt, Human
ucaacccaucaccuagguauuaaaccc

SEQ ID NO: 500316 - RNA, 19 nt, Human
ucacagaaaacugaacaug

SEQ ID NO: 500317 - RNA, 21 nt, Human
uccaccaagcagaaguuucug

SEQ ID NO: 500318 - RNA, 18 nt, Human
uccuacugcucuccccua

SEQ ID NO: 500319 - RNA, 21 nt, Human
ugaaaacacuccaaauacugu

SEQ ID NO: 500320 - RNA, 18 nt, Human
ugacaacagaagcaaagg

SEQ ID NO: 500321 - RNA, 18 nt, Human
ugacagaaaggggaggaa

SEQ ID NO: 500322 - RNA, 18 nt, Human
ugagauaacuacuaaugg

SEQ ID NO: 500323 - RNA, 23 nt, Human
ugcauuauuauaaauaccacaac

SEQ ID NO: 500324 - RNA, 21 nt, Human
ugccacagcagggugcuucag

SEQ ID NO: 500325 - RNA, 22 nt, Human
ugccacugugugcgugcgugug

SEQ ID NO: 500326 - RNA, 20 nt, Human
uggcaguuacacagaggacu

SEQ ID NO: 500327 - RNA, 23 nt, Human
uggcaucuuuuuccaacauucua

SEQ ID NO: 500328 - RNA, 23 nt, Human
uguaaauggaaaguuucccuuga

SEQ ID NO: 500329 - RNA, 26 nt, Human
ugucaagacagacuuggcaucuuuuu

SEQ ID NO: 500330 - RNA, 22 nt, Human
ugugugcccacacaugagcaua

SEQ ID NO: 500331 - RNA, 20 nt, Human
ugugugcgugcgugugugug

SEQ ID NO: 500332 - RNA, 21 nt, Human
uguguguguuugugcgugugu

SEQ ID NO: 500333 - RNA, 23 nt, Human
uguguguguuugugcgugugugc

SEQ ID NO: 500334 - RNA, 23 nt, Human
uguguuugugcgugugugcccac

SEQ ID NO: 500335 - RNA, 23 nt, Human
uuaaaagcagacuauuuacaagu

SEQ ID NO: 500336 - RNA, 24 nt, Human
uuaauucacagaaaacugaacaug

SEQ ID NO: 500337 - RNA, 24 nt, Human
uuacauaggugaacgugugccaug

SEQ ID NO: 500338 - RNA, 23 nt, Human
uuccugcuggugccacagcaggg

SEQ ID NO: 500339 - RNA, 21 nt, Human
uugugaaauacucuccauugg

SEQ ID NO: 500340 - RNA, 21 nt, Human
uuucagcacgaaugggcugcu

SEQ ID NO: 500341 - RNA, 24 nt, Human
uuugcugcaccucaacccaucacc

SEQ ID NO: 500342 - RNA, 23 nt, Human
uuuguagaaagccucacaaaccc

SEQ ID NO: 500343 - RNA, 27 nt, Human
aggggaggggaggggccgccagaggcu

SEQ ID NO: 500344 - RNA, 20 nt, Human
caacugagaacccgcugcgg

SEQ ID NO: 500345 - RNA, 20 nt, Human
cugcccagcgagcaacugag

SEQ ID NO: 500346 - RNA, 20 nt, Human
gcaggggaggggaggggccg

SEQ ID NO: 500347 - RNA, 24 nt, Human
ggagccucagggagacagcugggg

SEQ ID NO: 500348 - RNA, 18 nt, Human
uacugggguuaagggcag

SEQ ID NO: 500349 - RNA, 20 nt, Human
uacugggguuaagggcaggg

SEQ ID NO: 500350 - RNA, 18 nt, Human
ucggcagugggagcgcga

SEQ ID NO: 500351 - RNA, 22 nt, Human
ucggcagugggagcgcgaccug

SEQ ID NO: 500352 - RNA, 23 nt, Human
acccuugaagugagcugaaaaac

SEQ ID NO: 500353 - RNA, 20 nt, Human
uacacagugcuuuaauuugg

SEQ ID NO: 500354 - RNA, 22 nt, Human
uacccuugaagugagcugaaaa

SEQ ID NO: 500355 - RNA, 18 nt, Human
aauucugucauuacagca

SEQ ID NO: 500356 - RNA, 21 nt, Human
aggcuguuagaaaucugaagc

SEQ ID NO: 500357 - RNA, 22 nt, Human
aggcuguuagaaaucugaagcu

SEQ ID NO: 500358 - RNA, 24 nt, Human
caaaugcucuccucagaaaguuuc

SEQ ID NO: 500359 - RNA, 19 nt, Human
cucuccucagaaaguuuca

SEQ ID NO: 500360 - RNA, 23 nt, Human
cuucagcuacuggucuauuuugu

SEQ ID NO: 500361 - RNA, 20 nt, Human
cuuccaaugucaaagaaaag

SEQ ID NO: 500362 - RNA, 18 nt, Human
uagaaaucugaagcucaa

SEQ ID NO: 500363 - RNA, 24 nt, Human
uccaaugucaaagaaaagaugauc

SEQ ID NO: 500364 - RNA, 19 nt, Human
ugccuucagcuacuggucu

SEQ ID NO: 500365 - RNA, 18 nt, Human
aaggauggagccuccugc

SEQ ID NO: 500366 - RNA, 20 nt, Human
gggaggagccacagaccuug

SEQ ID NO: 500367 - RNA, 19 nt, Human
gggauggggaugcauaacu

SEQ ID NO: 500368 - RNA, 22 nt, Human
ggggauggggaugcauaacuug

SEQ ID NO: 500369 - RNA, 24 nt, Human
ucaaacuuguauuuauuuucuaag

SEQ ID NO: 500370 - RNA, 20 nt, Human
uggggaugcauaacuugggu

SEQ ID NO: 500371 - RNA, 21 nt, Human
agaaagaaaagaaaugaaaaa

SEQ ID NO: 500372 - RNA, 25 nt, Human
ugaaacaaggccaucagcuuucuca

SEQ ID NO: 500373 - RNA, 21 nt, Human
aaaaaaagguugggagugaag

SEQ ID NO: 500374 - RNA, 21 nt, Human
aaacaaagacagauucagcaa

SEQ ID NO: 500375 - RNA, 23 nt, Human
aaaccagugccagacauggaaga

SEQ ID NO: 500376 - RNA, 20 nt, Human
aaaccagugccagacauggg

SEQ ID NO: 500377 - RNA, 24 nt, Human
aauguuaaaagcugccaggaaaga

SEQ ID NO: 500378 - RNA, 22 nt, Human
acaguaaaaaacaccagcugaa

SEQ ID NO: 500379 - RNA, 18 nt, Human
acauggaccuuggagaaa

SEQ ID NO: 500380 - RNA, 23 nt, Human
agcaagugcaaaggugacuacaa

SEQ ID NO: 500381 - RNA, 23 nt, Human
agccaauacaggaaaucaugaaa

SEQ ID NO: 500382 - RNA, 20 nt, Human
agcugccaggaaagaaaaaa

SEQ ID NO: 500383 - RNA, 21 nt, Human
agcugccaggaaagaaaaaau

SEQ ID NO: 500384 - RNA, 22 nt, Human
aggaaccgguaaaaacccucga

SEQ ID NO: 500385 - RNA, 24 nt, Human
aggaaccgguaaaaacccucgagc

SEQ ID NO: 500386 - RNA, 18 nt, Human
aggaauguaaaaaagcgc

SEQ ID NO: 500387 - RNA, 25 nt, Human
aggcauccgugucaauaccuucagg

SEQ ID NO: 500388 - RNA, 24 nt, Human
agguugggagugaagauuuccaag

SEQ ID NO: 500389 - RNA, 23 nt, Human
agugcagaaacaaagacagauuc

SEQ ID NO: 500390 - RNA, 24 nt, Human
auccaugaaagccaucaugcccaa

SEQ ID NO: 500391 - RNA, 21 nt, Human
auggaaaggcacuguauggca

SEQ ID NO: 500392 - RNA, 21 nt, Human
auggaccuuggagaaauccaa

SEQ ID NO: 500393 - RNA, 28 nt, Human
caaaaccugacaaaacucaaugugcauu

SEQ ID NO: 500394 - RNA, 20 nt, Human
caagugcaaaggugacuaca

SEQ ID NO: 500395 - RNA, 23 nt, Human
cacuguauggcaacugcaagaau

SEQ ID NO: 500396 - RNA, 20 nt, Human
ccacugggcaaggccagcuc

SEQ ID NO: 500397 - RNA, 22 nt, Human
ccagugccagacauggaagacg

SEQ ID NO: 500398 - RNA, 26 nt, Human
cccccugaaaacaaaaccugacaaaa

SEQ ID NO: 500399 - RNA, 18 nt, Human
ccccugaaaacaaaaccu

SEQ ID NO: 500400 - RNA, 25 nt, Human
cccuugguacacccccugaaaacaa

SEQ ID NO: 500401 - RNA, 21 nt, Human
cugacaaaacucaaugugcau

SEQ ID NO: 500402 - RNA, 22 nt, Human
cugcuuaaaaaaacuguuucca

SEQ ID NO: 500403 - RNA, 21 nt, Human
gaagacgauguugaaguagca

SEQ ID NO: 500404 - RNA, 19 nt, Human
gaguguaaaaaggaaccgg

SEQ ID NO: 500405 - RNA, 20 nt, Human
gauuugcaacugugagaaac

SEQ ID NO: 500406 - RNA, 21 nt, Human
gauuugcaacugugagaaacc

SEQ ID NO: 500407 - RNA, 24 nt, Human
gcaacugcaagaaugaaaccaaug

SEQ ID NO: 500408 - RNA, 18 nt, Human
gcaaggaauguaaaaaag

SEQ ID NO: 500409 - RNA, 25 nt, Human
ggaaaucaugaaagaaaccgguacc

SEQ ID NO: 500410 - RNA, 18 nt, Human
ggagugaagauuuccaag

SEQ ID NO: 500411 - RNA, 26 nt, Human
guaaaaaacaccagcugaacacucag

SEQ ID NO: 500412 - RNA, 22 nt, Human
guggugcaggcugcuugccuga

SEQ ID NO: 500413 - RNA, 25 nt, Human
uaaaaaggaaccgguaaaaacccuc

SEQ ID NO: 500414 - RNA, 25 nt, Human
uacacccccugaaaacaaaaccuga

SEQ ID NO: 500415 - RNA, 21 nt, Human
uaccacagagccaauacagga

SEQ ID NO: 500416 - RNA, 22 nt, Human
uagcaaugccagaaaacauauu

SEQ ID NO: 500417 - RNA, 20 nt, Human
uagguguaggcauccguguc

SEQ ID NO: 500418 - RNA, 22 nt, Human
uauugcaaggaauguaaaaaag

SEQ ID NO: 500419 - RNA, 20 nt, Human
uccaagacauggaccuugga

SEQ ID NO: 500420 - RNA, 26 nt, Human
uccaagacauggaccuuggagaaagg

SEQ ID NO: 500421 - RNA, 21 nt, Human
uccaagaguuaacauaccaga

SEQ ID NO: 500422 - RNA, 21 nt, Human
uccaugaaagccaucaugccc

SEQ ID NO: 500423 - RNA, 24 nt, Human
ucccuggucgccaguggcagggug

SEQ ID NO: 500424 - RNA, 23 nt, Human
ugaaaacaaaaccugacaaaacu

SEQ ID NO: 500425 - RNA, 19 nt, Human
ugaaagaaacuguagauau

SEQ ID NO: 500426 - RNA, 21 nt, Human
ugaaagccaucaugcccaaaa

SEQ ID NO: 500427 - RNA, 21 nt, Human
ugaaguagcaaugccagaaaa

SEQ ID NO: 500428 - RNA, 26 nt, Human
ugacaaaacucaaugugcauuaauua

SEQ ID NO: 500429 - RNA, 18 nt, Human
ugaccagcagucccccag

SEQ ID NO: 500430 - RNA, 23 nt, Human
ugcaagaaugaaaccaaugagac

SEQ ID NO: 500431 - RNA, 28 nt, Human
ugccaggaaagaaaaaauauuuuguucc

SEQ ID NO: 500432 - RNA, 18 nt, Human
ugccugaccugccagcuu

SEQ ID NO: 500433 - RNA, 20 nt, Human
ugccugaccugccagcuuug

SEQ ID NO: 500434 - RNA, 20 nt, Human
ugggagugaagauuuccaag

SEQ ID NO: 500435 - RNA, 24 nt, Human
ugguacacccccugaaaacaaaac

SEQ ID NO: 500436 - RNA, 25 nt, Human
uucagguggggguuaaauaaaugga

SEQ ID NO: 500437 - RNA, 20 nt, Human
uugaaguagcaaugccagaa

SEQ ID NO: 500438 - RNA, 21 nt, Human
uugguuuaaaugaagagcaaa

SEQ ID NO: 500439 - RNA, 22 nt, Human
uuugguuuaaaugaagagcaaa

SEQ ID NO: 500440 - RNA, 27 nt, Human
uuuuuuuuuuuuuuuuuccccgcuuuu

SEQ ID NO: 500441 - RNA, 18 nt, Human
uuuuuuuuuuuuuuuuug

SEQ ID NO: 500442 - RNA, 21 nt, Human
uuuuuuuuuuuuuuuuugguu

SEQ ID NO: 500443 - RNA, 26 nt, Human
cacaggcacccucugcucaauauccu

SEQ ID NO: 500444 - RNA, 21 nt, Human
cacccucugcucaauauccuc

SEQ ID NO: 500445 - RNA, 18 nt, Human
cucugcucaauauccucc

SEQ ID NO: 500446 - RNA, 24 nt, Human
aaauaucucucugugcccugaccc

SEQ ID NO: 500447 - RNA, 19 nt, Human
cccccggaaggaagacgag

SEQ ID NO: 500448 - RNA, 19 nt, Human
ccccggaaggaagacgagg

SEQ ID NO: 500449 - RNA, 19 nt, Human
ccucuagcaacuuucccaa

SEQ ID NO: 500450 - RNA, 23 nt, Human
cuccaaaaaauguggcagaggga

SEQ ID NO: 500451 - RNA, 24 nt, Human
gccucuagcaacuuucccaaccuc

SEQ ID NO: 500452 - RNA, 20 nt, Human
ucugaagccucuagcaacuu

SEQ ID NO: 500453 - RNA, 21 nt, Human
ucuggagaacaaagcggcuuc

SEQ ID NO: 500454 - RNA, 22 nt, Human
ucuggagaacaaagcggcuucg

SEQ ID NO: 500455 - RNA, 19 nt, Human
uuaaauaucucucugugcc

SEQ ID NO: 500456 - RNA, 31 nt, Human
aaacaggaguuuuuaaaagacacgacccggg

SEQ ID NO: 500457 - RNA, 22 nt, Human
aagccacgcccuggcccgaaac

SEQ ID NO: 500458 - RNA, 21 nt, Human
acgagaggacgcccugucugc

SEQ ID NO: 500459 - RNA, 22 nt, Human
agaacacacgcaggggccccga

SEQ ID NO: 500460 - RNA, 19 nt, Human
agagggcacagggcgagca

SEQ ID NO: 500461 - RNA, 23 nt, Human
agcggggugacgggggugggggc

SEQ ID NO: 500462 - RNA, 21 nt, Human
aggagcugcccacggaggagg

SEQ ID NO: 500463 - RNA, 18 nt, Human
aggaggccgggcgggggg

SEQ ID NO: 500464 - RNA, 18 nt, Human
aggaggugcugggcaggg

SEQ ID NO: 500465 - RNA, 21 nt, Human
agggcagggguccuccccagg

SEQ ID NO: 500466 - RNA, 24 nt, Human
auccggagagaacacacgcagggg

SEQ ID NO: 500467 - RNA, 20 nt, Human
augaauggaggagaaacagg

SEQ ID NO: 500468 - RNA, 23 nt, Human
augcauuuuugauguggacgaaa

SEQ ID NO: 500469 - RNA, 22 nt, Human
caccgccgcgaacgcgcgcaca

SEQ ID NO: 500470 - RNA, 19 nt, Human
cagcagccgcgugggcgga

SEQ ID NO: 500471 - RNA, 23 nt, Human
ccacccgcgggcagaggagcacg

SEQ ID NO: 500472 - RNA, 27 nt, Human
ccacccgcgggcagaggagcacggggc

SEQ ID NO: 500473 - RNA, 23 nt, Human
ccccgccgcccucgccccgcccg

SEQ ID NO: 500474 - RNA, 20 nt, Human
cccgacaugcaggaggaggc

SEQ ID NO: 500475 - RNA, 23 nt, Human
cccgcaggccccacccgaggagc

SEQ ID NO: 500476 - RNA, 21 nt, Human
cccgccgcccucgccccgccc

SEQ ID NO: 500477 - RNA, 23 nt, Human
cccuucggcggcccuggccucgg

SEQ ID NO: 500478 - RNA, 18 nt, Human
ccgcacccccccgucugc

SEQ ID NO: 500479 - RNA, 18 nt, Human
ccgcagggccaccaggug

SEQ ID NO: 500480 - RNA, 20 nt, Human
ccgccgcccucgccccgccc

SEQ ID NO: 500481 - RNA, 22 nt, Human
ccggaguccgcgugcaggaggg

SEQ ID NO: 500482 - RNA, 21 nt, Human
ccgggagcgaguguucuuccu

SEQ ID NO: 500483 - RNA, 25 nt, Human
ccucaggggccuccgcggaggaucu

SEQ ID NO: 500484 - RNA, 20 nt, Human
ccucgccccgcccgcacccc

SEQ ID NO: 500485 - RNA, 20 nt, Human
ccuguggagggugcaguguu

SEQ ID NO: 500486 - RNA, 23 nt, Human
ccuucggcggcccuggccucggg

SEQ ID NO: 500487 - RNA, 18 nt, Human
cgacccgggagaagucag

SEQ ID NO: 500488 - RNA, 20 nt, Human
cgcccucgccccgcccgcac

SEQ ID NO: 500489 - RNA, 21 nt, Human
cgggcagggcgggccuggggc

SEQ ID NO: 500490 - RNA, 19 nt, Human
cgggcggggggcgaggacu

SEQ ID NO: 500491 - RNA, 22 nt, Human
cguggcguucguaagaagcaaa

SEQ ID NO: 500492 - RNA, 18 nt, Human
cuaggaggccgggcgggg

SEQ ID NO: 500493 - RNA, 22 nt, Human
cucgccccgcccgcaccccccc

SEQ ID NO: 500494 - RNA, 20 nt, Human
cuggccucgggcgcugcugg

SEQ ID NO: 500495 - RNA, 22 nt, Human
gacagagacggauggacagggg

SEQ ID NO: 500496 - RNA, 20 nt, Human
gacccgggagaagucaguga

SEQ ID NO: 500497 - RNA, 24 nt, Human
gagaagcagcagccgcgugggcga

SEQ ID NO: 500498 - RNA, 18 nt, Human
gagcgaguguucuuccuu

SEQ ID NO: 500499 - RNA, 19 nt, Human
gaggcggcgggcgcgggca

SEQ ID NO: 500500 - RNA, 19 nt, Human
gagggcacagggcgagcag

SEQ ID NO: 500501 - RNA, 22 nt, Human
gcagaggggcgcgguggucucu

SEQ ID NO: 500502 - RNA, 19 nt, Human
gcccuucggcggcccuggc

SEQ ID NO: 500503 - RNA, 21 nt, Human
gccgcgaacgcgcgcacaggg

SEQ ID NO: 500504 - RNA, 19 nt, Human
gccggcugcgcgcagggaa

SEQ ID NO: 500505 - RNA, 22 nt, Human
gcgcgggcggucagcggcgggg

SEQ ID NO: 500506 - RNA, 19 nt, Human
gcggagcgauccgaacccc

SEQ ID NO: 500507 - RNA, 21 nt, Human
gcggggugacggggguggggg

SEQ ID NO: 500508 - RNA, 21 nt, Human
ggaaccccgcaggccccaccc

SEQ ID NO: 500509 - RNA, 18 nt, Human
ggagaaacaggggcucgg

SEQ ID NO: 500510 - RNA, 19 nt, Human
ggagcacggggcggacugg

SEQ ID NO: 500511 - RNA, 22 nt, Human
ggaggagaaacaggggcucgga

SEQ ID NO: 500512 - RNA, 23 nt, Human
ggauuaggccacacacgcgccgg

SEQ ID NO: 500513 - RNA, 24 nt, Human
ggauuaggccacacacgcgccggc

SEQ ID NO: 500514 - RNA, 20 nt, Human
ggcagggguccuccccaggg

SEQ ID NO: 500515 - RNA, 26 nt, Human
ggcccgggggcgaggcggcgccuguc

SEQ ID NO: 500516 - RNA, 18 nt, Human
ggccgagggcaggggucc

SEQ ID NO: 500517 - RNA, 19 nt, Human
ggccucgggcgcugcuggg

SEQ ID NO: 500518 - RNA, 25 nt, Human
ggcgcagaggggcgcgguggucucu

SEQ ID NO: 500519 - RNA, 21 nt, Human
ggcgguaaacagcaagagaaa

SEQ ID NO: 500520 - RNA, 24 nt, Human
ggcggucagcggcggggcgcgcuc

SEQ ID NO: 500521 - RNA, 18 nt, Human
gggaggcggcgggcgcgg

SEQ ID NO: 500522 - RNA, 18 nt, Human
gggcagaggagcacgggg

SEQ ID NO: 500523 - RNA, 20 nt, Human
gggcagggcgggccuggggc

SEQ ID NO: 500524 - RNA, 22 nt, Human
gggccaggccggggggcggaga

SEQ ID NO: 500525 - RNA, 19 nt, Human
gggcccgggggcgaggcgg

SEQ ID NO: 500526 - RNA, 27 nt, Human
gggcgcgagggggccaggccggggggc

SEQ ID NO: 500527 - RNA, 25 nt, Human
gggcggacuggggggguccuggggg

SEQ ID NO: 500528 - RNA, 19 nt, Human
gggcgguaaacagcaagag

SEQ ID NO: 500529 - RNA, 18 nt, Human
gggcggucagcggcgggg

SEQ ID NO: 500530 - RNA, 19 nt, Human
gggcggucagcggcggggc

SEQ ID NO: 500531 - RNA, 21 nt, Human
ggggcgggggcuccgcggggc

SEQ ID NO: 500532 - RNA, 21 nt, Human
gggggcggagagcggccgcgu

SEQ ID NO: 500533 - RNA, 22 nt, Human
ggugcaguguucaauggccgag

SEQ ID NO: 500534 - RNA, 23 nt, Human
gugcugggcaggggcgcaggguc

SEQ ID NO: 500535 - RNA, 23 nt, Human
uaaaugcaaagaccucauuuacc

SEQ ID NO: 500536 - RNA, 23 nt, Human
uaagaagcaaaaccuuccagaga

SEQ ID NO: 500537 - RNA, 23 nt, Human
uaagcucgcggcccggggcgcca

SEQ ID NO: 500538 - RNA, 23 nt, Human
uagaagugaacacggccguggcg

SEQ ID NO: 500539 - RNA, 18 nt, Human
uauugcuuuguuuccuuu

SEQ ID NO: 500540 - RNA, 19 nt, Human
ucagcggcggggcgcgcuc

SEQ ID NO: 500541 - RNA, 21 nt, Human
uccuguggagggugcaguguu

SEQ ID NO: 500542 - RNA, 19 nt, Human
uccuucccggggcgcgggc

SEQ ID NO: 500543 - RNA, 18 nt, Human
ucgccccgcccgcacccc

SEQ ID NO: 500544 - RNA, 26 nt, Human
ucuaagcuaagcucgcggcccggggc

SEQ ID NO: 500545 - RNA, 25 nt, Human
ucuguagggggaggggcgggggcuc

SEQ ID NO: 500546 - RNA, 24 nt, Human
ucuuccuucccggggcgcgggcgg

SEQ ID NO: 500547 - RNA, 18 nt, Human
ugaauggaggagaaacag

SEQ ID NO: 500548 - RNA, 19 nt, Human
ugacgggggugggggcugg

SEQ ID NO: 500549 - RNA, 18 nt, Human
ugcaggaggaggcgcagg

SEQ ID NO: 500550 - RNA, 19 nt, Human
ugcaguguucaauggccga

SEQ ID NO: 500551 - RNA, 28 nt, Human
ugccaagccacgcccuggcccgaaacac

SEQ ID NO: 500552 - RNA, 23 nt, Human
ugggaagagcggggugacggggg

SEQ ID NO: 500553 - RNA, 21 nt, Human
ugggcaggggcgcagggucuc

SEQ ID NO: 500554 - RNA, 19 nt, Human
uguggacgaaagggcccgg

SEQ ID NO: 500555 - RNA, 21 nt, Human
uucccggggcgcgggcgguca

SEQ ID NO: 500556 - RNA, 23 nt, Human
uuccuuuaguuuagaagugaaca

SEQ ID NO: 500557 - RNA, 21 nt, Human
uugccgggugagggaggcggc

SEQ ID NO: 500558 - RNA, 19 nt, Human
uuugaaaucacugguguuu

SEQ ID NO: 500559 - RNA, 20 nt, Human
uuugauguggacgaaagggc

SEQ ID NO: 500560 - RNA, 23 nt, Human
uuuuuugaaaucacugguguuua

SEQ ID NO: 500561 - RNA, 18 nt, Human
uuuuuuuuuuuuuuuuug

SEQ ID NO: 500562 - RNA, 23 nt, Human
aacugaaccaaugccuguccuag

SEQ ID NO: 500563 - RNA, 18 nt, Human
ccuucuaggaacugaaga

SEQ ID NO: 500564 - RNA, 21 nt, Human
gcaucaucuucauuuuuaaac

SEQ ID NO: 500565 - RNA, 19 nt, Human
ucaacaagaacauguacag

SEQ ID NO: 500566 - RNA, 19 nt, Human
ugaagaacauccaucuuug

SEQ ID NO: 500567 - RNA, 19 nt, Human
aaacugcugggauuacaga

SEQ ID NO: 500568 - RNA, 24 nt, Human
aaacugcugggauuacagacguga

SEQ ID NO: 500569 - RNA, 19 nt, Human
aaagaaguuuauuuggcuc

SEQ ID NO: 500570 - RNA, 19 nt, Human
aaauagagacaggguuuug

SEQ ID NO: 500571 - RNA, 21 nt, Human
aagaagcugggagagacaggc

SEQ ID NO: 500572 - RNA, 18 nt, Human
aagcagacagacaagugc

SEQ ID NO: 500573 - RNA, 22 nt, Human
aagcagacagacaagugcugac

SEQ ID NO: 500574 - RNA, 22 nt, Human
aagcaugguacugacaucugcu

SEQ ID NO: 500575 - RNA, 21 nt, Human
aagccagcacaaacuacccca

SEQ ID NO: 500576 - RNA, 18 nt, Human
aaggccccagggguccaa

SEQ ID NO: 500577 - RNA, 19 nt, Human
aagugcugggauuacaggc

SEQ ID NO: 500578 - RNA, 19 nt, Human
aagugcugggauuacaggc

SEQ ID NO: 500579 - RNA, 22 nt, Human
aagugcugggauuacaggcgug

SEQ ID NO: 500580 - RNA, 23 nt, Human
aagugcugggauuacaggcguga

SEQ ID NO: 500581 - RNA, 24 nt, Human
aauguuggccagguuggucuugaa

SEQ ID NO: 500582 - RNA, 22 nt, Human
acaagaggacguucugucccuc

SEQ ID NO: 500583 - RNA, 24 nt, Human
acaauguuggccagguuggucuug

SEQ ID NO: 500584 - RNA, 24 nt, Human
acaggguuucacaauguuggccag

SEQ ID NO: 500585 - RNA, 24 nt, Human
acaggguuuugccuguugcccagg

SEQ ID NO: 500586 - RNA, 18 nt, Human
acaguucugcaggcugua

SEQ ID NO: 500587 - RNA, 19 nt, Human
acccaggcuggagugcagu

SEQ ID NO: 500588 - RNA, 19 nt, Human
acgacaggugcgugccacu

SEQ ID NO: 500589 - RNA, 21 nt, Human
acuccuagcaagugauuccaa

SEQ ID NO: 500590 - RNA, 25 nt, Human
acucugucgcccaggcuggacugca

SEQ ID NO: 500591 - RNA, 24 nt, Human
acugcaguggugcuaucaugguuc

SEQ ID NO: 500592 - RNA, 18 nt, Human
agaauucuaggacuccac

SEQ ID NO: 500593 - RNA, 23 nt, Human
agacaggcagguaacaacccagg

SEQ ID NO: 500594 - RNA, 24 nt, Human
agacaggcagguaacaacccaggu

SEQ ID NO: 500595 - RNA, 21 nt, Human
agacaggcagguaacaacccg

SEQ ID NO: 500596 - RNA, 22 nt, Human
agacaggguuuugccuguugcc

SEQ ID NO: 500597 - RNA, 21 nt, Human
agagcagugacuagacuuuuu

SEQ ID NO: 500598 - RNA, 20 nt, Human
agcacaaacuaccccaaugc

SEQ ID NO: 500599 - RNA, 19 nt, Human
agccaccacaccuggccua

SEQ ID NO: 500600 - RNA, 24 nt, Human
agcuagaccuccggcggagaggca

SEQ ID NO: 500601 - RNA, 20 nt, Human
aggacuccaccugccugcug

SEQ ID NO: 500602 - RNA, 19 nt, Human
aggcagguaacaacccagg

SEQ ID NO: 500603 - RNA, 24 nt, Human
aggcgauucgcccgccccagccuc

SEQ ID NO: 500604 - RNA, 25 nt, Human
aggcuggagugcaguggcacaaucu

SEQ ID NO: 500605 - RNA, 22 nt, Human
aggcuuaagugauccuccuacc

SEQ ID NO: 500606 - RNA, 22 nt, Human
aggcuuagaaaaugugcaaauu

SEQ ID NO: 500607 - RNA, 24 nt, Human
agggaggcugccaggguccuguuu

SEQ ID NO: 500608 - RNA, 20 nt, Human
agggugccuuucacucagcu

SEQ ID NO: 500609 - RNA, 25 nt, Human
aguagcugggauuacaggugccugu

SEQ ID NO: 500610 - RNA, 24 nt, Human
agugauucaccugccucagccucc

SEQ ID NO: 500611 - RNA, 19 nt, Human
agugcaguggcacaaucuu

SEQ ID NO: 500612 - RNA, 18 nt, Human
agugcugggauuacaggc

SEQ ID NO: 500613 - RNA, 18 nt, Human
aguggcuggccacccucc

SEQ ID NO: 500614 - RNA, 23 nt, Human
auacaugcgacaugaaugaaaca

SEQ ID NO: 500615 - RNA, 21 nt, Human
auauacacauguacauauaua

SEQ ID NO: 500616 - RNA, 19 nt, Human
aucccaccacaccuggccg

SEQ ID NO: 500617 - RNA, 18 nt, Human
auguacauauauauacac

SEQ ID NO: 500618 - RNA, 20 nt, Human
auguacauauauauacacaa

SEQ ID NO: 500619 - RNA, 24 nt, Human
auguggcacaaacuauaauggaau

SEQ ID NO: 500620 - RNA, 24 nt, Human
auuuuuauauuuuuaguagagaca

SEQ ID NO: 500621 - RNA, 28 nt, Human
caaaacaccaaaauaucacaucaguaua

SEQ ID NO: 500622 - RNA, 24 nt, Human
caaacugcugggauuacagacgug

SEQ ID NO: 500623 - RNA, 22 nt, Human
caaagagacuaaaaaccacuga

SEQ ID NO: 500624 - RNA, 22 nt, Human
caagaucugagggccuuggccu

SEQ ID NO: 500625 - RNA, 22 nt, Human
caagugauucaccugccucagc

SEQ ID NO: 500626 - RNA, 21 nt, Human
caagugcucacccagcccuca

SEQ ID NO: 500627 - RNA, 19 nt, Human
cacaaacuauaauggaaua

SEQ ID NO: 500628 - RNA, 21 nt, Human
cacaauguuggccagguuggu

SEQ ID NO: 500629 - RNA, 24 nt, Human
cacaauguuggccagguuggucuu

SEQ ID NO: 500630 - RNA, 18 nt, Human
cacacacacacacacaca

SEQ ID NO: 500631 - RNA, 20 nt, Human
cacacacacacacacacaua

SEQ ID NO: 500632 - RNA, 22 nt, Human
cacacacacacacacacauaua

SEQ ID NO: 500633 - RNA, 19 nt, Human
cacacacacacacacauau

SEQ ID NO: 500634 - RNA, 22 nt, Human
cacccuccccacucuggccaag

SEQ ID NO: 500635 - RNA, 18 nt, Human
caccugccugcuggggcu

SEQ ID NO: 500636 - RNA, 20 nt, Human
caccuggccuaauuauacau

SEQ ID NO: 500637 - RNA, 21 nt, Human
cacuacaccacuuacaauugc

SEQ ID NO: 500638 - RNA, 20 nt, Human
cacucauggagggaagaagc

SEQ ID NO: 500639 - RNA, 24 nt, Human
cacucugucgcccaggcuggacug

SEQ ID NO: 500640 - RNA, 23 nt, Human
cacugcagccuccaccucccggg

SEQ ID NO: 500641 - RNA, 22 nt, Human
cacugcaggcuugacuucccag

SEQ ID NO: 500642 - RNA, 23 nt, Human
cagccuccaccucccggguucaa

SEQ ID NO: 500643 - RNA, 20 nt, Human
cagccuccugaguagcuggg

SEQ ID NO: 500644 - RNA, 20 nt, Human
cagccuccuggguugcuggg

SEQ ID NO: 500645 - RNA, 24 nt, Human
cagcgagcaccaccgcugaccucc

SEQ ID NO: 500646 - RNA, 20 nt, Human
caggcgauucgcccgccccc

SEQ ID NO: 500647 - RNA, 24 nt, Human
caggguuucacaauguuggccagg

SEQ ID NO: 500648 - RNA, 23 nt, Human
caggguuuugccuguugcccagg

SEQ ID NO: 500649 - RNA, 23 nt, Human
cagguaacaacccaggucugucc

SEQ ID NO: 500650 - RNA, 19 nt, Human
cauauauacacacauauau

SEQ ID NO: 500651 - RNA, 26 nt, Human
ccaaaccgcagcgagcagugggaaac

SEQ ID NO: 500652 - RNA, 22 nt, Human
ccaaacugcugggauuacagac

SEQ ID NO: 500653 - RNA, 24 nt, Human
ccaaacugcugggauuacagacgu

SEQ ID NO: 500654 - RNA, 24 nt, Human
ccaaugcuugggugaguggccaag

SEQ ID NO: 500655 - RNA, 18 nt, Human
ccacauguccaucaaugg

SEQ ID NO: 500656 - RNA, 24 nt, Human
ccaccucccggguucaagugauuc

SEQ ID NO: 500657 - RNA, 20 nt, Human
ccacucuggccaagguccug

SEQ ID NO: 500658 - RNA, 22 nt, Human
cccagagccagcgccucccaag

SEQ ID NO: 500659 - RNA, 21 nt, Human
cccaggcuuaagugauccucc

SEQ ID NO: 500660 - RNA, 19 nt, Human
ccccacuguccuacucucu

SEQ ID NO: 500661 - RNA, 22 nt, Human
cccggguucaagugauucaccu

SEQ ID NO: 500662 - RNA, 23 nt, Human
cccggguucaagugauucaccug

SEQ ID NO: 500663 - RNA, 20 nt, Human
ccggguucaagugauucacc

SEQ ID NO: 500664 - RNA, 22 nt, Human
ccuaagugcugggauuacaggc

SEQ ID NO: 500665 - RNA, 24 nt, Human
ccuaagugcugggauuacaggcgu

SEQ ID NO: 500666 - RNA, 20 nt, Human
ccuacagugcugagggcugu

SEQ ID NO: 500667 - RNA, 18 nt, Human
ccucaagggugacccuuc

SEQ ID NO: 500668 - RNA, 19 nt, Human
ccucacaucaccugucacc

SEQ ID NO: 500669 - RNA, 20 nt, Human
ccucaggcgauucgcccgcc

SEQ ID NO: 500670 - RNA, 22 nt, Human
ccugaguagcugggauuacagg

SEQ ID NO: 500671 - RNA, 23 nt, Human
ccugaguagcugggauuacaggu

SEQ ID NO: 500672 - RNA, 24 nt, Human
ccugaguagcugggauuacaggug

SEQ ID NO: 500673 - RNA, 23 nt, Human
ccugccucagccuccugaguagc

SEQ ID NO: 500674 - RNA, 24 nt, Human
ccugccucagccuccugaguagcu

SEQ ID NO: 500675 - RNA, 22 nt, Human
ccuggccucaggcgauucgccc

SEQ ID NO: 500676 - RNA, 25 nt, Human
ccuggguggcagagagacaagacuc

SEQ ID NO: 500677 - RNA, 22 nt, Human
cgagauggggucucacucuguc

SEQ ID NO: 500678 - RNA, 23 nt, Human
cgcccacagcuagaccuccggcg

SEQ ID NO: 500679 - RNA, 20 nt, Human
cgcugaccuccauccgccgc

SEQ ID NO: 500680 - RNA, 19 nt, Human
cggaaccaugaggugcgcg

SEQ ID NO: 500681 - RNA, 22 nt, Human
cguguauauauacauauauaca

SEQ ID NO: 500682 - RNA, 19 nt, Human
cuaaaaaccacugaauuau

SEQ ID NO: 500683 - RNA, 21 nt, Human
cuaaguaaaugaagccaguca

SEQ ID NO: 500684 - RNA, 21 nt, Human
cuaagugcugggauuacaggc

SEQ ID NO: 500685 - RNA, 21 nt, Human
cucacugcagccuccaccucc

SEQ ID NO: 500686 - RNA, 24 nt, Human
cucacugcagccuccaccucccgg

SEQ ID NO: 500687 - RNA, 24 nt, Human
cucagccuccugaguagcugggau

SEQ ID NO: 500688 - RNA, 20 nt, Human
cucagcuccaccccacuguc

SEQ ID NO: 500689 - RNA, 26 nt, Human
cuccauccgccgcccuaacugucccc

SEQ ID NO: 500690 - RNA, 21 nt, Human
cucccaaacugcugggauuac

SEQ ID NO: 500691 - RNA, 20 nt, Human
cucccggguucaagugauuc

SEQ ID NO: 500692 - RNA, 23 nt, Human
cuccuaccucagccuccuggguu

SEQ ID NO: 500693 - RNA, 19 nt, Human
cuccuggguugcugggacg

SEQ ID NO: 500694 - RNA, 20 nt, Human
cucugcucuggagguucaga

SEQ ID NO: 500695 - RNA, 20 nt, Human
cucuguuacccaggcuggag

SEQ ID NO: 500696 - RNA, 21 nt, Human
cugaguagcugggauuacagg

SEQ ID NO: 500697 - RNA, 23 nt, Human
cugcagccuccaccucccggguu

SEQ ID NO: 500698 - RNA, 24 nt, Human
cugcagccuccaccucccggguuc

SEQ ID NO: 500699 - RNA, 23 nt, Human
cugcuuggcuccugggaaggccu

SEQ ID NO: 500700 - RNA, 23 nt, Human
cuggguugcugggacgacaggug

SEQ ID NO: 500701 - RNA, 25 nt, Human
cugucccuaaagcagcccucuuggg

SEQ ID NO: 500702 - RNA, 18 nt, Human
cuguuacccaggcuggag

SEQ ID NO: 500703 - RNA, 24 nt, Human
cuuaagugauccuccuaccucagc

SEQ ID NO: 500704 - RNA, 20 nt, Human
cuugaacuccugggcucaag

SEQ ID NO: 500705 - RNA, 20 nt, Human
cuuguugccucccagcaccu

SEQ ID NO: 500706 - RNA, 18 nt, Human
gaacagauagggcaggag

SEQ ID NO: 500707 - RNA, 18 nt, Human
gacaggguuuugccuguu

SEQ ID NO: 500708 - RNA, 21 nt, Human
gaccaagccugggaaggcccc

SEQ ID NO: 500709 - RNA, 21 nt, Human
gacuuagguaauauaaaacaa

SEQ ID NO: 500710 - RNA, 22 nt, Human
gagcagugacuagacuuuuucu

SEQ ID NO: 500711 - RNA, 18 nt, Human
gagggcagaacagauagg

SEQ ID NO: 500712 - RNA, 22 nt, Human
gauggcugugguucaguagcca

SEQ ID NO: 500713 - RNA, 18 nt, Human
gauuacagacgugagcca

SEQ ID NO: 500714 - RNA, 21 nt, Human
gauuacagacgugagccacca

SEQ ID NO: 500715 - RNA, 20 nt, Human
gauuacaggcgugaucccac

SEQ ID NO: 500716 - RNA, 24 nt, Human
gauuacaggugccugucaucaugc

SEQ ID NO: 500717 - RNA, 19 nt, Human
gcacaaacuauaauggaau

SEQ ID NO: 500718 - RNA, 18 nt, Human
gcagacuggagaaccacg

SEQ ID NO: 500719 - RNA, 18 nt, Human
gcaguccaugcugcuggc

SEQ ID NO: 500720 - RNA, 23 nt, Human
gccccagccucccuaagugcugg

SEQ ID NO: 500721 - RNA, 22 nt, Human
gcgauucgcccgccccagccuc

SEQ ID NO: 500722 - RNA, 24 nt, Human
gcgauucgcccgccccagccuccc

SEQ ID NO: 500723 - RNA, 20 nt, Human
gcucacaguucugcaggcuu

SEQ ID NO: 500724 - RNA, 25 nt, Human
gcucuguuacccaggcuggagugca

SEQ ID NO: 500725 - RNA, 19 nt, Human
gcuggagugcaguggcaca

SEQ ID NO: 500726 - RNA, 24 nt, Human
ggaggcugccaggguccuguuugg

SEQ ID NO: 500727 - RNA, 20 nt, Human
ggagguucagaauucuagga

SEQ ID NO: 500728 - RNA, 19 nt, Human
ggauuacagacgugagcca

SEQ ID NO: 500729 - RNA, 21 nt, Human
ggcucacaguucugcaggcug

SEQ ID NO: 500730 - RNA, 24 nt, Human
ggguggucuugaacuccugggcuc

SEQ ID NO: 500731 - RNA, 18 nt, Human
ggugaugguugcauguau

SEQ ID NO: 500732 - RNA, 22 nt, Human
gguggugaagacaacgauggag

SEQ ID NO: 500733 - RNA, 23 nt, Human
gucacaaaacaccaaaauaucac

SEQ ID NO: 500734 - RNA, 23 nt, Human
gugauccuccuaccucagccucc

SEQ ID NO: 500735 - RNA, 18 nt, Human
gugauucaccugccucag

SEQ ID NO: 500736 - RNA, 23 nt, Human
gugauucaccugccucagccucc

SEQ ID NO: 500737 - RNA, 19 nt, Human
guguauauauacauauaua

SEQ ID NO: 500738 - RNA, 24 nt, Human
guucaagugauucaccugccucag

SEQ ID NO: 500739 - RNA, 19 nt, Human
uaaagcagcccucuugggc

SEQ ID NO: 500740 - RNA, 24 nt, Human
uaaauaucuacauaggaaauccaa

SEQ ID NO: 500741 - RNA, 24 nt, Human
uaaaugggugaaguguauggcaug

SEQ ID NO: 500742 - RNA, 23 nt, Human
uaacaaaauaaaaagcauauuga

SEQ ID NO: 500743 - RNA, 21 nt, Human
uaacaggccccauucuccaac

SEQ ID NO: 500744 - RNA, 20 nt, Human
uaagugauccuccuaccuca

SEQ ID NO: 500745 - RNA, 27 nt, Human
uaagugauccuccuaccucagccuccu

SEQ ID NO: 500746 - RNA, 19 nt, Human
uaagugcugggauuacagg

SEQ ID NO: 500747 - RNA, 24 nt, Human
uaagugcugggauuacaggcguga

SEQ ID NO: 500748 - RNA, 24 nt, Human
uaauuuuuauauuuuuaguagaga

SEQ ID NO: 500749 - RNA, 19 nt, Human
uacaaggauggcaccaagc

SEQ ID NO: 500750 - RNA, 23 nt, Human
uacaccacuuacaauugcuccaa

SEQ ID NO: 500751 - RNA, 22 nt, Human
uacagacgugagccaccacacc

SEQ ID NO: 500752 - RNA, 21 nt, Human
uacccaggcuggagugcagug

SEQ ID NO: 500753 - RNA, 24 nt, Human
uacccaggcuggagugcaguggca

SEQ ID NO: 500754 - RNA, 20 nt, Human
uaccucagccuccuggguug

SEQ ID NO: 500755 - RNA, 24 nt, Human
uaccucagccuccuggguugcugg

SEQ ID NO: 500756 - RNA, 25 nt, Human
uacguguauauauacauauauacaa

SEQ ID NO: 500757 - RNA, 22 nt, Human
uagagacaggguuucacaaugu

SEQ ID NO: 500758 - RNA, 21 nt, Human
uagagacaggguuuugccugu

SEQ ID NO: 500759 - RNA, 21 nt, Human
uagcaagugauuccaaaccgc

SEQ ID NO: 500760 - RNA, 24 nt, Human
uaguagagacaggguuucacaaug

SEQ ID NO: 500761 - RNA, 22 nt, Human
uauacauauauacacacauaua

SEQ ID NO: 500762 - RNA, 25 nt, Human
uauacauauauacacacauauauac

SEQ ID NO: 500763 - RNA, 19 nt, Human
uauauacacacauauauac

SEQ ID NO: 500764 - RNA, 20 nt, Human
uauauacguguauauauaca

SEQ ID NO: 500765 - RNA, 18 nt, Human
uaucacaucaguauauga

SEQ ID NO: 500766 - RNA, 22 nt, Human
uauccagaagguggaaacaauc

SEQ ID NO: 500767 - RNA, 19 nt, Human
uaugaggcuuagaaaaugu

SEQ ID NO: 500768 - RNA, 20 nt, Human
ucaagugauucaccugccuc

SEQ ID NO: 500769 - RNA, 18 nt, Human
ucacccagcccucacauc

SEQ ID NO: 500770 - RNA, 23 nt, Human
ucacugcagccuccaccucccgg

SEQ ID NO: 500771 - RNA, 23 nt, Human
ucacugcagccuccaccucccgg

SEQ ID NO: 500772 - RNA, 24 nt, Human
ucacugcagccuccaccucccggg

SEQ ID NO: 500773 - RNA, 19 nt, Human
ucacugcaggcuugacuuc

SEQ ID NO: 500774 - RNA, 24 nt, Human
ucacugcaggcuugacuucccagg

SEQ ID NO: 500775 - RNA, 20 nt, Human
ucagccuccugaguagcugg

SEQ ID NO: 500776 - RNA, 21 nt, Human
ucagggugccuuucacucagc

SEQ ID NO: 500777 - RNA, 19 nt, Human
uccaugcugcuggcacaag

SEQ ID NO: 500778 - RNA, 24 nt, Human
ucccaaacugcugggauuacagac

SEQ ID NO: 500779 - RNA, 22 nt, Human
ucccaacaaccagcuuucaagu

SEQ ID NO: 500780 - RNA, 21 nt, Human
ucccaagugcucacccagccc

SEQ ID NO: 500781 - RNA, 29 nt, Human
ucccagagccagcgccucccaagugcuca

SEQ ID NO: 500782 - RNA, 21 nt, Human
ucccaggcuuaagugauccuc

SEQ ID NO: 500783 - RNA, 19 nt, Human
ucccggguucaagugauuc

SEQ ID NO: 500784 - RNA, 24 nt, Human
ucccggguucaagugauucaccug

SEQ ID NO: 500785 - RNA, 24 nt, Human
ucccuaagugcugggauuacaggc

SEQ ID NO: 500786 - RNA, 26 nt, Human
uccuccuaccucagccuccuggguug

SEQ ID NO: 500787 - RNA, 24 nt, Human
uccugaguagcugggauuacaggu

SEQ ID NO: 500788 - RNA, 18 nt, Human
uccuggguugcugggacg

SEQ ID NO: 500789 - RNA, 24 nt, Human
uccuggguugcugggacgacaggu

SEQ ID NO: 500790 - RNA, 24 nt, Human
ucgcccaggcuggacugcaguggu

SEQ ID NO: 500791 - RNA, 23 nt, Human
ucucacucugucgcccaggcugg

SEQ ID NO: 500792 - RNA, 24 nt, Human
ucucacucugucgcccaggcugga

SEQ ID NO: 500793 - RNA, 26 nt, Human
ucucacucugucgcccaggcuggacu

SEQ ID NO: 500794 - RNA, 27 nt, Human
ucucacucugucgcccaggcuggacug

SEQ ID NO: 500795 - RNA, 22 nt, Human
ucucagcuccaccccacugucc

SEQ ID NO: 500796 - RNA, 21 nt, Human
ucucccagagccagcgccucc

SEQ ID NO: 500797 - RNA, 20 nt, Human
ucucuaaggagaggcuggaa

SEQ ID NO: 500798 - RNA, 21 nt, Human
ucucuguucuguauggcugga

SEQ ID NO: 500799 - RNA, 24 nt, Human
ucugucccuaaagcagcccucuug

SEQ ID NO: 500800 - RNA, 24 nt, Human
ucuguuacccaggcuggagugcag

SEQ ID NO: 500801 - RNA, 21 nt, Human
ucuugaacuccugggcucaag

SEQ ID NO: 500802 - RNA, 23 nt, Human
ucuugcucuguuacccaggcugg

SEQ ID NO: 500803 - RNA, 24 nt, Human
ucuugcucuguuacccaggcugga

SEQ ID NO: 500804 - RNA, 25 nt, Human
ugacagaaggugaacaaggagcagg

SEQ ID NO: 500805 - RNA, 20 nt, Human
ugacagcacaaggcucuggu

SEQ ID NO: 500806 - RNA, 22 nt, Human
ugagacagagucuugcucuguu

SEQ ID NO: 500807 - RNA, 19 nt, Human
ugauacagaccccuacgca

SEQ ID NO: 500808 - RNA, 20 nt, Human
ugcaaagagacuaaaaacca

SEQ ID NO: 500809 - RNA, 22 nt, Human
ugcaaagagacuaaaaaccacu

SEQ ID NO: 500810 - RNA, 25 nt, Human
ugcagagggugaccaagccugggaa

SEQ ID NO: 500811 - RNA, 24 nt, Human
ugcccaggguggucuugaacuccu

SEQ ID NO: 500812 - RNA, 28 nt, Human
ugcccaggguggucuugaacuccugggc

SEQ ID NO: 500813 - RNA, 24 nt, Human
ugccucagccuccugaguagcugg

SEQ ID NO: 500814 - RNA, 21 nt, Human
ugccuguugcccagggugguc

SEQ ID NO: 500815 - RNA, 23 nt, Human
ugccuguugcccaggguggucuu

SEQ ID NO: 500816 - RNA, 22 nt, Human
ugcucuggagguucagaauucu

SEQ ID NO: 500817 - RNA, 19 nt, Human
ugcugagggcugugggccu

SEQ ID NO: 500818 - RNA, 24 nt, Human
ugcugggauuacagacgugagcca

SEQ ID NO: 500819 - RNA, 25 nt, Human
ugcugggauuacaggcgugauccca

SEQ ID NO: 500820 - RNA, 24 nt, Human
uggacugcaguggugcuaucaugg

SEQ ID NO: 500821 - RNA, 18 nt, Human
uggagugcaguggcacaa

SEQ ID NO: 500822 - RNA, 23 nt, Human
uggagugcaguggcacaaucuua

SEQ ID NO: 500823 - RNA, 24 nt, Human
uggcacaaucuuaacucacugcag

SEQ ID NO: 500824 - RNA, 24 nt, Human
uggccagguuggucuugaauuccu

SEQ ID NO: 500825 - RNA, 18 nt, Human
uggccucaggcgauucgc

SEQ ID NO: 500826 - RNA, 19 nt, Human
uggcuggaggcaacccagu

SEQ ID NO: 500827 - RNA, 19 nt, Human
ugggagaaagccucccagg

SEQ ID NO: 500828 - RNA, 20 nt, Human
ugggagagacaggcagguaa

SEQ ID NO: 500829 - RNA, 18 nt, Human
ugggauuacagacgugag

SEQ ID NO: 500830 - RNA, 19 nt, Human
ugggauuacagacgugagc

SEQ ID NO: 500831 - RNA, 22 nt, Human
ugggauuacagacgugagccac

SEQ ID NO: 500832 - RNA, 24 nt, Human
ugggauuacagacgugagccacca

SEQ ID NO: 500833 - RNA, 18 nt, Human
ugggauuacaggcgugau

SEQ ID NO: 500834 - RNA, 23 nt, Human
ugggauuacaggcgugaucccac

SEQ ID NO: 500835 - RNA, 25 nt, Human
ugggauuacaggcgugaucccacca

SEQ ID NO: 500836 - RNA, 22 nt, Human
ugggauuacaggugccugucau

SEQ ID NO: 500837 - RNA, 24 nt, Human
ugggauuacaggugccugucauca

SEQ ID NO: 500838 - RNA, 21 nt, Human
ugggcugggcguggcggggga

SEQ ID NO: 500839 - RNA, 24 nt, Human
uggggucucacucugucgcccagg

SEQ ID NO: 500840 - RNA, 23 nt, Human
ugggugaguggccaagcaucaga

SEQ ID NO: 500841 - RNA, 23 nt, Human
uggguugcugggacgacaggugc

SEQ ID NO: 500842 - RNA, 24 nt, Human
uggugcuaucaugguucacugcag

SEQ ID NO: 500843 - RNA, 19 nt, Human
uguauauauacauauauac

SEQ ID NO: 500844 - RNA, 22 nt, Human
uguauauauacauauauacaca

SEQ ID NO: 500845 - RNA, 23 nt, Human
ugucagggugccuuucacucagc

SEQ ID NO: 500846 - RNA, 21 nt, Human
ugucgcccaggcuggacugca

SEQ ID NO: 500847 - RNA, 20 nt, Human
uguguauauacguguauaua

SEQ ID NO: 500848 - RNA, 19 nt, Human
uguguguauauacguguau

SEQ ID NO: 500849 - RNA, 22 nt, Human
uguguguauauacguguauaua

SEQ ID NO: 500850 - RNA, 22 nt, Human
uuacaggcgugaucccaccaca

SEQ ID NO: 500851 - RNA, 24 nt, Human
uuacccaggcuggagugcaguggc

SEQ ID NO: 500852 - RNA, 18 nt, Human
uuaguagagacaggguuu

SEQ ID NO: 500853 - RNA, 21 nt, Human
uucaagugauucaccugccuc

SEQ ID NO: 500854 - RNA, 23 nt, Human
uucaagugauucaccugccucag

SEQ ID NO: 500855 - RNA, 24 nt, Human
uucacugcaggcuugacuucccag

SEQ ID NO: 500856 - RNA, 25 nt, Human
uucccaggcuuaagugauccuccua

SEQ ID NO: 500857 - RNA, 22 nt, Human
uucgagauggggucucacucug

SEQ ID NO: 500858 - RNA, 24 nt, Human
uugcucuguuacccaggcuggagu

SEQ ID NO: 500859 - RNA, 21 nt, Human
uugcugggacgacaggugcgu

SEQ ID NO: 500860 - RNA, 23 nt, Human
uuuauauuuuuaguagagacagg

SEQ ID NO: 500861 - RNA, 24 nt, Human
uuuauauuuuuaguagagacaggg

SEQ ID NO: 500862 - RNA, 19 nt, Human
uuucacaauguuggccagg

SEQ ID NO: 500863 - RNA, 20 nt, Human
uuucacaauguuggccaggu

SEQ ID NO: 500864 - RNA, 18 nt, Human
uuucuauaugcuaacaau

SEQ ID NO: 500865 - RNA, 24 nt, Human
uuuggaggggacaaaauauccaaa

SEQ ID NO: 500866 - RNA, 19 nt, Human
uuuugccuguugcccaggg

SEQ ID NO: 500867 - RNA, 24 nt, Human
uuuuuaguagagacaggguuucac

SEQ ID NO: 500868 - RNA, 20 nt, Human
uuuuuauauuuuuaguagag

SEQ ID NO: 500869 - RNA, 23 nt, Human
cgacucgagaggaaccgggacag

SEQ ID NO: 500870 - RNA, 23 nt, Human
ugguggugacggcauccacgggg

SEQ ID NO: 500871 - RNA, 23 nt, Human
uuccuuguguuuuguacaaaaag

SEQ ID NO: 500872 - RNA, 27 nt, Human
aaaaaaaaacacccaucagaucucauu

SEQ ID NO: 500873 - RNA, 25 nt, Human
aaaaaaaaauuaagaguaaagaaga

SEQ ID NO: 500874 - RNA, 26 nt, Human
aaaaaacaaaacaaaaaaaaacaccc

SEQ ID NO: 500875 - RNA, 22 nt, Human
aaaacaaaaaacaaaacaaaaa

SEQ ID NO: 500876 - RNA, 26 nt, Human
aaaacaaaacaaaaaaaaacacccau

SEQ ID NO: 500877 - RNA, 19 nt, Human
aaaacaucaaaagcucaga

SEQ ID NO: 500878 - RNA, 23 nt, Human
aaacaaaacaaaaaaaaacaccc

SEQ ID NO: 500879 - RNA, 19 nt, Human
aaacacccaucagaucuca

SEQ ID NO: 500880 - RNA, 20 nt, Human
aaacagacauccugccugug

SEQ ID NO: 500881 - RNA, 21 nt, Human
aaagaaaacauacucuuuaua

SEQ ID NO: 500882 - RNA, 22 nt, Human
aacaaggagucuguaaagaaaa

SEQ ID NO: 500883 - RNA, 20 nt, Human
aacauggagaaaccccgucu

SEQ ID NO: 500884 - RNA, 21 nt, Human
aacauggagaaaccccgucuc

SEQ ID NO: 500885 - RNA, 20 nt, Human
aacauggugaaacccugucu

SEQ ID NO: 500886 - RNA, 21 nt, Human
aacauggugaaacccugucuc

SEQ ID NO: 500887 - RNA, 24 nt, Human
aacuccaucucaaaaaacaaaaaa

SEQ ID NO: 500888 - RNA, 21 nt, Human
aagaaagacgcaaauacagaa

SEQ ID NO: 500889 - RNA, 23 nt, Human
aagaacagcaugaggguaaccac

SEQ ID NO: 500890 - RNA, 18 nt, Human
aagaaucccuuuuucuua

SEQ ID NO: 500891 - RNA, 22 nt, Human
aagagaugaaaacauuuacacc

SEQ ID NO: 500892 - RNA, 19 nt, Human
aagcacuaaaaagaaaaca

SEQ ID NO: 500893 - RNA, 24 nt, Human
aagcauuugaaauagaaugaaaua

SEQ ID NO: 500894 - RNA, 24 nt, Human
aaucacuugaacccuggaggaaga

SEQ ID NO: 500895 - RNA, 24 nt, Human
aaucgcuugaacccaggaggcaga

SEQ ID NO: 500896 - RNA, 27 nt, Human
acaaaaaaaaacacccaucagaucuca

SEQ ID NO: 500897 - RNA, 22 nt, Human
acaaaacaaaaaaaaacaccca

SEQ ID NO: 500898 - RNA, 27 nt, Human
acaaaacaaaaaaaaacacccaucaga

SEQ ID NO: 500899 - RNA, 23 nt, Human
acaaaacaaaacaucaaaagcuc

SEQ ID NO: 500900 - RNA, 20 nt, Human
acaagagcaaaacuccaucu

SEQ ID NO: 500901 - RNA, 22 nt, Human
acagagcacuaaacaguuuaac

SEQ ID NO: 500902 - RNA, 20 nt, Human
acauggcagcaggaagaagu

SEQ ID NO: 500903 - RNA, 19 nt, Human
accacugcacuccagccug

SEQ ID NO: 500904 - RNA, 24 nt, Human
acccaggaggcagagguugcggug

SEQ ID NO: 500905 - RNA, 24 nt, Human
accccgucucuacuaaaaauacaa

SEQ ID NO: 500906 - RNA, 24 nt, Human
acccugucucuaccaaaaauauaa

SEQ ID NO: 500907 - RNA, 18 nt, Human
acugcacuccagccuggg

SEQ ID NO: 500908 - RNA, 23 nt, Human
acugcacuccagccugggugacu

SEQ ID NO: 500909 - RNA, 22 nt, Human
acugcuugggugaccuuaggag

SEQ ID NO: 500910 - RNA, 21 nt, Human
agaaaacagacauccugccug

SEQ ID NO: 500911 - RNA, 26 nt, Human
agaaaacauacucuuuauauuugccc

SEQ ID NO: 500912 - RNA, 22 nt, Human
agaaucgcuugaacccaggagg

SEQ ID NO: 500913 - RNA, 26 nt, Human
agacagcaagccuaagagaugaaaac

SEQ ID NO: 500914 - RNA, 22 nt, Human
agacauccugccugugaaaaca

SEQ ID NO: 500915 - RNA, 25 nt, Human
agacgcaaauacagaaaggauaacc

SEQ ID NO: 500916 - RNA, 21 nt, Human
agagaacaaggagucuguaaa

SEQ ID NO: 500917 - RNA, 19 nt, Human
agagguuauagugagccaa

SEQ ID NO: 500918 - RNA, 24 nt, Human
agagguugcggugagccgagaucg

SEQ ID NO: 500919 - RNA, 24 nt, Human
agaucgugugccauugcacuccag

SEQ ID NO: 500920 - RNA, 18 nt, Human
agcacuaaaaagaaaaca

SEQ ID NO: 500921 - RNA, 24 nt, Human
agcacuuugggaggccuagguggg

SEQ ID NO: 500922 - RNA, 22 nt, Human
agcccuucuagagaacaaggag

SEQ ID NO: 500923 - RNA, 22 nt, Human
agccuggccaacauggugaaac

SEQ ID NO: 500924 - RNA, 24 nt, Human
agccuggccaacauggugaaaccc

SEQ ID NO: 500925 - RNA, 24 nt, Human
agcuacuugggaggcugagguggg

SEQ ID NO: 500926 - RNA, 23 nt, Human
agcugggcgugguggugcaugcc

SEQ ID NO: 500927 - RNA, 24 nt, Human
aggagaaauaaaaauuaauuucug

SEQ ID NO: 500928 - RNA, 25 nt, Human
aggagacagcaagccuaagagauga

SEQ ID NO: 500929 - RNA, 24 nt, Human
aggagcaguggcucacgccuguaa

SEQ ID NO: 500930 - RNA, 20 nt, Human
aggaguuugagaccagccug

SEQ ID NO: 500931 - RNA, 21 nt, Human
aggcagaaaacagacauccug

SEQ ID NO: 500932 - RNA, 21 nt, Human
aggcagagguugcggugagcc

SEQ ID NO: 500933 - RNA, 24 nt, Human
aggcagagguugcggugagccgag

SEQ ID NO: 500934 - RNA, 23 nt, Human
aggcaggagaaucgcuugaaccc

SEQ ID NO: 500935 - RNA, 24 nt, Human
aggcaggagaaucgcuugaaccca

SEQ ID NO: 500936 - RNA, 21 nt, Human
aggcccaggcgggcggaucac

SEQ ID NO: 500937 - RNA, 22 nt, Human
aggcgggcggaucaccugaggg

SEQ ID NO: 500938 - RNA, 22 nt, Human
aggcgggcggaucaccugaggu

SEQ ID NO: 500939 - RNA, 24 nt, Human
aggcugaggugggagaaucacuug

SEQ ID NO: 500940 - RNA, 18 nt, Human
aggucgggaguuugaggc

SEQ ID NO: 500941 - RNA, 18 nt, Human
aggugggagaaucacuug

SEQ ID NO: 500942 - RNA, 25 nt, Human
aggugggagaaucacuugaacccug

SEQ ID NO: 500943 - RNA, 22 nt, Human
agguggguggaucgcuugaggu

SEQ ID NO: 500944 - RNA, 18 nt, Human
aguaauguguauaaaauc

SEQ ID NO: 500945 - RNA, 24 nt, Human
aguggcucacgccuguaaucccag

SEQ ID NO: 500946 - RNA, 22 nt, Human
auaaaaauuaauuucugaacca

SEQ ID NO: 500947 - RNA, 18 nt, Human
auagcacguaugcuuuua

SEQ ID NO: 500948 - RNA, 20 nt, Human
aucgcuugaggucaggaguu

SEQ ID NO: 500949 - RNA, 24 nt, Human
aucucaccacugcacuccagccug

SEQ ID NO: 500950 - RNA, 19 nt, Human
aucucgucaggccuccccc

SEQ ID NO: 500951 - RNA, 21 nt, Human
aucucgucaggccucccccaa

SEQ ID NO: 500952 - RNA, 23 nt, Human
augaaacaccaggaauucugaag

SEQ ID NO: 500953 - RNA, 19 nt, Human
augccuguaaucccagcac

SEQ ID NO: 500954 - RNA, 24 nt, Human
augcugaggcaggagaaucgcuug

SEQ ID NO: 500955 - RNA, 24 nt, Human
auugcacuccagucugggcaacaa

SEQ ID NO: 500956 - RNA, 22 nt, Human
caaaaaaaaacacccaucagau

SEQ ID NO: 500957 - RNA, 24 nt, Human
caaaaaaaaacacccaucagaucu

SEQ ID NO: 500958 - RNA, 23 nt, Human
caaaaaacaaaaaacaaaacaaa

SEQ ID NO: 500959 - RNA, 24 nt, Human
caaaaaacaaaacaaaaaaaaaca

SEQ ID NO: 500960 - RNA, 20 nt, Human
caaaacaaaacaucaaaagc

SEQ ID NO: 500961 - RNA, 22 nt, Human
caaaacaaaacaucaaaagcuc

SEQ ID NO: 500962 - RNA, 25 nt, Human
caaaacaucaaaagcucagaguaag

SEQ ID NO: 500963 - RNA, 19 nt, Human
caaaauuagcugggcgugg

SEQ ID NO: 500964 - RNA, 19 nt, Human
caaacacauccuucuucac

SEQ ID NO: 500965 - RNA, 22 nt, Human
caaacuggagagagucauagca

SEQ ID NO: 500966 - RNA, 21 nt, Human
caacaagagcaaaacuccauc

SEQ ID NO: 500967 - RNA, 24 nt, Human
caacauggagaaaccccgucucua

SEQ ID NO: 500968 - RNA, 24 nt, Human
caacauggugaaacccugucucua

SEQ ID NO: 500969 - RNA, 24 nt, Human
caagagcaaaacuccaucucaaaa

SEQ ID NO: 500970 - RNA, 19 nt, Human
cacaagaacagcaugaggg

SEQ ID NO: 500971 - RNA, 21 nt, Human
cacaagaacagcaugagggua

SEQ ID NO: 500972 - RNA, 20 nt, Human
cacaggaccuaacuuacggc

SEQ ID NO: 500973 - RNA, 20 nt, Human
cacagucccacaggcugggg

SEQ ID NO: 500974 - RNA, 25 nt, Human
cacagucccacaggcuggggaggcc

SEQ ID NO: 500975 - RNA, 20 nt, Human
caccacauaaaagugugagg

SEQ ID NO: 500976 - RNA, 24 nt, Human
cacgccuguaaucccagcacuuug

SEQ ID NO: 500977 - RNA, 18 nt, Human
cacuccagccugggugac

SEQ ID NO: 500978 - RNA, 18 nt, Human
cacuccagccugggugac

SEQ ID NO: 500979 - RNA, 22 nt, Human
cacuccagccugggugacucug

SEQ ID NO: 500980 - RNA, 24 nt, Human
cacuccagucugggcaacaagagc

SEQ ID NO: 500981 - RNA, 19 nt, Human
cacugcacuccagccuggg

SEQ ID NO: 500982 - RNA, 19 nt, Human
cacugcacuccagccuggg

SEQ ID NO: 500983 - RNA, 19 nt, Human
cacugcacuccagccuggg

SEQ ID NO: 500984 - RNA, 22 nt, Human
cacugcacuccagccuggguga

SEQ ID NO: 500985 - RNA, 24 nt, Human
cacugcacuccagccugggugacu

SEQ ID NO: 500986 - RNA, 19 nt, Human
cacuugaacccuggaggaa

SEQ ID NO: 500987 - RNA, 19 nt, Human
cagaaacagcaagcuagaa

SEQ ID NO: 500988 - RNA, 19 nt, Human
cagaguaagauaagaaucc

SEQ ID NO: 500989 - RNA, 22 nt, Human
cagaguaagauaagaaucccuu

SEQ ID NO: 500990 - RNA, 24 nt, Human
cagcacuuugggaggcccaggcgg

SEQ ID NO: 500991 - RNA, 24 nt, Human
cagcacuuugggaggccuaggugg

SEQ ID NO: 500992 - RNA, 24 nt, Human
cagccuaaccaacauggagaaacc

SEQ ID NO: 500993 - RNA, 21 nt, Human
cagcuacuugggaggcugagg

SEQ ID NO: 500994 - RNA, 24 nt, Human
cagcuacuugggaggcugaggugg

SEQ ID NO: 500995 - RNA, 19 nt, Human
caguggcaugugcccguag

SEQ ID NO: 500996 - RNA, 24 nt, Human
caugccuguaaucccagcacuuug

SEQ ID NO: 500997 - RNA, 19 nt, Human
cauuaacacuauaaucuac

SEQ ID NO: 500998 - RNA, 18 nt, Human
cauugcacuccagucugg

SEQ ID NO: 500999 - RNA, 19 nt, Human
cauugcacuccagucuggg

SEQ ID NO: 501000 - RNA, 21 nt, Human
cauugcacuccagucugggca

SEQ ID NO: 501001 - RNA, 24 nt, Human
cauugcacuccagucugggcaaca

SEQ ID NO: 501002 - RNA, 24 nt, Human
ccaaaagauagaaugcucauuuga

SEQ ID NO: 501003 - RNA, 20 nt, Human
ccacugcacuccagccuggg

SEQ ID NO: 501004 - RNA, 20 nt, Human
ccacugcacuccagccuggg

SEQ ID NO: 501005 - RNA, 21 nt, Human
ccacugcacuccagccugggu

SEQ ID NO: 501006 - RNA, 21 nt, Human
ccacugcacuccagccugggu

SEQ ID NO: 501007 - RNA, 22 nt, Human
ccacugcacuccagccugggug

SEQ ID NO: 501008 - RNA, 23 nt, Human
ccacugcacuccagccuggguga

SEQ ID NO: 501009 - RNA, 24 nt, Human
ccacugcacuccagccugggugac

SEQ ID NO: 501010 - RNA, 26 nt, Human
ccaucucaaaaaacaaaaaacaaaac

SEQ ID NO: 501011 - RNA, 20 nt, Human
ccauugcacuccagucuggg

SEQ ID NO: 501012 - RNA, 21 nt, Human
ccauugcacuccagucugggc

SEQ ID NO: 501013 - RNA, 23 nt, Human
ccauugcacuccagucugggcaa

SEQ ID NO: 501014 - RNA, 24 nt, Human
ccauugcacuccagucugggcaac

SEQ ID NO: 501015 - RNA, 22 nt, Human
cccccaacgccguccacagccc

SEQ ID NO: 501016 - RNA, 18 nt, Human
cccguagucccagcuacu

SEQ ID NO: 501017 - RNA, 21 nt, Human
cccguagucccagcuacuugg

SEQ ID NO: 501018 - RNA, 23 nt, Human
ccggccggcagaagccccacagu

SEQ ID NO: 501019 - RNA, 25 nt, Human
ccuaagagaugaaaacauuuacacc

SEQ ID NO: 501020 - RNA, 22 nt, Human
ccugaggucgggaguuugaggc

SEQ ID NO: 501021 - RNA, 22 nt, Human
ccuggccaacauggugaaaccc

SEQ ID NO: 501022 - RNA, 24 nt, Human
ccuggccaacauggugaaacccug

SEQ ID NO: 501023 - RNA, 22 nt, Human
ccuguaaucccagcacuuuggg

SEQ ID NO: 501024 - RNA, 19 nt, Human
ccuguaaucccagcuacuc

SEQ ID NO: 501025 - RNA, 22 nt, Human
ccuguaaucccagcuacucgag

SEQ ID NO: 501026 - RNA, 23 nt, Human
cgccuguaaucccagcacuuugg

SEQ ID NO: 501027 - RNA, 24 nt, Human
cgccuguaaucccagcacuuuggg

SEQ ID NO: 501028 - RNA, 24 nt, Human
cggaucaccugaggucgggaguuu

SEQ ID NO: 501029 - RNA, 18 nt, Human
cgggcggaucaccugagg

SEQ ID NO: 501030 - RNA, 24 nt, Human
cgggcggaucaccugaggucggga

SEQ ID NO: 501031 - RNA, 24 nt, Human
cgugugccauugcacuccagucug

SEQ ID NO: 501032 - RNA, 19 nt, Human
cuaaaaaagcauuaaugga

SEQ ID NO: 501033 - RNA, 24 nt, Human
cuagguggguggaucgcuugaggu

SEQ ID NO: 501034 - RNA, 26 nt, Human
cuagguggguggaucgcuugagguca

SEQ ID NO: 501035 - RNA, 31 nt, Human
cucaaaaaacaaaaaacaaaacaaaaaaaag

SEQ ID NO: 501036 - RNA, 22 nt, Human
cucacgccuguaaucccagcac

SEQ ID NO: 501037 - RNA, 24 nt, Human
cucacgccuguaaucccagcacuu

SEQ ID NO: 501038 - RNA, 19 nt, Human
cucagaguaagauaagaau

SEQ ID NO: 501039 - RNA, 18 nt, Human
cuggcagauucuuuuugu

SEQ ID NO: 501040 - RNA, 24 nt, Human
cuggccaacauggugaaacccugu

SEQ ID NO: 501041 - RNA, 24 nt, Human
cugggcaacaagagcaaaacucca

SEQ ID NO: 501042 - RNA, 21 nt, Human
cugggugacucugucucaaaa

SEQ ID NO: 501043 - RNA, 24 nt, Human
gaaaauucccuuacaaaaccauca

SEQ ID NO: 501044 - RNA, 19 nt, Human
gaaauuuuuccaaagcacu

SEQ ID NO: 501045 - RNA, 23 nt, Human
gaaucacuugaacccuggaggaa

SEQ ID NO: 501046 - RNA, 23 nt, Human
gacagcaagccuaagagaugaaa

SEQ ID NO: 501047 - RNA, 21 nt, Human
gagaaaccccgucucuacuaa

SEQ ID NO: 501048 - RNA, 26 nt, Human
gagaaucacuugaacccuggaggaag

SEQ ID NO: 501049 - RNA, 18 nt, Human
gauaaaacaagauauagg

SEQ ID NO: 501050 - RNA, 24 nt, Human
gaucaccugaggucgggaguuuga

SEQ ID NO: 501051 - RNA, 24 nt, Human
gaucgcuugaggucaggaguuuga

SEQ ID NO: 501052 - RNA, 24 nt, Human
gaugaaacaccaggaauucugaag

SEQ ID NO: 501053 - RNA, 21 nt, Human
gauucaugccuguaaucccag

SEQ ID NO: 501054 - RNA, 23 nt, Human
gcaaauacagaaaggauaaccuu

SEQ ID NO: 501055 - RNA, 25 nt, Human
gcaggaagaagugccaagcaaaggg

SEQ ID NO: 501056 - RNA, 22 nt, Human
gcaggagaaucgcuugaaccca

SEQ ID NO: 501057 - RNA, 24 nt, Human
gccaacauggugaaacccugucuc

SEQ ID NO: 501058 - RNA, 19 nt, Human
gccaggagcaguggcucac

SEQ ID NO: 501059 - RNA, 22 nt, Human
gccauugcacuccagucugggc

SEQ ID NO: 501060 - RNA, 23 nt, Human
gccauugcacuccagucugggca

SEQ ID NO: 501061 - RNA, 24 nt, Human
gccauugcacuccagucugggcaa

SEQ ID NO: 501062 - RNA, 24 nt, Human
gcuugaggucaggaguuugagacc

SEQ ID NO: 501063 - RNA, 24 nt, Human
ggaaggggaagcaaacacauccuu

SEQ ID NO: 501064 - RNA, 22 nt, Human
ggaggcagagguugcggugagc

SEQ ID NO: 501065 - RNA, 22 nt, Human
ggaucaccugaggucgggaguu

SEQ ID NO: 501066 - RNA, 24 nt, Human
gggcgugguggugcaugccuguaa

SEQ ID NO: 501067 - RNA, 19 nt, Human
ggucaggaguuugagacca

SEQ ID NO: 501068 - RNA, 19 nt, Human
ggucgggaguuugaggcca

SEQ ID NO: 501069 - RNA, 24 nt, Human
ggugauucaugccuguaaucccag

SEQ ID NO: 501070 - RNA, 24 nt, Human
gguggugcaugccuguaaucccag

SEQ ID NO: 501071 - RNA, 20 nt, Human
gguuaauacuauaucagggu

SEQ ID NO: 501072 - RNA, 19 nt, Human
gugugccauugcacuccag

SEQ ID NO: 501073 - RNA, 26 nt, Human
guugcggugagccgagaucgugugcc

SEQ ID NO: 501074 - RNA, 18 nt, Human
uaaaaauacaaaauuagc

SEQ ID NO: 501075 - RNA, 19 nt, Human
uaaaaauacaaaauuagcu

SEQ ID NO: 501076 - RNA, 20 nt, Human
uacaaaacaaaacaucaaaa

SEQ ID NO: 501077 - RNA, 22 nt, Human
uacacugucaccacauaaaagu

SEQ ID NO: 501078 - RNA, 20 nt, Human
uacauugaaaugccacaaca

SEQ ID NO: 501079 - RNA, 21 nt, Human
uaccaaaaauauaaaaauuag

SEQ ID NO: 501080 - RNA, 25 nt, Human
uaccaaaaauauaaaaauuagccag

SEQ ID NO: 501081 - RNA, 22 nt, Human
uaggagacagcaagccuaagag

SEQ ID NO: 501082 - RNA, 24 nt, Human
uagguggguggaucgcuugagguc

SEQ ID NO: 501083 - RNA, 18 nt, Human
uauguuacaaaacaaaac

SEQ ID NO: 501084 - RNA, 26 nt, Human
uauuacaauacaauaugcaaaccaga

SEQ ID NO: 501085 - RNA, 23 nt, Human
ucaauaguuuacaugguuuucac

SEQ ID NO: 501086 - RNA, 20 nt, Human
ucaauuugguggggacacag

SEQ ID NO: 501087 - RNA, 20 nt, Human
ucaccacauaaaagugugag

SEQ ID NO: 501088 - RNA, 23 nt, Human
ucacugggaaauacaggcagaaa

SEQ ID NO: 501089 - RNA, 23 nt, Human
ucagaucuugggccaggagcagu

SEQ ID NO: 501090 - RNA, 23 nt, Human
ucaugccuguaaucccagcacuu

SEQ ID NO: 501091 - RNA, 22 nt, Human
uccacacauaguuaaauaagau

SEQ ID NO: 501092 - RNA, 30 nt, Human
uccaucucaaaaaacaaaaaacaaaacaaa

SEQ ID NO: 501093 - RNA, 26 nt, Human
ucccaaccccuaggcgaauccagguu

SEQ ID NO: 501094 - RNA, 19 nt, Human
ucgcuugaggucaggaguu

SEQ ID NO: 501095 - RNA, 18 nt, Human
ucucaaaaaaaaauuaag

SEQ ID NO: 501096 - RNA, 22 nt, Human
ucucaaaaaacaaaaaacaaaa

SEQ ID NO: 501097 - RNA, 20 nt, Human
ucucuacuaaaaauacaaaa

SEQ ID NO: 501098 - RNA, 21 nt, Human
ucuuagaaaggucaagcagau

SEQ ID NO: 501099 - RNA, 23 nt, Human
ugaaacaccaggaauucugaaga

SEQ ID NO: 501100 - RNA, 22 nt, Human
ugaaaugccacaacaaaaucuu

SEQ ID NO: 501101 - RNA, 24 nt, Human
ugagaacucaccaucacaagaaca

SEQ ID NO: 501102 - RNA, 23 nt, Human
ugagaccagccuggccaacaugg

SEQ ID NO: 501103 - RNA, 24 nt, Human
ugagaccagccuggccaacauggu

SEQ ID NO: 501104 - RNA, 20 nt, Human
ugaggcaggagaaucgcuug

SEQ ID NO: 501105 - RNA, 24 nt, Human
ugaggcaggagaaucgcuugaacc

SEQ ID NO: 501106 - RNA, 25 nt, Human
ugaggcaggagaaucgcuugaaccc

SEQ ID NO: 501107 - RNA, 24 nt, Human
ugaggccagccuaaccaacaugga

SEQ ID NO: 501108 - RNA, 18 nt, Human
ugaggucaggaguuugag

SEQ ID NO: 501109 - RNA, 18 nt, Human
ugaggucgggaguuugag

SEQ ID NO: 501110 - RNA, 20 nt, Human
ugaggugggagaaucacuug

SEQ ID NO: 501111 - RNA, 24 nt, Human
ugaggugggagaaucacuugaacc

SEQ ID NO: 501112 - RNA, 21 nt, Human
ugauucaugccuguaauccca

SEQ ID NO: 501113 - RNA, 24 nt, Human
ugauucaugccuguaaucccagca

SEQ ID NO: 501114 - RNA, 19 nt, Human
ugcacuccagucugggcaa

SEQ ID NO: 501115 - RNA, 22 nt, Human
ugcacuccagucugggcaacaa

SEQ ID NO: 501116 - RNA, 22 nt, Human
ugcccacugggucccucccaca

SEQ ID NO: 501117 - RNA, 24 nt, Human
ugcccguagucccagcuacuuggg

SEQ ID NO: 501118 - RNA, 23 nt, Human
ugccuguaaucccagcacuuugg

SEQ ID NO: 501119 - RNA, 23 nt, Human
ugccuguaaucccagcacuuugg

SEQ ID NO: 501120 - RNA, 22 nt, Human
ugccuguaaucccagcuacucg

SEQ ID NO: 501121 - RNA, 19 nt, Human
ugcuaaguugcauuguuuu

SEQ ID NO: 501122 - RNA, 23 nt, Human
uggaucgcuugaggucaggaguu

SEQ ID NO: 501123 - RNA, 24 nt, Human
uggaucgcuugaggucaggaguuu

SEQ ID NO: 501124 - RNA, 24 nt, Human
uggcaugugcccguagucccagcu

SEQ ID NO: 501125 - RNA, 24 nt, Human
uggccaacauggugaaacccuguc

SEQ ID NO: 501126 - RNA, 22 nt, Human
uggcucacgccuguaaucccag

SEQ ID NO: 501127 - RNA, 24 nt, Human
uggcucacgccuguaaucccagca

SEQ ID NO: 501128 - RNA, 24 nt, Human
ugggaggcccaggcgggcggauca

SEQ ID NO: 501129 - RNA, 23 nt, Human
ugggaggccuagguggguggauc

SEQ ID NO: 501130 - RNA, 24 nt, Human
ugggaggccuagguggguggaucg

SEQ ID NO: 501131 - RNA, 19 nt, Human
ugggaggcugaggugggag

SEQ ID NO: 501132 - RNA, 24 nt, Human
ugggaggcugaggugggagaauca

SEQ ID NO: 501133 - RNA, 18 nt, Human
ugggccaggagcaguggc

SEQ ID NO: 501134 - RNA, 26 nt, Human
ugggucccucccacaacacguaggga

SEQ ID NO: 501135 - RNA, 24 nt, Human
ugggugaccuuaggagacagcaag

SEQ ID NO: 501136 - RNA, 24 nt, Human
uggguggaucgcuugaggucagga

SEQ ID NO: 501137 - RNA, 20 nt, Human
ugguccagaaacagcaagcu

SEQ ID NO: 501138 - RNA, 24 nt, Human
uggugauucaugccuguaauccca

SEQ ID NO: 501139 - RNA, 21 nt, Human
uggugcaugccuguaauccca

SEQ ID NO: 501140 - RNA, 22 nt, Human
uggugcaugccuguaaucccag

SEQ ID NO: 501141 - RNA, 24 nt, Human
ugguggugcaugccuguaauccca

SEQ ID NO: 501142 - RNA, 23 nt, Human
ugguuugcuaaguugcauuguuu

SEQ ID NO: 501143 - RNA, 21 nt, Human
uguaaagaaaaccaaucaccu

SEQ ID NO: 501144 - RNA, 22 nt, Human
uguaaucccagcuacucgagau

SEQ ID NO: 501145 - RNA, 20 nt, Human
uguauaaaauccaaccacug

SEQ ID NO: 501146 - RNA, 24 nt, Human
uguuacaaaacaaaacaucaaaag

SEQ ID NO: 501147 - RNA, 23 nt, Human
uuaaucucgucaggccuccccca

SEQ ID NO: 501148 - RNA, 19 nt, Human
uuacacugucaccacauaa

SEQ ID NO: 501149 - RNA, 21 nt, Human
uuacuggguuguuccacacau

SEQ ID NO: 501150 - RNA, 22 nt, Human
uuagcugggcgugguggugcau

SEQ ID NO: 501151 - RNA, 24 nt, Human
uuagcugggcgugguggugcaugc

SEQ ID NO: 501152 - RNA, 21 nt, Human
uuaucaguuuuguuuuuuuuu

SEQ ID NO: 501153 - RNA, 21 nt, Human
uucaagacguagaaaagccga

SEQ ID NO: 501154 - RNA, 23 nt, Human
uucaugccuguaaucccagcacu

SEQ ID NO: 501155 - RNA, 18 nt, Human
uugcggugagccgagauc

SEQ ID NO: 501156 - RNA, 21 nt, Human
uugcggugagccgagaucgug

SEQ ID NO: 501157 - RNA, 22 nt, Human
uugcggugagccgagaucgugu

SEQ ID NO: 501158 - RNA, 25 nt, Human
uugggaggcugaggugggagaauca

SEQ ID NO: 501159 - RNA, 21 nt, Human
uuuccauaucaaaagucugua

SEQ ID NO: 501160 - RNA, 18 nt, Human
uuucuuagaaaggucaag

SEQ ID NO: 501161 - RNA, 23 nt, Human
aguauuuuuucaaaguucauaua

SEQ ID NO: 501162 - RNA, 19 nt, Human
caaaguucauauacaggca

SEQ ID NO: 501163 - RNA, 23 nt, Human
uaacaaaaguagagucaaguauu

SEQ ID NO: 501164 - RNA, 23 nt, Human
ucaaaguucauauacaggcacag

SEQ ID NO: 501165 - RNA, 19 nt, Human
uuuucccagagaaacgaau

SEQ ID NO: 501166 - RNA, 21 nt, Human
uuuuuuuuuuuuuuucccaga

SEQ ID NO: 501167 - RNA, 22 nt, Human
uuuuuuuuuuuuuuuuucccag

SEQ ID NO: 501168 - RNA, 18 nt, Human
aaaaucuugcagauauga

SEQ ID NO: 501169 - RNA, 21 nt, Human
aaggaccccagccgguugucc

SEQ ID NO: 501170 - RNA, 27 nt, Human
cccugagccgcggcgcgcaaggacccc

SEQ ID NO: 501171 - RNA, 20 nt, Human
cgcgcaaggaccccagccgg

SEQ ID NO: 501172 - RNA, 24 nt, Human
cuuuucagcaaugaaaaccucuga

SEQ ID NO: 501173 - RNA, 24 nt, Human
gaaaaaaaucuugcagauaugaaa

SEQ ID NO: 501174 - RNA, 18 nt, Human
uaugacauuuucuguuuu

SEQ ID NO: 501175 - RNA, 22 nt, Human
ugaaaaaaaucuugcagauaug

SEQ ID NO: 501176 - RNA, 24 nt, Human
agagguacuauuaguuuguguucc

SEQ ID NO: 501177 - RNA, 18 nt, Human
caaaugcugacucaauau

SEQ ID NO: 501178 - RNA, 23 nt, Human
caggauccuguuaacuuggauuc

SEQ ID NO: 501179 - RNA, 23 nt, Human
ccuggguucuauuuaugggaaag

SEQ ID NO: 501180 - RNA, 19 nt, Human
guucaaaugcugacucaau

SEQ ID NO: 501181 - RNA, 22 nt, Human
uaacuuggauucuuuuauguua

SEQ ID NO: 501182 - RNA, 19 nt, Human
uagcagaaucucuggaaac

SEQ ID NO: 501183 - RNA, 26 nt, Human
uauaaacagauguuuccucacucccc

SEQ ID NO: 501184 - RNA, 23 nt, Human
uauguuaacaauauuuacaucua

SEQ ID NO: 501185 - RNA, 18 nt, Human
uccuguuaacuuggauuc

SEQ ID NO: 501186 - RNA, 21 nt, Human
ugaaaacauuuacuugguuca

SEQ ID NO: 501187 - RNA, 21 nt, Human
ugguagaacuuugucuggccu

SEQ ID NO: 501188 - RNA, 24 nt, Human
uguuuccucacuccccauagguau

SEQ ID NO: 501189 - RNA, 22 nt, Human
uuagaaguuauauuuuaaaaug

SEQ ID NO: 501190 - RNA, 22 nt, Human
uucaugcaauuuugucuuacuu

SEQ ID NO: 501191 - RNA, 18 nt, Human
uuuauguucaugcaauuu

SEQ ID NO: 501192 - RNA, 20 nt, Human
uuuauguucaugcaauuuug

SEQ ID NO: 501193 - RNA, 23 nt, Human
acaaaaucaagagccaggagccc

SEQ ID NO: 501194 - RNA, 20 nt, Human
caaaaucaagagccaggagc

SEQ ID NO: 501195 - RNA, 23 nt, Human
cagcggcuuugugggaugucugu

SEQ ID NO: 501196 - RNA, 20 nt, Human
caggagcccgggaugcggag

SEQ ID NO: 501197 - RNA, 23 nt, Human
cccgggaugcggagaugggccuc

SEQ ID NO: 501198 - RNA, 24 nt, Human
cggcggaccuuggacggccagcgc

SEQ ID NO: 501199 - RNA, 22 nt, Human
cuguggcagacaaaaucaagag

SEQ ID NO: 501200 - RNA, 26 nt, Human
ucaagagccaggagcccgggaugcgg

SEQ ID NO: 501201 - RNA, 23 nt, Human
uggcagacaaaaucaagagccag

SEQ ID NO: 501202 - RNA, 22 nt, Human
uuaauaaaauggcagcggcuuu

SEQ ID NO: 501203 - RNA, 20 nt, Human
uugugggaugucuguggcag

SEQ ID NO: 501204 - RNA, 19 nt, Human
aaaaaaaacacgagucaaa

SEQ ID NO: 501205 - RNA, 23 nt, Human
aaaaaaaacacgagucaaaaaua

SEQ ID NO: 501206 - RNA, 28 nt, Human
aaaagaaaaaaaaaagauuagacagaag

SEQ ID NO: 501207 - RNA, 23 nt, Human
aaaucaagaccaaacuucagaga

SEQ ID NO: 501208 - RNA, 21 nt, Human
aacucugccccggccccccca

SEQ ID NO: 501209 - RNA, 18 nt, Human
aagcaagaaaaaggaugg

SEQ ID NO: 501210 - RNA, 18 nt, Human
aagccacaagcacuuucc

SEQ ID NO: 501211 - RNA, 18 nt, Human
aaguaugaaagcugaggc

SEQ ID NO: 501212 - RNA, 21 nt, Human
aaucucccccuccccacucac

SEQ ID NO: 501213 - RNA, 28 nt, Human
aaugacaagaagcaaaaauauuuguaga

SEQ ID NO: 501214 - RNA, 19 nt, Human
acaaaagaaaaaaaaaaga

SEQ ID NO: 501215 - RNA, 22 nt, Human
acaagcacuuucccgcaccucc

SEQ ID NO: 501216 - RNA, 20 nt, Human
acaauccucccacaucuaga

SEQ ID NO: 501217 - RNA, 22 nt, Human
acucugccccggcccccccacc

SEQ ID NO: 501218 - RNA, 24 nt, Human
agaaaaaaaaaagauuagacagaa

SEQ ID NO: 501219 - RNA, 26 nt, Human
agaagagggguguuagggagaggggu

SEQ ID NO: 501220 - RNA, 19 nt, Human
agaauacuguuguagcucu

SEQ ID NO: 501221 - RNA, 18 nt, Human
agagacaaaucaugagau

SEQ ID NO: 501222 - RNA, 18 nt, Human
agagauugugggagauga

SEQ ID NO: 501223 - RNA, 25 nt, Human
agaguucccagcuggaggcuggagu

SEQ ID NO: 501224 - RNA, 18 nt, Human
agauacccaggcagcagc

SEQ ID NO: 501225 - RNA, 23 nt, Human
agauacccaggcagcagcagccc

SEQ ID NO: 501226 - RNA, 19 nt, Human
agccaggaaucuggacagu

SEQ ID NO: 501227 - RNA, 25 nt, Human
agccaggaaucuggacaguguucug

SEQ ID NO: 501228 - RNA, 25 nt, Human
aggaacagagaagaauaccgguacc

SEQ ID NO: 501229 - RNA, 19 nt, Human
aggccuuccccucagguag

SEQ ID NO: 501230 - RNA, 24 nt, Human
aggcgaggugagaaugcgauuucu

SEQ ID NO: 501231 - RNA, 18 nt, Human
aggcuggaguauccuggg

SEQ ID NO: 501232 - RNA, 21 nt, Human
agggaagaaauagaacuugga

SEQ ID NO: 501233 - RNA, 18 nt, Human
agggagagggguaggggg

SEQ ID NO: 501234 - RNA, 19 nt, Human
agggagccaacgagaagag

SEQ ID NO: 501235 - RNA, 21 nt, Human
agguagcagcgucuccagagc

SEQ ID NO: 501236 - RNA, 18 nt, Human
agugcagauacaaaagaa

SEQ ID NO: 501237 - RNA, 21 nt, Human
auaacguaaaucccaguccca

SEQ ID NO: 501238 - RNA, 19 nt, Human
aucccccucugcccugccu

SEQ ID NO: 501239 - RNA, 21 nt, Human
aucuagagacaaaucaugaga

SEQ ID NO: 501240 - RNA, 25 nt, Human
caagaaaaaggaugguuacacacaa

SEQ ID NO: 501241 - RNA, 18 nt, Human
caagacaagaguuggagc

SEQ ID NO: 501242 - RNA, 21 nt, Human
caagucccuugucccacuccc

SEQ ID NO: 501243 - RNA, 23 nt, Human
cacaagcacuuucccgcaccucc

SEQ ID NO: 501244 - RNA, 18 nt, Human
caccacauuucucuggcu

SEQ ID NO: 501245 - RNA, 19 nt, Human
caccuccuacacucccaaa

SEQ ID NO: 501246 - RNA, 20 nt, Human
caccuccuacacucccaaac

SEQ ID NO: 501247 - RNA, 19 nt, Human
cagaagggaugggauuggc

SEQ ID NO: 501248 - RNA, 21 nt, Human
cagagccugaucugggguccc

SEQ ID NO: 501249 - RNA, 24 nt, Human
cagagucaagucccuugucccacu

SEQ ID NO: 501250 - RNA, 18 nt, Human
cagcagagucaagucccu

SEQ ID NO: 501251 - RNA, 20 nt, Human
cagcagcaaggcgaggugag

SEQ ID NO: 501252 - RNA, 23 nt, Human
cagcccuggagguaaagggcaag

SEQ ID NO: 501253 - RNA, 22 nt, Human
cagcuaugcccuaaauuccacu

SEQ ID NO: 501254 - RNA, 22 nt, Human
cauaaaacaaaucaagaccaaa

SEQ ID NO: 501255 - RNA, 22 nt, Human
ccagagccugaucugggguccc

SEQ ID NO: 501256 - RNA, 21 nt, Human
ccagucuauuuucccuucuua

SEQ ID NO: 501257 - RNA, 20 nt, Human
cccagacagacagcugcagg

SEQ ID NO: 501258 - RNA, 18 nt, Human
ccccagaucccccucugc

SEQ ID NO: 501259 - RNA, 21 nt, Human
cccgcaccuccuacacuccca

SEQ ID NO: 501260 - RNA, 22 nt, Human
cccgcaccuccuacacucccaa

SEQ ID NO: 501261 - RNA, 24 nt, Human
cccggcccccccaccacauuucuc

SEQ ID NO: 501262 - RNA, 20 nt, Human
cccuaaauuccacuuaaucu

SEQ ID NO: 501263 - RNA, 24 nt, Human
ccggcccccccaccacauuucucu

SEQ ID NO: 501264 - RNA, 19 nt, Human
cggggagaggcugagucuu

SEQ ID NO: 501265 - RNA, 22 nt, Human
cucagaccuucuuagugaacuu

SEQ ID NO: 501266 - RNA, 25 nt, Human
cucauaaaacaaaucaagaccaaac

SEQ ID NO: 501267 - RNA, 23 nt, Human
cucccccuccccacucacagacc

SEQ ID NO: 501268 - RNA, 28 nt, Human
cucccucuaccccagaucccccucugcc

SEQ ID NO: 501269 - RNA, 20 nt, Human
cuccuugccuuuccagcucc

SEQ ID NO: 501270 - RNA, 20 nt, Human
cucugcuacuucuggugucu

SEQ ID NO: 501271 - RNA, 19 nt, Human
cucuggcuccauccgggga

SEQ ID NO: 501272 - RNA, 24 nt, Human
cuggaggcuggaguauccuggggu

SEQ ID NO: 501273 - RNA, 21 nt, Human
gaacuuggaauuaaagcagca

SEQ ID NO: 501274 - RNA, 22 nt, Human
gaauaaaucucccccuccccac

SEQ ID NO: 501275 - RNA, 22 nt, Human
gacaguguucugggucauagcc

SEQ ID NO: 501276 - RNA, 18 nt, Human
gagcaguuaacaccacua

SEQ ID NO: 501277 - RNA, 20 nt, Human
gcagauacaaaagaaaaaaa

SEQ ID NO: 501278 - RNA, 20 nt, Human
gcucugcuuuccgcgcuccc

SEQ ID NO: 501279 - RNA, 22 nt, Human
gcuuuccgcgcucccagggggu

SEQ ID NO: 501280 - RNA, 22 nt, Human
ggaaaaaaaaacacgagucaaa

SEQ ID NO: 501281 - RNA, 19 nt, Human
ggaaaccucaaggaugcuc

SEQ ID NO: 501282 - RNA, 20 nt, Human
ggacagagcugauucagggg

SEQ ID NO: 501283 - RNA, 22 nt, Human
ggcaaagaggaacagagaagaa

SEQ ID NO: 501284 - RNA, 19 nt, Human
ggccagagauugugggaga

SEQ ID NO: 501285 - RNA, 21 nt, Human
ggcuguggucuagggagccag

SEQ ID NO: 501286 - RNA, 20 nt, Human
gggaagaaauagaacuugga

SEQ ID NO: 501287 - RNA, 20 nt, Human
gggaugggauuggccuaaaa

SEQ ID NO: 501288 - RNA, 20 nt, Human
ggggagaccccauuccuggu

SEQ ID NO: 501289 - RNA, 20 nt, Human
ggggucccagauacccaggc

SEQ ID NO: 501290 - RNA, 20 nt, Human
gguccaggaaccaugaagcu

SEQ ID NO: 501291 - RNA, 19 nt, Human
guagcucuggcccccugcu

SEQ ID NO: 501292 - RNA, 23 nt, Human
gugggauugagaaugguaugugg

SEQ ID NO: 501293 - RNA, 23 nt, Human
uaaagcagcagcaaggcgaggag

SEQ ID NO: 501294 - RNA, 19 nt, Human
uaagccacaagcacuuucc

SEQ ID NO: 501295 - RNA, 26 nt, Human
uaagggaagaaauagaacuuggaaaa

SEQ ID NO: 501296 - RNA, 20 nt, Human
uaaugagccccuuaaauaga

SEQ ID NO: 501297 - RNA, 24 nt, Human
uaaugagccccuuaaauagaaauu

SEQ ID NO: 501298 - RNA, 18 nt, Human
uaggggguuggacacaag

SEQ ID NO: 501299 - RNA, 18 nt, Human
uauccagaagggauggga

SEQ ID NO: 501300 - RNA, 18 nt, Human
ucaaaaauagaagucacu

SEQ ID NO: 501301 - RNA, 21 nt, Human
uccacuacaaaaauacagagg

SEQ ID NO: 501302 - RNA, 24 nt, Human
ucccaaaccuuguuugaugccaag

SEQ ID NO: 501303 - RNA, 27 nt, Human
ucccagacucccagaggcuucagcucc

SEQ ID NO: 501304 - RNA, 20 nt, Human
ucccagaggcuucagcuccu

SEQ ID NO: 501305 - RNA, 18 nt, Human
ucuaggaaagauguaggg

SEQ ID NO: 501306 - RNA, 24 nt, Human
ucuccagagccugaucuggggucc

SEQ ID NO: 501307 - RNA, 20 nt, Human
ucucccccuccccacucaca

SEQ ID NO: 501308 - RNA, 20 nt, Human
ucucuggcuccauccgggga

SEQ ID NO: 501309 - RNA, 22 nt, Human
ugacaagaagcaaaaauauuug

SEQ ID NO: 501310 - RNA, 21 nt, Human
ugagaauaaaucucccccucc

SEQ ID NO: 501311 - RNA, 22 nt, Human
ugagaauaaaucucccccuccc

SEQ ID NO: 501312 - RNA, 18 nt, Human
ugagaaugcgauuucuag

SEQ ID NO: 501313 - RNA, 20 nt, Human
ugagaaugguauguggaucu

SEQ ID NO: 501314 - RNA, 23 nt, Human
ugauuuaacaucugguuauccag

SEQ ID NO: 501315 - RNA, 22 nt, Human
ugcauugcuauaacguaaaucc

SEQ ID NO: 501316 - RNA, 21 nt, Human
ugccaagaggaguagaacuuc

SEQ ID NO: 501317 - RNA, 19 nt, Human
ugccccggcccccccacca

SEQ ID NO: 501318 - RNA, 24 nt, Human
ugcccugccuuugagaaugccagc

SEQ ID NO: 501319 - RNA, 21 nt, Human
uggagguaaagggcaagcucc

SEQ ID NO: 501320 - RNA, 19 nt, Human
uggauuguuuuuguuucuu

SEQ ID NO: 501321 - RNA, 24 nt, Human
ugguauguggaucucuuuucuugg

SEQ ID NO: 501322 - RNA, 22 nt, Human
uggucuagggagccaggaaucu

SEQ ID NO: 501323 - RNA, 19 nt, Human
uguauaggaguuuaacugg

SEQ ID NO: 501324 - RNA, 21 nt, Human
uguuagggagagggguagggg

SEQ ID NO: 501325 - RNA, 22 nt, Human
uucaucugguucagcagaguca

SEQ ID NO: 501326 - RNA, 22 nt, Human
uuccacuuaaucuaagccacaa

SEQ ID NO: 501327 - RNA, 18 nt, Human
uuccuggucagccagcuu

SEQ ID NO: 501328 - RNA, 20 nt, Human
uugagaaugccagcaauuuc

SEQ ID NO: 501329 - RNA, 26 nt, Human
uuucccgcaccuccuacacucccaaa

SEQ ID NO: 501330 - RNA, 21 nt, Human
aggggccugggagcauagucc

SEQ ID NO: 501331 - RNA, 19 nt, Human
caagcucacagcccucugu

SEQ ID NO: 501332 - RNA, 18 nt, Human
cacccggggcuccggggc

SEQ ID NO: 501333 - RNA, 18 nt, Human
cagucuuagaaaaggggg

SEQ ID NO: 501334 - RNA, 22 nt, Human
cauccccaaggcaccccugggc

SEQ ID NO: 501335 - RNA, 19 nt, Human
ccauccaguucugucugca

SEQ ID NO: 501336 - RNA, 24 nt, Human
cccaccgccagcguuaccuggggc

SEQ ID NO: 501337 - RNA, 18 nt, Human
cuccuggcucugugugua

SEQ ID NO: 501338 - RNA, 18 nt, Human
cuccuggcucugugugua

SEQ ID NO: 501339 - RNA, 20 nt, Human
cucugucugggucucuuuca

SEQ ID NO: 501340 - RNA, 24 nt, Human
cucuguguguauuucccggguccu

SEQ ID NO: 501341 - RNA, 25 nt, Human
cugcuggggucuuggccggcucguc

SEQ ID NO: 501342 - RNA, 19 nt, Human
cugcuggggucuuggccuc

SEQ ID NO: 501343 - RNA, 21 nt, Human
cugcuggggucuuggccucac

SEQ ID NO: 501344 - RNA, 21 nt, Human
cuggaggcccacccaccgcca

SEQ ID NO: 501345 - RNA, 24 nt, Human
cuguaugugugucugcucuuugcu

SEQ ID NO: 501346 - RNA, 23 nt, Human
cugucugggucucuuucaggcug

SEQ ID NO: 501347 - RNA, 23 nt, Human
cugucugggucuguuucaggcug

SEQ ID NO: 501348 - RNA, 23 nt, Human
cugucugggucuguuucaggcug

SEQ ID NO: 501349 - RNA, 23 nt, Human
cugucugggucuguuucaggcug

SEQ ID NO: 501350 - RNA, 23 nt, Human
cugucugggucuguuucaggcug

SEQ ID NO: 501351 - RNA, 20 nt, Human
gagcauaguccuggcggggc

SEQ ID NO: 501352 - RNA, 21 nt, Human
gcgagggaggccgggaggggu

SEQ ID NO: 501353 - RNA, 21 nt, Human
gcgcacccggggcuccggggc

SEQ ID NO: 501354 - RNA, 20 nt, Human
ggcagucuuagaaaaggggg

SEQ ID NO: 501355 - RNA, 18 nt, Human
gggaggggucccugggcg

SEQ ID NO: 501356 - RNA, 27 nt, Human
uacuuuauuucggaucaggcagucuua

SEQ ID NO: 501357 - RNA, 19 nt, Human
ucacgucccauccccaggu

SEQ ID NO: 501358 - RNA, 20 nt, Human
uccaaagaccagggcgcacc

SEQ ID NO: 501359 - RNA, 18 nt, Human
ucccggguccuguggccc

SEQ ID NO: 501360 - RNA, 19 nt, Human
ucccggguccuguggcccu

SEQ ID NO: 501361 - RNA, 20 nt, Human
ucccggguccuguggcccuc

SEQ ID NO: 501362 - RNA, 21 nt, Human
ucucggcggcuuccuccuccc

SEQ ID NO: 501363 - RNA, 18 nt, Human
ucucugcuccaagcugga

SEQ ID NO: 501364 - RNA, 28 nt, Human
ucucugcuggggucuuggccggcucguc

SEQ ID NO: 501365 - RNA, 20 nt, Human
ucugccugucuguccagguc

SEQ ID NO: 501366 - RNA, 18 nt, Human
ucugggucuguuucaggc

SEQ ID NO: 501367 - RNA, 18 nt, Human
ucuguccaggucuguuuu

SEQ ID NO: 501368 - RNA, 20 nt, Human
ucugucugucuguccggguc

SEQ ID NO: 501369 - RNA, 20 nt, Human
ucugucugucuguccggguc

SEQ ID NO: 501370 - RNA, 20 nt, Human
ucugucugucuguccggguc

SEQ ID NO: 501371 - RNA, 20 nt, Human
ucugucugucuguccggguc

SEQ ID NO: 501372 - RNA, 19 nt, Human
ugccucccccauucuggca

SEQ ID NO: 501373 - RNA, 25 nt, Human
ugcuccaagcuggaggcccacccac

SEQ ID NO: 501374 - RNA, 27 nt, Human
ugcuccuggcucuguguguauuucccg

SEQ ID NO: 501375 - RNA, 24 nt, Human
ugcugcgcaucuguugugugugug

SEQ ID NO: 501376 - RNA, 19 nt, Human
ugggagcauaguccuggcg

SEQ ID NO: 501377 - RNA, 25 nt, Human
ugggcggggaguugcugcgcaucug

SEQ ID NO: 501378 - RNA, 19 nt, Human
uguaugugugucugcucuu

SEQ ID NO: 501379 - RNA, 19 nt, Human
uguccgggucuguuucagg

SEQ ID NO: 501380 - RNA, 19 nt, Human
uguccgggucuguuucagg

SEQ ID NO: 501381 - RNA, 19 nt, Human
uguccgggucuguuucagg

SEQ ID NO: 501382 - RNA, 19 nt, Human
uguccgggucuguuucagg

SEQ ID NO: 501383 - RNA, 19 nt, Human
uguccgggucuguuucagg

SEQ ID NO: 501384 - RNA, 22 nt, Human
ugucugccugucucucugucug

SEQ ID NO: 501385 - RNA, 22 nt, Human
ugucugggucuguuucaaucug

SEQ ID NO: 501386 - RNA, 22 nt, Human
ugucugggucuguuucaggcug

SEQ ID NO: 501387 - RNA, 22 nt, Human
ugucugggucuguuucaggcug

SEQ ID NO: 501388 - RNA, 26 nt, Human
ugucugggucuguuucaggcugucug

SEQ ID NO: 501389 - RNA, 22 nt, Human
ugugcgagggaggccgggaggg

SEQ ID NO: 501390 - RNA, 23 nt, Human
uguugugugugugcgucugucug

SEQ ID NO: 501391 - RNA, 23 nt, Human
uguuucaaucugugucugucugu

SEQ ID NO: 501392 - RNA, 27 nt, Human
uguuucagacuacgucugccugucugu

SEQ ID NO: 501393 - RNA, 20 nt, Human
uguuucaggcugugucuggg

SEQ ID NO: 501394 - RNA, 21 nt, Human
uucccggguccuguggcccuc

SEQ ID NO: 501395 - RNA, 23 nt, Human
uugucugggucuguuucaggcug

SEQ ID NO: 501396 - RNA, 23 nt, Human
uugugggccguggcugcuccaaa

SEQ ID NO: 501397 - RNA, 20 nt, Human
uugugugugugcgucugucu

SEQ ID NO: 501398 - RNA, 24 nt, Human
uuucaggcuguaugugugucugcu

SEQ ID NO: 501399 - RNA, 18 nt, Human
uuuuaggcugugucugcc

SEQ ID NO: 501400 - RNA, 22 nt, Human
acagggcacaggagcugcggcc

SEQ ID NO: 501401 - RNA, 25 nt, Human
caccgggccccaacguccgaagccc

SEQ ID NO: 501402 - RNA, 19 nt, Human
ccaccgggccccaacgucc

SEQ ID NO: 501403 - RNA, 20 nt, Human
ccccaacguccgaagcccag

SEQ ID NO: 501404 - RNA, 23 nt, Human
ccccaggcuccugcugagacccc

SEQ ID NO: 501405 - RNA, 23 nt, Human
cccccaggcuccugcugagaccc

SEQ ID NO: 501406 - RNA, 20 nt, Human
ccucgggcaccuauccaccc

SEQ ID NO: 501407 - RNA, 19 nt, Human
ccugcugagaccccccaca

SEQ ID NO: 501408 - RNA, 20 nt, Human
gcaccuauccacccucgugc

SEQ ID NO: 501409 - RNA, 21 nt, Human
gcccagacacgagccccagga

SEQ ID NO: 501410 - RNA, 18 nt, Human
gccccaacguccgaagcc

SEQ ID NO: 501411 - RNA, 23 nt, Human
gccccaggccagcuguaggccuc

SEQ ID NO: 501412 - RNA, 22 nt, Human
gggcacaggagcugcggccagc

SEQ ID NO: 501413 - RNA, 19 nt, Human
guccugacagggcacagga

SEQ ID NO: 501414 - RNA, 23 nt, Human
gugguguguuugagcccucaguc

SEQ ID NO: 501415 - RNA, 19 nt, Human
uauuuggacacagaugggg

SEQ ID NO: 501416 - RNA, 20 nt, Human
uugugguguguuugagcccu

SEQ ID NO: 501417 - RNA, 21 nt, Human
uuuuuuuuuuugugguguguu

SEQ ID NO: 501418 - RNA, 22 nt, Human
uuuuuuuuuuuuuuuguggugu

SEQ ID NO: 501419 - RNA, 19 nt, Human
uuuuuuuuuuuuuuuuugu

SEQ ID NO: 501420 - RNA, 21 nt, Human
uuuuuuuuuuuuuuuuugugg

SEQ ID NO: 501421 - RNA, 24 nt, Human
uuuuuuuuuuuuuuuuuuuuuggg

SEQ ID NO: 501422 - RNA, 23 nt, Human
aaaagaauaccaggaacacacaa

SEQ ID NO: 501423 - RNA, 28 nt, Human
aaacaagcaagcaaacaaaccggacccc

SEQ ID NO: 501424 - RNA, 21 nt, Human
aaacaagcaaguaaacaagca

SEQ ID NO: 501425 - RNA, 24 nt, Human
aagaaacuucauaaguguugcuaa

SEQ ID NO: 501426 - RNA, 24 nt, Human
aagaacacauacucaacuaccuuc

SEQ ID NO: 501427 - RNA, 24 nt, Human
aagcaaacaaaccagcaugugaca

SEQ ID NO: 501428 - RNA, 26 nt, Human
aagcaaacaaaccagcaugugacaga

SEQ ID NO: 501429 - RNA, 18 nt, Human
aagcaagcaaacaaacca

SEQ ID NO: 501430 - RNA, 20 nt, Human
aagcaaguaaacaagcaagg

SEQ ID NO: 501431 - RNA, 21 nt, Human
aagcuguggagagugguuugg

SEQ ID NO: 501432 - RNA, 24 nt, Human
aaguaaacaagcaagcaaacaaac

SEQ ID NO: 501433 - RNA, 24 nt, Human
agcaugugacagaaaacuggcuaa

SEQ ID NO: 501434 - RNA, 22 nt, Human
aggaggcagcuguggugaguga

SEQ ID NO: 501435 - RNA, 18 nt, Human
aggaguuuuaugacuuuc

SEQ ID NO: 501436 - RNA, 25 nt, Human
auucaguggcuugauuccugacauc

SEQ ID NO: 501437 - RNA, 27 nt, Human
caagagcaccacuggaaacuggagacc

SEQ ID NO: 501438 - RNA, 19 nt, Human
caagcaagcaaacaaacca

SEQ ID NO: 501439 - RNA, 23 nt, Human
caagcaaguaaacaagcaagcaa

SEQ ID NO: 501440 - RNA, 23 nt, Human
caaguaaacaagcaagcaaacaa

SEQ ID NO: 501441 - RNA, 23 nt, Human
caauccaguuuuggagccaaaaa

SEQ ID NO: 501442 - RNA, 22 nt, Human
caaugggcaauuuaaaacuggu

SEQ ID NO: 501443 - RNA, 24 nt, Human
cacaaaauauucuucuccucuuuc

SEQ ID NO: 501444 - RNA, 21 nt, Human
caccaggcucaggcagcucag

SEQ ID NO: 501445 - RNA, 19 nt, Human
caccauaaugggggccaau

SEQ ID NO: 501446 - RNA, 21 nt, Human
cagaagcaccauaaugggggc

SEQ ID NO: 501447 - RNA, 24 nt, Human
cagaagcaccauaaugggggccaa

SEQ ID NO: 501448 - RNA, 22 nt, Human
cagcacuagaagcuauuaagaa

SEQ ID NO: 501449 - RNA, 28 nt, Human
cauuccucuucaagagcaccacuggaaa

SEQ ID NO: 501450 - RNA, 20 nt, Human
cauuuccucuuuaagaggaa

SEQ ID NO: 501451 - RNA, 22 nt, Human
ccacuggaaacaucuuuggaau

SEQ ID NO: 501452 - RNA, 18 nt, Human
ccucuggugaccugacuu

SEQ ID NO: 501453 - RNA, 19 nt, Human
cugaagcugguccaugccu

SEQ ID NO: 501454 - RNA, 23 nt, Human
gaagaugugauucuuuuaaugcc

SEQ ID NO: 501455 - RNA, 20 nt, Human
gcaaacaaaccagcauguga

SEQ ID NO: 501456 - RNA, 21 nt, Human
gcucaggaggcagcuguggug

SEQ ID NO: 501457 - RNA, 20 nt, Human
gcuucaaaauaggaaaaaag

SEQ ID NO: 501458 - RNA, 22 nt, Human
gggcaguugaggaagccuuagg

SEQ ID NO: 501459 - RNA, 20 nt, Human
gguaauaauauuagugucuu

SEQ ID NO: 501460 - RNA, 21 nt, Human
gugagacauaaaucaacauga

SEQ ID NO: 501461 - RNA, 21 nt, Human
gugugcacauguguuuugaua

SEQ ID NO: 501462 - RNA, 18 nt, Human
guuugggaggggauuuug

SEQ ID NO: 501463 - RNA, 20 nt, Human
uaaaaagcuguggagagugg

SEQ ID NO: 501464 - RNA, 20 nt, Human
uaaaaagcuguggagagugg

SEQ ID NO: 501465 - RNA, 21 nt, Human
uaaaaagcuguggagaguggu

SEQ ID NO: 501466 - RNA, 19 nt, Human
uaaaagaauaccaggaaca

SEQ ID NO: 501467 - RNA, 23 nt, Human
uaaacaagcaaguaaacaagcaa

SEQ ID NO: 501468 - RNA, 21 nt, Human
uaaagaacacauacucaacua

SEQ ID NO: 501469 - RNA, 19 nt, Human
uaaucugugugcacaugug

SEQ ID NO: 501470 - RNA, 24 nt, Human
uaccaggaacacacaaaauauucu

SEQ ID NO: 501471 - RNA, 26 nt, Human
uagaagcuauuaagagauuuggggca

SEQ ID NO: 501472 - RNA, 20 nt, Human
uaggaaaaaaguagcuacca

SEQ ID NO: 501473 - RNA, 20 nt, Human
uauaaaagaauaccaggaac

SEQ ID NO: 501474 - RNA, 28 nt, Human
ucaaaauaggaaaaaaguagcuaccaca

SEQ ID NO: 501475 - RNA, 23 nt, Human
ucuuccaggaaauccaauaacag

SEQ ID NO: 501476 - RNA, 20 nt, Human
ucuuucuuuugcaauccagu

SEQ ID NO: 501477 - RNA, 23 nt, Human
ucuuucuuuugcaauccaguuuu

SEQ ID NO: 501478 - RNA, 20 nt, Human
ugaguaggaagcuccaucug

SEQ ID NO: 501479 - RNA, 18 nt, Human
uggagagugguuugggag

SEQ ID NO: 501480 - RNA, 18 nt, Human
uguggagagugguuuggg

SEQ ID NO: 501481 - RNA, 22 nt, Human
uuagauuguagcagcacuagaa

SEQ ID NO: 501482 - RNA, 24 nt, Human
uuagugucuucucuucugaagaug

SEQ ID NO: 501483 - RNA, 23 nt, Human
uuugcaccaggcucaggcagcuc

SEQ ID NO: 501484 - RNA, 20 nt, Human
aagagcucaugguauccacc

SEQ ID NO: 501485 - RNA, 27 nt, Human
aagaggccaaacuggguagugggcacc

SEQ ID NO: 501486 - RNA, 22 nt, Human
aagaggccaaacuggguauugc

SEQ ID NO: 501487 - RNA, 25 nt, Human
aaguacugaaggagaggaggccaga

SEQ ID NO: 501488 - RNA, 18 nt, Human
accaccuaauccuaagca

SEQ ID NO: 501489 - RNA, 23 nt, Human
agaaagaaaaaggucuguucuaa

SEQ ID NO: 501490 - RNA, 23 nt, Human
agaggccaaacuggguauugcag

SEQ ID NO: 501491 - RNA, 18 nt, Human
agcaugggguggagagga

SEQ ID NO: 501492 - RNA, 21 nt, Human
agcugugauggccccaccccu

SEQ ID NO: 501493 - RNA, 20 nt, Human
aggagaggaggccagagggg

SEQ ID NO: 501494 - RNA, 18 nt, Human
aggggcuguggggauggg

SEQ ID NO: 501495 - RNA, 22 nt, Human
aguacugaaggagaggaggcca

SEQ ID NO: 501496 - RNA, 23 nt, Human
caaaaauaaaccaagcuguccug

SEQ ID NO: 501497 - RNA, 21 nt, Human
caaaagaggccaaacugggua

SEQ ID NO: 501498 - RNA, 21 nt, Human
caaagcucuagcagccaccau

SEQ ID NO: 501499 - RNA, 18 nt, Human
caagggggcagaagucag

SEQ ID NO: 501500 - RNA, 21 nt, Human
cacggcccacgagccggcagg

SEQ ID NO: 501501 - RNA, 18 nt, Human
cagaacaggaacuggcag

SEQ ID NO: 501502 - RNA, 18 nt, Human
cagcccgcgggcgccgug

SEQ ID NO: 501503 - RNA, 18 nt, Human
caggagggagcugugaug

SEQ ID NO: 501504 - RNA, 20 nt, Human
caggagggcagcccaagcuc

SEQ ID NO: 501505 - RNA, 20 nt, Human
caggccccacgcgagaaaga

SEQ ID NO: 501506 - RNA, 22 nt, Human
ccaccccugugaggaccaccua

SEQ ID NO: 501507 - RNA, 19 nt, Human
ccccaggggccuugucugc

SEQ ID NO: 501508 - RNA, 23 nt, Human
ccccugugaggaccaccuaaucc

SEQ ID NO: 501509 - RNA, 18 nt, Human
ccgccaggugaagagcuc

SEQ ID NO: 501510 - RNA, 18 nt, Human
ccgccccagcccgcgggc

SEQ ID NO: 501511 - RNA, 18 nt, Human
ccggauccggauaugaag

SEQ ID NO: 501512 - RNA, 19 nt, Human
ccgggccuggguaccuggg

SEQ ID NO: 501513 - RNA, 21 nt, Human
ccugaguguccagcaggaggg

SEQ ID NO: 501514 - RNA, 18 nt, Human
ccuggguaccugggcugc

SEQ ID NO: 501515 - RNA, 23 nt, Human
cgcagaagggcaaaggcacggcc

SEQ ID NO: 501516 - RNA, 18 nt, Human
cggcccacgagccggcag

SEQ ID NO: 501517 - RNA, 22 nt, Human
cuaauccuaagcaggggccaaa

SEQ ID NO: 501518 - RNA, 20 nt, Human
cuguggggauggguggggaa

SEQ ID NO: 501519 - RNA, 18 nt, Human
cuucagggcuacuuuuua

SEQ ID NO: 501520 - RNA, 22 nt, Human
cuucagggcuacuuuuuacccc

SEQ ID NO: 501521 - RNA, 23 nt, Human
cuuuacccaggcuggggaccugc

SEQ ID NO: 501522 - RNA, 23 nt, Human
gagggcagcccaagcucuggggg

SEQ ID NO: 501523 - RNA, 18 nt, Human
gaugcaauuccagaagag

SEQ ID NO: 501524 - RNA, 20 nt, Human
gcaggggcuguggggauggg

SEQ ID NO: 501525 - RNA, 23 nt, Human
gccacggagaaggaagaagcgac

SEQ ID NO: 501526 - RNA, 19 nt, Human
gcgagaaagaaaaaggucu

SEQ ID NO: 501527 - RNA, 23 nt, Human
gcgcugggaucugcguuauuaca

SEQ ID NO: 501528 - RNA, 21 nt, Human
gcguggagaggcuucacugaa

SEQ ID NO: 501529 - RNA, 24 nt, Human
ggaggagguccuacaggugguggc

SEQ ID NO: 501530 - RNA, 24 nt, Human
ggagggcagcccaagcucuggggg

SEQ ID NO: 501531 - RNA, 19 nt, Human
ggccuugucugcccgggcc

SEQ ID NO: 501532 - RNA, 20 nt, Human
ggguauugcaggggcugugg

SEQ ID NO: 501533 - RNA, 18 nt, Human
ggguguggggauguggug

SEQ ID NO: 501534 - RNA, 21 nt, Human
guccugaguguccagcaggag

SEQ ID NO: 501535 - RNA, 21 nt, Human
uacaagcaaaagaggccaaac

SEQ ID NO: 501536 - RNA, 18 nt, Human
uacccaggcuggggaccu

SEQ ID NO: 501537 - RNA, 21 nt, Human
uaccccacucucaaaaauaaa

SEQ ID NO: 501538 - RNA, 24 nt, Human
uagcagccaccauuaaggaaaaac

SEQ ID NO: 501539 - RNA, 18 nt, Human
uagcaugggguggagagg

SEQ ID NO: 501540 - RNA, 26 nt, Human
uaggccacggagaaggaagaagcgac

SEQ ID NO: 501541 - RNA, 21 nt, Human
uccggauaugaagggaaggga

SEQ ID NO: 501542 - RNA, 19 nt, Human
uccugagaugaauaaauaa

SEQ ID NO: 501543 - RNA, 20 nt, Human
ucguaggccacggagaagga

SEQ ID NO: 501544 - RNA, 21 nt, Human
ugaacacagaacaggaacugg

SEQ ID NO: 501545 - RNA, 21 nt, Human
ugaaggagaggaggccagagg

SEQ ID NO: 501546 - RNA, 18 nt, Human
ugaagggaagggaucaga

SEQ ID NO: 501547 - RNA, 22 nt, Human
ugagaugaauaaauaaguggca

SEQ ID NO: 501548 - RNA, 23 nt, Human
ugaggaccaccuaauccuaagca

SEQ ID NO: 501549 - RNA, 21 nt, Human
uggcaaugggguguggggaug

SEQ ID NO: 501550 - RNA, 21 nt, Human
ugggaggagguccuacaggug

SEQ ID NO: 501551 - RNA, 21 nt, Human
ugggcugcucuguaaggcaga

SEQ ID NO: 501552 - RNA, 22 nt, Human
uggggauggguggggaaaggcg

SEQ ID NO: 501553 - RNA, 24 nt, Human
ugggguggagaggaaaguggccuc

SEQ ID NO: 501554 - RNA, 20 nt, Human
ugggguguggggauguggug

SEQ ID NO: 501555 - RNA, 20 nt, Human
ugucuugggggagguguccg

SEQ ID NO: 501556 - RNA, 25 nt, Human
uuaaggaaaaacuuuugaaauucac

SEQ ID NO: 501557 - RNA, 24 nt, Human
uuuacccaggcuggggaccugcag

SEQ ID NO: 501558 - RNA, 19 nt, Human
aacccgccgccgcgaccuc

SEQ ID NO: 501559 - RNA, 22 nt, Human
accucuccccaggcuggggugg

SEQ ID NO: 501560 - RNA, 23 nt, Human
agagcgcaggaagcaaacccgcc

SEQ ID NO: 501561 - RNA, 22 nt, Human
agcgagcgggugggcgaggggc

SEQ ID NO: 501562 - RNA, 20 nt, Human
agggagcggagggcagcuca

SEQ ID NO: 501563 - RNA, 19 nt, Human
agggcagcucaucucagag

SEQ ID NO: 501564 - RNA, 27 nt, Human
caacuccccccucccccgggcgcgccc

SEQ ID NO: 501565 - RNA, 20 nt, Human
cagacggggcacagccgggc

SEQ ID NO: 501566 - RNA, 19 nt, Human
cagcccccaacuccccccu

SEQ ID NO: 501567 - RNA, 23 nt, Human
caguaaacaguccuauuguacaa

SEQ ID NO: 501568 - RNA, 22 nt, Human
caucucagagcgcaggaagcaa

SEQ ID NO: 501569 - RNA, 22 nt, Human
cccaacuccccccucccccggg

SEQ ID NO: 501570 - RNA, 24 nt, Human
ccccaacuccccccucccccgggc

SEQ ID NO: 501571 - RNA, 21 nt, Human
cccccaacuccccccuccccc

SEQ ID NO: 501572 - RNA, 22 nt, Human
cccccaacuccccccucccccc

SEQ ID NO: 501573 - RNA, 19 nt, Human
cccccgggcgcgccacccc

SEQ ID NO: 501574 - RNA, 20 nt, Human
cccccgggcgcgccaccccg

SEQ ID NO: 501575 - RNA, 22 nt, Human
cccccgggcgcgccaccccgga

SEQ ID NO: 501576 - RNA, 21 nt, Human
cccgccgccgcgaccucuccc

SEQ ID NO: 501577 - RNA, 21 nt, Human
cgccgccgcgaccucucccca

SEQ ID NO: 501578 - RNA, 18 nt, Human
cggagggagcggagggca

SEQ ID NO: 501579 - RNA, 18 nt, Human
cugggaagcuauccagcc

SEQ ID NO: 501580 - RNA, 18 nt, Human
gcggagggcagcucaucu

SEQ ID NO: 501581 - RNA, 18 nt, Human
ggacguggguggagggag

SEQ ID NO: 501582 - RNA, 22 nt, Human
ggaggugggcaguaaacagucc

SEQ ID NO: 501583 - RNA, 20 nt, Human
gggcagcgagcgggugggcg

SEQ ID NO: 501584 - RNA, 19 nt, Human
gggcaguaaacaguccuau

SEQ ID NO: 501585 - RNA, 23 nt, Human
gggccgggcagcgagcggguggg

SEQ ID NO: 501586 - RNA, 21 nt, Human
ggggcucugagggugcuggga

SEQ ID NO: 501587 - RNA, 26 nt, Human
ggggugggcuggcaggcggagguggg

SEQ ID NO: 501588 - RNA, 20 nt, Human
ggugggcuggcaggcggagg

SEQ ID NO: 501589 - RNA, 21 nt, Human
gucaaccccgguucccuggcc

SEQ ID NO: 501590 - RNA, 19 nt, Human
uauuguacaaauauauagc

SEQ ID NO: 501591 - RNA, 19 nt, Human
uccccaggcuggggugggc

SEQ ID NO: 501592 - RNA, 21 nt, Human
uccccaggcuggggugggcug

SEQ ID NO: 501593 - RNA, 22 nt, Human
uccccaggcuggggugggcugg

SEQ ID NO: 501594 - RNA, 19 nt, Human
uccccccucccccgggcgc

SEQ ID NO: 501595 - RNA, 20 nt, Human
ucccccgggcgcgccacccc

SEQ ID NO: 501596 - RNA, 19 nt, Human
ucccuggcacggggacagg

SEQ ID NO: 501597 - RNA, 20 nt, Human
ugcugggaagcuauccagcc

SEQ ID NO: 501598 - RNA, 18 nt, Human
uggcccaggcgguguuga

SEQ ID NO: 501599 - RNA, 18 nt, Human
ugggagggccuagcugug

SEQ ID NO: 501600 - RNA, 18 nt, Human
uggggugggcuggcaggc

SEQ ID NO: 501601 - RNA, 23 nt, Human
uguggcccaggcgguguugagca

SEQ ID NO: 501602 - RNA, 19 nt, Human
uuuuuuuuuuuugcggggu

SEQ ID NO: 501603 - RNA, 18 nt, Human
uuuuuuuuuuuuugcggg

SEQ ID NO: 501604 - RNA, 18 nt, Human
aagaaaauaagguuuuuc

SEQ ID NO: 501605 - RNA, 18 nt, Human
aauaguugaagacagacu

SEQ ID NO: 501606 - RNA, 23 nt, Human
acagagcuccaauuucaugaaac

SEQ ID NO: 501607 - RNA, 23 nt, Human
accaguaaaucuucccaguucug

SEQ ID NO: 501608 - RNA, 20 nt, Human
accauaguuuucagcaaagc

SEQ ID NO: 501609 - RNA, 18 nt, Human
aguucugaaaaucugaag

SEQ ID NO: 501610 - RNA, 27 nt, Human
cagcaacacucuagcgaagccacgcca

SEQ ID NO: 501611 - RNA, 18 nt, Human
cagcucuuacaaaagaaa

SEQ ID NO: 501612 - RNA, 18 nt, Human
caggaaauaaacagcaac

SEQ ID NO: 501613 - RNA, 18 nt, Human
cccacaccuauauagggu

SEQ ID NO: 501614 - RNA, 24 nt, Human
cccacaccuauauaggguuaacca

SEQ ID NO: 501615 - RNA, 21 nt, Human
cugaaaaucugaagcaacuga

SEQ ID NO: 501616 - RNA, 23 nt, Human
gcagugacaaaaauuucccacac

SEQ ID NO: 501617 - RNA, 23 nt, Human
uaaaauaagacuagaaaauaauu

SEQ ID NO: 501618 - RNA, 23 nt, Human
uaaacagcaacacucuagcgaag

SEQ ID NO: 501619 - RNA, 23 nt, Human
uagcgaagccacgccaaccaaac

SEQ ID NO: 501620 - RNA, 25 nt, Human
uauacagagcuccaauuucaugaaa

SEQ ID NO: 501621 - RNA, 20 nt, Human
uaugcagugacaaaaauuuc

SEQ ID NO: 501622 - RNA, 21 nt, Human
uauuuugucuuuuucaguuua

SEQ ID NO: 501623 - RNA, 26 nt, Human
uguaaaauaagacuagaaaauaauuu

SEQ ID NO: 501624 - RNA, 21 nt, Human
uguuugcucccagcucuuaca

SEQ ID NO: 501625 - RNA, 23 nt, Human
uucccacaccuauauaggguuaa

SEQ ID NO: 501626 - RNA, 18 nt, Human
uucugaaaaucugaagca

SEQ ID NO: 501627 - RNA, 20 nt, Human
aaagaaccauucagcaauaa

SEQ ID NO: 501628 - RNA, 19 nt, Human
aaauucaguguauuuauuu

SEQ ID NO: 501629 - RNA, 21 nt, Human
aacuaaagaaccauucagcaa

SEQ ID NO: 501630 - RNA, 20 nt, Human
aagacuaguuacacuguugc

SEQ ID NO: 501631 - RNA, 23 nt, Human
aguaauauguuuuucuaaaauuc

SEQ ID NO: 501632 - RNA, 21 nt, Human
caaaaugaguaacaaucaaau

SEQ ID NO: 501633 - RNA, 25 nt, Human
caacagcagcagcagcagcaggcug

SEQ ID NO: 501634 - RNA, 21 nt, Human
cagcagcagcagcagcaggcu

SEQ ID NO: 501635 - RNA, 22 nt, Human
cagcagcagcagcagcaggcug

SEQ ID NO: 501636 - RNA, 23 nt, Human
cagcagcagcaggcugaaaacaa

SEQ ID NO: 501637 - RNA, 23 nt, Human
cagcaggcugaaaacaacaacac

SEQ ID NO: 501638 - RNA, 22 nt, Human
caggcugaaaacaacaacacua

SEQ ID NO: 501639 - RNA, 25 nt, Human
caggcugaaaacaacaacacuacaa

SEQ ID NO: 501640 - RNA, 18 nt, Human
cauucagcaauaauggcu

SEQ ID NO: 501641 - RNA, 25 nt, Human
ccaacuggucuuugauuugggucua

SEQ ID NO: 501642 - RNA, 20 nt, Human
ccuugaaaauucaaggcaga

SEQ ID NO: 501643 - RNA, 19 nt, Human
cuguaaguugacaucuaug

SEQ ID NO: 501644 - RNA, 21 nt, Human
gaaaacaacaacacuacaacu

SEQ ID NO: 501645 - RNA, 21 nt, Human
gcaggcugaaaacaacaacac

SEQ ID NO: 501646 - RNA, 27 nt, Human
uaaaaucauuuagaaagccagaaauuc

SEQ ID NO: 501647 - RNA, 22 nt, Human
uacaugcaacauggacaaacac

SEQ ID NO: 501648 - RNA, 22 nt, Human
ucaaggcagaaaguaaaaucau

SEQ ID NO: 501649 - RNA, 23 nt, Human
ugagagcaaaaugaguaacaauc

SEQ ID NO: 501650 - RNA, 23 nt, Human
ugaggggagaaauguuaacucug

SEQ ID NO: 501651 - RNA, 21 nt, Human
ugcaagaacaaauaaaaaaua

SEQ ID NO: 501652 - RNA, 22 nt, Human
uggucacauauuaaagaaacug

SEQ ID NO: 501653 - RNA, 21 nt, Human
uguucugguuuucaugacaau

SEQ ID NO: 501654 - RNA, 18 nt, Human
uuaaagaaacuggcacuu

SEQ ID NO: 501655 - RNA, 24 nt, Human
uuaauaacuaaagaaccauucagc

SEQ ID NO: 501656 - RNA, 20 nt, Human
uucucagagcagggauuuau

SEQ ID NO: 501657 - RNA, 23 nt, Human
aaaaaacccaaaacaccuaaauu

SEQ ID NO: 501658 - RNA, 22 nt, Human
aaaaaaggaaagagacugggua

SEQ ID NO: 501659 - RNA, 22 nt, Human
aaagagagagaaacagcgagag

SEQ ID NO: 501660 - RNA, 18 nt, Human
aaagagagagagagagca

SEQ ID NO: 501661 - RNA, 22 nt, Human
aaagagcagcucaaauuuugau

SEQ ID NO: 501662 - RNA, 25 nt, Human
aaaguaaagaauuaucccagguucu

SEQ ID NO: 501663 - RNA, 18 nt, Human
aaccacacacaacccccc

SEQ ID NO: 501664 - RNA, 24 nt, Human
aaccacacacaaccccccacccca

SEQ ID NO: 501665 - RNA, 27 nt, Human
aaccacacacaaccccccaccccaaaa

SEQ ID NO: 501666 - RNA, 21 nt, Human
aaccccccaccccaaaacuuu

SEQ ID NO: 501667 - RNA, 18 nt, Human
aaggauggauaggaaagg

SEQ ID NO: 501668 - RNA, 23 nt, Human
acacaaccccccaccccaaaacu

SEQ ID NO: 501669 - RNA, 18 nt, Human
accacacacaacccccca

SEQ ID NO: 501670 - RNA, 27 nt, Human
accccccaccccaaaacuuuaaaaauc

SEQ ID NO: 501671 - RNA, 23 nt, Human
agaaacagcgagagcgagcaagc

SEQ ID NO: 501672 - RNA, 20 nt, Human
agaaaccacacacaaccccc

SEQ ID NO: 501673 - RNA, 21 nt, Human
agagaaagagagagagagagc

SEQ ID NO: 501674 - RNA, 27 nt, Human
agagccucuccugagccaucucaauac

SEQ ID NO: 501675 - RNA, 22 nt, Human
agcaaaaaaggaaagagacugg

SEQ ID NO: 501676 - RNA, 20 nt, Human
agcaaaaugugagauggugg

SEQ ID NO: 501677 - RNA, 22 nt, Human
agcaagugagcaaggaauacaa

SEQ ID NO: 501678 - RNA, 21 nt, Human
agcgagacagacagagagaga

SEQ ID NO: 501679 - RNA, 19 nt, Human
aggacacugaagucucugg

SEQ ID NO: 501680 - RNA, 24 nt, Human
agguagaguugaaguaaauguucu

SEQ ID NO: 501681 - RNA, 21 nt, Human
auccagggggaacuggugcca

SEQ ID NO: 501682 - RNA, 24 nt, Human
caaaagccaaagagcagcucaaau

SEQ ID NO: 501683 - RNA, 21 nt, Human
caaaugcagaugauuaccucg

SEQ ID NO: 501684 - RNA, 24 nt, Human
caagaaugccacguucuacaaccu

SEQ ID NO: 501685 - RNA, 25 nt, Human
cacaaccccccaccccaaaacuuua

SEQ ID NO: 501686 - RNA, 18 nt, Human
cacacaaccccccacccc

SEQ ID NO: 501687 - RNA, 20 nt, Human
cacacacaaccccccacccc

SEQ ID NO: 501688 - RNA, 24 nt, Human
cacacacaaccccccaccccaaaa

SEQ ID NO: 501689 - RNA, 26 nt, Human
caccccaaaacuuuaaaaaucaaaga

SEQ ID NO: 501690 - RNA, 18 nt, Human
cagcaaaaaaggaaagag

SEQ ID NO: 501691 - RNA, 24 nt, Human
ccacacacaaccccccaccccaaa

SEQ ID NO: 501692 - RNA, 23 nt, Human
cccaaaacuuuaaaaaucaaaga

SEQ ID NO: 501693 - RNA, 22 nt, Human
cccuuauagcaaaagccaaaga

SEQ ID NO: 501694 - RNA, 24 nt, Human
ccuaaauuaaaauucaaaagaaag

SEQ ID NO: 501695 - RNA, 23 nt, Human
ccucuccugagccaucucaauac

SEQ ID NO: 501696 - RNA, 19 nt, Human
cgagacagacagagagaga

SEQ ID NO: 501697 - RNA, 24 nt, Human
cucaaagagagagaaacagcgaga

SEQ ID NO: 501698 - RNA, 19 nt, Human
gaacacuauucucuuuaaa

SEQ ID NO: 501699 - RNA, 20 nt, Human
gaaugccacguucuacaacc

SEQ ID NO: 501700 - RNA, 23 nt, Human
gacagcuuugcaguagccaaaug

SEQ ID NO: 501701 - RNA, 20 nt, Human
gagagagaaagagagagaga

SEQ ID NO: 501702 - RNA, 20 nt, Human
gagagagagagagaaagaga

SEQ ID NO: 501703 - RNA, 24 nt, Human
gcaaaagccaaagagcagcucaaa

SEQ ID NO: 501704 - RNA, 19 nt, Human
gccacguucuacaaccugc

SEQ ID NO: 501705 - RNA, 25 nt, Human
ggaaaggaaucuuucaggacacuga

SEQ ID NO: 501706 - RNA, 24 nt, Human
guaaugauccucuccauauucucu

SEQ ID NO: 501707 - RNA, 25 nt, Human
guucuuucucucuuccgaccaguaa

SEQ ID NO: 501708 - RNA, 19 nt, Human
uaaaggaaaaaaacccaaa

SEQ ID NO: 501709 - RNA, 21 nt, Human
uaaaggaaaaaaacccaaaac

SEQ ID NO: 501710 - RNA, 23 nt, Human
uaaaggaaaaaaacccaaaacac

SEQ ID NO: 501711 - RNA, 24 nt, Human
uagcaaaagccaaagagcagcuca

SEQ ID NO: 501712 - RNA, 19 nt, Human
ucaaaagaaagaaaccaca

SEQ ID NO: 501713 - RNA, 21 nt, Human
ucaauguaaugauccucucca

SEQ ID NO: 501714 - RNA, 18 nt, Human
ucagcaaaaaaggaaaga

SEQ ID NO: 501715 - RNA, 21 nt, Human
ucagcaaaaaaggaaagagac

SEQ ID NO: 501716 - RNA, 24 nt, Human
ucagcaaaaaaggaaagagacugg

SEQ ID NO: 501717 - RNA, 20 nt, Human
uccaaacaaaugccucaaag

SEQ ID NO: 501718 - RNA, 21 nt, Human
ucccagguucuugggcaucuc

SEQ ID NO: 501719 - RNA, 25 nt, Human
ucccuuauagcaaaagccaaagagc

SEQ ID NO: 501720 - RNA, 23 nt, Human
ugagcaaggaauacaacggacag

SEQ ID NO: 501721 - RNA, 24 nt, Human
ugcccaagaaugccacguucuaca

SEQ ID NO: 501722 - RNA, 23 nt, Human
uggaaggauggauaggaaaggaa

SEQ ID NO: 501723 - RNA, 24 nt, Human
uggggaaaaaguguucacuuaaaa

SEQ ID NO: 501724 - RNA, 23 nt, Human
uguaaugauccucuccauauucu

SEQ ID NO: 501725 - RNA, 19 nt, Human
uguucaagaugcucaaugg

SEQ ID NO: 501726 - RNA, 20 nt, Human
uucaaaagaaagaaaccaca

SEQ ID NO: 501727 - RNA, 22 nt, Human
uuuaaaggaaaaaaacccaaaa

SEQ ID NO: 501728 - RNA, 23 nt, Human
uuucccuuauagcaaaagccaaa

SEQ ID NO: 501729 - RNA, 19 nt, Human
uuugcaguagccaaaugca

SEQ ID NO: 501730 - RNA, 18 nt, Human
uuuuuuuuuuuuuuuuug

SEQ ID NO: 501731 - RNA, 24 nt, Human
uuuuuuuuuuuuuuuuuugaauuu

SEQ ID NO: 501732 - RNA, 21 nt, Human
aaacaaaaccauuuacacgcg

SEQ ID NO: 501733 - RNA, 19 nt, Human
aaaccaaacuacugcgcaa

SEQ ID NO: 501734 - RNA, 22 nt, Human
aaccaaacuacugcgcaaacca

SEQ ID NO: 501735 - RNA, 24 nt, Human
aacuacugcgcaaaccaaacgugc

SEQ ID NO: 501736 - RNA, 23 nt, Human
aagugcagcgucuccuaaggacc

SEQ ID NO: 501737 - RNA, 22 nt, Human
agaaaagcccgccgaggccaag

SEQ ID NO: 501738 - RNA, 22 nt, Human
agacaaggaggggaggggaagg

SEQ ID NO: 501739 - RNA, 21 nt, Human
agagaggccugugagcccagc

SEQ ID NO: 501740 - RNA, 20 nt, Human
agaguuggcucgaagcacag

SEQ ID NO: 501741 - RNA, 22 nt, Human
agcccagcccccuccaccaccc

SEQ ID NO: 501742 - RNA, 19 nt, Human
agccucgagccccgcccag

SEQ ID NO: 501743 - RNA, 20 nt, Human
agccucgagccccgcccagc

SEQ ID NO: 501744 - RNA, 18 nt, Human
aggaagaaguuauaggaa

SEQ ID NO: 501745 - RNA, 19 nt, Human
aggaagggcuggccagggc

SEQ ID NO: 501746 - RNA, 24 nt, Human
aggagcgcugagucucuguccagc

SEQ ID NO: 501747 - RNA, 21 nt, Human
aggcaaggggagugcugggag

SEQ ID NO: 501748 - RNA, 23 nt, Human
aggcaaggggagugcugggagug

SEQ ID NO: 501749 - RNA, 20 nt, Human
aggcggggaaaagagaggcc

SEQ ID NO: 501750 - RNA, 23 nt, Human
aggggaggggaaggggaaagggc

SEQ ID NO: 501751 - RNA, 23 nt, Human
auagggagggcuccguggguccc

SEQ ID NO: 501752 - RNA, 22 nt, Human
augcgugugugugugugugugu

SEQ ID NO: 501753 - RNA, 22 nt, Human
augcgugugugugugugugugu

SEQ ID NO: 501754 - RNA, 21 nt, Human
caaacgugcaaaacaaaacca

SEQ ID NO: 501755 - RNA, 19 nt, Human
caccaccccugcccugugc

SEQ ID NO: 501756 - RNA, 22 nt, Human
caccaccccugcccugugcugu

SEQ ID NO: 501757 - RNA, 24 nt, Human
caccacggggccuaaggggugggg

SEQ ID NO: 501758 - RNA, 21 nt, Human
caccccugcccugugcugucu

SEQ ID NO: 501759 - RNA, 24 nt, Human
cacuaaagucugggcuuucccaaa

SEQ ID NO: 501760 - RNA, 22 nt, Human
cagccacccccaucccugcccc

SEQ ID NO: 501761 - RNA, 21 nt, Human
cagcccagaagacugcaggcg

SEQ ID NO: 501762 - RNA, 22 nt, Human
cagcccagccucuccugccccu

SEQ ID NO: 501763 - RNA, 24 nt, Human
cagcccccuccaccaccccugccc

SEQ ID NO: 501764 - RNA, 18 nt, Human
cagccucgagccccgccc

SEQ ID NO: 501765 - RNA, 18 nt, Human
cagcuacccuucugggcc

SEQ ID NO: 501766 - RNA, 19 nt, Human
caggagaagcuggcgaggg

SEQ ID NO: 501767 - RNA, 20 nt, Human
caggaugcacaaacaaguca

SEQ ID NO: 501768 - RNA, 21 nt, Human
cagggcucuaugcauugggcu

SEQ ID NO: 501769 - RNA, 28 nt, Human
caucccugccccuacacagggccagagg

SEQ ID NO: 501770 - RNA, 23 nt, Human
caugcgugugugugugugugugu

SEQ ID NO: 501771 - RNA, 20 nt, Human
ccaaggcagaaaggacuaca

SEQ ID NO: 501772 - RNA, 24 nt, Human
ccaaggcagaaaggacuacagcag

SEQ ID NO: 501773 - RNA, 23 nt, Human
ccaccccugcccugugcugucug

SEQ ID NO: 501774 - RNA, 20 nt, Human
ccagcccagccucuccugcc

SEQ ID NO: 501775 - RNA, 21 nt, Human
ccagcccccuccaccaccccu

SEQ ID NO: 501776 - RNA, 20 nt, Human
ccagggccucccgcagccca

SEQ ID NO: 501777 - RNA, 28 nt, Human
ccaugcgugugugugugugugugugugu

SEQ ID NO: 501778 - RNA, 19 nt, Human
cccagccacccccaucccu

SEQ ID NO: 501779 - RNA, 19 nt, Human
cccccuccaccaccccugc

SEQ ID NO: 501780 - RNA, 21 nt, Human
cccccuccaccaccccugccc

SEQ ID NO: 501781 - RNA, 19 nt, Human
ccccgcccagcuacccuuc

SEQ ID NO: 501782 - RNA, 21 nt, Human
ccccuacacagggccagaggu

SEQ ID NO: 501783 - RNA, 18 nt, Human
cccggggccccccucggg

SEQ ID NO: 501784 - RNA, 19 nt, Human
ccgcagcccagaagacugc

SEQ ID NO: 501785 - RNA, 18 nt, Human
ccgcggcgccggagcugc

SEQ ID NO: 501786 - RNA, 23 nt, Human
ccgcgucgacccucucucagcag

SEQ ID NO: 501787 - RNA, 20 nt, Human
ccggggccccccucgggugg

SEQ ID NO: 501788 - RNA, 24 nt, Human
ccuccgagaugcugcggccgcggg

SEQ ID NO: 501789 - RNA, 20 nt, Human
ccugcagcuucggcuggaga

SEQ ID NO: 501790 - RNA, 18 nt, Human
ccugccccuacacagggc

SEQ ID NO: 501791 - RNA, 19 nt, Human
ccugccccugcagcuucgg

SEQ ID NO: 501792 - RNA, 28 nt, Human
ccuggcaccagccucgagccccgcccag

SEQ ID NO: 501793 - RNA, 20 nt, Human
ccugggcauggcugggaagc

SEQ ID NO: 501794 - RNA, 21 nt, Human
cgcaaaccaaacgugcaaaac

SEQ ID NO: 501795 - RNA, 23 nt, Human
cgcaaaccaaacgugcaaaacaa

SEQ ID NO: 501796 - RNA, 24 nt, Human
cgccgaggccaaggcagaaaggac

SEQ ID NO: 501797 - RNA, 22 nt, Human
cgccucagcgcgcccagcgcgg

SEQ ID NO: 501798 - RNA, 23 nt, Human
cggagcugcgggugcucggggcg

SEQ ID NO: 501799 - RNA, 24 nt, Human
cggaggcaggagugagaggaaggg

SEQ ID NO: 501800 - RNA, 19 nt, Human
cggccgcgggggcccgugg

SEQ ID NO: 501801 - RNA, 23 nt, Human
cggccgcgucgacccucucucag

SEQ ID NO: 501802 - RNA, 23 nt, Human
cggguggugugccacccagccca

SEQ ID NO: 501803 - RNA, 18 nt, Human
cggugcguccucacucgg

SEQ ID NO: 501804 - RNA, 18 nt, Human
cucaaagugccuguuaga

SEQ ID NO: 501805 - RNA, 22 nt, Human
cuccaccaccccugcccugugc

SEQ ID NO: 501806 - RNA, 23 nt, Human
cuccuaaggaccacaucuauucc

SEQ ID NO: 501807 - RNA, 25 nt, Human
cugcacgcgcgcucgcucgggggcc

SEQ ID NO: 501808 - RNA, 23 nt, Human
cugccccugcagcuucggcugga

SEQ ID NO: 501809 - RNA, 24 nt, Human
cuggcaccagccucgagccccgcc

SEQ ID NO: 501810 - RNA, 19 nt, Human
gaagacaggggaaggcaag

SEQ ID NO: 501811 - RNA, 21 nt, Human
gagaggggaaaggacaccugc

SEQ ID NO: 501812 - RNA, 19 nt, Human
gagcccagcccccuccacc

SEQ ID NO: 501813 - RNA, 19 nt, Human
gagccccgcccagcuaccc

SEQ ID NO: 501814 - RNA, 24 nt, Human
gagucucuguccagcaggaagaag

SEQ ID NO: 501815 - RNA, 22 nt, Human
gcccagcccccuccaccacccc

SEQ ID NO: 501816 - RNA, 21 nt, Human
gccccagaaaagcccgccgag

SEQ ID NO: 501817 - RNA, 24 nt, Human
gccugugagcccagcccccuccac

SEQ ID NO: 501818 - RNA, 23 nt, Human
gcgcaaaccaaacgugcaaaaca

SEQ ID NO: 501819 - RNA, 25 nt, Human
gcgcucgcucgggggccgccucagc

SEQ ID NO: 501820 - RNA, 18 nt, Human
gcgggcugguggcggcgg

SEQ ID NO: 501821 - RNA, 21 nt, Human
gcuauucuaugcuagugacac

SEQ ID NO: 501822 - RNA, 18 nt, Human
ggaaggcaaggggagugc

SEQ ID NO: 501823 - RNA, 19 nt, Human
ggagugagaggaagggcug

SEQ ID NO: 501824 - RNA, 21 nt, Human
ggagugcugggagugaucagg

SEQ ID NO: 501825 - RNA, 22 nt, Human
ggccccagaaaagcccgccgag

SEQ ID NO: 501826 - RNA, 21 nt, Human
gggggcccguggcucgguccg

SEQ ID NO: 501827 - RNA, 20 nt, Human
gugugggcggggcgcaggag

SEQ ID NO: 501828 - RNA, 21 nt, Human
gugugugugugugugugugug

SEQ ID NO: 501829 - RNA, 21 nt, Human
gugugugugugugugugugug

SEQ ID NO: 501830 - RNA, 21 nt, Human
gugugugugugugugugugug

SEQ ID NO: 501831 - RNA, 20 nt, Human
uacacagggccagagguggg

SEQ ID NO: 501832 - RNA, 22 nt, Human
uagaguuggcucgaagcacagu

SEQ ID NO: 501833 - RNA, 20 nt, Human
ucacucggggggcuuggcaa

SEQ ID NO: 501834 - RNA, 20 nt, Human
ucccagccacccccaucccc

SEQ ID NO: 501835 - RNA, 20 nt, Human
ucccggggccccccucgggu

SEQ ID NO: 501836 - RNA, 18 nt, Human
uccgagaugcugcggccg

SEQ ID NO: 501837 - RNA, 19 nt, Human
uccgagaugcugcggccgc

SEQ ID NO: 501838 - RNA, 23 nt, Human
uccugggccccagaaaagcccgc

SEQ ID NO: 501839 - RNA, 19 nt, Human
ucggggcggcggcggcugc

SEQ ID NO: 501840 - RNA, 24 nt, Human
ucucuggggcuagcaucccaggcc

SEQ ID NO: 501841 - RNA, 22 nt, Human
ugcaaaacaaaaccauuuacac

SEQ ID NO: 501842 - RNA, 22 nt, Human
ugcaggcggggaaaagagaggc

SEQ ID NO: 501843 - RNA, 24 nt, Human
ugcccugugcugucugguuggugu

SEQ ID NO: 501844 - RNA, 21 nt, Human
ugcgcaaaccaaacgugcaaa

SEQ ID NO: 501845 - RNA, 22 nt, Human
ugcgggugcucggggcggcggc

SEQ ID NO: 501846 - RNA, 25 nt, Human
ugcgugugugugugugugugugugg

SEQ ID NO: 501847 - RNA, 24 nt, Human
ugcugcggccgcgggggcccgugg

SEQ ID NO: 501848 - RNA, 22 nt, Human
ugcugggagugaucaggggcag

SEQ ID NO: 501849 - RNA, 21 nt, Human
uggcaucucuggggcuagcau

SEQ ID NO: 501850 - RNA, 18 nt, Human
uggcucgaagcacaguga

SEQ ID NO: 501851 - RNA, 18 nt, Human
ugggaaacuagacaagga

SEQ ID NO: 501852 - RNA, 22 nt, Human
ugggaaaugucaccacggggcc

SEQ ID NO: 501853 - RNA, 25 nt, Human
ugugcugucugguuggugucaagug

SEQ ID NO: 501854 - RNA, 21 nt, Human
ugugugugugugguggcaggu

SEQ ID NO: 501855 - RNA, 20 nt, Human
ugugugugugugugguggca

SEQ ID NO: 501856 - RNA, 18 nt, Human
ugugugugugugugugug

SEQ ID NO: 501857 - RNA, 18 nt, Human
ugugugugugugugugug

SEQ ID NO: 501858 - RNA, 18 nt, Human
ugugugugugugugugug

SEQ ID NO: 501859 - RNA, 18 nt, Human
ugugugugugugugugug

SEQ ID NO: 501860 - RNA, 18 nt, Human
ugugugugugugugugug

SEQ ID NO: 501861 - RNA, 18 nt, Human
ugugugugugugugugug

SEQ ID NO: 501862 - RNA, 18 nt, Human
ugugugugugugugugug

SEQ ID NO: 501863 - RNA, 18 nt, Human
ugugugugugugugugug

SEQ ID NO: 501864 - RNA, 20 nt, Human
ugugugugugugugugugug

SEQ ID NO: 501865 - RNA, 21 nt, Human
ugugugugugugugugugugu

SEQ ID NO: 501866 - RNA, 21 nt, Human
ugugugugugugugugugugu

SEQ ID NO: 501867 - RNA, 21 nt, Human
ugugugugugugugugugugu

SEQ ID NO: 501868 - RNA, 21 nt, Human
ugugugugugugugugugugu

SEQ ID NO: 501869 - RNA, 21 nt, Human
ugugugugugugugugugugu

SEQ ID NO: 501870 - RNA, 21 nt, Human
ugugugugugugugugugugu

SEQ ID NO: 501871 - RNA, 21 nt, Human
ugugugugugugugugugugu

SEQ ID NO: 501872 - RNA, 21 nt, Human
ugugugugugugugugugugu

SEQ ID NO: 501873 - RNA, 21 nt, Human
ugugugugugugugugugugu

SEQ ID NO: 501874 - RNA, 21 nt, Human
ugugugugugugugugugugu

SEQ ID NO: 501875 - RNA, 21 nt, Human
ugugugugugugugugugugu

SEQ ID NO: 501876 - RNA, 21 nt, Human
ugugugugugugugugugugu

SEQ ID NO: 501877 - RNA, 22 nt, Human
ugugugugugugugugugugug

SEQ ID NO: 501878 - RNA, 22 nt, Human
ugugugugugugugugugugug

SEQ ID NO: 501879 - RNA, 22 nt, Human
ugugugugugugugugugugug

SEQ ID NO: 501880 - RNA, 22 nt, Human
ugugugugugugugugugugug

SEQ ID NO: 501881 - RNA, 24 nt, Human
uucacaggaugcacaaacaaguug

SEQ ID NO: 501882 - RNA, 19 nt, Human
aaaaauaacaaaacauuug

SEQ ID NO: 501883 - RNA, 22 nt, Human
aagguaaauuauuaauccacuc

SEQ ID NO: 501884 - RNA, 24 nt, Human
aaucacugcaaauuauuuuccaaa

SEQ ID NO: 501885 - RNA, 22 nt, Human
aaugacuccauuguccacuaag

SEQ ID NO: 501886 - RNA, 22 nt, Human
accuuaaaaauacaguucuagu

SEQ ID NO: 501887 - RNA, 21 nt, Human
aggggaaaacaaccuuaaaaa

SEQ ID NO: 501888 - RNA, 18 nt, Human
agguauuacaaacucaac

SEQ ID NO: 501889 - RNA, 22 nt, Human
auagcacacacgugaacaagcc

SEQ ID NO: 501890 - RNA, 22 nt, Human
caaggaaugaaaccauuuuuaa

SEQ ID NO: 501891 - RNA, 19 nt, Human
cacacacgugaacaagcca

SEQ ID NO: 501892 - RNA, 26 nt, Human
cacaguccagguuaaaggaaaacucu

SEQ ID NO: 501893 - RNA, 20 nt, Human
cagugaacaaagaaaaaaug

SEQ ID NO: 501894 - RNA, 22 nt, Human
cauuagaaaaguuuggacucag

SEQ ID NO: 501895 - RNA, 20 nt, Human
ccacuaaguuugggaaauaa

SEQ ID NO: 501896 - RNA, 22 nt, Human
ccacucgcauucaauucuacaa

SEQ ID NO: 501897 - RNA, 20 nt, Human
cccaagagcauuuaaaaaau

SEQ ID NO: 501898 - RNA, 21 nt, Human
cccaagagcauuuaaaaaaua

SEQ ID NO: 501899 - RNA, 22 nt, Human
ccuaccccuagcuaacccaaga

SEQ ID NO: 501900 - RNA, 23 nt, Human
ccuaccccuagcuaacccaagag

SEQ ID NO: 501901 - RNA, 22 nt, Human
cuuguucagaaauauaaucacu

SEQ ID NO: 501902 - RNA, 20 nt, Human
gaacaugggacaucauuuuu

SEQ ID NO: 501903 - RNA, 19 nt, Human
gcucuaaaccaagaguaag

SEQ ID NO: 501904 - RNA, 22 nt, Human
ggaaaacaaccuuaaaaauaca

SEQ ID NO: 501905 - RNA, 21 nt, Human
gggaaaacaaccuuaaaaaua

SEQ ID NO: 501906 - RNA, 23 nt, Human
uaaaaauaacaaaacauuugucu

SEQ ID NO: 501907 - RNA, 26 nt, Human
uaaucacugcaaauuauuuuccaagu

SEQ ID NO: 501908 - RNA, 18 nt, Human
uacaaggaaugaaaccau

SEQ ID NO: 501909 - RNA, 21 nt, Human
uacucuagguagaaaugacuc

SEQ ID NO: 501910 - RNA, 23 nt, Human
uagaacaaacaauuuacugagca

SEQ ID NO: 501911 - RNA, 24 nt, Human
uagagauucucuucccaaagagug

SEQ ID NO: 501912 - RNA, 18 nt, Human
uagccaucaaagauacca

SEQ ID NO: 501913 - RNA, 25 nt, Human
uauggcaacauugcuacuggagaua

SEQ ID NO: 501914 - RNA, 18 nt, Human
ugaacaaagaaaaaaugu

SEQ ID NO: 501915 - RNA, 19 nt, Human
uggcagagcugggaaauga

SEQ ID NO: 501916 - RNA, 23 nt, Human
uggcuuagaacaaacaauuuacu

SEQ ID NO: 501917 - RNA, 19 nt, Human
ugggaaauaaauaauaugg

SEQ ID NO: 501918 - RNA, 21 nt, Human
ugggaaauaaauaauauggca

SEQ ID NO: 501919 - RNA, 22 nt, Human
ugggaaauaaauaauauggcaa

SEQ ID NO: 501920 - RNA, 19 nt, Human
uuacugagcacuuacuaug

SEQ ID NO: 501921 - RNA, 22 nt, Human
uucaaaaugagcugucaaacua

SEQ ID NO: 501922 - RNA, 20 nt, Human
uucuaaaaaacaauauaacu

SEQ ID NO: 501923 - RNA, 19 nt, Human
uuggcccauuuugugaaug

SEQ ID NO: 501924 - RNA, 21 nt, Human
uugggcagugaacaaagaaaa

SEQ ID NO: 501925 - RNA, 24 nt, Human
uuuaggggaaaacaaccuuaaaaa

SEQ ID NO: 501926 - RNA, 26 nt, Human
uuucauagcacacacgugaacaagcc

SEQ ID NO: 501927 - RNA, 21 nt, Human
uuucccaaauuuaugugaaca

SEQ ID NO: 501928 - RNA, 23 nt, Human
aagcuggguccuccccacuucau

SEQ ID NO: 501929 - RNA, 24 nt, Human
agaggaugugggaaucccagcuca

SEQ ID NO: 501930 - RNA, 22 nt, Human
aggagcugguuugacuucaacu

SEQ ID NO: 501931 - RNA, 19 nt, Human
augaggcugcuucuucuug

SEQ ID NO: 501932 - RNA, 20 nt, Human
caaaugaggcugcuucuucu

SEQ ID NO: 501933 - RNA, 20 nt, Human
caccagaaaacaaaugaggc

SEQ ID NO: 501934 - RNA, 18 nt, Human
cagugggcuuccugggcu

SEQ ID NO: 501935 - RNA, 22 nt, Human
ccaaaagccauagguggccacc

SEQ ID NO: 501936 - RNA, 23 nt, Human
cccaaaagccauagguggccacc

SEQ ID NO: 501937 - RNA, 26 nt, Human
cccaaaagccauagguggccaccuac

SEQ ID NO: 501938 - RNA, 18 nt, Human
cccagcuccaggcuucug

SEQ ID NO: 501939 - RNA, 19 nt, Human
cuggaagcuggguccuccc

SEQ ID NO: 501940 - RNA, 19 nt, Human
ggaugcccagcuccaggcu

SEQ ID NO: 501941 - RNA, 22 nt, Human
guacagugggcuuccugggcug

SEQ ID NO: 501942 - RNA, 18 nt, Human
uagccucaucuuucaguc

SEQ ID NO: 501943 - RNA, 22 nt, Human
uaggauggacaggcuguggaua

SEQ ID NO: 501944 - RNA, 24 nt, Human
uagguggccaccuacgaugacacc

SEQ ID NO: 501945 - RNA, 25 nt, Human
ucccaaaagccauagguggccaccu

SEQ ID NO: 501946 - RNA, 23 nt, Human
ucccagauggcuccagguacagu

SEQ ID NO: 501947 - RNA, 25 nt, Human
uccuccccacuucauucugcucaaa

SEQ ID NO: 501948 - RNA, 22 nt, Human
uggaugcccagcuccaggcuuc

SEQ ID NO: 501949 - RNA, 18 nt, Human
ugggaugggcuaggaugg

SEQ ID NO: 501950 - RNA, 23 nt, Human
ugggaugggcuaggauggacagg

SEQ ID NO: 501951 - RNA, 20 nt, Human
aaaacaaccaacucucaaac

SEQ ID NO: 501952 - RNA, 22 nt, Human
aaaaccaccugaaauggaaauc

SEQ ID NO: 501953 - RNA, 23 nt, Human
aaccaccugaaauggaaauccaa

SEQ ID NO: 501954 - RNA, 20 nt, Human
auucaaguugcacuuggcug

SEQ ID NO: 501955 - RNA, 22 nt, Human
caacucucaaacaaaagaggaa

SEQ ID NO: 501956 - RNA, 22 nt, Human
caccacagcucaaggugaccgg

SEQ ID NO: 501957 - RNA, 19 nt, Human
cacuuagaaaaccaccuga

SEQ ID NO: 501958 - RNA, 21 nt, Human
cacuuagaaaaccaccugaaa

SEQ ID NO: 501959 - RNA, 21 nt, Human
cagaaaacgcaaugucuagga

SEQ ID NO: 501960 - RNA, 23 nt, Human
cagcacccagcucugugaccaag

SEQ ID NO: 501961 - RNA, 20 nt, Human
cagcucaaggugaccggcag

SEQ ID NO: 501962 - RNA, 20 nt, Human
ccaacucucaaacaaaagaa

SEQ ID NO: 501963 - RNA, 19 nt, Human
ccccgcgcccggcgccccc

SEQ ID NO: 501964 - RNA, 21 nt, Human
ccccggcccgcccgccucuca

SEQ ID NO: 501965 - RNA, 24 nt, Human
ccugaaauggaaauccaacagccc

SEQ ID NO: 501966 - RNA, 23 nt, Human
ccuuugaucccagaguccaugcg

SEQ ID NO: 501967 - RNA, 25 nt, Human
cggcagcacccagcucugugacugg

SEQ ID NO: 501968 - RNA, 25 nt, Human
cgggagccaccacagcucaaggucg

SEQ ID NO: 501969 - RNA, 18 nt, Human
gaccggcagcacccagcu

SEQ ID NO: 501970 - RNA, 21 nt, Human
gacgugaugggaacuugggag

SEQ ID NO: 501971 - RNA, 22 nt, Human
gaggaaagagccuuugauccca

SEQ ID NO: 501972 - RNA, 20 nt, Human
gaggacauggccgaaccccg

SEQ ID NO: 501973 - RNA, 24 nt, Human
gaggacauggccgaaccccggaca

SEQ ID NO: 501974 - RNA, 18 nt, Human
ggaauuccuccaaaugcu

SEQ ID NO: 501975 - RNA, 18 nt, Human
ggcaucguaagcgcuacc

SEQ ID NO: 501976 - RNA, 19 nt, Human
gggagccaccacagcucaa

SEQ ID NO: 501977 - RNA, 19 nt, Human
uaaaauagaaacauacauu

SEQ ID NO: 501978 - RNA, 19 nt, Human
uccaaaugcuuccaaaaau

SEQ ID NO: 501979 - RNA, 21 nt, Human
uccauacguguuugaaauuca

SEQ ID NO: 501980 - RNA, 22 nt, Human
ugaaauggaaauccaacagccc

SEQ ID NO: 501981 - RNA, 20 nt, Human
uggccgaaccccggacacuc

SEQ ID NO: 501982 - RNA, 18 nt, Human
uggcggcagcccgggcgg

SEQ ID NO: 501983 - RNA, 24 nt, Human
uuuuuuuuuuuuuuuuuuuauuuu

SEQ ID NO: 501984 - RNA, 21 nt, Human
aaaaauacaaacaaaaacaac

SEQ ID NO: 501985 - RNA, 20 nt, Human
aaacaaaaacaacggcuaga

SEQ ID NO: 501986 - RNA, 18 nt, Human
aaacugccaguugaccuu

SEQ ID NO: 501987 - RNA, 20 nt, Human
aagauuauaaaaauugaaga

SEQ ID NO: 501988 - RNA, 22 nt, Human
aagucuuucgcaaugccaauuc

SEQ ID NO: 501989 - RNA, 21 nt, Human
acuacagugugaucgcauuca

SEQ ID NO: 501990 - RNA, 18 nt, Human
agaauaggaaagacugaa

SEQ ID NO: 501991 - RNA, 19 nt, Human
agacaaaaauauagauagg

SEQ ID NO: 501992 - RNA, 18 nt, Human
agacugaaagugccaaug

SEQ ID NO: 501993 - RNA, 23 nt, Human
agagugucaaccugcaaaagcaa

SEQ ID NO: 501994 - RNA, 24 nt, Human
aucagacucgagcucugggaauau

SEQ ID NO: 501995 - RNA, 27 nt, Human
caaaauuaacaaugucucucaaaaucc

SEQ ID NO: 501996 - RNA, 21 nt, Human
caaagguaauaaaacugccag

SEQ ID NO: 501997 - RNA, 22 nt, Human
caaugacaagucauuugaucac

SEQ ID NO: 501998 - RNA, 18 nt, Human
cagauuuaaaagguuuga

SEQ ID NO: 501999 - RNA, 19 nt, Human
caucaucugucaggugaga

SEQ ID NO: 502000 - RNA, 22 nt, Human
cgcaaugccaauucccccaaaa

SEQ ID NO: 502001 - RNA, 24 nt, Human
cuguacuaucacccccgccuuucc

SEQ ID NO: 502002 - RNA, 19 nt, Human
cuucuacuauaucacuaca

SEQ ID NO: 502003 - RNA, 23 nt, Human
ggcuagaauaggaaagacugaaa

SEQ ID NO: 502004 - RNA, 22 nt, Human
gggcagaggggcggagaccucu

SEQ ID NO: 502005 - RNA, 24 nt, Human
gucuuucgcaaugccaauuccccc

SEQ ID NO: 502006 - RNA, 23 nt, Human
guuauuuucuuacauggcuucca

SEQ ID NO: 502007 - RNA, 21 nt, Human
uaaaaagaauaugaagccuug

SEQ ID NO: 502008 - RNA, 19 nt, Human
uacaaacaaaaacaacggc

SEQ ID NO: 502009 - RNA, 21 nt, Human
uacuugaucucuuagagacaa

SEQ ID NO: 502010 - RNA, 24 nt, Human
uaggaaagacugaaagugccaaug

SEQ ID NO: 502011 - RNA, 19 nt, Human
uaggggcagaggggcggag

SEQ ID NO: 502012 - RNA, 23 nt, Human
ucauuuuaaaaagaauaugaagc

SEQ ID NO: 502013 - RNA, 18 nt, Human
uccacaguacagucuggc

SEQ ID NO: 502014 - RNA, 20 nt, Human
ucgcauucagauuuaaaagg

SEQ ID NO: 502015 - RNA, 24 nt, Human
ucucuauuauucugaaaaucuacc

SEQ ID NO: 502016 - RNA, 18 nt, Human
ucucuuagagacaaaaau

SEQ ID NO: 502017 - RNA, 24 nt, Human
ucucuuagagacaaaaauauagau

SEQ ID NO: 502018 - RNA, 18 nt, Human
uggcuuccaacuaauuuu

SEQ ID NO: 502019 - RNA, 20 nt, Human
uucagauuuaaaagguuuga

SEQ ID NO: 502020 - RNA, 19 nt, Human
uugaccuugauagaaacua

SEQ ID NO: 502021 - RNA, 21 nt, Human
uugaccuugauagaaacuaug

SEQ ID NO: 502022 - RNA, 23 nt, Human
uugaucacagauaccucuauguu

SEQ ID NO: 502023 - RNA, 19 nt, Human
uuguuaugaauaugaacaa

SEQ ID NO: 502024 - RNA, 23 nt, Human
uuuaaaauaauauaucugaagac

SEQ ID NO: 502025 - RNA, 21 nt, Human
aagauucuauucuuaaucccc

SEQ ID NO: 502026 - RNA, 19 nt, Human
aagcccagugagaggcacu

SEQ ID NO: 502027 - RNA, 18 nt, Human
accacgggccacguugac

SEQ ID NO: 502028 - RNA, 24 nt, Human
accucaucgcucaggaugucuucc

SEQ ID NO: 502029 - RNA, 19 nt, Human
acuaaaguccucauacuuc

SEQ ID NO: 502030 - RNA, 18 nt, Human
agagcccuuucuguccac

SEQ ID NO: 502031 - RNA, 19 nt, Human
agagcccuuucuguccaca

SEQ ID NO: 502032 - RNA, 19 nt, Human
agcccacuuucccacuccc

SEQ ID NO: 502033 - RNA, 18 nt, Human
aggcagcagcacaagccc

SEQ ID NO: 502034 - RNA, 19 nt, Human
aguagaucuccucccggcc

SEQ ID NO: 502035 - RNA, 21 nt, Human
aucacagcuaugugcccagca

SEQ ID NO: 502036 - RNA, 23 nt, Human
aucacagcuaugugcccagcaca

SEQ ID NO: 502037 - RNA, 24 nt, Human
aucuccucccggccguccccgucg

SEQ ID NO: 502038 - RNA, 24 nt, Human
cacaagcccacuuucccacucccc

SEQ ID NO: 502039 - RNA, 20 nt, Human
caccacgggccacguugacc

SEQ ID NO: 502040 - RNA, 31 nt, Human
cagcagcacaagcccacuuucccacuccccu

SEQ ID NO: 502041 - RNA, 22 nt, Human
cagugacaccaccucccugggc

SEQ ID NO: 502042 - RNA, 24 nt, Human
cagugacaccaccucccugggcac

SEQ ID NO: 502043 - RNA, 21 nt, Human
caucuguguccuaagauaugg

SEQ ID NO: 502044 - RNA, 21 nt, Human
ccacagagcguccggcaaaga

SEQ ID NO: 502045 - RNA, 20 nt, Human
cccagcacagggccuggccu

SEQ ID NO: 502046 - RNA, 19 nt, Human
ccccugcucagcagcuggg

SEQ ID NO: 502047 - RNA, 21 nt, Human
cccugcuggacuccauccgcu

SEQ ID NO: 502048 - RNA, 21 nt, Human
cguccagagcccuuucugucc

SEQ ID NO: 502049 - RNA, 24 nt, Human
cuccccugcuggacuccauccgcu

SEQ ID NO: 502050 - RNA, 29 nt, Human
cucgcagcucuccuuaaccaccgacccca

SEQ ID NO: 502051 - RNA, 21 nt, Human
cugcugugaucacagcuaugu

SEQ ID NO: 502052 - RNA, 19 nt, Human
gauauggucauuagaccca

SEQ ID NO: 502053 - RNA, 18 nt, Human
gcaggcugugaccccgau

SEQ ID NO: 502054 - RNA, 24 nt, Human
uaagauauggucauuagacccacu

SEQ ID NO: 502055 - RNA, 21 nt, Human
uaaguaaugugcauggauggg

SEQ ID NO: 502056 - RNA, 18 nt, Human
uaagugacugguguaagg

SEQ ID NO: 502057 - RNA, 26 nt, Human
uaaucuaaucuccacacuaaccccaa

SEQ ID NO: 502058 - RNA, 28 nt, Human
uagaguagcguccagagcccuuucuguc

SEQ ID NO: 502059 - RNA, 23 nt, Human
uagcucccaggccuuuacauccc

SEQ ID NO: 502060 - RNA, 27 nt, Human
ucagcagcugggcucgcagcucuccuu

SEQ ID NO: 502061 - RNA, 19 nt, Human
uccacacaggccacagagc

SEQ ID NO: 502062 - RNA, 22 nt, Human
ucccugggcacaucuguguccu

SEQ ID NO: 502063 - RNA, 19 nt, Human
ugaucacagcuaugugccc

SEQ ID NO: 502064 - RNA, 18 nt, Human
ugggcuuggggagggucu

SEQ ID NO: 502065 - RNA, 22 nt, Human
ugguguugaggaaguagaucuc

SEQ ID NO: 502066 - RNA, 19 nt, Human
ugguucaugucccaccccu

SEQ ID NO: 502067 - RNA, 20 nt, Human
ugucgcaggcugugaccccg

SEQ ID NO: 502068 - RNA, 20 nt, Human
uuccugaaucaggauuugaa

SEQ ID NO: 502069 - RNA, 22 nt, Human
uuucuguccacacaggccacag

SEQ ID NO: 502070 - RNA, 19 nt, Human
aaacauuuuaaaaagccau

SEQ ID NO: 502071 - RNA, 23 nt, Human
aaagccauccauuaggucaauaa

SEQ ID NO: 502072 - RNA, 19 nt, Human
aaagugcuaggauuacagg

SEQ ID NO: 502073 - RNA, 24 nt, Human
aaagugcuaggauuacaggcauga

SEQ ID NO: 502074 - RNA, 20 nt, Human
aaaugccaaaguuugcugua

SEQ ID NO: 502075 - RNA, 25 nt, Human
aaaugccaaaguuugcuguauagcu

SEQ ID NO: 502076 - RNA, 18 nt, Human
aagcgauucuccacccuc

SEQ ID NO: 502077 - RNA, 20 nt, Human
aaguauagcuugguauaacc

SEQ ID NO: 502078 - RNA, 26 nt, Human
aagugcuaggauuacaggcaugagcc

SEQ ID NO: 502079 - RNA, 19 nt, Human
acacugcggcaacccugaa

SEQ ID NO: 502080 - RNA, 18 nt, Human
acgggguuucacuauguu

SEQ ID NO: 502081 - RNA, 23 nt, Human
acgggguuucacuauguuggcca

SEQ ID NO: 502082 - RNA, 24 nt, Human
acgggguuucacuauguuggccag

SEQ ID NO: 502083 - RNA, 21 nt, Human
acuagaaaaacaaacaucuau

SEQ ID NO: 502084 - RNA, 18 nt, Human
acuauguuggccaggcug

SEQ ID NO: 502085 - RNA, 23 nt, Human
agaaaaacaaacaucuauucugc

SEQ ID NO: 502086 - RNA, 20 nt, Human
agacaagguccgcucaugug

SEQ ID NO: 502087 - RNA, 19 nt, Human
agacagagucucccucugu

SEQ ID NO: 502088 - RNA, 24 nt, Human
agcgauucuccacccucagccucc

SEQ ID NO: 502089 - RNA, 25 nt, Human
aggcuggaguucaguggugagaucu

SEQ ID NO: 502090 - RNA, 19 nt, Human
aguagagacgggguuucac

SEQ ID NO: 502091 - RNA, 23 nt, Human
aguggugagaucuugacucacug

SEQ ID NO: 502092 - RNA, 18 nt, Human
auuuuuuugcuuuucuuu

SEQ ID NO: 502093 - RNA, 18 nt, Human
caaaaaauccuguuccau

SEQ ID NO: 502094 - RNA, 24 nt, Human
caaagugcuaggauuacaggcaug

SEQ ID NO: 502095 - RNA, 21 nt, Human
cacauguauuggucauggaau

SEQ ID NO: 502096 - RNA, 21 nt, Human
cacuauguuggccaggcuggu

SEQ ID NO: 502097 - RNA, 24 nt, Human
cacuauguuggccaggcuggucuc

SEQ ID NO: 502098 - RNA, 20 nt, Human
cacugcaaucuccaccuccc

SEQ ID NO: 502099 - RNA, 21 nt, Human
caugugauuuaguaaucuaag

SEQ ID NO: 502100 - RNA, 19 nt, Human
ccaaagugcuaggauuaca

SEQ ID NO: 502101 - RNA, 24 nt, Human
ccaaagugcuaggauuacaggcau

SEQ ID NO: 502102 - RNA, 24 nt, Human
ccaccucccagguucaagcgauuc

SEQ ID NO: 502103 - RNA, 20 nt, Human
ccaggcuggucuccaacucc

SEQ ID NO: 502104 - RNA, 24 nt, Human
cccaaguaucugagacuacaggug

SEQ ID NO: 502105 - RNA, 20 nt, Human
cccagguucaagcgauucuc

SEQ ID NO: 502106 - RNA, 23 nt, Human
cccucagccucccaaguaucuga

SEQ ID NO: 502107 - RNA, 23 nt, Human
ccggggcagaucauuauccgagg

SEQ ID NO: 502108 - RNA, 24 nt, Human
ccucccagguucaagcgauucucc

SEQ ID NO: 502109 - RNA, 19 nt, Human
ccugaccucaagugaucug

SEQ ID NO: 502110 - RNA, 24 nt, Human
ccugaccucaagugaucugccuac

SEQ ID NO: 502111 - RNA, 19 nt, Human
ccuucuugcucaucugacu

SEQ ID NO: 502112 - RNA, 24 nt, Human
cucaagugaucugccuaccucagc

SEQ ID NO: 502113 - RNA, 24 nt, Human
cucacugcaaucuccaccucccag

SEQ ID NO: 502114 - RNA, 22 nt, Human
cucauuuauugucauguaucac

SEQ ID NO: 502115 - RNA, 23 nt, Human
cuccacauaaaugccaaaguuug

SEQ ID NO: 502116 - RNA, 21 nt, Human
cucccaaguaucugagacuac

SEQ ID NO: 502117 - RNA, 24 nt, Human
cucccucugucgcccaggcuggag

SEQ ID NO: 502118 - RNA, 20 nt, Human
cucugucgcccaggcuggag

SEQ ID NO: 502119 - RNA, 23 nt, Human
cucugucgcccaggcuggaguuc

SEQ ID NO: 502120 - RNA, 24 nt, Human
cugcaaucuccaccucccagguuc

SEQ ID NO: 502121 - RNA, 24 nt, Human
gaccucaagugaucugccuaccuc

SEQ ID NO: 502122 - RNA, 24 nt, Human
gagacgggguuucacuauguuggc

SEQ ID NO: 502123 - RNA, 18 nt, Human
gauuacaggcaugagcca

SEQ ID NO: 502124 - RNA, 22 nt, Human
gauuacaggcaugagccaccgc

SEQ ID NO: 502125 - RNA, 22 nt, Human
gauuacaggcaugagccaccgc

SEQ ID NO: 502126 - RNA, 20 nt, Human
gcccaggcuggaguucagug

SEQ ID NO: 502127 - RNA, 21 nt, Human
gcugguccacugaggugacac

SEQ ID NO: 502128 - RNA, 23 nt, Human
gcuggucuccaacuccugaccuc

SEQ ID NO: 502129 - RNA, 22 nt, Human
ggaaaagaaaggcaugucccau

SEQ ID NO: 502130 - RNA, 22 nt, Human
ggauuacaggcaugagccaccg

SEQ ID NO: 502131 - RNA, 24 nt, Human
ggcuggucuccaacuccugaccuc

SEQ ID NO: 502132 - RNA, 23 nt, Human
gggguuucacuauguuggccagg

SEQ ID NO: 502133 - RNA, 22 nt, Human
ggguuucacuauguuggccagg

SEQ ID NO: 502134 - RNA, 23 nt, Human
ggucauggaauuuccagguaaaa

SEQ ID NO: 502135 - RNA, 23 nt, Human
guagagacgggguuucacuaugu

SEQ ID NO: 502136 - RNA, 18 nt, Human
gucuuggaaguaacuucu

SEQ ID NO: 502137 - RNA, 24 nt, Human
gugaucugccuaccucagccuccc

SEQ ID NO: 502138 - RNA, 25 nt, Human
gugcaugguuugguccucauguugc

SEQ ID NO: 502139 - RNA, 23 nt, Human
guggugagaucuugacucacugc

SEQ ID NO: 502140 - RNA, 20 nt, Human
guucaguggugagaucuuga

SEQ ID NO: 502141 - RNA, 25 nt, Human
uaaaaagccauccauuaggucaaua

SEQ ID NO: 502142 - RNA, 26 nt, Human
uaaaacaguuccauuagagcaaagca

SEQ ID NO: 502143 - RNA, 24 nt, Human
uaauuuuugcauuuuuaguagaga

SEQ ID NO: 502144 - RNA, 22 nt, Human
uacaggcaugagccaccgcgcc

SEQ ID NO: 502145 - RNA, 22 nt, Human
uacccugagcuccucuuugugc

SEQ ID NO: 502146 - RNA, 24 nt, Human
uaccucagccucccaaagugcuag

SEQ ID NO: 502147 - RNA, 20 nt, Human
uagaaaaacaaacaucuauu

SEQ ID NO: 502148 - RNA, 22 nt, Human
uagagacgggguuucacuaugu

SEQ ID NO: 502149 - RNA, 18 nt, Human
uaggauuacaggcaugag

SEQ ID NO: 502150 - RNA, 21 nt, Human
uaggauuacaggcaugagcca

SEQ ID NO: 502151 - RNA, 22 nt, Human
uaggauuacaggcaugagccac

SEQ ID NO: 502152 - RNA, 23 nt, Human
uaggauuacaggcaugagccacc

SEQ ID NO: 502153 - RNA, 24 nt, Human
uaggauuacaggcaugagccaccg

SEQ ID NO: 502154 - RNA, 24 nt, Human
uaggauuacaggcaugagccaccg

SEQ ID NO: 502155 - RNA, 24 nt, Human
uaguagagacgggguuucacuaug

SEQ ID NO: 502156 - RNA, 21 nt, Human
uauaaccacuagaaaaacaaa

SEQ ID NO: 502157 - RNA, 23 nt, Human
uauccgaggacaccaucuugcau

SEQ ID NO: 502158 - RNA, 19 nt, Human
uauguuggccaggcugguc

SEQ ID NO: 502159 - RNA, 24 nt, Human
uauguuggccaggcuggucuccaa

SEQ ID NO: 502160 - RNA, 22 nt, Human
ucacuauguuggccaggcuggu

SEQ ID NO: 502161 - RNA, 23 nt, Human
ucacugcaaucuccaccucccag

SEQ ID NO: 502162 - RNA, 24 nt, Human
ucacugcaaucuccaccucccagg

SEQ ID NO: 502163 - RNA, 25 nt, Human
ucagauuccaacaaugagaaaugcu

SEQ ID NO: 502164 - RNA, 18 nt, Human
ucagccucccaaagugcu

SEQ ID NO: 502165 - RNA, 19 nt, Human
ucaguggugagaucuugac

SEQ ID NO: 502166 - RNA, 24 nt, Human
ucccaaagugcuaggauuacaggc

SEQ ID NO: 502167 - RNA, 23 nt, Human
ucccaaguaucugagacuacagg

SEQ ID NO: 502168 - RNA, 21 nt, Human
ucccagguucaagcgauucuc

SEQ ID NO: 502169 - RNA, 22 nt, Human
ucccagguucaagcgauucucc

SEQ ID NO: 502170 - RNA, 27 nt, Human
uccccaaggcuucguagaauccuccug

SEQ ID NO: 502171 - RNA, 22 nt, Human
ucccccaggcugguccacugag

SEQ ID NO: 502172 - RNA, 20 nt, Human
ucccucugucgcccaggcug

SEQ ID NO: 502173 - RNA, 24 nt, Human
ucccucugucgcccaggcuggagu

SEQ ID NO: 502174 - RNA, 20 nt, Human
uccggggcagaucauuaucc

SEQ ID NO: 502175 - RNA, 18 nt, Human
ucgcccaggcuggaguuc

SEQ ID NO: 502176 - RNA, 23 nt, Human
ucucccucugucgcccaggcugg

SEQ ID NO: 502177 - RNA, 24 nt, Human
ucucccucugucgcccaggcugga

SEQ ID NO: 502178 - RNA, 18 nt, Human
ucugucgcccaggcugga

SEQ ID NO: 502179 - RNA, 20 nt, Human
ucuuuuuuuuugagacagag

SEQ ID NO: 502180 - RNA, 22 nt, Human
ucuuuuuuuuugagacagaguc

SEQ ID NO: 502181 - RNA, 18 nt, Human
ugaccucaagugaucugc

SEQ ID NO: 502182 - RNA, 19 nt, Human
ugaccucaagugaucugcc

SEQ ID NO: 502183 - RNA, 22 nt, Human
ugagacagagucucccucuguc

SEQ ID NO: 502184 - RNA, 23 nt, Human
ugagacagagucucccucugucg

SEQ ID NO: 502185 - RNA, 24 nt, Human
ugagacuacaggugcgcaccacua

SEQ ID NO: 502186 - RNA, 22 nt, Human
ugaucggaaaagaaaggcaugu

SEQ ID NO: 502187 - RNA, 24 nt, Human
ugaucugccuaccucagccuccca

SEQ ID NO: 502188 - RNA, 23 nt, Human
ugcccuagcuccggggcagauca

SEQ ID NO: 502189 - RNA, 20 nt, Human
ugcggcaacccugaaaucac

SEQ ID NO: 502190 - RNA, 20 nt, Human
uggaguucaguggugagauc

SEQ ID NO: 502191 - RNA, 24 nt, Human
uggccaggcuggucuccaacuccu

SEQ ID NO: 502192 - RNA, 20 nt, Human
uguaucacuccucccugaca

SEQ ID NO: 502193 - RNA, 25 nt, Human
uguuaaaagucugucuuggaaguaa

SEQ ID NO: 502194 - RNA, 22 nt, Human
uguugcugcccuagcuccgggg

SEQ ID NO: 502195 - RNA, 22 nt, Human
uuagagcaaagcaucaaaaaau

SEQ ID NO: 502196 - RNA, 18 nt, Human
uuaguagagacgggguuu

SEQ ID NO: 502197 - RNA, 21 nt, Human
uuaguagagacgggguuucac

SEQ ID NO: 502198 - RNA, 21 nt, Human
uuaguagagacgggguuucac

SEQ ID NO: 502199 - RNA, 24 nt, Human
uuaguagagacgggguuucacuau

SEQ ID NO: 502200 - RNA, 23 nt, Human
uucaagcgauucuccacccucag

SEQ ID NO: 502201 - RNA, 24 nt, Human
uucaagcgauucuccacccucagc

SEQ ID NO: 502202 - RNA, 21 nt, Human
uucacacgugaaaacaggaag

SEQ ID NO: 502203 - RNA, 22 nt, Human
uugcuguauagcuuaaauaaac

SEQ ID NO: 502204 - RNA, 23 nt, Human
uugcuguauagcuuaaauaaacu

SEQ ID NO: 502205 - RNA, 24 nt, Human
uuucacuauguuggccaggcuggu

SEQ ID NO: 502206 - RNA, 21 nt, Human
uuuugcauuuuuaguagagac

SEQ ID NO: 502207 - RNA, 24 nt, Human
uuuuuaguagagacgggguuucac

SEQ ID NO: 502208 - RNA, 20 nt, Human
uuuuugcauuuuuaguagag

SEQ ID NO: 502209 - RNA, 19 nt, Human
aaguaaacacucucccggc

SEQ ID NO: 502210 - RNA, 23 nt, Human
cccgccccuuccgcggguccccg

SEQ ID NO: 502211 - RNA, 20 nt, Human
guuuacaccgggcagcgccc

SEQ ID NO: 502212 - RNA, 23 nt, Human
uaaguaaacacucucccggcuca

SEQ ID NO: 502213 - RNA, 18 nt, Human
uccccguuuacaccgggc

SEQ ID NO: 502214 - RNA, 22 nt, Human
uccgcggguccccguuuacacc

SEQ ID NO: 502215 - RNA, 21 nt, Human
ugcauuuacaugucaaucggu

SEQ ID NO: 502216 - RNA, 24 nt, Human
uuuaaguaaacacucucccggcuc

SEQ ID NO: 502217 - RNA, 20 nt, Human
uuugagggcaugauuuuaag

SEQ ID NO: 502218 - RNA, 21 nt, Human
uuuuuuuuuuuugagggcaug

SEQ ID NO: 502219 - RNA, 19 nt, Human
uuuuuuuuuuuuugagggc

SEQ ID NO: 502220 - RNA, 28 nt, Human
uuuuuuuuuuuuuuuuuuuuuuugaggg

SEQ ID NO: 502221 - RNA, 22 nt, Human
acagaguuuuaauucugccaac

SEQ ID NO: 502222 - RNA, 19 nt, Human
acuacaaucacuggcugua

SEQ ID NO: 502223 - RNA, 19 nt, Human
agaaggguggaugccaggg

SEQ ID NO: 502224 - RNA, 20 nt, Human
agacagaaagcuagaagggu

SEQ ID NO: 502225 - RNA, 22 nt, Human
caaaugcaaucaagcugaaaag

SEQ ID NO: 502226 - RNA, 22 nt, Human
caccaccccacucaggcugcac

SEQ ID NO: 502227 - RNA, 23 nt, Human
ccuccaaugagaggaguggaagc

SEQ ID NO: 502228 - RNA, 23 nt, Human
cgcagccggccgcggaggacgcc

SEQ ID NO: 502229 - RNA, 23 nt, Human
cgggcagacuaccggccugcacc

SEQ ID NO: 502230 - RNA, 18 nt, Human
cucagaaagggauuagaa

SEQ ID NO: 502231 - RNA, 26 nt, Human
cugcaccaccccacucaggcugcaca

SEQ ID NO: 502232 - RNA, 23 nt, Human
cugccaacgaucaccacgcagcc

SEQ ID NO: 502233 - RNA, 20 nt, Human
cuuaggaucuccgugggcug

SEQ ID NO: 502234 - RNA, 19 nt, Human
gacagccccgagaacgcaa

SEQ ID NO: 502235 - RNA, 22 nt, Human
gcagccggccgcggaggacgcc

SEQ ID NO: 502236 - RNA, 18 nt, Human
gccuccaaugagaggagu

SEQ ID NO: 502237 - RNA, 23 nt, Human
gggccccagaguacucagaaagg

SEQ ID NO: 502238 - RNA, 18 nt, Human
ggggcuggggcuggggga

SEQ ID NO: 502239 - RNA, 23 nt, Human
gucacagagggcugauuaagggc

SEQ ID NO: 502240 - RNA, 21 nt, Human
uaccggccugcaccaccccac

SEQ ID NO: 502241 - RNA, 25 nt, Human
uccagguuaucugcccagguggcag

SEQ ID NO: 502242 - RNA, 20 nt, Human
ugcaccaccccacucaggcu

SEQ ID NO: 502243 - RNA, 19 nt, Human
ugucacagagggcugauua

SEQ ID NO: 502244 - RNA, 20 nt, Human
uucaauggguacagaguuuu

SEQ ID NO: 502245 - RNA, 24 nt, Human
aaagugcugggauuacaggcguga

SEQ ID NO: 502246 - RNA, 22 nt, Human
aacacucuccuaaaaucaaaua

SEQ ID NO: 502247 - RNA, 24 nt, Human
aagcaauucugccccaaccuccug

SEQ ID NO: 502248 - RNA, 24 nt, Human
aagugauccacccgccucggccuc

SEQ ID NO: 502249 - RNA, 19 nt, Human
aagugcugggauuacaggc

SEQ ID NO: 502250 - RNA, 19 nt, Human
aagugcugggauuacaggc

SEQ ID NO: 502251 - RNA, 26 nt, Human
aagugcugggauuacaggcgugagcc

SEQ ID NO: 502252 - RNA, 24 nt, Human
acaggguuucaccuuauuggccag

SEQ ID NO: 502253 - RNA, 25 nt, Human
acccgccucggccucccaaagugcu

SEQ ID NO: 502254 - RNA, 20 nt, Human
agcaauucugccccaaccuc

SEQ ID NO: 502255 - RNA, 18 nt, Human
agcagaaaugaggacuuc

SEQ ID NO: 502256 - RNA, 22 nt, Human
aggccggcagcaagacagagaa

SEQ ID NO: 502257 - RNA, 20 nt, Human
agggagggagcucaaaagau

SEQ ID NO: 502258 - RNA, 19 nt, Human
aggucacuguggccuaaaa

SEQ ID NO: 502259 - RNA, 20 nt, Human
aguagagacaggguuucacc

SEQ ID NO: 502260 - RNA, 18 nt, Human
aguagcuggguuuacagg

SEQ ID NO: 502261 - RNA, 21 nt, Human
agucagggucuuuuccacgug

SEQ ID NO: 502262 - RNA, 20 nt, Human
agugcaggggugcaaucucg

SEQ ID NO: 502263 - RNA, 24 nt, Human
agugcaggggugcaaucucggcuc

SEQ ID NO: 502264 - RNA, 18 nt, Human
agugcugggauuacaggc

SEQ ID NO: 502265 - RNA, 19 nt, Human
aucuccuuccaucaagcgc

SEQ ID NO: 502266 - RNA, 22 nt, Human
augcuggacggcccagcugcac

SEQ ID NO: 502267 - RNA, 24 nt, Human
auuuuuguauuuuuaguagagaca

SEQ ID NO: 502268 - RNA, 24 nt, Human
caaagugcugggauuacaggcgug

SEQ ID NO: 502269 - RNA, 24 nt, Human
caccaugcucggcuaauuuuugua

SEQ ID NO: 502270 - RNA, 23 nt, Human
cacccgccucggccucccaaagu

SEQ ID NO: 502271 - RNA, 21 nt, Human
caccuuauuggccaggcuggu

SEQ ID NO: 502272 - RNA, 24 nt, Human
caccuuauuggccaggcuggucuc

SEQ ID NO: 502273 - RNA, 19 nt, Human
cacugcaaccucugccccc

SEQ ID NO: 502274 - RNA, 21 nt, Human
cacugcaaccucugcccccug

SEQ ID NO: 502275 - RNA, 23 nt, Human
cacugcaaccucugcccccuggg

SEQ ID NO: 502276 - RNA, 24 nt, Human
cagaagaauuugaagacagucugg

SEQ ID NO: 502277 - RNA, 23 nt, Human
cagcagaaaugaggacuucagug

SEQ ID NO: 502278 - RNA, 24 nt, Human
caggguuucaccuuauuggccagg

SEQ ID NO: 502279 - RNA, 22 nt, Human
ccaaagugcugggauuacaggc

SEQ ID NO: 502280 - RNA, 22 nt, Human
ccaaagugcugggauuacaggc

SEQ ID NO: 502281 - RNA, 24 nt, Human
ccaaagugcugggauuacaggcgu

SEQ ID NO: 502282 - RNA, 19 nt, Human
ccacugcacccggccucaa

SEQ ID NO: 502283 - RNA, 21 nt, Human
ccacugcacccggccucaaag

SEQ ID NO: 502284 - RNA, 23 nt, Human
ccacugcacccggccucaaaggc

SEQ ID NO: 502285 - RNA, 19 nt, Human
cccuggguucaagcaauuc

SEQ ID NO: 502286 - RNA, 21 nt, Human
cccuggguucaagcaauucug

SEQ ID NO: 502287 - RNA, 22 nt, Human
ccugaccucaagugauccaccc

SEQ ID NO: 502288 - RNA, 23 nt, Human
ccugaccucaagugauccacccg

SEQ ID NO: 502289 - RNA, 24 nt, Human
cgccucggccucccaaagugcugg

SEQ ID NO: 502290 - RNA, 21 nt, Human
cucaaaagauauaaagaaguc

SEQ ID NO: 502291 - RNA, 22 nt, Human
cucacugcaaccucugcccccu

SEQ ID NO: 502292 - RNA, 24 nt, Human
cucacugcaaccucugcccccugg

SEQ ID NO: 502293 - RNA, 24 nt, Human
cucccauaagacuagucuacugug

SEQ ID NO: 502294 - RNA, 24 nt, Human
cucucugcucaggagagccggagg

SEQ ID NO: 502295 - RNA, 20 nt, Human
cucugcucaggagagccgga

SEQ ID NO: 502296 - RNA, 23 nt, Human
cugcaaccucugcccccuggguu

SEQ ID NO: 502297 - RNA, 24 nt, Human
cugcaaccucugcccccuggguuc

SEQ ID NO: 502298 - RNA, 23 nt, Human
cugccccaaccuccugaguagcu

SEQ ID NO: 502299 - RNA, 18 nt, Human
cugggagggaaugcagug

SEQ ID NO: 502300 - RNA, 18 nt, Human
gacaggguuucaccuuau

SEQ ID NO: 502301 - RNA, 24 nt, Human
gaccucaagugauccacccgccuc

SEQ ID NO: 502302 - RNA, 20 nt, Human
gacuucaguggaauugacau

SEQ ID NO: 502303 - RNA, 18 nt, Human
gauuacaggcgugagcca

SEQ ID NO: 502304 - RNA, 22 nt, Human
gauuacaggcgugagccacugc

SEQ ID NO: 502305 - RNA, 23 nt, Human
gauuacaggcgugagccacugca

SEQ ID NO: 502306 - RNA, 19 nt, Human
gcccccuggguucaagcaa

SEQ ID NO: 502307 - RNA, 23 nt, Human
gcuggucucgaacuccugaccuc

SEQ ID NO: 502308 - RNA, 24 nt, Human
ggcuggucucgaacuccugaccuc

SEQ ID NO: 502309 - RNA, 23 nt, Human
ggcuguucuuuuuuauuuuuuuu

SEQ ID NO: 502310 - RNA, 19 nt, Human
ggucucgaacuccugaccu

SEQ ID NO: 502311 - RNA, 24 nt, Human
gucagggucuuuuccacgugugga

SEQ ID NO: 502312 - RNA, 24 nt, Human
gugauccacccgccucggccuccc

SEQ ID NO: 502313 - RNA, 18 nt, Human
guucuuuuuuauuuuuuu

SEQ ID NO: 502314 - RNA, 19 nt, Human
guucuuuuuuauuuuuuuu

SEQ ID NO: 502315 - RNA, 24 nt, Human
uaauuuuuguauuuuuaguagaga

SEQ ID NO: 502316 - RNA, 22 nt, Human
uacaaaagcaacacauauucau

SEQ ID NO: 502317 - RNA, 18 nt, Human
uacaggcacaggccacca

SEQ ID NO: 502318 - RNA, 19 nt, Human
uacaggcgugagccacugc

SEQ ID NO: 502319 - RNA, 23 nt, Human
uacaggcgugagccacugcaccc

SEQ ID NO: 502320 - RNA, 18 nt, Human
uacauaauaaaagggagg

SEQ ID NO: 502321 - RNA, 21 nt, Human
uacauaauaaaagggagggag

SEQ ID NO: 502322 - RNA, 24 nt, Human
uagcaggaccucucucuaauggcu

SEQ ID NO: 502323 - RNA, 19 nt, Human
uaggucaaagcauauaaac

SEQ ID NO: 502324 - RNA, 19 nt, Human
uaguagagacaggguuuca

SEQ ID NO: 502325 - RNA, 26 nt, Human
uaguagagacaggguuucaccuuauu

SEQ ID NO: 502326 - RNA, 20 nt, Human
uauuggccaggcuggucucg

SEQ ID NO: 502327 - RNA, 18 nt, Human
ucacugcaaccucugccc

SEQ ID NO: 502328 - RNA, 23 nt, Human
ucacugcaaccucugcccccugg

SEQ ID NO: 502329 - RNA, 24 nt, Human
ucacugcaaccucugcccccuggg

SEQ ID NO: 502330 - RNA, 27 nt, Human
ucacugcaaccucugcccccuggguuc

SEQ ID NO: 502331 - RNA, 23 nt, Human
ucaguggaauugacaucuccuuc

SEQ ID NO: 502332 - RNA, 24 nt, Human
ucccaaagugcugggauuacaggc

SEQ ID NO: 502333 - RNA, 24 nt, Human
uccugaguagcuggguuuacaggc

SEQ ID NO: 502334 - RNA, 18 nt, Human
ucggccucccaaagugcu

SEQ ID NO: 502335 - RNA, 21 nt, Human
ucucgaacuccugaccucaag

SEQ ID NO: 502336 - RNA, 24 nt, Human
ucucguacuguugcccagccugga

SEQ ID NO: 502337 - RNA, 24 nt, Human
ucugcccccuggguucaagcaauu

SEQ ID NO: 502338 - RNA, 24 nt, Human
ugaccucaagugauccacccgccu

SEQ ID NO: 502339 - RNA, 22 nt, Human
ugcacccggccucaaaggcugg

SEQ ID NO: 502340 - RNA, 22 nt, Human
ugcagccuggcccaagagccag

SEQ ID NO: 502341 - RNA, 22 nt, Human
ugcaggggugcaaucucggcuc

SEQ ID NO: 502342 - RNA, 23 nt, Human
ugcaggggugcaaucucggcuca

SEQ ID NO: 502343 - RNA, 24 nt, Human
ugccccaaccuccugaguagcugg

SEQ ID NO: 502344 - RNA, 21 nt, Human
ugcuggacggcccagcugcac

SEQ ID NO: 502345 - RNA, 24 nt, Human
ugcugggauuacaggcgugagcca

SEQ ID NO: 502346 - RNA, 22 nt, Human
uggaacagagucucguacuguu

SEQ ID NO: 502347 - RNA, 19 nt, Human
uggagugcaggggugcaau

SEQ ID NO: 502348 - RNA, 23 nt, Human
uggagugcaggggugcaaucucg

SEQ ID NO: 502349 - RNA, 24 nt, Human
uggagugcaggggugcaaucucgg

SEQ ID NO: 502350 - RNA, 24 nt, Human
uggccaggcuggucucgaacuccu

SEQ ID NO: 502351 - RNA, 18 nt, Human
uggcccaagagccaggac

SEQ ID NO: 502352 - RNA, 18 nt, Human
ugggauuacaggcgugag

SEQ ID NO: 502353 - RNA, 19 nt, Human
ugggauuacaggcgugagc

SEQ ID NO: 502354 - RNA, 21 nt, Human
ugggauuacaggcgugagcca

SEQ ID NO: 502355 - RNA, 22 nt, Human
ugggauuacaggcgugagccac

SEQ ID NO: 502356 - RNA, 22 nt, Human
ugggauuacaggcgugagccac

SEQ ID NO: 502357 - RNA, 24 nt, Human
ugggauuacaggcgugagccacug

SEQ ID NO: 502358 - RNA, 26 nt, Human
ugggauuacaggcgugagccacugca

SEQ ID NO: 502359 - RNA, 22 nt, Human
uggguuuacaggcacaggccac

SEQ ID NO: 502360 - RNA, 24 nt, Human
uggguuuacaggcacaggccacca

SEQ ID NO: 502361 - RNA, 24 nt, Human
uguaaacaaaauuuuaauggcaaa

SEQ ID NO: 502362 - RNA, 23 nt, Human
uguuuguuuuuuuaaaggagucu

SEQ ID NO: 502363 - RNA, 24 nt, Human
uuaguagagacaggguuucaccuu

SEQ ID NO: 502364 - RNA, 25 nt, Human
uuaguagagacaggguuucaccuua

SEQ ID NO: 502365 - RNA, 20 nt, Human
uuauuuuuuuuggaacagag

SEQ ID NO: 502366 - RNA, 21 nt, Human
uucaagcaauucugccccaac

SEQ ID NO: 502367 - RNA, 20 nt, Human
uucaccuuauuggccaggcc

SEQ ID NO: 502368 - RNA, 21 nt, Human
uugaugcuggacggcccagcu

SEQ ID NO: 502369 - RNA, 18 nt, Human
uugcccagccuggagugc

SEQ ID NO: 502370 - RNA, 22 nt, Human
uuucaccuuauuggccaggcug

SEQ ID NO: 502371 - RNA, 24 nt, Human
uuuuuaguagagacaggguuucac

SEQ ID NO: 502372 - RNA, 20 nt, Human
uuuuuguauuuuuaguagag

SEQ ID NO: 502373 - RNA, 21 nt, Human
uuuuuguuuguuuguuuuuuu

SEQ ID NO: 502374 - RNA, 22 nt, Human
uuuuuuuguuuguuuguuuuuu

SEQ ID NO: 502375 - RNA, 21 nt, Human
uuuuuuuuggaacagagucuc

SEQ ID NO: 502376 - RNA, 18 nt, Human
aagaauccaguuccaccc

SEQ ID NO: 502377 - RNA, 21 nt, Human
agaaggcgguggucuccuugc

SEQ ID NO: 502378 - RNA, 22 nt, Human
agaaggcgguggucuccuugcc

SEQ ID NO: 502379 - RNA, 26 nt, Human
agcuccaccuccaucuggauccccau

SEQ ID NO: 502380 - RNA, 20 nt, Human
aggaagaauccaguuccacc

SEQ ID NO: 502381 - RNA, 22 nt, Human
auuccucagguuuuuuugaagc

SEQ ID NO: 502382 - RNA, 21 nt, Human
ccccugcugugaacccaggga

SEQ ID NO: 502383 - RNA, 22 nt, Human
cccuuuucccuuuuggguuguc

SEQ ID NO: 502384 - RNA, 18 nt, Human
ccugcuguggcgcauuuu

SEQ ID NO: 502385 - RNA, 18 nt, Human
ccuugugguccugcugug

SEQ ID NO: 502386 - RNA, 23 nt, Human
cuccaccuccaucuggaucccca

SEQ ID NO: 502387 - RNA, 25 nt, Human
cuuuuguuccuggaacuuccuugac

SEQ ID NO: 502388 - RNA, 18 nt, Human
ggaagcacuggagaaggc

SEQ ID NO: 502389 - RNA, 18 nt, Human
gucccuuuucccuuuugg

SEQ ID NO: 502390 - RNA, 22 nt, Human
uccaccuccaucuggaucccca

SEQ ID NO: 502391 - RNA, 19 nt, Human
uccaggaagaauccaguuc

SEQ ID NO: 502392 - RNA, 23 nt, Human
uccaggaagaauccaguuccacc

SEQ ID NO: 502393 - RNA, 21 nt, Human
uccccauccaggaagaaucca

SEQ ID NO: 502394 - RNA, 19 nt, Human
ucucuggccuugccuggga

SEQ ID NO: 502395 - RNA, 19 nt, Human
ucuggauccccauccagga

SEQ ID NO: 502396 - RNA, 20 nt, Human
ucuuugguguugaugggugg

SEQ ID NO: 502397 - RNA, 20 nt, Human
ucuuuuagggagagccuuuu

SEQ ID NO: 502398 - RNA, 18 nt, Human
ugcccaaggaagcacugg

SEQ ID NO: 502399 - RNA, 21 nt, Human
uggauccccauccaggaagaa

SEQ ID NO: 502400 - RNA, 18 nt, Human
uggcccacuccauuccuc

SEQ ID NO: 502401 - RNA, 20 nt, Human
uggcuggauaguguuggccc

SEQ ID NO: 502402 - RNA, 21 nt, Human
uguggcgcauuuugauugagu

SEQ ID NO: 502403 - RNA, 21 nt, Human
uuccucagguuuuuuugaagc

SEQ ID NO: 502404 - RNA, 21 nt, Human
uuccucagguuuuuuugaagc

SEQ ID NO: 502405 - RNA, 24 nt, Human
uuccuggaacuuccuugacggguc

SEQ ID NO: 502406 - RNA, 18 nt, Human
uugaagcgguggucuuuu

SEQ ID NO: 502407 - RNA, 21 nt, Human
uugccugggaauuacuggcug

SEQ ID NO: 502408 - RNA, 21 nt, Human
uuguuggaaaaugggcuggag

SEQ ID NO: 502409 - RNA, 24 nt, Human
uuuuuugaagcgguggucuuuuag

SEQ ID NO: 502410 - RNA, 25 nt, Human
aaacagccaugugcuagcugaaagc

SEQ ID NO: 502411 - RNA, 18 nt, Human
aacuagggaacaaaaagc

SEQ ID NO: 502412 - RNA, 22 nt, Human
aaggggcaaaaguauuagacau

SEQ ID NO: 502413 - RNA, 23 nt, Human
aagugccuucgcugggcuacucc

SEQ ID NO: 502414 - RNA, 22 nt, Human
acaauguuagcuguuuuuaauc

SEQ ID NO: 502415 - RNA, 21 nt, Human
acccuuagaccaacuagggaa

SEQ ID NO: 502416 - RNA, 19 nt, Human
acugggcuguacucgcccc

SEQ ID NO: 502417 - RNA, 23 nt, Human
agaauauagaaacagccaugugc

SEQ ID NO: 502418 - RNA, 19 nt, Human
agaguuucccacgccuccu

SEQ ID NO: 502419 - RNA, 18 nt, Human
agcaccuuccaaagugcc

SEQ ID NO: 502420 - RNA, 24 nt, Human
agccugggcucaucagaauauaga

SEQ ID NO: 502421 - RNA, 19 nt, Human
aggacugggcuguacucgc

SEQ ID NO: 502422 - RNA, 24 nt, Human
aguaguaaaguuucacgggagaaa

SEQ ID NO: 502423 - RNA, 21 nt, Human
augaacacuagcuggccuaug

SEQ ID NO: 502424 - RNA, 24 nt, Human
cacccugaacgcgccugaucucau

SEQ ID NO: 502425 - RNA, 18 nt, Human
cacccuuuugcaguccuc

SEQ ID NO: 502426 - RNA, 19 nt, Human
cagaguuucccacgccucc

SEQ ID NO: 502427 - RNA, 22 nt, Human
cauagagagauucaguaaccac

SEQ ID NO: 502428 - RNA, 26 nt, Human
cauagagagauucaguaaccaccugu

SEQ ID NO: 502429 - RNA, 22 nt, Human
cccacaacucuggauaaaaagg

SEQ ID NO: 502430 - RNA, 19 nt, Human
cccugaacgcgccugaucu

SEQ ID NO: 502431 - RNA, 19 nt, Human
ccucuguugccccuguguu

SEQ ID NO: 502432 - RNA, 18 nt, Human
ccugguuaguacuuggau

SEQ ID NO: 502433 - RNA, 24 nt, Human
cgaggccgacuccacccuuuugca

SEQ ID NO: 502434 - RNA, 22 nt, Human
cgcugggcuacucccaccuggc

SEQ ID NO: 502435 - RNA, 21 nt, Human
cggccauaucacccugaacgc

SEQ ID NO: 502436 - RNA, 18 nt, Human
cuagcugaaagccauuca

SEQ ID NO: 502437 - RNA, 20 nt, Human
cugaacgcgccugaucucau

SEQ ID NO: 502438 - RNA, 18 nt, Human
cuggcccuugcuuuucau

SEQ ID NO: 502439 - RNA, 26 nt, Human
cuuagaccaacuagggaacaaaaagc

SEQ ID NO: 502440 - RNA, 21 nt, Human
cuuuaaaaucucuuccaaucc

SEQ ID NO: 502441 - RNA, 21 nt, Human
gggcggggccugggcgggggc

SEQ ID NO: 502442 - RNA, 22 nt, Human
gggcggggccugggcgggggcg

SEQ ID NO: 502443 - RNA, 18 nt, Human
uaaaaaggggcaaaagua

SEQ ID NO: 502444 - RNA, 25 nt, Human
uaaacaaacacugaaggccucuuuc

SEQ ID NO: 502445 - RNA, 25 nt, Human
uaaacaaacacugaaggccucuuuc

SEQ ID NO: 502446 - RNA, 20 nt, Human
uacucccaccuggcccuugc

SEQ ID NO: 502447 - RNA, 26 nt, Human
uaguccaauacagacccuuagaccaa

SEQ ID NO: 502448 - RNA, 20 nt, Human
ucagaauauagaaacagcca

SEQ ID NO: 502449 - RNA, 20 nt, Human
ucccggcaggggcggggccu

SEQ ID NO: 502450 - RNA, 18 nt, Human
uccuaaaugcuaaaaucu

SEQ ID NO: 502451 - RNA, 18 nt, Human
ucgcugggcuacucccac

SEQ ID NO: 502452 - RNA, 22 nt, Human
ucuacggccauaucacccugaa

SEQ ID NO: 502453 - RNA, 21 nt, Human
ugaauggaaaguucauagaga

SEQ ID NO: 502454 - RNA, 21 nt, Human
ugagggaaguaaaugacauug

SEQ ID NO: 502455 - RNA, 19 nt, Human
ugagguccaauuugucugu

SEQ ID NO: 502456 - RNA, 18 nt, Human
ugccugcacauguuucuu

SEQ ID NO: 502457 - RNA, 27 nt, Human
uggaaaguucauagagagauucaguaa

SEQ ID NO: 502458 - RNA, 20 nt, Human
ugggagaaauuuuauaaaga

SEQ ID NO: 502459 - RNA, 19 nt, Human
uguuccuggcagcccaagu

SEQ ID NO: 502460 - RNA, 18 nt, Human
uugaauggaaaguucaua

SEQ ID NO: 502461 - RNA, 19 nt, Human
uuuucagacaauguuagcu

SEQ ID NO: 502462 - RNA, 21 nt, Human
aagaaagcagaauggagaacg

SEQ ID NO: 502463 - RNA, 18 nt, Human
aagaucccugagccaggg

SEQ ID NO: 502464 - RNA, 24 nt, Human
aagcagaguccccaggguuugugg

SEQ ID NO: 502465 - RNA, 22 nt, Human
aagcugcaggcuuggccuccau

SEQ ID NO: 502466 - RNA, 28 nt, Human
acacugcuucaggagaggggggaacgcc

SEQ ID NO: 502467 - RNA, 21 nt, Human
acaggaaccacccucccaggc

SEQ ID NO: 502468 - RNA, 20 nt, Human
acaguggguggccugguacc

SEQ ID NO: 502469 - RNA, 18 nt, Human
acccccucuccccccugc

SEQ ID NO: 502470 - RNA, 25 nt, Human
acccccucuccccccugccccccag

SEQ ID NO: 502471 - RNA, 19 nt, Human
acccuguggagcuggcaga

SEQ ID NO: 502472 - RNA, 24 nt, Human
agaaagcagaauggagaacgggac

SEQ ID NO: 502473 - RNA, 23 nt, Human
agaaagcugcaggcuuggccucc

SEQ ID NO: 502474 - RNA, 23 nt, Human
agaccaggggagccuggggccgg

SEQ ID NO: 502475 - RNA, 21 nt, Human
agacuccucugagcucugccc

SEQ ID NO: 502476 - RNA, 18 nt, Human
agccagggaaagcugaug

SEQ ID NO: 502477 - RNA, 22 nt, Human
agccuggggccggcccacugug

SEQ ID NO: 502478 - RNA, 21 nt, Human
agcugggcuggcugugaugga

SEQ ID NO: 502479 - RNA, 21 nt, Human
agcuggucccucugggguccu

SEQ ID NO: 502480 - RNA, 22 nt, Human
aggaccuuggagggaacagucu

SEQ ID NO: 502481 - RNA, 19 nt, Human
agggcugggcagcggguga

SEQ ID NO: 502482 - RNA, 26 nt, Human
agggggcucagccaagcugcugggcc

SEQ ID NO: 502483 - RNA, 22 nt, Human
agguuucuuggggguggaggug

SEQ ID NO: 502484 - RNA, 19 nt, Human
aguagcaggggauccuggg

SEQ ID NO: 502485 - RNA, 21 nt, Human
agucagccuggagccuggagc

SEQ ID NO: 502486 - RNA, 24 nt, Human
agucagccuggagccuggagccag

SEQ ID NO: 502487 - RNA, 18 nt, Human
aguggaugcugagaacag

SEQ ID NO: 502488 - RNA, 21 nt, Human
cacaguggguggccugguacc

SEQ ID NO: 502489 - RNA, 19 nt, Human
caccacgacccaaucccua

SEQ ID NO: 502490 - RNA, 19 nt, Human
caccacucaggcuugcccc

SEQ ID NO: 502491 - RNA, 21 nt, Human
cacggggacuccccgggccag

SEQ ID NO: 502492 - RNA, 24 nt, Human
cacuguguggcaagaaagcagaau

SEQ ID NO: 502493 - RNA, 21 nt, Human
cagagaguggcuacggggagg

SEQ ID NO: 502494 - RNA, 25 nt, Human
cagaguccccaggguuugugcuuuu

SEQ ID NO: 502495 - RNA, 20 nt, Human
cagccaagcagaguccccag

SEQ ID NO: 502496 - RNA, 23 nt, Human
cagccccucccugaacucugucc

SEQ ID NO: 502497 - RNA, 23 nt, Human
cagccgggcugggcuuuggggcc

SEQ ID NO: 502498 - RNA, 20 nt, Human
cagccuggagccuggagcca

SEQ ID NO: 502499 - RNA, 20 nt, Human
cagcugggagggcugggcag

SEQ ID NO: 502500 - RNA, 21 nt, Human
caggcgggagcagcaucucuc

SEQ ID NO: 502501 - RNA, 20 nt, Human
caggggaggccaggcugugu

SEQ ID NO: 502502 - RNA, 19 nt, Human
cagucagccuggagccugg

SEQ ID NO: 502503 - RNA, 23 nt, Human
cagucucugaaccacguuccucc

SEQ ID NO: 502504 - RNA, 20 nt, Human
caguggguggccugguaccc

SEQ ID NO: 502505 - RNA, 22 nt, Human
cauuacccccucuccccccugc

SEQ ID NO: 502506 - RNA, 20 nt, Human
ccaaucaggcgggagcagca

SEQ ID NO: 502507 - RNA, 20 nt, Human
ccacugcauucccacugaac

SEQ ID NO: 502508 - RNA, 19 nt, Human
ccaugcagacaugcggccg

SEQ ID NO: 502509 - RNA, 21 nt, Human
ccauggagggagaauggggcc

SEQ ID NO: 502510 - RNA, 21 nt, Human
ccauuggcuccagcuuugggc

SEQ ID NO: 502511 - RNA, 24 nt, Human
cccacuguguggcaagaaagcaga

SEQ ID NO: 502512 - RNA, 23 nt, Human
cccauggccuccgccauacugcc

SEQ ID NO: 502513 - RNA, 25 nt, Human
ccccacccacugcauucccacugaa

SEQ ID NO: 502514 - RNA, 21 nt, Human
ccccagggccaccauauuggg

SEQ ID NO: 502515 - RNA, 20 nt, Human
cccccagggaagaauuucca

SEQ ID NO: 502516 - RNA, 21 nt, Human
cccccagucagccuggagccu

SEQ ID NO: 502517 - RNA, 26 nt, Human
cccccagucagccuggagccuggagc

SEQ ID NO: 502518 - RNA, 20 nt, Human
cccccauggccuccgccaua

SEQ ID NO: 502519 - RNA, 20 nt, Human
cccccucuccccccugcccc

SEQ ID NO: 502520 - RNA, 18 nt, Human
ccccgggccagcccugag

SEQ ID NO: 502521 - RNA, 19 nt, Human
ccccuagccagacucagcc

SEQ ID NO: 502522 - RNA, 21 nt, Human
ccccuagccagacucagcccc

SEQ ID NO: 502523 - RNA, 22 nt, Human
cccugaguggagcugggcuggc

SEQ ID NO: 502524 - RNA, 21 nt, Human
cccugcucacccuggggcuag

SEQ ID NO: 502525 - RNA, 23 nt, Human
cccuguggagcuggcagagagug

SEQ ID NO: 502526 - RNA, 23 nt, Human
ccucagauucuccaccacgaccc

SEQ ID NO: 502527 - RNA, 21 nt, Human
ccucgccucgcuggccuggga

SEQ ID NO: 502528 - RNA, 19 nt, Human
ccucuccccccugcccccc

SEQ ID NO: 502529 - RNA, 19 nt, Human
ccugcagaccugcucuguc

SEQ ID NO: 502530 - RNA, 20 nt, Human
ccuggacucggccccuagcc

SEQ ID NO: 502531 - RNA, 20 nt, Human
ccuggaggggccaugcggcc

SEQ ID NO: 502532 - RNA, 19 nt, Human
cggccugggaccggguucc

SEQ ID NO: 502533 - RNA, 20 nt, Human
cucacaccggagauuggacc

SEQ ID NO: 502534 - RNA, 24 nt, Human
cucacaccggagauuggacccucc

SEQ ID NO: 502535 - RNA, 20 nt, Human
cucagcccucaccauuggcc

SEQ ID NO: 502536 - RNA, 22 nt, Human
cuccauuacccccucucccccc

SEQ ID NO: 502537 - RNA, 25 nt, Human
cuccugaggccuuggccuuagaggc

SEQ ID NO: 502538 - RNA, 23 nt, Human
cucggccccuagccagacucagc

SEQ ID NO: 502539 - RNA, 24 nt, Human
cucucagcccucaccauuggcucc

SEQ ID NO: 502540 - RNA, 22 nt, Human
cucugaaccacguuccucccgg

SEQ ID NO: 502541 - RNA, 22 nt, Human
cucugggguccugaggugaggg

SEQ ID NO: 502542 - RNA, 23 nt, Human
cugccccccagcuggucccucug

SEQ ID NO: 502543 - RNA, 19 nt, Human
cuggccugggaagggcugg

SEQ ID NO: 502544 - RNA, 19 nt, Human
cuguccccucugccagccc

SEQ ID NO: 502545 - RNA, 19 nt, Human
cuugaaaucccccgccuuc

SEQ ID NO: 502546 - RNA, 19 nt, Human
gaaaacuguugccagccuc

SEQ ID NO: 502547 - RNA, 19 nt, Human
gaaaucccccgccuuccug

SEQ ID NO: 502548 - RNA, 21 nt, Human
gaaccaggacuggggcaagga

SEQ ID NO: 502549 - RNA, 21 nt, Human
gaacucuguccccucugccag

SEQ ID NO: 502550 - RNA, 21 nt, Human
gaagaggagggacacgccccu

SEQ ID NO: 502551 - RNA, 20 nt, Human
gacagccaagcagagucccc

SEQ ID NO: 502552 - RNA, 19 nt, Human
gacgcuucugccaugcaga

SEQ ID NO: 502553 - RNA, 19 nt, Human
gacuggggcaaggagaggc

SEQ ID NO: 502554 - RNA, 21 nt, Human
gccaagcugcugggccauggg

SEQ ID NO: 502555 - RNA, 21 nt, Human
gccagcccugaguggagcugg

SEQ ID NO: 502556 - RNA, 21 nt, Human
gccccaaggccaaggccggca

SEQ ID NO: 502557 - RNA, 21 nt, Human
gcccucaccauuggcuccagc

SEQ ID NO: 502558 - RNA, 21 nt, Human
gccgaggggcccccauggccu

SEQ ID NO: 502559 - RNA, 18 nt, Human
gccggucugugucccagc

SEQ ID NO: 502560 - RNA, 19 nt, Human
gccucuuccccagggccac

SEQ ID NO: 502561 - RNA, 28 nt, Human
gcgugggaggcagaccccuccugguugg

SEQ ID NO: 502562 - RNA, 22 nt, Human
gcuccgcaggggaggccaggcu

SEQ ID NO: 502563 - RNA, 19 nt, Human
gcugaccacccagccacag

SEQ ID NO: 502564 - RNA, 23 nt, Human
gcuuuggggccccacugauccca

SEQ ID NO: 502565 - RNA, 19 nt, Human
ggacuggggcaaggagagg

SEQ ID NO: 502566 - RNA, 19 nt, Human
ggacuggggcaaggagagg

SEQ ID NO: 502567 - RNA, 22 nt, Human
ggagcugggcuggcugugaugg

SEQ ID NO: 502568 - RNA, 23 nt, Human
ggaggggcacuacaggaagagga

SEQ ID NO: 502569 - RNA, 22 nt, Human
ggagguggcuguggccaugcac

SEQ ID NO: 502570 - RNA, 20 nt, Human
ggaguagcaggggauccugg

SEQ ID NO: 502571 - RNA, 20 nt, Human
ggcagagaguggcuacgggg

SEQ ID NO: 502572 - RNA, 20 nt, Human
ggcauucuccauccccagau

SEQ ID NO: 502573 - RNA, 21 nt, Human
ggccaaggccggcaggggugu

SEQ ID NO: 502574 - RNA, 19 nt, Human
ggccccuagccagacucag

SEQ ID NO: 502575 - RNA, 18 nt, Human
ggccugggaagggcuggc

SEQ ID NO: 502576 - RNA, 29 nt, Human
ggcgggagcagcaucucucuccuccuggg

SEQ ID NO: 502577 - RNA, 18 nt, Human
ggcugugugugugugugu

SEQ ID NO: 502578 - RNA, 24 nt, Human
gggaggggcacuacaggaagagga

SEQ ID NO: 502579 - RNA, 20 nt, Human
gggcagagaguggcuacggg

SEQ ID NO: 502580 - RNA, 23 nt, Human
gggcucagccaagcugcugggcc

SEQ ID NO: 502581 - RNA, 21 nt, Human
gggcuccuggacucggccccu

SEQ ID NO: 502582 - RNA, 21 nt, Human
gggcugugcagccagucuggc

SEQ ID NO: 502583 - RNA, 22 nt, Human
ggggcucagccaagcugcuggg

SEQ ID NO: 502584 - RNA, 24 nt, Human
gggguggagguggcuguggccaug

SEQ ID NO: 502585 - RNA, 19 nt, Human
gggugaggggagggagaag

SEQ ID NO: 502586 - RNA, 19 nt, Human
gguggccugcagaccugcu

SEQ ID NO: 502587 - RNA, 21 nt, Human
gugcugggcucccacuagggc

SEQ ID NO: 502588 - RNA, 18 nt, Human
gugggaggcagaccccuc

SEQ ID NO: 502589 - RNA, 18 nt, Human
uaaaaguuucuuggaggc

SEQ ID NO: 502590 - RNA, 24 nt, Human
uacccccucuccccccugcccccc

SEQ ID NO: 502591 - RNA, 19 nt, Human
uacggggaggagaccaggg

SEQ ID NO: 502592 - RNA, 19 nt, Human
uacugggcccaagccucag

SEQ ID NO: 502593 - RNA, 19 nt, Human
uagaagcauagguaguggg

SEQ ID NO: 502594 - RNA, 20 nt, Human
ucagcccucaccauuggcuc

SEQ ID NO: 502595 - RNA, 22 nt, Human
ucagccuggagccuggagccag

SEQ ID NO: 502596 - RNA, 22 nt, Human
ucccagacuccucugagcucug

SEQ ID NO: 502597 - RNA, 22 nt, Human
ucccaggcacagagcagacccc

SEQ ID NO: 502598 - RNA, 21 nt, Human
uccccgggccagcccugagug

SEQ ID NO: 502599 - RNA, 19 nt, Human
uccccucugccagcccaga

SEQ ID NO: 502600 - RNA, 24 nt, Human
ucccgggaccuaagaggaccuugg

SEQ ID NO: 502601 - RNA, 23 nt, Human
ucccugagccagggaaagcugau

SEQ ID NO: 502602 - RNA, 19 nt, Human
ucccuggcugccagucucu

SEQ ID NO: 502603 - RNA, 20 nt, Human
ucccuggcugccagucucug

SEQ ID NO: 502604 - RNA, 23 nt, Human
ucucucuccuccuggggguuucu

SEQ ID NO: 502605 - RNA, 18 nt, Human
ugaaaucccccgccuucc

SEQ ID NO: 502606 - RNA, 22 nt, Human
ugaccacccagccacagcccuc

SEQ ID NO: 502607 - RNA, 22 nt, Human
ugagaacaggaaccacccuccc

SEQ ID NO: 502608 - RNA, 22 nt, Human
ugagccagggaaagcugaugcc

SEQ ID NO: 502609 - RNA, 21 nt, Human
ugagcucugccccgggcuccc

SEQ ID NO: 502610 - RNA, 25 nt, Human
ugaggggagggagaagaucccugag

SEQ ID NO: 502611 - RNA, 23 nt, Human
ugcaggggcacucgagccccuuc

SEQ ID NO: 502612 - RNA, 18 nt, Human
ugccccgggcucccuggc

SEQ ID NO: 502613 - RNA, 22 nt, Human
ugccccgggcucccuggcugcc

SEQ ID NO: 502614 - RNA, 22 nt, Human
ugcuaaggaaugcuugugcucc

SEQ ID NO: 502615 - RNA, 21 nt, Human
ugcuaaggaaugcuugugcuu

SEQ ID NO: 502616 - RNA, 20 nt, Human
ugcugggccaugggaggggc

SEQ ID NO: 502617 - RNA, 21 nt, Human
ugcugggcucccacuagggcu

SEQ ID NO: 502618 - RNA, 18 nt, Human
uggaauguauuauguggg

SEQ ID NO: 502619 - RNA, 25 nt, Human
uggagguuucuuggggguggaggug

SEQ ID NO: 502620 - RNA, 19 nt, Human
uggcagagagugcccucag

SEQ ID NO: 502621 - RNA, 19 nt, Human
uggccuccauuacccccuc

SEQ ID NO: 502622 - RNA, 21 nt, Human
uggcuguggccaugcacuccu

SEQ ID NO: 502623 - RNA, 25 nt, Human
uggcugugugugugugugugugugg

SEQ ID NO: 502624 - RNA, 25 nt, Human
uggcugugugugugugugugugugu

SEQ ID NO: 502625 - RNA, 20 nt, Human
ugggaagggcuggcuggggc

SEQ ID NO: 502626 - RNA, 19 nt, Human
ugggagggcugggcagcgg

SEQ ID NO: 502627 - RNA, 22 nt, Human
ugggagggcugggcagcgggug

SEQ ID NO: 502628 - RNA, 23 nt, Human
uggggcuacugggcccaagccuc

SEQ ID NO: 502629 - RNA, 18 nt, Human
uggggguggagguggcug

SEQ ID NO: 502630 - RNA, 23 nt, Human
uggugaugcucuccugaggccuu

SEQ ID NO: 502631 - RNA, 22 nt, Human
uguggccaugcacuccuuugga

SEQ ID NO: 502632 - RNA, 24 nt, Human
ugugguggugaugcucuccugagg

SEQ ID NO: 502633 - RNA, 21 nt, Human
uguguggcaagaaagcagaau

SEQ ID NO: 502634 - RNA, 19 nt, Human
uguguguguguguguagca

SEQ ID NO: 502635 - RNA, 23 nt, Human
uguguguguguguguagcaaucu

SEQ ID NO: 502636 - RNA, 18 nt, Human
ugugugugugugugugug

SEQ ID NO: 502637 - RNA, 18 nt, Human
ugugugugugugugugug

SEQ ID NO: 502638 - RNA, 18 nt, Human
ugugugugugugugugug

SEQ ID NO: 502639 - RNA, 18 nt, Human
ugugugugugugugugug

SEQ ID NO: 502640 - RNA, 18 nt, Human
ugugugugugugugugug

SEQ ID NO: 502641 - RNA, 18 nt, Human
ugugugugugugugugug

SEQ ID NO: 502642 - RNA, 18 nt, Human
ugugugugugugugugug

SEQ ID NO: 502643 - RNA, 18 nt, Human
ugugugugugugugugug

SEQ ID NO: 502644 - RNA, 18 nt, Human
ugugugugugugugugug

SEQ ID NO: 502645 - RNA, 18 nt, Human
ugugugugugugugugug

SEQ ID NO: 502646 - RNA, 18 nt, Human
ugugugugugugugugug

SEQ ID NO: 502647 - RNA, 22 nt, Human
ugugugugugugugugugugag

SEQ ID NO: 502648 - RNA, 21 nt, Human
ugugugugugugugugugugu

SEQ ID NO: 502649 - RNA, 21 nt, Human
ugugugugugugugugugugu

SEQ ID NO: 502650 - RNA, 21 nt, Human
ugugugugugugugugugugu

SEQ ID NO: 502651 - RNA, 21 nt, Human
ugugugugugugugugugugu

SEQ ID NO: 502652 - RNA, 21 nt, Human
ugugugugugugugugugugu

SEQ ID NO: 502653 - RNA, 21 nt, Human
ugugugugugugugugugugu

SEQ ID NO: 502654 - RNA, 21 nt, Human
ugugugugugugugugugugu

SEQ ID NO: 502655 - RNA, 21 nt, Human
ugugugugugugugugugugu

SEQ ID NO: 502656 - RNA, 21 nt, Human
ugugugugugugugugugugu

SEQ ID NO: 502657 - RNA, 21 nt, Human
ugugugugugugugugugugu

SEQ ID NO: 502658 - RNA, 21 nt, Human
ugugugugugugugugugugu

SEQ ID NO: 502659 - RNA, 21 nt, Human
ugugugugugugugugugugu

SEQ ID NO: 502660 - RNA, 21 nt, Human
ugugugugugugugugugugu

SEQ ID NO: 502661 - RNA, 21 nt, Human
ugugugugugugugugugugu

SEQ ID NO: 502662 - RNA, 21 nt, Human
ugugugugugugugugugugu

SEQ ID NO: 502663 - RNA, 21 nt, Human
ugugugugugugugugugugu

SEQ ID NO: 502664 - RNA, 21 nt, Human
ugugugugugugugugugugu

SEQ ID NO: 502665 - RNA, 21 nt, Human
ugugugugugugugugugugu

SEQ ID NO: 502666 - RNA, 22 nt, Human
ugugugugugugugugugugua

SEQ ID NO: 502667 - RNA, 22 nt, Human
ugugugugugugugugugugug

SEQ ID NO: 502668 - RNA, 22 nt, Human
ugugugugugugugugugugug

SEQ ID NO: 502669 - RNA, 22 nt, Human
ugugugugugugugugugugug

SEQ ID NO: 502670 - RNA, 22 nt, Human
ugugugugugugugugugugug

SEQ ID NO: 502671 - RNA, 22 nt, Human
ugugugugugugugugugugug

SEQ ID NO: 502672 - RNA, 22 nt, Human
ugugugugugugugugugugug

SEQ ID NO: 502673 - RNA, 22 nt, Human
ugugugugugugugugugugug

SEQ ID NO: 502674 - RNA, 22 nt, Human
ugugugugugugugugugugug

SEQ ID NO: 502675 - RNA, 22 nt, Human
uuggggguggagguggcugugg

SEQ ID NO: 502676 - RNA, 24 nt, Human
uuuccagaaagcugcaggcuuggc

SEQ ID NO: 502677 - RNA, 25 nt, Human
uuucuuggggguggagguggcugug

SEQ ID NO: 502678 - RNA, 18 nt, Human
uuuggggccccacugauc

SEQ ID NO: 502679 - RNA, 19 nt, Human
uuuuuuuuuuuuuuuccuu

SEQ ID NO: 502680 - RNA, 19 nt, Human
aaaaggccaagcacagugg

SEQ ID NO: 502681 - RNA, 24 nt, Human
aaagcaccugacucagugccuagc

SEQ ID NO: 502682 - RNA, 20 nt, Human
aaagugcugggauuuacaaa

SEQ ID NO: 502683 - RNA, 25 nt, Human
aaagugcugggauuuacaaacauga

SEQ ID NO: 502684 - RNA, 20 nt, Human
aacauaguaagacugcaucu

SEQ ID NO: 502685 - RNA, 22 nt, Human
aacauuuugggaggccaaggca

SEQ ID NO: 502686 - RNA, 23 nt, Human
aagcacagugcucaugccuguaa

SEQ ID NO: 502687 - RNA, 21 nt, Human
aagcacagugguucaugccug

SEQ ID NO: 502688 - RNA, 20 nt, Human
aagcagaaguacugaaaugu

SEQ ID NO: 502689 - RNA, 18 nt, Human
aaggacugucaggaggga

SEQ ID NO: 502690 - RNA, 23 nt, Human
aaggcaggaggaccacuugaggc

SEQ ID NO: 502691 - RNA, 18 nt, Human
acaaacaugagccaccau

SEQ ID NO: 502692 - RNA, 22 nt, Human
acacauuaaagauugagaagcu

SEQ ID NO: 502693 - RNA, 22 nt, Human
acagaaacauguuccaucuaca

SEQ ID NO: 502694 - RNA, 21 nt, Human
acauaguaagacugcaucucu

SEQ ID NO: 502695 - RNA, 23 nt, Human
acgccagguguuugaauaaagac

SEQ ID NO: 502696 - RNA, 22 nt, Human
agcacaguaaguacucaauaag

SEQ ID NO: 502697 - RNA, 22 nt, Human
agccugggcaacauaguaagac

SEQ ID NO: 502698 - RNA, 23 nt, Human
agccugggcaacauaguaagacu

SEQ ID NO: 502699 - RNA, 19 nt, Human
agcuugccaagcacagugc

SEQ ID NO: 502700 - RNA, 18 nt, Human
aggcaggaggaccacuug

SEQ ID NO: 502701 - RNA, 24 nt, Human
agugguucaugccuguacuaucag

SEQ ID NO: 502702 - RNA, 23 nt, Human
caaaaccaacucggccuucccaa

SEQ ID NO: 502703 - RNA, 23 nt, Human
caaaaccaacucggccuucccaa

SEQ ID NO: 502704 - RNA, 25 nt, Human
caaagugcugggauuuacaaacaug

SEQ ID NO: 502705 - RNA, 25 nt, Human
caacauaguaagacugcaucucuac

SEQ ID NO: 502706 - RNA, 24 nt, Human
caacauuuugggaggccaaggcag

SEQ ID NO: 502707 - RNA, 24 nt, Human
caacauuuugggaggccaaggcag

SEQ ID NO: 502708 - RNA, 26 nt, Human
caaggcaggaggaccacuugaggcca

SEQ ID NO: 502709 - RNA, 18 nt, Human
cacaguuuuguuuguugg

SEQ ID NO: 502710 - RNA, 24 nt, Human
caccuugggaggccaggaguucaa

SEQ ID NO: 502711 - RNA, 19 nt, Human
cagcaccuugggaggccag

SEQ ID NO: 502712 - RNA, 20 nt, Human
cagcaccuugggaggccagg

SEQ ID NO: 502713 - RNA, 21 nt, Human
cagcuggacccccugggagcu

SEQ ID NO: 502714 - RNA, 19 nt, Human
cagcuuacccccuuccaua

SEQ ID NO: 502715 - RNA, 22 nt, Human
cagcuuacccccuuccauaggg

SEQ ID NO: 502716 - RNA, 20 nt, Human
ccaaagugcugggauuuaca

SEQ ID NO: 502717 - RNA, 25 nt, Human
ccaaagugcugggauuuacaaacau

SEQ ID NO: 502718 - RNA, 20 nt, Human
ccuguaauugcaacauuuug

SEQ ID NO: 502719 - RNA, 22 nt, Human
ccuguaauugcaacauuuuggg

SEQ ID NO: 502720 - RNA, 24 nt, Human
ccuguaauugcaacauuuugggag

SEQ ID NO: 502721 - RNA, 22 nt, Human
ccuguacuaucagcaccuuggg

SEQ ID NO: 502722 - RNA, 18 nt, Human
cucaagagaaugaaaucc

SEQ ID NO: 502723 - RNA, 23 nt, Human
cucaauaagcagaaguacugaaa

SEQ ID NO: 502724 - RNA, 24 nt, Human
cucaugccuguaauugcaacauuu

SEQ ID NO: 502725 - RNA, 21 nt, Human
gaaaauccuccuuagcuugcc

SEQ ID NO: 502726 - RNA, 24 nt, Human
gaagauuuuucuggaaguggcugu

SEQ ID NO: 502727 - RNA, 24 nt, Human
gaccacuugaggccaggaguuuga

SEQ ID NO: 502728 - RNA, 18 nt, Human
gcaacauuuugggaggcc

SEQ ID NO: 502729 - RNA, 23 nt, Human
gcuguuggccgacgccagguguu

SEQ ID NO: 502730 - RNA, 23 nt, Human
ggaccacuugaggccaggaguuu

SEQ ID NO: 502731 - RNA, 23 nt, Human
ggauuuacaaacaugagccacca

SEQ ID NO: 502732 - RNA, 24 nt, Human
gggauuuacaaacaugagccacca

SEQ ID NO: 502733 - RNA, 22 nt, Human
guacugaaauguccugacacca

SEQ ID NO: 502734 - RNA, 23 nt, Human
uaaaaggccaagcacagugguuc

SEQ ID NO: 502735 - RNA, 18 nt, Human
uaaagauugagaagcuca

SEQ ID NO: 502736 - RNA, 20 nt, Human
uaagacaacagacucuauaa

SEQ ID NO: 502737 - RNA, 21 nt, Human
uaagacaacagacucuauaac

SEQ ID NO: 502738 - RNA, 23 nt, Human
uacaaaauuuuaaaaggccaagc

SEQ ID NO: 502739 - RNA, 24 nt, Human
uacaaacaugagccaccaugccug

SEQ ID NO: 502740 - RNA, 18 nt, Human
uagcuugccaagcacagu

SEQ ID NO: 502741 - RNA, 22 nt, Human
ucaaaaccaacucggccuuccc

SEQ ID NO: 502742 - RNA, 23 nt, Human
uccaucuacagcguaaacuggaa

SEQ ID NO: 502743 - RNA, 18 nt, Human
ucccaaagugcugggauu

SEQ ID NO: 502744 - RNA, 18 nt, Human
ucucuacaaaauuuuaaa

SEQ ID NO: 502745 - RNA, 20 nt, Human
ucugcuuaagacaacagacu

SEQ ID NO: 502746 - RNA, 21 nt, Human
ugacagcuggacccccuggga

SEQ ID NO: 502747 - RNA, 18 nt, Human
ugacucagugccuagcac

SEQ ID NO: 502748 - RNA, 20 nt, Human
ugacucagugccuagcacag

SEQ ID NO: 502749 - RNA, 18 nt, Human
ugccuguacuaucagcac

SEQ ID NO: 502750 - RNA, 21 nt, Human
ugccuguacuaucagcaccuu

SEQ ID NO: 502751 - RNA, 25 nt, Human
ugcugggauuuacaaacaugagcca

SEQ ID NO: 502752 - RNA, 24 nt, Human
ugggaggccaaggcaggaggacca

SEQ ID NO: 502753 - RNA, 24 nt, Human
ugggaggccaggaguucaaaacca

SEQ ID NO: 502754 - RNA, 18 nt, Human
uguuggugccuugaaaag

SEQ ID NO: 502755 - RNA, 26 nt, Human
uucaaaaccaacucggccuucccaaa

SEQ ID NO: 502756 - RNA, 20 nt, Human
uucacagaaacauguuccau

SEQ ID NO: 502757 - RNA, 21 nt, Human
uucagaaucggcaucuauucc

SEQ ID NO: 502758 - RNA, 20 nt, Human
uuugaauaaagacagcagca

SEQ ID NO: 502759 - RNA, 25 nt, Human
aaaaaggaaaaacaacacaagagaa

SEQ ID NO: 502760 - RNA, 25 nt, Human
aaacaacacaagagaacacauaucg

SEQ ID NO: 502761 - RNA, 23 nt, Human
aaaggcaucucagcaacacagaa

SEQ ID NO: 502762 - RNA, 20 nt, Human
aaagggagcugggaaguccc

SEQ ID NO: 502763 - RNA, 18 nt, Human
aaagucagugaagaccag

SEQ ID NO: 502764 - RNA, 20 nt, Human
aaauaaucacccgagggcaa

SEQ ID NO: 502765 - RNA, 21 nt, Human
aaccguaagggugucauagcc

SEQ ID NO: 502766 - RNA, 23 nt, Human
aagagcaaagguauggaaggaca

SEQ ID NO: 502767 - RNA, 19 nt, Human
aagcaggagcagcgacugg

SEQ ID NO: 502768 - RNA, 20 nt, Human
aagggagcugggaaguccca

SEQ ID NO: 502769 - RNA, 20 nt, Human
aaucacccgagggcaaggcg

SEQ ID NO: 502770 - RNA, 22 nt, Human
aaucgccuuuuucacuuggaac

SEQ ID NO: 502771 - RNA, 18 nt, Human
acaaugaggucaggaaca

SEQ ID NO: 502772 - RNA, 19 nt, Human
acagaaauaugaaagucug

SEQ ID NO: 502773 - RNA, 20 nt, Human
accaagguguacccggggug

SEQ ID NO: 502774 - RNA, 20 nt, Human
accaaugcaacaccuccuug

SEQ ID NO: 502775 - RNA, 21 nt, Human
acccuggacuaagccuccaca

SEQ ID NO: 502776 - RNA, 22 nt, Human
acuauagaggagggcagcugaa

SEQ ID NO: 502777 - RNA, 22 nt, Human
acuguggugccugagaagcuuc

SEQ ID NO: 502778 - RNA, 20 nt, Human
agagagcccggucccaagac

SEQ ID NO: 502779 - RNA, 22 nt, Human
agauuggauccacauguucucg

SEQ ID NO: 502780 - RNA, 21 nt, Human
agcuugaugaccuuguccggg

SEQ ID NO: 502781 - RNA, 24 nt, Human
agcuugaugaccuuguccgggucg

SEQ ID NO: 502782 - RNA, 21 nt, Human
aggagccucgcgcacagcacc

SEQ ID NO: 502783 - RNA, 24 nt, Human
aggcaucucagcaacacagaaaua

SEQ ID NO: 502784 - RNA, 24 nt, Human
agggagcugggaagucccacgaug

SEQ ID NO: 502785 - RNA, 19 nt, Human
agucugucgugaaccacag

SEQ ID NO: 502786 - RNA, 18 nt, Human
aucuggacacaugucaga

SEQ ID NO: 502787 - RNA, 19 nt, Human
auggagucguagccaauuc

SEQ ID NO: 502788 - RNA, 18 nt, Human
auggugccguucugagaa

SEQ ID NO: 502789 - RNA, 18 nt, Human
augucugcagauacucca

SEQ ID NO: 502790 - RNA, 24 nt, Human
auguguccacaaagaugguaaugu

SEQ ID NO: 502791 - RNA, 23 nt, Human
caaaagggagcugggaaguccca

SEQ ID NO: 502792 - RNA, 23 nt, Human
caaaaucuucuucaagagcaaag

SEQ ID NO: 502793 - RNA, 22 nt, Human
caaaggcaagcuugaugaccuu

SEQ ID NO: 502794 - RNA, 20 nt, Human
caaauaaucacccgagggca

SEQ ID NO: 502795 - RNA, 21 nt, Human
caaauaaucacccgagggcaa

SEQ ID NO: 502796 - RNA, 22 nt, Human
caagagaacacauaucguggug

SEQ ID NO: 502797 - RNA, 22 nt, Human
cacacagugugcauuaucuuca

SEQ ID NO: 502798 - RNA, 22 nt, Human
cacagcaccagcagcccgagaa

SEQ ID NO: 502799 - RNA, 27 nt, Human
cacagcaccagcagcccgagaagcagg

SEQ ID NO: 502800 - RNA, 31 nt, Human
caccagcagcccgagaagcaggagcagcgag

SEQ ID NO: 502801 - RNA, 24 nt, Human
caccgugaugagccaaaugcaguc

SEQ ID NO: 502802 - RNA, 22 nt, Human
caccuucccagcaucaccaacc

SEQ ID NO: 502803 - RNA, 23 nt, Human
cacgaugcaccauuuccugggcu

SEQ ID NO: 502804 - RNA, 25 nt, Human
cacgcagucaugucugcagauacuc

SEQ ID NO: 502805 - RNA, 23 nt, Human
cacucgaaagauacugauugccc

SEQ ID NO: 502806 - RNA, 20 nt, Human
cagcagugccgguacugugg

SEQ ID NO: 502807 - RNA, 21 nt, Human
cagccagaaugguccaggugc

SEQ ID NO: 502808 - RNA, 24 nt, Human
cagcccgagaagcaggagcagcga

SEQ ID NO: 502809 - RNA, 24 nt, Human
cagcgacuggaaucuccuccacgc

SEQ ID NO: 502810 - RNA, 18 nt, Human
cagcgagcgucucuguaa

SEQ ID NO: 502811 - RNA, 19 nt, Human
caggguguacccgggcucg

SEQ ID NO: 502812 - RNA, 19 nt, Human
caguaaagccagaguggaa

SEQ ID NO: 502813 - RNA, 19 nt, Human
caguaugauucccacuuaa

SEQ ID NO: 502814 - RNA, 18 nt, Human
cagugccgguacuguggu

SEQ ID NO: 502815 - RNA, 19 nt, Human
cauacagaugcagccaggc

SEQ ID NO: 502816 - RNA, 27 nt, Human
cauuucugccuguggaaccgcuggggg

SEQ ID NO: 502817 - RNA, 21 nt, Human
ccaaauaaucacccgagggca

SEQ ID NO: 502818 - RNA, 21 nt, Human
ccacugaucucuaagaaauca

SEQ ID NO: 502819 - RNA, 24 nt, Human
ccaggugcagucuaaguuguuggg

SEQ ID NO: 502820 - RNA, 23 nt, Human
ccaguuucuguugaucccaugcu

SEQ ID NO: 502821 - RNA, 19 nt, Human
cccgugaugaugauccagg

SEQ ID NO: 502822 - RNA, 19 nt, Human
cccuuguugaggcugucca

SEQ ID NO: 502823 - RNA, 19 nt, Human
ccgccgcgcauccgacgcc

SEQ ID NO: 502824 - RNA, 20 nt, Human
ccgccgcgcauccgacgccu

SEQ ID NO: 502825 - RNA, 20 nt, Human
ccgcuaaauuguccaaucau

SEQ ID NO: 502826 - RNA, 18 nt, Human
ccuggacugagaaugacu

SEQ ID NO: 502827 - RNA, 20 nt, Human
ccuggagcacguaauugucc

SEQ ID NO: 502828 - RNA, 22 nt, Human
cgaaagauacugauugccccac

SEQ ID NO: 502829 - RNA, 18 nt, Human
cgcacagcaccagcagcc

SEQ ID NO: 502830 - RNA, 18 nt, Human
cgcgcauccgacgccucc

SEQ ID NO: 502831 - RNA, 23 nt, Human
cgcguuguucucguacucugaag

SEQ ID NO: 502832 - RNA, 26 nt, Human
cucaggaucacaccacccaaggugcu

SEQ ID NO: 502833 - RNA, 20 nt, Human
cuccacacgcacgcgacacc

SEQ ID NO: 502834 - RNA, 22 nt, Human
cuccacacgcacgcgacaccga

SEQ ID NO: 502835 - RNA, 20 nt, Human
cuccacaguucugacccuuc

SEQ ID NO: 502836 - RNA, 23 nt, Human
cucugcaaaagggagcugggaag

SEQ ID NO: 502837 - RNA, 20 nt, Human
cucuugacuucaacucaauc

SEQ ID NO: 502838 - RNA, 21 nt, Human
cuggcagaguggcgugaggga

SEQ ID NO: 502839 - RNA, 23 nt, Human
cugggcagcaucuugacuccucu

SEQ ID NO: 502840 - RNA, 21 nt, Human
cuguacauuugcaccaacccu

SEQ ID NO: 502841 - RNA, 19 nt, Human
cuuggcaugcagcaagacc

SEQ ID NO: 502842 - RNA, 22 nt, Human
gaagaaccaucaaacacuucca

SEQ ID NO: 502843 - RNA, 21 nt, Human
gaaggucugggcgcccggcuc

SEQ ID NO: 502844 - RNA, 19 nt, Human
gaauguacccaggauaaca

SEQ ID NO: 502845 - RNA, 25 nt, Human
gacuggaaucuccuccaaccggagg

SEQ ID NO: 502846 - RNA, 18 nt, Human
gagcacauacaagaccga

SEQ ID NO: 502847 - RNA, 19 nt, Human
gaguggaagggagaguggu

SEQ ID NO: 502848 - RNA, 23 nt, Human
gauaacacucgaaagauacugau

SEQ ID NO: 502849 - RNA, 22 nt, Human
gaucacaccacccaaggugcuc

SEQ ID NO: 502850 - RNA, 20 nt, Human
gaugcaccauuuccugggcu

SEQ ID NO: 502851 - RNA, 21 nt, Human
gcacagcaccagcagcccgag

SEQ ID NO: 502852 - RNA, 22 nt, Human
gcagguagaguugguuggaagu

SEQ ID NO: 502853 - RNA, 23 nt, Human
gcagucaugucugcagauacucc

SEQ ID NO: 502854 - RNA, 23 nt, Human
gcaguccgcguuguucucguacu

SEQ ID NO: 502855 - RNA, 19 nt, Human
gcaucuugacuccucuuga

SEQ ID NO: 502856 - RNA, 21 nt, Human
gcccgagaagcaggagcagcg

SEQ ID NO: 502857 - RNA, 21 nt, Human
gcccggcucgcuucccucuca

SEQ ID NO: 502858 - RNA, 18 nt, Human
ggaaacccugggcucuca

SEQ ID NO: 502859 - RNA, 19 nt, Human
ggaacugagcguuaaaucc

SEQ ID NO: 502860 - RNA, 19 nt, Human
ggaccgucccaaacagcaa

SEQ ID NO: 502861 - RNA, 18 nt, Human
ggauccacauguucucgc

SEQ ID NO: 502862 - RNA, 23 nt, Human
ggcagcaucuugacuccucuuga

SEQ ID NO: 502863 - RNA, 19 nt, Human
ggcucagccagaauggucc

SEQ ID NO: 502864 - RNA, 25 nt, Human
gggcauugugcuucacauguuggga

SEQ ID NO: 502865 - RNA, 21 nt, Human
gggccggggccggggacgagc

SEQ ID NO: 502866 - RNA, 22 nt, Human
gucccaagacccgccgcgcauc

SEQ ID NO: 502867 - RNA, 19 nt, Human
gucggugguugcugucaga

SEQ ID NO: 502868 - RNA, 24 nt, Human
gucugggaguuaaaauaauuaccc

SEQ ID NO: 502869 - RNA, 19 nt, Human
gugcauuaucuucauacug

SEQ ID NO: 502870 - RNA, 19 nt, Human
guggaaccgcugggggagg

SEQ ID NO: 502871 - RNA, 21 nt, Human
guggaucuggacaguucugua

SEQ ID NO: 502872 - RNA, 18 nt, Human
uaaauucccuuguugagg

SEQ ID NO: 502873 - RNA, 21 nt, Human
uaacugauuacuccugcuugu

SEQ ID NO: 502874 - RNA, 19 nt, Human
uaagcauuucugccugugg

SEQ ID NO: 502875 - RNA, 19 nt, Human
uacccuggacugagaauga

SEQ ID NO: 502876 - RNA, 22 nt, Human
uacccuggacugagaaugacuc

SEQ ID NO: 502877 - RNA, 21 nt, Human
uagguaaaacuucauauaaug

SEQ ID NO: 502878 - RNA, 21 nt, Human
uaguuugauccguagaagacc

SEQ ID NO: 502879 - RNA, 22 nt, Human
uauaacugauuacuccugcuug

SEQ ID NO: 502880 - RNA, 24 nt, Human
ucaaaaucuucuucaagagcaaag

SEQ ID NO: 502881 - RNA, 19 nt, Human
ucagcgucccuccacaggu

SEQ ID NO: 502882 - RNA, 20 nt, Human
uccacacgcacgcgacaccg

SEQ ID NO: 502883 - RNA, 22 nt, Human
uccacgagcccagacgauugca

SEQ ID NO: 502884 - RNA, 20 nt, Human
uccuguuggggcacugaggg

SEQ ID NO: 502885 - RNA, 22 nt, Human
ucguucaccauguaccgaucuc

SEQ ID NO: 502886 - RNA, 21 nt, Human
ucucccaccuucccagcauca

SEQ ID NO: 502887 - RNA, 22 nt, Human
ucugaaauggggguggaucugg

SEQ ID NO: 502888 - RNA, 24 nt, Human
ucugaggcauugaguaugacgugu

SEQ ID NO: 502889 - RNA, 22 nt, Human
ucuguaacucucugacagguga

SEQ ID NO: 502890 - RNA, 26 nt, Human
ucugucgugaaccacagagugaggau

SEQ ID NO: 502891 - RNA, 24 nt, Human
ucuugcuacugauaacuggagagg

SEQ ID NO: 502892 - RNA, 21 nt, Human
ugaaaggcaucucagcaacac

SEQ ID NO: 502893 - RNA, 19 nt, Human
ugaagggaagugcgggcug

SEQ ID NO: 502894 - RNA, 18 nt, Human
ugaagucggaaccugcuc

SEQ ID NO: 502895 - RNA, 19 nt, Human
ugagcacauacaagaccga

SEQ ID NO: 502896 - RNA, 20 nt, Human
ugagcaggacuugguuggug

SEQ ID NO: 502897 - RNA, 18 nt, Human
ugauccguagaagacccu

SEQ ID NO: 502898 - RNA, 21 nt, Human
ugcagccaggcauuuagaacc

SEQ ID NO: 502899 - RNA, 24 nt, Human
ugccuguggaaccgcugggggagg

SEQ ID NO: 502900 - RNA, 20 nt, Human
ugcuuugaaaccuugggcac

SEQ ID NO: 502901 - RNA, 18 nt, Human
uggaaaccagcagcugcc

SEQ ID NO: 502902 - RNA, 18 nt, Human
uggaaggagagcacgucg

SEQ ID NO: 502903 - RNA, 23 nt, Human
uggaaggagagcacgucguucac

SEQ ID NO: 502904 - RNA, 19 nt, Human
uggaagggagagugguaua

SEQ ID NO: 502905 - RNA, 21 nt, Human
uggaagggagagugguauaug

SEQ ID NO: 502906 - RNA, 24 nt, Human
uggaaucccaggaucuggacacau

SEQ ID NO: 502907 - RNA, 24 nt, Human
uggauggagcuuccgugccacuga

SEQ ID NO: 502908 - RNA, 22 nt, Human
uggcacugguacuucacaaaau

SEQ ID NO: 502909 - RNA, 28 nt, Human
uggcauaguucggauacccgugaggaaa

SEQ ID NO: 502910 - RNA, 22 nt, Human
uggcauggucaguggaccagcg

SEQ ID NO: 502911 - RNA, 19 nt, Human
uggcuagguaaaacuucau

SEQ ID NO: 502912 - RNA, 19 nt, Human
ugggaacugagcuugcaag

SEQ ID NO: 502913 - RNA, 23 nt, Human
ugggaagccggggcucaggauca

SEQ ID NO: 502914 - RNA, 22 nt, Human
ugggacccuggacuaagccucc

SEQ ID NO: 502915 - RNA, 21 nt, Human
uggggguggaucuggacaguu

SEQ ID NO: 502916 - RNA, 19 nt, Human
uggucacuccaagcagcga

SEQ ID NO: 502917 - RNA, 22 nt, Human
ugguccaggugcaguccgcguu

SEQ ID NO: 502918 - RNA, 19 nt, Human
uguaccggauuuugucucc

SEQ ID NO: 502919 - RNA, 21 nt, Human
uguggaaccgcugggggaggu

SEQ ID NO: 502920 - RNA, 22 nt, Human
uguggccgaccauucgguaucc

SEQ ID NO: 502921 - RNA, 21 nt, Human
uguggucacuccaagcagcga

SEQ ID NO: 502922 - RNA, 21 nt, Human
uuccagugcaucaaacugcuu

SEQ ID NO: 502923 - RNA, 18 nt, Human
uucccagucugggugcgg

SEQ ID NO: 502924 - RNA, 21 nt, Human
uuccuccgcaggcucccucag

SEQ ID NO: 502925 - RNA, 30 nt, Human
uuccuccgcaggcucccucagcucugcaaa

SEQ ID NO: 502926 - RNA, 20 nt, Human
uuccugggcugacgaugcag

SEQ ID NO: 502927 - RNA, 24 nt, Human
uuggaacugagcguuaaauccuuu

SEQ ID NO: 502928 - RNA, 22 nt, Human
uuuucuggaaucccaggaucug

SEQ ID NO: 502929 - RNA, 21 nt, Human
aaggagagucaaccaggcagc

SEQ ID NO: 502930 - RNA, 25 nt, Human
acagagucuccuauaguacagcaag

SEQ ID NO: 502931 - RNA, 22 nt, Human
acagcagcacuuagcuuccucc

SEQ ID NO: 502932 - RNA, 21 nt, Human
agaaauggcaggagcugcagg

SEQ ID NO: 502933 - RNA, 21 nt, Human
agagucaaccaggcagcccua

SEQ ID NO: 502934 - RNA, 19 nt, Human
agcagcacuuagcuuccuc

SEQ ID NO: 502935 - RNA, 19 nt, Human
aggcccuggcugcccgcac

SEQ ID NO: 502936 - RNA, 21 nt, Human
caaugggaaggagagucaacc

SEQ ID NO: 502937 - RNA, 24 nt, Human
caccuucacuguaaacaaugggaa

SEQ ID NO: 502938 - RNA, 23 nt, Human
cagccaagugagacguuagguau

SEQ ID NO: 502939 - RNA, 20 nt, Human
ccacuaccuccaccucggca

SEQ ID NO: 502940 - RNA, 20 nt, Human
cccauggcggucugcagcca

SEQ ID NO: 502941 - RNA, 20 nt, Human
ccccaaagaggagucccuuc

SEQ ID NO: 502942 - RNA, 19 nt, Human
ccccagggccugaggacuc

SEQ ID NO: 502943 - RNA, 19 nt, Human
ccuuuuccucuuaaagaaa

SEQ ID NO: 502944 - RNA, 23 nt, Human
cugggggcaucuguuuucuucuu

SEQ ID NO: 502945 - RNA, 20 nt, Human
cuuccaaugagaaauggcag

SEQ ID NO: 502946 - RNA, 18 nt, Human
cuuccuccacuaccucca

SEQ ID NO: 502947 - RNA, 24 nt, Human
gcacuuagcuuccuccacuaccuc

SEQ ID NO: 502948 - RNA, 20 nt, Human
gccccuucugggggcaucug

SEQ ID NO: 502949 - RNA, 21 nt, Human
ggccccuucugggggcaucug

SEQ ID NO: 502950 - RNA, 21 nt, Human
gucacuuguggcgcugagcag

SEQ ID NO: 502951 - RNA, 21 nt, Human
uaaccaccugcacugaucccc

SEQ ID NO: 502952 - RNA, 19 nt, Human
ucauaugugacuuuugucc

SEQ ID NO: 502953 - RNA, 23 nt, Human
uccccagggccugaggacuccug

SEQ ID NO: 502954 - RNA, 21 nt, Human
ucccccaaagaggagucccuu

SEQ ID NO: 502955 - RNA, 21 nt, Human
ucuccuauaguacagcaaguu

SEQ ID NO: 502956 - RNA, 20 nt, Human
ucuuaaagaaacagcagcac

SEQ ID NO: 502957 - RNA, 20 nt, Human
ugaaugacaccuucacugua

SEQ ID NO: 502958 - RNA, 22 nt, Human
ugagcagucuucuuccuuuucc

SEQ ID NO: 502959 - RNA, 27 nt, Human
uggaggaacagcagcucugggaccugc

SEQ ID NO: 502960 - RNA, 18 nt, Human
uggauauccacccucccc

SEQ ID NO: 502961 - RNA, 21 nt, Human
uggauauccacccucccccaa

SEQ ID NO: 502962 - RNA, 18 nt, Human
uggcaggagcugcaggua

SEQ ID NO: 502963 - RNA, 26 nt, Human
uggcaggagcugcagguacaauugag

SEQ ID NO: 502964 - RNA, 18 nt, Human
uggcgcugagcagucuuc

SEQ ID NO: 502965 - RNA, 20 nt, Human
ugggggcaucuguuuucuuc

SEQ ID NO: 502966 - RNA, 21 nt, Human
uuaaagaaacagcagcacuua

SEQ ID NO: 502967 - RNA, 19 nt, Human
uuccaaugagaaauggcag

SEQ ID NO: 502968 - RNA, 19 nt, Human
uucuucuuuuuaguuugga

SEQ ID NO: 502969 - RNA, 20 nt, Human
uucuucuuuuuaguuuggau

SEQ ID NO: 502970 - RNA, 24 nt, Human
uuguggcgcugagcagucuucuuc

SEQ ID NO: 502971 - RNA, 21 nt, Human
caagaaauagacucuguacaa

SEQ ID NO: 502972 - RNA, 25 nt, Human
ccccacccacuaccccgcuuccucu

SEQ ID NO: 502973 - RNA, 19 nt, Human
ccccgcuuccucucuucuu

SEQ ID NO: 502974 - RNA, 22 nt, Human
ccuacccccacccacuaccccg

SEQ ID NO: 502975 - RNA, 19 nt, Human
ucccuacccccacccacua

SEQ ID NO: 502976 - RNA, 22 nt, Human
ucccuacccccacccacuaccc

SEQ ID NO: 502977 - RNA, 23 nt, Human
ucccuacccccacccacuacccc

SEQ ID NO: 502978 - RNA, 20 nt, Human
uucccuacccccacccacua

SEQ ID NO: 502979 - RNA, 22 nt, Human
uuucuucccuacccccacccac

SEQ ID NO: 502980 - RNA, 23 nt, Human
aaaucuaugcccuaaccuugcgg

SEQ ID NO: 502981 - RNA, 18 nt, Human
aacaggagaccuccaccc

SEQ ID NO: 502982 - RNA, 21 nt, Human
aaccaguugcacauccaggac

SEQ ID NO: 502983 - RNA, 23 nt, Human
aagcagcuuuagaguguagccaa

SEQ ID NO: 502984 - RNA, 20 nt, Human
aagguuuccuuggggcuuuu

SEQ ID NO: 502985 - RNA, 18 nt, Human
acccgcaaagguuuccuu

SEQ ID NO: 502986 - RNA, 27 nt, Human
agcaagggaggcagcugugcagagaga

SEQ ID NO: 502987 - RNA, 22 nt, Human
aggagggugcggaaaggcuuug

SEQ ID NO: 502988 - RNA, 21 nt, Human
agggguuggcccuucugcagc

SEQ ID NO: 502989 - RNA, 20 nt, Human
agggugcggaaaggcuuuga

SEQ ID NO: 502990 - RNA, 20 nt, Human
auaugugugcaugugugugu

SEQ ID NO: 502991 - RNA, 27 nt, Human
auccucccuaccacuccaaaggagccc

SEQ ID NO: 502992 - RNA, 18 nt, Human
aucugcucugcgccccuc

SEQ ID NO: 502993 - RNA, 21 nt, Human
augacagagggggccucugug

SEQ ID NO: 502994 - RNA, 23 nt, Human
auguguaugugugcaugugcgug

SEQ ID NO: 502995 - RNA, 22 nt, Human
augugugcaugcauguguaugu

SEQ ID NO: 502996 - RNA, 33 nt, Human
augugugcaugugugugcaugcauguguguggu

SEQ ID NO: 502997 - RNA, 18 nt, Human
augugugccuguguaugu

SEQ ID NO: 502998 - RNA, 22 nt, Human
augugugugcaugcaugugugu

SEQ ID NO: 502999 - RNA, 22 nt, Human
augugugugugcauguguaugu

SEQ ID NO: 503000 - RNA, 24 nt, Human
auuucccagcgccccucucugcca

SEQ ID NO: 503001 - RNA, 19 nt, Human
caaagcagcuuuagagugu

SEQ ID NO: 503002 - RNA, 21 nt, Human
cacugugcugugacagacagg

SEQ ID NO: 503003 - RNA, 20 nt, Human
cacuuugccucuggaguuuu

SEQ ID NO: 503004 - RNA, 25 nt, Human
cagcucccgggucugcugguccccu

SEQ ID NO: 503005 - RNA, 23 nt, Human
caggggacagcucccgggucugc

SEQ ID NO: 503006 - RNA, 21 nt, Human
cauauguaugugugcaugcau

SEQ ID NO: 503007 - RNA, 18 nt, Human
caugaaggcaaagcagcu

SEQ ID NO: 503008 - RNA, 21 nt, Human
cauguguauauauguguuugu

SEQ ID NO: 503009 - RNA, 24 nt, Human
cauguguaugugugcaugcaugug

SEQ ID NO: 503010 - RNA, 20 nt, Human
cauguguaugugugcaugug

SEQ ID NO: 503011 - RNA, 18 nt, Human
caugugugugugcauaca

SEQ ID NO: 503012 - RNA, 23 nt, Human
caugugugugugcauacaugugu

SEQ ID NO: 503013 - RNA, 20 nt, Human
caugugugugugcaugugua

SEQ ID NO: 503014 - RNA, 21 nt, Human
caugugugugugcgugcauau

SEQ ID NO: 503015 - RNA, 22 nt, Human
ccacccgcaaagguuuccuugg

SEQ ID NO: 503016 - RNA, 21 nt, Human
ccacccucagggagagcaagg

SEQ ID NO: 503017 - RNA, 21 nt, Human
ccacucaggcccaauguucca

SEQ ID NO: 503018 - RNA, 22 nt, Human
ccaggggaaacccaguuggccc

SEQ ID NO: 503019 - RNA, 21 nt, Human
cccaaagacagaugugagacc

SEQ ID NO: 503020 - RNA, 18 nt, Human
cccaugcaaagagggcuc

SEQ ID NO: 503021 - RNA, 23 nt, Human
ccccacccgcaaagguuuccuug

SEQ ID NO: 503022 - RNA, 22 nt, Human
cccccaugcagaugaaacuccu

SEQ ID NO: 503023 - RNA, 20 nt, Human
cccgcggccguggggcuccg

SEQ ID NO: 503024 - RNA, 20 nt, Human
ccuccugcccagccagggga

SEQ ID NO: 503025 - RNA, 22 nt, Human
ccugcaaagugcccccaugcag

SEQ ID NO: 503026 - RNA, 28 nt, Human
ccugugcauauaugugugcaugugugug

SEQ ID NO: 503027 - RNA, 28 nt, Human
ccuguguaugugugcaugcauguguaug

SEQ ID NO: 503028 - RNA, 20 nt, Human
cgccguccuaggcgccgccc

SEQ ID NO: 503029 - RNA, 31 nt, Human
cgugcauauguaugugugcaugcauguagug

SEQ ID NO: 503030 - RNA, 18 nt, Human
cguggccccacugugcug

SEQ ID NO: 503031 - RNA, 20 nt, Human
cucuccuccugcccagccag

SEQ ID NO: 503032 - RNA, 18 nt, Human
cugauccucccuaccacu

SEQ ID NO: 503033 - RNA, 19 nt, Human
cugcccucuccuccugccc

SEQ ID NO: 503034 - RNA, 25 nt, Human
cuugugguugccagguccacuuugc

SEQ ID NO: 503035 - RNA, 20 nt, Human
gaaaggcuuugagcagggaa

SEQ ID NO: 503036 - RNA, 24 nt, Human
gagcaagggaggcagcugugcaga

SEQ ID NO: 503037 - RNA, 22 nt, Human
gagcagggaagggcugcucucu

SEQ ID NO: 503038 - RNA, 23 nt, Human
gagcuguaguggagccgggcggc

SEQ ID NO: 503039 - RNA, 25 nt, Human
gaggaggggcugcuuuccuauggca

SEQ ID NO: 503040 - RNA, 18 nt, Human
gauuccuuccaggcugcu

SEQ ID NO: 503041 - RNA, 21 nt, Human
gcaugugcacauguaugugug

SEQ ID NO: 503042 - RNA, 21 nt, Human
gcgggaggcgagagcugcccu

SEQ ID NO: 503043 - RNA, 24 nt, Human
gcgguggaggggguggugccugaa

SEQ ID NO: 503044 - RNA, 20 nt, Human
gcuggagcuguaguggagcc

SEQ ID NO: 503045 - RNA, 24 nt, Human
ggacagucaggagggugcggaaag

SEQ ID NO: 503046 - RNA, 21 nt, Human
ggagagccgugugcgggaggc

SEQ ID NO: 503047 - RNA, 18 nt, Human
ggaggggguggugccuga

SEQ ID NO: 503048 - RNA, 19 nt, Human
ggauuccuuccaggcugcu

SEQ ID NO: 503049 - RNA, 19 nt, Human
ggcaggccacccucaggga

SEQ ID NO: 503050 - RNA, 28 nt, Human
gggaaacugcuggccagcaugggugccc

SEQ ID NO: 503051 - RNA, 23 nt, Human
ggggagcccaaagcugcaggguc

SEQ ID NO: 503052 - RNA, 18 nt, Human
gggggagcccaaagcugc

SEQ ID NO: 503053 - RNA, 21 nt, Human
gggggagcccaaagcugcagg

SEQ ID NO: 503054 - RNA, 18 nt, Human
guaacgccccacccgcaa

SEQ ID NO: 503055 - RNA, 21 nt, Human
guaugugcauguguauauaug

SEQ ID NO: 503056 - RNA, 19 nt, Human
guaugugugaggaggggcu

SEQ ID NO: 503057 - RNA, 20 nt, Human
guaugugugcaugugugugu

SEQ ID NO: 503058 - RNA, 23 nt, Human
gugcaaaccaguugcacauccag

SEQ ID NO: 503059 - RNA, 18 nt, Human
gugcaaggccagagaaug

SEQ ID NO: 503060 - RNA, 18 nt, Human
guggcucugccacagccc

SEQ ID NO: 503061 - RNA, 29 nt, Human
gugugugcaugcaugugugugcaugugca

SEQ ID NO: 503062 - RNA, 21 nt, Human
gugugugcauguguaugugug

SEQ ID NO: 503063 - RNA, 21 nt, Human
gugugugcgugcauauguaug

SEQ ID NO: 503064 - RNA, 19 nt, Human
uauaugugugcaugugugu

SEQ ID NO: 503065 - RNA, 22 nt, Human
uauaugugugcaugugugugug

SEQ ID NO: 503066 - RNA, 19 nt, Human
uauauguguuugugugcau

SEQ ID NO: 503067 - RNA, 19 nt, Human
uaugggggagcccaaagcu

SEQ ID NO: 503068 - RNA, 18 nt, Human
uaugugcauguguauaua

SEQ ID NO: 503069 - RNA, 19 nt, Human
uaugugugcaugugugugu

SEQ ID NO: 503070 - RNA, 24 nt, Human
uaugugugcggugcaugugugugu

SEQ ID NO: 503071 - RNA, 24 nt, Human
uauguguuugugugcauggauaug

SEQ ID NO: 503072 - RNA, 22 nt, Human
ucagggagagcaagggaggcag

SEQ ID NO: 503073 - RNA, 20 nt, Human
ucauauguggacaggagagu

SEQ ID NO: 503074 - RNA, 19 nt, Human
uccaggcccuucccacucc

SEQ ID NO: 503075 - RNA, 20 nt, Human
ucccgagguagcugccuccc

SEQ ID NO: 503076 - RNA, 21 nt, Human
ucccgagguagcugccucccu

SEQ ID NO: 503077 - RNA, 21 nt, Human
ucgccguccuaggcgccgccc

SEQ ID NO: 503078 - RNA, 20 nt, Human
ucguggccccacugugcugu

SEQ ID NO: 503079 - RNA, 19 nt, Human
ucuaugcccuaaccuugcg

SEQ ID NO: 503080 - RNA, 19 nt, Human
ucugcccucuccuccugcc

SEQ ID NO: 503081 - RNA, 20 nt, Human
ucugcccucuccuccugccc

SEQ ID NO: 503082 - RNA, 21 nt, Human
ucuggggccucaggagggccc

SEQ ID NO: 503083 - RNA, 24 nt, Human
ucuguaggugaggcuuucuggggc

SEQ ID NO: 503084 - RNA, 22 nt, Human
ucuguguaugugcauguguaua

SEQ ID NO: 503085 - RNA, 19 nt, Human
ucugugugacaguggcucu

SEQ ID NO: 503086 - RNA, 22 nt, Human
ucugugugacaguggcucugcc

SEQ ID NO: 503087 - RNA, 18 nt, Human
ugaagaaauaaauguuga

SEQ ID NO: 503088 - RNA, 20 nt, Human
ugaucaggagagccgugugc

SEQ ID NO: 503089 - RNA, 24 nt, Human
ugcauacaugugugugccugugca

SEQ ID NO: 503090 - RNA, 22 nt, Human
ugcaugcauguaugccugugua

SEQ ID NO: 503091 - RNA, 25 nt, Human
ugcaugcauguaugccuguguaugu

SEQ ID NO: 503092 - RNA, 22 nt, Human
ugcaugcaugugugccugugua

SEQ ID NO: 503093 - RNA, 20 nt, Human
ugcauggauaugugugcggu

SEQ ID NO: 503094 - RNA, 22 nt, Human
ugcauguaugccuguguaugug

SEQ ID NO: 503095 - RNA, 19 nt, Human
ugcaugugugccuguguau

SEQ ID NO: 503096 - RNA, 22 nt, Human
ugcaugugugccuguguaugug

SEQ ID NO: 503097 - RNA, 20 nt, Human
ugcaugugugugugcauaca

SEQ ID NO: 503098 - RNA, 19 nt, Human
ugcaugugugugugcaugu

SEQ ID NO: 503099 - RNA, 21 nt, Human
ugcccaaagacagaugugaga

SEQ ID NO: 503100 - RNA, 19 nt, Human
ugccucugucucccaucuc

SEQ ID NO: 503101 - RNA, 26 nt, Human
ugccugaaucuguuugaacaugaagg

SEQ ID NO: 503102 - RNA, 24 nt, Human
ugcgggcgguggaggggguggugc

SEQ ID NO: 503103 - RNA, 24 nt, Human
ugcguguaugugugcaugugugug

SEQ ID NO: 503104 - RNA, 19 nt, Human
uggaggggguggugccuga

SEQ ID NO: 503105 - RNA, 22 nt, Human
uggcccaccuggccagcagaaa

SEQ ID NO: 503106 - RNA, 19 nt, Human
uggcucugccacagcccuc

SEQ ID NO: 503107 - RNA, 24 nt, Human
ugggacaaggucggcaugcagcug

SEQ ID NO: 503108 - RNA, 24 nt, Human
uguauauauguguuugugugcaug

SEQ ID NO: 503109 - RNA, 19 nt, Human
uguaugccuguguaugugu

SEQ ID NO: 503110 - RNA, 20 nt, Human
uguaugugcauguguauaua

SEQ ID NO: 503111 - RNA, 19 nt, Human
uguaugugugcacguguau

SEQ ID NO: 503112 - RNA, 20 nt, Human
uguaugugugcacguguaug

SEQ ID NO: 503113 - RNA, 22 nt, Human
uguaugugugcacguguaugug

SEQ ID NO: 503114 - RNA, 20 nt, Human
uguaugugugcaugcaugug

SEQ ID NO: 503115 - RNA, 20 nt, Human
uguaugugugcaugugugug

SEQ ID NO: 503116 - RNA, 22 nt, Human
uguaugugugcaugugugugca

SEQ ID NO: 503117 - RNA, 21 nt, Human
uguaugugugcaugugugugu

SEQ ID NO: 503118 - RNA, 22 nt, Human
uguaugugugcaugugugugug

SEQ ID NO: 503119 - RNA, 18 nt, Human
ugugcacauguaugugug

SEQ ID NO: 503120 - RNA, 18 nt, Human
ugugcacauguaugugug

SEQ ID NO: 503121 - RNA, 18 nt, Human
ugugcacguguaugugug

SEQ ID NO: 503122 - RNA, 28 nt, Human
ugugcacguguaugugugcaugugugug

SEQ ID NO: 503123 - RNA, 20 nt, Human
ugugcaggaaguuggugggu

SEQ ID NO: 503124 - RNA, 21 nt, Human
ugugcagugcaaaccaguugc

SEQ ID NO: 503125 - RNA, 23 nt, Human
ugugcauauaugugugcaugugu

SEQ ID NO: 503126 - RNA, 24 nt, Human
ugugcauauaugugugcaugugug

SEQ ID NO: 503127 - RNA, 22 nt, Human
ugugcaugcaugugugccugug

SEQ ID NO: 503128 - RNA, 19 nt, Human
ugugcauggauaugugugc

SEQ ID NO: 503129 - RNA, 19 nt, Human
ugugcauguguauauaugu

SEQ ID NO: 503130 - RNA, 19 nt, Human
ugugcaugugugugugcau

SEQ ID NO: 503131 - RNA, 19 nt, Human
ugugcggugcaugugugug

SEQ ID NO: 503132 - RNA, 19 nt, Human
ugugcgugcauauguaugu

SEQ ID NO: 503133 - RNA, 19 nt, Human
ugugcguguaugugugcau

SEQ ID NO: 503134 - RNA, 21 nt, Human
uguggggugauuucccagcgc

SEQ ID NO: 503135 - RNA, 22 nt, Human
uguguauauauguguuugugug

SEQ ID NO: 503136 - RNA, 22 nt, Human
uguguaugugcauguguauaua

SEQ ID NO: 503137 - RNA, 19 nt, Human
uguguaugugugcacgugu

SEQ ID NO: 503138 - RNA, 25 nt, Human
uguguaugugugcaugcaugugugc

SEQ ID NO: 503139 - RNA, 19 nt, Human
uguguaugugugcaugugc

SEQ ID NO: 503140 - RNA, 19 nt, Human
ugugugaggaggggcugcu

SEQ ID NO: 503141 - RNA, 20 nt, Human
ugugugcacguguaugugug

SEQ ID NO: 503142 - RNA, 19 nt, Human
ugugugcauacaugugugu

SEQ ID NO: 503143 - RNA, 26 nt, Human
ugugugcauacaugugugugccugug

SEQ ID NO: 503144 - RNA, 18 nt, Human
ugugugcaugcauguaug

SEQ ID NO: 503145 - RNA, 26 nt, Human
ugugugcaugcauguaugccugugua

SEQ ID NO: 503146 - RNA, 19 nt, Human
ugugugcaugcauguguau

SEQ ID NO: 503147 - RNA, 19 nt, Human
ugugugcaugcauguguau

SEQ ID NO: 503148 - RNA, 22 nt, Human
ugugugcaugcauguguaugug

SEQ ID NO: 503149 - RNA, 24 nt, Human
ugugugcaugcauguguaugugug

SEQ ID NO: 503150 - RNA, 18 nt, Human
ugugugcaugcaugugug

SEQ ID NO: 503151 - RNA, 26 nt, Human
ugugugcaugcaugugugccugugua

SEQ ID NO: 503152 - RNA, 19 nt, Human
ugugugcaugcaugugugu

SEQ ID NO: 503153 - RNA, 18 nt, Human
ugugugcauggauaugug

SEQ ID NO: 503154 - RNA, 20 nt, Human
ugugugcauggauaugugug

SEQ ID NO: 503155 - RNA, 22 nt, Human
ugugugcauggauaugugugcg

SEQ ID NO: 503156 - RNA, 21 nt, Human
ugugugcaugugcacauguau

SEQ ID NO: 503157 - RNA, 24 nt, Human
ugugugcaugugcacauguaugug

SEQ ID NO: 503158 - RNA, 19 nt, Human
ugugugcaugugcguguau

SEQ ID NO: 503159 - RNA, 19 nt, Human
ugugugcaugugcguguau

SEQ ID NO: 503160 - RNA, 19 nt, Human
ugugugcaugugugugcau

SEQ ID NO: 503161 - RNA, 20 nt, Human
ugugugcaugugugugcaug

SEQ ID NO: 503162 - RNA, 21 nt, Human
ugugugcaugugugugugcau

SEQ ID NO: 503163 - RNA, 22 nt, Human
ugugugcaugugugugugcaug

SEQ ID NO: 503164 - RNA, 23 nt, Human
ugugugcaugugugugugcaugu

SEQ ID NO: 503165 - RNA, 29 nt, Human
ugugugcaugugugugugcauguguaugg

SEQ ID NO: 503166 - RNA, 22 nt, Human
ugugugcaugugugugugcgug

SEQ ID NO: 503167 - RNA, 24 nt, Human
ugugugcaugugugugugcgugca

SEQ ID NO: 503168 - RNA, 19 nt, Human
ugugugccugugcauauau

SEQ ID NO: 503169 - RNA, 22 nt, Human
ugugugccugugcauauaugug

SEQ ID NO: 503170 - RNA, 19 nt, Human
ugugugccuguguaugugu

SEQ ID NO: 503171 - RNA, 21 nt, Human
ugugugcggugcaugugugug

SEQ ID NO: 503172 - RNA, 19 nt, Human
ugugugcgugcauauguau

SEQ ID NO: 503173 - RNA, 24 nt, Human
ugugugcgugcauauguaugugug

SEQ ID NO: 503174 - RNA, 22 nt, Human
ugugugcgugcauauguauguu

SEQ ID NO: 503175 - RNA, 21 nt, Human
ugugugugcauacaugugugu

SEQ ID NO: 503176 - RNA, 24 nt, Human
ugugugugcaugcaugugugugca

SEQ ID NO: 503177 - RNA, 19 nt, Human
ugugugugcaugugcacau

SEQ ID NO: 503178 - RNA, 22 nt, Human
ugugugugugcauacaugugug

SEQ ID NO: 503179 - RNA, 25 nt, Human
ugugugugugcauacaugugugugg

SEQ ID NO: 503180 - RNA, 22 nt, Human
ugugugugugcauguguaugug

SEQ ID NO: 503181 - RNA, 19 nt, Human
ugugugugugcgugcauau

SEQ ID NO: 503182 - RNA, 22 nt, Human
ugugugugugcgugcauaugua

SEQ ID NO: 503183 - RNA, 23 nt, Human
uuacugagucaguaauacuaugc

SEQ ID NO: 503184 - RNA, 19 nt, Human
uucccagcgccccucucug

SEQ ID NO: 503185 - RNA, 21 nt, Human
uugcaagggguuggcccuucu

SEQ ID NO: 503186 - RNA, 23 nt, Human
uuuagaguguagccaacaggaga

SEQ ID NO: 503187 - RNA, 21 nt, Human
uuuucaaccccagggagcccu

SEQ ID NO: 503188 - RNA, 24 nt, Human
aaaagaaacaacaaaacuucagug

SEQ ID NO: 503189 - RNA, 22 nt, Human
aaaucaccuuauaaucucucau

SEQ ID NO: 503190 - RNA, 22 nt, Human
aacaaccccaaucccaaaccaa

SEQ ID NO: 503191 - RNA, 19 nt, Human
aacauccacaaacacagca

SEQ ID NO: 503192 - RNA, 21 nt, Human
aacauccacaaacacagcaaa

SEQ ID NO: 503193 - RNA, 19 nt, Human
aagcucggcagugcuucuc

SEQ ID NO: 503194 - RNA, 22 nt, Human
aagucagcaaaagaaacaacaa

SEQ ID NO: 503195 - RNA, 19 nt, Human
acacaaacucguguugucu

SEQ ID NO: 503196 - RNA, 21 nt, Human
acagguuaucucucuccaaga

SEQ ID NO: 503197 - RNA, 18 nt, Human
acccugaaagcaguaacu

SEQ ID NO: 503198 - RNA, 19 nt, Human
acuacuaagcuacucucca

SEQ ID NO: 503199 - RNA, 20 nt, Human
acugcaugccgcuuuucuca

SEQ ID NO: 503200 - RNA, 23 nt, Human
aggacagugaccaaaaaaaaaga

SEQ ID NO: 503201 - RNA, 23 nt, Human
aggcugcccaacaaccccaaucc

SEQ ID NO: 503202 - RNA, 20 nt, Human
auaacaucuucucucuuucu

SEQ ID NO: 503203 - RNA, 22 nt, Human
caaaagaaacaacaaaacuuca

SEQ ID NO: 503204 - RNA, 19 nt, Human
caaaccaaccucccaggcc

SEQ ID NO: 503205 - RNA, 23 nt, Human
caacaaccccaaucccaaaccaa

SEQ ID NO: 503206 - RNA, 23 nt, Human
caacacacacacacaaacucgug

SEQ ID NO: 503207 - RNA, 22 nt, Human
cacaaacacagcaaacagucca

SEQ ID NO: 503208 - RNA, 20 nt, Human
cacacacacacaaacucgug

SEQ ID NO: 503209 - RNA, 26 nt, Human
caccuagauacuuuuggaaauguucu

SEQ ID NO: 503210 - RNA, 19 nt, Human
cagcaaaagaaacaacaaa

SEQ ID NO: 503211 - RNA, 23 nt, Human
cagcaaaagaaacaacaaaacuu

SEQ ID NO: 503212 - RNA, 20 nt, Human
cagcaccgagaggcccagca

SEQ ID NO: 503213 - RNA, 18 nt, Human
cagcagcaccgagaggcc

SEQ ID NO: 503214 - RNA, 22 nt, Human
caggaagaugcuaauagguaca

SEQ ID NO: 503215 - RNA, 19 nt, Human
caggaaggacuggagggcg

SEQ ID NO: 503216 - RNA, 23 nt, Human
caggauaggccaggugaauggca

SEQ ID NO: 503217 - RNA, 18 nt, Human
caggguacaucuagaggg

SEQ ID NO: 503218 - RNA, 18 nt, Human
ccacaaacacagcaaaca

SEQ ID NO: 503219 - RNA, 20 nt, Human
cccacacuuccacuccugug

SEQ ID NO: 503220 - RNA, 20 nt, Human
ccccaaucccaaaccaaccu

SEQ ID NO: 503221 - RNA, 28 nt, Human
ccccaaucccaaaccaaccucccaggcc

SEQ ID NO: 503222 - RNA, 21 nt, Human
ccuagaaauccuccuggauuc

SEQ ID NO: 503223 - RNA, 24 nt, Human
ccucugcuggucccacugcugcuu

SEQ ID NO: 503224 - RNA, 25 nt, Human
cuacuaagcuacucuccaucaacac

SEQ ID NO: 503225 - RNA, 22 nt, Human
cuagaaauccuccuggauucaa

SEQ ID NO: 503226 - RNA, 20 nt, Human
cuccacaaagaccuguucuc

SEQ ID NO: 503227 - RNA, 19 nt, Human
cuccuggauucaaugacaa

SEQ ID NO: 503228 - RNA, 25 nt, Human
cucuccaucaacacacacacacaaa

SEQ ID NO: 503229 - RNA, 26 nt, Human
cugaaggcaucuccaggaaggacugg

SEQ ID NO: 503230 - RNA, 20 nt, Human
cuggucccacugcugcuuca

SEQ ID NO: 503231 - RNA, 20 nt, Human
cuguggccgccgucagcagc

SEQ ID NO: 503232 - RNA, 21 nt, Human
cuugcaucacccacacuucca

SEQ ID NO: 503233 - RNA, 20 nt, Human
cuugggcaugagaagggcca

SEQ ID NO: 503234 - RNA, 20 nt, Human
gaaagcuuuuuauuugagaa

SEQ ID NO: 503235 - RNA, 25 nt, Human
gaacaccuagauacuuuuggaaaug

SEQ ID NO: 503236 - RNA, 20 nt, Human
gaaucuuuaauagcuacacc

SEQ ID NO: 503237 - RNA, 23 nt, Human
gagauccuuuugccaauaacauc

SEQ ID NO: 503238 - RNA, 22 nt, Human
gaggcgcagaggccgccgcaga

SEQ ID NO: 503239 - RNA, 26 nt, Human
gcccaacaaccccaaucccaaaccaa

SEQ ID NO: 503240 - RNA, 26 nt, Human
gcggccucucucucccgcccgcccga

SEQ ID NO: 503241 - RNA, 25 nt, Human
gcugcccaacaaccccaaucccaaa

SEQ ID NO: 503242 - RNA, 21 nt, Human
gcuggucccacugcugcuuca

SEQ ID NO: 503243 - RNA, 18 nt, Human
ggccaggauaggccaggu

SEQ ID NO: 503244 - RNA, 23 nt, Human
ggccgggcacaggguuggauucc

SEQ ID NO: 503245 - RNA, 23 nt, Human
ggcugcccaacaaccccaauccc

SEQ ID NO: 503246 - RNA, 21 nt, Human
gggaugcuggcugaaggcauc

SEQ ID NO: 503247 - RNA, 19 nt, Human
ggguacaucuagaggguuc

SEQ ID NO: 503248 - RNA, 21 nt, Human
uaaccaaagucagcaaaagaa

SEQ ID NO: 503249 - RNA, 20 nt, Human
uaagcuacucuccaucaaca

SEQ ID NO: 503250 - RNA, 20 nt, Human
uacaaacugucagguggagg

SEQ ID NO: 503251 - RNA, 26 nt, Human
uagauacuuuuggaaauguucuuguu

SEQ ID NO: 503252 - RNA, 23 nt, Human
uauaagggacccugaaagcagua

SEQ ID NO: 503253 - RNA, 19 nt, Human
ucacagagauuagagcucc

SEQ ID NO: 503254 - RNA, 23 nt, Human
ucacccagacagacucuuccaaa

SEQ ID NO: 503255 - RNA, 19 nt, Human
ucaguaacaacccuaagca

SEQ ID NO: 503256 - RNA, 23 nt, Human
uccacaaacacagcaaacagucc

SEQ ID NO: 503257 - RNA, 21 nt, Human
uccacaaagaccuguucucca

SEQ ID NO: 503258 - RNA, 18 nt, Human
ucccaaaccaaccuccca

SEQ ID NO: 503259 - RNA, 21 nt, Human
ucccgcccgcccgaggcgcag

SEQ ID NO: 503260 - RNA, 22 nt, Human
ucccugugaaaucaaucacugc

SEQ ID NO: 503261 - RNA, 24 nt, Human
ucccugugaaaucaaucacugccu

SEQ ID NO: 503262 - RNA, 23 nt, Human
ucuuccaaaaagugucugcccac

SEQ ID NO: 503263 - RNA, 19 nt, Human
ugaaacaacugucuugggc

SEQ ID NO: 503264 - RNA, 18 nt, Human
ugaagauacuacuaagcu

SEQ ID NO: 503265 - RNA, 23 nt, Human
ugaaggcaucuccaggaaggacu

SEQ ID NO: 503266 - RNA, 25 nt, Human
ugagauccuuuugccaauaacaucu

SEQ ID NO: 503267 - RNA, 23 nt, Human
ugcccuagaaauccuccuggauu

SEQ ID NO: 503268 - RNA, 19 nt, Human
uguaaucacagagauuaga

SEQ ID NO: 503269 - RNA, 22 nt, Human
ugucuugggcaugagaagggcc

SEQ ID NO: 503270 - RNA, 23 nt, Human
uguggagucugggaugcuggcug

SEQ ID NO: 503271 - RNA, 21 nt, Human
uuuaaaaggacagugaccaaa

SEQ ID NO: 503272 - RNA, 26 nt, Human
uuugagaacaccuagauacuuuugga

SEQ ID NO: 503273 - RNA, 24 nt, Human
aacuuuacauaauuuucuuccaaa

SEQ ID NO: 503274 - RNA, 18 nt, Human
caaaggagaggcuauuug

SEQ ID NO: 503275 - RNA, 21 nt, Human
caaaggccucuucuaacauuc

SEQ ID NO: 503276 - RNA, 23 nt, Human
ccucuucuaacauucaguaaaga

SEQ ID NO: 503277 - RNA, 25 nt, Human
cgcaaaaaaucugagaaacggcgca

SEQ ID NO: 503278 - RNA, 23 nt, Human
cugaucacuucugaggagaaaca

SEQ ID NO: 503279 - RNA, 23 nt, Human
uccaaaggccucuucuaacauuc

SEQ ID NO: 503280 - RNA, 19 nt, Human
ugaggagaaacacauaaug

SEQ ID NO: 503281 - RNA, 18 nt, Human
uggggaaagguaucgauc

SEQ ID NO: 503282 - RNA, 19 nt, Human
uuaggcucgcaaaaaaucu

SEQ ID NO: 503283 - RNA, 20 nt, Human
uuuauuuauugccucuccca

SEQ ID NO: 503284 - RNA, 24 nt, Human
ucucucacaugcaguggccgcagu

SEQ ID NO: 503285 - RNA, 19 nt, Human
accaugcugccauuccagc

SEQ ID NO: 503286 - RNA, 19 nt, Human
aggcagugguuggugcccg

SEQ ID NO: 503287 - RNA, 21 nt, Human
aggcgggugggaggggacaag

SEQ ID NO: 503288 - RNA, 18 nt, Human
cagcauggaacagugggc

SEQ ID NO: 503289 - RNA, 18 nt, Human
ccauuccagcugcccugc

SEQ ID NO: 503290 - RNA, 20 nt, Human
ccugguguuugucauggcug

SEQ ID NO: 503291 - RNA, 21 nt, Human
cuguggucuugcugaagaggc

SEQ ID NO: 503292 - RNA, 21 nt, Human
ggcaggugggggcaguggucu

SEQ ID NO: 503293 - RNA, 22 nt, Human
ggcuguggucuugcugaagagg

SEQ ID NO: 503294 - RNA, 21 nt, Human
gggcagcauggaacagugggc

SEQ ID NO: 503295 - RNA, 24 nt, Human
gggucaugaggcgggugggagggg

SEQ ID NO: 503296 - RNA, 19 nt, Human
gguagauggcgcagggcag

SEQ ID NO: 503297 - RNA, 18 nt, Human
guuggaggcagugguugg

SEQ ID NO: 503298 - RNA, 19 nt, Human
uaccaugcugccauuccag

SEQ ID NO: 503299 - RNA, 19 nt, Human
ucauggcuguggucuugcu

SEQ ID NO: 503300 - RNA, 24 nt, Human
ucauggcuguggucuugcugaaga

SEQ ID NO: 503301 - RNA, 20 nt, Human
uccagcugcccugcggugac

SEQ ID NO: 503302 - RNA, 20 nt, Human
ugcccgugccgagccuucuu

SEQ ID NO: 503303 - RNA, 18 nt, Human
ugccugugcugagccuuc

SEQ ID NO: 503304 - RNA, 19 nt, Human
ugcugagccuucuugggca

SEQ ID NO: 503305 - RNA, 22 nt, Human
ugguuggugcccgugccgagcc

SEQ ID NO: 503306 - RNA, 24 nt, Human
ugucauggcuguggucuugcugaa

SEQ ID NO: 503307 - RNA, 19 nt, Human
ugugaggcugggucaugag

SEQ ID NO: 503308 - RNA, 21 nt, Human
ugugaggcugggucaugaggc

SEQ ID NO: 503309 - RNA, 18 nt, Human
uuagaagcaaaugugauc

SEQ ID NO: 503310 - RNA, 23 nt, Human
uuagaagcaaaugugaucuauuu

SEQ ID NO: 503311 - RNA, 22 nt, Human
agcacauugggaagagccuccc

SEQ ID NO: 503312 - RNA, 23 nt, Human
aggaugggguggccgcagcugcu

SEQ ID NO: 503313 - RNA, 19 nt, Human
augugaucaugaaaacugu

SEQ ID NO: 503314 - RNA, 19 nt, Human
cagcacucuuaguucaugc

SEQ ID NO: 503315 - RNA, 18 nt, Human
caugaaaacuguggcugc

SEQ ID NO: 503316 - RNA, 20 nt, Human
ccagugguucuccuaggucu

SEQ ID NO: 503317 - RNA, 28 nt, Human
ccucccaccugccauugcuucauuuuca

SEQ ID NO: 503318 - RNA, 23 nt, Human
cugcugugccugcagcuccuucu

SEQ ID NO: 503319 - RNA, 23 nt, Human
cuucagcacucuuaguucaugcc

SEQ ID NO: 503320 - RNA, 22 nt, Human
gccccagaggccuuguggccuc

SEQ ID NO: 503321 - RNA, 22 nt, Human
ggccuuguggccucagcccuug

SEQ ID NO: 503322 - RNA, 18 nt, Human
gggagcugaccugaccag

SEQ ID NO: 503323 - RNA, 19 nt, Human
gggaugccucaaaacacca

SEQ ID NO: 503324 - RNA, 20 nt, Human
gucacagagguuggagggau

SEQ ID NO: 503325 - RNA, 19 nt, Human
gucccuugggcaagaggca

SEQ ID NO: 503326 - RNA, 23 nt, Human
uaggucuucagcacucuuaguuc

SEQ ID NO: 503327 - RNA, 21 nt, Human
uaugaugugaucaugaaaacu

SEQ ID NO: 503328 - RNA, 22 nt, Human
ucacagagguuggagggaugcc

SEQ ID NO: 503329 - RNA, 25 nt, Human
ucacagagguuggagggaugccuca

SEQ ID NO: 503330 - RNA, 18 nt, Human
ucccuguggagcugggag

SEQ ID NO: 503331 - RNA, 19 nt, Human
uccuccucgucgucucagg

SEQ ID NO: 503332 - RNA, 18 nt, Human
uccuguuagcgucagccc

SEQ ID NO: 503333 - RNA, 21 nt, Human
ucucagggcuggagcuguggg

SEQ ID NO: 503334 - RNA, 20 nt, Human
ugccccagaggccuuguggc

SEQ ID NO: 503335 - RNA, 19 nt, Human
uggagcugggagcugaccu

SEQ ID NO: 503336 - RNA, 22 nt, Human
uguggagcugggagcugaccug

SEQ ID NO: 503337 - RNA, 22 nt, Human
aacaaacaaguccaaagcugcu

SEQ ID NO: 503338 - RNA, 22 nt, Human
acaggaaggacaggauccugga

SEQ ID NO: 503339 - RNA, 22 nt, Human
accgcugacuuugcucuuccca

SEQ ID NO: 503340 - RNA, 20 nt, Human
agccacugaagaguccucag

SEQ ID NO: 503341 - RNA, 22 nt, Human
aggcagcucuggauguggaguc

SEQ ID NO: 503342 - RNA, 24 nt, Human
agggaggcagcucuggauguggag

SEQ ID NO: 503343 - RNA, 18 nt, Human
cacaugcaaaauaggaua

SEQ ID NO: 503344 - RNA, 20 nt, Human
caggaaggacaggauccugg

SEQ ID NO: 503345 - RNA, 21 nt, Human
cccagcccccgugcccacagg

SEQ ID NO: 503346 - RNA, 21 nt, Human
ccuggauuaaagggaggcagc

SEQ ID NO: 503347 - RNA, 19 nt, Human
ccugugggacaaacuuguc

SEQ ID NO: 503348 - RNA, 18 nt, Human
gaagaguccucaggagag

SEQ ID NO: 503349 - RNA, 18 nt, Human
gacagcccugugggacaa

SEQ ID NO: 503350 - RNA, 24 nt, Human
gcugacuuugcucuucccagcccc

SEQ ID NO: 503351 - RNA, 20 nt, Human
uacaggacaggaaggacagg

SEQ ID NO: 503352 - RNA, 23 nt, Human
uagugcugauguccacggaaugu

SEQ ID NO: 503353 - RNA, 20 nt, Human
ucucaccccacacuggcaac

SEQ ID NO: 503354 - RNA, 19 nt, Human
ugagaucucaaacacaugc

SEQ ID NO: 503355 - RNA, 18 nt, Human
ugagcacagacccagccc

SEQ ID NO: 503356 - RNA, 21 nt, Human
ugagcacagacccagcccuua

SEQ ID NO: 503357 - RNA, 18 nt, Human
uguccacggaauguggga

SEQ ID NO: 503358 - RNA, 22 nt, Human
aaaaaagauucuuuuauacaaa

SEQ ID NO: 503359 - RNA, 20 nt, Human
aagaacccuacggagagggu

SEQ ID NO: 503360 - RNA, 19 nt, Human
aagaauguggacagaggug

SEQ ID NO: 503361 - RNA, 21 nt, Human
aauaaucagugaauguagaac

SEQ ID NO: 503362 - RNA, 23 nt, Human
acaaaaccgaugaaaaucacacu

SEQ ID NO: 503363 - RNA, 21 nt, Human
agaacugcacagaucuguguu

SEQ ID NO: 503364 - RNA, 19 nt, Human
aggcgcgaauccugcccaa

SEQ ID NO: 503365 - RNA, 19 nt, Human
auguggacagagguggcag

SEQ ID NO: 503366 - RNA, 18 nt, Human
caaaagcacuuuaaugcc

SEQ ID NO: 503367 - RNA, 18 nt, Human
cacagaucuguguuucca

SEQ ID NO: 503368 - RNA, 21 nt, Human
cacugcgcacgcugaaagggc

SEQ ID NO: 503369 - RNA, 23 nt, Human
ccagcagcugguccgguucucuu

SEQ ID NO: 503370 - RNA, 26 nt, Human
ccgcucucuccuggaaaaauggaggc

SEQ ID NO: 503371 - RNA, 22 nt, Human
ccuauccuccuucaaucaagag

SEQ ID NO: 503372 - RNA, 24 nt, Human
cgagcgcacguucacugcgcacgg

SEQ ID NO: 503373 - RNA, 26 nt, Human
cugcagcugagacaggaccggggucc

SEQ ID NO: 503374 - RNA, 18 nt, Human
cuggaaaaauggaggcgc

SEQ ID NO: 503375 - RNA, 23 nt, Human
gacaguuucccugccagcagcug

SEQ ID NO: 503376 - RNA, 21 nt, Human
gacugcagcugagacaggacg

SEQ ID NO: 503377 - RNA, 18 nt, Human
gagaaagaacccuacgga

SEQ ID NO: 503378 - RNA, 18 nt, Human
ggggaggaggguagaguc

SEQ ID NO: 503379 - RNA, 19 nt, Human
gggggaggaggguagaguc

SEQ ID NO: 503380 - RNA, 18 nt, Human
uccaacuuuuuccaccau

SEQ ID NO: 503381 - RNA, 20 nt, Human
uccaagaagaauguggacag

SEQ ID NO: 503382 - RNA, 22 nt, Human
ucucuccuggaaaaauggaggc

SEQ ID NO: 503383 - RNA, 24 nt, Human
ugagacaggacgugggggaggagg

SEQ ID NO: 503384 - RNA, 21 nt, Human
ugcccuauccuccuucaauca

SEQ ID NO: 503385 - RNA, 21 nt, Human
ugggggaggaggguagagucc

SEQ ID NO: 503386 - RNA, 22 nt, Human
ugucaaaagcacuuuaaugccc

SEQ ID NO: 503387 - RNA, 18 nt, Human
aauuauagaauuuccaga

SEQ ID NO: 503388 - RNA, 20 nt, Human
aggguuaggaugcaggucau

SEQ ID NO: 503389 - RNA, 20 nt, Human
ccagguauuuuugaaaaccu

SEQ ID NO: 503390 - RNA, 20 nt, Human
ggaguccuccaccuggcacu

SEQ ID NO: 503391 - RNA, 24 nt, Human
ucauucaaggguuaggaugcaggu

SEQ ID NO: 503392 - RNA, 22 nt, Human
ugggaguccuccaccuggcacu

SEQ ID NO: 503393 - RNA, 23 nt, Human
uucaaggguuaggaugcagguca

SEQ ID NO: 503394 - RNA, 19 nt, Human
uuucuugccagguauuuuu

SEQ ID NO: 503395 - RNA, 20 nt, Human
aaacaauaaggcaggacucu

SEQ ID NO: 503396 - RNA, 22 nt, Human
aaauuaaacuaaaaaccacccc

SEQ ID NO: 503397 - RNA, 18 nt, Human
aagaaccuuguaacaaag

SEQ ID NO: 503398 - RNA, 21 nt, Human
aagcguugucucuuuuaaaca

SEQ ID NO: 503399 - RNA, 22 nt, Human
aaucauaagccauccaguuuuu

SEQ ID NO: 503400 - RNA, 19 nt, Human
acaggaguuuucugcagag

SEQ ID NO: 503401 - RNA, 23 nt, Human
accacuugaggcaaaaggaaucc

SEQ ID NO: 503402 - RNA, 21 nt, Human
aggcaggacucuacauaagca

SEQ ID NO: 503403 - RNA, 23 nt, Human
auaaaaacaaacaauaaggcagg

SEQ ID NO: 503404 - RNA, 23 nt, Human
caagaaccaugugauagaggcac

SEQ ID NO: 503405 - RNA, 21 nt, Human
ccagcugagccagaccgccaa

SEQ ID NO: 503406 - RNA, 23 nt, Human
cccccugcccagcugagccagac

SEQ ID NO: 503407 - RNA, 21 nt, Human
cuugaagagggaacaaaaugu

SEQ ID NO: 503408 - RNA, 19 nt, Human
gcaggacucuacauaagca

SEQ ID NO: 503409 - RNA, 22 nt, Human
gucgaugggaagcuagaaaaga

SEQ ID NO: 503410 - RNA, 21 nt, Human
uaaaaacaaacaauaaggcag

SEQ ID NO: 503411 - RNA, 22 nt, Human
uacauaagcaaaccaagaacaa

SEQ ID NO: 503412 - RNA, 23 nt, Human
uacauaagcaaaccaagaacaau

SEQ ID NO: 503413 - RNA, 23 nt, Human
uacccccugcccagcugagccag

SEQ ID NO: 503414 - RNA, 23 nt, Human
uccaguuuuuaaaauaaaacugu

SEQ ID NO: 503415 - RNA, 22 nt, Human
ucucacauuuuugaaaaccuaa

SEQ ID NO: 503416 - RNA, 24 nt, Human
ugaagagggaacaaaaugugguuc

SEQ ID NO: 503417 - RNA, 21 nt, Human
ugagccagaccgccaacacca

SEQ ID NO: 503418 - RNA, 19 nt, Human
ugccauaaauaaaaacaaa

SEQ ID NO: 503419 - RNA, 22 nt, Human
ugccauaaauaaaaacaaacaa

SEQ ID NO: 503420 - RNA, 21 nt, Human
uuacaacgugcgcacugaccg

SEQ ID NO: 503421 - RNA, 22 nt, Human
uugaaacuacaaaacggauuuc

SEQ ID NO: 503422 - RNA, 19 nt, Human
uuugaaacuacaaaacgga

SEQ ID NO: 503423 - RNA, 21 nt, Human
acugucuuacaaagccaccac

SEQ ID NO: 503424 - RNA, 20 nt, Human
caaagccaccaccuguuccc

SEQ ID NO: 503425 - RNA, 23 nt, Human
ccucaccaacauaggcuuuccug

SEQ ID NO: 503426 - RNA, 23 nt, Human
cgcccgcccaccacagauuucug

SEQ ID NO: 503427 - RNA, 19 nt, Human
ucaccaacauaggcuuucc

SEQ ID NO: 503428 - RNA, 19 nt, Human
ucacucauucucccaucau

SEQ ID NO: 503429 - RNA, 22 nt, Human
ucagaaacuuucuucccaacug

SEQ ID NO: 503430 - RNA, 18 nt, Human
uccugggggauggccugc

SEQ ID NO: 503431 - RNA, 22 nt, Human
ucuccuugcucaccugccgccc

SEQ ID NO: 503432 - RNA, 19 nt, Human
ugguggugccaggcugcag

SEQ ID NO: 503433 - RNA, 19 nt, Human
uuacagacacguucuccuu

SEQ ID NO: 503434 - RNA, 25 nt, Human
uucacucauucucccaucauaaccc

SEQ ID NO: 503435 - RNA, 22 nt, Human
agaaggucagggcccacgagga

SEQ ID NO: 503436 - RNA, 23 nt, Human
agagagaaggucagggcccacga

SEQ ID NO: 503437 - RNA, 20 nt, Human
agcugcuggagacaggagcu

SEQ ID NO: 503438 - RNA, 22 nt, Human
cagaaagcacugcgugauccac

SEQ ID NO: 503439 - RNA, 25 nt, Human
cagcgacaaacaaucaggcccccac

SEQ ID NO: 503440 - RNA, 19 nt, Human
caggcccccacaaugaacu

SEQ ID NO: 503441 - RNA, 22 nt, Human
ccacucgugcugggaccauucc

SEQ ID NO: 503442 - RNA, 18 nt, Human
ccagcgacaaacaaucag

SEQ ID NO: 503443 - RNA, 22 nt, Human
cccacaaugaacuggccacucg

SEQ ID NO: 503444 - RNA, 22 nt, Human
cccacgaggaugcggaggcaga

SEQ ID NO: 503445 - RNA, 23 nt, Human
ccuccagcgacaaacaaucaggc

SEQ ID NO: 503446 - RNA, 19 nt, Human
ccugagggagccugagcca

SEQ ID NO: 503447 - RNA, 21 nt, Human
cgacaaacaaucaggccccca

SEQ ID NO: 503448 - RNA, 22 nt, Human
cuccggagccucugcccggcuc

SEQ ID NO: 503449 - RNA, 21 nt, Human
cugggcuuagcgccucugccc

SEQ ID NO: 503450 - RNA, 22 nt, Human
gaccauucccuaggggaggagg

SEQ ID NO: 503451 - RNA, 18 nt, Human
gagccugagccaaaaaca

SEQ ID NO: 503452 - RNA, 24 nt, Human
gcagaaagcacugcgugauccaca

SEQ ID NO: 503453 - RNA, 18 nt, Human
gcccacgaggaugcggag

SEQ ID NO: 503454 - RNA, 20 nt, Human
gcuggagacaggagcugaug

SEQ ID NO: 503455 - RNA, 20 nt, Human
gggagccugagccaaaaaca

SEQ ID NO: 503456 - RNA, 24 nt, Human
ucaggcccccacaaugaacuggcc

SEQ ID NO: 503457 - RNA, 26 nt, Human
ugagccaaaaacacgggcagaaagca

SEQ ID NO: 503458 - RNA, 24 nt, Human
ugagggagccugagccaaaaacac

SEQ ID NO: 503459 - RNA, 20 nt, Human
ugcccugagggagccugagc

SEQ ID NO: 503460 - RNA, 21 nt, Human
aagcaaauauuauuuuucuua

SEQ ID NO: 503461 - RNA, 25 nt, Human
acaagcaaugucagacacaaggaac

SEQ ID NO: 503462 - RNA, 20 nt, Human
acuuccauucugggagugag

SEQ ID NO: 503463 - RNA, 21 nt, Human
agacagaaauccagaaaaauc

SEQ ID NO: 503464 - RNA, 30 nt, Human
agacagaaauccagaaaaaucuccuuaauu

SEQ ID NO: 503465 - RNA, 19 nt, Human
agugaacaauaaauuaaua

SEQ ID NO: 503466 - RNA, 19 nt, Human
aguggugguucaagggaag

SEQ ID NO: 503467 - RNA, 21 nt, Human
caagaggccuaguauuaaaaa

SEQ ID NO: 503468 - RNA, 26 nt, Human
caagaggccuaguauuaaaaaaauca

SEQ ID NO: 503469 - RNA, 20 nt, Human
cacaaggaacugaaguaacg

SEQ ID NO: 503470 - RNA, 21 nt, Human
gaaguucuuccuugauaccuu

SEQ ID NO: 503471 - RNA, 20 nt, Human
gcaugaaggacuaauccaaa

SEQ ID NO: 503472 - RNA, 18 nt, Human
ggaagaaaccacuaggcu

SEQ ID NO: 503473 - RNA, 20 nt, Human
gggcaccucaugucucaaau

SEQ ID NO: 503474 - RNA, 18 nt, Human
uaaaaaaaucaccaggag

SEQ ID NO: 503475 - RNA, 20 nt, Human
uaacagaacagaagcauaaa

SEQ ID NO: 503476 - RNA, 24 nt, Human
uaacguuuucaaucucauucaggc

SEQ ID NO: 503477 - RNA, 22 nt, Human
uacaaacaagcaaugucagaca

SEQ ID NO: 503478 - RNA, 25 nt, Human
uagaaagaguucuguggauaugaua

SEQ ID NO: 503479 - RNA, 25 nt, Human
uagaaguucuuccuugauaccuugg

SEQ ID NO: 503480 - RNA, 22 nt, Human
uaugauacauagacagaaaucc

SEQ ID NO: 503481 - RNA, 23 nt, Human
ucaacuuucuuuuuaguuuauua

SEQ ID NO: 503482 - RNA, 21 nt, Human
ucaaucagagaucaaauucac

SEQ ID NO: 503483 - RNA, 19 nt, Human
ucuuuuaacagaauuccag

SEQ ID NO: 503484 - RNA, 21 nt, Human
ugaaggaagaaaccacuaggc

SEQ ID NO: 503485 - RNA, 19 nt, Human
ugccuggcucaauauaaaa

SEQ ID NO: 503486 - RNA, 23 nt, Human
ugccuggcucaauauaaaauucc

SEQ ID NO: 503487 - RNA, 20 nt, Human
uggcauuaacugcuagggga

SEQ ID NO: 503488 - RNA, 23 nt, Human
uguggauaugauacauagacaga

SEQ ID NO: 503489 - RNA, 23 nt, Human
uuaguuacaaacaagcaauguca

SEQ ID NO: 503490 - RNA, 18 nt, Human
uucaagcagagacuggag

SEQ ID NO: 503491 - RNA, 19 nt, Human
uucaagggaagacggaaaa

SEQ ID NO: 503492 - RNA, 19 nt, Human
uuccacuagcaaauagggc

SEQ ID NO: 503493 - RNA, 18 nt, Human
uuccagagaagagagcuc

SEQ ID NO: 503494 - RNA, 25 nt, Human
uuccauucugggagugagauaugcu

SEQ ID NO: 503495 - RNA, 23 nt, Human
uuccuugauaccuuggauaaaua

SEQ ID NO: 503496 - RNA, 20 nt, Human
uugguggcccagcuugcaug

SEQ ID NO: 503497 - RNA, 20 nt, Human
uuuucaaucucauucaggcc

SEQ ID NO: 503498 - RNA, 18 nt, Human
uuuuuuuuuuuuuuuuug

SEQ ID NO: 503499 - RNA, 24 nt, Human
uuuuuuuuuuuuuuuuugauuuuu

SEQ ID NO: 503500 - RNA, 22 nt, Human
aacugcuuuucaaagacuaggu

SEQ ID NO: 503501 - RNA, 22 nt, Human
acauaauaaaaaugcaagaaac

SEQ ID NO: 503502 - RNA, 31 nt, Human
uagcaacauaauaaaaaugcaagaaacuagg

SEQ ID NO: 503503 - RNA, 19 nt, Human
ugaagggaaauauggcaua

SEQ ID NO: 503504 - RNA, 23 nt, Human
ugauacagaucaucuuucuaacu

SEQ ID NO: 503505 - RNA, 23 nt, Human
uggaggguugggggaaaaguaua

SEQ ID NO: 503506 - RNA, 18 nt, Human
ugggggaaaaguauagca

SEQ ID NO: 503507 - RNA, 18 nt, Human
uuaguauacggauaacaa

SEQ ID NO: 503508 - RNA, 22 nt, Human
uuaguauacggauaacaaaagu

SEQ ID NO: 503509 - RNA, 23 nt, Human
uucaaauucaaacaaucaaaaca

SEQ ID NO: 503510 - RNA, 22 nt, Human
aaaacacaacaaucagcuacaa

SEQ ID NO: 503511 - RNA, 24 nt, Human
aaagccaaaaaaagaaagaaggga

SEQ ID NO: 503512 - RNA, 21 nt, Human
aacccagcucucaagccccug

SEQ ID NO: 503513 - RNA, 24 nt, Human
aagaaagaggcaaagcuuucagga

SEQ ID NO: 503514 - RNA, 19 nt, Human
aagcaaaagcaaaaaacag

SEQ ID NO: 503515 - RNA, 22 nt, Human
aagcaaaagcaaaaaacaguuu

SEQ ID NO: 503516 - RNA, 24 nt, Human
aagcaaaagcaaaaaacaguuuaa

SEQ ID NO: 503517 - RNA, 20 nt, Human
aagccccuggucagcaaucu

SEQ ID NO: 503518 - RNA, 21 nt, Human
aagcuugaccauaccagaaac

SEQ ID NO: 503519 - RNA, 21 nt, Human
aaucacauuuuuuucuaacau

SEQ ID NO: 503520 - RNA, 28 nt, Human
agaaagaggcaaagcuuucaggacagaa

SEQ ID NO: 503521 - RNA, 23 nt, Human
agcaaaagcaaaaaacaguuuaa

SEQ ID NO: 503522 - RNA, 20 nt, Human
aggagggaaaauagaaccca

SEQ ID NO: 503523 - RNA, 21 nt, Human
augcuggcuccgugggcugga

SEQ ID NO: 503524 - RNA, 19 nt, Human
augugacaguucaugugca

SEQ ID NO: 503525 - RNA, 21 nt, Human
cacaacaaucagcuacaaaca

SEQ ID NO: 503526 - RNA, 19 nt, Human
cacaccccccgcggcgccc

SEQ ID NO: 503527 - RNA, 22 nt, Human
cacaguacagcuaaguacaaaa

SEQ ID NO: 503528 - RNA, 20 nt, Human
caccgccgccgccgcugccg

SEQ ID NO: 503529 - RNA, 22 nt, Human
caccggccaccgccgccgccgc

SEQ ID NO: 503530 - RNA, 22 nt, Human
cacgugcauguccgucacuggu

SEQ ID NO: 503531 - RNA, 23 nt, Human
cagaaccugaucguagcaugcca

SEQ ID NO: 503532 - RNA, 21 nt, Human
cagagaaguccuggcgacgca

SEQ ID NO: 503533 - RNA, 22 nt, Human
cagcccagagaaguccuggcga

SEQ ID NO: 503534 - RNA, 24 nt, Human
cagcugacuccaagcaaagggagu

SEQ ID NO: 503535 - RNA, 20 nt, Human
caucuuguucuuuggcuuca

SEQ ID NO: 503536 - RNA, 20 nt, Human
ccaaagccaaaaaaagaaag

SEQ ID NO: 503537 - RNA, 25 nt, Human
ccaccgccgccgccgcugccgccaa

SEQ ID NO: 503538 - RNA, 23 nt, Human
ccagcuuucaaccccauuacaua

SEQ ID NO: 503539 - RNA, 25 nt, Human
ccaucuaggaaaacgaguuaguugu

SEQ ID NO: 503540 - RNA, 21 nt, Human
cccaaagccaaaaaaagaaag

SEQ ID NO: 503541 - RNA, 24 nt, Human
cccaaagccaaaaaaagaaagaag

SEQ ID NO: 503542 - RNA, 25 nt, Human
cccaaagccaaaaaaagaaagaagg

SEQ ID NO: 503543 - RNA, 18 nt, Human
ccgccgccgccgcugccg

SEQ ID NO: 503544 - RNA, 18 nt, Human
ccgccgccgcuccacggc

SEQ ID NO: 503545 - RNA, 23 nt, Human
ccgccgccgcuccacggcuccgg

SEQ ID NO: 503546 - RNA, 18 nt, Human
ccgccgccgcugccgcca

SEQ ID NO: 503547 - RNA, 26 nt, Human
ccgcggcgcccgcuccgccgccgcuc

SEQ ID NO: 503548 - RNA, 24 nt, Human
ccggcgagcuccgcgcguccgcac

SEQ ID NO: 503549 - RNA, 22 nt, Human
ccuccuccccagcuuucaaccc

SEQ ID NO: 503550 - RNA, 19 nt, Human
cgccgccgcugccgccaaa

SEQ ID NO: 503551 - RNA, 19 nt, Human
cuagagucugauagcuaac

SEQ ID NO: 503552 - RNA, 19 nt, Human
cucauaaucacccuucugc

SEQ ID NO: 503553 - RNA, 18 nt, Human
cuccgcgccacacccccc

SEQ ID NO: 503554 - RNA, 19 nt, Human
gacagaaccugaucguagc

SEQ ID NO: 503555 - RNA, 22 nt, Human
gcaaaagcaaaaaacaguuuaa

SEQ ID NO: 503556 - RNA, 25 nt, Human
gcuaaguacaaaaugcaucaaccua

SEQ ID NO: 503557 - RNA, 22 nt, Human
ggaaaagcaaaagcaaaaaaca

SEQ ID NO: 503558 - RNA, 22 nt, Human
gguucaaaugcuggcuccgugg

SEQ ID NO: 503559 - RNA, 18 nt, Human
gucaaugucuccguuucc

SEQ ID NO: 503560 - RNA, 18 nt, Human
gucaguuugaggagggaa

SEQ ID NO: 503561 - RNA, 18 nt, Human
gugcagcugacuccaagc

SEQ ID NO: 503562 - RNA, 21 nt, Human
gugcauguccgucacuggugg

SEQ ID NO: 503563 - RNA, 24 nt, Human
uaaaacacaacaaucagcuacaaa

SEQ ID NO: 503564 - RNA, 22 nt, Human
uaaacacagcccagagaagucc

SEQ ID NO: 503565 - RNA, 19 nt, Human
uaaauuacugaccuaguga

SEQ ID NO: 503566 - RNA, 20 nt, Human
uaaucgcuccacaggcucag

SEQ ID NO: 503567 - RNA, 20 nt, Human
uacaaacagggcaaagaaaa

SEQ ID NO: 503568 - RNA, 22 nt, Human
uacaaacagggcaaagaaaaug

SEQ ID NO: 503569 - RNA, 23 nt, Human
uacagcaguagauccuccucccc

SEQ ID NO: 503570 - RNA, 21 nt, Human
uagcgcaucuuguucuuuggc

SEQ ID NO: 503571 - RNA, 21 nt, Human
uauacaagguucaaaugcugg

SEQ ID NO: 503572 - RNA, 22 nt, Human
uauuuuauuacaggucucaugu

SEQ ID NO: 503573 - RNA, 24 nt, Human
ucagaacauuccaugauuugcuaa

SEQ ID NO: 503574 - RNA, 21 nt, Human
uccaagcaaagggagucaggg

SEQ ID NO: 503575 - RNA, 18 nt, Human
uccacaggcucagacaca

SEQ ID NO: 503576 - RNA, 18 nt, Human
uccacuagcgcaucuugu

SEQ ID NO: 503577 - RNA, 19 nt, Human
uccacuagcgcaucuuguu

SEQ ID NO: 503578 - RNA, 22 nt, Human
ucccaaagccaaaaaaagaaag

SEQ ID NO: 503579 - RNA, 20 nt, Human
uccccugccucuccguggcu

SEQ ID NO: 503580 - RNA, 25 nt, Human
uccccugccucuccguggcugcaaa

SEQ ID NO: 503581 - RNA, 24 nt, Human
uccucagcacuucacaguaaaccc

SEQ ID NO: 503582 - RNA, 21 nt, Human
ucuccgcgccacaccccccgc

SEQ ID NO: 503583 - RNA, 20 nt, Human
ugaaccacucauaaucaccc

SEQ ID NO: 503584 - RNA, 23 nt, Human
ugacaguucaugugcaagaauca

SEQ ID NO: 503585 - RNA, 23 nt, Human
ugaugcuuuucccaaagccaaaa

SEQ ID NO: 503586 - RNA, 19 nt, Human
ugcaagaaucacuuuuuag

SEQ ID NO: 503587 - RNA, 21 nt, Human
ugcaaguaauuaaaaugcugg

SEQ ID NO: 503588 - RNA, 18 nt, Human
uggcccagcuuauaaggg

SEQ ID NO: 503589 - RNA, 19 nt, Human
ugggaagaagaccauagaa

SEQ ID NO: 503590 - RNA, 19 nt, Human
ugguggccauucuggagug

SEQ ID NO: 503591 - RNA, 21 nt, Human
uuaaaacucuaaguccuuccc

SEQ ID NO: 503592 - RNA, 25 nt, Human
uuacaauuaaaaacucucuugggaa

SEQ ID NO: 503593 - RNA, 18 nt, Human
uucaggacagaaccugau

SEQ ID NO: 503594 - RNA, 21 nt, Human
uucagguccguaaucauucuc

SEQ ID NO: 503595 - RNA, 22 nt, Human
uugucaacacuguccucagcac

SEQ ID NO: 503596 - RNA, 20 nt, Human
uuugaaaucaguaagacuga

SEQ ID NO: 503597 - RNA, 18 nt, Human
acuacagcccacagaauu

SEQ ID NO: 503598 - RNA, 22 nt, Human
agaacaauucuagacacuaccu

SEQ ID NO: 503599 - RNA, 19 nt, Human
agcaauaauggaauguaac

SEQ ID NO: 503600 - RNA, 26 nt, Human
agucacaaugauggcauacuacagcc

SEQ ID NO: 503601 - RNA, 24 nt, Human
auggcauacuacagcccacagaau

SEQ ID NO: 503602 - RNA, 21 nt, Human
auguuucuucucacucugcca

SEQ ID NO: 503603 - RNA, 23 nt, Human
cacaaugauggcauacuacagcc

SEQ ID NO: 503604 - RNA, 18 nt, Human
caccgcgugcugcagccc

SEQ ID NO: 503605 - RNA, 24 nt, Human
caccgcgugcugcagcccacagcc

SEQ ID NO: 503606 - RNA, 18 nt, Human
cagcaaaacaaacugcuc

SEQ ID NO: 503607 - RNA, 26 nt, Human
cagcaaaacaaacugcucaacuaagc

SEQ ID NO: 503608 - RNA, 28 nt, Human
cccacagaauuuaaaucucagcggaccg

SEQ ID NO: 503609 - RNA, 21 nt, Human
cccacagaauuuaaaucucau

SEQ ID NO: 503610 - RNA, 21 nt, Human
ccucuguauccagauagaaau

SEQ ID NO: 503611 - RNA, 20 nt, Human
cgauuuauuccuuauuuucu

SEQ ID NO: 503612 - RNA, 21 nt, Human
cuuaaaugcuaaaaacuucua

SEQ ID NO: 503613 - RNA, 18 nt, Human
gaagaaaaaucugccucu

SEQ ID NO: 503614 - RNA, 21 nt, Human
gacuauuuugaaauauccaaa

SEQ ID NO: 503615 - RNA, 22 nt, Human
gagcauaauuaaaagagaauac

SEQ ID NO: 503616 - RNA, 21 nt, Human
gagcauuucacaccuuaaaug

SEQ ID NO: 503617 - RNA, 20 nt, Human
gcagcccacagccggccgcc

SEQ ID NO: 503618 - RNA, 21 nt, Human
gcagugaacacgcaacccgaa

SEQ ID NO: 503619 - RNA, 21 nt, Human
ggagaacaauucuagacacua

SEQ ID NO: 503620 - RNA, 23 nt, Human
ggcaaaagggaaauacucacuaa

SEQ ID NO: 503621 - RNA, 18 nt, Human
ggguggagacagguuggc

SEQ ID NO: 503622 - RNA, 19 nt, Human
guggccggaaugcucggcc

SEQ ID NO: 503623 - RNA, 20 nt, Human
uaaaaagaguaguuuuagca

SEQ ID NO: 503624 - RNA, 22 nt, Human
uaaaagguccauaucuuaagaa

SEQ ID NO: 503625 - RNA, 27 nt, Human
uaaaugcuaaaaacuucuaacuugcuu

SEQ ID NO: 503626 - RNA, 20 nt, Human
uaacuugcuuuaggaauuag

SEQ ID NO: 503627 - RNA, 20 nt, Human
uaacuugcuuuaggaauugg

SEQ ID NO: 503628 - RNA, 27 nt, Human
uaaugcaacauaaaaauguccagcuuu

SEQ ID NO: 503629 - RNA, 21 nt, Human
uaucaagugaaugaauccaua

SEQ ID NO: 503630 - RNA, 19 nt, Human
uauccagauagaaaugaau

SEQ ID NO: 503631 - RNA, 19 nt, Human
uauggagugaaauacuaau

SEQ ID NO: 503632 - RNA, 18 nt, Human
ugaaauauccaaaaauca

SEQ ID NO: 503633 - RNA, 18 nt, Human
ugaaauauccagcuacaa

SEQ ID NO: 503634 - RNA, 23 nt, Human
ugacuuggccgcggaaggcgugg

SEQ ID NO: 503635 - RNA, 22 nt, Human
ugcugcagcccacagccggccg

SEQ ID NO: 503636 - RNA, 22 nt, Human
uggagacagguuggcagcaaaa

SEQ ID NO: 503637 - RNA, 20 nt, Human
uggcagcaaaacaaacugcu

SEQ ID NO: 503638 - RNA, 21 nt, Human
uggcagcaaaacaaacugcuc

SEQ ID NO: 503639 - RNA, 23 nt, Human
uggcagcaaaacaaacugcucaa

SEQ ID NO: 503640 - RNA, 23 nt, Human
uggcagcaaaacaaacugcucaa

SEQ ID NO: 503641 - RNA, 18 nt, Human
uucauuuccuacucaguu

SEQ ID NO: 503642 - RNA, 19 nt, Human
uuugaaauauccagcuaca

SEQ ID NO: 503643 - RNA, 19 nt, Human
uuuugguugaauuuagaac

SEQ ID NO: 503644 - RNA, 18 nt, Human
acccccaaagccgucccc

SEQ ID NO: 503645 - RNA, 22 nt, Human
agaaagcagcguggaccgagac

SEQ ID NO: 503646 - RNA, 21 nt, Human
agccugggccacgugagccuc

SEQ ID NO: 503647 - RNA, 23 nt, Human
aggaggcugcaggaagcuccagg

SEQ ID NO: 503648 - RNA, 22 nt, Human
aggagggagcagcaggcggcgg

SEQ ID NO: 503649 - RNA, 24 nt, Human
caaggggaaacacaccaacccgcc

SEQ ID NO: 503650 - RNA, 20 nt, Human
caggauggcagcccaggccu

SEQ ID NO: 503651 - RNA, 19 nt, Human
cauguccuuugggaagaaa

SEQ ID NO: 503652 - RNA, 22 nt, Human
ccaagacauaaaaggccgccca

SEQ ID NO: 503653 - RNA, 26 nt, Human
cccaggaaaagcaacgcccccuugcc

SEQ ID NO: 503654 - RNA, 21 nt, Human
cccuaggagggagcagcaggc

SEQ ID NO: 503655 - RNA, 26 nt, Human
cucgugggacccccaaagccgucccc

SEQ ID NO: 503656 - RNA, 22 nt, Human
cucuuuggcacagcacaccugg

SEQ ID NO: 503657 - RNA, 23 nt, Human
cuuuacaucaggugucuccaaga

SEQ ID NO: 503658 - RNA, 23 nt, Human
gagcagcaggcggcggggguucc

SEQ ID NO: 503659 - RNA, 19 nt, Human
gccugggccacgugagccu

SEQ ID NO: 503660 - RNA, 23 nt, Human
uaaacuccuaguccaugucucgu

SEQ ID NO: 503661 - RNA, 22 nt, Human
uacacaaggggaaacacaccaa

SEQ ID NO: 503662 - RNA, 19 nt, Human
uaccgcggcgacacaaccc

SEQ ID NO: 503663 - RNA, 22 nt, Human
uaggagggagcagcaggcggcg

SEQ ID NO: 503664 - RNA, 19 nt, Human
ucagucccugcccgcugcc

SEQ ID NO: 503665 - RNA, 20 nt, Human
uccaggcaugucugugcugg

SEQ ID NO: 503666 - RNA, 23 nt, Human
ucuccaagacauaaaaggccgcc

SEQ ID NO: 503667 - RNA, 22 nt, Human
ugagcucuuuggcacagcacac

SEQ ID NO: 503668 - RNA, 18 nt, Human
ugagggcugguccgggga

SEQ ID NO: 503669 - RNA, 19 nt, Human
ugccagugggaggacggca

SEQ ID NO: 503670 - RNA, 28 nt, Human
ugcguaggaggcugcaggaagcuccagg

SEQ ID NO: 503671 - RNA, 18 nt, Human
uggcagcccaggccacgu

SEQ ID NO: 503672 - RNA, 21 nt, Human
uggcagcccaggccacguggc

SEQ ID NO: 503673 - RNA, 19 nt, Human
ugggaagaaagcagcgugg

SEQ ID NO: 503674 - RNA, 23 nt, Human
ugggaagaaagcagcguggaccg

SEQ ID NO: 503675 - RNA, 21 nt, Human
ugggacccccaaagccguccc

SEQ ID NO: 503676 - RNA, 22 nt, Human
ugggacccccaaagccgucccc

SEQ ID NO: 503677 - RNA, 23 nt, Human
ugggccuuuaacaccugucacuu

SEQ ID NO: 503678 - RNA, 21 nt, Human
aaaaaaagagguagcaaauga

SEQ ID NO: 503679 - RNA, 19 nt, Human
aaacaaaagaccacaacaa

SEQ ID NO: 503680 - RNA, 20 nt, Human
aagagguagcaaaugaaaau

SEQ ID NO: 503681 - RNA, 21 nt, Human
agaaaaaacaaaagaccacaa

SEQ ID NO: 503682 - RNA, 22 nt, Human
agaaaaaacaaaagaccacaac

SEQ ID NO: 503683 - RNA, 24 nt, Human
agagguagcaaaugaaaauuaaag

SEQ ID NO: 503684 - RNA, 18 nt, Human
auaauaaaaaaagaggua

SEQ ID NO: 503685 - RNA, 26 nt, Human
auacuaagagaaaaaacaaaagacca

SEQ ID NO: 503686 - RNA, 18 nt, Human
cagcgcggagcuggaggc

SEQ ID NO: 503687 - RNA, 23 nt, Human
ccgaggccgccgcagccucgugc

SEQ ID NO: 503688 - RNA, 27 nt, Human
cuauacuaagagaaaaaacaaaagacc

SEQ ID NO: 503689 - RNA, 20 nt, Human
cuccgaggccgccgcagccu

SEQ ID NO: 503690 - RNA, 19 nt, Human
gagaaaaaacaaaagacca

SEQ ID NO: 503691 - RNA, 22 nt, Human
guggucagcgucuggcuccgcc

SEQ ID NO: 503692 - RNA, 20 nt, Human
uaaaaugucauuuaagugaa

SEQ ID NO: 503693 - RNA, 22 nt, Human
uaagagaaaaaacaaaagacca

SEQ ID NO: 503694 - RNA, 28 nt, Human
uaagugaaccauuccaaggcauaauaaa

SEQ ID NO: 503695 - RNA, 25 nt, Human
uagguugagagaaugugacuaugaa

SEQ ID NO: 503696 - RNA, 19 nt, Human
uauuccaaauuauagguug

SEQ ID NO: 503697 - RNA, 22 nt, Human
ucauucagauguauacauaaac

SEQ ID NO: 503698 - RNA, 22 nt, Human
uccaaggcauaauaaaaaaaga

SEQ ID NO: 503699 - RNA, 20 nt, Human
ucccggcugccgggcagcgc

SEQ ID NO: 503700 - RNA, 19 nt, Human
uccgaggccgccgcagccu

SEQ ID NO: 503701 - RNA, 20 nt, Human
uccgccgcgcuccgaggccg

SEQ ID NO: 503702 - RNA, 24 nt, Human
ugauugaagcaaaaugaauaaugc

SEQ ID NO: 503703 - RNA, 28 nt, Human
uggaggcggaggagaccgaggagaggaa

SEQ ID NO: 503704 - RNA, 24 nt, Human
ugugacuaugaagaaaguauucua

SEQ ID NO: 503705 - RNA, 20 nt, Human
uuuuuuuuuuuuuuguugga

SEQ ID NO: 503706 - RNA, 20 nt, Human
uuuuuuuuuuuuuuguugga

SEQ ID NO: 503707 - RNA, 20 nt, Human
uuuuuuuuuuuuuuuuuguu

SEQ ID NO: 503708 - RNA, 23 nt, Human
uuuuuuuuuuuuuuuuuuguugg

SEQ ID NO: 503709 - RNA, 18 nt, Human
agaggcagagagccaugc

SEQ ID NO: 503710 - RNA, 18 nt, Human
cagaggcagagagccaug

SEQ ID NO: 503711 - RNA, 21 nt, Human
cagaggcagagagccaugccu

SEQ ID NO: 503712 - RNA, 25 nt, Human
cagaggcagagagccaugccugcau

SEQ ID NO: 503713 - RNA, 23 nt, Human
cagucaguuagcacugauggcaa

SEQ ID NO: 503714 - RNA, 22 nt, Human
ccagcaggauccgugcaccucc

SEQ ID NO: 503715 - RNA, 22 nt, Human
cccacccacugccuuuggccgc

SEQ ID NO: 503716 - RNA, 22 nt, Human
cccagugcccagcaggauccgu

SEQ ID NO: 503717 - RNA, 19 nt, Human
ccuccugccccauuccugu

SEQ ID NO: 503718 - RNA, 21 nt, Human
ccugcccacccacugccuuug

SEQ ID NO: 503719 - RNA, 20 nt, Human
ccuggcccuuaacccuuucc

SEQ ID NO: 503720 - RNA, 21 nt, Human
cugaaccuugagauacaguga

SEQ ID NO: 503721 - RNA, 22 nt, Human
cugcugucucuggcccugggag

SEQ ID NO: 503722 - RNA, 24 nt, Human
cugcugucucuggcccugggagau

SEQ ID NO: 503723 - RNA, 19 nt, Human
cuggcccuuaacccuuucc

SEQ ID NO: 503724 - RNA, 21 nt, Human
ggaccugcccacccacugccu

SEQ ID NO: 503725 - RNA, 22 nt, Human
ggagcccaggagggagggaggg

SEQ ID NO: 503726 - RNA, 23 nt, Human
ggaguugugaccuggagcccagg

SEQ ID NO: 503727 - RNA, 23 nt, Human
guccuggcccuuaacccuuucca

SEQ ID NO: 503728 - RNA, 24 nt, Human
ucaggauuuuaucguuauuuuauu

SEQ ID NO: 503729 - RNA, 18 nt, Human
ucauugccuccugccucu

SEQ ID NO: 503730 - RNA, 20 nt, Human
ucugcugucucuggcccugg

SEQ ID NO: 503731 - RNA, 25 nt, Human
ugccccauuccuguccuggcccuua

SEQ ID NO: 503732 - RNA, 19 nt, Human
ugccuccugccucuaaucu

SEQ ID NO: 503733 - RNA, 20 nt, Human
uggagaggcagucaguuagc

SEQ ID NO: 503734 - RNA, 23 nt, Human
ugggucugcugucucuggcccug

SEQ ID NO: 503735 - RNA, 19 nt, Human
uguccuggcccuuaacccu

SEQ ID NO: 503736 - RNA, 27 nt, Human
uuagcacugauggcaacugguaucucu

SEQ ID NO: 503737 - RNA, 23 nt, Human
uuauuuuauugucauugccuccu

SEQ ID NO: 503738 - RNA, 21 nt, Human
uuggccgcccccugcucccag

SEQ ID NO: 503739 - RNA, 25 nt, Human
uuuuauugucauugccuccugccuc

SEQ ID NO: 503740 - RNA, 22 nt, Human
augaauuucugaaaagauaaag

SEQ ID NO: 503741 - RNA, 23 nt, Human
ggaucauuugauuuuuaaaaaug

SEQ ID NO: 503742 - RNA, 20 nt, Human
ucaugaucagaaaauagagc

SEQ ID NO: 503743 - RNA, 26 nt, Human
ugaucagaaaauagagcaaaauuuca

SEQ ID NO: 503744 - RNA, 19 nt, Human
uuucaugaucagaaaauag

SEQ ID NO: 503745 - RNA, 22 nt, Human
aacugugaggggagggcugugg

SEQ ID NO: 503746 - RNA, 18 nt, Human
agcagcagcaggagcggc

SEQ ID NO: 503747 - RNA, 24 nt, Human
caacugugaggggagggcuguggg

SEQ ID NO: 503748 - RNA, 22 nt, Human
cagaaguaggaaggugccgccc

SEQ ID NO: 503749 - RNA, 24 nt, Human
cagcccgagcagccgcugcggcgg

SEQ ID NO: 503750 - RNA, 21 nt, Human
cccccugccuggcucugggga

SEQ ID NO: 503751 - RNA, 19 nt, Human
cccgacccggccgggccgg

SEQ ID NO: 503752 - RNA, 19 nt, Human
cgcgcagcgcgcggcggcc

SEQ ID NO: 503753 - RNA, 19 nt, Human
cgcgcagcgcgcggcggcc

SEQ ID NO: 503754 - RNA, 24 nt, Human
cggcggcaguagcagcagcaggag

SEQ ID NO: 503755 - RNA, 18 nt, Human
gcgcagcgcgcggcggcc

SEQ ID NO: 503756 - RNA, 20 nt, Human
gcucuggggacuccugcuuc

SEQ ID NO: 503757 - RNA, 20 nt, Human
ggcgcgcagcgcgcggcggc

SEQ ID NO: 503758 - RNA, 23 nt, Human
gggagggcuguggcugggcagaa

SEQ ID NO: 503759 - RNA, 20 nt, Human
uagcagcagcaggagcggcc

SEQ ID NO: 503760 - RNA, 21 nt, Human
uaggaaggugccgccccagug

SEQ ID NO: 503761 - RNA, 18 nt, Human
ucaggcaaacaggugcuc

SEQ ID NO: 503762 - RNA, 19 nt, Human
ucccugggccgcccgaccc

SEQ ID NO: 503763 - RNA, 18 nt, Human
uccggggcgugcucagcc

SEQ ID NO: 503764 - RNA, 19 nt, Human
ugggcagaaguaggaaggu

SEQ ID NO: 503765 - RNA, 21 nt, Human
ugucaagucugucggucccug

SEQ ID NO: 503766 - RNA, 24 nt, Human
ugucaagucugucggucccugggc

SEQ ID NO: 503767 - RNA, 20 nt, Human
gggagggaagcugagagagu

SEQ ID NO: 503768 - RNA, 21 nt, Human
uagaaacugauccugggaggg

SEQ ID NO: 503769 - RNA, 21 nt, Human
ugauccugggagggaagcuga

SEQ ID NO: 503770 - RNA, 21 nt, Human
ugggagggaagcugagagagu

SEQ ID NO: 503771 - RNA, 24 nt, Human
aaaaagccacagaaauaaaaagga

SEQ ID NO: 503772 - RNA, 23 nt, Human
aaaaaggagaucagugguugcca

SEQ ID NO: 503773 - RNA, 18 nt, Human
aaacgccaugcuaaaugg

SEQ ID NO: 503774 - RNA, 24 nt, Human
aaagaacuucacuggucacaaacc

SEQ ID NO: 503775 - RNA, 21 nt, Human
aagaacaauacagaaaggccg

SEQ ID NO: 503776 - RNA, 19 nt, Human
aagaagccagacacaaaag

SEQ ID NO: 503777 - RNA, 27 nt, Human
aagaagccagacacaaaagaccacagu

SEQ ID NO: 503778 - RNA, 18 nt, Human
aaguaccaaaggcugccu

SEQ ID NO: 503779 - RNA, 24 nt, Human
aauuccauaacugaucucaugcca

SEQ ID NO: 503780 - RNA, 26 nt, Human
acaaaacaugaacacacuuucucccc

SEQ ID NO: 503781 - RNA, 22 nt, Human
acaaagcacgcgaaggguagag

SEQ ID NO: 503782 - RNA, 22 nt, Human
acaaagcacgcgaaggguagag

SEQ ID NO: 503783 - RNA, 23 nt, Human
acaaagcacgcgaaggguagagg

SEQ ID NO: 503784 - RNA, 23 nt, Human
acaauggaauuuuauucagccau

SEQ ID NO: 503785 - RNA, 23 nt, Human
acacagcaaaggcacagugaccu

SEQ ID NO: 503786 - RNA, 23 nt, Human
acacagcaaaggcacaguggugu

SEQ ID NO: 503787 - RNA, 22 nt, Human
acagaaauaaaaaggagaucag

SEQ ID NO: 503788 - RNA, 24 nt, Human
acagcaaaggcacagugaccugga

SEQ ID NO: 503789 - RNA, 21 nt, Human
acccucgcucggguccucccg

SEQ ID NO: 503790 - RNA, 18 nt, Human
acuuacagcauguucccu

SEQ ID NO: 503791 - RNA, 19 nt, Human
agaagaagccagacacaaa

SEQ ID NO: 503792 - RNA, 21 nt, Human
agccauagaaaggaaugaaau

SEQ ID NO: 503793 - RNA, 19 nt, Human
aggcuuuacaucccauguu

SEQ ID NO: 503794 - RNA, 20 nt, Human
agggauacucagacuguauu

SEQ ID NO: 503795 - RNA, 21 nt, Human
auacaacacagcaaaggcaca

SEQ ID NO: 503796 - RNA, 24 nt, Human
caaaagacuucccagacaaagcac

SEQ ID NO: 503797 - RNA, 22 nt, Human
caaaauuucugaaugccaacau

SEQ ID NO: 503798 - RNA, 19 nt, Human
caagucuuggaccuauuca

SEQ ID NO: 503799 - RNA, 21 nt, Human
cacaaacgcuuguggaucccc

SEQ ID NO: 503800 - RNA, 26 nt, Human
cacccccaagucuuggaccuauucaa

SEQ ID NO: 503801 - RNA, 19 nt, Human
cagaaauaaaaaggagauc

SEQ ID NO: 503802 - RNA, 24 nt, Human
cagaagaacaauacagaaaggcca

SEQ ID NO: 503803 - RNA, 22 nt, Human
cagcuacagauauuuuaaguac

SEQ ID NO: 503804 - RNA, 22 nt, Human
caugcacaaaauuauuuaaaau

SEQ ID NO: 503805 - RNA, 19 nt, Human
ccacagaaauaaaaaggag

SEQ ID NO: 503806 - RNA, 24 nt, Human
ccagaaaucacagucaaaaugcag

SEQ ID NO: 503807 - RNA, 18 nt, Human
ccagaauagaaaaagcca

SEQ ID NO: 503808 - RNA, 19 nt, Human
ccagcggcaacaaggcugu

SEQ ID NO: 503809 - RNA, 21 nt, Human
ccagguaacacagugacucau

SEQ ID NO: 503810 - RNA, 19 nt, Human
cccccaagucuuggaccua

SEQ ID NO: 503811 - RNA, 19 nt, Human
ccccuacuacgccccagga

SEQ ID NO: 503812 - RNA, 19 nt, Human
cccucgcucggguccuccc

SEQ ID NO: 503813 - RNA, 19 nt, Human
ccuacuacgccccaggaac

SEQ ID NO: 503814 - RNA, 25 nt, Human
ccuacugucucagaagaagccagac

SEQ ID NO: 503815 - RNA, 20 nt, Human
ccuuccuacugucucagaag

SEQ ID NO: 503816 - RNA, 21 nt, Human
ccuugcaaacgccaugcuaaa

SEQ ID NO: 503817 - RNA, 19 nt, Human
cgucauccuaacauccuga

SEQ ID NO: 503818 - RNA, 21 nt, Human
cuaaagccucgagguuagcag

SEQ ID NO: 503819 - RNA, 18 nt, Human
cuagccccaagcauuuca

SEQ ID NO: 503820 - RNA, 18 nt, Human
cucaggagagaaggaaaa

SEQ ID NO: 503821 - RNA, 23 nt, Human
cucaggagagaaggaaaaggaaa

SEQ ID NO: 503822 - RNA, 21 nt, Human
cucuggagggaaaagaaaacu

SEQ ID NO: 503823 - RNA, 19 nt, Human
cuuacagcauguucccugc

SEQ ID NO: 503824 - RNA, 18 nt, Human
cuucccggggaaccccgg

SEQ ID NO: 503825 - RNA, 21 nt, Human
cuucccggggaaccccggcuu

SEQ ID NO: 503826 - RNA, 21 nt, Human
cuuccuggcaagccgagaccc

SEQ ID NO: 503827 - RNA, 22 nt, Human
cuuuaggcuauguauauaaggu

SEQ ID NO: 503828 - RNA, 22 nt, Human
gaaauucaaaacacuucuagcc

SEQ ID NO: 503829 - RNA, 18 nt, Human
gagaucagugguugccag

SEQ ID NO: 503830 - RNA, 26 nt, Human
gagcaucccuaaucugaaaauccaaa

SEQ ID NO: 503831 - RNA, 19 nt, Human
gcaauagaaacugacaugg

SEQ ID NO: 503832 - RNA, 19 nt, Human
gcacagugaccuggacucu

SEQ ID NO: 503833 - RNA, 19 nt, Human
gcauguucccugccauccu

SEQ ID NO: 503834 - RNA, 22 nt, Human
gcgaaggguagaggauauaggu

SEQ ID NO: 503835 - RNA, 19 nt, Human
gcugaucuugauuccugag

SEQ ID NO: 503836 - RNA, 18 nt, Human
ggugccaacacccagaua

SEQ ID NO: 503837 - RNA, 22 nt, Human
gguggaggggaagauagggagu

SEQ ID NO: 503838 - RNA, 23 nt, Human
uaacugaucucaugccagaaauc

SEQ ID NO: 503839 - RNA, 24 nt, Human
uaccaggaaauaaacagggugagg

SEQ ID NO: 503840 - RNA, 19 nt, Human
uagaaaaagccacagaaau

SEQ ID NO: 503841 - RNA, 18 nt, Human
uaguguguacaggcauuu

SEQ ID NO: 503842 - RNA, 23 nt, Human
uauaugaagcauaaaugaauuuc

SEQ ID NO: 503843 - RNA, 19 nt, Human
uauccagaauagaaaaagc

SEQ ID NO: 503844 - RNA, 20 nt, Human
uauguauauaagguguauau

SEQ ID NO: 503845 - RNA, 22 nt, Human
uauuccaaaaucugaaauucaa

SEQ ID NO: 503846 - RNA, 21 nt, Human
ucaaaacacuucuagccccaa

SEQ ID NO: 503847 - RNA, 24 nt, Human
ucaucugguugugaugaucaucuc

SEQ ID NO: 503848 - RNA, 18 nt, Human
uccagaauagaaaaagcc

SEQ ID NO: 503849 - RNA, 23 nt, Human
uccagaauagaaaaagccacaga

SEQ ID NO: 503850 - RNA, 20 nt, Human
uccagguaacacagugacuc

SEQ ID NO: 503851 - RNA, 23 nt, Human
uccccagugagguuguugggaaa

SEQ ID NO: 503852 - RNA, 22 nt, Human
uccccauuauucccagucaugu

SEQ ID NO: 503853 - RNA, 22 nt, Human
ugaaaauccaaaaugcuccaaa

SEQ ID NO: 503854 - RNA, 25 nt, Human
ugaaauucaaaacacuucuagcccc

SEQ ID NO: 503855 - RNA, 22 nt, Human
ugacauggggccaaaagacuuc

SEQ ID NO: 503856 - RNA, 22 nt, Human
ugagagcacagaagaacaauac

SEQ ID NO: 503857 - RNA, 24 nt, Human
ugcagucgaaacuuuguuucaugc

SEQ ID NO: 503858 - RNA, 23 nt, Human
ugccagcggacagguggagggga

SEQ ID NO: 503859 - RNA, 23 nt, Human
ugccauccuuuccauacaacaca

SEQ ID NO: 503860 - RNA, 24 nt, Human
ugccugaggcaaagccuuacuugc

SEQ ID NO: 503861 - RNA, 19 nt, Human
ugcuccaaaauuucaaaau

SEQ ID NO: 503862 - RNA, 21 nt, Human
uggagugaugaaaauguuuug

SEQ ID NO: 503863 - RNA, 18 nt, Human
uggaucuccuaaggccag

SEQ ID NO: 503864 - RNA, 19 nt, Human
uggcagaauaguggcuggg

SEQ ID NO: 503865 - RNA, 21 nt, Human
uggcugaguuccagguaacac

SEQ ID NO: 503866 - RNA, 20 nt, Human
ugguugacagaaguauguau

SEQ ID NO: 503867 - RNA, 24 nt, Human
ugucaaugagguaguaguaugggu

SEQ ID NO: 503868 - RNA, 20 nt, Human
ugugaggcuuuacaucccau

SEQ ID NO: 503869 - RNA, 19 nt, Human
ugugaugaucaucucgagu

SEQ ID NO: 503870 - RNA, 21 nt, Human
uguuuagucuugagucucauc

SEQ ID NO: 503871 - RNA, 23 nt, Human
uucaaaauuucugaaugccaaca

SEQ ID NO: 503872 - RNA, 24 nt, Human
uuccacuuauaugaaauauccaga

SEQ ID NO: 503873 - RNA, 22 nt, Human
uugauuccugaguuuuuuggag

SEQ ID NO: 503874 - RNA, 26 nt, Human
uugcaaaggcacuucgagugcgcggg

SEQ ID NO: 503875 - RNA, 23 nt, Human
uugccagcggacagguggagggg

SEQ ID NO: 503876 - RNA, 19 nt, Human
uuucauguuuagucuugag

SEQ ID NO: 503877 - RNA, 24 nt, Human
uuucuccccagugagguuguuggg

SEQ ID NO: 503878 - RNA, 23 nt, Human
uuugcuggagaacagagggauuc

SEQ ID NO: 503879 - RNA, 22 nt, Human
uuuuaccaggaaauaaacaggg

SEQ ID NO: 503880 - RNA, 22 nt, Human
gacucgcugccgccgcuccuuu

SEQ ID NO: 503881 - RNA, 18 nt, Human
gagaaggaaguuuauugc

SEQ ID NO: 503882 - RNA, 23 nt, Human
ucagguggcccgaggagaaggaa

SEQ ID NO: 503883 - RNA, 20 nt, Human
ucgcugccgccgcucccagc

SEQ ID NO: 503884 - RNA, 19 nt, Human
ugccgccgcucccagcaac

SEQ ID NO: 503885 - RNA, 19 nt, Human
uuuuuuuucagguggcccg

SEQ ID NO: 503886 - RNA, 22 nt, Human
uuuuuuuuuuuuuuuuuucagg

SEQ ID NO: 503887 - RNA, 20 nt, Human
accaggaagagagcacccca

SEQ ID NO: 503888 - RNA, 18 nt, Human
agagaagcagaggaccag

SEQ ID NO: 503889 - RNA, 24 nt, Human
agagcaacugggggacuuacacuu

SEQ ID NO: 503890 - RNA, 19 nt, Human
aggggguggggaggaucca

SEQ ID NO: 503891 - RNA, 19 nt, Human
aguccccccucccggcucc

SEQ ID NO: 503892 - RNA, 22 nt, Human
aguccugguucgcucccucucg

SEQ ID NO: 503893 - RNA, 26 nt, Human
auucacaauauuccaggggggccagc

SEQ ID NO: 503894 - RNA, 20 nt, Human
caccccaccgugggcuccug

SEQ ID NO: 503895 - RNA, 21 nt, Human
cagacagccacuguucccauu

SEQ ID NO: 503896 - RNA, 21 nt, Human
cagagcaacugggggacuuac

SEQ ID NO: 503897 - RNA, 19 nt, Human
cagcccccgcgcuucuccc

SEQ ID NO: 503898 - RNA, 21 nt, Human
caggagcaggagggggugggg

SEQ ID NO: 503899 - RNA, 24 nt, Human
caggagcaggaggggguggggagg

SEQ ID NO: 503900 - RNA, 24 nt, Human
ccccaccucccuagucauucacaa

SEQ ID NO: 503901 - RNA, 22 nt, Human
ccccaggagcaggagggggugg

SEQ ID NO: 503902 - RNA, 22 nt, Human
cccccucccggcuccccgaugg

SEQ ID NO: 503903 - RNA, 18 nt, Human
ccccggccaggcgccccc

SEQ ID NO: 503904 - RNA, 21 nt, Human
ccccugcccugccgucacccc

SEQ ID NO: 503905 - RNA, 26 nt, Human
ccccugcccugccgucaccccagguu

SEQ ID NO: 503906 - RNA, 21 nt, Human
cccggccaggcgcccccugcc

SEQ ID NO: 503907 - RNA, 22 nt, Human
cccggccaggcgcccccugccc

SEQ ID NO: 503908 - RNA, 23 nt, Human
ccggcuccccgauggccuccuuc

SEQ ID NO: 503909 - RNA, 21 nt, Human
ccucccggcuccccgauggcc

SEQ ID NO: 503910 - RNA, 20 nt, Human
ccuccuggaugaccugguug

SEQ ID NO: 503911 - RNA, 21 nt, Human
ccuccuggaugaccugguugu

SEQ ID NO: 503912 - RNA, 24 nt, Human
ccuccuucggggcgcucgcuacuc

SEQ ID NO: 503913 - RNA, 21 nt, Human
ccuccuucuaggagugagagc

SEQ ID NO: 503914 - RNA, 22 nt, Human
ccugccgucaccccaguccugg

SEQ ID NO: 503915 - RNA, 22 nt, Human
ccuggaccagagcaacuggggg

SEQ ID NO: 503916 - RNA, 20 nt, Human
cggcuccccgauggccuccu

SEQ ID NO: 503917 - RNA, 20 nt, Human
cucacacccuccuucuagga

SEQ ID NO: 503918 - RNA, 19 nt, Human
gagaagcagaggaccagga

SEQ ID NO: 503919 - RNA, 20 nt, Human
gagaagcagaggaccaggaa

SEQ ID NO: 503920 - RNA, 25 nt, Human
gcaguccccccucccggcuccccga

SEQ ID NO: 503921 - RNA, 20 nt, Human
gccgucaccccaguccuggu

SEQ ID NO: 503922 - RNA, 19 nt, Human
ggaccagagcaacuggggg

SEQ ID NO: 503923 - RNA, 19 nt, Human
ggauccagagaagcagagg

SEQ ID NO: 503924 - RNA, 24 nt, Human
ggggguggggaggauccagagaag

SEQ ID NO: 503925 - RNA, 24 nt, Human
gggguccucucgcaguccccccuc

SEQ ID NO: 503926 - RNA, 18 nt, Human
gggguggggaggauccag

SEQ ID NO: 503927 - RNA, 19 nt, Human
guccucucgcagucccccc

SEQ ID NO: 503928 - RNA, 19 nt, Human
uccccgauggccuccuucg

SEQ ID NO: 503929 - RNA, 19 nt, Human
uccuggaugaccugguugu

SEQ ID NO: 503930 - RNA, 19 nt, Human
ucucgcaguccccccuccc

SEQ ID NO: 503931 - RNA, 22 nt, Human
ucucugagaaaagggccggccc

SEQ ID NO: 503932 - RNA, 20 nt, Human
ucuugggcagaaauccagcc

SEQ ID NO: 503933 - RNA, 18 nt, Human
ugccagcagcaggacgga

SEQ ID NO: 503934 - RNA, 21 nt, Human
ugccgucaccccaguccuggu

SEQ ID NO: 503935 - RNA, 28 nt, Human
ugcucuaccccaccucccuagucauuca

SEQ ID NO: 503936 - RNA, 26 nt, Human
ugggcagaaauccagccacugcccca

SEQ ID NO: 503937 - RNA, 20 nt, Human
uugagugaucucugagaaaa

SEQ ID NO: 503938 - RNA, 18 nt, Human
uugggcagaaauccagcc

SEQ ID NO: 503939 - RNA, 22 nt, Human
uuuuuuuuuuuuugaggguucu

SEQ ID NO: 503940 - RNA, 24 nt, Human
uuuuuuuuuuuuuuuuuuugaggg

SEQ ID NO: 503941 - RNA, 24 nt, Human
aaacaaacaaauaaauaauaagca

SEQ ID NO: 503942 - RNA, 21 nt, Human
aaacaaacaguagccuucccc

SEQ ID NO: 503943 - RNA, 24 nt, Human
aaacaaacaguagccuuccccagu

SEQ ID NO: 503944 - RNA, 23 nt, Human
aaauccuuccgauagauacgcca

SEQ ID NO: 503945 - RNA, 18 nt, Human
aagcaaacaaaaacaaac

SEQ ID NO: 503946 - RNA, 18 nt, Human
aagcaaacaaaaacaaac

SEQ ID NO: 503947 - RNA, 24 nt, Human
aagggaacauucugaaacuuaguu

SEQ ID NO: 503948 - RNA, 23 nt, Human
aauauaacuaacuguacaagaca

SEQ ID NO: 503949 - RNA, 20 nt, Human
auaggcuuccucgcaggcuu

SEQ ID NO: 503950 - RNA, 18 nt, Human
aucuccuaaucugaauuu

SEQ ID NO: 503951 - RNA, 20 nt, Human
caaaaacaaacaguagccuu

SEQ ID NO: 503952 - RNA, 18 nt, Human
caaacaguagccuucccc

SEQ ID NO: 503953 - RNA, 23 nt, Human
cgucucaggacaggaaacuauuc

SEQ ID NO: 503954 - RNA, 20 nt, Human
gcuguucaaaggguaagcac

SEQ ID NO: 503955 - RNA, 19 nt, Human
ggcgcccggcuccucugcc

SEQ ID NO: 503956 - RNA, 19 nt, Human
uaagcaaacaaaaacaaac

SEQ ID NO: 503957 - RNA, 24 nt, Human
uacaagaagggaacauucugaaac

SEQ ID NO: 503958 - RNA, 18 nt, Human
uagaaucuuuuguaggua

SEQ ID NO: 503959 - RNA, 22 nt, Human
ucacucugcuguucaaagggua

SEQ ID NO: 503960 - RNA, 26 nt, Human
uccauaggcuuccucgcaggcuucug

SEQ ID NO: 503961 - RNA, 24 nt, Human
ucgguuucaguuuaacugaagcga

SEQ ID NO: 503962 - RNA, 21 nt, Human
ucuuguguauagggguaaucu

SEQ ID NO: 503963 - RNA, 21 nt, Human
uuccccaguugcaggggccua

SEQ ID NO: 503964 - RNA, 20 nt, Human
uuccucgcaggcuucugugc

SEQ ID NO: 503965 - RNA, 22 nt, Human
uucgguuucaguuuaacugaag

SEQ ID NO: 503966 - RNA, 22 nt, Human
uugcaggggccuaaaauaucuc

SEQ ID NO: 503967 - RNA, 24 nt, Human
uugcaggggccuaaaauaucuccu

SEQ ID NO: 503968 - RNA, 21 nt, Human
uuuagguuggccauucuugug

SEQ ID NO: 503969 - RNA, 18 nt, Human
uuuugcccuuuuccuucc

SEQ ID NO: 503970 - RNA, 23 nt, Human
ccggccguccuguccugcuccug

SEQ ID NO: 503971 - RNA, 18 nt, Human
ccugcuccugccaggugg

SEQ ID NO: 503972 - RNA, 19 nt, Human
cuguccugcuccugccagg

SEQ ID NO: 503973 - RNA, 18 nt, Human
uuuugguacccacagacu

SEQ ID NO: 503974 - RNA, 18 nt, Human
uuuuuuuuuuuuuuuuug

SEQ ID NO: 503975 - RNA, 20 nt, Human
uuuuuuuuuuuuuuuuuugg

SEQ ID NO: 503976 - RNA, 25 nt, Human
aaaaaaacagaucacauuuugcuga

SEQ ID NO: 503977 - RNA, 26 nt, Human
aaaaaaaccaaaaaggcugggaaagg

SEQ ID NO: 503978 - RNA, 20 nt, Human
aaaaaaccaaaaaggcuggu

SEQ ID NO: 503979 - RNA, 23 nt, Human
aaaagaaaaaaaauaagaaagaa

SEQ ID NO: 503980 - RNA, 23 nt, Human
aaacaaacaguaaaaugauucca

SEQ ID NO: 503981 - RNA, 26 nt, Human
aaacaaacaguaaaaugauuccagag

SEQ ID NO: 503982 - RNA, 19 nt, Human
aaacaaacucaaaucauga

SEQ ID NO: 503983 - RNA, 21 nt, Human
aaacaacaaaauccaaaugca

SEQ ID NO: 503984 - RNA, 19 nt, Human
aaacaccccaaaacaaacu

SEQ ID NO: 503985 - RNA, 24 nt, Human
aaacaccccaaaacaaacucaaau

SEQ ID NO: 503986 - RNA, 19 nt, Human
aaacagcaaaaaagcaaac

SEQ ID NO: 503987 - RNA, 24 nt, Human
aaagcgguuucccuguguguguuu

SEQ ID NO: 503988 - RNA, 18 nt, Human
aaaggacuuucccccuca

SEQ ID NO: 503989 - RNA, 22 nt, Human
aacaccccaaaacaaacucaaa

SEQ ID NO: 503990 - RNA, 24 nt, Human
aaccaaauaugaugugaggucaga

SEQ ID NO: 503991 - RNA, 23 nt, Human
aacuauuuuguaauucuaaacaa

SEQ ID NO: 503992 - RNA, 19 nt, Human
aagaacauuaagacucaug

SEQ ID NO: 503993 - RNA, 23 nt, Human
aagaagcuuccagggcaugccga

SEQ ID NO: 503994 - RNA, 19 nt, Human
aagguaaugaaacuacagg

SEQ ID NO: 503995 - RNA, 20 nt, Human
aaucuaccuccguuuucccu

SEQ ID NO: 503996 - RNA, 23 nt, Human
acaaaacacauaauaaaauaccc

SEQ ID NO: 503997 - RNA, 20 nt, Human
acaaacaucaauucucacag

SEQ ID NO: 503998 - RNA, 21 nt, Human
acaagccaacuauaaccccua

SEQ ID NO: 503999 - RNA, 22 nt, Human
acagaccucuagagacuuaaaa

SEQ ID NO: 504000 - RNA, 24 nt, Human
accacaacuuaauucacagaagca

SEQ ID NO: 504001 - RNA, 23 nt, Human
accugguauauucagagguaccu

SEQ ID NO: 504002 - RNA, 20 nt, Human
acuguuuuuggaaguagucu

SEQ ID NO: 504003 - RNA, 20 nt, Human
acuucucacaagaaacacac

SEQ ID NO: 504004 - RNA, 21 nt, Human
agaaaguacaaaauagcccuc

SEQ ID NO: 504005 - RNA, 18 nt, Human
agaacauuaagacucaug

SEQ ID NO: 504006 - RNA, 25 nt, Human
agacagaagcaaaaaaacugcauca

SEQ ID NO: 504007 - RNA, 22 nt, Human
agacuggagcuuguguuggggc

SEQ ID NO: 504008 - RNA, 20 nt, Human
agcacaagccaacuauaacc

SEQ ID NO: 504009 - RNA, 22 nt, Human
agcugaggccaagaagcuucca

SEQ ID NO: 504010 - RNA, 19 nt, Human
aggaaacagaaacaaaacc

SEQ ID NO: 504011 - RNA, 21 nt, Human
aggaaauccagccggaauucc

SEQ ID NO: 504012 - RNA, 21 nt, Human
aggaagacuggagcuuguguu

SEQ ID NO: 504013 - RNA, 26 nt, Human
agggagauggggaggggagucggcuu

SEQ ID NO: 504014 - RNA, 23 nt, Human
agggcaaaaaaggacuuuccccc

SEQ ID NO: 504015 - RNA, 20 nt, Human
aggggagcugaggccaagaa

SEQ ID NO: 504016 - RNA, 22 nt, Human
aggggagcugaggccaagaagc

SEQ ID NO: 504017 - RNA, 19 nt, Human
agguggguugagguugaga

SEQ ID NO: 504018 - RNA, 24 nt, Human
aguaaaaugauuccagaguagcac

SEQ ID NO: 504019 - RNA, 23 nt, Human
auaaaacaaacaauacucaaaug

SEQ ID NO: 504020 - RNA, 19 nt, Human
aucacaauucucuaauuua

SEQ ID NO: 504021 - RNA, 19 nt, Human
augagagcagggagccucu

SEQ ID NO: 504022 - RNA, 20 nt, Human
augcagguggguugagguug

SEQ ID NO: 504023 - RNA, 22 nt, Human
caaaauagcccucagaggauga

SEQ ID NO: 504024 - RNA, 22 nt, Human
caaauaugaugugaggucagaa

SEQ ID NO: 504025 - RNA, 20 nt, Human
caaauuacuucucacaagaa

SEQ ID NO: 504026 - RNA, 25 nt, Human
caagaaacacacugaagcucuagga

SEQ ID NO: 504027 - RNA, 19 nt, Human
caaucaacccgaaaucaaa

SEQ ID NO: 504028 - RNA, 23 nt, Human
cacaaacacaucuaaauagucca

SEQ ID NO: 504029 - RNA, 26 nt, Human
cacuuauacaaugucuuacaaaaaac

SEQ ID NO: 504030 - RNA, 25 nt, Human
cagaaacaaaaccccucaagagacu

SEQ ID NO: 504031 - RNA, 27 nt, Human
cagacaguuuuuuucucaaacuguuuu

SEQ ID NO: 504032 - RNA, 21 nt, Human
cagaccucuagagacuuaaaa

SEQ ID NO: 504033 - RNA, 20 nt, Human
cagagagaaauaacaaacaa

SEQ ID NO: 504034 - RNA, 22 nt, Human
cagcacaaaaaaacaaauacaa

SEQ ID NO: 504035 - RNA, 24 nt, Human
caggaacuggugcuagguauuugg

SEQ ID NO: 504036 - RNA, 20 nt, Human
cauggugagguugccuucac

SEQ ID NO: 504037 - RNA, 24 nt, Human
ccaacauucugugucccuggacac

SEQ ID NO: 504038 - RNA, 25 nt, Human
ccaauucuaaacuugucuuaucaac

SEQ ID NO: 504039 - RNA, 24 nt, Human
cgggaggaaauccagccggaauuu

SEQ ID NO: 504040 - RNA, 18 nt, Human
cucaguguuuuccucugg

SEQ ID NO: 504041 - RNA, 19 nt, Human
cugggggagaugcaugcag

SEQ ID NO: 504042 - RNA, 22 nt, Human
cuguacauugaaacaguauaaa

SEQ ID NO: 504043 - RNA, 22 nt, Human
cuuuuuuuugagacgccacagg

SEQ ID NO: 504044 - RNA, 20 nt, Human
gacagaagcaaaaaaacugc

SEQ ID NO: 504045 - RNA, 19 nt, Human
gagcggggaaggggagcug

SEQ ID NO: 504046 - RNA, 21 nt, Human
gagcugaggccaagaagcuuc

SEQ ID NO: 504047 - RNA, 18 nt, Human
gaggacagaagaaucaga

SEQ ID NO: 504048 - RNA, 24 nt, Human
gaguagcacaagccaacuauaacc

SEQ ID NO: 504049 - RNA, 19 nt, Human
gcagguggguugagguuga

SEQ ID NO: 504050 - RNA, 19 nt, Human
gcaugugcuauaagaagga

SEQ ID NO: 504051 - RNA, 19 nt, Human
gcugaacacaaacacaucu

SEQ ID NO: 504052 - RNA, 21 nt, Human
ggaaaaugguuuaauauugga

SEQ ID NO: 504053 - RNA, 23 nt, Human
ggaaacaccccaaaacaaacuca

SEQ ID NO: 504054 - RNA, 20 nt, Human
ggagaugcaugcaggugggu

SEQ ID NO: 504055 - RNA, 20 nt, Human
ggauagcaaguuaacaaacu

SEQ ID NO: 504056 - RNA, 24 nt, Human
gggaaaaaagaaaucaagccaaag

SEQ ID NO: 504057 - RNA, 21 nt, Human
gggcaaaaaaggacuuucccc

SEQ ID NO: 504058 - RNA, 22 nt, Human
ggucuuagaaauucaaguggug

SEQ ID NO: 504059 - RNA, 26 nt, Human
gguuuuuuuaaaauuuuauuuuuuuu

SEQ ID NO: 504060 - RNA, 25 nt, Human
guagcacaagccaacuauaaccccu

SEQ ID NO: 504061 - RNA, 20 nt, Human
uaaaaaaaccaaaaaggcug

SEQ ID NO: 504062 - RNA, 25 nt, Human
uaaaaaaaccaaaaaggcugggaaa

SEQ ID NO: 504063 - RNA, 18 nt, Human
uaaaagaaaaaaacagau

SEQ ID NO: 504064 - RNA, 22 nt, Human
uaaaauacccauguuaucaaau

SEQ ID NO: 504065 - RNA, 24 nt, Human
uaaaaugauuccagaguagcacaa

SEQ ID NO: 504066 - RNA, 26 nt, Human
uaaacagcaaaaaagcaaacccuaaa

SEQ ID NO: 504067 - RNA, 19 nt, Human
uaaauuguuuuucguugag

SEQ ID NO: 504068 - RNA, 24 nt, Human
uaaccaaagaacaaaguagucaaa

SEQ ID NO: 504069 - RNA, 18 nt, Human
uaagcaaagggaaaaaag

SEQ ID NO: 504070 - RNA, 24 nt, Human
uaauaaauuucagucuugcaugaa

SEQ ID NO: 504071 - RNA, 20 nt, Human
uaauucucaaaagaaaagca

SEQ ID NO: 504072 - RNA, 20 nt, Human
uacagaccucuagagacuua

SEQ ID NO: 504073 - RNA, 23 nt, Human
uaucaacaaagaacauuaagacu

SEQ ID NO: 504074 - RNA, 19 nt, Human
ucaaucaacccgaaaucaa

SEQ ID NO: 504075 - RNA, 21 nt, Human
ucaaucaaucaacccgaaauc

SEQ ID NO: 504076 - RNA, 25 nt, Human
ucaaucaaucaaucaaucaacccga

SEQ ID NO: 504077 - RNA, 20 nt, Human
ucaauuaaaaaaaccaaaaa

SEQ ID NO: 504078 - RNA, 20 nt, Human
ucagaaagacaucagaaaca

SEQ ID NO: 504079 - RNA, 24 nt, Human
uccaaauuggaaacaccccaaaac

SEQ ID NO: 504080 - RNA, 21 nt, Human
uccacaauuaaaaaaaaugac

SEQ ID NO: 504081 - RNA, 25 nt, Human
uccacaauuaaaaaaaaugacauca

SEQ ID NO: 504082 - RNA, 25 nt, Human
ucuagacuaggacauagccgggguc

SEQ ID NO: 504083 - RNA, 23 nt, Human
ugaaacaguauaaaauauaggua

SEQ ID NO: 504084 - RNA, 27 nt, Human
ugaaaccacaacuuaauucacagaagc

SEQ ID NO: 504085 - RNA, 19 nt, Human
ugacauuauucaaaaaggu

SEQ ID NO: 504086 - RNA, 19 nt, Human
ugacuugugaagaagaaac

SEQ ID NO: 504087 - RNA, 24 nt, Human
ugagaaauaaucaaaaguaguaaa

SEQ ID NO: 504088 - RNA, 22 nt, Human
ugagagcagggagccucugggg

SEQ ID NO: 504089 - RNA, 21 nt, Human
ugagagggagauggggagggg

SEQ ID NO: 504090 - RNA, 21 nt, Human
ugaggccaagaagcuuccagg

SEQ ID NO: 504091 - RNA, 22 nt, Human
uggaaacaccccaaaacaaacu

SEQ ID NO: 504092 - RNA, 22 nt, Human
uggcacaggcccuuugcacccu

SEQ ID NO: 504093 - RNA, 26 nt, Human
uggcucaaauuccaucaaacaacaag

SEQ ID NO: 504094 - RNA, 20 nt, Human
ugggacaugggcacuuauaa

SEQ ID NO: 504095 - RNA, 18 nt, Human
uggggaggggagucggcu

SEQ ID NO: 504096 - RNA, 20 nt, Human
uggggcuguaggcgugacau

SEQ ID NO: 504097 - RNA, 21 nt, Human
ugggggagaugcaugcaggug

SEQ ID NO: 504098 - RNA, 23 nt, Human
uggugcuagguauuuggucagua

SEQ ID NO: 504099 - RNA, 23 nt, Human
ugugaagaagaaacacuccgauu

SEQ ID NO: 504100 - RNA, 24 nt, Human
ugugaagaagaaacacuccgauuc

SEQ ID NO: 504101 - RNA, 19 nt, Human
ugugauaaagaacugagcu

SEQ ID NO: 504102 - RNA, 26 nt, Human
uguuucaacuacacgguuauguucac

SEQ ID NO: 504103 - RNA, 26 nt, Human
uuaaaaaaaccaaaaaggcugggaaa

SEQ ID NO: 504104 - RNA, 18 nt, Human
uuaaaagauaaaagugga

SEQ ID NO: 504105 - RNA, 23 nt, Human
uuagaaauauuauuuaggaguau

SEQ ID NO: 504106 - RNA, 18 nt, Human
uuagaaauucaaguggug

SEQ ID NO: 504107 - RNA, 19 nt, Human
uucaaaacuuucucaccuu

SEQ ID NO: 504108 - RNA, 18 nt, Human
uucacaaugaggacagaa

SEQ ID NO: 504109 - RNA, 25 nt, Human
uucacuuuuuuucuuuaaaagaaaa

SEQ ID NO: 504110 - RNA, 19 nt, Human
uucuaaacuugucuuauca

SEQ ID NO: 504111 - RNA, 20 nt, Human
uugaucuaaacagcaaaaaa

SEQ ID NO: 504112 - RNA, 19 nt, Human
uuggccucguggaauuguu

SEQ ID NO: 504113 - RNA, 20 nt, Human
uugucuaauaauaaauuuca

SEQ ID NO: 504114 - RNA, 21 nt, Human
uuuauccacuuaaagugacug

SEQ ID NO: 504115 - RNA, 18 nt, Human
uuucuuauacuaaucuac

SEQ ID NO: 504116 - RNA, 23 nt, Human
uuuuuguuuuuuugcaucaguag

SEQ ID NO: 504117 - RNA, 23 nt, Human
uuuuuuggagaagggcaaaaaag

SEQ ID NO: 504118 - RNA, 24 nt, Human
uuuuuuuaauuagcacuuaagaua

SEQ ID NO: 504119 - RNA, 24 nt, Human
augaacuugaaguuguuuucauuc

SEQ ID NO: 504120 - RNA, 21 nt, Human
caaauuuauucacagcagcuc

SEQ ID NO: 504121 - RNA, 24 nt, Human
caauccuuauucaaaguacagcua

SEQ ID NO: 504122 - RNA, 18 nt, Human
ccaacaugaacuauuugc

SEQ ID NO: 504123 - RNA, 20 nt, Human
gggagguccaauggcggcag

SEQ ID NO: 504124 - RNA, 20 nt, Human
uaaaagggagguccaauggc

SEQ ID NO: 504125 - RNA, 22 nt, Human
ucuaaagucguccagugcagca

SEQ ID NO: 504126 - RNA, 22 nt, Human
uucaaaguacagcuaguucucc

SEQ ID NO: 504127 - RNA, 24 nt, Human
aaaaaaaaaaaaaaagacacauca

SEQ ID NO: 504128 - RNA, 24 nt, Human
aaaaaaagacacaucaacugcaaa

SEQ ID NO: 504129 - RNA, 22 nt, Human
aaaaagacacaucaacugcaaa

SEQ ID NO: 504130 - RNA, 18 nt, Human
aaacagcagaaaacaggg

SEQ ID NO: 504131 - RNA, 18 nt, Human
aagacacaucaacugcaa

SEQ ID NO: 504132 - RNA, 22 nt, Human
aagacgaagccccggcgaggaa

SEQ ID NO: 504133 - RNA, 18 nt, Human
aaugacaugagcuugaaa

SEQ ID NO: 504134 - RNA, 18 nt, Human
acagcgcugccauuacug

SEQ ID NO: 504135 - RNA, 24 nt, Human
accgaauuuccacuuuucagcaau

SEQ ID NO: 504136 - RNA, 20 nt, Human
aggaaggugggcggaggcgg

SEQ ID NO: 504137 - RNA, 22 nt, Human
aggaaggugggcggaggcggcg

SEQ ID NO: 504138 - RNA, 21 nt, Human
aggcagcccgaaggagugaaa

SEQ ID NO: 504139 - RNA, 19 nt, Human
aggccgccuccccggccgg

SEQ ID NO: 504140 - RNA, 19 nt, Human
aggcggcggcggcggcggc

SEQ ID NO: 504141 - RNA, 24 nt, Human
aggggagggggaggcagcccgaag

SEQ ID NO: 504142 - RNA, 25 nt, Human
aggugggcggaggcggcggcggcgg

SEQ ID NO: 504143 - RNA, 18 nt, Human
auuaaaaaaaaaaaaaaa

SEQ ID NO: 504144 - RNA, 20 nt, Human
auuaaaaaaaaaaaaaaaga

SEQ ID NO: 504145 - RNA, 24 nt, Human
caagcagcaguaucauguuuguca

SEQ ID NO: 504146 - RNA, 19 nt, Human
caccacgcuggaggagagc

SEQ ID NO: 504147 - RNA, 25 nt, Human
cacucauucuuuuaauaaaguuuua

SEQ ID NO: 504148 - RNA, 23 nt, Human
cagcccgaaggagugaaagacga

SEQ ID NO: 504149 - RNA, 21 nt, Human
caggggacaaggggaggggga

SEQ ID NO: 504150 - RNA, 27 nt, Human
ccaaauggugauggcaaugaucuucuc

SEQ ID NO: 504151 - RNA, 19 nt, Human
ccgccuccccggccggccg

SEQ ID NO: 504152 - RNA, 24 nt, Human
cggcgaggaaggugggcggaggcg

SEQ ID NO: 504153 - RNA, 20 nt, Human
cggcggcggcggcggcuguc

SEQ ID NO: 504154 - RNA, 23 nt, Human
cugugcgccgaggccgccucccc

SEQ ID NO: 504155 - RNA, 18 nt, Human
cuugaaauaucucuaggc

SEQ ID NO: 504156 - RNA, 23 nt, Human
cuuuaagauacauuaaaaaaaaa

SEQ ID NO: 504157 - RNA, 18 nt, Human
gaggcacaguccugcuuu

SEQ ID NO: 504158 - RNA, 22 nt, Human
gaggcggcggcggcggcggcug

SEQ ID NO: 504159 - RNA, 22 nt, Human
gcaaugaucuucucacaccacg

SEQ ID NO: 504160 - RNA, 25 nt, Human
gcggcggcggcggcggcugucagcu

SEQ ID NO: 504161 - RNA, 19 nt, Human
ggacaaggggagggggagg

SEQ ID NO: 504162 - RNA, 22 nt, Human
ggcaaggggcaggggacaaggg

SEQ ID NO: 504163 - RNA, 18 nt, Human
ggcggcggcggcggcggc

SEQ ID NO: 504164 - RNA, 24 nt, Human
gggcaaggggcaggggacaagggg

SEQ ID NO: 504165 - RNA, 21 nt, Human
gggcaggggacaaggggaggg

SEQ ID NO: 504166 - RNA, 24 nt, Human
gggcggaggcggcggcggcggcgg

SEQ ID NO: 504167 - RNA, 20 nt, Human
ggggagggggaggcagcccg

SEQ ID NO: 504168 - RNA, 27 nt, Human
ggugggcggaggcggcggcggcggcga

SEQ ID NO: 504169 - RNA, 21 nt, Human
uaagaaaugucauaaugacau

SEQ ID NO: 504170 - RNA, 23 nt, Human
ucacaccacgcuggaggagagcg

SEQ ID NO: 504171 - RNA, 20 nt, Human
ucccacaggaacacaccaaa

SEQ ID NO: 504172 - RNA, 19 nt, Human
ugaaagacgaagccccggc

SEQ ID NO: 504173 - RNA, 20 nt, Human
ugacaugagcuugaaauauc

SEQ ID NO: 504174 - RNA, 24 nt, Human
uggugauggcaaugaucuucucac

SEQ ID NO: 504175 - RNA, 24 nt, Human
uuuuuuuuuuuuuuauuugacaag

SEQ ID NO: 504176 - RNA, 21 nt, Human
uuuuuuuuuuuuuuuuuauuu

SEQ ID NO: 504177 - RNA, 19 nt, Human
acagccugauggaggugcu

SEQ ID NO: 504178 - RNA, 20 nt, Human
agagauuuuccacagccuga

SEQ ID NO: 504179 - RNA, 23 nt, Human
cgggcagccgaggucuguaauca

SEQ ID NO: 504180 - RNA, 22 nt, Human
gagaacagagauuuuccacagc

SEQ ID NO: 504181 - RNA, 18 nt, Human
gcagcuuccgccacgugu

SEQ ID NO: 504182 - RNA, 20 nt, Human
ucuguaaucagaaccgcugg

SEQ ID NO: 504183 - RNA, 24 nt, Human
ugagaacagagauuuuccacagcc

SEQ ID NO: 504184 - RNA, 20 nt, Human
ugcguguaguugucgggcag

SEQ ID NO: 504185 - RNA, 26 nt, Human
uuccacagccugauggaggugcugcu

SEQ ID NO: 504186 - RNA, 27 nt, Human
aaaggggagagcuggcaucccgucggg

SEQ ID NO: 504187 - RNA, 21 nt, Human
aagcacaaaggggagagcugg

SEQ ID NO: 504188 - RNA, 20 nt, Human
acacgcacccccgcaccccc

SEQ ID NO: 504189 - RNA, 23 nt, Human
acagacaggccacaggcaggaac

SEQ ID NO: 504190 - RNA, 19 nt, Human
acccagagccccauucccc

SEQ ID NO: 504191 - RNA, 18 nt, Human
accccaggcucccagcuc

SEQ ID NO: 504192 - RNA, 18 nt, Human
agccccuucccugagcag

SEQ ID NO: 504193 - RNA, 20 nt, Human
aggcaggaacccagagcccc

SEQ ID NO: 504194 - RNA, 21 nt, Human
aggcaggaacccagagcccca

SEQ ID NO: 504195 - RNA, 22 nt, Human
aggccacaggcaggaacccaga

SEQ ID NO: 504196 - RNA, 20 nt, Human
aggcucccagcucccagucu

SEQ ID NO: 504197 - RNA, 23 nt, Human
aguuaguuuuauuuuacucccuu

SEQ ID NO: 504198 - RNA, 18 nt, Human
auggccaagcccccaggc

SEQ ID NO: 504199 - RNA, 22 nt, Human
caacccuccucuucccuggccc

SEQ ID NO: 504200 - RNA, 20 nt, Human
cacccugggcccuccauggg

SEQ ID NO: 504201 - RNA, 20 nt, Human
caccggagccccccaacccu

SEQ ID NO: 504202 - RNA, 18 nt, Human
cacgcacccccgcacccc

SEQ ID NO: 504203 - RNA, 21 nt, Human
cagaggaacggaaggccggca

SEQ ID NO: 504204 - RNA, 19 nt, Human
cauggccaagcccccaggc

SEQ ID NO: 504205 - RNA, 21 nt, Human
cauggccaagcccccaggccc

SEQ ID NO: 504206 - RNA, 18 nt, Human
cauuggguccaagcugca

SEQ ID NO: 504207 - RNA, 19 nt, Human
ccaacugaugcccauacca

SEQ ID NO: 504208 - RNA, 19 nt, Human
ccaagcccccaggcccuga

SEQ ID NO: 504209 - RNA, 19 nt, Human
ccaccccaccuuggcccca

SEQ ID NO: 504210 - RNA, 23 nt, Human
ccaccggagccccccaacccucc

SEQ ID NO: 504211 - RNA, 21 nt, Human
ccagcauggccaagcccccag

SEQ ID NO: 504212 - RNA, 21 nt, Human
ccaggcccugaccaccaccca

SEQ ID NO: 504213 - RNA, 20 nt, Human
cccaacccuccucuucccug

SEQ ID NO: 504214 - RNA, 20 nt, Human
cccauaccaggcacccuggg

SEQ ID NO: 504215 - RNA, 19 nt, Human
ccccaacccuccucuuccc

SEQ ID NO: 504216 - RNA, 23 nt, Human
ccccaccaacugaugcccauacc

SEQ ID NO: 504217 - RNA, 24 nt, Human
ccccaccuuggccccaguggugac

SEQ ID NO: 504218 - RNA, 25 nt, Human
ccccaggcccugaccaccacccauu

SEQ ID NO: 504219 - RNA, 21 nt, Human
ccccaguggugaccaagccag

SEQ ID NO: 504220 - RNA, 26 nt, Human
cccccaacccuccucuucccuggccc

SEQ ID NO: 504221 - RNA, 23 nt, Human
cccccagcauggccaagccccca

SEQ ID NO: 504222 - RNA, 19 nt, Human
cccccaggcccugaccacc

SEQ ID NO: 504223 - RNA, 22 nt, Human
cccccaggcccugaccaccacc

SEQ ID NO: 504224 - RNA, 23 nt, Human
cccccaggcccugaccaccaccc

SEQ ID NO: 504225 - RNA, 25 nt, Human
ccccgcacccccaccaacugaugcc

SEQ ID NO: 504226 - RNA, 27 nt, Human
ccccgcacccccaccaacugaugccca

SEQ ID NO: 504227 - RNA, 18 nt, Human
ccccucugggcagagucu

SEQ ID NO: 504228 - RNA, 20 nt, Human
ccccucugggcagagucugc

SEQ ID NO: 504229 - RNA, 23 nt, Human
ccccucugggcagagucugccug

SEQ ID NO: 504230 - RNA, 26 nt, Human
ccucucuccaccccaccuuggcccca

SEQ ID NO: 504231 - RNA, 21 nt, Human
cggagccccccaacccuccuc

SEQ ID NO: 504232 - RNA, 24 nt, Human
cucccccugggguucagaccacag

SEQ ID NO: 504233 - RNA, 21 nt, Human
cucguaggccucucuccaccc

SEQ ID NO: 504234 - RNA, 18 nt, Human
cugaauuagggaggagga

SEQ ID NO: 504235 - RNA, 19 nt, Human
cugggucugaauuagggag

SEQ ID NO: 504236 - RNA, 20 nt, Human
cuguccaccccaggcuccca

SEQ ID NO: 504237 - RNA, 20 nt, Human
gacacgcacccccgcacccc

SEQ ID NO: 504238 - RNA, 22 nt, Human
gagccccauuugcuguugcagg

SEQ ID NO: 504239 - RNA, 22 nt, Human
gcagggaagcacaaaggggaga

SEQ ID NO: 504240 - RNA, 21 nt, Human
gccccuucccugagcagccug

SEQ ID NO: 504241 - RNA, 18 nt, Human
gcuaaggagaaggcugag

SEQ ID NO: 504242 - RNA, 22 nt, Human
ggaaggccggcaucgcagaagc

SEQ ID NO: 504243 - RNA, 24 nt, Human
ggacacgcacccccgcacccccac

SEQ ID NO: 504244 - RNA, 21 nt, Human
ggccccaguggugaccaagcc

SEQ ID NO: 504245 - RNA, 21 nt, Human
ggcugaagaaggagccccauu

SEQ ID NO: 504246 - RNA, 18 nt, Human
ggcugaggagaagggguc

SEQ ID NO: 504247 - RNA, 18 nt, Human
ggcugccccucugggcag

SEQ ID NO: 504248 - RNA, 20 nt, Human
ggcugccccucugggcagag

SEQ ID NO: 504249 - RNA, 26 nt, Human
gggagggcugaagaaggagccccauu

SEQ ID NO: 504250 - RNA, 24 nt, Human
ggggacacgcacccccgcaccccc

SEQ ID NO: 504251 - RNA, 19 nt, Human
ggugaccaagccagggcac

SEQ ID NO: 504252 - RNA, 18 nt, Human
gguggagucaaugcccca

SEQ ID NO: 504253 - RNA, 23 nt, Human
guccuguccaccccaggcuccca

SEQ ID NO: 504254 - RNA, 18 nt, Human
guggugaccaagccaggg

SEQ ID NO: 504255 - RNA, 22 nt, Human
uaaggagaaggcugaggagaag

SEQ ID NO: 504256 - RNA, 19 nt, Human
uaccaggcacccugggccc

SEQ ID NO: 504257 - RNA, 19 nt, Human
uccagcucaggacaggggu

SEQ ID NO: 504258 - RNA, 19 nt, Human
uccauggguugcugcaggg

SEQ ID NO: 504259 - RNA, 21 nt, Human
uccauggguugcugcagggaa

SEQ ID NO: 504260 - RNA, 24 nt, Human
ucccagucugucucaguuuggggc

SEQ ID NO: 504261 - RNA, 18 nt, Human
ucccugagcagccuggcu

SEQ ID NO: 504262 - RNA, 19 nt, Human
ucccugagcagccuggcug

SEQ ID NO: 504263 - RNA, 21 nt, Human
uccucugccgcuuucagcccc

SEQ ID NO: 504264 - RNA, 23 nt, Human
uccuguccaccccaggcucccag

SEQ ID NO: 504265 - RNA, 19 nt, Human
ucugaauuagggaggagga

SEQ ID NO: 504266 - RNA, 18 nt, Human
ucugggcagagucugccu

SEQ ID NO: 504267 - RNA, 21 nt, Human
ucugggcagagucugccugag

SEQ ID NO: 504268 - RNA, 18 nt, Human
ugaccaagccagggcacu

SEQ ID NO: 504269 - RNA, 23 nt, Human
ugccccacucccccugggguuca

SEQ ID NO: 504270 - RNA, 20 nt, Human
ugccccucugggcagagucu

SEQ ID NO: 504271 - RNA, 21 nt, Human
ugccccucugggcagagucug

SEQ ID NO: 504272 - RNA, 21 nt, Human
uggggcugggaaggggagggc

SEQ ID NO: 504273 - RNA, 24 nt, Human
uggucauaggggcgggcgggcggg

SEQ ID NO: 504274 - RNA, 23 nt, Human
uuuccaccggagccccccaaccc

SEQ ID NO: 504275 - RNA, 19 nt, Human
aaaaacuuagccacaggua

SEQ ID NO: 504276 - RNA, 21 nt, Human
aaaaagaagaggaaauugaag

SEQ ID NO: 504277 - RNA, 20 nt, Human
aaaagagauaaaucagagaa

SEQ ID NO: 504278 - RNA, 23 nt, Human
aaacauacaaaagagauaaauca

SEQ ID NO: 504279 - RNA, 22 nt, Human
aacaaaugaaugaagaaaugaa

SEQ ID NO: 504280 - RNA, 19 nt, Human
aacuacugaaugaacaaau

SEQ ID NO: 504281 - RNA, 22 nt, Human
aacugguagcacaagcagccuu

SEQ ID NO: 504282 - RNA, 24 nt, Human
aagcacaagccguuagccaccaac

SEQ ID NO: 504283 - RNA, 22 nt, Human
aagcagccuuggcaaaacacag

SEQ ID NO: 504284 - RNA, 22 nt, Human
acaaaagagauaaaucagagaa

SEQ ID NO: 504285 - RNA, 22 nt, Human
acaaguuuccucuaaauggcag

SEQ ID NO: 504286 - RNA, 19 nt, Human
acuaugcaggugggcucug

SEQ ID NO: 504287 - RNA, 23 nt, Human
agagaugcugcugagcagaagag

SEQ ID NO: 504288 - RNA, 25 nt, Human
agaggaaaaagaagaggaaauugaa

SEQ ID NO: 504289 - RNA, 21 nt, Human
agccaccaacaaacugguagc

SEQ ID NO: 504290 - RNA, 19 nt, Human
agucacagaggucagagga

SEQ ID NO: 504291 - RNA, 23 nt, Human
agucacagaggucagaggaaaaa

SEQ ID NO: 504292 - RNA, 18 nt, Human
auaaaagacacuuaagcc

SEQ ID NO: 504293 - RNA, 18 nt, Human
auagaagggaauuaccau

SEQ ID NO: 504294 - RNA, 19 nt, Human
caagcagccuuggcaaaac

SEQ ID NO: 504295 - RNA, 21 nt, Human
caagcagccuuggcaaaacac

SEQ ID NO: 504296 - RNA, 22 nt, Human
caauucacaucagacuucagaa

SEQ ID NO: 504297 - RNA, 20 nt, Human
cacgaagcuccuugcuaggg

SEQ ID NO: 504298 - RNA, 18 nt, Human
cagaggaaaaagaagagg

SEQ ID NO: 504299 - RNA, 18 nt, Human
cauagccuagagccaggc

SEQ ID NO: 504300 - RNA, 23 nt, Human
cauggccacaucugagaaaagag

SEQ ID NO: 504301 - RNA, 24 nt, Human
cauuuaaaaaucuacugcaaauua

SEQ ID NO: 504302 - RNA, 22 nt, Human
ccaccaacaaacugguagcaca

SEQ ID NO: 504303 - RNA, 24 nt, Human
ccuagagccaggcacccaggaaau

SEQ ID NO: 504304 - RNA, 19 nt, Human
cguggagggugaagagggu

SEQ ID NO: 504305 - RNA, 20 nt, Human
cuacugcaaauuaaguauaa

SEQ ID NO: 504306 - RNA, 22 nt, Human
cugcugagcagaagaguccugu

SEQ ID NO: 504307 - RNA, 22 nt, Human
cuuggcaaaacacaguuacuau

SEQ ID NO: 504308 - RNA, 22 nt, Human
cuuuuuagcuguguaauucuaa

SEQ ID NO: 504309 - RNA, 21 nt, Human
gaaaauccaaacauacaaaag

SEQ ID NO: 504310 - RNA, 20 nt, Human
gaaagcaacuaauuaagagc

SEQ ID NO: 504311 - RNA, 18 nt, Human
gaguaguaggggguggcg

SEQ ID NO: 504312 - RNA, 23 nt, Human
gcuaaaauagaagggaauuacca

SEQ ID NO: 504313 - RNA, 25 nt, Human
ggaaauagugaaagcaaccgguacc

SEQ ID NO: 504314 - RNA, 21 nt, Human
ggguguugugaggaggguaga

SEQ ID NO: 504315 - RNA, 27 nt, Human
gguuggcugcucagacuguucaggacu

SEQ ID NO: 504316 - RNA, 23 nt, Human
uaagaaaaauuaagucacagagg

SEQ ID NO: 504317 - RNA, 24 nt, Human
uaagccacugaaauagaaaguaaa

SEQ ID NO: 504318 - RNA, 22 nt, Human
uauaucuuauuuugguguuuaa

SEQ ID NO: 504319 - RNA, 20 nt, Human
uauuauaucuuauuuuggug

SEQ ID NO: 504320 - RNA, 21 nt, Human
uauuugcaacuaaaucuaaca

SEQ ID NO: 504321 - RNA, 20 nt, Human
uauuuuaucuuauuuuggug

SEQ ID NO: 504322 - RNA, 24 nt, Human
uauuuugguguuuuuuuuccuuuu

SEQ ID NO: 504323 - RNA, 18 nt, Human
ucaggacauagccuagag

SEQ ID NO: 504324 - RNA, 24 nt, Human
ucauugugagaagcaaaguacacc

SEQ ID NO: 504325 - RNA, 23 nt, Human
uccaaacauacaaaagagauaaa

SEQ ID NO: 504326 - RNA, 19 nt, Human
uccacuguuaaucugggcg

SEQ ID NO: 504327 - RNA, 19 nt, Human
uccuguguucaauuuuguu

SEQ ID NO: 504328 - RNA, 21 nt, Human
ucgauauugaaaauccaaaca

SEQ ID NO: 504329 - RNA, 23 nt, Human
ucgauauugaaaauccaaacaua

SEQ ID NO: 504330 - RNA, 18 nt, Human
ugaaauagaaaguaaaua

SEQ ID NO: 504331 - RNA, 22 nt, Human
ugaagaggguguugugaggagg

SEQ ID NO: 504332 - RNA, 24 nt, Human
ugagaagugguauuuuugaguguu

SEQ ID NO: 504333 - RNA, 18 nt, Human
ugaguguuucaauaaaaa

SEQ ID NO: 504334 - RNA, 22 nt, Human
ugcaaaaacaaauguuuuauua

SEQ ID NO: 504335 - RNA, 23 nt, Human
ugcacagaaucaccuuuaaaaac

SEQ ID NO: 504336 - RNA, 19 nt, Human
ugcaggugggcucuguuuu

SEQ ID NO: 504337 - RNA, 24 nt, Human
ugcugcugagcagaagaguccugu

SEQ ID NO: 504338 - RNA, 23 nt, Human
uggcaaaacacaguuacuaugca

SEQ ID NO: 504339 - RNA, 18 nt, Human
ugggcgauugccauucag

SEQ ID NO: 504340 - RNA, 26 nt, Human
ugguagcacaagcagccuuggcaaaa

SEQ ID NO: 504341 - RNA, 20 nt, Human
ugguauuuuugaguguuuca

SEQ ID NO: 504342 - RNA, 23 nt, Human
uguauuuacaaucuuggguaguc

SEQ ID NO: 504343 - RNA, 20 nt, Human
ugugagaagcaaaguacacc

SEQ ID NO: 504344 - RNA, 18 nt, Human
uguucaggacugcuacug

SEQ ID NO: 504345 - RNA, 24 nt, Human
uuaaaccauaauuauuaggcaaca

SEQ ID NO: 504346 - RNA, 24 nt, Human
uuauuuugguguuuaaauuuguuu

SEQ ID NO: 504347 - RNA, 26 nt, Human
uucagagucugaaaaaucacagaacc

SEQ ID NO: 504348 - RNA, 24 nt, Human
uucauuugacauuuauugcaauaa

SEQ ID NO: 504349 - RNA, 19 nt, Human
uuuuccuuuuuagcugugu

SEQ ID NO: 504350 - RNA, 18 nt, Human
aagaagccccgugauuuc

SEQ ID NO: 504351 - RNA, 23 nt, Human
aagaagccccgugauuucgugau

SEQ ID NO: 504352 - RNA, 23 nt, Human
aggcagaugcugcgaccuugccc

SEQ ID NO: 504353 - RNA, 18 nt, Human
cacagcacuccaccccuc

SEQ ID NO: 504354 - RNA, 24 nt, Human
cacagcacuccaccccuccacacc

SEQ ID NO: 504355 - RNA, 22 nt, Human
caccacgcugccaucucagagu

SEQ ID NO: 504356 - RNA, 22 nt, Human
caccccuccacaccgaagcccg

SEQ ID NO: 504357 - RNA, 23 nt, Human
caccgaagcccgcagcuucucag

SEQ ID NO: 504358 - RNA, 19 nt, Human
cacuccaccccuccacacc

SEQ ID NO: 504359 - RNA, 19 nt, Human
cagcagguucuucccuggg

SEQ ID NO: 504360 - RNA, 20 nt, Human
cagcagguucuucccugggu

SEQ ID NO: 504361 - RNA, 19 nt, Human
cagcuucucaggaaagggc

SEQ ID NO: 504362 - RNA, 21 nt, Human
cagugcauaucaucacacaca

SEQ ID NO: 504363 - RNA, 19 nt, Human
ccccuccacaccgaagccc

SEQ ID NO: 504364 - RNA, 23 nt, Human
ccucugcagaacacucugggccu

SEQ ID NO: 504365 - RNA, 19 nt, Human
cgccagcggaggaacguuc

SEQ ID NO: 504366 - RNA, 24 nt, Human
cuccacaccgaagcccgcagcuuc

SEQ ID NO: 504367 - RNA, 22 nt, Human
cugagccagcagaaagaagccc

SEQ ID NO: 504368 - RNA, 21 nt, Human
gaacacacacauccccugugc

SEQ ID NO: 504369 - RNA, 24 nt, Human
gaacacucugggccucccggcuga

SEQ ID NO: 504370 - RNA, 18 nt, Human
gaguccauuucaaugcug

SEQ ID NO: 504371 - RNA, 23 nt, Human
gcagaaagaagccccgugauuuc

SEQ ID NO: 504372 - RNA, 21 nt, Human
gcgugaccuggggcagggagc

SEQ ID NO: 504373 - RNA, 22 nt, Human
uacaucaggaacacacacaucc

SEQ ID NO: 504374 - RNA, 21 nt, Human
uacgcagccucugcagaacac

SEQ ID NO: 504375 - RNA, 22 nt, Human
ucacagcacuccaccccuccac

SEQ ID NO: 504376 - RNA, 19 nt, Human
ucacagcacuccaccccuu

SEQ ID NO: 504377 - RNA, 19 nt, Human
uccccugugcggagaucug

SEQ ID NO: 504378 - RNA, 20 nt, Human
ucugccuuuuucaguauugg

SEQ ID NO: 504379 - RNA, 21 nt, Human
ugagcaugaggggcuucuugg

SEQ ID NO: 504380 - RNA, 21 nt, Human
ugggccucccggcugagccag

SEQ ID NO: 504381 - RNA, 20 nt, Human
uucuuggugucauuuccacu

SEQ ID NO: 504382 - RNA, 19 nt, Human
uuucaaacuacagaaaagu

SEQ ID NO: 504383 - RNA, 20 nt, Human
aaaauuuucaccacaaaacc

SEQ ID NO: 504384 - RNA, 24 nt, Human
aaacaagcggcccgacaaggggca

SEQ ID NO: 504385 - RNA, 19 nt, Human
aaauauaucucucaauaca

SEQ ID NO: 504386 - RNA, 23 nt, Human
aacacagcugaggaaaauuuaua

SEQ ID NO: 504387 - RNA, 23 nt, Human
aacuauucaaaacugcuaagcag

SEQ ID NO: 504388 - RNA, 27 nt, Human
aacuauucaaaacugcuaagcagccuc

SEQ ID NO: 504389 - RNA, 23 nt, Human
aagcagccuccuguaccacauaa

SEQ ID NO: 504390 - RNA, 22 nt, Human
acaaaaccaauaguuaacuacu

SEQ ID NO: 504391 - RNA, 20 nt, Human
acaaggcagugaacacaugc

SEQ ID NO: 504392 - RNA, 25 nt, Human
acaucaaggaaccaucgucagaaca

SEQ ID NO: 504393 - RNA, 18 nt, Human
aggcagugaacacaugca

SEQ ID NO: 504394 - RNA, 21 nt, Human
auauuguuuucacaucaagga

SEQ ID NO: 504395 - RNA, 20 nt, Human
caaggaaccaucgucagaac

SEQ ID NO: 504396 - RNA, 23 nt, Human
caccacaaaaccaauaguuaacu

SEQ ID NO: 504397 - RNA, 28 nt, Human
ccacaaaaccaauaguuaacuacuaaca

SEQ ID NO: 504398 - RNA, 21 nt, Human
ccaguggagggagaacgaggc

SEQ ID NO: 504399 - RNA, 19 nt, Human
ccuccuguaccacauaagu

SEQ ID NO: 504400 - RNA, 19 nt, Human
cuaagcagccuccuguacc

SEQ ID NO: 504401 - RNA, 20 nt, Human
cugaugugcaacacagcuga

SEQ ID NO: 504402 - RNA, 22 nt, Human
gaaaggacaaggcagugaacac

SEQ ID NO: 504403 - RNA, 20 nt, Human
gaaaggacaaggcagugagg

SEQ ID NO: 504404 - RNA, 23 nt, Human
gaacacaugcauuccaguggagg

SEQ ID NO: 504405 - RNA, 21 nt, Human
ggacaaggcagugaacacaug

SEQ ID NO: 504406 - RNA, 19 nt, Human
ggugacggcagcagccaaa

SEQ ID NO: 504407 - RNA, 24 nt, Human
guagaaaaaguaagaaaauuuuca

SEQ ID NO: 504408 - RNA, 21 nt, Human
uaagaaaauacagauauggua

SEQ ID NO: 504409 - RNA, 21 nt, Human
uaagcagccuccuguaccaca

SEQ ID NO: 504410 - RNA, 24 nt, Human
uaagcagccuccuguaccacauaa

SEQ ID NO: 504411 - RNA, 26 nt, Human
uaagcagccuccuguaccacauaagu

SEQ ID NO: 504412 - RNA, 18 nt, Human
uaggaugauaaugugcaa

SEQ ID NO: 504413 - RNA, 21 nt, Human
uauuguuuucacaucaaggaa

SEQ ID NO: 504414 - RNA, 21 nt, Human
ucaauacagugaucacaccuc

SEQ ID NO: 504415 - RNA, 21 nt, Human
ugacggcagcagccaaacaag

SEQ ID NO: 504416 - RNA, 22 nt, Human
aagcaagagcuguggaggggcu

SEQ ID NO: 504417 - RNA, 23 nt, Human
aagguucucugagaccgacaugg

SEQ ID NO: 504418 - RNA, 21 nt, Human
aggaggagggagggagcuagc

SEQ ID NO: 504419 - RNA, 21 nt, Human
agggagcuagcaagcuaaggc

SEQ ID NO: 504420 - RNA, 19 nt, Human
auaaucggcaagcaagagc

SEQ ID NO: 504421 - RNA, 23 nt, Human
cacccaggaggagggagggagcu

SEQ ID NO: 504422 - RNA, 21 nt, Human
cagcacccaggaggagggagg

SEQ ID NO: 504423 - RNA, 26 nt, Human
ccagaagauaguugacugauaucuuc

SEQ ID NO: 504424 - RNA, 19 nt, Human
cgacaugggggcuagugcu

SEQ ID NO: 504425 - RNA, 18 nt, Human
cucugagaccgacauggg

SEQ ID NO: 504426 - RNA, 19 nt, Human
gcuggugguuacauaaucg

SEQ ID NO: 504427 - RNA, 21 nt, Human
gcuguggaggggcuugcugga

SEQ ID NO: 504428 - RNA, 26 nt, Human
uaacucagagguggggagaagguucu

SEQ ID NO: 504429 - RNA, 20 nt, Human
uaaggcagguggcccuccug

SEQ ID NO: 504430 - RNA, 25 nt, Human
ucaauagcaucaaugcaauccagaa

SEQ ID NO: 504431 - RNA, 25 nt, Human
ucaaugcaauccagaagauaguuga

SEQ ID NO: 504432 - RNA, 21 nt, Human
ugagaccgacaugggggcuag

SEQ ID NO: 504433 - RNA, 24 nt, Human
uggaugcccucagcacccaggagg

SEQ ID NO: 504434 - RNA, 18 nt, Human
uguggaggggcuugcugg

SEQ ID NO: 504435 - RNA, 21 nt, Human
uguggaggggcuugcuggaug

SEQ ID NO: 504436 - RNA, 22 nt, Human
agcaguuggugccaggaggggc

SEQ ID NO: 504437 - RNA, 22 nt, Human
aggcugggcccacuccuacagc

SEQ ID NO: 504438 - RNA, 23 nt, Human
agggacaugggcaggguuuccca

SEQ ID NO: 504439 - RNA, 20 nt, Human
caggggagcaguuggugcca

SEQ ID NO: 504440 - RNA, 18 nt, Human
ccacuccagcugagccug

SEQ ID NO: 504441 - RNA, 18 nt, Human
ccaggaggggcugcgcug

SEQ ID NO: 504442 - RNA, 24 nt, Human
cccaaccacuccagcugagccugg

SEQ ID NO: 504443 - RNA, 20 nt, Human
cccuggccuggccucugugg

SEQ ID NO: 504444 - RNA, 18 nt, Human
cccuggggaagcagggcc

SEQ ID NO: 504445 - RNA, 26 nt, Human
ccguggccauggcagggggguagucc

SEQ ID NO: 504446 - RNA, 19 nt, Human
ccucaggaccugggccacc

SEQ ID NO: 504447 - RNA, 23 nt, Human
ccucuguggcccuaagugucccu

SEQ ID NO: 504448 - RNA, 19 nt, Human
ccuggccuggccucugugg

SEQ ID NO: 504449 - RNA, 23 nt, Human
cgucccugcucuccuagguguca

SEQ ID NO: 504450 - RNA, 21 nt, Human
cuaggugucaagaugcagagg

SEQ ID NO: 504451 - RNA, 19 nt, Human
cucaggaccugggccacca

SEQ ID NO: 504452 - RNA, 23 nt, Human
cucaggaccugggccaccacggg

SEQ ID NO: 504453 - RNA, 20 nt, Human
cuguagggcccuggccuggc

SEQ ID NO: 504454 - RNA, 21 nt, Human
cuuugcagcugggucccagcc

SEQ ID NO: 504455 - RNA, 22 nt, Human
gaccugggccaccacgggaggc

SEQ ID NO: 504456 - RNA, 20 nt, Human
gagggcggggcucaggcagg

SEQ ID NO: 504457 - RNA, 20 nt, Human
gcugcgcugucagucgcugg

SEQ ID NO: 504458 - RNA, 21 nt, Human
ggagcaguuggugccaggagg

SEQ ID NO: 504459 - RNA, 21 nt, Human
gggcggggcucaggcaggugg

SEQ ID NO: 504460 - RNA, 23 nt, Human
ggggugaggaggauuuggaggcc

SEQ ID NO: 504461 - RNA, 22 nt, Human
gggugaggaggauuuggaggcc

SEQ ID NO: 504462 - RNA, 21 nt, Human
ggugaggaggauuuggaggcc

SEQ ID NO: 504463 - RNA, 22 nt, Human
ggugaggaggauuuggaggccu

SEQ ID NO: 504464 - RNA, 19 nt, Human
ggugugggggugaggagga

SEQ ID NO: 504465 - RNA, 19 nt, Human
guggcccuaagugucccug

SEQ ID NO: 504466 - RNA, 22 nt, Human
ucccagugccccacuugcugug

SEQ ID NO: 504467 - RNA, 18 nt, Human
uccgucccugcucuccua

SEQ ID NO: 504468 - RNA, 21 nt, Human
uccuacagccuuugcagcugg

SEQ ID NO: 504469 - RNA, 18 nt, Human
ugagggacaugggcaggg

SEQ ID NO: 504470 - RNA, 18 nt, Human
ugccaguccucaggaccu

SEQ ID NO: 504471 - RNA, 18 nt, Human
uggcaggggagcaguugg

SEQ ID NO: 504472 - RNA, 25 nt, Human
uggccucuguggcccuaaguguccc

SEQ ID NO: 504473 - RNA, 23 nt, Human
ugggggugaggaggauuuggagg

SEQ ID NO: 504474 - RNA, 24 nt, Human
uggugccaggaggggcugcgcugu

SEQ ID NO: 504475 - RNA, 18 nt, Human
ugugggggugaggaggau

SEQ ID NO: 504476 - RNA, 28 nt, Human
aaaagcagcaaggagcugaccgguaccc

SEQ ID NO: 504477 - RNA, 19 nt, Human
aaaauccacccgagugcac

SEQ ID NO: 504478 - RNA, 23 nt, Human
aaacccugauucccccagccccc

SEQ ID NO: 504479 - RNA, 18 nt, Human
aaaggcugcucaggcagg

SEQ ID NO: 504480 - RNA, 18 nt, Human
aaaguccuucagcuucuc

SEQ ID NO: 504481 - RNA, 18 nt, Human
aaauggagggacugccca

SEQ ID NO: 504482 - RNA, 21 nt, Human
aaccaggaaggagccauagcc

SEQ ID NO: 504483 - RNA, 23 nt, Human
aaccaggaaggagccauagccca

SEQ ID NO: 504484 - RNA, 19 nt, Human
aagccucuuaagaacacag

SEQ ID NO: 504485 - RNA, 19 nt, Human
aagcggcuguuugaggagc

SEQ ID NO: 504486 - RNA, 22 nt, Human
aagcugacacccgcuguccuga

SEQ ID NO: 504487 - RNA, 21 nt, Human
aagcuggucuccacacagugc

SEQ ID NO: 504488 - RNA, 21 nt, Human
aaggagacgcgcugcugcugc

SEQ ID NO: 504489 - RNA, 22 nt, Human
aaggagacgcgcugcugcugcc

SEQ ID NO: 504490 - RNA, 18 nt, Human
aaggugccgacccagggc

SEQ ID NO: 504491 - RNA, 23 nt, Human
aauuacaaggugccgacccaggg

SEQ ID NO: 504492 - RNA, 22 nt, Human
acaaacccacagaaaauccacc

SEQ ID NO: 504493 - RNA, 18 nt, Human
acacaugcacacuggcua

SEQ ID NO: 504494 - RNA, 18 nt, Human
acagcccaagucuggguc

SEQ ID NO: 504495 - RNA, 21 nt, Human
acccacagaaaauccacccga

SEQ ID NO: 504496 - RNA, 22 nt, Human
acccacagaaaauccacccgag

SEQ ID NO: 504497 - RNA, 24 nt, Human
acccccaugacacuccccagcccu

SEQ ID NO: 504498 - RNA, 23 nt, Human
acccgagugcacugagcacgcca

SEQ ID NO: 504499 - RNA, 20 nt, Human
acccugauucccccagcccc

SEQ ID NO: 504500 - RNA, 21 nt, Human
accuugauggccuucuugcug

SEQ ID NO: 504501 - RNA, 21 nt, Human
accuugcuccugcuccuucug

SEQ ID NO: 504502 - RNA, 20 nt, Human
acugcaacgggaaagccacg

SEQ ID NO: 504503 - RNA, 18 nt, Human
acugugugggggggccug

SEQ ID NO: 504504 - RNA, 22 nt, Human
agaauuacaaggugccgaccca

SEQ ID NO: 504505 - RNA, 22 nt, Human
agacagaaguccccgccccagc

SEQ ID NO: 504506 - RNA, 21 nt, Human
agcacaggcagacagaagucc

SEQ ID NO: 504507 - RNA, 18 nt, Human
agcagaccugcagggccc

SEQ ID NO: 504508 - RNA, 20 nt, Human
agcagcgcuggguacaagcu

SEQ ID NO: 504509 - RNA, 18 nt, Human
agcagcuuguccuggcug

SEQ ID NO: 504510 - RNA, 18 nt, Human
agccaccucccagccacc

SEQ ID NO: 504511 - RNA, 22 nt, Human
agccgggagguggggaacaggg

SEQ ID NO: 504512 - RNA, 23 nt, Human
agcgugcacuguggggucccagg

SEQ ID NO: 504513 - RNA, 25 nt, Human
agcuguguggccucaagccagccuu

SEQ ID NO: 504514 - RNA, 21 nt, Human
aggaagaaaaaggcaggacag

SEQ ID NO: 504515 - RNA, 23 nt, Human
aggaagaaaaaggcaggacagaa

SEQ ID NO: 504516 - RNA, 26 nt, Human
aggaaggagccauagcccaggcagga

SEQ ID NO: 504517 - RNA, 18 nt, Human
aggaauggggaacccaga

SEQ ID NO: 504518 - RNA, 20 nt, Human
aggacacagggguaugggga

SEQ ID NO: 504519 - RNA, 18 nt, Human
aggagaggguggaguugg

SEQ ID NO: 504520 - RNA, 21 nt, Human
aggagccaccucccagccacc

SEQ ID NO: 504521 - RNA, 24 nt, Human
aggagcuggggguggugguggggg

SEQ ID NO: 504522 - RNA, 18 nt, Human
aggcaaaagcagcgcugg

SEQ ID NO: 504523 - RNA, 22 nt, Human
aggcaagggcucugaagucagg

SEQ ID NO: 504524 - RNA, 20 nt, Human
agggaagcaggucugagcaa

SEQ ID NO: 504525 - RNA, 19 nt, Human
agggcugaggacuucuggu

SEQ ID NO: 504526 - RNA, 24 nt, Human
agugagaaguccagagcucuacag

SEQ ID NO: 504527 - RNA, 25 nt, Human
auacagcagugaagcugaaaugaaa

SEQ ID NO: 504528 - RNA, 22 nt, Human
aucagcugccaccccaucccag

SEQ ID NO: 504529 - RNA, 21 nt, Human
auggagcacaggcagacagaa

SEQ ID NO: 504530 - RNA, 18 nt, Human
caacagcccaagucuggg

SEQ ID NO: 504531 - RNA, 20 nt, Human
caagcacuucacaaccccuc

SEQ ID NO: 504532 - RNA, 25 nt, Human
caauggccugcaccuggcuccggcu

SEQ ID NO: 504533 - RNA, 19 nt, Human
cacccugcagagcuggacc

SEQ ID NO: 504534 - RNA, 23 nt, Human
caccuccccucaaacgaggagcc

SEQ ID NO: 504535 - RNA, 23 nt, Human
cacgcacacaggaaaguccuuca

SEQ ID NO: 504536 - RNA, 25 nt, Human
cacuccccagcccuccaaggccacu

SEQ ID NO: 504537 - RNA, 20 nt, Human
cacugagcacgccagaaauc

SEQ ID NO: 504538 - RNA, 18 nt, Human
cacuguggggucccaggc

SEQ ID NO: 504539 - RNA, 24 nt, Human
cacuuaacaaacccacagaaaauc

SEQ ID NO: 504540 - RNA, 19 nt, Human
cagaauuacaaggugccga

SEQ ID NO: 504541 - RNA, 20 nt, Human
cagagaugccuggagggaaa

SEQ ID NO: 504542 - RNA, 24 nt, Human
cagagcaacagcccaagucugggu

SEQ ID NO: 504543 - RNA, 22 nt, Human
cagagcugccaggccaggcccu

SEQ ID NO: 504544 - RNA, 22 nt, Human
cagcaaggagcugacagagcug

SEQ ID NO: 504545 - RNA, 21 nt, Human
cagcagugaagcugaaaugaa

SEQ ID NO: 504546 - RNA, 19 nt, Human
cagccuccucugggggaca

SEQ ID NO: 504547 - RNA, 20 nt, Human
cagggcuggaggggaggagg

SEQ ID NO: 504548 - RNA, 21 nt, Human
caggggccagcuggcaagagc

SEQ ID NO: 504549 - RNA, 20 nt, Human
cagggucgaggaguugacgg

SEQ ID NO: 504550 - RNA, 19 nt, Human
caucccagucagccuccuc

SEQ ID NO: 504551 - RNA, 19 nt, Human
caugacacuccccagcccu

SEQ ID NO: 504552 - RNA, 22 nt, Human
caugugcccuaggggaagcagg

SEQ ID NO: 504553 - RNA, 24 nt, Human
ccaaggcccuccgaccgcaggcuc

SEQ ID NO: 504554 - RNA, 22 nt, Human
ccagagccucacuuguucaggu

SEQ ID NO: 504555 - RNA, 22 nt, Human
ccagcuuucgcuccuucaugcu

SEQ ID NO: 504556 - RNA, 19 nt, Human
ccaggauggccaagggaug

SEQ ID NO: 504557 - RNA, 23 nt, Human
ccaggccgggccucccgcccaca

SEQ ID NO: 504558 - RNA, 22 nt, Human
ccagggcccgcucaccuugcuc

SEQ ID NO: 504559 - RNA, 21 nt, Human
ccagucguccucguccuccuc

SEQ ID NO: 504560 - RNA, 22 nt, Human
ccaugacacuccccagcccucc

SEQ ID NO: 504561 - RNA, 22 nt, Human
cccacccccaugacacucccca

SEQ ID NO: 504562 - RNA, 19 nt, Human
cccagagccucacuuguuc

SEQ ID NO: 504563 - RNA, 21 nt, Human
cccagagccucacuuguucag

SEQ ID NO: 504564 - RNA, 19 nt, Human
cccauggagcacaggcaga

SEQ ID NO: 504565 - RNA, 25 nt, Human
ccccacccccaugacacuccccagc

SEQ ID NO: 504566 - RNA, 19 nt, Human
ccccacccugcagagcugg

SEQ ID NO: 504567 - RNA, 18 nt, Human
ccccaugacacuccccag

SEQ ID NO: 504568 - RNA, 19 nt, Human
cccccaagucccucuucug

SEQ ID NO: 504569 - RNA, 22 nt, Human
cccccaugacacuccccagccc

SEQ ID NO: 504570 - RNA, 21 nt, Human
cccccuaggauucccagucgu

SEQ ID NO: 504571 - RNA, 19 nt, Human
cccccugcacaccuccugc

SEQ ID NO: 504572 - RNA, 21 nt, Human
ccccgcgcuggggaggccgga

SEQ ID NO: 504573 - RNA, 21 nt, Human
ccccucggcccugccuucugg

SEQ ID NO: 504574 - RNA, 20 nt, Human
ccccugagcuagccaugcuc

SEQ ID NO: 504575 - RNA, 30 nt, Human
ccccugagcuagccaugcucugacagucuu

SEQ ID NO: 504576 - RNA, 24 nt, Human
cccgcccacaccccucggcccugc

SEQ ID NO: 504577 - RNA, 19 nt, Human
cccuccgaccgcaggcucc

SEQ ID NO: 504578 - RNA, 21 nt, Human
cccugcuuccucucuagcccc

SEQ ID NO: 504579 - RNA, 20 nt, Human
cccuggacuggagccgggag

SEQ ID NO: 504580 - RNA, 23 nt, Human
ccucccgagccgagccaccccag

SEQ ID NO: 504581 - RNA, 19 nt, Human
ccucccgcccacaccccuc

SEQ ID NO: 504582 - RNA, 18 nt, Human
ccugcacaccuccugcuu

SEQ ID NO: 504583 - RNA, 22 nt, Human
ccuucugcuucuucuucuccag

SEQ ID NO: 504584 - RNA, 20 nt, Human
cgacccagggcgggcagcgg

SEQ ID NO: 504585 - RNA, 23 nt, Human
cgcagcuuggccuugccgaugcc

SEQ ID NO: 504586 - RNA, 24 nt, Human
cgcccacaccccucggcccugccu

SEQ ID NO: 504587 - RNA, 19 nt, Human
cgcgguugagggugggagu

SEQ ID NO: 504588 - RNA, 25 nt, Human
cuacaggggccgcgguuggccaggg

SEQ ID NO: 504589 - RNA, 20 nt, Human
cuacaguuugaaagccacua

SEQ ID NO: 504590 - RNA, 20 nt, Human
cuagggacaggcccuaugcu

SEQ ID NO: 504591 - RNA, 21 nt, Human
cucaaaaccauagugcccagg

SEQ ID NO: 504592 - RNA, 21 nt, Human
cucagaggcauggggaaaugg

SEQ ID NO: 504593 - RNA, 19 nt, Human
cucggcccugccuucuggc

SEQ ID NO: 504594 - RNA, 23 nt, Human
cucucccacaucaucaggggcac

SEQ ID NO: 504595 - RNA, 18 nt, Human
cugagcccauguuccucu

SEQ ID NO: 504596 - RNA, 18 nt, Human
cugcaaccaccugagcgc

SEQ ID NO: 504597 - RNA, 20 nt, Human
cugcucuaccugcugggaga

SEQ ID NO: 504598 - RNA, 18 nt, Human
cuggauccuguggcgggg

SEQ ID NO: 504599 - RNA, 21 nt, Human
cuguaccugugucugaugccc

SEQ ID NO: 504600 - RNA, 22 nt, Human
cuguaccugugucugaugcccu

SEQ ID NO: 504601 - RNA, 24 nt, Human
cugugugcagauacucccugcuuc

SEQ ID NO: 504602 - RNA, 23 nt, Human
cuguguuuccuaguuagcucaga

SEQ ID NO: 504603 - RNA, 24 nt, Human
cuuccucucuagcccccacccugc

SEQ ID NO: 504604 - RNA, 20 nt, Human
cuuggcacuggagaacaccu

SEQ ID NO: 504605 - RNA, 24 nt, Human
cuuggccuugccgaugcccccagc

SEQ ID NO: 504606 - RNA, 24 nt, Human
gaaacccugauucccccagccccc

SEQ ID NO: 504607 - RNA, 20 nt, Human
gaagacauacuucuuguacc

SEQ ID NO: 504608 - RNA, 24 nt, Human
gagaacaccuguggacacagggac

SEQ ID NO: 504609 - RNA, 19 nt, Human
gagccugcugggagggaag

SEQ ID NO: 504610 - RNA, 18 nt, Human
gagcugggggugguggug

SEQ ID NO: 504611 - RNA, 18 nt, Human
gagggugguuggugggaa

SEQ ID NO: 504612 - RNA, 18 nt, Human
gcagccagcagaccugca

SEQ ID NO: 504613 - RNA, 24 nt, Human
gcagcgcuggguacaagcucaaaa

SEQ ID NO: 504614 - RNA, 22 nt, Human
gcagcuuggccuugccgaugcc

SEQ ID NO: 504615 - RNA, 19 nt, Human
gcaggggccagcuggcaag

SEQ ID NO: 504616 - RNA, 21 nt, Human
gccaaggagaccuucucucca

SEQ ID NO: 504617 - RNA, 20 nt, Human
gcccaagucugggucugggg

SEQ ID NO: 504618 - RNA, 21 nt, Human
gcccaguagccucaggacaca

SEQ ID NO: 504619 - RNA, 26 nt, Human
gccuggagggaaaaggcugagugagg

SEQ ID NO: 504620 - RNA, 18 nt, Human
gccugggccaaggagacc

SEQ ID NO: 504621 - RNA, 21 nt, Human
gccugggcgagaagaaagccc

SEQ ID NO: 504622 - RNA, 18 nt, Human
gcgcgggcauccugugug

SEQ ID NO: 504623 - RNA, 20 nt, Human
gcucaggcagggcuggggaa

SEQ ID NO: 504624 - RNA, 23 nt, Human
gcuccugcuccuucugcuucuuc

SEQ ID NO: 504625 - RNA, 20 nt, Human
gcuguguggccucaagccag

SEQ ID NO: 504626 - RNA, 24 nt, Human
ggaauggggaacccagagccucac

SEQ ID NO: 504627 - RNA, 18 nt, Human
ggacuggagccgggaggu

SEQ ID NO: 504628 - RNA, 24 nt, Human
ggacuggagccgggagguggggaa

SEQ ID NO: 504629 - RNA, 18 nt, Human
ggagaccuucucuccaau

SEQ ID NO: 504630 - RNA, 19 nt, Human
ggagcugacagagcugaug

SEQ ID NO: 504631 - RNA, 22 nt, Human
ggagcugggggugguggugggg

SEQ ID NO: 504632 - RNA, 21 nt, Human
ggaggggaggaggcgaucuug

SEQ ID NO: 504633 - RNA, 23 nt, Human
ggauccuguggcgggggcgucuc

SEQ ID NO: 504634 - RNA, 22 nt, Human
ggcaagagcagggggugggcag

SEQ ID NO: 504635 - RNA, 19 nt, Human
ggcauggggaaauggaggg

SEQ ID NO: 504636 - RNA, 25 nt, Human
ggcugaccauugccuuggaccgcuc

SEQ ID NO: 504637 - RNA, 19 nt, Human
gggaaauggagggacugcc

SEQ ID NO: 504638 - RNA, 24 nt, Human
gggcaagcacuucacaaccccuca

SEQ ID NO: 504639 - RNA, 19 nt, Human
gggcaaggaggaaaggcug

SEQ ID NO: 504640 - RNA, 18 nt, Human
gggccccucaccagcccc

SEQ ID NO: 504641 - RNA, 19 nt, Human
gggggcacaggagggaugg

SEQ ID NO: 504642 - RNA, 25 nt, Human
gggggcccuaagaggcucagagggc

SEQ ID NO: 504643 - RNA, 23 nt, Human
ggggucgaccacuucccugggag

SEQ ID NO: 504644 - RNA, 22 nt, Human
ggguacuuggcacuggagaaca

SEQ ID NO: 504645 - RNA, 23 nt, Human
gggugggagugggggugcacugg

SEQ ID NO: 504646 - RNA, 19 nt, Human
gggugguggugggggcggu

SEQ ID NO: 504647 - RNA, 22 nt, Human
ggugggggcgguggggguggug

SEQ ID NO: 504648 - RNA, 20 nt, Human
gguggugggggcgguggggg

SEQ ID NO: 504649 - RNA, 25 nt, Human
gucaccuccccucaaacgaggagcc

SEQ ID NO: 504650 - RNA, 25 nt, Human
gucagagcaacagcccaagucuggg

SEQ ID NO: 504651 - RNA, 23 nt, Human
guccagggggcggugcuugcucu

SEQ ID NO: 504652 - RNA, 21 nt, Human
gugcacuguggggucccaggc

SEQ ID NO: 504653 - RNA, 19 nt, Human
guggcgcaggcugggugga

SEQ ID NO: 504654 - RNA, 18 nt, Human
guuccgucacccccuccc

SEQ ID NO: 504655 - RNA, 20 nt, Human
guugcggugggggcacagga

SEQ ID NO: 504656 - RNA, 19 nt, Human
guugcugggaagaccccca

SEQ ID NO: 504657 - RNA, 23 nt, Human
uacagcagugaagcugaaaugaa

SEQ ID NO: 504658 - RNA, 20 nt, Human
uaggauugcuuggcaggaga

SEQ ID NO: 504659 - RNA, 23 nt, Human
uaggggaagcaggggccagcugg

SEQ ID NO: 504660 - RNA, 24 nt, Human
uauccaguccuccuggugugugac

SEQ ID NO: 504661 - RNA, 20 nt, Human
ucacuagggacaggcccuau

SEQ ID NO: 504662 - RNA, 22 nt, Human
ucacuauggcucccaaaccagg

SEQ ID NO: 504663 - RNA, 24 nt, Human
ucagagccucagucgaucccugac

SEQ ID NO: 504664 - RNA, 23 nt, Human
ucaggagcugggggugguggugg

SEQ ID NO: 504665 - RNA, 19 nt, Human
ucagggcuggaggggagga

SEQ ID NO: 504666 - RNA, 18 nt, Human
uccaaggccacuguguuu

SEQ ID NO: 504667 - RNA, 23 nt, Human
uccagcuuucgcuccuucaugcu

SEQ ID NO: 504668 - RNA, 21 nt, Human
ucccaaaccaggaaggagcca

SEQ ID NO: 504669 - RNA, 22 nt, Human
ucccaaaccaggaaggagccau

SEQ ID NO: 504670 - RNA, 22 nt, Human
ucccagucguccucguccuccu

SEQ ID NO: 504671 - RNA, 21 nt, Human
uccccacccccaugacacucc

SEQ ID NO: 504672 - RNA, 24 nt, Human
uccccagcccuccaaggccacugu

SEQ ID NO: 504673 - RNA, 22 nt, Human
ucccugcuuccucucuagcccc

SEQ ID NO: 504674 - RNA, 26 nt, Human
ucgcuccuucaugcugcgcagcuugg

SEQ ID NO: 504675 - RNA, 23 nt, Human
ucggcccugccuucuggccauac

SEQ ID NO: 504676 - RNA, 19 nt, Human
ucggugguguugaaaagca

SEQ ID NO: 504677 - RNA, 23 nt, Human
ucuagcccccacccugcagagcu

SEQ ID NO: 504678 - RNA, 25 nt, Human
ucucacugcaacgggaaagccacag

SEQ ID NO: 504679 - RNA, 19 nt, Human
ucucagggggcugcagugg

SEQ ID NO: 504680 - RNA, 21 nt, Human
ucuccaauggccugcaccugg

SEQ ID NO: 504681 - RNA, 24 nt, Human
ucuccaauggccugcaccuggcuc

SEQ ID NO: 504682 - RNA, 25 nt, Human
ucuccaauggccugcaccuggcucc

SEQ ID NO: 504683 - RNA, 28 nt, Human
ucuccacacagugcugguuccgucaccc

SEQ ID NO: 504684 - RNA, 24 nt, Human
ucuccugucacaguuugggcuggg

SEQ ID NO: 504685 - RNA, 26 nt, Human
ucucuaaaaauaucucagggggcugc

SEQ ID NO: 504686 - RNA, 20 nt, Human
ucugguggcggcccagggcu

SEQ ID NO: 504687 - RNA, 18 nt, Human
ugaaaagcagcaaggagc

SEQ ID NO: 504688 - RNA, 21 nt, Human
ugaaaagcagcaaggagcuga

SEQ ID NO: 504689 - RNA, 23 nt, Human
ugaaauggaaacuauucaaaaaa

SEQ ID NO: 504690 - RNA, 20 nt, Human
ugaagagauccgacaucaag

SEQ ID NO: 504691 - RNA, 21 nt, Human
ugacacgcgggcaaaggcucc

SEQ ID NO: 504692 - RNA, 18 nt, Human
ugacacuccccagcccuc

SEQ ID NO: 504693 - RNA, 22 nt, Human
ugacacuccccagcccuccaag

SEQ ID NO: 504694 - RNA, 21 nt, Human
ugacccagcaccgggcacuga

SEQ ID NO: 504695 - RNA, 22 nt, Human
ugagaaagcggcuguuugagga

SEQ ID NO: 504696 - RNA, 19 nt, Human
ugagcuuagagaggaaagc

SEQ ID NO: 504697 - RNA, 18 nt, Human
ugagggugguugguggga

SEQ ID NO: 504698 - RNA, 23 nt, Human
ugaugagaaagcggcuguuugag

SEQ ID NO: 504699 - RNA, 22 nt, Human
ugcaccuggcuccggcucugcu

SEQ ID NO: 504700 - RNA, 23 nt, Human
ugcaccuggcuccggcucugcuc

SEQ ID NO: 504701 - RNA, 18 nt, Human
ugcaggcgcucuggagca

SEQ ID NO: 504702 - RNA, 23 nt, Human
ugccagggccgaucuuggugcca

SEQ ID NO: 504703 - RNA, 20 nt, Human
ugcccuaggggaagcagggg

SEQ ID NO: 504704 - RNA, 21 nt, Human
ugcccuggguccccacuaagc

SEQ ID NO: 504705 - RNA, 21 nt, Human
ugcccuugaucuucucaaucu

SEQ ID NO: 504706 - RNA, 21 nt, Human
ugccuccuacccuugcgccuc

SEQ ID NO: 504707 - RNA, 18 nt, Human
ugccuggggucacagagc

SEQ ID NO: 504708 - RNA, 20 nt, Human
ugccuuggaccgcucuuggc

SEQ ID NO: 504709 - RNA, 24 nt, Human
ugcuccccacccccugcacaccuc

SEQ ID NO: 504710 - RNA, 24 nt, Human
ugcuccugcuccuucugcuucuuc

SEQ ID NO: 504711 - RNA, 20 nt, Human
ugcucugacagucucaguug

SEQ ID NO: 504712 - RNA, 18 nt, Human
ugcugggaagacccccaa

SEQ ID NO: 504713 - RNA, 20 nt, Human
uggaccccugagcuagccuc

SEQ ID NO: 504714 - RNA, 25 nt, Human
uggauccuguggcgggggcgucucu

SEQ ID NO: 504715 - RNA, 19 nt, Human
uggcaagagcagggggugg

SEQ ID NO: 504716 - RNA, 21 nt, Human
uggcaagagcagggggugggc

SEQ ID NO: 504717 - RNA, 21 nt, Human
uggcacuggagaacaccugug

SEQ ID NO: 504718 - RNA, 23 nt, Human
uggcacuggagaacaccugugga

SEQ ID NO: 504719 - RNA, 22 nt, Human
uggccaagggauggugaauauu

SEQ ID NO: 504720 - RNA, 21 nt, Human
uggccuucuugcugcccuuga

SEQ ID NO: 504721 - RNA, 21 nt, Human
uggcgcaggcuggguggagcc

SEQ ID NO: 504722 - RNA, 18 nt, Human
uggcgggggcgucucugc

SEQ ID NO: 504723 - RNA, 21 nt, Human
uggcucccuguccccaccccc

SEQ ID NO: 504724 - RNA, 19 nt, Human
ugggcugcuccccaccccc

SEQ ID NO: 504725 - RNA, 22 nt, Human
uggggcaagcacuucacaaccc

SEQ ID NO: 504726 - RNA, 18 nt, Human
ugggggggccugggcacu

SEQ ID NO: 504727 - RNA, 18 nt, Human
uggguacaagcucaaaac

SEQ ID NO: 504728 - RNA, 23 nt, Human
ugguggcggcccagggcuuccag

SEQ ID NO: 504729 - RNA, 20 nt, Human
uggugggaaacccugauucc

SEQ ID NO: 504730 - RNA, 22 nt, Human
uggugggggcgguggggguggu

SEQ ID NO: 504731 - RNA, 18 nt, Human
ugguguugaaaagcagca

SEQ ID NO: 504732 - RNA, 21 nt, Human
ugguuggugggaaacccugau

SEQ ID NO: 504733 - RNA, 19 nt, Human
ugucauggagcccccuagg

SEQ ID NO: 504734 - RNA, 18 nt, Human
uguccaagagccugcugg

SEQ ID NO: 504735 - RNA, 24 nt, Human
uguccaagagccugcugggaggga

SEQ ID NO: 504736 - RNA, 24 nt, Human
uguccccacccccaugacacuccc

SEQ ID NO: 504737 - RNA, 21 nt, Human
uguggcuguugcggugggggc

SEQ ID NO: 504738 - RNA, 23 nt, Human
uucaaaaaauugagaauuucuga

SEQ ID NO: 504739 - RNA, 22 nt, Human
uucuccugagagggccaggaug

SEQ ID NO: 504740 - RNA, 25 nt, Human
uucuccugucacaguuugggcuggg

SEQ ID NO: 504741 - RNA, 22 nt, Human
uugauggccuucuugcugcccu

SEQ ID NO: 504742 - RNA, 22 nt, Human
uugccagggccgaucuuggugc

SEQ ID NO: 504743 - RNA, 22 nt, Human
uuggugugccguuuucucugga

SEQ ID NO: 504744 - RNA, 19 nt, Human
uugugccacuucuggaugc

SEQ ID NO: 504745 - RNA, 18 nt, Human
aaaacaccaguuuucuaa

SEQ ID NO: 504746 - RNA, 25 nt, Human
aaaaggagggaaacuccuugguaaa

SEQ ID NO: 504747 - RNA, 20 nt, Human
aaacaaaaaaaggagggaaa

SEQ ID NO: 504748 - RNA, 19 nt, Human
aaacagaugguuagaaacu

SEQ ID NO: 504749 - RNA, 25 nt, Human
aagcgaucuucccaccuuggccucc

SEQ ID NO: 504750 - RNA, 21 nt, Human
aagucucuaguuuucgcccca

SEQ ID NO: 504751 - RNA, 26 nt, Human
aagugccaggauuacaggccugagcc

SEQ ID NO: 504752 - RNA, 24 nt, Human
aauggagaaucaaaaauuugcuag

SEQ ID NO: 504753 - RNA, 24 nt, Human
aauggagaaucaaaaauuugcuag

SEQ ID NO: 504754 - RNA, 22 nt, Human
acaaacaaaaaaaggagggaaa

SEQ ID NO: 504755 - RNA, 21 nt, Human
agaaaaaacagaugguuagaa

SEQ ID NO: 504756 - RNA, 24 nt, Human
agaaaguugugaaauauaagggua

SEQ ID NO: 504757 - RNA, 21 nt, Human
agaacaaacccacaaguugga

SEQ ID NO: 504758 - RNA, 20 nt, Human
agccaccacaccuagcccua

SEQ ID NO: 504759 - RNA, 20 nt, Human
aggagagggcacuucugcag

SEQ ID NO: 504760 - RNA, 22 nt, Human
aggagggaaacuccuugguaaa

SEQ ID NO: 504761 - RNA, 23 nt, Human
aggauuacaggccugagccacca

SEQ ID NO: 504762 - RNA, 24 nt, Human
aggggucucgcuauguugcccagg

SEQ ID NO: 504763 - RNA, 24 nt, Human
agugccaggauuacaggccugagc

SEQ ID NO: 504764 - RNA, 22 nt, Human
aucccuaccuuuccacccccaa

SEQ ID NO: 504765 - RNA, 22 nt, Human
aucccucccuuuccacccccaa

SEQ ID NO: 504766 - RNA, 21 nt, Human
augcacuuucuaacuucagca

SEQ ID NO: 504767 - RNA, 24 nt, Human
auggaaaaacagaacaaacccaca

SEQ ID NO: 504768 - RNA, 24 nt, Human
auggaaaaacagaacaaacccaca

SEQ ID NO: 504769 - RNA, 30 nt, Human
auggaaaccagugaagagaggaaacaccgg

SEQ ID NO: 504770 - RNA, 21 nt, Human
augucuggccaaucgucuugg

SEQ ID NO: 504771 - RNA, 23 nt, Human
caaacaaaaaaaggagggaaacu

SEQ ID NO: 504772 - RNA, 24 nt, Human
caaagugccaggauuacaggccug

SEQ ID NO: 504773 - RNA, 27 nt, Human
caagcgaucuucccaccuuggccuccc

SEQ ID NO: 504774 - RNA, 24 nt, Human
caauucaucccucccuuuccaccc

SEQ ID NO: 504775 - RNA, 25 nt, Human
cacaccuagcccuaaaucagaauuu

SEQ ID NO: 504776 - RNA, 21 nt, Human
caggauuacaggccugagcca

SEQ ID NO: 504777 - RNA, 21 nt, Human
caucccuaccuuuccaccccc

SEQ ID NO: 504778 - RNA, 21 nt, Human
caucccucccuuuccaccccc

SEQ ID NO: 504779 - RNA, 22 nt, Human
caucccucccuuuccaccccca

SEQ ID NO: 504780 - RNA, 19 nt, Human
ccaaagugccaggauuaca

SEQ ID NO: 504781 - RNA, 25 nt, Human
ccaauucaucccuaccuuuccaccc

SEQ ID NO: 504782 - RNA, 19 nt, Human
ccaccacaccuagcccuaa

SEQ ID NO: 504783 - RNA, 24 nt, Human
cccaagcaagucucuaguuuucgc

SEQ ID NO: 504784 - RNA, 22 nt, Human
cccaauucaucccuaccuuucc

SEQ ID NO: 504785 - RNA, 22 nt, Human
cccaauucaucccucccuuucc

SEQ ID NO: 504786 - RNA, 19 nt, Human
ccccaauucaucccucccu

SEQ ID NO: 504787 - RNA, 20 nt, Human
cccuaccuuuccacccccaa

SEQ ID NO: 504788 - RNA, 18 nt, Human
cccucccuuuccaccccc

SEQ ID NO: 504789 - RNA, 20 nt, Human
cccucccuuuccacccccaa

SEQ ID NO: 504790 - RNA, 21 nt, Human
ccuauccuguuucuuuagaaa

SEQ ID NO: 504791 - RNA, 24 nt, Human
cgcuauguugcccaggcuggucuu

SEQ ID NO: 504792 - RNA, 27 nt, Human
cgcuauguugcccaggcuggucuugaa

SEQ ID NO: 504793 - RNA, 24 nt, Human
cggcaccacuugggaaggggcugg

SEQ ID NO: 504794 - RNA, 26 nt, Human
cuagcccuaaaucagaauuuuuuaaa

SEQ ID NO: 504795 - RNA, 24 nt, Human
cucaagcgaucuucccaccuuggc

SEQ ID NO: 504796 - RNA, 24 nt, Human
cucaagcgauguucccaccuuggc

SEQ ID NO: 504797 - RNA, 22 nt, Human
cucugaauucaccaggguucua

SEQ ID NO: 504798 - RNA, 27 nt, Human
cucuuggccucaagcgaucuucccacc

SEQ ID NO: 504799 - RNA, 18 nt, Human
cugagccaccacaccuag

SEQ ID NO: 504800 - RNA, 19 nt, Human
gaaaacaccaguuuucuaa

SEQ ID NO: 504801 - RNA, 23 nt, Human
gaaaccagugaagagaggaaaca

SEQ ID NO: 504802 - RNA, 18 nt, Human
gaacaaacccacaaguug

SEQ ID NO: 504803 - RNA, 19 nt, Human
gacauacugccucuccacc

SEQ ID NO: 504804 - RNA, 18 nt, Human
gauuacaggccugagcca

SEQ ID NO: 504805 - RNA, 21 nt, Human
gauuacaggccugagccacca

SEQ ID NO: 504806 - RNA, 22 nt, Human
gcaccacuugggaaggggcugg

SEQ ID NO: 504807 - RNA, 21 nt, Human
gccaggauuacaggccugagc

SEQ ID NO: 504808 - RNA, 24 nt, Human
gccugagccaccacaccuagcccu

SEQ ID NO: 504809 - RNA, 24 nt, Human
gcuauguugcccaggcuggucuug

SEQ ID NO: 504810 - RNA, 24 nt, Human
ggaaaaacagaacaaacccacaag

SEQ ID NO: 504811 - RNA, 24 nt, Human
ggaaaaacagaacaaacccacaag

SEQ ID NO: 504812 - RNA, 19 nt, Human
ggauuacaggccugagcca

SEQ ID NO: 504813 - RNA, 22 nt, Human
ggauuacaggccugagccacca

SEQ ID NO: 504814 - RNA, 19 nt, Human
ggccucaagcgauguuccc

SEQ ID NO: 504815 - RNA, 18 nt, Human
ggugcaaaccuuuacuuc

SEQ ID NO: 504816 - RNA, 19 nt, Human
ggugccuucucuaaacucc

SEQ ID NO: 504817 - RNA, 24 nt, Human
gucucgcuauguugcccaggcugg

SEQ ID NO: 504818 - RNA, 24 nt, Human
uaaaagaacaaaaaucauuuggca

SEQ ID NO: 504819 - RNA, 20 nt, Human
uaaggguacucauggaaacc

SEQ ID NO: 504820 - RNA, 24 nt, Human
uaaggguacucauggaaaccaguc

SEQ ID NO: 504821 - RNA, 24 nt, Human
uaaggguacucauggaaaccagug

SEQ ID NO: 504822 - RNA, 22 nt, Human
uacaggccugagccaccacacc

SEQ ID NO: 504823 - RNA, 23 nt, Human
uauguugcccaggcuggucuuga

SEQ ID NO: 504824 - RNA, 24 nt, Human
uauguugcccaggcuggucuugaa

SEQ ID NO: 504825 - RNA, 18 nt, Human
ucaacaaacaaaaaagga

SEQ ID NO: 504826 - RNA, 22 nt, Human
ucagaucugaggugaugucugg

SEQ ID NO: 504827 - RNA, 24 nt, Human
ucccaaagugccaggauuacaggc

SEQ ID NO: 504828 - RNA, 21 nt, Human
ucccuaccuuuccacccccaa

SEQ ID NO: 504829 - RNA, 21 nt, Human
ucccucccuuuccacccccaa

SEQ ID NO: 504830 - RNA, 23 nt, Human
ucuaaagaaagauuacucugaau

SEQ ID NO: 504831 - RNA, 21 nt, Human
ucucauggaaaaacagaacaa

SEQ ID NO: 504832 - RNA, 21 nt, Human
ucucauggaaaaacagaacaa

SEQ ID NO: 504833 - RNA, 18 nt, Human
ucucgcuauguugcccag

SEQ ID NO: 504834 - RNA, 19 nt, Human
ucucgcuauguugcccagg

SEQ ID NO: 504835 - RNA, 23 nt, Human
ucucgcuauguugcccaggcugg

SEQ ID NO: 504836 - RNA, 24 nt, Human
ucucgcuauguugcccaggcuggu

SEQ ID NO: 504837 - RNA, 26 nt, Human
ucucgcuauguugcccaggcuggucu

SEQ ID NO: 504838 - RNA, 27 nt, Human
ucucgcuauguugcccaggcuggucuu

SEQ ID NO: 504839 - RNA, 22 nt, Human
ugaaaaaaaaccgccaguauuu

SEQ ID NO: 504840 - RNA, 19 nt, Human
ugaaagggaggagguggcc

SEQ ID NO: 504841 - RNA, 20 nt, Human
ugaaagggaggagguggcca

SEQ ID NO: 504842 - RNA, 23 nt, Human
ugaacucucacuuucaaauacca

SEQ ID NO: 504843 - RNA, 23 nt, Human
ugaacucucacuuucaaauacca

SEQ ID NO: 504844 - RNA, 19 nt, Human
ugccaaaccaaagugaaag

SEQ ID NO: 504845 - RNA, 24 nt, Human
ugcccaggcuggucuugaacucuu

SEQ ID NO: 504846 - RNA, 25 nt, Human
ugcuaaucaacaaacaaaaaaagga

SEQ ID NO: 504847 - RNA, 22 nt, Human
ugcuggagucucuuacuuuugg

SEQ ID NO: 504848 - RNA, 22 nt, Human
ugcuggagucucuuacuuuugg

SEQ ID NO: 504849 - RNA, 21 nt, Human
uggaaaaacagaacaaaccca

SEQ ID NO: 504850 - RNA, 21 nt, Human
uggaaaaacagaacaaaccca

SEQ ID NO: 504851 - RNA, 28 nt, Human
uggaaagcaggcauuuuuaccaaagagc

SEQ ID NO: 504852 - RNA, 23 nt, Human
uggaagacgcuggucucagaucu

SEQ ID NO: 504853 - RNA, 21 nt, Human
uggccucaagcgaucuuccca

SEQ ID NO: 504854 - RNA, 21 nt, Human
uggccucaagcgauguuccca

SEQ ID NO: 504855 - RNA, 21 nt, Human
ugggaagagcuaccugcugcc

SEQ ID NO: 504856 - RNA, 24 nt, Human
ugggaagagcuaccugcugcccua

SEQ ID NO: 504857 - RNA, 22 nt, Human
ugggaaggggcugggcucaggg

SEQ ID NO: 504858 - RNA, 24 nt, Human
ugggaguaaggcucugagagaugg

SEQ ID NO: 504859 - RNA, 21 nt, Human
uguauuuuuaucacgcacaua

SEQ ID NO: 504860 - RNA, 23 nt, Human
ugucaugaacucucacuuucaaa

SEQ ID NO: 504861 - RNA, 23 nt, Human
uguucccaccuuggccucccaaa

SEQ ID NO: 504862 - RNA, 24 nt, Human
uuauucucauggaaaaacagaaca

SEQ ID NO: 504863 - RNA, 24 nt, Human
uuauucucauggaaaaacagaaca

SEQ ID NO: 504864 - RNA, 22 nt, Human
uucuaaagaaagauuacucuga

SEQ ID NO: 504865 - RNA, 23 nt, Human
uuggcaguuuuaaguuuaauagg

SEQ ID NO: 504866 - RNA, 22 nt, Human
uuggccucaagcgauguuccca

SEQ ID NO: 504867 - RNA, 25 nt, Human
uuuuggaaaauggagaaucaaaaau

SEQ ID NO: 504868 - RNA, 25 nt, Human
uuuuggaaaauggagaaucaaaaau

SEQ ID NO: 504869 - RNA, 25 nt, Human
uuuuuuuuuaauacagauagggguc

SEQ ID NO: 504870 - RNA, 23 nt, Human
uuuuuuuuuuuugaaaaaaaacc

SEQ ID NO: 504871 - RNA, 27 nt, Human
uuuuuuuuuuuuuuuuuuuuuuugggg

SEQ ID NO: 504872 - RNA, 21 nt, Human
agggagggggguggaguuagg

SEQ ID NO: 504873 - RNA, 23 nt, Human
ccagcccggcuuugcucggcgga

SEQ ID NO: 504874 - RNA, 21 nt, Human
cccagcccggcuuugcucggc

SEQ ID NO: 504875 - RNA, 23 nt, Human
cuccaagcccagcccggcuuugc

SEQ ID NO: 504876 - RNA, 22 nt, Human
cugccagggagggggguggagu

SEQ ID NO: 504877 - RNA, 21 nt, Human
gagcagcuccaagcccagccc

SEQ ID NO: 504878 - RNA, 19 nt, Human
ucagaacucggccuucugc

SEQ ID NO: 504879 - RNA, 20 nt, Human
ugccagggagggggguggag

SEQ ID NO: 504880 - RNA, 20 nt, Human
accaagugcucaguuguucu

SEQ ID NO: 504881 - RNA, 21 nt, Human
cacagagguagaaaugcucau

SEQ ID NO: 504882 - RNA, 18 nt, Human
aaccugaagguggaggcu

SEQ ID NO: 504883 - RNA, 23 nt, Human
aacugugugugugugugugugug

SEQ ID NO: 504884 - RNA, 19 nt, Human
aauguccaauccauccuca

SEQ ID NO: 504885 - RNA, 18 nt, Human
acugaacuccagccaggg

SEQ ID NO: 504886 - RNA, 24 nt, Human
acugaacuccagccagggcaacag

SEQ ID NO: 504887 - RNA, 24 nt, Human
acugaaugagauguuucacuuuuc

SEQ ID NO: 504888 - RNA, 24 nt, Human
acugugugugugugugugugugug

SEQ ID NO: 504889 - RNA, 18 nt, Human
agagaucauucauugaau

SEQ ID NO: 504890 - RNA, 22 nt, Human
aggcaggagaaucacuugaacc

SEQ ID NO: 504891 - RNA, 24 nt, Human
aggcaggagaaucacuugaaccug

SEQ ID NO: 504892 - RNA, 24 nt, Human
aggcugaggcaggagaaucacuug

SEQ ID NO: 504893 - RNA, 19 nt, Human
agguggaggcuguaguaag

SEQ ID NO: 504894 - RNA, 25 nt, Human
agguggaggcuguaguaagccugag

SEQ ID NO: 504895 - RNA, 24 nt, Human
aucaugucacugaacuccagccag

SEQ ID NO: 504896 - RNA, 20 nt, Human
auggcuccuauauuuuuuug

SEQ ID NO: 504897 - RNA, 18 nt, Human
caagcaacuuucaugaca

SEQ ID NO: 504898 - RNA, 18 nt, Human
cacugaacuccagccagg

SEQ ID NO: 504899 - RNA, 19 nt, Human
cacugaacuccagccaggg

SEQ ID NO: 504900 - RNA, 20 nt, Human
cacugaacuccagccagggc

SEQ ID NO: 504901 - RNA, 24 nt, Human
cacugaacuccagccagggcaaca

SEQ ID NO: 504902 - RNA, 21 nt, Human
cacuugugauaacuuucucca

SEQ ID NO: 504903 - RNA, 23 nt, Human
cagaaagaaagauguaggcucau

SEQ ID NO: 504904 - RNA, 20 nt, Human
cagccagggcaacagagcga

SEQ ID NO: 504905 - RNA, 25 nt, Human
caggaagaucaccaacugaaugaga

SEQ ID NO: 504906 - RNA, 19 nt, Human
cccuguaaucccagcuacc

SEQ ID NO: 504907 - RNA, 20 nt, Human
ccuguaaucccagcuaccag

SEQ ID NO: 504908 - RNA, 18 nt, Human
cuuuuuuuuuuuuuuuug

SEQ ID NO: 504909 - RNA, 23 nt, Human
gagaggcugaggcaggagaauca

SEQ ID NO: 504910 - RNA, 22 nt, Human
gcaggagaaucacuugaaccug

SEQ ID NO: 504911 - RNA, 25 nt, Human
ggaggcuguaguaagccugagauca

SEQ ID NO: 504912 - RNA, 18 nt, Human
guaucuguggaugcagcu

SEQ ID NO: 504913 - RNA, 24 nt, Human
gugguuguuuaaacuucagaaaga

SEQ ID NO: 504914 - RNA, 18 nt, Human
gugugugugugugugugu

SEQ ID NO: 504915 - RNA, 21 nt, Human
gugugugugugugugugugug

SEQ ID NO: 504916 - RNA, 21 nt, Human
gugugugugugugugugugug

SEQ ID NO: 504917 - RNA, 20 nt, Human
uaauacauuuuuuuucuuuu

SEQ ID NO: 504918 - RNA, 19 nt, Human
uaccagagaggcugaggca

SEQ ID NO: 504919 - RNA, 21 nt, Human
uaccagagaggcugaggcagg

SEQ ID NO: 504920 - RNA, 23 nt, Human
uagauacaacaucugucuccuug

SEQ ID NO: 504921 - RNA, 20 nt, Human
uaggcucaucgggugguaau

SEQ ID NO: 504922 - RNA, 21 nt, Human
uauuuuuuuguaucuguggau

SEQ ID NO: 504923 - RNA, 21 nt, Human
ucacugaacuccagccagggc

SEQ ID NO: 504924 - RNA, 18 nt, Human
ucccuguaaucccagcua

SEQ ID NO: 504925 - RNA, 22 nt, Human
ucccuguaaucccagcuaccag

SEQ ID NO: 504926 - RNA, 20 nt, Human
uccucacgguagucaucuuu

SEQ ID NO: 504927 - RNA, 22 nt, Human
ucucacaaauucagcugcagac

SEQ ID NO: 504928 - RNA, 21 nt, Human
ucugcugaguucuccuuugua

SEQ ID NO: 504929 - RNA, 21 nt, Human
ugaauauucuucuuuaaaucu

SEQ ID NO: 504930 - RNA, 22 nt, Human
ugagaucaugucacugaacucc

SEQ ID NO: 504931 - RNA, 20 nt, Human
ugaggcaggagaaucacuug

SEQ ID NO: 504932 - RNA, 24 nt, Human
ugaggcaggagaaucacuugaacc

SEQ ID NO: 504933 - RNA, 24 nt, Human
ugaggcaggagaaucacuugaacc

SEQ ID NO: 504934 - RNA, 18 nt, Human
ugaggccucuuguuuucu

SEQ ID NO: 504935 - RNA, 22 nt, Human
uggauuggaaguggcacaucca

SEQ ID NO: 504936 - RNA, 22 nt, Human
uggcacauccaacaaccauaaa

SEQ ID NO: 504937 - RNA, 24 nt, Human
uggcacauccaacaaccauaaaca

SEQ ID NO: 504938 - RNA, 21 nt, Human
uguaauguccaauccauccuc

SEQ ID NO: 504939 - RNA, 20 nt, Human
uguguguguguguguccaua

SEQ ID NO: 504940 - RNA, 22 nt, Human
uguguguguguguguguccaua

SEQ ID NO: 504941 - RNA, 18 nt, Human
ugugugugugugugugug

SEQ ID NO: 504942 - RNA, 18 nt, Human
ugugugugugugugugug

SEQ ID NO: 504943 - RNA, 18 nt, Human
ugugugugugugugugug

SEQ ID NO: 504944 - RNA, 18 nt, Human
ugugugugugugugugug

SEQ ID NO: 504945 - RNA, 18 nt, Human
ugugugugugugugugug

SEQ ID NO: 504946 - RNA, 18 nt, Human
ugugugugugugugugug

SEQ ID NO: 504947 - RNA, 18 nt, Human
ugugugugugugugugug

SEQ ID NO: 504948 - RNA, 18 nt, Human
ugugugugugugugugug

SEQ ID NO: 504949 - RNA, 18 nt, Human
ugugugugugugugugug

SEQ ID NO: 504950 - RNA, 18 nt, Human
ugugugugugugugugug

SEQ ID NO: 504951 - RNA, 18 nt, Human
ugugugugugugugugug

SEQ ID NO: 504952 - RNA, 18 nt, Human
ugugugugugugugugug

SEQ ID NO: 504953 - RNA, 18 nt, Human
ugugugugugugugugug

SEQ ID NO: 504954 - RNA, 18 nt, Human
ugugugugugugugugug

SEQ ID NO: 504955 - RNA, 18 nt, Human
ugugugugugugugugug

SEQ ID NO: 504956 - RNA, 18 nt, Human
ugugugugugugugugug

SEQ ID NO: 504957 - RNA, 18 nt, Human
ugugugugugugugugug

SEQ ID NO: 504958 - RNA, 21 nt, Human
ugugugugugugugugugugu

SEQ ID NO: 504959 - RNA, 21 nt, Human
ugugugugugugugugugugu

SEQ ID NO: 504960 - RNA, 21 nt, Human
ugugugugugugugugugugu

SEQ ID NO: 504961 - RNA, 21 nt, Human
ugugugugugugugugugugu

SEQ ID NO: 504962 - RNA, 21 nt, Human
ugugugugugugugugugugu

SEQ ID NO: 504963 - RNA, 21 nt, Human
ugugugugugugugugugugu

SEQ ID NO: 504964 - RNA, 21 nt, Human
ugugugugugugugugugugu

SEQ ID NO: 504965 - RNA, 21 nt, Human
ugugugugugugugugugugu

SEQ ID NO: 504966 - RNA, 21 nt, Human
ugugugugugugugugugugu

SEQ ID NO: 504967 - RNA, 21 nt, Human
ugugugugugugugugugugu

SEQ ID NO: 504968 - RNA, 21 nt, Human
ugugugugugugugugugugu

SEQ ID NO: 504969 - RNA, 21 nt, Human
ugugugugugugugugugugu

SEQ ID NO: 504970 - RNA, 21 nt, Human
ugugugugugugugugugugu

SEQ ID NO: 504971 - RNA, 21 nt, Human
ugugugugugugugugugugu

SEQ ID NO: 504972 - RNA, 21 nt, Human
ugugugugugugugugugugu

SEQ ID NO: 504973 - RNA, 21 nt, Human
ugugugugugugugugugugu

SEQ ID NO: 504974 - RNA, 21 nt, Human
ugugugugugugugugugugu

SEQ ID NO: 504975 - RNA, 21 nt, Human
ugugugugugugugugugugu

SEQ ID NO: 504976 - RNA, 21 nt, Human
ugugugugugugugugugugu

SEQ ID NO: 504977 - RNA, 21 nt, Human
ugugugugugugugugugugu

SEQ ID NO: 504978 - RNA, 21 nt, Human
ugugugugugugugugugugu

SEQ ID NO: 504979 - RNA, 21 nt, Human
ugugugugugugugugugugu

SEQ ID NO: 504980 - RNA, 21 nt, Human
ugugugugugugugugugugu

SEQ ID NO: 504981 - RNA, 21 nt, Human
ugugugugugugugugugugu

SEQ ID NO: 504982 - RNA, 21 nt, Human
ugugugugugugugugugugu

SEQ ID NO: 504983 - RNA, 21 nt, Human
ugugugugugugugugugugu

SEQ ID NO: 504984 - RNA, 21 nt, Human
ugugugugugugugugugugu

SEQ ID NO: 504985 - RNA, 21 nt, Human
ugugugugugugugugugugu

SEQ ID NO: 504986 - RNA, 21 nt, Human
ugugugugugugugugugugu

SEQ ID NO: 504987 - RNA, 21 nt, Human
ugugugugugugugugugugu

SEQ ID NO: 504988 - RNA, 22 nt, Human
ugugugugugugugugugugug

SEQ ID NO: 504989 - RNA, 22 nt, Human
ugugugugugugugugugugug

SEQ ID NO: 504990 - RNA, 22 nt, Human
ugugugugugugugugugugug

SEQ ID NO: 504991 - RNA, 22 nt, Human
ugugugugugugugugugugug

SEQ ID NO: 504992 - RNA, 22 nt, Human
ugugugugugugugugugugug

SEQ ID NO: 504993 - RNA, 22 nt, Human
ugugugugugugugugugugug

SEQ ID NO: 504994 - RNA, 22 nt, Human
ugugugugugugugugugugug

SEQ ID NO: 504995 - RNA, 22 nt, Human
ugugugugugugugugugugug

SEQ ID NO: 504996 - RNA, 22 nt, Human
ugugugugugugugugugugug

SEQ ID NO: 504997 - RNA, 22 nt, Human
ugugugugugugugugugugug

SEQ ID NO: 504998 - RNA, 22 nt, Human
ugugugugugugugugugugug

SEQ ID NO: 504999 - RNA, 22 nt, Human
ugugugugugugugugugugug

SEQ ID NO: 505000 - RNA, 23 nt, Human
ugugugugugugugugugugugu

SEQ ID NO: 505001 - RNA, 28 nt, Human
uuacuugaaaguaggcuuucuacaaggu

SEQ ID NO: 505002 - RNA, 27 nt, Human
uucaagucuuucaauggauccccccuu

SEQ ID NO: 505003 - RNA, 24 nt, Human
uucuaggguaaccuuuccacuugu

SEQ ID NO: 505004 - RNA, 21 nt, Human
uucuccagcaagaaaugccag

SEQ ID NO: 505005 - RNA, 18 nt, Human
uuucuuuucuuuuacuuu

SEQ ID NO: 505006 - RNA, 22 nt, Human
uuuuguaucuguggaugcagcu

SEQ ID NO: 505007 - RNA, 20 nt, Human
uuuuuuuuuuuuuugccaaa

SEQ ID NO: 505008 - RNA, 23 nt, Human
aaaauaauagagguuuaaauauc

SEQ ID NO: 505009 - RNA, 19 nt, Human
aaaauggacauuuggggac

SEQ ID NO: 505010 - RNA, 23 nt, Human
aaaccaaauuauuucuuccucaa

SEQ ID NO: 505011 - RNA, 23 nt, Human
aaaccagaacaaauagaaaacaa

SEQ ID NO: 505012 - RNA, 22 nt, Human
aagcauguuuucagcaacgugg

SEQ ID NO: 505013 - RNA, 19 nt, Human
aauauccaucucucccagg

SEQ ID NO: 505014 - RNA, 22 nt, Human
aaugacaagaaaaaagucugua

SEQ ID NO: 505015 - RNA, 21 nt, Human
aauggaaugauaaaaccaaag

SEQ ID NO: 505016 - RNA, 21 nt, Human
aauggacgugaacagaacugc

SEQ ID NO: 505017 - RNA, 22 nt, Human
aauugcaggguuuguaaagauu

SEQ ID NO: 505018 - RNA, 22 nt, Human
accacuauugcagaaacacaga

SEQ ID NO: 505019 - RNA, 25 nt, Human
acccuagaaagggggaaacuccgac

SEQ ID NO: 505020 - RNA, 21 nt, Human
acuggauugagaguagacucu

SEQ ID NO: 505021 - RNA, 27 nt, Human
acuucaaaauacuaauucaaaaaaggg

SEQ ID NO: 505022 - RNA, 22 nt, Human
agaggcauccuuuucugaagga

SEQ ID NO: 505023 - RNA, 24 nt, Human
agccaaaccugcuaccugggcccg

SEQ ID NO: 505024 - RNA, 24 nt, Human
aggaaagacaaugauaccacaaaa

SEQ ID NO: 505025 - RNA, 20 nt, Human
aggaggaugaagcugcugcu

SEQ ID NO: 505026 - RNA, 23 nt, Human
aggcagggcuagcccuaaaccca

SEQ ID NO: 505027 - RNA, 21 nt, Human
agggaauuuaaguauuuuucu

SEQ ID NO: 505028 - RNA, 19 nt, Human
augcaacguuaggacucug

SEQ ID NO: 505029 - RNA, 22 nt, Human
auguuguauuaagaugaaguca

SEQ ID NO: 505030 - RNA, 23 nt, Human
caaaaccagaacaaauagaaaac

SEQ ID NO: 505031 - RNA, 20 nt, Human
caaaagaaaaaugauuucau

SEQ ID NO: 505032 - RNA, 22 nt, Human
caaugauaccacaaaacaacac

SEQ ID NO: 505033 - RNA, 23 nt, Human
caaugcacuuaacuuaaagcuuc

SEQ ID NO: 505034 - RNA, 20 nt, Human
caauuaccacauucugucac

SEQ ID NO: 505035 - RNA, 19 nt, Human
cacacccuucauuuuaccc

SEQ ID NO: 505036 - RNA, 20 nt, Human
cagaaucacucauuuaucuc

SEQ ID NO: 505037 - RNA, 25 nt, Human
cagaauuucuggcauauaaacacac

SEQ ID NO: 505038 - RNA, 23 nt, Human
cagagaaugcacauuccacagca

SEQ ID NO: 505039 - RNA, 19 nt, Human
cagcucgaauaagaugcaa

SEQ ID NO: 505040 - RNA, 22 nt, Human
cauauaaacacacauccuccug

SEQ ID NO: 505041 - RNA, 19 nt, Human
cauaugacauauacauaug

SEQ ID NO: 505042 - RNA, 18 nt, Human
cauccauugccggcaaug

SEQ ID NO: 505043 - RNA, 22 nt, Human
cauccucacccuagaaaggggg

SEQ ID NO: 505044 - RNA, 22 nt, Human
caucucaccaccccaaccaagc

SEQ ID NO: 505045 - RNA, 21 nt, Human
cauuuagauuccuaaucauuc

SEQ ID NO: 505046 - RNA, 21 nt, Human
cauuuggggacagaaucacuc

SEQ ID NO: 505047 - RNA, 18 nt, Human
cauuuuacccaagggaga

SEQ ID NO: 505048 - RNA, 22 nt, Human
ccacaaaacaacacucagagaa

SEQ ID NO: 505049 - RNA, 22 nt, Human
ccagaacaaauagaaaacaaca

SEQ ID NO: 505050 - RNA, 23 nt, Human
ccagagucucucagccucacccc

SEQ ID NO: 505051 - RNA, 24 nt, Human
ccccacacccuucauuuuacccaa

SEQ ID NO: 505052 - RNA, 21 nt, Human
cccccgcgcagccaaaccugc

SEQ ID NO: 505053 - RNA, 26 nt, Human
cccccgcgcagccaaaccugcuaccu

SEQ ID NO: 505054 - RNA, 18 nt, Human
cccuaaacccagagucuc

SEQ ID NO: 505055 - RNA, 23 nt, Human
cccuuaguaucugcaggggucaa

SEQ ID NO: 505056 - RNA, 22 nt, Human
ccugcagauaccaacaucugaa

SEQ ID NO: 505057 - RNA, 21 nt, Human
ccugcagauaccgagggcugg

SEQ ID NO: 505058 - RNA, 22 nt, Human
ccuuucaacuaaggaacuccgg

SEQ ID NO: 505059 - RNA, 20 nt, Human
cgacgcgcggcccccgcgca

SEQ ID NO: 505060 - RNA, 26 nt, Human
cgcagccaaaccugcuaccugggccc

SEQ ID NO: 505061 - RNA, 21 nt, Human
cgcgcggcccccgcgcagcca

SEQ ID NO: 505062 - RNA, 23 nt, Human
cgugaacagaacugccagcucga

SEQ ID NO: 505063 - RNA, 22 nt, Human
cuaauccuccaggaaaaucacu

SEQ ID NO: 505064 - RNA, 26 nt, Human
cucagccucaccccugauccgguucc

SEQ ID NO: 505065 - RNA, 18 nt, Human
cucucagccucaccccug

SEQ ID NO: 505066 - RNA, 23 nt, Human
cuucaguuucuuugccuuucccg

SEQ ID NO: 505067 - RNA, 20 nt, Human
gaaacacagaaaaacugagc

SEQ ID NO: 505068 - RNA, 19 nt, Human
gaaagacaaugauaccaca

SEQ ID NO: 505069 - RNA, 24 nt, Human
gauuggacuucuaggcugucagag

SEQ ID NO: 505070 - RNA, 18 nt, Human
gcccuaaacccagagucu

SEQ ID NO: 505071 - RNA, 21 nt, Human
gcccuuaguaucugcaggggu

SEQ ID NO: 505072 - RNA, 22 nt, Human
ggaaagacaaugauaccacaaa

SEQ ID NO: 505073 - RNA, 23 nt, Human
ggacucugccuucaguuucuuug

SEQ ID NO: 505074 - RNA, 25 nt, Human
ggaggcagggcuagccccccaaggg

SEQ ID NO: 505075 - RNA, 22 nt, Human
gggaaacuccgacgcgcggccc

SEQ ID NO: 505076 - RNA, 25 nt, Human
guagaaccauccucacccuagaaag

SEQ ID NO: 505077 - RNA, 22 nt, Human
gucucucagccucaccccugau

SEQ ID NO: 505078 - RNA, 19 nt, Human
uaaaaccgcaaaagauaaa

SEQ ID NO: 505079 - RNA, 21 nt, Human
uaaauacccuaauccuccagg

SEQ ID NO: 505080 - RNA, 24 nt, Human
uaaauauccaucucucccaggaaa

SEQ ID NO: 505081 - RNA, 20 nt, Human
uaauaccuaauaaauguaaa

SEQ ID NO: 505082 - RNA, 21 nt, Human
uacaauuaccacauucuguca

SEQ ID NO: 505083 - RNA, 20 nt, Human
uacccuaauccuccaggaaa

SEQ ID NO: 505084 - RNA, 21 nt, Human
uacccuaauccuccaggaaaa

SEQ ID NO: 505085 - RNA, 25 nt, Human
uagcaaaauggaaugauaaaaccaa

SEQ ID NO: 505086 - RNA, 23 nt, Human
uaggacucugccuucaguuucuu

SEQ ID NO: 505087 - RNA, 18 nt, Human
uaucaucuaugguccugg

SEQ ID NO: 505088 - RNA, 22 nt, Human
uauuacagggugauuggacuuc

SEQ ID NO: 505089 - RNA, 21 nt, Human
ucaaaaaagggaaacuacuaa

SEQ ID NO: 505090 - RNA, 21 nt, Human
ucaaaauacuaauucaaaaaa

SEQ ID NO: 505091 - RNA, 21 nt, Human
ucaaugcacuuaacuuaaagc

SEQ ID NO: 505092 - RNA, 23 nt, Human
ucauucaacacauauuuauuaca

SEQ ID NO: 505093 - RNA, 21 nt, Human
uccaggaaaaucacuucaaaa

SEQ ID NO: 505094 - RNA, 21 nt, Human
uccaucucucccaggaaauug

SEQ ID NO: 505095 - RNA, 19 nt, Human
ucucuaauaacuggauuga

SEQ ID NO: 505096 - RNA, 23 nt, Human
ucuucauucaacacauauuuauu

SEQ ID NO: 505097 - RNA, 18 nt, Human
ugacaguaacuacuauga

SEQ ID NO: 505098 - RNA, 21 nt, Human
ugacauauacauaugaugacu

SEQ ID NO: 505099 - RNA, 22 nt, Human
ugauaaaaccaaagaguaaaag

SEQ ID NO: 505100 - RNA, 18 nt, Human
ugcagauaccaacaucug

SEQ ID NO: 505101 - RNA, 18 nt, Human
ugccccauuccauaaaau

SEQ ID NO: 505102 - RNA, 24 nt, Human
ugccggcaauggacgugaacagaa

SEQ ID NO: 505103 - RNA, 23 nt, Human
uggaaugauaaaaccaaagagua

SEQ ID NO: 505104 - RNA, 22 nt, Human
uggaugagaaaccugcagauac

SEQ ID NO: 505105 - RNA, 19 nt, Human
uggcauauaaacacacauc

SEQ ID NO: 505106 - RNA, 18 nt, Human
ugguguccauguuguauu

SEQ ID NO: 505107 - RNA, 26 nt, Human
uguaaagauucuuuccacuuuuuguc

SEQ ID NO: 505108 - RNA, 21 nt, Human
uguaaaugcuacauaaagagu

SEQ ID NO: 505109 - RNA, 21 nt, Human
ugucacagcagggcgcaccuu

SEQ ID NO: 505110 - RNA, 24 nt, Human
ugugcaaaauauauguacuuuuuc

SEQ ID NO: 505111 - RNA, 21 nt, Human
uuaacuuaaagcuucagguau

SEQ ID NO: 505112 - RNA, 20 nt, Human
uucacccauuucuucauuca

SEQ ID NO: 505113 - RNA, 21 nt, Human
uucaucaauuuacuuugcccc

SEQ ID NO: 505114 - RNA, 20 nt, Human
uuccaugaagacaauggaaa

SEQ ID NO: 505115 - RNA, 22 nt, Human
uugcaguugguugaauccaugg

SEQ ID NO: 505116 - RNA, 19 nt, Human
uuugcaguugguugaaucc

SEQ ID NO: 505117 - RNA, 21 nt, Human
aaaaaaccuccugcacaugcc

SEQ ID NO: 505118 - RNA, 23 nt, Human
aaaaaccuccugcacaugccugg

SEQ ID NO: 505119 - RNA, 20 nt, Human
aaaaucuuucuaaacugugg

SEQ ID NO: 505120 - RNA, 23 nt, Human
aaaccaaaaaaccuccugcacau

SEQ ID NO: 505121 - RNA, 19 nt, Human
aaagugcugggauuacagg

SEQ ID NO: 505122 - RNA, 22 nt, Human
aaagugcugggauuacagggug

SEQ ID NO: 505123 - RNA, 25 nt, Human
aaagugcugggauuacaggguguga

SEQ ID NO: 505124 - RNA, 19 nt, Human
aagcgagcucucuggaauc

SEQ ID NO: 505125 - RNA, 20 nt, Human
aagugcugggauuacagggu

SEQ ID NO: 505126 - RNA, 22 nt, Human
aagugcugggauuacagggugu

SEQ ID NO: 505127 - RNA, 27 nt, Human
aagugcugggauuacagggugugagcu

SEQ ID NO: 505128 - RNA, 18 nt, Human
acugcaccuggccagagu

SEQ ID NO: 505129 - RNA, 19 nt, Human
acuuuuuuuuucuuuucag

SEQ ID NO: 505130 - RNA, 21 nt, Human
agacagagccuucccucugug

SEQ ID NO: 505131 - RNA, 24 nt, Human
aggagcaagcgagcucucuggaaa

SEQ ID NO: 505132 - RNA, 23 nt, Human
aguacaguggcaugaucauggcu

SEQ ID NO: 505133 - RNA, 22 nt, Human
auucauagacagagccuucccu

SEQ ID NO: 505134 - RNA, 25 nt, Human
caaagugcugggauuacagggugug

SEQ ID NO: 505135 - RNA, 22 nt, Human
caacaaaaugcugaaaccaaaa

SEQ ID NO: 505136 - RNA, 21 nt, Human
cagaggcuccaccugaaacuc

SEQ ID NO: 505137 - RNA, 22 nt, Human
caucaccucccagaggcuccac

SEQ ID NO: 505138 - RNA, 24 nt, Human
caucccagccucccaagucacugg

SEQ ID NO: 505139 - RNA, 24 nt, Human
caucuccugggcucaagagauccu

SEQ ID NO: 505140 - RNA, 24 nt, Human
cauguuucccaggcuggucuugaa

SEQ ID NO: 505141 - RNA, 21 nt, Human
ccaaagugcugggauuacagg

SEQ ID NO: 505142 - RNA, 24 nt, Human
ccaaagugcugggauuacagggug

SEQ ID NO: 505143 - RNA, 25 nt, Human
ccaaagugcugggauuacagggugu

SEQ ID NO: 505144 - RNA, 21 nt, Human
ccaguaccaauucccaacaug

SEQ ID NO: 505145 - RNA, 19 nt, Human
ccauguuucccaggcuggu

SEQ ID NO: 505146 - RNA, 21 nt, Human
ccauguuucccaggcuggucu

SEQ ID NO: 505147 - RNA, 22 nt, Human
cccaagucacugggacuauagg

SEQ ID NO: 505148 - RNA, 21 nt, Human
ccucugguguuuucuuagucc

SEQ ID NO: 505149 - RNA, 20 nt, Human
ccugggcucaagagauccuc

SEQ ID NO: 505150 - RNA, 19 nt, Human
cuacugcaccuggccagag

SEQ ID NO: 505151 - RNA, 24 nt, Human
cucaagugaucugccuaccucagc

SEQ ID NO: 505152 - RNA, 24 nt, Human
cucaugaccucaucaccucccaga

SEQ ID NO: 505153 - RNA, 25 nt, Human
cuccugggcucaagagauccuccca

SEQ ID NO: 505154 - RNA, 18 nt, Human
cugaaaccaaaaaaccuc

SEQ ID NO: 505155 - RNA, 19 nt, Human
cugaaaccaaaaaaccucc

SEQ ID NO: 505156 - RNA, 23 nt, Human
cugaaaugucauugggaagaaca

SEQ ID NO: 505157 - RNA, 18 nt, Human
cugguguuuucuuagucc

SEQ ID NO: 505158 - RNA, 20 nt, Human
gaacaaauauccugaaaugu

SEQ ID NO: 505159 - RNA, 22 nt, Human
gaacaccaccaugaccaacuaa

SEQ ID NO: 505160 - RNA, 27 nt, Human
gaccucaucaccucccagaggcuccac

SEQ ID NO: 505161 - RNA, 18 nt, Human
gagauccucccaucccag

SEQ ID NO: 505162 - RNA, 23 nt, Human
gagauccucccaucccagccucc

SEQ ID NO: 505163 - RNA, 18 nt, Human
gagcucaagugaucugcc

SEQ ID NO: 505164 - RNA, 24 nt, Human
gagcucaagugaucugccuaccuc

SEQ ID NO: 505165 - RNA, 20 nt, Human
gauuacagggugugagcuac

SEQ ID NO: 505166 - RNA, 24 nt, Human
gauuacagggugugagcuacugca

SEQ ID NO: 505167 - RNA, 22 nt, Human
gcucacugcaagccugcaucuc

SEQ ID NO: 505168 - RNA, 19 nt, Human
ggaagaacaaaauucacuu

SEQ ID NO: 505169 - RNA, 19 nt, Human
gugaacaccaccaugacca

SEQ ID NO: 505170 - RNA, 24 nt, Human
gugaucugccuaccucagccuccc

SEQ ID NO: 505171 - RNA, 23 nt, Human
uacaguggcaugaucauggcuca

SEQ ID NO: 505172 - RNA, 24 nt, Human
uaccucagccucccaaagugcugg

SEQ ID NO: 505173 - RNA, 19 nt, Human
uacugcaccuggccagagu

SEQ ID NO: 505174 - RNA, 23 nt, Human
uagcaaaauaccaaagauacugg

SEQ ID NO: 505175 - RNA, 21 nt, Human
uaggugaacaccaccaugacc

SEQ ID NO: 505176 - RNA, 19 nt, Human
uaugucuuuagcaauggga

SEQ ID NO: 505177 - RNA, 24 nt, Human
uauugcccacaguucuggagacug

SEQ ID NO: 505178 - RNA, 25 nt, Human
ucacugcaagccugcaucuccuggg

SEQ ID NO: 505179 - RNA, 24 nt, Human
ucacugggacuauaggugaacacc

SEQ ID NO: 505180 - RNA, 23 nt, Human
ucagcaugcaacaaaaugcugaa

SEQ ID NO: 505181 - RNA, 18 nt, Human
ucagccucccaaagugcu

SEQ ID NO: 505182 - RNA, 21 nt, Human
uccaccugaaacucauuugau

SEQ ID NO: 505183 - RNA, 19 nt, Human
uccaguaucaagaugcggc

SEQ ID NO: 505184 - RNA, 23 nt, Human
ucccaaagugcugggauuacagg

SEQ ID NO: 505185 - RNA, 24 nt, Human
ucccaagucacugggacuauaggu

SEQ ID NO: 505186 - RNA, 22 nt, Human
ucccaucccagccucccaaguc

SEQ ID NO: 505187 - RNA, 27 nt, Human
uccucccaucccagccucccaagucac

SEQ ID NO: 505188 - RNA, 18 nt, Human
uccugggcucaagagauc

SEQ ID NO: 505189 - RNA, 22 nt, Human
uccugggcucaagagauccucc

SEQ ID NO: 505190 - RNA, 23 nt, Human
ucuugaacucuugagcucaagug

SEQ ID NO: 505191 - RNA, 23 nt, Human
ugaaaugucauugggaagaacaa

SEQ ID NO: 505192 - RNA, 18 nt, Human
ugaccucaucaccuccca

SEQ ID NO: 505193 - RNA, 18 nt, Human
ugaccucaucaccuccca

SEQ ID NO: 505194 - RNA, 18 nt, Human
ugagcucaagugaucugc

SEQ ID NO: 505195 - RNA, 20 nt, Human
ugagcucaagugaucugccu

SEQ ID NO: 505196 - RNA, 22 nt, Human
ugagcucaagugaucugccuac

SEQ ID NO: 505197 - RNA, 24 nt, Human
ugaucugccuaccucagccuccca

SEQ ID NO: 505198 - RNA, 22 nt, Human
ugauuuggagauuuaaagagua

SEQ ID NO: 505199 - RNA, 24 nt, Human
ugccauguuucccaggcuggucuu

SEQ ID NO: 505200 - RNA, 27 nt, Human
ugccauguuucccaggcuggucuugaa

SEQ ID NO: 505201 - RNA, 23 nt, Human
ugccuggagcaagaaggguugcu

SEQ ID NO: 505202 - RNA, 21 nt, Human
ugcuauagcaaaauaccaaag

SEQ ID NO: 505203 - RNA, 18 nt, Human
ugcugggauuacagggug

SEQ ID NO: 505204 - RNA, 18 nt, Human
uggcaugaucauggcuca

SEQ ID NO: 505205 - RNA, 19 nt, Human
ugggacuauaggugaacac

SEQ ID NO: 505206 - RNA, 22 nt, Human
ugggacuauaggugaacaccac

SEQ ID NO: 505207 - RNA, 24 nt, Human
ugggacuauaggugaacaccacca

SEQ ID NO: 505208 - RNA, 20 nt, Human
ugggauuacagggugugagc

SEQ ID NO: 505209 - RNA, 23 nt, Human
ugggauuacagggugugagcuac

SEQ ID NO: 505210 - RNA, 23 nt, Human
ugggauuacagggugugagcuac

SEQ ID NO: 505211 - RNA, 25 nt, Human
ugggauuacagggugugagcuacug

SEQ ID NO: 505212 - RNA, 26 nt, Human
ugggauuacagggugugagcuacuga

SEQ ID NO: 505213 - RNA, 22 nt, Human
ugucauugggaagaacaaaauu

SEQ ID NO: 505214 - RNA, 23 nt, Human
ugucugguggggacccacuuucu

SEQ ID NO: 505215 - RNA, 19 nt, Human
uuaacccuccacuuccauc

SEQ ID NO: 505216 - RNA, 24 nt, Human
uucccaggcuggucuugaacucuu

SEQ ID NO: 505217 - RNA, 20 nt, Human
uugugaugucaauauuuuua

SEQ ID NO: 505218 - RNA, 20 nt, Human
uuuaacccuccacuuccauc

SEQ ID NO: 505219 - RNA, 19 nt, Human
uuuuuuuuuuuuuuuguga

SEQ ID NO: 505220 - RNA, 22 nt, Human
aaaaaaacagagauaugguaga

SEQ ID NO: 505221 - RNA, 21 nt, Human
aaaaaacugaucugaaucaaa

SEQ ID NO: 505222 - RNA, 27 nt, Human
aaaaacagagauaugguagaaaaagga

SEQ ID NO: 505223 - RNA, 26 nt, Human
aaaacagagauaugguagaaaaagga

SEQ ID NO: 505224 - RNA, 20 nt, Human
aaaacaugcauuccaauaaa

SEQ ID NO: 505225 - RNA, 20 nt, Human
aaacauggucaaaaugucua

SEQ ID NO: 505226 - RNA, 23 nt, Human
aaacauguacacaaaauauaucc

SEQ ID NO: 505227 - RNA, 19 nt, Human
aacaaugacaggucaaccc

SEQ ID NO: 505228 - RNA, 18 nt, Human
aaccauuuagcucuauga

SEQ ID NO: 505229 - RNA, 21 nt, Human
acaaaacaaguaccacaaaga

SEQ ID NO: 505230 - RNA, 22 nt, Human
acauucugacagaauacuaaca

SEQ ID NO: 505231 - RNA, 21 nt, Human
acuuugaaaggagaaggcaau

SEQ ID NO: 505232 - RNA, 25 nt, Human
agauacugauuuuuuuuucuuuaaa

SEQ ID NO: 505233 - RNA, 19 nt, Human
agauaggcuuaaucuucca

SEQ ID NO: 505234 - RNA, 19 nt, Human
agccuauugguccaaugac

SEQ ID NO: 505235 - RNA, 23 nt, Human
agcucuaugagaaacugaaauaa

SEQ ID NO: 505236 - RNA, 18 nt, Human
aggagaaggcaaugaaaa

SEQ ID NO: 505237 - RNA, 20 nt, Human
aguguccagaaacagggcca

SEQ ID NO: 505238 - RNA, 19 nt, Human
auauauauauauauauaua

SEQ ID NO: 505239 - RNA, 19 nt, Human
auauauauauauauauaua

SEQ ID NO: 505240 - RNA, 19 nt, Human
auauauauauauauauaua

SEQ ID NO: 505241 - RNA, 19 nt, Human
auauauauauauauauaua

SEQ ID NO: 505242 - RNA, 19 nt, Human
auauauauauauauauaua

SEQ ID NO: 505243 - RNA, 19 nt, Human
auauauauauauauauaua

SEQ ID NO: 505244 - RNA, 19 nt, Human
auauauauauauauauaua

SEQ ID NO: 505245 - RNA, 19 nt, Human
auauauauauauauauaua

SEQ ID NO: 505246 - RNA, 19 nt, Human
auauauauauauauauaua

SEQ ID NO: 505247 - RNA, 19 nt, Human
auauauauauauauauaua

SEQ ID NO: 505248 - RNA, 19 nt, Human
auauauauauauauauaua

SEQ ID NO: 505249 - RNA, 19 nt, Human
auauauauauauauauaua

SEQ ID NO: 505250 - RNA, 19 nt, Human
auauauauauauauauaua

SEQ ID NO: 505251 - RNA, 19 nt, Human
auauauauauauauauaua

SEQ ID NO: 505252 - RNA, 19 nt, Human
auauauauauauauauaua

SEQ ID NO: 505253 - RNA, 19 nt, Human
auauauauauauauauaua

SEQ ID NO: 505254 - RNA, 19 nt, Human
auauauauauauauauaua

SEQ ID NO: 505255 - RNA, 19 nt, Human
auauauauauauauauaua

SEQ ID NO: 505256 - RNA, 19 nt, Human
auauauauauauauauaua

SEQ ID NO: 505257 - RNA, 25 nt, Human
caaaacaaguaccacaaagaagugu

SEQ ID NO: 505258 - RNA, 22 nt, Human
caagagaauauauguaaaacca

SEQ ID NO: 505259 - RNA, 21 nt, Human
cauacauauauauauauauau

SEQ ID NO: 505260 - RNA, 22 nt, Human
cauacauauauauauauauaua

SEQ ID NO: 505261 - RNA, 22 nt, Human
ccaaaauacaaugcagaucuuc

SEQ ID NO: 505262 - RNA, 21 nt, Human
ccacaaagaagugucacagcc

SEQ ID NO: 505263 - RNA, 24 nt, Human
cccaaaauuuaccuuucacacaaa

SEQ ID NO: 505264 - RNA, 22 nt, Human
cuaaaaaaacagagauauggua

SEQ ID NO: 505265 - RNA, 21 nt, Human
cugguauuaacuuuagggcau

SEQ ID NO: 505266 - RNA, 19 nt, Human
gagaauauauguaaaacca

SEQ ID NO: 505267 - RNA, 18 nt, Human
gcaaacagagagguuugc

SEQ ID NO: 505268 - RNA, 20 nt, Human
gcuuaaagagaaaaaguaac

SEQ ID NO: 505269 - RNA, 20 nt, Human
ggccaaaaaacagggucaga

SEQ ID NO: 505270 - RNA, 19 nt, Human
gggcaugccacagggccau

SEQ ID NO: 505271 - RNA, 18 nt, Human
guaguucuaaaaaaacag

SEQ ID NO: 505272 - RNA, 23 nt, Human
guguguacauacauauauauaua

SEQ ID NO: 505273 - RNA, 26 nt, Human
guguguacauacauauauauauauau

SEQ ID NO: 505274 - RNA, 24 nt, Human
uaaaaaaacagagauaugguagaa

SEQ ID NO: 505275 - RNA, 27 nt, Human
uaaaaaaacagagauaugguagaaaaa

SEQ ID NO: 505276 - RNA, 24 nt, Human
uaaaagagaaacauguacacaaaa

SEQ ID NO: 505277 - RNA, 23 nt, Human
uaaagcagaacaauugucaguuu

SEQ ID NO: 505278 - RNA, 22 nt, Human
uaacagauaggcuuaaucuucc

SEQ ID NO: 505279 - RNA, 24 nt, Human
uaacauaaacaguaugccaaaaac

SEQ ID NO: 505280 - RNA, 21 nt, Human
uaauaacuagaaaacagauac

SEQ ID NO: 505281 - RNA, 20 nt, Human
uacauacauauauauauaua

SEQ ID NO: 505282 - RNA, 20 nt, Human
uacauacauauauauauaua

SEQ ID NO: 505283 - RNA, 20 nt, Human
uacauacauauauauauaua

SEQ ID NO: 505284 - RNA, 22 nt, Human
uacauauauauauauauauaua

SEQ ID NO: 505285 - RNA, 25 nt, Human
uaccacaaagaagugucacagccua

SEQ ID NO: 505286 - RNA, 25 nt, Human
uaccacacaguugaguaguucuaaa

SEQ ID NO: 505287 - RNA, 19 nt, Human
uagcucuaugagaaacuga

SEQ ID NO: 505288 - RNA, 19 nt, Human
uauauauauauauauauau

SEQ ID NO: 505289 - RNA, 19 nt, Human
uauauauauauauauauau

SEQ ID NO: 505290 - RNA, 19 nt, Human
uauauauauauauauauau

SEQ ID NO: 505291 - RNA, 19 nt, Human
uauauauauauauauauau

SEQ ID NO: 505292 - RNA, 19 nt, Human
uauauauauauauauauau

SEQ ID NO: 505293 - RNA, 19 nt, Human
uauauauauauauauauau

SEQ ID NO: 505294 - RNA, 19 nt, Human
uauauauauauauauauau

SEQ ID NO: 505295 - RNA, 19 nt, Human
uauauauauauauauauau

SEQ ID NO: 505296 - RNA, 19 nt, Human
uauauauauauauauauau

SEQ ID NO: 505297 - RNA, 19 nt, Human
uauauauauauauauauau

SEQ ID NO: 505298 - RNA, 19 nt, Human
uauauauauauauauauau

SEQ ID NO: 505299 - RNA, 19 nt, Human
uauauauauauauauauau

SEQ ID NO: 505300 - RNA, 19 nt, Human
uauauauauauauauauau

SEQ ID NO: 505301 - RNA, 23 nt, Human
uaucauuuaaaugacuugacaau

SEQ ID NO: 505302 - RNA, 23 nt, Human
uaugccaaaaacaacagaacaaa

SEQ ID NO: 505303 - RNA, 20 nt, Human
ucacacaaaacaaguaccac

SEQ ID NO: 505304 - RNA, 21 nt, Human
ucacagccuaagaaacugccu

SEQ ID NO: 505305 - RNA, 22 nt, Human
uccuaaguaccauauuucuaag

SEQ ID NO: 505306 - RNA, 24 nt, Human
ucucuuaucuguuccacuggugaa

SEQ ID NO: 505307 - RNA, 19 nt, Human
ucuucauauuugugccucg

SEQ ID NO: 505308 - RNA, 20 nt, Human
ucuuccaguaauuauccugg

SEQ ID NO: 505309 - RNA, 19 nt, Human
ugaaacuaaagcagaacaa

SEQ ID NO: 505310 - RNA, 20 nt, Human
ugaaagaaguggguccagua

SEQ ID NO: 505311 - RNA, 22 nt, Human
ugaaauaaaagaaaauuaagga

SEQ ID NO: 505312 - RNA, 23 nt, Human
ugcagaucuucguaauauuguau

SEQ ID NO: 505313 - RNA, 20 nt, Human
ugccaaaaacaacagaacaa

SEQ ID NO: 505314 - RNA, 21 nt, Human
ugccaaaaacaacagaacaag

SEQ ID NO: 505315 - RNA, 24 nt, Human
uggcaaaguaauaaaauuugucaa

SEQ ID NO: 505316 - RNA, 20 nt, Human
uggcaacaaugacaggucaa

SEQ ID NO: 505317 - RNA, 22 nt, Human
uguacauacauauauauauaua

SEQ ID NO: 505318 - RNA, 18 nt, Human
uguguacauacauauaua

SEQ ID NO: 505319 - RNA, 24 nt, Human
uguguacauacauauauauauaua

SEQ ID NO: 505320 - RNA, 27 nt, Human
uguguacauacauauauauauauauau

SEQ ID NO: 505321 - RNA, 20 nt, Human
uguguguacauacauauaua

SEQ ID NO: 505322 - RNA, 23 nt, Human
uguguguguacauacauauauau

SEQ ID NO: 505323 - RNA, 24 nt, Human
uguguguguacauacauauauaua

SEQ ID NO: 505324 - RNA, 23 nt, Human
uuagggcauauaagguaucuuca

SEQ ID NO: 505325 - RNA, 24 nt, Human
uuaucauuuaaaugacuugacaau

SEQ ID NO: 505326 - RNA, 22 nt, Human
uucaucucuucugaaagaagug

SEQ ID NO: 505327 - RNA, 20 nt, Human
uucauguuaacuuauuuucc

SEQ ID NO: 505328 - RNA, 18 nt, Human
uuguuguuguuguuucca

SEQ ID NO: 505329 - RNA, 20 nt, Human
uuguuguuguuuccaaugcu

SEQ ID NO: 505330 - RNA, 20 nt, Human
uuucacacaaaacaaguacc

SEQ ID NO: 505331 - RNA, 23 nt, Human
uuucuaccucuauuagaccacaa

SEQ ID NO: 505332 - RNA, 21 nt, Human
aauuaagaaaauaugauauau

SEQ ID NO: 505333 - RNA, 24 nt, Human
auuaaaaaguagaaagcuaaaguu

SEQ ID NO: 505334 - RNA, 20 nt, Human
cagcagcgccucagccuggc

SEQ ID NO: 505335 - RNA, 18 nt, Human
ccagcagcagcgccucag

SEQ ID NO: 505336 - RNA, 18 nt, Human
ccagcagcagcgccucag

SEQ ID NO: 505337 - RNA, 21 nt, Human
cgccucagccuggcccaauuu

SEQ ID NO: 505338 - RNA, 18 nt, Human
cgucucggaucggccgcu

SEQ ID NO: 505339 - RNA, 23 nt, Human
cucggaucggccgcuccagcagc

SEQ ID NO: 505340 - RNA, 22 nt, Human
uaaaaugaucaauauacugugc

SEQ ID NO: 505341 - RNA, 23 nt, Human
uaagaaaaagaauccaaaaauaa

SEQ ID NO: 505342 - RNA, 24 nt, Human
uauauaaaaauccaaauuuacaaa

SEQ ID NO: 505343 - RNA, 21 nt, Human
uuaaaaugaucaauauacugu

SEQ ID NO: 505344 - RNA, 19 nt, Human
uuuauauuacaaagugaua

SEQ ID NO: 505345 - RNA, 18 nt, Human
aaccaccucuccccuucc

SEQ ID NO: 505346 - RNA, 21 nt, Human
aagagcugcuauuauuacuac

SEQ ID NO: 505347 - RNA, 21 nt, Human
acagcucugaaggacaucauc

SEQ ID NO: 505348 - RNA, 25 nt, Human
accaccucuccccuuccuuccccca

SEQ ID NO: 505349 - RNA, 24 nt, Human
accucuccccuuccuucccccacu

SEQ ID NO: 505350 - RNA, 22 nt, Human
caaggugaacugagccccuucu

SEQ ID NO: 505351 - RNA, 18 nt, Human
caccagcacagcccucgc

SEQ ID NO: 505352 - RNA, 21 nt, Human
caccucuccccuuccuucccc

SEQ ID NO: 505353 - RNA, 21 nt, Human
cacugcccccauucuuagccc

SEQ ID NO: 505354 - RNA, 21 nt, Human
ccacaagccccgccccugccc

SEQ ID NO: 505355 - RNA, 22 nt, Human
cccacaagccccgccccugccc

SEQ ID NO: 505356 - RNA, 23 nt, Human
cccacaagccccgccccugcccc

SEQ ID NO: 505357 - RNA, 22 nt, Human
cccccauucuuagccccgcccc

SEQ ID NO: 505358 - RNA, 19 nt, Human
ccccgccccucccacaagc

SEQ ID NO: 505359 - RNA, 24 nt, Human
ccccucccacaagccccgccccug

SEQ ID NO: 505360 - RNA, 22 nt, Human
cccgcccaccagcccugcacca

SEQ ID NO: 505361 - RNA, 21 nt, Human
cccugcaccagcacagcccuc

SEQ ID NO: 505362 - RNA, 24 nt, Human
cccugccccggccguuucccuggc

SEQ ID NO: 505363 - RNA, 21 nt, Human
cccuucuguuucuucuguucc

SEQ ID NO: 505364 - RNA, 20 nt, Human
ccuggccccgcccaccagcc

SEQ ID NO: 505365 - RNA, 23 nt, Human
ccuggccccgcccaccagcccug

SEQ ID NO: 505366 - RNA, 19 nt, Human
cgccccugccccggccguu

SEQ ID NO: 505367 - RNA, 23 nt, Human
cucuccccuuccuucccccacug

SEQ ID NO: 505368 - RNA, 21 nt, Human
cucugaaggacaucaucaagg

SEQ ID NO: 505369 - RNA, 20 nt, Human
cugcccccauucuuagcccc

SEQ ID NO: 505370 - RNA, 20 nt, Human
gcucugaaggacaucaucaa

SEQ ID NO: 505371 - RNA, 26 nt, Human
uaaccaccucuccccuuccuuccccc

SEQ ID NO: 505372 - RNA, 21 nt, Human
uagccccgccccucccacaag

SEQ ID NO: 505373 - RNA, 24 nt, Human
ucccccacugcccccauucuuagc

SEQ ID NO: 505374 - RNA, 18 nt, Human
ucccuggccccgcccacc

SEQ ID NO: 505375 - RNA, 18 nt, Human
ucuguuucuucuguuccc

SEQ ID NO: 505376 - RNA, 18 nt, Human
ugcaccagcacagcccuc

SEQ ID NO: 505377 - RNA, 22 nt, Human
uucccuuccucucaucacagcu

SEQ ID NO: 505378 - RNA, 24 nt, Human
uucuuagccccgccccucccacaa

SEQ ID NO: 505379 - RNA, 21 nt, Human
aagagcugcuauuauuacuac

SEQ ID NO: 505380 - RNA, 20 nt, Human
acagagagggggccuccaga

SEQ ID NO: 505381 - RNA, 18 nt, Human
agauggugaugggugggg

SEQ ID NO: 505382 - RNA, 19 nt, Human
aggaauccaaaggucuggg

SEQ ID NO: 505383 - RNA, 18 nt, Human
aggcauauggacuugaaa

SEQ ID NO: 505384 - RNA, 24 nt, Human
agggaggauaaggggaccccaggg

SEQ ID NO: 505385 - RNA, 26 nt, Human
agggaggauaaggggaccccagggcc

SEQ ID NO: 505386 - RNA, 26 nt, Human
auacccgccucuuccgcgaaccccgg

SEQ ID NO: 505387 - RNA, 21 nt, Human
aucaccuuauuucaccuccca

SEQ ID NO: 505388 - RNA, 18 nt, Human
auuuaggagggggcaacc

SEQ ID NO: 505389 - RNA, 18 nt, Human
caaggugaacugagccgc

SEQ ID NO: 505390 - RNA, 18 nt, Human
caccggcacagcccucgc

SEQ ID NO: 505391 - RNA, 23 nt, Human
caccuagcuugggacacagccag

SEQ ID NO: 505392 - RNA, 24 nt, Human
caccucccaacuacacgccccacc

SEQ ID NO: 505393 - RNA, 22 nt, Human
cacgccccaccaugaaugccac

SEQ ID NO: 505394 - RNA, 22 nt, Human
caggguuaagggucucaggagg

SEQ ID NO: 505395 - RNA, 21 nt, Human
cccaacuacacgccccaccau

SEQ ID NO: 505396 - RNA, 28 nt, Human
ccccgcccugaccccgccuuucccuggc

SEQ ID NO: 505397 - RNA, 21 nt, Human
cccgcaucuuccccccauucu

SEQ ID NO: 505398 - RNA, 20 nt, Human
ccugaccccgccuuucccug

SEQ ID NO: 505399 - RNA, 19 nt, Human
ccuggccccgcccaccaga

SEQ ID NO: 505400 - RNA, 23 nt, Human
ccuggccccgcccaccagaccug

SEQ ID NO: 505401 - RNA, 20 nt, Human
cggaagcaccuuaucaaggu

SEQ ID NO: 505402 - RNA, 19 nt, Human
cucaggaggggggacucca

SEQ ID NO: 505403 - RNA, 21 nt, Human
cugaccccgccuuucccuggc

SEQ ID NO: 505404 - RNA, 18 nt, Human
cuggccccgcccaccaga

SEQ ID NO: 505405 - RNA, 21 nt, Human
cuuucccgcaucuucccccca

SEQ ID NO: 505406 - RNA, 22 nt, Human
cuuuggauuuggggucugagag

SEQ ID NO: 505407 - RNA, 21 nt, Human
gaggaauccaaaggucugggu

SEQ ID NO: 505408 - RNA, 22 nt, Human
gcaggguuaagggucucaggag

SEQ ID NO: 505409 - RNA, 21 nt, Human
gcaucuggaggucuucuguug

SEQ ID NO: 505410 - RNA, 19 nt, Human
ggaagcaccuuaucaaggu

SEQ ID NO: 505411 - RNA, 18 nt, Human
ggaggauaaggggacccc

SEQ ID NO: 505412 - RNA, 22 nt, Human
ggcaaccgauaaacuguagaac

SEQ ID NO: 505413 - RNA, 21 nt, Human
gggcagcugaacagagagggg

SEQ ID NO: 505414 - RNA, 19 nt, Human
gggccuccagacuaaaucu

SEQ ID NO: 505415 - RNA, 23 nt, Human
uacuacucuucauagcauaaugu

SEQ ID NO: 505416 - RNA, 23 nt, Human
uagaacugaagaguuuggaauau

SEQ ID NO: 505417 - RNA, 23 nt, Human
uagccaccacgccccuuccuuuc

SEQ ID NO: 505418 - RNA, 18 nt, Human
uaucaaggugaacugagc

SEQ ID NO: 505419 - RNA, 22 nt, Human
ucaucccagcucggaagcaccu

SEQ ID NO: 505420 - RNA, 21 nt, Human
uccaagggagaggaauccaaa

SEQ ID NO: 505421 - RNA, 21 nt, Human
uccaggcauauggacuugaaa

SEQ ID NO: 505422 - RNA, 19 nt, Human
ucccagcucggaagcaccu

SEQ ID NO: 505423 - RNA, 23 nt, Human
ucccgcaucuuccccccauucuu

SEQ ID NO: 505424 - RNA, 21 nt, Human
ucccucuagccaccacgcccc

SEQ ID NO: 505425 - RNA, 18 nt, Human
ucccuggccccgcccacc

SEQ ID NO: 505426 - RNA, 23 nt, Human
ucggaagcaccuuaucaagguga

SEQ ID NO: 505427 - RNA, 25 nt, Human
ucggaagcaccuuaucaaggugaac

SEQ ID NO: 505428 - RNA, 20 nt, Human
ucucggggcuaggaagaccc

SEQ ID NO: 505429 - RNA, 18 nt, Human
ucuguuucuucucuuccc

SEQ ID NO: 505430 - RNA, 25 nt, Human
ugaaagucucggggcuaggaagacc

SEQ ID NO: 505431 - RNA, 20 nt, Human
ugacagauggugaugggugg

SEQ ID NO: 505432 - RNA, 21 nt, Human
uggauuugggcauuccaaggg

SEQ ID NO: 505433 - RNA, 19 nt, Human
uggggugguuugccuuuau

SEQ ID NO: 505434 - RNA, 19 nt, Human
uguugcggaggaugcaggg

SEQ ID NO: 505435 - RNA, 21 nt, Human
uucccuggccccgcccaccuu

SEQ ID NO: 505436 - RNA, 22 nt, Human
uucccuuccucucaucccagcu

SEQ ID NO: 505437 - RNA, 21 nt, Human
uuggaauauuugcauagggga

SEQ ID NO: 505438 - RNA, 23 nt, Human
uuggaauauuugcauaggggagc

SEQ ID NO: 505439 - RNA, 19 nt, Human
uuggauuuggggucugaga

SEQ ID NO: 505440 - RNA, 19 nt, Human
aacucucuuuaauggaggu

SEQ ID NO: 505441 - RNA, 21 nt, Human
agcacaggagcagccaaacua

SEQ ID NO: 505442 - RNA, 23 nt, Human
agcacaggagcagccaaacuauc

SEQ ID NO: 505443 - RNA, 20 nt, Human
augugguggucaauacaagu

SEQ ID NO: 505444 - RNA, 18 nt, Human
cagagaaaauaucccuca

SEQ ID NO: 505445 - RNA, 22 nt, Human
gcgggcuuucacuucaaggcuu

SEQ ID NO: 505446 - RNA, 18 nt, Human
gggagaggcuaauggccc

SEQ ID NO: 505447 - RNA, 23 nt, Human
gguguucuuuuuucuuguucuuu

SEQ ID NO: 505448 - RNA, 18 nt, Human
uacaagugauacagagua

SEQ ID NO: 505449 - RNA, 25 nt, Human
ucccucacagagagaagggagaggc

SEQ ID NO: 505450 - RNA, 23 nt, Human
ucucucuuuugaaugaacauuga

SEQ ID NO: 505451 - RNA, 19 nt, Human
ucuuguucuuuccggugcc

SEQ ID NO: 505452 - RNA, 19 nt, Human
ugacagcacaggagcagcc

SEQ ID NO: 505453 - RNA, 19 nt, Human
ugauaagggagaauugcag

SEQ ID NO: 505454 - RNA, 22 nt, Human
ugggaagauguggauugacaag

SEQ ID NO: 505455 - RNA, 24 nt, Human
uugaaugaacauuggcucacugaa

SEQ ID NO: 505456 - RNA, 19 nt, Human
uugcaggugacagcacagg

SEQ ID NO: 505457 - RNA, 22 nt, Human
uuggcucacugaagaagauaaa

SEQ ID NO: 505458 - RNA, 21 nt, Human
aacacuuuuuauuuagcacau

SEQ ID NO: 505459 - RNA, 18 nt, Human
aacucuccuuaauggagu

SEQ ID NO: 505460 - RNA, 18 nt, Human
aagauauuuggauuagga

SEQ ID NO: 505461 - RNA, 21 nt, Human
aaguggccagggucaaagaua

SEQ ID NO: 505462 - RNA, 22 nt, Human
agacagggaugaagcagaucug

SEQ ID NO: 505463 - RNA, 23 nt, Human
agagaaacaaucccuuugguaac

SEQ ID NO: 505464 - RNA, 18 nt, Human
aggcaugaaguagucacu

SEQ ID NO: 505465 - RNA, 19 nt, Human
auuaauaacacuuuuuauu

SEQ ID NO: 505466 - RNA, 23 nt, Human
auuucagguuaaaguucuguaaa

SEQ ID NO: 505467 - RNA, 19 nt, Human
caucauguagcacggaagu

SEQ ID NO: 505468 - RNA, 21 nt, Human
cuccaugcgggcaaguccuuc

SEQ ID NO: 505469 - RNA, 20 nt, Human
gaaugggaagauuugaugag

SEQ ID NO: 505470 - RNA, 24 nt, Human
gauuucagguuaaaguucuguaaa

SEQ ID NO: 505471 - RNA, 21 nt, Human
ggucagagaagacauaauagu

SEQ ID NO: 505472 - RNA, 20 nt, Human
uaaaaaaagaguugcaggug

SEQ ID NO: 505473 - RNA, 18 nt, Human
uaggaaauucuuugucau

SEQ ID NO: 505474 - RNA, 20 nt, Human
uccuucuccugcacaaauuc

SEQ ID NO: 505475 - RNA, 20 nt, Human
ugaccugaacaacucuccuu

SEQ ID NO: 505476 - RNA, 18 nt, Human
ugagaaaggcaugaagua

SEQ ID NO: 505477 - RNA, 19 nt, Human
ugcugagaaaggcaugaag

SEQ ID NO: 505478 - RNA, 23 nt, Human
ugggaauguccuugauaaaaaaa

SEQ ID NO: 505479 - RNA, 25 nt, Human
uugugcagugaccugaacaacucuc

SEQ ID NO: 505480 - RNA, 21 nt, Human
uuugugcagugaccugaacaa

SEQ ID NO: 505481 - RNA, 21 nt, Human
cacccccaccccaccaggcac

SEQ ID NO: 505482 - RNA, 19 nt, Human
ccucugggcuaggagcagg

SEQ ID NO: 505483 - RNA, 22 nt, Human
ccucugggcuaggagcaggcug

SEQ ID NO: 505484 - RNA, 24 nt, Human
ccucugggcuaggagcaggcuggg

SEQ ID NO: 505485 - RNA, 24 nt, Human
ccuggcacccccaccccaccaggc

SEQ ID NO: 505486 - RNA, 24 nt, Human
cuccucuggacacaccuggcaccc

SEQ ID NO: 505487 - RNA, 19 nt, Human
gcacccccaccccaccagg

SEQ ID NO: 505488 - RNA, 22 nt, Human
gcacccccaccccaccaggcac

SEQ ID NO: 505489 - RNA, 23 nt, Human
ggcacagaggaccaggcaggaca

SEQ ID NO: 505490 - RNA, 21 nt, Human
uguacauuagagccucugggc

SEQ ID NO: 505491 - RNA, 21 nt, Human
aguuugagaaauccugaccuc

SEQ ID NO: 505492 - RNA, 22 nt, Human
gaaucaguuugagaaauccuga

SEQ ID NO: 505493 - RNA, 24 nt, Human
ggggcccugcugccagcccgggag

SEQ ID NO: 505494 - RNA, 25 nt, Human
ugcaaagaaaggaaucaguuugaga

SEQ ID NO: 505495 - RNA, 23 nt, Human
ugggaaaauauuuauuuucaaau

SEQ ID NO: 505496 - RNA, 24 nt, Human
uugaaagcgggggguucagggugu

SEQ ID NO: 505497 - RNA, 18 nt, Human
aacugcaggcguguaaau

SEQ ID NO: 505498 - RNA, 18 nt, Human
acagucucuggguggcau

SEQ ID NO: 505499 - RNA, 21 nt, Human
accacuuccaaguugccuucc

SEQ ID NO: 505500 - RNA, 23 nt, Human
agccagacucccacgugugggcu

SEQ ID NO: 505501 - RNA, 23 nt, Human
auagacagcgacagucucugggu

SEQ ID NO: 505502 - RNA, 19 nt, Human
cacuuccaaguugccuucc

SEQ ID NO: 505503 - RNA, 18 nt, Human
cagauccaggggaguugg

SEQ ID NO: 505504 - RNA, 24 nt, Human
ccaccacuuccaaguugccuuccu

SEQ ID NO: 505505 - RNA, 21 nt, Human
ccacuuccaaguugccuuccu

SEQ ID NO: 505506 - RNA, 21 nt, Human
cccacuguugaggcuggaggc

SEQ ID NO: 505507 - RNA, 20 nt, Human
ccuuguaguuguguaugggu

SEQ ID NO: 505508 - RNA, 21 nt, Human
cuggagacauuaacccugucc

SEQ ID NO: 505509 - RNA, 21 nt, Human
cugggagagugguguagccaa

SEQ ID NO: 505510 - RNA, 21 nt, Human
cugugaacauguguggccguu

SEQ ID NO: 505511 - RNA, 22 nt, Human
gacagacuccggaaaacaacug

SEQ ID NO: 505512 - RNA, 19 nt, Human
gcuaacccagcaguugcuu

SEQ ID NO: 505513 - RNA, 18 nt, Human
ggacugugccucuguggg

SEQ ID NO: 505514 - RNA, 24 nt, Human
gggcugcaguugcagagguggcug

SEQ ID NO: 505515 - RNA, 18 nt, Human
gggguguguggacaucgg

SEQ ID NO: 505516 - RNA, 18 nt, Human
guggaaagcuaacccagc

SEQ ID NO: 505517 - RNA, 24 nt, Human
guugcagagguggcuggggacugu

SEQ ID NO: 505518 - RNA, 24 nt, Human
uaugugcuugugauugcagaugga

SEQ ID NO: 505519 - RNA, 21 nt, Human
ucacaggcugggagaguggug

SEQ ID NO: 505520 - RNA, 19 nt, Human
uccugggcacccaccacuu

SEQ ID NO: 505521 - RNA, 23 nt, Human
uccugggcacccaccacuuccaa

SEQ ID NO: 505522 - RNA, 19 nt, Human
ucucuggguggcaugaccc

SEQ ID NO: 505523 - RNA, 24 nt, Human
ucuggggagccaggacgaugucgu

SEQ ID NO: 505524 - RNA, 19 nt, Human
ucuguggcuugugaaggug

SEQ ID NO: 505525 - RNA, 22 nt, Human
ucuguggcuugugaaggugaca

SEQ ID NO: 505526 - RNA, 19 nt, Human
ugaggguccucguaugucc

SEQ ID NO: 505527 - RNA, 21 nt, Human
ugcaguguacacucuggagac

SEQ ID NO: 505528 - RNA, 18 nt, Human
uggcaugaccccggaggg

SEQ ID NO: 505529 - RNA, 21 nt, Human
uggcaugaccccggagggggc

SEQ ID NO: 505530 - RNA, 18 nt, Human
ugggacagacuccggaaa

SEQ ID NO: 505531 - RNA, 22 nt, Human
ugggagagugguguagccaaga

SEQ ID NO: 505532 - RNA, 23 nt, Human
ugggcugcagauccaggggaguu

SEQ ID NO: 505533 - RNA, 23 nt, Human
uguccaugcccacuguugaggcu

SEQ ID NO: 505534 - RNA, 19 nt, Human
ugugaaggugacagccaga

SEQ ID NO: 505535 - RNA, 20 nt, Human
uguggacaagugguuggggg

SEQ ID NO: 505536 - RNA, 21 nt, Human
uuaaaaaggggugacugaggg

SEQ ID NO: 505537 - RNA, 20 nt, Human
uugcuuuguggcccuuguag

SEQ ID NO: 505538 - RNA, 23 nt, Human
aacacucuauacagaccaugaga

SEQ ID NO: 505539 - RNA, 19 nt, Human
aagcagagaagccaaaucu

SEQ ID NO: 505540 - RNA, 22 nt, Human
aagccaaaucuacuuccccagc

SEQ ID NO: 505541 - RNA, 24 nt, Human
agaagcagagaagccaaaucuacu

SEQ ID NO: 505542 - RNA, 18 nt, Human
agccaucaaaauaauucc

SEQ ID NO: 505543 - RNA, 25 nt, Human
auagaauacuacagauauaacacau

SEQ ID NO: 505544 - RNA, 24 nt, Human
caaaauaauuccuauuuuuauuaa

SEQ ID NO: 505545 - RNA, 22 nt, Human
cacagcuuucuuaaagagcaaa

SEQ ID NO: 505546 - RNA, 22 nt, Human
cacucuauacagaccaugagag

SEQ ID NO: 505547 - RNA, 23 nt, Human
cagcacugauuuggucaucuccu

SEQ ID NO: 505548 - RNA, 21 nt, Human
cagcuuucuuaaagagcaaac

SEQ ID NO: 505549 - RNA, 19 nt, Human
gagaagcagagaagccaaa

SEQ ID NO: 505550 - RNA, 22 nt, Human
gagagagcacaaugcacguaca

SEQ ID NO: 505551 - RNA, 21 nt, Human
gccaaaucuacuuccccagca

SEQ ID NO: 505552 - RNA, 22 nt, Human
uaccaaguauaacacucuauac

SEQ ID NO: 505553 - RNA, 25 nt, Human
uauacagaccaugagagagcacaau

SEQ ID NO: 505554 - RNA, 19 nt, Human
ucagcagcgugcugcuguu

SEQ ID NO: 505555 - RNA, 21 nt, Human
ucucucuccucugagucuuuu

SEQ ID NO: 505556 - RNA, 19 nt, Human
ugaaauuauugagaaaugu

SEQ ID NO: 505557 - RNA, 18 nt, Human
ugagaagcagagaagcca

SEQ ID NO: 505558 - RNA, 20 nt, Human
ugaggucucugguguucugg

SEQ ID NO: 505559 - RNA, 23 nt, Human
ugcagcacauuggaugaagcccg

SEQ ID NO: 505560 - RNA, 21 nt, Human
ugcugcuguuugcugggcugu

SEQ ID NO: 505561 - RNA, 25 nt, Human
uguuugcugggcuguguguguggag

SEQ ID NO: 505562 - RNA, 20 nt, Human
uuccccagcacugauuuggu

SEQ ID NO: 505563 - RNA, 19 nt, Human
uugcugggcugugugugug

SEQ ID NO: 505564 - RNA, 23 nt, Human
aaggaugggcagugcuggaggca

SEQ ID NO: 505565 - RNA, 20 nt, Human
aagggcccaggaagcuccaa

SEQ ID NO: 505566 - RNA, 25 nt, Human
acucuacaaaggugggugggugggu

SEQ ID NO: 505567 - RNA, 18 nt, Human
aggaagcuccaaggacaa

SEQ ID NO: 505568 - RNA, 18 nt, Human
aggacaguggaaaggggc

SEQ ID NO: 505569 - RNA, 18 nt, Human
aggggcaaggaugggcag

SEQ ID NO: 505570 - RNA, 21 nt, Human
cagggaagggcccaggaagcu

SEQ ID NO: 505571 - RNA, 19 nt, Human
ccaggaagcuccaaggaca

SEQ ID NO: 505572 - RNA, 21 nt, Human
ccugaggcccagggaagggcc

SEQ ID NO: 505573 - RNA, 22 nt, Human
cuccaaggacaguggaaagggg

SEQ ID NO: 505574 - RNA, 19 nt, Human
gacgggauggaggguggga

SEQ ID NO: 505575 - RNA, 18 nt, Human
gggcagugcuggaggcag

SEQ ID NO: 505576 - RNA, 22 nt, Human
uccugaggcccagggaagggcc

SEQ ID NO: 505577 - RNA, 25 nt, Human
uggaaaggggcaaggaugggcagug

SEQ ID NO: 505578 - RNA, 24 nt, Human
uuuguuucugggacucuacaaagg

SEQ ID NO: 505579 - RNA, 20 nt, Human
uuuuuuuuuuuuuuugucag

SEQ ID NO: 505580 - RNA, 21 nt, Human
uuuuuuuuuuuuuuugucagc

SEQ ID NO: 505581 - RNA, 19 nt, Human
uuuuuuuuuuuuuuuuugu

SEQ ID NO: 505582 - RNA, 27 nt, Human
uuuuuuuuuuuuuuuuuuuuuuugggg

SEQ ID NO: 505583 - RNA, 19 nt, Human
aaacagguggaugggucag

SEQ ID NO: 505584 - RNA, 24 nt, Human
aaagucacugcaagcuuacauuca

SEQ ID NO: 505585 - RNA, 23 nt, Human
agccaaagcccgcccucggcgcg

SEQ ID NO: 505586 - RNA, 21 nt, Human
cagccaaagcccgcccucggc

SEQ ID NO: 505587 - RNA, 23 nt, Human
cagguggaugggucagaaaguca

SEQ ID NO: 505588 - RNA, 19 nt, Human
cagugaggcccaggcagag

SEQ ID NO: 505589 - RNA, 23 nt, Human
cccacacaaccucuucuccucuu

SEQ ID NO: 505590 - RNA, 19 nt, Human
cccgcagccaaagcccgcc

SEQ ID NO: 505591 - RNA, 20 nt, Human
ccucuucuccucuucugcug

SEQ ID NO: 505592 - RNA, 20 nt, Human
cgcagccaaagcccgcccuc

SEQ ID NO: 505593 - RNA, 22 nt, Human
cucuucuccucuucugcuggga

SEQ ID NO: 505594 - RNA, 20 nt, Human
cugcaggcugucagugaggc

SEQ ID NO: 505595 - RNA, 18 nt, Human
cuuccugcggggcucagu

SEQ ID NO: 505596 - RNA, 19 nt, Human
cuuucaucuccgccauggc

SEQ ID NO: 505597 - RNA, 22 nt, Human
gaugcaguuccugggcccugcg

SEQ ID NO: 505598 - RNA, 22 nt, Human
gccugcccgaugcaguuccugg

SEQ ID NO: 505599 - RNA, 22 nt, Human
ucacugcaagcuuacauucagg

SEQ ID NO: 505600 - RNA, 24 nt, Human
ugcggagaaaggaauaaaagccag

SEQ ID NO: 505601 - RNA, 23 nt, Human
uggcaggaaccggaagugcagca

SEQ ID NO: 505602 - RNA, 23 nt, Human
uguggucuggcaggaaccggaag

SEQ ID NO: 505603 - RNA, 23 nt, Human
uucaugacaaucugcaaaaaaac

SEQ ID NO: 505604 - RNA, 18 nt, Human
accacauuuuguuuaucc

SEQ ID NO: 505605 - RNA, 18 nt, Human
agauaucuaggauggaau

SEQ ID NO: 505606 - RNA, 25 nt, Human
agcugcugaaagccaccaauccgcu

SEQ ID NO: 505607 - RNA, 23 nt, Human
agguccggaacauuuucaccauc

SEQ ID NO: 505608 - RNA, 21 nt, Human
aguggggucagagugggucuc

SEQ ID NO: 505609 - RNA, 23 nt, Human
caccaauccgcuaugcaucucuu

SEQ ID NO: 505610 - RNA, 18 nt, Human
caccuccccacagcugcu

SEQ ID NO: 505611 - RNA, 23 nt, Human
ccccacagcugcugaaagccacc

SEQ ID NO: 505612 - RNA, 19 nt, Human
ccggaacauuuucaccauc

SEQ ID NO: 505613 - RNA, 24 nt, Human
cugaaagccaccaauccgcuaugc

SEQ ID NO: 505614 - RNA, 19 nt, Human
cugucccagacaaccuccu

SEQ ID NO: 505615 - RNA, 19 nt, Human
gaacacuugucucaauuau

SEQ ID NO: 505616 - RNA, 19 nt, Human
gacagaaaaaaaauguaug

SEQ ID NO: 505617 - RNA, 18 nt, Human
gcugaaagccaccaaucc

SEQ ID NO: 505618 - RNA, 21 nt, Human
ggaaagaugcucacagcauau

SEQ ID NO: 505619 - RNA, 22 nt, Human
uaccacgaaauucaccauuuca

SEQ ID NO: 505620 - RNA, 24 nt, Human
uacugugaauagggccgccaugaa

SEQ ID NO: 505621 - RNA, 20 nt, Human
uagcauuuagugcacucaca

SEQ ID NO: 505622 - RNA, 19 nt, Human
uaggauggaauacaggacu

SEQ ID NO: 505623 - RNA, 23 nt, Human
uaugaacaaccuggacagaaaaa

SEQ ID NO: 505624 - RNA, 21 nt, Human
ucacuuuugaugaaucagggg

SEQ ID NO: 505625 - RNA, 23 nt, Human
ucaguaucaugcauucaagguuc

SEQ ID NO: 505626 - RNA, 22 nt, Human
uccucagucccaccuccccaca

SEQ ID NO: 505627 - RNA, 21 nt, Human
ucuaggauggaauacaggacu

SEQ ID NO: 505628 - RNA, 24 nt, Human
ugagguagaauucacauaccacga

SEQ ID NO: 505629 - RNA, 25 nt, Human
ugagguagaauucacauaccacgaa

SEQ ID NO: 505630 - RNA, 21 nt, Human
ugcuucauuccuuuuuauggc

SEQ ID NO: 505631 - RNA, 27 nt, Human
uuagcagucgcuccucagucccaccuc

SEQ ID NO: 505632 - RNA, 24 nt, Human
uucaaaguguccaauucaauagca

SEQ ID NO: 505633 - RNA, 20 nt, Human
uuggccuguucuggaaauuu

SEQ ID NO: 505634 - RNA, 19 nt, Human
uuugcaucugacgucuuuc

SEQ ID NO: 505635 - RNA, 21 nt, Human
acugaggcacaggggccaaca

SEQ ID NO: 505636 - RNA, 18 nt, Human
agacaucuccccgccucu

SEQ ID NO: 505637 - RNA, 21 nt, Human
agguaggugggugggucacug

SEQ ID NO: 505638 - RNA, 21 nt, Human
agguaguuggugcaaagguag

SEQ ID NO: 505639 - RNA, 20 nt, Human
ccccgcaguccuccagcgcc

SEQ ID NO: 505640 - RNA, 21 nt, Human
cccuagauccccgcaguccuc

SEQ ID NO: 505641 - RNA, 19 nt, Human
cgcgggacugaggcacagg

SEQ ID NO: 505642 - RNA, 21 nt, Human
gcccuagauccccgcaguccu

SEQ ID NO: 505643 - RNA, 22 nt, Human
ggcccuagauccccgcaguccu

SEQ ID NO: 505644 - RNA, 18 nt, Human
ggggaaaaagucuuuacu

SEQ ID NO: 505645 - RNA, 23 nt, Human
gguaggugggugggucacugcag

SEQ ID NO: 505646 - RNA, 25 nt, Human
uccccgcaguccuccagcgcccccu

SEQ ID NO: 505647 - RNA, 23 nt, Human
aaaaaaacauuuguucaaaagcu

SEQ ID NO: 505648 - RNA, 18 nt, Human
aaaaagaaaaaagaaaaa

SEQ ID NO: 505649 - RNA, 23 nt, Human
aaaaagaaaaaagaaaaaaacau

SEQ ID NO: 505650 - RNA, 25 nt, Human
aaacaugauuuggcaaucuuuuugc

SEQ ID NO: 505651 - RNA, 23 nt, Human
aacuguuacuucuucugaugccu

SEQ ID NO: 505652 - RNA, 28 nt, Human
aacuuugaaguaggaaauagaaaaaaaa

SEQ ID NO: 505653 - RNA, 21 nt, Human
aagauguuuuuccugagaccc

SEQ ID NO: 505654 - RNA, 19 nt, Human
aagcaaacaugaugaaaau

SEQ ID NO: 505655 - RNA, 19 nt, Human
aaggaagauguuuuuccug

SEQ ID NO: 505656 - RNA, 27 nt, Human
aaguaggaaauagaaaaaaagggaccc

SEQ ID NO: 505657 - RNA, 26 nt, Human
acuuugaaguaggaaauagaaaaaaa

SEQ ID NO: 505658 - RNA, 30 nt, Human
agaaaaaagaaaaaaacauuuguucaaaag

SEQ ID NO: 505659 - RNA, 24 nt, Human
aggaagauguuuuuccugagaccc

SEQ ID NO: 505660 - RNA, 21 nt, Human
caaaaguccuccuaccaaaca

SEQ ID NO: 505661 - RNA, 19 nt, Human
cacuauguggcaccagaac

SEQ ID NO: 505662 - RNA, 18 nt, Human
cagguuaaaaaacaugca

SEQ ID NO: 505663 - RNA, 19 nt, Human
cugaccacuauguggcacc

SEQ ID NO: 505664 - RNA, 21 nt, Human
cuucucuguuccauuucugac

SEQ ID NO: 505665 - RNA, 21 nt, Human
ggaaaagcagguuaaaaaaca

SEQ ID NO: 505666 - RNA, 22 nt, Human
ggaaauagaaaaaaaaucugcu

SEQ ID NO: 505667 - RNA, 20 nt, Human
gugaaucuuuaaucaaugcc

SEQ ID NO: 505668 - RNA, 24 nt, Human
uaaaaaacaugcagaucacucuug

SEQ ID NO: 505669 - RNA, 23 nt, Human
uaccucaaaaguccuccuaccaa

SEQ ID NO: 505670 - RNA, 23 nt, Human
uauugcaaaaaaaaagaaaaaag

SEQ ID NO: 505671 - RNA, 19 nt, Human
ucaaaaguccuccuaccaa

SEQ ID NO: 505672 - RNA, 25 nt, Human
ucaaaaguccuccuaccaaacauga

SEQ ID NO: 505673 - RNA, 23 nt, Human
uccaaaaggugcuaugcaaaaga

SEQ ID NO: 505674 - RNA, 27 nt, Human
ucuuuauugcaaaaaaaaagaaaaaaa

SEQ ID NO: 505675 - RNA, 19 nt, Human
ugaacaaggcuuaagacag

SEQ ID NO: 505676 - RNA, 23 nt, Human
ugcaaaaaaaaagaaaaaagaaa

SEQ ID NO: 505677 - RNA, 21 nt, Human
uggggaaaagcagguuaaaaa

SEQ ID NO: 505678 - RNA, 27 nt, Human
uuaguaugauggcaguaggagcuuuuu

SEQ ID NO: 505679 - RNA, 22 nt, Human
uuauugcaaaaaaaaagaaaaa

SEQ ID NO: 505680 - RNA, 20 nt, Human
uuuccugagacccucugcca

SEQ ID NO: 505681 - RNA, 22 nt, Human
uuucugaccacuauguggcacc

SEQ ID NO: 505682 - RNA, 23 nt, Human
aaaauacgagcagaacuucugag

SEQ ID NO: 505683 - RNA, 21 nt, Human
aaacaaucagugaacuccaac

SEQ ID NO: 505684 - RNA, 22 nt, Human
aaaucuaaucaucuauuuccaa

SEQ ID NO: 505685 - RNA, 19 nt, Human
aaauucacuucacacccac

SEQ ID NO: 505686 - RNA, 19 nt, Human
aaccagaguacccguccug

SEQ ID NO: 505687 - RNA, 25 nt, Human
aagaaaaaaauaauaguuuuaagga

SEQ ID NO: 505688 - RNA, 19 nt, Human
aagaagaaaaaaauaauag

SEQ ID NO: 505689 - RNA, 24 nt, Human
aagaucaaggaacucauucaaaac

SEQ ID NO: 505690 - RNA, 23 nt, Human
aauucagccuuuggaccuuacug

SEQ ID NO: 505691 - RNA, 24 nt, Human
acacccaccuaaaauacgagcaga

SEQ ID NO: 505692 - RNA, 20 nt, Human
accacacgcagaagaaaaau

SEQ ID NO: 505693 - RNA, 21 nt, Human
accacacgcagaagaaaaaua

SEQ ID NO: 505694 - RNA, 21 nt, Human
agaaaacccuauuucugcuga

SEQ ID NO: 505695 - RNA, 21 nt, Human
agaacaggcugaaacucuuga

SEQ ID NO: 505696 - RNA, 27 nt, Human
agaacuucugaggcccaaugaacccau

SEQ ID NO: 505697 - RNA, 25 nt, Human
agaagaaaaaaauaauaguuuuaag

SEQ ID NO: 505698 - RNA, 19 nt, Human
agcgaagggagagcccgga

SEQ ID NO: 505699 - RNA, 21 nt, Human
agcgaagggagagcccggaac

SEQ ID NO: 505700 - RNA, 25 nt, Human
aggaaaucuacagaagggaaucugg

SEQ ID NO: 505701 - RNA, 18 nt, Human
auccugugggaauaauug

SEQ ID NO: 505702 - RNA, 22 nt, Human
aucuuuccuuuccguuuuccuu

SEQ ID NO: 505703 - RNA, 19 nt, Human
caaaaaguauuccuuggag

SEQ ID NO: 505704 - RNA, 23 nt, Human
caaggaacucauucaaaacaaag

SEQ ID NO: 505705 - RNA, 19 nt, Human
cacaguguaauugggucug

SEQ ID NO: 505706 - RNA, 25 nt, Human
cacucaaaauacauuuauugaugaa

SEQ ID NO: 505707 - RNA, 23 nt, Human
cacuucacacccaccuaaaauac

SEQ ID NO: 505708 - RNA, 22 nt, Human
cagaucucuuaaaaugugguuc

SEQ ID NO: 505709 - RNA, 23 nt, Human
cagguacuauaacuuacaccuua

SEQ ID NO: 505710 - RNA, 19 nt, Human
cagugcuuaaagaucaagg

SEQ ID NO: 505711 - RNA, 23 nt, Human
caucacagaaacccuggcacuuu

SEQ ID NO: 505712 - RNA, 23 nt, Human
ccagaguacccguccuguaacuu

SEQ ID NO: 505713 - RNA, 18 nt, Human
ccaggcaagaucgcccau

SEQ ID NO: 505714 - RNA, 25 nt, Human
ccauagaaccaaacauuaauacucc

SEQ ID NO: 505715 - RNA, 25 nt, Human
cccacaguuagaauaaccuuuauuc

SEQ ID NO: 505716 - RNA, 19 nt, Human
cccuuaaacaacaugauua

SEQ ID NO: 505717 - RNA, 25 nt, Human
ccuacuuagaucuucuuuuuuucca

SEQ ID NO: 505718 - RNA, 18 nt, Human
cuagcccuuaaacaacau

SEQ ID NO: 505719 - RNA, 20 nt, Human
cuagcccuuaaacaacauga

SEQ ID NO: 505720 - RNA, 20 nt, Human
cucaaaauacauuuauugau

SEQ ID NO: 505721 - RNA, 24 nt, Human
cugaccccaaaaaguauuccuugg

SEQ ID NO: 505722 - RNA, 22 nt, Human
cugaggcuuggagcgaagggag

SEQ ID NO: 505723 - RNA, 24 nt, Human
cuguaacuuccaucaggaccucaa

SEQ ID NO: 505724 - RNA, 18 nt, Human
cuuggcuucaagcggcug

SEQ ID NO: 505725 - RNA, 21 nt, Human
gagcuucacaaagcaaucuag

SEQ ID NO: 505726 - RNA, 19 nt, Human
ggaauggggaggauggagg

SEQ ID NO: 505727 - RNA, 22 nt, Human
gggaggccauaaacaacucaaa

SEQ ID NO: 505728 - RNA, 19 nt, Human
ggguuuguaaaaugccuua

SEQ ID NO: 505729 - RNA, 20 nt, Human
gugaagugucugcuaccugu

SEQ ID NO: 505730 - RNA, 20 nt, Human
guuuuaaggaaaucuacaga

SEQ ID NO: 505731 - RNA, 23 nt, Human
uaaaaugccuuaagggaggccau

SEQ ID NO: 505732 - RNA, 25 nt, Human
uaaauaagauccaacucuuucuguu

SEQ ID NO: 505733 - RNA, 25 nt, Human
uaagaaaaucaucagugcuuaaaga

SEQ ID NO: 505734 - RNA, 22 nt, Human
uaagauccaacucuuucuguug

SEQ ID NO: 505735 - RNA, 21 nt, Human
uaaggaaaucuacagaaggga

SEQ ID NO: 505736 - RNA, 24 nt, Human
uaaggaaaucuacagaagggaauc

SEQ ID NO: 505737 - RNA, 25 nt, Human
uaccaagagcuucacaaagcaaucu

SEQ ID NO: 505738 - RNA, 20 nt, Human
uauaucuccuagcagggaua

SEQ ID NO: 505739 - RNA, 22 nt, Human
uauguaagucagggagccccuc

SEQ ID NO: 505740 - RNA, 27 nt, Human
ucaauacugaaacuuucuucaccuagc

SEQ ID NO: 505741 - RNA, 22 nt, Human
ucaauaucuuucuaauauaggu

SEQ ID NO: 505742 - RNA, 25 nt, Human
ucacagaaacccuggcacuuugagg

SEQ ID NO: 505743 - RNA, 19 nt, Human
ucaccagaacaggcugaaa

SEQ ID NO: 505744 - RNA, 24 nt, Human
ucagucagaucaauaucuuucuaa

SEQ ID NO: 505745 - RNA, 19 nt, Human
ucucuaccaagagcuucac

SEQ ID NO: 505746 - RNA, 21 nt, Human
ucucuaccaagagcuucacaa

SEQ ID NO: 505747 - RNA, 21 nt, Human
ucugcugaucuuuccuuuccg

SEQ ID NO: 505748 - RNA, 22 nt, Human
ugaaaguaauauaugcuacuua

SEQ ID NO: 505749 - RNA, 20 nt, Human
ugaccacacgcagaagaaaa

SEQ ID NO: 505750 - RNA, 24 nt, Human
ugaucuuuccuuuccguuuuccuu

SEQ ID NO: 505751 - RNA, 21 nt, Human
ugcuuccuugugugggccaaa

SEQ ID NO: 505752 - RNA, 22 nt, Human
ugcuuugcauccucauauauaa

SEQ ID NO: 505753 - RNA, 24 nt, Human
ugucaauuacauuacucuucccug

SEQ ID NO: 505754 - RNA, 22 nt, Human
uuacaccuuaaaaugcuuuguu

SEQ ID NO: 505755 - RNA, 23 nt, Human
uuacaccuuaaaaugcuuuguuu

SEQ ID NO: 505756 - RNA, 19 nt, Human
uugaaugcuuugcauccuc

SEQ ID NO: 505757 - RNA, 23 nt, Human
uugaugcuauuaugacacuuaau

SEQ ID NO: 505758 - RNA, 20 nt, Human
uugauggugaagaugagaaa

SEQ ID NO: 505759 - RNA, 19 nt, Human
uuucucaucuuuuacuugg

SEQ ID NO: 505760 - RNA, 21 nt, Human
uuucucaucuuuuacuuggaa

SEQ ID NO: 505761 - RNA, 20 nt, Human
uuuuagguggcaguagcugg

SEQ ID NO: 505762 - RNA, 21 nt, Human
uuuuuuuucuccccacaguua

SEQ ID NO: 505763 - RNA, 23 nt, Human
aagaaggaagaccgagaaaagga

SEQ ID NO: 505764 - RNA, 19 nt, Human
aagcaagaaggaagaccga

SEQ ID NO: 505765 - RNA, 18 nt, Human
aagugcccgccgagcuau

SEQ ID NO: 505766 - RNA, 24 nt, Human
aauguacaugaauauaaaaagugg

SEQ ID NO: 505767 - RNA, 31 nt, Human
agcagcucccggagcgguggggcggggccuu

SEQ ID NO: 505768 - RNA, 22 nt, Human
aggaagaccgagaaaaggaagc

SEQ ID NO: 505769 - RNA, 19 nt, Human
caaaaagagcuuuagucuc

SEQ ID NO: 505770 - RNA, 23 nt, Human
caaaaagagcuuuagucucgaaa

SEQ ID NO: 505771 - RNA, 18 nt, Human
cagcucccggagcggugg

SEQ ID NO: 505772 - RNA, 28 nt, Human
caguaugguuuuccuauguuuaagaucu

SEQ ID NO: 505773 - RNA, 23 nt, Human
cauacaaaaagagcuuuagucuc

SEQ ID NO: 505774 - RNA, 21 nt, Human
ccagcugccgccgcugcugcc

SEQ ID NO: 505775 - RNA, 21 nt, Human
ccagcugccgccgcugcugcc

SEQ ID NO: 505776 - RNA, 22 nt, Human
ccagcugccgccgcugcugccu

SEQ ID NO: 505777 - RNA, 27 nt, Human
cccggaacucugggcgccggccccgga

SEQ ID NO: 505778 - RNA, 21 nt, Human
cccuaaagcaagaaggaagac

SEQ ID NO: 505779 - RNA, 24 nt, Human
ccgcugcugccuuucccucuccug

SEQ ID NO: 505780 - RNA, 18 nt, Human
ccggccccggaagugccc

SEQ ID NO: 505781 - RNA, 20 nt, Human
ccggucccuaaagcaagaag

SEQ ID NO: 505782 - RNA, 20 nt, Human
ccuccagcugccgccgcugc

SEQ ID NO: 505783 - RNA, 19 nt, Human
cggcugaugagcagcuccc

SEQ ID NO: 505784 - RNA, 22 nt, Human
cuccugccugcacccucccgga

SEQ ID NO: 505785 - RNA, 23 nt, Human
cugcucggcccacccgcaucagg

SEQ ID NO: 505786 - RNA, 21 nt, Human
cugcugccuuucccucuccug

SEQ ID NO: 505787 - RNA, 19 nt, Human
gcaggaaguugcggcugau

SEQ ID NO: 505788 - RNA, 22 nt, Human
gcgguggggcggggccuccucu

SEQ ID NO: 505789 - RNA, 21 nt, Human
gcugcugccuuucccucuccu

SEQ ID NO: 505790 - RNA, 18 nt, Human
ggaacucugggcgccggc

SEQ ID NO: 505791 - RNA, 21 nt, Human
ggaacucugggcgccggcccc

SEQ ID NO: 505792 - RNA, 18 nt, Human
gggccuccucuucuccag

SEQ ID NO: 505793 - RNA, 19 nt, Human
uaaagcaagaaggaagacc

SEQ ID NO: 505794 - RNA, 24 nt, Human
uauuuugguucaaggacucuuccg

SEQ ID NO: 505795 - RNA, 21 nt, Human
ucagaacaguaugguuuuccu

SEQ ID NO: 505796 - RNA, 21 nt, Human
uccagcugccgccgcugcugc

SEQ ID NO: 505797 - RNA, 25 nt, Human
ucccggagcgguggggcggggccuu

SEQ ID NO: 505798 - RNA, 19 nt, Human
ucccuaaagcaagaaggaa

SEQ ID NO: 505799 - RNA, 19 nt, Human
ucccucuccugccugcacc

SEQ ID NO: 505800 - RNA, 26 nt, Human
ucggcaggaaguugcggcugaugagc

SEQ ID NO: 505801 - RNA, 19 nt, Human
ucucgaaagaggaauuacc

SEQ ID NO: 505802 - RNA, 23 nt, Human
ugacacacacgcauacaaaaaga

SEQ ID NO: 505803 - RNA, 24 nt, Human
ugagcagcucccggagcggugggg

SEQ ID NO: 505804 - RNA, 20 nt, Human
ugaugagcagcucccggagc

SEQ ID NO: 505805 - RNA, 19 nt, Human
ugcucggcccacccgcauc

SEQ ID NO: 505806 - RNA, 25 nt, Human
uugacacacacgcauacaaaaagag

SEQ ID NO: 505807 - RNA, 18 nt, Human
caaguaauuacacaaguc

SEQ ID NO: 505808 - RNA, 24 nt, Human
cccugccgcgggcacuccccuucu

SEQ ID NO: 505809 - RNA, 21 nt, Human
cugccgcgggcacuccccuuc

SEQ ID NO: 505810 - RNA, 21 nt, Human
guucuucuaauaauaauaaau

SEQ ID NO: 505811 - RNA, 23 nt, Human
uacacaaguaauuacacaagucc

SEQ ID NO: 505812 - RNA, 22 nt, Human
uucagugauuuuaauguguaag

SEQ ID NO: 505813 - RNA, 19 nt, Human
uuucaaugaacccugccgc

SEQ ID NO: 505814 - RNA, 19 nt, Human
accucauccacuaugacaa

SEQ ID NO: 505815 - RNA, 18 nt, Human
agaagggguggcauuuug

SEQ ID NO: 505816 - RNA, 18 nt, Human
agcggagggagagggggg

SEQ ID NO: 505817 - RNA, 19 nt, Human
aggcagggcggucccaggc

SEQ ID NO: 505818 - RNA, 22 nt, Human
agggagagggggggaccgagcc

SEQ ID NO: 505819 - RNA, 21 nt, Human
aucccaucccuugguccccag

SEQ ID NO: 505820 - RNA, 20 nt, Human
auggugguuacagagacugc

SEQ ID NO: 505821 - RNA, 20 nt, Human
cauuuuguucuguuucuuag

SEQ ID NO: 505822 - RNA, 23 nt, Human
ccacuaugacaagucagcuaugc

SEQ ID NO: 505823 - RNA, 21 nt, Human
cccguggcgacggcggccacg

SEQ ID NO: 505824 - RNA, 21 nt, Human
ccuuugguucauuuaacacua

SEQ ID NO: 505825 - RNA, 19 nt, Human
cgggagugcgaagcggagg

SEQ ID NO: 505826 - RNA, 24 nt, Human
cugcgcugcucgcgcccccacacc

SEQ ID NO: 505827 - RNA, 19 nt, Human
cuugcuguuacucccuuga

SEQ ID NO: 505828 - RNA, 20 nt, Human
cuugggguaagggagggaag

SEQ ID NO: 505829 - RNA, 22 nt, Human
gaaaggcagccucgggggcaca

SEQ ID NO: 505830 - RNA, 22 nt, Human
gaccuucccguacccgacggga

SEQ ID NO: 505831 - RNA, 22 nt, Human
gagggagagggggggaccgagc

SEQ ID NO: 505832 - RNA, 22 nt, Human
gggcccgggcugaggggugggg

SEQ ID NO: 505833 - RNA, 23 nt, Human
gggcugaggggugggggagaggc

SEQ ID NO: 505834 - RNA, 20 nt, Human
ggggaccgagcccgggcccg

SEQ ID NO: 505835 - RNA, 19 nt, Human
ggggagaggccgcccugcg

SEQ ID NO: 505836 - RNA, 20 nt, Human
gggggcacaaaggcagguuu

SEQ ID NO: 505837 - RNA, 21 nt, Human
guggaggacgcuuaggaaaca

SEQ ID NO: 505838 - RNA, 18 nt, Human
guuuguuuuguuuaaaaa

SEQ ID NO: 505839 - RNA, 22 nt, Human
uaaaacucaccugggucccaca

SEQ ID NO: 505840 - RNA, 23 nt, Human
uagaguagggaaucccaucccuu

SEQ ID NO: 505841 - RNA, 21 nt, Human
ucccaucccuugguccccagc

SEQ ID NO: 505842 - RNA, 19 nt, Human
ucccauguacaccaaaucc

SEQ ID NO: 505843 - RNA, 19 nt, Human
uccccagcuaaauacugcg

SEQ ID NO: 505844 - RNA, 22 nt, Human
uccccugguuguuagcucugau

SEQ ID NO: 505845 - RNA, 22 nt, Human
ucccuugguccccagcuaaaua

SEQ ID NO: 505846 - RNA, 21 nt, Human
uccuuugguucauuuaacacu

SEQ ID NO: 505847 - RNA, 21 nt, Human
ugaggcagggcggucccaggc

SEQ ID NO: 505848 - RNA, 18 nt, Human
ugaggggugggggagagg

SEQ ID NO: 505849 - RNA, 21 nt, Human
ugcaaauaaccuacaucauua

SEQ ID NO: 505850 - RNA, 23 nt, Human
ugcagaaaaaaggccuuggcuuc

SEQ ID NO: 505851 - RNA, 20 nt, Human
ugcuccagcacuggccuugc

SEQ ID NO: 505852 - RNA, 25 nt, Human
ugcuccagcccagaccucauccacu

SEQ ID NO: 505853 - RNA, 21 nt, Human
uggaaagaguucuagguuggg

SEQ ID NO: 505854 - RNA, 21 nt, Human
uggccuggauggugguuacag

SEQ ID NO: 505855 - RNA, 21 nt, Human
ugggguaagggagggaaggug

SEQ ID NO: 505856 - RNA, 23 nt, Human
ugggguaagggagggaaggugag

SEQ ID NO: 505857 - RNA, 25 nt, Human
uguucuguuucuuagcagcauuguc

SEQ ID NO: 505858 - RNA, 23 nt, Human
uguuuuguuuaaaaaggaaaagc

SEQ ID NO: 505859 - RNA, 21 nt, Human
uuacuugcagaaaaaaggccu

SEQ ID NO: 505860 - RNA, 21 nt, Human
uucccaaaauugauggcagaa

SEQ ID NO: 505861 - RNA, 20 nt, Human
uucucuggaaagaguucuag

SEQ ID NO: 505862 - RNA, 22 nt, Human
uugggguaagggagggaaggug

SEQ ID NO: 505863 - RNA, 21 nt, Human
aaaacccaacgcagcggcccc

SEQ ID NO: 505864 - RNA, 21 nt, Human
aaacaugaauauaaaccacca

SEQ ID NO: 505865 - RNA, 24 nt, Human
aaacaugaauauaaaccaccacac

SEQ ID NO: 505866 - RNA, 20 nt, Human
aaagagccccguccagacag

SEQ ID NO: 505867 - RNA, 24 nt, Human
aaagugcugggauuacagguguga

SEQ ID NO: 505868 - RNA, 18 nt, Human
aaggaggugucaccaggu

SEQ ID NO: 505869 - RNA, 18 nt, Human
aagugcugggauuacagg

SEQ ID NO: 505870 - RNA, 19 nt, Human
aagugcugggauuacaggu

SEQ ID NO: 505871 - RNA, 26 nt, Human
aagugcugggauuacaggugugagcc

SEQ ID NO: 505872 - RNA, 22 nt, Human
acagaacagcccggucagccuc

SEQ ID NO: 505873 - RNA, 18 nt, Human
acagcgcuggcggcagac

SEQ ID NO: 505874 - RNA, 25 nt, Human
accacacacacgcucaccccgggca

SEQ ID NO: 505875 - RNA, 21 nt, Human
accucccucacaggcuccagc

SEQ ID NO: 505876 - RNA, 23 nt, Human
accucggccucccaaagugcugg

SEQ ID NO: 505877 - RNA, 21 nt, Human
agaacaggggcccuggccuuc

SEQ ID NO: 505878 - RNA, 20 nt, Human
agaacccuaaccccuagaac

SEQ ID NO: 505879 - RNA, 21 nt, Human
agagccccguccagacagccc

SEQ ID NO: 505880 - RNA, 22 nt, Human
agccacaggcggaggcucuggg

SEQ ID NO: 505881 - RNA, 20 nt, Human
agcgaggccuggccucccuc

SEQ ID NO: 505882 - RNA, 24 nt, Human
aggccuggccucccucccugccug

SEQ ID NO: 505883 - RNA, 19 nt, Human
aggugccaccugcccgggg

SEQ ID NO: 505884 - RNA, 22 nt, Human
aggugccaccugcccgggguug

SEQ ID NO: 505885 - RNA, 23 nt, Human
aggugugagccacugugccuggc

SEQ ID NO: 505886 - RNA, 23 nt, Human
aguagcugggauuacaggcaugu

SEQ ID NO: 505887 - RNA, 25 nt, Human
agucuggucucaaacuccugaccuc

SEQ ID NO: 505888 - RNA, 21 nt, Human
agugcaauggcgugaucuuag

SEQ ID NO: 505889 - RNA, 24 nt, Human
agugcaauggcgugaucuuagcuc

SEQ ID NO: 505890 - RNA, 19 nt, Human
aucccacacggccuggcug

SEQ ID NO: 505891 - RNA, 20 nt, Human
auggaacagaagaugcgggc

SEQ ID NO: 505892 - RNA, 20 nt, Human
augggguuucuccauguugg

SEQ ID NO: 505893 - RNA, 21 nt, Human
augggguuucuccauguuggu

SEQ ID NO: 505894 - RNA, 24 nt, Human
augggguuucuccauguuggucag

SEQ ID NO: 505895 - RNA, 19 nt, Human
auuuuaguagagauggggu

SEQ ID NO: 505896 - RNA, 24 nt, Human
caaagugcugggauuacaggugug

SEQ ID NO: 505897 - RNA, 22 nt, Human
caagcaauucuccugccucagc

SEQ ID NO: 505898 - RNA, 18 nt, Human
cacaaggccagccacagc

SEQ ID NO: 505899 - RNA, 22 nt, Human
cacaaggccagccacagccuag

SEQ ID NO: 505900 - RNA, 19 nt, Human
cacagccuagagguccuuc

SEQ ID NO: 505901 - RNA, 21 nt, Human
caccacaaccucugccuccca

SEQ ID NO: 505902 - RNA, 22 nt, Human
caccacaaccucugccucccag

SEQ ID NO: 505903 - RNA, 19 nt, Human
cacucgaaugcagcagggc

SEQ ID NO: 505904 - RNA, 21 nt, Human
cagccaguccugcugcaggca

SEQ ID NO: 505905 - RNA, 21 nt, Human
ccaaagugcugggauuacagg

SEQ ID NO: 505906 - RNA, 21 nt, Human
ccaaagugcugggauuacagg

SEQ ID NO: 505907 - RNA, 24 nt, Human
ccaaagugcugggauuacaggugu

SEQ ID NO: 505908 - RNA, 23 nt, Human
ccacaaccucugccucccagguu

SEQ ID NO: 505909 - RNA, 24 nt, Human
ccacaaccucugccucccagguuc

SEQ ID NO: 505910 - RNA, 20 nt, Human
ccaccacgccuggcuaauuu

SEQ ID NO: 505911 - RNA, 23 nt, Human
ccagacagcccuguuaacaccug

SEQ ID NO: 505912 - RNA, 21 nt, Human
ccaggcccacuccaagcccug

SEQ ID NO: 505913 - RNA, 22 nt, Human
ccauguuggucagucuggucuc

SEQ ID NO: 505914 - RNA, 26 nt, Human
cccacagcaggggcagccaguccugc

SEQ ID NO: 505915 - RNA, 18 nt, Human
cccagauugagggggaag

SEQ ID NO: 505916 - RNA, 23 nt, Human
cccagguucaagcaauucuccug

SEQ ID NO: 505917 - RNA, 22 nt, Human
ccccccacagcaggggcagcca

SEQ ID NO: 505918 - RNA, 21 nt, Human
ccccggccgcccagcugagug

SEQ ID NO: 505919 - RNA, 19 nt, Human
ccccgggcaauccaggccu

SEQ ID NO: 505920 - RNA, 23 nt, Human
cccgaagcgacacuucccuggca

SEQ ID NO: 505921 - RNA, 23 nt, Human
cccgaguagcugggauuacaggc

SEQ ID NO: 505922 - RNA, 24 nt, Human
cccgaguagcugggauuacaggca

SEQ ID NO: 505923 - RNA, 21 nt, Human
cccuaagccugccccggccgc

SEQ ID NO: 505924 - RNA, 23 nt, Human
ccgaguagcugggauuacaggca

SEQ ID NO: 505925 - RNA, 24 nt, Human
ccgaguagcugggauuacaggcau

SEQ ID NO: 505926 - RNA, 25 nt, Human
ccgccaccucccucacaggcuccag

SEQ ID NO: 505927 - RNA, 24 nt, Human
ccucccagguucaagcaauucucc

SEQ ID NO: 505928 - RNA, 19 nt, Human
ccucccucccugccugucc

SEQ ID NO: 505929 - RNA, 20 nt, Human
ccucucguugcccaggcugg

SEQ ID NO: 505930 - RNA, 21 nt, Human
ccucucguugcccaggcugga

SEQ ID NO: 505931 - RNA, 23 nt, Human
ccucucguugcccaggcuggagu

SEQ ID NO: 505932 - RNA, 24 nt, Human
ccugaccucaggugaucuggccac

SEQ ID NO: 505933 - RNA, 23 nt, Human
ccugccucagccucccgaguagc

SEQ ID NO: 505934 - RNA, 23 nt, Human
ccugcugcaggcagaguuucagu

SEQ ID NO: 505935 - RNA, 19 nt, Human
ccuggcacaggaguucugg

SEQ ID NO: 505936 - RNA, 21 nt, Human
ccuggcacaggaguucuggaa

SEQ ID NO: 505937 - RNA, 22 nt, Human
ccuuuggggaaagaacccuaac

SEQ ID NO: 505938 - RNA, 18 nt, Human
cgcccuucccucccgccu

SEQ ID NO: 505939 - RNA, 21 nt, Human
cgggcaaaacccaacgcagcg

SEQ ID NO: 505940 - RNA, 20 nt, Human
cguugcccaggcuggagugc

SEQ ID NO: 505941 - RNA, 21 nt, Human
cuagagguccuuccugguccc

SEQ ID NO: 505942 - RNA, 19 nt, Human
cucacaggcuccagcaggu

SEQ ID NO: 505943 - RNA, 24 nt, Human
cucaccacaaccucugccucccag

SEQ ID NO: 505944 - RNA, 24 nt, Human
cucagccucccgaguagcugggau

SEQ ID NO: 505945 - RNA, 24 nt, Human
cuccauguuggucagucuggucuc

SEQ ID NO: 505946 - RNA, 18 nt, Human
cucccucccugccugucc

SEQ ID NO: 505947 - RNA, 21 nt, Human
cuccugccuccaggaacaagg

SEQ ID NO: 505948 - RNA, 24 nt, Human
cucguugcccaggcuggagugcaa

SEQ ID NO: 505949 - RNA, 19 nt, Human
cucucguugcccaggcugg

SEQ ID NO: 505950 - RNA, 20 nt, Human
cucucguugcccaggcugga

SEQ ID NO: 505951 - RNA, 21 nt, Human
cucucguugcccaggcuggag

SEQ ID NO: 505952 - RNA, 19 nt, Human
cugaaccccccacagcagg

SEQ ID NO: 505953 - RNA, 22 nt, Human
cugccaccucccacacguccgu

SEQ ID NO: 505954 - RNA, 23 nt, Human
cugccucagccucccgaguagcu

SEQ ID NO: 505955 - RNA, 21 nt, Human
cugcggacccgcggguacccu

SEQ ID NO: 505956 - RNA, 18 nt, Human
cugugcccuaagccugcc

SEQ ID NO: 505957 - RNA, 22 nt, Human
cuucccaccacacacacgcuca

SEQ ID NO: 505958 - RNA, 24 nt, Human
gacccccugucccggagucgccuu

SEQ ID NO: 505959 - RNA, 26 nt, Human
gacccgccaccucccucacaggcucc

SEQ ID NO: 505960 - RNA, 24 nt, Human
gaccucaggugaucuggccaccuc

SEQ ID NO: 505961 - RNA, 24 nt, Human
gagaugggguuucuccauguuggu

SEQ ID NO: 505962 - RNA, 23 nt, Human
gaggccuggccucccucccugcc

SEQ ID NO: 505963 - RNA, 25 nt, Human
gaguagcugggauuacaggcaugug

SEQ ID NO: 505964 - RNA, 18 nt, Human
gauuacaggcaugugcca

SEQ ID NO: 505965 - RNA, 18 nt, Human
gauuacaggugugagcca

SEQ ID NO: 505966 - RNA, 21 nt, Human
gauuacaggugugagccacug

SEQ ID NO: 505967 - RNA, 24 nt, Human
gauuacaggugugagccacugugc

SEQ ID NO: 505968 - RNA, 21 nt, Human
gcacaaggccagccacagccu

SEQ ID NO: 505969 - RNA, 21 nt, Human
gcacaggaguucuggagccac

SEQ ID NO: 505970 - RNA, 24 nt, Human
gcccaggcuggagugcaauggcgu

SEQ ID NO: 505971 - RNA, 21 nt, Human
gcccgggguugggggacacuc

SEQ ID NO: 505972 - RNA, 22 nt, Human
gcccgggguugggggacacucg

SEQ ID NO: 505973 - RNA, 21 nt, Human
gccgagacccccugucccgga

SEQ ID NO: 505974 - RNA, 22 nt, Human
gccuggcacaggaguucuggag

SEQ ID NO: 505975 - RNA, 18 nt, Human
gcggacccgcggguaccc

SEQ ID NO: 505976 - RNA, 18 nt, Human
gcggaggcucuggggaaa

SEQ ID NO: 505977 - RNA, 19 nt, Human
gcuggagugcaauggcgug

SEQ ID NO: 505978 - RNA, 18 nt, Human
ggagaggggcagggagga

SEQ ID NO: 505979 - RNA, 19 nt, Human
ggauuacaggcaugugcca

SEQ ID NO: 505980 - RNA, 19 nt, Human
ggcagggaggacgcugagg

SEQ ID NO: 505981 - RNA, 21 nt, Human
ggccuggccucccucccugcc

SEQ ID NO: 505982 - RNA, 22 nt, Human
ggcuggagugcaauggcgugau

SEQ ID NO: 505983 - RNA, 25 nt, Human
gggcuuuggggaaccggaugcaguc

SEQ ID NO: 505984 - RNA, 20 nt, Human
ggggacacucgaaugcagca

SEQ ID NO: 505985 - RNA, 22 nt, Human
gggguuucuccauguuggucag

SEQ ID NO: 505986 - RNA, 19 nt, Human
gggucugcacaaggccagc

SEQ ID NO: 505987 - RNA, 21 nt, Human
ggucccaggcccacuccaagc

SEQ ID NO: 505988 - RNA, 20 nt, Human
guagcugggauuacaggcau

SEQ ID NO: 505989 - RNA, 22 nt, Human
gucaccuaugcaggcuguggcc

SEQ ID NO: 505990 - RNA, 20 nt, Human
gucugcacaaggccagccac

SEQ ID NO: 505991 - RNA, 23 nt, Human
uaacugugcccuaagccugcccc

SEQ ID NO: 505992 - RNA, 21 nt, Human
uaaugaugggcccaucucucc

SEQ ID NO: 505993 - RNA, 24 nt, Human
uaauuuuguauuuuaguagagaug

SEQ ID NO: 505994 - RNA, 27 nt, Human
uacagaacagcccggucagccucgucc

SEQ ID NO: 505995 - RNA, 22 nt, Human
uacaggcaugugccaccacgcc

SEQ ID NO: 505996 - RNA, 22 nt, Human
uacaggugugagccacugugcc

SEQ ID NO: 505997 - RNA, 23 nt, Human
uacaggugugagccacugugccu

SEQ ID NO: 505998 - RNA, 24 nt, Human
uagaacaggggcccuggccuuccc

SEQ ID NO: 505999 - RNA, 18 nt, Human
uagaccccagauugaggg

SEQ ID NO: 506000 - RNA, 23 nt, Human
uagcucaccacaaccucugccuc

SEQ ID NO: 506001 - RNA, 24 nt, Human
uaguagagaugggguuucuccaug

SEQ ID NO: 506002 - RNA, 24 nt, Human
ucaccacaaccucugccucccagg

SEQ ID NO: 506003 - RNA, 25 nt, Human
ucaccacaaccucugccucccaggu

SEQ ID NO: 506004 - RNA, 20 nt, Human
ucagccucccgaguagcugg

SEQ ID NO: 506005 - RNA, 18 nt, Human
uccacaaacaugaauaua

SEQ ID NO: 506006 - RNA, 22 nt, Human
uccacaaacaugaauauaaacc

SEQ ID NO: 506007 - RNA, 27 nt, Human
uccacaaacaugaauauaaaccaccac

SEQ ID NO: 506008 - RNA, 21 nt, Human
uccagacagcccuguuaacac

SEQ ID NO: 506009 - RNA, 23 nt, Human
ucccaaagugcugggauuacagg

SEQ ID NO: 506010 - RNA, 19 nt, Human
ucccaggcccacuccaagc

SEQ ID NO: 506011 - RNA, 22 nt, Human
ucccaggcccacuccaagcccu

SEQ ID NO: 506012 - RNA, 21 nt, Human
ucccaggcccacuccaagccu

SEQ ID NO: 506013 - RNA, 21 nt, Human
ucccagguucaagcaauucuc

SEQ ID NO: 506014 - RNA, 24 nt, Human
ucccagguucaagcaauucuccug

SEQ ID NO: 506015 - RNA, 24 nt, Human
ucccgaguagcugggauuacaggc

SEQ ID NO: 506016 - RNA, 18 nt, Human
ucccggagucgccuggcc

SEQ ID NO: 506017 - RNA, 22 nt, Human
ucccucucguugcccaggcugg

SEQ ID NO: 506018 - RNA, 23 nt, Human
ucccucucguugcccaggcugga

SEQ ID NO: 506019 - RNA, 20 nt, Human
uccuggucccaggcccacuc

SEQ ID NO: 506020 - RNA, 22 nt, Human
uccuuuggggaaagaacccuaa

SEQ ID NO: 506021 - RNA, 22 nt, Human
ucgcggaagccaggucuuccca

SEQ ID NO: 506022 - RNA, 21 nt, Human
ucggaggcuggcgccugccac

SEQ ID NO: 506023 - RNA, 18 nt, Human
ucggccucccaaagugcu

SEQ ID NO: 506024 - RNA, 22 nt, Human
ucuccagugccgcccuucccuc

SEQ ID NO: 506025 - RNA, 24 nt, Human
ucuccugccucagccucccgagua

SEQ ID NO: 506026 - RNA, 18 nt, Human
ugaaaggagaaaugucuu

SEQ ID NO: 506027 - RNA, 24 nt, Human
ugaccucaggugaucuggccaccu

SEQ ID NO: 506028 - RNA, 25 nt, Human
ugaccucaggugaucuggccaccuc

SEQ ID NO: 506029 - RNA, 23 nt, Human
ugaccuggcugagggaaagaggu

SEQ ID NO: 506030 - RNA, 21 nt, Human
ugagggggaagcaaaagagcc

SEQ ID NO: 506031 - RNA, 21 nt, Human
ugagugggacugaaggaggug

SEQ ID NO: 506032 - RNA, 24 nt, Human
ugaucuggccaccucggccuccca

SEQ ID NO: 506033 - RNA, 18 nt, Human
ugcccaggcuggagugca

SEQ ID NO: 506034 - RNA, 21 nt, Human
ugcccaggcuggagugcaaug

SEQ ID NO: 506035 - RNA, 21 nt, Human
ugcccaggcuggagugcaaug

SEQ ID NO: 506036 - RNA, 24 nt, Human
ugcccaggcuggagugcaauggcg

SEQ ID NO: 506037 - RNA, 24 nt, Human
ugccucagccucccgaguagcugg

SEQ ID NO: 506038 - RNA, 24 nt, Human
ugcugggauuacaggugugagcca

SEQ ID NO: 506039 - RNA, 19 nt, Human
uggaacagaagaugcgggc

SEQ ID NO: 506040 - RNA, 19 nt, Human
uggagugcaauggcgugau

SEQ ID NO: 506041 - RNA, 23 nt, Human
uggagugcaauggcgugaucuua

SEQ ID NO: 506042 - RNA, 24 nt, Human
uggagugcaauggcgugaucuuag

SEQ ID NO: 506043 - RNA, 19 nt, Human
uggcccaaggucaucacag

SEQ ID NO: 506044 - RNA, 20 nt, Human
uggccccuaacugugcccuu

SEQ ID NO: 506045 - RNA, 24 nt, Human
uggcgugaucuuagcucaccacaa

SEQ ID NO: 506046 - RNA, 19 nt, Human
ugggaugcuggccccuaau

SEQ ID NO: 506047 - RNA, 18 nt, Human
ugggauuacaggcaugug

SEQ ID NO: 506048 - RNA, 21 nt, Human
ugggauuacaggcaugugcca

SEQ ID NO: 506049 - RNA, 22 nt, Human
ugggauuacaggcaugugccac

SEQ ID NO: 506050 - RNA, 24 nt, Human
ugggauuacaggcaugugccacca

SEQ ID NO: 506051 - RNA, 18 nt, Human
ugggauuacaggugugag

SEQ ID NO: 506052 - RNA, 21 nt, Human
ugggauuacaggugugagcca

SEQ ID NO: 506053 - RNA, 22 nt, Human
ugggauuacaggugugagccac

SEQ ID NO: 506054 - RNA, 22 nt, Human
ugggauuacaggugugagccac

SEQ ID NO: 506055 - RNA, 22 nt, Human
ugggauuacaggugugagccac

SEQ ID NO: 506056 - RNA, 24 nt, Human
ugggauuacaggugugagccacug

SEQ ID NO: 506057 - RNA, 19 nt, Human
ugggguuucuccauguugg

SEQ ID NO: 506058 - RNA, 24 nt, Human
uggucagucuggucucaaacuccu

SEQ ID NO: 506059 - RNA, 21 nt, Human
ugucaccaggugccaccugcc

SEQ ID NO: 506060 - RNA, 19 nt, Human
uuacuggagcugaauuccc

SEQ ID NO: 506061 - RNA, 25 nt, Human
uuagcucaccacaaccucugccucc

SEQ ID NO: 506062 - RNA, 18 nt, Human
uuaguagagaugggguuu

SEQ ID NO: 506063 - RNA, 24 nt, Human
uuaguagagaugggguuucuccau

SEQ ID NO: 506064 - RNA, 21 nt, Human
uucaagcaauucuccugccuc

SEQ ID NO: 506065 - RNA, 24 nt, Human
uucaagcaauucuccugccucagc

SEQ ID NO: 506066 - RNA, 19 nt, Human
uucuggagccacgguccug

SEQ ID NO: 506067 - RNA, 18 nt, Human
uugcccaggcuggagugc

SEQ ID NO: 506068 - RNA, 18 nt, Human
uuucuccauguuggucag

SEQ ID NO: 506069 - RNA, 19 nt, Human
uuuuguauuuuaguagaga

SEQ ID NO: 506070 - RNA, 20 nt, Human
uuuuuuuuuuugaaacagag

SEQ ID NO: 506071 - RNA, 23 nt, Human
uuuuuuuuuuuugaaacagaguu

SEQ ID NO: 506072 - RNA, 18 nt, Human
uuuuuuuuuuuuuuuuug

SEQ ID NO: 506073 - RNA, 19 nt, Human
aaacacaugaauccaauga

SEQ ID NO: 506074 - RNA, 23 nt, Human
aaacaucacgcauuuuaaaaaua

SEQ ID NO: 506075 - RNA, 24 nt, Human
aaggagguuuuuucacauuugguu

SEQ ID NO: 506076 - RNA, 21 nt, Human
aaucagguguggaaggagcug

SEQ ID NO: 506077 - RNA, 21 nt, Human
aauuuucuuuuuaaacauagc

SEQ ID NO: 506078 - RNA, 20 nt, Human
acaacuaggcaguaugugug

SEQ ID NO: 506079 - RNA, 23 nt, Human
acaauuccuugugacuggcccag

SEQ ID NO: 506080 - RNA, 21 nt, Human
acacaaugggaugaaggaggu

SEQ ID NO: 506081 - RNA, 18 nt, Human
acacucccagaacccaga

SEQ ID NO: 506082 - RNA, 22 nt, Human
acagaacacucccagaacccag

SEQ ID NO: 506083 - RNA, 25 nt, Human
accaggcacuguaugcgcccauccu

SEQ ID NO: 506084 - RNA, 18 nt, Human
accccauggaagccucga

SEQ ID NO: 506085 - RNA, 24 nt, Human
accugccacccugaaccgaaacgg

SEQ ID NO: 506086 - RNA, 18 nt, Human
accugcugugccuccuuc

SEQ ID NO: 506087 - RNA, 22 nt, Human
accuuggugccucgugugccca

SEQ ID NO: 506088 - RNA, 25 nt, Human
acgcaaccagggccggcugggagcc

SEQ ID NO: 506089 - RNA, 21 nt, Human
acgugaagcuaggacuccugc

SEQ ID NO: 506090 - RNA, 23 nt, Human
agaacacucccagaacccagaau

SEQ ID NO: 506091 - RNA, 21 nt, Human
agaggaaggaggaguucagag

SEQ ID NO: 506092 - RNA, 22 nt, Human
agaggaaggaggaguucagagg

SEQ ID NO: 506093 - RNA, 19 nt, Human
agccucgacgccauacccc

SEQ ID NO: 506094 - RNA, 24 nt, Human
agcugcuucgagcagcgggaaugu

SEQ ID NO: 506095 - RNA, 18 nt, Human
aggcaaggcugacauaua

SEQ ID NO: 506096 - RNA, 19 nt, Human
agggauucuuuuuuuuuuu

SEQ ID NO: 506097 - RNA, 25 nt, Human
agggauucuuuuuuuuuuuuuuuuu

SEQ ID NO: 506098 - RNA, 20 nt, Human
agugucccugugaacgcucu

SEQ ID NO: 506099 - RNA, 22 nt, Human
auaaaacacaugaauccaauga

SEQ ID NO: 506100 - RNA, 18 nt, Human
auguaagaggcacagaac

SEQ ID NO: 506101 - RNA, 23 nt, Human
caaacucugaggagccucccagg

SEQ ID NO: 506102 - RNA, 21 nt, Human
caacacacacccuuggcccuc

SEQ ID NO: 506103 - RNA, 23 nt, Human
caccaggcacuguaugcgcccau

SEQ ID NO: 506104 - RNA, 19 nt, Human
cacccugaaccgaaacggc

SEQ ID NO: 506105 - RNA, 22 nt, Human
caccugccacccugaaccgaaa

SEQ ID NO: 506106 - RNA, 26 nt, Human
caccuggaacacggguugugcacaaa

SEQ ID NO: 506107 - RNA, 22 nt, Human
cagaaggaagcuggccuccccc

SEQ ID NO: 506108 - RNA, 22 nt, Human
cagaaggaagcuggccuccccc

SEQ ID NO: 506109 - RNA, 21 nt, Human
cagauaaaacacaugaaucca

SEQ ID NO: 506110 - RNA, 27 nt, Human
cagcagacaaacucugaggagccuccc

SEQ ID NO: 506111 - RNA, 19 nt, Human
caguccgcagcucccugcc

SEQ ID NO: 506112 - RNA, 18 nt, Human
cauaaaacaucacgcauu

SEQ ID NO: 506113 - RNA, 20 nt, Human
caugaauccaaugaccuucc

SEQ ID NO: 506114 - RNA, 21 nt, Human
ccacccgaucucacgauggca

SEQ ID NO: 506115 - RNA, 21 nt, Human
ccagacagugucccugugaac

SEQ ID NO: 506116 - RNA, 21 nt, Human
ccauaccccagugcuggacac

SEQ ID NO: 506117 - RNA, 19 nt, Human
ccauggaagccucgacgcc

SEQ ID NO: 506118 - RNA, 25 nt, Human
cccagaacccagaaucugcugucau

SEQ ID NO: 506119 - RNA, 18 nt, Human
cccauccugucagaagga

SEQ ID NO: 506120 - RNA, 23 nt, Human
ccccaccccauggaagccucgac

SEQ ID NO: 506121 - RNA, 23 nt, Human
ccccagacagugucccugugaac

SEQ ID NO: 506122 - RNA, 24 nt, Human
cccccuuuggcuuagacaacacaa

SEQ ID NO: 506123 - RNA, 19 nt, Human
ccccugaccucaggggcuc

SEQ ID NO: 506124 - RNA, 20 nt, Human
cccgacacuugagcuccucc

SEQ ID NO: 506125 - RNA, 19 nt, Human
cccuccaccaccucagcug

SEQ ID NO: 506126 - RNA, 21 nt, Human
ccucacagcugaaaugcugcc

SEQ ID NO: 506127 - RNA, 18 nt, Human
ccucaggggcucccuccc

SEQ ID NO: 506128 - RNA, 21 nt, Human
cgcacaguggcugcuagacac

SEQ ID NO: 506129 - RNA, 20 nt, Human
cggccccugaccucaggggc

SEQ ID NO: 506130 - RNA, 24 nt, Human
cggccccugaccucaggggcuccc

SEQ ID NO: 506131 - RNA, 22 nt, Human
cuaauaccuaaaaaauggacac

SEQ ID NO: 506132 - RNA, 23 nt, Human
cuaauaccuaaaaaauggacaca

SEQ ID NO: 506133 - RNA, 22 nt, Human
cucccuccaccaccucagcugg

SEQ ID NO: 506134 - RNA, 19 nt, Human
cugaauacaauggucauaa

SEQ ID NO: 506135 - RNA, 24 nt, Human
cugacacacggagagucacaggcu

SEQ ID NO: 506136 - RNA, 23 nt, Human
cuggacaccugccacccugaacc

SEQ ID NO: 506137 - RNA, 23 nt, Human
cugggccuugcugcgggcaggug

SEQ ID NO: 506138 - RNA, 18 nt, Human
cuuacauaaccaucagcu

SEQ ID NO: 506139 - RNA, 23 nt, Human
cuugcacugcacccccagacagu

SEQ ID NO: 506140 - RNA, 20 nt, Human
gacacaauuucauaaaacau

SEQ ID NO: 506141 - RNA, 18 nt, Human
gacuccugccugcuuccc

SEQ ID NO: 506142 - RNA, 19 nt, Human
gcacugugccuggcacaug

SEQ ID NO: 506143 - RNA, 19 nt, Human
gcccagcacugugccuggc

SEQ ID NO: 506144 - RNA, 23 nt, Human
gccgcagcaacuuggccggcccg

SEQ ID NO: 506145 - RNA, 20 nt, Human
gcugacguguggugaaaugu

SEQ ID NO: 506146 - RNA, 20 nt, Human
gcugggccuugcugcgggca

SEQ ID NO: 506147 - RNA, 21 nt, Human
ggcagguggcccggaccuugg

SEQ ID NO: 506148 - RNA, 25 nt, Human
ggcuauacagcugcuucgagcagcg

SEQ ID NO: 506149 - RNA, 19 nt, Human
ggugacaggucugccggcu

SEQ ID NO: 506150 - RNA, 21 nt, Human
gugaagcuaggacuccugccu

SEQ ID NO: 506151 - RNA, 24 nt, Human
gugcuggacaccugccacccugaa

SEQ ID NO: 506152 - RNA, 23 nt, Human
guuaagaaguuaagacaaccauu

SEQ ID NO: 506153 - RNA, 22 nt, Human
uaaaaaccugagaagucuaacu

SEQ ID NO: 506154 - RNA, 18 nt, Human
uaaagagagaccaugagg

SEQ ID NO: 506155 - RNA, 25 nt, Human
uaaauaaaaaccugagaagucuaac

SEQ ID NO: 506156 - RNA, 19 nt, Human
uaaauauguacauuccacu

SEQ ID NO: 506157 - RNA, 26 nt, Human
uaacgcacucacacaaccugaaguua

SEQ ID NO: 506158 - RNA, 22 nt, Human
uaagacaaccauuuuuacagau

SEQ ID NO: 506159 - RNA, 18 nt, Human
uacacauuuccuauuuga

SEQ ID NO: 506160 - RNA, 19 nt, Human
uacaggugugccgccucag

SEQ ID NO: 506161 - RNA, 19 nt, Human
uccacaauuuggucacuac

SEQ ID NO: 506162 - RNA, 24 nt, Human
uccacaauuuggucacuacauuug

SEQ ID NO: 506163 - RNA, 18 nt, Human
uccacaugucaugaaaca

SEQ ID NO: 506164 - RNA, 22 nt, Human
uccacaugucaugaaacaccaa

SEQ ID NO: 506165 - RNA, 21 nt, Human
ucccagaacccagaaucugcu

SEQ ID NO: 506166 - RNA, 22 nt, Human
uccgcagacauuuugguuugaa

SEQ ID NO: 506167 - RNA, 21 nt, Human
ucugaacaaggcaaggcugac

SEQ ID NO: 506168 - RNA, 18 nt, Human
ucuggguguuuccugguc

SEQ ID NO: 506169 - RNA, 18 nt, Human
ucuguaacagcaccagcu

SEQ ID NO: 506170 - RNA, 21 nt, Human
ucuuccacaauuuggucacua

SEQ ID NO: 506171 - RNA, 18 nt, Human
ugaaaaugugacccauuu

SEQ ID NO: 506172 - RNA, 19 nt, Human
ugaaaugcugccuccgccg

SEQ ID NO: 506173 - RNA, 20 nt, Human
ugaaauguuacagagagccc

SEQ ID NO: 506174 - RNA, 18 nt, Human
ugaaccgaaacggccccu

SEQ ID NO: 506175 - RNA, 23 nt, Human
ugaacgcucucaucaaagguucu

SEQ ID NO: 506176 - RNA, 24 nt, Human
ugaacugaaaggcaucauuacaaa

SEQ ID NO: 506177 - RNA, 21 nt, Human
ugaagcuguguguucggggaa

SEQ ID NO: 506178 - RNA, 20 nt, Human
ugacagaaaucucuuccaca

SEQ ID NO: 506179 - RNA, 22 nt, Human
ugacagcugaaagcaaaccugu

SEQ ID NO: 506180 - RNA, 23 nt, Human
ugacagcugaaagcaaaccuguu

SEQ ID NO: 506181 - RNA, 21 nt, Human
ugaccucaggggcucccucca

SEQ ID NO: 506182 - RNA, 22 nt, Human
ugagaagucuaacgugaagcua

SEQ ID NO: 506183 - RNA, 23 nt, Human
ugauuacagagaguaucaaacug

SEQ ID NO: 506184 - RNA, 24 nt, Human
ugcaagugacagcugaaagcaaac

SEQ ID NO: 506185 - RNA, 18 nt, Human
ugcacaaaucacaccagg

SEQ ID NO: 506186 - RNA, 21 nt, Human
ugccaaacaccaauuuucuuu

SEQ ID NO: 506187 - RNA, 24 nt, Human
ugccuccuucuccgcagaugcucu

SEQ ID NO: 506188 - RNA, 18 nt, Human
uggacgcaaccagggccg

SEQ ID NO: 506189 - RNA, 22 nt, Human
uggcacaugguggauacucagg

SEQ ID NO: 506190 - RNA, 19 nt, Human
ugggaagagccauccggaa

SEQ ID NO: 506191 - RNA, 21 nt, Human
ugucagaaggaagcuggccuc

SEQ ID NO: 506192 - RNA, 20 nt, Human
uguguucggggaaagguugc

SEQ ID NO: 506193 - RNA, 20 nt, Human
uguuccguuugccaaacacc

SEQ ID NO: 506194 - RNA, 22 nt, Human
uuaaaaauacaaaugagguaua

SEQ ID NO: 506195 - RNA, 20 nt, Human
uuaaauaaaaaccugagaag

SEQ ID NO: 506196 - RNA, 30 nt, Human
uuacagauaaaacacaugaauccaaugacc

SEQ ID NO: 506197 - RNA, 22 nt, Human
uuagacaguucccgacacuuga

SEQ ID NO: 506198 - RNA, 23 nt, Human
uuccuggucugcaguccgcagcu

SEQ ID NO: 506199 - RNA, 24 nt, Human
uuucuuuuuaaacauagcuuguga

SEQ ID NO: 506200 - RNA, 24 nt, Human
uuuucugccauaucuaauaccuaa

SEQ ID NO: 506201 - RNA, 20 nt, Human
uuuuuuuuuuuuuuuuuaac

SEQ ID NO: 506202 - RNA, 19 nt, Human
aaagcccuuacaaggguuc

SEQ ID NO: 506203 - RNA, 18 nt, Human
aagccccaagccccagag

SEQ ID NO: 506204 - RNA, 21 nt, Human
aaggaacuucugagggcaguc

SEQ ID NO: 506205 - RNA, 20 nt, Human
aaggaagaggcugggcacag

SEQ ID NO: 506206 - RNA, 20 nt, Human
aagggagaauuagggaggag

SEQ ID NO: 506207 - RNA, 19 nt, Human
acuggagcagaaaggcaca

SEQ ID NO: 506208 - RNA, 20 nt, Human
agaagcacagaaagcuggcg

SEQ ID NO: 506209 - RNA, 22 nt, Human
agagggucuuugggugccugca

SEQ ID NO: 506210 - RNA, 19 nt, Human
agcugcuggccccacaccc

SEQ ID NO: 506211 - RNA, 22 nt, Human
aggcagaagcacagaaagcugg

SEQ ID NO: 506212 - RNA, 22 nt, Human
aggcugggcacagagggucuuu

SEQ ID NO: 506213 - RNA, 24 nt, Human
agguguaggaaauuuugagacugg

SEQ ID NO: 506214 - RNA, 19 nt, Human
auaauccuggcagcccggg

SEQ ID NO: 506215 - RNA, 24 nt, Human
auccugagaagccccaagccccag

SEQ ID NO: 506216 - RNA, 21 nt, Human
auccuggcagcccggggucug

SEQ ID NO: 506217 - RNA, 20 nt, Human
caaacuggugucugcccccc

SEQ ID NO: 506218 - RNA, 21 nt, Human
caaggaagaggcugggcacag

SEQ ID NO: 506219 - RNA, 23 nt, Human
cacaaccucaaaggccuuguggg

SEQ ID NO: 506220 - RNA, 22 nt, Human
cacccuggacaaggaacuucug

SEQ ID NO: 506221 - RNA, 22 nt, Human
cacugugggugcccacccugga

SEQ ID NO: 506222 - RNA, 22 nt, Human
cagaaagcuggcguugaaacca

SEQ ID NO: 506223 - RNA, 26 nt, Human
cagcaggucuccugccuagcccuguc

SEQ ID NO: 506224 - RNA, 25 nt, Human
ccaagccccagagccagaguuucuc

SEQ ID NO: 506225 - RNA, 26 nt, Human
ccagauauaccagccacagucacaac

SEQ ID NO: 506226 - RNA, 18 nt, Human
ccaguccccaccagcugc

SEQ ID NO: 506227 - RNA, 25 nt, Human
cccaaugaggagcagcaggguaccc

SEQ ID NO: 506228 - RNA, 18 nt, Human
ccccccaagagauccccc

SEQ ID NO: 506229 - RNA, 19 nt, Human
ccccccaagagaucccccc

SEQ ID NO: 506230 - RNA, 18 nt, Human
ccugcuuccguuuuccuu

SEQ ID NO: 506231 - RNA, 25 nt, Human
ccuggagcuaccaggcaagaacccu

SEQ ID NO: 506232 - RNA, 23 nt, Human
cgagaacucaaggaagaggcugg

SEQ ID NO: 506233 - RNA, 19 nt, Human
cucacucuaguccugaggc

SEQ ID NO: 506234 - RNA, 19 nt, Human
cugagaagccccaagcccc

SEQ ID NO: 506235 - RNA, 23 nt, Human
cuggguccuggagcuaccaggca

SEQ ID NO: 506236 - RNA, 21 nt, Human
cuuuagaucagauguguugcu

SEQ ID NO: 506237 - RNA, 20 nt, Human
gaaaccaguccccaccagcu

SEQ ID NO: 506238 - RNA, 20 nt, Human
gagccagucuuuagaucaga

SEQ ID NO: 506239 - RNA, 18 nt, Human
gcacagagggucuuuggg

SEQ ID NO: 506240 - RNA, 23 nt, Human
gcagcccggggucuggagccagu

SEQ ID NO: 506241 - RNA, 19 nt, Human
gccacagggucccuggcuc

SEQ ID NO: 506242 - RNA, 21 nt, Human
gccccuggcugguaccaucuc

SEQ ID NO: 506243 - RNA, 21 nt, Human
ggaagaggcugggcacagagg

SEQ ID NO: 506244 - RNA, 20 nt, Human
ggcagcccggggucuggagc

SEQ ID NO: 506245 - RNA, 19 nt, Human
ggucaugcuugccccuggc

SEQ ID NO: 506246 - RNA, 18 nt, Human
ggugccugcagagcuggg

SEQ ID NO: 506247 - RNA, 26 nt, Human
gucuuugggugccugcagagcuggcc

SEQ ID NO: 506248 - RNA, 18 nt, Human
uaccagccacagucacaa

SEQ ID NO: 506249 - RNA, 24 nt, Human
uaccagccacagucacaaccucaa

SEQ ID NO: 506250 - RNA, 23 nt, Human
uccccaccagcugcuggccccac

SEQ ID NO: 506251 - RNA, 20 nt, Human
uccuggcagcccggggucug

SEQ ID NO: 506252 - RNA, 19 nt, Human
uccuuggaaaaauguaaag

SEQ ID NO: 506253 - RNA, 18 nt, Human
ugagaagccccaagcccc

SEQ ID NO: 506254 - RNA, 19 nt, Human
ugagacuggagcagaaagg

SEQ ID NO: 506255 - RNA, 23 nt, Human
ugcauaauccuggcagcccgggg

SEQ ID NO: 506256 - RNA, 20 nt, Human
ugccugcagagcuggguccu

SEQ ID NO: 506257 - RNA, 21 nt, Human
uggaaaaauguaaagaacugg

SEQ ID NO: 506258 - RNA, 18 nt, Human
uggcaaacuggugucugc

SEQ ID NO: 506259 - RNA, 19 nt, Human
uggcucuggucaugcuugc

SEQ ID NO: 506260 - RNA, 22 nt, Human
ugggggaucagagccacagggu

SEQ ID NO: 506261 - RNA, 23 nt, Human
ugggguggauaaaugggggauca

SEQ ID NO: 506262 - RNA, 19 nt, Human
ugggugccugcagagcugg

SEQ ID NO: 506263 - RNA, 21 nt, Human
uucauuggcaaacuggugucu

SEQ ID NO: 506264 - RNA, 23 nt, Human
uuguggggaaggaagggagaauu

SEQ ID NO: 506265 - RNA, 24 nt, Human
uuuauuaaaaagucagcuauuagg

SEQ ID NO: 506266 - RNA, 21 nt, Human
uuuuccuuuccuuggaaaaau

SEQ ID NO: 506267 - RNA, 20 nt, Human
aaagaccaaccaagcaacca

SEQ ID NO: 506268 - RNA, 19 nt, Human
aaauacucagaaaagacca

SEQ ID NO: 506269 - RNA, 21 nt, Human
aaccaaugugaaucaugagac

SEQ ID NO: 506270 - RNA, 19 nt, Human
aagaaaucaaggucacgaa

SEQ ID NO: 506271 - RNA, 19 nt, Human
aagcaaccaaagcauaaca

SEQ ID NO: 506272 - RNA, 24 nt, Human
aagcacccugucgagcggagacac

SEQ ID NO: 506273 - RNA, 25 nt, Human
aaugcagcaaauccagguggcaaca

SEQ ID NO: 506274 - RNA, 22 nt, Human
acccucugucuuuauuaaauuu

SEQ ID NO: 506275 - RNA, 22 nt, Human
agcagagcaaugcagcaaaucc

SEQ ID NO: 506276 - RNA, 18 nt, Human
agugucuccccccacccc

SEQ ID NO: 506277 - RNA, 22 nt, Human
auaaccaccagguaaaaaaugu

SEQ ID NO: 506278 - RNA, 25 nt, Human
augagugucuccccccacccccggu

SEQ ID NO: 506279 - RNA, 25 nt, Human
caacacuaaaauacucagaaaagac

SEQ ID NO: 506280 - RNA, 19 nt, Human
caaccaagcaaccaaagca

SEQ ID NO: 506281 - RNA, 25 nt, Human
caaccaagcaaccaaagcauaacau

SEQ ID NO: 506282 - RNA, 22 nt, Human
caagcaaccaaagcauaacauc

SEQ ID NO: 506283 - RNA, 24 nt, Human
cacuaaaauacucagaaaagacca

SEQ ID NO: 506284 - RNA, 28 nt, Human
cagcaaauccagguggcaacacuaaaau

SEQ ID NO: 506285 - RNA, 24 nt, Human
cagcucagcagagcaaugcagcaa

SEQ ID NO: 506286 - RNA, 22 nt, Human
ccacccacgagcagaggcccac

SEQ ID NO: 506287 - RNA, 23 nt, Human
cccccaaguccaugcucauaacc

SEQ ID NO: 506288 - RNA, 19 nt, Human
ccccccacccccgguuucc

SEQ ID NO: 506289 - RNA, 20 nt, Human
cccgaugggcucugcccaag

SEQ ID NO: 506290 - RNA, 19 nt, Human
ccuccacgagaaccaccca

SEQ ID NO: 506291 - RNA, 18 nt, Human
cucagucacuguggcccc

SEQ ID NO: 506292 - RNA, 24 nt, Human
cuccccccacccccgguuuccgcu

SEQ ID NO: 506293 - RNA, 22 nt, Human
cuggugauggggccuagaaaug

SEQ ID NO: 506294 - RNA, 20 nt, Human
gaggcccacucgccccgggc

SEQ ID NO: 506295 - RNA, 26 nt, Human
gaggcugugucgggaaucaaacucag

SEQ ID NO: 506296 - RNA, 19 nt, Human
gcaaauccagguggcaaca

SEQ ID NO: 506297 - RNA, 24 nt, Human
ggagacacgcgggagcugaccucc

SEQ ID NO: 506298 - RNA, 23 nt, Human
uaaaauacucagaaaagaccaac

SEQ ID NO: 506299 - RNA, 23 nt, Human
uaacaucagcaauagcacaacca

SEQ ID NO: 506300 - RNA, 21 nt, Human
uaagcguuuuacaaauauuaa

SEQ ID NO: 506301 - RNA, 21 nt, Human
uaauaagcuuacccaaaacua

SEQ ID NO: 506302 - RNA, 22 nt, Human
uauuuccuuuuacaggugaccc

SEQ ID NO: 506303 - RNA, 19 nt, Human
ucacuguggcccccaaguc

SEQ ID NO: 506304 - RNA, 21 nt, Human
ucagaaaagaccaaccaagca

SEQ ID NO: 506305 - RNA, 20 nt, Human
uccccccacccccgguuucc

SEQ ID NO: 506306 - RNA, 27 nt, Human
ugagugucuccccccacccccgguuuc

SEQ ID NO: 506307 - RNA, 23 nt, Human
uuaauaagcuuacccaaaacuac

SEQ ID NO: 506308 - RNA, 23 nt, Human
uuaauacucacaucaaucuuaua

SEQ ID NO: 506309 - RNA, 21 nt, Human
uuacccaaaacuacacagcaa

SEQ ID NO: 506310 - RNA, 24 nt, Human
aaacuuccaagcuacuugggaucc

SEQ ID NO: 506311 - RNA, 27 nt, Human
aaggagggagggagggagugaggaggg

SEQ ID NO: 506312 - RNA, 21 nt, Human
accacuccacacaaaggagca

SEQ ID NO: 506313 - RNA, 23 nt, Human
accuucaagcugugcaaaggcug

SEQ ID NO: 506314 - RNA, 22 nt, Human
acgugcgugugugugugugugu

SEQ ID NO: 506315 - RNA, 22 nt, Human
acgugcgugugugugugugugu

SEQ ID NO: 506316 - RNA, 22 nt, Human
acgugcgugugugugugugugu

SEQ ID NO: 506317 - RNA, 22 nt, Human
agaaaugugauucuccaagaaa

SEQ ID NO: 506318 - RNA, 19 nt, Human
agaaggagggagggaggga

SEQ ID NO: 506319 - RNA, 24 nt, Human
agagaaggagggagggagggagug

SEQ ID NO: 506320 - RNA, 25 nt, Human
agagagaaggagggagggagggagu

SEQ ID NO: 506321 - RNA, 21 nt, Human
agauggccuuuuugaauucua

SEQ ID NO: 506322 - RNA, 24 nt, Human
aggagggagggagggagugaggag

SEQ ID NO: 506323 - RNA, 25 nt, Human
aggagggagggagggagugaggagg

SEQ ID NO: 506324 - RNA, 19 nt, Human
agggagggagggagugagg

SEQ ID NO: 506325 - RNA, 25 nt, Human
agggagggagggagugaggagggag

SEQ ID NO: 506326 - RNA, 22 nt, Human
agugaggagggaggauggggag

SEQ ID NO: 506327 - RNA, 24 nt, Human
caaaggcuggaaaaggaggugagg

SEQ ID NO: 506328 - RNA, 18 nt, Human
caagcugugcaaaggcug

SEQ ID NO: 506329 - RNA, 19 nt, Human
cagaaccuucaagcugugc

SEQ ID NO: 506330 - RNA, 19 nt, Human
ccacaaagaccuaagggca

SEQ ID NO: 506331 - RNA, 21 nt, Human
ccacuccacacaaaggagcaa

SEQ ID NO: 506332 - RNA, 22 nt, Human
ccacugcaaaaggugacagaac

SEQ ID NO: 506333 - RNA, 18 nt, Human
cccacauauaauuuaaga

SEQ ID NO: 506334 - RNA, 22 nt, Human
cuccuacuaagcaauucccuuc

SEQ ID NO: 506335 - RNA, 26 nt, Human
cugacacaccacuccacacaaaggag

SEQ ID NO: 506336 - RNA, 19 nt, Human
cuucaagcugugcaaaggc

SEQ ID NO: 506337 - RNA, 21 nt, Human
cuuucuagauaaaaacccugg

SEQ ID NO: 506338 - RNA, 20 nt, Human
gaaggagggagggagggagu

SEQ ID NO: 506339 - RNA, 21 nt, Human
gaaggagggagggagggagug

SEQ ID NO: 506340 - RNA, 24 nt, Human
gagagagagagagagagagaagga

SEQ ID NO: 506341 - RNA, 19 nt, Human
gagcaaauuaugcugugca

SEQ ID NO: 506342 - RNA, 21 nt, Human
ggaggagauguucaagggcug

SEQ ID NO: 506343 - RNA, 20 nt, Human
ggagggagggagugaggagg

SEQ ID NO: 506344 - RNA, 25 nt, Human
ggagugaggagggaggauggggagc

SEQ ID NO: 506345 - RNA, 18 nt, Human
gggaaaagaaaaguggua

SEQ ID NO: 506346 - RNA, 18 nt, Human
guaacguagaaucuuggc

SEQ ID NO: 506347 - RNA, 22 nt, Human
gucuuguuugucuuuaaccugu

SEQ ID NO: 506348 - RNA, 22 nt, Human
gugaaagcaaaaagauggccuu

SEQ ID NO: 506349 - RNA, 33 nt, Human
guggacgugcguguguguguguguguguguggu

SEQ ID NO: 506350 - RNA, 21 nt, Human
guguggacgugcgugugugug

SEQ ID NO: 506351 - RNA, 21 nt, Human
gugugugugugugugugugug

SEQ ID NO: 506352 - RNA, 24 nt, Human
uaaccuguaaagaaaugugauucu

SEQ ID NO: 506353 - RNA, 24 nt, Human
uaacuucuuucuggaagucccaua

SEQ ID NO: 506354 - RNA, 25 nt, Human
uaagacucuucuagucucuuuggag

SEQ ID NO: 506355 - RNA, 23 nt, Human
uagauaaaaacccuggggucuug

SEQ ID NO: 506356 - RNA, 22 nt, Human
ucccuccuccucccacauauaa

SEQ ID NO: 506357 - RNA, 18 nt, Human
ucuccugggcacaaaaac

SEQ ID NO: 506358 - RNA, 23 nt, Human
ucuccugggcacaaaaacuucca

SEQ ID NO: 506359 - RNA, 22 nt, Human
ucuuuggaggagauguucaagg

SEQ ID NO: 506360 - RNA, 18 nt, Human
ugaaagcaaaaagauggc

SEQ ID NO: 506361 - RNA, 19 nt, Human
ugacacaccacuccacaca

SEQ ID NO: 506362 - RNA, 18 nt, Human
ugacagaaccuucaagcu

SEQ ID NO: 506363 - RNA, 21 nt, Human
ugaggagggaggauggggagc

SEQ ID NO: 506364 - RNA, 23 nt, Human
ugauguucuaucccuccuccucc

SEQ ID NO: 506365 - RNA, 28 nt, Human
uggaccacugcaaaaggugacagaaccu

SEQ ID NO: 506366 - RNA, 23 nt, Human
uggacgugcgugugugugugugu

SEQ ID NO: 506367 - RNA, 24 nt, Human
uggacgugcgugugugugugugug

SEQ ID NO: 506368 - RNA, 22 nt, Human
ugguaaauuuuauugaugugaa

SEQ ID NO: 506369 - RNA, 22 nt, Human
uggugacuuaaacagccacaaa

SEQ ID NO: 506370 - RNA, 21 nt, Human
ugugcaaaggcuggaaaagga

SEQ ID NO: 506371 - RNA, 21 nt, Human
ugugugugugugugugucugu

SEQ ID NO: 506372 - RNA, 22 nt, Human
ugugugugugugugugucugug

SEQ ID NO: 506373 - RNA, 18 nt, Human
ugugugugugugugugug

SEQ ID NO: 506374 - RNA, 18 nt, Human
ugugugugugugugugug

SEQ ID NO: 506375 - RNA, 18 nt, Human
ugugugugugugugugug

SEQ ID NO: 506376 - RNA, 18 nt, Human
ugugugugugugugugug

SEQ ID NO: 506377 - RNA, 18 nt, Human
ugugugugugugugugug

SEQ ID NO: 506378 - RNA, 18 nt, Human
ugugugugugugugugug

SEQ ID NO: 506379 - RNA, 18 nt, Human
ugugugugugugugugug

SEQ ID NO: 506380 - RNA, 18 nt, Human
ugugugugugugugugug

SEQ ID NO: 506381 - RNA, 22 nt, Human
ugugugugugugugugugucug

SEQ ID NO: 506382 - RNA, 21 nt, Human
ugugugugugugugugugugu

SEQ ID NO: 506383 - RNA, 21 nt, Human
ugugugugugugugugugugu

SEQ ID NO: 506384 - RNA, 21 nt, Human
ugugugugugugugugugugu

SEQ ID NO: 506385 - RNA, 21 nt, Human
ugugugugugugugugugugu

SEQ ID NO: 506386 - RNA, 21 nt, Human
ugugugugugugugugugugu

SEQ ID NO: 506387 - RNA, 21 nt, Human
ugugugugugugugugugugu

SEQ ID NO: 506388 - RNA, 21 nt, Human
ugugugugugugugugugugu

SEQ ID NO: 506389 - RNA, 21 nt, Human
ugugugugugugugugugugu

SEQ ID NO: 506390 - RNA, 21 nt, Human
ugugugugugugugugugugu

SEQ ID NO: 506391 - RNA, 21 nt, Human
ugugugugugugugugugugu

SEQ ID NO: 506392 - RNA, 21 nt, Human
ugugugugugugugugugugu

SEQ ID NO: 506393 - RNA, 21 nt, Human
ugugugugugugugugugugu

SEQ ID NO: 506394 - RNA, 21 nt, Human
ugugugugugugugugugugu

SEQ ID NO: 506395 - RNA, 22 nt, Human
ugugugugugugugugugugug

SEQ ID NO: 506396 - RNA, 22 nt, Human
ugugugugugugugugugugug

SEQ ID NO: 506397 - RNA, 22 nt, Human
ugugugugugugugugugugug

SEQ ID NO: 506398 - RNA, 22 nt, Human
ugugugugugugugugugugug

SEQ ID NO: 506399 - RNA, 22 nt, Human
ugugugugugugugugugugug

SEQ ID NO: 506400 - RNA, 22 nt, Human
uguguguguguguguguguguu

SEQ ID NO: 506401 - RNA, 24 nt, Human
uguucuaucccuccuccucccaca

SEQ ID NO: 506402 - RNA, 27 nt, Human
uuaaacagccacaaagaccuaagggcc

SEQ ID NO: 506403 - RNA, 25 nt, Human
uuacauggauucaguuucugaugaa

SEQ ID NO: 506404 - RNA, 18 nt, Human
uucaagggcugacacacc

SEQ ID NO: 506405 - RNA, 20 nt, Human
uucacaguuauuuacucucc

SEQ ID NO: 506406 - RNA, 24 nt, Human
uuggaguuuuagggcacuguugac

SEQ ID NO: 506407 - RNA, 20 nt, Human
uuuggaggagauguucaagg

SEQ ID NO: 506408 - RNA, 19 nt, Human
aacaguaccuacauucagu

SEQ ID NO: 506409 - RNA, 23 nt, Human
accugguuucugccacuugccau

SEQ ID NO: 506410 - RNA, 23 nt, Human
agacaaaagauugaaaaccuuag

SEQ ID NO: 506411 - RNA, 18 nt, Human
aggaagggagaaaaaguc

SEQ ID NO: 506412 - RNA, 22 nt, Human
aggagucauacaaacuucgcca

SEQ ID NO: 506413 - RNA, 20 nt, Human
agucuuugaaguggcuacca

SEQ ID NO: 506414 - RNA, 28 nt, Human
agucuuugaaguggcuaccaggauccuu

SEQ ID NO: 506415 - RNA, 25 nt, Human
caaauagcuuacaauuucugcuaga

SEQ ID NO: 506416 - RNA, 18 nt, Human
cacaucaugccuguugcc

SEQ ID NO: 506417 - RNA, 25 nt, Human
cacucugggcaguugugaccggcua

SEQ ID NO: 506418 - RNA, 20 nt, Human
caguagucauguaggcagag

SEQ ID NO: 506419 - RNA, 19 nt, Human
cauguaaacuucucugugc

SEQ ID NO: 506420 - RNA, 26 nt, Human
cauuguugcucccucagucuuuuuua

SEQ ID NO: 506421 - RNA, 21 nt, Human
cauuucuuccucugaugucca

SEQ ID NO: 506422 - RNA, 19 nt, Human
ccccucuccuccuuucagc

SEQ ID NO: 506423 - RNA, 18 nt, Human
ccccuuuuccccucuccu

SEQ ID NO: 506424 - RNA, 20 nt, Human
ccgugccgccgucgcuuugu

SEQ ID NO: 506425 - RNA, 20 nt, Human
cuccccuuuuccccucuccu

SEQ ID NO: 506426 - RNA, 18 nt, Human
cuuccccuccccuuuucc

SEQ ID NO: 506427 - RNA, 18 nt, Human
cuuucagcugcuguuacu

SEQ ID NO: 506428 - RNA, 21 nt, Human
cuuuccacauuguugcucccu

SEQ ID NO: 506429 - RNA, 19 nt, Human
gccuaagcuuugaaaacuc

SEQ ID NO: 506430 - RNA, 24 nt, Human
gcugcacugcgaagcuguccaaug

SEQ ID NO: 506431 - RNA, 21 nt, Human
guugcucccucagucuuuuuc

SEQ ID NO: 506432 - RNA, 23 nt, Human
uaccaggauccuuugcagaucuc

SEQ ID NO: 506433 - RNA, 24 nt, Human
uagguggaggucguggcuuggccu

SEQ ID NO: 506434 - RNA, 19 nt, Human
uaucuuguuuaccuuaucu

SEQ ID NO: 506435 - RNA, 19 nt, Human
uaugaaauuaguguuccaa

SEQ ID NO: 506436 - RNA, 21 nt, Human
uccuuagaguaccugaauugc

SEQ ID NO: 506437 - RNA, 22 nt, Human
ucuacagugaaaauuguaaaaa

SEQ ID NO: 506438 - RNA, 18 nt, Human
ucuaugcugggugacucc

SEQ ID NO: 506439 - RNA, 20 nt, Human
ucuuccccuccccuuuuccc

SEQ ID NO: 506440 - RNA, 25 nt, Human
ucuuuuauuccuuugguaacuauua

SEQ ID NO: 506441 - RNA, 19 nt, Human
ugagaggaaaggguacuug

SEQ ID NO: 506442 - RNA, 19 nt, Human
ugauaggacugcggugcuc

SEQ ID NO: 506443 - RNA, 20 nt, Human
ugauugucugaggaagggag

SEQ ID NO: 506444 - RNA, 22 nt, Human
ugcaaagagaaugccaaagcag

SEQ ID NO: 506445 - RNA, 22 nt, Human
ugcucccucagucuuuuuuaca

SEQ ID NO: 506446 - RNA, 18 nt, Human
ugggaugucauucacuca

SEQ ID NO: 506447 - RNA, 20 nt, Human
uguaaacuucucugugcugc

SEQ ID NO: 506448 - RNA, 24 nt, Human
uguuccuauacagcuuccuuuccu

SEQ ID NO: 506449 - RNA, 19 nt, Human
uuacugcuguuaauuuacc

SEQ ID NO: 506450 - RNA, 18 nt, Human
uucagccgcuggccgggu

SEQ ID NO: 506451 - RNA, 18 nt, Human
uucgccauuucuuccucu

SEQ ID NO: 506452 - RNA, 21 nt, Human
uucugagcuacagcaaaccuu

SEQ ID NO: 506453 - RNA, 18 nt, Human
uuugaaguggcuaccagg

SEQ ID NO: 506454 - RNA, 24 nt, Human
uuuuuuuuuuuuggaaaggaagcu

SEQ ID NO: 506455 - RNA, 22 nt, Human
uuuuuuuuuuuuuuggaaagga

SEQ ID NO: 506456 - RNA, 18 nt, Human
uuuuuuuuuuuuuuuuug

SEQ ID NO: 506457 - RNA, 18 nt, Human
ccccuucugucgucuucu

SEQ ID NO: 506458 - RNA, 21 nt, Human
cuucucgcagccguagucgac

SEQ ID NO: 506459 - RNA, 23 nt, Human
uauuuugcauguuucaacuguuc

SEQ ID NO: 506460 - RNA, 22 nt, Human
ucugucgucuucucgcagccgu

SEQ ID NO: 506461 - RNA, 19 nt, Human
ugcauguuucaacuguucu

SEQ ID NO: 506462 - RNA, 18 nt, Human
uucaacuguucuucauug

SEQ ID NO: 506463 - RNA, 20 nt, Human
uuuagucacacaauuuuaau

SEQ ID NO: 506464 - RNA, 23 nt, Human
uuuuuuagucacacaauuuuaau

SEQ ID NO: 506465 - RNA, 26 nt, Human
aaaaaugagcaaaauuacaacauggc

SEQ ID NO: 506466 - RNA, 22 nt, Human
aaaauuacaacauggcgggcca

SEQ ID NO: 506467 - RNA, 18 nt, Human
aaaggaaaugagaugggg

SEQ ID NO: 506468 - RNA, 25 nt, Human
aacuccugaguucaagcaauuccuu

SEQ ID NO: 506469 - RNA, 19 nt, Human
aagaagccaagcaucaggu

SEQ ID NO: 506470 - RNA, 18 nt, Human
aagcaaggaggaggcagg

SEQ ID NO: 506471 - RNA, 25 nt, Human
aagccaagcaucagguaaaccagaa

SEQ ID NO: 506472 - RNA, 21 nt, Human
aaggacaccaauuauauugca

SEQ ID NO: 506473 - RNA, 18 nt, Human
aaggaggaggcaggccca

SEQ ID NO: 506474 - RNA, 23 nt, Human
aaggaggaggcaggcccacugca

SEQ ID NO: 506475 - RNA, 20 nt, Human
aagugccuuucuaaagaccc

SEQ ID NO: 506476 - RNA, 23 nt, Human
acagaagacagccacagcuccca

SEQ ID NO: 506477 - RNA, 24 nt, Human
acccagacuggagugcaguggcgu

SEQ ID NO: 506478 - RNA, 18 nt, Human
accccaucuccaaauaca

SEQ ID NO: 506479 - RNA, 19 nt, Human
accccgugaugaugaggau

SEQ ID NO: 506480 - RNA, 20 nt, Human
accucagccccuggaguagc

SEQ ID NO: 506481 - RNA, 22 nt, Human
acgggcuaaaggaaaugagaug

SEQ ID NO: 506482 - RNA, 25 nt, Human
acucagcaccccacugggugccccc

SEQ ID NO: 506483 - RNA, 24 nt, Human
acugaguuuugccauguugcccag

SEQ ID NO: 506484 - RNA, 19 nt, Human
acuggagugcaguggcgug

SEQ ID NO: 506485 - RNA, 24 nt, Human
agaggaaagcccauuuuauggaga

SEQ ID NO: 506486 - RNA, 21 nt, Human
aggaggaccuucugagauucu

SEQ ID NO: 506487 - RNA, 21 nt, Human
aggcgugagccaccacuccca

SEQ ID NO: 506488 - RNA, 23 nt, Human
agggauuauaggcgugagccacc

SEQ ID NO: 506489 - RNA, 24 nt, Human
agggauuauaggcgugagccacca

SEQ ID NO: 506490 - RNA, 18 nt, Human
aguagcugggaugccagg

SEQ ID NO: 506491 - RNA, 19 nt, Human
agugcaguggcgugaucuc

SEQ ID NO: 506492 - RNA, 21 nt, Human
agugcaguggcgugaucucag

SEQ ID NO: 506493 - RNA, 23 nt, Human
agugcaguggcgugaucucagcu

SEQ ID NO: 506494 - RNA, 24 nt, Human
agugcaguggcgugaucucagcuc

SEQ ID NO: 506495 - RNA, 24 nt, Human
aguggcgugaucucagcucacugc

SEQ ID NO: 506496 - RNA, 23 nt, Human
caaaauuacaacauggcgggcca

SEQ ID NO: 506497 - RNA, 24 nt, Human
caaagcgcagggauuauaggcgug

SEQ ID NO: 506498 - RNA, 28 nt, Human
caacuccugaguucaagcaauuccccuu

SEQ ID NO: 506499 - RNA, 24 nt, Human
cacccagacuggagugcaguggcg

SEQ ID NO: 506500 - RNA, 24 nt, Human
caccucagccccuggaguagcugg

SEQ ID NO: 506501 - RNA, 24 nt, Human
cacucccaccccagacucugagga

SEQ ID NO: 506502 - RNA, 21 nt, Human
cagagucuaagauugaggugu

SEQ ID NO: 506503 - RNA, 19 nt, Human
cagcaccccacugggugcc

SEQ ID NO: 506504 - RNA, 21 nt, Human
cagcaccccacugggugcccc

SEQ ID NO: 506505 - RNA, 21 nt, Human
cagccucgaccuucugggcuu

SEQ ID NO: 506506 - RNA, 24 nt, Human
cagccucgaccuucugggcuuaag

SEQ ID NO: 506507 - RNA, 22 nt, Human
cagccugugaagaaggcugccu

SEQ ID NO: 506508 - RNA, 19 nt, Human
cauguugcccaggcugguc

SEQ ID NO: 506509 - RNA, 24 nt, Human
cauguugcccaggcuggucuccaa

SEQ ID NO: 506510 - RNA, 20 nt, Human
ccaaagcgcagggauuauag

SEQ ID NO: 506511 - RNA, 22 nt, Human
ccaaagcgcagggauuauaggc

SEQ ID NO: 506512 - RNA, 22 nt, Human
ccaaagcgcagggauuauaggc

SEQ ID NO: 506513 - RNA, 24 nt, Human
ccaaagcgcagggauuauaggcgu

SEQ ID NO: 506514 - RNA, 27 nt, Human
ccaacuccugaguucaagcaauucuuu

SEQ ID NO: 506515 - RNA, 20 nt, Human
ccaggcuggucuccaacucc

SEQ ID NO: 506516 - RNA, 19 nt, Human
ccauguugcccaggcuggu

SEQ ID NO: 506517 - RNA, 22 nt, Human
ccauguugcccaggcuggucuc

SEQ ID NO: 506518 - RNA, 18 nt, Human
cccacuccugggccuuca

SEQ ID NO: 506519 - RNA, 23 nt, Human
cccacugggugcccccccucaga

SEQ ID NO: 506520 - RNA, 23 nt, Human
cccgggugcuggugcugagcugg

SEQ ID NO: 506521 - RNA, 23 nt, Human
ccgcugggcccagaccucccugg

SEQ ID NO: 506522 - RNA, 21 nt, Human
ccucagccccuggaguagcug

SEQ ID NO: 506523 - RNA, 22 nt, Human
ccuccacagaagacagccacag

SEQ ID NO: 506524 - RNA, 25 nt, Human
ccucccuggcggccacugcagguca

SEQ ID NO: 506525 - RNA, 18 nt, Human
ccucgaccuucugggcuu

SEQ ID NO: 506526 - RNA, 18 nt, Human
ccucggacugccaaagcg

SEQ ID NO: 506527 - RNA, 20 nt, Human
ccugaguucaagcaauuccc

SEQ ID NO: 506528 - RNA, 23 nt, Human
ccugaguucaagcaauuccccug

SEQ ID NO: 506529 - RNA, 20 nt, Human
ccugggccuucauguggucu

SEQ ID NO: 506530 - RNA, 19 nt, Human
ccuucugagauucugccca

SEQ ID NO: 506531 - RNA, 18 nt, Human
cgauggcuauucccccuc

SEQ ID NO: 506532 - RNA, 20 nt, Human
cuaauuuuuuguauuuuuug

SEQ ID NO: 506533 - RNA, 19 nt, Human
cucaaucacccuguuccca

SEQ ID NO: 506534 - RNA, 19 nt, Human
cucacugcagccucgaccu

SEQ ID NO: 506535 - RNA, 24 nt, Human
cucagccccuggaguagcugggau

SEQ ID NO: 506536 - RNA, 21 nt, Human
cuccaaauacagugauauucu

SEQ ID NO: 506537 - RNA, 24 nt, Human
cucucucugucacccagacuggag

SEQ ID NO: 506538 - RNA, 23 nt, Human
cucucugucacccagacuggagu

SEQ ID NO: 506539 - RNA, 23 nt, Human
cucugucacccagacuggagugc

SEQ ID NO: 506540 - RNA, 24 nt, Human
cugaauuccuugggcccaucucuc

SEQ ID NO: 506541 - RNA, 21 nt, Human
cugaccuucaccccgugauga

SEQ ID NO: 506542 - RNA, 22 nt, Human
cugcagccucgaccuucugggc

SEQ ID NO: 506543 - RNA, 24 nt, Human
cuggaguagcugggaugccaggug

SEQ ID NO: 506544 - RNA, 24 nt, Human
cuggagugcaguggcgugaucuca

SEQ ID NO: 506545 - RNA, 24 nt, Human
cuggcaacuuuuuuuuuuuuugga

SEQ ID NO: 506546 - RNA, 22 nt, Human
cugggcuuaagcaaugcuguca

SEQ ID NO: 506547 - RNA, 18 nt, Human
gagccuccuccacagaag

SEQ ID NO: 506548 - RNA, 22 nt, Human
gagccuccuccacagaagacag

SEQ ID NO: 506549 - RNA, 18 nt, Human
gaggaccuucugagauuc

SEQ ID NO: 506550 - RNA, 18 nt, Human
gaggaggcaggcccacug

SEQ ID NO: 506551 - RNA, 22 nt, Human
gaggaggcaggcccacugcagg

SEQ ID NO: 506552 - RNA, 18 nt, Human
gauuauaggcgugagcca

SEQ ID NO: 506553 - RNA, 21 nt, Human
gauuauaggcgugagccacca

SEQ ID NO: 506554 - RNA, 22 nt, Human
gauuauaggcgugagccaccac

SEQ ID NO: 506555 - RNA, 21 nt, Human
gcagugagguagagggagcau

SEQ ID NO: 506556 - RNA, 20 nt, Human
gccauguugcccaggcuggu

SEQ ID NO: 506557 - RNA, 18 nt, Human
gcuccuaaaagcaggagu

SEQ ID NO: 506558 - RNA, 21 nt, Human
gcugagcuggguccaaaaguc

SEQ ID NO: 506559 - RNA, 19 nt, Human
gcugcuucagaaggucuga

SEQ ID NO: 506560 - RNA, 22 nt, Human
ggauuauaggcgugagccacca

SEQ ID NO: 506561 - RNA, 19 nt, Human
ggcacacgggcuaaaggaa

SEQ ID NO: 506562 - RNA, 20 nt, Human
ggcuauucccccucccacuc

SEQ ID NO: 506563 - RNA, 18 nt, Human
ggcugguucugaaccccc

SEQ ID NO: 506564 - RNA, 18 nt, Human
gggauuauaggcgugagc

SEQ ID NO: 506565 - RNA, 23 nt, Human
gggauuauaggcgugagccacca

SEQ ID NO: 506566 - RNA, 22 nt, Human
ggggaggacucugucucucugg

SEQ ID NO: 506567 - RNA, 19 nt, Human
ggguagcccuaaaagaagc

SEQ ID NO: 506568 - RNA, 22 nt, Human
ggguagcccuaaaagaagccaa

SEQ ID NO: 506569 - RNA, 22 nt, Human
ggugucagcaggguugguuucc

SEQ ID NO: 506570 - RNA, 21 nt, Human
gguuaagacuucaacauagaa

SEQ ID NO: 506571 - RNA, 20 nt, Human
guacagacugaguuuugcca

SEQ ID NO: 506572 - RNA, 24 nt, Human
guuuugccauguugcccaggcugg

SEQ ID NO: 506573 - RNA, 18 nt, Human
uaaaaaugagcaaaauua

SEQ ID NO: 506574 - RNA, 20 nt, Human
uaaaaaugagcaaaauuacu

SEQ ID NO: 506575 - RNA, 23 nt, Human
uaaaagaagccaagcaucaggua

SEQ ID NO: 506576 - RNA, 26 nt, Human
uaaccuccccuucuuauaaggacacc

SEQ ID NO: 506577 - RNA, 20 nt, Human
uaagugccuuucuaaagacc

SEQ ID NO: 506578 - RNA, 25 nt, Human
uaauuuuuuguauuuuuuguacaga

SEQ ID NO: 506579 - RNA, 21 nt, Human
uauggagaauuaagagcuuug

SEQ ID NO: 506580 - RNA, 24 nt, Human
ucacugcagccucgaccuucuggg

SEQ ID NO: 506581 - RNA, 18 nt, Human
ucagccccuggaguagcu

SEQ ID NO: 506582 - RNA, 22 nt, Human
ucagccccuggaguagcuggga

SEQ ID NO: 506583 - RNA, 19 nt, Human
uccacacucccaccccaga

SEQ ID NO: 506584 - RNA, 18 nt, Human
uccacagaagacagccac

SEQ ID NO: 506585 - RNA, 21 nt, Human
uccacagaagacagccacagc

SEQ ID NO: 506586 - RNA, 18 nt, Human
ucccuggcggccacugca

SEQ ID NO: 506587 - RNA, 19 nt, Human
ucccuggcggccacugcag

SEQ ID NO: 506588 - RNA, 22 nt, Human
uccuaaguccacacucccaccc

SEQ ID NO: 506589 - RNA, 23 nt, Human
uccuaaguccacacucccacccc

SEQ ID NO: 506590 - RNA, 19 nt, Human
uccugaguucaagcaauuc

SEQ ID NO: 506591 - RNA, 24 nt, Human
uccugaguucaagcaauuccccug

SEQ ID NO: 506592 - RNA, 23 nt, Human
ucuccaacuccugaguucaagca

SEQ ID NO: 506593 - RNA, 24 nt, Human
ucucucucugucacccagacugga

SEQ ID NO: 506594 - RNA, 24 nt, Human
ucucucugucacccagacuggagu

SEQ ID NO: 506595 - RNA, 24 nt, Human
ucugucacccagacuggagugcag

SEQ ID NO: 506596 - RNA, 21 nt, Human
ugaggugucagcaggguuggu

SEQ ID NO: 506597 - RNA, 21 nt, Human
ugaguucaagcaauuccccug

SEQ ID NO: 506598 - RNA, 22 nt, Human
ugcaguggcgugaucucagcuc

SEQ ID NO: 506599 - RNA, 21 nt, Human
ugccaggugccuaccccuaca

SEQ ID NO: 506600 - RNA, 24 nt, Human
ugccauguugcccaggcuggucuc

SEQ ID NO: 506601 - RNA, 27 nt, Human
ugccauguugcccaggcuggucuccaa

SEQ ID NO: 506602 - RNA, 24 nt, Human
ugcccaggcuggucuccaacuccu

SEQ ID NO: 506603 - RNA, 27 nt, Human
ugcccaggcuggucuccaacuccugag

SEQ ID NO: 506604 - RNA, 18 nt, Human
ugcuggagccuccuccac

SEQ ID NO: 506605 - RNA, 19 nt, Human
uggagaauuaagagcuuug

SEQ ID NO: 506606 - RNA, 25 nt, Human
uggaguagcugggaugccaggugcc

SEQ ID NO: 506607 - RNA, 19 nt, Human
uggagugcaguggcgugau

SEQ ID NO: 506608 - RNA, 24 nt, Human
uggagugcaguggcgugaucucag

SEQ ID NO: 506609 - RNA, 25 nt, Human
uggccaggcugguucugaacccccu

SEQ ID NO: 506610 - RNA, 24 nt, Human
uggcgugaucucagcucacugcag

SEQ ID NO: 506611 - RNA, 22 nt, Human
ugggaaugcuggagccuccucc

SEQ ID NO: 506612 - RNA, 21 nt, Human
ugggaggucacaggauugguc

SEQ ID NO: 506613 - RNA, 21 nt, Human
ugggugcccccccucagaguu

SEQ ID NO: 506614 - RNA, 20 nt, Human
ugguucugaacccccucagc

SEQ ID NO: 506615 - RNA, 24 nt, Human
uguacagacugaguuuugccaugu

SEQ ID NO: 506616 - RNA, 23 nt, Human
uuauggagaauuaagagcuuugg

SEQ ID NO: 506617 - RNA, 21 nt, Human
uucaagcaauuccccugccuc

SEQ ID NO: 506618 - RNA, 26 nt, Human
uucaagcaauuccccugccucggacu

SEQ ID NO: 506619 - RNA, 18 nt, Human
uuccaugguucugggagg

SEQ ID NO: 506620 - RNA, 19 nt, Human
uuccucugaggcccccuua

SEQ ID NO: 506621 - RNA, 21 nt, Human
uuggucagccugacguccugg

SEQ ID NO: 506622 - RNA, 24 nt, Human
uuuauggagaauuaagagcuuugg

SEQ ID NO: 506623 - RNA, 23 nt, Human
uuuugccauguugcccaggcugg

SEQ ID NO: 506624 - RNA, 21 nt, Human
uuuuuguauuuuuuguacaga

SEQ ID NO: 506625 - RNA, 18 nt, Human
uuuuuuuuuuuuuuuuug

SEQ ID NO: 506626 - RNA, 22 nt, Human
uuuuuuuuuuuuuuuuuggcuu

SEQ ID NO: 506627 - RNA, 18 nt, Human
aagcccggcgccacccag

SEQ ID NO: 506628 - RNA, 22 nt, Human
aagcgcccccaccgcaggccga

SEQ ID NO: 506629 - RNA, 18 nt, Human
agagaagcagccccgucc

SEQ ID NO: 506630 - RNA, 18 nt, Human
agcagcuuccacuccagg

SEQ ID NO: 506631 - RNA, 22 nt, Human
agccccgucccacacccacccc

SEQ ID NO: 506632 - RNA, 21 nt, Human
agcuccucccacuccgccucc

SEQ ID NO: 506633 - RNA, 21 nt, Human
aggcguccacaggcgcgacga

SEQ ID NO: 506634 - RNA, 20 nt, Human
aucccacccuccccguccca

SEQ ID NO: 506635 - RNA, 18 nt, Human
cacccgggcgaugggagg

SEQ ID NO: 506636 - RNA, 20 nt, Human
cagcagggcaccccacaccc

SEQ ID NO: 506637 - RNA, 24 nt, Human
cagggcaccccacacccgggggac

SEQ ID NO: 506638 - RNA, 22 nt, Human
caucccacccuccccgucccac

SEQ ID NO: 506639 - RNA, 23 nt, Human
ccaagcccggcgccacccagcag

SEQ ID NO: 506640 - RNA, 22 nt, Human
ccacacccaccccugccugcga

SEQ ID NO: 506641 - RNA, 28 nt, Human
cccaccaagcccggcgccacccagcagc

SEQ ID NO: 506642 - RNA, 18 nt, Human
cccacccuccccguccca

SEQ ID NO: 506643 - RNA, 23 nt, Human
cccccaccgcaggccgagcuccg

SEQ ID NO: 506644 - RNA, 18 nt, Human
cccgcaaacccuccuccg

SEQ ID NO: 506645 - RNA, 23 nt, Human
ccgccuuccagcagcuuccacuc

SEQ ID NO: 506646 - RNA, 19 nt, Human
ccggcuguccuggggccug

SEQ ID NO: 506647 - RNA, 30 nt, Human
ccuccccgucccacgaccuccuccugggcc

SEQ ID NO: 506648 - RNA, 22 nt, Human
ccuccuccugggcuaauggcag

SEQ ID NO: 506649 - RNA, 20 nt, Human
ccuggcuccagcuccuccca

SEQ ID NO: 506650 - RNA, 23 nt, Human
cgccucugcgccucggugggucc

SEQ ID NO: 506651 - RNA, 21 nt, Human
cggcgagaagggcacacagug

SEQ ID NO: 506652 - RNA, 24 nt, Human
cgucccacacccaccccugccugc

SEQ ID NO: 506653 - RNA, 22 nt, Human
cuccagggaaagugcagucacc

SEQ ID NO: 506654 - RNA, 27 nt, Human
cugcagagggccgcucuuuccucccag

SEQ ID NO: 506655 - RNA, 22 nt, Human
gaacuuacgggccuggcuccag

SEQ ID NO: 506656 - RNA, 23 nt, Human
gaagcgcccccaccgcaggccga

SEQ ID NO: 506657 - RNA, 25 nt, Human
gaggcuguguagagaagcagccccg

SEQ ID NO: 506658 - RNA, 18 nt, Human
gauggggcucgcggagga

SEQ ID NO: 506659 - RNA, 18 nt, Human
gcaacuacccgcaaaccc

SEQ ID NO: 506660 - RNA, 22 nt, Human
gcagcaacaggcagcaccccgc

SEQ ID NO: 506661 - RNA, 18 nt, Human
gccuaggcguccacaggc

SEQ ID NO: 506662 - RNA, 25 nt, Human
gcugcauucgggccgccucugcgcc

SEQ ID NO: 506663 - RNA, 21 nt, Human
gcuguguagagaagcagcccc

SEQ ID NO: 506664 - RNA, 22 nt, Human
ggccuggcuccagcuccuccca

SEQ ID NO: 506665 - RNA, 21 nt, Human
gggcgaugggaggcgcagcgu

SEQ ID NO: 506666 - RNA, 18 nt, Human
gggcuaauggcagcaaca

SEQ ID NO: 506667 - RNA, 20 nt, Human
gggugaaggugaaggccagc

SEQ ID NO: 506668 - RNA, 19 nt, Human
ggugaaggccagcguagag

SEQ ID NO: 506669 - RNA, 24 nt, Human
guagagaagcagccccgucccaca

SEQ ID NO: 506670 - RNA, 23 nt, Human
guccgccuuccagcagcuuccac

SEQ ID NO: 506671 - RNA, 24 nt, Human
guggcgcugggcaaggacaggcac

SEQ ID NO: 506672 - RNA, 19 nt, Human
uagagaagcagccccgucc

SEQ ID NO: 506673 - RNA, 22 nt, Human
uauuuuauuucucuuggcugca

SEQ ID NO: 506674 - RNA, 18 nt, Human
uccacaggaagcgccccc

SEQ ID NO: 506675 - RNA, 22 nt, Human
ucccacccuccccgucccacga

SEQ ID NO: 506676 - RNA, 20 nt, Human
ucccacgaccuccuccuggg

SEQ ID NO: 506677 - RNA, 20 nt, Human
ucccacuccgccuccagccu

SEQ ID NO: 506678 - RNA, 21 nt, Human
ucccagggucaccgacgaugc

SEQ ID NO: 506679 - RNA, 19 nt, Human
uccgccuuccagcagcuuc

SEQ ID NO: 506680 - RNA, 23 nt, Human
ucucuuggcugcagagggccgcu

SEQ ID NO: 506681 - RNA, 19 nt, Human
ugccuaggcguccacaggc

SEQ ID NO: 506682 - RNA, 19 nt, Human
uggagggucccagggucac

SEQ ID NO: 506683 - RNA, 23 nt, Human
ugggaggcgcagcguccacagga

SEQ ID NO: 506684 - RNA, 20 nt, Human
uuggcugcagagggccgcuc

SEQ ID NO: 506685 - RNA, 21 nt, Human
aaaagaagaaaaauuguacaa

SEQ ID NO: 506686 - RNA, 21 nt, Human
aaacucuuaacguuuacugua

SEQ ID NO: 506687 - RNA, 19 nt, Human
accuauacugaauuacucc

SEQ ID NO: 506688 - RNA, 20 nt, Human
acggaacugggcaguggaca

SEQ ID NO: 506689 - RNA, 21 nt, Human
acugaauuacuccaaaaauaa

SEQ ID NO: 506690 - RNA, 23 nt, Human
agaaaagaagaaaaauuguacaa

SEQ ID NO: 506691 - RNA, 23 nt, Human
auuacacugaauacuuucuaacc

SEQ ID NO: 506692 - RNA, 20 nt, Human
caauauuacacugaauacuu

SEQ ID NO: 506693 - RNA, 23 nt, Human
ccuauacugaauuacuccaaaaa

SEQ ID NO: 506694 - RNA, 23 nt, Human
ccugugcacuagcagguuacuga

SEQ ID NO: 506695 - RNA, 24 nt, Human
cucgcucugucauccacacuggag

SEQ ID NO: 506696 - RNA, 22 nt, Human
cugaauuauucuuaucucaaug

SEQ ID NO: 506697 - RNA, 25 nt, Human
gcaggccaaaggggcuucucccucc

SEQ ID NO: 506698 - RNA, 21 nt, Human
uaaaguacagccugugcacua

SEQ ID NO: 506699 - RNA, 21 nt, Human
uacaaucuuaacuguuuaaaa

SEQ ID NO: 506700 - RNA, 24 nt, Human
ucucgcucugucauccacacugga

SEQ ID NO: 506701 - RNA, 22 nt, Human
ugaggcagggucucgcucuguc

SEQ ID NO: 506702 - RNA, 18 nt, Human
ugaugcaugucugaaguu

SEQ ID NO: 506703 - RNA, 21 nt, Human
ugcacuagcagguuacugaaa

SEQ ID NO: 506704 - RNA, 24 nt, Human
uggcuuucuuuuuuuuuuuuuuuu

SEQ ID NO: 506705 - RNA, 19 nt, Human
uuaaacgaaccuauacuga

SEQ ID NO: 506706 - RNA, 20 nt, Human
uuuuuuuugaggcagggucu

SEQ ID NO: 506707 - RNA, 23 nt, Human
uuuuuuuuuuuugaggcaggguc

SEQ ID NO: 506708 - RNA, 25 nt, Human
uuuuuuuuuuuugaggcagggucuc

SEQ ID NO: 506709 - RNA, 18 nt, Human
uuuuuuuuuuuuuuuuug

SEQ ID NO: 506710 - RNA, 27 nt, Human
uuuuuuuuuuuuuuuuugaggcagggg

SEQ ID NO: 506711 - RNA, 20 nt, Human
aaaaaaaaauccccuaucug

SEQ ID NO: 506712 - RNA, 20 nt, Human
aaaaaaaaauccccuaucug

SEQ ID NO: 506713 - RNA, 23 nt, Human
aaaaauccccuaucugcccaguc

SEQ ID NO: 506714 - RNA, 23 nt, Human
aaaaauccccuaucugcccaguc

SEQ ID NO: 506715 - RNA, 23 nt, Human
aaaacagagauuaaagaaucaau

SEQ ID NO: 506716 - RNA, 19 nt, Human
aaaacugagaaacaagaaa

SEQ ID NO: 506717 - RNA, 19 nt, Human
aaaacugagaaacaagaaa

SEQ ID NO: 506718 - RNA, 19 nt, Human
aaaauccccuaucugcccu

SEQ ID NO: 506719 - RNA, 19 nt, Human
aaaauccccuaucugcccu

SEQ ID NO: 506720 - RNA, 25 nt, Human
aaacauuaaaauugcaccacagaau

SEQ ID NO: 506721 - RNA, 25 nt, Human
aaacauuaaaauugcaccacagaau

SEQ ID NO: 506722 - RNA, 18 nt, Human
aaauacaaccaaaaaccc

SEQ ID NO: 506723 - RNA, 18 nt, Human
aaauacaaccaaaaaccc

SEQ ID NO: 506724 - RNA, 18 nt, Human
aaauacaaccaaaaaccc

SEQ ID NO: 506725 - RNA, 20 nt, Human
aaauacaaccaaaaacccug

SEQ ID NO: 506726 - RNA, 20 nt, Human
aaauacaaccaaaaacccug

SEQ ID NO: 506727 - RNA, 20 nt, Human
aaauacaaccaaaaacccug

SEQ ID NO: 506728 - RNA, 21 nt, Human
aacaacacuguugucagccac

SEQ ID NO: 506729 - RNA, 21 nt, Human
aacaacacuguugucagccac

SEQ ID NO: 506730 - RNA, 26 nt, Human
aacacuguugucagccacuguucacg

SEQ ID NO: 506731 - RNA, 26 nt, Human
aacacuguugucagccacuguucacg

SEQ ID NO: 506732 - RNA, 26 nt, Human
aacacuguugucagccacuguucacg

SEQ ID NO: 506733 - RNA, 21 nt, Human
acaacauaaaaaagaagugau

SEQ ID NO: 506734 - RNA, 18 nt, Human
acagcuuuggaaaacagu

SEQ ID NO: 506735 - RNA, 21 nt, Human
accaaguccaaggcacgcguc

SEQ ID NO: 506736 - RNA, 21 nt, Human
accaaguccaaggcacgcguc

SEQ ID NO: 506737 - RNA, 19 nt, Human
accagugagguuuacagcu

SEQ ID NO: 506738 - RNA, 20 nt, Human
acgccgcggagugggcggac

SEQ ID NO: 506739 - RNA, 25 nt, Human
acgccgcggagugggcggacggcca

SEQ ID NO: 506740 - RNA, 21 nt, Human
agaacaacucaugugcagaca

SEQ ID NO: 506741 - RNA, 21 nt, Human
agaacaacucaugugcagaca

SEQ ID NO: 506742 - RNA, 19 nt, Human
agacgaaaccucugggucc

SEQ ID NO: 506743 - RNA, 19 nt, Human
agacgaaaccucugggucc

SEQ ID NO: 506744 - RNA, 19 nt, Human
agacgaaaccucugggucc

SEQ ID NO: 506745 - RNA, 24 nt, Human
agacgaaaccucuggguccaagca

SEQ ID NO: 506746 - RNA, 24 nt, Human
agacgaaaccucuggguccaagca

SEQ ID NO: 506747 - RNA, 24 nt, Human
agacgaaaccucuggguccaagca

SEQ ID NO: 506748 - RNA, 23 nt, Human
agagacgagggcaagaaagccag

SEQ ID NO: 506749 - RNA, 23 nt, Human
agagacgagggcaagaaagccag

SEQ ID NO: 506750 - RNA, 23 nt, Human
agagugaaaacagagauuaaaga

SEQ ID NO: 506751 - RNA, 18 nt, Human
agcgugugaaucggacau

SEQ ID NO: 506752 - RNA, 23 nt, Human
agggcagcaggaggcauccugga

SEQ ID NO: 506753 - RNA, 19 nt, Human
agggguggauguggcgugc

SEQ ID NO: 506754 - RNA, 19 nt, Human
agggguggauguggcgugc

SEQ ID NO: 506755 - RNA, 24 nt, Human
auagcagaaaacugagaaacaaga

SEQ ID NO: 506756 - RNA, 24 nt, Human
auagcagaaaacugagaaacaaga

SEQ ID NO: 506757 - RNA, 23 nt, Human
augaagcaggaguguguggccuu

SEQ ID NO: 506758 - RNA, 23 nt, Human
augaagcaggaguguguggccuu

SEQ ID NO: 506759 - RNA, 28 nt, Human
auuucauuaauuugaaauuuggggcagg

SEQ ID NO: 506760 - RNA, 28 nt, Human
auuucauuaauuugaaauuuggggcagg

SEQ ID NO: 506761 - RNA, 22 nt, Human
caacaacacuguugucagccac

SEQ ID NO: 506762 - RNA, 21 nt, Human
caacacugaaagcuuggacac

SEQ ID NO: 506763 - RNA, 21 nt, Human
caacacugaaagcuuggacac

SEQ ID NO: 506764 - RNA, 21 nt, Human
caacacugaaagcuuggacac

SEQ ID NO: 506765 - RNA, 21 nt, Human
caaccaaaaacccuggcagac

SEQ ID NO: 506766 - RNA, 21 nt, Human
caaccaaaaacccuggcagac

SEQ ID NO: 506767 - RNA, 22 nt, Human
cacauguagaauaccaagucca

SEQ ID NO: 506768 - RNA, 22 nt, Human
cacauguagaauaccaagucca

SEQ ID NO: 506769 - RNA, 22 nt, Human
cacuguugucagccacuguuca

SEQ ID NO: 506770 - RNA, 22 nt, Human
cacuguugucagccacuguuca

SEQ ID NO: 506771 - RNA, 22 nt, Human
cacuguugucagccacuguuca

SEQ ID NO: 506772 - RNA, 25 nt, Human
cagaaaacugagaaacaagaaaaca

SEQ ID NO: 506773 - RNA, 25 nt, Human
cagaaaacugagaaacaagaaaaca

SEQ ID NO: 506774 - RNA, 21 nt, Human
cagacagggguggauguggcg

SEQ ID NO: 506775 - RNA, 21 nt, Human
cagacagggguggauguggcg

SEQ ID NO: 506776 - RNA, 19 nt, Human
cagagccugagagugaaaa

SEQ ID NO: 506777 - RNA, 20 nt, Human
caggcucacaacaacacugu

SEQ ID NO: 506778 - RNA, 20 nt, Human
caggcucacaacaacacugu

SEQ ID NO: 506779 - RNA, 20 nt, Human
caggcucacaacaacacugu

SEQ ID NO: 506780 - RNA, 22 nt, Human
caucccgguuccagauuuccgc

SEQ ID NO: 506781 - RNA, 21 nt, Human
ccaacacugaaagcuuggaca

SEQ ID NO: 506782 - RNA, 21 nt, Human
ccaacacugaaagcuuggaca

SEQ ID NO: 506783 - RNA, 21 nt, Human
ccaacacugaaagcuuggaca

SEQ ID NO: 506784 - RNA, 23 nt, Human
ccaagcagacagccaggcucaca

SEQ ID NO: 506785 - RNA, 23 nt, Human
ccaagcagacagccaggcucaca

SEQ ID NO: 506786 - RNA, 23 nt, Human
ccaagcagacagccaggcucaca

SEQ ID NO: 506787 - RNA, 23 nt, Human
ccacaacauaaaaaagaagugau

SEQ ID NO: 506788 - RNA, 18 nt, Human
ccagugagguuuacagcu

SEQ ID NO: 506789 - RNA, 21 nt, Human
ccccgcccccucgcgggggcg

SEQ ID NO: 506790 - RNA, 19 nt, Human
cccgcccccucgcgggggc

SEQ ID NO: 506791 - RNA, 22 nt, Human
cccugaaauccuaaauacaacc

SEQ ID NO: 506792 - RNA, 21 nt, Human
ccuucgccuccgacucagugu

SEQ ID NO: 506793 - RNA, 22 nt, Human
cgagggcaagaaagccagucac

SEQ ID NO: 506794 - RNA, 22 nt, Human
cgagggcaagaaagccagucac

SEQ ID NO: 506795 - RNA, 23 nt, Human
cuagggucucgcagccauuuccc

SEQ ID NO: 506796 - RNA, 20 nt, Human
cuccggugcgccugcccucc

SEQ ID NO: 506797 - RNA, 21 nt, Human
cugauggugcagccggugucu

SEQ ID NO: 506798 - RNA, 22 nt, Human
cugcuucccgcugauggugcag

SEQ ID NO: 506799 - RNA, 21 nt, Human
cuggccguggacaauguggaa

SEQ ID NO: 506800 - RNA, 21 nt, Human
cuggccguggacaauguggaa

SEQ ID NO: 506801 - RNA, 25 nt, Human
gaaaacagugacaggaaguccugac

SEQ ID NO: 506802 - RNA, 21 nt, Human
gaaaacugagaaacaagaaaa

SEQ ID NO: 506803 - RNA, 18 nt, Human
gaguguguggccuucgaa

SEQ ID NO: 506804 - RNA, 18 nt, Human
gaguguguggccuucgaa

SEQ ID NO: 506805 - RNA, 22 nt, Human
gcaaagauucccacaacauaaa

SEQ ID NO: 506806 - RNA, 22 nt, Human
gcaaagauucccacaacauaaa

SEQ ID NO: 506807 - RNA, 23 nt, Human
gcagacagccaggcucacaacaa

SEQ ID NO: 506808 - RNA, 23 nt, Human
gcagacagccaggcucacaacaa

SEQ ID NO: 506809 - RNA, 23 nt, Human
gcagacagccaggcucacaacaa

SEQ ID NO: 506810 - RNA, 23 nt, Human
gcggacggccaccgagauggcgc

SEQ ID NO: 506811 - RNA, 22 nt, Human
gugcgccugcccucccgcuccc

SEQ ID NO: 506812 - RNA, 18 nt, Human
gugcguggucgccgcgag

SEQ ID NO: 506813 - RNA, 19 nt, Human
gugugaaucggacauggaa

SEQ ID NO: 506814 - RNA, 19 nt, Human
gugugaaucggacauggaa

SEQ ID NO: 506815 - RNA, 21 nt, Human
uaaauacaaccaaaaacccug

SEQ ID NO: 506816 - RNA, 21 nt, Human
uaaauacaaccaaaaacccug

SEQ ID NO: 506817 - RNA, 21 nt, Human
uaaauacaaccaaaaacccug

SEQ ID NO: 506818 - RNA, 20 nt, Human
uaaauguacaccugaaaauc

SEQ ID NO: 506819 - RNA, 20 nt, Human
uaaauguacaccugaaaauc

SEQ ID NO: 506820 - RNA, 20 nt, Human
uacagcgcuguugucagaac

SEQ ID NO: 506821 - RNA, 20 nt, Human
uacagcgcuguugucagaac

SEQ ID NO: 506822 - RNA, 20 nt, Human
uagcgugugaaucggacaug

SEQ ID NO: 506823 - RNA, 20 nt, Human
uaggugugaacucacuuacc

SEQ ID NO: 506824 - RNA, 20 nt, Human
uaggugugaacucacuuacc

SEQ ID NO: 506825 - RNA, 25 nt, Human
uauagcagaaaacugagaaacaaga

SEQ ID NO: 506826 - RNA, 25 nt, Human
uauagcagaaaacugagaaacaaga

SEQ ID NO: 506827 - RNA, 21 nt, Human
uccaacacugaaagcuuggac

SEQ ID NO: 506828 - RNA, 21 nt, Human
uccaacacugaaagcuuggac

SEQ ID NO: 506829 - RNA, 21 nt, Human
uccaacacugaaagcuuggac

SEQ ID NO: 506830 - RNA, 23 nt, Human
uccaagcagacagccaggcucac

SEQ ID NO: 506831 - RNA, 23 nt, Human
uccaagcagacagccaggcucac

SEQ ID NO: 506832 - RNA, 23 nt, Human
uccaagcagacagccaggcucac

SEQ ID NO: 506833 - RNA, 20 nt, Human
uccccgaacgccgcggagug

SEQ ID NO: 506834 - RNA, 27 nt, Human
uccccgaacgccgcggagugggcggac

SEQ ID NO: 506835 - RNA, 21 nt, Human
uccccuaucugcccagucaaa

SEQ ID NO: 506836 - RNA, 21 nt, Human
uccccuaucugcccagucaaa

SEQ ID NO: 506837 - RNA, 24 nt, Human
ucccugaaauccuaaauacaacca

SEQ ID NO: 506838 - RNA, 24 nt, Human
ucccugaaauccuaaauacaacca

SEQ ID NO: 506839 - RNA, 20 nt, Human
uccgcagcagccaucuugcc

SEQ ID NO: 506840 - RNA, 21 nt, Human
uccgcaggccgcaggccucua

SEQ ID NO: 506841 - RNA, 21 nt, Human
ucggacauggaaaaaaaaaaa

SEQ ID NO: 506842 - RNA, 21 nt, Human
ucggacauggaaaaaaaaaaa

SEQ ID NO: 506843 - RNA, 26 nt, Human
ugaaaaucagaugcaacacuaacuug

SEQ ID NO: 506844 - RNA, 26 nt, Human
ugaaaaucagaugcaacacuaacuug

SEQ ID NO: 506845 - RNA, 20 nt, Human
ugaagcaggaguguguggcc

SEQ ID NO: 506846 - RNA, 20 nt, Human
ugaagcaggaguguguggcc

SEQ ID NO: 506847 - RNA, 19 nt, Human
ugaauugaaaauaguuuua

SEQ ID NO: 506848 - RNA, 19 nt, Human
ugaauugaaaauaguuuua

SEQ ID NO: 506849 - RNA, 18 nt, Human
ugacaggaaguccugaca

SEQ ID NO: 506850 - RNA, 18 nt, Human
ugagaaacaagaaaacau

SEQ ID NO: 506851 - RNA, 21 nt, Human
ugagaaacaagaaaacauuaa

SEQ ID NO: 506852 - RNA, 21 nt, Human
ugagaaacaagaaaacauuaa

SEQ ID NO: 506853 - RNA, 18 nt, Human
ugccagagggccgacgcc

SEQ ID NO: 506854 - RNA, 21 nt, Human
uggaaaaacugaagcguauac

SEQ ID NO: 506855 - RNA, 21 nt, Human
uggaaaaacugaagcguauac

SEQ ID NO: 506856 - RNA, 19 nt, Human
uggaaaacagugacaggaa

SEQ ID NO: 506857 - RNA, 19 nt, Human
uggacaauguggaaaaacu

SEQ ID NO: 506858 - RNA, 19 nt, Human
uggacaauguggaaaaacu

SEQ ID NO: 506859 - RNA, 22 nt, Human
uggacacuuuucccugaaaucc

SEQ ID NO: 506860 - RNA, 21 nt, Human
uggauguggcgugccgggcag

SEQ ID NO: 506861 - RNA, 21 nt, Human
uggauguggcgugccgggcag

SEQ ID NO: 506862 - RNA, 22 nt, Human
uggccguggacaauguggaaaa

SEQ ID NO: 506863 - RNA, 22 nt, Human
uggccguggacaauguggaaaa

SEQ ID NO: 506864 - RNA, 18 nt, Human
uguggguguguagcgugu

SEQ ID NO: 506865 - RNA, 18 nt, Human
uguggguguguagcgugu

SEQ ID NO: 506866 - RNA, 23 nt, Human
uuggacacuuuucccugaaaucc

SEQ ID NO: 506867 - RNA, 23 nt, Human
uuggacacuuuucccugaaaucc

SEQ ID NO: 506868 - RNA, 19 nt, Human
uuggucaucggcucgcgcu

SEQ ID NO: 506869 - RNA, 21 nt, Human
uuuacagcuuuggaaaacagu

SEQ ID NO: 506870 - RNA, 21 nt, Human
aaacacuuaaaaugcaaguuu

SEQ ID NO: 506871 - RNA, 27 nt, Human
aaaccaagggcgggcgaacccucggaa

SEQ ID NO: 506872 - RNA, 20 nt, Human
aaggaggaacagaggcagug

SEQ ID NO: 506873 - RNA, 23 nt, Human
aaugcaaagcucaauacugaaau

SEQ ID NO: 506874 - RNA, 18 nt, Human
aggcucaaggaggaacag

SEQ ID NO: 506875 - RNA, 20 nt, Human
cacuucugggucugcuggug

SEQ ID NO: 506876 - RNA, 24 nt, Human
cagacuaucaaaauuguuagcuuu

SEQ ID NO: 506877 - RNA, 21 nt, Human
gcgaacccucggagguagaac

SEQ ID NO: 506878 - RNA, 18 nt, Human
ggaggaacagaggcagug

SEQ ID NO: 506879 - RNA, 18 nt, Human
gucaaaggagccaaaggc

SEQ ID NO: 506880 - RNA, 22 nt, Human
uaaacacuuaaaaugcaaguuu

SEQ ID NO: 506881 - RNA, 21 nt, Human
uaaauaaacaucuaaugaaga

SEQ ID NO: 506882 - RNA, 21 nt, Human
uaagauaaaacuagagagucu

SEQ ID NO: 506883 - RNA, 19 nt, Human
uaauacaaguuauacagaa

SEQ ID NO: 506884 - RNA, 23 nt, Human
uauuugcuuuuaaacacuuaaaa

SEQ ID NO: 506885 - RNA, 23 nt, Human
ucaaaaccagcaacuucccauga

SEQ ID NO: 506886 - RNA, 24 nt, Human
ucaaaaccagcaacuucccaugaa

SEQ ID NO: 506887 - RNA, 24 nt, Human
ucaaaggagccaaaggcuaaggug

SEQ ID NO: 506888 - RNA, 20 nt, Human
ucccaugaaacuagauagcu

SEQ ID NO: 506889 - RNA, 22 nt, Human
ucuguaauaguggaaaacuuuu

SEQ ID NO: 506890 - RNA, 19 nt, Human
ugaaacuagauagcugaga

SEQ ID NO: 506891 - RNA, 19 nt, Human
ugaaagucaguauuugcuu

SEQ ID NO: 506892 - RNA, 20 nt, Human
ugagaggauccaacagauuu

SEQ ID NO: 506893 - RNA, 24 nt, Human
uguggggcuucgaguggucaaagg

SEQ ID NO: 506894 - RNA, 19 nt, Human
uguuucacccaccacuucu

SEQ ID NO: 506895 - RNA, 24 nt, Human
uuaagauaaaacuagagagucuaa

SEQ ID NO: 506896 - RNA, 25 nt, Human
uucuaaauaaacaucuaaugaagaa

SEQ ID NO: 506897 - RNA, 27 nt, Human
aaaccaagggcgggcgaacccucggaa

SEQ ID NO: 506898 - RNA, 27 nt, Human
aaaccaagggcgggcgaacccucggaa

SEQ ID NO: 506899 - RNA, 20 nt, Human
aaggaggaacagaggcagug

SEQ ID NO: 506900 - RNA, 20 nt, Human
aaggaggaacagaggcagug

SEQ ID NO: 506901 - RNA, 18 nt, Human
aggcucaaggaggaacag

SEQ ID NO: 506902 - RNA, 20 nt, Human
cacuucugggucugcuggug

SEQ ID NO: 506903 - RNA, 20 nt, Human
cacuucugggucugcuggug

SEQ ID NO: 506904 - RNA, 21 nt, Human
gcgaacccucggagguagaac

SEQ ID NO: 506905 - RNA, 21 nt, Human
gcgaacccucggagguagaac

SEQ ID NO: 506906 - RNA, 18 nt, Human
ggaggaacagaggcagug

SEQ ID NO: 506907 - RNA, 18 nt, Human
ggaggaacagaggcagug

SEQ ID NO: 506908 - RNA, 18 nt, Human
gucaaaggagccaaaggc

SEQ ID NO: 506909 - RNA, 18 nt, Human
gucaaaggagccaaaggc

SEQ ID NO: 506910 - RNA, 21 nt, Human
uaagauaaaacuagagagucu

SEQ ID NO: 506911 - RNA, 19 nt, Human
uaauacaaguuauacagaa

SEQ ID NO: 506912 - RNA, 23 nt, Human
ucaaaaccagcaacuucccauga

SEQ ID NO: 506913 - RNA, 24 nt, Human
ucaaaaccagcaacuucccaugaa

SEQ ID NO: 506914 - RNA, 24 nt, Human
ucaaaggagccaaaggcuaaggug

SEQ ID NO: 506915 - RNA, 24 nt, Human
ucaaaggagccaaaggcuaaggug

SEQ ID NO: 506916 - RNA, 20 nt, Human
ucccaugaaacuagauagcu

SEQ ID NO: 506917 - RNA, 22 nt, Human
ucuguaauaguggaaaacuuuu

SEQ ID NO: 506918 - RNA, 19 nt, Human
ugaaacuagauagcugaga

SEQ ID NO: 506919 - RNA, 20 nt, Human
ugagaggauccaacagauuu

SEQ ID NO: 506920 - RNA, 24 nt, Human
uguggggcuucgaguggucaaagg

SEQ ID NO: 506921 - RNA, 24 nt, Human
uguggggcuucgaguggucaaagg

SEQ ID NO: 506922 - RNA, 19 nt, Human
uguuucacccaccacuucu

SEQ ID NO: 506923 - RNA, 19 nt, Human
uguuucacccaccacuucu

SEQ ID NO: 506924 - RNA, 24 nt, Human
uuaagauaaaacuagagagucuaa

SEQ ID NO: 506925 - RNA, 21 nt, Human
aaaaaccucaguccagacgac

SEQ ID NO: 506926 - RNA, 24 nt, Human
aaaaaggaagaaaaagaaaccuga

SEQ ID NO: 506927 - RNA, 18 nt, Human
acagccgcuccaaaagcc

SEQ ID NO: 506928 - RNA, 24 nt, Human
acccgcuccgucgcccuccccaca

SEQ ID NO: 506929 - RNA, 19 nt, Human
agaaagaaauauuuaaaaa

SEQ ID NO: 506930 - RNA, 23 nt, Human
agacgacacccacagccgcucca

SEQ ID NO: 506931 - RNA, 23 nt, Human
aggaagaaaaagaaaccugaagu

SEQ ID NO: 506932 - RNA, 24 nt, Human
auaaaaguuuacaauauaccguaa

SEQ ID NO: 506933 - RNA, 21 nt, Human
caaaagccucgcgcccucccc

SEQ ID NO: 506934 - RNA, 19 nt, Human
cacccacagccgcuccaaa

SEQ ID NO: 506935 - RNA, 22 nt, Human
cacccacagccgcuccaaaagc

SEQ ID NO: 506936 - RNA, 21 nt, Human
cccacagccgcuccaaaagcc

SEQ ID NO: 506937 - RNA, 20 nt, Human
ccccacagccgcggcccgga

SEQ ID NO: 506938 - RNA, 20 nt, Human
ccccccgcccccccccccaa

SEQ ID NO: 506939 - RNA, 25 nt, Human
ccccccgcccccccccccaagguug

SEQ ID NO: 506940 - RNA, 18 nt, Human
cccccgcccccccccccc

SEQ ID NO: 506941 - RNA, 23 nt, Human
cccgcccccccccccaagguuga

SEQ ID NO: 506942 - RNA, 19 nt, Human
cccgcuccgucgcccuccc

SEQ ID NO: 506943 - RNA, 21 nt, Human
cccgcuccgucgcccucccca

SEQ ID NO: 506944 - RNA, 24 nt, Human
cccgcuccgucgcccuccccacag

SEQ ID NO: 506945 - RNA, 24 nt, Human
cgcccuccccacagccgcggcccg

SEQ ID NO: 506946 - RNA, 24 nt, Human
cuccaaaagccucgcgcccucccc

SEQ ID NO: 506947 - RNA, 21 nt, Human
cuccccccgccccccccccca

SEQ ID NO: 506948 - RNA, 24 nt, Human
cugaagacauuuuuuuuaaacccu

SEQ ID NO: 506949 - RNA, 20 nt, Human
gaagaaaaagaaaccugaag

SEQ ID NO: 506950 - RNA, 21 nt, Human
gacgcucggcgcucccgggcc

SEQ ID NO: 506951 - RNA, 22 nt, Human
gacgcucggcgcucccgggccu

SEQ ID NO: 506952 - RNA, 20 nt, Human
gagaaagaaauauuuaaaaa

SEQ ID NO: 506953 - RNA, 24 nt, Human
gagaaagaaauauuuaaaaaccuc

SEQ ID NO: 506954 - RNA, 18 nt, Human
gcccccccccccaagguu

SEQ ID NO: 506955 - RNA, 24 nt, Human
gcccuccccccgccccccccccca

SEQ ID NO: 506956 - RNA, 20 nt, Human
gccucgcgcccuccccccgc

SEQ ID NO: 506957 - RNA, 25 nt, Human
gccucgcgcccuccccccgcccccc

SEQ ID NO: 506958 - RNA, 21 nt, Human
gcggcggcggcggcgacgcuc

SEQ ID NO: 506959 - RNA, 21 nt, Human
gcggcggcggcggcgacgcuc

SEQ ID NO: 506960 - RNA, 20 nt, Human
gcuccgucgcccuccccaca

SEQ ID NO: 506961 - RNA, 21 nt, Human
gcuccgucgcccuccccacag

SEQ ID NO: 506962 - RNA, 18 nt, Human
ggcggcggcggcggcgac

SEQ ID NO: 506963 - RNA, 19 nt, Human
uaaaaaccucaguccagac

SEQ ID NO: 506964 - RNA, 24 nt, Human
uaacauaaaaguuuacaauauacc

SEQ ID NO: 506965 - RNA, 18 nt, Human
uacaauauaccguaaaac

SEQ ID NO: 506966 - RNA, 18 nt, Human
uccaaaaaaaaggaagaa

SEQ ID NO: 506967 - RNA, 20 nt, Human
uccaaaaaaaaggaagaaaa

SEQ ID NO: 506968 - RNA, 21 nt, Human
uccaaaagccucgcgcccucc

SEQ ID NO: 506969 - RNA, 21 nt, Human
uccagacgacacccacagccg

SEQ ID NO: 506970 - RNA, 18 nt, Human
ucccgggccuccucgcuc

SEQ ID NO: 506971 - RNA, 19 nt, Human
uccugggucugggccgugc

SEQ ID NO: 506972 - RNA, 21 nt, Human
ucgcgcccuccccccgccccc

SEQ ID NO: 506973 - RNA, 20 nt, Human
uggaauccugggucugggcc

SEQ ID NO: 506974 - RNA, 19 nt, Human
uugaauuaaagcugaagac

SEQ ID NO: 506975 - RNA, 25 nt, Human
aaaaaaacaaaacaaacacaagguu

SEQ ID NO: 506976 - RNA, 23 nt, Human
aaaaacaaaacaaacacaaaaac

SEQ ID NO: 506977 - RNA, 22 nt, Human
aaacaaaacaaacacaaaaaca

SEQ ID NO: 506978 - RNA, 23 nt, Human
aaacaaaacaaacacaaaaacaa

SEQ ID NO: 506979 - RNA, 24 nt, Human
aaacaaaacaaacacaaaaacaaa

SEQ ID NO: 506980 - RNA, 21 nt, Human
aaacaaacacaaaaacaaaac

SEQ ID NO: 506981 - RNA, 22 nt, Human
aaacaaacacaaaaacaaaaca

SEQ ID NO: 506982 - RNA, 23 nt, Human
aacacaaaaacaaaacaaguaaa

SEQ ID NO: 506983 - RNA, 28 nt, Human
aacacaaaaacaaaacaaguaaaucauc

SEQ ID NO: 506984 - RNA, 26 nt, Human
aacacaaaaacaaaacagcagggacu

SEQ ID NO: 506985 - RNA, 18 nt, Human
aacacggugaaacccugu

SEQ ID NO: 506986 - RNA, 19 nt, Human
aacacggugaaacccuguc

SEQ ID NO: 506987 - RNA, 18 nt, Human
aauacuaagacaaguaaa

SEQ ID NO: 506988 - RNA, 24 nt, Human
aauugcuugaaccugggaggcgga

SEQ ID NO: 506989 - RNA, 20 nt, Human
acaaaacaaacacaaaaacc

SEQ ID NO: 506990 - RNA, 19 nt, Human
acaagagugaaacuccauc

SEQ ID NO: 506991 - RNA, 20 nt, Human
acaagagugaaacuccaucu

SEQ ID NO: 506992 - RNA, 21 nt, Human
acaagagugaaacuccaucuc

SEQ ID NO: 506993 - RNA, 24 nt, Human
acccugucauuacuaaaaaugcaa

SEQ ID NO: 506994 - RNA, 22 nt, Human
agaauugcuugaaccugggagg

SEQ ID NO: 506995 - RNA, 23 nt, Human
agacaaguaaauugucggccagg

SEQ ID NO: 506996 - RNA, 22 nt, Human
agacagguggaucgccugaggu

SEQ ID NO: 506997 - RNA, 26 nt, Human
agacagguggaucgccugaggucagg

SEQ ID NO: 506998 - RNA, 24 nt, Human
agccuggccaacacggugaaaccc

SEQ ID NO: 506999 - RNA, 21 nt, Human
aggaguuggagaccagccugg

SEQ ID NO: 507000 - RNA, 24 nt, Human
aggcacaguggcucacgccuguaa

SEQ ID NO: 507001 - RNA, 22 nt, Human
aggcaggagaauugcuugaacc

SEQ ID NO: 507002 - RNA, 24 nt, Human
aggcaggagaauugcuugaaccug

SEQ ID NO: 507003 - RNA, 24 nt, Human
aggcggagguugcggugagccgag

SEQ ID NO: 507004 - RNA, 21 nt, Human
aggcugaggcaggagaauugc

SEQ ID NO: 507005 - RNA, 24 nt, Human
aggcugaggcaggagaauugcuug

SEQ ID NO: 507006 - RNA, 24 nt, Human
aguggcucacgccuguaaucccag

SEQ ID NO: 507007 - RNA, 21 nt, Human
auaauacuaagacaaguaaau

SEQ ID NO: 507008 - RNA, 23 nt, Human
aucacgccauugcacuccagucu

SEQ ID NO: 507009 - RNA, 22 nt, Human
aucccagcacuuuagaaggcca

SEQ ID NO: 507010 - RNA, 19 nt, Human
auuacuaaaaaugcaaaaa

SEQ ID NO: 507011 - RNA, 21 nt, Human
auugcacuccagucuagguga

SEQ ID NO: 507012 - RNA, 25 nt, Human
auugcacuccagucuaggugacaag

SEQ ID NO: 507013 - RNA, 27 nt, Human
caaaaaaacaaaacaaacacaaaaaca

SEQ ID NO: 507014 - RNA, 26 nt, Human
caaaacaaacacaaaaacaaaacaag

SEQ ID NO: 507015 - RNA, 24 nt, Human
caagacagguggaucgccugaggu

SEQ ID NO: 507016 - RNA, 26 nt, Human
caagacagguggaucgccugagguca

SEQ ID NO: 507017 - RNA, 24 nt, Human
caccuacuugggaggcugaggcag

SEQ ID NO: 507018 - RNA, 23 nt, Human
caccuguagucccaccuacuugg

SEQ ID NO: 507019 - RNA, 24 nt, Human
caccuguagucccaccuacuuggg

SEQ ID NO: 507020 - RNA, 23 nt, Human
cacgccuguaaucccagcacuuu

SEQ ID NO: 507021 - RNA, 24 nt, Human
cacuccagucuaggugacaagagu

SEQ ID NO: 507022 - RNA, 19 nt, Human
cauugcacuccagucuagg

SEQ ID NO: 507023 - RNA, 21 nt, Human
cauugcacuccagucuaggug

SEQ ID NO: 507024 - RNA, 23 nt, Human
cauugcacuccagucuaggugac

SEQ ID NO: 507025 - RNA, 24 nt, Human
cauugcacuccagucuaggugaca

SEQ ID NO: 507026 - RNA, 25 nt, Human
cauugcacuccagucuaggugacaa

SEQ ID NO: 507027 - RNA, 19 nt, Human
ccauugcacuccagucuag

SEQ ID NO: 507028 - RNA, 20 nt, Human
ccauugcacuccagucuagg

SEQ ID NO: 507029 - RNA, 21 nt, Human
ccauugcacuccagucuaggu

SEQ ID NO: 507030 - RNA, 24 nt, Human
ccauugcacuccagucuaggugac

SEQ ID NO: 507031 - RNA, 20 nt, Human
cccuacaccacagccagccc

SEQ ID NO: 507032 - RNA, 23 nt, Human
ccuacaccacagccagcccagga

SEQ ID NO: 507033 - RNA, 20 nt, Human
ccugaggucaggaguuggag

SEQ ID NO: 507034 - RNA, 22 nt, Human
ccuggccaacacggugaaaccc

SEQ ID NO: 507035 - RNA, 24 nt, Human
ccuggccaacacggugaaacccug

SEQ ID NO: 507036 - RNA, 18 nt, Human
cgccuguaaucccagcac

SEQ ID NO: 507037 - RNA, 22 nt, Human
cgccuguaaucccagcacuuua

SEQ ID NO: 507038 - RNA, 23 nt, Human
cucaaaaaaacaaaacaaacaca

SEQ ID NO: 507039 - RNA, 22 nt, Human
cucacgccuguaaucccagcac

SEQ ID NO: 507040 - RNA, 24 nt, Human
cucacgccuguaaucccagcacuu

SEQ ID NO: 507041 - RNA, 24 nt, Human
cuccaucucaaaaaaacaaaacaa

SEQ ID NO: 507042 - RNA, 24 nt, Human
cugaaacauacaaaagccuaaaga

SEQ ID NO: 507043 - RNA, 18 nt, Human
cuggccaacacggugaaa

SEQ ID NO: 507044 - RNA, 24 nt, Human
cuggccaacacggugaaacccugu

SEQ ID NO: 507045 - RNA, 23 nt, Human
gagaucacgccauugcacuccag

SEQ ID NO: 507046 - RNA, 22 nt, Human
gagguugcggugagccgagauc

SEQ ID NO: 507047 - RNA, 18 nt, Human
gaucgccugaggucagga

SEQ ID NO: 507048 - RNA, 23 nt, Human
gaucgccugaggucaggaguugg

SEQ ID NO: 507049 - RNA, 24 nt, Human
gaucgccugaggucaggaguugga

SEQ ID NO: 507050 - RNA, 21 nt, Human
gcaacgcccuacaccacagcc

SEQ ID NO: 507051 - RNA, 22 nt, Human
gccaacacggugaaacccuguc

SEQ ID NO: 507052 - RNA, 22 nt, Human
gcccaggaccgacugaucgcuc

SEQ ID NO: 507053 - RNA, 18 nt, Human
ggagguugcggugagccg

SEQ ID NO: 507054 - RNA, 20 nt, Human
ggagguugcggugagccgag

SEQ ID NO: 507055 - RNA, 22 nt, Human
ggagguugcggugagccgagau

SEQ ID NO: 507056 - RNA, 23 nt, Human
ggagguugcggugagccgagauc

SEQ ID NO: 507057 - RNA, 24 nt, Human
ggagguugcggugagccgagauca

SEQ ID NO: 507058 - RNA, 24 nt, Human
ggcaccuguagucccaccuacuug

SEQ ID NO: 507059 - RNA, 22 nt, Human
ggugugguggcgggcaccugua

SEQ ID NO: 507060 - RNA, 24 nt, Human
gucggccaggcacaguggcucacg

SEQ ID NO: 507061 - RNA, 21 nt, Human
gugaaacccugucauuacuaa

SEQ ID NO: 507062 - RNA, 21 nt, Human
guggaucgccugaggucagga

SEQ ID NO: 507063 - RNA, 19 nt, Human
guugcggugagccgagauc

SEQ ID NO: 507064 - RNA, 22 nt, Human
uaaaauucucuaauguaucuuc

SEQ ID NO: 507065 - RNA, 23 nt, Human
uaagacaaguaaauugucggcca

SEQ ID NO: 507066 - RNA, 21 nt, Human
uaagucuuuagucaaaaauuc

SEQ ID NO: 507067 - RNA, 20 nt, Human
ucaggaguuggagaccagcc

SEQ ID NO: 507068 - RNA, 26 nt, Human
uccaucucaaaaaaacaaaacaaaca

SEQ ID NO: 507069 - RNA, 23 nt, Human
ucucaaaaaaacaaaacaaacac

SEQ ID NO: 507070 - RNA, 23 nt, Human
ugaaccugggaggcggagguugc

SEQ ID NO: 507071 - RNA, 22 nt, Human
ugagccgagaucacgccauugc

SEQ ID NO: 507072 - RNA, 24 nt, Human
ugaggcaggagaauugcuugaacc

SEQ ID NO: 507073 - RNA, 25 nt, Human
ugaggcaggagaauugcuugaaccu

SEQ ID NO: 507074 - RNA, 22 nt, Human
ugcaacgcccuacaccacagcc

SEQ ID NO: 507075 - RNA, 25 nt, Human
ugcacuccagucuaggugacaagag

SEQ ID NO: 507076 - RNA, 21 nt, Human
ugcuugaaccugggaggcgga

SEQ ID NO: 507077 - RNA, 23 nt, Human
uggaucgccugaggucaggaguu

SEQ ID NO: 507078 - RNA, 27 nt, Human
uggaucgccugaggucaggaguuggag

SEQ ID NO: 507079 - RNA, 24 nt, Human
uggccaacacggugaaacccuguc

SEQ ID NO: 507080 - RNA, 22 nt, Human
uggcucacgccuguaaucccag

SEQ ID NO: 507081 - RNA, 24 nt, Human
uggcucacgccuguaaucccagca

SEQ ID NO: 507082 - RNA, 24 nt, Human
ugggaggcggagguugcggugagc

SEQ ID NO: 507083 - RNA, 19 nt, Human
ugggaggcugaggcaggag

SEQ ID NO: 507084 - RNA, 22 nt, Human
ugggaggcugaggcaggagaau

SEQ ID NO: 507085 - RNA, 24 nt, Human
ugguggcgggcaccuguaguccca

SEQ ID NO: 507086 - RNA, 18 nt, Human
uguagucccaccuacuug

SEQ ID NO: 507087 - RNA, 18 nt, Human
uuagccgggugugguggc

SEQ ID NO: 507088 - RNA, 24 nt, Human
uuagccgggugugguggcgggcac

SEQ ID NO: 507089 - RNA, 24 nt, Human
uugaaccugggaggcggagguugc

SEQ ID NO: 507090 - RNA, 20 nt, Human
uugcggugagccgagaucac

SEQ ID NO: 507091 - RNA, 24 nt, Human
uugcuugaaccugggaggcggagg

SEQ ID NO: 507092 - RNA, 23 nt, Human
uugggaggcugaggcaggagaau

SEQ ID NO: 507093 - RNA, 24 nt, Human
aaaaaaaaucgucaucaacagcca

SEQ ID NO: 507094 - RNA, 18 nt, Human
aaaaggagagccggcucc

SEQ ID NO: 507095 - RNA, 18 nt, Human
aaacaaaaugccuggagc

SEQ ID NO: 507096 - RNA, 20 nt, Human
aaagacacauucucugucuc

SEQ ID NO: 507097 - RNA, 19 nt, Human
aagcagaaacagagagguc

SEQ ID NO: 507098 - RNA, 22 nt, Human
aagcagaaacagagaggucacg

SEQ ID NO: 507099 - RNA, 18 nt, Human
aagcagaauccgcgcgcg

SEQ ID NO: 507100 - RNA, 23 nt, Human
aaguguuagaagguagcccagcu

SEQ ID NO: 507101 - RNA, 21 nt, Human
aaugcuggaggagaggaagag

SEQ ID NO: 507102 - RNA, 26 nt, Human
accacacuagaauguacacuccggca

SEQ ID NO: 507103 - RNA, 24 nt, Human
accaguccacgcacuggcucaggc

SEQ ID NO: 507104 - RNA, 23 nt, Human
agacaaaugccccagcuaucccc

SEQ ID NO: 507105 - RNA, 19 nt, Human
agagaaaggcucuggccuc

SEQ ID NO: 507106 - RNA, 21 nt, Human
agagcagccccagaaaagccc

SEQ ID NO: 507107 - RNA, 18 nt, Human
agaggcuguugugggcug

SEQ ID NO: 507108 - RNA, 19 nt, Human
agaggcuguugugggcugg

SEQ ID NO: 507109 - RNA, 21 nt, Human
agauggggcacuggcucuggg

SEQ ID NO: 507110 - RNA, 18 nt, Human
agccaccaguauacacca

SEQ ID NO: 507111 - RNA, 20 nt, Human
agccccagaaaagcccugac

SEQ ID NO: 507112 - RNA, 18 nt, Human
agcggcggcgcggcccgg

SEQ ID NO: 507113 - RNA, 30 nt, Human
agcuagacaaaugccccagcuauccccagg

SEQ ID NO: 507114 - RNA, 19 nt, Human
aggagcccuggccaacagu

SEQ ID NO: 507115 - RNA, 22 nt, Human
aggagcccuggccaacaguuuc

SEQ ID NO: 507116 - RNA, 24 nt, Human
aggcuggccaucuugggcuggggc

SEQ ID NO: 507117 - RNA, 24 nt, Human
agggcugauggcagagaaaggcuc

SEQ ID NO: 507118 - RNA, 21 nt, Human
aucacacuuccgaaaaacaca

SEQ ID NO: 507119 - RNA, 21 nt, Human
augucuggaugccaguggaga

SEQ ID NO: 507120 - RNA, 24 nt, Human
auucaaauucugggugacaauuuc

SEQ ID NO: 507121 - RNA, 27 nt, Human
caaagggucggcuccagccauggacac

SEQ ID NO: 507122 - RNA, 20 nt, Human
caaaugccccagcuaucccc

SEQ ID NO: 507123 - RNA, 23 nt, Human
caagagcagccccagaaaagccc

SEQ ID NO: 507124 - RNA, 27 nt, Human
caccagaaacaaaaugccuggagcuuc

SEQ ID NO: 507125 - RNA, 18 nt, Human
caccagcaagcagaaaca

SEQ ID NO: 507126 - RNA, 27 nt, Human
caccgcgccaccggcgccaucagggcu

SEQ ID NO: 507127 - RNA, 18 nt, Human
cacucagaggcccagcgg

SEQ ID NO: 507128 - RNA, 20 nt, Human
cacuuccgaaaaacacaagg

SEQ ID NO: 507129 - RNA, 19 nt, Human
cagaagacagugaggccac

SEQ ID NO: 507130 - RNA, 20 nt, Human
cagagucaccacucccacau

SEQ ID NO: 507131 - RNA, 24 nt, Human
cagcaccagcaagcagaaacagag

SEQ ID NO: 507132 - RNA, 24 nt, Human
cagccaccaguauacaccacacua

SEQ ID NO: 507133 - RNA, 23 nt, Human
cagcggggccacguccgccuccc

SEQ ID NO: 507134 - RNA, 23 nt, Human
cagcugcagccugggguuguggc

SEQ ID NO: 507135 - RNA, 22 nt, Human
caggagaauagcugguggacac

SEQ ID NO: 507136 - RNA, 19 nt, Human
caggccagccagcccuggg

SEQ ID NO: 507137 - RNA, 22 nt, Human
caggccagccagcccuggguac

SEQ ID NO: 507138 - RNA, 24 nt, Human
caggcuuacuucacuugaacaugg

SEQ ID NO: 507139 - RNA, 18 nt, Human
caguagcaccaagaccag

SEQ ID NO: 507140 - RNA, 21 nt, Human
caguauacaccacacuagaau

SEQ ID NO: 507141 - RNA, 24 nt, Human
caugcccaccgcgccaccggcgcc

SEQ ID NO: 507142 - RNA, 19 nt, Human
ccaccaguauacaccacac

SEQ ID NO: 507143 - RNA, 23 nt, Human
ccacgccugugggucccucuacc

SEQ ID NO: 507144 - RNA, 21 nt, Human
ccagaagacagugaggccacg

SEQ ID NO: 507145 - RNA, 18 nt, Human
ccagcuagacaaaugccc

SEQ ID NO: 507146 - RNA, 22 nt, Human
ccagcuauccccaggggaguua

SEQ ID NO: 507147 - RNA, 18 nt, Human
cccacagauguggaugac

SEQ ID NO: 507148 - RNA, 21 nt, Human
cccaccgcgccaccggcgcca

SEQ ID NO: 507149 - RNA, 18 nt, Human
ccccagaaaagcccugac

SEQ ID NO: 507150 - RNA, 21 nt, Human
ccgcgcgcggcggcggcagcg

SEQ ID NO: 507151 - RNA, 21 nt, Human
ccucccagcguggcucagcuc

SEQ ID NO: 507152 - RNA, 24 nt, Human
ccuccuggcagccacaggagcccu

SEQ ID NO: 507153 - RNA, 22 nt, Human
cgcuggggagugggggagugcu

SEQ ID NO: 507154 - RNA, 19 nt, Human
cgggcaggcccccaugcuu

SEQ ID NO: 507155 - RNA, 19 nt, Human
cggggagaggcaaauggca

SEQ ID NO: 507156 - RNA, 28 nt, Human
cuacagagaauuguguaaaaaaaaaaaa

SEQ ID NO: 507157 - RNA, 19 nt, Human
cucagcucggcucccucaa

SEQ ID NO: 507158 - RNA, 20 nt, Human
cucagcucggcucccucaac

SEQ ID NO: 507159 - RNA, 28 nt, Human
cugcagggggucugagucaagcccuccu

SEQ ID NO: 507160 - RNA, 20 nt, Human
gaagcaucacacuuccgaaa

SEQ ID NO: 507161 - RNA, 21 nt, Human
gaauuguguaaaaaaaaaaaa

SEQ ID NO: 507162 - RNA, 18 nt, Human
gacacagggggacagugg

SEQ ID NO: 507163 - RNA, 22 nt, Human
gacacauucucugucucugggu

SEQ ID NO: 507164 - RNA, 18 nt, Human
gagaaagagaggcuguug

SEQ ID NO: 507165 - RNA, 22 nt, Human
gagaaugcuggaggagaggaag

SEQ ID NO: 507166 - RNA, 18 nt, Human
gaggagaaagagaggcug

SEQ ID NO: 507167 - RNA, 21 nt, Human
gaggagaaugcuggaggagag

SEQ ID NO: 507168 - RNA, 23 nt, Human
gaggcuguugugggcugguucuu

SEQ ID NO: 507169 - RNA, 18 nt, Human
gagugcuuguauguggga

SEQ ID NO: 507170 - RNA, 24 nt, Human
gcacucagaggcccagcggggcca

SEQ ID NO: 507171 - RNA, 21 nt, Human
gcagggggucugagucaagcc

SEQ ID NO: 507172 - RNA, 18 nt, Human
gccccagaaaagcccuga

SEQ ID NO: 507173 - RNA, 25 nt, Human
gccccagaaaagcccugacaggaag

SEQ ID NO: 507174 - RNA, 18 nt, Human
gcccugacaggaagggug

SEQ ID NO: 507175 - RNA, 18 nt, Human
gcgcgcggcggcggcagc

SEQ ID NO: 507176 - RNA, 24 nt, Human
gcggcagcggcggcgcggcccggc

SEQ ID NO: 507177 - RNA, 21 nt, Human
gcggcggcggcagcggcggcg

SEQ ID NO: 507178 - RNA, 19 nt, Human
gcucugggggugucggcuc

SEQ ID NO: 507179 - RNA, 19 nt, Human
gcugauggcagagaaaggc

SEQ ID NO: 507180 - RNA, 19 nt, Human
gcuggccaucuugggcugg

SEQ ID NO: 507181 - RNA, 19 nt, Human
ggagugcuuguauguggga

SEQ ID NO: 507182 - RNA, 22 nt, Human
ggcagcggcggcgcggcccggc

SEQ ID NO: 507183 - RNA, 18 nt, Human
ggccgaggaaguuagagc

SEQ ID NO: 507184 - RNA, 21 nt, Human
ggcggcagcggcggcgcggcc

SEQ ID NO: 507185 - RNA, 18 nt, Human
ggcuggggcucccugggc

SEQ ID NO: 507186 - RNA, 21 nt, Human
gggaggcugcaguauguggag

SEQ ID NO: 507187 - RNA, 19 nt, Human
gggugucggcuccucuccc

SEQ ID NO: 507188 - RNA, 25 nt, Human
gucaucaacagccaccaguauacac

SEQ ID NO: 507189 - RNA, 19 nt, Human
gugagaacauucuuacccc

SEQ ID NO: 507190 - RNA, 21 nt, Human
gugggucccucuacccacggc

SEQ ID NO: 507191 - RNA, 24 nt, Human
guggucugagcuauggcaaaguga

SEQ ID NO: 507192 - RNA, 21 nt, Human
uacauggccacaagaggagcc

SEQ ID NO: 507193 - RNA, 23 nt, Human
uacccacggcccacccacagaug

SEQ ID NO: 507194 - RNA, 21 nt, Human
uacgggcaggcccccaugcug

SEQ ID NO: 507195 - RNA, 25 nt, Human
uagacaaaugccccagcuaucccca

SEQ ID NO: 507196 - RNA, 21 nt, Human
uauacaccacacuagaaugua

SEQ ID NO: 507197 - RNA, 26 nt, Human
uauacaccacacuagaauguacacuc

SEQ ID NO: 507198 - RNA, 27 nt, Human
ucagaggagaaugcuggaggagaggaa

SEQ ID NO: 507199 - RNA, 19 nt, Human
uccacgccugugggucccu

SEQ ID NO: 507200 - RNA, 22 nt, Human
ugaggauccugcaaacaacccc

SEQ ID NO: 507201 - RNA, 18 nt, Human
ugauggcagagaaaggcu

SEQ ID NO: 507202 - RNA, 27 nt, Human
ugauggcagagaaaggcucuccccgag

SEQ ID NO: 507203 - RNA, 20 nt, Human
ugcccgguccacgccugugg

SEQ ID NO: 507204 - RNA, 18 nt, Human
ugccuggagcuucugagc

SEQ ID NO: 507205 - RNA, 20 nt, Human
ugccuggagcuucugagcag

SEQ ID NO: 507206 - RNA, 19 nt, Human
ugcuggaggagaggaagag

SEQ ID NO: 507207 - RNA, 21 nt, Human
uggacacagggggacagugga

SEQ ID NO: 507208 - RNA, 19 nt, Human
uggaggagaggaagaggaa

SEQ ID NO: 507209 - RNA, 23 nt, Human
uggaugacccaaagcagaugucu

SEQ ID NO: 507210 - RNA, 24 nt, Human
uggcagccacaggagcccucucug

SEQ ID NO: 507211 - RNA, 23 nt, Human
uggcaggccagccagcccugggu

SEQ ID NO: 507212 - RNA, 19 nt, Human
ugggcagguaacaaggggg

SEQ ID NO: 507213 - RNA, 18 nt, Human
ugggcuugcaguggggag

SEQ ID NO: 507214 - RNA, 21 nt, Human
ugggcuugcaguggggagggu

SEQ ID NO: 507215 - RNA, 24 nt, Human
ugggcuugcaguggggagggucag

SEQ ID NO: 507216 - RNA, 23 nt, Human
uguaaaaaaaaaaaaaaaaucgu

SEQ ID NO: 507217 - RNA, 22 nt, Human
ugugagaacauucuuaccccua

SEQ ID NO: 507218 - RNA, 22 nt, Human
uguggaggagaaagagaggcug

SEQ ID NO: 507219 - RNA, 20 nt, Human
ugugggcugguucuuaagac

SEQ ID NO: 507220 - RNA, 20 nt, Human
uguguaaaaaaaaaaaaaaa

SEQ ID NO: 507221 - RNA, 23 nt, Human
uucugagaagcagaauccgcgcg

SEQ ID NO: 507222 - RNA, 18 nt, Human
uugcaguggggaggguca

SEQ ID NO: 507223 - RNA, 22 nt, Human
uuggcagucaaagagaagcauc

SEQ ID NO: 507224 - RNA, 23 nt, Human
uugggcuggggcucccugggcuu

SEQ ID NO: 507225 - RNA, 24 nt, Human
uuguguaaaaaaaaaaaaaaaauc

SEQ ID NO: 507226 - RNA, 20 nt, Human
aaacauuuucagcaaaauuc

SEQ ID NO: 507227 - RNA, 21 nt, Human
aaauagugaauuuuaaagcuu

SEQ ID NO: 507228 - RNA, 21 nt, Human
augaagcuaaagaaaagccag

SEQ ID NO: 507229 - RNA, 20 nt, Human
cauuuucagcaaaauucuag

SEQ ID NO: 507230 - RNA, 23 nt, Human
cuaaagaaaagccagaagacuaa

SEQ ID NO: 507231 - RNA, 21 nt, Human
cuucuuccuaaccuuucauug

SEQ ID NO: 507232 - RNA, 26 nt, Human
uaaacuagaagugauaaaauguucag

SEQ ID NO: 507233 - RNA, 21 nt, Human
uaucacaacaugcuuauuuga

SEQ ID NO: 507234 - RNA, 23 nt, Human
uccaaaauaaaagaguauuucau

SEQ ID NO: 507235 - RNA, 20 nt, Human
ugaagcuaaagaaaagccag

SEQ ID NO: 507236 - RNA, 23 nt, Human
ugagaauagcauuuuaaaacauu

SEQ ID NO: 507237 - RNA, 21 nt, Human
uggcuggaugagaauagcauu

SEQ ID NO: 507238 - RNA, 18 nt, Human
uucagcaaaauucuagaa

SEQ ID NO: 507239 - RNA, 23 nt, Human
uugauaguaaaauagugaauuuu

SEQ ID NO: 507240 - RNA, 21 nt, Human
uuuaaagcuucuuccuaaccu

SEQ ID NO: 507241 - RNA, 28 nt, Human
uuuuucaauugucacuagugaucuugau

SEQ ID NO: 507242 - RNA, 19 nt, Human
aagcggcaguagccgcgga

SEQ ID NO: 507243 - RNA, 19 nt, Human
acgccgaaacccagugacg

SEQ ID NO: 507244 - RNA, 23 nt, Human
agacagcugaaccgcuugccaga

SEQ ID NO: 507245 - RNA, 20 nt, Human
agacaggauucuuucaggua

SEQ ID NO: 507246 - RNA, 23 nt, Human
agacgccgaaacccagugacgcc

SEQ ID NO: 507247 - RNA, 19 nt, Human
agagucuuuaggucuucuc

SEQ ID NO: 507248 - RNA, 19 nt, Human
agggagcagacagcugaac

SEQ ID NO: 507249 - RNA, 18 nt, Human
aggucuucucucagccaa

SEQ ID NO: 507250 - RNA, 20 nt, Human
caaagggaauaaacauggug

SEQ ID NO: 507251 - RNA, 26 nt, Human
caaagggaauaaacauggugaaguca

SEQ ID NO: 507252 - RNA, 19 nt, Human
caacaaauacucagaaucc

SEQ ID NO: 507253 - RNA, 19 nt, Human
cagcagugcaacccgacuc

SEQ ID NO: 507254 - RNA, 23 nt, Human
ccagugacgcccuccaccgcucc

SEQ ID NO: 507255 - RNA, 21 nt, Human
ccugcccaacaaauacucaga

SEQ ID NO: 507256 - RNA, 23 nt, Human
ccugcccaacaaauacucagaau

SEQ ID NO: 507257 - RNA, 21 nt, Human
cgccgaaacccagugacgccc

SEQ ID NO: 507258 - RNA, 26 nt, Human
gaucacagcagugcaacccgacucgg

SEQ ID NO: 507259 - RNA, 23 nt, Human
gcagugcaacccgacucguggcc

SEQ ID NO: 507260 - RNA, 20 nt, Human
ggagaccaaauaagacagga

SEQ ID NO: 507261 - RNA, 20 nt, Human
uauggagaccaaauaagaca

SEQ ID NO: 507262 - RNA, 21 nt, Human
uauuuuauugaaggagauaag

SEQ ID NO: 507263 - RNA, 22 nt, Human
uauuuuauugaaggagauaagu

SEQ ID NO: 507264 - RNA, 20 nt, Human
ugaagcggcaguagccgcgg

SEQ ID NO: 507265 - RNA, 21 nt, Human
ugaagcggcaguagccgcgga

SEQ ID NO: 507266 - RNA, 22 nt, Human
aaaaacuaaaaagaaaaugcca

SEQ ID NO: 507267 - RNA, 24 nt, Human
aaaaacuaaaaagaaaaugccacu

SEQ ID NO: 507268 - RNA, 19 nt, Human
aacuugucucuuuaauacc

SEQ ID NO: 507269 - RNA, 18 nt, Human
aagaagaaauucuagucc

SEQ ID NO: 507270 - RNA, 21 nt, Human
agaaaaugccacucaacauca

SEQ ID NO: 507271 - RNA, 22 nt, Human
agcaauaggccagcaggaaaaa

SEQ ID NO: 507272 - RNA, 19 nt, Human
caacaucauugguauagca

SEQ ID NO: 507273 - RNA, 21 nt, Human
caacuguccagaguucucagc

SEQ ID NO: 507274 - RNA, 24 nt, Human
caagccccacgcgccucccggaaa

SEQ ID NO: 507275 - RNA, 21 nt, Human
cagccuuuaaaacuucauuga

SEQ ID NO: 507276 - RNA, 22 nt, Human
caggaaaaaaaauucugugaua

SEQ ID NO: 507277 - RNA, 18 nt, Human
cccggaaacaggcccgcc

SEQ ID NO: 507278 - RNA, 19 nt, Human
ccucaagccccacgcgccu

SEQ ID NO: 507279 - RNA, 25 nt, Human
cggccucaagccccacgcgccuccc

SEQ ID NO: 507280 - RNA, 24 nt, Human
cucaagccccacgcgccucccgga

SEQ ID NO: 507281 - RNA, 21 nt, Human
cucccggaaacaggcccgccc

SEQ ID NO: 507282 - RNA, 20 nt, Human
cucggccucaagccccacgc

SEQ ID NO: 507283 - RNA, 21 nt, Human
cugcucuucauucuuuuccac

SEQ ID NO: 507284 - RNA, 19 nt, Human
cugugauaaacuugucucu

SEQ ID NO: 507285 - RNA, 24 nt, Human
cuugcuucuggauuuuauguuaau

SEQ ID NO: 507286 - RNA, 20 nt, Human
gaaaaaguauuuauuucugc

SEQ ID NO: 507287 - RNA, 18 nt, Human
gagcaaauccaguaucca

SEQ ID NO: 507288 - RNA, 19 nt, Human
gguauagcaauaggccagc

SEQ ID NO: 507289 - RNA, 23 nt, Human
uaguuguagauauggaauauauu

SEQ ID NO: 507290 - RNA, 25 nt, Human
uaguuguagauauggaauauauuuu

SEQ ID NO: 507291 - RNA, 22 nt, Human
uccagaguucucagcuuacgga

SEQ ID NO: 507292 - RNA, 21 nt, Human
ucuccaaaaaauguuaagagg

SEQ ID NO: 507293 - RNA, 24 nt, Human
ucuggauuuuauguuaauuucuga

SEQ ID NO: 507294 - RNA, 21 nt, Human
ucuuuuacugcugcucuucau

SEQ ID NO: 507295 - RNA, 20 nt, Human
uggcagcaagggccguucuc

SEQ ID NO: 507296 - RNA, 25 nt, Human
uguccagaguucucagcuuacggaa

SEQ ID NO: 507297 - RNA, 18 nt, Human
uuaaaggcaaagcaccau

SEQ ID NO: 507298 - RNA, 24 nt, Human
uuaauaccaagaagaaauucuagu

SEQ ID NO: 507299 - RNA, 19 nt, Human
uucugcuccguucauacau

SEQ ID NO: 507300 - RNA, 23 nt, Human
uugguacagccuuuaaaacuuca

SEQ ID NO: 507301 - RNA, 18 nt, Human
uugguauagcaauaggcc

SEQ ID NO: 507302 - RNA, 24 nt, Human
uugguggcagcaagggccguucuc

SEQ ID NO: 507303 - RNA, 20 nt, Human
aaaugacccuugcgcugagg

SEQ ID NO: 507304 - RNA, 19 nt, Human
aacuguauaccaucauaca

SEQ ID NO: 507305 - RNA, 18 nt, Human
cacacucuucggcugccc

SEQ ID NO: 507306 - RNA, 25 nt, Human
caguagcucgggcaccuaagcacac

SEQ ID NO: 507307 - RNA, 22 nt, Human
ccacacucuucggcugcccgga

SEQ ID NO: 507308 - RNA, 24 nt, Human
ccaucauacaaaaaaggauuuuau

SEQ ID NO: 507309 - RNA, 19 nt, Human
cccuugcgcugaggaccgu

SEQ ID NO: 507310 - RNA, 19 nt, Human
ccguuaccuaccacacucu

SEQ ID NO: 507311 - RNA, 21 nt, Human
ccucgugccgaaucuuggcuc

SEQ ID NO: 507312 - RNA, 22 nt, Human
cgacgaaaugacccuugcgcug

SEQ ID NO: 507313 - RNA, 21 nt, Human
cgagggccgucccuucccagc

SEQ ID NO: 507314 - RNA, 21 nt, Human
gggaaaaaaaucaauacaaug

SEQ ID NO: 507315 - RNA, 25 nt, Human
ugcccggacuuagacccucaguagc

SEQ ID NO: 507316 - RNA, 21 nt, Human
uucccagcgacgaaaugaccc

SEQ ID NO: 507317 - RNA, 23 nt, Human
aaaauccuaaaguuaaucucaca

SEQ ID NO: 507318 - RNA, 20 nt, Human
aaacaguaaggaaauacaau

SEQ ID NO: 507319 - RNA, 18 nt, Human
aagcuacaagggagcuga

SEQ ID NO: 507320 - RNA, 19 nt, Human
aaugacacuuuuuuuucag

SEQ ID NO: 507321 - RNA, 21 nt, Human
aaugacacuuuuuuuucagug

SEQ ID NO: 507322 - RNA, 22 nt, Human
agccaguauuaucaucagcaca

SEQ ID NO: 507323 - RNA, 20 nt, Human
aguaaggaaauacaauauua

SEQ ID NO: 507324 - RNA, 20 nt, Human
augaaucacuaguaaaagag

SEQ ID NO: 507325 - RNA, 22 nt, Human
caacucccaaaauaaacagaaa

SEQ ID NO: 507326 - RNA, 23 nt, Human
caagggagcugagaguugauggc

SEQ ID NO: 507327 - RNA, 21 nt, Human
cccaaaauaaacagaaagagc

SEQ ID NO: 507328 - RNA, 21 nt, Human
cccacaaaagcuacaagggag

SEQ ID NO: 507329 - RNA, 18 nt, Human
cccugcaucugcugcugu

SEQ ID NO: 507330 - RNA, 23 nt, Human
ccgcacagagauacuauaucugu

SEQ ID NO: 507331 - RNA, 18 nt, Human
ccugcaucugcugcugug

SEQ ID NO: 507332 - RNA, 19 nt, Human
cucccaaaauaaacagaaa

SEQ ID NO: 507333 - RNA, 20 nt, Human
cuuacacaacaaaaaauccu

SEQ ID NO: 507334 - RNA, 22 nt, Human
uaaaaaaaaacccugcaucugc

SEQ ID NO: 507335 - RNA, 21 nt, Human
uaaauaagaaacccuaaaaag

SEQ ID NO: 507336 - RNA, 18 nt, Human
ugaaucacuaguaaaaga

SEQ ID NO: 507337 - RNA, 22 nt, Human
ugauaaaucaaacuacaucuuu

SEQ ID NO: 507338 - RNA, 20 nt, Human
ugauuuguaaagaaauaaau

SEQ ID NO: 507339 - RNA, 18 nt, Human
uuaaaaaaaaacccugca

SEQ ID NO: 507340 - RNA, 24 nt, Human
uuuuuuuucaguguauuaaucuga

SEQ ID NO: 507341 - RNA, 24 nt, Human
aaaaauugcaaauuggccuuaacc

SEQ ID NO: 507342 - RNA, 21 nt, Human
aaaagcaggugagaaaaauca

SEQ ID NO: 507343 - RNA, 23 nt, Human
aaaaggccugagccaugcaccgc

SEQ ID NO: 507344 - RNA, 19 nt, Human
aaauaccauaugauugguc

SEQ ID NO: 507345 - RNA, 22 nt, Human
aaauuccuuaaagaacaccacc

SEQ ID NO: 507346 - RNA, 18 nt, Human
aacacuuucaguucugcc

SEQ ID NO: 507347 - RNA, 21 nt, Human
aagaaacucaggccuggagac

SEQ ID NO: 507348 - RNA, 20 nt, Human
aagcacaagacaagcugugg

SEQ ID NO: 507349 - RNA, 22 nt, Human
aagcuguggugacucccugaga

SEQ ID NO: 507350 - RNA, 21 nt, Human
aaucauuuuaggggauggagg

SEQ ID NO: 507351 - RNA, 23 nt, Human
aaugacaugugauuuaaaaaucc

SEQ ID NO: 507352 - RNA, 20 nt, Human
accaggccaccaccauaaga

SEQ ID NO: 507353 - RNA, 20 nt, Human
acccacagaaaaggacaaac

SEQ ID NO: 507354 - RNA, 20 nt, Human
accgcaggcucaguacacuu

SEQ ID NO: 507355 - RNA, 19 nt, Human
acuccauagccuuggaaua

SEQ ID NO: 507356 - RNA, 21 nt, Human
agaaaaaacacucugaccucc

SEQ ID NO: 507357 - RNA, 22 nt, Human
agaaaaagcaguaauucagaga

SEQ ID NO: 507358 - RNA, 23 nt, Human
agaaauuccuuaaagaacaccac

SEQ ID NO: 507359 - RNA, 23 nt, Human
agagagcuauauuaaauacuugg

SEQ ID NO: 507360 - RNA, 30 nt, Human
agagcaccgggcaauuuauugcucuuuucc

SEQ ID NO: 507361 - RNA, 18 nt, Human
agcccagcaaaccuuggg

SEQ ID NO: 507362 - RNA, 20 nt, Human
aggccaccaccauaagagag

SEQ ID NO: 507363 - RNA, 21 nt, Human
aguaauucagagaaagaaagg

SEQ ID NO: 507364 - RNA, 18 nt, Human
auaccugaaaacacuuuc

SEQ ID NO: 507365 - RNA, 20 nt, Human
auggaagcagcauuucuggg

SEQ ID NO: 507366 - RNA, 19 nt, Human
caaaacagagaacauaggu

SEQ ID NO: 507367 - RNA, 20 nt, Human
caauuugguuauagaaauuc

SEQ ID NO: 507368 - RNA, 23 nt, Human
cacaagacaagcuguggugacuc

SEQ ID NO: 507369 - RNA, 18 nt, Human
cacagaaaaggacaaaca

SEQ ID NO: 507370 - RNA, 21 nt, Human
cacagaaaaggacaaacaaga

SEQ ID NO: 507371 - RNA, 23 nt, Human
cacagaaccugugaauccccauu

SEQ ID NO: 507372 - RNA, 22 nt, Human
caccgcaggcucaguacacuag

SEQ ID NO: 507373 - RNA, 21 nt, Human
caccucccccccaaaaacaac

SEQ ID NO: 507374 - RNA, 21 nt, Human
cacugcagguaggucucugcc

SEQ ID NO: 507375 - RNA, 19 nt, Human
cacuggcuaaaagcaaagc

SEQ ID NO: 507376 - RNA, 20 nt, Human
cacuguggugaugcacagaa

SEQ ID NO: 507377 - RNA, 21 nt, Human
cagaacucacugcaacugaca

SEQ ID NO: 507378 - RNA, 18 nt, Human
cagaagaaacucaggccu

SEQ ID NO: 507379 - RNA, 18 nt, Human
cagcaaaccuugggaaua

SEQ ID NO: 507380 - RNA, 20 nt, Human
cagcaucuaacaacaccccu

SEQ ID NO: 507381 - RNA, 20 nt, Human
caucaccaggccaccaccau

SEQ ID NO: 507382 - RNA, 21 nt, Human
cauccugaucuuccuaggaga

SEQ ID NO: 507383 - RNA, 20 nt, Human
ccacagaaaaggacaaacaa

SEQ ID NO: 507384 - RNA, 21 nt, Human
ccaccucccccccaaaaacaa

SEQ ID NO: 507385 - RNA, 18 nt, Human
ccagaagaaacucaggcc

SEQ ID NO: 507386 - RNA, 19 nt, Human
ccaucuucacaaucaccac

SEQ ID NO: 507387 - RNA, 22 nt, Human
cccaaagacagaaaaaacacuc

SEQ ID NO: 507388 - RNA, 19 nt, Human
cccauucuaaaauggaauc

SEQ ID NO: 507389 - RNA, 18 nt, Human
ccccaaaaacaacucaac

SEQ ID NO: 507390 - RNA, 19 nt, Human
ccccaggagaauccucucu

SEQ ID NO: 507391 - RNA, 19 nt, Human
ccccaugcugaaugggccc

SEQ ID NO: 507392 - RNA, 24 nt, Human
cccccaaaaacaacucaacuaauu

SEQ ID NO: 507393 - RNA, 23 nt, Human
cccccaccucccccccaaaaaca

SEQ ID NO: 507394 - RNA, 18 nt, Human
cccccuacccccaccucc

SEQ ID NO: 507395 - RNA, 19 nt, Human
cccccuacccccaccuccc

SEQ ID NO: 507396 - RNA, 27 nt, Human
cccccuacccccaccucccccccaaaa

SEQ ID NO: 507397 - RNA, 19 nt, Human
ccccuacccccaccucccc

SEQ ID NO: 507398 - RNA, 20 nt, Human
ccccuacccccaccuccccc

SEQ ID NO: 507399 - RNA, 21 nt, Human
ccccuacccccaccucccccc

SEQ ID NO: 507400 - RNA, 25 nt, Human
ccccuacccccaccucccccccaaa

SEQ ID NO: 507401 - RNA, 18 nt, Human
ccccuagcuucacacggu

SEQ ID NO: 507402 - RNA, 18 nt, Human
cccuacccccaccucccc

SEQ ID NO: 507403 - RNA, 22 nt, Human
cccuacccccaccuccccccca

SEQ ID NO: 507404 - RNA, 19 nt, Human
cccuagcuucacacggucc

SEQ ID NO: 507405 - RNA, 18 nt, Human
ccuagcuucacacggucc

SEQ ID NO: 507406 - RNA, 22 nt, Human
ccugcauucuucugagcugccc

SEQ ID NO: 507407 - RNA, 18 nt, Human
ccuggagacacugcacua

SEQ ID NO: 507408 - RNA, 19 nt, Human
ccuugugccccagcucucc

SEQ ID NO: 507409 - RNA, 23 nt, Human
cggggcugcagggcuggggggcg

SEQ ID NO: 507410 - RNA, 22 nt, Human
cuaaacccacagaaaaggacaa

SEQ ID NO: 507411 - RNA, 22 nt, Human
cuaugauaagugaaaucaaaaa

SEQ ID NO: 507412 - RNA, 21 nt, Human
cucuaagacaccccaggagaa

SEQ ID NO: 507413 - RNA, 22 nt, Human
cucuccuauguguggauuucau

SEQ ID NO: 507414 - RNA, 21 nt, Human
cucuuucugguguucugugcc

SEQ ID NO: 507415 - RNA, 19 nt, Human
cugcagguaggucucugcc

SEQ ID NO: 507416 - RNA, 18 nt, Human
cugccuccaguccccuug

SEQ ID NO: 507417 - RNA, 18 nt, Human
cugccucuaagacacccc

SEQ ID NO: 507418 - RNA, 21 nt, Human
cuggcugcgccuuguaccgga

SEQ ID NO: 507419 - RNA, 21 nt, Human
cuggggggcggcggcggggcc

SEQ ID NO: 507420 - RNA, 23 nt, Human
cuguccucgccgggcugggcgcg

SEQ ID NO: 507421 - RNA, 19 nt, Human
cuucaaguaggaccggucc

SEQ ID NO: 507422 - RNA, 20 nt, Human
cuucugcagugugcugagaa

SEQ ID NO: 507423 - RNA, 22 nt, Human
cuuggcccaaagacagaaaaaa

SEQ ID NO: 507424 - RNA, 25 nt, Human
cuuuguggccgcgcugggggccgcc

SEQ ID NO: 507425 - RNA, 23 nt, Human
cuuuuagaguugaggccaggcug

SEQ ID NO: 507426 - RNA, 18 nt, Human
gaagaaacucaggccugg

SEQ ID NO: 507427 - RNA, 18 nt, Human
gaaucuaccuacacacca

SEQ ID NO: 507428 - RNA, 21 nt, Human
gaaucuguuccagaagaaacu

SEQ ID NO: 507429 - RNA, 22 nt, Human
gagaaagaaaggaaaaugacag

SEQ ID NO: 507430 - RNA, 20 nt, Human
gagcugcccuucugcagugu

SEQ ID NO: 507431 - RNA, 22 nt, Human
gcagcagcugcuggagcgcggc

SEQ ID NO: 507432 - RNA, 22 nt, Human
gcagugugcugagaaacacccc

SEQ ID NO: 507433 - RNA, 23 nt, Human
gccgggcugggcgcggccggggc

SEQ ID NO: 507434 - RNA, 24 nt, Human
gccuccuggugcuguccucgccgg

SEQ ID NO: 507435 - RNA, 20 nt, Human
gcgcggccggggcugcgggg

SEQ ID NO: 507436 - RNA, 22 nt, Human
gcggcagcagcugcuggagcgc

SEQ ID NO: 507437 - RNA, 18 nt, Human
gcggcggcggggccgggc

SEQ ID NO: 507438 - RNA, 19 nt, Human
gcuguccucgccgggcugg

SEQ ID NO: 507439 - RNA, 19 nt, Human
ggaaaagcaggugagaaaa

SEQ ID NO: 507440 - RNA, 19 nt, Human
ggagcaaaucacauauuca

SEQ ID NO: 507441 - RNA, 21 nt, Human
gggaggagcuggcugcgccuu

SEQ ID NO: 507442 - RNA, 23 nt, Human
gggcugggcgcggccggggcugc

SEQ ID NO: 507443 - RNA, 21 nt, Human
gggcugggcggcagcagcugc

SEQ ID NO: 507444 - RNA, 21 nt, Human
gggcugggcggcagcagcugc

SEQ ID NO: 507445 - RNA, 24 nt, Human
ggggaguagucuuccgauuccgag

SEQ ID NO: 507446 - RNA, 24 nt, Human
gggggccgccuccuggugcugucc

SEQ ID NO: 507447 - RNA, 21 nt, Human
gggggcggcggcggggccggg

SEQ ID NO: 507448 - RNA, 22 nt, Human
ggggggcggcggcggggccggg

SEQ ID NO: 507449 - RNA, 21 nt, Human
gguguucugugcccccuaccc

SEQ ID NO: 507450 - RNA, 19 nt, Human
guaaagggaaaccgcuaca

SEQ ID NO: 507451 - RNA, 19 nt, Human
gucucggaggagcuugggg

SEQ ID NO: 507452 - RNA, 22 nt, Human
uaaaaaaaaucauuuuagggga

SEQ ID NO: 507453 - RNA, 20 nt, Human
uaaaagaaagacggucccca

SEQ ID NO: 507454 - RNA, 21 nt, Human
uaaaagcaaagcaaucuggau

SEQ ID NO: 507455 - RNA, 22 nt, Human
uaaaauucccuugaaaauacca

SEQ ID NO: 507456 - RNA, 20 nt, Human
uaaaccugccacguucuaaa

SEQ ID NO: 507457 - RNA, 26 nt, Human
uaaauguaaaagagcaaaaaauuuug

SEQ ID NO: 507458 - RNA, 27 nt, Human
uaaauguccuucuuuucuggacauuuc

SEQ ID NO: 507459 - RNA, 20 nt, Human
uaacaacaccccuugaucug

SEQ ID NO: 507460 - RNA, 24 nt, Human
uaacaacaccccuugaucugcagu

SEQ ID NO: 507461 - RNA, 24 nt, Human
uaacuagucuacuaucaaacugaa

SEQ ID NO: 507462 - RNA, 19 nt, Human
uaagagagcuauauuaaau

SEQ ID NO: 507463 - RNA, 19 nt, Human
uacagugaugugcugggau

SEQ ID NO: 507464 - RNA, 21 nt, Human
uacccccaccucccccccaaa

SEQ ID NO: 507465 - RNA, 19 nt, Human
uagaaagcacuggcuaaaa

SEQ ID NO: 507466 - RNA, 21 nt, Human
uagcagcaaauuaccaucuuc

SEQ ID NO: 507467 - RNA, 19 nt, Human
uaucaaacugaaaagauga

SEQ ID NO: 507468 - RNA, 23 nt, Human
ucauguggagacaauuugggggg

SEQ ID NO: 507469 - RNA, 22 nt, Human
uccacuugggaugcagaacuca

SEQ ID NO: 507470 - RNA, 20 nt, Human
uccauauuaauguagaccau

SEQ ID NO: 507471 - RNA, 19 nt, Human
ucccagagcccagcaaacc

SEQ ID NO: 507472 - RNA, 23 nt, Human
ucccagagcccagcaaaccuugg

SEQ ID NO: 507473 - RNA, 20 nt, Human
uccccauucuaaaauggaau

SEQ ID NO: 507474 - RNA, 19 nt, Human
ucuaaaauggaaucuguuc

SEQ ID NO: 507475 - RNA, 18 nt, Human
ucuaacaacaccccuuga

SEQ ID NO: 507476 - RNA, 19 nt, Human
ucucagacaggacuuggcc

SEQ ID NO: 507477 - RNA, 18 nt, Human
ucugaccuccuggacagc

SEQ ID NO: 507478 - RNA, 19 nt, Human
ucugaccuccuggacagcu

SEQ ID NO: 507479 - RNA, 23 nt, Human
ugaaaaaaaaaaucuguuucuga

SEQ ID NO: 507480 - RNA, 21 nt, Human
ugaaaaauucccaaacaagaa

SEQ ID NO: 507481 - RNA, 21 nt, Human
ugaaaacacuuucaguucugc

SEQ ID NO: 507482 - RNA, 18 nt, Human
ugaguucgggaggagcug

SEQ ID NO: 507483 - RNA, 24 nt, Human
ugcacagaaccugugaauccccau

SEQ ID NO: 507484 - RNA, 23 nt, Human
ugccccagcucuccuaugugugg

SEQ ID NO: 507485 - RNA, 20 nt, Human
ugccuccaguccccuugugc

SEQ ID NO: 507486 - RNA, 24 nt, Human
ugcucuaaaagggggggaaaaaaa

SEQ ID NO: 507487 - RNA, 23 nt, Human
uggaucccagagcccagcaaacc

SEQ ID NO: 507488 - RNA, 18 nt, Human
uggcuaaaagcaaagcaa

SEQ ID NO: 507489 - RNA, 21 nt, Human
ugggaugcagaacucacugca

SEQ ID NO: 507490 - RNA, 23 nt, Human
ugggggaaaaaaaucucagaguc

SEQ ID NO: 507491 - RNA, 23 nt, Human
ugggggccgccuccuggugcugu

SEQ ID NO: 507492 - RNA, 18 nt, Human
ugguugucucguggaucc

SEQ ID NO: 507493 - RNA, 19 nt, Human
uguagaugucugacacuga

SEQ ID NO: 507494 - RNA, 24 nt, Human
ugucaguaaaagaaagacgguccc

SEQ ID NO: 507495 - RNA, 19 nt, Human
ugugaagaagaaagaaccg

SEQ ID NO: 507496 - RNA, 20 nt, Human
uguguguauacauccaaagg

SEQ ID NO: 507497 - RNA, 24 nt, Human
uuagaugagggcuacgguaaaaac

SEQ ID NO: 507498 - RNA, 21 nt, Human
uuccugggucaagcucuuugc

SEQ ID NO: 507499 - RNA, 18 nt, Human
uugaaaauaccauaugau

SEQ ID NO: 507500 - RNA, 23 nt, Human
uugaucugcaguaaaaucaagaa

SEQ ID NO: 507501 - RNA, 22 nt, Human
uuguggccgcgcugggggcccc

SEQ ID NO: 507502 - RNA, 22 nt, Human
aaaaaaaacaaagguaacaaaa

SEQ ID NO: 507503 - RNA, 18 nt, Human
aaaaaacugcgaagucac

SEQ ID NO: 507504 - RNA, 24 nt, Human
aaaaacaaagguaacaaaaccccc

SEQ ID NO: 507505 - RNA, 21 nt, Human
aaaacaaagguaacaaaaccc

SEQ ID NO: 507506 - RNA, 20 nt, Human
aaacaaaaaguuauagaauu

SEQ ID NO: 507507 - RNA, 25 nt, Human
aacaaaacccccaccaacucaaugg

SEQ ID NO: 507508 - RNA, 18 nt, Human
aacucaaugggaaucugc

SEQ ID NO: 507509 - RNA, 18 nt, Human
aagcuacauccaaggaac

SEQ ID NO: 507510 - RNA, 22 nt, Human
aagguaacaaaacccccaccaa

SEQ ID NO: 507511 - RNA, 19 nt, Human
aaguaaacugaaaguccau

SEQ ID NO: 507512 - RNA, 24 nt, Human
acaaaacccccaccaacucaaugg

SEQ ID NO: 507513 - RNA, 23 nt, Human
accacagucccuggacaaagggc

SEQ ID NO: 507514 - RNA, 26 nt, Human
agaaaaaaaacaaagguaacaaaacc

SEQ ID NO: 507515 - RNA, 22 nt, Human
agaaaauaaaguaucugaacaa

SEQ ID NO: 507516 - RNA, 24 nt, Human
agauaaaccuaucacaggaguagc

SEQ ID NO: 507517 - RNA, 23 nt, Human
aggcauucagcaccacgaacaug

SEQ ID NO: 507518 - RNA, 21 nt, Human
aucugaacaaucuucaugagg

SEQ ID NO: 507519 - RNA, 22 nt, Human
augaugcugagaggcauucagc

SEQ ID NO: 507520 - RNA, 21 nt, Human
augauuuuaucauucaagaag

SEQ ID NO: 507521 - RNA, 21 nt, Human
caaaacccccaccaacucaau

SEQ ID NO: 507522 - RNA, 23 nt, Human
caaagguaacaaaacccccacca

SEQ ID NO: 507523 - RNA, 21 nt, Human
caaauaauucauaaauccaac

SEQ ID NO: 507524 - RNA, 24 nt, Human
caacauaaucaaagagauguguaa

SEQ ID NO: 507525 - RNA, 19 nt, Human
caauagaguaagugccaca

SEQ ID NO: 507526 - RNA, 21 nt, Human
cacaaugaaacuaagauaaac

SEQ ID NO: 507527 - RNA, 23 nt, Human
caccaacucaaugggaaucugca

SEQ ID NO: 507528 - RNA, 22 nt, Human
cagcaauggcuaggaagacuuu

SEQ ID NO: 507529 - RNA, 20 nt, Human
cagcaccacgaacauguugu

SEQ ID NO: 507530 - RNA, 22 nt, Human
cagcuuccaauuuccacucucu

SEQ ID NO: 507531 - RNA, 24 nt, Human
cccaccaacucaaugggaaucugc

SEQ ID NO: 507532 - RNA, 25 nt, Human
cccacuuuugaaccuaaaagguuuc

SEQ ID NO: 507533 - RNA, 20 nt, Human
cccagggagacccaguuuca

SEQ ID NO: 507534 - RNA, 20 nt, Human
ccugcuauuccauuuauacc

SEQ ID NO: 507535 - RNA, 18 nt, Human
ccuguaggucgaaaugcc

SEQ ID NO: 507536 - RNA, 23 nt, Human
cgaaaugccaaaaucugauugua

SEQ ID NO: 507537 - RNA, 24 nt, Human
cgaagucacugcccucauccacga

SEQ ID NO: 507538 - RNA, 21 nt, Human
cgcuucauuucuagguagcug

SEQ ID NO: 507539 - RNA, 19 nt, Human
cugugaaguucuccauuau

SEQ ID NO: 507540 - RNA, 21 nt, Human
gaacauguuguucaaacauaa

SEQ ID NO: 507541 - RNA, 18 nt, Human
ggugcuauuucauucaaa

SEQ ID NO: 507542 - RNA, 22 nt, Human
guaagugccacagacaacaaga

SEQ ID NO: 507543 - RNA, 22 nt, Human
uaaaacaucagcaauggcuagg

SEQ ID NO: 507544 - RNA, 21 nt, Human
uagauuuccaggugcccacau

SEQ ID NO: 507545 - RNA, 21 nt, Human
uaggaagacuuucucuuuucc

SEQ ID NO: 507546 - RNA, 19 nt, Human
uagguucaacagcuuaauc

SEQ ID NO: 507547 - RNA, 18 nt, Human
uaguggauacucaaccac

SEQ ID NO: 507548 - RNA, 26 nt, Human
ucauaaauccaaccacagucccugga

SEQ ID NO: 507549 - RNA, 22 nt, Human
uccaaauaauucauaaauccaa

SEQ ID NO: 507550 - RNA, 22 nt, Human
ucccagggagacccaguuucag

SEQ ID NO: 507551 - RNA, 24 nt, Human
ucccuuuagggucuuggcgggaac

SEQ ID NO: 507552 - RNA, 24 nt, Human
ucuguaagcccuuaaaauuaauuu

SEQ ID NO: 507553 - RNA, 20 nt, Human
ugaauuaauuucugguauau

SEQ ID NO: 507554 - RNA, 18 nt, Human
ugagaaaaaaaacaaagg

SEQ ID NO: 507555 - RNA, 21 nt, Human
ugagaaaauaaaguaucugaa

SEQ ID NO: 507556 - RNA, 18 nt, Human
ugaugcagaauauaacug

SEQ ID NO: 507557 - RNA, 20 nt, Human
ugggagaaggugaaccaaug

SEQ ID NO: 507558 - RNA, 19 nt, Human
uguccuuuuccagggcuug

SEQ ID NO: 507559 - RNA, 20 nt, Human
ugucgguagugaugagugaa

SEQ ID NO: 507560 - RNA, 27 nt, Human
uguuuccuuuggucuggggggaggacc

SEQ ID NO: 507561 - RNA, 22 nt, Human
uucaagaaguauuaaucuuaag

SEQ ID NO: 507562 - RNA, 18 nt, Human
uuccugggacaugcccac

SEQ ID NO: 507563 - RNA, 23 nt, Human
uucuagguagcugcuguguucac

SEQ ID NO: 507564 - RNA, 21 nt, Human
uuuccagggcuugauucauaa

SEQ ID NO: 507565 - RNA, 23 nt, Human
uuuccaggugcccacauuuacag

SEQ ID NO: 507566 - RNA, 21 nt, Human
uuugaaccuaaaacaucagca

SEQ ID NO: 507567 - RNA, 18 nt, Human
aaaaacaaacucuuuccc

SEQ ID NO: 507568 - RNA, 18 nt, Human
aaaguaggccccaaaaac

SEQ ID NO: 507569 - RNA, 23 nt, Human
acccugcccgcuggagcccaaau

SEQ ID NO: 507570 - RNA, 24 nt, Human
acuccaaagauuuuauaaaaaaag

SEQ ID NO: 507571 - RNA, 26 nt, Human
agaacagggccagagacccuaaggga

SEQ ID NO: 507572 - RNA, 26 nt, Human
aguuaccagagugggcagaaaaagga

SEQ ID NO: 507573 - RNA, 19 nt, Human
caagaacagggccagagac

SEQ ID NO: 507574 - RNA, 24 nt, Human
caagaacagggccagagacccuaa

SEQ ID NO: 507575 - RNA, 22 nt, Human
cagggcuccugcgugaggcuuc

SEQ ID NO: 507576 - RNA, 23 nt, Human
caugcuggggcaagaacagggcc

SEQ ID NO: 507577 - RNA, 23 nt, Human
cccaaaaacaaacucuuucccac

SEQ ID NO: 507578 - RNA, 18 nt, Human
cccuaagggaaagagccc

SEQ ID NO: 507579 - RNA, 20 nt, Human
cgaggaccccagugaacaag

SEQ ID NO: 507580 - RNA, 19 nt, Human
cuaucuucaaaacugcagu

SEQ ID NO: 507581 - RNA, 24 nt, Human
gaaaaguaggccccaaaaacaaac

SEQ ID NO: 507582 - RNA, 20 nt, Human
gaacaaguuuugggaagugc

SEQ ID NO: 507583 - RNA, 18 nt, Human
gaacagggccagagaccc

SEQ ID NO: 507584 - RNA, 22 nt, Human
gcagagcaauaaguuaccagag

SEQ ID NO: 507585 - RNA, 18 nt, Human
gggcaagaacagggccag

SEQ ID NO: 507586 - RNA, 21 nt, Human
uccacgggggcagggcuccug

SEQ ID NO: 507587 - RNA, 20 nt, Human
uccacggugggcccauaaga

SEQ ID NO: 507588 - RNA, 19 nt, Human
uccauaggcacgaggaccc

SEQ ID NO: 507589 - RNA, 19 nt, Human
ugcgugaggcuuccacaac

SEQ ID NO: 507590 - RNA, 27 nt, Human
ugcucacgcauacuccaaagauuuuau

SEQ ID NO: 507591 - RNA, 20 nt, Human
ugggaagugcugcuccgggc

SEQ ID NO: 507592 - RNA, 20 nt, Human
uuaguuauaaaaagaaggau

SEQ ID NO: 507593 - RNA, 21 nt, Human
aaaauccccucccuguugccu

SEQ ID NO: 507594 - RNA, 19 nt, Human
aaacagccccuugacaaag

SEQ ID NO: 507595 - RNA, 22 nt, Human
aacagagcagagcuggagaagu

SEQ ID NO: 507596 - RNA, 18 nt, Human
aagaagaaacuguggcac

SEQ ID NO: 507597 - RNA, 20 nt, Human
aaggagcagauuaaaauccc

SEQ ID NO: 507598 - RNA, 18 nt, Human
aauccauaaaccuuccuc

SEQ ID NO: 507599 - RNA, 24 nt, Human
acacagaaucccaaaaccccaggg

SEQ ID NO: 507600 - RNA, 18 nt, Human
acccauccuaugaaacuc

SEQ ID NO: 507601 - RNA, 21 nt, Human
acgggcuggccugcauagccc

SEQ ID NO: 507602 - RNA, 18 nt, Human
acuggcuucccaccacua

SEQ ID NO: 507603 - RNA, 23 nt, Human
agacaccgggagaccuggaaaca

SEQ ID NO: 507604 - RNA, 19 nt, Human
agagaaaacagagcagagc

SEQ ID NO: 507605 - RNA, 22 nt, Human
agagccccuccagggucuccuu

SEQ ID NO: 507606 - RNA, 19 nt, Human
agccaacaacccauggccu

SEQ ID NO: 507607 - RNA, 18 nt, Human
agccccacacuguggcug

SEQ ID NO: 507608 - RNA, 19 nt, Human
agcuacaaagucucaagga

SEQ ID NO: 507609 - RNA, 21 nt, Human
agcuacaaagucucaaggacu

SEQ ID NO: 507610 - RNA, 21 nt, Human
agcucuggaaaggccaccggg

SEQ ID NO: 507611 - RNA, 18 nt, Human
agcuggcagcccacugca

SEQ ID NO: 507612 - RNA, 26 nt, Human
aggacuagaaggaagcaccagccuug

SEQ ID NO: 507613 - RNA, 21 nt, Human
aggcugccaccaugagggaag

SEQ ID NO: 507614 - RNA, 22 nt, Human
agggguggagagaggggucaga

SEQ ID NO: 507615 - RNA, 18 nt, Human
auccauaaaccuuccuca

SEQ ID NO: 507616 - RNA, 22 nt, Human
caaacuggacagugauagcuaa

SEQ ID NO: 507617 - RNA, 25 nt, Human
caaacuggacagugauagcuaaccc

SEQ ID NO: 507618 - RNA, 24 nt, Human
caagaagaaacuguggcacggaga

SEQ ID NO: 507619 - RNA, 23 nt, Human
cacacagaaucccaaaaccccag

SEQ ID NO: 507620 - RNA, 18 nt, Human
cacagagcacagguaagc

SEQ ID NO: 507621 - RNA, 20 nt, Human
caccacacagaaucccaaaa

SEQ ID NO: 507622 - RNA, 22 nt, Human
caccagccuuguucugccccag

SEQ ID NO: 507623 - RNA, 24 nt, Human
caccaugggccucccuuccuccag

SEQ ID NO: 507624 - RNA, 19 nt, Human
caccccagcuggccaacug

SEQ ID NO: 507625 - RNA, 23 nt, Human
caccgggaacacaagagccaaca

SEQ ID NO: 507626 - RNA, 24 nt, Human
cagaaucccaaaaccccaggguuc

SEQ ID NO: 507627 - RNA, 21 nt, Human
cagagccccuccagggucucc

SEQ ID NO: 507628 - RNA, 23 nt, Human
cagauuaaaauccccucccuguu

SEQ ID NO: 507629 - RNA, 18 nt, Human
cagccaccacuacguguc

SEQ ID NO: 507630 - RNA, 18 nt, Human
cagcuagagggucugcgc

SEQ ID NO: 507631 - RNA, 21 nt, Human
cagguccguggcuacaacuaa

SEQ ID NO: 507632 - RNA, 21 nt, Human
cagucaccacacagaauccca

SEQ ID NO: 507633 - RNA, 22 nt, Human
caguucccauuccagcucugcu

SEQ ID NO: 507634 - RNA, 20 nt, Human
caugugccuacaugcauuca

SEQ ID NO: 507635 - RNA, 19 nt, Human
cauuauacuaacccugccu

SEQ ID NO: 507636 - RNA, 18 nt, Human
ccaccagagcccccccgu

SEQ ID NO: 507637 - RNA, 19 nt, Human
ccagccagagggucugugc

SEQ ID NO: 507638 - RNA, 24 nt, Human
ccagccagcccaaccucugauugc

SEQ ID NO: 507639 - RNA, 19 nt, Human
ccagggguggagagagggg

SEQ ID NO: 507640 - RNA, 18 nt, Human
cccaggguucugcuugag

SEQ ID NO: 507641 - RNA, 19 nt, Human
cccaugccgggccugaggg

SEQ ID NO: 507642 - RNA, 19 nt, Human
cccucaguguccugcugug

SEQ ID NO: 507643 - RNA, 21 nt, Human
ccuccagggucuccuuggcag

SEQ ID NO: 507644 - RNA, 21 nt, Human
ccucuuugcuggcugcagccu

SEQ ID NO: 507645 - RNA, 23 nt, Human
ccugcauagcccagggguggaga

SEQ ID NO: 507646 - RNA, 20 nt, Human
ccuuccucagcagucaccac

SEQ ID NO: 507647 - RNA, 18 nt, Human
ccuugaccaccagagccc

SEQ ID NO: 507648 - RNA, 24 nt, Human
cggagagauucaguuacuugucca

SEQ ID NO: 507649 - RNA, 21 nt, Human
cggagugagugcuccaccaug

SEQ ID NO: 507650 - RNA, 22 nt, Human
cgggaacacaagagccaacaac

SEQ ID NO: 507651 - RNA, 19 nt, Human
cgggcagacaggcacggag

SEQ ID NO: 507652 - RNA, 21 nt, Human
cgggguggaugcugaggaaga

SEQ ID NO: 507653 - RNA, 21 nt, Human
cuaugaaacucacuccuuugg

SEQ ID NO: 507654 - RNA, 23 nt, Human
cucaaggacuagaaggaagcacc

SEQ ID NO: 507655 - RNA, 22 nt, Human
cugcagccuugcugcucagugg

SEQ ID NO: 507656 - RNA, 20 nt, Human
cugcugccuugaccaccaga

SEQ ID NO: 507657 - RNA, 20 nt, Human
cuugcucuacacguuucugu

SEQ ID NO: 507658 - RNA, 18 nt, Human
gacaaugucucagagaau

SEQ ID NO: 507659 - RNA, 21 nt, Human
gacagugauagcuaacccugu

SEQ ID NO: 507660 - RNA, 20 nt, Human
gccaacuggcuucccaccac

SEQ ID NO: 507661 - RNA, 21 nt, Human
gccagagggucugugcugucc

SEQ ID NO: 507662 - RNA, 18 nt, Human
gcccaugccgggccugag

SEQ ID NO: 507663 - RNA, 21 nt, Human
gccgggccugaggggccuggc

SEQ ID NO: 507664 - RNA, 21 nt, Human
gcuacaacuaaaucccuaguu

SEQ ID NO: 507665 - RNA, 18 nt, Human
ggaacacaagagccaaca

SEQ ID NO: 507666 - RNA, 18 nt, Human
ggagagaggggucagacu

SEQ ID NO: 507667 - RNA, 24 nt, Human
ggcaggggcuguccccuaugagcc

SEQ ID NO: 507668 - RNA, 19 nt, Human
ggccugaggggccuggcuc

SEQ ID NO: 507669 - RNA, 20 nt, Human
ggccugaggggccuggcuca

SEQ ID NO: 507670 - RNA, 21 nt, Human
ggccugaggggccuggcucag

SEQ ID NO: 507671 - RNA, 19 nt, Human
gggagaccuggaaacagcc

SEQ ID NO: 507672 - RNA, 20 nt, Human
gggcaacaggccugggcuca

SEQ ID NO: 507673 - RNA, 19 nt, Human
gggccuggcucagacuuua

SEQ ID NO: 507674 - RNA, 23 nt, Human
ggggcuguccccuaugagccucu

SEQ ID NO: 507675 - RNA, 23 nt, Human
guucucaguccuuuccugugugg

SEQ ID NO: 507676 - RNA, 25 nt, Human
uaaagccacccauccuaugaaacuc

SEQ ID NO: 507677 - RNA, 24 nt, Human
uaaaucccuaguuggggaaucaca

SEQ ID NO: 507678 - RNA, 23 nt, Human
uacaacuaaaucccuaguugggg

SEQ ID NO: 507679 - RNA, 21 nt, Human
uagaaccuauggagacuuggu

SEQ ID NO: 507680 - RNA, 20 nt, Human
uagcugggagcagcguucau

SEQ ID NO: 507681 - RNA, 21 nt, Human
uaugcugucuagcgugucugc

SEQ ID NO: 507682 - RNA, 22 nt, Human
uauuucacuuuaauccgccugu

SEQ ID NO: 507683 - RNA, 21 nt, Human
ucacgggguggaugcugagga

SEQ ID NO: 507684 - RNA, 23 nt, Human
ucagagccccuccagggucuccu

SEQ ID NO: 507685 - RNA, 26 nt, Human
ucaguuccucccaccaaacuggacag

SEQ ID NO: 507686 - RNA, 28 nt, Human
ucaguuccucccaccaaacuggacagug

SEQ ID NO: 507687 - RNA, 19 nt, Human
ucccaccaaacuggacagu

SEQ ID NO: 507688 - RNA, 24 nt, Human
ucccuaguuggggaaucacagagc

SEQ ID NO: 507689 - RNA, 19 nt, Human
ucccuguugccuaccaggu

SEQ ID NO: 507690 - RNA, 18 nt, Human
ucguacaguagauacagu

SEQ ID NO: 507691 - RNA, 22 nt, Human
ucucugugacaugcacccuguc

SEQ ID NO: 507692 - RNA, 20 nt, Human
ucugcugugacuuccucaug

SEQ ID NO: 507693 - RNA, 21 nt, Human
ucuguccucuguucagcucug

SEQ ID NO: 507694 - RNA, 19 nt, Human
ucugugcaucuguccucug

SEQ ID NO: 507695 - RNA, 18 nt, Human
ugagaacugucucucugu

SEQ ID NO: 507696 - RNA, 20 nt, Human
ugagggaagcuggagggagg

SEQ ID NO: 507697 - RNA, 27 nt, Human
ugagugcuccaccaugggccucccuuc

SEQ ID NO: 507698 - RNA, 18 nt, Human
ugaguguagacugggucc

SEQ ID NO: 507699 - RNA, 23 nt, Human
ugaguguagacuggguccaugug

SEQ ID NO: 507700 - RNA, 22 nt, Human
ugcauacuugcgugugugcaca

SEQ ID NO: 507701 - RNA, 19 nt, Human
ugcauccaggacuaugcug

SEQ ID NO: 507702 - RNA, 21 nt, Human
ugccccagccagagggucugu

SEQ ID NO: 507703 - RNA, 21 nt, Human
ugccccagcuagagggucugc

SEQ ID NO: 507704 - RNA, 19 nt, Human
ugccgggccugaggggccu

SEQ ID NO: 507705 - RNA, 22 nt, Human
ugcgugugugcacacgcacaca

SEQ ID NO: 507706 - RNA, 18 nt, Human
ugcucagugggcgguugu

SEQ ID NO: 507707 - RNA, 21 nt, Human
ugcuggcugcagccuugcugc

SEQ ID NO: 507708 - RNA, 22 nt, Human
uggauggguuuugagggucugg

SEQ ID NO: 507709 - RNA, 24 nt, Human
ugggagcagcguucaugugcacug

SEQ ID NO: 507710 - RNA, 24 nt, Human
uggggaaucacagagcacagguaa

SEQ ID NO: 507711 - RNA, 22 nt, Human
ugggguaugccugaauguaacu

SEQ ID NO: 507712 - RNA, 23 nt, Human
uggguuguuuacuccucccacag

SEQ ID NO: 507713 - RNA, 21 nt, Human
ugucaaauccauaaaccuucc

SEQ ID NO: 507714 - RNA, 18 nt, Human
uguccaggaucacagaac

SEQ ID NO: 507715 - RNA, 19 nt, Human
ugugcacacgcacacaugu

SEQ ID NO: 507716 - RNA, 22 nt, Human
ugugcauacuugcgugugugca

SEQ ID NO: 507717 - RNA, 19 nt, Human
uguguggauggaguguugg

SEQ ID NO: 507718 - RNA, 23 nt, Human
uguucguguuuaguguaugucug

SEQ ID NO: 507719 - RNA, 21 nt, Human
uuccucauggcagagccccac

SEQ ID NO: 507720 - RNA, 18 nt, Human
uucugccccagcuagagg

SEQ ID NO: 507721 - RNA, 21 nt, Human
uugacccuuaugucugggugc

SEQ ID NO: 507722 - RNA, 23 nt, Human
uuggauggguuuugagggucugg

SEQ ID NO: 507723 - RNA, 18 nt, Human
aaaacaccuggaaggaca

SEQ ID NO: 507724 - RNA, 18 nt, Human
aaaagaaaacaagagaag

SEQ ID NO: 507725 - RNA, 19 nt, Human
aaaagaaaacaagagaagc

SEQ ID NO: 507726 - RNA, 25 nt, Human
aaaagaaaacaagagaagcaaagaa

SEQ ID NO: 507727 - RNA, 21 nt, Human
aaacaccuggaaggacaagaa

SEQ ID NO: 507728 - RNA, 23 nt, Human
aaacaccuggaaggacaagaaaa

SEQ ID NO: 507729 - RNA, 23 nt, Human
aaacagaccacacaaaggcccuc

SEQ ID NO: 507730 - RNA, 23 nt, Human
aaacaggaaaccagaggugacaa

SEQ ID NO: 507731 - RNA, 23 nt, Human
aaaccccaucucuuacuaaaaaa

SEQ ID NO: 507732 - RNA, 24 nt, Human
aaagugcagggauuacaggcguga

SEQ ID NO: 507733 - RNA, 21 nt, Human
aacacagugacagcaagacua

SEQ ID NO: 507734 - RNA, 19 nt, Human
aacauggcgaaaccccauc

SEQ ID NO: 507735 - RNA, 20 nt, Human
aacauggcgaaaccccaucu

SEQ ID NO: 507736 - RNA, 21 nt, Human
aacauggcgaaaccccaucuc

SEQ ID NO: 507737 - RNA, 21 nt, Human
aacauggcgaaaccccaucuc

SEQ ID NO: 507738 - RNA, 23 nt, Human
aaccaaagauacaaaauucucug

SEQ ID NO: 507739 - RNA, 18 nt, Human
aaccagauugucaaggac

SEQ ID NO: 507740 - RNA, 19 nt, Human
aacugccagaggcauaaaa

SEQ ID NO: 507741 - RNA, 23 nt, Human
aagaucgugccauugcacuccag

SEQ ID NO: 507742 - RNA, 20 nt, Human
aagcaccaaagcauacuuuc

SEQ ID NO: 507743 - RNA, 20 nt, Human
aagcagcaccaucucagcca

SEQ ID NO: 507744 - RNA, 23 nt, Human
aagcuacagaguccaccuagaau

SEQ ID NO: 507745 - RNA, 23 nt, Human
aaggcaggaggaucacuucaguc

SEQ ID NO: 507746 - RNA, 21 nt, Human
aagggauucuccugccucagc

SEQ ID NO: 507747 - RNA, 24 nt, Human
aaucaccugaacccaggaggugga

SEQ ID NO: 507748 - RNA, 25 nt, Human
aaucaccugaacccaggagguggag

SEQ ID NO: 507749 - RNA, 24 nt, Human
aaucagcaguagaaaaaaucagca

SEQ ID NO: 507750 - RNA, 24 nt, Human
aaucaucaacagcaaaguuuuaag

SEQ ID NO: 507751 - RNA, 19 nt, Human
acaagagcgaaacuccauc

SEQ ID NO: 507752 - RNA, 20 nt, Human
acaagagcgaaacuccaucu

SEQ ID NO: 507753 - RNA, 21 nt, Human
acaagagcgaaacuccaucuc

SEQ ID NO: 507754 - RNA, 19 nt, Human
acaccaaagacaaacaaac

SEQ ID NO: 507755 - RNA, 22 nt, Human
acaccaaagacaaacaaacuuc

SEQ ID NO: 507756 - RNA, 20 nt, Human
acaccacugcacuccagucu

SEQ ID NO: 507757 - RNA, 22 nt, Human
acaccacugcacuccagucugc

SEQ ID NO: 507758 - RNA, 20 nt, Human
acagaacgagaccccaucuc

SEQ ID NO: 507759 - RNA, 22 nt, Human
accaaagauacaaaauucucug

SEQ ID NO: 507760 - RNA, 20 nt, Human
accauucaugguaggaaaau

SEQ ID NO: 507761 - RNA, 19 nt, Human
acccaggcuggagugcagu

SEQ ID NO: 507762 - RNA, 23 nt, Human
acccaggcuggagugcaguggug

SEQ ID NO: 507763 - RNA, 20 nt, Human
accgcucccuacuaacccua

SEQ ID NO: 507764 - RNA, 18 nt, Human
accugaaaugaaauaacu

SEQ ID NO: 507765 - RNA, 20 nt, Human
acugaaagcuacagaguccg

SEQ ID NO: 507766 - RNA, 23 nt, Human
acugcacuccagucugcaugaca

SEQ ID NO: 507767 - RNA, 24 nt, Human
acugcacuccagucugcaugacag

SEQ ID NO: 507768 - RNA, 23 nt, Human
acuuuuauuccuugcuuuuagca

SEQ ID NO: 507769 - RNA, 22 nt, Human
agaaaacagaagaaagccaaag

SEQ ID NO: 507770 - RNA, 26 nt, Human
agaaagaaaacagaagaaagccaaag

SEQ ID NO: 507771 - RNA, 25 nt, Human
agaaagccaaagcuuaccacaucag

SEQ ID NO: 507772 - RNA, 18 nt, Human
agaacacugacacccugc

SEQ ID NO: 507773 - RNA, 18 nt, Human
agaagagcccaguuguuc

SEQ ID NO: 507774 - RNA, 19 nt, Human
agacaggaaccugggggcc

SEQ ID NO: 507775 - RNA, 24 nt, Human
agagaggccaaggcaggaggauca

SEQ ID NO: 507776 - RNA, 18 nt, Human
agcaggaaauaugccaaa

SEQ ID NO: 507777 - RNA, 21 nt, Human
agcauagugagacccccaucu

SEQ ID NO: 507778 - RNA, 20 nt, Human
agccgcgcaugguggcaguu

SEQ ID NO: 507779 - RNA, 22 nt, Human
agccugagcagcauagugagac

SEQ ID NO: 507780 - RNA, 24 nt, Human
agcggcucaugccuguaaucccag

SEQ ID NO: 507781 - RNA, 23 nt, Human
aggagguggagacugcagugagc

SEQ ID NO: 507782 - RNA, 24 nt, Human
aggaucacuugaggccaggaguuu

SEQ ID NO: 507783 - RNA, 22 nt, Human
aggcagcaagauaacuugagcc

SEQ ID NO: 507784 - RNA, 20 nt, Human
aggcaggaggaucacuucag

SEQ ID NO: 507785 - RNA, 21 nt, Human
aggcaggcaggucgcuugagg

SEQ ID NO: 507786 - RNA, 23 nt, Human
aggcaggcaggucgcuugagguc

SEQ ID NO: 507787 - RNA, 26 nt, Human
aggcaggcaggucgcuugaggucagg

SEQ ID NO: 507788 - RNA, 24 nt, Human
aggcauagcggcucaugccuguaa

SEQ ID NO: 507789 - RNA, 24 nt, Human
aggcuaaggugggaggaucacuug

SEQ ID NO: 507790 - RNA, 23 nt, Human
aggcuaugggcacccagcaauca

SEQ ID NO: 507791 - RNA, 18 nt, Human
aggcugagagaacacuga

SEQ ID NO: 507792 - RNA, 22 nt, Human
agggauuacaggcgugagccac

SEQ ID NO: 507793 - RNA, 24 nt, Human
agggauuacaggcgugagccaccg

SEQ ID NO: 507794 - RNA, 24 nt, Human
agggauucuccugccucagcaucc

SEQ ID NO: 507795 - RNA, 21 nt, Human
aggucaaaggucaugucuguu

SEQ ID NO: 507796 - RNA, 21 nt, Human
aggugcagcagcuuggugacc

SEQ ID NO: 507797 - RNA, 24 nt, Human
agguggagacugcagugagccaag

SEQ ID NO: 507798 - RNA, 18 nt, Human
aggugggaggaucacuug

SEQ ID NO: 507799 - RNA, 23 nt, Human
aggugggaggaucacuugaggcc

SEQ ID NO: 507800 - RNA, 23 nt, Human
aguaggccgaggauggagaauca

SEQ ID NO: 507801 - RNA, 19 nt, Human
agucacuagaaacagacca

SEQ ID NO: 507802 - RNA, 20 nt, Human
agugcaguggugcaauccug

SEQ ID NO: 507803 - RNA, 24 nt, Human
aguggcucacacuuauaaucccag

SEQ ID NO: 507804 - RNA, 21 nt, Human
auaguaaagucugugaguucc

SEQ ID NO: 507805 - RNA, 24 nt, Human
auagugagacccccaucucuaaaa

SEQ ID NO: 507806 - RNA, 22 nt, Human
auauacuuuucuaauauaucaa

SEQ ID NO: 507807 - RNA, 24 nt, Human
aucacaccacugcacuccagucug

SEQ ID NO: 507808 - RNA, 24 nt, Human
aucuguguauuuuuaguagagaug

SEQ ID NO: 507809 - RNA, 23 nt, Human
augaaauaacuucaacuaaacau

SEQ ID NO: 507810 - RNA, 20 nt, Human
augaagacuuuagucuggaa

SEQ ID NO: 507811 - RNA, 19 nt, Human
augagccauauccugcuuu

SEQ ID NO: 507812 - RNA, 21 nt, Human
augcagcgacccauaacauag

SEQ ID NO: 507813 - RNA, 19 nt, Human
augccuguaaucccagcac

SEQ ID NO: 507814 - RNA, 24 nt, Human
augggguuucgccacgcuggccag

SEQ ID NO: 507815 - RNA, 24 nt, Human
auugcacuccagccugggcgacaa

SEQ ID NO: 507816 - RNA, 25 nt, Human
auugcacuccagccugggcgacaag

SEQ ID NO: 507817 - RNA, 24 nt, Human
caaaauaauggcaucagggauccc

SEQ ID NO: 507818 - RNA, 20 nt, Human
caaacuucuccaaauauguu

SEQ ID NO: 507819 - RNA, 21 nt, Human
caaacuucuccaaauauguuc

SEQ ID NO: 507820 - RNA, 21 nt, Human
caaagugcagggauuacaggc

SEQ ID NO: 507821 - RNA, 23 nt, Human
caaagugcagggauuacaggcgu

SEQ ID NO: 507822 - RNA, 22 nt, Human
caaauuagccgcgcaugguggc

SEQ ID NO: 507823 - RNA, 24 nt, Human
caacauggcgaaaccccaucucuu

SEQ ID NO: 507824 - RNA, 20 nt, Human
caaccuucgccccccagguu

SEQ ID NO: 507825 - RNA, 21 nt, Human
caagagaagcaaagaagguaa

SEQ ID NO: 507826 - RNA, 24 nt, Human
caaggcaggcaggucgcuugaggu

SEQ ID NO: 507827 - RNA, 21 nt, Human
cacaccacugcacuccagucu

SEQ ID NO: 507828 - RNA, 23 nt, Human
cacacuuauaaucccagcaacuu

SEQ ID NO: 507829 - RNA, 20 nt, Human
cacagcacuggaaaacaccu

SEQ ID NO: 507830 - RNA, 27 nt, Human
cacagccacagaugaaugcuguuucug

SEQ ID NO: 507831 - RNA, 21 nt, Human
cacaggggccuccuggggcag

SEQ ID NO: 507832 - RNA, 18 nt, Human
caccaaagacaaacaaac

SEQ ID NO: 507833 - RNA, 22 nt, Human
caccacugcacuccagucugca

SEQ ID NO: 507834 - RNA, 24 nt, Human
cacccaggcuggagugcaguggug

SEQ ID NO: 507835 - RNA, 24 nt, Human
caccccacucaccuucuccugacu

SEQ ID NO: 507836 - RNA, 18 nt, Human
caccuguagucccagcua

SEQ ID NO: 507837 - RNA, 20 nt, Human
caccuguagucccagcuacc

SEQ ID NO: 507838 - RNA, 24 nt, Human
cacgcuggccaggccggucucaaa

SEQ ID NO: 507839 - RNA, 24 nt, Human
cacuccagccugggcgacaagagc

SEQ ID NO: 507840 - RNA, 25 nt, Human
cacuccagccugggcgacaagagcg

SEQ ID NO: 507841 - RNA, 21 nt, Human
cacugcaaccuucgcccccca

SEQ ID NO: 507842 - RNA, 18 nt, Human
cacugcacuccagucugc

SEQ ID NO: 507843 - RNA, 19 nt, Human
cacugcacuccagucugca

SEQ ID NO: 507844 - RNA, 22 nt, Human
cacugcacuccagucugcauga

SEQ ID NO: 507845 - RNA, 24 nt, Human
cacugcacuccagucugcaugaca

SEQ ID NO: 507846 - RNA, 24 nt, Human
cacugcacuccagucugcaugaca

SEQ ID NO: 507847 - RNA, 18 nt, Human
cacugucaucaugcaaag

SEQ ID NO: 507848 - RNA, 23 nt, Human
cacuuauaaucccagcaacuugg

SEQ ID NO: 507849 - RNA, 24 nt, Human
cacuuauaaucccagcaacuuggg

SEQ ID NO: 507850 - RNA, 21 nt, Human
cagaacgagaccccaucucuu

SEQ ID NO: 507851 - RNA, 24 nt, Human
cagaagaaagccaaagcuuaccac

SEQ ID NO: 507852 - RNA, 21 nt, Human
cagauugucaaggacaugcaa

SEQ ID NO: 507853 - RNA, 24 nt, Human
cagcaacuugggaggcuaaggugg

SEQ ID NO: 507854 - RNA, 18 nt, Human
cagcaagauaacuugagc

SEQ ID NO: 507855 - RNA, 18 nt, Human
cagcacuggaaaacaccu

SEQ ID NO: 507856 - RNA, 24 nt, Human
cagcacuuugggaggccaaggcag

SEQ ID NO: 507857 - RNA, 25 nt, Human
cagcacuuugggaggccaaggcagg

SEQ ID NO: 507858 - RNA, 22 nt, Human
cagcagcagcucaugcucugcg

SEQ ID NO: 507859 - RNA, 18 nt, Human
cagcaguagaaaaaaucc

SEQ ID NO: 507860 - RNA, 29 nt, Human
caggagguggagacugcagugacaacggu

SEQ ID NO: 507861 - RNA, 23 nt, Human
caggaguucaggaccagcccgag

SEQ ID NO: 507862 - RNA, 23 nt, Human
caggcaauggagauagauaauau

SEQ ID NO: 507863 - RNA, 18 nt, Human
caggcaggucgcuugagg

SEQ ID NO: 507864 - RNA, 21 nt, Human
cagggcaaaucaggacagugg

SEQ ID NO: 507865 - RNA, 24 nt, Human
caggucgcuugaggucaggagucu

SEQ ID NO: 507866 - RNA, 22 nt, Human
caggucuucaccacugucauua

SEQ ID NO: 507867 - RNA, 21 nt, Human
cauagaccuaugucaaacccu

SEQ ID NO: 507868 - RNA, 20 nt, Human
cauagugagacccccaucuc

SEQ ID NO: 507869 - RNA, 24 nt, Human
caugccuguaaucccagcacuuug

SEQ ID NO: 507870 - RNA, 19 nt, Human
cauugcacuccagccuggg

SEQ ID NO: 507871 - RNA, 21 nt, Human
cauugcacuccagccugggcg

SEQ ID NO: 507872 - RNA, 22 nt, Human
cauugcacuccagccugggcga

SEQ ID NO: 507873 - RNA, 24 nt, Human
cauugcacuccagccugggcgaca

SEQ ID NO: 507874 - RNA, 18 nt, Human
ccacugcacuccagucug

SEQ ID NO: 507875 - RNA, 18 nt, Human
ccacugcacuccagucug

SEQ ID NO: 507876 - RNA, 19 nt, Human
ccacugcacuccagucugc

SEQ ID NO: 507877 - RNA, 24 nt, Human
ccacugcacuccagucugcaugac

SEQ ID NO: 507878 - RNA, 20 nt, Human
ccauugcacuccagccuggg

SEQ ID NO: 507879 - RNA, 21 nt, Human
ccauugcacuccagccugggc

SEQ ID NO: 507880 - RNA, 22 nt, Human
ccauugcacuccagccugggcg

SEQ ID NO: 507881 - RNA, 24 nt, Human
ccauugcacuccagccugggcgac

SEQ ID NO: 507882 - RNA, 20 nt, Human
cccagcaaucaugaggcucu

SEQ ID NO: 507883 - RNA, 18 nt, Human
cccauacacaugcucaca

SEQ ID NO: 507884 - RNA, 18 nt, Human
cccaucuucuccgucuuc

SEQ ID NO: 507885 - RNA, 23 nt, Human
ccccaccaucucugcugucccug

SEQ ID NO: 507886 - RNA, 24 nt, Human
cccccagcugauagacacaggccc

SEQ ID NO: 507887 - RNA, 24 nt, Human
ccccccagguuaaagggauucucc

SEQ ID NO: 507888 - RNA, 23 nt, Human
ccggccaacauggcgaaacccca

SEQ ID NO: 507889 - RNA, 21 nt, Human
ccuccuauaacuccugcuaug

SEQ ID NO: 507890 - RNA, 18 nt, Human
ccugaccucaagugaucc

SEQ ID NO: 507891 - RNA, 19 nt, Human
ccugaccucaagugauccg

SEQ ID NO: 507892 - RNA, 18 nt, Human
ccuggaaggacaagaaaa

SEQ ID NO: 507893 - RNA, 18 nt, Human
ccuggaaggacaagaaaa

SEQ ID NO: 507894 - RNA, 24 nt, Human
ccuguaaucucagcuacucaguag

SEQ ID NO: 507895 - RNA, 20 nt, Human
ccuguagucccagcuaccag

SEQ ID NO: 507896 - RNA, 21 nt, Human
cgaaaccccaucucuuacuaa

SEQ ID NO: 507897 - RNA, 18 nt, Human
cgacgaggcauagcggcu

SEQ ID NO: 507898 - RNA, 20 nt, Human
cgaggauggagaaucaccug

SEQ ID NO: 507899 - RNA, 24 nt, Human
cgaggauggagaaucaccugaacc

SEQ ID NO: 507900 - RNA, 27 nt, Human
cgccacgcuggccaggccggucucaaa

SEQ ID NO: 507901 - RNA, 23 nt, Human
cgccccagccucucaaagugcag

SEQ ID NO: 507902 - RNA, 22 nt, Human
cggcucaugccuguaaucccag

SEQ ID NO: 507903 - RNA, 24 nt, Human
cguuccgucacccaggcuggagug

SEQ ID NO: 507904 - RNA, 22 nt, Human
cuaaauccuaucaaugucagaa

SEQ ID NO: 507905 - RNA, 19 nt, Human
cuagggacaacaggauuuc

SEQ ID NO: 507906 - RNA, 19 nt, Human
cucaagugauccgccccag

SEQ ID NO: 507907 - RNA, 23 nt, Human
cucacacuuauaaucccagcaac

SEQ ID NO: 507908 - RNA, 24 nt, Human
cucacugcaaccuucgccccccag

SEQ ID NO: 507909 - RNA, 24 nt, Human
cucaugccuguaaucccagcacuu

SEQ ID NO: 507910 - RNA, 18 nt, Human
cucuggguuaaagcugga

SEQ ID NO: 507911 - RNA, 19 nt, Human
cucuucccaaggagacuga

SEQ ID NO: 507912 - RNA, 22 nt, Human
cugacccaagauaauauaaccu

SEQ ID NO: 507913 - RNA, 22 nt, Human
cugcagugagccaagaucgugc

SEQ ID NO: 507914 - RNA, 23 nt, Human
cugccucagcauccugaguagcu

SEQ ID NO: 507915 - RNA, 24 nt, Human
cuggacaccaaaguucuccuuccg

SEQ ID NO: 507916 - RNA, 21 nt, Human
cugggaugagaagcccaaggg

SEQ ID NO: 507917 - RNA, 22 nt, Human
cuggguuaaagcuggaagucac

SEQ ID NO: 507918 - RNA, 18 nt, Human
cugugcccuuucagcagc

SEQ ID NO: 507919 - RNA, 22 nt, Human
gaaaaggaaguaacuaccccac

SEQ ID NO: 507920 - RNA, 19 nt, Human
gacagaacgagaccccauc

SEQ ID NO: 507921 - RNA, 25 nt, Human
gacagaacgagaccccaucucuuaa

SEQ ID NO: 507922 - RNA, 26 nt, Human
gaccucaagugauccgccccagccuc

SEQ ID NO: 507923 - RNA, 20 nt, Human
gacuccuuuggcuuucaggg

SEQ ID NO: 507924 - RNA, 20 nt, Human
gacuuagaacaaaagaaaac

SEQ ID NO: 507925 - RNA, 21 nt, Human
gagaagcuugaaaacaacuua

SEQ ID NO: 507926 - RNA, 20 nt, Human
gagaggcagcagagaagggg

SEQ ID NO: 507927 - RNA, 21 nt, Human
gagaugggguuucgccacgcu

SEQ ID NO: 507928 - RNA, 24 nt, Human
gagaugggguuucgccacgcuggc

SEQ ID NO: 507929 - RNA, 24 nt, Human
gaucacuugaggccaggaguuuga

SEQ ID NO: 507930 - RNA, 18 nt, Human
gauuacaggcgugagcca

SEQ ID NO: 507931 - RNA, 21 nt, Human
gauuacaggcgugagccaccg

SEQ ID NO: 507932 - RNA, 24 nt, Human
gauuacaggcgugagccaccgugc

SEQ ID NO: 507933 - RNA, 24 nt, Human
gcaaguucucugggcucuaagaga

SEQ ID NO: 507934 - RNA, 21 nt, Human
gcagcagagaaggggccacga

SEQ ID NO: 507935 - RNA, 18 nt, Human
gcagcagcuuggugaccc

SEQ ID NO: 507936 - RNA, 18 nt, Human
gcaugacagaacgagacc

SEQ ID NO: 507937 - RNA, 24 nt, Human
gcauucuguugcauuaccagugug

SEQ ID NO: 507938 - RNA, 24 nt, Human
gccaacauggcgaaaccccaucuc

SEQ ID NO: 507939 - RNA, 19 nt, Human
gccauugcacuccagccug

SEQ ID NO: 507940 - RNA, 22 nt, Human
gccauugcacuccagccugggc

SEQ ID NO: 507941 - RNA, 24 nt, Human
gccauugcacuccagccugggcga

SEQ ID NO: 507942 - RNA, 20 nt, Human
gcccaacauccauccacagg

SEQ ID NO: 507943 - RNA, 22 nt, Human
gcccaggaguucaggaccagcc

SEQ ID NO: 507944 - RNA, 24 nt, Human
gcgaaacacaaaaaccaaagauac

SEQ ID NO: 507945 - RNA, 24 nt, Human
gcgcaugguggcaguugccuguaa

SEQ ID NO: 507946 - RNA, 20 nt, Human
gcugugaucacaccacugca

SEQ ID NO: 507947 - RNA, 19 nt, Human
ggagaaucaccugaaccca

SEQ ID NO: 507948 - RNA, 19 nt, Human
ggaucacuugaggccagga

SEQ ID NO: 507949 - RNA, 22 nt, Human
ggaucacuugaggccaggaguu

SEQ ID NO: 507950 - RNA, 19 nt, Human
ggccaggaguuugagauca

SEQ ID NO: 507951 - RNA, 27 nt, Human
ggccgaggauggagaaucaccugaacc

SEQ ID NO: 507952 - RNA, 24 nt, Human
ggccggucucaaacuccugaccuc

SEQ ID NO: 507953 - RNA, 23 nt, Human
ggcgaaaccccaucucuuacuaa

SEQ ID NO: 507954 - RNA, 20 nt, Human
ggcucaugccuguaauccca

SEQ ID NO: 507955 - RNA, 23 nt, Human
ggcucaugccuguaaucccagca

SEQ ID NO: 507956 - RNA, 22 nt, Human
gggauuacaggcgugagccacc

SEQ ID NO: 507957 - RNA, 22 nt, Human
gggauuacaggcgugagccacc

SEQ ID NO: 507958 - RNA, 23 nt, Human
gggauuacaggcgugagccaccg

SEQ ID NO: 507959 - RNA, 22 nt, Human
gggguuucgccacgcuggccag

SEQ ID NO: 507960 - RNA, 24 nt, Human
gguggcaguugccuguaaucucag

SEQ ID NO: 507961 - RNA, 22 nt, Human
ggugugguggcaugcaccugua

SEQ ID NO: 507962 - RNA, 21 nt, Human
gugaguggaaagcaaacagga

SEQ ID NO: 507963 - RNA, 18 nt, Human
gugauccgccccagccuc

SEQ ID NO: 507964 - RNA, 24 nt, Human
gugcuuugcaauuuuucucagagu

SEQ ID NO: 507965 - RNA, 19 nt, Human
guuccgucacccaggcugg

SEQ ID NO: 507966 - RNA, 22 nt, Human
guuccgucacccaggcuggagu

SEQ ID NO: 507967 - RNA, 22 nt, Human
uaaaaaaagagaaaagccuucu

SEQ ID NO: 507968 - RNA, 20 nt, Human
uaaaaaacugaauaccccaa

SEQ ID NO: 507969 - RNA, 22 nt, Human
uaaaaaacugaauaccccaaga

SEQ ID NO: 507970 - RNA, 19 nt, Human
uaaacagccaugcuuaagc

SEQ ID NO: 507971 - RNA, 22 nt, Human
uaaauccuaucaaugucagaaa

SEQ ID NO: 507972 - RNA, 33 nt, Human
uaacuucaacuaaacaugucuaucucaguauua

SEQ ID NO: 507973 - RNA, 25 nt, Human
uaacuucauuguagaaaaggacauc

SEQ ID NO: 507974 - RNA, 23 nt, Human
uaacuugagcccaggaguucagg

SEQ ID NO: 507975 - RNA, 24 nt, Human
uaaggugggaggaucacuugaggc

SEQ ID NO: 507976 - RNA, 18 nt, Human
uaauagggauuuuugcuc

SEQ ID NO: 507977 - RNA, 22 nt, Human
uaauagggauuuuugcucuguu

SEQ ID NO: 507978 - RNA, 23 nt, Human
uaaucuguguauuuuuaguagag

SEQ ID NO: 507979 - RNA, 24 nt, Human
uaaucuguguauuuuuaguagaga

SEQ ID NO: 507980 - RNA, 22 nt, Human
uacaaugagcugugaucacacc

SEQ ID NO: 507981 - RNA, 22 nt, Human
uacagaccgcucccuacuaacc

SEQ ID NO: 507982 - RNA, 24 nt, Human
uacaggcgugagccaccgugccca

SEQ ID NO: 507983 - RNA, 19 nt, Human
uacaucagcacagccacag

SEQ ID NO: 507984 - RNA, 23 nt, Human
uacuaaaaaaaaauacacaaauu

SEQ ID NO: 507985 - RNA, 23 nt, Human
uacuccagugaucuuuuagaaag

SEQ ID NO: 507986 - RNA, 20 nt, Human
uacuguuucccauuauaugu

SEQ ID NO: 507987 - RNA, 23 nt, Human
uagaaaccagauugucaaggaca

SEQ ID NO: 507988 - RNA, 25 nt, Human
uagaaagaaaacagaagaaagccaa

SEQ ID NO: 507989 - RNA, 23 nt, Human
uagaacaaaagaaaacaagagaa

SEQ ID NO: 507990 - RNA, 21 nt, Human
uagcacauuucuuaacaggca

SEQ ID NO: 507991 - RNA, 24 nt, Human
uagcggcucaugccuguaauccca

SEQ ID NO: 507992 - RNA, 19 nt, Human
uaggugggugugguggcau

SEQ ID NO: 507993 - RNA, 20 nt, Human
uaggugggugugguggcaug

SEQ ID NO: 507994 - RNA, 18 nt, Human
uaguagagaugggguuuc

SEQ ID NO: 507995 - RNA, 24 nt, Human
uaguagagaugggguuucgccacg

SEQ ID NO: 507996 - RNA, 21 nt, Human
uauaaaccaccuaaacagaau

SEQ ID NO: 507997 - RNA, 20 nt, Human
uauaaagagugagcacaugu

SEQ ID NO: 507998 - RNA, 20 nt, Human
uauagcaaaaacauaaacag

SEQ ID NO: 507999 - RNA, 25 nt, Human
uauauacugaacugggaaauaacau

SEQ ID NO: 508000 - RNA, 19 nt, Human
uauuuugguaagcagacga

SEQ ID NO: 508001 - RNA, 24 nt, Human
ucaaagugcagggauuacaggcgu

SEQ ID NO: 508002 - RNA, 23 nt, Human
ucacaccacugcacuccagucug

SEQ ID NO: 508003 - RNA, 24 nt, Human
ucacccaggcuggagugcaguggu

SEQ ID NO: 508004 - RNA, 18 nt, Human
ucacugcaaccuucgccc

SEQ ID NO: 508005 - RNA, 21 nt, Human
ucacugcaaccuucgcccccc

SEQ ID NO: 508006 - RNA, 24 nt, Human
ucacugcaaccuucgccccccagg

SEQ ID NO: 508007 - RNA, 23 nt, Human
ucacuugaggccaggaguuugag

SEQ ID NO: 508008 - RNA, 20 nt, Human
ucaggacagugggaucuggg

SEQ ID NO: 508009 - RNA, 22 nt, Human
ucaugccuguaaucccagcacu

SEQ ID NO: 508010 - RNA, 21 nt, Human
uccaauuuugacaauaucucu

SEQ ID NO: 508011 - RNA, 19 nt, Human
uccagccugggcgacaaga

SEQ ID NO: 508012 - RNA, 24 nt, Human
uccaucuccaaaaaaaaaaaaaaa

SEQ ID NO: 508013 - RNA, 18 nt, Human
uccauucagcaaaaaggc

SEQ ID NO: 508014 - RNA, 24 nt, Human
ucccguuccgucacccaggcugga

SEQ ID NO: 508015 - RNA, 24 nt, Human
uccgucacccaggcuggagugcag

SEQ ID NO: 508016 - RNA, 24 nt, Human
uccugaguagcugggacaacaggu

SEQ ID NO: 508017 - RNA, 23 nt, Human
ucgugccauugcacuccagccug

SEQ ID NO: 508018 - RNA, 24 nt, Human
ucucaaagugcagggauuacaggc

SEQ ID NO: 508019 - RNA, 21 nt, Human
ucucaguauuuuuuccagcac

SEQ ID NO: 508020 - RNA, 20 nt, Human
ucuccaaaaaaaaaaaaaaa

SEQ ID NO: 508021 - RNA, 22 nt, Human
ucuccauuuaaaaucaucaaca

SEQ ID NO: 508022 - RNA, 21 nt, Human
ucucuuaaaaaaaaaaaaaaa

SEQ ID NO: 508023 - RNA, 23 nt, Human
ucugaagccaaugaugaagacuu

SEQ ID NO: 508024 - RNA, 19 nt, Human
ugaaaugaacacauucuca

SEQ ID NO: 508025 - RNA, 19 nt, Human
ugacagaacgagaccccau

SEQ ID NO: 508026 - RNA, 21 nt, Human
ugacauauguuaacacagcca

SEQ ID NO: 508027 - RNA, 22 nt, Human
ugaccagcucuuuugaaaagcc

SEQ ID NO: 508028 - RNA, 18 nt, Human
ugaccucaagugauccgc

SEQ ID NO: 508029 - RNA, 21 nt, Human
ugagacccccaucucuaaaaa

SEQ ID NO: 508030 - RNA, 21 nt, Human
ugagaggcagcagagaagggg

SEQ ID NO: 508031 - RNA, 22 nt, Human
ugagccaagaucgugccauugc

SEQ ID NO: 508032 - RNA, 23 nt, Human
ugagcccaggaguucaggaccag

SEQ ID NO: 508033 - RNA, 19 nt, Human
ugaggcagcaagauaacuu

SEQ ID NO: 508034 - RNA, 18 nt, Human
ugagguagggauaguggc

SEQ ID NO: 508035 - RNA, 22 nt, Human
ugaguuggcuaacugcaggcau

SEQ ID NO: 508036 - RNA, 24 nt, Human
ugcaccuguagucccagcuaccag

SEQ ID NO: 508037 - RNA, 22 nt, Human
ugcaguggugcaauccuggcuc

SEQ ID NO: 508038 - RNA, 21 nt, Human
ugccucagcauccugaguagc

SEQ ID NO: 508039 - RNA, 24 nt, Human
ugccucagcauccugaguagcugg

SEQ ID NO: 508040 - RNA, 23 nt, Human
ugccuguaaucccagcacuuugg

SEQ ID NO: 508041 - RNA, 24 nt, Human
ugccuguaaucccagcacuuuggg

SEQ ID NO: 508042 - RNA, 19 nt, Human
ugccuguaaucucagcuac

SEQ ID NO: 508043 - RNA, 22 nt, Human
ugccuguaaucucagcuacuca

SEQ ID NO: 508044 - RNA, 23 nt, Human
ugccuguaaucucagcuacucag

SEQ ID NO: 508045 - RNA, 21 nt, Human
uggaaagcaaacaggaaacca

SEQ ID NO: 508046 - RNA, 18 nt, Human
uggaaaugaaacuccagc

SEQ ID NO: 508047 - RNA, 21 nt, Human
uggaauuuaccaccaugagca

SEQ ID NO: 508048 - RNA, 24 nt, Human
uggagugcaguggugcaauccugg

SEQ ID NO: 508049 - RNA, 18 nt, Human
uggcacugggaacacagu

SEQ ID NO: 508050 - RNA, 21 nt, Human
uggcagagauguuuuaaguac

SEQ ID NO: 508051 - RNA, 22 nt, Human
uggcaguugccuguaaucucag

SEQ ID NO: 508052 - RNA, 22 nt, Human
uggcaugcaccuguagucccag

SEQ ID NO: 508053 - RNA, 21 nt, Human
uggccaaacccucccgauguu

SEQ ID NO: 508054 - RNA, 24 nt, Human
uggccaggccggucucaaacuccu

SEQ ID NO: 508055 - RNA, 24 nt, Human
uggcucacacuuauaaucccagca

SEQ ID NO: 508056 - RNA, 23 nt, Human
ugggaggccaaggcaggcagguc

SEQ ID NO: 508057 - RNA, 19 nt, Human
ugggaggcuaaggugggag

SEQ ID NO: 508058 - RNA, 24 nt, Human
ugggaggcuaaggugggaggauca

SEQ ID NO: 508059 - RNA, 18 nt, Human
ugggaggcugaggcagca

SEQ ID NO: 508060 - RNA, 23 nt, Human
ugggaggcugaggcagcaagaua

SEQ ID NO: 508061 - RNA, 20 nt, Human
ugggcucuaagagaaagaga

SEQ ID NO: 508062 - RNA, 24 nt, Human
ugggguuucgccacgcuggccagg

SEQ ID NO: 508063 - RNA, 24 nt, Human
ugguggcaguugccuguaaucuca

SEQ ID NO: 508064 - RNA, 24 nt, Human
ugguggcaugcaccuguaguccca

SEQ ID NO: 508065 - RNA, 24 nt, Human
uguaguaugauugagcacucucaa

SEQ ID NO: 508066 - RNA, 23 nt, Human
ugugcaaaaaucagcaguagaaa

SEQ ID NO: 508067 - RNA, 23 nt, Human
ugugcagcgaaacacaaaaacca

SEQ ID NO: 508068 - RNA, 22 nt, Human
ugugcucauucacauagcuagg

SEQ ID NO: 508069 - RNA, 18 nt, Human
ugugguggcaugcaccug

SEQ ID NO: 508070 - RNA, 23 nt, Human
uuacccaugggaggcugaggcag

SEQ ID NO: 508071 - RNA, 22 nt, Human
uuaggugggugugguggcaugc

SEQ ID NO: 508072 - RNA, 18 nt, Human
uuaguagagaugggguuu

SEQ ID NO: 508073 - RNA, 22 nt, Human
uuaguagagaugggguuucgcc

SEQ ID NO: 508074 - RNA, 23 nt, Human
uuaguagagaugggguuucgcca

SEQ ID NO: 508075 - RNA, 19 nt, Human
uucaagaagugcccccagc

SEQ ID NO: 508076 - RNA, 18 nt, Human
uucaauauauuaaccgag

SEQ ID NO: 508077 - RNA, 19 nt, Human
uucuugggcuguaagaaaa

SEQ ID NO: 508078 - RNA, 22 nt, Human
uugagcccaggaguucaggacc

SEQ ID NO: 508079 - RNA, 21 nt, Human
uugaggccaggaguuugagau

SEQ ID NO: 508080 - RNA, 25 nt, Human
uugggaggcuaaggugggaggauca

SEQ ID NO: 508081 - RNA, 21 nt, Human
uuuacaaaacugaaagcuaca

SEQ ID NO: 508082 - RNA, 20 nt, Human
uuugaaaagccugagaacca

SEQ ID NO: 508083 - RNA, 24 nt, Human
uuuggaacagacaggaaccugggg

SEQ ID NO: 508084 - RNA, 22 nt, Human
uuuuuaguagagaugggguuuc

SEQ ID NO: 508085 - RNA, 23 nt, Human
uuuuuaguagagaugggguuucg

SEQ ID NO: 508086 - RNA, 21 nt, Human
aaucuuguccccacuccuccc

SEQ ID NO: 508087 - RNA, 23 nt, Human
aucuuguccccacuccuccccca

SEQ ID NO: 508088 - RNA, 20 nt, Human
cccccaaucccacacaucug

SEQ ID NO: 508089 - RNA, 23 nt, Human
guccccacuccucccccaauccc

SEQ ID NO: 508090 - RNA, 25 nt, Human
guccccacuccucccccaaucccac

SEQ ID NO: 508091 - RNA, 19 nt, Human
uaagccgguauaaaauaca

SEQ ID NO: 508092 - RNA, 19 nt, Human
ucacuuggagauaaaaaau

SEQ ID NO: 508093 - RNA, 21 nt, Human
ucccacacaucugugcucuuc

SEQ ID NO: 508094 - RNA, 22 nt, Human
uccccacuccucccccaauccc

SEQ ID NO: 508095 - RNA, 19 nt, Human
ucccccaaucccacacauc

SEQ ID NO: 508096 - RNA, 25 nt, Human
uguccccacuccucccccaauccca

SEQ ID NO: 508097 - RNA, 19 nt, Human
aaaacaacaggcgucccca

SEQ ID NO: 508098 - RNA, 27 nt, Human
aaaauaaaaacucaugaaaauauaaga

SEQ ID NO: 508099 - RNA, 24 nt, Human
aaacaacaggcguccccacccccc

SEQ ID NO: 508100 - RNA, 20 nt, Human
aaacccaaauugagccaaaa

SEQ ID NO: 508101 - RNA, 20 nt, Human
aacaacaggcguccccaccc

SEQ ID NO: 508102 - RNA, 22 nt, Human
aacaacaggcguccccaccccc

SEQ ID NO: 508103 - RNA, 19 nt, Human
aacaggcguccccaccccc

SEQ ID NO: 508104 - RNA, 24 nt, Human
aagagaggcugccggaucgcagca

SEQ ID NO: 508105 - RNA, 18 nt, Human
acaaacccaaauugagcc

SEQ ID NO: 508106 - RNA, 22 nt, Human
acaacaggcguccccacccccc

SEQ ID NO: 508107 - RNA, 24 nt, Human
accaacaaacccaaauugagccaa

SEQ ID NO: 508108 - RNA, 24 nt, Human
acccuagaauguggaauacaaaau

SEQ ID NO: 508109 - RNA, 19 nt, Human
agcacuuuaaaaagguaau

SEQ ID NO: 508110 - RNA, 21 nt, Human
agccacacgcuccccgccccg

SEQ ID NO: 508111 - RNA, 19 nt, Human
agccccagcugccaccacg

SEQ ID NO: 508112 - RNA, 26 nt, Human
aggacagaugugccacccuaucucgg

SEQ ID NO: 508113 - RNA, 18 nt, Human
auaaagaaagccuuuucu

SEQ ID NO: 508114 - RNA, 27 nt, Human
auauucuuuagaugccuacuuuugcca

SEQ ID NO: 508115 - RNA, 19 nt, Human
caaauuacagaauacccua

SEQ ID NO: 508116 - RNA, 23 nt, Human
caacaaacccaaauugagccaaa

SEQ ID NO: 508117 - RNA, 21 nt, Human
caacaggcguccccacccccc

SEQ ID NO: 508118 - RNA, 19 nt, Human
caaccucuuagaagacgau

SEQ ID NO: 508119 - RNA, 21 nt, Human
cacagccacacgcuccccgcc

SEQ ID NO: 508120 - RNA, 19 nt, Human
cagcagaugacagacagcu

SEQ ID NO: 508121 - RNA, 21 nt, Human
cagcagaugacagacagcuga

SEQ ID NO: 508122 - RNA, 21 nt, Human
cagccacacgcuccccgcccc

SEQ ID NO: 508123 - RNA, 22 nt, Human
cagccaggacacaagaagggga

SEQ ID NO: 508124 - RNA, 19 nt, Human
cagggcacagaagagcucc

SEQ ID NO: 508125 - RNA, 19 nt, Human
ccaaaacaacaggcguccc

SEQ ID NO: 508126 - RNA, 21 nt, Human
ccaaaacaacaggcgucccca

SEQ ID NO: 508127 - RNA, 21 nt, Human
ccaacaaacccaaauugagcc

SEQ ID NO: 508128 - RNA, 21 nt, Human
ccacacgcuccccgccccgcg

SEQ ID NO: 508129 - RNA, 21 nt, Human
ccagcaucccagccagccagg

SEQ ID NO: 508130 - RNA, 19 nt, Human
ccauccacagccccagcug

SEQ ID NO: 508131 - RNA, 19 nt, Human
cccagccagccaggacaca

SEQ ID NO: 508132 - RNA, 21 nt, Human
cccgccccgcggugauuagga

SEQ ID NO: 508133 - RNA, 22 nt, Human
cccgccccgcggugauuaggaa

SEQ ID NO: 508134 - RNA, 21 nt, Human
cccucccauccacagccccag

SEQ ID NO: 508135 - RNA, 22 nt, Human
ccgaacaccaacagugcugcag

SEQ ID NO: 508136 - RNA, 23 nt, Human
ccucugaagagccaccagcaucc

SEQ ID NO: 508137 - RNA, 24 nt, Human
cgcagcagaugacagacagcugau

SEQ ID NO: 508138 - RNA, 23 nt, Human
cuaggaacaacucauuauucagc

SEQ ID NO: 508139 - RNA, 20 nt, Human
cuccaugugaccaacaaacc

SEQ ID NO: 508140 - RNA, 24 nt, Human
cucccauccacagccccagcugcc

SEQ ID NO: 508141 - RNA, 25 nt, Human
cucguccccauuaagaacacaacca

SEQ ID NO: 508142 - RNA, 25 nt, Human
cucuaggaacaacucauuauucagc

SEQ ID NO: 508143 - RNA, 21 nt, Human
gacaagagagacaguaaggaa

SEQ ID NO: 508144 - RNA, 24 nt, Human
gaccccucccauccacagggcacc

SEQ ID NO: 508145 - RNA, 26 nt, Human
gagagacaguaaggaagauuugaggc

SEQ ID NO: 508146 - RNA, 21 nt, Human
gagggauaaugugccaccacc

SEQ ID NO: 508147 - RNA, 22 nt, Human
gcagugaagagaggcugccgga

SEQ ID NO: 508148 - RNA, 20 nt, Human
gccaaaacaacaggcguccc

SEQ ID NO: 508149 - RNA, 18 nt, Human
gccacccuaucucggauu

SEQ ID NO: 508150 - RNA, 18 nt, Human
gcugcaguaagcugucuc

SEQ ID NO: 508151 - RNA, 21 nt, Human
ggaauuucucacaauccacuc

SEQ ID NO: 508152 - RNA, 18 nt, Human
ggacagaugugccacccu

SEQ ID NO: 508153 - RNA, 24 nt, Human
gucuccucuaggaacaacucauua

SEQ ID NO: 508154 - RNA, 19 nt, Human
gugggagagcaggaaugga

SEQ ID NO: 508155 - RNA, 23 nt, Human
uaauaagauuuuaauaauauugg

SEQ ID NO: 508156 - RNA, 23 nt, Human
uaaucuuuaggauaaagaaagcc

SEQ ID NO: 508157 - RNA, 19 nt, Human
uaggaacaacucauuauuc

SEQ ID NO: 508158 - RNA, 24 nt, Human
uaguaagaaguuauguguaacuuc

SEQ ID NO: 508159 - RNA, 23 nt, Human
uauaagagcacuuuaaaaaggua

SEQ ID NO: 508160 - RNA, 26 nt, Human
ucaaacacauguagauuccaugugac

SEQ ID NO: 508161 - RNA, 22 nt, Human
ucagaucagugugucugcucgu

SEQ ID NO: 508162 - RNA, 22 nt, Human
ucgcagcagaugacagacagcu

SEQ ID NO: 508163 - RNA, 21 nt, Human
ucuccaguugcagaggggccu

SEQ ID NO: 508164 - RNA, 21 nt, Human
ugaaaggcauuagcaaccucu

SEQ ID NO: 508165 - RNA, 18 nt, Human
ugagccaaaacaacaggc

SEQ ID NO: 508166 - RNA, 25 nt, Human
ugagccaaaacaacaggcgucccca

SEQ ID NO: 508167 - RNA, 22 nt, Human
ugaggccuaauuuucuuccaag

SEQ ID NO: 508168 - RNA, 24 nt, Human
ugcaccaggccaccacaggcuccc

SEQ ID NO: 508169 - RNA, 23 nt, Human
ugcaccaggccaccacaggcuuc

SEQ ID NO: 508170 - RNA, 19 nt, Human
ugcggaggaggggcaacac

SEQ ID NO: 508171 - RNA, 20 nt, Human
ugugugcagugggagagcag

SEQ ID NO: 508172 - RNA, 21 nt, Human
uuaaaugagauuaaagagaag

SEQ ID NO: 508173 - RNA, 19 nt, Human
uuauuuguccuuccagcac

SEQ ID NO: 508174 - RNA, 18 nt, Human
uucagaucagugugucug

SEQ ID NO: 508175 - RNA, 22 nt, Human
uuccgggaggguggcugggggu

SEQ ID NO: 508176 - RNA, 18 nt, Human
aaccaaccccuagcuacc

SEQ ID NO: 508177 - RNA, 20 nt, Human
aagaacccuugcccccagug

SEQ ID NO: 508178 - RNA, 21 nt, Human
aagaacccuugcccccagugu

SEQ ID NO: 508179 - RNA, 18 nt, Human
aagacccaauccuucccc

SEQ ID NO: 508180 - RNA, 22 nt, Human
acccaauccuuccccacaccag

SEQ ID NO: 508181 - RNA, 21 nt, Human
agcauuuaauggucagaaaca

SEQ ID NO: 508182 - RNA, 21 nt, Human
aggcuggguucgggucccggg

SEQ ID NO: 508183 - RNA, 21 nt, Human
caagaagaacccuugccccca

SEQ ID NO: 508184 - RNA, 21 nt, Human
caagucccuuuguccccacuc

SEQ ID NO: 508185 - RNA, 19 nt, Human
cagucagccacagaagcug

SEQ ID NO: 508186 - RNA, 24 nt, Human
ccaccuucugaugauaaccaaccc

SEQ ID NO: 508187 - RNA, 21 nt, Human
cccaauccuuccccacaccag

SEQ ID NO: 508188 - RNA, 18 nt, Human
ccccacaccaggcaaagc

SEQ ID NO: 508189 - RNA, 21 nt, Human
ccccacaugcaagaagaaccc

SEQ ID NO: 508190 - RNA, 19 nt, Human
ccccagugucaaaugggau

SEQ ID NO: 508191 - RNA, 26 nt, Human
cccccagugucaaaugggauggggau

SEQ ID NO: 508192 - RNA, 24 nt, Human
cccuauguaagcuguuaacagagu

SEQ ID NO: 508193 - RNA, 24 nt, Human
cccuuuguccccacucucuugucc

SEQ ID NO: 508194 - RNA, 23 nt, Human
ccucgguggagccggggccggug

SEQ ID NO: 508195 - RNA, 18 nt, Human
ccuugaacuugucauagg

SEQ ID NO: 508196 - RNA, 18 nt, Human
cggcgagacgggcugggg

SEQ ID NO: 508197 - RNA, 19 nt, Human
cgggcugggggacccgggc

SEQ ID NO: 508198 - RNA, 22 nt, Human
cuauguaagcuguuaacagagu

SEQ ID NO: 508199 - RNA, 19 nt, Human
cuugcccccagugucaaau

SEQ ID NO: 508200 - RNA, 23 nt, Human
gauggggaugcuagaguuauagu

SEQ ID NO: 508201 - RNA, 23 nt, Human
ggacaagacccaauccuucccca

SEQ ID NO: 508202 - RNA, 21 nt, Human
ggccugaggggagaccaccuu

SEQ ID NO: 508203 - RNA, 18 nt, Human
gggagcggcagaugagca

SEQ ID NO: 508204 - RNA, 18 nt, Human
ggguaggggagaggcugg

SEQ ID NO: 508205 - RNA, 19 nt, Human
uaacagaguucacaggggu

SEQ ID NO: 508206 - RNA, 28 nt, Human
uacaacagcauuuaauggucagaaaaga

SEQ ID NO: 508207 - RNA, 24 nt, Human
uauccuguccucuugguuuuucca

SEQ ID NO: 508208 - RNA, 25 nt, Human
ucucuuguccuugaacuugucauag

SEQ ID NO: 508209 - RNA, 23 nt, Human
ugcuagaguuauaguaaagggga

SEQ ID NO: 508210 - RNA, 18 nt, Human
ugucaaaugggaugggga

SEQ ID NO: 508211 - RNA, 23 nt, Human
uguccuugaacuugucauagggg

SEQ ID NO: 508212 - RNA, 23 nt, Human
uuuguccccacucucuuguccuu

SEQ ID NO: 508213 - RNA, 22 nt, Human
uuuuuuuuuuuuuuuuuuucag

SEQ ID NO: 508214 - RNA, 26 nt, Human
aaccugaccuccaacuuuagagccca

SEQ ID NO: 508215 - RNA, 20 nt, Human
agcagcuaucacuccucugc

SEQ ID NO: 508216 - RNA, 26 nt, Human
agccugaccuccaacuuuagagccca

SEQ ID NO: 508217 - RNA, 18 nt, Human
caaaguagcucaucccac

SEQ ID NO: 508218 - RNA, 23 nt, Human
caauaaauacaaagcuuccucug

SEQ ID NO: 508219 - RNA, 23 nt, Human
caauaaauacaaagcuuccucug

SEQ ID NO: 508220 - RNA, 19 nt, Human
cacugaaauaagaacacug

SEQ ID NO: 508221 - RNA, 19 nt, Human
cacugaaauaagaacacug

SEQ ID NO: 508222 - RNA, 22 nt, Human
cacugauuggggggaggguggg

SEQ ID NO: 508223 - RNA, 22 nt, Human
cacugauuggggggaggguggg

SEQ ID NO: 508224 - RNA, 24 nt, Human
cagagaggugggccuugaagccaa

SEQ ID NO: 508225 - RNA, 24 nt, Human
cagagaggugggccuugaagccaa

SEQ ID NO: 508226 - RNA, 23 nt, Human
ccaauaaauacaaagcuuccucu

SEQ ID NO: 508227 - RNA, 23 nt, Human
ccaauaaauacaaagcuuccucu

SEQ ID NO: 508228 - RNA, 22 nt, Human
cccacugcacgaauugcuugga

SEQ ID NO: 508229 - RNA, 24 nt, Human
ccucagguaaccugaccuccaacu

SEQ ID NO: 508230 - RNA, 24 nt, Human
ccucagguagccugaccuccaacu

SEQ ID NO: 508231 - RNA, 19 nt, Human
cuggcaaaguagcucaucc

SEQ ID NO: 508232 - RNA, 21 nt, Human
cuuuagagcccagaguacaga

SEQ ID NO: 508233 - RNA, 21 nt, Human
cuuuagagcccagaguacaga

SEQ ID NO: 508234 - RNA, 25 nt, Human
gcccagaguacagagaggugggccu

SEQ ID NO: 508235 - RNA, 25 nt, Human
gcccagaguacagagaggugggccu

SEQ ID NO: 508236 - RNA, 21 nt, Human
uaaccugaccuccaacuuuag

SEQ ID NO: 508237 - RNA, 20 nt, Human
ugauuggggggagggugggu

SEQ ID NO: 508238 - RNA, 20 nt, Human
ugauuggggggagggugggu

SEQ ID NO: 508239 - RNA, 26 nt, Human
ugauuggggggaggguggguguugca

SEQ ID NO: 508240 - RNA, 26 nt, Human
ugauuggggggaggguggguguugca

SEQ ID NO: 508241 - RNA, 18 nt, Human
uggagccugacugcccag

SEQ ID NO: 508242 - RNA, 18 nt, Human
uggagccugacugcccag

SEQ ID NO: 508243 - RNA, 26 nt, Human
uugaagccaauaaauacaaagcuucc

SEQ ID NO: 508244 - RNA, 26 nt, Human
uugaagccaauaaauacaaagcuucc

SEQ ID NO: 508245 - RNA, 26 nt, Human
aaaacaagaccaagguaaacaaaaaa

SEQ ID NO: 508246 - RNA, 21 nt, Human
aaacaagaccaagguaaacaa

SEQ ID NO: 508247 - RNA, 18 nt, Human
aaacaaggccuaaugaag

SEQ ID NO: 508248 - RNA, 19 nt, Human
aaacacggugcagcuggug

SEQ ID NO: 508249 - RNA, 19 nt, Human
aaauaaaaauuugagacuc

SEQ ID NO: 508250 - RNA, 20 nt, Human
aaauccaaauuaacuuagcc

SEQ ID NO: 508251 - RNA, 21 nt, Human
aaauggcagccauuauggcaa

SEQ ID NO: 508252 - RNA, 20 nt, Human
aacaaauccaaauuaacuua

SEQ ID NO: 508253 - RNA, 18 nt, Human
aacacggugcagcuggug

SEQ ID NO: 508254 - RNA, 20 nt, Human
aagaggcagaacagggaagg

SEQ ID NO: 508255 - RNA, 22 nt, Human
aagcacuucaaacaaaagaaaa

SEQ ID NO: 508256 - RNA, 25 nt, Human
aagcacuucaaacaaaagaaaaggu

SEQ ID NO: 508257 - RNA, 23 nt, Human
aaggaacacccauccccuuuccu

SEQ ID NO: 508258 - RNA, 26 nt, Human
acacugcaucacauauauuacucugu

SEQ ID NO: 508259 - RNA, 25 nt, Human
acagaauacuagcuuacacuaaaac

SEQ ID NO: 508260 - RNA, 18 nt, Human
acccaucccccugcucca

SEQ ID NO: 508261 - RNA, 19 nt, Human
agaaaaagagggcaaauga

SEQ ID NO: 508262 - RNA, 20 nt, Human
agaaaaagagggcaaaugag

SEQ ID NO: 508263 - RNA, 21 nt, Human
agacaaauaaagauugccccc

SEQ ID NO: 508264 - RNA, 23 nt, Human
agcagcuacccuguguucccaau

SEQ ID NO: 508265 - RNA, 23 nt, Human
agguaaacaaaaaaucuguauuu

SEQ ID NO: 508266 - RNA, 24 nt, Human
aggugguaaauacaaugccauucc

SEQ ID NO: 508267 - RNA, 23 nt, Human
aguaaccugucauucauaaagau

SEQ ID NO: 508268 - RNA, 22 nt, Human
auaaacgcaugacaugugugua

SEQ ID NO: 508269 - RNA, 23 nt, Human
auaagcacuucaaacaaaagaaa

SEQ ID NO: 508270 - RNA, 19 nt, Human
aucuauggcaaaauggcag

SEQ ID NO: 508271 - RNA, 26 nt, Human
augauacuaaagauaaagugacaauu

SEQ ID NO: 508272 - RNA, 20 nt, Human
caaauacaauuccuaauuca

SEQ ID NO: 508273 - RNA, 19 nt, Human
caacaaauacaauuccuaa

SEQ ID NO: 508274 - RNA, 18 nt, Human
caacccaacuccaggaua

SEQ ID NO: 508275 - RNA, 22 nt, Human
caaggaacacccauccccuuuc

SEQ ID NO: 508276 - RNA, 20 nt, Human
cagcuacccuguguucccaa

SEQ ID NO: 508277 - RNA, 20 nt, Human
caggguucagugagggagac

SEQ ID NO: 508278 - RNA, 19 nt, Human
caggucccaaacagaacaa

SEQ ID NO: 508279 - RNA, 20 nt, Human
cagugauuucacaguaggcu

SEQ ID NO: 508280 - RNA, 22 nt, Human
caguggcucuauuauucugcaa

SEQ ID NO: 508281 - RNA, 22 nt, Human
caguuuuucaguuauauggaaa

SEQ ID NO: 508282 - RNA, 24 nt, Human
caugacauguguguagucuaugca

SEQ ID NO: 508283 - RNA, 19 nt, Human
ccaucccccugcuccaacu

SEQ ID NO: 508284 - RNA, 21 nt, Human
ccccuguggcagcauuaaucc

SEQ ID NO: 508285 - RNA, 22 nt, Human
ccuccacuggcaaauauggagc

SEQ ID NO: 508286 - RNA, 23 nt, Human
ccuguauucacuuagaaaaagag

SEQ ID NO: 508287 - RNA, 21 nt, Human
cguguaaacauaugaagcuau

SEQ ID NO: 508288 - RNA, 23 nt, Human
cguguccuguauucacuuagaaa

SEQ ID NO: 508289 - RNA, 20 nt, Human
cuucucaaauucuucuuaaa

SEQ ID NO: 508290 - RNA, 19 nt, Human
gagcaagagcaacagcagc

SEQ ID NO: 508291 - RNA, 18 nt, Human
gcaaugaagggauauguu

SEQ ID NO: 508292 - RNA, 19 nt, Human
gcagaaagcaguugguaca

SEQ ID NO: 508293 - RNA, 22 nt, Human
ggauaccaagugaaaacagcaa

SEQ ID NO: 508294 - RNA, 21 nt, Human
gggaaugaugagacccauacu

SEQ ID NO: 508295 - RNA, 22 nt, Human
ggugagagcaagagcaacagca

SEQ ID NO: 508296 - RNA, 26 nt, Human
guaagacaaauaaagauugccccccu

SEQ ID NO: 508297 - RNA, 19 nt, Human
guccuuugggaucugcccu

SEQ ID NO: 508298 - RNA, 21 nt, Human
uaaaaccuaucuugaggaaac

SEQ ID NO: 508299 - RNA, 22 nt, Human
uaaagaucaaggaguaccucuc

SEQ ID NO: 508300 - RNA, 22 nt, Human
uaacaaauccaaauuaacuuag

SEQ ID NO: 508301 - RNA, 19 nt, Human
uaacuuagccuaaguuucc

SEQ ID NO: 508302 - RNA, 18 nt, Human
uaagacuuaaaacaagac

SEQ ID NO: 508303 - RNA, 18 nt, Human
uaaggcaaaacaguaacc

SEQ ID NO: 508304 - RNA, 22 nt, Human
uaaggcaaaacaguaaccuguc

SEQ ID NO: 508305 - RNA, 19 nt, Human
uaagguuagcaacccaacu

SEQ ID NO: 508306 - RNA, 19 nt, Human
uaaguuuccaaagcuguag

SEQ ID NO: 508307 - RNA, 18 nt, Human
uacaaugccauuccaagg

SEQ ID NO: 508308 - RNA, 20 nt, Human
uacacuaaaaccuaucuuga

SEQ ID NO: 508309 - RNA, 21 nt, Human
uacacugcaucacauauauua

SEQ ID NO: 508310 - RNA, 22 nt, Human
uacagaaaacacggugcagcug

SEQ ID NO: 508311 - RNA, 19 nt, Human
uacuaaagauaaagugaca

SEQ ID NO: 508312 - RNA, 22 nt, Human
uagaaaacaucauagaaauuaa

SEQ ID NO: 508313 - RNA, 18 nt, Human
uauaaacaaggccuaaug

SEQ ID NO: 508314 - RNA, 25 nt, Human
uaugcccauuuccuccacuggcaaa

SEQ ID NO: 508315 - RNA, 21 nt, Human
ucagugagggagacacagacu

SEQ ID NO: 508316 - RNA, 18 nt, Human
ucauaaagaucaaggagu

SEQ ID NO: 508317 - RNA, 18 nt, Human
ucccccugcuccaacucc

SEQ ID NO: 508318 - RNA, 22 nt, Human
uccucaagucucuuggccacuu

SEQ ID NO: 508319 - RNA, 23 nt, Human
ucuacgaacacacagaauacuag

SEQ ID NO: 508320 - RNA, 18 nt, Human
ucuauggcaaaauggcag

SEQ ID NO: 508321 - RNA, 19 nt, Human
ucugcaaaucuguaauuac

SEQ ID NO: 508322 - RNA, 27 nt, Human
ucugcuguuaggccagaaccggggucc

SEQ ID NO: 508323 - RNA, 21 nt, Human
ugaaucaaguaacaaauccaa

SEQ ID NO: 508324 - RNA, 22 nt, Human
ugagaucagaucaagagacagu

SEQ ID NO: 508325 - RNA, 18 nt, Human
ugaggaaacauuaaacca

SEQ ID NO: 508326 - RNA, 20 nt, Human
ugcccauuuccuccacuggc

SEQ ID NO: 508327 - RNA, 19 nt, Human
ugccuuaacaacuucacag

SEQ ID NO: 508328 - RNA, 18 nt, Human
ugccuugccuaugcuccc

SEQ ID NO: 508329 - RNA, 19 nt, Human
uguccuguauucacuuaga

SEQ ID NO: 508330 - RNA, 21 nt, Human
uuagugucuuuuaaaagcuuc

SEQ ID NO: 508331 - RNA, 20 nt, Human
uucaagagauuauaauaguu

SEQ ID NO: 508332 - RNA, 20 nt, Human
uucacaaauaugcaugacac

SEQ ID NO: 508333 - RNA, 18 nt, Human
uucacuuagaaaaagagg

SEQ ID NO: 508334 - RNA, 25 nt, Human
uuccaaggaacacccauccccuuuc

SEQ ID NO: 508335 - RNA, 22 nt, Human
uugcuucucaaauucuucuuaa

SEQ ID NO: 508336 - RNA, 20 nt, Human
uuuaaaagcuuccuaaauau

SEQ ID NO: 508337 - RNA, 21 nt, Human
uuuagugucuuuuaaaagcuu

SEQ ID NO: 508338 - RNA, 22 nt, Human
uuuaugguuuacaaucaaaaug

SEQ ID NO: 508339 - RNA, 23 nt, Human
uuucuuagcaauagaauuccgua

SEQ ID NO: 508340 - RNA, 24 nt, Human
uuuuccaggucccaaacagaacaa

SEQ ID NO: 508341 - RNA, 23 nt, Human
gcagcagaaucagguuuauugga

SEQ ID NO: 508342 - RNA, 24 nt, Human
uuuuuuuuuuuuuuuuuuuuuggg

SEQ ID NO: 508343 - RNA, 22 nt, Human
aaaaagauaaaucacaguguaa

SEQ ID NO: 508344 - RNA, 19 nt, Human
acaagaaccuuugcugaaa

SEQ ID NO: 508345 - RNA, 21 nt, Human
acccagaaguuggugacuaau

SEQ ID NO: 508346 - RNA, 23 nt, Human
aggcagcagugaauuuucagaac

SEQ ID NO: 508347 - RNA, 22 nt, Human
caaaaagauaaaucacagugua

SEQ ID NO: 508348 - RNA, 21 nt, Human
cagcaaaaagauaaaucacag

SEQ ID NO: 508349 - RNA, 20 nt, Human
ccccucagcaaaaagauaaa

SEQ ID NO: 508350 - RNA, 21 nt, Human
gaaccuuugcugaaacaguuu

SEQ ID NO: 508351 - RNA, 23 nt, Human
uacaagaaccuuugcugaaacag

SEQ ID NO: 508352 - RNA, 24 nt, Human
uagugcuccuuaggccuuuaagcu

SEQ ID NO: 508353 - RNA, 23 nt, Human
uauagccaaauguugcuagugcu

SEQ ID NO: 508354 - RNA, 24 nt, Human
uauagccaaauguugcuagugcuc

SEQ ID NO: 508355 - RNA, 21 nt, Human
ucaucuuuggcugggguuaga

SEQ ID NO: 508356 - RNA, 22 nt, Human
ugaaacaguuuccacaaaggca

SEQ ID NO: 508357 - RNA, 20 nt, Human
ugacuagcaaaccaauauag

SEQ ID NO: 508358 - RNA, 24 nt, Human
uggcugggguuagacccagaaguu

SEQ ID NO: 508359 - RNA, 21 nt, Human
uguucugcugucaucuuuggc

SEQ ID NO: 508360 - RNA, 21 nt, Human
uuacacagcaauacacacuuu

SEQ ID NO: 508361 - RNA, 24 nt, Human
uuagacccagaaguuggugacuag

SEQ ID NO: 508362 - RNA, 21 nt, Human
uucucguccuccacucgaggg

SEQ ID NO: 508363 - RNA, 24 nt, Human
uugcugaaacaguuuccacaaagg

SEQ ID NO: 508364 - RNA, 20 nt, Human
uuguucugcugucaucuuug

SEQ ID NO: 508365 - RNA, 22 nt, Human
agaaggagggggcuuggguggu

SEQ ID NO: 508366 - RNA, 25 nt, Human
agauuccacacaaagaaggaggggg

SEQ ID NO: 508367 - RNA, 18 nt, Human
auugcagauuccacacaa

SEQ ID NO: 508368 - RNA, 19 nt, Human
caaaacacaaggccaucac

SEQ ID NO: 508369 - RNA, 21 nt, Human
caaccugggcucagucuggcc

SEQ ID NO: 508370 - RNA, 26 nt, Human
cagccgagccccaaccuagacacggu

SEQ ID NO: 508371 - RNA, 19 nt, Human
caggagaccccagggccac

SEQ ID NO: 508372 - RNA, 20 nt, Human
ccaaccuagacacggucuga

SEQ ID NO: 508373 - RNA, 23 nt, Human
ccacagccgagccccaaccuaga

SEQ ID NO: 508374 - RNA, 22 nt, Human
cccagggccacagccgagcccc

SEQ ID NO: 508375 - RNA, 21 nt, Human
ccgccggugucugggcuccug

SEQ ID NO: 508376 - RNA, 18 nt, Human
cgccugaaaucaaccugg

SEQ ID NO: 508377 - RNA, 18 nt, Human
cugcagcagcuccuagcc

SEQ ID NO: 508378 - RNA, 25 nt, Human
cugcagcagcuccuagccuugcuuc

SEQ ID NO: 508379 - RNA, 19 nt, Human
cuguugcugagccucagcc

SEQ ID NO: 508380 - RNA, 21 nt, Human
gagaggagcaaaacacaaggc

SEQ ID NO: 508381 - RNA, 20 nt, Human
gcuccuagccuugcuucugg

SEQ ID NO: 508382 - RNA, 19 nt, Human
ggaggugcucagcugacug

SEQ ID NO: 508383 - RNA, 19 nt, Human
ggcauggggcuggagggag

SEQ ID NO: 508384 - RNA, 21 nt, Human
ggggcuguugcugagccucag

SEQ ID NO: 508385 - RNA, 23 nt, Human
gggggcuugggugguagcacugg

SEQ ID NO: 508386 - RNA, 20 nt, Human
guugcugagccucagcccca

SEQ ID NO: 508387 - RNA, 19 nt, Human
uaagacaguuaaccuaaac

SEQ ID NO: 508388 - RNA, 24 nt, Human
uacaaaaagucuuuauuucacaga

SEQ ID NO: 508389 - RNA, 22 nt, Human
uccacacaaagaaggagggggc

SEQ ID NO: 508390 - RNA, 21 nt, Human
uccauaguuauggggaaggac

SEQ ID NO: 508391 - RNA, 21 nt, Human
uccgccugaaaucaaccuggg

SEQ ID NO: 508392 - RNA, 23 nt, Human
uccucuccagaaggcucuucuga

SEQ ID NO: 508393 - RNA, 21 nt, Human
uccuggagcugcuguggaguc

SEQ ID NO: 508394 - RNA, 19 nt, Human
ucugagcugagcaggagac

SEQ ID NO: 508395 - RNA, 23 nt, Human
ugagcaggagaccccagggcccc

SEQ ID NO: 508396 - RNA, 21 nt, Human
ugagcaggaugggaggugcuc

SEQ ID NO: 508397 - RNA, 19 nt, Human
ugaggggcuguugcugagc

SEQ ID NO: 508398 - RNA, 21 nt, Human
ugaggggcuguugcugagccu

SEQ ID NO: 508399 - RNA, 20 nt, Human
ugccugggagucuugggguu

SEQ ID NO: 508400 - RNA, 21 nt, Human
ugcucagcugacuguccucuc

SEQ ID NO: 508401 - RNA, 19 nt, Human
ugcuguggagucuauuggu

SEQ ID NO: 508402 - RNA, 18 nt, Human
uggaagccugaggggcug

SEQ ID NO: 508403 - RNA, 20 nt, Human
ugggcucagucuggcccugg

SEQ ID NO: 508404 - RNA, 19 nt, Human
uuggaagccugaggggcug

SEQ ID NO: 508405 - RNA, 23 nt, Human
uuuaagacaguuaaccuaaacuu

SEQ ID NO: 508406 - RNA, 19 nt, Human
aagaagauaaaauucucug

SEQ ID NO: 508407 - RNA, 24 nt, Human
agagaaugcgauucaggaagaugg

SEQ ID NO: 508408 - RNA, 20 nt, Human
agaggcgaguccagguacug

SEQ ID NO: 508409 - RNA, 18 nt, Human
agagggcagggagguuag

SEQ ID NO: 508410 - RNA, 19 nt, Human
aggaagaagauaaaauucu

SEQ ID NO: 508411 - RNA, 21 nt, Human
aggccagaguccaguagagaa

SEQ ID NO: 508412 - RNA, 18 nt, Human
agugguuugcuacugaag

SEQ ID NO: 508413 - RNA, 18 nt, Human
cagcccugguggcaucuc

SEQ ID NO: 508414 - RNA, 20 nt, Human
caguggggguggauaaagac

SEQ ID NO: 508415 - RNA, 23 nt, Human
ccagaguccaguagagaaugcga

SEQ ID NO: 508416 - RNA, 19 nt, Human
ccagugaaccaaugccaag

SEQ ID NO: 508417 - RNA, 20 nt, Human
cccauggucucuacuccugg

SEQ ID NO: 508418 - RNA, 19 nt, Human
cuccagcucaauccuaauc

SEQ ID NO: 508419 - RNA, 22 nt, Human
cugcuggaaggugaccucuuuu

SEQ ID NO: 508420 - RNA, 19 nt, Human
gccugcugccaccucucca

SEQ ID NO: 508421 - RNA, 21 nt, Human
gcugaccacaacagugggggu

SEQ ID NO: 508422 - RNA, 19 nt, Human
gggcagggagguuagcuac

SEQ ID NO: 508423 - RNA, 23 nt, Human
uaaaauucucuggggcugaccac

SEQ ID NO: 508424 - RNA, 20 nt, Human
uagaaaaaugaagacucaua

SEQ ID NO: 508425 - RNA, 20 nt, Human
ucaauccuaauccaccccau

SEQ ID NO: 508426 - RNA, 19 nt, Human
uccacuucccgcgccgccu

SEQ ID NO: 508427 - RNA, 22 nt, Human
uccagccagcaggagcgagagu

SEQ ID NO: 508428 - RNA, 26 nt, Human
ucuccagcucaauccuaauccacccc

SEQ ID NO: 508429 - RNA, 23 nt, Human
ugccuguacuucucaucuucuau

SEQ ID NO: 508430 - RNA, 22 nt, Human
aaaaaaaaaaaaucaaaccagc

SEQ ID NO: 508431 - RNA, 25 nt, Human
aaaaaaaaaaaucaaaccagcaaaa

SEQ ID NO: 508432 - RNA, 29 nt, Human
aaacaagaacaugaaaaaugagggacccc

SEQ ID NO: 508433 - RNA, 20 nt, Human
aaagcggauuuucaaaacca

SEQ ID NO: 508434 - RNA, 21 nt, Human
aacuugccccccugcauagaa

SEQ ID NO: 508435 - RNA, 22 nt, Human
aagaaaaggaagauuuuuaauu

SEQ ID NO: 508436 - RNA, 23 nt, Human
aagccagaagaucuucuccacag

SEQ ID NO: 508437 - RNA, 22 nt, Human
aagccucacagggugggaaggg

SEQ ID NO: 508438 - RNA, 23 nt, Human
aaggaaaacaggagagaggaaag

SEQ ID NO: 508439 - RNA, 22 nt, Human
aaggagaaaaaaaaaacgcugg

SEQ ID NO: 508440 - RNA, 19 nt, Human
aaggagcugggaggugaug

SEQ ID NO: 508441 - RNA, 25 nt, Human
aagggccucccugaacucucacucc

SEQ ID NO: 508442 - RNA, 21 nt, Human
acacagaaaauagaagucaag

SEQ ID NO: 508443 - RNA, 20 nt, Human
acagaaaaugacuugaggau

SEQ ID NO: 508444 - RNA, 19 nt, Human
acagaacacuagagcagcc

SEQ ID NO: 508445 - RNA, 22 nt, Human
acagcccccuucccugucucaa

SEQ ID NO: 508446 - RNA, 20 nt, Human
acaugugcacaucacaugua

SEQ ID NO: 508447 - RNA, 23 nt, Human
acauguggacauacacggccaca

SEQ ID NO: 508448 - RNA, 20 nt, Human
acccuuggaucccaaucccu

SEQ ID NO: 508449 - RNA, 21 nt, Human
accuggaggaccaaucaggcu

SEQ ID NO: 508450 - RNA, 22 nt, Human
agaaaaaaaaaacgcuggaagg

SEQ ID NO: 508451 - RNA, 23 nt, Human
agaaaaaaaaaacgcuggaagga

SEQ ID NO: 508452 - RNA, 24 nt, Human
agaaagcggauuuucaaaaccagg

SEQ ID NO: 508453 - RNA, 22 nt, Human
agaagggagggcaucuuuuuau

SEQ ID NO: 508454 - RNA, 20 nt, Human
agacaaauaaaugagcaagg

SEQ ID NO: 508455 - RNA, 21 nt, Human
agacucagaaaacuuaaggca

SEQ ID NO: 508456 - RNA, 21 nt, Human
agagaaagcggauuuucaaaa

SEQ ID NO: 508457 - RNA, 25 nt, Human
agagaggaaaggaaagaguaucugg

SEQ ID NO: 508458 - RNA, 21 nt, Human
agaggaaggaaaacaggagag

SEQ ID NO: 508459 - RNA, 21 nt, Human
agaguguguaauaaaaggcug

SEQ ID NO: 508460 - RNA, 21 nt, Human
agaucuucuccacacccgcac

SEQ ID NO: 508461 - RNA, 19 nt, Human
agcagccaggggcaaggaa

SEQ ID NO: 508462 - RNA, 21 nt, Human
agcaggagaagggcacuggug

SEQ ID NO: 508463 - RNA, 21 nt, Human
aggaagccgcaacugugcuga

SEQ ID NO: 508464 - RNA, 23 nt, Human
aggaaggaaaacaggagagagga

SEQ ID NO: 508465 - RNA, 23 nt, Human
aggacagauacaugaaucaaugc

SEQ ID NO: 508466 - RNA, 21 nt, Human
aggagaaaaaaaaaacgcugg

SEQ ID NO: 508467 - RNA, 23 nt, Human
aggcaagaugcagggaagccaga

SEQ ID NO: 508468 - RNA, 24 nt, Human
aggcaagaugcagggaagccagaa

SEQ ID NO: 508469 - RNA, 18 nt, Human
aggcagauaccagauuua

SEQ ID NO: 508470 - RNA, 18 nt, Human
aggcauuggagacacucu

SEQ ID NO: 508471 - RNA, 21 nt, Human
aggcugggcgauggagguggg

SEQ ID NO: 508472 - RNA, 20 nt, Human
agggaguaaagacccuaaca

SEQ ID NO: 508473 - RNA, 19 nt, Human
aguuugaacccaggcagga

SEQ ID NO: 508474 - RNA, 24 nt, Human
auaaaaauacugcuacaaagacac

SEQ ID NO: 508475 - RNA, 19 nt, Human
aucaagaaaaggaagauuu

SEQ ID NO: 508476 - RNA, 18 nt, Human
augcagaguugcucggag

SEQ ID NO: 508477 - RNA, 18 nt, Human
caaagcaacuuaggaagc

SEQ ID NO: 508478 - RNA, 25 nt, Human
caaccaguacgcauacaugcagugu

SEQ ID NO: 508479 - RNA, 21 nt, Human
caagaacaugaaaaaugacua

SEQ ID NO: 508480 - RNA, 23 nt, Human
caccccagagggugagauuccug

SEQ ID NO: 508481 - RNA, 21 nt, Human
cagaaaacuuaaggcaucaac

SEQ ID NO: 508482 - RNA, 23 nt, Human
cagagccugcuugcacccaaccc

SEQ ID NO: 508483 - RNA, 20 nt, Human
cagcaccccagagggugaga

SEQ ID NO: 508484 - RNA, 24 nt, Human
cagcgcugaaugcuacagaaauac

SEQ ID NO: 508485 - RNA, 18 nt, Human
cagcugaaaugccaggca

SEQ ID NO: 508486 - RNA, 22 nt, Human
cagggcaguuuuuuuuucuucu

SEQ ID NO: 508487 - RNA, 33 nt, Human
caguacgcauacaugcacuucacacauguggug

SEQ ID NO: 508488 - RNA, 22 nt, Human
cauaaacuaaauacagacaaau

SEQ ID NO: 508489 - RNA, 21 nt, Human
cauacacggccacagguaucg

SEQ ID NO: 508490 - RNA, 24 nt, Human
caucaagaaaaggaagauuuuuaa

SEQ ID NO: 508491 - RNA, 21 nt, Human
cauccaguaaacuugcccccc

SEQ ID NO: 508492 - RNA, 23 nt, Human
cauuagggaguaaagacccuaac

SEQ ID NO: 508493 - RNA, 24 nt, Human
ccaaaccacauccucugggaagag

SEQ ID NO: 508494 - RNA, 20 nt, Human
ccaaaggcaagaugcaggga

SEQ ID NO: 508495 - RNA, 25 nt, Human
ccagacaggagaaugggcugggacu

SEQ ID NO: 508496 - RNA, 18 nt, Human
ccauguuuuccucucccc

SEQ ID NO: 508497 - RNA, 25 nt, Human
ccauuuaaaaaaaaaaaaaaaaaaa

SEQ ID NO: 508498 - RNA, 22 nt, Human
cccaaaucauauauagugcuag

SEQ ID NO: 508499 - RNA, 18 nt, Human
ccccaaaccacauccucu

SEQ ID NO: 508500 - RNA, 23 nt, Human
ccccaauccagaucaagucaagc

SEQ ID NO: 508501 - RNA, 20 nt, Human
ccccuccaucgccaucuugg

SEQ ID NO: 508502 - RNA, 21 nt, Human
cccgcacugggcguggguggg

SEQ ID NO: 508503 - RNA, 25 nt, Human
cccucagccaaagcaacuuaggaag

SEQ ID NO: 508504 - RNA, 21 nt, Human
cccuccaucgccaucuugggc

SEQ ID NO: 508505 - RNA, 18 nt, Human
ccgccgccgccgccgccg

SEQ ID NO: 508506 - RNA, 23 nt, Human
ccgccgccgccgccgccuccccg

SEQ ID NO: 508507 - RNA, 18 nt, Human
ccgccgccgccuccccgu

SEQ ID NO: 508508 - RNA, 20 nt, Human
ccgccgccgccuccccgugc

SEQ ID NO: 508509 - RNA, 22 nt, Human
ccgccgccgccuccccgugcuu

SEQ ID NO: 508510 - RNA, 18 nt, Human
ccgcugccgccucacccg

SEQ ID NO: 508511 - RNA, 19 nt, Human
ccgcugccgccucacccgc

SEQ ID NO: 508512 - RNA, 20 nt, Human
ccggcgcgggggccagggcc

SEQ ID NO: 508513 - RNA, 18 nt, Human
ccuacuguuaaaacagcc

SEQ ID NO: 508514 - RNA, 19 nt, Human
ccugccccaaaccacaucc

SEQ ID NO: 508515 - RNA, 24 nt, Human
ccuuuagcuucuucugggggccgc

SEQ ID NO: 508516 - RNA, 20 nt, Human
cgccgccgccgccuccccgu

SEQ ID NO: 508517 - RNA, 22 nt, Human
cggccucgggggcccgggcccg

SEQ ID NO: 508518 - RNA, 18 nt, Human
cgucaguggcccggggag

SEQ ID NO: 508519 - RNA, 19 nt, Human
cucuggaucacagcccccu

SEQ ID NO: 508520 - RNA, 18 nt, Human
cugaaggagggggaggag

SEQ ID NO: 508521 - RNA, 18 nt, Human
cuggugcugggagagcga

SEQ ID NO: 508522 - RNA, 27 nt, Human
cuuuaaaaaaaaaaaaucaaaccagca

SEQ ID NO: 508523 - RNA, 24 nt, Human
gaaaaaccaaauaaaugacauugu

SEQ ID NO: 508524 - RNA, 22 nt, Human
gaaaacaggagagaggaaagga

SEQ ID NO: 508525 - RNA, 20 nt, Human
gagccugcuugcacccaacc

SEQ ID NO: 508526 - RNA, 22 nt, Human
gagccugcuugcacccaaccca

SEQ ID NO: 508527 - RNA, 20 nt, Human
gaucacagcccccuucccug

SEQ ID NO: 508528 - RNA, 23 nt, Human
gcaaagaccuccuugccagcacc

SEQ ID NO: 508529 - RNA, 18 nt, Human
gcaauaaggagcugggag

SEQ ID NO: 508530 - RNA, 26 nt, Human
gcacugggcgugggugggcugccugg

SEQ ID NO: 508531 - RNA, 23 nt, Human
gcagggcaagcagaagcacugag

SEQ ID NO: 508532 - RNA, 18 nt, Human
gcaguuuuuuuuucuucu

SEQ ID NO: 508533 - RNA, 28 nt, Human
gcauacaugcacuucacacaugugcaca

SEQ ID NO: 508534 - RNA, 21 nt, Human
gccccuccaucgccaucuugg

SEQ ID NO: 508535 - RNA, 21 nt, Human
gccgccgccgccgccgccgcc

SEQ ID NO: 508536 - RNA, 22 nt, Human
gccgccgccgccgccgccgccu

SEQ ID NO: 508537 - RNA, 19 nt, Human
gccgccucacccgccccuc

SEQ ID NO: 508538 - RNA, 20 nt, Human
gccucccugaacucucacuc

SEQ ID NO: 508539 - RNA, 20 nt, Human
gcgcggcgccgcgggcgggg

SEQ ID NO: 508540 - RNA, 23 nt, Human
ggagaaaaaaaaaacgcuggaag

SEQ ID NO: 508541 - RNA, 19 nt, Human
ggagaagggcacuggugcu

SEQ ID NO: 508542 - RNA, 18 nt, Human
ggagacagaacacuagag

SEQ ID NO: 508543 - RNA, 19 nt, Human
ggaggcaggaggauggcag

SEQ ID NO: 508544 - RNA, 18 nt, Human
ggagggggaggaggugga

SEQ ID NO: 508545 - RNA, 21 nt, Human
ggcaaggaaggaggggaagag

SEQ ID NO: 508546 - RNA, 24 nt, Human
ggcccagaaggcagaguuaacucu

SEQ ID NO: 508547 - RNA, 18 nt, Human
ggcgggggcgcggccucg

SEQ ID NO: 508548 - RNA, 21 nt, Human
gggaggagguggaaacguagg

SEQ ID NO: 508549 - RNA, 18 nt, Human
gggcgauggagguggggg

SEQ ID NO: 508550 - RNA, 23 nt, Human
gggcgugggugggcugccugggg

SEQ ID NO: 508551 - RNA, 20 nt, Human
gggggagugaauaauccaug

SEQ ID NO: 508552 - RNA, 18 nt, Human
gucaagccucacagggug

SEQ ID NO: 508553 - RNA, 18 nt, Human
gucugggagaggugugag

SEQ ID NO: 508554 - RNA, 19 nt, Human
gucugggagaggugugaga

SEQ ID NO: 508555 - RNA, 24 nt, Human
uaaaaauacugcuacaaagacaca

SEQ ID NO: 508556 - RNA, 24 nt, Human
uaaaacagccauuuaauucagggc

SEQ ID NO: 508557 - RNA, 19 nt, Human
uaaaaggccaauagauucu

SEQ ID NO: 508558 - RNA, 19 nt, Human
uaaagaaaaaacaaacuga

SEQ ID NO: 508559 - RNA, 24 nt, Human
uaaauacagacaaauaaaugagca

SEQ ID NO: 508560 - RNA, 19 nt, Human
uaacgagauacaaaaccaa

SEQ ID NO: 508561 - RNA, 21 nt, Human
uaacgagauacaaaaccaaca

SEQ ID NO: 508562 - RNA, 18 nt, Human
uaagagccuacuguuaaa

SEQ ID NO: 508563 - RNA, 23 nt, Human
uaagagccuacuguuaaaacagc

SEQ ID NO: 508564 - RNA, 21 nt, Human
uacagaaauacuacaagugac

SEQ ID NO: 508565 - RNA, 21 nt, Human
uacaggcacacauguggacau

SEQ ID NO: 508566 - RNA, 21 nt, Human
uagagcagccaggggcaagga

SEQ ID NO: 508567 - RNA, 19 nt, Human
uaucacaaagaguaugggg

SEQ ID NO: 508568 - RNA, 22 nt, Human
ucaacagugagugacacccgag

SEQ ID NO: 508569 - RNA, 21 nt, Human
ucaacugugaguuauaggcag

SEQ ID NO: 508570 - RNA, 23 nt, Human
ucacauguguaucacaaagagua

SEQ ID NO: 508571 - RNA, 23 nt, Human
uccauggagaacccuuggauccc

SEQ ID NO: 508572 - RNA, 18 nt, Human
ucccagauuacaaaauua

SEQ ID NO: 508573 - RNA, 20 nt, Human
ucccugaacucucacucccc

SEQ ID NO: 508574 - RNA, 18 nt, Human
uccuuuagcuucuucugg

SEQ ID NO: 508575 - RNA, 23 nt, Human
ucgggccgccgccgccgccgccg

SEQ ID NO: 508576 - RNA, 19 nt, Human
ucuacaggcacacaugugg

SEQ ID NO: 508577 - RNA, 22 nt, Human
ugaaaaaccaaauaaaugacau

SEQ ID NO: 508578 - RNA, 24 nt, Human
ugaaaaaccaaauaaaugacauug

SEQ ID NO: 508579 - RNA, 19 nt, Human
ugaagaggaggcaggagga

SEQ ID NO: 508580 - RNA, 20 nt, Human
ugaaggagggggaggaggug

SEQ ID NO: 508581 - RNA, 20 nt, Human
ugacaaagggauuaauaccc

SEQ ID NO: 508582 - RNA, 20 nt, Human
ugacuuggauccauccaugg

SEQ ID NO: 508583 - RNA, 22 nt, Human
ugagaaauggccacuuucuuau

SEQ ID NO: 508584 - RNA, 24 nt, Human
ugagagggcugaggugaaaaacca

SEQ ID NO: 508585 - RNA, 23 nt, Human
ugagccucuggaucacagccccc

SEQ ID NO: 508586 - RNA, 26 nt, Human
ugagccucuggaucacaggacccguc

SEQ ID NO: 508587 - RNA, 23 nt, Human
ugagugacacccgaguauaauaa

SEQ ID NO: 508588 - RNA, 21 nt, Human
ugauccauaccugccugcccc

SEQ ID NO: 508589 - RNA, 24 nt, Human
ugcaaagaccuccuugccagcacc

SEQ ID NO: 508590 - RNA, 18 nt, Human
ugcacccaacccagccag

SEQ ID NO: 508591 - RNA, 22 nt, Human
ugcagaguugcucggaggggag

SEQ ID NO: 508592 - RNA, 20 nt, Human
ugccgccucacccgccccuc

SEQ ID NO: 508593 - RNA, 21 nt, Human
ugccugggccacgguuuccca

SEQ ID NO: 508594 - RNA, 22 nt, Human
ugcuacagaaauacuacaaguc

SEQ ID NO: 508595 - RNA, 21 nt, Human
ugcucggaggggagccagggc

SEQ ID NO: 508596 - RNA, 22 nt, Human
ugcucggaggggagccagggcc

SEQ ID NO: 508597 - RNA, 18 nt, Human
ugcugagagacauuccac

SEQ ID NO: 508598 - RNA, 21 nt, Human
ugcugggagagcgaggugacu

SEQ ID NO: 508599 - RNA, 19 nt, Human
uggaggugggggcccacag

SEQ ID NO: 508600 - RNA, 24 nt, Human
uggaggugggggcccacagggcug

SEQ ID NO: 508601 - RNA, 18 nt, Human
uggcccggggaggcgcgg

SEQ ID NO: 508602 - RNA, 20 nt, Human
ugggagcaggagaagggcac

SEQ ID NO: 508603 - RNA, 19 nt, Human
ugggcaauaaggagcuggg

SEQ ID NO: 508604 - RNA, 18 nt, Human
ugggcgugggugggcugc

SEQ ID NO: 508605 - RNA, 21 nt, Human
uggggcaccguucugaccugg

SEQ ID NO: 508606 - RNA, 20 nt, Human
ugggggcccacagggcuggg

SEQ ID NO: 508607 - RNA, 19 nt, Human
ugguguuagccacagcagc

SEQ ID NO: 508608 - RNA, 22 nt, Human
uguaucuacaggcacacaugug

SEQ ID NO: 508609 - RNA, 20 nt, Human
ugugcacaucacauguagcu

SEQ ID NO: 508610 - RNA, 20 nt, Human
uguuagccacagcagcgcug

SEQ ID NO: 508611 - RNA, 20 nt, Human
uuaaaaaaaaaaaaaaaaaa

SEQ ID NO: 508612 - RNA, 23 nt, Human
uuagagaaggaugcagaguuuga

SEQ ID NO: 508613 - RNA, 23 nt, Human
uucuucuggaagagaggcccaaa

SEQ ID NO: 508614 - RNA, 20 nt, Human
aaguagcugggacuauaggc

SEQ ID NO: 508615 - RNA, 22 nt, Human
aaguagcugggacuauaggcau

SEQ ID NO: 508616 - RNA, 24 nt, Human
aaguagcugggacuauaggcaugc

SEQ ID NO: 508617 - RNA, 21 nt, Human
caaguagcugggacuauaggc

SEQ ID NO: 508618 - RNA, 22 nt, Human
cucucagucucuuugcugucau

SEQ ID NO: 508619 - RNA, 23 nt, Human
cuguucugugcuuugaucaacag

SEQ ID NO: 508620 - RNA, 21 nt, Human
gaaccuguucugugcuuugau

SEQ ID NO: 508621 - RNA, 19 nt, Human
ucaacagucucucagucuc

SEQ ID NO: 508622 - RNA, 20 nt, Human
ugggacuauaggcaugcuac

SEQ ID NO: 508623 - RNA, 21 nt, Human
ugggacuauaggcaugcuacc

SEQ ID NO: 508624 - RNA, 21 nt, Human
ugggacuauaggcaugcuacc

SEQ ID NO: 508625 - RNA, 22 nt, Human
ugggacuauaggcaugcuaccg

SEQ ID NO: 508626 - RNA, 22 nt, Human
uucaugcaguggaaaaguuauu

SEQ ID NO: 508627 - RNA, 19 nt, Human
uuucaugcaguggaaaagu

SEQ ID NO: 508628 - RNA, 19 nt, Human
aaacccuuaaacagaaucc

SEQ ID NO: 508629 - RNA, 18 nt, Human
aacaggaaggggacauga

SEQ ID NO: 508630 - RNA, 20 nt, Human
aacaguaaaacaacaacaac

SEQ ID NO: 508631 - RNA, 23 nt, Human
aacaguaaaacaacaacaacagu

SEQ ID NO: 508632 - RNA, 24 nt, Human
aacaguaaaacaacaacaacaguc

SEQ ID NO: 508633 - RNA, 20 nt, Human
aagaacaggaaggggacaug

SEQ ID NO: 508634 - RNA, 25 nt, Human
aagaagcccaagcugaggacaagua

SEQ ID NO: 508635 - RNA, 23 nt, Human
aauaacaguaaaacaacaacaac

SEQ ID NO: 508636 - RNA, 21 nt, Human
acacuagagauguccaacccc

SEQ ID NO: 508637 - RNA, 20 nt, Human
acaguaaaacaacaacaaaa

SEQ ID NO: 508638 - RNA, 22 nt, Human
accccaagugauuauagaaaaa

SEQ ID NO: 508639 - RNA, 20 nt, Human
acuauuacuauccauauuuu

SEQ ID NO: 508640 - RNA, 22 nt, Human
agaaaaaucaauguggcagcua

SEQ ID NO: 508641 - RNA, 19 nt, Human
agaacaggaaggggacaug

SEQ ID NO: 508642 - RNA, 23 nt, Human
agacagaaugggccgcuuugggg

SEQ ID NO: 508643 - RNA, 18 nt, Human
agagagaagcugggggcg

SEQ ID NO: 508644 - RNA, 21 nt, Human
agccagugggguccagugugu

SEQ ID NO: 508645 - RNA, 22 nt, Human
aggaagaacaggaaggggaccg

SEQ ID NO: 508646 - RNA, 23 nt, Human
aggaaggaagaacaggaagggga

SEQ ID NO: 508647 - RNA, 24 nt, Human
aggaaggaagaacaggaaggggac

SEQ ID NO: 508648 - RNA, 19 nt, Human
aggaaggggacaugagagu

SEQ ID NO: 508649 - RNA, 23 nt, Human
aggaaucaguguuguccaguggg

SEQ ID NO: 508650 - RNA, 22 nt, Human
aggggacaugagagugugucca

SEQ ID NO: 508651 - RNA, 23 nt, Human
aggggcaucagcucccugggugg

SEQ ID NO: 508652 - RNA, 20 nt, Human
aggugaugggcugucgggag

SEQ ID NO: 508653 - RNA, 23 nt, Human
aggugaugggcugucgggagggg

SEQ ID NO: 508654 - RNA, 23 nt, Human
aguacaggagcaggcacaaggaa

SEQ ID NO: 508655 - RNA, 20 nt, Human
auccuauauuucuccccacc

SEQ ID NO: 508656 - RNA, 18 nt, Human
augagaguguguccagga

SEQ ID NO: 508657 - RNA, 23 nt, Human
caaaccccaagugauuauagaaa

SEQ ID NO: 508658 - RNA, 20 nt, Human
cagcugggugggcgacaggg

SEQ ID NO: 508659 - RNA, 19 nt, Human
caugagaguguguccagga

SEQ ID NO: 508660 - RNA, 20 nt, Human
cauuuuccucuccuucuugu

SEQ ID NO: 508661 - RNA, 18 nt, Human
ccacccuuccccaaggga

SEQ ID NO: 508662 - RNA, 21 nt, Human
ccaggaaggggagaaggggca

SEQ ID NO: 508663 - RNA, 20 nt, Human
cccaaaaauguacaaacccc

SEQ ID NO: 508664 - RNA, 19 nt, Human
cccacccuuccccaaggga

SEQ ID NO: 508665 - RNA, 21 nt, Human
cccagcccaccugcagucuca

SEQ ID NO: 508666 - RNA, 21 nt, Human
ccccaaaaauguacaaacccc

SEQ ID NO: 508667 - RNA, 22 nt, Human
ccccaagggauggcuagaggag

SEQ ID NO: 508668 - RNA, 22 nt, Human
cccccaaucccaauauuuacuc

SEQ ID NO: 508669 - RNA, 20 nt, Human
cccugagggaggggcagcug

SEQ ID NO: 508670 - RNA, 20 nt, Human
cccugugccagacacuggcc

SEQ ID NO: 508671 - RNA, 21 nt, Human
ccucacccccagauucucagc

SEQ ID NO: 508672 - RNA, 21 nt, Human
ccucuccuucuuguccuccuc

SEQ ID NO: 508673 - RNA, 22 nt, Human
ccugaucccucgggccuaaggg

SEQ ID NO: 508674 - RNA, 23 nt, Human
ccugaucccucgggccuaagggg

SEQ ID NO: 508675 - RNA, 18 nt, Human
ccugcagucucacugccu

SEQ ID NO: 508676 - RNA, 20 nt, Human
cuauuacuauccauauuuaa

SEQ ID NO: 508677 - RNA, 19 nt, Human
cuccccacccuuccccaag

SEQ ID NO: 508678 - RNA, 18 nt, Human
cucccucuuuccccccaa

SEQ ID NO: 508679 - RNA, 23 nt, Human
cuccucacccccagauucucagc

SEQ ID NO: 508680 - RNA, 21 nt, Human
cucuccuucuuguccuccuca

SEQ ID NO: 508681 - RNA, 18 nt, Human
gaaggaagaacaggaagg

SEQ ID NO: 508682 - RNA, 20 nt, Human
gaaggaagaacaggaagggg

SEQ ID NO: 508683 - RNA, 22 nt, Human
gauggaggaggaagaagcccaa

SEQ ID NO: 508684 - RNA, 18 nt, Human
gcagccaccucuccagga

SEQ ID NO: 508685 - RNA, 20 nt, Human
gccuaagggggugggggcag

SEQ ID NO: 508686 - RNA, 20 nt, Human
gcuccaaugggccaugucca

SEQ ID NO: 508687 - RNA, 23 nt, Human
gcucccucuuuccccccaauccc

SEQ ID NO: 508688 - RNA, 26 nt, Human
ggcgacaggggggcuucuaggaagga

SEQ ID NO: 508689 - RNA, 22 nt, Human
gggccuaagggggugggggcag

SEQ ID NO: 508690 - RNA, 21 nt, Human
gggcuucuaggaaggaagaac

SEQ ID NO: 508691 - RNA, 18 nt, Human
gggggcagcaucucugca

SEQ ID NO: 508692 - RNA, 23 nt, Human
gggggugacugagggcuggggcg

SEQ ID NO: 508693 - RNA, 25 nt, Human
ggugauggaggaggaagaagcccaa

SEQ ID NO: 508694 - RNA, 21 nt, Human
ggugaugggcugucgggaggg

SEQ ID NO: 508695 - RNA, 20 nt, Human
ggugggcccagcccaccugc

SEQ ID NO: 508696 - RNA, 18 nt, Human
guaaaacaacaacaacag

SEQ ID NO: 508697 - RNA, 19 nt, Human
gugacagggagagagaagc

SEQ ID NO: 508698 - RNA, 21 nt, Human
guggagaggaucccauccaca

SEQ ID NO: 508699 - RNA, 24 nt, Human
gugugacagggagagagaagcugg

SEQ ID NO: 508700 - RNA, 23 nt, Human
uaaaaaucugugucucucccccc

SEQ ID NO: 508701 - RNA, 21 nt, Human
uaaacccuuaaacagaaucca

SEQ ID NO: 508702 - RNA, 18 nt, Human
uaaguuaaucaggggacu

SEQ ID NO: 508703 - RNA, 19 nt, Human
uagaaaaaucaauguggca

SEQ ID NO: 508704 - RNA, 22 nt, Human
uagcugacagcaacagacagaa

SEQ ID NO: 508705 - RNA, 21 nt, Human
uaggaaggaagaacaggaagg

SEQ ID NO: 508706 - RNA, 24 nt, Human
uaggaaggaagaacaggaagggga

SEQ ID NO: 508707 - RNA, 23 nt, Human
uaguguaaaaaucugugucucuc

SEQ ID NO: 508708 - RNA, 20 nt, Human
uauagaaaaaucaauguggc

SEQ ID NO: 508709 - RNA, 21 nt, Human
uauagaaaaaucaauguggca

SEQ ID NO: 508710 - RNA, 25 nt, Human
uauagaaaaaucaauguggcagcua

SEQ ID NO: 508711 - RNA, 25 nt, Human
uauccauauuuaacacaugagaacu

SEQ ID NO: 508712 - RNA, 22 nt, Human
ucaggugauggaggaggaagaa

SEQ ID NO: 508713 - RNA, 19 nt, Human
uccacagaaacguauaggc

SEQ ID NO: 508714 - RNA, 22 nt, Human
uccagugugugacagggagaga

SEQ ID NO: 508715 - RNA, 19 nt, Human
ucccugagggaggggcagc

SEQ ID NO: 508716 - RNA, 19 nt, Human
ucccugagggaggggcagc

SEQ ID NO: 508717 - RNA, 21 nt, Human
ucccugagggaggggcagcug

SEQ ID NO: 508718 - RNA, 23 nt, Human
ucccugagggaggggcagcugga

SEQ ID NO: 508719 - RNA, 20 nt, Human
ucccugggugggcccagccc

SEQ ID NO: 508720 - RNA, 22 nt, Human
uccucuccuucuuguccuccuc

SEQ ID NO: 508721 - RNA, 23 nt, Human
ugacagggagagagaagcugggg

SEQ ID NO: 508722 - RNA, 22 nt, Human
ugggggcagcaucucugcaggg

SEQ ID NO: 508723 - RNA, 21 nt, Human
ugggggugacugagggcuggg

SEQ ID NO: 508724 - RNA, 19 nt, Human
ugggugggcgacagggggg

SEQ ID NO: 508725 - RNA, 19 nt, Human
ugucacuggcuuccccugg

SEQ ID NO: 508726 - RNA, 23 nt, Human
uguccaaccccaaggcuaugggc

SEQ ID NO: 508727 - RNA, 26 nt, Human
uguccuccucacccccagauucucaa

SEQ ID NO: 508728 - RNA, 25 nt, Human
ugugugacagggagagagaagcugg

SEQ ID NO: 508729 - RNA, 24 nt, Human
uuacuccacagaaacguauaggcu

SEQ ID NO: 508730 - RNA, 21 nt, Human
uuagaaugcuuccccugugcc

SEQ ID NO: 508731 - RNA, 27 nt, Human
uucacagucacuucauaagguagauac

SEQ ID NO: 508732 - RNA, 27 nt, Human
uuguguccucuuguuuuagugucacug

SEQ ID NO: 508733 - RNA, 20 nt, Human
aaaccuuggaacuuucuaga

SEQ ID NO: 508734 - RNA, 25 nt, Human
accaggaaaagagggcaaagcaaac

SEQ ID NO: 508735 - RNA, 20 nt, Human
agaagaaaacagagcuauaa

SEQ ID NO: 508736 - RNA, 22 nt, Human
agaagaaaacagagcuauaauc

SEQ ID NO: 508737 - RNA, 21 nt, Human
agagcuauaauccacugcguu

SEQ ID NO: 508738 - RNA, 23 nt, Human
agccacaaaccuuggaacuuucu

SEQ ID NO: 508739 - RNA, 21 nt, Human
agccucugucucucaguuuca

SEQ ID NO: 508740 - RNA, 19 nt, Human
aggcaugggugagugguag

SEQ ID NO: 508741 - RNA, 19 nt, Human
caaacaagccucugucucu

SEQ ID NO: 508742 - RNA, 23 nt, Human
ccacugcguuuccccaacccaaa

SEQ ID NO: 508743 - RNA, 24 nt, Human
ccaggcaacuuguaggucucccuu

SEQ ID NO: 508744 - RNA, 21 nt, Human
ccucaaaaacagcuggccucu

SEQ ID NO: 508745 - RNA, 24 nt, Human
cuuuagaauaauucaagccacaaa

SEQ ID NO: 508746 - RNA, 20 nt, Human
gaacauggccaggcacugac

SEQ ID NO: 508747 - RNA, 18 nt, Human
gcaaagcaaacaagccuc

SEQ ID NO: 508748 - RNA, 18 nt, Human
ggcaaagcaaacaagccu

SEQ ID NO: 508749 - RNA, 24 nt, Human
gguagggagugggggugaccagga

SEQ ID NO: 508750 - RNA, 20 nt, Human
gugguaggcauacauccaca

SEQ ID NO: 508751 - RNA, 19 nt, Human
uaauccacugcguuucccc

SEQ ID NO: 508752 - RNA, 21 nt, Human
ucucucaguuucauuaaaugu

SEQ ID NO: 508753 - RNA, 21 nt, Human
ucuucaauuauuucagcuucu

SEQ ID NO: 508754 - RNA, 21 nt, Human
ugaaggagcccggugguaggc

SEQ ID NO: 508755 - RNA, 24 nt, Human
ugcacaguuuuggaaagaagaaaa

SEQ ID NO: 508756 - RNA, 23 nt, Human
uggaacuuucuagagcacugaac

SEQ ID NO: 508757 - RNA, 23 nt, Human
uggagguuucauccaggggugca

SEQ ID NO: 508758 - RNA, 24 nt, Human
uggugaaggagcccggugguaggc

SEQ ID NO: 508759 - RNA, 19 nt, Human
ugguguuggaacuggagua

SEQ ID NO: 508760 - RNA, 19 nt, Human
uguagggaggaccugagcc

SEQ ID NO: 508761 - RNA, 23 nt, Human
uguggagcaggauccucaaaaac

SEQ ID NO: 508762 - RNA, 21 nt, Human
uucuagagcacugaaccccag

SEQ ID NO: 508763 - RNA, 22 nt, Human
uuggaacuuucuagagcacuga

SEQ ID NO: 508764 - RNA, 26 nt, Human
uuguaggucucccuugauggagguuu

SEQ ID NO: 508765 - RNA, 20 nt, Human
aacgccccaaggacagccag

SEQ ID NO: 508766 - RNA, 20 nt, Human
aagccccugggcaggagccc

SEQ ID NO: 508767 - RNA, 21 nt, Human
accacgcccacgacaaacacu

SEQ ID NO: 508768 - RNA, 19 nt, Human
acucaucuuuccuccaacc

SEQ ID NO: 508769 - RNA, 28 nt, Human
acugaaggagugacucaggaaggaggag

SEQ ID NO: 508770 - RNA, 19 nt, Human
agacuuggaggaacuggca

SEQ ID NO: 508771 - RNA, 24 nt, Human
agagggagaagacaggcgcaguca

SEQ ID NO: 508772 - RNA, 21 nt, Human
agcagcaauggcggggccaaa

SEQ ID NO: 508773 - RNA, 23 nt, Human
agccuccugcggacuccaagcag

SEQ ID NO: 508774 - RNA, 19 nt, Human
agcuaacgccugugccugg

SEQ ID NO: 508775 - RNA, 21 nt, Human
aggaacuggcacgaagccaag

SEQ ID NO: 508776 - RNA, 18 nt, Human
aggaaggaggaggggaag

SEQ ID NO: 508777 - RNA, 18 nt, Human
agugguugagagggaggg

SEQ ID NO: 508778 - RNA, 20 nt, Human
aucaggaagaggccgacuuc

SEQ ID NO: 508779 - RNA, 23 nt, Human
augcaggauggaaagaaagauuc

SEQ ID NO: 508780 - RNA, 22 nt, Human
caagccccugggcaggagcccu

SEQ ID NO: 508781 - RNA, 20 nt, Human
caccacacaccggccuaggu

SEQ ID NO: 508782 - RNA, 21 nt, Human
caccagagccuucccuggggg

SEQ ID NO: 508783 - RNA, 18 nt, Human
caccaucaccacacaccg

SEQ ID NO: 508784 - RNA, 21 nt, Human
caccuggaauacgccagcagc

SEQ ID NO: 508785 - RNA, 21 nt, Human
caccuucuucgccggcagaau

SEQ ID NO: 508786 - RNA, 21 nt, Human
cagaagaucccagcugaccac

SEQ ID NO: 508787 - RNA, 23 nt, Human
cagaccacgcccacgacaaacac

SEQ ID NO: 508788 - RNA, 20 nt, Human
cagcaccugcuccaccuggu

SEQ ID NO: 508789 - RNA, 20 nt, Human
cagcaccugcuccaccuggu

SEQ ID NO: 508790 - RNA, 22 nt, Human
cagcagcaauggcggggccaaa

SEQ ID NO: 508791 - RNA, 23 nt, Human
cagcagcaccugcuccaccuggu

SEQ ID NO: 508792 - RNA, 20 nt, Human
cagcaggggcagcuguugca

SEQ ID NO: 508793 - RNA, 23 nt, Human
cagcuuggccaggacagggggcc

SEQ ID NO: 508794 - RNA, 23 nt, Human
caggaagaggccgacuucucccg

SEQ ID NO: 508795 - RNA, 19 nt, Human
cagggccucugucaccugg

SEQ ID NO: 508796 - RNA, 21 nt, Human
cagggccucugucaccuggcc

SEQ ID NO: 508797 - RNA, 23 nt, Human
cagggcuguggggcaggauagag

SEQ ID NO: 508798 - RNA, 23 nt, Human
cagguucuccaccagagccuucc

SEQ ID NO: 508799 - RNA, 21 nt, Human
caguuugcgauuucaccaguc

SEQ ID NO: 508800 - RNA, 18 nt, Human
ccaccaucaccacacacc

SEQ ID NO: 508801 - RNA, 19 nt, Human
ccaccaucaccacacaccg

SEQ ID NO: 508802 - RNA, 22 nt, Human
ccaccaucaccacacaccggcc

SEQ ID NO: 508803 - RNA, 18 nt, Human
ccacgcccacgacaaaca

SEQ ID NO: 508804 - RNA, 22 nt, Human
cccaaggacagccaggacccac

SEQ ID NO: 508805 - RNA, 26 nt, Human
cccacgacaaacacugucuccagagg

SEQ ID NO: 508806 - RNA, 21 nt, Human
ccccaaggacagccaggaccc

SEQ ID NO: 508807 - RNA, 19 nt, Human
ccuccaaccacagagagga

SEQ ID NO: 508808 - RNA, 22 nt, Human
ccuccugcccccgguuuguccc

SEQ ID NO: 508809 - RNA, 26 nt, Human
ccucuuaaggugggcaggacggagau

SEQ ID NO: 508810 - RNA, 20 nt, Human
ccugcagcucugcagaccug

SEQ ID NO: 508811 - RNA, 22 nt, Human
ccugcccccgguuugucccuga

SEQ ID NO: 508812 - RNA, 20 nt, Human
ccugggucccggcagcgcuc

SEQ ID NO: 508813 - RNA, 22 nt, Human
ccuuugcaaacagggguccggu

SEQ ID NO: 508814 - RNA, 22 nt, Human
cgccugugccugggucccggca

SEQ ID NO: 508815 - RNA, 24 nt, Human
cggagaugccacaguggaugccac

SEQ ID NO: 508816 - RNA, 24 nt, Human
cguccuaaggaccucugcugccac

SEQ ID NO: 508817 - RNA, 20 nt, Human
cuauuccaggaggggagcug

SEQ ID NO: 508818 - RNA, 18 nt, Human
cucaggaaggaggagggg

SEQ ID NO: 508819 - RNA, 21 nt, Human
cucaggaaggaggaggggaag

SEQ ID NO: 508820 - RNA, 22 nt, Human
cuccaagcaggaagccuggcuc

SEQ ID NO: 508821 - RNA, 22 nt, Human
cuccacacucuccuccuggguu

SEQ ID NO: 508822 - RNA, 20 nt, Human
cuccaugaugauacgggguu

SEQ ID NO: 508823 - RNA, 24 nt, Human
cuccuggguuucaccuuuguaaca

SEQ ID NO: 508824 - RNA, 22 nt, Human
cucuauagucauguugagagcc

SEQ ID NO: 508825 - RNA, 20 nt, Human
cucuggacuccacacucucc

SEQ ID NO: 508826 - RNA, 21 nt, Human
cugccacagccuccugcggac

SEQ ID NO: 508827 - RNA, 19 nt, Human
cuucacucaucuuuccucc

SEQ ID NO: 508828 - RNA, 18 nt, Human
gaagaggccgacuucucc

SEQ ID NO: 508829 - RNA, 19 nt, Human
gaaggaggaggggaaggug

SEQ ID NO: 508830 - RNA, 20 nt, Human
gaccacggccccuuucucug

SEQ ID NO: 508831 - RNA, 20 nt, Human
gagaagacaggcgcagucag

SEQ ID NO: 508832 - RNA, 24 nt, Human
gagaagacaggcgcagucagcagg

SEQ ID NO: 508833 - RNA, 19 nt, Human
gagagggagggaggugcca

SEQ ID NO: 508834 - RNA, 19 nt, Human
gagagggagggaggugcca

SEQ ID NO: 508835 - RNA, 18 nt, Human
gcacuaugcuggcaaaau

SEQ ID NO: 508836 - RNA, 19 nt, Human
gcagaccacgcccacgaca

SEQ ID NO: 508837 - RNA, 18 nt, Human
gccacaggccuggaugca

SEQ ID NO: 508838 - RNA, 18 nt, Human
gccaggacagggggccgg

SEQ ID NO: 508839 - RNA, 20 nt, Human
gcccaucaggaagaggccga

SEQ ID NO: 508840 - RNA, 19 nt, Human
gcccuguggccacgggauc

SEQ ID NO: 508841 - RNA, 18 nt, Human
gccuaauggcccuuggca

SEQ ID NO: 508842 - RNA, 21 nt, Human
gccugggucccggcagcgcuc

SEQ ID NO: 508843 - RNA, 18 nt, Human
gcucuggacuccacacuc

SEQ ID NO: 508844 - RNA, 22 nt, Human
gcugccacagccuccugcggac

SEQ ID NO: 508845 - RNA, 18 nt, Human
ggaacagacgcccaguuu

SEQ ID NO: 508846 - RNA, 20 nt, Human
ggcaggacggagaugccaca

SEQ ID NO: 508847 - RNA, 24 nt, Human
gggccaaagguagcuuugaccucc

SEQ ID NO: 508848 - RNA, 20 nt, Human
gggcucuggggaggguuuga

SEQ ID NO: 508849 - RNA, 20 nt, Human
ggucagagggagaagacagg

SEQ ID NO: 508850 - RNA, 23 nt, Human
uacaaauccaggcagggcugugg

SEQ ID NO: 508851 - RNA, 19 nt, Human
uagcugugcaggaugcaaa

SEQ ID NO: 508852 - RNA, 20 nt, Human
ucaagugguugagagggagg

SEQ ID NO: 508853 - RNA, 21 nt, Human
ucaccuggccucucuccuggc

SEQ ID NO: 508854 - RNA, 24 nt, Human
ucaccuggccucucuccuggccac

SEQ ID NO: 508855 - RNA, 21 nt, Human
ucaccuucuucgccggcagaa

SEQ ID NO: 508856 - RNA, 23 nt, Human
ucagugacuuuccuccugccccc

SEQ ID NO: 508857 - RNA, 24 nt, Human
uccacacucuccuccuggguuuca

SEQ ID NO: 508858 - RNA, 18 nt, Human
uccaggaggggagcugcc

SEQ ID NO: 508859 - RNA, 23 nt, Human
uccaggaggggagcugcccugga

SEQ ID NO: 508860 - RNA, 24 nt, Human
uccaugaugauacggggucucuau

SEQ ID NO: 508861 - RNA, 23 nt, Human
ucccugaugguggcagaagaucc

SEQ ID NO: 508862 - RNA, 20 nt, Human
ucugcagaccugauguuggg

SEQ ID NO: 508863 - RNA, 20 nt, Human
ucugcccuuccucguccccc

SEQ ID NO: 508864 - RNA, 19 nt, Human
ugagagggagggaggugcc

SEQ ID NO: 508865 - RNA, 21 nt, Human
ugcaaacagggguccggugcc

SEQ ID NO: 508866 - RNA, 24 nt, Human
ugccacagccuccugcggacucca

SEQ ID NO: 508867 - RNA, 22 nt, Human
ugcccaccaucaccacacaccg

SEQ ID NO: 508868 - RNA, 22 nt, Human
ugcccuggaacgccccaaggac

SEQ ID NO: 508869 - RNA, 19 nt, Human
ugcccuuccucgucccgcu

SEQ ID NO: 508870 - RNA, 22 nt, Human
ugccuggccgggggcucugggg

SEQ ID NO: 508871 - RNA, 18 nt, Human
ugccugggucccggcagc

SEQ ID NO: 508872 - RNA, 19 nt, Human
uggaugccacugcugccac

SEQ ID NO: 508873 - RNA, 19 nt, Human
uggcagaagaucccagcug

SEQ ID NO: 508874 - RNA, 24 nt, Human
ugggcaggagcccuguggccacgg

SEQ ID NO: 508875 - RNA, 21 nt, Human
uggggaagggcaugcccacca

SEQ ID NO: 508876 - RNA, 20 nt, Human
uggggucagagggagaagac

SEQ ID NO: 508877 - RNA, 18 nt, Human
ugguugcccaucaggaag

SEQ ID NO: 508878 - RNA, 20 nt, Human
ugugcgcucuuagguuccug

SEQ ID NO: 508879 - RNA, 20 nt, Human
uucaggauucccgcauuuuc

SEQ ID NO: 508880 - RNA, 25 nt, Human
uucccacaggaacaaaggucuccau

SEQ ID NO: 508881 - RNA, 21 nt, Human
uuccucgucccgcuguuccuc

SEQ ID NO: 508882 - RNA, 19 nt, Human
uuucccacaggaacaaagg

SEQ ID NO: 508883 - RNA, 22 nt, Human
aaaaaaaaaaaaaaaagaaaaa

SEQ ID NO: 508884 - RNA, 23 nt, Human
aaaaaaaaaaaaagaaaaaagga

SEQ ID NO: 508885 - RNA, 23 nt, Human
aaaaaaaaagaaaaggcgaagag

SEQ ID NO: 508886 - RNA, 22 nt, Human
aaaaaagaaaaggcgaagagga

SEQ ID NO: 508887 - RNA, 27 nt, Human
aaaaaagacucaucccaacagaguaaa

SEQ ID NO: 508888 - RNA, 26 nt, Human
aaaaaggaaagacaguguuccuuaaa

SEQ ID NO: 508889 - RNA, 23 nt, Human
aaaccagaacauagaacaaagug

SEQ ID NO: 508890 - RNA, 19 nt, Human
aaccacucugaacagaaac

SEQ ID NO: 508891 - RNA, 22 nt, Human
aagaacgugggaaaaccaugaa

SEQ ID NO: 508892 - RNA, 19 nt, Human
aaggagcuucauauauuuu

SEQ ID NO: 508893 - RNA, 22 nt, Human
aauuaaaaaaaaaaaaaaaaga

SEQ ID NO: 508894 - RNA, 22 nt, Human
acagagcaaaguaaaaaaagga

SEQ ID NO: 508895 - RNA, 23 nt, Human
acagagcaaaguaaaaaaaggag

SEQ ID NO: 508896 - RNA, 23 nt, Human
acuaaucugcaugaaaagacaaa

SEQ ID NO: 508897 - RNA, 23 nt, Human
acuaaucugcaugaaaagacaaa

SEQ ID NO: 508898 - RNA, 22 nt, Human
acuccugccucugcuacauuuu

SEQ ID NO: 508899 - RNA, 24 nt, Human
acucugaacagaaacaaaaaaaga

SEQ ID NO: 508900 - RNA, 24 nt, Human
agaaacaaaaaaagacucauccca

SEQ ID NO: 508901 - RNA, 21 nt, Human
agaagccuggcaaaaucuacc

SEQ ID NO: 508902 - RNA, 18 nt, Human
agagaucugggagcgggg

SEQ ID NO: 508903 - RNA, 22 nt, Human
aggaaaaaaaaagaaaaggcga

SEQ ID NO: 508904 - RNA, 28 nt, Human
aggaaaaaaaaagaaaaggcgaagagga

SEQ ID NO: 508905 - RNA, 22 nt, Human
aggaaaaaaaaaggaaagacag

SEQ ID NO: 508906 - RNA, 22 nt, Human
agggaaagagaagguaaaggac

SEQ ID NO: 508907 - RNA, 23 nt, Human
auacugacaggaguuacaccaau

SEQ ID NO: 508908 - RNA, 20 nt, Human
auuaaaaaaaaaaaaaaaga

SEQ ID NO: 508909 - RNA, 24 nt, Human
caaaaccagaacauagaacaaagu

SEQ ID NO: 508910 - RNA, 18 nt, Human
caaaguaaaaaaaggagc

SEQ ID NO: 508911 - RNA, 19 nt, Human
caacaacauaacaaacuua

SEQ ID NO: 508912 - RNA, 25 nt, Human
cacucugaacagaaacaaaaaaaga

SEQ ID NO: 508913 - RNA, 20 nt, Human
caguguguagguugaugugg

SEQ ID NO: 508914 - RNA, 23 nt, Human
ccacucugaacagaaacaaaaaa

SEQ ID NO: 508915 - RNA, 20 nt, Human
ccgauggcggcggcgccucc

SEQ ID NO: 508916 - RNA, 25 nt, Human
ccgauggcggcggcgccuccgcugu

SEQ ID NO: 508917 - RNA, 19 nt, Human
ccgccucucucgucggaga

SEQ ID NO: 508918 - RNA, 27 nt, Human
ccgucgcagacgccaccgucgccgccu

SEQ ID NO: 508919 - RNA, 23 nt, Human
ccucucucgucggagacgggagc

SEQ ID NO: 508920 - RNA, 24 nt, Human
ccugcggcuccggucuggugacga

SEQ ID NO: 508921 - RNA, 18 nt, Human
ccugggacaugcauagga

SEQ ID NO: 508922 - RNA, 19 nt, Human
cgaagaggaaaaaaaaagg

SEQ ID NO: 508923 - RNA, 22 nt, Human
cgaccgauggcggcggcgccuc

SEQ ID NO: 508924 - RNA, 22 nt, Human
cgcagacgccaccgucgccgcc

SEQ ID NO: 508925 - RNA, 21 nt, Human
cgcagcgcucucucgcuccga

SEQ ID NO: 508926 - RNA, 23 nt, Human
cggcggcaggcgcagcgcucucu

SEQ ID NO: 508927 - RNA, 19 nt, Human
cgguacccuuguuggugcu

SEQ ID NO: 508928 - RNA, 26 nt, Human
cuaacuaaucugcaugaaaagacaaa

SEQ ID NO: 508929 - RNA, 26 nt, Human
cuaacuaaucugcaugaaaagacaaa

SEQ ID NO: 508930 - RNA, 24 nt, Human
cuggugacgaccgauggcggcuuu

SEQ ID NO: 508931 - RNA, 19 nt, Human
gaaaaaaaaaggaaagaca

SEQ ID NO: 508932 - RNA, 20 nt, Human
gaaaagacaaaucacgaugg

SEQ ID NO: 508933 - RNA, 23 nt, Human
gaaaagacaaaucacgaugggga

SEQ ID NO: 508934 - RNA, 18 nt, Human
gaagaggaaaaaaaaagg

SEQ ID NO: 508935 - RNA, 23 nt, Human
gacgcgcugucucccgucgcaga

SEQ ID NO: 508936 - RNA, 19 nt, Human
gaugacagcaagaggaaag

SEQ ID NO: 508937 - RNA, 22 nt, Human
gccaaaaugaggauauuuuugc

SEQ ID NO: 508938 - RNA, 22 nt, Human
gccaccgucgccgccucucucg

SEQ ID NO: 508939 - RNA, 26 nt, Human
gccaccgucgccgccucucucgucgg

SEQ ID NO: 508940 - RNA, 21 nt, Human
gccuggcaaaaucuaccaaca

SEQ ID NO: 508941 - RNA, 24 nt, Human
gcggcggcgccuccgcuguugggg

SEQ ID NO: 508942 - RNA, 24 nt, Human
ggagacgggagcaaaacacagaga

SEQ ID NO: 508943 - RNA, 18 nt, Human
ggccgggcucgggagggc

SEQ ID NO: 508944 - RNA, 21 nt, Human
ggcgcagcgcucucucgcucc

SEQ ID NO: 508945 - RNA, 23 nt, Human
gggaaaaauuaaaaaaaaaaaaa

SEQ ID NO: 508946 - RNA, 23 nt, Human
gggaaaaauuaaaaaaaaaaaaa

SEQ ID NO: 508947 - RNA, 28 nt, Human
gggaaaaauuaaaaaaaaaaaaaaagaa

SEQ ID NO: 508948 - RNA, 20 nt, Human
gggagggccugcggcuccgg

SEQ ID NO: 508949 - RNA, 22 nt, Human
gggcacggauggccgggcucgg

SEQ ID NO: 508950 - RNA, 21 nt, Human
gggccugcggcuccggucugg

SEQ ID NO: 508951 - RNA, 18 nt, Human
ggggggaaaaauuaaaaa

SEQ ID NO: 508952 - RNA, 18 nt, Human
ggggggaaaaauuaaaaa

SEQ ID NO: 508953 - RNA, 20 nt, Human
gucaguguguagguugaugu

SEQ ID NO: 508954 - RNA, 21 nt, Human
uaagcucucuggccuguuuua

SEQ ID NO: 508955 - RNA, 21 nt, Human
uaaguacacaccuauuuuccu

SEQ ID NO: 508956 - RNA, 19 nt, Human
uaagucugcuggagucacu

SEQ ID NO: 508957 - RNA, 21 nt, Human
uacaaaaccagaacauagaac

SEQ ID NO: 508958 - RNA, 21 nt, Human
uacaaaaccagaacauagaac

SEQ ID NO: 508959 - RNA, 23 nt, Human
uacaaaaccagaacauagaacaa

SEQ ID NO: 508960 - RNA, 24 nt, Human
uacaaaaccagaacauagaacaaa

SEQ ID NO: 508961 - RNA, 23 nt, Human
uacaagagcacauuacacuaaaa

SEQ ID NO: 508962 - RNA, 18 nt, Human
uaccaauauacugacagg

SEQ ID NO: 508963 - RNA, 23 nt, Human
uagaacaaagugguaaaccacug

SEQ ID NO: 508964 - RNA, 24 nt, Human
uagccaaagaacgugggaaaacca

SEQ ID NO: 508965 - RNA, 23 nt, Human
uaguugaucacaaacuugacauc

SEQ ID NO: 508966 - RNA, 19 nt, Human
uauauauauauauauauau

SEQ ID NO: 508967 - RNA, 18 nt, Human
ucacuaccacuugagugg

SEQ ID NO: 508968 - RNA, 24 nt, Human
uccaaacuccugccucugcuacau

SEQ ID NO: 508969 - RNA, 25 nt, Human
uccaaacuccugccucugcuacauu

SEQ ID NO: 508970 - RNA, 19 nt, Human
uccgacgcgcugucucccg

SEQ ID NO: 508971 - RNA, 22 nt, Human
ucuaccaacaacauaacaaacu

SEQ ID NO: 508972 - RNA, 23 nt, Human
ugaacagaaacaaaaaaagacuc

SEQ ID NO: 508973 - RNA, 25 nt, Human
ugaacagaaacaaaaaaagacucau

SEQ ID NO: 508974 - RNA, 26 nt, Human
ugaacagaaacaaaaaaagacucauc

SEQ ID NO: 508975 - RNA, 23 nt, Human
ugaggccaaaucacuucuacucc

SEQ ID NO: 508976 - RNA, 21 nt, Human
ugauguggcagggaaagagaa

SEQ ID NO: 508977 - RNA, 21 nt, Human
ugcagaaacauccagauuauc

SEQ ID NO: 508978 - RNA, 23 nt, Human
uggauugauagccugauuggccu

SEQ ID NO: 508979 - RNA, 23 nt, Human
uggcaaaaucuaccaacaacaua

SEQ ID NO: 508980 - RNA, 19 nt, Human
uggccgggcucgggagggc

SEQ ID NO: 508981 - RNA, 23 nt, Human
uggccgggcucgggagggccugc

SEQ ID NO: 508982 - RNA, 26 nt, Human
uggcggcggcgccuccgcuguugggg

SEQ ID NO: 508983 - RNA, 27 nt, Human
uggggggaaaaauuaaaaaaaaaaaaa

SEQ ID NO: 508984 - RNA, 21 nt, Human
uggggugaagaagguauaggc

SEQ ID NO: 508985 - RNA, 22 nt, Human
uuaaaaaaaaaaaaaaaagaaa

SEQ ID NO: 508986 - RNA, 20 nt, Human
uuaaaaaaaaaaaaaaagaa

SEQ ID NO: 508987 - RNA, 19 nt, Human
uugauguggcagggaaaga

SEQ ID NO: 508988 - RNA, 20 nt, Human
uuggggggaaaaauuaaaaa

SEQ ID NO: 508989 - RNA, 20 nt, Human
uuggggggaaaaauuaaaaa

SEQ ID NO: 508990 - RNA, 19 nt, Human
uuuauauauauauauauau

SEQ ID NO: 508991 - RNA, 23 nt, Human
uuugcagaaacauccagauuauc

SEQ ID NO: 508992 - RNA, 25 nt, Human
uuuggauugauagccugauuggccu

SEQ ID NO: 508993 - RNA, 21 nt, Human
uuuuauauauauauauauauu

SEQ ID NO: 508994 - RNA, 20 nt, Human
uuuuauauauauauauauuu

SEQ ID NO: 508995 - RNA, 31 nt, Human
uuuuuuuuuuuuuuauauauauauauauauu

SEQ ID NO: 508996 - RNA, 32 nt, Human
uuuuuuuuuuuuuuuauauauauauauauuau

SEQ ID NO: 508997 - RNA, 24 nt, Human
uuuuuuuuuuuuuuuuuuacaaaa

SEQ ID NO: 508998 - RNA, 20 nt, Human
aaaaauccucacaaaacaag

SEQ ID NO: 508999 - RNA, 22 nt, Human
aaaaauccucacaaaacaagaa

SEQ ID NO: 509000 - RNA, 21 nt, Human
aaauucuaaagucuacaaaaa

SEQ ID NO: 509001 - RNA, 18 nt, Human
aacaagaaggaaagguac

SEQ ID NO: 509002 - RNA, 18 nt, Human
aagaaacuuaaagccugu

SEQ ID NO: 509003 - RNA, 23 nt, Human
aagaaggaaagguacaaaaagaa

SEQ ID NO: 509004 - RNA, 22 nt, Human
aagaaucuauaaaagcaaugcc

SEQ ID NO: 509005 - RNA, 23 nt, Human
aagcaaugccacccuaaucuuaa

SEQ ID NO: 509006 - RNA, 21 nt, Human
acaaaacaagaaggaaaggua

SEQ ID NO: 509007 - RNA, 23 nt, Human
acaaaacaagaaggaaagguaca

SEQ ID NO: 509008 - RNA, 18 nt, Human
acaacccauaguuuuugc

SEQ ID NO: 509009 - RNA, 21 nt, Human
acaagaaacaccagauauucc

SEQ ID NO: 509010 - RNA, 26 nt, Human
acagcagugagcacagcaauccaugc

SEQ ID NO: 509011 - RNA, 24 nt, Human
accagcugcccaguacacuagguc

SEQ ID NO: 509012 - RNA, 18 nt, Human
agaaauaaaagagagacc

SEQ ID NO: 509013 - RNA, 19 nt, Human
agauauuccuugcucugcc

SEQ ID NO: 509014 - RNA, 24 nt, Human
caaaaaauaaccugagaccggggc

SEQ ID NO: 509015 - RNA, 21 nt, Human
caaaaaauaaccugagacucu

SEQ ID NO: 509016 - RNA, 19 nt, Human
caaaaaaugcaacaccuga

SEQ ID NO: 509017 - RNA, 20 nt, Human
caacaccugagaaaggccug

SEQ ID NO: 509018 - RNA, 21 nt, Human
caagaaauaacuaaaaacaaa

SEQ ID NO: 509019 - RNA, 24 nt, Human
caagaaggaaagguacaaaaagaa

SEQ ID NO: 509020 - RNA, 19 nt, Human
ccacaaaaauccucacaaa

SEQ ID NO: 509021 - RNA, 22 nt, Human
ccacaaaaauccucacaaaaca

SEQ ID NO: 509022 - RNA, 20 nt, Human
cccagaaauaaaagagagac

SEQ ID NO: 509023 - RNA, 21 nt, Human
ccuugggcaaccaagaaacuu

SEQ ID NO: 509024 - RNA, 18 nt, Human
cugcagcauuuucaggag

SEQ ID NO: 509025 - RNA, 24 nt, Human
cuguugcuuuaaaaucaagaaucu

SEQ ID NO: 509026 - RNA, 19 nt, Human
gaaacuuaaagccuguuuu

SEQ ID NO: 509027 - RNA, 18 nt, Human
gaaggaaagguacaaaaa

SEQ ID NO: 509028 - RNA, 21 nt, Human
gccacaaaaauccucacaaaa

SEQ ID NO: 509029 - RNA, 19 nt, Human
gucaccuuuuacagcagug

SEQ ID NO: 509030 - RNA, 22 nt, Human
uaaaaacaaaaaauaaccugag

SEQ ID NO: 509031 - RNA, 24 nt, Human
uaaaagagagacgugauagaagua

SEQ ID NO: 509032 - RNA, 18 nt, Human
uaaaagcaaugccacccu

SEQ ID NO: 509033 - RNA, 23 nt, Human
uaaaauauuaucaucacaagaaa

SEQ ID NO: 509034 - RNA, 22 nt, Human
uaaagccuguuuuauaucccag

SEQ ID NO: 509035 - RNA, 23 nt, Human
uacaacccauaguuuuugcucca

SEQ ID NO: 509036 - RNA, 24 nt, Human
uagaaguaacagugcucagugcuu

SEQ ID NO: 509037 - RNA, 18 nt, Human
uagguauuucccaaagcu

SEQ ID NO: 509038 - RNA, 20 nt, Human
uagguauuucccaaagcucu

SEQ ID NO: 509039 - RNA, 19 nt, Human
uauucaaauuacaacccau

SEQ ID NO: 509040 - RNA, 22 nt, Human
ucaggaggagucauuagauacu

SEQ ID NO: 509041 - RNA, 18 nt, Human
uccaaaaaaugcaacacc

SEQ ID NO: 509042 - RNA, 21 nt, Human
uccaagaaauaacuaaaaaca

SEQ ID NO: 509043 - RNA, 20 nt, Human
ucccagaaauaaaagagaga

SEQ ID NO: 509044 - RNA, 19 nt, Human
ucuaaagucuacaaaaauc

SEQ ID NO: 509045 - RNA, 20 nt, Human
ucuaaagucuacaaaaaucc

SEQ ID NO: 509046 - RNA, 25 nt, Human
ucuacaaaaauccuguuaaaucaag

SEQ ID NO: 509047 - RNA, 21 nt, Human
ucuuagguauuucccaaagcu

SEQ ID NO: 509048 - RNA, 20 nt, Human
ugagcacagcaauccaugcc

SEQ ID NO: 509049 - RNA, 25 nt, Human
ugagcacagcaauccaugccacaaa

SEQ ID NO: 509050 - RNA, 20 nt, Human
ugcaccgccaccagcugccc

SEQ ID NO: 509051 - RNA, 23 nt, Human
ugccacaaaaauccucacaaaac

SEQ ID NO: 509052 - RNA, 27 nt, Human
ugccacaaaaauccucacaaaacaaga

SEQ ID NO: 509053 - RNA, 22 nt, Human
ugccuagaauaaggcgccacac

SEQ ID NO: 509054 - RNA, 24 nt, Human
ugcucagugcuugcaacccaaguc

SEQ ID NO: 509055 - RNA, 22 nt, Human
uuaaaaucaagaaucuauaaaa

SEQ ID NO: 509056 - RNA, 24 nt, Human
uuuauacugcagcauuuucaggag

SEQ ID NO: 509057 - RNA, 21 nt, Human
aaagagacagggacuuggcaa

SEQ ID NO: 509058 - RNA, 21 nt, Human
aaggacacuauuaagggacac

SEQ ID NO: 509059 - RNA, 22 nt, Human
aauaauaggaccacaugagaaa

SEQ ID NO: 509060 - RNA, 22 nt, Human
acauacucuugagcaaugcuaa

SEQ ID NO: 509061 - RNA, 22 nt, Human
acuauuaagggacacuuuugag

SEQ ID NO: 509062 - RNA, 21 nt, Human
agacagggacuuggcaagugg

SEQ ID NO: 509063 - RNA, 28 nt, Human
agacaggugaacucacaaaguauaggca

SEQ ID NO: 509064 - RNA, 19 nt, Human
aggaaaaacugaugaagua

SEQ ID NO: 509065 - RNA, 22 nt, Human
aggaccacaugagaaacuguuc

SEQ ID NO: 509066 - RNA, 26 nt, Human
auacaccuuucaaaaggaaaaacuga

SEQ ID NO: 509067 - RNA, 19 nt, Human
caacuucagaaggcucugc

SEQ ID NO: 509068 - RNA, 20 nt, Human
caccuuucaaaaggaaaaac

SEQ ID NO: 509069 - RNA, 20 nt, Human
caguagacaaauaauaggac

SEQ ID NO: 509070 - RNA, 24 nt, Human
ccagccuacuuacaaauaaagcua

SEQ ID NO: 509071 - RNA, 23 nt, Human
cuccagagacuguuacacucccu

SEQ ID NO: 509072 - RNA, 23 nt, Human
cucccuuaaguccuucuugguaa

SEQ ID NO: 509073 - RNA, 19 nt, Human
cucuuucuccucgguuugc

SEQ ID NO: 509074 - RNA, 20 nt, Human
cugaaagagacagggacuug

SEQ ID NO: 509075 - RNA, 22 nt, Human
cuucucuuuuuuucucuuucuc

SEQ ID NO: 509076 - RNA, 18 nt, Human
gaaacuguucggcaggug

SEQ ID NO: 509077 - RNA, 19 nt, Human
gaacucacaaaguauaggc

SEQ ID NO: 509078 - RNA, 18 nt, Human
gcucaaagugguccucca

SEQ ID NO: 509079 - RNA, 24 nt, Human
gcuuucuuuuuaacuuguuuagcu

SEQ ID NO: 509080 - RNA, 21 nt, Human
gguauaaacuguauuacaacc

SEQ ID NO: 509081 - RNA, 20 nt, Human
ggugaacucacaaaguauag

SEQ ID NO: 509082 - RNA, 19 nt, Human
uaacuuguuuagcuuuggg

SEQ ID NO: 509083 - RNA, 24 nt, Human
uaaguauagguaauccacaucaaa

SEQ ID NO: 509084 - RNA, 21 nt, Human
uagagcauacacugguauaaa

SEQ ID NO: 509085 - RNA, 23 nt, Human
uaggaccacaugagaaacuguuc

SEQ ID NO: 509086 - RNA, 18 nt, Human
ucaccuuauaaugagaag

SEQ ID NO: 509087 - RNA, 22 nt, Human
ucagaaggcucugcuuucuuuu

SEQ ID NO: 509088 - RNA, 25 nt, Human
ucccuuaaguccuucuugguaaaua

SEQ ID NO: 509089 - RNA, 20 nt, Human
ucuaaucuacagauaauaca

SEQ ID NO: 509090 - RNA, 23 nt, Human
ucuaaucuacagauaauacauua

SEQ ID NO: 509091 - RNA, 21 nt, Human
ucuucagucuuaucagauuuu

SEQ ID NO: 509092 - RNA, 22 nt, Human
ugaaagagacagggacuuggca

SEQ ID NO: 509093 - RNA, 22 nt, Human
ugaaaucuuguuucaaaacauu

SEQ ID NO: 509094 - RNA, 18 nt, Human
ugagaaacuguucggcag

SEQ ID NO: 509095 - RNA, 18 nt, Human
ugucugaaagagacaggg

SEQ ID NO: 509096 - RNA, 23 nt, Human
ugucugaaagagacagggacuug

SEQ ID NO: 509097 - RNA, 19 nt, Human
uuauuucagggaaggacac

SEQ ID NO: 509098 - RNA, 22 nt, Human
uucaaaaggaaaaacugaugaa

SEQ ID NO: 509099 - RNA, 22 nt, Human
uucauacaccuuucaaaaggaa

SEQ ID NO: 509100 - RNA, 23 nt, Human
uuccaaaggcucaaagugguccu

SEQ ID NO: 509101 - RNA, 24 nt, Human
uuccaauaggaagaaguggaguac

SEQ ID NO: 509102 - RNA, 22 nt, Human
uugagcaaugcuaaucugcgcc

SEQ ID NO: 509103 - RNA, 20 nt, Human
uugcucaguauuaagucuca

SEQ ID NO: 509104 - RNA, 21 nt, Human
uuggggaaaacaguuucuucc

SEQ ID NO: 509105 - RNA, 23 nt, Human
aaaaaauuaccuucaaaacccac

SEQ ID NO: 509106 - RNA, 22 nt, Human
aaacuaggauacugcacaaaca

SEQ ID NO: 509107 - RNA, 21 nt, Human
aaagccucaacauaaaaaaau

SEQ ID NO: 509108 - RNA, 25 nt, Human
acaucaauuuggcuucaaaaagacc

SEQ ID NO: 509109 - RNA, 26 nt, Human
caaaacccacugagacauucucacau

SEQ ID NO: 509110 - RNA, 23 nt, Human
caucuucuucaucaucuucauug

SEQ ID NO: 509111 - RNA, 20 nt, Human
ccacaguaacgacgccaugg

SEQ ID NO: 509112 - RNA, 18 nt, Human
ccccugcgucgccucccc

SEQ ID NO: 509113 - RNA, 21 nt, Human
ccgccccugcgucgccucccc

SEQ ID NO: 509114 - RNA, 19 nt, Human
ccgccgccccugcgucgcc

SEQ ID NO: 509115 - RNA, 20 nt, Human
ccgccgccccugcgucgccu

SEQ ID NO: 509116 - RNA, 20 nt, Human
ccgcucgcucuccgccgccc

SEQ ID NO: 509117 - RNA, 20 nt, Human
ccuucaaaacccacugagac

SEQ ID NO: 509118 - RNA, 19 nt, Human
cucuccgccgccccugcgu

SEQ ID NO: 509119 - RNA, 19 nt, Human
cugcaguacucuuaauacc

SEQ ID NO: 509120 - RNA, 24 nt, Human
cuucacaucaauuuggcuucaaaa

SEQ ID NO: 509121 - RNA, 21 nt, Human
uaaaguggagagcugggaucc

SEQ ID NO: 509122 - RNA, 21 nt, Human
uaaaguggagagcugggaucc

SEQ ID NO: 509123 - RNA, 18 nt, Human
uauucaaaaggaucacaa

SEQ ID NO: 509124 - RNA, 25 nt, Human
uauuuugccaucugugacaguuuca

SEQ ID NO: 509125 - RNA, 21 nt, Human
uccgggguuggcugagguuug

SEQ ID NO: 509126 - RNA, 24 nt, Human
ucgaaaaagccucaacauaaaaaa

SEQ ID NO: 509127 - RNA, 20 nt, Human
ucgcucuccgccgccccugc

SEQ ID NO: 509128 - RNA, 23 nt, Human
ucuccgccgccccugcgucgccu

SEQ ID NO: 509129 - RNA, 18 nt, Human
ugaauuagcugccaaauc

SEQ ID NO: 509130 - RNA, 22 nt, Human
ugaguaaaguggagagcuggga

SEQ ID NO: 509131 - RNA, 22 nt, Human
ugggauccuucuguaaaacuuc

SEQ ID NO: 509132 - RNA, 24 nt, Human
uuccacacggugacuggauucuac

SEQ ID NO: 509133 - RNA, 25 nt, Human
uucucacauaaacuaggauacugca

SEQ ID NO: 509134 - RNA, 18 nt, Human
accaccacaccaaagugu

SEQ ID NO: 509135 - RNA, 21 nt, Human
aguguuguuuuuuguuuuuga

SEQ ID NO: 509136 - RNA, 23 nt, Human
cagcaagaagggagauugacaga

SEQ ID NO: 509137 - RNA, 21 nt, Human
gaaaauagcuacguaccauac

SEQ ID NO: 509138 - RNA, 20 nt, Human
gaagggauuuaagggcugcc

SEQ ID NO: 509139 - RNA, 28 nt, Human
guguuguuuuuuguuuuuguuuuuuuuu

SEQ ID NO: 509140 - RNA, 24 nt, Human
uaauauagucauaugaaagcuaau

SEQ ID NO: 509141 - RNA, 25 nt, Human
uguuguuuuuuguuuuuguuuuuuu

SEQ ID NO: 509142 - RNA, 24 nt, Human
uuaaacaaauggagaaaagacaga

SEQ ID NO: 509143 - RNA, 19 nt, Human
uuucccaaaaauacuucca

SEQ ID NO: 509144 - RNA, 18 nt, Human
uuuuuugguuucucuuuu

SEQ ID NO: 509145 - RNA, 18 nt, Human
aacaucauuuauuguuag

SEQ ID NO: 509146 - RNA, 24 nt, Human
aacuucucauccagaacccacccc

SEQ ID NO: 509147 - RNA, 20 nt, Human
acagggcagcccagagccuc

SEQ ID NO: 509148 - RNA, 23 nt, Human
accccucuugcagcccgcucagc

SEQ ID NO: 509149 - RNA, 19 nt, Human
agacccggccagccuuggg

SEQ ID NO: 509150 - RNA, 25 nt, Human
aggagccgacagggcagcccagagc

SEQ ID NO: 509151 - RNA, 20 nt, Human
agguuuuauuucaaguuggg

SEQ ID NO: 509152 - RNA, 24 nt, Human
auaguaguaagaagggugcugcga

SEQ ID NO: 509153 - RNA, 24 nt, Human
caagguucacucucuacucccucg

SEQ ID NO: 509154 - RNA, 18 nt, Human
caaguacguggcuuauca

SEQ ID NO: 509155 - RNA, 22 nt, Human
cagcagcuucuucuccaaugcu

SEQ ID NO: 509156 - RNA, 21 nt, Human
cagcuguuuucccagaugugu

SEQ ID NO: 509157 - RNA, 20 nt, Human
ccagaacccaccccucuugc

SEQ ID NO: 509158 - RNA, 21 nt, Human
ccaugcucagcagcuucuucu

SEQ ID NO: 509159 - RNA, 19 nt, Human
cccagagccucccacugac

SEQ ID NO: 509160 - RNA, 19 nt, Human
ccccucacccucucugucu

SEQ ID NO: 509161 - RNA, 25 nt, Human
ccgacagggcagcccagagccuccc

SEQ ID NO: 509162 - RNA, 21 nt, Human
ccucccacugacaaguguggu

SEQ ID NO: 509163 - RNA, 21 nt, Human
cgagacaggggucugaaguca

SEQ ID NO: 509164 - RNA, 20 nt, Human
cgccccggugcuaauuauuc

SEQ ID NO: 509165 - RNA, 23 nt, Human
cgggagaagcgcacaucagugac

SEQ ID NO: 509166 - RNA, 23 nt, Human
cguggaggcaggacuggaggcug

SEQ ID NO: 509167 - RNA, 18 nt, Human
cucagcagcuucuucucc

SEQ ID NO: 509168 - RNA, 22 nt, Human
cuggccagcagcguaccuuucc

SEQ ID NO: 509169 - RNA, 23 nt, Human
cugggcucaaccccucacccucu

SEQ ID NO: 509170 - RNA, 23 nt, Human
cuguagcuccgaauaggggaugg

SEQ ID NO: 509171 - RNA, 22 nt, Human
gagguugcagcuguuuucccag

SEQ ID NO: 509172 - RNA, 19 nt, Human
gcagcuguuuucccagaug

SEQ ID NO: 509173 - RNA, 21 nt, Human
ggagcaccgugaggaagaagc

SEQ ID NO: 509174 - RNA, 33 nt, Human
gggagauaaggucuucagguuuuauuucaagaa

SEQ ID NO: 509175 - RNA, 19 nt, Human
guauccgagguugcagcug

SEQ ID NO: 509176 - RNA, 18 nt, Human
gucacggacgcgccgcga

SEQ ID NO: 509177 - RNA, 23 nt, Human
uacaaagugaucaaguacguggc

SEQ ID NO: 509178 - RNA, 26 nt, Human
uaccugguuccugggauucucuuuag

SEQ ID NO: 509179 - RNA, 18 nt, Human
uagaucugggcucaaccc

SEQ ID NO: 509180 - RNA, 19 nt, Human
ucaguacgguguguggagc

SEQ ID NO: 509181 - RNA, 22 nt, Human
uccugggauucucuuuaguugu

SEQ ID NO: 509182 - RNA, 18 nt, Human
ucgcguacgguggcuggc

SEQ ID NO: 509183 - RNA, 20 nt, Human
ucuccaaugcuggccagcag

SEQ ID NO: 509184 - RNA, 23 nt, Human
ucugggcucaaccccucacccuc

SEQ ID NO: 509185 - RNA, 19 nt, Human
ucugugagcccagagugca

SEQ ID NO: 509186 - RNA, 21 nt, Human
ugagcccagagugcaagcuga

SEQ ID NO: 509187 - RNA, 22 nt, Human
ugauacaaagucaaaauccacu

SEQ ID NO: 509188 - RNA, 23 nt, Human
uggaggcuggcgauacgaggcgg

SEQ ID NO: 509189 - RNA, 19 nt, Human
uggcgauugguuaccuggu

SEQ ID NO: 509190 - RNA, 18 nt, Human
ugggucaucuuuucuuca

SEQ ID NO: 509191 - RNA, 19 nt, Human
uguggagcuggagcaccgu

SEQ ID NO: 509192 - RNA, 23 nt, Human
uguguucccugcgcagggucugg

SEQ ID NO: 509193 - RNA, 27 nt, Human
uuauuuuccuuccuuuuaaccuucagg

SEQ ID NO: 509194 - RNA, 20 nt, Human
uuccugggauucucuuuagu

SEQ ID NO: 509195 - RNA, 19 nt, Human
uucucauccagaacccacc

SEQ ID NO: 509196 - RNA, 20 nt, Human
uugcagcuguuuucccagau

SEQ ID NO: 509197 - RNA, 22 nt, Human
uuuuaagaguucagcugcgagg

SEQ ID NO: 509198 - RNA, 18 nt, Human
aaauaaacauuugcacuc

SEQ ID NO: 509199 - RNA, 27 nt, Human
aagggauaaauagaacuuuauuuuaaa

SEQ ID NO: 509200 - RNA, 23 nt, Human
acacagccccagcagaagcaggg

SEQ ID NO: 509201 - RNA, 18 nt, Human
agaccccaacccuugaac

SEQ ID NO: 509202 - RNA, 20 nt, Human
agaccccaacccuugaacag

SEQ ID NO: 509203 - RNA, 21 nt, Human
cacagccccagcagaagcagg

SEQ ID NO: 509204 - RNA, 20 nt, Human
cggggaccuagcagacccca

SEQ ID NO: 509205 - RNA, 24 nt, Human
cuucuugcugccauagccuucuac

SEQ ID NO: 509206 - RNA, 23 nt, Human
gaccccaacccuugaacagcugg

SEQ ID NO: 509207 - RNA, 20 nt, Human
gccauagccuucuaccuccc

SEQ ID NO: 509208 - RNA, 21 nt, Human
uagcacucgguauuuggcugc

SEQ ID NO: 509209 - RNA, 18 nt, Human
uggcaggcugcagcugca

SEQ ID NO: 509210 - RNA, 20 nt, Human
aacacccuaauucacaaaag

SEQ ID NO: 509211 - RNA, 22 nt, Human
aacaggcucuggagcucaaucc

SEQ ID NO: 509212 - RNA, 23 nt, Human
aagcacgaaagucuacauuuauu

SEQ ID NO: 509213 - RNA, 18 nt, Human
aagcagcacaggugauuu

SEQ ID NO: 509214 - RNA, 19 nt, Human
aagcggaaaaaaauacgga

SEQ ID NO: 509215 - RNA, 24 nt, Human
acaagacacagaccccuuccgucg

SEQ ID NO: 509216 - RNA, 18 nt, Human
acagccaccggagaccaa

SEQ ID NO: 509217 - RNA, 22 nt, Human
acccggggcuuccagguuccac

SEQ ID NO: 509218 - RNA, 18 nt, Human
acuccauccagggacaau

SEQ ID NO: 509219 - RNA, 18 nt, Human
acugcacuccauccaggg

SEQ ID NO: 509220 - RNA, 25 nt, Human
agccaccggagaccaacagaaaacc

SEQ ID NO: 509221 - RNA, 22 nt, Human
aggcugaagccaagcugugaaa

SEQ ID NO: 509222 - RNA, 19 nt, Human
aggugauuuaggugcaucu

SEQ ID NO: 509223 - RNA, 21 nt, Human
aucaauacaagacacagaccc

SEQ ID NO: 509224 - RNA, 21 nt, Human
augguauuaaaagcaagguuc

SEQ ID NO: 509225 - RNA, 18 nt, Human
caaaauucaugccaaugu

SEQ ID NO: 509226 - RNA, 22 nt, Human
caacagaaaaccuaaugucagc

SEQ ID NO: 509227 - RNA, 18 nt, Human
caagacacagaccccuuc

SEQ ID NO: 509228 - RNA, 20 nt, Human
caagacacagaccccuuccc

SEQ ID NO: 509229 - RNA, 24 nt, Human
caagccuccucugacaagaacugg

SEQ ID NO: 509230 - RNA, 24 nt, Human
caagggacaguuggcgcccagggc

SEQ ID NO: 509231 - RNA, 18 nt, Human
cacccggggcuuccaggu

SEQ ID NO: 509232 - RNA, 21 nt, Human
cagaacacaguuaagggcagc

SEQ ID NO: 509233 - RNA, 19 nt, Human
ccaggaggagaggaaauua

SEQ ID NO: 509234 - RNA, 23 nt, Human
ccaggaggagaggaaauuaagaa

SEQ ID NO: 509235 - RNA, 18 nt, Human
cccagggcgggcugcagg

SEQ ID NO: 509236 - RNA, 20 nt, Human
ccccgcucgcuguccuuuuu

SEQ ID NO: 509237 - RNA, 19 nt, Human
ccggacagccaaggaggau

SEQ ID NO: 509238 - RNA, 20 nt, Human
ccuaaugucagccuuaaaau

SEQ ID NO: 509239 - RNA, 19 nt, Human
ccuccuggcacgguggaaa

SEQ ID NO: 509240 - RNA, 18 nt, Human
ccucuggcuuagggugag

SEQ ID NO: 509241 - RNA, 19 nt, Human
cgcccagggcgggcugcag

SEQ ID NO: 509242 - RNA, 18 nt, Human
cggaaaaaaauacggaga

SEQ ID NO: 509243 - RNA, 23 nt, Human
cggagaccaacagaaaaccuaau

SEQ ID NO: 509244 - RNA, 19 nt, Human
cgugcguuuccucagcacu

SEQ ID NO: 509245 - RNA, 23 nt, Human
cguuccaggcugacgcgcagggc

SEQ ID NO: 509246 - RNA, 22 nt, Human
cuagucucuacagugccccaca

SEQ ID NO: 509247 - RNA, 22 nt, Human
cugauaggcugaagccaagcug

SEQ ID NO: 509248 - RNA, 24 nt, Human
cugccacccggggcuuccagguuc

SEQ ID NO: 509249 - RNA, 21 nt, Human
cuggcacgguggaaauucccc

SEQ ID NO: 509250 - RNA, 19 nt, Human
cuuuccucuggcuuagggu

SEQ ID NO: 509251 - RNA, 18 nt, Human
gaagguggaggaaagcag

SEQ ID NO: 509252 - RNA, 25 nt, Human
gacaaucaaggacagccaccggaga

SEQ ID NO: 509253 - RNA, 22 nt, Human
gagaagguggaggaaagcagca

SEQ ID NO: 509254 - RNA, 24 nt, Human
gagcuggcuagucucuacagugcc

SEQ ID NO: 509255 - RNA, 19 nt, Human
gaggaaagcagcacaggug

SEQ ID NO: 509256 - RNA, 18 nt, Human
gcacgcgccggacagcca

SEQ ID NO: 509257 - RNA, 18 nt, Human
gcccagggcgggcugcag

SEQ ID NO: 509258 - RNA, 20 nt, Human
gcucccuaacaggcucugga

SEQ ID NO: 509259 - RNA, 18 nt, Human
ggaggagaagggcugugg

SEQ ID NO: 509260 - RNA, 22 nt, Human
ggcuuccagguuccacucgaag

SEQ ID NO: 509261 - RNA, 23 nt, Human
gggacaguuggcgcccagggaag

SEQ ID NO: 509262 - RNA, 20 nt, Human
ggggugccagcucaaccccg

SEQ ID NO: 509263 - RNA, 18 nt, Human
ggugacugcacuccaucc

SEQ ID NO: 509264 - RNA, 21 nt, Human
gguggaggaaagcagcacagg

SEQ ID NO: 509265 - RNA, 18 nt, Human
uacagugccccacaccac

SEQ ID NO: 509266 - RNA, 20 nt, Human
uacauuuauuugggacacag

SEQ ID NO: 509267 - RNA, 18 nt, Human
ucacaucccggggugcca

SEQ ID NO: 509268 - RNA, 23 nt, Human
ucagaacacaguuaagggcagca

SEQ ID NO: 509269 - RNA, 19 nt, Human
uccagggccucccauggag

SEQ ID NO: 509270 - RNA, 22 nt, Human
ucccauggaggagaagggcugu

SEQ ID NO: 509271 - RNA, 22 nt, Human
ucccggggugccagcucaaccc

SEQ ID NO: 509272 - RNA, 19 nt, Human
uccucugacaagaacugga

SEQ ID NO: 509273 - RNA, 20 nt, Human
ucgggagcuggcuagucucu

SEQ ID NO: 509274 - RNA, 20 nt, Human
ucuacagugccccacaccac

SEQ ID NO: 509275 - RNA, 23 nt, Human
ucuacagugccccacaccacuga

SEQ ID NO: 509276 - RNA, 19 nt, Human
ugaaacuucagaacacagu

SEQ ID NO: 509277 - RNA, 22 nt, Human
ugacugcacuccauccagggac

SEQ ID NO: 509278 - RNA, 23 nt, Human
ugauaggcugaagccaagcugug

SEQ ID NO: 509279 - RNA, 20 nt, Human
ugccaagggacaguuggcgc

SEQ ID NO: 509280 - RNA, 21 nt, Human
ugccaagggacaguuggcgcc

SEQ ID NO: 509281 - RNA, 23 nt, Human
ugggaaaaaggugacugcacucc

SEQ ID NO: 509282 - RNA, 19 nt, Human
ugggcagggaaaagggggu

SEQ ID NO: 509283 - RNA, 22 nt, Human
ugggcagggaaaaggggguccu

SEQ ID NO: 509284 - RNA, 22 nt, Human
uguggccccucugauucuuggg

SEQ ID NO: 509285 - RNA, 23 nt, Human
uuagugauaaauauauucucuuu

SEQ ID NO: 509286 - RNA, 22 nt, Human
uucaagcggaaaaaaauacgga

SEQ ID NO: 509287 - RNA, 20 nt, Human
uuccucuggcuuagggugag

SEQ ID NO: 509288 - RNA, 18 nt, Human
uucugggaaaaaggugac

SEQ ID NO: 509289 - RNA, 22 nt, Human
aaaagaacaggaauaauuuagg

SEQ ID NO: 509290 - RNA, 18 nt, Human
aaacaaacaaaaagagua

SEQ ID NO: 509291 - RNA, 23 nt, Human
aaccacacuaagaaacaaacaaa

SEQ ID NO: 509292 - RNA, 22 nt, Human
aagaaacaaacaaacaaaaaga

SEQ ID NO: 509293 - RNA, 28 nt, Human
aagaaacaaacaaacaaaaagaguaagg

SEQ ID NO: 509294 - RNA, 19 nt, Human
aagaagaagaaaagcaugg

SEQ ID NO: 509295 - RNA, 19 nt, Human
aagaagaagaaaagcaugg

SEQ ID NO: 509296 - RNA, 24 nt, Human
aagaguaaggaaaauuaggaacac

SEQ ID NO: 509297 - RNA, 18 nt, Human
acacauuuacaaaauacc

SEQ ID NO: 509298 - RNA, 24 nt, Human
acacuaagaaacaaacaaacaaaa

SEQ ID NO: 509299 - RNA, 21 nt, Human
acacuaagaaacaaacaaacc

SEQ ID NO: 509300 - RNA, 19 nt, Human
agaagaagaaaagcaugga

SEQ ID NO: 509301 - RNA, 21 nt, Human
aguucagccauccagcuaccu

SEQ ID NO: 509302 - RNA, 18 nt, Human
caaacaaacaaaaagagu

SEQ ID NO: 509303 - RNA, 25 nt, Human
caauaaaccacacuaagaaacaaac

SEQ ID NO: 509304 - RNA, 30 nt, Human
cacacuaagaaacaaacaaacaaaaagagg

SEQ ID NO: 509305 - RNA, 24 nt, Human
cccauauccagcaguucagccauc

SEQ ID NO: 509306 - RNA, 25 nt, Human
cccauugcaaacagggcuuaaaagc

SEQ ID NO: 509307 - RNA, 21 nt, Human
ccugcuuaaaagaacaggaau

SEQ ID NO: 509308 - RNA, 21 nt, Human
cggcauuguaaaugauuguca

SEQ ID NO: 509309 - RNA, 19 nt, Human
cucacuacagcacucuucg

SEQ ID NO: 509310 - RNA, 22 nt, Human
cucacuacagcacucuucggca

SEQ ID NO: 509311 - RNA, 23 nt, Human
gaaacaaacaaacaaaaagagua

SEQ ID NO: 509312 - RNA, 21 nt, Human
gaagaaaagcauggaguagua

SEQ ID NO: 509313 - RNA, 19 nt, Human
gagugguugauuuaaaaac

SEQ ID NO: 509314 - RNA, 23 nt, Human
gcagcugacauuccacaagcaag

SEQ ID NO: 509315 - RNA, 22 nt, Human
uacacaguguuauuuucuucaa

SEQ ID NO: 509316 - RNA, 25 nt, Human
ucagccauccagcuaccuuugggac

SEQ ID NO: 509317 - RNA, 23 nt, Human
uccaagaagaagaaaagcaugga

SEQ ID NO: 509318 - RNA, 20 nt, Human
uccucuacaaaaaguagggu

SEQ ID NO: 509319 - RNA, 19 nt, Human
ucuccguugcuguguuacc

SEQ ID NO: 509320 - RNA, 19 nt, Human
ucuguucuccguugcugug

SEQ ID NO: 509321 - RNA, 21 nt, Human
ugacacauuuacaaaauacca

SEQ ID NO: 509322 - RNA, 21 nt, Human
ugguggguuccgguauuuccu

SEQ ID NO: 509323 - RNA, 25 nt, Human
uuaaaagaacaggaauaauuuaggc

SEQ ID NO: 509324 - RNA, 19 nt, Human
uucuccguugcuguguuac

SEQ ID NO: 509325 - RNA, 22 nt, Human
uucugcacugggccucgugcuc

SEQ ID NO: 509326 - RNA, 25 nt, Human
uugcaaacagggcuuaaaagccuau

SEQ ID NO: 509327 - RNA, 22 nt, Human
aaaacaaaaaacaaaaacugga

SEQ ID NO: 509328 - RNA, 21 nt, Human
aaaaucucccucagucacaag

SEQ ID NO: 509329 - RNA, 21 nt, Human
aaacaaaaaacaaaaacugga

SEQ ID NO: 509330 - RNA, 21 nt, Human
aaacaaaaaacaaaaacugga

SEQ ID NO: 509331 - RNA, 22 nt, Human
aaacaaaaaacaaaaacuggaa

SEQ ID NO: 509332 - RNA, 27 nt, Human
aaacaaaaacuggaaaacuuuucagaa

SEQ ID NO: 509333 - RNA, 18 nt, Human
aaacaagaacuaagggca

SEQ ID NO: 509334 - RNA, 20 nt, Human
aaacaagaacuaagggcaac

SEQ ID NO: 509335 - RNA, 24 nt, Human
aaagucacccaguaagaaccaaaa

SEQ ID NO: 509336 - RNA, 19 nt, Human
aacugccccccaccccccc

SEQ ID NO: 509337 - RNA, 25 nt, Human
aagaugcuuucacgcuccuggaagu

SEQ ID NO: 509338 - RNA, 21 nt, Human
aagcacaauaaaagagcuaaa

SEQ ID NO: 509339 - RNA, 28 nt, Human
aagcacaauaaaagagcuaaaucacggc

SEQ ID NO: 509340 - RNA, 24 nt, Human
aagcagcaaagccagauuguccca

SEQ ID NO: 509341 - RNA, 20 nt, Human
aagucacccaguaagaacca

SEQ ID NO: 509342 - RNA, 22 nt, Human
acaaaaaacaaaaaacaaaaac

SEQ ID NO: 509343 - RNA, 25 nt, Human
acacagucacuccucaugcccgcau

SEQ ID NO: 509344 - RNA, 21 nt, Human
acagggucacgcacugaggac

SEQ ID NO: 509345 - RNA, 27 nt, Human
acccaguaagaaccaaaagcauaauuu

SEQ ID NO: 509346 - RNA, 19 nt, Human
acccccucugaccagggga

SEQ ID NO: 509347 - RNA, 19 nt, Human
accccucuccccuccccca

SEQ ID NO: 509348 - RNA, 24 nt, Human
accuacacacacaaaacacugaua

SEQ ID NO: 509349 - RNA, 19 nt, Human
acugccccccacccccccc

SEQ ID NO: 509350 - RNA, 23 nt, Human
agaaaaucucccucagucacaag

SEQ ID NO: 509351 - RNA, 25 nt, Human
agaaaaucucccucagucacaagaa

SEQ ID NO: 509352 - RNA, 24 nt, Human
agaaaugacaaaacaccccacaga

SEQ ID NO: 509353 - RNA, 18 nt, Human
agaaggaaaaaauaucau

SEQ ID NO: 509354 - RNA, 23 nt, Human
agacagcccuaaacacuagcuga

SEQ ID NO: 509355 - RNA, 19 nt, Human
agacauuaaacaagaacua

SEQ ID NO: 509356 - RNA, 18 nt, Human
agagacauuaaacaagaa

SEQ ID NO: 509357 - RNA, 24 nt, Human
agcuccgcaaccuccuguggcccu

SEQ ID NO: 509358 - RNA, 21 nt, Human
agcugauuccaaggcuucucu

SEQ ID NO: 509359 - RNA, 24 nt, Human
aguguuggaaauaaagacugagcc

SEQ ID NO: 509360 - RNA, 21 nt, Human
augagaaaacugaggcucagg

SEQ ID NO: 509361 - RNA, 23 nt, Human
augcccgcauguucacuggugcc

SEQ ID NO: 509362 - RNA, 19 nt, Human
auuaagaaaugacaaaaca

SEQ ID NO: 509363 - RNA, 21 nt, Human
auugucccaagucccuacgaa

SEQ ID NO: 509364 - RNA, 25 nt, Human
caacauccaagcuccgcaaccuccu

SEQ ID NO: 509365 - RNA, 22 nt, Human
caacuguaguccaagcucccag

SEQ ID NO: 509366 - RNA, 22 nt, Human
cacacaccaaaaaagauacaag

SEQ ID NO: 509367 - RNA, 22 nt, Human
cacaccaaaaaagauacaagaa

SEQ ID NO: 509368 - RNA, 21 nt, Human
caccaaaaaagauacaagaau

SEQ ID NO: 509369 - RNA, 22 nt, Human
caccaaaaaagauacaagaaug

SEQ ID NO: 509370 - RNA, 25 nt, Human
cacccccacccccucugaccagggg

SEQ ID NO: 509371 - RNA, 19 nt, Human
caccccccccgcccacaca

SEQ ID NO: 509372 - RNA, 24 nt, Human
caccccccccgcccacacaccaaa

SEQ ID NO: 509373 - RNA, 20 nt, Human
cagaacaggaacagacugug

SEQ ID NO: 509374 - RNA, 19 nt, Human
caguagggaucgccauccc

SEQ ID NO: 509375 - RNA, 24 nt, Human
caugcccgcauguucacuggugcc

SEQ ID NO: 509376 - RNA, 18 nt, Human
ccacacaccaaaaaagau

SEQ ID NO: 509377 - RNA, 24 nt, Human
ccacacaccaaaaaagauacaagg

SEQ ID NO: 509378 - RNA, 26 nt, Human
ccaccccccccgcccacacaccaaaa

SEQ ID NO: 509379 - RNA, 19 nt, Human
ccaguaagaaccaaaagca

SEQ ID NO: 509380 - RNA, 22 nt, Human
cccacacaccaaaaaagauaca

SEQ ID NO: 509381 - RNA, 24 nt, Human
cccacagauguauuuggaccaagu

SEQ ID NO: 509382 - RNA, 22 nt, Human
cccacccccucugaccagggga

SEQ ID NO: 509383 - RNA, 20 nt, Human
ccccacccccucugaccagg

SEQ ID NO: 509384 - RNA, 19 nt, Human
cccccacccccacccccuc

SEQ ID NO: 509385 - RNA, 21 nt, Human
cccccacccccacccccucug

SEQ ID NO: 509386 - RNA, 21 nt, Human
ccccccaccccccccgcccac

SEQ ID NO: 509387 - RNA, 24 nt, Human
ccccccccgcccacacaccaaaaa

SEQ ID NO: 509388 - RNA, 20 nt, Human
cccgcccacacaccaaaaag

SEQ ID NO: 509389 - RNA, 29 nt, Human
cccugguuauaacuaugauucauucauuu

SEQ ID NO: 509390 - RNA, 28 nt, Human
ccgcccacacaccaaaaaagauacaaga

SEQ ID NO: 509391 - RNA, 21 nt, Human
ccuacacacacaaaacacuga

SEQ ID NO: 509392 - RNA, 21 nt, Human
ccucaugcccgcauguucacu

SEQ ID NO: 509393 - RNA, 18 nt, Human
ccucccccacccccaccc

SEQ ID NO: 509394 - RNA, 24 nt, Human
ccucccucuggaaacuucuacaga

SEQ ID NO: 509395 - RNA, 19 nt, Human
ccucuugggcagcuuggcc

SEQ ID NO: 509396 - RNA, 26 nt, Human
ccuguggcccuuccagaaaaucuccc

SEQ ID NO: 509397 - RNA, 23 nt, Human
ccuucacccaggaagcuuacaug

SEQ ID NO: 509398 - RNA, 19 nt, Human
cuccaggcauaguucuggg

SEQ ID NO: 509399 - RNA, 18 nt, Human
cucccccacccccacccc

SEQ ID NO: 509400 - RNA, 21 nt, Human
cucccccacccccacccccuc

SEQ ID NO: 509401 - RNA, 22 nt, Human
cuccccucccccacccccaccc

SEQ ID NO: 509402 - RNA, 18 nt, Human
cucuccccucccccaccc

SEQ ID NO: 509403 - RNA, 18 nt, Human
cucugcucagaauaucag

SEQ ID NO: 509404 - RNA, 19 nt, Human
cucuugggcagcuuggccc

SEQ ID NO: 509405 - RNA, 22 nt, Human
cugaacugccccccaccccccc

SEQ ID NO: 509406 - RNA, 21 nt, Human
cugacagacagcccuaaacac

SEQ ID NO: 509407 - RNA, 22 nt, Human
cuggcauaagccaauguucucu

SEQ ID NO: 509408 - RNA, 19 nt, Human
gaacagacuguggauaucc

SEQ ID NO: 509409 - RNA, 20 nt, Human
gaacugccccccaccccccc

SEQ ID NO: 509410 - RNA, 22 nt, Human
gaagucaggcaccuucagcuga

SEQ ID NO: 509411 - RNA, 19 nt, Human
gacaaugaggguuagagag

SEQ ID NO: 509412 - RNA, 22 nt, Human
gaggcuccuuuacuggucucug

SEQ ID NO: 509413 - RNA, 23 nt, Human
gauaauuaaauagcuaagaggaa

SEQ ID NO: 509414 - RNA, 20 nt, Human
gcccacguauaaccauuucu

SEQ ID NO: 509415 - RNA, 21 nt, Human
gcccagauguggugugguauc

SEQ ID NO: 509416 - RNA, 24 nt, Human
ggagucaccuacacacacaaaaca

SEQ ID NO: 509417 - RNA, 21 nt, Human
guacacagucacuccucaugc

SEQ ID NO: 509418 - RNA, 21 nt, Human
gucucugcuuggagacagaca

SEQ ID NO: 509419 - RNA, 20 nt, Human
uaacagcaccucccucugga

SEQ ID NO: 509420 - RNA, 21 nt, Human
uaacagcaccucccucuggaa

SEQ ID NO: 509421 - RNA, 18 nt, Human
uaagaggaaccguuagug

SEQ ID NO: 509422 - RNA, 21 nt, Human
uaagcacaauaaaagagcuaa

SEQ ID NO: 509423 - RNA, 21 nt, Human
uaaguaggacuaaacauucua

SEQ ID NO: 509424 - RNA, 20 nt, Human
uaagucaaagucacccagua

SEQ ID NO: 509425 - RNA, 21 nt, Human
uacaagaauguaagcccagau

SEQ ID NO: 509426 - RNA, 22 nt, Human
uaccagcacuaugaaugauuaa

SEQ ID NO: 509427 - RNA, 21 nt, Human
uacgugugucgugcgugcucc

SEQ ID NO: 509428 - RNA, 20 nt, Human
uagaaagcagcaaagccaga

SEQ ID NO: 509429 - RNA, 24 nt, Human
uagaaagcagcaaagccagauugu

SEQ ID NO: 509430 - RNA, 21 nt, Human
uagcaguagaaagcagcaaag

SEQ ID NO: 509431 - RNA, 18 nt, Human
uagguaccccucuccccu

SEQ ID NO: 509432 - RNA, 21 nt, Human
uauaaccauuucugacagaca

SEQ ID NO: 509433 - RNA, 21 nt, Human
uaucuggcauaagccaauguu

SEQ ID NO: 509434 - RNA, 23 nt, Human
ucaaccuucacccaggaagcuua

SEQ ID NO: 509435 - RNA, 22 nt, Human
ucagaauaucagaacaggaaca

SEQ ID NO: 509436 - RNA, 22 nt, Human
ucagucccaggaguugagcaaa

SEQ ID NO: 509437 - RNA, 20 nt, Human
uccaucaggccacagcuucc

SEQ ID NO: 509438 - RNA, 18 nt, Human
ucccucagucacaagaac

SEQ ID NO: 509439 - RNA, 20 nt, Human
uccugaaagcacugacaggg

SEQ ID NO: 509440 - RNA, 24 nt, Human
ucuggguacuuuccauuccuuuuc

SEQ ID NO: 509441 - RNA, 19 nt, Human
ucuugggcagcuuggcccc

SEQ ID NO: 509442 - RNA, 21 nt, Human
ugaaagcacugacagggucac

SEQ ID NO: 509443 - RNA, 18 nt, Human
ugaagagccucuugggca

SEQ ID NO: 509444 - RNA, 20 nt, Human
ugacagacagcccuaaacac

SEQ ID NO: 509445 - RNA, 20 nt, Human
ugacaggauucagaagguac

SEQ ID NO: 509446 - RNA, 23 nt, Human
ugacagggucacgcacugaggac

SEQ ID NO: 509447 - RNA, 21 nt, Human
ugacugcacaggaccacggcu

SEQ ID NO: 509448 - RNA, 20 nt, Human
ugagccggacuugacauaca

SEQ ID NO: 509449 - RNA, 19 nt, Human
ugaggaccaggaggcuccu

SEQ ID NO: 509450 - RNA, 21 nt, Human
ugaggaccaggaggcuccuuu

SEQ ID NO: 509451 - RNA, 18 nt, Human
ugaggguuagagagaggu

SEQ ID NO: 509452 - RNA, 18 nt, Human
ugaggguuagagagaggu

SEQ ID NO: 509453 - RNA, 22 nt, Human
ugaggguuagagagaggugccu

SEQ ID NO: 509454 - RNA, 25 nt, Human
ugccccccaccccccccgcccacac

SEQ ID NO: 509455 - RNA, 21 nt, Human
ugcccgaaaagaaacagcuga

SEQ ID NO: 509456 - RNA, 18 nt, Human
uggaccaaguaagcacaa

SEQ ID NO: 509457 - RNA, 20 nt, Human
uggcggcauccuggggcggc

SEQ ID NO: 509458 - RNA, 19 nt, Human
ugggcagcuuggccccugg

SEQ ID NO: 509459 - RNA, 19 nt, Human
uuaaauagcuaagaggaac

SEQ ID NO: 509460 - RNA, 19 nt, Human
uucacugaacugcccccca

SEQ ID NO: 509461 - RNA, 19 nt, Human
uucuauuuuaaaacugcau

SEQ ID NO: 509462 - RNA, 25 nt, Human
uucucuggguucuagguaccccucu

SEQ ID NO: 509463 - RNA, 23 nt, Human
uugcuguacuucacaucauaugg

SEQ ID NO: 509464 - RNA, 19 nt, Human
uuuuaccagcacuaugaau

SEQ ID NO: 509465 - RNA, 24 nt, Human
uuuucuauuuuaaaacugcauuca

SEQ ID NO: 509466 - RNA, 23 nt, Human
uuuugcccacguauaaccauuuc

SEQ ID NO: 509467 - RNA, 22 nt, Human
uuuuuuuuuuuuuuuuuaccag

SEQ ID NO: 509468 - RNA, 20 nt, Human
aaagugcugggauuacaggc

SEQ ID NO: 509469 - RNA, 23 nt, Human
aaagugcugggauuacaggcgua

SEQ ID NO: 509470 - RNA, 22 nt, Human
aacaccagugcucccagccccc

SEQ ID NO: 509471 - RNA, 18 nt, Human
aaccaagccugugcaccu

SEQ ID NO: 509472 - RNA, 24 nt, Human
aagaggccaggaagauggggggug

SEQ ID NO: 509473 - RNA, 19 nt, Human
aagugcugggauuacaggc

SEQ ID NO: 509474 - RNA, 19 nt, Human
aagugcugggauuacaggc

SEQ ID NO: 509475 - RNA, 26 nt, Human
aagugcugggauuacaggcguaagcc

SEQ ID NO: 509476 - RNA, 23 nt, Human
aaguucauucuggguuuucaggc

SEQ ID NO: 509477 - RNA, 19 nt, Human
acaccagugcucccagccc

SEQ ID NO: 509478 - RNA, 18 nt, Human
acagauuaagaauguugg

SEQ ID NO: 509479 - RNA, 20 nt, Human
acagugggggcagguccaga

SEQ ID NO: 509480 - RNA, 20 nt, Human
accugauaccucaucauccu

SEQ ID NO: 509481 - RNA, 20 nt, Human
acgcaguucaccagguacgg

SEQ ID NO: 509482 - RNA, 18 nt, Human
acggagccgcagggaagc

SEQ ID NO: 509483 - RNA, 18 nt, Human
acgggguuucaccguguu

SEQ ID NO: 509484 - RNA, 19 nt, Human
acgggguuucaccguguua

SEQ ID NO: 509485 - RNA, 20 nt, Human
acgggguuucaccguguuag

SEQ ID NO: 509486 - RNA, 24 nt, Human
acgggguuucaccguguuagccag

SEQ ID NO: 509487 - RNA, 18 nt, Human
acgggguuucuccauguu

SEQ ID NO: 509488 - RNA, 20 nt, Human
acgggguuucuccauguugg

SEQ ID NO: 509489 - RNA, 24 nt, Human
acgggguuucuccauguuggucag

SEQ ID NO: 509490 - RNA, 22 nt, Human
acuaaaaccaaacauauaugcg

SEQ ID NO: 509491 - RNA, 20 nt, Human
acugcaagcucugccucccg

SEQ ID NO: 509492 - RNA, 19 nt, Human
agagacgggguuucaccgu

SEQ ID NO: 509493 - RNA, 18 nt, Human
agagggagggaagggcug

SEQ ID NO: 509494 - RNA, 23 nt, Human
agcugacgcugacacccagcacg

SEQ ID NO: 509495 - RNA, 18 nt, Human
aggagcugguguuugcug

SEQ ID NO: 509496 - RNA, 23 nt, Human
aggagucggauggcacuuucacu

SEQ ID NO: 509497 - RNA, 18 nt, Human
aggauggacucaagagag

SEQ ID NO: 509498 - RNA, 19 nt, Human
aggcagcugcugcuuucug

SEQ ID NO: 509499 - RNA, 25 nt, Human
aggcuggagugcaguggcacgaucu

SEQ ID NO: 509500 - RNA, 20 nt, Human
aguagagacgggguuucacc

SEQ ID NO: 509501 - RNA, 18 nt, Human
aguagcugggacuacagg

SEQ ID NO: 509502 - RNA, 19 nt, Human
aguagcugggacuacaggc

SEQ ID NO: 509503 - RNA, 20 nt, Human
agugcaguggcacgaucuug

SEQ ID NO: 509504 - RNA, 23 nt, Human
agugcaguggcacgaucuuggcu

SEQ ID NO: 509505 - RNA, 24 nt, Human
agugcaguggcacgaucuuggcuc

SEQ ID NO: 509506 - RNA, 24 nt, Human
aguggcucacgccuguaaucccag

SEQ ID NO: 509507 - RNA, 23 nt, Human
augaaccaagcccaugcaaccuc

SEQ ID NO: 509508 - RNA, 18 nt, Human
augaauucauggaacaga

SEQ ID NO: 509509 - RNA, 19 nt, Human
augcaggccacaguggggg

SEQ ID NO: 509510 - RNA, 21 nt, Human
auggugcagccugugguccca

SEQ ID NO: 509511 - RNA, 21 nt, Human
auugugagugggucuuauggu

SEQ ID NO: 509512 - RNA, 24 nt, Human
caaagugcugggauuacaggcgua

SEQ ID NO: 509513 - RNA, 24 nt, Human
caauagagacgggguuucuccaug

SEQ ID NO: 509514 - RNA, 28 nt, Human
cacaauccgugcuccaggcccucugcac

SEQ ID NO: 509515 - RNA, 18 nt, Human
caccguguuagccaggau

SEQ ID NO: 509516 - RNA, 24 nt, Human
caccguguuagccaggauggucuc

SEQ ID NO: 509517 - RNA, 24 nt, Human
caccuggaaucuggagacauggga

SEQ ID NO: 509518 - RNA, 21 nt, Human
cacgccuguaaucccagccug

SEQ ID NO: 509519 - RNA, 22 nt, Human
cacggcacaggaccaccacaga

SEQ ID NO: 509520 - RNA, 25 nt, Human
cacggcacaggaccaccacagauga

SEQ ID NO: 509521 - RNA, 21 nt, Human
cacgugaacaccagugcuccc

SEQ ID NO: 509522 - RNA, 21 nt, Human
cacuccauucuccugccucag

SEQ ID NO: 509523 - RNA, 22 nt, Human
cacuccauucuccugccucagc

SEQ ID NO: 509524 - RNA, 23 nt, Human
cacugcaagcucugccucccggg

SEQ ID NO: 509525 - RNA, 21 nt, Human
cagaaugaaugaaccaagccc

SEQ ID NO: 509526 - RNA, 20 nt, Human
cagaugauaaaguggccaga

SEQ ID NO: 509527 - RNA, 21 nt, Human
cagcacccugcagcaggaaga

SEQ ID NO: 509528 - RNA, 25 nt, Human
cagcaggaagaaggaaagcuagacc

SEQ ID NO: 509529 - RNA, 19 nt, Human
cagccccccugcacaacuc

SEQ ID NO: 509530 - RNA, 22 nt, Human
cagccccugggggcccauccug

SEQ ID NO: 509531 - RNA, 20 nt, Human
cagcuuccucagccccuggg

SEQ ID NO: 509532 - RNA, 21 nt, Human
caggcgcccgccaccacgccc

SEQ ID NO: 509533 - RNA, 24 nt, Human
caggcguaagccacugugcccggc

SEQ ID NO: 509534 - RNA, 20 nt, Human
cagggcuaagcccaggcugg

SEQ ID NO: 509535 - RNA, 22 nt, Human
cagggcuaagcccaggcugggg

SEQ ID NO: 509536 - RNA, 19 nt, Human
cagugacugcguagccccc

SEQ ID NO: 509537 - RNA, 19 nt, Human
caguggcacgaucuuggcu

SEQ ID NO: 509538 - RNA, 23 nt, Human
cauacaggacagaaauguacaau

SEQ ID NO: 509539 - RNA, 22 nt, Human
ccaaagugcugggauuacaggc

SEQ ID NO: 509540 - RNA, 22 nt, Human
ccaaagugcugggauuacaggc

SEQ ID NO: 509541 - RNA, 24 nt, Human
ccaaagugcugggauuacaggcgu

SEQ ID NO: 509542 - RNA, 25 nt, Human
ccaccuccugagcgucuccccucca

SEQ ID NO: 509543 - RNA, 24 nt, Human
ccagaagcugacgcugacacccag

SEQ ID NO: 509544 - RNA, 19 nt, Human
ccagggcacuuucccagcg

SEQ ID NO: 509545 - RNA, 21 nt, Human
ccauguuggucaggcugaucu

SEQ ID NO: 509546 - RNA, 22 nt, Human
cccaccugcaacaauuuaagag

SEQ ID NO: 509547 - RNA, 23 nt, Human
cccgaguagcugggacuacaggc

SEQ ID NO: 509548 - RNA, 24 nt, Human
cccgaguagcugggacuacaggcg

SEQ ID NO: 509549 - RNA, 21 nt, Human
cccgccaccacgcccagcuaa

SEQ ID NO: 509550 - RNA, 23 nt, Human
cccuccacccaccugauaccuca

SEQ ID NO: 509551 - RNA, 26 nt, Human
cccugcuggcucuaacgccccuccua

SEQ ID NO: 509552 - RNA, 21 nt, Human
ccgguccagggcacuuuccca

SEQ ID NO: 509553 - RNA, 23 nt, Human
ccuauaacccuggauacauacag

SEQ ID NO: 509554 - RNA, 27 nt, Human
ccucccgccucggccucccaauagaga

SEQ ID NO: 509555 - RNA, 22 nt, Human
ccugaccucaggugaucugccc

SEQ ID NO: 509556 - RNA, 20 nt, Human
ccugcaccuggaaucuggag

SEQ ID NO: 509557 - RNA, 23 nt, Human
ccugccucagccucccgaguagc

SEQ ID NO: 509558 - RNA, 23 nt, Human
ccugggggcagguguucugucgg

SEQ ID NO: 509559 - RNA, 21 nt, Human
ccugggggcccauccuguggg

SEQ ID NO: 509560 - RNA, 23 nt, Human
ccugugcaccuccgccuuuccca

SEQ ID NO: 509561 - RNA, 19 nt, Human
cgccucggccucccaauag

SEQ ID NO: 509562 - RNA, 19 nt, Human
cgccuguaaucccagccug

SEQ ID NO: 509563 - RNA, 24 nt, Human
cgguccagggcacuuucccagcgg

SEQ ID NO: 509564 - RNA, 23 nt, Human
cguagccccccuuuguggggugg

SEQ ID NO: 509565 - RNA, 23 nt, Human
cuaaaaccaaacauauaugcgug

SEQ ID NO: 509566 - RNA, 22 nt, Human
cuaagcccaggcuggggguuca

SEQ ID NO: 509567 - RNA, 22 nt, Human
cuacccaggaccccucaggcag

SEQ ID NO: 509568 - RNA, 18 nt, Human
cuagcccugugagccgcc

SEQ ID NO: 509569 - RNA, 21 nt, Human
cuaggccucccaaagugcugg

SEQ ID NO: 509570 - RNA, 20 nt, Human
cucacgccuguaaucccagc

SEQ ID NO: 509571 - RNA, 20 nt, Human
cucacgccuguaaucccagc

SEQ ID NO: 509572 - RNA, 24 nt, Human
cucacugcaagcucugccucccgg

SEQ ID NO: 509573 - RNA, 24 nt, Human
cucagccucccgaguagcugggac

SEQ ID NO: 509574 - RNA, 24 nt, Human
cuccauguuggucaggcugaucuu

SEQ ID NO: 509575 - RNA, 27 nt, Human
cucccagaagcugacgcugacacccag

SEQ ID NO: 509576 - RNA, 23 nt, Human
cucccagccccccugcacaacuc

SEQ ID NO: 509577 - RNA, 24 nt, Human
cuccccuccacccaccugauaccc

SEQ ID NO: 509578 - RNA, 24 nt, Human
cuccccuccacccaccugauaccu

SEQ ID NO: 509579 - RNA, 26 nt, Human
cuccugaccucaggugaucugcccgc

SEQ ID NO: 509580 - RNA, 24 nt, Human
cuccugacuuugugauccucccgc

SEQ ID NO: 509581 - RNA, 21 nt, Human
cuccugagcgucuccccucca

SEQ ID NO: 509582 - RNA, 18 nt, Human
cuccuuggggcugacugg

SEQ ID NO: 509583 - RNA, 20 nt, Human
cucugauggggccuuuguuc

SEQ ID NO: 509584 - RNA, 20 nt, Human
cucugucaaccaggcuggag

SEQ ID NO: 509585 - RNA, 23 nt, Human
cugacuuugugauccucccgccu

SEQ ID NO: 509586 - RNA, 18 nt, Human
cugaucacccaaaacaaa

SEQ ID NO: 509587 - RNA, 22 nt, Human
cugcacugggacaggaccacag

SEQ ID NO: 509588 - RNA, 19 nt, Human
cugcagcuccagccagcca

SEQ ID NO: 509589 - RNA, 23 nt, Human
cugccucagccucccgaguagcu

SEQ ID NO: 509590 - RNA, 18 nt, Human
cugcugcuuucuggaugg

SEQ ID NO: 509591 - RNA, 21 nt, Human
cugggccuggugcgccagcug

SEQ ID NO: 509592 - RNA, 24 nt, Human
cuugcucugucaaccaggcuggag

SEQ ID NO: 509593 - RNA, 21 nt, Human
cuuguuggucuccagcaggga

SEQ ID NO: 509594 - RNA, 21 nt, Human
gaaccugcaccuggaaucugg

SEQ ID NO: 509595 - RNA, 18 nt, Human
gaagaugggggguggcug

SEQ ID NO: 509596 - RNA, 24 nt, Human
gaaggaaagcuagacccuggggag

SEQ ID NO: 509597 - RNA, 19 nt, Human
gaaguccuucccgcaggcc

SEQ ID NO: 509598 - RNA, 18 nt, Human
gaaugaaugaaccaagcc

SEQ ID NO: 509599 - RNA, 22 nt, Human
gaccucaggugaucugcccgcc

SEQ ID NO: 509600 - RNA, 25 nt, Human
gacggagucuugcucugucaaccag

SEQ ID NO: 509601 - RNA, 24 nt, Human
gacuuugugauccucccgccucgg

SEQ ID NO: 509602 - RNA, 24 nt, Human
gagacgggguuucaccguguuagc

SEQ ID NO: 509603 - RNA, 20 nt, Human
gagacgggguuucuccaugu

SEQ ID NO: 509604 - RNA, 23 nt, Human
gagacgggguuucuccauguugg

SEQ ID NO: 509605 - RNA, 24 nt, Human
gagacgggguuucuccauguuggu

SEQ ID NO: 509606 - RNA, 25 nt, Human
gaguagcugggacuacaggcgcccg

SEQ ID NO: 509607 - RNA, 21 nt, Human
gagucucaguucugaucaccc

SEQ ID NO: 509608 - RNA, 18 nt, Human
gauccucccgccucggcc

SEQ ID NO: 509609 - RNA, 18 nt, Human
gauuacaggcguaagcca

SEQ ID NO: 509610 - RNA, 21 nt, Human
gauuacaggcguaagccacug

SEQ ID NO: 509611 - RNA, 24 nt, Human
gauuacaggcguaagccacugugc

SEQ ID NO: 509612 - RNA, 20 nt, Human
gcacaacucucaaagugacc

SEQ ID NO: 509613 - RNA, 18 nt, Human
gcagcaggaagaaggaaa

SEQ ID NO: 509614 - RNA, 24 nt, Human
gcccagcuaauuuuuuuguauuuu

SEQ ID NO: 509615 - RNA, 21 nt, Human
gcccagcucacacgugcugcu

SEQ ID NO: 509616 - RNA, 24 nt, Human
gccccuccuacccaggaccccuca

SEQ ID NO: 509617 - RNA, 21 nt, Human
gccgcagggaagccgccagga

SEQ ID NO: 509618 - RNA, 25 nt, Human
gccucccggguucacuccauucucc

SEQ ID NO: 509619 - RNA, 22 nt, Human
gccuguggucccacgugaacac

SEQ ID NO: 509620 - RNA, 21 nt, Human
gcuaaaaagcaggagggacug

SEQ ID NO: 509621 - RNA, 21 nt, Human
gcucacugcaagcucugccuc

SEQ ID NO: 509622 - RNA, 23 nt, Human
gcugaucuugaacuccugaccuc

SEQ ID NO: 509623 - RNA, 19 nt, Human
gcuggagugcaguggcacg

SEQ ID NO: 509624 - RNA, 19 nt, Human
ggagggaagggcugguguu

SEQ ID NO: 509625 - RNA, 20 nt, Human
ggaggugcuaagaaccugca

SEQ ID NO: 509626 - RNA, 20 nt, Human
ggaugcggacgcaguucacc

SEQ ID NO: 509627 - RNA, 24 nt, Human
ggauggucucgaucuccugacuuu

SEQ ID NO: 509628 - RNA, 24 nt, Human
ggauuacaggcguaagccacugug

SEQ ID NO: 509629 - RNA, 21 nt, Human
ggcacaggaccaccacagaug

SEQ ID NO: 509630 - RNA, 19 nt, Human
ggcaggucagcugcacgga

SEQ ID NO: 509631 - RNA, 18 nt, Human
ggcccagcucacacgugc

SEQ ID NO: 509632 - RNA, 21 nt, Human
ggccgggugcaguggcucacg

SEQ ID NO: 509633 - RNA, 18 nt, Human
ggccuggugcgccagcug

SEQ ID NO: 509634 - RNA, 24 nt, Human
ggcugaucuugaacuccugaccuc

SEQ ID NO: 509635 - RNA, 23 nt, Human
gggaagggcugguguuaggggua

SEQ ID NO: 509636 - RNA, 20 nt, Human
gggacaggguggagcugcca

SEQ ID NO: 509637 - RNA, 20 nt, Human
gggcuggagggcaggucagc

SEQ ID NO: 509638 - RNA, 22 nt, Human
gggggguggcugggauggucug

SEQ ID NO: 509639 - RNA, 20 nt, Human
gggguggggggacagggugg

SEQ ID NO: 509640 - RNA, 23 nt, Human
gggguuucaccguguuagccagg

SEQ ID NO: 509641 - RNA, 23 nt, Human
gggguuucuccauguuggucagg

SEQ ID NO: 509642 - RNA, 24 nt, Human
gggugcaguggcucacgccuguaa

SEQ ID NO: 509643 - RNA, 22 nt, Human
ggguuucaccguguuagccagg

SEQ ID NO: 509644 - RNA, 22 nt, Human
ggguuucuccauguuggucagg

SEQ ID NO: 509645 - RNA, 23 nt, Human
guagagacgggguuucaccgugu

SEQ ID NO: 509646 - RNA, 22 nt, Human
guauccuccuccuccuccucca

SEQ ID NO: 509647 - RNA, 19 nt, Human
gucaaccaggcuggagugc

SEQ ID NO: 509648 - RNA, 24 nt, Human
gucuggggucccacauacauguuc

SEQ ID NO: 509649 - RNA, 24 nt, Human
gugauccucccgccucggccuccc

SEQ ID NO: 509650 - RNA, 23 nt, Human
guggggccugggggcagguguuc

SEQ ID NO: 509651 - RNA, 24 nt, Human
uacaggcgcccgccaccacgccca

SEQ ID NO: 509652 - RNA, 23 nt, Human
uacaggcguaagccacugugccc

SEQ ID NO: 509653 - RNA, 21 nt, Human
uacauacaggacagaaaugua

SEQ ID NO: 509654 - RNA, 22 nt, Human
uacccaggaccccucaggcagc

SEQ ID NO: 509655 - RNA, 24 nt, Human
uacccaggaccccucaggcagcac

SEQ ID NO: 509656 - RNA, 21 nt, Human
uaguagagacgggguuucacc

SEQ ID NO: 509657 - RNA, 24 nt, Human
uaguagagacgggguuucaccgug

SEQ ID NO: 509658 - RNA, 26 nt, Human
uaguagagacgggguuucaccguguu

SEQ ID NO: 509659 - RNA, 26 nt, Human
uaguagagacgggguuucaccguugg

SEQ ID NO: 509660 - RNA, 27 nt, Human
uauaacccuggauacauacaggacaga

SEQ ID NO: 509661 - RNA, 24 nt, Human
ucaccguguuagccaggauggucu

SEQ ID NO: 509662 - RNA, 22 nt, Human
ucacgccuguaaucccagccug

SEQ ID NO: 509663 - RNA, 25 nt, Human
ucacuccauucuccugccucagccu

SEQ ID NO: 509664 - RNA, 18 nt, Human
ucacugcaagcucugccu

SEQ ID NO: 509665 - RNA, 18 nt, Human
ucacugcaagcucugccu

SEQ ID NO: 509666 - RNA, 24 nt, Human
ucacugcaagcucugccucccggg

SEQ ID NO: 509667 - RNA, 20 nt, Human
ucagccccugggggcccauc

SEQ ID NO: 509668 - RNA, 23 nt, Human
ucagccucccgaguagcugggac

SEQ ID NO: 509669 - RNA, 24 nt, Human
uccauguuggucaggcugaucuug

SEQ ID NO: 509670 - RNA, 24 nt, Human
ucccaaagugcugggauuacaggc

SEQ ID NO: 509671 - RNA, 23 nt, Human
ucccagaagcugacgcugacacc

SEQ ID NO: 509672 - RNA, 24 nt, Human
ucccgaguagcugggacuacaggc

SEQ ID NO: 509673 - RNA, 21 nt, Human
ucccggguucacuccauucuc

SEQ ID NO: 509674 - RNA, 24 nt, Human
ucccggguucacuccauucuccug

SEQ ID NO: 509675 - RNA, 22 nt, Human
uccucagccccugggggcccau

SEQ ID NO: 509676 - RNA, 18 nt, Human
uccuccuccagcugcugc

SEQ ID NO: 509677 - RNA, 23 nt, Human
uccugccccuaguccugggcugg

SEQ ID NO: 509678 - RNA, 21 nt, Human
uccuucccgcaggccucgcag

SEQ ID NO: 509679 - RNA, 20 nt, Human
uccuuggggcugacuggcgu

SEQ ID NO: 509680 - RNA, 22 nt, Human
uccuuggggcugacuggcguau

SEQ ID NO: 509681 - RNA, 20 nt, Human
ucuagcccugugagccgccg

SEQ ID NO: 509682 - RNA, 24 nt, Human
ucuccugccucagccucccgagua

SEQ ID NO: 509683 - RNA, 22 nt, Human
ucucugggauggacacaaguuc

SEQ ID NO: 509684 - RNA, 26 nt, Human
ucugcacugggacaggaccacagggc

SEQ ID NO: 509685 - RNA, 19 nt, Human
ucugucaaccaggcuggag

SEQ ID NO: 509686 - RNA, 24 nt, Human
ucugucaaccaggcuggagugcag

SEQ ID NO: 509687 - RNA, 23 nt, Human
ucuugaacuccugaccucaggug

SEQ ID NO: 509688 - RNA, 23 nt, Human
ucuugcucugucaaccaggcugg

SEQ ID NO: 509689 - RNA, 24 nt, Human
ucuugcucugucaaccaggcugga

SEQ ID NO: 509690 - RNA, 23 nt, Human
ugacacaaaggguaccucaugac

SEQ ID NO: 509691 - RNA, 20 nt, Human
ugacccagguggaugggcaa

SEQ ID NO: 509692 - RNA, 18 nt, Human
ugaccucaggugaucugc

SEQ ID NO: 509693 - RNA, 20 nt, Human
ugaccucaggugaucugccc

SEQ ID NO: 509694 - RNA, 24 nt, Human
ugaccucaggugaucugcccgccu

SEQ ID NO: 509695 - RNA, 19 nt, Human
ugacugcguagccccccuu

SEQ ID NO: 509696 - RNA, 19 nt, Human
ugacuggcguauccuccuc

SEQ ID NO: 509697 - RNA, 22 nt, Human
ugacuuugugauccucccgccu

SEQ ID NO: 509698 - RNA, 22 nt, Human
ugagacggagucuugcucuguc

SEQ ID NO: 509699 - RNA, 18 nt, Human
ugagcaaccaugcccggc

SEQ ID NO: 509700 - RNA, 20 nt, Human
ugagcaaccaugcccggcuc

SEQ ID NO: 509701 - RNA, 20 nt, Human
ugagcuggugacacaaaggg

SEQ ID NO: 509702 - RNA, 23 nt, Human
ugcaccuccgccuuucccaccuc

SEQ ID NO: 509703 - RNA, 20 nt, Human
ugcaccuggaaucuggagac

SEQ ID NO: 509704 - RNA, 20 nt, Human
ugcagagggagggaagggcu

SEQ ID NO: 509705 - RNA, 21 nt, Human
ugcaggccacagugggggcag

SEQ ID NO: 509706 - RNA, 24 nt, Human
ugcagugaucucugggauggacac

SEQ ID NO: 509707 - RNA, 23 nt, Human
ugccccuaguccugggcuggagg

SEQ ID NO: 509708 - RNA, 24 nt, Human
ugccucagccucccgaguagcugg

SEQ ID NO: 509709 - RNA, 23 nt, Human
ugcgccagcugccgguccagggc

SEQ ID NO: 509710 - RNA, 24 nt, Human
ugcugggauuacaggcguaagcca

SEQ ID NO: 509711 - RNA, 18 nt, Human
uggaacagaaugaaugaa

SEQ ID NO: 509712 - RNA, 23 nt, Human
uggagugcaguggcacgaucuug

SEQ ID NO: 509713 - RNA, 24 nt, Human
uggagugcaguggcacgaucuugg

SEQ ID NO: 509714 - RNA, 19 nt, Human
uggcccagcucacacgugc

SEQ ID NO: 509715 - RNA, 23 nt, Human
uggcccagcucacacgugcugcu

SEQ ID NO: 509716 - RNA, 25 nt, Human
uggcccagcucacacgugcugcuuc

SEQ ID NO: 509717 - RNA, 21 nt, Human
uggcucacgccuguaauccca

SEQ ID NO: 509718 - RNA, 22 nt, Human
uggcucacgccuguaaucccag

SEQ ID NO: 509719 - RNA, 19 nt, Human
uggcucacugcaagcucug

SEQ ID NO: 509720 - RNA, 19 nt, Human
ugggacaggaccacagggc

SEQ ID NO: 509721 - RNA, 21 nt, Human
ugggacuacaggcgcccgcca

SEQ ID NO: 509722 - RNA, 22 nt, Human
ugggacuacaggcgcccgccac

SEQ ID NO: 509723 - RNA, 24 nt, Human
ugggacuacaggcgcccgccacca

SEQ ID NO: 509724 - RNA, 21 nt, Human
ugggauuacaggcguaagcca

SEQ ID NO: 509725 - RNA, 22 nt, Human
ugggauuacaggcguaagccac

SEQ ID NO: 509726 - RNA, 22 nt, Human
ugggauuacaggcguaagccac

SEQ ID NO: 509727 - RNA, 22 nt, Human
ugggauuacaggcguaagccac

SEQ ID NO: 509728 - RNA, 24 nt, Human
ugggauuacaggcguaagccacug

SEQ ID NO: 509729 - RNA, 26 nt, Human
ugggauuacaggcguaagccacugug

SEQ ID NO: 509730 - RNA, 19 nt, Human
ugggccuggugcgccagcu

SEQ ID NO: 509731 - RNA, 20 nt, Human
ugggcuggagggcaggucag

SEQ ID NO: 509732 - RNA, 22 nt, Human
uggggaggacuaacaaggcagc

SEQ ID NO: 509733 - RNA, 23 nt, Human
uggggccugggggcagguguucu

SEQ ID NO: 509734 - RNA, 21 nt, Human
ugggggcccauccuguggggc

SEQ ID NO: 509735 - RNA, 18 nt, Human
ugggguggggggacaggg

SEQ ID NO: 509736 - RNA, 24 nt, Human
uggucaggcugaucuugaacuccu

SEQ ID NO: 509737 - RNA, 21 nt, Human
uguauuuuuaguagagacggg

SEQ ID NO: 509738 - RNA, 18 nt, Human
uuaguagagacgggguuu

SEQ ID NO: 509739 - RNA, 22 nt, Human
uuaguagagacgggguuucacc

SEQ ID NO: 509740 - RNA, 24 nt, Human
uuaguagagacgggguuucaccgu

SEQ ID NO: 509741 - RNA, 18 nt, Human
uucauggaacagaaugaa

SEQ ID NO: 509742 - RNA, 25 nt, Human
uucugcagagggagggaagggcugg

SEQ ID NO: 509743 - RNA, 23 nt, Human
uuguauuuuuaguagagacgggg

SEQ ID NO: 509744 - RNA, 19 nt, Human
uuuauucacaauccgugcu

SEQ ID NO: 509745 - RNA, 19 nt, Human
uuucaccguguuagccagg

SEQ ID NO: 509746 - RNA, 21 nt, Human
uuucuccauguuggucaggcu

SEQ ID NO: 509747 - RNA, 27 nt, Human
uuugugauccucccgccucggccuccc

SEQ ID NO: 509748 - RNA, 24 nt, Human
uuuuuaguagagacgggguuucac

SEQ ID NO: 509749 - RNA, 21 nt, Human
uuuuuguauuuuuaguagaga

SEQ ID NO: 509750 - RNA, 21 nt, Human
uuuuuuguauuuuuaguagag

SEQ ID NO: 509751 - RNA, 24 nt, Human
uuuuuuguauuuuuaguagagacg

SEQ ID NO: 509752 - RNA, 19 nt, Human
aaaaaaacaaauacaccag

SEQ ID NO: 509753 - RNA, 26 nt, Human
aaaacaaauacaccagugauguuccu

SEQ ID NO: 509754 - RNA, 25 nt, Human
aaacaaauacaccagugauguuccu

SEQ ID NO: 509755 - RNA, 22 nt, Human
aacaaaaaaacaaauacaccag

SEQ ID NO: 509756 - RNA, 20 nt, Human
aagaacccaagcaaacaaac

SEQ ID NO: 509757 - RNA, 21 nt, Human
aagcaaacaaacaaaaaaaca

SEQ ID NO: 509758 - RNA, 19 nt, Human
aagcaaagccagcccagca

SEQ ID NO: 509759 - RNA, 25 nt, Human
acccaagcaaacaaacaaaaaaaca

SEQ ID NO: 509760 - RNA, 22 nt, Human
agagcaaccaaacauuccacag

SEQ ID NO: 509761 - RNA, 22 nt, Human
agcaaagccagcccagcaaacc

SEQ ID NO: 509762 - RNA, 21 nt, Human
agcagcccuggggcaacaaaa

SEQ ID NO: 509763 - RNA, 18 nt, Human
agcagggaaagcaaagcc

SEQ ID NO: 509764 - RNA, 19 nt, Human
agccaacucccacucugcc

SEQ ID NO: 509765 - RNA, 21 nt, Human
agccaacucccacucugcccg

SEQ ID NO: 509766 - RNA, 19 nt, Human
agcgggaagaaaggacuaa

SEQ ID NO: 509767 - RNA, 21 nt, Human
auaaacagggacaagggcuga

SEQ ID NO: 509768 - RNA, 18 nt, Human
caaaaccagugccugcug

SEQ ID NO: 509769 - RNA, 22 nt, Human
caaagccagcccagcaaacccc

SEQ ID NO: 509770 - RNA, 22 nt, Human
cagcaaagcagcccuggggcaa

SEQ ID NO: 509771 - RNA, 18 nt, Human
cagcauggaggagaggac

SEQ ID NO: 509772 - RNA, 18 nt, Human
cagcccagcaaacccucu

SEQ ID NO: 509773 - RNA, 24 nt, Human
cagcgggaagaaaggacuaaugaa

SEQ ID NO: 509774 - RNA, 22 nt, Human
cagcucaccccaccugggacca

SEQ ID NO: 509775 - RNA, 20 nt, Human
cagcuguagcugugggcucc

SEQ ID NO: 509776 - RNA, 19 nt, Human
caggacugcaugccugcug

SEQ ID NO: 509777 - RNA, 24 nt, Human
ccaacucccacucugcccgcugca

SEQ ID NO: 509778 - RNA, 19 nt, Human
ccagcaaggaugcaaaugc

SEQ ID NO: 509779 - RNA, 21 nt, Human
ccagcagggaaagcaaagcca

SEQ ID NO: 509780 - RNA, 19 nt, Human
ccagugccugcuggaagaa

SEQ ID NO: 509781 - RNA, 22 nt, Human
cccaagcaaacaaacaaaaaaa

SEQ ID NO: 509782 - RNA, 24 nt, Human
cccaagcaaacaaacaaaaaaaca

SEQ ID NO: 509783 - RNA, 27 nt, Human
cccaagcaaacaaacaaaaaggaguuc

SEQ ID NO: 509784 - RNA, 20 nt, Human
cccugugggaucugagcuga

SEQ ID NO: 509785 - RNA, 21 nt, Human
ccugcagcuguagcugugggc

SEQ ID NO: 509786 - RNA, 19 nt, Human
cucccacucugcccgcugc

SEQ ID NO: 509787 - RNA, 23 nt, Human
cuccugagugcucagcuagcgug

SEQ ID NO: 509788 - RNA, 19 nt, Human
cucucugucaaucaccaau

SEQ ID NO: 509789 - RNA, 19 nt, Human
cugcagauaaacagggaca

SEQ ID NO: 509790 - RNA, 19 nt, Human
cugcuaacacaaaacagcg

SEQ ID NO: 509791 - RNA, 24 nt, Human
cugcuggaagaacuguccccacgg

SEQ ID NO: 509792 - RNA, 20 nt, Human
cuugcaagucuccuggcugc

SEQ ID NO: 509793 - RNA, 23 nt, Human
gacgccagcagucccugcagcug

SEQ ID NO: 509794 - RNA, 21 nt, Human
gaggacgccagcagucccugc

SEQ ID NO: 509795 - RNA, 18 nt, Human
gcaagucuccuggcugca

SEQ ID NO: 509796 - RNA, 23 nt, Human
gcacaaaguccuccaggauccca

SEQ ID NO: 509797 - RNA, 23 nt, Human
gccagcucaccccaccugggacc

SEQ ID NO: 509798 - RNA, 21 nt, Human
gccugcuggaaguggcaugcu

SEQ ID NO: 509799 - RNA, 22 nt, Human
gcuaaagaggaggcccuguggg

SEQ ID NO: 509800 - RNA, 25 nt, Human
gcugcagauaaacagggacaagggc

SEQ ID NO: 509801 - RNA, 23 nt, Human
gcugcagcacagaaggaugccug

SEQ ID NO: 509802 - RNA, 19 nt, Human
ggaaagcaaagccagccca

SEQ ID NO: 509803 - RNA, 19 nt, Human
ggcaugcuggguuagugag

SEQ ID NO: 509804 - RNA, 24 nt, Human
guccaccccacaugguguuuuggc

SEQ ID NO: 509805 - RNA, 20 nt, Human
guguuuuggccuucaguggc

SEQ ID NO: 509806 - RNA, 18 nt, Human
uaaaggucauugaaacag

SEQ ID NO: 509807 - RNA, 20 nt, Human
uaacacaaaacagcgcacga

SEQ ID NO: 509808 - RNA, 21 nt, Human
uaacacagcuguggccccagc

SEQ ID NO: 509809 - RNA, 22 nt, Human
uaagccuaccugugaaacacaa

SEQ ID NO: 509810 - RNA, 24 nt, Human
ucaccaaucccuugcaagucuccu

SEQ ID NO: 509811 - RNA, 20 nt, Human
ucauugaaacaguaaggggg

SEQ ID NO: 509812 - RNA, 18 nt, Human
ucccauagagcugggcca

SEQ ID NO: 509813 - RNA, 18 nt, Human
ugaaaugcaaucaucauc

SEQ ID NO: 509814 - RNA, 20 nt, Human
ugaacaggccgcagcccacu

SEQ ID NO: 509815 - RNA, 22 nt, Human
ugaugaacucuccugagugcuc

SEQ ID NO: 509816 - RNA, 21 nt, Human
ugcaagaacccaagcaaacaa

SEQ ID NO: 509817 - RNA, 26 nt, Human
ugcaagaacccaagcaaacaaacaaa

SEQ ID NO: 509818 - RNA, 19 nt, Human
ugcacaaaguccuccagga

SEQ ID NO: 509819 - RNA, 21 nt, Human
ugcuggaagaacuguccccac

SEQ ID NO: 509820 - RNA, 18 nt, Human
uggaagaacuguccccac

SEQ ID NO: 509821 - RNA, 19 nt, Human
uggcaccaggaccuggcac

SEQ ID NO: 509822 - RNA, 19 nt, Human
uggcaccaggaccuggcac

SEQ ID NO: 509823 - RNA, 19 nt, Human
ugggaccaggggcagcagc

SEQ ID NO: 509824 - RNA, 24 nt, Human
ugggaccaggggcagcagcaugga

SEQ ID NO: 509825 - RNA, 21 nt, Human
ugggcagcgggaagaaaggac

SEQ ID NO: 509826 - RNA, 19 nt, Human
uguuuuggccuucaguggc

SEQ ID NO: 509827 - RNA, 23 nt, Human
uuagggcauccaaacuguuguga

SEQ ID NO: 509828 - RNA, 19 nt, Human
uuugggagacccugugccc

SEQ ID NO: 509829 - RNA, 20 nt, Human
uuuuuuuuuuuuuugggagg

SEQ ID NO: 509830 - RNA, 22 nt, Human
uuuuuuuuuuuuuuugggaggg

SEQ ID NO: 509831 - RNA, 20 nt, Human
aaacaaugaugaagaauggc

SEQ ID NO: 509832 - RNA, 24 nt, Human
aacaaugaugaagaauggcuguca

SEQ ID NO: 509833 - RNA, 19 nt, Human
auauauauauauauauaua

SEQ ID NO: 509834 - RNA, 19 nt, Human
auauauauauauauauaua

SEQ ID NO: 509835 - RNA, 25 nt, Human
caacccgucagaaccagcaaccgcu

SEQ ID NO: 509836 - RNA, 18 nt, Human
cagaaccagcaaccgcug

SEQ ID NO: 509837 - RNA, 22 nt, Human
ccacagcagaguauaugaucag

SEQ ID NO: 509838 - RNA, 20 nt, Human
cccaggguuuggcauccagc

SEQ ID NO: 509839 - RNA, 25 nt, Human
cugaaggcuucuaccuuacacauga

SEQ ID NO: 509840 - RNA, 27 nt, Human
cuuuucagaccaccccugaaaagcugg

SEQ ID NO: 509841 - RNA, 22 nt, Human
gaaccagcaaccgcuggaaaug

SEQ ID NO: 509842 - RNA, 18 nt, Human
gagauuuaacauuguaca

SEQ ID NO: 509843 - RNA, 19 nt, Human
guauauauauauauauaua

SEQ ID NO: 509844 - RNA, 19 nt, Human
uauauauauauauauauau

SEQ ID NO: 509845 - RNA, 19 nt, Human
uauauauauauauauauau

SEQ ID NO: 509846 - RNA, 21 nt, Human
uaugguauauauauauauaua

SEQ ID NO: 509847 - RNA, 23 nt, Human
ugcacauuaagucuuuacuaccu

SEQ ID NO: 509848 - RNA, 24 nt, Human
uggcguccgggcccggaagccccu

SEQ ID NO: 509849 - RNA, 20 nt, Human
uggcuuuucagaccaccccu

SEQ ID NO: 509850 - RNA, 18 nt, Human
ugguauauauauauauau

SEQ ID NO: 509851 - RNA, 23 nt, Human
ugguauauauauauauauauaua

SEQ ID NO: 509852 - RNA, 23 nt, Human
uuuuaugguauauauauauauau

SEQ ID NO: 509853 - RNA, 19 nt, Human
aagaauugcaggaaggagg

SEQ ID NO: 509854 - RNA, 25 nt, Human
accccacccucccccucccaccuca

SEQ ID NO: 509855 - RNA, 24 nt, Human
accgaagccgcagaagcaaagcca

SEQ ID NO: 509856 - RNA, 23 nt, Human
accuaccccacccucccccuccc

SEQ ID NO: 509857 - RNA, 27 nt, Human
accuaccccacccucccccucccaccu

SEQ ID NO: 509858 - RNA, 20 nt, Human
accucagccacagaggaaca

SEQ ID NO: 509859 - RNA, 21 nt, Human
accucagccacagaggaacaa

SEQ ID NO: 509860 - RNA, 22 nt, Human
acucccuguugccauaacacag

SEQ ID NO: 509861 - RNA, 18 nt, Human
agaacagcguccagcacg

SEQ ID NO: 509862 - RNA, 28 nt, Human
agaagcaaagccaggagcagaauccauu

SEQ ID NO: 509863 - RNA, 22 nt, Human
agcccuccaguccccaaaccag

SEQ ID NO: 509864 - RNA, 24 nt, Human
agccgcagaagcaaagccaggagc

SEQ ID NO: 509865 - RNA, 19 nt, Human
aggccagggcugggcagcc

SEQ ID NO: 509866 - RNA, 18 nt, Human
aggcguuggcggccaccc

SEQ ID NO: 509867 - RNA, 19 nt, Human
aggcguuggcggccacccu

SEQ ID NO: 509868 - RNA, 24 nt, Human
augagaugcccacucccuguugcc

SEQ ID NO: 509869 - RNA, 21 nt, Human
auggcagcggugaccaagcac

SEQ ID NO: 509870 - RNA, 22 nt, Human
caaagagcacacugaacagaac

SEQ ID NO: 509871 - RNA, 21 nt, Human
caagaaggcauggagccuggg

SEQ ID NO: 509872 - RNA, 18 nt, Human
cacacugaacagaacagc

SEQ ID NO: 509873 - RNA, 24 nt, Human
caccauauaauaaacaguucaaaa

SEQ ID NO: 509874 - RNA, 21 nt, Human
caccauggaggacagaaggca

SEQ ID NO: 509875 - RNA, 18 nt, Human
cacccucccccucccacc

SEQ ID NO: 509876 - RNA, 20 nt, Human
caccucagccacagaggaac

SEQ ID NO: 509877 - RNA, 22 nt, Human
caccucagccacagaggaacaa

SEQ ID NO: 509878 - RNA, 22 nt, Human
cagaacagcguccagcacguga

SEQ ID NO: 509879 - RNA, 23 nt, Human
cagaauccauucugccagcgcug

SEQ ID NO: 509880 - RNA, 22 nt, Human
caggagcagaauccauucugcc

SEQ ID NO: 509881 - RNA, 24 nt, Human
caggagcagaauccauucugccag

SEQ ID NO: 509882 - RNA, 25 nt, Human
caggcagaugagaugcccacucccu

SEQ ID NO: 509883 - RNA, 19 nt, Human
caguggacagugguggggg

SEQ ID NO: 509884 - RNA, 18 nt, Human
ccacccucccaagaaggc

SEQ ID NO: 509885 - RNA, 22 nt, Human
ccaccgaagccgcagaagcaaa

SEQ ID NO: 509886 - RNA, 24 nt, Human
ccacgugccuccucggccuucugg

SEQ ID NO: 509887 - RNA, 20 nt, Human
ccaggcuuucucgauaucgg

SEQ ID NO: 509888 - RNA, 23 nt, Human
cccaaaccaguccucggcccugc

SEQ ID NO: 509889 - RNA, 25 nt, Human
cccagcccagcuaggcgcauccucu

SEQ ID NO: 509890 - RNA, 18 nt, Human
ccccacccucccccuccc

SEQ ID NO: 509891 - RNA, 19 nt, Human
ccccacccucccccuccca

SEQ ID NO: 509892 - RNA, 21 nt, Human
ccccucccaccucagccacag

SEQ ID NO: 509893 - RNA, 26 nt, Human
cccucccaccucagccacagaggaac

SEQ ID NO: 509894 - RNA, 19 nt, Human
cccucccccucccaccuca

SEQ ID NO: 509895 - RNA, 22 nt, Human
cccucccccucccaccucagcc

SEQ ID NO: 509896 - RNA, 18 nt, Human
cccugacucuggagaggg

SEQ ID NO: 509897 - RNA, 30 nt, Human
ccucaccauggaggacagaaggcaggggcu

SEQ ID NO: 509898 - RNA, 24 nt, Human
ccucccgacuccuugguccugccu

SEQ ID NO: 509899 - RNA, 24 nt, Human
ccuccucggccuucuggcagggcg

SEQ ID NO: 509900 - RNA, 26 nt, Human
cgaagccgcagaagcaaagccaggag

SEQ ID NO: 509901 - RNA, 19 nt, Human
cgacuccuugguccugccu

SEQ ID NO: 509902 - RNA, 31 nt, Human
cuccaguccccaaaccaguccucggcccugg

SEQ ID NO: 509903 - RNA, 19 nt, Human
cucccccucccaccucagc

SEQ ID NO: 509904 - RNA, 18 nt, Human
cucccugacucuggagag

SEQ ID NO: 509905 - RNA, 20 nt, Human
cugcaguccccguucaaggc

SEQ ID NO: 509906 - RNA, 25 nt, Human
cugccagcccuccaguccccaaacc

SEQ ID NO: 509907 - RNA, 20 nt, Human
gacagugguggggggccagg

SEQ ID NO: 509908 - RNA, 20 nt, Human
gacugcagagaucuccagcc

SEQ ID NO: 509909 - RNA, 23 nt, Human
gagagcugaccacaggcagauga

SEQ ID NO: 509910 - RNA, 22 nt, Human
gcagcggugaccaagcacagcc

SEQ ID NO: 509911 - RNA, 21 nt, Human
gccagggcugggcagcccucc

SEQ ID NO: 509912 - RNA, 20 nt, Human
gccagguuucuggucagugg

SEQ ID NO: 509913 - RNA, 21 nt, Human
gcccugcagccagguuucugg

SEQ ID NO: 509914 - RNA, 19 nt, Human
gcugccagcccuccagucc

SEQ ID NO: 509915 - RNA, 20 nt, Human
ggaggcccuccacgugccuu

SEQ ID NO: 509916 - RNA, 21 nt, Human
ggggccucccgacuccuuggu

SEQ ID NO: 509917 - RNA, 18 nt, Human
ggucaguggacaguggug

SEQ ID NO: 509918 - RNA, 18 nt, Human
ggugaccaagcacagcca

SEQ ID NO: 509919 - RNA, 22 nt, Human
uaccccacccucccccucccac

SEQ ID NO: 509920 - RNA, 28 nt, Human
uaccccacccucccccucccaccucagc

SEQ ID NO: 509921 - RNA, 21 nt, Human
uaggcgcauccucugcggcau

SEQ ID NO: 509922 - RNA, 23 nt, Human
ucaguggacagugguggggggcc

SEQ ID NO: 509923 - RNA, 23 nt, Human
uccauaacugucuccaccgaagc

SEQ ID NO: 509924 - RNA, 18 nt, Human
ucccaagaaggcauggag

SEQ ID NO: 509925 - RNA, 22 nt, Human
uccccaaaccaguccucggccc

SEQ ID NO: 509926 - RNA, 24 nt, Human
ucugagagcugaccacaggcagau

SEQ ID NO: 509927 - RNA, 22 nt, Human
ugagaugaaaucaucauccacc

SEQ ID NO: 509928 - RNA, 27 nt, Human
ugcaaggaacauuuuauuccauaaaau

SEQ ID NO: 509929 - RNA, 24 nt, Human
uggagccugggggcccccagccag

SEQ ID NO: 509930 - RNA, 20 nt, Human
uggaggacagaaggcagggg

SEQ ID NO: 509931 - RNA, 25 nt, Human
uggggagacaucugugcccucacca

SEQ ID NO: 509932 - RNA, 23 nt, Human
ugggggcccccagccaggccccu

SEQ ID NO: 509933 - RNA, 21 nt, Human
uuuuuuuuuuuugcaaggaac

SEQ ID NO: 509934 - RNA, 21 nt, Human
uuuuuuuuuuuuuugcaagga

SEQ ID NO: 509935 - RNA, 21 nt, Human
uuuuuuuuuuuuuuuuugcaa

SEQ ID NO: 509936 - RNA, 20 nt, Human
uuuuuuuuuuuuuuuuuugg

SEQ ID NO: 509937 - RNA, 19 nt, Human
acaaacaccuccaugggcu

SEQ ID NO: 509938 - RNA, 20 nt, Human
acauccaagagaucaaagag

SEQ ID NO: 509939 - RNA, 19 nt, Human
aggcuggggugcaggagaa

SEQ ID NO: 509940 - RNA, 25 nt, Human
agggaggugggaggggcgggcaggg

SEQ ID NO: 509941 - RNA, 21 nt, Human
aggugggaggggcgggcaggg

SEQ ID NO: 509942 - RNA, 23 nt, Human
agguguccgaguccucaggcaug

SEQ ID NO: 509943 - RNA, 24 nt, Human
aucucgccugcccagaaccuucca

SEQ ID NO: 509944 - RNA, 22 nt, Human
auggccgggaaguucugcucca

SEQ ID NO: 509945 - RNA, 19 nt, Human
caccgcuccuccugggcca

SEQ ID NO: 509946 - RNA, 21 nt, Human
caccgcuccuccugggccaug

SEQ ID NO: 509947 - RNA, 27 nt, Human
cagcgugagcuuggucucgucguccac

SEQ ID NO: 509948 - RNA, 26 nt, Human
cauuaacuucaaaccgguccuggacg

SEQ ID NO: 509949 - RNA, 19 nt, Human
ccaugggcugugugggaag

SEQ ID NO: 509950 - RNA, 20 nt, Human
ccuccaugggcuguguggga

SEQ ID NO: 509951 - RNA, 22 nt, Human
cgcccgggccacccggugcagg

SEQ ID NO: 509952 - RNA, 23 nt, Human
cgggcgcucagacacgaguugcu

SEQ ID NO: 509953 - RNA, 24 nt, Human
cgugagcuuggucucgucguccac

SEQ ID NO: 509954 - RNA, 19 nt, Human
cucgcacucaccgcuccuc

SEQ ID NO: 509955 - RNA, 22 nt, Human
cucgcacucaccgcuccuccug

SEQ ID NO: 509956 - RNA, 22 nt, Human
cuggaaauccuugaacugcuga

SEQ ID NO: 509957 - RNA, 21 nt, Human
cuucucaacaguggcgccugg

SEQ ID NO: 509958 - RNA, 21 nt, Human
cuucucaacaguggcgccugg

SEQ ID NO: 509959 - RNA, 24 nt, Human
cuucucacugucuuugaguuugac

SEQ ID NO: 509960 - RNA, 19 nt, Human
gaaauccuugaacugcuga

SEQ ID NO: 509961 - RNA, 19 nt, Human
gaagggaggugggaggggc

SEQ ID NO: 509962 - RNA, 21 nt, Human
gaaguucugccacauuaacuu

SEQ ID NO: 509963 - RNA, 21 nt, Human
gccuggaaaggggaggugaag

SEQ ID NO: 509964 - RNA, 21 nt, Human
gccuggaaaggggaggugaag

SEQ ID NO: 509965 - RNA, 18 nt, Human
gcuccgggugggcggcuc

SEQ ID NO: 509966 - RNA, 18 nt, Human
gcuccgggugggcggcuc

SEQ ID NO: 509967 - RNA, 21 nt, Human
ggaaguucugcuccacgagga

SEQ ID NO: 509968 - RNA, 23 nt, Human
ggaggugggaggggcgggcaggg

SEQ ID NO: 509969 - RNA, 21 nt, Human
ggcgacuccuuugugcgacac

SEQ ID NO: 509970 - RNA, 22 nt, Human
ggcugugugggaagggaggugg

SEQ ID NO: 509971 - RNA, 24 nt, Human
gggaagggaggugggaggggcggg

SEQ ID NO: 509972 - RNA, 20 nt, Human
gggaggugggaggggcgggc

SEQ ID NO: 509973 - RNA, 24 nt, Human
gggccagggccaugcagcgcugca

SEQ ID NO: 509974 - RNA, 25 nt, Human
gguggauggcgauggccgggaaguu

SEQ ID NO: 509975 - RNA, 21 nt, Human
guggauggcgauggccgggaa

SEQ ID NO: 509976 - RNA, 23 nt, Human
guggugcucccugcagccuuggc

SEQ ID NO: 509977 - RNA, 21 nt, Human
ucagacacgaguugcugcgcu

SEQ ID NO: 509978 - RNA, 18 nt, Human
uccaagagaucaaagagc

SEQ ID NO: 509979 - RNA, 22 nt, Human
uccacaaacaccuccaugggcu

SEQ ID NO: 509980 - RNA, 24 nt, Human
uccaugggcugugugggaagggag

SEQ ID NO: 509981 - RNA, 21 nt, Human
ucccagaggaccugcugcacc

SEQ ID NO: 509982 - RNA, 18 nt, Human
ucccugcagccuuggcgg

SEQ ID NO: 509983 - RNA, 19 nt, Human
ucccugcagccuuggcggg

SEQ ID NO: 509984 - RNA, 20 nt, Human
uccgggugggcggcucuggc

SEQ ID NO: 509985 - RNA, 20 nt, Human
uccgggugggcggcucuggc

SEQ ID NO: 509986 - RNA, 27 nt, Human
ucguccacaaacaccuccaugggcugu

SEQ ID NO: 509987 - RNA, 19 nt, Human
ugacucgcucgauguccau

SEQ ID NO: 509988 - RNA, 19 nt, Human
ugcagccuuggcgggcggc

SEQ ID NO: 509989 - RNA, 22 nt, Human
ugcagccuuggcgggcggcucg

SEQ ID NO: 509990 - RNA, 24 nt, Human
ugccaaagcgacccgcccgggcca

SEQ ID NO: 509991 - RNA, 21 nt, Human
ugcccagaaccuuccaguggg

SEQ ID NO: 509992 - RNA, 22 nt, Human
ugcccagaaccuuccagugggc

SEQ ID NO: 509993 - RNA, 19 nt, Human
ugcucccugcagccuuggc

SEQ ID NO: 509994 - RNA, 22 nt, Human
uggaaaggggaggugaagcugc

SEQ ID NO: 509995 - RNA, 19 nt, Human
uggcgauggccgggaaguu

SEQ ID NO: 509996 - RNA, 19 nt, Human
uggcgggcggcucgcacuc

SEQ ID NO: 509997 - RNA, 19 nt, Human
ugggaagggaggugggagg

SEQ ID NO: 509998 - RNA, 20 nt, Human
ugggaagggaggugggaggg

SEQ ID NO: 509999 - RNA, 22 nt, Human
ugggaagggaggugggaggggc

SEQ ID NO: 510000 - RNA, 20 nt, Human
ugggcaucucgccugcccag

SEQ ID NO: 510001 - RNA, 24 nt, Human
uguauguggagaugucgauuuccu

SEQ ID NO: 510002 - RNA, 18 nt, Human
uguccgaguccucaggca

SEQ ID NO: 510003 - RNA, 23 nt, Human
uuaaacuccagcacauccaagag

SEQ ID NO: 510004 - RNA, 23 nt, Human
uuccagugggcgacuccuuugug

SEQ ID NO: 510005 - RNA, 25 nt, Human
uugugcgacacuucccagaggaccu

SEQ ID NO: 510006 - RNA, 24 nt, Human
uuuuuuuuuuuccauaauaacaag

SEQ ID NO: 510007 - RNA, 20 nt, Human
uuuuuuuuuuuuuuuuccau

SEQ ID NO: 510008 - RNA, 24 nt, Human
uuuuuuuuuuuuuuuuuuuuccau

SEQ ID NO: 510009 - RNA, 24 nt, Human
uuuuuuuuuuuuuuuuuuuuuccu

SEQ ID NO: 510010 - RNA, 18 nt, Human
aaccuccuuccucacagc

SEQ ID NO: 510011 - RNA, 30 nt, Human
aagaaaauaaauauuuccacgaggucaagg

SEQ ID NO: 510012 - RNA, 22 nt, Human
aagcccuggcuacugcugcugg

SEQ ID NO: 510013 - RNA, 22 nt, Human
aaguccaagcccuggcuacugc

SEQ ID NO: 510014 - RNA, 26 nt, Human
acccacuccaccuucccauccuggag

SEQ ID NO: 510015 - RNA, 18 nt, Human
acuccggccggguuccag

SEQ ID NO: 510016 - RNA, 22 nt, Human
agccagguuuaaaucccuguuu

SEQ ID NO: 510017 - RNA, 21 nt, Human
agcccuggcuacugcugcugg

SEQ ID NO: 510018 - RNA, 18 nt, Human
agcugcacaaauuguccc

SEQ ID NO: 510019 - RNA, 23 nt, Human
caaagccagguuuaaaucccugu

SEQ ID NO: 510020 - RNA, 22 nt, Human
caagccaaaguacaggggcugg

SEQ ID NO: 510021 - RNA, 20 nt, Human
caccaugucccugcacaaga

SEQ ID NO: 510022 - RNA, 20 nt, Human
cacuccaccuucccauccug

SEQ ID NO: 510023 - RNA, 19 nt, Human
caggggcuggagacggggu

SEQ ID NO: 510024 - RNA, 23 nt, Human
ccaaagccagguuuaaaucccug

SEQ ID NO: 510025 - RNA, 22 nt, Human
ccagguuuaaaucccuguuucu

SEQ ID NO: 510026 - RNA, 24 nt, Human
cccagaaccuccuuccucacagcc

SEQ ID NO: 510027 - RNA, 26 nt, Human
ccucacagccggcgcucagagcuacu

SEQ ID NO: 510028 - RNA, 19 nt, Human
cggggugggaaguggggca

SEQ ID NO: 510029 - RNA, 18 nt, Human
cuugaaguugaugcaaug

SEQ ID NO: 510030 - RNA, 19 nt, Human
cuuggggugauggaggcug

SEQ ID NO: 510031 - RNA, 22 nt, Human
cuuuagaugagcacaguagcuc

SEQ ID NO: 510032 - RNA, 24 nt, Human
gccaaaguacaggggcuggagacg

SEQ ID NO: 510033 - RNA, 19 nt, Human
gcccagaaccuccuuccuc

SEQ ID NO: 510034 - RNA, 21 nt, Human
ggagacggggugggaaguggg

SEQ ID NO: 510035 - RNA, 23 nt, Human
ggagacggggugggaaguggggc

SEQ ID NO: 510036 - RNA, 21 nt, Human
gggaaguggggcaaacacuuu

SEQ ID NO: 510037 - RNA, 19 nt, Human
gggugauggaggcugcagg

SEQ ID NO: 510038 - RNA, 24 nt, Human
uacaggggcuggagacgggguggg

SEQ ID NO: 510039 - RNA, 19 nt, Human
ucacccacuccaccuuccc

SEQ ID NO: 510040 - RNA, 18 nt, Human
ucuguguuagauaugagc

SEQ ID NO: 510041 - RNA, 24 nt, Human
uugaugcaaugugucucuguguua

SEQ ID NO: 510042 - RNA, 23 nt, Human
agauuguagcaaaguguguuuau

SEQ ID NO: 510043 - RNA, 19 nt, Human
agccaagagaacacaaguc

SEQ ID NO: 510044 - RNA, 20 nt, Human
agcggccucggccuccagga

SEQ ID NO: 510045 - RNA, 19 nt, Human
aggcaggacacccuugacc

SEQ ID NO: 510046 - RNA, 23 nt, Human
aggcaggacacccuugaccaugg

SEQ ID NO: 510047 - RNA, 18 nt, Human
caccugcguggcagcucc

SEQ ID NO: 510048 - RNA, 20 nt, Human
cagcuccacgggccaggccc

SEQ ID NO: 510049 - RNA, 19 nt, Human
cagcuggaggaccauccca

SEQ ID NO: 510050 - RNA, 19 nt, Human
caggaagcagcggccggaa

SEQ ID NO: 510051 - RNA, 18 nt, Human
cagguggugcagagacag

SEQ ID NO: 510052 - RNA, 21 nt, Human
caucuugucuguacccccacc

SEQ ID NO: 510053 - RNA, 21 nt, Human
ccaccaccugcguggcaccug

SEQ ID NO: 510054 - RNA, 27 nt, Human
ccagcaauucucuuuaauccucuuucu

SEQ ID NO: 510055 - RNA, 23 nt, Human
ccccaccaccugcguggcaccug

SEQ ID NO: 510056 - RNA, 25 nt, Human
ccuccaggacccggcgcgcagcuuu

SEQ ID NO: 510057 - RNA, 22 nt, Human
ccugcguggcagcuccacgggc

SEQ ID NO: 510058 - RNA, 21 nt, Human
cgcaguaauagcugaguguuc

SEQ ID NO: 510059 - RNA, 23 nt, Human
cguggcagcuccacgggccaggc

SEQ ID NO: 510060 - RNA, 23 nt, Human
cucaggcccuggacccaggcagg

SEQ ID NO: 510061 - RNA, 24 nt, Human
cuuucuuuuccuucuaaaagcuuu

SEQ ID NO: 510062 - RNA, 18 nt, Human
gaccuugugggcagcugg

SEQ ID NO: 510063 - RNA, 19 nt, Human
gaggaggggcugggcugca

SEQ ID NO: 510064 - RNA, 19 nt, Human
gcaccucaguguuuucagc

SEQ ID NO: 510065 - RNA, 20 nt, Human
gcgggagcggccucggccuc

SEQ ID NO: 510066 - RNA, 23 nt, Human
gcugguucagauuggugcucucc

SEQ ID NO: 510067 - RNA, 23 nt, Human
ggaguuggggccguggggaggga

SEQ ID NO: 510068 - RNA, 18 nt, Human
ggcaccugguccucagac

SEQ ID NO: 510069 - RNA, 22 nt, Human
gggagggaaagcgcaguaauag

SEQ ID NO: 510070 - RNA, 24 nt, Human
gggauccauguggcucccucaggc

SEQ ID NO: 510071 - RNA, 19 nt, Human
ggggacugcggggacaacg

SEQ ID NO: 510072 - RNA, 19 nt, Human
ggggagggaaagcgcagua

SEQ ID NO: 510073 - RNA, 21 nt, Human
uaagaaaacgcacuagcaaga

SEQ ID NO: 510074 - RNA, 26 nt, Human
uaauccucuuucuuuuccuucuaaaa

SEQ ID NO: 510075 - RNA, 21 nt, Human
uagcaagauuguagcaaagug

SEQ ID NO: 510076 - RNA, 20 nt, Human
ucagacaccugcguggcacc

SEQ ID NO: 510077 - RNA, 20 nt, Human
uccaccuggcugagugaggc

SEQ ID NO: 510078 - RNA, 18 nt, Human
uccacgggccaggcccac

SEQ ID NO: 510079 - RNA, 21 nt, Human
ucccagcaucuugucuguacc

SEQ ID NO: 510080 - RNA, 23 nt, Human
ucggccuccaggacccggcgcgc

SEQ ID NO: 510081 - RNA, 26 nt, Human
ucuuucuuuuccuucuaaaagcuuuu

SEQ ID NO: 510082 - RNA, 23 nt, Human
ugaguguucagaggaggggcugg

SEQ ID NO: 510083 - RNA, 24 nt, Human
ugaguguucagaggaggggcuggg

SEQ ID NO: 510084 - RNA, 19 nt, Human
ugcaaacagguggugcaga

SEQ ID NO: 510085 - RNA, 18 nt, Human
ugcccuggaguuggggcc

SEQ ID NO: 510086 - RNA, 24 nt, Human
ugcccuggaguuggggccgugggg

SEQ ID NO: 510087 - RNA, 24 nt, Human
ugcugguucagauuggugcucucc

SEQ ID NO: 510088 - RNA, 20 nt, Human
uggcugagugaggcggcagg

SEQ ID NO: 510089 - RNA, 24 nt, Human
ugggagcaccucaguguuuucagc

SEQ ID NO: 510090 - RNA, 19 nt, Human
ugggcugcaggcauugcug

SEQ ID NO: 510091 - RNA, 24 nt, Human
uuaggaucaccagcaauucucuuu

SEQ ID NO: 510092 - RNA, 23 nt, Human
uucagccaagagaacacaagucu

SEQ ID NO: 510093 - RNA, 24 nt, Human
uuuuuacaguaaauagauuaucuu

SEQ ID NO: 510094 - RNA, 18 nt, Human
uuuuuuuuuuuuaggauc

SEQ ID NO: 510095 - RNA, 20 nt, Human
aaagucacugguuuccucca

SEQ ID NO: 510096 - RNA, 18 nt, Human
accccacagcucuggacc

SEQ ID NO: 510097 - RNA, 21 nt, Human
agcaucuuuccaggggcuucc

SEQ ID NO: 510098 - RNA, 21 nt, Human
caacccccggccccgaagcuc

SEQ ID NO: 510099 - RNA, 23 nt, Human
caacccccggccccgaagcuccu

SEQ ID NO: 510100 - RNA, 18 nt, Human
cagcagccgcaccagcca

SEQ ID NO: 510101 - RNA, 19 nt, Human
cagccgcaccagccaaggc

SEQ ID NO: 510102 - RNA, 21 nt, Human
caggggcuucccuacuagcuc

SEQ ID NO: 510103 - RNA, 24 nt, Human
caucuuuccaggggcuucccuacu

SEQ ID NO: 510104 - RNA, 20 nt, Human
ccacugggugucggaggugg

SEQ ID NO: 510105 - RNA, 20 nt, Human
ccagagaccgcgcggaggca

SEQ ID NO: 510106 - RNA, 21 nt, Human
ccagcagccgcaccagccaag

SEQ ID NO: 510107 - RNA, 18 nt, Human
cccaacccccggccccga

SEQ ID NO: 510108 - RNA, 29 nt, Human
cccaacccccggccccgaagccgguuccg

SEQ ID NO: 510109 - RNA, 21 nt, Human
cccacagcucuggaccggcca

SEQ ID NO: 510110 - RNA, 23 nt, Human
cccacagcucuggaccggccacu

SEQ ID NO: 510111 - RNA, 21 nt, Human
cccccggccccgaagcuccuu

SEQ ID NO: 510112 - RNA, 25 nt, Human
cccgaagcuccuucccugccggauc

SEQ ID NO: 510113 - RNA, 21 nt, Human
cccggccccgaagcuccuucc

SEQ ID NO: 510114 - RNA, 18 nt, Human
ccgaagcuccuucccugc

SEQ ID NO: 510115 - RNA, 21 nt, Human
ccgauccgccagagaccgcgc

SEQ ID NO: 510116 - RNA, 23 nt, Human
ccgccagagaccgcgcggaggca

SEQ ID NO: 510117 - RNA, 21 nt, Human
ccuucccugccggauccucuc

SEQ ID NO: 510118 - RNA, 20 nt, Human
cggccccgaagcuccuuccc

SEQ ID NO: 510119 - RNA, 19 nt, Human
cugccggauccucucgccu

SEQ ID NO: 510120 - RNA, 19 nt, Human
gauccgauuccccgauccg

SEQ ID NO: 510121 - RNA, 27 nt, Human
gccccgaagcuccuucccugccggauc

SEQ ID NO: 510122 - RNA, 22 nt, Human
guaaaugugcggcccaaccccc

SEQ ID NO: 510123 - RNA, 18 nt, Human
uacuagcucagccccaua

SEQ ID NO: 510124 - RNA, 21 nt, Human
ucagccccauaaagucacugg

SEQ ID NO: 510125 - RNA, 21 nt, Human
uccacuccgcuucgcgcacgu

SEQ ID NO: 510126 - RNA, 19 nt, Human
uccgggagaccugcccggg

SEQ ID NO: 510127 - RNA, 20 nt, Human
ucggaacgcagcaucuuucc

SEQ ID NO: 510128 - RNA, 23 nt, Human
uggaccagcagccgcaccagcca

SEQ ID NO: 510129 - RNA, 22 nt, Human
ugugcggcccaacccccggccc

SEQ ID NO: 510130 - RNA, 24 nt, Human
uucggaacgcagcaucuuuccagg

SEQ ID NO: 510131 - RNA, 21 nt, Human
uuggcgguaacaaugcucuuu

SEQ ID NO: 510132 - RNA, 25 nt, Human
uuggcgguaacaaugcucuuuauuu

SEQ ID NO: 510133 - RNA, 23 nt, Human
cacgucucagaccaagucgagga

SEQ ID NO: 510134 - RNA, 21 nt, Human
caguuggucuugguauugggg

SEQ ID NO: 510135 - RNA, 18 nt, Human
ucagaccaagucgaggac

SEQ ID NO: 510136 - RNA, 23 nt, Human
ugaagcagauucuggcuuucagu

SEQ ID NO: 510137 - RNA, 21 nt, Human
ugggguaaggggguauugcag

SEQ ID NO: 510138 - RNA, 23 nt, Human
ugggguaaggggguauugcaggu

SEQ ID NO: 510139 - RNA, 18 nt, Human
agcagaagguacaggagu

SEQ ID NO: 510140 - RNA, 23 nt, Human
aggcagggugaccagagagggca

SEQ ID NO: 510141 - RNA, 19 nt, Human
aggcauuuauuugagauga

SEQ ID NO: 510142 - RNA, 23 nt, Human
aggcauuuauuugagaugaggaa

SEQ ID NO: 510143 - RNA, 19 nt, Human
cuguagcucucaaagcaaa

SEQ ID NO: 510144 - RNA, 22 nt, Human
gaaaggaaauugagcagaaggu

SEQ ID NO: 510145 - RNA, 22 nt, Human
ucaaagcaaauuuugagcucau

SEQ ID NO: 510146 - RNA, 21 nt, Human
ugaccagagagggcagacagc

SEQ ID NO: 510147 - RNA, 22 nt, Human
ugagaugaggaaaggaaauuga

SEQ ID NO: 510148 - RNA, 19 nt, Human
ugaggaaaggaaauugagc

SEQ ID NO: 510149 - RNA, 23 nt, Human
uuugagcucauuuuucuuuuucu

SEQ ID NO: 510150 - RNA, 19 nt, Human
auugguggggggugggagg

SEQ ID NO: 510151 - RNA, 21 nt, Human
cacucugaggacaggggugag

SEQ ID NO: 510152 - RNA, 22 nt, Human
cagugcuuuaucuguaugugac

SEQ ID NO: 510153 - RNA, 22 nt, Human
ggaaauagugaaaauuuuagac

SEQ ID NO: 510154 - RNA, 19 nt, Human
ggggggugggagggucacu

SEQ ID NO: 510155 - RNA, 23 nt, Human
ggggggugggagggucacugugg

SEQ ID NO: 510156 - RNA, 22 nt, Human
ggugagugauagccgagaggaa

SEQ ID NO: 510157 - RNA, 20 nt, Human
uacacagcuguuucuauuaa

SEQ ID NO: 510158 - RNA, 25 nt, Human
ucaagaagagcacugaagaguuuau

SEQ ID NO: 510159 - RNA, 21 nt, Human
uccuugggaagcaggaggugg

SEQ ID NO: 510160 - RNA, 19 nt, Human
ugggagggucacuguggug

SEQ ID NO: 510161 - RNA, 19 nt, Human
uggggggugggagggucac

SEQ ID NO: 510162 - RNA, 19 nt, Human
ugguggggggugggagggu

SEQ ID NO: 510163 - RNA, 20 nt, Human
uugguggggggugggagggu

SEQ ID NO: 510164 - RNA, 25 nt, Human
aaaaacuggaaagccugcuagacaa

SEQ ID NO: 510165 - RNA, 21 nt, Human
aaaggcaucaucaaaguucca

SEQ ID NO: 510166 - RNA, 24 nt, Human
aacagugcuguccuuugccuuggc

SEQ ID NO: 510167 - RNA, 21 nt, Human
aagaauccacguggccuccca

SEQ ID NO: 510168 - RNA, 24 nt, Human
accuggacuggggcccccuguggc

SEQ ID NO: 510169 - RNA, 20 nt, Human
agaacccagaguggagcccc

SEQ ID NO: 510170 - RNA, 23 nt, Human
agagaaagaaacugagacccaaa

SEQ ID NO: 510171 - RNA, 21 nt, Human
agaguggagccccgggcugcu

SEQ ID NO: 510172 - RNA, 22 nt, Human
agaguggagccccgggcugcug

SEQ ID NO: 510173 - RNA, 18 nt, Human
agcugauagggagguccu

SEQ ID NO: 510174 - RNA, 21 nt, Human
agcugcaaggcugagaagagg

SEQ ID NO: 510175 - RNA, 22 nt, Human
aggcaaaugguuccaugucccu

SEQ ID NO: 510176 - RNA, 18 nt, Human
aggcagggagggugaggg

SEQ ID NO: 510177 - RNA, 24 nt, Human
aggcagggagggugagggugaggg

SEQ ID NO: 510178 - RNA, 18 nt, Human
aggccaccuggacugggg

SEQ ID NO: 510179 - RNA, 24 nt, Human
aggggucuugccagcuccagaugg

SEQ ID NO: 510180 - RNA, 25 nt, Human
agguggggugggaggagccgcagag

SEQ ID NO: 510181 - RNA, 25 nt, Human
auaaacuuccuuccacuuuacucug

SEQ ID NO: 510182 - RNA, 21 nt, Human
auggcaacuuguuugcagaga

SEQ ID NO: 510183 - RNA, 19 nt, Human
auguucccagguggugagg

SEQ ID NO: 510184 - RNA, 22 nt, Human
caaagaagggucagccaaagcc

SEQ ID NO: 510185 - RNA, 21 nt, Human
caagaauccacguggccuccc

SEQ ID NO: 510186 - RNA, 20 nt, Human
caagggucaagggcuggugu

SEQ ID NO: 510187 - RNA, 25 nt, Human
caccuggacuggggcccccuguggc

SEQ ID NO: 510188 - RNA, 19 nt, Human
cagagaaagaaacugagac

SEQ ID NO: 510189 - RNA, 24 nt, Human
cagagaaagaaacugagacccaaa

SEQ ID NO: 510190 - RNA, 23 nt, Human
ccaaagaagggucagccaaagcc

SEQ ID NO: 510191 - RNA, 23 nt, Human
ccagaguggagccccgggcugcu

SEQ ID NO: 510192 - RNA, 19 nt, Human
ccagggccaggcagggagg

SEQ ID NO: 510193 - RNA, 19 nt, Human
ccaggggagggaggagccc

SEQ ID NO: 510194 - RNA, 20 nt, Human
ccaggggagggaggagccca

SEQ ID NO: 510195 - RNA, 25 nt, Human
cccacgcugaaccccaaagguuuuc

SEQ ID NO: 510196 - RNA, 21 nt, Human
cccagggcaccuacagauaga

SEQ ID NO: 510197 - RNA, 23 nt, Human
cccagguuucuucagaccucucc

SEQ ID NO: 510198 - RNA, 25 nt, Human
cccggaguuaagagggugucugggg

SEQ ID NO: 510199 - RNA, 22 nt, Human
cccuccuauuccucuuugcgcc

SEQ ID NO: 510200 - RNA, 20 nt, Human
ccucccacgcugaaccccaa

SEQ ID NO: 510201 - RNA, 25 nt, Human
ccuccuauuccucuuugcgccugga

SEQ ID NO: 510202 - RNA, 26 nt, Human
ccuguacaaagccaagaauccacgug

SEQ ID NO: 510203 - RNA, 18 nt, Human
ccuugagcugcaaggcug

SEQ ID NO: 510204 - RNA, 24 nt, Human
cgcugaaccccaauuuuggggcuc

SEQ ID NO: 510205 - RNA, 21 nt, Human
cgggagauggggugugggcaa

SEQ ID NO: 510206 - RNA, 22 nt, Human
cuccugagaucaacccuugagc

SEQ ID NO: 510207 - RNA, 22 nt, Human
cugaauaaacuuccuuccacuu

SEQ ID NO: 510208 - RNA, 27 nt, Human
cugcuagacaaauucuaaaagagcugu

SEQ ID NO: 510209 - RNA, 28 nt, Human
cugcuagacaaauucuaaaagagcuguu

SEQ ID NO: 510210 - RNA, 19 nt, Human
cuuauucagcauucggaac

SEQ ID NO: 510211 - RNA, 21 nt, Human
cuucagaccucuccaggcccu

SEQ ID NO: 510212 - RNA, 18 nt, Human
cuucccucuccugggucc

SEQ ID NO: 510213 - RNA, 21 nt, Human
cuuccuguacaaagccaagaa

SEQ ID NO: 510214 - RNA, 19 nt, Human
gagaaagaaacugagaccc

SEQ ID NO: 510215 - RNA, 22 nt, Human
gagcugcaaggcugagaagagg

SEQ ID NO: 510216 - RNA, 22 nt, Human
gagggaggagcccagaggggcc

SEQ ID NO: 510217 - RNA, 25 nt, Human
gcagagaaagaaacugagacccaaa

SEQ ID NO: 510218 - RNA, 21 nt, Human
gccaggggagggaggagccca

SEQ ID NO: 510219 - RNA, 21 nt, Human
gccccgggcugcuggcuccca

SEQ ID NO: 510220 - RNA, 21 nt, Human
gccucccacgcugaaccccaa

SEQ ID NO: 510221 - RNA, 21 nt, Human
gcucuaggcuuggcugcugug

SEQ ID NO: 510222 - RNA, 23 nt, Human
gcuugcucuuguagaucuuccug

SEQ ID NO: 510223 - RNA, 21 nt, Human
ggagggaggagcccagagggg

SEQ ID NO: 510224 - RNA, 23 nt, Human
ggagggaggagcccagaggggcc

SEQ ID NO: 510225 - RNA, 26 nt, Human
ggagugguaggaaaagccaggggagg

SEQ ID NO: 510226 - RNA, 21 nt, Human
ggcaaaugguuccaugucccu

SEQ ID NO: 510227 - RNA, 22 nt, Human
gggagugguaggaaaagccagg

SEQ ID NO: 510228 - RNA, 22 nt, Human
ggggagggaggagcccagaggg

SEQ ID NO: 510229 - RNA, 23 nt, Human
ggggugugggcaacgcucacugu

SEQ ID NO: 510230 - RNA, 22 nt, Human
gggugugggcaacgcucacugu

SEQ ID NO: 510231 - RNA, 20 nt, Human
guacaaagccaagaauccac

SEQ ID NO: 510232 - RNA, 19 nt, Human
guuugcagagaaagaaacu

SEQ ID NO: 510233 - RNA, 25 nt, Human
ucaagggcugguguugaccuugugg

SEQ ID NO: 510234 - RNA, 23 nt, Human
ucccagguuucuucagaccucuc

SEQ ID NO: 510235 - RNA, 20 nt, Human
ucuccuggguccuggacucc

SEQ ID NO: 510236 - RNA, 22 nt, Human
ucuccuggguccuggacuccug

SEQ ID NO: 510237 - RNA, 23 nt, Human
ucugaauaaacuuccuuccacuu

SEQ ID NO: 510238 - RNA, 19 nt, Human
ucuucccucuccugggucc

SEQ ID NO: 510239 - RNA, 18 nt, Human
ugagacccaaagaagggu

SEQ ID NO: 510240 - RNA, 22 nt, Human
ugagaugcuguuaggccaccug

SEQ ID NO: 510241 - RNA, 21 nt, Human
ugaggguaucaggcaggcaga

SEQ ID NO: 510242 - RNA, 23 nt, Human
ugccagcuccagauggacauucc

SEQ ID NO: 510243 - RNA, 25 nt, Human
uggaagaagucagcugauagggagg

SEQ ID NO: 510244 - RNA, 20 nt, Human
uggaaggcaaaccagauggc

SEQ ID NO: 510245 - RNA, 23 nt, Human
uggcaucccuggcauggacacau

SEQ ID NO: 510246 - RNA, 27 nt, Human
uggccucccacgcugaaccccaauuuu

SEQ ID NO: 510247 - RNA, 24 nt, Human
uggcucccagguuucuucagaccu

SEQ ID NO: 510248 - RNA, 19 nt, Human
ugggaggagccgcagagca

SEQ ID NO: 510249 - RNA, 19 nt, Human
ugggaugggguccagggcc

SEQ ID NO: 510250 - RNA, 19 nt, Human
uggggcucacccugugaca

SEQ ID NO: 510251 - RNA, 24 nt, Human
uguacaaagccaagaauccacgug

SEQ ID NO: 510252 - RNA, 22 nt, Human
uguuaggccaccuggacugggg

SEQ ID NO: 510253 - RNA, 24 nt, Human
uuauucagcauucggaacccaguu

SEQ ID NO: 510254 - RNA, 20 nt, Human
uuccuguacaaagccaagaa

SEQ ID NO: 510255 - RNA, 24 nt, Human
uucugaauaaacuuccuuccacuu

SEQ ID NO: 510256 - RNA, 25 nt, Human
uuuuucuuuuuuguauuuuuuuaau

SEQ ID NO: 510257 - RNA, 24 nt, Human
aaagugcugggauuauaggcauga

SEQ ID NO: 510258 - RNA, 20 nt, Human
aaaguucccccgguacccaa

SEQ ID NO: 510259 - RNA, 20 nt, Human
aaaguucccccgguacccaa

SEQ ID NO: 510260 - RNA, 25 nt, Human
aagcaauucucccaccucagccucc

SEQ ID NO: 510261 - RNA, 25 nt, Human
aagcaauucucccaccucagccucc

SEQ ID NO: 510262 - RNA, 19 nt, Human
aagugcugggauuauaggc

SEQ ID NO: 510263 - RNA, 21 nt, Human
aagugcugggauuauaggcau

SEQ ID NO: 510264 - RNA, 18 nt, Human
acagggaaauauauuuuc

SEQ ID NO: 510265 - RNA, 19 nt, Human
acagggaaauauauuuuca

SEQ ID NO: 510266 - RNA, 24 nt, Human
accguguuggccaggcuggucucg

SEQ ID NO: 510267 - RNA, 21 nt, Human
acugcagccucugccuccgcc

SEQ ID NO: 510268 - RNA, 21 nt, Human
acugcagccucugccuccgcc

SEQ ID NO: 510269 - RNA, 19 nt, Human
agagaugggguuucaccgu

SEQ ID NO: 510270 - RNA, 23 nt, Human
agagguggcggcggcggcggcgg

SEQ ID NO: 510271 - RNA, 19 nt, Human
aggcaugagccaccgugcc

SEQ ID NO: 510272 - RNA, 20 nt, Human
aggcaugagccaccgugccu

SEQ ID NO: 510273 - RNA, 23 nt, Human
aggcaugagccaccgugccuggc

SEQ ID NO: 510274 - RNA, 24 nt, Human
aggugauccacccaccuuggccuc

SEQ ID NO: 510275 - RNA, 23 nt, Human
agguggcggcggcggcggcggcu

SEQ ID NO: 510276 - RNA, 20 nt, Human
aguagagaugggguuucacc

SEQ ID NO: 510277 - RNA, 20 nt, Human
agugcaguggcacaaucuug

SEQ ID NO: 510278 - RNA, 20 nt, Human
agugcaguggcacaaucuug

SEQ ID NO: 510279 - RNA, 18 nt, Human
augggguuucaccguguu

SEQ ID NO: 510280 - RNA, 23 nt, Human
augggguuucaccguguuggcca

SEQ ID NO: 510281 - RNA, 24 nt, Human
augggguuucaccguguuggccag

SEQ ID NO: 510282 - RNA, 24 nt, Human
auuuuugcauuuuuaguagagaug

SEQ ID NO: 510283 - RNA, 28 nt, Human
auuuuuuauauauauuuauuuauuuuug

SEQ ID NO: 510284 - RNA, 24 nt, Human
caaagugcugggauuauaggcaug

SEQ ID NO: 510285 - RNA, 27 nt, Human
caagcaauucucccaccucagccuccc

SEQ ID NO: 510286 - RNA, 27 nt, Human
caagcaauucucccaccucagccuccc

SEQ ID NO: 510287 - RNA, 22 nt, Human
cacccaccuuggccucccaaag

SEQ ID NO: 510288 - RNA, 23 nt, Human
cacccaccuuggccucccaaagu

SEQ ID NO: 510289 - RNA, 21 nt, Human
caccguguuggccaggcuggu

SEQ ID NO: 510290 - RNA, 24 nt, Human
caccguguuggccaggcuggucuc

SEQ ID NO: 510291 - RNA, 24 nt, Human
caccucagccucccauguagcugg

SEQ ID NO: 510292 - RNA, 24 nt, Human
caccucagccucccauguagcugg

SEQ ID NO: 510293 - RNA, 30 nt, Human
cacugcagccucugccuccgccuccugggg

SEQ ID NO: 510294 - RNA, 30 nt, Human; identical to SEQ ID NO: 510293

SEQ ID NO: 510295 - RNA, 24 nt, Human
ccaaagugcugggauuauaggcau

SEQ ID NO: 510296 - RNA, 23 nt, Human
ccauguagcugggauuacaggca

SEQ ID NO: 510297 - RNA, 23 nt, Human
ccauguagcugggauuacaggca

SEQ ID NO: 510298 - RNA, 24 nt, Human
ccauguagcugggauuacaggcau

SEQ ID NO: 510299 - RNA, 24 nt, Human
ccauguagcugggauuacaggcau

SEQ ID NO: 510300 - RNA, 23 nt, Human
cccaccucagccucccauguagc

SEQ ID NO: 510301 - RNA, 23 nt, Human
cccaccucagccucccauguagc

SEQ ID NO: 510302 - RNA, 19 nt, Human
cccauguagcugggauuac

SEQ ID NO: 510303 - RNA, 19 nt, Human
cccauguagcugggauuac

SEQ ID NO: 510304 - RNA, 20 nt, Human
ccgccacgcccggcuaauuu

SEQ ID NO: 510305 - RNA, 20 nt, Human
ccgccacgcccggcuaauuu

SEQ ID NO: 510306 - RNA, 26 nt, Human
ccgccuccuggguucaagcaauucuu

SEQ ID NO: 510307 - RNA, 27 nt, Human
ccgccuccuggguucaagcaauucuuu

SEQ ID NO: 510308 - RNA, 18 nt, Human
ccucaaugacgauaauac

SEQ ID NO: 510309 - RNA, 19 nt, Human
ccuccgccuccuggguuca

SEQ ID NO: 510310 - RNA, 19 nt, Human
ccuccgccuccuggguuca

SEQ ID NO: 510311 - RNA, 24 nt, Human
ccuccuggguucaagcaauucucc

SEQ ID NO: 510312 - RNA, 24 nt, Human
ccuccuggguucaagcaauucucc

SEQ ID NO: 510313 - RNA, 24 nt, Human
ccugaccucaggugauccacccac

SEQ ID NO: 510314 - RNA, 20 nt, Human
cgaaauagcuuuuuagaagc

SEQ ID NO: 510315 - RNA, 20 nt, Human
cggcggcggcggcggcuccc

SEQ ID NO: 510316 - RNA, 24 nt, Human
cgguacccaaguuaccauauuaua

SEQ ID NO: 510317 - RNA, 24 nt, Human
cgguacccaaguuaccauauuaua

SEQ ID NO: 510318 - RNA, 22 nt, Human
cucagagguggcggcggcggcg

SEQ ID NO: 510319 - RNA, 24 nt, Human
cucagccucccauguagcugggau

SEQ ID NO: 510320 - RNA, 24 nt, Human
cucagccucccauguagcugggau

SEQ ID NO: 510321 - RNA, 24 nt, Human
cucaggugauccacccaccuuggc

SEQ ID NO: 510322 - RNA, 21 nt, Human
cuccuggguucaagcaauucu

SEQ ID NO: 510323 - RNA, 21 nt, Human
cuccuggguucaagcaauucu

SEQ ID NO: 510324 - RNA, 18 nt, Human
cucuguugcccagggugg

SEQ ID NO: 510325 - RNA, 18 nt, Human
cucuguugcccagggugg

SEQ ID NO: 510326 - RNA, 18 nt, Human
cugcagccucugccuccg

SEQ ID NO: 510327 - RNA, 18 nt, Human
cugcagccucugccuccg

SEQ ID NO: 510328 - RNA, 24 nt, Human
cugcagccucugccuccgccuccu

SEQ ID NO: 510329 - RNA, 24 nt, Human
cugcagccucugccuccgccuccu

SEQ ID NO: 510330 - RNA, 20 nt, Human
cugcucagagguggcggcgg

SEQ ID NO: 510331 - RNA, 24 nt, Human
gaccucaggugauccacccaccuu

SEQ ID NO: 510332 - RNA, 24 nt, Human
gagaugggguuucaccguguuggc

SEQ ID NO: 510333 - RNA, 26 nt, Human
gagcaguacagagucaggcugacugu

SEQ ID NO: 510334 - RNA, 18 nt, Human
gagcaucacuggucucaa

SEQ ID NO: 510335 - RNA, 21 nt, Human
gauuauaggcaugagccaccg

SEQ ID NO: 510336 - RNA, 24 nt, Human
gauuauaggcaugagccaccgugc

SEQ ID NO: 510337 - RNA, 21 nt, Human
gcggcggcggcggcggcuccc

SEQ ID NO: 510338 - RNA, 25 nt, Human
gcggcggcggcggcggcuccccggc

SEQ ID NO: 510339 - RNA, 18 nt, Human
gcucagagguggcggcgg

SEQ ID NO: 510340 - RNA, 23 nt, Human
gcuggucucgaacuccugaccuc

SEQ ID NO: 510341 - RNA, 19 nt, Human
gcugguguggugucggccg

SEQ ID NO: 510342 - RNA, 19 nt, Human
ggauuacaggcaugugccg

SEQ ID NO: 510343 - RNA, 19 nt, Human
ggauuacaggcaugugccg

SEQ ID NO: 510344 - RNA, 20 nt, Human
ggcggcggcggcggcucccc

SEQ ID NO: 510345 - RNA, 18 nt, Human
ggcuccccggcuggugug

SEQ ID NO: 510346 - RNA, 24 nt, Human
ggcuggucucgaacuccugaccuc

SEQ ID NO: 510347 - RNA, 22 nt, Human
gggguuucaccguguuggccag

SEQ ID NO: 510348 - RNA, 22 nt, Human
gggucuugcucuguugcccagg

SEQ ID NO: 510349 - RNA, 22 nt, Human
gggucuugcucuguugcccagg

SEQ ID NO: 510350 - RNA, 19 nt, Human
ggucucgaacuccugaccu

SEQ ID NO: 510351 - RNA, 23 nt, Human
gguggagugcaguggcacaaucu

SEQ ID NO: 510352 - RNA, 23 nt, Human
gguggagugcaguggcacaaucu

SEQ ID NO: 510353 - RNA, 18 nt, Human
guagcugggauuacaggc

SEQ ID NO: 510354 - RNA, 22 nt, Human
guagcugggauuacaggcaugu

SEQ ID NO: 510355 - RNA, 22 nt, Human
guagcugggauuacaggcaugu

SEQ ID NO: 510356 - RNA, 24 nt, Human
gugauccacccaccuuggccuccc

SEQ ID NO: 510357 - RNA, 25 nt, Human
guggcggcggcggcggcggcucccc

SEQ ID NO: 510358 - RNA, 18 nt, Human
uaaaaugacagacaugag

SEQ ID NO: 510359 - RNA, 19 nt, Human
uaaaaugacagacaugagu

SEQ ID NO: 510360 - RNA, 24 nt, Human
uaaaaugacagacaugagugaaac

SEQ ID NO: 510361 - RNA, 22 nt, Human
uaaaugauaugcuuauaaaaug

SEQ ID NO: 510362 - RNA, 24 nt, Human
uaauuuuugcauuuuuaguagaga

SEQ ID NO: 510363 - RNA, 23 nt, Human
uacaggcaugugccgccacgccc

SEQ ID NO: 510364 - RNA, 23 nt, Human
uacaggcaugugccgccacgccc

SEQ ID NO: 510365 - RNA, 21 nt, Human
uagcuuuuuagaagcuuuuua

SEQ ID NO: 510366 - RNA, 21 nt, Human
uaguagagaugggguuucacc

SEQ ID NO: 510367 - RNA, 24 nt, Human
uaguagagaugggguuucaccgug

SEQ ID NO: 510368 - RNA, 25 nt, Human
uaguagagaugggguuucaccgugu

SEQ ID NO: 510369 - RNA, 18 nt, Human
uauaguauaaagauagug

SEQ ID NO: 510370 - RNA, 18 nt, Human
uauaguauaaagauagug

SEQ ID NO: 510371 - RNA, 24 nt, Human
uauaguauaaagauagugaaauac

SEQ ID NO: 510372 - RNA, 24 nt, Human
uauaguauaaagauagugaaauac

SEQ ID NO: 510373 - RNA, 20 nt, Human
uauauauuuauuuauuuuug

SEQ ID NO: 510374 - RNA, 23 nt, Human
uauuuauuuuugagauggggucu

SEQ ID NO: 510375 - RNA, 29 nt, Human
ucaaugacgauaauacacaagucacaagg

SEQ ID NO: 510376 - RNA, 27 nt, Human
ucacaaguuuccugugagugaaacuga

SEQ ID NO: 510377 - RNA, 24 nt, Human
ucaccgagcucuuacucugaaauu

SEQ ID NO: 510378 - RNA, 24 nt, Human
ucaccguguuggccaggcuggucu

SEQ ID NO: 510379 - RNA, 19 nt, Human
ucacugcagccucugccuc

SEQ ID NO: 510380 - RNA, 19 nt, Human
ucacugcagccucugccuc

SEQ ID NO: 510381 - RNA, 19 nt, Human
ucacugcagccucugccuc

SEQ ID NO: 510382 - RNA, 20 nt, Human
ucacugcagccucugccucc

SEQ ID NO: 510383 - RNA, 20 nt, Human
ucacugcagccucugccucc

SEQ ID NO: 510384 - RNA, 21 nt, Human
ucacugcagccucugccuccg

SEQ ID NO: 510385 - RNA, 31 nt, Human
ucacugcagccucugccuccgccuccugggg

SEQ ID NO: 510386 - RNA, 31 nt, Human; identical to SEQ ID NO: 510385

SEQ ID NO: 510387 - RNA, 22 nt, Human
ucagagguggcggcggcggcuu

SEQ ID NO: 510388 - RNA, 24 nt, Human
ucccaaagugcugggauuauaggc

SEQ ID NO: 510389 - RNA, 24 nt, Human
ucccauguagcugggauuacaggc

SEQ ID NO: 510390 - RNA, 24 nt, Human
ucccauguagcugggauuacaggc

SEQ ID NO: 510391 - RNA, 24 nt, Human
uccgccuccuggguucaagcaauu

SEQ ID NO: 510392 - RNA, 24 nt, Human
uccgccuccuggguucaagcaauu

SEQ ID NO: 510393 - RNA, 21 nt, Human
uccuggguucaagcaauucuc

SEQ ID NO: 510394 - RNA, 21 nt, Human
uccuggguucaagcaauucuc

SEQ ID NO: 510395 - RNA, 23 nt, Human
uccuggguucaagcaauucuccc

SEQ ID NO: 510396 - RNA, 23 nt, Human
uccuggguucaagcaauucuccc

SEQ ID NO: 510397 - RNA, 20 nt, Human
ucuaaaguuuuggagaagaa

SEQ ID NO: 510398 - RNA, 26 nt, Human
ucucccaccucagccucccauguagc

SEQ ID NO: 510399 - RNA, 26 nt, Human
ucucccaccucagccucccauguagc

SEQ ID NO: 510400 - RNA, 23 nt, Human
ucucgaacuccugaccucaggug

SEQ ID NO: 510401 - RNA, 24 nt, Human
ucuguugcccaggguggagugcag

SEQ ID NO: 510402 - RNA, 24 nt, Human
ucuguugcccaggguggagugcag

SEQ ID NO: 510403 - RNA, 22 nt, Human
ucuugcucuguugcccagggug

SEQ ID NO: 510404 - RNA, 23 nt, Human
ucuugcucuguugcccagggugg

SEQ ID NO: 510405 - RNA, 23 nt, Human
ucuugcucuguugcccagggugg

SEQ ID NO: 510406 - RNA, 24 nt, Human
ucuugcucuguugcccagggugga

SEQ ID NO: 510407 - RNA, 24 nt, Human
ucuugcucuguugcccagggugga

SEQ ID NO: 510408 - RNA, 25 nt, Human
ugaaugguggaaauucaguaaguac

SEQ ID NO: 510409 - RNA, 25 nt, Human
ugaaugguggaaauucaguaaguac

SEQ ID NO: 510410 - RNA, 21 nt, Human
ugaccucaggugauccaccca

SEQ ID NO: 510411 - RNA, 24 nt, Human
ugaccucaggugauccacccaccu

SEQ ID NO: 510412 - RNA, 28 nt, Human
ugacgauaauacacaagucacaaguuuc

SEQ ID NO: 510413 - RNA, 22 nt, Human
ugagauggggucuugcucuguu

SEQ ID NO: 510414 - RNA, 22 nt, Human
ugagauggggucuugcucuguu

SEQ ID NO: 510415 - RNA, 24 nt, Human
ugauccacccaccuuggccuccca

SEQ ID NO: 510416 - RNA, 19 nt, Human
ugccuccgccuccuggguu

SEQ ID NO: 510417 - RNA, 19 nt, Human
ugccuccgccuccuggguu

SEQ ID NO: 510418 - RNA, 23 nt, Human
uggagugcaguggcacaaucuug

SEQ ID NO: 510419 - RNA, 23 nt, Human
uggagugcaguggcacaaucuug

SEQ ID NO: 510420 - RNA, 24 nt, Human
uggagugcaguggcacaaucuugg

SEQ ID NO: 510421 - RNA, 24 nt, Human
uggagugcaguggcacaaucuugg

SEQ ID NO: 510422 - RNA, 23 nt, Human
uggcacaaucuugggucacugca

SEQ ID NO: 510423 - RNA, 24 nt, Human
uggcacaaucuugggucacugcag

SEQ ID NO: 510424 - RNA, 24 nt, Human
uggccaggcuggucucgaacuccu

SEQ ID NO: 510425 - RNA, 18 nt, Human
uggcggcggcggcggcgg

SEQ ID NO: 510426 - RNA, 18 nt, Human
ugggauuacaggcaugug

SEQ ID NO: 510427 - RNA, 18 nt, Human
ugggauuacaggcaugug

SEQ ID NO: 510428 - RNA, 21 nt, Human
ugggauuacaggcaugugccg

SEQ ID NO: 510429 - RNA, 21 nt, Human
ugggauuacaggcaugugccg

SEQ ID NO: 510430 - RNA, 21 nt, Human
ugggauuacaggcaugugccg

SEQ ID NO: 510431 - RNA, 21 nt, Human
ugggauuacaggcaugugccg

SEQ ID NO: 510432 - RNA, 22 nt, Human
ugggauuacaggcaugugccgc

SEQ ID NO: 510433 - RNA, 22 nt, Human
ugggauuacaggcaugugccgc

SEQ ID NO: 510434 - RNA, 24 nt, Human
ugggauuacaggcaugugccgcca

SEQ ID NO: 510435 - RNA, 24 nt, Human
ugggauuacaggcaugugccgcca

SEQ ID NO: 510436 - RNA, 18 nt, Human
ugggauuauaggcaugag

SEQ ID NO: 510437 - RNA, 21 nt, Human
ugggauuauaggcaugagcca

SEQ ID NO: 510438 - RNA, 22 nt, Human
ugggauuauaggcaugagccac

SEQ ID NO: 510439 - RNA, 23 nt, Human
ugggauuauaggcaugagccacc

SEQ ID NO: 510440 - RNA, 23 nt, Human
ugggauuauaggcaugagccacc

SEQ ID NO: 510441 - RNA, 24 nt, Human
ugggauuauaggcaugagccaccg

SEQ ID NO: 510442 - RNA, 24 nt, Human
uggggucuugcucuguugcccagg

SEQ ID NO: 510443 - RNA, 24 nt, Human
uggggucuugcucuguugcccagg

SEQ ID NO: 510444 - RNA, 24 nt, Human
ugggguuucaccguguuggccagg

SEQ ID NO: 510445 - RNA, 21 nt, Human
uggguucaagcaauucuccca

SEQ ID NO: 510446 - RNA, 21 nt, Human
uggguucaagcaauucuccca

SEQ ID NO: 510447 - RNA, 19 nt, Human
uguagcugggauuacaggc

SEQ ID NO: 510448 - RNA, 19 nt, Human
uguagcugggauuacaggc

SEQ ID NO: 510449 - RNA, 24 nt, Human
uguagcugggauuacaggcaugug

SEQ ID NO: 510450 - RNA, 24 nt, Human
uguagcugggauuacaggcaugug

SEQ ID NO: 510451 - RNA, 18 nt, Human
uuaguagagaugggguuu

SEQ ID NO: 510452 - RNA, 22 nt, Human
uuaguagagaugggguuucacc

SEQ ID NO: 510453 - RNA, 24 nt, Human
uuaguagagaugggguuucaccgu

SEQ ID NO: 510454 - RNA, 24 nt, Human
uucaagcaauucucccaccucagc

SEQ ID NO: 510455 - RNA, 24 nt, Human
uucaagcaauucucccaccucagc

SEQ ID NO: 510456 - RNA, 20 nt, Human
uugaaugguggaaauucagu

SEQ ID NO: 510457 - RNA, 20 nt, Human
uugaaugguggaaauucagu

SEQ ID NO: 510458 - RNA, 21 nt, Human
uugagauggggucuugcucug

SEQ ID NO: 510459 - RNA, 21 nt, Human
uugagauggggucuugcucug

SEQ ID NO: 510460 - RNA, 18 nt, Human
uugcccaggguggagugc

SEQ ID NO: 510461 - RNA, 18 nt, Human
uugcccaggguggagugc

SEQ ID NO: 510462 - RNA, 18 nt, Human
uuggccucccaaagugcu

SEQ ID NO: 510463 - RNA, 23 nt, Human
uugggucacugcagccucugccu

SEQ ID NO: 510464 - RNA, 24 nt, Human
uuuauuuauuuuugagaugggguc

SEQ ID NO: 510465 - RNA, 24 nt, Human
uuuauuuauuuuugagaugggguc

SEQ ID NO: 510466 - RNA, 21 nt, Human
uuuauuuuugagauggggucu

SEQ ID NO: 510467 - RNA, 24 nt, Human
uuucaccguguuggccaggcuggu

SEQ ID NO: 510468 - RNA, 22 nt, Human
uuugagauggggucuugcucug

SEQ ID NO: 510469 - RNA, 22 nt, Human
uuugagauggggucuugcucug

SEQ ID NO: 510470 - RNA, 24 nt, Human
uuuuuaguagagaugggguuucac

SEQ ID NO: 510471 - RNA, 20 nt, Human
uuuuugcauuuuuaguagag

SEQ ID NO: 510472 - RNA, 24 nt, Human
uuuuuuuuuuuuuugaauggugga

SEQ ID NO: 510473 - RNA, 21 nt, Human
uuuuuuuuuuuuuuugaaugg

SEQ ID NO: 510474 - RNA, 21 nt, Human
uuuuuuuuuuuuuuugaaugg

SEQ ID NO: 510475 - RNA, 19 nt, Human
aaaaggcuucugcuccgag

SEQ ID NO: 510476 - RNA, 20 nt, Human
aaacaaaccccaccaucuuc

SEQ ID NO: 510477 - RNA, 23 nt, Human
aaacaaaccccaccaucuuccca

SEQ ID NO: 510478 - RNA, 24 nt, Human
aacaaaccccaccaucuucccaac

SEQ ID NO: 510479 - RNA, 20 nt, Human
accccaccaucuucccaaca

SEQ ID NO: 510480 - RNA, 24 nt, Human
acucgcacccccagccccgcgcac

SEQ ID NO: 510481 - RNA, 21 nt, Human
agccccugacccacuccgcag

SEQ ID NO: 510482 - RNA, 24 nt, Human
agccccugacccacuccgcagucu

SEQ ID NO: 510483 - RNA, 23 nt, Human
aguaaacagggcagucacuuucc

SEQ ID NO: 510484 - RNA, 21 nt, Human
caagcuggcaaacaaacccca

SEQ ID NO: 510485 - RNA, 24 nt, Human
caggaagagacuucagggguggua

SEQ ID NO: 510486 - RNA, 25 nt, Human
cagugaagcuucucucucaaagcuc

SEQ ID NO: 510487 - RNA, 23 nt, Human
ccaccaucuucccaacagccaca

SEQ ID NO: 510488 - RNA, 23 nt, Human
ccccaccaucuucccaacagcca

SEQ ID NO: 510489 - RNA, 20 nt, Human
cccccagccccgcgcaccca

SEQ ID NO: 510490 - RNA, 25 nt, Human
cgcacccccagccccgcgcacccag

SEQ ID NO: 510491 - RNA, 19 nt, Human
cuagcagcaccagccucuu

SEQ ID NO: 510492 - RNA, 23 nt, Human
cuccaagcuggcaaacaaacccc

SEQ ID NO: 510493 - RNA, 19 nt, Human
cucgcagccccugacccac

SEQ ID NO: 510494 - RNA, 20 nt, Human
cucgcagccccugacccacu

SEQ ID NO: 510495 - RNA, 21 nt, Human
gaagagcuuggucguggauaa

SEQ ID NO: 510496 - RNA, 20 nt, Human
gagccccaguuuuuccucag

SEQ ID NO: 510497 - RNA, 19 nt, Human
gaggugcagacuaagcgag

SEQ ID NO: 510498 - RNA, 20 nt, Human
gcacuuccuuuuccuaauuu

SEQ ID NO: 510499 - RNA, 20 nt, Human
ggaagguuugcuccguuuca

SEQ ID NO: 510500 - RNA, 20 nt, Human
gguaggacuuggggcagccc

SEQ ID NO: 510501 - RNA, 24 nt, Human
gugcagacuaagcgagcuccgcag

SEQ ID NO: 510502 - RNA, 24 nt, Human
uagaaugaggccccggaggucgcc

SEQ ID NO: 510503 - RNA, 19 nt, Human
ucagaagauuuuguuccug

SEQ ID NO: 510504 - RNA, 21 nt, Human
uccgcagguggaagagcuugg

SEQ ID NO: 510505 - RNA, 18 nt, Human
ucgcagccccugacccac

SEQ ID NO: 510506 - RNA, 18 nt, Human
ugcagacuaagcgagcuc

SEQ ID NO: 510507 - RNA, 30 nt, Human
ugcuccguuucagugaagcuucucucucaa

SEQ ID NO: 510508 - RNA, 26 nt, Human
uggcaaacaaaccccaccaucuuccc

SEQ ID NO: 510509 - RNA, 20 nt, Human
aaauccaaagcaauuaaaaa

SEQ ID NO: 510510 - RNA, 19 nt, Human
aaccuggagcugaggaggu

SEQ ID NO: 510511 - RNA, 21 nt, Human
aagaacauugcugaugucccc

SEQ ID NO: 510512 - RNA, 23 nt, Human
aagacagaaaacauuuaacaaau

SEQ ID NO: 510513 - RNA, 23 nt, Human
acaaaaaaagagaauaaccuaga

SEQ ID NO: 510514 - RNA, 23 nt, Human
acacuuaacagaagacagaaaac

SEQ ID NO: 510515 - RNA, 19 nt, Human
acagaacaugggcuuugag

SEQ ID NO: 510516 - RNA, 22 nt, Human
acagcucacagagaaggaggug

SEQ ID NO: 510517 - RNA, 24 nt, Human
accaccauggaggagacgagagga

SEQ ID NO: 510518 - RNA, 19 nt, Human
acccaugagaaacugagga

SEQ ID NO: 510519 - RNA, 22 nt, Human
acccccacuacccucacacccc

SEQ ID NO: 510520 - RNA, 19 nt, Human
acuccauguguucucuugg

SEQ ID NO: 510521 - RNA, 25 nt, Human
agacagaaaacauuuaacaaaucca

SEQ ID NO: 510522 - RNA, 24 nt, Human
agacccagcaugcucucuacagaa

SEQ ID NO: 510523 - RNA, 18 nt, Human
agacugacagcucacaga

SEQ ID NO: 510524 - RNA, 24 nt, Human
agagaaaacacacuuaacagaaga

SEQ ID NO: 510525 - RNA, 20 nt, Human
agagaccugccaggggcagu

SEQ ID NO: 510526 - RNA, 19 nt, Human
agaugcccuggccugggcc

SEQ ID NO: 510527 - RNA, 18 nt, Human
agccacaaaaaaagagaa

SEQ ID NO: 510528 - RNA, 22 nt, Human
agccccugggaagcuugggggc

SEQ ID NO: 510529 - RNA, 23 nt, Human
aggaagccccugggaagcuuggg

SEQ ID NO: 510530 - RNA, 26 nt, Human
aggaagccccugggaagcuugggggc

SEQ ID NO: 510531 - RNA, 19 nt, Human
aggguccuucagacuccag

SEQ ID NO: 510532 - RNA, 20 nt, Human
aguggugccaggugacaguc

SEQ ID NO: 510533 - RNA, 25 nt, Human
augguagcuacucagccagugggcc

SEQ ID NO: 510534 - RNA, 19 nt, Human
cacaccccuaccaccaguu

SEQ ID NO: 510535 - RNA, 19 nt, Human
cacccccacuacccucaca

SEQ ID NO: 510536 - RNA, 23 nt, Human
cacccccacuacccucacacccc

SEQ ID NO: 510537 - RNA, 19 nt, Human
caccccuaccaccaguuuc

SEQ ID NO: 510538 - RNA, 18 nt, Human
cacugagucucacagucc

SEQ ID NO: 510539 - RNA, 19 nt, Human
cacugagugguacagauuc

SEQ ID NO: 510540 - RNA, 24 nt, Human
cagaagacagaaaacauuuaacaa

SEQ ID NO: 510541 - RNA, 18 nt, Human
cagagaccugccaggggc

SEQ ID NO: 510542 - RNA, 20 nt, Human
cagugggcuccuauaugcgg

SEQ ID NO: 510543 - RNA, 21 nt, Human
ccaaugccaccacaggacgua

SEQ ID NO: 510544 - RNA, 24 nt, Human
ccacagcugggacccugaccaugc

SEQ ID NO: 510545 - RNA, 20 nt, Human
ccagcagagugccccagugg

SEQ ID NO: 510546 - RNA, 20 nt, Human
ccccagcucaaucuuccucc

SEQ ID NO: 510547 - RNA, 23 nt, Human
cccccacuacccucacaccccua

SEQ ID NO: 510548 - RNA, 22 nt, Human
cccgaggccuuguucugaaaca

SEQ ID NO: 510549 - RNA, 22 nt, Human
cccuaccaccaguuuccccacc

SEQ ID NO: 510550 - RNA, 22 nt, Human
cccugcucucacccacagcugg

SEQ ID NO: 510551 - RNA, 23 nt, Human
ccuauaugcgguacacgucagaa

SEQ ID NO: 510552 - RNA, 22 nt, Human
ccuccucuccucucucuguccc

SEQ ID NO: 510553 - RNA, 25 nt, Human
ccucugaucagucccagccugauuc

SEQ ID NO: 510554 - RNA, 22 nt, Human
ccugccaggggcagugaccacc

SEQ ID NO: 510555 - RNA, 28 nt, Human
ccuggccugggccuuaggacaucuugac

SEQ ID NO: 510556 - RNA, 21 nt, Human
ccuguguggaagugguguagg

SEQ ID NO: 510557 - RNA, 20 nt, Human
cucaaucuuccuccucuccu

SEQ ID NO: 510558 - RNA, 22 nt, Human
cucaaucuuccuccucuccucu

SEQ ID NO: 510559 - RNA, 20 nt, Human
cucugaucagucccagccuc

SEQ ID NO: 510560 - RNA, 23 nt, Human
cugacacccccacuacccucaca

SEQ ID NO: 510561 - RNA, 18 nt, Human
cugaucagucccagccug

SEQ ID NO: 510562 - RNA, 21 nt, Human
gaaacaccugggggcugacac

SEQ ID NO: 510563 - RNA, 24 nt, Human
gaaggguggaggguccggcagggg

SEQ ID NO: 510564 - RNA, 19 nt, Human
gacagcuggacagugcccu

SEQ ID NO: 510565 - RNA, 18 nt, Human
gaggcagacuugggagug

SEQ ID NO: 510566 - RNA, 21 nt, Human
gaggccuuguucugaaacacc

SEQ ID NO: 510567 - RNA, 21 nt, Human
gccacaaaaaaagagaauaac

SEQ ID NO: 510568 - RNA, 19 nt, Human
gccccugggaagcuugggg

SEQ ID NO: 510569 - RNA, 20 nt, Human
gcugacacccccacuacccu

SEQ ID NO: 510570 - RNA, 22 nt, Human
ggaacucucccaaugccaccac

SEQ ID NO: 510571 - RNA, 25 nt, Human
ggagguggcagagaccugccaggaa

SEQ ID NO: 510572 - RNA, 22 nt, Human
ggccuuguucugaaacaccugg

SEQ ID NO: 510573 - RNA, 20 nt, Human
gguggggaugguagcacuga

SEQ ID NO: 510574 - RNA, 18 nt, Human
guggaagugguguagggg

SEQ ID NO: 510575 - RNA, 27 nt, Human
uaacagaagacagaaaacauuuaacaa

SEQ ID NO: 510576 - RNA, 20 nt, Human
uaaccuagacugacagcuca

SEQ ID NO: 510577 - RNA, 20 nt, Human
uagcaggcucuucccugagc

SEQ ID NO: 510578 - RNA, 23 nt, Human
uagccacaaaaaaagagaauaac

SEQ ID NO: 510579 - RNA, 20 nt, Human
uagccagcagagugccccag

SEQ ID NO: 510580 - RNA, 23 nt, Human
uaucccuauauuacccaugagaa

SEQ ID NO: 510581 - RNA, 26 nt, Human
ucacaccccuaccaccaguuucccca

SEQ ID NO: 510582 - RNA, 23 nt, Human
ucacaugcgcaauucccagcccu

SEQ ID NO: 510583 - RNA, 19 nt, Human
uccauguguucucuugggc

SEQ ID NO: 510584 - RNA, 22 nt, Human
ucccagccugauucccguuccc

SEQ ID NO: 510585 - RNA, 20 nt, Human
uccccaguggacagcuggac

SEQ ID NO: 510586 - RNA, 23 nt, Human
uccuccucuccucucucuguccc

SEQ ID NO: 510587 - RNA, 19 nt, Human
ucuacagaagccuuuacug

SEQ ID NO: 510588 - RNA, 20 nt, Human
ucucucugucccuucaccua

SEQ ID NO: 510589 - RNA, 19 nt, Human
ucucugucccuucaccucu

SEQ ID NO: 510590 - RNA, 21 nt, Human
ucucugucccuucaccucuga

SEQ ID NO: 510591 - RNA, 21 nt, Human
ucucuugggccucacagaaca

SEQ ID NO: 510592 - RNA, 21 nt, Human
ucugaaacaccugggggcuga

SEQ ID NO: 510593 - RNA, 19 nt, Human
ucuggggguggcaggagaa

SEQ ID NO: 510594 - RNA, 20 nt, Human
ucuuccuccucuccucucuc

SEQ ID NO: 510595 - RNA, 22 nt, Human
ugaaacaccugggggcugacac

SEQ ID NO: 510596 - RNA, 24 nt, Human
ugaagaacauugcugaugucccca

SEQ ID NO: 510597 - RNA, 19 nt, Human
ugaccaugccaugaggccc

SEQ ID NO: 510598 - RNA, 22 nt, Human
ugagggugggagccaagaggca

SEQ ID NO: 510599 - RNA, 23 nt, Human
ugauucccguucccugaugccuc

SEQ ID NO: 510600 - RNA, 18 nt, Human
ugcagaaaagcauuuccc

SEQ ID NO: 510601 - RNA, 25 nt, Human
ugcagaaaagcauuucccuuucaga

SEQ ID NO: 510602 - RNA, 18 nt, Human
ugccagaugccucuagga

SEQ ID NO: 510603 - RNA, 20 nt, Human
ugccaggggcagugaccacc

SEQ ID NO: 510604 - RNA, 23 nt, Human
ugccaugaggccccuguguggaa

SEQ ID NO: 510605 - RNA, 19 nt, Human
uggagcugaggaggucugg

SEQ ID NO: 510606 - RNA, 21 nt, Human
uggagcugaggaggucugggg

SEQ ID NO: 510607 - RNA, 18 nt, Human
uggaugagcagggacagu

SEQ ID NO: 510608 - RNA, 21 nt, Human
uggcagagaccugccagguga

SEQ ID NO: 510609 - RNA, 22 nt, Human
uggcaggagaauggaugagcag

SEQ ID NO: 510610 - RNA, 22 nt, Human
uggcgagaggagguggcaaccu

SEQ ID NO: 510611 - RNA, 24 nt, Human
ugggagccaagaggcagacuuggg

SEQ ID NO: 510612 - RNA, 20 nt, Human
ugggagugcccgaggccuug

SEQ ID NO: 510613 - RNA, 20 nt, Human
uggugccaggugacaguccc

SEQ ID NO: 510614 - RNA, 21 nt, Human
ugucuacagugcucauaaaug

SEQ ID NO: 510615 - RNA, 20 nt, Human
uguguggaagugguguaggg

SEQ ID NO: 510616 - RNA, 18 nt, Human
uuggcuguugccccagcu

SEQ ID NO: 510617 - RNA, 24 nt, Human
uuguucugaaacaccugggggcug

SEQ ID NO: 510618 - RNA, 18 nt, Human
uuuuccuuuuaauauggu

SEQ ID NO: 510619 - RNA, 20 nt, Human
uuuuuccuuuuaauaugguu

SEQ ID NO: 510620 - RNA, 24 nt, Human
aaauggccuccacacccaaaaaac

SEQ ID NO: 510621 - RNA, 22 nt, Human
acacccaaaaaacaaaaaaaaa

SEQ ID NO: 510622 - RNA, 21 nt, Human
caagcaaacaguuuauugaga

SEQ ID NO: 510623 - RNA, 18 nt, Human
caucaagcaaacaguuua

SEQ ID NO: 510624 - RNA, 23 nt, Human
ccacacccaaaaaacaaaaaaaa

SEQ ID NO: 510625 - RNA, 24 nt, Human
ccacacccaaaaaacaaaaaaaaa

SEQ ID NO: 510626 - RNA, 22 nt, Human
ccuccacacccaaaaaacaaaa

SEQ ID NO: 510627 - RNA, 22 nt, Human
cucuaaaaauggccuccacacc

SEQ ID NO: 510628 - RNA, 18 nt, Human
gccuccacacccaaaaaa

SEQ ID NO: 510629 - RNA, 24 nt, Human
uccacacccaaaaaacaaaaaaaa

SEQ ID NO: 510630 - RNA, 20 nt, Human
aagaccaaccagaugcagga

SEQ ID NO: 510631 - RNA, 20 nt, Human
aagcacccaccuccaugccc

SEQ ID NO: 510632 - RNA, 20 nt, Human
aagcacccaccuccaugccc

SEQ ID NO: 510633 - RNA, 21 nt, Human
acccugaccuucaggccccgg

SEQ ID NO: 510634 - RNA, 20 nt, Human
accucagccuccugaguagc

SEQ ID NO: 510635 - RNA, 23 nt, Human
accucagccuccugaguagcugg

SEQ ID NO: 510636 - RNA, 23 nt, Human
accucagccuccugaguagcugg

SEQ ID NO: 510637 - RNA, 19 nt, Human
acugcagccucagccuccu

SEQ ID NO: 510638 - RNA, 19 nt, Human
acugcagccucagccuccu

SEQ ID NO: 510639 - RNA, 21 nt, Human
agcuggaacuacaagcaccca

SEQ ID NO: 510640 - RNA, 21 nt, Human
agcuggaacuacaagcaccca

SEQ ID NO: 510641 - RNA, 18 nt, Human
aggugcucaauaaagacc

SEQ ID NO: 510642 - RNA, 28 nt, Human
caacuccugagauccaaugauccucccu

SEQ ID NO: 510643 - RNA, 20 nt, Human
caagcacccaccuccaugcc

SEQ ID NO: 510644 - RNA, 26 nt, Human
caaugauccucccaccucggccuccc

SEQ ID NO: 510645 - RNA, 19 nt, Human
cagccuccugaguagcugg

SEQ ID NO: 510646 - RNA, 19 nt, Human
cagccuccugaguagcugg

SEQ ID NO: 510647 - RNA, 19 nt, Human
caguggugcaaucacaacu

SEQ ID NO: 510648 - RNA, 19 nt, Human
caguggugcaaucacaacu

SEQ ID NO: 510649 - RNA, 22 nt, Human
caugcugaucucgaacuccuga

SEQ ID NO: 510650 - RNA, 23 nt, Human
ccaccucagccuccugaguagcu

SEQ ID NO: 510651 - RNA, 20 nt, Human
ccaugcccgccaauugccca

SEQ ID NO: 510652 - RNA, 20 nt, Human
ccaugcccgccaauugccca

SEQ ID NO: 510653 - RNA, 23 nt, Human
cccaccucagccuccugaguagc

SEQ ID NO: 510654 - RNA, 24 nt, Human
cccaccucagccuccugaguagcu

SEQ ID NO: 510655 - RNA, 21 nt, Human
cccugaccuucaggccccggc

SEQ ID NO: 510656 - RNA, 26 nt, Human
ccucccaccucggccuccccuucugc

SEQ ID NO: 510657 - RNA, 22 nt, Human
cgccgcgcaggcggccgcuccu

SEQ ID NO: 510658 - RNA, 25 nt, Human
gaguagcuggaacuacaagcaccca

SEQ ID NO: 510659 - RNA, 25 nt, Human
gaguagcuggaacuacaagcaccca

SEQ ID NO: 510660 - RNA, 18 nt, Human
gcgcaggcggccgcuccu

SEQ ID NO: 510661 - RNA, 20 nt, Human
gcuggaacuacaagcaccca

SEQ ID NO: 510662 - RNA, 20 nt, Human
gcuggaacuacaagcaccca

SEQ ID NO: 510663 - RNA, 23 nt, Human
gggugacccugaccuucaggccc

SEQ ID NO: 510664 - RNA, 23 nt, Human
guggugcaaucacaacucacugc

SEQ ID NO: 510665 - RNA, 23 nt, Human
guggugcaaucacaacucacugc

SEQ ID NO: 510666 - RNA, 24 nt, Human
uaauuuuuuauuuauuuguagaga

SEQ ID NO: 510667 - RNA, 22 nt, Human
uacaagcacccaccuccaugcc

SEQ ID NO: 510668 - RNA, 25 nt, Human
ucaagucauccucccaccucagccu

SEQ ID NO: 510669 - RNA, 25 nt, Human
ucaagucauccucccaccucagccu

SEQ ID NO: 510670 - RNA, 18 nt, Human
ucacugcagccucagccu

SEQ ID NO: 510671 - RNA, 18 nt, Human
ucacugcagccucagccu

SEQ ID NO: 510672 - RNA, 19 nt, Human
ucacugcagccucagccuc

SEQ ID NO: 510673 - RNA, 19 nt, Human
ucacugcagccucagccuc

SEQ ID NO: 510674 - RNA, 22 nt, Human
ucacugcagccucagccuccug

SEQ ID NO: 510675 - RNA, 22 nt, Human
ucacugcagccucagccuccug

SEQ ID NO: 510676 - RNA, 23 nt, Human
ucagccuccugaguagcuggaac

SEQ ID NO: 510677 - RNA, 23 nt, Human
ucagccuccugaguagcuggaac

SEQ ID NO: 510678 - RNA, 23 nt, Human
uccaaugauccucccaccucggc

SEQ ID NO: 510679 - RNA, 18 nt, Human
uccuaggaggaccagaac

SEQ ID NO: 510680 - RNA, 26 nt, Human
uccucccaccucagccuccugaguag

SEQ ID NO: 510681 - RNA, 26 nt, Human
uccucccaccucagccuccugaguag

SEQ ID NO: 510682 - RNA, 23 nt, Human
ucucgaacuccugagauccaaug

SEQ ID NO: 510683 - RNA, 19 nt, Human
ugaccuucaggccccggca

SEQ ID NO: 510684 - RNA, 21 nt, Human
ugaccuucaggccccggcacc

SEQ ID NO: 510685 - RNA, 18 nt, Human
uggaacuacaagcaccca

SEQ ID NO: 510686 - RNA, 18 nt, Human
uggaacuacaagcaccca

SEQ ID NO: 510687 - RNA, 24 nt, Human
uggugcaaucacaacucacugcag

SEQ ID NO: 510688 - RNA, 24 nt, Human
uggugcaaucacaacucacugcag

SEQ ID NO: 510689 - RNA, 24 nt, Human
uucaagucauccucccaccucagc

SEQ ID NO: 510690 - RNA, 24 nt, Human
uucaagucauccucccaccucagc

SEQ ID NO: 510691 - RNA, 28 nt, Human
uuuuuauuuauuuguagagauggagucg

SEQ ID NO: 510692 - RNA, 19 nt, Human
cagccacugcagccugcac

SEQ ID NO: 510693 - RNA, 21 nt, Human
ccagccacugcagccugcacc

SEQ ID NO: 510694 - RNA, 23 nt, Human
ccagccacugcagccugcaccca

SEQ ID NO: 510695 - RNA, 21 nt, Human
uggccgggcgaggacggcgcc

SEQ ID NO: 510696 - RNA, 21 nt, Human
agcaggcuggcccagccuccc

SEQ ID NO: 510697 - RNA, 25 nt, Human
caagucccagaugaagggugacagg

SEQ ID NO: 510698 - RNA, 22 nt, Human
cacacagagcuugggccuggga

SEQ ID NO: 510699 - RNA, 19 nt, Human
cacagagcuugggccuggg

SEQ ID NO: 510700 - RNA, 19 nt, Human
cacucucugccugguccug

SEQ ID NO: 510701 - RNA, 23 nt, Human
cagagcuugggccugggagccuc

SEQ ID NO: 510702 - RNA, 18 nt, Human
cagcaggcuggcccagcc

SEQ ID NO: 510703 - RNA, 21 nt, Human
cagcaggcuggcccagccucc

SEQ ID NO: 510704 - RNA, 19 nt, Human
ccagugcagguugggaugu

SEQ ID NO: 510705 - RNA, 21 nt, Human
cccagccuccccuuuaugaga

SEQ ID NO: 510706 - RNA, 22 nt, Human
cccccagccucacucucugccu

SEQ ID NO: 510707 - RNA, 24 nt, Human
cccccugcgggcagcugggaaggc

SEQ ID NO: 510708 - RNA, 24 nt, Human
ccggcggcggcgacgagcuccccc

SEQ ID NO: 510709 - RNA, 28 nt, Human
ccggcggcggcgacgagcucccccagcu

SEQ ID NO: 510710 - RNA, 24 nt, Human
ccucacucucugccugguccugaa

SEQ ID NO: 510711 - RNA, 23 nt, Human
cuaggguccaccuggucucuccu

SEQ ID NO: 510712 - RNA, 26 nt, Human
cucccccagcuucacgacaucccucc

SEQ ID NO: 510713 - RNA, 18 nt, Human
cugaagcagacagcagca

SEQ ID NO: 510714 - RNA, 22 nt, Human
cugcaugggggcugcagcugcc

SEQ ID NO: 510715 - RNA, 18 nt, Human
cuugggccugggagccuc

SEQ ID NO: 510716 - RNA, 24 nt, Human
gaacaagcgcucgggugggcccca

SEQ ID NO: 510717 - RNA, 20 nt, Human
gaagggugacaggcagcuag

SEQ ID NO: 510718 - RNA, 19 nt, Human
gacagcagcaggcuggccc

SEQ ID NO: 510719 - RNA, 23 nt, Human
gagacuauccuaggguuugacag

SEQ ID NO: 510720 - RNA, 21 nt, Human
ggugugagaacccccagccuc

SEQ ID NO: 510721 - RNA, 18 nt, Human
ucugccugguccugaagc

SEQ ID NO: 510722 - RNA, 26 nt, Human
ugaagcagacagcagcaggcuggccc

SEQ ID NO: 510723 - RNA, 19 nt, Human
ugagaccagaacaagcgcu

SEQ ID NO: 510724 - RNA, 19 nt, Human
ugcaugggggcugcagcug

SEQ ID NO: 510725 - RNA, 21 nt, Human
ugggaaggcaguggccaaagg

SEQ ID NO: 510726 - RNA, 25 nt, Human
ugggagccucuucugcaugggggcu

SEQ ID NO: 510727 - RNA, 22 nt, Human
ugggccccagugcagguuggga

SEQ ID NO: 510728 - RNA, 23 nt, Human
ugggccugggagccucuucugca

SEQ ID NO: 510729 - RNA, 21 nt, Human
ugguccugaagcagacagcag

SEQ ID NO: 510730 - RNA, 22 nt, Human
uuuuuugggccacacugaggca

SEQ ID NO: 510731 - RNA, 20 nt, Human
uuuuuuuuuuuuuugggcca

SEQ ID NO: 510732 - RNA, 26 nt, Human
uuuuuuuuuuuuuuuuuuuuuuuggg

SEQ ID NO: 510733 - RNA, 24 nt, Human
aauuauuggaaaucacaaugcacu

SEQ ID NO: 510734 - RNA, 20 nt, Human
agacagcuuuuagaaccacu

SEQ ID NO: 510735 - RNA, 21 nt, Human
agacuaguuuacaagaccaga

SEQ ID NO: 510736 - RNA, 24 nt, Human
caagccgcccgcagccaaaccaca

SEQ ID NO: 510737 - RNA, 20 nt, Human
caccgaccgaccgccccucg

SEQ ID NO: 510738 - RNA, 19 nt, Human
cagcuaacaugcacaaguc

SEQ ID NO: 510739 - RNA, 20 nt, Human
ccaaaccacagccgggaaag

SEQ ID NO: 510740 - RNA, 23 nt, Human
ccacauugcucuuuucauuaaug

SEQ ID NO: 510741 - RNA, 19 nt, Human
cccaagccgcccgcagcca

SEQ ID NO: 510742 - RNA, 21 nt, Human
cccgcagccaaaccacagccg

SEQ ID NO: 510743 - RNA, 21 nt, Human
ccgcccgcagccaaaccacag

SEQ ID NO: 510744 - RNA, 19 nt, Human
ccggaguggcaccuuucuu

SEQ ID NO: 510745 - RNA, 24 nt, Human
cgcccgcagccaaaccacagccgg

SEQ ID NO: 510746 - RNA, 21 nt, Human
cgcugagacccgggcgcgucc

SEQ ID NO: 510747 - RNA, 22 nt, Human
gcaccuuucuucuucuaccuga

SEQ ID NO: 510748 - RNA, 21 nt, Human
gcccgcagccaaaccacagcc

SEQ ID NO: 510749 - RNA, 21 nt, Human
gcccucacauaaaucuacaca

SEQ ID NO: 510750 - RNA, 21 nt, Human
uaagacuaguuuacaagacca

SEQ ID NO: 510751 - RNA, 22 nt, Human
uacaagaccagaguuuuacaag

SEQ ID NO: 510752 - RNA, 22 nt, Human
ucacauaaaucuacacagcuaa

SEQ ID NO: 510753 - RNA, 24 nt, Human
ucaccgaccgaccgccccucgugc

SEQ ID NO: 510754 - RNA, 19 nt, Human
ugccggaguggcaccuuuc

SEQ ID NO: 510755 - RNA, 23 nt, Human
ugccggaguggcaccuuucuucu

SEQ ID NO: 510756 - RNA, 20 nt, Human
uuuuuuuuuuuuuugaucgg

SEQ ID NO: 510757 - RNA, 18 nt, Human
uuuuuuuuuuuuuuuuug

SEQ ID NO: 510758 - RNA, 24 nt, Human
uuuuuuuuuuuuuuuuugaucggg

SEQ ID NO: 510759 - RNA, 19 nt, Human
aaagggcagguuccuaaac

SEQ ID NO: 510760 - RNA, 18 nt, Human
aaagucagugcccuggag

SEQ ID NO: 510761 - RNA, 25 nt, Human
aaaguuucccagagccaggaagcau

SEQ ID NO: 510762 - RNA, 21 nt, Human
aacagcacccgcugccuuggc

SEQ ID NO: 510763 - RNA, 23 nt, Human
aacugguccaucuggguggccuc

SEQ ID NO: 510764 - RNA, 21 nt, Human
aaggauggagaucuucaccgu

SEQ ID NO: 510765 - RNA, 19 nt, Human
acaauccaagcacgaggcc

SEQ ID NO: 510766 - RNA, 21 nt, Human
acacaggauccucuucaugug

SEQ ID NO: 510767 - RNA, 22 nt, Human
acacugaggacuugggguggcc

SEQ ID NO: 510768 - RNA, 19 nt, Human
acagcagcagcuccgucuc

SEQ ID NO: 510769 - RNA, 18 nt, Human
acagcccucuccccaggc

SEQ ID NO: 510770 - RNA, 19 nt, Human
accugggugcacugcagag

SEQ ID NO: 510771 - RNA, 25 nt, Human
accuuuucuccaagacucuucaggg

SEQ ID NO: 510772 - RNA, 24 nt, Human
acucauguggacacacauccucug

SEQ ID NO: 510773 - RNA, 21 nt, Human
acucauguucauuccuuccuc

SEQ ID NO: 510774 - RNA, 18 nt, Human
acuccauaccacaucaug

SEQ ID NO: 510775 - RNA, 20 nt, Human
agaaccuuuucuccaagacu

SEQ ID NO: 510776 - RNA, 21 nt, Human
agagcacuccccagcugcucc

SEQ ID NO: 510777 - RNA, 22 nt, Human
agaggacagaggcuaggccucg

SEQ ID NO: 510778 - RNA, 21 nt, Human
agaggggacagaggggcugug

SEQ ID NO: 510779 - RNA, 20 nt, Human
agaggugaaccggggcuccc

SEQ ID NO: 510780 - RNA, 23 nt, Human
agccacacggugcggccacagaa

SEQ ID NO: 510781 - RNA, 22 nt, Human
agccacggggugucugccagcc

SEQ ID NO: 510782 - RNA, 20 nt, Human
agcgaggacaccccagugcg

SEQ ID NO: 510783 - RNA, 21 nt, Human
agcuaaguccaccaacagagc

SEQ ID NO: 510784 - RNA, 18 nt, Human
aggaccaggggcugcugc

SEQ ID NO: 510785 - RNA, 22 nt, Human
aggagagaggauggaggagggg

SEQ ID NO: 510786 - RNA, 26 nt, Human
aggcaagcagugcccaggaggccaga

SEQ ID NO: 510787 - RNA, 21 nt, Human
aggcacgcccucauccccaag

SEQ ID NO: 510788 - RNA, 24 nt, Human
aggccaggcaagcagugcccagga

SEQ ID NO: 510789 - RNA, 19 nt, Human
aggcgagcucccugcccuc

SEQ ID NO: 510790 - RNA, 22 nt, Human
aggcggauccagcugcagggcc

SEQ ID NO: 510791 - RNA, 21 nt, Human
agggccaucuucccagacagc

SEQ ID NO: 510792 - RNA, 22 nt, Human
agggggcgggcugcagcaucug

SEQ ID NO: 510793 - RNA, 22 nt, Human
agggugcucucaaaugcccugu

SEQ ID NO: 510794 - RNA, 23 nt, Human
agguccuugaggucccuccgcuc

SEQ ID NO: 510795 - RNA, 18 nt, Human
aguggggggagggaggag

SEQ ID NO: 510796 - RNA, 24 nt, Human
auguucuugguucggcuccugcac

SEQ ID NO: 510797 - RNA, 24 nt, Human
caaaucagagucccugccagcacc

SEQ ID NO: 510798 - RNA, 23 nt, Human
caacgggaaaaaagggcaaaguc

SEQ ID NO: 510799 - RNA, 26 nt, Human
caacuccuugccaggaguaggacacu

SEQ ID NO: 510800 - RNA, 21 nt, Human
caagaagccacugcaggggca

SEQ ID NO: 510801 - RNA, 27 nt, Human
cacacaggauccucuucauguggccca

SEQ ID NO: 510802 - RNA, 22 nt, Human
cacagucagcuguuuauccucc

SEQ ID NO: 510803 - RNA, 23 nt, Human
cacaucgccaggccagcagggcc

SEQ ID NO: 510804 - RNA, 23 nt, Human
caccaugagaagggggcgggcug

SEQ ID NO: 510805 - RNA, 20 nt, Human
cacccccgcaggugcagccc

SEQ ID NO: 510806 - RNA, 20 nt, Human
caccgugcgacacugggcga

SEQ ID NO: 510807 - RNA, 19 nt, Human
cacggccaggcagccaggc

SEQ ID NO: 510808 - RNA, 23 nt, Human
cacucacaccccaagcugaacuc

SEQ ID NO: 510809 - RNA, 22 nt, Human
cagaaugggcagaaaaaguuuc

SEQ ID NO: 510810 - RNA, 22 nt, Human
cagagccaggacagaggcaggg

SEQ ID NO: 510811 - RNA, 19 nt, Human
cagaggcagggcaggggca

SEQ ID NO: 510812 - RNA, 25 nt, Human
cagaggcagggcaggggcagcgcgg

SEQ ID NO: 510813 - RNA, 21 nt, Human
cagcaaccuccucuguccccc

SEQ ID NO: 510814 - RNA, 21 nt, Human
cagcaagaccuuuugcuccag

SEQ ID NO: 510815 - RNA, 18 nt, Human
cagcagagcagcccccag

SEQ ID NO: 510816 - RNA, 20 nt, Human
cagcagagcagcccccagac

SEQ ID NO: 510817 - RNA, 20 nt, Human
cagcagcaggcgacaagaag

SEQ ID NO: 510818 - RNA, 20 nt, Human
cagcccucuccccaggcgag

SEQ ID NO: 510819 - RNA, 22 nt, Human
cagccuccugagcugucggucc

SEQ ID NO: 510820 - RNA, 18 nt, Human
caggcagccaggccagag

SEQ ID NO: 510821 - RNA, 21 nt, Human
cagggauccuuccugccucuc

SEQ ID NO: 510822 - RNA, 21 nt, Human
cagggccaucuucccagacag

SEQ ID NO: 510823 - RNA, 24 nt, Human
caucaacaaacaggggcccuugca

SEQ ID NO: 510824 - RNA, 18 nt, Human
caucacacucucuucguc

SEQ ID NO: 510825 - RNA, 24 nt, Human
caucacgcccagcagcaggcgaca

SEQ ID NO: 510826 - RNA, 19 nt, Human
cauguccccuccccaccca

SEQ ID NO: 510827 - RNA, 21 nt, Human
ccaaaucagagucccugccag

SEQ ID NO: 510828 - RNA, 23 nt, Human
ccaagaacuccauaccacaucau

SEQ ID NO: 510829 - RNA, 22 nt, Human
ccacacggugcggccacagaag

SEQ ID NO: 510830 - RNA, 20 nt, Human
ccaccuuccacccacaucac

SEQ ID NO: 510831 - RNA, 23 nt, Human
ccaccuuccacccacaucacuuc

SEQ ID NO: 510832 - RNA, 21 nt, Human
ccacugcaggggcagacacuc

SEQ ID NO: 510833 - RNA, 25 nt, Human
ccacugcaggggcagacacucagga

SEQ ID NO: 510834 - RNA, 19 nt, Human
ccagcgacaucacgcccag

SEQ ID NO: 510835 - RNA, 20 nt, Human
ccagcugcuccuucugaggc

SEQ ID NO: 510836 - RNA, 21 nt, Human
ccaggccagagccauuuccuc

SEQ ID NO: 510837 - RNA, 21 nt, Human
ccaggcuacugugagcuucuu

SEQ ID NO: 510838 - RNA, 18 nt, Human
cccaacacgucgcaugca

SEQ ID NO: 510839 - RNA, 23 nt, Human
cccaagcugaacucgccuagagc

SEQ ID NO: 510840 - RNA, 22 nt, Human
cccaaggauggagaucuucacc

SEQ ID NO: 510841 - RNA, 26 nt, Human
cccagacagcagcagcuccgucucac

SEQ ID NO: 510842 - RNA, 22 nt, Human
cccagagccaggaagcauuucc

SEQ ID NO: 510843 - RNA, 21 nt, Human
cccaucuacaauguucugggg

SEQ ID NO: 510844 - RNA, 23 nt, Human
ccccaaggauggagaucuucacc

SEQ ID NO: 510845 - RNA, 19 nt, Human
cccccagacagcgaggaca

SEQ ID NO: 510846 - RNA, 22 nt, Human
ccccgcaggugcagcccagcuu

SEQ ID NO: 510847 - RNA, 20 nt, Human
ccccuccccacccaaguucc

SEQ ID NO: 510848 - RNA, 19 nt, Human
ccccucugugguucugggc

SEQ ID NO: 510849 - RNA, 21 nt, Human
ccccucugugguucugggcuu

SEQ ID NO: 510850 - RNA, 19 nt, Human
ccccugcugccugcccaaa

SEQ ID NO: 510851 - RNA, 22 nt, Human
cccgucacacuccagcaagacc

SEQ ID NO: 510852 - RNA, 18 nt, Human
cccuugcaggcugcugug

SEQ ID NO: 510853 - RNA, 19 nt, Human
ccugccagcaccuccagcg

SEQ ID NO: 510854 - RNA, 24 nt, Human
ccuggcccaccagggguccccugg

SEQ ID NO: 510855 - RNA, 20 nt, Human
cgacaagaagccacugcagg

SEQ ID NO: 510856 - RNA, 21 nt, Human
cgaggccaggcaagcagugcc

SEQ ID NO: 510857 - RNA, 19 nt, Human
cggcugaaacgcagccugu

SEQ ID NO: 510858 - RNA, 24 nt, Human
cgggacgccagcccagcaccaaag

SEQ ID NO: 510859 - RNA, 19 nt, Human
cgggccagaacgaccacga

SEQ ID NO: 510860 - RNA, 18 nt, Human
cggucuaugcccaccccc

SEQ ID NO: 510861 - RNA, 19 nt, Human
cucacaccccaagcugaac

SEQ ID NO: 510862 - RNA, 22 nt, Human
cucagagccccggaugucgugc

SEQ ID NO: 510863 - RNA, 23 nt, Human
cucauguucauuccuuccucaca

SEQ ID NO: 510864 - RNA, 19 nt, Human
cugcagcaucugcccaggg

SEQ ID NO: 510865 - RNA, 28 nt, Human
cugcugccugcccaaacugguccaucug

SEQ ID NO: 510866 - RNA, 20 nt, Human
cuggagaaaguguuguuuca

SEQ ID NO: 510867 - RNA, 18 nt, Human
cuggcucagccuccauac

SEQ ID NO: 510868 - RNA, 19 nt, Human
cuggucagugucugugccc

SEQ ID NO: 510869 - RNA, 22 nt, Human
cugugcugggccccagccacgu

SEQ ID NO: 510870 - RNA, 25 nt, Human
cuucagggauccuuccugccucucu

SEQ ID NO: 510871 - RNA, 31 nt, Human
cuuccagugaggcagcuaaguccaccaacaa

SEQ ID NO: 510872 - RNA, 26 nt, Human
cuucccaagacauuuacaagcaccuc

SEQ ID NO: 510873 - RNA, 20 nt, Human
cuugguucggcuccugcacu

SEQ ID NO: 510874 - RNA, 25 nt, Human
gaaacccaaggccuggcucagccuc

SEQ ID NO: 510875 - RNA, 22 nt, Human
gagaagccacggccaggcagcc

SEQ ID NO: 510876 - RNA, 18 nt, Human
gagagaggauggaggagg

SEQ ID NO: 510877 - RNA, 18 nt, Human
gagaggacagaggcuagg

SEQ ID NO: 510878 - RNA, 18 nt, Human
gagagggcggaggcuagg

SEQ ID NO: 510879 - RNA, 29 nt, Human
gagcgggaggagagaggauggaggagggg

SEQ ID NO: 510880 - RNA, 18 nt, Human
gagcuggcauugacggcg

SEQ ID NO: 510881 - RNA, 21 nt, Human
gaggacaccccagugcgggac

SEQ ID NO: 510882 - RNA, 18 nt, Human
gaggagcgggaggagaga

SEQ ID NO: 510883 - RNA, 21 nt, Human
gaggagggaggagcacaggcc

SEQ ID NO: 510884 - RNA, 18 nt, Human
gauggaggagggaggagc

SEQ ID NO: 510885 - RNA, 24 nt, Human
gcaccaaagggcagguuccuaaac

SEQ ID NO: 510886 - RNA, 20 nt, Human
gcagagcagcccccagacag

SEQ ID NO: 510887 - RNA, 19 nt, Human
gccaauggucaugcaggga

SEQ ID NO: 510888 - RNA, 22 nt, Human
gcgggacgccagcccagcacca

SEQ ID NO: 510889 - RNA, 18 nt, Human
gcugcaguugagccccuc

SEQ ID NO: 510890 - RNA, 21 nt, Human
gcuggagaaaguguuguuuca

SEQ ID NO: 510891 - RNA, 23 nt, Human
gcugugcuggggaaacccaaggc

SEQ ID NO: 510892 - RNA, 22 nt, Human
ggacacugaggacuuggggugg

SEQ ID NO: 510893 - RNA, 19 nt, Human
ggacagaggcagggcaggg

SEQ ID NO: 510894 - RNA, 21 nt, Human
ggaccccugcugccugcccaa

SEQ ID NO: 510895 - RNA, 20 nt, Human
ggaccuggacagcgccggca

SEQ ID NO: 510896 - RNA, 18 nt, Human
ggacuugggguggcccug

SEQ ID NO: 510897 - RNA, 22 nt, Human
ggacuugggguggcccugaugu

SEQ ID NO: 510898 - RNA, 19 nt, Human
ggagagaggauggaggagg

SEQ ID NO: 510899 - RNA, 18 nt, Human
ggagcacccaaaggcacg

SEQ ID NO: 510900 - RNA, 24 nt, Human
ggaggcugugcuggggaaacccaa

SEQ ID NO: 510901 - RNA, 21 nt, Human
ggagugggaugggucgcccgu

SEQ ID NO: 510902 - RNA, 18 nt, Human
ggauccagcugcagggcc

SEQ ID NO: 510903 - RNA, 18 nt, Human
ggccagaacgaccacgag

SEQ ID NO: 510904 - RNA, 18 nt, Human
ggcccaccagggccacgc

SEQ ID NO: 510905 - RNA, 23 nt, Human
gggcauccuucaccugggcacug

SEQ ID NO: 510906 - RNA, 24 nt, Human
gggcugcugcagacccagcccggu

SEQ ID NO: 510907 - RNA, 23 nt, Human
guagcugacagaggaaguagcac

SEQ ID NO: 510908 - RNA, 22 nt, Human
guagcuguguuguuauguucga

SEQ ID NO: 510909 - RNA, 27 nt, Human
gugaggcagcuaaguccaccaacagag

SEQ ID NO: 510910 - RNA, 21 nt, Human
guugagccccucugugguucu

SEQ ID NO: 510911 - RNA, 18 nt, Human
guuguuucaaagguagcu

SEQ ID NO: 510912 - RNA, 24 nt, Human
uacacagaacaacuuauguacagc

SEQ ID NO: 510913 - RNA, 19 nt, Human
uagccugaugacucgagag

SEQ ID NO: 510914 - RNA, 21 nt, Human
uagcugacagaggaaguagca

SEQ ID NO: 510915 - RNA, 25 nt, Human
uauguacaugacaauacaagaggcg

SEQ ID NO: 510916 - RNA, 19 nt, Human
ucacugccgccugcucagg

SEQ ID NO: 510917 - RNA, 18 nt, Human
ucagagccaggacagagg

SEQ ID NO: 510918 - RNA, 20 nt, Human
ucagagccaggacagaggca

SEQ ID NO: 510919 - RNA, 19 nt, Human
ucagagccccggaugucgu

SEQ ID NO: 510920 - RNA, 18 nt, Human
ucauguggcccaccuugg

SEQ ID NO: 510921 - RNA, 20 nt, Human
uccacccacaucacuuccag

SEQ ID NO: 510922 - RNA, 22 nt, Human
uccagcaagaccuuuugcucca

SEQ ID NO: 510923 - RNA, 20 nt, Human
uccaggacgaagcugcaguu

SEQ ID NO: 510924 - RNA, 23 nt, Human
uccauaccacaucauguucuugg

SEQ ID NO: 510925 - RNA, 18 nt, Human
ucccacacagaaacacuc

SEQ ID NO: 510926 - RNA, 20 nt, Human
ucccagagccaggaagcauu

SEQ ID NO: 510927 - RNA, 21 nt, Human
ucccaggacuucagggugcuc

SEQ ID NO: 510928 - RNA, 22 nt, Human
ucccccagaggugaaccggggc

SEQ ID NO: 510929 - RNA, 24 nt, Human
ucccuacggggcacagcccucucc

SEQ ID NO: 510930 - RNA, 25 nt, Human
ucccucugccaacccccaucuacaa

SEQ ID NO: 510931 - RNA, 21 nt, Human
uccucauguccccuccccacc

SEQ ID NO: 510932 - RNA, 22 nt, Human
uccuccucauguccccucccca

SEQ ID NO: 510933 - RNA, 22 nt, Human
uccucugucugcagggaugcag

SEQ ID NO: 510934 - RNA, 24 nt, Human
ucucaaaugcccugucucugguca

SEQ ID NO: 510935 - RNA, 23 nt, Human
ucucacucacaccccaagcugaa

SEQ ID NO: 510936 - RNA, 23 nt, Human
ucugggacccuaagaaccccagg

SEQ ID NO: 510937 - RNA, 19 nt, Human
ucuugguucggcuccugca

SEQ ID NO: 510938 - RNA, 22 nt, Human
ucuuugguuccaagaacuccau

SEQ ID NO: 510939 - RNA, 20 nt, Human
ugaaacgcagccuguugcgg

SEQ ID NO: 510940 - RNA, 20 nt, Human
ugacuaaaggaccuggacag

SEQ ID NO: 510941 - RNA, 18 nt, Human
ugacucgagagacggcca

SEQ ID NO: 510942 - RNA, 20 nt, Human
ugagaacuggcugggggcca

SEQ ID NO: 510943 - RNA, 25 nt, Human
ugagaagggggcgggcugcagcauc

SEQ ID NO: 510944 - RNA, 21 nt, Human
ugagagguggaaaagguaaca

SEQ ID NO: 510945 - RNA, 23 nt, Human
ugcgacacugggcgauccgauga

SEQ ID NO: 510946 - RNA, 19 nt, Human
uggaggagggaggagcaca

SEQ ID NO: 510947 - RNA, 21 nt, Human
uggcaagcugucucacucacc

SEQ ID NO: 510948 - RNA, 21 nt, Human
uggcaggaggcgcagaggcca

SEQ ID NO: 510949 - RNA, 19 nt, Human
ugggagagucuuucaucca

SEQ ID NO: 510950 - RNA, 18 nt, Human
ugggcagaaaaaguuucc

SEQ ID NO: 510951 - RNA, 18 nt, Human
ugggccggggcagcagag

SEQ ID NO: 510952 - RNA, 21 nt, Human
ugggccggggcagcagagcag

SEQ ID NO: 510953 - RNA, 21 nt, Human
uggggaaaacaaugagaggug

SEQ ID NO: 510954 - RNA, 19 nt, Human
uggggagugggaugggucg

SEQ ID NO: 510955 - RNA, 23 nt, Human
ugguuccaagaacuccauaccac

SEQ ID NO: 510956 - RNA, 18 nt, Human
uguggaggccacaggcug

SEQ ID NO: 510957 - RNA, 18 nt, Human
uucacugccgccugcuca

SEQ ID NO: 510958 - RNA, 23 nt, Human
uucccagacagcagcagcuccgu

SEQ ID NO: 510959 - RNA, 22 nt, Human
uucucugggugcucaucgcgcc

SEQ ID NO: 510960 - RNA, 19 nt, Human
uucugagaacuggcugggg

SEQ ID NO: 510961 - RNA, 20 nt, Human
uuguuucaaagguagcugug

SEQ ID NO: 510962 - RNA, 18 nt, Human
uuuacaagcaccucugag

SEQ ID NO: 510963 - RNA, 24 nt, Human
uuuauacacagaacaacuuaugua

SEQ ID NO: 510964 - RNA, 25 nt, Human
uuucccagagccaggaagcauuucc

SEQ ID NO: 510965 - RNA, 18 nt, Human
uuucucccucugccaacc

SEQ ID NO: 510966 - RNA, 18 nt, Human
uuugggagccaaagagaa

SEQ ID NO: 510967 - RNA, 18 nt, Human
uuugggagccaaagagaa

SEQ ID NO: 510968 - RNA, 19 nt, Human
aaugacaggggagcgggga

SEQ ID NO: 510969 - RNA, 18 nt, Human
acuggaauguggcaguga

SEQ ID NO: 510970 - RNA, 18 nt, Human
agagucccgccccccacc

SEQ ID NO: 510971 - RNA, 21 nt, Human
agagucccgccccccaccccc

SEQ ID NO: 510972 - RNA, 19 nt, Human
agcuccugaguccagcccu

SEQ ID NO: 510973 - RNA, 23 nt, Human
aggcccccccagcuccugagucc

SEQ ID NO: 510974 - RNA, 24 nt, Human
agguccccccguggccgucccacu

SEQ ID NO: 510975 - RNA, 22 nt, Human
caccgugagagucccgcccccc

SEQ ID NO: 510976 - RNA, 26 nt, Human
cagcaggcgcugaguuucccgaaucg

SEQ ID NO: 510977 - RNA, 22 nt, Human
cagcaggcgcugaguuuccggg

SEQ ID NO: 510978 - RNA, 24 nt, Human
caggaagccucuucccgaaggccu

SEQ ID NO: 510979 - RNA, 23 nt, Human
caggugaggcccccccagcuccu

SEQ ID NO: 510980 - RNA, 19 nt, Human
cauugucccuccugcugcc

SEQ ID NO: 510981 - RNA, 20 nt, Human
ccagaaccccggcaaaggca

SEQ ID NO: 510982 - RNA, 18 nt, Human
cccccaggccgcacaguc

SEQ ID NO: 510983 - RNA, 18 nt, Human
ccccccagcuccugaguc

SEQ ID NO: 510984 - RNA, 18 nt, Human
cccgaaggccucccccuc

SEQ ID NO: 510985 - RNA, 21 nt, Human
cccgaaggccucccccucucc

SEQ ID NO: 510986 - RNA, 27 nt, Human
cccuagccccggccggcggagggcccc

SEQ ID NO: 510987 - RNA, 19 nt, Human
cccugccccagaaccccgg

SEQ ID NO: 510988 - RNA, 19 nt, Human
ccgggccggcggccggggc

SEQ ID NO: 510989 - RNA, 18 nt, Human
ccggguccggcggggucc

SEQ ID NO: 510990 - RNA, 22 nt, Human
ccuggccgcauugucccuccug

SEQ ID NO: 510991 - RNA, 20 nt, Human
ccuuagggggcggcaugggg

SEQ ID NO: 510992 - RNA, 25 nt, Human
cgcauugucccuccugcugcccgug

SEQ ID NO: 510993 - RNA, 23 nt, Human
cggcauggggcucuuucccuggg

SEQ ID NO: 510994 - RNA, 21 nt, Human
cgggaggaagcccggaggagg

SEQ ID NO: 510995 - RNA, 25 nt, Human
cucuucccgaaggccucccccucuc

SEQ ID NO: 510996 - RNA, 18 nt, Human
cugcccgugggcggcccg

SEQ ID NO: 510997 - RNA, 19 nt, Human
cuggccgcauugucccucc

SEQ ID NO: 510998 - RNA, 23 nt, Human
gagcgcccugccccagaaccccg

SEQ ID NO: 510999 - RNA, 20 nt, Human
gaggugggguggggcaggag

SEQ ID NO: 511000 - RNA, 19 nt, Human
gccccagaaccccggcaaa

SEQ ID NO: 511001 - RNA, 21 nt, Human
gccgcauugucccuccugcug

SEQ ID NO: 511002 - RNA, 19 nt, Human
gccggggcucagcacgccc

SEQ ID NO: 511003 - RNA, 18 nt, Human
ggaggugggguggggcag

SEQ ID NO: 511004 - RNA, 20 nt, Human
ggcaggagcgggggcugggg

SEQ ID NO: 511005 - RNA, 23 nt, Human
ggccgaagaccagggggcccagg

SEQ ID NO: 511006 - RNA, 18 nt, Human
ggccuagguccccccgug

SEQ ID NO: 511007 - RNA, 21 nt, Human
ggccucccccucuccagcccc

SEQ ID NO: 511008 - RNA, 22 nt, Human
ggcgcugaguuuccgggaggaa

SEQ ID NO: 511009 - RNA, 22 nt, Human
gggccuagguccccccguggcc

SEQ ID NO: 511010 - RNA, 19 nt, Human
gggcucuuucccuggggcc

SEQ ID NO: 511011 - RNA, 20 nt, Human
ggggagcggggagggucgcc

SEQ ID NO: 511012 - RNA, 21 nt, Human
ggguggggcaggagcgggggc

SEQ ID NO: 511013 - RNA, 24 nt, Human
ucacacccagcuguaaacauguca

SEQ ID NO: 511014 - RNA, 19 nt, Human
uccccuggccgcauugucc

SEQ ID NO: 511015 - RNA, 22 nt, Human
ucccgccccccacccccaggcc

SEQ ID NO: 511016 - RNA, 19 nt, Human
uccugaguccagcccuagg

SEQ ID NO: 511017 - RNA, 24 nt, Human
ucuccagccccuccacuccuggga

SEQ ID NO: 511018 - RNA, 20 nt, Human
ugaggugggcaaggaaggcg

SEQ ID NO: 511019 - RNA, 20 nt, Human
ugagucacacccagcuguaa

SEQ ID NO: 511020 - RNA, 21 nt, Human
ugccaagcaaggcagggcagg

SEQ ID NO: 511021 - RNA, 19 nt, Human
ugccccagaaccccggcaa

SEQ ID NO: 511022 - RNA, 19 nt, Human
ugccgggccggcggccggg

SEQ ID NO: 511023 - RNA, 24 nt, Human
uggcagugaggugggcaaggaagg

SEQ ID NO: 511024 - RNA, 19 nt, Human
uggggcaggagcgggggcu

SEQ ID NO: 511025 - RNA, 24 nt, Human
ugggguggggcaggagcgggggcu

SEQ ID NO: 511026 - RNA, 26 nt, Human
ugggguggggcaggagcgggggcugg

SEQ ID NO: 511027 - RNA, 18 nt, Human
uguggcagugaggugggc

SEQ ID NO: 511028 - RNA, 25 nt, Human
uguggcagugaggugggcaaggaag

SEQ ID NO: 511029 - RNA, 22 nt, Human
uuacugagucacacccagcugu

SEQ ID NO: 511030 - RNA, 22 nt, Human
aaaaaacaaaaaagagacugag

SEQ ID NO: 511031 - RNA, 25 nt, Human
aaaaacaaaaaagagacugaguagc

SEQ ID NO: 511032 - RNA, 18 nt, Human
aaacaaaaaagagacuga

SEQ ID NO: 511033 - RNA, 22 nt, Human
aaacaaaaaagagacugaguag

SEQ ID NO: 511034 - RNA, 21 nt, Human
aaacaauacccagccucccuc

SEQ ID NO: 511035 - RNA, 21 nt, Human
aacaauacccagccucccuca

SEQ ID NO: 511036 - RNA, 21 nt, Human
aagcauccgacgguuccccac

SEQ ID NO: 511037 - RNA, 21 nt, Human
aauggaggccucucucccuuc

SEQ ID NO: 511038 - RNA, 26 nt, Human
acaaaaaagagacugaguagcuacgu

SEQ ID NO: 511039 - RNA, 19 nt, Human
acaaacaauacccagccuc

SEQ ID NO: 511040 - RNA, 19 nt, Human
accacagcaagccggugcu

SEQ ID NO: 511041 - RNA, 23 nt, Human
accccagaguccaagagaauccu

SEQ ID NO: 511042 - RNA, 22 nt, Human
accggggaugcacagucugcau

SEQ ID NO: 511043 - RNA, 19 nt, Human
agacacuuggcaucagugg

SEQ ID NO: 511044 - RNA, 21 nt, Human
agacagugagugaggaccggc

SEQ ID NO: 511045 - RNA, 24 nt, Human
agaggucagaagucggauaaaacc

SEQ ID NO: 511046 - RNA, 18 nt, Human
agcgauccacagguggau

SEQ ID NO: 511047 - RNA, 21 nt, Human
agcugcugggccgggaauccu

SEQ ID NO: 511048 - RNA, 20 nt, Human
aggaaggaguuuggguuugg

SEQ ID NO: 511049 - RNA, 22 nt, Human
aggccucucucccuucgugccc

SEQ ID NO: 511050 - RNA, 26 nt, Human
aggucuuggagagaguccggauagcu

SEQ ID NO: 511051 - RNA, 23 nt, Human
augaguucgugcaccaaacaaaa

SEQ ID NO: 511052 - RNA, 20 nt, Human
augcccagaggucagaaguc

SEQ ID NO: 511053 - RNA, 23 nt, Human
caaaacaaacaaaaaaacaaaaa

SEQ ID NO: 511054 - RNA, 26 nt, Human
caaaacaaacaaaaaaacaaaaaaga

SEQ ID NO: 511055 - RNA, 18 nt, Human
caaaacaacuccaagggu

SEQ ID NO: 511056 - RNA, 19 nt, Human
caaacaauacccagccucc

SEQ ID NO: 511057 - RNA, 22 nt, Human
caaacaauacccagccucccuc

SEQ ID NO: 511058 - RNA, 19 nt, Human
caacccucagcaggaaucu

SEQ ID NO: 511059 - RNA, 21 nt, Human
cacaacauccaguugugcccc

SEQ ID NO: 511060 - RNA, 25 nt, Human
cacacccacucgcucagguuggaaa

SEQ ID NO: 511061 - RNA, 18 nt, Human
caccaucuuugcacacac

SEQ ID NO: 511062 - RNA, 23 nt, Human
caccaucuuugcacacacaccca

SEQ ID NO: 511063 - RNA, 19 nt, Human
caccccugucccggccccg

SEQ ID NO: 511064 - RNA, 23 nt, Human
caccccugucccggccccggggg

SEQ ID NO: 511065 - RNA, 18 nt, Human
cacugagcacaaggacuc

SEQ ID NO: 511066 - RNA, 25 nt, Human
cagcaggugccuugugugcauaccu

SEQ ID NO: 511067 - RNA, 19 nt, Human
cagccauugugcgcgccug

SEQ ID NO: 511068 - RNA, 19 nt, Human
cagcugccacuccagcagg

SEQ ID NO: 511069 - RNA, 19 nt, Human
caggacacuugaguccucc

SEQ ID NO: 511070 - RNA, 19 nt, Human
caggagagacacaagcccc

SEQ ID NO: 511071 - RNA, 23 nt, Human
caggagagacacaagccccaaga

SEQ ID NO: 511072 - RNA, 23 nt, Human
caguagggcucaguugccuggag

SEQ ID NO: 511073 - RNA, 18 nt, Human
cauagccuuuggccaagu

SEQ ID NO: 511074 - RNA, 25 nt, Human
cauuccaacuaucucaaaaucuugu

SEQ ID NO: 511075 - RNA, 19 nt, Human
ccacagcaagccggugcug

SEQ ID NO: 511076 - RNA, 21 nt, Human
ccagcccagcagccucaaccc

SEQ ID NO: 511077 - RNA, 22 nt, Human
ccagcccagcagccucaacccu

SEQ ID NO: 511078 - RNA, 22 nt, Human
ccaugcuaaucccuuaaaguca

SEQ ID NO: 511079 - RNA, 21 nt, Human
cccacaacauccaguugugcc

SEQ ID NO: 511080 - RNA, 23 nt, Human
cccaggcacuucuguucugagca

SEQ ID NO: 511081 - RNA, 23 nt, Human
ccccgggggccaagggccugccc

SEQ ID NO: 511082 - RNA, 22 nt, Human
ccccugucccggccccgggggc

SEQ ID NO: 511083 - RNA, 21 nt, Human
ccccugugggacaauggaggc

SEQ ID NO: 511084 - RNA, 19 nt, Human
cccgcgcgccucucccucc

SEQ ID NO: 511085 - RNA, 18 nt, Human
cccuucgugcccaggccu

SEQ ID NO: 511086 - RNA, 24 nt, Human
ccggugcugugugcucccaauucc

SEQ ID NO: 511087 - RNA, 19 nt, Human
ccucccagccugcccuggc

SEQ ID NO: 511088 - RNA, 23 nt, Human
ccuccugucuccuucugcauucc

SEQ ID NO: 511089 - RNA, 21 nt, Human
ccucucccuccaguaccucuu

SEQ ID NO: 511090 - RNA, 23 nt, Human
ccugcaagcccuguguuccuugc

SEQ ID NO: 511091 - RNA, 23 nt, Human
ccugcccuggccaucaccccagc

SEQ ID NO: 511092 - RNA, 18 nt, Human
ccugucaccaaagaggag

SEQ ID NO: 511093 - RNA, 23 nt, Human
cgacgguuccccacugcucccag

SEQ ID NO: 511094 - RNA, 24 nt, Human
cgcaccaucuuugcacacacaccc

SEQ ID NO: 511095 - RNA, 19 nt, Human
cgcagauccgugacucgca

SEQ ID NO: 511096 - RNA, 20 nt, Human
cgcuccccaccaaggcauug

SEQ ID NO: 511097 - RNA, 23 nt, Human
cgggaauccugcuccccugccga

SEQ ID NO: 511098 - RNA, 18 nt, Human
cucaagaguugaagcauc

SEQ ID NO: 511099 - RNA, 19 nt, Human
cucaagaguugaagcaucc

SEQ ID NO: 511100 - RNA, 21 nt, Human
cuccagcccagcagccucaac

SEQ ID NO: 511101 - RNA, 23 nt, Human
cuccagcccagcagccucaaccc

SEQ ID NO: 511102 - RNA, 23 nt, Human
cuccaguaccucuugugugcacu

SEQ ID NO: 511103 - RNA, 18 nt, Human
cuccuguccagagaagau

SEQ ID NO: 511104 - RNA, 21 nt, Human
cugcaagcccuguguuccuug

SEQ ID NO: 511105 - RNA, 20 nt, Human
cugcuccccugccgagaccu

SEQ ID NO: 511106 - RNA, 21 nt, Human
cugcuccccugccgagaccuc

SEQ ID NO: 511107 - RNA, 24 nt, Human
cugucaccaaagaggagggggccc

SEQ ID NO: 511108 - RNA, 29 nt, Human
cuucaaaacaaacaaaaaaacaaaaaaga

SEQ ID NO: 511109 - RNA, 23 nt, Human
cuucgugcccaggccugggccuc

SEQ ID NO: 511110 - RNA, 23 nt, Human
cuuggggcuccgggccagggaga

SEQ ID NO: 511111 - RNA, 21 nt, Human
gaaucccaaagcugucaccuc

SEQ ID NO: 511112 - RNA, 21 nt, Human
gacacuuggcaucaguggugu

SEQ ID NO: 511113 - RNA, 27 nt, Human
gagaagaguaggaggaugccgguaccc

SEQ ID NO: 511114 - RNA, 21 nt, Human
gagaaggggacauuacaaugc

SEQ ID NO: 511115 - RNA, 19 nt, Human
gagggggccagccucaucc

SEQ ID NO: 511116 - RNA, 20 nt, Human
gcacuucuguucugagcaac

SEQ ID NO: 511117 - RNA, 19 nt, Human
gccagggagagaaggggac

SEQ ID NO: 511118 - RNA, 25 nt, Human
gcccgcuccccaccaaggcauugcc

SEQ ID NO: 511119 - RNA, 21 nt, Human
gccugagcaggacaaggaccc

SEQ ID NO: 511120 - RNA, 19 nt, Human
gccuggagccugcucaucc

SEQ ID NO: 511121 - RNA, 18 nt, Human
gccuugugugcauaccug

SEQ ID NO: 511122 - RNA, 22 nt, Human
gcucagccagugcacugagcac

SEQ ID NO: 511123 - RNA, 18 nt, Human
ggacaauggaggccucuc

SEQ ID NO: 511124 - RNA, 19 nt, Human
ggaggcuuccugucaccaa

SEQ ID NO: 511125 - RNA, 21 nt, Human
ggaguuuggguuugguuucuc

SEQ ID NO: 511126 - RNA, 22 nt, Human
ggaguuuggguuugguuucucu

SEQ ID NO: 511127 - RNA, 20 nt, Human
ggaugcacagucugcauuua

SEQ ID NO: 511128 - RNA, 18 nt, Human
gggcaccggggaugcaca

SEQ ID NO: 511129 - RNA, 23 nt, Human
gggcaccggggaugcacagucug

SEQ ID NO: 511130 - RNA, 26 nt, Human
gggcacucugugucugucccgucccc

SEQ ID NO: 511131 - RNA, 22 nt, Human
gggcagggaugccugagcagga

SEQ ID NO: 511132 - RNA, 20 nt, Human
gggggccaagggccugccag

SEQ ID NO: 511133 - RNA, 24 nt, Human
guaccacagcaagccggugcugug

SEQ ID NO: 511134 - RNA, 22 nt, Human
gucacccuuccugcgcagaucc

SEQ ID NO: 511135 - RNA, 19 nt, Human
guggggcccaggagcaggg

SEQ ID NO: 511136 - RNA, 20 nt, Human
uaaaaccagagaucccagac

SEQ ID NO: 511137 - RNA, 24 nt, Human
uaaaaccagagaucccagaccucc

SEQ ID NO: 511138 - RNA, 24 nt, Human
ucagaagucggauaaaaccagaga

SEQ ID NO: 511139 - RNA, 23 nt, Human
ucagcugccccucagguccucaa

SEQ ID NO: 511140 - RNA, 18 nt, Human
uccaugggaggcuuccug

SEQ ID NO: 511141 - RNA, 21 nt, Human
ucccauugaucuaugugucua

SEQ ID NO: 511142 - RNA, 18 nt, Human
uccccacugcucccagga

SEQ ID NO: 511143 - RNA, 18 nt, Human
ucccuguugccacugccc

SEQ ID NO: 511144 - RNA, 23 nt, Human
uccuauggaaaguaugucccucc

SEQ ID NO: 511145 - RNA, 18 nt, Human
uccugagggcaccgggga

SEQ ID NO: 511146 - RNA, 18 nt, Human
uccuggaugaguucgugc

SEQ ID NO: 511147 - RNA, 21 nt, Human
ucgcucagguuggaaagaugc

SEQ ID NO: 511148 - RNA, 20 nt, Human
ucguguugagggcccuccug

SEQ ID NO: 511149 - RNA, 18 nt, Human
ucucccuccaguaccucu

SEQ ID NO: 511150 - RNA, 23 nt, Human
ucucccuguugccacugccccug

SEQ ID NO: 511151 - RNA, 22 nt, Human
ucucuguggggcccaggagcag

SEQ ID NO: 511152 - RNA, 20 nt, Human
ugaaauacacaaacaauacc

SEQ ID NO: 511153 - RNA, 21 nt, Human
ugaagcauccgacgguucccc

SEQ ID NO: 511154 - RNA, 20 nt, Human
ugagcaggacaaggacccca

SEQ ID NO: 511155 - RNA, 18 nt, Human
ugcccagaggucagaagu

SEQ ID NO: 511156 - RNA, 20 nt, Human
ugcccaggccugggccucug

SEQ ID NO: 511157 - RNA, 21 nt, Human
ugcccaggccugggccucugc

SEQ ID NO: 511158 - RNA, 20 nt, Human
ugccccagacuccuguccag

SEQ ID NO: 511159 - RNA, 21 nt, Human
ugcccuggccaucaccccagc

SEQ ID NO: 511160 - RNA, 19 nt, Human
ugccugagcaggacaagga

SEQ ID NO: 511161 - RNA, 22 nt, Human
ugcugugugcucccaauuccag

SEQ ID NO: 511162 - RNA, 20 nt, Human
uggcagcuaaggcggaugcu

SEQ ID NO: 511163 - RNA, 26 nt, Human
ugggccagaaccaggucuuggagaga

SEQ ID NO: 511164 - RNA, 20 nt, Human
ugugugcauaccuggccaug

SEQ ID NO: 511165 - RNA, 18 nt, Human
uguucuucccgcgcgccu

SEQ ID NO: 511166 - RNA, 22 nt, Human
uguuuugguuaccaugcacuug

SEQ ID NO: 511167 - RNA, 18 nt, Human
uuagagcccagcucucaa

SEQ ID NO: 511168 - RNA, 20 nt, Human
uugugugcacugcccgcucc

SEQ ID NO: 511169 - RNA, 20 nt, Human
aagccugcgguugauccugg

SEQ ID NO: 511170 - RNA, 19 nt, Human
aauguccuugcaagacuga

SEQ ID NO: 511171 - RNA, 21 nt, Human
caagauggagucccuccucuc

SEQ ID NO: 511172 - RNA, 21 nt, Human
cacaaagaaucaaaaaugcag

SEQ ID NO: 511173 - RNA, 19 nt, Human
cagugcagccaugccaggc

SEQ ID NO: 511174 - RNA, 25 nt, Human
ccucucaugauccagccacaaaggc

SEQ ID NO: 511175 - RNA, 18 nt, Human
gaguccuugggaagguuc

SEQ ID NO: 511176 - RNA, 21 nt, Human
gugcagccaugccaggcuggg

SEQ ID NO: 511177 - RNA, 18 nt, Human
uacagugcagccaugcca

SEQ ID NO: 511178 - RNA, 21 nt, Human
uauuuuuuccaugacuuuuuc

SEQ ID NO: 511179 - RNA, 18 nt, Human
uccaugacuuuuuccucc

SEQ ID NO: 511180 - RNA, 18 nt, Human
uccuugggaagguuccag

SEQ ID NO: 511181 - RNA, 21 nt, Human
ugaccaagggacugaagaaag

SEQ ID NO: 511182 - RNA, 26 nt, Human
ugaccaagggacugaagaaagccugc

SEQ ID NO: 511183 - RNA, 19 nt, Human
ugaguccuugggaagguuc

SEQ ID NO: 511184 - RNA, 23 nt, Human
ugccaggcugggggacauggcuc

SEQ ID NO: 511185 - RNA, 18 nt, Human
ugggggacauggcucaag

SEQ ID NO: 511186 - RNA, 20 nt, Human
ugggggacauggcucaagau

SEQ ID NO: 511187 - RNA, 19 nt, Human
aagaaugaaguugcagacc

SEQ ID NO: 511188 - RNA, 24 nt, Human
aagcuucacagcguggaagggaac

SEQ ID NO: 511189 - RNA, 19 nt, Human
aaguugcagacccuugcgg

SEQ ID NO: 511190 - RNA, 19 nt, Human
aaguugcagaccuucgcgg

SEQ ID NO: 511191 - RNA, 23 nt, Human
accaaaagaacaaagcuucacag

SEQ ID NO: 511192 - RNA, 18 nt, Human
acccaacgagugagcagc

SEQ ID NO: 511193 - RNA, 19 nt, Human
agcuacgcagccgccccca

SEQ ID NO: 511194 - RNA, 25 nt, Human
agcuacgcagccgcccccacuccuc

SEQ ID NO: 511195 - RNA, 19 nt, Human
aguaagcccccaaauugcu

SEQ ID NO: 511196 - RNA, 18 nt, Human
caaaugaucaccuagaca

SEQ ID NO: 511197 - RNA, 19 nt, Human
caaaugaucaccuagacac

SEQ ID NO: 511198 - RNA, 21 nt, Human
caaaugaucaccuagacaccc

SEQ ID NO: 511199 - RNA, 22 nt, Human
cagacucugcuccagauccaaa

SEQ ID NO: 511200 - RNA, 24 nt, Human
cagauccaaaugaucaccuagaca

SEQ ID NO: 511201 - RNA, 23 nt, Human
cagcuacgcagccgcccccacuc

SEQ ID NO: 511202 - RNA, 18 nt, Human
cccucaggcuccugggcu

SEQ ID NO: 511203 - RNA, 26 nt, Human
cuccugggcugggaccacagcuacgc

SEQ ID NO: 511204 - RNA, 20 nt, Human
cuggcagaauggcagacucu

SEQ ID NO: 511205 - RNA, 18 nt, Human
gaaugaaguugcagaccc

SEQ ID NO: 511206 - RNA, 19 nt, Human
gcagacccuugcggugagu

SEQ ID NO: 511207 - RNA, 18 nt, Human
gcagccgcccccacuccu

SEQ ID NO: 511208 - RNA, 23 nt, Human
ggaccacagcuacgcagccgccc

SEQ ID NO: 511209 - RNA, 24 nt, Human
uauuacgguucuuaaagauggugu

SEQ ID NO: 511210 - RNA, 21 nt, Human
ucaggcuccugggcugggacc

SEQ ID NO: 511211 - RNA, 20 nt, Human
ucucacugcuuggcaauagu

SEQ ID NO: 511212 - RNA, 20 nt, Human
ugcuccagauccaaaugauc

SEQ ID NO: 511213 - RNA, 23 nt, Human
uggcaauagucucaccacuuggu

SEQ ID NO: 511214 - RNA, 23 nt, Human
uggcaauagucucacugcuuggc

SEQ ID NO: 511215 - RNA, 23 nt, Human
uggcagaauggcagacucugcuc

SEQ ID NO: 511216 - RNA, 26 nt, Human
uuggcgauaggugauagucucaccgc

SEQ ID NO: 511217 - RNA, 28 nt, Human
uuggugauaggugacagucucuucaaag

SEQ ID NO: 511218 - RNA, 27 nt, Human
uuguucauuccucucggugcauucgug

SEQ ID NO: 511219 - RNA, 22 nt, Human
aaacaaacaggagaucuaacag

SEQ ID NO: 511220 - RNA, 20 nt, Human
aaacaggagaucuaacaggc

SEQ ID NO: 511221 - RNA, 25 nt, Human
aaagaagaaaaucacauuucuaaaa

SEQ ID NO: 511222 - RNA, 18 nt, Human
aacagccaugcagccccc

SEQ ID NO: 511223 - RNA, 25 nt, Human
aagaacuuccgacagagcagcacac

SEQ ID NO: 511224 - RNA, 25 nt, Human
aagcaguucucaaaggcaccuccca

SEQ ID NO: 511225 - RNA, 18 nt, Human
aaggcaccucccacgcuc

SEQ ID NO: 511226 - RNA, 20 nt, Human
acacugcugcugcugcaagc

SEQ ID NO: 511227 - RNA, 21 nt, Human
acagauagaucaucaaaaaca

SEQ ID NO: 511228 - RNA, 23 nt, Human
acaggaagacugcugagaggaug

SEQ ID NO: 511229 - RNA, 22 nt, Human
acaggagaaacagcaguugcag

SEQ ID NO: 511230 - RNA, 29 nt, Human
accucuuccugccccuccccucccccaag

SEQ ID NO: 511231 - RNA, 20 nt, Human
agaagaaaaccaccuuggag

SEQ ID NO: 511232 - RNA, 24 nt, Human
agagaagaaaaccaccuuggagga

SEQ ID NO: 511233 - RNA, 19 nt, Human
agagagcaagugugcuuug

SEQ ID NO: 511234 - RNA, 21 nt, Human
agagcaagugugcuuuggggg

SEQ ID NO: 511235 - RNA, 22 nt, Human
agccaugcagcccccacccccc

SEQ ID NO: 511236 - RNA, 19 nt, Human
aggaaaccugaaauagcug

SEQ ID NO: 511237 - RNA, 19 nt, Human
aggaaaccugaaauagcug

SEQ ID NO: 511238 - RNA, 20 nt, Human
aggaaaccugaaauagcugu

SEQ ID NO: 511239 - RNA, 22 nt, Human
aggcaccucccacgcucuaaac

SEQ ID NO: 511240 - RNA, 21 nt, Human
aguuauacuccucacagguca

SEQ ID NO: 511241 - RNA, 23 nt, Human
auaaauacucuaauagcuuaaaa

SEQ ID NO: 511242 - RNA, 21 nt, Human
augaagauaaauacucuaaua

SEQ ID NO: 511243 - RNA, 19 nt, Human
augcagcccccaccccccc

SEQ ID NO: 511244 - RNA, 24 nt, Human
auggcagagcaauuaagcugagug

SEQ ID NO: 511245 - RNA, 24 nt, Human
auguucugccaacugaaacaaaca

SEQ ID NO: 511246 - RNA, 24 nt, Human
auuauacaugcuacccugacgacg

SEQ ID NO: 511247 - RNA, 24 nt, Human
caagcccugcauaggagggacagg

SEQ ID NO: 511248 - RNA, 21 nt, Human
caagcuaacacaggaaaccug

SEQ ID NO: 511249 - RNA, 19 nt, Human
cacccccccaggcaggccc

SEQ ID NO: 511250 - RNA, 21 nt, Human
cagaaaaggcugaagaaaacu

SEQ ID NO: 511251 - RNA, 23 nt, Human
cagaguggguggcuuacuguugg

SEQ ID NO: 511252 - RNA, 21 nt, Human
cagcaguugcaggagguggcc

SEQ ID NO: 511253 - RNA, 18 nt, Human
cagccaccauccuauccc

SEQ ID NO: 511254 - RNA, 21 nt, Human
cagccaugcagcccccacccc

SEQ ID NO: 511255 - RNA, 27 nt, Human
cagcccccacccccccaggcaggcccc

SEQ ID NO: 511256 - RNA, 18 nt, Human
cagcugcuccucccgcag

SEQ ID NO: 511257 - RNA, 18 nt, Human
ccacacugcugcugcugc

SEQ ID NO: 511258 - RNA, 21 nt, Human
ccaccauccuauccccaagcu

SEQ ID NO: 511259 - RNA, 23 nt, Human
ccacccaacagccaugcagcccc

SEQ ID NO: 511260 - RNA, 18 nt, Human
ccacuuuggaccaucuga

SEQ ID NO: 511261 - RNA, 20 nt, Human
ccacuuuggaccaucugauc

SEQ ID NO: 511262 - RNA, 18 nt, Human
ccaggugggaauuaagaa

SEQ ID NO: 511263 - RNA, 18 nt, Human
ccaguccucccucccacc

SEQ ID NO: 511264 - RNA, 18 nt, Human
ccaguccucccucccacc

SEQ ID NO: 511265 - RNA, 20 nt, Human
ccaugcagcccccacccccc

SEQ ID NO: 511266 - RNA, 20 nt, Human
ccccaaagaugugauuggcu

SEQ ID NO: 511267 - RNA, 21 nt, Human
ccccaaagaugugauuggcuu

SEQ ID NO: 511268 - RNA, 23 nt, Human
ccccacccccccaggcaggccca

SEQ ID NO: 511269 - RNA, 23 nt, Human
cccccacccccccaggcaggccc

SEQ ID NO: 511270 - RNA, 20 nt, Human
ccuauccccaagcuaacaca

SEQ ID NO: 511271 - RNA, 18 nt, Human
cuauccccaagcuaacac

SEQ ID NO: 511272 - RNA, 21 nt, Human
cuauccccaagcuaacacagg

SEQ ID NO: 511273 - RNA, 20 nt, Human
cucacaggucaaaagaagaa

SEQ ID NO: 511274 - RNA, 18 nt, Human
cuccagaguggguggcuu

SEQ ID NO: 511275 - RNA, 18 nt, Human
cugcagcuccuucugccu

SEQ ID NO: 511276 - RNA, 19 nt, Human
cugcugcugcaagcccugc

SEQ ID NO: 511277 - RNA, 22 nt, Human
cugcugcugcugcaagcccugc

SEQ ID NO: 511278 - RNA, 19 nt, Human
cuggcugcuacccagcugg

SEQ ID NO: 511279 - RNA, 22 nt, Human
cuucccagggcagagaagccug

SEQ ID NO: 511280 - RNA, 23 nt, Human
cuucugguugucugauggccuuu

SEQ ID NO: 511281 - RNA, 19 nt, Human
gaacugaaccagaaaaggc

SEQ ID NO: 511282 - RNA, 20 nt, Human
gaacugaaccagaaaaggcu

SEQ ID NO: 511283 - RNA, 23 nt, Human
gaacugaaccagaaaaggcugaa

SEQ ID NO: 511284 - RNA, 21 nt, Human
gacaagggaacugaaccagaa

SEQ ID NO: 511285 - RNA, 24 nt, Human
gacacacagcugcuccucccgcag

SEQ ID NO: 511286 - RNA, 24 nt, Human
gacaggaagacugcugagaggaug

SEQ ID NO: 511287 - RNA, 19 nt, Human
gagaaacagcaguugcagg

SEQ ID NO: 511288 - RNA, 19 nt, Human
gagugaggugccggggaca

SEQ ID NO: 511289 - RNA, 18 nt, Human
gauucugugacuccagag

SEQ ID NO: 511290 - RNA, 19 nt, Human
ggcacuaucagugggaguu

SEQ ID NO: 511291 - RNA, 21 nt, Human
ggcgggugacaggaagacugc

SEQ ID NO: 511292 - RNA, 21 nt, Human
gggaguuuucaggaagccaag

SEQ ID NO: 511293 - RNA, 23 nt, Human
ggguacagaucgaguuauuuaag

SEQ ID NO: 511294 - RNA, 19 nt, Human
guacauguugcuuuguggg

SEQ ID NO: 511295 - RNA, 21 nt, Human
gugaguuauugggagaccaga

SEQ ID NO: 511296 - RNA, 24 nt, Human
uaaaacccucgauguauaacacac

SEQ ID NO: 511297 - RNA, 23 nt, Human
uaacacgcucucacaugcacgua

SEQ ID NO: 511298 - RNA, 20 nt, Human
uaagagaagaaaaccaccuu

SEQ ID NO: 511299 - RNA, 23 nt, Human
uagaagacacguauaauggaaca

SEQ ID NO: 511300 - RNA, 23 nt, Human
uagcaaggcuccuaacaggccag

SEQ ID NO: 511301 - RNA, 21 nt, Human
uaggagaucauggagucaagc

SEQ ID NO: 511302 - RNA, 23 nt, Human
uaggagggacaggagaaacagca

SEQ ID NO: 511303 - RNA, 24 nt, Human
ucaaaguauuucauuaaggugcaa

SEQ ID NO: 511304 - RNA, 21 nt, Human
ucacaggucaaaagaagaaaa

SEQ ID NO: 511305 - RNA, 21 nt, Human
uccacuuuggaccaucugauc

SEQ ID NO: 511306 - RNA, 18 nt, Human
ucccagggaugcugagug

SEQ ID NO: 511307 - RNA, 18 nt, Human
ucccagggcagagaagcc

SEQ ID NO: 511308 - RNA, 21 nt, Human
ucccagggcagagaagccugc

SEQ ID NO: 511309 - RNA, 19 nt, Human
uccccaagcuaacacagga

SEQ ID NO: 511310 - RNA, 25 nt, Human
uccccaagcuaacacaggaaaccug

SEQ ID NO: 511311 - RNA, 18 nt, Human
ucccugugcugacacugc

SEQ ID NO: 511312 - RNA, 23 nt, Human
ucccugugcugacacugccaccc

SEQ ID NO: 511313 - RNA, 21 nt, Human
uccugccccuccccuccccca

SEQ ID NO: 511314 - RNA, 22 nt, Human
ucuccagccaccauccuauccc

SEQ ID NO: 511315 - RNA, 20 nt, Human
ugaaacgcccucuuaaggac

SEQ ID NO: 511316 - RNA, 20 nt, Human
ugaaauagcuguaauuuggc

SEQ ID NO: 511317 - RNA, 22 nt, Human
ugacacugccacccaacagcca

SEQ ID NO: 511318 - RNA, 18 nt, Human
ugagagagcaagugugcu

SEQ ID NO: 511319 - RNA, 24 nt, Human
ugagaggaugaugccacaguuggg

SEQ ID NO: 511320 - RNA, 23 nt, Human
ugaguuuauuugcuuguauuuaa

SEQ ID NO: 511321 - RNA, 19 nt, Human
ugcauaggagggacaggag

SEQ ID NO: 511322 - RNA, 20 nt, Human
ugcuggagagcuccaacucu

SEQ ID NO: 511323 - RNA, 23 nt, Human
ugcuucugguugucugauggccu

SEQ ID NO: 511324 - RNA, 19 nt, Human
ugggggauggagauggcca

SEQ ID NO: 511325 - RNA, 21 nt, Human
ugggggauggagauggccaca

SEQ ID NO: 511326 - RNA, 21 nt, Human
uggguggcuuacuguuggugg

SEQ ID NO: 511327 - RNA, 23 nt, Human
ugucacgauauccucacuuaaaa

SEQ ID NO: 511328 - RNA, 26 nt, Human
uguggcauauacauguuugugacacu

SEQ ID NO: 511329 - RNA, 22 nt, Human
uuagaagacacguauaauggaa

SEQ ID NO: 511330 - RNA, 18 nt, Human
uucaucgccaccuucagc

SEQ ID NO: 511331 - RNA, 22 nt, Human
uucucaccucuuccugccccuc

SEQ ID NO: 511332 - RNA, 19 nt, Human
uuggaccaucugaucuucu

SEQ ID NO: 511333 - RNA, 20 nt, Human
uuuaagagaagaaaaccacc

SEQ ID NO: 511334 - RNA, 18 nt, Human
uuugcuuguauuuaaaau

SEQ ID NO: 511335 - RNA, 23 nt, Human
ggacaauaugguaacuggccccc

SEQ ID NO: 511336 - RNA, 20 nt, Human
uuccugaaugucaaggaccc

SEQ ID NO: 511337 - RNA, 26 nt, Human
aaaaaucugucccuuacuaucaggug

SEQ ID NO: 511338 - RNA, 20 nt, Human
aaacucaaaaaaaaaaaaac

SEQ ID NO: 511339 - RNA, 22 nt, Human
acucaaaaaaaaaaaaacaaaa

SEQ ID NO: 511340 - RNA, 28 nt, Human
acucaaaaaaaaaaaaacaaaaccuguc

SEQ ID NO: 511341 - RNA, 18 nt, Human
agaucagagauuaaagac

SEQ ID NO: 511342 - RNA, 24 nt, Human
aucauccuagggacugcuggaggu

SEQ ID NO: 511343 - RNA, 27 nt, Human
caaaaaacuaaaacuacaauuaguucc

SEQ ID NO: 511344 - RNA, 20 nt, Human
caacagccuagaaggcaaaa

SEQ ID NO: 511345 - RNA, 18 nt, Human
caacuacugcaggacugg

SEQ ID NO: 511346 - RNA, 19 nt, Human
cacggagagauggagaaga

SEQ ID NO: 511347 - RNA, 22 nt, Human
cagccuagaaggcaaaauuauu

SEQ ID NO: 511348 - RNA, 18 nt, Human
cagugggaacuaccuggc

SEQ ID NO: 511349 - RNA, 20 nt, Human
ccauggccuucuaacacuaa

SEQ ID NO: 511350 - RNA, 20 nt, Human
cuaaaacuacaauuaguucc

SEQ ID NO: 511351 - RNA, 18 nt, Human
cuccucucgaaaaccuua

SEQ ID NO: 511352 - RNA, 19 nt, Human
cugaacugcauuuugacau

SEQ ID NO: 511353 - RNA, 21 nt, Human
cuuuaaauucugccuucaauu

SEQ ID NO: 511354 - RNA, 18 nt, Human
cuuuaagucuuccuuucc

SEQ ID NO: 511355 - RNA, 20 nt, Human
gacuauguggcaucagaaaa

SEQ ID NO: 511356 - RNA, 23 nt, Human
gcaaagcugacauaaacucaaaa

SEQ ID NO: 511357 - RNA, 23 nt, Human
uaaaaaauauccguagacuacau

SEQ ID NO: 511358 - RNA, 23 nt, Human
uaaacucaaaaaaaaaaaaacaa

SEQ ID NO: 511359 - RNA, 22 nt, Human
uaagcuccauggccuucuaaca

SEQ ID NO: 511360 - RNA, 23 nt, Human
ucacagcaugcccaagcuucugc

SEQ ID NO: 511361 - RNA, 23 nt, Human
ucuguuaucuauccuguuaucaa

SEQ ID NO: 511362 - RNA, 18 nt, Human
ugauaaaaaauauccgua

SEQ ID NO: 511363 - RNA, 26 nt, Human
ugccauaaacauuuccaucaguggga

SEQ ID NO: 511364 - RNA, 18 nt, Human
uggaaaaucacagcaugc

SEQ ID NO: 511365 - RNA, 24 nt, Human
uguugcucuugucugaacugcauu

SEQ ID NO: 511366 - RNA, 22 nt, Human
uuaaaaaucugucccuuacuau

SEQ ID NO: 511367 - RNA, 21 nt, Human
uuagagcaacagccuagaagg

SEQ ID NO: 511368 - RNA, 22 nt, Human
uuccacucacuaucaacuuuaa

SEQ ID NO: 511369 - RNA, 22 nt, Human
uuuaaaaugucuucaguauaca

SEQ ID NO: 511370 - RNA, 21 nt, Human
uuuaaacaaagcagaagugag

SEQ ID NO: 511371 - RNA, 24 nt, Human
uuucuuguuuugaauuuuaaaaag

SEQ ID NO: 511372 - RNA, 21 nt, Human
uuuguuuuguuucuuguuuug

SEQ ID NO: 511373 - RNA, 19 nt, Human
uuuugacauugugauagca

SEQ ID NO: 511374 - RNA, 22 nt, Human
aaccaacccaguaugcaaaacg

SEQ ID NO: 511375 - RNA, 24 nt, Human
aaccaacccaguaugcaaaacgca

SEQ ID NO: 511376 - RNA, 22 nt, Human
aagccagggacaggccugagca

SEQ ID NO: 511377 - RNA, 25 nt, Human
accgcagccccagcaaaccaaccca

SEQ ID NO: 511378 - RNA, 24 nt, Human
acgacauuuauccgcgcagacuga

SEQ ID NO: 511379 - RNA, 18 nt, Human
agaagccagggacaggcc

SEQ ID NO: 511380 - RNA, 18 nt, Human
agauuccccucacggccu

SEQ ID NO: 511381 - RNA, 25 nt, Human
agccggccccucacuccccggcccc

SEQ ID NO: 511382 - RNA, 20 nt, Human
aggcucacaggauaaacacc

SEQ ID NO: 511383 - RNA, 19 nt, Human
agggcccagcgaggugggc

SEQ ID NO: 511384 - RNA, 19 nt, Human
aggugggcucagccggccc

SEQ ID NO: 511385 - RNA, 19 nt, Human
auccggucccgcccgcacc

SEQ ID NO: 511386 - RNA, 19 nt, Human
aucucagacccccgccugc

SEQ ID NO: 511387 - RNA, 21 nt, Human
caaacaaguaggccugcuccu

SEQ ID NO: 511388 - RNA, 24 nt, Human
caaggcggggcgccagggagggcc

SEQ ID NO: 511389 - RNA, 20 nt, Human
caaguaggccugcuccucuc

SEQ ID NO: 511390 - RNA, 20 nt, Human
caccagcacccacacaggga

SEQ ID NO: 511391 - RNA, 20 nt, Human
caccagcagcccccagaagc

SEQ ID NO: 511392 - RNA, 20 nt, Human
cacccgcgacacccugaucu

SEQ ID NO: 511393 - RNA, 22 nt, Human
caccuucguuuuacuccaaggg

SEQ ID NO: 511394 - RNA, 18 nt, Human
cacgacauuuauccgcgc

SEQ ID NO: 511395 - RNA, 19 nt, Human
cacgacauuuauccgcgca

SEQ ID NO: 511396 - RNA, 23 nt, Human
cagcagcccccagaagccaggga

SEQ ID NO: 511397 - RNA, 18 nt, Human
cagcccccagaagccagg

SEQ ID NO: 511398 - RNA, 19 nt, Human
cagcccccagaagccaggg

SEQ ID NO: 511399 - RNA, 21 nt, Human
ccaaggaacugaaaauaccac

SEQ ID NO: 511400 - RNA, 21 nt, Human
ccacccgcgacacccugaucu

SEQ ID NO: 511401 - RNA, 24 nt, Human
ccagcacccacacagggaggacac

SEQ ID NO: 511402 - RNA, 22 nt, Human
ccccagaagccagggacaggcc

SEQ ID NO: 511403 - RNA, 22 nt, Human
ccccagcaaaccaacccaguau

SEQ ID NO: 511404 - RNA, 19 nt, Human
cccccagcaccucagacug

SEQ ID NO: 511405 - RNA, 18 nt, Human
cccccgccgcccccgggc

SEQ ID NO: 511406 - RNA, 22 nt, Human
cccccgccgcccccgggcccac

SEQ ID NO: 511407 - RNA, 23 nt, Human
cccgccugcaaagcugugagagc

SEQ ID NO: 511408 - RNA, 24 nt, Human
cccgcgacacccugaucucagacc

SEQ ID NO: 511409 - RNA, 20 nt, Human
cccgcgcgcucgccgccgcc

SEQ ID NO: 511410 - RNA, 20 nt, Human
ccgcgcgcucgccgccgccc

SEQ ID NO: 511411 - RNA, 25 nt, Human
ccggccccucacuccccggcccccg

SEQ ID NO: 511412 - RNA, 21 nt, Human
ccuaacccccagcaccucaga

SEQ ID NO: 511413 - RNA, 19 nt, Human
cgcacaggcucacaggaua

SEQ ID NO: 511414 - RNA, 20 nt, Human
cggcccccgccgcccccggg

SEQ ID NO: 511415 - RNA, 22 nt, Human
cucacaggauaaacaccuucgu

SEQ ID NO: 511416 - RNA, 25 nt, Human
cugaaaauaccaccagcagccccca

SEQ ID NO: 511417 - RNA, 21 nt, Human
cuggugucacuacgaaaaggg

SEQ ID NO: 511418 - RNA, 23 nt, Human
gagcacacaucucuguuaaagcc

SEQ ID NO: 511419 - RNA, 23 nt, Human
gcacaggcucacaggauaaacac

SEQ ID NO: 511420 - RNA, 22 nt, Human
gcagccccagcaaaccaaccca

SEQ ID NO: 511421 - RNA, 18 nt, Human
gcgaaguauccacacacc

SEQ ID NO: 511422 - RNA, 21 nt, Human
gcgcgcucgccgccgcccaag

SEQ ID NO: 511423 - RNA, 18 nt, Human
gcggcauaugcugucacc

SEQ ID NO: 511424 - RNA, 19 nt, Human
ggacacaggugaaggcaga

SEQ ID NO: 511425 - RNA, 20 nt, Human
ggacgaaauccggucccgcc

SEQ ID NO: 511426 - RNA, 22 nt, Human
ggccccucacuccccggccccc

SEQ ID NO: 511427 - RNA, 23 nt, Human
gggagggcccagcgaggugggcu

SEQ ID NO: 511428 - RNA, 24 nt, Human
uaauuaguuaagauuaggccaugc

SEQ ID NO: 511429 - RNA, 23 nt, Human
uaggaaaaucaguaaucuauuca

SEQ ID NO: 511430 - RNA, 21 nt, Human
uauccacacaccaaggaacug

SEQ ID NO: 511431 - RNA, 21 nt, Human
ucagaggugcuccagcccugg

SEQ ID NO: 511432 - RNA, 21 nt, Human
ucagccggccccucacucccc

SEQ ID NO: 511433 - RNA, 26 nt, Human
ucaguaaucuauucauuaaguuuccu

SEQ ID NO: 511434 - RNA, 20 nt, Human
uccacacaccaaggaacuga

SEQ ID NO: 511435 - RNA, 18 nt, Human
uccccggcccccgccgcc

SEQ ID NO: 511436 - RNA, 18 nt, Human
ugaaaauaccaccagcag

SEQ ID NO: 511437 - RNA, 21 nt, Human
ugaccccccacccgcgacacc

SEQ ID NO: 511438 - RNA, 19 nt, Human
ugacuaggaaaaucaguaa

SEQ ID NO: 511439 - RNA, 23 nt, Human
ugagcagauuccccucacggccu

SEQ ID NO: 511440 - RNA, 20 nt, Human
ugggccccaauccaacacag

SEQ ID NO: 511441 - RNA, 23 nt, Human
uguguaaccgcaaaauuuauaua

SEQ ID NO: 511442 - RNA, 19 nt, Human
uuaaagcccagcucgcggc

SEQ ID NO: 511443 - RNA, 22 nt, Human
uugaaguccuaacccccagcac

SEQ ID NO: 511444 - RNA, 19 nt, Human
uuggacaccagcacccaca

SEQ ID NO: 511445 - RNA, 18 nt, Human
uuguggacauaagauccu

SEQ ID NO: 511446 - RNA, 23 nt, Human
uuuccauacaaaaagggcuccac

SEQ ID NO: 511447 - RNA, 20 nt, Human
uuuuguggacauaagauccu

SEQ ID NO: 511448 - RNA, 25 nt, Human
uuuuuuuuuuuuuuccuuacagggg

SEQ ID NO: 511449 - RNA, 22 nt, Human
aaaaaaaaaaaaaaaaagcugg

SEQ ID NO: 511450 - RNA, 18 nt, Human
aaaaaaaaaaaaaaaagc

SEQ ID NO: 511451 - RNA, 22 nt, Human
aaaaaaaaagcuggcguacucg

SEQ ID NO: 511452 - RNA, 19 nt, Human
aaaaaaaccuccuaaaauu

SEQ ID NO: 511453 - RNA, 19 nt, Human
aaaacacaugaaacgcaca

SEQ ID NO: 511454 - RNA, 24 nt, Human
aaaaccuccuaaaauuaaaagccu

SEQ ID NO: 511455 - RNA, 19 nt, Human
aaaccacgcugaccaguga

SEQ ID NO: 511456 - RNA, 19 nt, Human
aaaggaagcccaaguuguc

SEQ ID NO: 511457 - RNA, 20 nt, Human
aaagucaguuuuugauaggu

SEQ ID NO: 511458 - RNA, 28 nt, Human
aaaucauaaaaauucauguugcgauaaa

SEQ ID NO: 511459 - RNA, 29 nt, Human
aaaucauaaaaauucauguugcgauaaau

SEQ ID NO: 511460 - RNA, 23 nt, Human
aacaaaacuggccaacauucccc

SEQ ID NO: 511461 - RNA, 19 nt, Human
aacaaauuguauaagcaca

SEQ ID NO: 511462 - RNA, 22 nt, Human
aagacacaggaccagagaccca

SEQ ID NO: 511463 - RNA, 19 nt, Human
aagcaccuaugagacugug

SEQ ID NO: 511464 - RNA, 24 nt, Human
aagcagaaauggcaagacuaaguc

SEQ ID NO: 511465 - RNA, 26 nt, Human
aagcagaaauggcaagacuaagucca

SEQ ID NO: 511466 - RNA, 19 nt, Human
aagcucccuggagcucugc

SEQ ID NO: 511467 - RNA, 21 nt, Human
aagcuuguuuguuugcaccua

SEQ ID NO: 511468 - RNA, 21 nt, Human
aaggcaauacccuuuaucuua

SEQ ID NO: 511469 - RNA, 21 nt, Human
aaguugauacuaccaaaaauc

SEQ ID NO: 511470 - RNA, 20 nt, Human
aauacaaucauauacuauga

SEQ ID NO: 511471 - RNA, 23 nt, Human
acacacacuuucugugcuucucu

SEQ ID NO: 511472 - RNA, 18 nt, Human
acauggcuagaagcugga

SEQ ID NO: 511473 - RNA, 19 nt, Human
accacgcugaccagugaca

SEQ ID NO: 511474 - RNA, 25 nt, Human
acccugauaacaccaagaacauucu

SEQ ID NO: 511475 - RNA, 22 nt, Human
agagaaaaaaggggaauuuuaa

SEQ ID NO: 511476 - RNA, 18 nt, Human
agaguccguuaaagacag

SEQ ID NO: 511477 - RNA, 18 nt, Human
agagugaaggaggaaguu

SEQ ID NO: 511478 - RNA, 18 nt, Human
agcaccaacaugugaccu

SEQ ID NO: 511479 - RNA, 19 nt, Human
agcauuauaaucauauacu

SEQ ID NO: 511480 - RNA, 18 nt, Human
agcucaccuacuuuggga

SEQ ID NO: 511481 - RNA, 20 nt, Human
agcugcugccuuuuuuuuuu

SEQ ID NO: 511482 - RNA, 21 nt, Human
aggaaaagaccagcaccacca

SEQ ID NO: 511483 - RNA, 22 nt, Human
aggcaauacccuuuaucuuaac

SEQ ID NO: 511484 - RNA, 21 nt, Human
aggcagcaccaacaugugacc

SEQ ID NO: 511485 - RNA, 24 nt, Human
aggggaaaaaaaacuaaauuaaaa

SEQ ID NO: 511486 - RNA, 27 nt, Human
aggguuugagccaaaauagucgacauc

SEQ ID NO: 511487 - RNA, 18 nt, Human
agugaaggaggaaguugg

SEQ ID NO: 511488 - RNA, 18 nt, Human
aguugagcuccuucuucu

SEQ ID NO: 511489 - RNA, 24 nt, Human
auaacaccaagaacauucuacaua

SEQ ID NO: 511490 - RNA, 22 nt, Human
auagggcccauaggggcaugcc

SEQ ID NO: 511491 - RNA, 19 nt, Human
auauauauuuuaacucuga

SEQ ID NO: 511492 - RNA, 22 nt, Human
auauauuuguauguauguaugu

SEQ ID NO: 511493 - RNA, 18 nt, Human
aucauuuaauugcuuugg

SEQ ID NO: 511494 - RNA, 18 nt, Human
auccaguuaccucuguca

SEQ ID NO: 511495 - RNA, 26 nt, Human
aucuugggaucuuuucacauagggcu

SEQ ID NO: 511496 - RNA, 19 nt, Human
augaacacaugcugaauua

SEQ ID NO: 511497 - RNA, 19 nt, Human
auggagcuguuagagauuc

SEQ ID NO: 511498 - RNA, 27 nt, Human
augucaauggaaauuccaugauauacc

SEQ ID NO: 511499 - RNA, 21 nt, Human
auuuucuuuagccuuucauug

SEQ ID NO: 511500 - RNA, 24 nt, Human
caaaacuaaacaaaacuggccaac

SEQ ID NO: 511501 - RNA, 23 nt, Human
caaaagaaaccccucacaauuac

SEQ ID NO: 511502 - RNA, 21 nt, Human
caacugggcuccauccaugcc

SEQ ID NO: 511503 - RNA, 22 nt, Human
caacugggcuccauccaugcca

SEQ ID NO: 511504 - RNA, 19 nt, Human
caaggacuuguuguaauau

SEQ ID NO: 511505 - RNA, 24 nt, Human
caaguccaaauucaaaugucaaug

SEQ ID NO: 511506 - RNA, 19 nt, Human
caccaauaugauaacacuc

SEQ ID NO: 511507 - RNA, 22 nt, Human
caccacauuuacccagggcucc

SEQ ID NO: 511508 - RNA, 18 nt, Human
caccccuuucuccucucu

SEQ ID NO: 511509 - RNA, 23 nt, Human
cacccuuguaaucccacccuuug

SEQ ID NO: 511510 - RNA, 24 nt, Human
cacucucucccuuccccaggagcg

SEQ ID NO: 511511 - RNA, 23 nt, Human
cagauuacagaugaucauucuaa

SEQ ID NO: 511512 - RNA, 21 nt, Human
cagcuggugacacgacugaua

SEQ ID NO: 511513 - RNA, 21 nt, Human
caggacaugaccaagauugug

SEQ ID NO: 511514 - RNA, 22 nt, Human
caggaccagagacccaauguga

SEQ ID NO: 511515 - RNA, 21 nt, Human
cagggccuuguucuucccagu

SEQ ID NO: 511516 - RNA, 22 nt, Human
caguaaauauugaauaagcucc

SEQ ID NO: 511517 - RNA, 23 nt, Human
cagucucacucucucccuucccc

SEQ ID NO: 511518 - RNA, 22 nt, Human
cauugggcuaaccucagggaga

SEQ ID NO: 511519 - RNA, 18 nt, Human
cauuucagacaacuaguu

SEQ ID NO: 511520 - RNA, 18 nt, Human
ccaaaagaaaccccucac

SEQ ID NO: 511521 - RNA, 21 nt, Human
ccaaaagaaaccccucacaau

SEQ ID NO: 511522 - RNA, 22 nt, Human
ccagcaguuggagugugcccau

SEQ ID NO: 511523 - RNA, 21 nt, Human
ccagcccagcaguuggagugu

SEQ ID NO: 511524 - RNA, 19 nt, Human
ccauugggcuaaccucagg

SEQ ID NO: 511525 - RNA, 19 nt, Human
cccaaguugucuccucuuu

SEQ ID NO: 511526 - RNA, 22 nt, Human
cccagucucacucucucccuuc

SEQ ID NO: 511527 - RNA, 22 nt, Human
ccccaauccuaauacacauaaa

SEQ ID NO: 511528 - RNA, 23 nt, Human
ccccaggagcgacugacuccucu

SEQ ID NO: 511529 - RNA, 22 nt, Human
ccccucacaauuacaaauauuu

SEQ ID NO: 511530 - RNA, 22 nt, Human
cuaacaaaugugacccacucuc

SEQ ID NO: 511531 - RNA, 23 nt, Human
cuaaccuuaacaccaacgucuaa

SEQ ID NO: 511532 - RNA, 23 nt, Human
cuaacuuccucuucuucuauuuu

SEQ ID NO: 511533 - RNA, 19 nt, Human
cucacucucucccuucccc

SEQ ID NO: 511534 - RNA, 18 nt, Human
cucacucucugucuuucc

SEQ ID NO: 511535 - RNA, 21 nt, Human
cucagccuaaucucauccccc

SEQ ID NO: 511536 - RNA, 19 nt, Human
cugcugccuuuuuuuuuuu

SEQ ID NO: 511537 - RNA, 23 nt, Human
cuggauacuuauuucuucacauc

SEQ ID NO: 511538 - RNA, 22 nt, Human
cuggccaacauucccuacccca

SEQ ID NO: 511539 - RNA, 21 nt, Human
cugguuccccuucacccucuc

SEQ ID NO: 511540 - RNA, 22 nt, Human
cuucuugcuuccacauagggcc

SEQ ID NO: 511541 - RNA, 22 nt, Human
cuuuuuuaccacucucuccacc

SEQ ID NO: 511542 - RNA, 28 nt, Human
gaacaaauguccagauucauccauccuc

SEQ ID NO: 511543 - RNA, 27 nt, Human
gagcugcugccuuuuuuuuuuuuuuuu

SEQ ID NO: 511544 - RNA, 28 nt, Human
gagcugcugccuuuuuuuuuuuuuuuuu

SEQ ID NO: 511545 - RNA, 21 nt, Human
gauuacuaaaccucagcuaau

SEQ ID NO: 511546 - RNA, 18 nt, Human
gauuucauaauagucuca

SEQ ID NO: 511547 - RNA, 19 nt, Human
gcagcaccaacaugugacc

SEQ ID NO: 511548 - RNA, 18 nt, Human
gcccaaugccauuugagu

SEQ ID NO: 511549 - RNA, 25 nt, Human
gccuguuucuuucuugaauugccaa

SEQ ID NO: 511550 - RNA, 21 nt, Human
gcucuuuaaacguagccuguu

SEQ ID NO: 511551 - RNA, 22 nt, Human
gcugccuuuuuuuuuuuuuuuu

SEQ ID NO: 511552 - RNA, 25 nt, Human
gcuggaacaucagaaaugacucuag

SEQ ID NO: 511553 - RNA, 30 nt, Human
ggaacaaaccuuauaaaacacaugaaacgg

SEQ ID NO: 511554 - RNA, 23 nt, Human
ggacuuguuguaauauuugggaa

SEQ ID NO: 511555 - RNA, 19 nt, Human
ggagaaacaugauuaggga

SEQ ID NO: 511556 - RNA, 21 nt, Human
ggauucaguucuuaauuuccu

SEQ ID NO: 511557 - RNA, 21 nt, Human
ggcaugccugaggaacacccu

SEQ ID NO: 511558 - RNA, 18 nt, Human
ggcccauaggggcaugcc

SEQ ID NO: 511559 - RNA, 20 nt, Human
gggagggggagaaguggagg

SEQ ID NO: 511560 - RNA, 25 nt, Human
ggggagggggagaaguggaggguuu

SEQ ID NO: 511561 - RNA, 22 nt, Human
ggggauguucugaaaagcucua

SEQ ID NO: 511562 - RNA, 24 nt, Human
gggggaagguuggggguuggggga

SEQ ID NO: 511563 - RNA, 28 nt, Human
gggggugggggagguaagggggaagguu

SEQ ID NO: 511564 - RNA, 20 nt, Human
ggguaguuuuuuuuuuuucu

SEQ ID NO: 511565 - RNA, 23 nt, Human
ggguggugauaaagggggugggg

SEQ ID NO: 511566 - RNA, 24 nt, Human
ggguuucuuucauuuauguguuua

SEQ ID NO: 511567 - RNA, 21 nt, Human
guaaaauacacucaggcaaaa

SEQ ID NO: 511568 - RNA, 22 nt, Human
gucugggugacaaugugauggc

SEQ ID NO: 511569 - RNA, 22 nt, Human
guuaaaaaaaaaaaaaaaaaaa

SEQ ID NO: 511570 - RNA, 24 nt, Human
uaaaacacaugaaacgcacaugag

SEQ ID NO: 511571 - RNA, 23 nt, Human
uaaaucagucaauucuucuugcu

SEQ ID NO: 511572 - RNA, 23 nt, Human
uaacaccaacgucuaaccacaug

SEQ ID NO: 511573 - RNA, 25 nt, Human
uaacccacugaaaauauacauacca

SEQ ID NO: 511574 - RNA, 19 nt, Human
uaagugacugucacuuagc

SEQ ID NO: 511575 - RNA, 24 nt, Human
uaagugacugucacuuagcuauac

SEQ ID NO: 511576 - RNA, 23 nt, Human
uaaugaagcuuaaaaggcuaaac

SEQ ID NO: 511577 - RNA, 18 nt, Human
uacacauuucccuguggg

SEQ ID NO: 511578 - RNA, 23 nt, Human
uaccacucucuccaccugccuag

SEQ ID NO: 511579 - RNA, 20 nt, Human
uacuaugauauauaaauaga

SEQ ID NO: 511580 - RNA, 21 nt, Human
uacuaugauauauaaauagau

SEQ ID NO: 511581 - RNA, 24 nt, Human
uacuaugauuucauaauagucuca

SEQ ID NO: 511582 - RNA, 22 nt, Human
uagauuacuaaaccucagcuaa

SEQ ID NO: 511583 - RNA, 23 nt, Human
uaguucucacucuuuucucgggc

SEQ ID NO: 511584 - RNA, 25 nt, Human
uaguucucacucuuuucucgggcuc

SEQ ID NO: 511585 - RNA, 20 nt, Human
uaguuuuuuuuuuuucuuuu

SEQ ID NO: 511586 - RNA, 21 nt, Human
uauacauaccacauacauggu

SEQ ID NO: 511587 - RNA, 22 nt, Human
uauguauguauguaugugugua

SEQ ID NO: 511588 - RNA, 23 nt, Human
uauguauguauguauguguguau

SEQ ID NO: 511589 - RNA, 23 nt, Human
uauguauguauguguguauguac

SEQ ID NO: 511590 - RNA, 21 nt, Human
uauguauguguguauguacgu

SEQ ID NO: 511591 - RNA, 20 nt, Human
uauguguagcauaugcacgc

SEQ ID NO: 511592 - RNA, 18 nt, Human
uauguguguauguacgua

SEQ ID NO: 511593 - RNA, 18 nt, Human
uauguguguauguacgua

SEQ ID NO: 511594 - RNA, 20 nt, Human
uauugguucagacucaccuu

SEQ ID NO: 511595 - RNA, 20 nt, Human
ucaaagaagcagaaauggca

SEQ ID NO: 511596 - RNA, 23 nt, Human
ucaaagaagcagaaauggcaaga

SEQ ID NO: 511597 - RNA, 20 nt, Human
ucaaaucuucccagauuggu

SEQ ID NO: 511598 - RNA, 25 nt, Human
ucaaaucuucccagauugguagacc

SEQ ID NO: 511599 - RNA, 23 nt, Human
ucaagaaaaucauuguugauccc

SEQ ID NO: 511600 - RNA, 18 nt, Human
ucaccacauuuacccagg

SEQ ID NO: 511601 - RNA, 22 nt, Human
ucacucucucccuuccccagga

SEQ ID NO: 511602 - RNA, 23 nt, Human
ucacugggaaguugauacuacca

SEQ ID NO: 511603 - RNA, 27 nt, Human
ucacugggaaguugauacuaccaaaaa

SEQ ID NO: 511604 - RNA, 19 nt, Human
ucagaaaugacucuaacau

SEQ ID NO: 511605 - RNA, 18 nt, Human
ucauugucucuaugcucu

SEQ ID NO: 511606 - RNA, 18 nt, Human
uccaaaagaaaccccuca

SEQ ID NO: 511607 - RNA, 22 nt, Human
uccaugccaaauagagccaagg

SEQ ID NO: 511608 - RNA, 18 nt, Human
uccauugggcuaaccuca

SEQ ID NO: 511609 - RNA, 18 nt, Human
ucccucuucggggcgccc

SEQ ID NO: 511610 - RNA, 22 nt, Human
uccgcacacugggucaacucug

SEQ ID NO: 511611 - RNA, 25 nt, Human
ucggagcugcugccuuuuuuuuuuu

SEQ ID NO: 511612 - RNA, 23 nt, Human
ucuacugauaaucucccaaagca

SEQ ID NO: 511613 - RNA, 19 nt, Human
ucuauugaacaucuuccuc

SEQ ID NO: 511614 - RNA, 20 nt, Human
ucucccagucucacucucuc

SEQ ID NO: 511615 - RNA, 27 nt, Human
ucugcaacugagaagcacauaugugua

SEQ ID NO: 511616 - RNA, 22 nt, Human
ucugccuccucuuuccuagcuu

SEQ ID NO: 511617 - RNA, 20 nt, Human
ucuggccuuguguauguuuc

SEQ ID NO: 511618 - RNA, 20 nt, Human
ucugugcuucucuuucuccc

SEQ ID NO: 511619 - RNA, 18 nt, Human
ucuucaaaggaacaaacc

SEQ ID NO: 511620 - RNA, 23 nt, Human
ugaaacucugugaauuuuccaaa

SEQ ID NO: 511621 - RNA, 18 nt, Human
ugaacacaugcugaauua

SEQ ID NO: 511622 - RNA, 19 nt, Human
ugaagacacaggaccagag

SEQ ID NO: 511623 - RNA, 20 nt, Human
ugaagacacaggaccagaga

SEQ ID NO: 511624 - RNA, 23 nt, Human
ugaauuuucccgaaaggccauac

SEQ ID NO: 511625 - RNA, 19 nt, Human
ugacaugggccuggagaag

SEQ ID NO: 511626 - RNA, 19 nt, Human
ugaccagugacaugggccu

SEQ ID NO: 511627 - RNA, 21 nt, Human
ugacuccucuuuuuucucacu

SEQ ID NO: 511628 - RNA, 18 nt, Human
ugacuucauuaaacaucu

SEQ ID NO: 511629 - RNA, 22 nt, Human
ugacuugggccacauagaaauu

SEQ ID NO: 511630 - RNA, 18 nt, Human
ugagagcacuacauggcu

SEQ ID NO: 511631 - RNA, 20 nt, Human
ugagcagucuuguuuggaua

SEQ ID NO: 511632 - RNA, 21 nt, Human
ugaggugaagacacaggacca

SEQ ID NO: 511633 - RNA, 22 nt, Human
ugauaacacucuuucuacugau

SEQ ID NO: 511634 - RNA, 21 nt, Human
ugauaugguuacuuacucagc

SEQ ID NO: 511635 - RNA, 18 nt, Human
ugcagcagccuucagccu

SEQ ID NO: 511636 - RNA, 21 nt, Human
ugccaaauagagccaaggcaa

SEQ ID NO: 511637 - RNA, 20 nt, Human
ugccagaguuuuuuuuuuuu

SEQ ID NO: 511638 - RNA, 20 nt, Human
ugccuccugagucaguuccc

SEQ ID NO: 511639 - RNA, 20 nt, Human
ugccuccugagucaguuccc

SEQ ID NO: 511640 - RNA, 18 nt, Human
ugcuaucugucuguggug

SEQ ID NO: 511641 - RNA, 29 nt, Human
ugcugccuuuuuuuuuuuuuuuuuuuuuu

SEQ ID NO: 511642 - RNA, 20 nt, Human
uggaacagagcugggucugu

SEQ ID NO: 511643 - RNA, 22 nt, Human
uggaacagagcugggucuguua

SEQ ID NO: 511644 - RNA, 25 nt, Human
uggaacaucagaaaugacucuaaca

SEQ ID NO: 511645 - RNA, 18 nt, Human
uggaauggacaaaagauc

SEQ ID NO: 511646 - RNA, 21 nt, Human
uggauacuuauuucuucacau

SEQ ID NO: 511647 - RNA, 22 nt, Human
uggcaaaacuaaacaaaacugg

SEQ ID NO: 511648 - RNA, 21 nt, Human
ugggaucuuuucacauagggc

SEQ ID NO: 511649 - RNA, 19 nt, Human
ugggggcagagauaagccc

SEQ ID NO: 511650 - RNA, 19 nt, Human
ugggucuucgaagucucag

SEQ ID NO: 511651 - RNA, 24 nt, Human
ugguagaccaaccccucagggccu

SEQ ID NO: 511652 - RNA, 22 nt, Human
uguagcauaugcacgcgugcau

SEQ ID NO: 511653 - RNA, 24 nt, Human
uguagcauaugcacgcgugcauuu

SEQ ID NO: 511654 - RNA, 24 nt, Human
uguaguaauuauucagguaagucu

SEQ ID NO: 511655 - RNA, 18 nt, Human
uguauguauguauguaug

SEQ ID NO: 511656 - RNA, 18 nt, Human
uguauguauguaugugug

SEQ ID NO: 511657 - RNA, 22 nt, Human
uguauguguguauguacguaua

SEQ ID NO: 511658 - RNA, 22 nt, Human
ugucagaguccguuaaagacag

SEQ ID NO: 511659 - RNA, 19 nt, Human
uguguguauguacguauaa

SEQ ID NO: 511660 - RNA, 20 nt, Human
uuaaaaaaaaaaaaaaaaaa

SEQ ID NO: 511661 - RNA, 23 nt, Human
uuaacucugacuuuuggccauac

SEQ ID NO: 511662 - RNA, 18 nt, Human
uuagaacauuagaaagcu

SEQ ID NO: 511663 - RNA, 23 nt, Human
uuccagaaauucuugcauguucu

SEQ ID NO: 511664 - RNA, 26 nt, Human
uuccaugauauaccggggguugccuc

SEQ ID NO: 511665 - RNA, 25 nt, Human
uucuacauuacugugcgggcaucuc

SEQ ID NO: 511666 - RNA, 22 nt, Human
uucuucuuuuucuggccuugug

SEQ ID NO: 511667 - RNA, 18 nt, Human
uucuuuagccuuucauug

SEQ ID NO: 511668 - RNA, 21 nt, Human
uugcagcagccuucagccuuc

SEQ ID NO: 511669 - RNA, 20 nt, Human
uuucugugcuucucuuucuc

SEQ ID NO: 511670 - RNA, 22 nt, Human
uuucugugcuucucuuucuccc

SEQ ID NO: 511671 - RNA, 21 nt, Human
uuugugggugguuuuuauaga

SEQ ID NO: 511672 - RNA, 23 nt, Human
uuuucaggauuuaagauguuaaa

SEQ ID NO: 511673 - RNA, 24 nt, Human
uuuuucuggccuuguguauguuuc

SEQ ID NO: 511674 - RNA, 23 nt, Human
uuuuuuuuuuuuuuuuuuucagg

SEQ ID NO: 511675 - RNA, 24 nt, Human
aaccauuucuuaguuucccuccca

SEQ ID NO: 511676 - RNA, 19 nt, Human
acaaaaauagauuauauua

SEQ ID NO: 511677 - RNA, 21 nt, Human
acauuccacaaacgauuguca

SEQ ID NO: 511678 - RNA, 21 nt, Human
acgacaggcacuuaaagcuca

SEQ ID NO: 511679 - RNA, 24 nt, Human
auuacauuccacaaacgauuguca

SEQ ID NO: 511680 - RNA, 22 nt, Human
caucaagauuacauuccacaaa

SEQ ID NO: 511681 - RNA, 22 nt, Human
ccacaaagcaccuaaaauaaca

SEQ ID NO: 511682 - RNA, 23 nt, Human
ccucaaagcagugcucaucaccu

SEQ ID NO: 511683 - RNA, 23 nt, Human
ccuguuugcucuucccccacagg

SEQ ID NO: 511684 - RNA, 21 nt, Human
cugaaaagagaugacauucau

SEQ ID NO: 511685 - RNA, 19 nt, Human
cuguuugcucuucccccac

SEQ ID NO: 511686 - RNA, 22 nt, Human
gauacuggaaacugaaaagaga

SEQ ID NO: 511687 - RNA, 18 nt, Human
gcugaauuauaaauacac

SEQ ID NO: 511688 - RNA, 22 nt, Human
uaaaaaggauacuggaaacuga

SEQ ID NO: 511689 - RNA, 22 nt, Human
uaagaaaaaagacuuaccacaa

SEQ ID NO: 511690 - RNA, 23 nt, Human
uaccacaaagcaccuaaaauaac

SEQ ID NO: 511691 - RNA, 24 nt, Human
uaccacaaagcaccuaaaauaaca

SEQ ID NO: 511692 - RNA, 20 nt, Human
ucccaagucucaguaucaag

SEQ ID NO: 511693 - RNA, 22 nt, Human
uccuguuugcucuucccccaca

SEQ ID NO: 511694 - RNA, 20 nt, Human
ugaaaagagaugacauucau

SEQ ID NO: 511695 - RNA, 19 nt, Human
ugcucaucaccuaacugca

SEQ ID NO: 511696 - RNA, 23 nt, Human
uuaguuucccucccaagucucag

SEQ ID NO: 511697 - RNA, 26 nt, Human
aaaacagagagagaauuacuuaggua

SEQ ID NO: 511698 - RNA, 21 nt, Human
aaguuucuuucuucucccucu

SEQ ID NO: 511699 - RNA, 22 nt, Human
agccacugccgggcgcaguccg

SEQ ID NO: 511700 - RNA, 21 nt, Human
aggcggaggcugcuguggucg

SEQ ID NO: 511701 - RNA, 24 nt, Human
aguuucuuucuucucccucuuuuc

SEQ ID NO: 511702 - RNA, 19 nt, Human
aucaguaguuuagcacugg

SEQ ID NO: 511703 - RNA, 27 nt, Human
cacccuuuauuucuuuucauaauuaca

SEQ ID NO: 511704 - RNA, 21 nt, Human
cagcgcagaauaguccggagc

SEQ ID NO: 511705 - RNA, 20 nt, Human
ccagaagcaggcacagguau

SEQ ID NO: 511706 - RNA, 21 nt, Human
ccggagcagcaggaggcggag

SEQ ID NO: 511707 - RNA, 22 nt, Human
ccggagcagcaggaggcggagg

SEQ ID NO: 511708 - RNA, 25 nt, Human
cgcccucggccuccggaccgcgccu

SEQ ID NO: 511709 - RNA, 19 nt, Human
cggagcagcaggaggcgga

SEQ ID NO: 511710 - RNA, 19 nt, Human
cggccuccggaccgcgccu

SEQ ID NO: 511711 - RNA, 21 nt, Human
gagcagcaggaggcggaggcu

SEQ ID NO: 511712 - RNA, 19 nt, Human
gauacaggguuugaacuuc

SEQ ID NO: 511713 - RNA, 19 nt, Human
ucacacuuccaaccccaga

SEQ ID NO: 511714 - RNA, 23 nt, Human
ucaucgauauaccucuuggcuau

SEQ ID NO: 511715 - RNA, 20 nt, Human
ucgcccgcgaagccacugcc

SEQ ID NO: 511716 - RNA, 22 nt, Human
uguagaguuuuaaaauccccua

SEQ ID NO: 511717 - RNA, 20 nt, Human
ugugauaaucuguaaccuaa

SEQ ID NO: 511718 - RNA, 20 nt, Human
uuagaugugcaauucugagc

SEQ ID NO: 511719 - RNA, 25 nt, Human
uucuucucccucuuuuccuguuaga

SEQ ID NO: 511720 - RNA, 22 nt, Human
uuuagcacuggcacaaaacaga

SEQ ID NO: 511721 - RNA, 23 nt, Human
uuuccagccuccuuuuaaacucc

SEQ ID NO: 511722 - RNA, 21 nt, Human
uuuccaucaucgauauaccuc

SEQ ID NO: 511723 - RNA, 24 nt, Human
aaaaugcuaggauuacaggcauga

SEQ ID NO: 511724 - RNA, 25 nt, Human
aaacacagucauguugauuuguuua

SEQ ID NO: 511725 - RNA, 21 nt, Human
aaaggcacuugccaccacacc

SEQ ID NO: 511726 - RNA, 22 nt, Human
aacuacaauuuaaaagccacua

SEQ ID NO: 511727 - RNA, 22 nt, Human
aagaaaccagucuuugaagauu

SEQ ID NO: 511728 - RNA, 23 nt, Human
aagggugggaccagguggaggua

SEQ ID NO: 511729 - RNA, 22 nt, Human
aaguagcugggauuacaggcau

SEQ ID NO: 511730 - RNA, 18 nt, Human
aaguguccugaggccuca

SEQ ID NO: 511731 - RNA, 24 nt, Human
aaguuuuuguauuuuuaguagaga

SEQ ID NO: 511732 - RNA, 24 nt, Human
acaaaucaggccuuguugaaacac

SEQ ID NO: 511733 - RNA, 22 nt, Human
acagaucccugaaguugcuguu

SEQ ID NO: 511734 - RNA, 20 nt, Human
acagguuuguagguuaggag

SEQ ID NO: 511735 - RNA, 21 nt, Human
accacuaauaaaauacaggaa

SEQ ID NO: 511736 - RNA, 18 nt, Human
accauguuggccaggcug

SEQ ID NO: 511737 - RNA, 20 nt, Human
accauguuggccaggcuggu

SEQ ID NO: 511738 - RNA, 23 nt, Human
accauguuggccaggcuggucuc

SEQ ID NO: 511739 - RNA, 21 nt, Human
acccagcuaaguuuuuguauu

SEQ ID NO: 511740 - RNA, 20 nt, Human
accuugaaaccuuacugcug

SEQ ID NO: 511741 - RNA, 18 nt, Human
acggcguuuuaccauguu

SEQ ID NO: 511742 - RNA, 24 nt, Human
acggcguuuuaccauguuggccag

SEQ ID NO: 511743 - RNA, 18 nt, Human
acugaguccauuaaaccu

SEQ ID NO: 511744 - RNA, 24 nt, Human
acugcaguggugcaaucucggcuc

SEQ ID NO: 511745 - RNA, 23 nt, Human
acugcccuacuucccuuucuucu

SEQ ID NO: 511746 - RNA, 20 nt, Human
acuuuucaaagauacaaaag

SEQ ID NO: 511747 - RNA, 19 nt, Human
agagaaaaaguggggcugg

SEQ ID NO: 511748 - RNA, 18 nt, Human
agauuacaauggagcuga

SEQ ID NO: 511749 - RNA, 19 nt, Human
aggcacuugccaccacacc

SEQ ID NO: 511750 - RNA, 25 nt, Human
aggcuggagugcaguggcgcgaucu

SEQ ID NO: 511751 - RNA, 22 nt, Human
aguagcugaagcacaagaaaau

SEQ ID NO: 511752 - RNA, 23 nt, Human
agugcaguggcgcgaucuuggcu

SEQ ID NO: 511753 - RNA, 24 nt, Human
agugcaguggcgcgaucuuggcuc

SEQ ID NO: 511754 - RNA, 19 nt, Human
auaaaauauaccucaugcc

SEQ ID NO: 511755 - RNA, 22 nt, Human
auacagaccauagccaacaaag

SEQ ID NO: 511756 - RNA, 22 nt, Human
auacuaucuuuggagaauguau

SEQ ID NO: 511757 - RNA, 21 nt, Human
auaggccugugaaguaacacu

SEQ ID NO: 511758 - RNA, 23 nt, Human
auauaucuauauauauauuuuua

SEQ ID NO: 511759 - RNA, 19 nt, Human
aucuugaacuacucaauug

SEQ ID NO: 511760 - RNA, 22 nt, Human
augagaucugaagguuuuauaa

SEQ ID NO: 511761 - RNA, 23 nt, Human
caaaauauuccugaagauauuaa

SEQ ID NO: 511762 - RNA, 20 nt, Human
caaccucugccucccagguu

SEQ ID NO: 511763 - RNA, 22 nt, Human
caagaaauaacacaauagugac

SEQ ID NO: 511764 - RNA, 22 nt, Human
caagcgauucuccugccucagc

SEQ ID NO: 511765 - RNA, 22 nt, Human
caagcgauucuccugccucagc

SEQ ID NO: 511766 - RNA, 21 nt, Human
caauugcuauaccuaaaagga

SEQ ID NO: 511767 - RNA, 18 nt, Human
cacaaguuucugccucag

SEQ ID NO: 511768 - RNA, 24 nt, Human
cacccaggcuggagugcaguggcg

SEQ ID NO: 511769 - RNA, 18 nt, Human
cacugcaaccucugccuc

SEQ ID NO: 511770 - RNA, 21 nt, Human
cacugcaaccucugccuccca

SEQ ID NO: 511771 - RNA, 21 nt, Human
cacugcaacuuccgccuccca

SEQ ID NO: 511772 - RNA, 24 nt, Human
cacuguguuacaacugccuacagu

SEQ ID NO: 511773 - RNA, 19 nt, Human
caguggcgcgaucuuggcu

SEQ ID NO: 511774 - RNA, 20 nt, Human
cauccaggcugaacugcagu

SEQ ID NO: 511775 - RNA, 24 nt, Human
cauguuggccaggcuggucucaaa

SEQ ID NO: 511776 - RNA, 24 nt, Human
ccaaaaugcuaggauuacaggcau

SEQ ID NO: 511777 - RNA, 23 nt, Human
ccaaguagcugggauuacaggca

SEQ ID NO: 511778 - RNA, 24 nt, Human
ccaaguagcugggauuacaggcau

SEQ ID NO: 511779 - RNA, 23 nt, Human
cccaaguagcugggauuacaggc

SEQ ID NO: 511780 - RNA, 24 nt, Human
cccaaguagcugggauuacaggca

SEQ ID NO: 511781 - RNA, 20 nt, Human
cccagguucaagcgauucuc

SEQ ID NO: 511782 - RNA, 20 nt, Human
cccagguucaagcgauucuc

SEQ ID NO: 511783 - RNA, 23 nt, Human
cccagguucaagcgauucuccug

SEQ ID NO: 511784 - RNA, 23 nt, Human
cccagguucaagcgauucuccug

SEQ ID NO: 511785 - RNA, 19 nt, Human
cccuacuucccuuucuucu

SEQ ID NO: 511786 - RNA, 24 nt, Human
ccgccucguccucccaaaaugcua

SEQ ID NO: 511787 - RNA, 19 nt, Human
ccgcgcagaauccuaaccc

SEQ ID NO: 511788 - RNA, 21 nt, Human
ccuacaguaaucaguacagua

SEQ ID NO: 511789 - RNA, 24 nt, Human
ccucccagguucaagcgauucucc

SEQ ID NO: 511790 - RNA, 24 nt, Human
ccucccagguucaagcgauucucc

SEQ ID NO: 511791 - RNA, 21 nt, Human
ccucguccucccaaaaugcua

SEQ ID NO: 511792 - RNA, 26 nt, Human
cgcaaaauuaaucugcuccucaauga

SEQ ID NO: 511793 - RNA, 24 nt, Human
cggcguuuuaccauguuggccagg

SEQ ID NO: 511794 - RNA, 21 nt, Human
cucacucucaucauccaggcu

SEQ ID NO: 511795 - RNA, 24 nt, Human
cucacugcaaccucugccucccag

SEQ ID NO: 511796 - RNA, 24 nt, Human
cucacugcaaccucugccucccag

SEQ ID NO: 511797 - RNA, 24 nt, Human
cucagccucccaaguagcugggau

SEQ ID NO: 511798 - RNA, 20 nt, Human
cucaucauccaggcugaacu

SEQ ID NO: 511799 - RNA, 21 nt, Human
cugaaauuauuaaaauguacu

SEQ ID NO: 511800 - RNA, 24 nt, Human
cugcaaccucugccucccagguuc

SEQ ID NO: 511801 - RNA, 23 nt, Human
cugcaacuuccgccucccagguu

SEQ ID NO: 511802 - RNA, 24 nt, Human
cugcaacuuccgccucccagguuc

SEQ ID NO: 511803 - RNA, 23 nt, Human
cugccgcccugugaaaaaggugc

SEQ ID NO: 511804 - RNA, 23 nt, Human
cugccucagccucccaaguagcu

SEQ ID NO: 511805 - RNA, 18 nt, Human
cugccucagccuccugag

SEQ ID NO: 511806 - RNA, 22 nt, Human
cuggaccaaagacuacucaagu

SEQ ID NO: 511807 - RNA, 21 nt, Human
cuguaccuugaaaccuuacug

SEQ ID NO: 511808 - RNA, 19 nt, Human
cuguguccucacccaaauc

SEQ ID NO: 511809 - RNA, 22 nt, Human
cuuccaguccugccaacuuguu

SEQ ID NO: 511810 - RNA, 18 nt, Human
cuucccuuucuucucuau

SEQ ID NO: 511811 - RNA, 19 nt, Human
cuucccuuucuucucuauu

SEQ ID NO: 511812 - RNA, 22 nt, Human
cuucccuuucuucucuauugca

SEQ ID NO: 511813 - RNA, 24 nt, Human
cuuguucugucacccaggcuggag

SEQ ID NO: 511814 - RNA, 18 nt, Human
cuuuauacaguuccccuc

SEQ ID NO: 511815 - RNA, 21 nt, Human
gaacagaccauaaaccuccau

SEQ ID NO: 511816 - RNA, 24 nt, Human
gacaucgagugauccacccgccuc

SEQ ID NO: 511817 - RNA, 19 nt, Human
gagaaaaaguggggcuggg

SEQ ID NO: 511818 - RNA, 18 nt, Human
gauuacaggcaugagcca

SEQ ID NO: 511819 - RNA, 22 nt, Human
gauuacaggcaugagccaccgc

SEQ ID NO: 511820 - RNA, 23 nt, Human
gauuacaggcaugagccaccgca

SEQ ID NO: 511821 - RNA, 21 nt, Human
gauucuccugccucagccucc

SEQ ID NO: 511822 - RNA, 21 nt, Human
gauucuccugccucagccucc

SEQ ID NO: 511823 - RNA, 22 nt, Human
gcaaccucugccucccagguuc

SEQ ID NO: 511824 - RNA, 19 nt, Human
gcagaauccuaaccccagc

SEQ ID NO: 511825 - RNA, 23 nt, Human
gccaccgcaccuagccggcaaac

SEQ ID NO: 511826 - RNA, 20 nt, Human
gccuaggguagggacauccu

SEQ ID NO: 511827 - RNA, 23 nt, Human
gcgauucuccugccucagccucc

SEQ ID NO: 511828 - RNA, 24 nt, Human
gcgauucuccugccucagccuccc

SEQ ID NO: 511829 - RNA, 18 nt, Human
gcuacagauacuacauug

SEQ ID NO: 511830 - RNA, 21 nt, Human
gcucacugcaaccucugccuc

SEQ ID NO: 511831 - RNA, 21 nt, Human
ggacacagccaugguaacauc

SEQ ID NO: 511832 - RNA, 22 nt, Human
ggauuacaggcaugagccaccg

SEQ ID NO: 511833 - RNA, 23 nt, Human
ggcguuuuaccauguuggccagg

SEQ ID NO: 511834 - RNA, 22 nt, Human
ggggaaaucaaaugaguaaugu

SEQ ID NO: 511835 - RNA, 18 nt, Human
guagcugggauuacaggc

SEQ ID NO: 511836 - RNA, 18 nt, Human
guauaaguguccugaggc

SEQ ID NO: 511837 - RNA, 21 nt, Human
gucucauucaaaagggaauaa

SEQ ID NO: 511838 - RNA, 24 nt, Human
gugauccacccgccucguccuccc

SEQ ID NO: 511839 - RNA, 24 nt, Human
guuuuuguauuuuuaguagagacg

SEQ ID NO: 511840 - RNA, 22 nt, Human
uaaaaacacaaccaucuuucca

SEQ ID NO: 511841 - RNA, 25 nt, Human
uaaauggagauaacaguccuggcuu

SEQ ID NO: 511842 - RNA, 21 nt, Human
uaacaacaaauugugacagag

SEQ ID NO: 511843 - RNA, 22 nt, Human
uaaccaugaacacuaauagcca

SEQ ID NO: 511844 - RNA, 20 nt, Human
uaaccuguauucaaaucccu

SEQ ID NO: 511845 - RNA, 24 nt, Human
uaaguuuuuguauuuuuaguagag

SEQ ID NO: 511846 - RNA, 22 nt, Human
uaauucuguucaacccagaagu

SEQ ID NO: 511847 - RNA, 18 nt, Human
uacaaaagaaauuaaaca

SEQ ID NO: 511848 - RNA, 22 nt, Human
uacacacuaucaacggcagagu

SEQ ID NO: 511849 - RNA, 24 nt, Human
uacaggcauccgccguuacaccca

SEQ ID NO: 511850 - RNA, 22 nt, Human
uacaggcaugagccaccgcacc

SEQ ID NO: 511851 - RNA, 23 nt, Human
uacaguaaucaguacaguaauau

SEQ ID NO: 511852 - RNA, 21 nt, Human
uacaguagugcacaguaauau

SEQ ID NO: 511853 - RNA, 21 nt, Human
uaccauguuggccaggcuggu

SEQ ID NO: 511854 - RNA, 27 nt, Human
uaccauguuggccaggcuggucucaaa

SEQ ID NO: 511855 - RNA, 23 nt, Human
uacccaguuugggguauuucuuc

SEQ ID NO: 511856 - RNA, 22 nt, Human
uagagacggcguuuuaccaugu

SEQ ID NO: 511857 - RNA, 18 nt, Human
uaggauuacaggcaugag

SEQ ID NO: 511858 - RNA, 22 nt, Human
uaggauuacaggcaugagccac

SEQ ID NO: 511859 - RNA, 23 nt, Human
uaggauuacaggcaugagccacc

SEQ ID NO: 511860 - RNA, 24 nt, Human
uaggauuacaggcaugagccaccg

SEQ ID NO: 511861 - RNA, 24 nt, Human
uaggauuacaggcaugagccaccg

SEQ ID NO: 511862 - RNA, 22 nt, Human
uagggacauccuuuccagcuca

SEQ ID NO: 511863 - RNA, 18 nt, Human
uaggguauaccaucuagg

SEQ ID NO: 511864 - RNA, 24 nt, Human
uaguagagacggcguuuuaccaug

SEQ ID NO: 511865 - RNA, 18 nt, Human
uaguaugucuuuauacag

SEQ ID NO: 511866 - RNA, 19 nt, Human
uauaagcgucuggcauuuc

SEQ ID NO: 511867 - RNA, 20 nt, Human
uaucccaaaauauuccugaa

SEQ ID NO: 511868 - RNA, 21 nt, Human
uauguagccuaaguauauagu

SEQ ID NO: 511869 - RNA, 24 nt, Human
ucacccaggcuggagugcaguggc

SEQ ID NO: 511870 - RNA, 19 nt, Human
ucacugcaaccucugccuc

SEQ ID NO: 511871 - RNA, 24 nt, Human
ucacugcaaccucugccucccagg

SEQ ID NO: 511872 - RNA, 25 nt, Human
ucacugcaaccucugccucccaggu

SEQ ID NO: 511873 - RNA, 19 nt, Human
ucacugcaacuuccgccuc

SEQ ID NO: 511874 - RNA, 23 nt, Human
ucacugcaacuuccgccucccag

SEQ ID NO: 511875 - RNA, 24 nt, Human
ucacugcaacuuccgccucccagg

SEQ ID NO: 511876 - RNA, 20 nt, Human
ucagccucccaaguagcugg

SEQ ID NO: 511877 - RNA, 21 nt, Human
ucaguacaguaauaugccaua

SEQ ID NO: 511878 - RNA, 20 nt, Human
uccacugcuggcagucauuu

SEQ ID NO: 511879 - RNA, 24 nt, Human
ucccaaaaugcuaggauuacaggc

SEQ ID NO: 511880 - RNA, 24 nt, Human
ucccaaguagcugggauuacaggc

SEQ ID NO: 511881 - RNA, 21 nt, Human
ucccagguucaagcgauucuc

SEQ ID NO: 511882 - RNA, 21 nt, Human
ucccagguucaagcgauucuc

SEQ ID NO: 511883 - RNA, 24 nt, Human
ucccagguucaagcgauucuccug

SEQ ID NO: 511884 - RNA, 24 nt, Human
ucccagguucaagcgauucuccug

SEQ ID NO: 511885 - RNA, 22 nt, Human
ucccuuucuucucuauugcagg

SEQ ID NO: 511886 - RNA, 19 nt, Human
ucuacaguagugcacagua

SEQ ID NO: 511887 - RNA, 25 nt, Human
ucucacucucaucauccaggcugaa

SEQ ID NO: 511888 - RNA, 24 nt, Human
ucugucacccaggcuggagugcag

SEQ ID NO: 511889 - RNA, 22 nt, Human
ucuuguucugucacccaggcug

SEQ ID NO: 511890 - RNA, 23 nt, Human
ucuuguucugucacccaggcugg

SEQ ID NO: 511891 - RNA, 24 nt, Human
ucuuguucugucacccaggcugga

SEQ ID NO: 511892 - RNA, 23 nt, Human
ugacucacccagagccagcuucc

SEQ ID NO: 511893 - RNA, 21 nt, Human
ugagaacagaccauaaaccuc

SEQ ID NO: 511894 - RNA, 23 nt, Human
ugagaacagaccauaaaccucca

SEQ ID NO: 511895 - RNA, 19 nt, Human
ugaggugggauuaaaggca

SEQ ID NO: 511896 - RNA, 23 nt, Human
ugcaacuuccgccucccagguuc

SEQ ID NO: 511897 - RNA, 24 nt, Human
ugcaagcuccuugaaggcagagau

SEQ ID NO: 511898 - RNA, 18 nt, Human
ugcaguggugcaaucucg

SEQ ID NO: 511899 - RNA, 22 nt, Human
ugcaguggugcaaucucggcuc

SEQ ID NO: 511900 - RNA, 24 nt, Human
ugccucagccucccaaguagcugg

SEQ ID NO: 511901 - RNA, 21 nt, Human
ugccucagccuccugaggugg

SEQ ID NO: 511902 - RNA, 23 nt, Human
uggagugcaguggcgcgaucuug

SEQ ID NO: 511903 - RNA, 24 nt, Human
uggagugcaguggcgcgaucuugg

SEQ ID NO: 511904 - RNA, 18 nt, Human
uggcacuagaaacagaac

SEQ ID NO: 511905 - RNA, 24 nt, Human
uggccaggcuggucucaaacuccu

SEQ ID NO: 511906 - RNA, 22 nt, Human
ugggauuaaaggcacuugccac

SEQ ID NO: 511907 - RNA, 24 nt, Human
ugggauuaaaggcacuugccacca

SEQ ID NO: 511908 - RNA, 19 nt, Human
ugggauuacaggcauccgc

SEQ ID NO: 511909 - RNA, 19 nt, Human
ugggauuacaggcauccgc

SEQ ID NO: 511910 - RNA, 20 nt, Human
ugggauuacaggcauccgcc

SEQ ID NO: 511911 - RNA, 20 nt, Human
ugggauuacaggcauccgcc

SEQ ID NO: 511912 - RNA, 21 nt, Human
ugggauuacaggcauccgccg

SEQ ID NO: 511913 - RNA, 21 nt, Human
ugggauuacaggcauccgccg

SEQ ID NO: 511914 - RNA, 24 nt, Human
ugggauuacaggcauccgccguua

SEQ ID NO: 511915 - RNA, 18 nt, Human
uggggcugggagagugga

SEQ ID NO: 511916 - RNA, 22 nt, Human
uguagguuaggagcaauaggcu

SEQ ID NO: 511917 - RNA, 24 nt, Human
uguucugucacccaggcuggagug

SEQ ID NO: 511918 - RNA, 18 nt, Human
uuaaaacugaaggcacua

SEQ ID NO: 511919 - RNA, 18 nt, Human
uuaguagagacggcguuu

SEQ ID NO: 511920 - RNA, 24 nt, Human
uuaguagagacggcguuuuaccau

SEQ ID NO: 511921 - RNA, 22 nt, Human
uuauauccauguugggaguaga

SEQ ID NO: 511922 - RNA, 21 nt, Human
uucaagcgauucuccugccuc

SEQ ID NO: 511923 - RNA, 21 nt, Human
uucaagcgauucuccugccuc

SEQ ID NO: 511924 - RNA, 23 nt, Human
uucaagcgauucuccugccucag

SEQ ID NO: 511925 - RNA, 23 nt, Human
uucaagcgauucuccugccucag

SEQ ID NO: 511926 - RNA, 24 nt, Human
uucaagcgauucuccugccucagc

SEQ ID NO: 511927 - RNA, 24 nt, Human
uucaagcgauucuccugccucagc

SEQ ID NO: 511928 - RNA, 21 nt, Human
uuccucaguaauaggaaacug

SEQ ID NO: 511929 - RNA, 19 nt, Human
uucuguucaacccagaagu

SEQ ID NO: 511930 - RNA, 20 nt, Human
uugacuccuacucuacuguu

SEQ ID NO: 511931 - RNA, 23 nt, Human
uugagacagucuuguucugucac

SEQ ID NO: 511932 - RNA, 24 nt, Human
uuguucugucacccaggcuggagu

SEQ ID NO: 511933 - RNA, 23 nt, Human
uuuauaagcgucuggcauuucca

SEQ ID NO: 511934 - RNA, 19 nt, Human
uuucucaucuguuaaaugg

SEQ ID NO: 511935 - RNA, 20 nt, Human
uuucucaucuguuaaaugga

SEQ ID NO: 511936 - RNA, 24 nt, Human
uuuguagguuaggagcaauaggcu

SEQ ID NO: 511937 - RNA, 21 nt, Human
uuuuuaguagagacggcguuu

SEQ ID NO: 511938 - RNA, 19 nt, Human
uuuuuguauuuuuaguaga

SEQ ID NO: 511939 - RNA, 21 nt, Human
uuuuuguauuuuuaguagaga

SEQ ID NO: 511940 - RNA, 24 nt, Human
uuuuuugagacagucuuguucugu

SEQ ID NO: 511941 - RNA, 19 nt, Human
aaaaguaguaaggacagcc

SEQ ID NO: 511942 - RNA, 23 nt, Human
cucgaguuuuuuuuuuuuuuuuu

SEQ ID NO: 511943 - RNA, 24 nt, Human
cucgaguuuuuuuuuuuuuuuuuc

SEQ ID NO: 511944 - RNA, 20 nt, Human
cuguguaguugugacuucca

SEQ ID NO: 511945 - RNA, 20 nt, Human
gaguuuuuuuuuuuuuuuuu

SEQ ID NO: 511946 - RNA, 18 nt, Human
uagagcgaacacagugag

SEQ ID NO: 511947 - RNA, 22 nt, Human
ugcuaaaugcccuguuuauucu

SEQ ID NO: 511948 - RNA, 24 nt, Human
uuuguaggcugagaaaucucugug

SEQ ID NO: 511949 - RNA, 21 nt, Human
aaacacuaguggcugagagcc

SEQ ID NO: 511950 - RNA, 23 nt, Human
agaagguggccacugagcugacc

SEQ ID NO: 511951 - RNA, 20 nt, Human
aggaagagggauguuguucu

SEQ ID NO: 511952 - RNA, 22 nt, Human
augccuacauggcugugacuau

SEQ ID NO: 511953 - RNA, 23 nt, Human
cacagccauguuccuuacacucu

SEQ ID NO: 511954 - RNA, 19 nt, Human
cagcacagccauguuccuu

SEQ ID NO: 511955 - RNA, 21 nt, Human
caguguuuuccucuuccaucc

SEQ ID NO: 511956 - RNA, 21 nt, Human
ccaacccacccccaagcaccc

SEQ ID NO: 511957 - RNA, 24 nt, Human
cccacccccaagcacccuuguaug

SEQ ID NO: 511958 - RNA, 25 nt, Human
ccccaagcacccuuguaugcauucc

SEQ ID NO: 511959 - RNA, 20 nt, Human
cuauguuaugccuacauggc

SEQ ID NO: 511960 - RNA, 23 nt, Human
cuccaaaccugucccacucucug

SEQ ID NO: 511961 - RNA, 24 nt, Human
cuccaaaccugucccacucucugc

SEQ ID NO: 511962 - RNA, 19 nt, Human
cucuuccauccgugccuca

SEQ ID NO: 511963 - RNA, 23 nt, Human
cugugcacuugcaccccaauccc

SEQ ID NO: 511964 - RNA, 21 nt, Human
cuugggauccccaacccaccc

SEQ ID NO: 511965 - RNA, 22 nt, Human
gcuuuauucagcagccccuuca

SEQ ID NO: 511966 - RNA, 20 nt, Human
gcuuuggcucuccugccuug

SEQ ID NO: 511967 - RNA, 18 nt, Human
ggcagcuuccaauggugc

SEQ ID NO: 511968 - RNA, 19 nt, Human
uauacacuacacaaacacu

SEQ ID NO: 511969 - RNA, 24 nt, Human
ucagaaggaaauuacaauuuugaa

SEQ ID NO: 511970 - RNA, 18 nt, Human
uccccaacccacccccaa

SEQ ID NO: 511971 - RNA, 19 nt, Human
ugaauuggcauugauuuaa

SEQ ID NO: 511972 - RNA, 21 nt, Human
ugagagccagguggggagcug

SEQ ID NO: 511973 - RNA, 24 nt, Human
ugcccugggcuucagaagguggcc

SEQ ID NO: 511974 - RNA, 24 nt, Human
ugccuacauggcugugacuauaua

SEQ ID NO: 511975 - RNA, 22 nt, Human
ugccuugggauccccaacccac

SEQ ID NO: 511976 - RNA, 21 nt, Human
ugggauccccaacccaccccc

SEQ ID NO: 511977 - RNA, 21 nt, Human
ugucccacucucugcauucuu

SEQ ID NO: 511978 - RNA, 24 nt, Human
uguucucaguguuuuccucuucca

SEQ ID NO: 511979 - RNA, 26 nt, Human
uguuuuccucuuccauccgugccuca

SEQ ID NO: 511980 - RNA, 20 nt, Human
uuacagguuucagaagaaga

SEQ ID NO: 511981 - RNA, 24 nt, Human
uuccucugacuccagcuuuggcuc

SEQ ID NO: 511982 - RNA, 21 nt, Human
uuuuccucuuccauccgugcc

SEQ ID NO: 511983 - RNA, 22 nt, Human
aaaccaaagaggccaggagccu

SEQ ID NO: 511984 - RNA, 22 nt, Human
aagucuucugcagcuccaaucu

SEQ ID NO: 511985 - RNA, 24 nt, Human
acaaacugugguuuggccuagagc

SEQ ID NO: 511986 - RNA, 19 nt, Human
acauggcucccccaccucc

SEQ ID NO: 511987 - RNA, 19 nt, Human
acccucugcucccaccacc

SEQ ID NO: 511988 - RNA, 24 nt, Human
agacauggcucccccaccuccuca

SEQ ID NO: 511989 - RNA, 22 nt, Human
auaaaccaaagaggccaggagc

SEQ ID NO: 511990 - RNA, 24 nt, Human
auaaaccaaagaggccaggagccu

SEQ ID NO: 511991 - RNA, 18 nt, Human
aucugguccagaaucauc

SEQ ID NO: 511992 - RNA, 19 nt, Human
augugcuggggaacgugga

SEQ ID NO: 511993 - RNA, 18 nt, Human
caccugggaugugcuggg

SEQ ID NO: 511994 - RNA, 23 nt, Human
cagacauggcucccccaccuccu

SEQ ID NO: 511995 - RNA, 24 nt, Human
caggagccuacuagccacccccau

SEQ ID NO: 511996 - RNA, 22 nt, Human
caggcccgagguugggcugggg

SEQ ID NO: 511997 - RNA, 22 nt, Human
cagggcucuggagcugcucuuc

SEQ ID NO: 511998 - RNA, 19 nt, Human
caucugguccagaaucauc

SEQ ID NO: 511999 - RNA, 18 nt, Human
cauggcucccccaccucc

SEQ ID NO: 512000 - RNA, 18 nt, Human
ccagggcucuggagcugc

SEQ ID NO: 512001 - RNA, 21 nt, Human
ccccggccagggcucuggagc

SEQ ID NO: 512002 - RNA, 21 nt, Human
cccuaaggacccugguggggc

SEQ ID NO: 512003 - RNA, 19 nt, Human
ccugagcacagacauggcu

SEQ ID NO: 512004 - RNA, 24 nt, Human
cuccucacaagguuuuugguacaa

SEQ ID NO: 512005 - RNA, 18 nt, Human
cugugguuuggccuagag

SEQ ID NO: 512006 - RNA, 20 nt, Human
gcagcuugggguccugggcc

SEQ ID NO: 512007 - RNA, 21 nt, Human
gcccgagguugggcuggggag

SEQ ID NO: 512008 - RNA, 23 nt, Human
ggaugugcuggggaacguggagu

SEQ ID NO: 512009 - RNA, 18 nt, Human
ggcuccucaggcuucauc

SEQ ID NO: 512010 - RNA, 18 nt, Human
uaaaccaaagaggccagg

SEQ ID NO: 512011 - RNA, 25 nt, Human
uaaaccaaagaggccaggagccuac

SEQ ID NO: 512012 - RNA, 21 nt, Human
uacuagccacccccauccccu

SEQ ID NO: 512013 - RNA, 24 nt, Human
uagagcaucccuaaggacccuggu

SEQ ID NO: 512014 - RNA, 23 nt, Human
uccccuucccucuuccugagcac

SEQ ID NO: 512015 - RNA, 18 nt, Human
ucccugggcucugcagcu

SEQ ID NO: 512016 - RNA, 23 nt, Human
ucuccuauccugcuaucuuagag

SEQ ID NO: 512017 - RNA, 22 nt, Human
ucugcagcuugggguccugggc

SEQ ID NO: 512018 - RNA, 22 nt, Human
ucugcucccaccaccugggaug

SEQ ID NO: 512019 - RNA, 22 nt, Human
ugcucuucccugggcucugcag

SEQ ID NO: 512020 - RNA, 18 nt, Human
ugcuggggaacguggagu

SEQ ID NO: 512021 - RNA, 21 nt, Human
uggaaggcuccucaggcuuca

SEQ ID NO: 512022 - RNA, 21 nt, Human
uggagcugcucuucccugggc

SEQ ID NO: 512023 - RNA, 18 nt, Human
uggaguggggcagccuga

SEQ ID NO: 512024 - RNA, 21 nt, Human
uggggcaggguacccucugcu

SEQ ID NO: 512025 - RNA, 19 nt, Human
ugugcuggggaacguggag

SEQ ID NO: 512026 - RNA, 22 nt, Human
uuagagcuggaaggcuccucag

SEQ ID NO: 512027 - RNA, 18 nt, Human
aaaguacugggauuacaa

SEQ ID NO: 512028 - RNA, 22 nt, Human
aaaguacugggauuacaagcau

SEQ ID NO: 512029 - RNA, 24 nt, Human
aaaguacugggauuacaagcauga

SEQ ID NO: 512030 - RNA, 21 nt, Human
aaguacugggauuacaagcau

SEQ ID NO: 512031 - RNA, 26 nt, Human
aaguacugggauuacaagcaugagcc

SEQ ID NO: 512032 - RNA, 20 nt, Human
aaguagcugggacuacaggc

SEQ ID NO: 512033 - RNA, 21 nt, Human
aaguagcugggacuacaggca

SEQ ID NO: 512034 - RNA, 25 nt, Human
aaguagcugggacuacaggcaaugc

SEQ ID NO: 512035 - RNA, 21 nt, Human
acaccaagcuaauuuuuguau

SEQ ID NO: 512036 - RNA, 21 nt, Human
accacagccuccuaaaguacu

SEQ ID NO: 512037 - RNA, 24 nt, Human
accauguuggccaggcuggucuug

SEQ ID NO: 512038 - RNA, 18 nt, Human
acucugucacccaggcug

SEQ ID NO: 512039 - RNA, 24 nt, Human
acucugucacccaggcugaagugc

SEQ ID NO: 512040 - RNA, 24 nt, Human
aggcugaagugcaguggcacgacc

SEQ ID NO: 512041 - RNA, 18 nt, Human
agugauccaccuaccacg

SEQ ID NO: 512042 - RNA, 23 nt, Human
agugcaguggcacgaccucagcu

SEQ ID NO: 512043 - RNA, 24 nt, Human
auccaccuaccacagccuccuaaa

SEQ ID NO: 512044 - RNA, 18 nt, Human
augagguuucaccauguu

SEQ ID NO: 512045 - RNA, 20 nt, Human
augagguuucaccauguugg

SEQ ID NO: 512046 - RNA, 24 nt, Human
augcaacaaaacacauggagacuu

SEQ ID NO: 512047 - RNA, 21 nt, Human
auuacaagcaugagccacuac

SEQ ID NO: 512048 - RNA, 18 nt, Human
auucuccugccucagccu

SEQ ID NO: 512049 - RNA, 24 nt, Human
auuuuuguauuuuuaguagagaug

SEQ ID NO: 512050 - RNA, 24 nt, Human
caacaaaacacauggagacuuuga

SEQ ID NO: 512051 - RNA, 22 nt, Human
caagugauucuccugccucagc

SEQ ID NO: 512052 - RNA, 27 nt, Human
caagugauucuccugccucagccuccc

SEQ ID NO: 512053 - RNA, 21 nt, Human
caaugcaccaccacaccaagc

SEQ ID NO: 512054 - RNA, 24 nt, Human
caccacaccaagcuaauuuuugua

SEQ ID NO: 512055 - RNA, 21 nt, Human
caccauguuggccaggcuggu

SEQ ID NO: 512056 - RNA, 23 nt, Human
caccauguuggccaggcuggucu

SEQ ID NO: 512057 - RNA, 24 nt, Human
caccauguuggccaggcuggucuu

SEQ ID NO: 512058 - RNA, 27 nt, Human
caccauguuggccaggcuggucuugaa

SEQ ID NO: 512059 - RNA, 23 nt, Human
cacccaggcugaagugcaguggc

SEQ ID NO: 512060 - RNA, 23 nt, Human
cacucugucacccaggcugaagu

SEQ ID NO: 512061 - RNA, 24 nt, Human
cacucugucacccaggcugaagug

SEQ ID NO: 512062 - RNA, 23 nt, Human
cacugcaaccuccacuuccuggg

SEQ ID NO: 512063 - RNA, 24 nt, Human
cauguuggccaggcuggucuugaa

SEQ ID NO: 512064 - RNA, 23 nt, Human
ccauaaacauuuucaaaaugcag

SEQ ID NO: 512065 - RNA, 22 nt, Human
ccauuuguuagugguuuuuuuc

SEQ ID NO: 512066 - RNA, 23 nt, Human
cccaaguagcugggacuacaggc

SEQ ID NO: 512067 - RNA, 24 nt, Human
cccaaguagcugggacuacaggca

SEQ ID NO: 512068 - RNA, 24 nt, Human
ccgaccucauaguaguuuugauuu

SEQ ID NO: 512069 - RNA, 22 nt, Human
ccuccacuuccuggguucaagu

SEQ ID NO: 512070 - RNA, 24 nt, Human
ccugaccucaagugauccaccuac

SEQ ID NO: 512071 - RNA, 25 nt, Human
ccugaccucaagugauccaccuacc

SEQ ID NO: 512072 - RNA, 23 nt, Human
ccugccucagccucccaaguagc

SEQ ID NO: 512073 - RNA, 23 nt, Human
ccuggguucaagugauucuccuc

SEQ ID NO: 512074 - RNA, 23 nt, Human
ccuggguucaagugauucuccug

SEQ ID NO: 512075 - RNA, 21 nt, Human
cucaagugauccaccuaccac

SEQ ID NO: 512076 - RNA, 24 nt, Human
cucacugcaaccuccacuuccugg

SEQ ID NO: 512077 - RNA, 24 nt, Human
cucagccucccaaguagcugggac

SEQ ID NO: 512078 - RNA, 23 nt, Human
cugcaaccuccacuuccuggguu

SEQ ID NO: 512079 - RNA, 23 nt, Human
cugccucagccucccaaguagcu

SEQ ID NO: 512080 - RNA, 21 nt, Human
cuuccuggguucaagugauuc

SEQ ID NO: 512081 - RNA, 24 nt, Human
cuuccuggguucaagugauucucc

SEQ ID NO: 512082 - RNA, 22 nt, Human
gaccucaagugauccaccuacc

SEQ ID NO: 512083 - RNA, 19 nt, Human
gaccucagcucacugcaac

SEQ ID NO: 512084 - RNA, 21 nt, Human
gagccacuacacccgaccuca

SEQ ID NO: 512085 - RNA, 22 nt, Human
gagguuucaccauguuggccag

SEQ ID NO: 512086 - RNA, 18 nt, Human
gauuacaagcaugagcca

SEQ ID NO: 512087 - RNA, 19 nt, Human
gauuacaagcaugagccac

SEQ ID NO: 512088 - RNA, 21 nt, Human
gauucuccugccucagccucc

SEQ ID NO: 512089 - RNA, 22 nt, Human
gcaaccuccacuuccuggguuc

SEQ ID NO: 512090 - RNA, 19 nt, Human
gcugaagugcaguggcacg

SEQ ID NO: 512091 - RNA, 23 nt, Human
gcuggucuugaacuccugaccuc

SEQ ID NO: 512092 - RNA, 19 nt, Human
ggauuacaagcaugagcca

SEQ ID NO: 512093 - RNA, 24 nt, Human
ggcuggucuugaacuccugaccuc

SEQ ID NO: 512094 - RNA, 19 nt, Human
ggucuugaacuccugaccu

SEQ ID NO: 512095 - RNA, 23 nt, Human
gugauccaccuaccacagccucc

SEQ ID NO: 512096 - RNA, 24 nt, Human
gugauucuccugccucagccuccc

SEQ ID NO: 512097 - RNA, 24 nt, Human
uaaaguacugggauuacaagcaug

SEQ ID NO: 512098 - RNA, 24 nt, Human
uaauuuuuguauuuuuaguagaga

SEQ ID NO: 512099 - RNA, 23 nt, Human
uacaagcaugagccacuacaccc

SEQ ID NO: 512100 - RNA, 23 nt, Human
uacacccgaccucauaguaguuu

SEQ ID NO: 512101 - RNA, 28 nt, Human
uacacuucccuaaugauugaccccuggg

SEQ ID NO: 512102 - RNA, 24 nt, Human
uaccacagccuccuaaaguacugg

SEQ ID NO: 512103 - RNA, 27 nt, Human
uacugggauuacaagcaugagccacua

SEQ ID NO: 512104 - RNA, 22 nt, Human
uagagaugagguuucaccaugu

SEQ ID NO: 512105 - RNA, 24 nt, Human
uaguagagaugagguuucaccaug

SEQ ID NO: 512106 - RNA, 26 nt, Human
uaguagagaugagguuucaccauguu

SEQ ID NO: 512107 - RNA, 19 nt, Human
ucaagugauucuccugccu

SEQ ID NO: 512108 - RNA, 24 nt, Human
ucacugcaaccuccacuuccuggg

SEQ ID NO: 512109 - RNA, 25 nt, Human
ucacugcaaccuccacuuccugggu

SEQ ID NO: 512110 - RNA, 26 nt, Human
ucacugcaaccuccacuuccuggguu

SEQ ID NO: 512111 - RNA, 18 nt, Human
ucagccucccaaguagcu

SEQ ID NO: 512112 - RNA, 20 nt, Human
ucagccucccaaguagcugg

SEQ ID NO: 512113 - RNA, 24 nt, Human
uccauaaacauuuucaaaaugcag

SEQ ID NO: 512114 - RNA, 24 nt, Human
ucccaaguagcugggacuacaggc

SEQ ID NO: 512115 - RNA, 18 nt, Human
uccuaaaguacugggauu

SEQ ID NO: 512116 - RNA, 24 nt, Human
uccuaaaguacugggauuacaagc

SEQ ID NO: 512117 - RNA, 20 nt, Human
uccuggguucaagugauucu

SEQ ID NO: 512118 - RNA, 21 nt, Human
uccuggguucaagugauucuc

SEQ ID NO: 512119 - RNA, 24 nt, Human
uccuggguucaagugauucuccug

SEQ ID NO: 512120 - RNA, 19 nt, Human
ucucacucugucacccagg

SEQ ID NO: 512121 - RNA, 24 nt, Human
ucucacucugucacccaggcugaa

SEQ ID NO: 512122 - RNA, 26 nt, Human
ucucacucugucacccaggcugaagu

SEQ ID NO: 512123 - RNA, 27 nt, Human
ucucacucugucacccaggcugaagug

SEQ ID NO: 512124 - RNA, 26 nt, Human
ucuccugccucagccucccaaguagc

SEQ ID NO: 512125 - RNA, 24 nt, Human
ucugucacccaggcugaagugcag

SEQ ID NO: 512126 - RNA, 21 nt, Human
ucuugaacuccugaccucaag

SEQ ID NO: 512127 - RNA, 19 nt, Human
ugaagugcaguggcacgac

SEQ ID NO: 512128 - RNA, 19 nt, Human
ugaccucaagugauccacc

SEQ ID NO: 512129 - RNA, 20 nt, Human
ugaccucaagugauccaccu

SEQ ID NO: 512130 - RNA, 24 nt, Human
ugagguuucaccauguuggccagg

SEQ ID NO: 512131 - RNA, 24 nt, Human
ugccucagccucccaaguagcugg

SEQ ID NO: 512132 - RNA, 23 nt, Human
uggagacuuugaaaauccuucag

SEQ ID NO: 512133 - RNA, 24 nt, Human
uggcacgaccucagcucacugcaa

SEQ ID NO: 512134 - RNA, 24 nt, Human
uggccaggcuggucuugaacuccu

SEQ ID NO: 512135 - RNA, 22 nt, Human
ugggacuacaggcaaugcacca

SEQ ID NO: 512136 - RNA, 25 nt, Human
ugggacuacaggcaaugcaccacca

SEQ ID NO: 512137 - RNA, 21 nt, Human
ugggauuacaagcaugagcca

SEQ ID NO: 512138 - RNA, 22 nt, Human
ugggauuacaagcaugagccac

SEQ ID NO: 512139 - RNA, 22 nt, Human
ugggauuacaagcaugagccac

SEQ ID NO: 512140 - RNA, 23 nt, Human
ugggauuacaagcaugagccacu

SEQ ID NO: 512141 - RNA, 24 nt, Human
ugggauuacaagcaugagccacua

SEQ ID NO: 512142 - RNA, 24 nt, Human
ugggauuacaagcaugagccacua

SEQ ID NO: 512143 - RNA, 26 nt, Human
ugggauuacaagcaugagccacuaca

SEQ ID NO: 512144 - RNA, 23 nt, Human
uggguucaagugauucuccugcc

SEQ ID NO: 512145 - RNA, 24 nt, Human
uggguucaagugauucuccugccu

SEQ ID NO: 512146 - RNA, 18 nt, Human
uuaguagagaugagguuu

SEQ ID NO: 512147 - RNA, 22 nt, Human
uuaguagagaugagguuucacc

SEQ ID NO: 512148 - RNA, 24 nt, Human
uuaguagagaugagguuucaccau

SEQ ID NO: 512149 - RNA, 19 nt, Human
uuagugguuuuuuucuucu

SEQ ID NO: 512150 - RNA, 21 nt, Human
uucaagugauucuccugccuc

SEQ ID NO: 512151 - RNA, 23 nt, Human
uucaagugauucuccugccucag

SEQ ID NO: 512152 - RNA, 24 nt, Human
uucaagugauucuccugccucagc

SEQ ID NO: 512153 - RNA, 25 nt, Human
uugcucucuaucaccaaauacugua

SEQ ID NO: 512154 - RNA, 24 nt, Human
uuucaccauguuggccaggcuggu

SEQ ID NO: 512155 - RNA, 23 nt, Human
uuuggagacugucucacucuguc

SEQ ID NO: 512156 - RNA, 24 nt, Human
uuuuuaguagagaugagguuucac

SEQ ID NO: 512157 - RNA, 20 nt, Human
uuuuuguauuuuuaguagag

SEQ ID NO: 512158 - RNA, 25 nt, Human
uuuuuuuuuuuuggagacugucuca

SEQ ID NO: 512159 - RNA, 18 nt, Human
uuuuuuuuuuuuuuuuug

SEQ ID NO: 512160 - RNA, 19 nt, Human
aaagaggacacucugguuc

SEQ ID NO: 512161 - RNA, 21 nt, Human
aagggcucaccuucggcuucu

SEQ ID NO: 512162 - RNA, 19 nt, Human
aggcagaggggcaggagcu

SEQ ID NO: 512163 - RNA, 23 nt, Human
aggcagcggcagaggcggauguc

SEQ ID NO: 512164 - RNA, 24 nt, Human
agggcaguggugacaugcugcugu

SEQ ID NO: 512165 - RNA, 18 nt, Human
aggggcaggagcuccugc

SEQ ID NO: 512166 - RNA, 21 nt, Human
aggucuccgacacagccgucu

SEQ ID NO: 512167 - RNA, 23 nt, Human
caccuucggcuucugcguggagg

SEQ ID NO: 512168 - RNA, 20 nt, Human
cacgccgaaaccccccgcca

SEQ ID NO: 512169 - RNA, 23 nt, Human
cagaugaugccucguuccagucc

SEQ ID NO: 512170 - RNA, 20 nt, Human
caggggguguagggggcagg

SEQ ID NO: 512171 - RNA, 18 nt, Human
caguccaucaucaguuuc

SEQ ID NO: 512172 - RNA, 18 nt, Human
ccccccgccaccaaccgg

SEQ ID NO: 512173 - RNA, 18 nt, Human
cccgccaccaaccggcug

SEQ ID NO: 512174 - RNA, 19 nt, Human
ccgaaaccccccgccacca

SEQ ID NO: 512175 - RNA, 22 nt, Human
ccgaaaccccccgccaccaacc

SEQ ID NO: 512176 - RNA, 19 nt, Human
ccgcugcgccaccccgcuc

SEQ ID NO: 512177 - RNA, 18 nt, Human
cgacuggcccucacuacu

SEQ ID NO: 512178 - RNA, 19 nt, Human
cgccgaaggccucgacugu

SEQ ID NO: 512179 - RNA, 23 nt, Human
cgccguccacggcccggcuugga

SEQ ID NO: 512180 - RNA, 18 nt, Human
cucaccuucggcuucugc

SEQ ID NO: 512181 - RNA, 24 nt, Human
cucaccuucggcuucugcguggag

SEQ ID NO: 512182 - RNA, 20 nt, Human
cugcaggggguguagggggc

SEQ ID NO: 512183 - RNA, 18 nt, Human
cugguuccaguuguagcc

SEQ ID NO: 512184 - RNA, 22 nt, Human
gaaaccccccgccaccaaccgg

SEQ ID NO: 512185 - RNA, 20 nt, Human
gaaggccucgacugugaggg

SEQ ID NO: 512186 - RNA, 23 nt, Human
gacgauguggacgcugggaggga

SEQ ID NO: 512187 - RNA, 21 nt, Human
gacuggcuguggcuuggggau

SEQ ID NO: 512188 - RNA, 19 nt, Human
gagcaggccccaccgcccc

SEQ ID NO: 512189 - RNA, 21 nt, Human
gaggaugacucagagaagguc

SEQ ID NO: 512190 - RNA, 21 nt, Human
gccccguccaccucgcggcug

SEQ ID NO: 512191 - RNA, 19 nt, Human
gccggggcccagugcuccg

SEQ ID NO: 512192 - RNA, 21 nt, Human
gcggaugucgggaagcccaga

SEQ ID NO: 512193 - RNA, 22 nt, Human
gcuauaguaguccaggccgagg

SEQ ID NO: 512194 - RNA, 20 nt, Human
ggagaugggucugcaggggg

SEQ ID NO: 512195 - RNA, 22 nt, Human
ggagaugggugggagggggugg

SEQ ID NO: 512196 - RNA, 21 nt, Human
ggaggagaugggugggagggg

SEQ ID NO: 512197 - RNA, 22 nt, Human
ggagggagaugggucugcaggg

SEQ ID NO: 512198 - RNA, 20 nt, Human
ggaggggguggagggagaug

SEQ ID NO: 512199 - RNA, 20 nt, Human
ggcugccggggcccagugcu

SEQ ID NO: 512200 - RNA, 20 nt, Human
gggcaggagcuccugccaga

SEQ ID NO: 512201 - RNA, 23 nt, Human
gguccagucggcacuucaguugg

SEQ ID NO: 512202 - RNA, 19 nt, Human
gucugcaggggguguaggg

SEQ ID NO: 512203 - RNA, 21 nt, Human
gucugcugcuucaccuucugc

SEQ ID NO: 512204 - RNA, 22 nt, Human
gugcugucggaggaugacucag

SEQ ID NO: 512205 - RNA, 21 nt, Human
guggaggagaugggugggagg

SEQ ID NO: 512206 - RNA, 21 nt, Human
guggagggagaugggucugca

SEQ ID NO: 512207 - RNA, 19 nt, Human
uagccugaggcagcggcag

SEQ ID NO: 512208 - RNA, 19 nt, Human
uccacggcccggcuuggag

SEQ ID NO: 512209 - RNA, 19 nt, Human
ucucgcucucccacgccga

SEQ ID NO: 512210 - RNA, 18 nt, Human
ucugcaggggguguaggg

SEQ ID NO: 512211 - RNA, 22 nt, Human
ugaacugggugcugucggagga

SEQ ID NO: 512212 - RNA, 21 nt, Human
ugcaggggguguagggggcag

SEQ ID NO: 512213 - RNA, 20 nt, Human
ugcguggaggagaugggugg

SEQ ID NO: 512214 - RNA, 23 nt, Human
uggagcuacucugaaagaggaca

SEQ ID NO: 512215 - RNA, 18 nt, Human
uggagggagaugggucug

SEQ ID NO: 512216 - RNA, 20 nt, Human
uggccgcugcgccaccccgc

SEQ ID NO: 512217 - RNA, 22 nt, Human
uggcuuggggaugaacuuggcu

SEQ ID NO: 512218 - RNA, 29 nt, Human
uggcuuggggaugaacuuggcuuuggccg

SEQ ID NO: 512219 - RNA, 21 nt, Human
ugggaggcagaggggcagggg

SEQ ID NO: 512220 - RNA, 23 nt, Human
uguagccgggggcagaugaugcc

SEQ ID NO: 512221 - RNA, 19 nt, Human
uguagggggcaggguggga

SEQ ID NO: 512222 - RNA, 19 nt, Human
ugucgggaagcccagaugu

SEQ ID NO: 512223 - RNA, 19 nt, Human
ugugcagaaagggcucacc

SEQ ID NO: 512224 - RNA, 21 nt, Human
uucaccuucugcgguguguag

SEQ ID NO: 512225 - RNA, 27 nt, Human
uuuuaaguuuuguacauuuuuaaaaag

SEQ ID NO: 512226 - RNA, 19 nt, Human
uuuucugaaagccaggaac

SEQ ID NO: 512227 - RNA, 24 nt, Human
uuuuuuuuuucuaaaacuguguuu

SEQ ID NO: 512228 - RNA, 21 nt, Human
aaccaugcuccaaaaaacaaa

SEQ ID NO: 512229 - RNA, 22 nt, Human
aagaaaaacuucagcaaggaga

SEQ ID NO: 512230 - RNA, 24 nt, Human
acaaacuuucaagcucccgguuaa

SEQ ID NO: 512231 - RNA, 22 nt, Human
aggaagagcugaaagacacaug

SEQ ID NO: 512232 - RNA, 21 nt, Human
aucagcgcaugcucgcaauga

SEQ ID NO: 512233 - RNA, 19 nt, Human
augaggaagaaaauuugca

SEQ ID NO: 512234 - RNA, 24 nt, Human
caaagaaccaugcuccaaaaaaca

SEQ ID NO: 512235 - RNA, 21 nt, Human
caacauuuaauuucugcuugu

SEQ ID NO: 512236 - RNA, 21 nt, Human
caagcucccgguuaaucccca

SEQ ID NO: 512237 - RNA, 21 nt, Human
caggguucucgcgggguuagg

SEQ ID NO: 512238 - RNA, 27 nt, Human
ccaaagacaaacuuucaagcucccggu

SEQ ID NO: 512239 - RNA, 24 nt, Human
ccaaucagcgcaugcucgcaauga

SEQ ID NO: 512240 - RNA, 24 nt, Human
cccaaagaaccaugcuccaaaaaa

SEQ ID NO: 512241 - RNA, 25 nt, Human
cccccagguagucuguacauaauuc

SEQ ID NO: 512242 - RNA, 21 nt, Human
cugcuggcucugcucauucug

SEQ ID NO: 512243 - RNA, 23 nt, Human
cugugguggcaaagggacggcac

SEQ ID NO: 512244 - RNA, 20 nt, Human
cuucccaaagaaccaugcuc

SEQ ID NO: 512245 - RNA, 21 nt, Human
gagcugaaagacacaugugcu

SEQ ID NO: 512246 - RNA, 18 nt, Human
gcuccaaaaaacaaaaga

SEQ ID NO: 512247 - RNA, 18 nt, Human
gcucugcucauucugcuu

SEQ ID NO: 512248 - RNA, 22 nt, Human
uaucagguuaccaaagacaaac

SEQ ID NO: 512249 - RNA, 20 nt, Human
ucgcgggguuaggcgucccc

SEQ ID NO: 512250 - RNA, 18 nt, Human
uggcaaagggacggcacu

SEQ ID NO: 512251 - RNA, 21 nt, Human
ugggugaaaaggaagagcuga

SEQ ID NO: 512252 - RNA, 21 nt, Human
ugugguggcaaagggacggca

SEQ ID NO: 512253 - RNA, 24 nt, Human
aaaacggcaacucccagaacuucc

SEQ ID NO: 512254 - RNA, 19 nt, Human
aaacagaaagggagccuuc

SEQ ID NO: 512255 - RNA, 22 nt, Human
aaacagaaagggagccuuccag

SEQ ID NO: 512256 - RNA, 21 nt, Human
aaggaucuucccagggcaucc

SEQ ID NO: 512257 - RNA, 18 nt, Human
aagggagaggggaagggg

SEQ ID NO: 512258 - RNA, 20 nt, Human
acugugacgaacagcaaagc

SEQ ID NO: 512259 - RNA, 20 nt, Human
agaagagggagccggaagcu

SEQ ID NO: 512260 - RNA, 26 nt, Human
agacaauagauggagaaaggggaccc

SEQ ID NO: 512261 - RNA, 20 nt, Human
agagaaagcggcagccaagg

SEQ ID NO: 512262 - RNA, 18 nt, Human
agaggggggagaagaggg

SEQ ID NO: 512263 - RNA, 21 nt, Human
agaucaaacuuccgaaacugc

SEQ ID NO: 512264 - RNA, 21 nt, Human
agcaauggaacagcaauggga

SEQ ID NO: 512265 - RNA, 21 nt, Human
agcccaagggagaggggaagg

SEQ ID NO: 512266 - RNA, 18 nt, Human
aggaggacgggcugagga

SEQ ID NO: 512267 - RNA, 24 nt, Human
aggcccugcaagugcccucugcuc

SEQ ID NO: 512268 - RNA, 27 nt, Human
aggcuguggggagagaaagcggcagcc

SEQ ID NO: 512269 - RNA, 25 nt, Human
agggagccggaagcugggggcacag

SEQ ID NO: 512270 - RNA, 18 nt, Human
augggacagauauuucuc

SEQ ID NO: 512271 - RNA, 23 nt, Human
auuccccacaugcugccccuuuu

SEQ ID NO: 512272 - RNA, 18 nt, Human
caacaauuuuucaucaga

SEQ ID NO: 512273 - RNA, 25 nt, Human
cacagcuugaagacugcucauccca

SEQ ID NO: 512274 - RNA, 23 nt, Human
cacuccuacccauauuccuaagc

SEQ ID NO: 512275 - RNA, 19 nt, Human
cagcaaugggaaagcuagg

SEQ ID NO: 512276 - RNA, 23 nt, Human
cagcaggaacggggcaggggcuc

SEQ ID NO: 512277 - RNA, 24 nt, Human
caggagcucaggaagaugucgcuc

SEQ ID NO: 512278 - RNA, 18 nt, Human
cagggcaaaggagcgcgg

SEQ ID NO: 512279 - RNA, 19 nt, Human
ccaagaacggccaggccgc

SEQ ID NO: 512280 - RNA, 21 nt, Human
ccacaugcugccccuuuuccc

SEQ ID NO: 512281 - RNA, 21 nt, Human
ccaggcccugcaagugcccuc

SEQ ID NO: 512282 - RNA, 20 nt, Human
ccccaagucggaaacggaau

SEQ ID NO: 512283 - RNA, 24 nt, Human
ccccagagaucuaaaugggacaga

SEQ ID NO: 512284 - RNA, 22 nt, Human
cccccaaacguuuugaugaaaa

SEQ ID NO: 512285 - RNA, 18 nt, Human
ccuggggcccggcagggc

SEQ ID NO: 512286 - RNA, 20 nt, Human
ccuugaggcuguggggagag

SEQ ID NO: 512287 - RNA, 19 nt, Human
cgagugggcgggggugggg

SEQ ID NO: 512288 - RNA, 24 nt, Human
cgcggguuggaggaggacgggcug

SEQ ID NO: 512289 - RNA, 21 nt, Human
cggccaggccgcagcaggaac

SEQ ID NO: 512290 - RNA, 21 nt, Human
cucacaaacaacuuggaagcc

SEQ ID NO: 512291 - RNA, 26 nt, Human
cuccugcccgcuaacuaccacagcuu

SEQ ID NO: 512292 - RNA, 19 nt, Human
cugacuacaagucauaaaa

SEQ ID NO: 512293 - RNA, 24 nt, Human
cugacuacaagucauaaaacuuca

SEQ ID NO: 512294 - RNA, 18 nt, Human
cuugaagacugcucaucc

SEQ ID NO: 512295 - RNA, 22 nt, Human
cuuucacuccuacccauauucc

SEQ ID NO: 512296 - RNA, 18 nt, Human
gaaccccaagucggaaac

SEQ ID NO: 512297 - RNA, 20 nt, Human
gacacugugacgaacagcaa

SEQ ID NO: 512298 - RNA, 18 nt, Human
gagcgcggguuggaggag

SEQ ID NO: 512299 - RNA, 18 nt, Human
gaggagagggaaaggcag

SEQ ID NO: 512300 - RNA, 24 nt, Human
gaggagagggaaaggcagucccag

SEQ ID NO: 512301 - RNA, 22 nt, Human
gaggugagagucagguggccug

SEQ ID NO: 512302 - RNA, 21 nt, Human
gcaggagggguggagaggggu

SEQ ID NO: 512303 - RNA, 19 nt, Human
gcggggggcauuccccaca

SEQ ID NO: 512304 - RNA, 24 nt, Human
ggagacacaucuuccucuguuauc

SEQ ID NO: 512305 - RNA, 21 nt, Human
ggagccggaagcugggggcac

SEQ ID NO: 512306 - RNA, 22 nt, Human
ggaggacgggcugaggagaggg

SEQ ID NO: 512307 - RNA, 20 nt, Human
ggcgggggugggguggggug

SEQ ID NO: 512308 - RNA, 20 nt, Human
gggcgggggugggguggggu

SEQ ID NO: 512309 - RNA, 22 nt, Human
ggggagaagagggagccggaag

SEQ ID NO: 512310 - RNA, 20 nt, Human
gggggagaagagggagccgg

SEQ ID NO: 512311 - RNA, 19 nt, Human
ggggugggguggggugggg

SEQ ID NO: 512312 - RNA, 22 nt, Human
ggguagaggggggagaagaggg

SEQ ID NO: 512313 - RNA, 24 nt, Human
ggguagaggggggagaagagggag

SEQ ID NO: 512314 - RNA, 18 nt, Human
gggugggguggggugggg

SEQ ID NO: 512315 - RNA, 26 nt, Human
ggugaaagagacaauagauggagaaa

SEQ ID NO: 512316 - RNA, 24 nt, Human
gugaaaacagccugccugaacccc

SEQ ID NO: 512317 - RNA, 18 nt, Human
guggccuugaggcugugg

SEQ ID NO: 512318 - RNA, 21 nt, Human
gugggcggggguggggugggg

SEQ ID NO: 512319 - RNA, 22 nt, Human
gugggcgggggugggguggggu

SEQ ID NO: 512320 - RNA, 26 nt, Human
guggggugggguggcggguugacggc

SEQ ID NO: 512321 - RNA, 26 nt, Human
uaaaacuucaaacagaaagggagccu

SEQ ID NO: 512322 - RNA, 22 nt, Human
uaaaugucugaagcuggcaggu

SEQ ID NO: 512323 - RNA, 21 nt, Human
uaacuaccacagcuugaagac

SEQ ID NO: 512324 - RNA, 19 nt, Human
uaagcagagguucauaaug

SEQ ID NO: 512325 - RNA, 22 nt, Human
uacaagucauaaaacuucaaac

SEQ ID NO: 512326 - RNA, 18 nt, Human
uaccugaauggaaaauga

SEQ ID NO: 512327 - RNA, 19 nt, Human
uagggccagcguggaggca

SEQ ID NO: 512328 - RNA, 18 nt, Human
uaggguggccuugaggcu

SEQ ID NO: 512329 - RNA, 20 nt, Human
uauggcaggcauggacagga

SEQ ID NO: 512330 - RNA, 19 nt, Human
ucagaucaaacuuccgaaa

SEQ ID NO: 512331 - RNA, 24 nt, Human
ucagcaaaaggauuuguggaaggc

SEQ ID NO: 512332 - RNA, 25 nt, Human
ucagguggccugccauccuggggcc

SEQ ID NO: 512333 - RNA, 21 nt, Human
ucauaaaacuucaaacagaaa

SEQ ID NO: 512334 - RNA, 19 nt, Human
ucccuaaaugucugaagcu

SEQ ID NO: 512335 - RNA, 21 nt, Human
uccuagaacugaaacauucua

SEQ ID NO: 512336 - RNA, 23 nt, Human
ugaaaacagccugccugaacccc

SEQ ID NO: 512337 - RNA, 24 nt, Human
ugaaaacagccugccugaacccca

SEQ ID NO: 512338 - RNA, 23 nt, Human
ugacacugugacgaacagcaaag

SEQ ID NO: 512339 - RNA, 18 nt, Human
ugcaagugcccucugcuc

SEQ ID NO: 512340 - RNA, 21 nt, Human
ugcucaucccaggcccugcaa

SEQ ID NO: 512341 - RNA, 18 nt, Human
uggaacagcaaugggaaa

SEQ ID NO: 512342 - RNA, 23 nt, Human
uggaaggcggggggcauucccca

SEQ ID NO: 512343 - RNA, 25 nt, Human
uggaaggcggggggcauuccccaca

SEQ ID NO: 512344 - RNA, 22 nt, Human
uggagaaaggcauaaugaccau

SEQ ID NO: 512345 - RNA, 21 nt, Human
uggcaggcauggacaggagcu

SEQ ID NO: 512346 - RNA, 18 nt, Human
uggccuugaggcuguggg

SEQ ID NO: 512347 - RNA, 24 nt, Human
uggccuugaggcuguggggagaga

SEQ ID NO: 512348 - RNA, 18 nt, Human
uggcggguagagggggga

SEQ ID NO: 512349 - RNA, 20 nt, Human
ugggaaagcuagggccagcg

SEQ ID NO: 512350 - RNA, 19 nt, Human
ugggaccaggugaugguac

SEQ ID NO: 512351 - RNA, 18 nt, Human
ugggaggagacacaucuu

SEQ ID NO: 512352 - RNA, 21 nt, Human
uggggcccggcagggcaaagg

SEQ ID NO: 512353 - RNA, 20 nt, Human
ugucucagcaauggaacagc

SEQ ID NO: 512354 - RNA, 20 nt, Human
uuaaguuuucagaucucaca

SEQ ID NO: 512355 - RNA, 21 nt, Human
uuccugggucagcaaaaggau

SEQ ID NO: 512356 - RNA, 19 nt, Human
aagcguuuucugcaagaac

SEQ ID NO: 512357 - RNA, 20 nt, Human
aauugucaagagcaguuggu

SEQ ID NO: 512358 - RNA, 21 nt, Human
acacugaagacacaaagaaug

SEQ ID NO: 512359 - RNA, 18 nt, Human
acccagagauacgugguu

SEQ ID NO: 512360 - RNA, 20 nt, Human
accuugagcagguauagaag

SEQ ID NO: 512361 - RNA, 19 nt, Human
acuguacuuucauucaaau

SEQ ID NO: 512362 - RNA, 19 nt, Human
agaguccugggugacaugc

SEQ ID NO: 512363 - RNA, 23 nt, Human
agcaguuggugguucugaaauac

SEQ ID NO: 512364 - RNA, 19 nt, Human
agccaacacugaagacaca

SEQ ID NO: 512365 - RNA, 18 nt, Human
agguugccacuggcaugg

SEQ ID NO: 512366 - RNA, 23 nt, Human
auagagccaugcccacugaccca

SEQ ID NO: 512367 - RNA, 18 nt, Human
caaagaugacaaugaccu

SEQ ID NO: 512368 - RNA, 26 nt, Human
caagccaacacugaagacacaaagaa

SEQ ID NO: 512369 - RNA, 21 nt, Human
cacaguuaugugaacguguca

SEQ ID NO: 512370 - RNA, 21 nt, Human
caccggcagaguccuggguga

SEQ ID NO: 512371 - RNA, 21 nt, Human
caugugcugcacaguuaugug

SEQ ID NO: 512372 - RNA, 26 nt, Human
ccagcggcuccugacuccuguucucu

SEQ ID NO: 512373 - RNA, 19 nt, Human
ccucucggcuuaguaaggg

SEQ ID NO: 512374 - RNA, 24 nt, Human
cuauagguccugccugcaggaaug

SEQ ID NO: 512375 - RNA, 21 nt, Human
ggaauugagaggagcagggcu

SEQ ID NO: 512376 - RNA, 26 nt, Human
ggcuaaggccucccaaugcuguuugu

SEQ ID NO: 512377 - RNA, 25 nt, Human
gugguucugaaauacaauccucagc

SEQ ID NO: 512378 - RNA, 22 nt, Human
uaaaacaagccaacacugaaga

SEQ ID NO: 512379 - RNA, 24 nt, Human
uacagauggaucagcuaaaacaag

SEQ ID NO: 512380 - RNA, 22 nt, Human
uagagccaugcccacugacccc

SEQ ID NO: 512381 - RNA, 22 nt, Human
uagcuguggucuuccuaaguac

SEQ ID NO: 512382 - RNA, 24 nt, Human
uaggaauagagccaugcccacuga

SEQ ID NO: 512383 - RNA, 24 nt, Human
uagguucauugaaaccaggguaac

SEQ ID NO: 512384 - RNA, 19 nt, Human
ucaaccgaaaauaucucuu

SEQ ID NO: 512385 - RNA, 18 nt, Human
ucagagacaugccugcaa

SEQ ID NO: 512386 - RNA, 19 nt, Human
ucauucaaaucuucacgug

SEQ ID NO: 512387 - RNA, 21 nt, Human
ucauugaaaccaggguaacac

SEQ ID NO: 512388 - RNA, 18 nt, Human
ucccggcaugugcugcac

SEQ ID NO: 512389 - RNA, 22 nt, Human
ucuccugccagcggcuccugac

SEQ ID NO: 512390 - RNA, 22 nt, Human
ucugaaauacaauccucagcca

SEQ ID NO: 512391 - RNA, 21 nt, Human
ugaaaccaggguaacaccuuu

SEQ ID NO: 512392 - RNA, 20 nt, Human
ugaaauacaauccucagcca

SEQ ID NO: 512393 - RNA, 18 nt, Human
ugacaugcugucuccugc

SEQ ID NO: 512394 - RNA, 24 nt, Human
ugacaugcugucuccugccagcgg

SEQ ID NO: 512395 - RNA, 19 nt, Human
ugagaggagcagggcuaag

SEQ ID NO: 512396 - RNA, 22 nt, Human
ugaggaauuuuguagcuaccca

SEQ ID NO: 512397 - RNA, 21 nt, Human
ugcugcacaguuaugugaacg

SEQ ID NO: 512398 - RNA, 21 nt, Human
ugucaagagcaguuggugguu

SEQ ID NO: 512399 - RNA, 21 nt, Human
aacugguaccccacaggaccc

SEQ ID NO: 512400 - RNA, 23 nt, Human
aagccccccuucgagcuguggcc

SEQ ID NO: 512401 - RNA, 22 nt, Human
aagggccaggaccugaggggca

SEQ ID NO: 512402 - RNA, 23 nt, Human
acuggaccaaggagccgguugug

SEQ ID NO: 512403 - RNA, 21 nt, Human
agccggccggccgccggccuc

SEQ ID NO: 512404 - RNA, 19 nt, Human
agcuggucccgugagaccc

SEQ ID NO: 512405 - RNA, 21 nt, Human
agggaagaaauaaggccaccu

SEQ ID NO: 512406 - RNA, 22 nt, Human
agggaccuaggacaugcgaggg

SEQ ID NO: 512407 - RNA, 20 nt, Human
agggaguggggagggguggg

SEQ ID NO: 512408 - RNA, 24 nt, Human
agugcccagccacugcugggaggg

SEQ ID NO: 512409 - RNA, 21 nt, Human
cacugcugggaggggguugca

SEQ ID NO: 512410 - RNA, 20 nt, Human
cagaagccccagagcaucac

SEQ ID NO: 512411 - RNA, 24 nt, Human
cagagcaucacaagucuuuguaaa

SEQ ID NO: 512412 - RNA, 22 nt, Human
cagcaggcaccagggcccagau

SEQ ID NO: 512413 - RNA, 19 nt, Human
cagccggccggccgccggc

SEQ ID NO: 512414 - RNA, 22 nt, Human
caggcaccagggcccagauuuc

SEQ ID NO: 512415 - RNA, 25 nt, Human
ccacccaggacaauaaggguugugg

SEQ ID NO: 512416 - RNA, 18 nt, Human
ccauaggggaccagcuuc

SEQ ID NO: 512417 - RNA, 18 nt, Human
ccaucgccuccaccuacg

SEQ ID NO: 512418 - RNA, 23 nt, Human
ccaugaccaggaaaggguggggc

SEQ ID NO: 512419 - RNA, 20 nt, Human
cccaggacaauaaggguugu

SEQ ID NO: 512420 - RNA, 23 nt, Human
ccccaccccggugcagaacugga

SEQ ID NO: 512421 - RNA, 24 nt, Human
ccccagggaagggggagaagacua

SEQ ID NO: 512422 - RNA, 22 nt, Human
cccccacccaccaucacuggcc

SEQ ID NO: 512423 - RNA, 21 nt, Human
ccccgggucccagccccaccc

SEQ ID NO: 512424 - RNA, 18 nt, Human
cccggugcagaacuggac

SEQ ID NO: 512425 - RNA, 19 nt, Human
ccgcgcucucuccgcgggc

SEQ ID NO: 512426 - RNA, 21 nt, Human
ccugaggggcagagagagcuc

SEQ ID NO: 512427 - RNA, 21 nt, Human
cgccggccucccgcgccgcgc

SEQ ID NO: 512428 - RNA, 23 nt, Human
cgggagagaggugguacugaaaa

SEQ ID NO: 512429 - RNA, 26 nt, Human
cggggaaggcccagcccccacccacc

SEQ ID NO: 512430 - RNA, 23 nt, Human
cggugcagaacuggaccaaggag

SEQ ID NO: 512431 - RNA, 18 nt, Human
cgugacccaucgccucca

SEQ ID NO: 512432 - RNA, 22 nt, Human
cuacugaggaucuaaaagacca

SEQ ID NO: 512433 - RNA, 23 nt, Human
cucccgcgccgcgcucucuccgc

SEQ ID NO: 512434 - RNA, 18 nt, Human
cugaaaacacugaccgca

SEQ ID NO: 512435 - RNA, 22 nt, Human
cugggucacuaucacuuggggu

SEQ ID NO: 512436 - RNA, 19 nt, Human
gaagccccagagcaucaca

SEQ ID NO: 512437 - RNA, 22 nt, Human
gaccaggaaaggguggggcuug

SEQ ID NO: 512438 - RNA, 22 nt, Human
gaccuaggacaugcgaggguca

SEQ ID NO: 512439 - RNA, 22 nt, Human
gacugaaaccuggaccccuagc

SEQ ID NO: 512440 - RNA, 24 nt, Human
gaggggugggccuguggcugcagg

SEQ ID NO: 512441 - RNA, 22 nt, Human
gccccagagcaucacaagucuu

SEQ ID NO: 512442 - RNA, 27 nt, Human
gcccucaaaccuuccccgggucccagc

SEQ ID NO: 512443 - RNA, 21 nt, Human
ggaaggacaggucacaacagg

SEQ ID NO: 512444 - RNA, 22 nt, Human
ggagccgguugugcuuaacaug

SEQ ID NO: 512445 - RNA, 20 nt, Human
ggaguggggaggggugggcc

SEQ ID NO: 512446 - RNA, 18 nt, Human
ggaucuaaaagaccacug

SEQ ID NO: 512447 - RNA, 24 nt, Human
ggcccagcccccacccaccaucac

SEQ ID NO: 512448 - RNA, 23 nt, Human
ggcugggucaggccaagaugaau

SEQ ID NO: 512449 - RNA, 22 nt, Human
gggaagggggagaagacuaagu

SEQ ID NO: 512450 - RNA, 26 nt, Human
gggccaggaccugaggggcagagaga

SEQ ID NO: 512451 - RNA, 19 nt, Human
gggcuuggccacagaagcc

SEQ ID NO: 512452 - RNA, 22 nt, Human
gggcuuggccacagaagcccca

SEQ ID NO: 512453 - RNA, 23 nt, Human
gucacuaucacuuagccuuugga

SEQ ID NO: 512454 - RNA, 26 nt, Human
uaaauaaauaaguaaauagccaagug

SEQ ID NO: 512455 - RNA, 18 nt, Human
uaaauagccaagugggca

SEQ ID NO: 512456 - RNA, 18 nt, Human
uaacacucccacgcgcac

SEQ ID NO: 512457 - RNA, 18 nt, Human
uaccccacaggacccaac

SEQ ID NO: 512458 - RNA, 19 nt, Human
uacgggaucagggaguggg

SEQ ID NO: 512459 - RNA, 22 nt, Human
uaggaaccuaaacugguacccc

SEQ ID NO: 512460 - RNA, 18 nt, Human
uaucacuugggguccuga

SEQ ID NO: 512461 - RNA, 20 nt, Human
ucaaggaggggaggugacag

SEQ ID NO: 512462 - RNA, 21 nt, Human
ucaggccaagaugaauccaua

SEQ ID NO: 512463 - RNA, 21 nt, Human
ucagggaguggggaggggugg

SEQ ID NO: 512464 - RNA, 19 nt, Human
uccauaggggaccagcuuc

SEQ ID NO: 512465 - RNA, 20 nt, Human
ucccagccccaccccggugc

SEQ ID NO: 512466 - RNA, 22 nt, Human
ucccagccccaccccggugcag

SEQ ID NO: 512467 - RNA, 21 nt, Human
ucccgcgccgcgcucucuccg

SEQ ID NO: 512468 - RNA, 23 nt, Human
ucuacugaggaucuaaaagacca

SEQ ID NO: 512469 - RNA, 24 nt, Human
ucucucaggcuucuggacuguucu

SEQ ID NO: 512470 - RNA, 20 nt, Human
ugaauccauaggggaccagc

SEQ ID NO: 512471 - RNA, 19 nt, Human
ugacugaaaccuggacccc

SEQ ID NO: 512472 - RNA, 28 nt, Human
ugaggggcagagagagcucuccccgagg

SEQ ID NO: 512473 - RNA, 18 nt, Human
ugcugggaggggguugca

SEQ ID NO: 512474 - RNA, 24 nt, Human
uggaccaaggagccgguugugcuu

SEQ ID NO: 512475 - RNA, 22 nt, Human
uggccacagaagccccagagca

SEQ ID NO: 512476 - RNA, 18 nt, Human
uggcugcaggugcagugg

SEQ ID NO: 512477 - RNA, 20 nt, Human
uggcugcaggugcagugggg

SEQ ID NO: 512478 - RNA, 18 nt, Human
ugggaggggguugcaagg

SEQ ID NO: 512479 - RNA, 20 nt, Human
ugggaggggguugcaagggc

SEQ ID NO: 512480 - RNA, 24 nt, Human
ugggaggggguugcaagggcccuc

SEQ ID NO: 512481 - RNA, 21 nt, Human
ugggguccugauggguccacc

SEQ ID NO: 512482 - RNA, 19 nt, Human
uucccuagaccucugguug

SEQ ID NO: 512483 - RNA, 20 nt, Human
uucccuagaccucugguuga

SEQ ID NO: 512484 - RNA, 19 nt, Human
uuucaaggaggggagguga

SEQ ID NO: 512485 - RNA, 18 nt, Human
aaagaugacaagaaauua

SEQ ID NO: 512486 - RNA, 19 nt, Human
aaagugcuggaauuacagg

SEQ ID NO: 512487 - RNA, 24 nt, Human
aaagugcuggaauuacagguguga

SEQ ID NO: 512488 - RNA, 24 nt, Human
aacccgucccucuccagcugagcc

SEQ ID NO: 512489 - RNA, 24 nt, Human
aacgauucuccugccucagccucc

SEQ ID NO: 512490 - RNA, 20 nt, Human
aaggcaugguggggaaaaca

SEQ ID NO: 512491 - RNA, 24 nt, Human
aagggguuucaccauguuggccag

SEQ ID NO: 512492 - RNA, 26 nt, Human
aagugcuggaauuacaggugugagcc

SEQ ID NO: 512493 - RNA, 19 nt, Human
aaugauccacccaccucag

SEQ ID NO: 512494 - RNA, 18 nt, Human
aauuacaggugugagcca

SEQ ID NO: 512495 - RNA, 21 nt, Human
aauuacaggugugagccacca

SEQ ID NO: 512496 - RNA, 21 nt, Human
acaugggcaccuggcuguggc

SEQ ID NO: 512497 - RNA, 22 nt, Human
accauguuggccaggcuggucu

SEQ ID NO: 512498 - RNA, 23 nt, Human
accucagccucccaaagugcugg

SEQ ID NO: 512499 - RNA, 19 nt, Human
acugaaaucccccaggaag

SEQ ID NO: 512500 - RNA, 25 nt, Human
acuuuguugcccaggcuggagugca

SEQ ID NO: 512501 - RNA, 21 nt, Human
agacugaaaucccccaggaag

SEQ ID NO: 512502 - RNA, 22 nt, Human
agccugucagagaccagcccag

SEQ ID NO: 512503 - RNA, 19 nt, Human
aggcaaguuaucaauaaga

SEQ ID NO: 512504 - RNA, 21 nt, Human
aggcaugugccaccacgccca

SEQ ID NO: 512505 - RNA, 24 nt, Human
agggguuucaccauguuggccagg

SEQ ID NO: 512506 - RNA, 18 nt, Human
aggugugagccaccaagc

SEQ ID NO: 512507 - RNA, 23 nt, Human
aguagcugggaucauaggcaugu

SEQ ID NO: 512508 - RNA, 23 nt, Human
agugcaguggugcagucuuggcu

SEQ ID NO: 512509 - RNA, 24 nt, Human
agugcaguggugcagucuuggcuc

SEQ ID NO: 512510 - RNA, 24 nt, Human
augauccacccaccucagccuccc

SEQ ID NO: 512511 - RNA, 18 nt, Human
augugccaccacgcccag

SEQ ID NO: 512512 - RNA, 24 nt, Human
auuccuggccucaaaugauccacc

SEQ ID NO: 512513 - RNA, 24 nt, Human
caaaaggacagugcgucccaaccc

SEQ ID NO: 512514 - RNA, 22 nt, Human
caaaaguccggcuccaaaacua

SEQ ID NO: 512515 - RNA, 24 nt, Human
caaagugcuggaauuacaggugug

SEQ ID NO: 512516 - RNA, 19 nt, Human
caaaugauccacccaccuc

SEQ ID NO: 512517 - RNA, 21 nt, Human
caccauguuggccaggcuggu

SEQ ID NO: 512518 - RNA, 22 nt, Human
caccauguuggccaggcugguc

SEQ ID NO: 512519 - RNA, 23 nt, Human
caccauguuggccaggcuggucu

SEQ ID NO: 512520 - RNA, 24 nt, Human
caccauguuggccaggcuggucuu

SEQ ID NO: 512521 - RNA, 22 nt, Human
cacccaccucagccucccaaag

SEQ ID NO: 512522 - RNA, 23 nt, Human
cacccaccucagccucccaaagu

SEQ ID NO: 512523 - RNA, 22 nt, Human
cacuuuguugcccaggcuggag

SEQ ID NO: 512524 - RNA, 24 nt, Human
cacuuuguugcccaggcuggagug

SEQ ID NO: 512525 - RNA, 24 nt, Human
cagagucucacuuuguugcccagg

SEQ ID NO: 512526 - RNA, 19 nt, Human
cagcccagcucugaaauca

SEQ ID NO: 512527 - RNA, 24 nt, Human
caguagagaagggguuucaccaug

SEQ ID NO: 512528 - RNA, 25 nt, Human
caguagcugggaucauaggcaugug

SEQ ID NO: 512529 - RNA, 23 nt, Human
cagugcgucccaacccgucccuc

SEQ ID NO: 512530 - RNA, 27 nt, Human
caucuacuaccauauucuuuguucuuc

SEQ ID NO: 512531 - RNA, 21 nt, Human
caugugccaccacgcccagcu

SEQ ID NO: 512532 - RNA, 24 nt, Human
cauguuggccaggcuggucuugaa

SEQ ID NO: 512533 - RNA, 23 nt, Human
cauuccggauucacgaaucauuc

SEQ ID NO: 512534 - RNA, 21 nt, Human
ccaaagugcuggaauuacagg

SEQ ID NO: 512535 - RNA, 24 nt, Human
ccaaagugcuggaauuacaggugu

SEQ ID NO: 512536 - RNA, 26 nt, Human
ccacccaccucagccucccaaagugc

SEQ ID NO: 512537 - RNA, 19 nt, Human
ccacgcccagcuaauuauu

SEQ ID NO: 512538 - RNA, 19 nt, Human
cccaggcuggagugcagug

SEQ ID NO: 512539 - RNA, 22 nt, Human
ccucagacgcggggcgggcccu

SEQ ID NO: 512540 - RNA, 24 nt, Human
ccugccucagccuccccaguagcu

SEQ ID NO: 512541 - RNA, 24 nt, Human
ccuggccucaaaugauccacccac

SEQ ID NO: 512542 - RNA, 21 nt, Human
cgaaucauucuucaaaagucc

SEQ ID NO: 512543 - RNA, 18 nt, Human
cgauucuccugccucagc

SEQ ID NO: 512544 - RNA, 24 nt, Human
cucaaaugauccacccaccucagc

SEQ ID NO: 512545 - RNA, 24 nt, Human
cucacuuuguugcccaggcuggag

SEQ ID NO: 512546 - RNA, 24 nt, Human
cucagccuccccaguagcugggau

SEQ ID NO: 512547 - RNA, 18 nt, Human
cugagccugucagagacc

SEQ ID NO: 512548 - RNA, 19 nt, Human
cuuggcuuccaucuuggca

SEQ ID NO: 512549 - RNA, 19 nt, Human
gaagggguuucaccauguu

SEQ ID NO: 512550 - RNA, 22 nt, Human
gaagggguuucaccauguuggc

SEQ ID NO: 512551 - RNA, 19 nt, Human
gaccuccgcucccucagac

SEQ ID NO: 512552 - RNA, 18 nt, Human
gagaaaagggaauucggc

SEQ ID NO: 512553 - RNA, 19 nt, Human
gcccaggcuggagugcagu

SEQ ID NO: 512554 - RNA, 21 nt, Human
ggaaaacagaugcagagauag

SEQ ID NO: 512555 - RNA, 23 nt, Human
ggcaacuccaaaggcaugguggg

SEQ ID NO: 512556 - RNA, 24 nt, Human
ggccucaaaugauccacccaccuc

SEQ ID NO: 512557 - RNA, 18 nt, Human
gggguuucaccauguugg

SEQ ID NO: 512558 - RNA, 22 nt, Human
gggguuucaccauguuggccag

SEQ ID NO: 512559 - RNA, 23 nt, Human
gggguuucaccauguuggccagg

SEQ ID NO: 512560 - RNA, 20 nt, Human
ggguuaaaacgauucuccug

SEQ ID NO: 512561 - RNA, 20 nt, Human
gucccucuccagcugagccu

SEQ ID NO: 512562 - RNA, 24 nt, Human
gucucacuuuguugcccaggcugg

SEQ ID NO: 512563 - RNA, 22 nt, Human
uaaaaugccgugaugacgcugu

SEQ ID NO: 512564 - RNA, 24 nt, Human
uaauuauuguauuuucaguagaga

SEQ ID NO: 512565 - RNA, 24 nt, Human
uacaggugugagccaccaagccca

SEQ ID NO: 512566 - RNA, 21 nt, Human
uagagaagggguuucaccaug

SEQ ID NO: 512567 - RNA, 22 nt, Human
uagagaagggguuucaccaugu

SEQ ID NO: 512568 - RNA, 21 nt, Human
uauuucuccugcagucucuuu

SEQ ID NO: 512569 - RNA, 20 nt, Human
ucaaaugauccacccaccuc

SEQ ID NO: 512570 - RNA, 21 nt, Human
ucacugcagccugucuucugg

SEQ ID NO: 512571 - RNA, 22 nt, Human
ucacugcagccugucuucuggg

SEQ ID NO: 512572 - RNA, 22 nt, Human
ucacugcagccugucuucuggg

SEQ ID NO: 512573 - RNA, 24 nt, Human
ucacuuuguugcccaggcuggagu

SEQ ID NO: 512574 - RNA, 18 nt, Human
ucagccucccaaagugcu

SEQ ID NO: 512575 - RNA, 18 nt, Human
ucagccuccccaguagcu

SEQ ID NO: 512576 - RNA, 20 nt, Human
ucagccuccccaguagcugg

SEQ ID NO: 512577 - RNA, 24 nt, Human
ucaguagagaagggguuucaccau

SEQ ID NO: 512578 - RNA, 21 nt, Human
uccacccaccucagccuccca

SEQ ID NO: 512579 - RNA, 23 nt, Human
ucccaaagugcuggaauuacagg

SEQ ID NO: 512580 - RNA, 19 nt, Human
ucccaacccgucccucucc

SEQ ID NO: 512581 - RNA, 22 nt, Human
ucccaacccgucccucuccagc

SEQ ID NO: 512582 - RNA, 18 nt, Human
ucccccaggaagaccucc

SEQ ID NO: 512583 - RNA, 25 nt, Human
ucccccaggaagaccuccgcucccu

SEQ ID NO: 512584 - RNA, 19 nt, Human
ucccucuccagcugagccu

SEQ ID NO: 512585 - RNA, 23 nt, Human
ucucacuuuguugcccaggcugg

SEQ ID NO: 512586 - RNA, 24 nt, Human
ucucacuuuguugcccaggcugga

SEQ ID NO: 512587 - RNA, 25 nt, Human
ucuccugccucagccuccccaguag

SEQ ID NO: 512588 - RNA, 24 nt, Human
ucuucuggguuaaaacgauucucc

SEQ ID NO: 512589 - RNA, 23 nt, Human
ugaaaucccccaggaagaccucc

SEQ ID NO: 512590 - RNA, 24 nt, Human
ugauccacccaccucagccuccca

SEQ ID NO: 512591 - RNA, 22 nt, Human
ugcaguggugcagucuuggcuc

SEQ ID NO: 512592 - RNA, 18 nt, Human
ugcccaggcuggagugca

SEQ ID NO: 512593 - RNA, 21 nt, Human
ugcccaggcuggagugcagug

SEQ ID NO: 512594 - RNA, 24 nt, Human
ugcccaggcuggagugcaguggug

SEQ ID NO: 512595 - RNA, 21 nt, Human
ugccucagccuccccaguagc

SEQ ID NO: 512596 - RNA, 24 nt, Human
ugccucagccuccccaguagcugg

SEQ ID NO: 512597 - RNA, 24 nt, Human
ugcuggaauuacaggugugagcca

SEQ ID NO: 512598 - RNA, 18 nt, Human
uggaauuacaggugugag

SEQ ID NO: 512599 - RNA, 19 nt, Human
uggaauuacaggugugagc

SEQ ID NO: 512600 - RNA, 22 nt, Human
uggaauuacaggugugagccac

SEQ ID NO: 512601 - RNA, 24 nt, Human
uggaauuacaggugugagccacca

SEQ ID NO: 512602 - RNA, 28 nt, Human
uggagugcaguggugcaguccuagcacg

SEQ ID NO: 512603 - RNA, 23 nt, Human
uggagugcaguggugcagucuug

SEQ ID NO: 512604 - RNA, 24 nt, Human
uggagugcaguggugcagucuugg

SEQ ID NO: 512605 - RNA, 24 nt, Human
uggccaggcuggucuugaauuccu

SEQ ID NO: 512606 - RNA, 22 nt, Human
uggccucaaaugauccacccac

SEQ ID NO: 512607 - RNA, 18 nt, Human
ugggaucauaggcaugug

SEQ ID NO: 512608 - RNA, 21 nt, Human
ugggaucauaggcaugugcca

SEQ ID NO: 512609 - RNA, 22 nt, Human
ugggaucauaggcaugugccac

SEQ ID NO: 512610 - RNA, 24 nt, Human
ugggaucauaggcaugugccacca

SEQ ID NO: 512611 - RNA, 24 nt, Human
uggugcagucuuggcucacugcag

SEQ ID NO: 512612 - RNA, 21 nt, Human
uguugcccaggcuggagugca

SEQ ID NO: 512613 - RNA, 27 nt, Human
uuccuggccucaaaugauccacccacc

SEQ ID NO: 512614 - RNA, 24 nt, Human
uucuggguuaaaacgauucuccug

SEQ ID NO: 512615 - RNA, 24 nt, Human
uugcccaggcuggagugcaguggu

SEQ ID NO: 512616 - RNA, 24 nt, Human
uuucaccauguuggccaggcuggu

SEQ ID NO: 512617 - RNA, 24 nt, Human
uuuucaguagagaagggguuucac

SEQ ID NO: 512618 - RNA, 26 nt, Human
uuuuuauuuuuugaggcagagucuca

SEQ ID NO: 512619 - RNA, 25 nt, Human
uuuuuuauuuuuugaggcagagucu

SEQ ID NO: 512620 - RNA, 18 nt, Human
aaguuuauuuacaguagg

SEQ ID NO: 512621 - RNA, 22 nt, Human
acagauugugccauccaaaccc

SEQ ID NO: 512622 - RNA, 26 nt, Human
agaaauuaauaaaaagucagaaaucc

SEQ ID NO: 512623 - RNA, 20 nt, Human
aggaacaaucuggucaggug

SEQ ID NO: 512624 - RNA, 22 nt, Human
cagauggagcaagacagcagau

SEQ ID NO: 512625 - RNA, 21 nt, Human
cagcagauggguaaagcacac

SEQ ID NO: 512626 - RNA, 23 nt, Human
ccacaagcacaugaauuguaccu

SEQ ID NO: 512627 - RNA, 27 nt, Human
ccuccaagcaccuguugcgcuuggcuu

SEQ ID NO: 512628 - RNA, 18 nt, Human
cuuggcucuggucucaga

SEQ ID NO: 512629 - RNA, 19 nt, Human
gcugcuccuagucccaggc

SEQ ID NO: 512630 - RNA, 19 nt, Human
guacccaaaccuucugagu

SEQ ID NO: 512631 - RNA, 22 nt, Human
uaaagcacacgcuuucaaucca

SEQ ID NO: 512632 - RNA, 24 nt, Human
ucccaggcuccaacucaagccacu

SEQ ID NO: 512633 - RNA, 22 nt, Human
uccuaagucaguuggaaaaccc

SEQ ID NO: 512634 - RNA, 22 nt, Human
uccuagucccaggcuccaacuc

SEQ ID NO: 512635 - RNA, 20 nt, Human
ucuggucaggugaaguuuau

SEQ ID NO: 512636 - RNA, 22 nt, Human
ugaccuccaagcaccuguugcg

SEQ ID NO: 512637 - RNA, 23 nt, Human
uggaauagaugccuggaucuguc

SEQ ID NO: 512638 - RNA, 18 nt, Human
uuggugccaagucugcuu

SEQ ID NO: 512639 - RNA, 23 nt, Human
uuggugccaagucugcuuuccuu

SEQ ID NO: 512640 - RNA, 27 nt, Human
uuuuucgcugaguugcuugcuucugau

SEQ ID NO: 512641 - RNA, 26 nt, Human
aaaaaucuggaagaauuuacuaagug

SEQ ID NO: 512642 - RNA, 20 nt, Human
aaaagaaagaugucagauaa

SEQ ID NO: 512643 - RNA, 19 nt, Human
aaacaaauagaaaaaucug

SEQ ID NO: 512644 - RNA, 21 nt, Human
aauacugacauugccucaugc

SEQ ID NO: 512645 - RNA, 21 nt, Human
acaaaacccaugccauccaaa

SEQ ID NO: 512646 - RNA, 20 nt, Human
accaaaaucugguuuacauu

SEQ ID NO: 512647 - RNA, 26 nt, Human
acuuuaaggaagugucaaacaaauag

SEQ ID NO: 512648 - RNA, 24 nt, Human
agagcugauguguuuuuuaaauaa

SEQ ID NO: 512649 - RNA, 20 nt, Human
agaguccuucuagcccccuc

SEQ ID NO: 512650 - RNA, 19 nt, Human
agcaauguguauuccuuac

SEQ ID NO: 512651 - RNA, 20 nt, Human
agcagcaagaaguauuccaa

SEQ ID NO: 512652 - RNA, 23 nt, Human
aucguaauaaaagaauuuauguc

SEQ ID NO: 512653 - RNA, 22 nt, Human
caaaaaaguuuggcuggggcag

SEQ ID NO: 512654 - RNA, 18 nt, Human
caaaaauauucacaagug

SEQ ID NO: 512655 - RNA, 26 nt, Human
caauguacucuucuaggcugaauuaa

SEQ ID NO: 512656 - RNA, 20 nt, Human
cacuuccugcccaacaaaau

SEQ ID NO: 512657 - RNA, 21 nt, Human
cagaguccuucuagcccccuc

SEQ ID NO: 512658 - RNA, 19 nt, Human
ccaaauggcauagaaucaa

SEQ ID NO: 512659 - RNA, 18 nt, Human
cucacaaaaauauucaca

SEQ ID NO: 512660 - RNA, 18 nt, Human
gggacacaugaccugaaa

SEQ ID NO: 512661 - RNA, 21 nt, Human
uacugacauugccucaugcac

SEQ ID NO: 512662 - RNA, 19 nt, Human
uaucaugccaaauaccacu

SEQ ID NO: 512663 - RNA, 19 nt, Human
uaugacugaaaaaaugacu

SEQ ID NO: 512664 - RNA, 18 nt, Human
ucacaagugggaguuuuc

SEQ ID NO: 512665 - RNA, 21 nt, Human
ucagaguccuucuagcccccu

SEQ ID NO: 512666 - RNA, 19 nt, Human
ucgcgguuuuccaccagga

SEQ ID NO: 512667 - RNA, 20 nt, Human
ugaaaagaaagaugucagau

SEQ ID NO: 512668 - RNA, 20 nt, Human
ugagacagagcugauguguu

SEQ ID NO: 512669 - RNA, 18 nt, Human
uguaucaguccuucuucu

SEQ ID NO: 512670 - RNA, 20 nt, Human
uuuguaucaguccuucuucu

SEQ ID NO: 512671 - RNA, 19 nt, Human
aaccaagacaauauuuaca

SEQ ID NO: 512672 - RNA, 19 nt, Human
aaccuccaccuccuacguc

SEQ ID NO: 512673 - RNA, 23 nt, Human
aaguaccccugaauggcucaaag

SEQ ID NO: 512674 - RNA, 24 nt, Human
aaugcacaaguaccccugaauggc

SEQ ID NO: 512675 - RNA, 23 nt, Human
accugcggcuuuagccugcgcuu

SEQ ID NO: 512676 - RNA, 23 nt, Human
agaaaggcucaacagacgccuuc

SEQ ID NO: 512677 - RNA, 23 nt, Human
agagaaaccuaaaauguuaauau

SEQ ID NO: 512678 - RNA, 20 nt, Human
caccugcggcuuuagccugc

SEQ ID NO: 512679 - RNA, 23 nt, Human
ccacaaccuccaccuccuacguc

SEQ ID NO: 512680 - RNA, 26 nt, Human
cccgcaagccucaacucaggacuucg

SEQ ID NO: 512681 - RNA, 21 nt, Human
cgacgccucccucacgacuga

SEQ ID NO: 512682 - RNA, 22 nt, Human
cguaagacgaaguggggcuuuu

SEQ ID NO: 512683 - RNA, 24 nt, Human
cucaacagacgccuuccuuucgga

SEQ ID NO: 512684 - RNA, 22 nt, Human
ggaaaggaucccgcaagccuca

SEQ ID NO: 512685 - RNA, 20 nt, Human
uaaugcuagaaacacuaacu

SEQ ID NO: 512686 - RNA, 18 nt, Human
uauuuacaacuauauaca

SEQ ID NO: 512687 - RNA, 18 nt, Human
ucaacagacgccuuccuu

SEQ ID NO: 512688 - RNA, 24 nt, Human
ucaccugcggcuuuagccugcgcu

SEQ ID NO: 512689 - RNA, 19 nt, Human
uccacaaccuccaccuccu

SEQ ID NO: 512690 - RNA, 20 nt, Human
uuacaucuuuuuguguuggu

SEQ ID NO: 512691 - RNA, 22 nt, Human
uucauuuuuacauaaccaagac

SEQ ID NO: 512692 - RNA, 21 nt, Human
uuuaagaaugaaaacaagaaa

SEQ ID NO: 512693 - RNA, 21 nt, Human
uuuuuuuuuuuuuuuuuuaag

SEQ ID NO: 512694 - RNA, 20 nt, Human
aaaaacuuaaaaaaaagucu

SEQ ID NO: 512695 - RNA, 22 nt, Human
aaaagaucaguuacuaugaaaa

SEQ ID NO: 512696 - RNA, 21 nt, Human
aaacaccauggcaaccauuua

SEQ ID NO: 512697 - RNA, 18 nt, Human
aaacagaugccuaccuuc

SEQ ID NO: 512698 - RNA, 21 nt, Human
aaacuccaaagcauuuuggca

SEQ ID NO: 512699 - RNA, 26 nt, Human
aaauagagauaaaaggcaguccacag

SEQ ID NO: 512700 - RNA, 21 nt, Human
aaauccuuagacaaaagauca

SEQ ID NO: 512701 - RNA, 25 nt, Human
aacaagaauagccuccacacaucau

SEQ ID NO: 512702 - RNA, 22 nt, Human
aagcauacaugaccccuagcaa

SEQ ID NO: 512703 - RNA, 22 nt, Human
aagcauuuuggcaaucucggca

SEQ ID NO: 512704 - RNA, 22 nt, Human
aaucuauuuuggacuuuucuua

SEQ ID NO: 512705 - RNA, 20 nt, Human
aauuauuugaaaucauucaa

SEQ ID NO: 512706 - RNA, 22 nt, Human
acacaauguacagacaugaucc

SEQ ID NO: 512707 - RNA, 20 nt, Human
acacacgugcacacacagga

SEQ ID NO: 512708 - RNA, 30 nt, Human
acacaugugcacuugcacacacgugcacag

SEQ ID NO: 512709 - RNA, 19 nt, Human
accccuagcaaucaaagug

SEQ ID NO: 512710 - RNA, 22 nt, Human
acugaaucccccuugcugcagu

SEQ ID NO: 512711 - RNA, 20 nt, Human
agaaacaccauggcaaccau

SEQ ID NO: 512712 - RNA, 21 nt, Human
agaagaggcuauaaagaaaug

SEQ ID NO: 512713 - RNA, 18 nt, Human
agacccuaggauaagcau

SEQ ID NO: 512714 - RNA, 19 nt, Human
aggcagggaggggcuugga

SEQ ID NO: 512715 - RNA, 22 nt, Human
agguaaaaauccuuagacaaaa

SEQ ID NO: 512716 - RNA, 21 nt, Human
auaaaaggcaguccacauuca

SEQ ID NO: 512717 - RNA, 20 nt, Human
augaaaauaacaguuaaaac

SEQ ID NO: 512718 - RNA, 21 nt, Human
caacagguauagauauaaaaa

SEQ ID NO: 512719 - RNA, 26 nt, Human
caagacagauuuacuucagaagucaa

SEQ ID NO: 512720 - RNA, 21 nt, Human
cacauucauauuuucaagaca

SEQ ID NO: 512721 - RNA, 25 nt, Human
cacugaaucccccuugcugcaguuu

SEQ ID NO: 512722 - RNA, 24 nt, Human
cacuugcacacacgugcacacaca

SEQ ID NO: 512723 - RNA, 23 nt, Human
cauacaugaccccuagcaaucaa

SEQ ID NO: 512724 - RNA, 24 nt, Human
cauuuuggcaaucucggcaacacc

SEQ ID NO: 512725 - RNA, 23 nt, Human
cccuuaguacuuuaugcuuuguu

SEQ ID NO: 512726 - RNA, 21 nt, Human
ccuaggugucacucagaagca

SEQ ID NO: 512727 - RNA, 23 nt, Human
ccuccacacaucauuuuuacaaa

SEQ ID NO: 512728 - RNA, 18 nt, Human
cggaaagcagcugcgacu

SEQ ID NO: 512729 - RNA, 23 nt, Human
cggcaacaccggcuuccucggaa

SEQ ID NO: 512730 - RNA, 22 nt, Human
cuacacauuaaugguaaaacac

SEQ ID NO: 512731 - RNA, 21 nt, Human
cucuaggcugcacugccugcu

SEQ ID NO: 512732 - RNA, 20 nt, Human
cuuagaccaaagagagaggu

SEQ ID NO: 512733 - RNA, 18 nt, Human
cuucgaagcauacaugac

SEQ ID NO: 512734 - RNA, 20 nt, Human
cuuuucauucauuacacaau

SEQ ID NO: 512735 - RNA, 22 nt, Human
gaaaauaacaguuaaaacugca

SEQ ID NO: 512736 - RNA, 19 nt, Human
gaguuucuuacacuuggcu

SEQ ID NO: 512737 - RNA, 25 nt, Human
gauggagaaacaagaauagccucca

SEQ ID NO: 512738 - RNA, 18 nt, Human
gauuacauuuaugugcuu

SEQ ID NO: 512739 - RNA, 18 nt, Human
gcaaaaaccaaccucagg

SEQ ID NO: 512740 - RNA, 24 nt, Human
gcaaaaaccaaccucaggcauaca

SEQ ID NO: 512741 - RNA, 18 nt, Human
ggaggggcuuggaagaaa

SEQ ID NO: 512742 - RNA, 27 nt, Human
guaaaacacuuauuuuuagaaacacca

SEQ ID NO: 512743 - RNA, 20 nt, Human
uaaaaaaaaaccccuaugau

SEQ ID NO: 512744 - RNA, 24 nt, Human
uaaacagaugccuaccuuccuuua

SEQ ID NO: 512745 - RNA, 23 nt, Human
uaacauaauaacgcugauguuug

SEQ ID NO: 512746 - RNA, 23 nt, Human
uaaccagagguaaagccagggug

SEQ ID NO: 512747 - RNA, 26 nt, Human
uacacacacacaugugcacuugcaca

SEQ ID NO: 512748 - RNA, 22 nt, Human
uagacauagcuaucaagaguuu

SEQ ID NO: 512749 - RNA, 21 nt, Human
uaggugucacucagaagcauc

SEQ ID NO: 512750 - RNA, 23 nt, Human
uaugaaaauaacaguuaaaacug

SEQ ID NO: 512751 - RNA, 19 nt, Human
uauguccucucuucuguga

SEQ ID NO: 512752 - RNA, 25 nt, Human
uauuacacacacacaugugcacuug

SEQ ID NO: 512753 - RNA, 21 nt, Human
uccacauucauauuuucaaga

SEQ ID NO: 512754 - RNA, 20 nt, Human
ucggcaacaccggcuuccuc

SEQ ID NO: 512755 - RNA, 18 nt, Human
ucucuaggcugcacugcc

SEQ ID NO: 512756 - RNA, 21 nt, Human
ugacuuaggcuccucacaugg

SEQ ID NO: 512757 - RNA, 20 nt, Human
uggaagaaaagauaaaguga

SEQ ID NO: 512758 - RNA, 19 nt, Human
uggugucuggaccacaacc

SEQ ID NO: 512759 - RNA, 19 nt, Human
uguaaaauaauguucugca

SEQ ID NO: 512760 - RNA, 20 nt, Human
uguguuagagaucagaagag

SEQ ID NO: 512761 - RNA, 24 nt, Human
uguguuagagaucagaagaggcua

SEQ ID NO: 512762 - RNA, 28 nt, Human
uguguuauuacacacacacaugugcagg

SEQ ID NO: 512763 - RNA, 24 nt, Human
uuacacacacacaugugcacuugc

SEQ ID NO: 512764 - RNA, 21 nt, Human
uucaauaguuuguugcauguu

SEQ ID NO: 512765 - RNA, 25 nt, Human
uucgaagcauacaugaccccuagca

SEQ ID NO: 512766 - RNA, 20 nt, Human
uucuguucuuuacaaugugu

SEQ ID NO: 512767 - RNA, 24 nt, Human
uuuacuucagaagucaauugaaau

SEQ ID NO: 512768 - RNA, 22 nt, Human
aaaaaacagagacauuaaagga

SEQ ID NO: 512769 - RNA, 20 nt, Human
aaaaacaaaaacaaaacaga

SEQ ID NO: 512770 - RNA, 22 nt, Human
aaaaacagagacauuaaaggaa

SEQ ID NO: 512771 - RNA, 25 nt, Human
aaacaaaaacaaaacagaugguaga

SEQ ID NO: 512772 - RNA, 19 nt, Human
aaacagaugguagagccaa

SEQ ID NO: 512773 - RNA, 21 nt, Human
aaacagaugguagagccaaaa

SEQ ID NO: 512774 - RNA, 22 nt, Human
acagcccaauacaggaucaucc

SEQ ID NO: 512775 - RNA, 19 nt, Human
accucaggacaaagagaaa

SEQ ID NO: 512776 - RNA, 21 nt, Human
acgaaguuggaggaagcccuu

SEQ ID NO: 512777 - RNA, 22 nt, Human
agaauaaaaaauaaacagagga

SEQ ID NO: 512778 - RNA, 22 nt, Human
agacauuuauucacuucaacau

SEQ ID NO: 512779 - RNA, 22 nt, Human
aggaucauccaaaaacacguug

SEQ ID NO: 512780 - RNA, 18 nt, Human
caaaacagaugguagagc

SEQ ID NO: 512781 - RNA, 24 nt, Human
caaaacagaugguagagccaaaaa

SEQ ID NO: 512782 - RNA, 22 nt, Human
caagaauucuuccuuuugaaca

SEQ ID NO: 512783 - RNA, 26 nt, Human
caagauauagauaaaaacaaaaacaa

SEQ ID NO: 512784 - RNA, 22 nt, Human
caauuucacacgaaguuggagg

SEQ ID NO: 512785 - RNA, 21 nt, Human
cauccaaaaacacguugacac

SEQ ID NO: 512786 - RNA, 20 nt, Human
ccgaaaaaccucaggacaaa

SEQ ID NO: 512787 - RNA, 19 nt, Human
ccuccaaggaccacuggca

SEQ ID NO: 512788 - RNA, 19 nt, Human
cgaguuaauaacaacaucu

SEQ ID NO: 512789 - RNA, 22 nt, Human
cuccaaggaccacuggcacucu

SEQ ID NO: 512790 - RNA, 20 nt, Human
cuuggacucgaccuccaagg

SEQ ID NO: 512791 - RNA, 21 nt, Human
gaucauccaaaaacacguuga

SEQ ID NO: 512792 - RNA, 22 nt, Human
gcugaccugcucuagggaugaa

SEQ ID NO: 512793 - RNA, 20 nt, Human
ggacuccggcgccccagcuc

SEQ ID NO: 512794 - RNA, 22 nt, Human
ggcaagaauucuuccuuuugaa

SEQ ID NO: 512795 - RNA, 18 nt, Human
ggcuucaagccacguccu

SEQ ID NO: 512796 - RNA, 20 nt, Human
gggaaggaggcugaccugcu

SEQ ID NO: 512797 - RNA, 19 nt, Human
gugauguuuaaggccagga

SEQ ID NO: 512798 - RNA, 23 nt, Human
uaaaaaauaaacagaggaaauaa

SEQ ID NO: 512799 - RNA, 19 nt, Human
uaaguacagcccaauacag

SEQ ID NO: 512800 - RNA, 24 nt, Human
uaccaagauauagauaaaaacaaa

SEQ ID NO: 512801 - RNA, 23 nt, Human
uagaauaaaaaauaaacagagga

SEQ ID NO: 512802 - RNA, 25 nt, Human
uauagauaaaaacaaaaacaaaaca

SEQ ID NO: 512803 - RNA, 18 nt, Human
uauuucaaauauagcugc

SEQ ID NO: 512804 - RNA, 19 nt, Human
ucaggacaaagagaaagua

SEQ ID NO: 512805 - RNA, 18 nt, Human
ucauccaaaaacacguug

SEQ ID NO: 512806 - RNA, 18 nt, Human
uccuuggacucgaccucc

SEQ ID NO: 512807 - RNA, 23 nt, Human
ugacacuuccaagacacuggcac

SEQ ID NO: 512808 - RNA, 20 nt, Human
ugauguuuaaggccaggagc

SEQ ID NO: 512809 - RNA, 22 nt, Human
uguuuuguuuugcuuguuuuua

SEQ ID NO: 512810 - RNA, 22 nt, Human
uuaaggucagggagugcuagag

SEQ ID NO: 512811 - RNA, 19 nt, Human
uugaacaagaccgaaaaac

SEQ ID NO: 512812 - RNA, 19 nt, Human
uugaacaagaccgaaaaac

SEQ ID NO: 512813 - RNA, 22 nt, Human
uuuuguuuugcuuguuuuuaau

SEQ ID NO: 512814 - RNA, 23 nt, Human
aaaaaucaccacauuuauaagaa

SEQ ID NO: 512815 - RNA, 18 nt, Human
aacagcaccauuaagcca

SEQ ID NO: 512816 - RNA, 21 nt, Human
aagccagaaacuugcagggaa

SEQ ID NO: 512817 - RNA, 19 nt, Human
acugaucaugcugugcaug

SEQ ID NO: 512818 - RNA, 23 nt, Human
agcugcugcugguccgcucuggc

SEQ ID NO: 512819 - RNA, 27 nt, Human
aggcaccaaaaaucgcccuguauaaca

SEQ ID NO: 512820 - RNA, 18 nt, Human
aggcggcggccgcagcgc

SEQ ID NO: 512821 - RNA, 23 nt, Human
aggcggcggccgcagcgcuugag

SEQ ID NO: 512822 - RNA, 19 nt, Human
aucccugcuguaacucuga

SEQ ID NO: 512823 - RNA, 22 nt, Human
caucacccaucacaggcaagcc

SEQ ID NO: 512824 - RNA, 21 nt, Human
cauuaagccauuucaucuagc

SEQ ID NO: 512825 - RNA, 23 nt, Human
ccaaaaaucgcccuguauaacac

SEQ ID NO: 512826 - RNA, 18 nt, Human
ccaaucucaucuacugau

SEQ ID NO: 512827 - RNA, 18 nt, Human
ccaucacaggcaagccag

SEQ ID NO: 512828 - RNA, 22 nt, Human
cccaucacaggcaagccagaaa

SEQ ID NO: 512829 - RNA, 26 nt, Human
cccccaaucucaucuacugaucuuuu

SEQ ID NO: 512830 - RNA, 23 nt, Human
cccggcccggccgcccgcucggc

SEQ ID NO: 512831 - RNA, 23 nt, Human
ccucucuaaaagccucaucaccc

SEQ ID NO: 512832 - RNA, 23 nt, Human
cgccagcccggccgccggugcac

SEQ ID NO: 512833 - RNA, 21 nt, Human
cgcuugagcugcugcuggucc

SEQ ID NO: 512834 - RNA, 19 nt, Human
gcugcugguccgcucuggg

SEQ ID NO: 512835 - RNA, 19 nt, Human
ggcaagccagaaacuugca

SEQ ID NO: 512836 - RNA, 19 nt, Human
ggcccggccgcccgcucga

SEQ ID NO: 512837 - RNA, 19 nt, Human
uaacaccucucuaaaagcc

SEQ ID NO: 512838 - RNA, 22 nt, Human
uaacucccuaauuaacuggccg

SEQ ID NO: 512839 - RNA, 21 nt, Human
uagaagaagcagguaucuuug

SEQ ID NO: 512840 - RNA, 22 nt, Human
uagcucccugucuuuagucuuu

SEQ ID NO: 512841 - RNA, 18 nt, Human
ucaucuagcucccugucu

SEQ ID NO: 512842 - RNA, 20 nt, Human
ucaucugucacacaagacug

SEQ ID NO: 512843 - RNA, 19 nt, Human
ucuaaaagccucaucaccc

SEQ ID NO: 512844 - RNA, 21 nt, Human
ucucuaaaagccucaucaccc

SEQ ID NO: 512845 - RNA, 18 nt, Human
uguaucauauagaagaag

SEQ ID NO: 512846 - RNA, 22 nt, Human
uuauaagaagcucgcugaugcc

SEQ ID NO: 512847 - RNA, 21 nt, Human
uucaucuagcucccugucuuu

SEQ ID NO: 512848 - RNA, 19 nt, Human
uucaucugucacacaagac

SEQ ID NO: 512849 - RNA, 19 nt, Human
uuuacgcaaucugcucucc

SEQ ID NO: 512850 - RNA, 18 nt, Human
uuuuuuuuuuuuuugucc

SEQ ID NO: 512851 - RNA, 20 nt, Human
uuuuuuuuuuuuuuuguccu

SEQ ID NO: 512852 - RNA, 19 nt, Human
uuuuuuuuuuuuuuuuugu

SEQ ID NO: 512853 - RNA, 27 nt, Human
uuuuuuuuuuuuuuuuuuuuuuugggg

SEQ ID NO: 512854 - RNA, 21 nt, Human
aagagggaggagaagaggagg

SEQ ID NO: 512855 - RNA, 18 nt, Human
agaagugagggagggaga

SEQ ID NO: 512856 - RNA, 19 nt, Human
agaggaaggaggggggaga

SEQ ID NO: 512857 - RNA, 21 nt, Human
agaggaaggaggggggagauu

SEQ ID NO: 512858 - RNA, 20 nt, Human
agagggaggagaagaggagg

SEQ ID NO: 512859 - RNA, 22 nt, Human
aggaggaagggaaagggcagaa

SEQ ID NO: 512860 - RNA, 27 nt, Human
aggaggaagggaaagggcagaagugag

SEQ ID NO: 512861 - RNA, 18 nt, Human
aggaggaggaagggaaag

SEQ ID NO: 512862 - RNA, 26 nt, Human
aggaggggggagaugagggaagaggg

SEQ ID NO: 512863 - RNA, 19 nt, Human
aggcacucagggaagauaa

SEQ ID NO: 512864 - RNA, 19 nt, Human
aggcaggcagaugcagagg

SEQ ID NO: 512865 - RNA, 28 nt, Human
agggaggagaagaggaggaggaagggaa

SEQ ID NO: 512866 - RNA, 22 nt, Human
aggggggagaugagggaagagg

SEQ ID NO: 512867 - RNA, 18 nt, Human
augagggaagagggagga

SEQ ID NO: 512868 - RNA, 18 nt, Human
caggaucugugggcucag

SEQ ID NO: 512869 - RNA, 23 nt, Human
caggugguuccugagacagguga

SEQ ID NO: 512870 - RNA, 19 nt, Human
ccacugggaagggacccag

SEQ ID NO: 512871 - RNA, 18 nt, Human
ccaggcacucagggaaga

SEQ ID NO: 512872 - RNA, 18 nt, Human
ccccaggguagcccuccu

SEQ ID NO: 512873 - RNA, 20 nt, Human
ccugagcagcgagcuggccc

SEQ ID NO: 512874 - RNA, 21 nt, Human
cucccaaugugcagaguccac

SEQ ID NO: 512875 - RNA, 21 nt, Human
cucucaggccucccagugguc

SEQ ID NO: 512876 - RNA, 24 nt, Human
cugagcagcgagcuggcccacucu

SEQ ID NO: 512877 - RNA, 23 nt, Human
cugcccuggccgcugcccacagg

SEQ ID NO: 512878 - RNA, 21 nt, Human
gagcagucugcuccccgcugg

SEQ ID NO: 512879 - RNA, 28 nt, Human
gaggaggaagggaaagggcagaagugag

SEQ ID NO: 512880 - RNA, 21 nt, Human
gccucaguuuccccaguggcu

SEQ ID NO: 512881 - RNA, 21 nt, Human
gccugagcagcgagcuggccc

SEQ ID NO: 512882 - RNA, 21 nt, Human
ggaagagggaggagaagagga

SEQ ID NO: 512883 - RNA, 22 nt, Human
gggaagagggaggagaagagga

SEQ ID NO: 512884 - RNA, 22 nt, Human
gggaagagggaggagaagagga

SEQ ID NO: 512885 - RNA, 21 nt, Human
gggggagaugagggaagaggg

SEQ ID NO: 512886 - RNA, 22 nt, Human
ggguggggcagaggaaggaggg

SEQ ID NO: 512887 - RNA, 24 nt, Human
ggugaacucucagccccaggguag

SEQ ID NO: 512888 - RNA, 21 nt, Human
gguggggcagaggaaggaggg

SEQ ID NO: 512889 - RNA, 18 nt, Human
gguuuugccucaguuucc

SEQ ID NO: 512890 - RNA, 21 nt, Human
gugguuccugagacaggugaa

SEQ ID NO: 512891 - RNA, 19 nt, Human
uaaaacagcccagcuaagc

SEQ ID NO: 512892 - RNA, 23 nt, Human
ucagccccaggguagcccuccuc

SEQ ID NO: 512893 - RNA, 24 nt, Human
ugagggaagagggaggagaagagg

SEQ ID NO: 512894 - RNA, 18 nt, Human
ugagggagggagacccag

SEQ ID NO: 512895 - RNA, 21 nt, Human
ugcccuggccgcugcccacag

SEQ ID NO: 512896 - RNA, 22 nt, Human
ugccucaguuuccccaguggcu

SEQ ID NO: 512897 - RNA, 20 nt, Human
ugcuugugguugcaaguguu

SEQ ID NO: 512898 - RNA, 20 nt, Human
ugggaagggacccagggagc

SEQ ID NO: 512899 - RNA, 24 nt, Human
ugggaagggacccagggagcggcg

SEQ ID NO: 512900 - RNA, 18 nt, Human
ugggcucaggugguuccu

SEQ ID NO: 512901 - RNA, 20 nt, Human
uuaaugcaagagggcagguc

SEQ ID NO: 512902 - RNA, 21 nt, Human
uuuauaaggcucccaaugugc

SEQ ID NO: 512903 - RNA, 20 nt, Human
aaauagguaacauuguaaua

SEQ ID NO: 512904 - RNA, 21 nt, Human
aagaaauagguaacaucaaaa

SEQ ID NO: 512905 - RNA, 26 nt, Human
cagaaacuuacaaacugggucaaaaa

SEQ ID NO: 512906 - RNA, 21 nt, Human
caggggucucccuauuaacuu

SEQ ID NO: 512907 - RNA, 23 nt, Human
cuccugcugacagaaacuuacaa

SEQ ID NO: 512908 - RNA, 20 nt, Human
gccccgcaaaccugcucccc

SEQ ID NO: 512909 - RNA, 23 nt, Human
gguaauaggagacccacaagaaa

SEQ ID NO: 512910 - RNA, 18 nt, Human
uacuccugggccuauccu

SEQ ID NO: 512911 - RNA, 23 nt, Human
ucacaauauauaaugagcauccu

SEQ ID NO: 512912 - RNA, 20 nt, Human
ucuccugcugacagaaacuu

SEQ ID NO: 512913 - RNA, 25 nt, Human
ucuccugcugacagaaacuuacaaa

SEQ ID NO: 512914 - RNA, 24 nt, Human
ugggucaaaaacaacauucauuua

SEQ ID NO: 512915 - RNA, 22 nt, Human
uugcuuuuuaaaacuguuuuau

SEQ ID NO: 512916 - RNA, 21 nt, Human
uuuugcuuuuuaaaacuguuu

SEQ ID NO: 512917 - RNA, 20 nt, Human
uuuuuuuuuuuuuugcuuuu

SEQ ID NO: 512918 - RNA, 22 nt, Human
uuuuuuuuuuuuuugcuuuuua

SEQ ID NO: 512919 - RNA, 31 nt, Human
aaaaaucaacaacaacuauauuuuggacaaa

SEQ ID NO: 512920 - RNA, 19 nt, Human
aaagauauaauucuuugga

SEQ ID NO: 512921 - RNA, 22 nt, Human
aaccccuugagaugaaaacaaa

SEQ ID NO: 512922 - RNA, 18 nt, Human
aaccugguucuugaauga

SEQ ID NO: 512923 - RNA, 24 nt, Human
aacuuguucccaucccagucucca

SEQ ID NO: 512924 - RNA, 21 nt, Human
aaggauuugguacaaacugca

SEQ ID NO: 512925 - RNA, 24 nt, Human
acaagaaaaggaugcaaggcuucu

SEQ ID NO: 512926 - RNA, 19 nt, Human
acgauaacggcggaauauc

SEQ ID NO: 512927 - RNA, 22 nt, Human
agaagauggaaacaaaaucaaa

SEQ ID NO: 512928 - RNA, 19 nt, Human
agagauaauagugaagagu

SEQ ID NO: 512929 - RNA, 23 nt, Human
agauaauagugaagaguguggag

SEQ ID NO: 512930 - RNA, 18 nt, Human
agauuuuuuuuuuuuaag

SEQ ID NO: 512931 - RNA, 22 nt, Human
agggcugggaugacuucugagc

SEQ ID NO: 512932 - RNA, 24 nt, Human
augaacaaacacaguucauguaaa

SEQ ID NO: 512933 - RNA, 28 nt, Human
augcaaggcuucuacguuacacuuugga

SEQ ID NO: 512934 - RNA, 21 nt, Human
caaagaagcggccacucaaac

SEQ ID NO: 512935 - RNA, 22 nt, Human
caaagaagcggccacucaaacc

SEQ ID NO: 512936 - RNA, 21 nt, Human
caggagauucagagggcuggg

SEQ ID NO: 512937 - RNA, 19 nt, Human
caggccaaagggaagcuga

SEQ ID NO: 512938 - RNA, 19 nt, Human
caggccaaagggaagcuga

SEQ ID NO: 512939 - RNA, 20 nt, Human
ccaaacagaucccaacacua

SEQ ID NO: 512940 - RNA, 24 nt, Human
ccacgauaacggcggaauaucccu

SEQ ID NO: 512941 - RNA, 24 nt, Human
ccaucccagucuccaaacagaucc

SEQ ID NO: 512942 - RNA, 18 nt, Human
cccagggaaccccuugag

SEQ ID NO: 512943 - RNA, 21 nt, Human
ccccuuaggucagaaugaaca

SEQ ID NO: 512944 - RNA, 23 nt, Human
ccugggccacgauaacggcggaa

SEQ ID NO: 512945 - RNA, 22 nt, Human
cugauggccacaacauuucauu

SEQ ID NO: 512946 - RNA, 22 nt, Human
cuuggcuuucauuucacagggc

SEQ ID NO: 512947 - RNA, 23 nt, Human
cuuuugagucucugauggccaca

SEQ ID NO: 512948 - RNA, 18 nt, Human
gaagauuacagaagaugg

SEQ ID NO: 512949 - RNA, 19 nt, Human
gaaggugcugauuaggacu

SEQ ID NO: 512950 - RNA, 23 nt, Human
gaaggugcugauuaggacuggga

SEQ ID NO: 512951 - RNA, 19 nt, Human
gaggacuucuggcuugaaa

SEQ ID NO: 512952 - RNA, 20 nt, Human
gccugcagccuugucucugg

SEQ ID NO: 512953 - RNA, 20 nt, Human
gggagaguggugacaaagaa

SEQ ID NO: 512954 - RNA, 24 nt, Human
gggagaguggugacaaagaagcgg

SEQ ID NO: 512955 - RNA, 21 nt, Human
gggaugcucaggagccaaggc

SEQ ID NO: 512956 - RNA, 24 nt, Human
gguaagaaauaaaacauagcacag

SEQ ID NO: 512957 - RNA, 22 nt, Human
guggugacaaagaagcggccac

SEQ ID NO: 512958 - RNA, 23 nt, Human
uaaaaaaaaaucaacaacaacua

SEQ ID NO: 512959 - RNA, 23 nt, Human
uaaaacauagcacaggagauuca

SEQ ID NO: 512960 - RNA, 24 nt, Human
uaagaaauaaaacauagcacagga

SEQ ID NO: 512961 - RNA, 24 nt, Human
uacacaagaaaaggaugcaaggcu

SEQ ID NO: 512962 - RNA, 26 nt, Human
uacacaagaaaaggaugcaaggcuuc

SEQ ID NO: 512963 - RNA, 24 nt, Human
uacccaaggcccuuucaauuucua

SEQ ID NO: 512964 - RNA, 22 nt, Human
uagccucccuggguacuuacag

SEQ ID NO: 512965 - RNA, 19 nt, Human
uaggucagaaugaacaaac

SEQ ID NO: 512966 - RNA, 23 nt, Human
uauuaaaguaguucaagacccag

SEQ ID NO: 512967 - RNA, 19 nt, Human
ucaauuucuagcugugaaa

SEQ ID NO: 512968 - RNA, 19 nt, Human
ucccaacacuacguuuguu

SEQ ID NO: 512969 - RNA, 24 nt, Human
ucccaacacuacguuuguuuuucu

SEQ ID NO: 512970 - RNA, 25 nt, Human
uccuuaguauacaugaggcuuacug

SEQ ID NO: 512971 - RNA, 18 nt, Human
ucugucuuguaaaauccu

SEQ ID NO: 512972 - RNA, 24 nt, Human
ugaaaaaaugcugggagaguggug

SEQ ID NO: 512973 - RNA, 22 nt, Human
ugaaaacaaaacaguauucaac

SEQ ID NO: 512974 - RNA, 19 nt, Human
ugaagaguguggagagccu

SEQ ID NO: 512975 - RNA, 20 nt, Human
ugacaaaaauaaauacuuua

SEQ ID NO: 512976 - RNA, 18 nt, Human
ugacuucugagcugcucu

SEQ ID NO: 512977 - RNA, 20 nt, Human
ugagaugaaaacaaaacagu

SEQ ID NO: 512978 - RNA, 18 nt, Human
ugccaugagaccaaauga

SEQ ID NO: 512979 - RNA, 25 nt, Human
ugccaugagaccaaaugacuagaga

SEQ ID NO: 512980 - RNA, 22 nt, Human
uggaaacaaaaucaaaucuuuc

SEQ ID NO: 512981 - RNA, 20 nt, Human
uggcuuucauuucacagggc

SEQ ID NO: 512982 - RNA, 21 nt, Human
ugggagaguggugacaaagaa

SEQ ID NO: 512983 - RNA, 18 nt, Human
uguucccaucccagucuc

SEQ ID NO: 512984 - RNA, 22 nt, Human
uucaugcacuguggugccugau

SEQ ID NO: 512985 - RNA, 27 nt, Human
uugguacaaacugcaggccaaagggaa

SEQ ID NO: 512986 - RNA, 19 nt, Human
uuuaagagaagcuugcuca

SEQ ID NO: 512987 - RNA, 22 nt, Human
uuucacuuucagguacuggagu

SEQ ID NO: 512988 - RNA, 23 nt, Human
uuuuaaggaaauuagccucccug

SEQ ID NO: 512989 - RNA, 22 nt, Human
aaauucacccacagcagaggcc

SEQ ID NO: 512990 - RNA, 25 nt, Human
aagcaauccucccaccucagccucc

SEQ ID NO: 512991 - RNA, 18 nt, Human
aagcaaucuuccuaccuc

SEQ ID NO: 512992 - RNA, 18 nt, Human
aaggugcccuuaggcccc

SEQ ID NO: 512993 - RNA, 22 nt, Human
acagcaggcagccucagccuca

SEQ ID NO: 512994 - RNA, 19 nt, Human
acugcagccuccacuuccu

SEQ ID NO: 512995 - RNA, 20 nt, Human
aggcagaacgggcuccugca

SEQ ID NO: 512996 - RNA, 23 nt, Human
aggccaggcugggaccuccuucc

SEQ ID NO: 512997 - RNA, 21 nt, Human
aggccucaauuagaggccuac

SEQ ID NO: 512998 - RNA, 24 nt, Human
aggcggccuccgagccccugggcc

SEQ ID NO: 512999 - RNA, 20 nt, Human
agggagccacagauggagag

SEQ ID NO: 513000 - RNA, 22 nt, Human
aggggccgcgaggaaggcccag

SEQ ID NO: 513001 - RNA, 19 nt, Human
agguugcccaggcugcucu

SEQ ID NO: 513002 - RNA, 24 nt, Human
auaggucacugcagccuccacuuc

SEQ ID NO: 513003 - RNA, 18 nt, Human
aucacugcucaucccugg

SEQ ID NO: 513004 - RNA, 21 nt, Human
aucucaccuuuguacccugcc

SEQ ID NO: 513005 - RNA, 18 nt, Human
caaaaacccgacuuaaag

SEQ ID NO: 513006 - RNA, 27 nt, Human
caagcaauccucccaccucagccuccc

SEQ ID NO: 513007 - RNA, 27 nt, Human
caagcaaucuuccuaccuccaccuccc

SEQ ID NO: 513008 - RNA, 22 nt, Human
caaugggguagacgcucucaca

SEQ ID NO: 513009 - RNA, 21 nt, Human
cacaguccacguccaucagca

SEQ ID NO: 513010 - RNA, 22 nt, Human
cacaguccacguccaucagcac

SEQ ID NO: 513011 - RNA, 24 nt, Human
cacaguccacguccaucagcaccc

SEQ ID NO: 513012 - RNA, 24 nt, Human
caccucagccuccccaguagcugg

SEQ ID NO: 513013 - RNA, 24 nt, Human
cagaaauucacccacagcagaggc

SEQ ID NO: 513014 - RNA, 20 nt, Human
cagcaggcagccucagccuc

SEQ ID NO: 513015 - RNA, 19 nt, Human
cagccuccacuuccugggc

SEQ ID NO: 513016 - RNA, 23 nt, Human
cagccuccacuuccugggcucaa

SEQ ID NO: 513017 - RNA, 24 nt, Human
cagcgucuugauagguugcccagg

SEQ ID NO: 513018 - RNA, 24 nt, Human
cagggucuugcucugucacccagg

SEQ ID NO: 513019 - RNA, 26 nt, Human
caguagcugggaccacaggcacgcac

SEQ ID NO: 513020 - RNA, 22 nt, Human
caucggaaccugggcaggcuuc

SEQ ID NO: 513021 - RNA, 26 nt, Human
ccacagcagaggccaggccucaauua

SEQ ID NO: 513022 - RNA, 22 nt, Human
ccaccucagccuccccaguagc

SEQ ID NO: 513023 - RNA, 19 nt, Human
ccagaaucucacugcggac

SEQ ID NO: 513024 - RNA, 23 nt, Human
ccaguacagaaauucacccacag

SEQ ID NO: 513025 - RNA, 19 nt, Human
ccaucggaaccugggcagg

SEQ ID NO: 513026 - RNA, 19 nt, Human
cccaacaagccccuguccc

SEQ ID NO: 513027 - RNA, 24 nt, Human
cccacagcagaggccaggccucaa

SEQ ID NO: 513028 - RNA, 20 nt, Human
ccccagccuuacacagaguc

SEQ ID NO: 513029 - RNA, 21 nt, Human
ccccagccuuacacagagucc

SEQ ID NO: 513030 - RNA, 21 nt, Human
cccccaggacagcaggcagcc

SEQ ID NO: 513031 - RNA, 19 nt, Human
ccccugggcacccgugauc

SEQ ID NO: 513032 - RNA, 23 nt, Human
ccccugggcacccgugauccgcc

SEQ ID NO: 513033 - RNA, 21 nt, Human
cccuggaccauucagaaccuc

SEQ ID NO: 513034 - RNA, 22 nt, Human
cccuuaggccccaacaagcccc

SEQ ID NO: 513035 - RNA, 24 nt, Human
cccuuaggccccaacaagccccug

SEQ ID NO: 513036 - RNA, 19 nt, Human
ccgcgaggaaggcccaggg

SEQ ID NO: 513037 - RNA, 18 nt, Human
ccucaguccccaaggccu

SEQ ID NO: 513038 - RNA, 19 nt, Human
ccuccacuuccugggcuca

SEQ ID NO: 513039 - RNA, 25 nt, Human
ccucccaccucagccuccccaguag

SEQ ID NO: 513040 - RNA, 21 nt, Human
ccuccuucccuagggaguccu

SEQ ID NO: 513041 - RNA, 20 nt, Human
ccugggcucaagcaauccuc

SEQ ID NO: 513042 - RNA, 20 nt, Human
ccuuaggccccaacaagccc

SEQ ID NO: 513043 - RNA, 22 nt, Human
cgacuuaaaguagcucagacac

SEQ ID NO: 513044 - RNA, 24 nt, Human
cggaaccugggcaggcuucccaga

SEQ ID NO: 513045 - RNA, 19 nt, Human
cggggcugcaggagaggca

SEQ ID NO: 513046 - RNA, 19 nt, Human
cuacacaaugggguagacg

SEQ ID NO: 513047 - RNA, 24 nt, Human
cuagagcacccagccgccacucag

SEQ ID NO: 513048 - RNA, 24 nt, Human
cucaagcaauccucccaccucagc

SEQ ID NO: 513049 - RNA, 24 nt, Human
cucaagcaaucuuccuaccuccac

SEQ ID NO: 513050 - RNA, 23 nt, Human
cucacaguccacguccaucagca

SEQ ID NO: 513051 - RNA, 24 nt, Human
cucagccuccccaguagcugggac

SEQ ID NO: 513052 - RNA, 24 nt, Human
cuccccaguagcugggaccacagg

SEQ ID NO: 513053 - RNA, 23 nt, Human
cuccccaguuguugcgccauggu

SEQ ID NO: 513054 - RNA, 20 nt, Human
cucugucacccaggcuggag

SEQ ID NO: 513055 - RNA, 23 nt, Human
cugcagccuccacuuccugggcu

SEQ ID NO: 513056 - RNA, 21 nt, Human
cuggccucaagcaaucuuccu

SEQ ID NO: 513057 - RNA, 22 nt, Human
cuggccucaagcaaucuuccua

SEQ ID NO: 513058 - RNA, 19 nt, Human
cugucacccaggcuggagu

SEQ ID NO: 513059 - RNA, 19 nt, Human
cuucccagaggaggcggcc

SEQ ID NO: 513060 - RNA, 24 nt, Human
cuuccugggcucaagcaauccucc

SEQ ID NO: 513061 - RNA, 21 nt, Human
cuugcucugucacccaggcug

SEQ ID NO: 513062 - RNA, 24 nt, Human
cuugcucugucacccaggcuggag

SEQ ID NO: 513063 - RNA, 20 nt, Human
gaggaggcggccuccgagcc

SEQ ID NO: 513064 - RNA, 19 nt, Human
gaguggcaggugucuggga

SEQ ID NO: 513065 - RNA, 21 nt, Human
gauggagagggaugauggggg

SEQ ID NO: 513066 - RNA, 21 nt, Human
gccaacaggggccgcgaggaa

SEQ ID NO: 513067 - RNA, 24 nt, Human
gccccaacaagccccuguccccag

SEQ ID NO: 513068 - RNA, 19 nt, Human
gcuccaucugcaggcacug

SEQ ID NO: 513069 - RNA, 25 nt, Human
gcucugucacccaggcuggaguaca

SEQ ID NO: 513070 - RNA, 26 nt, Human
gcugcuguuguggacucuccgagggu

SEQ ID NO: 513071 - RNA, 21 nt, Human
gcuggaguacaguggugccag

SEQ ID NO: 513072 - RNA, 19 nt, Human
gcuugaggcaucacugcuc

SEQ ID NO: 513073 - RNA, 23 nt, Human
ggacuccuggccucaagcaaucu

SEQ ID NO: 513074 - RNA, 18 nt, Human
ggagagggaugauggggg

SEQ ID NO: 513075 - RNA, 20 nt, Human
ggagagggaugaugggggug

SEQ ID NO: 513076 - RNA, 24 nt, Human
ggaucugggcugugcccggagagg

SEQ ID NO: 513077 - RNA, 19 nt, Human
ggcuccugcaguucccaag

SEQ ID NO: 513078 - RNA, 30 nt, Human
gggguggaucugggcugugcccggagaggg

SEQ ID NO: 513079 - RNA, 18 nt, Human
guagcugggaccacaggc

SEQ ID NO: 513080 - RNA, 21 nt, Human
uacacaaugggguagacgcuc

SEQ ID NO: 513081 - RNA, 27 nt, Human
uacccugcccucacuggcugcgucuca

SEQ ID NO: 513082 - RNA, 18 nt, Human
uaccuccaccuccccagu

SEQ ID NO: 513083 - RNA, 23 nt, Human
uagaggccuacacaaugggguag

SEQ ID NO: 513084 - RNA, 20 nt, Human
uagccaagaugagacucuca

SEQ ID NO: 513085 - RNA, 23 nt, Human
uagguugcccaggcugcucuggg

SEQ ID NO: 513086 - RNA, 19 nt, Human
ucacuagagcacccagccg

SEQ ID NO: 513087 - RNA, 21 nt, Human
ucacuagagcacccagccgcc

SEQ ID NO: 513088 - RNA, 24 nt, Human
ucacugcagccuccacuuccuggg

SEQ ID NO: 513089 - RNA, 18 nt, Human
ucagccuccccaguagcu

SEQ ID NO: 513090 - RNA, 22 nt, Human
ucccaaggugcccuuaggcccc

SEQ ID NO: 513091 - RNA, 20 nt, Human
ucccaccucagccuccccag

SEQ ID NO: 513092 - RNA, 21 nt, Human
ucccaccucagccuccccagu

SEQ ID NO: 513093 - RNA, 18 nt, Human
ucccagggaaggcuuuga

SEQ ID NO: 513094 - RNA, 18 nt, Human
ucccaguacugagaccca

SEQ ID NO: 513095 - RNA, 22 nt, Human
uccccaguagcugggaccacag

SEQ ID NO: 513096 - RNA, 22 nt, Human
ucccugauugaccaccugguuu

SEQ ID NO: 513097 - RNA, 22 nt, Human
uccgccagggccucagucccca

SEQ ID NO: 513098 - RNA, 18 nt, Human
uccugggcucaagcaauc

SEQ ID NO: 513099 - RNA, 21 nt, Human
ucggaaccugggcaggcuucc

SEQ ID NO: 513100 - RNA, 20 nt, Human
ucgguggugcucccugauug

SEQ ID NO: 513101 - RNA, 20 nt, Human
ucugcuucccucuguguggc

SEQ ID NO: 513102 - RNA, 18 nt, Human
ucugucacccaggcugga

SEQ ID NO: 513103 - RNA, 24 nt, Human
ucugucacccaggcuggaguacag

SEQ ID NO: 513104 - RNA, 23 nt, Human
ucuugcucugucacccaggcugg

SEQ ID NO: 513105 - RNA, 24 nt, Human
ucuugcucugucacccaggcugga

SEQ ID NO: 513106 - RNA, 23 nt, Human
ugaugggagucagaggccccagg

SEQ ID NO: 513107 - RNA, 18 nt, Human
ugauggggguggaucugg

SEQ ID NO: 513108 - RNA, 21 nt, Human
ugcaggcacuguuggaaccag

SEQ ID NO: 513109 - RNA, 23 nt, Human
ugcagggggugggggaauugggg

SEQ ID NO: 513110 - RNA, 23 nt, Human
ugcccuuaggccccaacaagccc

SEQ ID NO: 513111 - RNA, 18 nt, Human
ugcucugggacuccuggc

SEQ ID NO: 513112 - RNA, 20 nt, Human
ugcuggagguaggagccaug

SEQ ID NO: 513113 - RNA, 21 nt, Human
ugcuguuguggacucuccgag

SEQ ID NO: 513114 - RNA, 18 nt, Human
uggagagggaugaugggg

SEQ ID NO: 513115 - RNA, 28 nt, Human
uggaguacaguggugccauccuagcacg

SEQ ID NO: 513116 - RNA, 20 nt, Human
uggccucaagcaaucuuccu

SEQ ID NO: 513117 - RNA, 21 nt, Human
uggccucaagcaaucuuccua

SEQ ID NO: 513118 - RNA, 25 nt, Human
uggccucaagcaaucuuccuaccuc

SEQ ID NO: 513119 - RNA, 24 nt, Human
uggcuccaucugcaggcacuguug

SEQ ID NO: 513120 - RNA, 18 nt, Human
uggcugcgucucauuucu

SEQ ID NO: 513121 - RNA, 21 nt, Human
ugggaccacaggcacgcacca

SEQ ID NO: 513122 - RNA, 24 nt, Human
ugggaccacaggcacgcaccacca

SEQ ID NO: 513123 - RNA, 25 nt, Human
ugggggaauuggggccaacaggggc

SEQ ID NO: 513124 - RNA, 22 nt, Human
ugucccagcaucugucucuccg

SEQ ID NO: 513125 - RNA, 22 nt, Human
ugugaggggcagggagccacag

SEQ ID NO: 513126 - RNA, 25 nt, Human
uuccugggcucaagcaauccuccca

SEQ ID NO: 513127 - RNA, 23 nt, Human
uuggaaccaguacccaaggauga

SEQ ID NO: 513128 - RNA, 18 nt, Human
uugguggcggggcugcag

SEQ ID NO: 513129 - RNA, 18 nt, Human
uuuaucagaugcauucac

SEQ ID NO: 513130 - RNA, 24 nt, Human
uuuuuuuuuuuagacagggucuug

SEQ ID NO: 513131 - RNA, 23 nt, Human
uuuuuuuuuuuuagacagggucu

SEQ ID NO: 513132 - RNA, 25 nt, Human
uuuuuuuuuuuuuuuuuagacaggg

SEQ ID NO: 513133 - RNA, 18 nt, Human
aaaaacuaauguggaccu

SEQ ID NO: 513134 - RNA, 20 nt, Human
aaaaggaaguaaguuaugga

SEQ ID NO: 513135 - RNA, 19 nt, Human
aaacccauaaucacaucuc

SEQ ID NO: 513136 - RNA, 23 nt, Human
aaauauguaccaaggaaauacaa

SEQ ID NO: 513137 - RNA, 22 nt, Human
aacuccacuuuuuuucuauuuu

SEQ ID NO: 513138 - RNA, 22 nt, Human
aagccacccaaagauuagggag

SEQ ID NO: 513139 - RNA, 23 nt, Human
aaggaaaccuuugauucauguga

SEQ ID NO: 513140 - RNA, 18 nt, Human
aauaaaggauacugcaca

SEQ ID NO: 513141 - RNA, 23 nt, Human
aauauaacuuuuuacccagccca

SEQ ID NO: 513142 - RNA, 19 nt, Human
aauauacaguaauacacug

SEQ ID NO: 513143 - RNA, 22 nt, Human
aauaucauugcuaccaaguggc

SEQ ID NO: 513144 - RNA, 21 nt, Human
acaaaauaggcuuugccaaac

SEQ ID NO: 513145 - RNA, 18 nt, Human
acauuauaaaauuaacuu

SEQ ID NO: 513146 - RNA, 19 nt, Human
acccagcaacuccgcaguu

SEQ ID NO: 513147 - RNA, 23 nt, Human
acuaaagagacuucaauucacau

SEQ ID NO: 513148 - RNA, 21 nt, Human
acuuuuuacccagcccaggac

SEQ ID NO: 513149 - RNA, 24 nt, Human
agacaaaaaggaaguaaguuaugg

SEQ ID NO: 513150 - RNA, 19 nt, Human
agacaugaaaggaaaccuu

SEQ ID NO: 513151 - RNA, 19 nt, Human
agccgagcuggugaccuca

SEQ ID NO: 513152 - RNA, 21 nt, Human
agccuaggcuaaauagaggac

SEQ ID NO: 513153 - RNA, 21 nt, Human
agcuggugaccucagguaccc

SEQ ID NO: 513154 - RNA, 20 nt, Human
aggcggaggcugauguggcc

SEQ ID NO: 513155 - RNA, 22 nt, Human
aguaaguuauggaagagcacaa

SEQ ID NO: 513156 - RNA, 20 nt, Human
aguggcacuuuuuuccuucu

SEQ ID NO: 513157 - RNA, 21 nt, Human
auaaaaaaauccuuuaaugga

SEQ ID NO: 513158 - RNA, 22 nt, Human
augccuuguuagucagcacaca

SEQ ID NO: 513159 - RNA, 19 nt, Human
caaggaaaccggaacccau

SEQ ID NO: 513160 - RNA, 21 nt, Human
cacuguaccauuguauccuaa

SEQ ID NO: 513161 - RNA, 24 nt, Human
cagcaaaaaggggaaaagcuauuc

SEQ ID NO: 513162 - RNA, 21 nt, Human
cagcacagaaauaaaggauac

SEQ ID NO: 513163 - RNA, 25 nt, Human
cagccgagcuggugaccucagguac

SEQ ID NO: 513164 - RNA, 24 nt, Human
caggguuuggaaaaaaaaaaagua

SEQ ID NO: 513165 - RNA, 23 nt, Human
cagguacccagcccgccccaccc

SEQ ID NO: 513166 - RNA, 25 nt, Human
caguggcacuuuuuuccuucuaucu

SEQ ID NO: 513167 - RNA, 26 nt, Human
caugaaaggaaaccuuugauucaugu

SEQ ID NO: 513168 - RNA, 21 nt, Human
cauuagguuuaguuaacuuaa

SEQ ID NO: 513169 - RNA, 18 nt, Human
ccacccggacgguugccc

SEQ ID NO: 513170 - RNA, 20 nt, Human
ccagcccgccccacccaccc

SEQ ID NO: 513171 - RNA, 22 nt, Human
cccccaucccucuccggccgcu

SEQ ID NO: 513172 - RNA, 22 nt, Human
ccccccaucccucuccggccgc

SEQ ID NO: 513173 - RNA, 18 nt, Human
cccgcggcgaggcucaga

SEQ ID NO: 513174 - RNA, 18 nt, Human
ccgccuccgccgccccug

SEQ ID NO: 513175 - RNA, 23 nt, Human
ccgccuccgccgccccugccucu

SEQ ID NO: 513176 - RNA, 20 nt, Human
ccuaagaggaucuggggaau

SEQ ID NO: 513177 - RNA, 22 nt, Human
cgauuaaaaguaauugcaccca

SEQ ID NO: 513178 - RNA, 21 nt, Human
cgccccugccucuacagccga

SEQ ID NO: 513179 - RNA, 21 nt, Human
cggcccgggugcacccgccag

SEQ ID NO: 513180 - RNA, 21 nt, Human
cucuuaaaauacagcaccgcu

SEQ ID NO: 513181 - RNA, 24 nt, Human
cugauaggcaguggcacuuuuuuc

SEQ ID NO: 513182 - RNA, 20 nt, Human
cuucucucgcugaggguaag

SEQ ID NO: 513183 - RNA, 18 nt, Human
gaagagcacaaagagauu

SEQ ID NO: 513184 - RNA, 20 nt, Human
gacuguaaauagacaugaaa

SEQ ID NO: 513185 - RNA, 20 nt, Human
gagagaacagcacagaaauu

SEQ ID NO: 513186 - RNA, 23 nt, Human
gcacuguaaaauugugaaaacaa

SEQ ID NO: 513187 - RNA, 24 nt, Human
gccacuucuggaacacuucugcaa

SEQ ID NO: 513188 - RNA, 22 nt, Human
gccccacccacccggacgguug

SEQ ID NO: 513189 - RNA, 24 nt, Human
gcgaggcucagacugggugggcgc

SEQ ID NO: 513190 - RNA, 21 nt, Human
gcugacacugcccuggagcac

SEQ ID NO: 513191 - RNA, 19 nt, Human
gggugcgcacuggcggccc

SEQ ID NO: 513192 - RNA, 19 nt, Human
ggguuuggaaaaaaaaaaa

SEQ ID NO: 513193 - RNA, 23 nt, Human
guacccagcccgccccacccacc

SEQ ID NO: 513194 - RNA, 19 nt, Human
gucagugguuuaucacuga

SEQ ID NO: 513195 - RNA, 23 nt, Human
uaaaaacuaauguggaccuuuga

SEQ ID NO: 513196 - RNA, 23 nt, Human
uaaaacagccauuccaacaguuu

SEQ ID NO: 513197 - RNA, 18 nt, Human
uaaaauacagcaccgcug

SEQ ID NO: 513198 - RNA, 22 nt, Human
uaaaggaaagccacccaaagau

SEQ ID NO: 513199 - RNA, 19 nt, Human
uaagcuacaggcuacauuu

SEQ ID NO: 513200 - RNA, 20 nt, Human
uacaaaauaggcuuugccaa

SEQ ID NO: 513201 - RNA, 18 nt, Human
uacacuguagauaaaguu

SEQ ID NO: 513202 - RNA, 26 nt, Human
uaccaaggaaauacaaauuggauaau

SEQ ID NO: 513203 - RNA, 27 nt, Human
uaccaaggaaauacaaauuggauaaug

SEQ ID NO: 513204 - RNA, 24 nt, Human
uacuaaagagacuucaauucacau

SEQ ID NO: 513205 - RNA, 24 nt, Human
uacuccaccuagcauaccaucugu

SEQ ID NO: 513206 - RNA, 18 nt, Human
uagcauaccaucuguacc

SEQ ID NO: 513207 - RNA, 22 nt, Human
uaucaagcauacuccaccuagc

SEQ ID NO: 513208 - RNA, 24 nt, Human
uauguaccaaggaaauacaaauug

SEQ ID NO: 513209 - RNA, 22 nt, Human
uauuuaacuggcaacuauccau

SEQ ID NO: 513210 - RNA, 21 nt, Human
uauuucaaaagcaggguuugg

SEQ ID NO: 513211 - RNA, 21 nt, Human
ucacaguaagacacugauaac

SEQ ID NO: 513212 - RNA, 18 nt, Human
ucagguacccagcccgcc

SEQ ID NO: 513213 - RNA, 21 nt, Human
ucuccauggcaacaaaaaccc

SEQ ID NO: 513214 - RNA, 21 nt, Human
ucucucgcugaggguaagggu

SEQ ID NO: 513215 - RNA, 19 nt, Human
ucucuugcucuucuuuuug

SEQ ID NO: 513216 - RNA, 27 nt, Human
ucucuugcucuucuuuuugucagcaaa

SEQ ID NO: 513217 - RNA, 22 nt, Human
ucuggaacacuucugcaacauc

SEQ ID NO: 513218 - RNA, 22 nt, Human
ugaaaggaaaccuuugauucau

SEQ ID NO: 513219 - RNA, 19 nt, Human
ugcaaagacucuauauugg

SEQ ID NO: 513220 - RNA, 18 nt, Human
ugcaaggaaaccggaacc

SEQ ID NO: 513221 - RNA, 23 nt, Human
ugcccuggagcacucuaggaugc

SEQ ID NO: 513222 - RNA, 23 nt, Human
uggaacacuucugcaacaucuuu

SEQ ID NO: 513223 - RNA, 20 nt, Human
uggaagagcacaaagagauu

SEQ ID NO: 513224 - RNA, 27 nt, Human
uggaagagcacaaagagauugaggaca

SEQ ID NO: 513225 - RNA, 22 nt, Human
uggcauaggaggauucccacag

SEQ ID NO: 513226 - RNA, 24 nt, Human
uguaaaagcaaggccauggguggu

SEQ ID NO: 513227 - RNA, 21 nt, Human
ugugaaaacaaauaacuauga

SEQ ID NO: 513228 - RNA, 21 nt, Human
uguguacacugucuucacaca

SEQ ID NO: 513229 - RNA, 18 nt, Human
uucaacccuaaugucagu

SEQ ID NO: 513230 - RNA, 24 nt, Human
uucccuguaagguuaaaauaaaaa

SEQ ID NO: 513231 - RNA, 23 nt, Human
uuuuuuuuuuuuaaaggaaagcc

SEQ ID NO: 513232 - RNA, 20 nt, Human
uuuuuuuuuuuuuuuaaagg

SEQ ID NO: 513233 - RNA, 25 nt, Human
aaacaaaacacaagagucuucugag

SEQ ID NO: 513234 - RNA, 22 nt, Human
aaacagcaugauccuggaaacu

SEQ ID NO: 513235 - RNA, 21 nt, Human
aaaccaaaacaaaacacaaga

SEQ ID NO: 513236 - RNA, 19 nt, Human
aaagaaaaaaaaaaugcaa

SEQ ID NO: 513237 - RNA, 22 nt, Human
aacaaaacacaagagucuucug

SEQ ID NO: 513238 - RNA, 22 nt, Human
aacaacaugaaggugacaaacu

SEQ ID NO: 513239 - RNA, 25 nt, Human
aaccaaacauuuaaaucuuccaagg

SEQ ID NO: 513240 - RNA, 23 nt, Human
aacccuggaaaaucuguagaaaa

SEQ ID NO: 513241 - RNA, 18 nt, Human
aagaaaagaaaaaucuga

SEQ ID NO: 513242 - RNA, 21 nt, Human
aagcuucuggaccgcagaccu

SEQ ID NO: 513243 - RNA, 21 nt, Human
aaggaaucaaaugaggcuggu

SEQ ID NO: 513244 - RNA, 22 nt, Human
aaugacaggcguaaggggcagg

SEQ ID NO: 513245 - RNA, 27 nt, Human
aaugcaacuuauuaaauuggacauuuu

SEQ ID NO: 513246 - RNA, 18 nt, Human
acaaaauaagaaaagaaa

SEQ ID NO: 513247 - RNA, 20 nt, Human
accaaaacaaaacacaagag

SEQ ID NO: 513248 - RNA, 23 nt, Human
acccagaaguuggagcaggggcc

SEQ ID NO: 513249 - RNA, 21 nt, Human
accgcaagcuucuggaccgcg

SEQ ID NO: 513250 - RNA, 22 nt, Human
acuagacucagacaagccaguc

SEQ ID NO: 513251 - RNA, 24 nt, Human
agaaaaaaaaaaugcaacuuauua

SEQ ID NO: 513252 - RNA, 18 nt, Human
agaaaaaaaaaccaaaac

SEQ ID NO: 513253 - RNA, 18 nt, Human
agagaaaagguaggcugc

SEQ ID NO: 513254 - RNA, 21 nt, Human
agcugcagugugagcaacccc

SEQ ID NO: 513255 - RNA, 20 nt, Human
aggcaaaaauuguaggucca

SEQ ID NO: 513256 - RNA, 23 nt, Human
aggcaaaaauuguagguccaaag

SEQ ID NO: 513257 - RNA, 20 nt, Human
aggcaaaauuuauccacaga

SEQ ID NO: 513258 - RNA, 24 nt, Human
aggcaacagguuaaauauauggca

SEQ ID NO: 513259 - RNA, 21 nt, Human
aggcucuugguccccaguucc

SEQ ID NO: 513260 - RNA, 21 nt, Human
auaaagcagcaaacagcuuug

SEQ ID NO: 513261 - RNA, 24 nt, Human
augacuaauguacacuucaagcau

SEQ ID NO: 513262 - RNA, 22 nt, Human
caaaacacaagagucuucugag

SEQ ID NO: 513263 - RNA, 19 nt, Human
caacagguuaaauauaugg

SEQ ID NO: 513264 - RNA, 23 nt, Human
cacaaaauaagaaaagaaaaauc

SEQ ID NO: 513265 - RNA, 19 nt, Human
cacaagagucuucugagga

SEQ ID NO: 513266 - RNA, 18 nt, Human
cacaagguauucuguuuc

SEQ ID NO: 513267 - RNA, 18 nt, Human
cacacacacacauccauu

SEQ ID NO: 513268 - RNA, 18 nt, Human
cacacgcaugccugugug

SEQ ID NO: 513269 - RNA, 21 nt, Human
cacacgcaugccuguguguuc

SEQ ID NO: 513270 - RNA, 24 nt, Human
cagaguuuaagugugaaaguguua

SEQ ID NO: 513271 - RNA, 21 nt, Human
cagcaauucauuauugguuuc

SEQ ID NO: 513272 - RNA, 27 nt, Human
caguggcacacacucaccgcaagcuuc

SEQ ID NO: 513273 - RNA, 25 nt, Human
cauacacacgcaugccuguguguuc

SEQ ID NO: 513274 - RNA, 24 nt, Human
ccacuaaggaccugccaggcugaa

SEQ ID NO: 513275 - RNA, 20 nt, Human
ccaucugggucauggcuggg

SEQ ID NO: 513276 - RNA, 31 nt, Human
cccauguacgugcacauacacacgcauggug

SEQ ID NO: 513277 - RNA, 18 nt, Human
ccugagcagauuuuugag

SEQ ID NO: 513278 - RNA, 23 nt, Human
ccugcauaaagcagcaaacagcu

SEQ ID NO: 513279 - RNA, 19 nt, Human
ccuugcugcugacccagaa

SEQ ID NO: 513280 - RNA, 22 nt, Human
cucacacacacacauccauuca

SEQ ID NO: 513281 - RNA, 18 nt, Human
cucaccgcaagcuucugg

SEQ ID NO: 513282 - RNA, 23 nt, Human
cucagaaaaaaaaaccaaaacaa

SEQ ID NO: 513283 - RNA, 23 nt, Human
cugccaggcugaaugacaggcgu

SEQ ID NO: 513284 - RNA, 18 nt, Human
cuucuaccuucaaacagu

SEQ ID NO: 513285 - RNA, 19 nt, Human
cuugccccucucucaacuu

SEQ ID NO: 513286 - RNA, 29 nt, Human
gaaaaaaaaaccaaaacaaaacacaagaa

SEQ ID NO: 513287 - RNA, 18 nt, Human
gaacacuuaacaauuguu

SEQ ID NO: 513288 - RNA, 23 nt, Human
gacacuagacucagacaagccag

SEQ ID NO: 513289 - RNA, 23 nt, Human
gaccauuuaaagcucauaccuga

SEQ ID NO: 513290 - RNA, 19 nt, Human
gacccagaaguuggagcag

SEQ ID NO: 513291 - RNA, 18 nt, Human
gcagcugcagugugagca

SEQ ID NO: 513292 - RNA, 19 nt, Human
gcaggguggugauagggca

SEQ ID NO: 513293 - RNA, 24 nt, Human
gcagugugagcaaccccaucagga

SEQ ID NO: 513294 - RNA, 20 nt, Human
ggaggcucuugguccccagu

SEQ ID NO: 513295 - RNA, 22 nt, Human
ggaggugggaugcucgcaggug

SEQ ID NO: 513296 - RNA, 22 nt, Human
ggcagcucaucagaaagguagg

SEQ ID NO: 513297 - RNA, 21 nt, Human
gucaagagcaacuucuguuga

SEQ ID NO: 513298 - RNA, 18 nt, Human
gucauggcugggcuuuca

SEQ ID NO: 513299 - RNA, 27 nt, Human
gugcacauacacacgcaugccugugug

SEQ ID NO: 513300 - RNA, 28 nt, Human
uaaaaucauauuauccaaacacuaccaa

SEQ ID NO: 513301 - RNA, 19 nt, Human
uaaacuauccuguucuuug

SEQ ID NO: 513302 - RNA, 21 nt, Human
uaaagaguccgaguagcucag

SEQ ID NO: 513303 - RNA, 19 nt, Human
uaaagguuuccaaacagca

SEQ ID NO: 513304 - RNA, 18 nt, Human
uaacguuguuuuuggcaa

SEQ ID NO: 513305 - RNA, 19 nt, Human
uaaugcuauuuggguucaa

SEQ ID NO: 513306 - RNA, 25 nt, Human
uaccuaguacuauuuaauaccaaca

SEQ ID NO: 513307 - RNA, 29 nt, Human
uacgugcacauacacacgcaugccugugu

SEQ ID NO: 513308 - RNA, 23 nt, Human
uacuaaacugcuuuugcaaaaca

SEQ ID NO: 513309 - RNA, 29 nt, Human
uacuaaacugcuuuugcaaaacagcuccu

SEQ ID NO: 513310 - RNA, 21 nt, Human
uacuucuccauuugacuugga

SEQ ID NO: 513311 - RNA, 21 nt, Human
uagcccacuaaggaccugcca

SEQ ID NO: 513312 - RNA, 22 nt, Human
uagcccacuaaggaccugccag

SEQ ID NO: 513313 - RNA, 20 nt, Human
uagcuucacaagaaaucaaa

SEQ ID NO: 513314 - RNA, 24 nt, Human
uagcuucaugcaggaaagauuuua

SEQ ID NO: 513315 - RNA, 22 nt, Human
uaggcugcuucuaccuucaaac

SEQ ID NO: 513316 - RNA, 26 nt, Human
uauucaucugaccaaaauucaacaua

SEQ ID NO: 513317 - RNA, 26 nt, Human
ucaaaauuagcuucacaagaaaucaa

SEQ ID NO: 513318 - RNA, 21 nt, Human
ucagaaaaaaaaaccaaaaca

SEQ ID NO: 513319 - RNA, 26 nt, Human
ucagcuuucuaaugcuauuuggguuc

SEQ ID NO: 513320 - RNA, 22 nt, Human
ucauuugcaaccaaacauuuaa

SEQ ID NO: 513321 - RNA, 22 nt, Human
uccaaacacuaccagaagaaca

SEQ ID NO: 513322 - RNA, 23 nt, Human
ucccuugccccucucucaacuug

SEQ ID NO: 513323 - RNA, 25 nt, Human
uccgaguagcucagaaaaaaaaacc

SEQ ID NO: 513324 - RNA, 23 nt, Human
uccugguugcgaagccuuugacc

SEQ ID NO: 513325 - RNA, 27 nt, Human
ucuaccuucaaacagucaagagcaacu

SEQ ID NO: 513326 - RNA, 19 nt, Human
ucucacauuagcacucuga

SEQ ID NO: 513327 - RNA, 21 nt, Human
ucugaggaaauuacuaccuca

SEQ ID NO: 513328 - RNA, 19 nt, Human
ucuggcccauguacgugca

SEQ ID NO: 513329 - RNA, 24 nt, Human
ucuugcgcugggggcgggcagcuc

SEQ ID NO: 513330 - RNA, 22 nt, Human
ucuuucuacaggggugucugua

SEQ ID NO: 513331 - RNA, 19 nt, Human
ugacagauuuuaaaaucgg

SEQ ID NO: 513332 - RNA, 23 nt, Human
ugaccaaaauucaacauaaccuu

SEQ ID NO: 513333 - RNA, 18 nt, Human
ugagcacaaguuuccaug

SEQ ID NO: 513334 - RNA, 26 nt, Human
ugaggaaauuacuaccucaaaaaaau

SEQ ID NO: 513335 - RNA, 19 nt, Human
ugcaaaacagcucccugca

SEQ ID NO: 513336 - RNA, 18 nt, Human
ugcaaacaucuacaaaga

SEQ ID NO: 513337 - RNA, 22 nt, Human
ugcacagaucuggauaaacugu

SEQ ID NO: 513338 - RNA, 27 nt, Human
ugcacagaucuggauaaacugugcaaa

SEQ ID NO: 513339 - RNA, 21 nt, Human
ugcauaaauaacaacaugaag

SEQ ID NO: 513340 - RNA, 23 nt, Human
ugcugcugacccagaaguuggag

SEQ ID NO: 513341 - RNA, 18 nt, Human
uggaggccaggcucucug

SEQ ID NO: 513342 - RNA, 19 nt, Human
uggauuacaaucagggcac

SEQ ID NO: 513343 - RNA, 23 nt, Human
uggcaaaagguuuuuauucagac

SEQ ID NO: 513344 - RNA, 18 nt, Human
uggcuggcauuuuacaau

SEQ ID NO: 513345 - RNA, 23 nt, Human
ugggaugcucgcaggugcccagg

SEQ ID NO: 513346 - RNA, 23 nt, Human
uggguggucauguugagagcagg

SEQ ID NO: 513347 - RNA, 19 nt, Human
uggguguagacacaauacc

SEQ ID NO: 513348 - RNA, 18 nt, Human
uggugggugggcuuggag

SEQ ID NO: 513349 - RNA, 21 nt, Human
uguguuaaaaaugccaaccaa

SEQ ID NO: 513350 - RNA, 23 nt, Human
uguguuaaaaaugccaaccaagg

SEQ ID NO: 513351 - RNA, 20 nt, Human
uucacugcuuguaaaugcaa

SEQ ID NO: 513352 - RNA, 21 nt, Human
uucucacucacaaaguggcug

SEQ ID NO: 513353 - RNA, 21 nt, Human
uucuggcccauguacgugcac

SEQ ID NO: 513354 - RNA, 18 nt, Human
uucuucccaauaaacuaa

SEQ ID NO: 513355 - RNA, 22 nt, Human
uugcauccugguugcgaagccu

SEQ ID NO: 513356 - RNA, 18 nt, Human
uuggagcuccaucagugg

SEQ ID NO: 513357 - RNA, 19 nt, Human
uuguuuuguuuuuaaaaua

SEQ ID NO: 513358 - RNA, 24 nt, Human
uuuagcuucaugcaggaaagauuu

SEQ ID NO: 513359 - RNA, 21 nt, Human
uuucuaguucauaaauuuugg

SEQ ID NO: 513360 - RNA, 18 nt, Human
uuuuuuuuuuuuuuuuug

SEQ ID NO: 513361 - RNA, 18 nt, Human
accugggguaguggucgg

SEQ ID NO: 513362 - RNA, 21 nt, Human
agaagcaaguuacaaaguuag

SEQ ID NO: 513363 - RNA, 22 nt, Human
agacagcuccgggauccucuca

SEQ ID NO: 513364 - RNA, 24 nt, Human
agcaaguuacaaaguuagaaaccu

SEQ ID NO: 513365 - RNA, 24 nt, Human
agcugguaggugagcagaggguuc

SEQ ID NO: 513366 - RNA, 18 nt, Human
agggagaggaggaugggg

SEQ ID NO: 513367 - RNA, 18 nt, Human
agggagaggaggaugggg

SEQ ID NO: 513368 - RNA, 19 nt, Human
agggagaggaggauggggu

SEQ ID NO: 513369 - RNA, 18 nt, Human
agggugguggggggaugg

SEQ ID NO: 513370 - RNA, 21 nt, Human
cagccuagccccucccacccc

SEQ ID NO: 513371 - RNA, 21 nt, Human
caggauggagggugguggggg

SEQ ID NO: 513372 - RNA, 21 nt, Human
cagggccagacagcuccggga

SEQ ID NO: 513373 - RNA, 25 nt, Human
ccccucccaccccagauuugugcga

SEQ ID NO: 513374 - RNA, 21 nt, Human
ccuagccccucccaccccaga

SEQ ID NO: 513375 - RNA, 20 nt, Human
ccuggagggagaggaggaug

SEQ ID NO: 513376 - RNA, 19 nt, Human
cgagggcccccaggaugga

SEQ ID NO: 513377 - RNA, 26 nt, Human
cggaaguagagcuugcagagggagga

SEQ ID NO: 513378 - RNA, 25 nt, Human
cugagauuauagguuagggacccac

SEQ ID NO: 513379 - RNA, 26 nt, Human
gaaugcagggccagacagcuccggga

SEQ ID NO: 513380 - RNA, 22 nt, Human
gagggagaggaggaugggguca

SEQ ID NO: 513381 - RNA, 21 nt, Human
gagggcccccaggauggaggg

SEQ ID NO: 513382 - RNA, 21 nt, Human
gcacaggucaggacaugcugg

SEQ ID NO: 513383 - RNA, 19 nt, Human
ggacaugcugggggcuccu

SEQ ID NO: 513384 - RNA, 22 nt, Human
ggaggacacgcuguggaugucc

SEQ ID NO: 513385 - RNA, 21 nt, Human
ggagggagaggaggauggggu

SEQ ID NO: 513386 - RNA, 20 nt, Human
ggcuccuggagggagaggag

SEQ ID NO: 513387 - RNA, 25 nt, Human
gggaggacacgcuguggauguccug

SEQ ID NO: 513388 - RNA, 25 nt, Human
gggcagacccuucaguccaggguug

SEQ ID NO: 513389 - RNA, 22 nt, Human
gggcuccuggagggagaggagg

SEQ ID NO: 513390 - RNA, 21 nt, Human
gggugguggggggaugggcag

SEQ ID NO: 513391 - RNA, 19 nt, Human
uagccccucccaccccaga

SEQ ID NO: 513392 - RNA, 23 nt, Human
ucccauagagcugguaggugagc

SEQ ID NO: 513393 - RNA, 23 nt, Human
uccuggagggagaggaggauggg

SEQ ID NO: 513394 - RNA, 21 nt, Human
ugagcagaggguucggaagcu

SEQ ID NO: 513395 - RNA, 19 nt, Human
ugcugggggcuccuggagg

SEQ ID NO: 513396 - RNA, 20 nt, Human
uggagggagaggaggauggg

SEQ ID NO: 513397 - RNA, 22 nt, Human
uggagggagaggaggauggggu

SEQ ID NO: 513398 - RNA, 24 nt, Human
uggagggugguggggggaugggca

SEQ ID NO: 513399 - RNA, 21 nt, Human
uggggaaagaaggguaggagu

SEQ ID NO: 513400 - RNA, 18 nt, Human
ugguggggggaugggcag

SEQ ID NO: 513401 - RNA, 23 nt, Human
ugguggggggaugggcagacccu

SEQ ID NO: 513402 - RNA, 21 nt, Human
uuauucauuaauguugucaga

SEQ ID NO: 513403 - RNA, 22 nt, Human
aaaaaaaagcauaguaaaggua

SEQ ID NO: 513404 - RNA, 23 nt, Human
aaaaaaaagcauaguaaagguaa

SEQ ID NO: 513405 - RNA, 20 nt, Human
aaaaaagcauaguaaaggua

SEQ ID NO: 513406 - RNA, 22 nt, Human
aacucugcaagccugcagaaca

SEQ ID NO: 513407 - RNA, 19 nt, Human
aaugaacaaaaucaauuuu

SEQ ID NO: 513408 - RNA, 20 nt, Human
aaugacaaaagagccaguua

SEQ ID NO: 513409 - RNA, 22 nt, Human
aaugacaaaagagccaguuaaa

SEQ ID NO: 513410 - RNA, 18 nt, Human
acaucuucagaguuaggg

SEQ ID NO: 513411 - RNA, 20 nt, Human
agcacaaugacaaaagagcc

SEQ ID NO: 513412 - RNA, 21 nt, Human
agcacaaugacaaaagagcca

SEQ ID NO: 513413 - RNA, 22 nt, Human
caaaagagccaguuaaauggua

SEQ ID NO: 513414 - RNA, 24 nt, Human
cacaauaugacagucagccaaaaa

SEQ ID NO: 513415 - RNA, 26 nt, Human
cacgcgcugugcccgacgcgcaugcg

SEQ ID NO: 513416 - RNA, 23 nt, Human
cagcacaaugacaaaagagccag

SEQ ID NO: 513417 - RNA, 22 nt, Human
gaccacaauaugacagucagcc

SEQ ID NO: 513418 - RNA, 25 nt, Human
gagaagaacucugcaagccugcaga

SEQ ID NO: 513419 - RNA, 22 nt, Human
ggcgccggagaccagaagagcu

SEQ ID NO: 513420 - RNA, 19 nt, Human
gugcccgacgcgcaugcgc

SEQ ID NO: 513421 - RNA, 18 nt, Human
uaacagcacaaugacaaa

SEQ ID NO: 513422 - RNA, 19 nt, Human
uaaggaccacaauaugaca

SEQ ID NO: 513423 - RNA, 23 nt, Human
uaaugaacaaaaucaauuuugaa

SEQ ID NO: 513424 - RNA, 21 nt, Human
ucaaaauauugaagaacauug

SEQ ID NO: 513425 - RNA, 18 nt, Human
ucugcaagccugcagaac

SEQ ID NO: 513426 - RNA, 21 nt, Human
uguaaaaaaaagcauaguaaa

SEQ ID NO: 513427 - RNA, 19 nt, Human
uguacaaacugcuuuaaac

SEQ ID NO: 513428 - RNA, 24 nt, Human
uuaaguagguaaugaacaaaauca

SEQ ID NO: 513429 - RNA, 27 nt, Human
uuaccgaaucaauuaugacauuuguac

SEQ ID NO: 513430 - RNA, 25 nt, Human
aaaaggcuaggguggcccuucugca

SEQ ID NO: 513431 - RNA, 19 nt, Human
aagcaguuaaaaggcuagg

SEQ ID NO: 513432 - RNA, 21 nt, Human
accccgggcccccucccucgc

SEQ ID NO: 513433 - RNA, 23 nt, Human
accccgggcccccucccucgccc

SEQ ID NO: 513434 - RNA, 18 nt, Human
caaccccgggcccccucc

SEQ ID NO: 513435 - RNA, 21 nt, Human
cacccugacccuggcgugccc

SEQ ID NO: 513436 - RNA, 22 nt, Human
cagcaacggugccccgaggccu

SEQ ID NO: 513437 - RNA, 25 nt, Human
ccacucccgggccccugccgguccc

SEQ ID NO: 513438 - RNA, 22 nt, Human
ccccgaggccugcagggcuguu

SEQ ID NO: 513439 - RNA, 21 nt, Human
ccccgccugggccccggccuc

SEQ ID NO: 513440 - RNA, 21 nt, Human
ccccggccucgcucgccaccu

SEQ ID NO: 513441 - RNA, 22 nt, Human
ccccgggcccccucccucgccc

SEQ ID NO: 513442 - RNA, 21 nt, Human
ccccgggcccccuuccccaac

SEQ ID NO: 513443 - RNA, 23 nt, Human
ccccgggcccccuuccccaaccc

SEQ ID NO: 513444 - RNA, 21 nt, Human
cccgcucgcggccucuccccc

SEQ ID NO: 513445 - RNA, 20 nt, Human
cccuggcgugcccgccacuc

SEQ ID NO: 513446 - RNA, 21 nt, Human
ccgggccccugccgguccccg

SEQ ID NO: 513447 - RNA, 18 nt, Human
ccucccucgcccggcacc

SEQ ID NO: 513448 - RNA, 18 nt, Human
ccugacccuggcgugccc

SEQ ID NO: 513449 - RNA, 20 nt, Human
ccugggccccggccucgcuc

SEQ ID NO: 513450 - RNA, 25 nt, Human
ccugucuucagaccucugcucuggg

SEQ ID NO: 513451 - RNA, 22 nt, Human
cgccggcgccgcccagcaacgg

SEQ ID NO: 513452 - RNA, 22 nt, Human
cgccugggccccggccucgcuc

SEQ ID NO: 513453 - RNA, 21 nt, Human
cgggcccccuuccccaacccc

SEQ ID NO: 513454 - RNA, 22 nt, Human
cggucccgcucgcggccucucc

SEQ ID NO: 513455 - RNA, 24 nt, Human
cucgcccggcacccugacccuggc

SEQ ID NO: 513456 - RNA, 23 nt, Human
gaccucugcucccagcccacuuc

SEQ ID NO: 513457 - RNA, 20 nt, Human
gauccucagcauggagcucc

SEQ ID NO: 513458 - RNA, 21 nt, Human
gcagggcuguuuaccucccuc

SEQ ID NO: 513459 - RNA, 22 nt, Human
gcccccuuccccaaccccgggc

SEQ ID NO: 513460 - RNA, 21 nt, Human
gcucgccaccuccgcgaccuc

SEQ ID NO: 513461 - RNA, 21 nt, Human
ggcuaggguggcccuucugca

SEQ ID NO: 513462 - RNA, 25 nt, Human
gguccaacccuguccuuugcagcca

SEQ ID NO: 513463 - RNA, 23 nt, Human
uccccaaccccgggcccccuccc

SEQ ID NO: 513464 - RNA, 25 nt, Human
ucccccgcggcacucgggcaggggc

SEQ ID NO: 513465 - RNA, 25 nt, Human
uccccgggcccccuuccccaacccc

SEQ ID NO: 513466 - RNA, 18 nt, Human
ucugcucugggauugggu

SEQ ID NO: 513467 - RNA, 19 nt, Human
ugacaaagcaguuaaaagg

SEQ ID NO: 513468 - RNA, 20 nt, Human
ugccccgaggccugcagggc

SEQ ID NO: 513469 - RNA, 20 nt, Human
ugcuccugucuucagaccuc

SEQ ID NO: 513470 - RNA, 22 nt, Human
ugggauuggguccaacccuguc

SEQ ID NO: 513471 - RNA, 19 nt, Human
uuccccaaccccgggcccc

SEQ ID NO: 513472 - RNA, 18 nt, Human
uuuuuuuuuuuuuuucug

SEQ ID NO: 513473 - RNA, 19 nt, Human
uuuuuuuuuuuuuuucugu

SEQ ID NO: 513474 - RNA, 23 nt, Human
acaaacaucuauugagcaucucc

SEQ ID NO: 513475 - RNA, 21 nt, Human
acaauaucaacagcagcucca

SEQ ID NO: 513476 - RNA, 22 nt, Human
acaauaucaacagcagcuccaa

SEQ ID NO: 513477 - RNA, 20 nt, Human
acacaggacagauggaucuc

SEQ ID NO: 513478 - RNA, 24 nt, Human
agaauacaugcaaacaaguaaacu

SEQ ID NO: 513479 - RNA, 18 nt, Human
agaccggaccaagcugga

SEQ ID NO: 513480 - RNA, 21 nt, Human
agcucugguucuugucuuugu

SEQ ID NO: 513481 - RNA, 20 nt, Human
caccugaaaggaauucacac

SEQ ID NO: 513482 - RNA, 21 nt, Human
caccugaaaggaauucacacg

SEQ ID NO: 513483 - RNA, 20 nt, Human
caggacagauggaucuccaa

SEQ ID NO: 513484 - RNA, 22 nt, Human
cccgggucaacaggaccaggag

SEQ ID NO: 513485 - RNA, 24 nt, Human
ccuuuaauuugauaaucauucauu

SEQ ID NO: 513486 - RNA, 24 nt, Human
cugagaaacucuuuaaaaguuuau

SEQ ID NO: 513487 - RNA, 18 nt, Human
gcauaaauaggaaauccu

SEQ ID NO: 513488 - RNA, 22 nt, Human
ggaaauaacaaaagaaacaugc

SEQ ID NO: 513489 - RNA, 24 nt, Human
ggaaauaacaaaagaaacaugcag

SEQ ID NO: 513490 - RNA, 26 nt, Human
ggaaauaacaaaagaaaccgguaccc

SEQ ID NO: 513491 - RNA, 23 nt, Human
ggaaauccuuuaauuugauaauc

SEQ ID NO: 513492 - RNA, 21 nt, Human
ggagguuccgaggggcccggg

SEQ ID NO: 513493 - RNA, 20 nt, Human
gggaggagaaugcccagcuc

SEQ ID NO: 513494 - RNA, 22 nt, Human
ggggaggagaaugcccagcucu

SEQ ID NO: 513495 - RNA, 22 nt, Human
gggggaggagaaugcccagcuc

SEQ ID NO: 513496 - RNA, 23 nt, Human
gguaaaggaaauaacaaaagaaa

SEQ ID NO: 513497 - RNA, 21 nt, Human
uaaaggaaauaacaaaagaaa

SEQ ID NO: 513498 - RNA, 19 nt, Human
uacagcaguuaacauucag

SEQ ID NO: 513499 - RNA, 21 nt, Human
uagcggguggacgcugauguc

SEQ ID NO: 513500 - RNA, 22 nt, Human
uaucaacagcagcuccaagcag

SEQ ID NO: 513501 - RNA, 21 nt, Human
ucaaugcaaugcucuuauccc

SEQ ID NO: 513502 - RNA, 22 nt, Human
uccugagcugacugcuggccuc

SEQ ID NO: 513503 - RNA, 20 nt, Human
ugaaggcagauuggcauuac

SEQ ID NO: 513504 - RNA, 22 nt, Human
ugacaauaucaacagcagcucc

SEQ ID NO: 513505 - RNA, 21 nt, Human
ugcaaacaaguaaacuuaaaa

SEQ ID NO: 513506 - RNA, 19 nt, Human
ugccucaaccugcuacuau

SEQ ID NO: 513507 - RNA, 18 nt, Human
uggccucggugugcuccu

SEQ ID NO: 513508 - RNA, 24 nt, Human
uggugcugacacugcacauaugug

SEQ ID NO: 513509 - RNA, 18 nt, Human
ugugaauauuccucucug

SEQ ID NO: 513510 - RNA, 21 nt, Human
uuccacacaggacagauggau

SEQ ID NO: 513511 - RNA, 21 nt, Human
uuccagucccagaccggaccu

SEQ ID NO: 513512 - RNA, 23 nt, Human
uuccgaggggcccgggucaacag

SEQ ID NO: 513513 - RNA, 23 nt, Human
uuuucuuuuuuaaaauuuguuuu

SEQ ID NO: 513514 - RNA, 18 nt, Human
aaaacuaaaccaaauaua

SEQ ID NO: 513515 - RNA, 19 nt, Human
aaggugcaucuaucaugcu

SEQ ID NO: 513516 - RNA, 19 nt, Human
aagguguucuauuuucuuu

SEQ ID NO: 513517 - RNA, 18 nt, Human
aauggaauuauacaguau

SEQ ID NO: 513518 - RNA, 24 nt, Human
acaagacacagcaauacacuucaa

SEQ ID NO: 513519 - RNA, 20 nt, Human
acuaaaauacauaaaaagcu

SEQ ID NO: 513520 - RNA, 25 nt, Human
acuucagguguaaacauuuccauuu

SEQ ID NO: 513521 - RNA, 21 nt, Human
agaagaagauguacuaugaca

SEQ ID NO: 513522 - RNA, 19 nt, Human
agcaagcaugagggcugac

SEQ ID NO: 513523 - RNA, 19 nt, Human
agcgagggcagcucccugu

SEQ ID NO: 513524 - RNA, 23 nt, Human
auacaguaugguaaacacacuuu

SEQ ID NO: 513525 - RNA, 22 nt, Human
caaaguaaacuauaaauaccaa

SEQ ID NO: 513526 - RNA, 24 nt, Human
caacuaaaauacauaaaaagcuag

SEQ ID NO: 513527 - RNA, 22 nt, Human
caagacacagcaauacacuuca

SEQ ID NO: 513528 - RNA, 20 nt, Human
caccccccuccccgaccccg

SEQ ID NO: 513529 - RNA, 23 nt, Human
caccccccuccccgaccccggcc

SEQ ID NO: 513530 - RNA, 19 nt, Human
cacuucaauucaucugggg

SEQ ID NO: 513531 - RNA, 20 nt, Human
cagcagaauaacggcacaag

SEQ ID NO: 513532 - RNA, 22 nt, Human
cagcagcagaagaagauguacu

SEQ ID NO: 513533 - RNA, 21 nt, Human
cagcuuccagccccagccccu

SEQ ID NO: 513534 - RNA, 19 nt, Human
caggaucuuccauuucagu

SEQ ID NO: 513535 - RNA, 18 nt, Human
ccaccccccuccccgacc

SEQ ID NO: 513536 - RNA, 22 nt, Human
ccccuugcaaacaugaaucuac

SEQ ID NO: 513537 - RNA, 18 nt, Human
cccggccgacccagcccc

SEQ ID NO: 513538 - RNA, 22 nt, Human
ccuccccgaccccggccgaccc

SEQ ID NO: 513539 - RNA, 21 nt, Human
ccuccuggcaauggacagccu

SEQ ID NO: 513540 - RNA, 20 nt, Human
ccucugaagccacugguaag

SEQ ID NO: 513541 - RNA, 20 nt, Human
ccuuuucaccaccccccucc

SEQ ID NO: 513542 - RNA, 20 nt, Human
cggcauguguacuugcuuug

SEQ ID NO: 513543 - RNA, 21 nt, Human
cuaaauuaugauuuuauaaca

SEQ ID NO: 513544 - RNA, 25 nt, Human
cucccugucaccuuuucaccacccc

SEQ ID NO: 513545 - RNA, 18 nt, Human
cucuuuccuuucuaauuc

SEQ ID NO: 513546 - RNA, 20 nt, Human
cuuccagccccagccccuuu

SEQ ID NO: 513547 - RNA, 21 nt, Human
cuugcaaacaugaaucuacuu

SEQ ID NO: 513548 - RNA, 25 nt, Human
cuuuccuuucuaauucuucucuuuu

SEQ ID NO: 513549 - RNA, 20 nt, Human
cuuuguugcucuuccucuga

SEQ ID NO: 513550 - RNA, 24 nt, Human
cuuuucaccaccccccuccccgac

SEQ ID NO: 513551 - RNA, 24 nt, Human
cuuuuuuuuuuuuguacagcauau

SEQ ID NO: 513552 - RNA, 21 nt, Human
gaaaagcaguuuuucugccag

SEQ ID NO: 513553 - RNA, 20 nt, Human
gaaaugaggcauguuucuaa

SEQ ID NO: 513554 - RNA, 20 nt, Human
gcaauggacagccuguauca

SEQ ID NO: 513555 - RNA, 20 nt, Human
gcucuugagcgagggcagcu

SEQ ID NO: 513556 - RNA, 19 nt, Human
gcugagguuauguuuuccc

SEQ ID NO: 513557 - RNA, 21 nt, Human
gcugagguuauguuuucccaa

SEQ ID NO: 513558 - RNA, 25 nt, Human
gcuuccagccccagccccuugcaaa

SEQ ID NO: 513559 - RNA, 21 nt, Human
gugcuucaauauuugcaccau

SEQ ID NO: 513560 - RNA, 21 nt, Human
uaaaaagcuaguuaaagcaag

SEQ ID NO: 513561 - RNA, 20 nt, Human
uaaaauuucauaggugacac

SEQ ID NO: 513562 - RNA, 22 nt, Human
uaaacacauuuuuccuuuuuuu

SEQ ID NO: 513563 - RNA, 22 nt, Human
uaaauggaauuauacaguaugg

SEQ ID NO: 513564 - RNA, 22 nt, Human
uaacaaguaggugccuuuaaaa

SEQ ID NO: 513565 - RNA, 21 nt, Human
uaagccgauauaguaaacaac

SEQ ID NO: 513566 - RNA, 19 nt, Human
uaagguuuggaauggugcc

SEQ ID NO: 513567 - RNA, 25 nt, Human
uacaguaugguaaacacacuuuuaa

SEQ ID NO: 513568 - RNA, 20 nt, Human
uaccuuaaaauaugacucug

SEQ ID NO: 513569 - RNA, 21 nt, Human
uagaauguaucuguuuuaacu

SEQ ID NO: 513570 - RNA, 20 nt, Human
uauaacaaguaggugccuuu

SEQ ID NO: 513571 - RNA, 19 nt, Human
ucacagcaggaucuuccau

SEQ ID NO: 513572 - RNA, 25 nt, Human
ucaccaccccccuccccgaccccgg

SEQ ID NO: 513573 - RNA, 25 nt, Human
ucacuguaagauuccucaugcccau

SEQ ID NO: 513574 - RNA, 20 nt, Human
ucagacccccaaccaccggc

SEQ ID NO: 513575 - RNA, 23 nt, Human
ucaugcucuuccuucaguuucuu

SEQ ID NO: 513576 - RNA, 20 nt, Human
uccccgaccccggccgaccc

SEQ ID NO: 513577 - RNA, 24 nt, Human
ucccugucaccuuuucaccacccc

SEQ ID NO: 513578 - RNA, 21 nt, Human
ucuacaauccaacuuuagagc

SEQ ID NO: 513579 - RNA, 18 nt, Human
ucucuuuccuuucuaauu

SEQ ID NO: 513580 - RNA, 25 nt, Human
ucugugccuaauaaaauuucauagg

SEQ ID NO: 513581 - RNA, 23 nt, Human
ucuuuccuuucuaauucuucccu

SEQ ID NO: 513582 - RNA, 23 nt, Human
ucuuuguacugcuccuuucacag

SEQ ID NO: 513583 - RNA, 19 nt, Human
ugaaauauaauuuacauac

SEQ ID NO: 513584 - RNA, 24 nt, Human
ugaaauauaauuuacauacuauag

SEQ ID NO: 513585 - RNA, 26 nt, Human
ugaaauauaauuuacauacuauagaa

SEQ ID NO: 513586 - RNA, 19 nt, Human
ugaccacuuucacauggcc

SEQ ID NO: 513587 - RNA, 18 nt, Human
ugcacagcaagcaugagg

SEQ ID NO: 513588 - RNA, 23 nt, Human
ugcuuuguuuuucaauaaaaauu

SEQ ID NO: 513589 - RNA, 25 nt, Human
uggaaaagcaguuuuucugccagug

SEQ ID NO: 513590 - RNA, 22 nt, Human
ugggguauuauuguccuugucc

SEQ ID NO: 513591 - RNA, 22 nt, Human
uggugccaucuuccagcagaau

SEQ ID NO: 513592 - RNA, 21 nt, Human
uguacugcuccuuucacagca

SEQ ID NO: 513593 - RNA, 18 nt, Human
ugucacagauaucaaucu

SEQ ID NO: 513594 - RNA, 23 nt, Human
uguuaaccaggagagugaccacu

SEQ ID NO: 513595 - RNA, 23 nt, Human
uucaccaccccccuccccgaccc

SEQ ID NO: 513596 - RNA, 24 nt, Human
uucuggaugcuucauguaaaugga

SEQ ID NO: 513597 - RNA, 21 nt, Human
uugaaaauacucacuucaggu

SEQ ID NO: 513598 - RNA, 22 nt, Human
uuguacugcuccuuucacagca

SEQ ID NO: 513599 - RNA, 18 nt, Human
uuucccaaucuuucuuug

SEQ ID NO: 513600 - RNA, 23 nt, Human
uuucuaagccgauauaguaaaca

SEQ ID NO: 513601 - RNA, 23 nt, Human
uuuuaaggugcaucuaucaugcu

SEQ ID NO: 513602 - RNA, 18 nt, Human
uuuucaccaccccccucc

SEQ ID NO: 513603 - RNA, 19 nt, Human
uuuucuguuaaccaggaga

SEQ ID NO: 513604 - RNA, 25 nt, Human
aagccuuggacacggcggccagccu

SEQ ID NO: 513605 - RNA, 24 nt, Human
cagccucugcuccacacgggcgcc

SEQ ID NO: 513606 - RNA, 24 nt, Human
uuuuuuuuuuuuuuuugggcuuuu

SEQ ID NO: 513607 - RNA, 24 nt, Human
uuuuuuuuuuuuuuuuuuuuuggg

SEQ ID NO: 513608 - RNA, 19 nt, Human
aagagccagauaacggcca

SEQ ID NO: 513609 - RNA, 20 nt, Human
agcaaugacauaguugguaa

SEQ ID NO: 513610 - RNA, 18 nt, Human
aggccucuggaucccagc

SEQ ID NO: 513611 - RNA, 21 nt, Human
aucccagcgggcaccuuccag

SEQ ID NO: 513612 - RNA, 21 nt, Human
cagcuccuugggcugagacuc

SEQ ID NO: 513613 - RNA, 24 nt, Human
ccagggcacagaugagggccacac

SEQ ID NO: 513614 - RNA, 22 nt, Human
ccccagcccuucugucugaguc

SEQ ID NO: 513615 - RNA, 18 nt, Human
ccucuggaucccagcggg

SEQ ID NO: 513616 - RNA, 18 nt, Human
cugauggguggggaucuc

SEQ ID NO: 513617 - RNA, 18 nt, Human
cuggaaggccucuggauc

SEQ ID NO: 513618 - RNA, 18 nt, Human
cugguccugggccuugcg

SEQ ID NO: 513619 - RNA, 20 nt, Human
cuuagaaaauucagcuuuaa

SEQ ID NO: 513620 - RNA, 20 nt, Human
gccacaccacgcuuuaucca

SEQ ID NO: 513621 - RNA, 18 nt, Human
gcuggggcugaugggugg

SEQ ID NO: 513622 - RNA, 22 nt, Human
guccugguccugggccuugcgg

SEQ ID NO: 513623 - RNA, 18 nt, Human
gugucgcuggggcugaug

SEQ ID NO: 513624 - RNA, 19 nt, Human
gugucgcuggggcugaugg

SEQ ID NO: 513625 - RNA, 20 nt, Human
guguuccagcacgagucagu

SEQ ID NO: 513626 - RNA, 18 nt, Human
guuccagcacgagucagu

SEQ ID NO: 513627 - RNA, 19 nt, Human
uauccagugucgcuggggc

SEQ ID NO: 513628 - RNA, 24 nt, Human
ucgcuggggcugauggguggggau

SEQ ID NO: 513629 - RNA, 22 nt, Human
ucuccacagcaaugacauaguu

SEQ ID NO: 513630 - RNA, 22 nt, Human
ugacauaguugguagagugucc

SEQ ID NO: 513631 - RNA, 20 nt, Human
uggggcacagguaaaagucc

SEQ ID NO: 513632 - RNA, 24 nt, Human
uggugccucaaacaucaccuugaa

SEQ ID NO: 513633 - RNA, 21 nt, Human
ugguugauaguguuccagcac

SEQ ID NO: 513634 - RNA, 18 nt, Human
ugucgcuggggcugaugg

SEQ ID NO: 513635 - RNA, 19 nt, Human
uuaauggccccagcccuuc

SEQ ID NO: 513636 - RNA, 18 nt, Human
uuccaggaauaauccaug

SEQ ID NO: 513637 - RNA, 19 nt, Human
uuccaggaauaauccaugg

SEQ ID NO: 513638 - RNA, 21 nt, Human
aaaaagcaauguaaucaucac

SEQ ID NO: 513639 - RNA, 24 nt, Human
aaaauaagacuuuggaacaggaua

SEQ ID NO: 513640 - RNA, 19 nt, Human
aaacaaagcaggaacacua

SEQ ID NO: 513641 - RNA, 19 nt, Human
aaacagaaaagaaguuauc

SEQ ID NO: 513642 - RNA, 20 nt, Human
aacauggagaaaccccgucu

SEQ ID NO: 513643 - RNA, 21 nt, Human
aacauggagaaaccccgucuc

SEQ ID NO: 513644 - RNA, 21 nt, Human
aaccugauuaaucaucuacag

SEQ ID NO: 513645 - RNA, 18 nt, Human
aagaaagauuaugggcag

SEQ ID NO: 513646 - RNA, 19 nt, Human
aagaaagauuaugggcagc

SEQ ID NO: 513647 - RNA, 18 nt, Human
aagcaauguaaucaucac

SEQ ID NO: 513648 - RNA, 19 nt, Human
aagcacccuaugaagcaga

SEQ ID NO: 513649 - RNA, 18 nt, Human
aagcauuuggcccguuag

SEQ ID NO: 513650 - RNA, 24 nt, Human
aaucacuugaacccaggaggugga

SEQ ID NO: 513651 - RNA, 18 nt, Human
aauuagccaggcauggug

SEQ ID NO: 513652 - RNA, 23 nt, Human
acaaagcaggaacacuauauccu

SEQ ID NO: 513653 - RNA, 18 nt, Human
acacuuuuaaaccuacau

SEQ ID NO: 513654 - RNA, 21 nt, Human
accauucuuccugugguuuuc

SEQ ID NO: 513655 - RNA, 24 nt, Human
acccaggagguggaaguugcagug

SEQ ID NO: 513656 - RNA, 24 nt, Human
accccgucucuacuaaaaauacaa

SEQ ID NO: 513657 - RNA, 24 nt, Human
accuacaugaagcucauucuucac

SEQ ID NO: 513658 - RNA, 28 nt, Human
agaaaagaaguuaucauuaaaaaaauac

SEQ ID NO: 513659 - RNA, 23 nt, Human
agacugcaucaaagaaaucuuca

SEQ ID NO: 513660 - RNA, 23 nt, Human
agauauccucaguuaaacaaaaa

SEQ ID NO: 513661 - RNA, 22 nt, Human
agaucaccugagguugggaguu

SEQ ID NO: 513662 - RNA, 24 nt, Human
agcaauguaaucaucacaaacuaa

SEQ ID NO: 513663 - RNA, 24 nt, Human
agcacuuugggaggccgaggcagg

SEQ ID NO: 513664 - RNA, 23 nt, Human
agccaggcaugguggugcaugcc

SEQ ID NO: 513665 - RNA, 25 nt, Human
agccugcaugaaacuugguauugcc

SEQ ID NO: 513666 - RNA, 26 nt, Human
aggcagaucaccugagguugggaguu

SEQ ID NO: 513667 - RNA, 18 nt, Human
aggcaggagaaucacuug

SEQ ID NO: 513668 - RNA, 23 nt, Human
aggcaggagaaucacuugaaccc

SEQ ID NO: 513669 - RNA, 24 nt, Human
aggcaggagaaucacuugaaccca

SEQ ID NO: 513670 - RNA, 22 nt, Human
aggcaggcagaucaccugaggg

SEQ ID NO: 513671 - RNA, 22 nt, Human
aggcaggcagaucaccugaggu

SEQ ID NO: 513672 - RNA, 26 nt, Human
aggcaggcagaucaccugagguuggg

SEQ ID NO: 513673 - RNA, 24 nt, Human
aggcaugguggugcaugccuguaa

SEQ ID NO: 513674 - RNA, 24 nt, Human
aggugcaguggcucacgccucuaa

SEQ ID NO: 513675 - RNA, 19 nt, Human
agguggaaguugcagugag

SEQ ID NO: 513676 - RNA, 24 nt, Human
agguggaaguugcagugagccaag

SEQ ID NO: 513677 - RNA, 24 nt, Human
aguggcucacgccucuaaucccag

SEQ ID NO: 513678 - RNA, 25 nt, Human
auauauguguauauauguacacaaa

SEQ ID NO: 513679 - RNA, 23 nt, Human
auauguguauauauguacacaaa

SEQ ID NO: 513680 - RNA, 20 nt, Human
aucaccugagguugggaguu

SEQ ID NO: 513681 - RNA, 24 nt, Human
aucacgccauugcccuccagccug

SEQ ID NO: 513682 - RNA, 19 nt, Human
augccauggcaacuccgug

SEQ ID NO: 513683 - RNA, 18 nt, Human
auugcccuccagccuggg

SEQ ID NO: 513684 - RNA, 19 nt, Human
auuuucguguguuuccuuu

SEQ ID NO: 513685 - RNA, 22 nt, Human
caaacaaagaaccauucuguau

SEQ ID NO: 513686 - RNA, 20 nt, Human
caaagaaaucuucaaagcac

SEQ ID NO: 513687 - RNA, 23 nt, Human
caaagaaccauucuguauacuaa

SEQ ID NO: 513688 - RNA, 19 nt, Human
caaaucccuccaguacucc

SEQ ID NO: 513689 - RNA, 24 nt, Human
caacauggagaaaccccgucucua

SEQ ID NO: 513690 - RNA, 19 nt, Human
caaguuuaaaugagguucu

SEQ ID NO: 513691 - RNA, 28 nt, Human
cacaauccaguucauucugaggucaucc

SEQ ID NO: 513692 - RNA, 24 nt, Human
cacgccucuaaucccagcacuuug

SEQ ID NO: 513693 - RNA, 24 nt, Human
cagaucaccugagguugggaguuu

SEQ ID NO: 513694 - RNA, 24 nt, Human
cagcacuuugggaggccgaggcag

SEQ ID NO: 513695 - RNA, 25 nt, Human
cagcacuuugggaggccgaggcagg

SEQ ID NO: 513696 - RNA, 24 nt, Human
cagcagcagcaccagcuuucccaa

SEQ ID NO: 513697 - RNA, 24 nt, Human
cagccuuaccaacauggagaaacc

SEQ ID NO: 513698 - RNA, 23 nt, Human
caggccaggugcaguggcucacg

SEQ ID NO: 513699 - RNA, 24 nt, Human
caugccuguaaucccagcuacuug

SEQ ID NO: 513700 - RNA, 19 nt, Human
cauugcccuccagccuggg

SEQ ID NO: 513701 - RNA, 22 nt, Human
cauugcccuccagccugggcaa

SEQ ID NO: 513702 - RNA, 23 nt, Human
cauugcccuccagccugggcaac

SEQ ID NO: 513703 - RNA, 24 nt, Human
cauugcccuccagccugggcaaca

SEQ ID NO: 513704 - RNA, 23 nt, Human
ccaagaaagauuaugggcagccc

SEQ ID NO: 513705 - RNA, 21 nt, Human
ccauugcccuccagccugggc

SEQ ID NO: 513706 - RNA, 23 nt, Human
ccauugcccuccagccugggcaa

SEQ ID NO: 513707 - RNA, 24 nt, Human
ccauugcccuccagccugggcaac

SEQ ID NO: 513708 - RNA, 18 nt, Human
ccccgacgcccgccccuc

SEQ ID NO: 513709 - RNA, 22 nt, Human
cccuccaguacuccugugaagu

SEQ ID NO: 513710 - RNA, 22 nt, Human
ccucuaaucccagcacuuuggg

SEQ ID NO: 513711 - RNA, 18 nt, Human
ccuguaaucccagcuacu

SEQ ID NO: 513712 - RNA, 21 nt, Human
ccuguaaucccagcuacuugg

SEQ ID NO: 513713 - RNA, 22 nt, Human
ccuguaaucccagcuacuuggg

SEQ ID NO: 513714 - RNA, 18 nt, Human
ccuuugaaaagcagcuua

SEQ ID NO: 513715 - RNA, 20 nt, Human
cgaggcaggcagaucaccug

SEQ ID NO: 513716 - RNA, 24 nt, Human
cgccauugcccuccagccugggca

SEQ ID NO: 513717 - RNA, 23 nt, Human
cgccucuaaucccagcacuuugg

SEQ ID NO: 513718 - RNA, 22 nt, Human
cucacgccucuaaucccagcac

SEQ ID NO: 513719 - RNA, 24 nt, Human
cucacgccucuaaucccagcacuu

SEQ ID NO: 513720 - RNA, 19 nt, Human
cugucggcgggaaucaggc

SEQ ID NO: 513721 - RNA, 20 nt, Human
cuugugaacaccacaaucca

SEQ ID NO: 513722 - RNA, 19 nt, Human
gaaguugcagugagccaag

SEQ ID NO: 513723 - RNA, 26 nt, Human
gacagauuauuucuuauuuaaaacac

SEQ ID NO: 513724 - RNA, 19 nt, Human
gaccauucuuccugugguu

SEQ ID NO: 513725 - RNA, 21 nt, Human
gagaaaccccgucucuacuaa

SEQ ID NO: 513726 - RNA, 23 nt, Human
gagaaucacuugaacccaggagg

SEQ ID NO: 513727 - RNA, 19 nt, Human
gagagagguggggaagagg

SEQ ID NO: 513728 - RNA, 24 nt, Human
gaucaccugagguugggaguuuga

SEQ ID NO: 513729 - RNA, 24 nt, Human
gaugagagagguggggaagaggga

SEQ ID NO: 513730 - RNA, 21 nt, Human
gcagaucaccugagguuggga

SEQ ID NO: 513731 - RNA, 22 nt, Human
gcaggagaaucacuugaaccca

SEQ ID NO: 513732 - RNA, 22 nt, Human
gccauugcccuccagccugggc

SEQ ID NO: 513733 - RNA, 20 nt, Human
gccuguaaucccagcuacuu

SEQ ID NO: 513734 - RNA, 20 nt, Human
ggaaguugcagugagccaag

SEQ ID NO: 513735 - RNA, 24 nt, Human
ggaaguugcagugagccaagauca

SEQ ID NO: 513736 - RNA, 19 nt, Human
ggacaaggccuguccggua

SEQ ID NO: 513737 - RNA, 24 nt, Human
ggcagcagcagcaccagcuuuccc

SEQ ID NO: 513738 - RNA, 22 nt, Human
ggcucagaauacacuuuuaaac

SEQ ID NO: 513739 - RNA, 24 nt, Human
gguggugcaugccuguaaucccag

SEQ ID NO: 513740 - RNA, 19 nt, Human
gguugggaguuugagauca

SEQ ID NO: 513741 - RNA, 20 nt, Human
uaaaaauacaaaauuagcca

SEQ ID NO: 513742 - RNA, 22 nt, Human
uaaaaauacaaaauuagccagg

SEQ ID NO: 513743 - RNA, 23 nt, Human
uaaaaauacaaaauuagccaggc

SEQ ID NO: 513744 - RNA, 22 nt, Human
uaaaauaguauaccccgaagga

SEQ ID NO: 513745 - RNA, 18 nt, Human
uaaacaaagcaggaacac

SEQ ID NO: 513746 - RNA, 25 nt, Human
uaaacagaaaagaaguuaucauuaa

SEQ ID NO: 513747 - RNA, 23 nt, Human
uaaacuacuggacaacaaaaagc

SEQ ID NO: 513748 - RNA, 26 nt, Human
uaagacuuuggaacaggauagaaaug

SEQ ID NO: 513749 - RNA, 23 nt, Human
uaaucaucuacaggcucagaaua

SEQ ID NO: 513750 - RNA, 21 nt, Human
uaccuuugaaaagcagcuuau

SEQ ID NO: 513751 - RNA, 28 nt, Human
uagcuugcaaaucccuccaguacuccuu

SEQ ID NO: 513752 - RNA, 18 nt, Human
uaguauaccccgaaggaa

SEQ ID NO: 513753 - RNA, 31 nt, Human
uagugcaaaauauauauguguauauauguaa

SEQ ID NO: 513754 - RNA, 19 nt, Human
uauaaaauaagacuuugga

SEQ ID NO: 513755 - RNA, 20 nt, Human
uauaaauaaguuuucauuuu

SEQ ID NO: 513756 - RNA, 18 nt, Human
uauauacaagaacugugu

SEQ ID NO: 513757 - RNA, 21 nt, Human
uauauacaagaacugugugca

SEQ ID NO: 513758 - RNA, 22 nt, Human
uauauauguguauauauguaca

SEQ ID NO: 513759 - RNA, 19 nt, Human
uauauguguauauauguac

SEQ ID NO: 513760 - RNA, 22 nt, Human
uauauguguauauauguacaca

SEQ ID NO: 513761 - RNA, 23 nt, Human
ucaaguaucagcaauauuagucc

SEQ ID NO: 513762 - RNA, 20 nt, Human
ucaaguuuaaaugagguucu

SEQ ID NO: 513763 - RNA, 18 nt, Human
ucaccugagguugggagu

SEQ ID NO: 513764 - RNA, 23 nt, Human
ucacgccauugcccuccagccug

SEQ ID NO: 513765 - RNA, 19 nt, Human
ucaggcagcagcagcacca

SEQ ID NO: 513766 - RNA, 21 nt, Human
ucaguggguuaugucuagccu

SEQ ID NO: 513767 - RNA, 23 nt, Human
ucccuccaguacuccugugaagu

SEQ ID NO: 513768 - RNA, 23 nt, Human
ucguguguuuccuuuuugacugu

SEQ ID NO: 513769 - RNA, 21 nt, Human
ucuacaggcucagaauacacu

SEQ ID NO: 513770 - RNA, 20 nt, Human
ucucuacuaaaaauacaaaa

SEQ ID NO: 513771 - RNA, 22 nt, Human
ugaaagaaaaaaauaaggaaaa

SEQ ID NO: 513772 - RNA, 21 nt, Human
ugaagcagacacuagauaucc

SEQ ID NO: 513773 - RNA, 24 nt, Human
ugagaucagccuuaccaacaugga

SEQ ID NO: 513774 - RNA, 23 nt, Human
ugagcaggaaguuuuggaaggca

SEQ ID NO: 513775 - RNA, 20 nt, Human
ugaggcaggagaaucacuug

SEQ ID NO: 513776 - RNA, 24 nt, Human
ugaggcaggagaaucacuugaacc

SEQ ID NO: 513777 - RNA, 25 nt, Human
ugaggcaggagaaucacuugaaccc

SEQ ID NO: 513778 - RNA, 20 nt, Human
ugcaucaaagaaaucuucaa

SEQ ID NO: 513779 - RNA, 25 nt, Human
ugccauggcaacuccgugacuaaga

SEQ ID NO: 513780 - RNA, 19 nt, Human
ugcccuccagccugggcaa

SEQ ID NO: 513781 - RNA, 24 nt, Human
ugccuguaaucccagcuacuuggg

SEQ ID NO: 513782 - RNA, 22 nt, Human
uggaagcauuuggcccguuagc

SEQ ID NO: 513783 - RNA, 21 nt, Human
uggcucacgccucuaauccca

SEQ ID NO: 513784 - RNA, 24 nt, Human
uggcucacgccucuaaucccagca

SEQ ID NO: 513785 - RNA, 20 nt, Human
ugggaggccgaggcaggcag

SEQ ID NO: 513786 - RNA, 24 nt, Human
ugggaggccgaggcaggcagauca

SEQ ID NO: 513787 - RNA, 21 nt, Human
uggugcaugccuguaauccca

SEQ ID NO: 513788 - RNA, 22 nt, Human
uggugcaugccuguaaucccag

SEQ ID NO: 513789 - RNA, 24 nt, Human
ugguggugcaugccuguaauccca

SEQ ID NO: 513790 - RNA, 25 nt, Human
uguguagugcaaaauauauaugugu

SEQ ID NO: 513791 - RNA, 18 nt, Human
uguguauauauguacaca

SEQ ID NO: 513792 - RNA, 24 nt, Human
uuaaaagcaaauaguaguagaucc

SEQ ID NO: 513793 - RNA, 21 nt, Human
uucaaagcacccuaugaagca

SEQ ID NO: 513794 - RNA, 20 nt, Human
uugcagugagccaagaucac

SEQ ID NO: 513795 - RNA, 20 nt, Human
uugcuugcuucacuuuuucc

SEQ ID NO: 513796 - RNA, 25 nt, Human
uugggaggccgaggcaggcagauca

SEQ ID NO: 513797 - RNA, 20 nt, Human
uugggaguuugagaucagcc

SEQ ID NO: 513798 - RNA, 20 nt, Human
uuuauuuauauacuaagaga

SEQ ID NO: 513799 - RNA, 20 nt, Human
uuucuacuacaugccauggc

SEQ ID NO: 513800 - RNA, 25 nt, Human
uuucuugugaacaccacaauccagu

SEQ ID NO: 513801 - RNA, 18 nt, Human
uuuuuggucuagaugaga

SEQ ID NO: 513802 - RNA, 18 nt, Human
accccgggacuccucgca

SEQ ID NO: 513803 - RNA, 22 nt, Human
accuggagcacagaccccauga

SEQ ID NO: 513804 - RNA, 23 nt, Human
agauauggucccagccucccccg

SEQ ID NO: 513805 - RNA, 23 nt, Human
agguucccuccugaguccacccc

SEQ ID NO: 513806 - RNA, 22 nt, Human
agguucccuccugaguccaccu

SEQ ID NO: 513807 - RNA, 21 nt, Human
caccauguuggcccgucuggu

SEQ ID NO: 513808 - RNA, 23 nt, Human
caccauguuggcccgucugguuu

SEQ ID NO: 513809 - RNA, 23 nt, Human
cacccagaccuggagcacagacc

SEQ ID NO: 513810 - RNA, 22 nt, Human
cagagauauggucccagccucc

SEQ ID NO: 513811 - RNA, 24 nt, Human
cagcagacggggccaugggccucu

SEQ ID NO: 513812 - RNA, 22 nt, Human
cagccguggcccuugggcucgu

SEQ ID NO: 513813 - RNA, 23 nt, Human
cagccuugaucccccaaacuggg

SEQ ID NO: 513814 - RNA, 21 nt, Human
caugggccucugguggggcac

SEQ ID NO: 513815 - RNA, 23 nt, Human
ccacauugcucccacggugcaca

SEQ ID NO: 513816 - RNA, 20 nt, Human
cccacggugcacacuccagc

SEQ ID NO: 513817 - RNA, 21 nt, Human
ccccacaccccgggacuccuc

SEQ ID NO: 513818 - RNA, 19 nt, Human
ccgcagccuuggggccagg

SEQ ID NO: 513819 - RNA, 22 nt, Human
ccgcagccuuggggccagguuc

SEQ ID NO: 513820 - RNA, 25 nt, Human
ccggugcgaugacacacuguccccc

SEQ ID NO: 513821 - RNA, 21 nt, Human
ccucugaaguggccgcagccu

SEQ ID NO: 513822 - RNA, 22 nt, Human
ccucugguggggcacucggcuc

SEQ ID NO: 513823 - RNA, 19 nt, Human
ccugcauguaggugugugg

SEQ ID NO: 513824 - RNA, 21 nt, Human
cucagccuugaucccccaaac

SEQ ID NO: 513825 - RNA, 18 nt, Human
cuccggggggcccuggug

SEQ ID NO: 513826 - RNA, 23 nt, Human
cuccugaguccaccugggccaca

SEQ ID NO: 513827 - RNA, 22 nt, Human
cucugguggggcacucggcucc

SEQ ID NO: 513828 - RNA, 23 nt, Human
gacuccucgcagacggggacacc

SEQ ID NO: 513829 - RNA, 18 nt, Human
gcccuugggcucgugagg

SEQ ID NO: 513830 - RNA, 19 nt, Human
ggccaugggccucuggugg

SEQ ID NO: 513831 - RNA, 22 nt, Human
ggcccuugggcucgugaggcug

SEQ ID NO: 513832 - RNA, 22 nt, Human
ggcgaucacccagaccuggagc

SEQ ID NO: 513833 - RNA, 21 nt, Human
guggcccuugggcucgugagg

SEQ ID NO: 513834 - RNA, 20 nt, Human
ucccagccguggcccuuggg

SEQ ID NO: 513835 - RNA, 21 nt, Human
ucccagccguggcccuugggc

SEQ ID NO: 513836 - RNA, 21 nt, Human
ugaccuaggugaucugcccac

SEQ ID NO: 513837 - RNA, 20 nt, Human
ugccguagucccagccgugg

SEQ ID NO: 513838 - RNA, 23 nt, Human
ugggccacauugcucccacggug

SEQ ID NO: 513839 - RNA, 22 nt, Human
ugguuugaaacucuugaccuag

SEQ ID NO: 513840 - RNA, 24 nt, Human
ugguuugaaacucuugaccuaggu

SEQ ID NO: 513841 - RNA, 18 nt, Human
uguagguguguggggggg

SEQ ID NO: 513842 - RNA, 20 nt, Human
uguaggugugugggggggcc

SEQ ID NO: 513843 - RNA, 20 nt, Human
ugucccccggcucaggcugu

SEQ ID NO: 513844 - RNA, 19 nt, Human
ugugggggggccucagcag

SEQ ID NO: 513845 - RNA, 18 nt, Human
uugaucccccaaacuggg

SEQ ID NO: 513846 - RNA, 18 nt, Human
uuggggccagguucccuc

SEQ ID NO: 513847 - RNA, 23 nt, Human
aaaaaauuuaaacuauaaagagu

SEQ ID NO: 513848 - RNA, 20 nt, Human
aaaaacgccacauugaacga

SEQ ID NO: 513849 - RNA, 25 nt, Human
aaaacgccacauugaacgaggcaau

SEQ ID NO: 513850 - RNA, 26 nt, Human
aaaagaaagaucucagccaaaaagaa

SEQ ID NO: 513851 - RNA, 23 nt, Human
aagaaagaucucagccaaaaaga

SEQ ID NO: 513852 - RNA, 23 nt, Human
aaguaaaagaaagaucucagccc

SEQ ID NO: 513853 - RNA, 19 nt, Human
agacaagauguggcacaug

SEQ ID NO: 513854 - RNA, 20 nt, Human
agccaaaaagaagguaccag

SEQ ID NO: 513855 - RNA, 30 nt, Human
aguaaaagaaagaucucagccaaaaagaaa

SEQ ID NO: 513856 - RNA, 21 nt, Human
aguuuuuuuuguuuucuuucc

SEQ ID NO: 513857 - RNA, 24 nt, Human
aucacaaguaaaagaaagaucuca

SEQ ID NO: 513858 - RNA, 18 nt, Human
auuaucuagcuacaugac

SEQ ID NO: 513859 - RNA, 21 nt, Human
caauuaccauaauuaucuagc

SEQ ID NO: 513860 - RNA, 23 nt, Human
cacuuuacugagacaaagacaau

SEQ ID NO: 513861 - RNA, 19 nt, Human
cgaaacugguagcauccuc

SEQ ID NO: 513862 - RNA, 26 nt, Human
cugagacaaagacaauggccauuuau

SEQ ID NO: 513863 - RNA, 20 nt, Human
gaacagguuugauuuaaaau

SEQ ID NO: 513864 - RNA, 18 nt, Human
guaagacaagauguggca

SEQ ID NO: 513865 - RNA, 21 nt, Human
uaaaauguauuaugccaagaa

SEQ ID NO: 513866 - RNA, 21 nt, Human
uaagacaagauguggcacaug

SEQ ID NO: 513867 - RNA, 24 nt, Human
uagaaaauaaguaaacuagagaaa

SEQ ID NO: 513868 - RNA, 23 nt, Human
uaugccaagaaacaagcauagaa

SEQ ID NO: 513869 - RNA, 22 nt, Human
ucacaaguaaaagaaagaucuc

SEQ ID NO: 513870 - RNA, 21 nt, Human
ugagacaaagacaauggccau

SEQ ID NO: 513871 - RNA, 24 nt, Human
ugccaagaaacaagcauagaaaua

SEQ ID NO: 513872 - RNA, 20 nt, Human
uggcuuuuauguguaagaca

SEQ ID NO: 513873 - RNA, 24 nt, Human
uggcuuuuauguguaagacaagau

SEQ ID NO: 513874 - RNA, 18 nt, Human
uguaagacaagauguggc

SEQ ID NO: 513875 - RNA, 21 nt, Human
uuaccagguauuuuuugcuua

SEQ ID NO: 513876 - RNA, 23 nt, Human
uuaccauaauuaucuagcuacau

SEQ ID NO: 513877 - RNA, 25 nt, Human
uuuguuuucuuuccuuuuguuuuuu

SEQ ID NO: 513878 - RNA, 20 nt, Human
uuuuuuuuuuucugaaggau

SEQ ID NO: 513879 - RNA, 22 nt, Human
uuuuuuuuuuuuuuucugaagg

SEQ ID NO: 513880 - RNA, 27 nt, Human
uuuuuuuuuuuuuuuuuuuuucugggg

SEQ ID NO: 513881 - RNA, 19 nt, Human
aaaaaaaaaaaaaaagaca

SEQ ID NO: 513882 - RNA, 24 nt, Human
aaaaaaaaaaaaaaagacagccag

SEQ ID NO: 513883 - RNA, 24 nt, Human
aaaaaagcacacacauaaacugcg

SEQ ID NO: 513884 - RNA, 24 nt, Human
aaaaguccugggugugaaccagga

SEQ ID NO: 513885 - RNA, 24 nt, Human
aaacaggaaaagagauccuucuag

SEQ ID NO: 513886 - RNA, 21 nt, Human
aaagggguggguuuuuguuuu

SEQ ID NO: 513887 - RNA, 19 nt, Human
aaaguccugggugugaacc

SEQ ID NO: 513888 - RNA, 20 nt, Human
aacagagugaaacuuggucu

SEQ ID NO: 513889 - RNA, 19 nt, Human
aacauaaugaaaccccauc

SEQ ID NO: 513890 - RNA, 21 nt, Human
aacauaaugaaaccccaucuc

SEQ ID NO: 513891 - RNA, 21 nt, Human
aacauaaugaaaccccaucuc

SEQ ID NO: 513892 - RNA, 28 nt, Human
aaccccgaagcccuccugaagacgcccc

SEQ ID NO: 513893 - RNA, 21 nt, Human
aagacuccauuccucccacgg

SEQ ID NO: 513894 - RNA, 23 nt, Human
aagguggguggaucaccugaggu

SEQ ID NO: 513895 - RNA, 23 nt, Human
aauugcuugaacccgggaggcgg

SEQ ID NO: 513896 - RNA, 21 nt, Human
acacagacacagccacaaaag

SEQ ID NO: 513897 - RNA, 21 nt, Human
acacagccacaaaaguccagc

SEQ ID NO: 513898 - RNA, 21 nt, Human
acacugaacaucagucaaagg

SEQ ID NO: 513899 - RNA, 23 nt, Human
acagcgcgggcacagcaggcacc

SEQ ID NO: 513900 - RNA, 22 nt, Human
acaguaucuuaguuuuugacug

SEQ ID NO: 513901 - RNA, 19 nt, Human
accaaagacuccauuccuc

SEQ ID NO: 513902 - RNA, 23 nt, Human
accaacagaagaacacauagcaa

SEQ ID NO: 513903 - RNA, 19 nt, Human
acccacaggccacaaagug

SEQ ID NO: 513904 - RNA, 24 nt, Human
accccaucucuacuaaaaauacaa

SEQ ID NO: 513905 - RNA, 24 nt, Human
acgccacugcacucuaccuugggc

SEQ ID NO: 513906 - RNA, 21 nt, Human
acggggcagccugggcuccuc

SEQ ID NO: 513907 - RNA, 20 nt, Human
acuaccuucuacuucauucc

SEQ ID NO: 513908 - RNA, 18 nt, Human
acugcacucuaccuuggg

SEQ ID NO: 513909 - RNA, 24 nt, Human
acugcacucuaccuugggcaacag

SEQ ID NO: 513910 - RNA, 20 nt, Human
agacaagauacaucucugaa

SEQ ID NO: 513911 - RNA, 26 nt, Human
agacacagacacagccacaaaagucc

SEQ ID NO: 513912 - RNA, 18 nt, Human
agacccccgggccccagc

SEQ ID NO: 513913 - RNA, 19 nt, Human
agagaucacgccacugcac

SEQ ID NO: 513914 - RNA, 22 nt, Human
agagcacccagcacccagaagu

SEQ ID NO: 513915 - RNA, 28 nt, Human
agcaaaaccccgaagcccuccugaagac

SEQ ID NO: 513916 - RNA, 19 nt, Human
agcaaacauuaaaaccauu

SEQ ID NO: 513917 - RNA, 24 nt, Human
agcacuucgggaggccaagguggg

SEQ ID NO: 513918 - RNA, 18 nt, Human
agccaggaacgccguugg

SEQ ID NO: 513919 - RNA, 24 nt, Human
agccggggucucucauacccgcag

SEQ ID NO: 513920 - RNA, 24 nt, Human
agccuggccaacauaaugaaaccc

SEQ ID NO: 513921 - RNA, 23 nt, Human
agcgagcagacagcucaauggga

SEQ ID NO: 513922 - RNA, 21 nt, Human
agcucacgccuguagucccag

SEQ ID NO: 513923 - RNA, 22 nt, Human
agcugcuaaccucggugaggaa

SEQ ID NO: 513924 - RNA, 23 nt, Human
aggaaaagagauccuucuagugu

SEQ ID NO: 513925 - RNA, 19 nt, Human
aggaggcauuaaggaaccc

SEQ ID NO: 513926 - RNA, 21 nt, Human
aggcaaucaaagaaagaaggc

SEQ ID NO: 513927 - RNA, 25 nt, Human
aggcagggugggagccacaaugggu

SEQ ID NO: 513928 - RNA, 21 nt, Human
aggccaagguggguggaucac

SEQ ID NO: 513929 - RNA, 19 nt, Human
aggcggcaguugcaaugag

SEQ ID NO: 513930 - RNA, 18 nt, Human
aggucaucgggugcgugg

SEQ ID NO: 513931 - RNA, 19 nt, Human
agugacugcugaacucuac

SEQ ID NO: 513932 - RNA, 23 nt, Human
aguggcucaugccuguaauccca

SEQ ID NO: 513933 - RNA, 24 nt, Human
aguggcucaugccuguaaucccag

SEQ ID NO: 513934 - RNA, 22 nt, Human
auauaccccgcaaugacaaaau

SEQ ID NO: 513935 - RNA, 23 nt, Human
aucacgccacugcacucuaccuu

SEQ ID NO: 513936 - RNA, 22 nt, Human
aucccagcacuucgggaggcca

SEQ ID NO: 513937 - RNA, 18 nt, Human
auccugcuaggaaggccc

SEQ ID NO: 513938 - RNA, 19 nt, Human
augccuguaaucccagcac

SEQ ID NO: 513939 - RNA, 24 nt, Human
auuagccgggcaugguagcucacg

SEQ ID NO: 513940 - RNA, 20 nt, Human
caaagaaagaaggcaucacc

SEQ ID NO: 513941 - RNA, 20 nt, Human
caaagacuccauuccuccca

SEQ ID NO: 513942 - RNA, 22 nt, Human
caaagcacaaaaaacauuuaca

SEQ ID NO: 513943 - RNA, 21 nt, Human
caaauuugaaacuagcauuca

SEQ ID NO: 513944 - RNA, 20 nt, Human
caacaacguggccccuguuc

SEQ ID NO: 513945 - RNA, 21 nt, Human
caagguggguggaucaccuga

SEQ ID NO: 513946 - RNA, 24 nt, Human
caagguggguggaucaccugaggu

SEQ ID NO: 513947 - RNA, 19 nt, Human
cacaaaaguccagcagcag

SEQ ID NO: 513948 - RNA, 19 nt, Human
cacagacacagccacaaaa

SEQ ID NO: 513949 - RNA, 20 nt, Human
cacccagaaguuucccagau

SEQ ID NO: 513950 - RNA, 21 nt, Human
caccuaagaaauauuuugaau

SEQ ID NO: 513951 - RNA, 22 nt, Human
cacgaccugacaggcugaccga

SEQ ID NO: 513952 - RNA, 23 nt, Human
cacucuaccuugggcaacagagu

SEQ ID NO: 513953 - RNA, 23 nt, Human
cacugcacucuaccuugggcaac

SEQ ID NO: 513954 - RNA, 24 nt, Human
cacugcacucuaccuugggcaaca

SEQ ID NO: 513955 - RNA, 18 nt, Human
cacugggaucguccugga

SEQ ID NO: 513956 - RNA, 21 nt, Human
cagagcacccagcacccagaa

SEQ ID NO: 513957 - RNA, 24 nt, Human
cagcacccagaaguuucccagaug

SEQ ID NO: 513958 - RNA, 24 nt, Human
cagcacuucgggaggccaaggugg

SEQ ID NO: 513959 - RNA, 20 nt, Human
cagcagagcacccagcaccc

SEQ ID NO: 513960 - RNA, 21 nt, Human
cagcagcagagcacccagcac

SEQ ID NO: 513961 - RNA, 19 nt, Human
cagcagcagagcacccagg

SEQ ID NO: 513962 - RNA, 20 nt, Human
cagcccucuuacucuagccc

SEQ ID NO: 513963 - RNA, 19 nt, Human
caggccacaaagugaugga

SEQ ID NO: 513964 - RNA, 23 nt, Human
cauauaccccgcaaugacaaaau

SEQ ID NO: 513965 - RNA, 21 nt, Human
caucgggugcguggggaaucu

SEQ ID NO: 513966 - RNA, 20 nt, Human
caugccuguaaucccagcac

SEQ ID NO: 513967 - RNA, 22 nt, Human
cauuccugaaacucauuggcgc

SEQ ID NO: 513968 - RNA, 20 nt, Human
ccacugcacucuaccuuggg

SEQ ID NO: 513969 - RNA, 21 nt, Human
ccacugcacucuaccuugggc

SEQ ID NO: 513970 - RNA, 22 nt, Human
ccacugcacucuaccuugggca

SEQ ID NO: 513971 - RNA, 23 nt, Human
ccacugcacucuaccuugggcaa

SEQ ID NO: 513972 - RNA, 24 nt, Human
ccacugcacucuaccuugggcaac

SEQ ID NO: 513973 - RNA, 19 nt, Human
ccagcagcagagcacccag

SEQ ID NO: 513974 - RNA, 25 nt, Human
ccauggccgggcgcaguggcucaug

SEQ ID NO: 513975 - RNA, 21 nt, Human
cccacagggcgaucuaauuua

SEQ ID NO: 513976 - RNA, 25 nt, Human
cccagcacccagaaguuucccagau

SEQ ID NO: 513977 - RNA, 22 nt, Human
cccagguacuugggaggcugau

SEQ ID NO: 513978 - RNA, 18 nt, Human
cccccgggccccagcagg

SEQ ID NO: 513979 - RNA, 21 nt, Human
ccccgaagcccuccugaagac

SEQ ID NO: 513980 - RNA, 23 nt, Human
ccccgaagcccuccugaagacgc

SEQ ID NO: 513981 - RNA, 19 nt, Human
ccccgggccccagcaggau

SEQ ID NO: 513982 - RNA, 20 nt, Human
ccccgggccccagcaggauc

SEQ ID NO: 513983 - RNA, 20 nt, Human
ccugaagacgccccuucucc

SEQ ID NO: 513984 - RNA, 24 nt, Human
ccuggccaacauaaugaaacccca

SEQ ID NO: 513985 - RNA, 20 nt, Human
ccuguaaucccagcacuucg

SEQ ID NO: 513986 - RNA, 20 nt, Human
ccuguaaucccagcacuucg

SEQ ID NO: 513987 - RNA, 22 nt, Human
ccuguaaucccagcacuucggg

SEQ ID NO: 513988 - RNA, 21 nt, Human
ccuguagucccagguacuugg

SEQ ID NO: 513989 - RNA, 22 nt, Human
ccuguagucccagguacuuggg

SEQ ID NO: 513990 - RNA, 21 nt, Human
ccugugggcaggagagccagg

SEQ ID NO: 513991 - RNA, 21 nt, Human
cgagaccagccuggccaacau

SEQ ID NO: 513992 - RNA, 22 nt, Human
cgggcacagcaggcacagcggg

SEQ ID NO: 513993 - RNA, 25 nt, Human
cucacgccuguagucccagguacuu

SEQ ID NO: 513994 - RNA, 20 nt, Human
cucagucaagcuaagaguug

SEQ ID NO: 513995 - RNA, 21 nt, Human
cucaugaagcacuuuuauaga

SEQ ID NO: 513996 - RNA, 24 nt, Human
cucaugccuguaaucccagcacuu

SEQ ID NO: 513997 - RNA, 21 nt, Human
cuccaccaacagaagaacaca

SEQ ID NO: 513998 - RNA, 26 nt, Human
cugacaaagacaagauacaucucuga

SEQ ID NO: 513999 - RNA, 23 nt, Human
cugcaaaccccacagggcgaucu

SEQ ID NO: 514000 - RNA, 23 nt, Human
cuggccaacauaaugaaacccca

SEQ ID NO: 514001 - RNA, 21 nt, Human
cuugaacccgggaggcggcag

SEQ ID NO: 514002 - RNA, 22 nt, Human
cuuucuauccugcuaggaaggc

SEQ ID NO: 514003 - RNA, 18 nt, Human
gaacccgggaggcggcag

SEQ ID NO: 514004 - RNA, 20 nt, Human
gaagcacuuuuauagaguga

SEQ ID NO: 514005 - RNA, 19 nt, Human
gaagggccugacaaagaca

SEQ ID NO: 514006 - RNA, 22 nt, Human
gaccagcaaacauuaaaaccaa

SEQ ID NO: 514007 - RNA, 21 nt, Human
gacuagacuacaaugcacaaa

SEQ ID NO: 514008 - RNA, 24 nt, Human
gaucaccugagguaaggaguucga

SEQ ID NO: 514009 - RNA, 20 nt, Human
gcagagaucacgccacugca

SEQ ID NO: 514010 - RNA, 20 nt, Human
gcagcaacuaugggacucac

SEQ ID NO: 514011 - RNA, 24 nt, Human
gcagcagagcacccagcacccaga

SEQ ID NO: 514012 - RNA, 22 nt, Human
gcagcggcgacagcgcgggcac

SEQ ID NO: 514013 - RNA, 24 nt, Human
gcagggagguugaaaucaacuucc

SEQ ID NO: 514014 - RNA, 21 nt, Human
gcaugagaauugcuugaaccc

SEQ ID NO: 514015 - RNA, 22 nt, Human
gcaugagaauugcuugaacccg

SEQ ID NO: 514016 - RNA, 24 nt, Human
gccacugcacucuaccuugggcaa

SEQ ID NO: 514017 - RNA, 19 nt, Human
gcccauuugucugucugac

SEQ ID NO: 514018 - RNA, 23 nt, Human
gccuguagucccagguacuuggg

SEQ ID NO: 514019 - RNA, 18 nt, Human
gcuguguauagagccauc

SEQ ID NO: 514020 - RNA, 22 nt, Human
ggccacagacgguuucauaacc

SEQ ID NO: 514021 - RNA, 19 nt, Human
ggccaugaagaugaagggc

SEQ ID NO: 514022 - RNA, 18 nt, Human
ggcccagugaaggaggca

SEQ ID NO: 514023 - RNA, 19 nt, Human
ggcuugguacaagaucuuu

SEQ ID NO: 514024 - RNA, 24 nt, Human
gggaccaaaggucacggcagaaaa

SEQ ID NO: 514025 - RNA, 23 nt, Human
gggaggccaagguggguggauca

SEQ ID NO: 514026 - RNA, 24 nt, Human
gggcacagcaggcacagcgggcaa

SEQ ID NO: 514027 - RNA, 24 nt, Human
gggcaugguagcucacgccuguag

SEQ ID NO: 514028 - RNA, 24 nt, Human
gggcgcaguggcucaugccuguaa

SEQ ID NO: 514029 - RNA, 19 nt, Human
gguagcagcggcgacagcg

SEQ ID NO: 514030 - RNA, 24 nt, Human
gguagcucacgccuguagucccag

SEQ ID NO: 514031 - RNA, 25 nt, Human
ggugggccaugaagaugaagggccu

SEQ ID NO: 514032 - RNA, 18 nt, Human
gguuuuuguuuuguuuua

SEQ ID NO: 514033 - RNA, 18 nt, Human
uaaaaauaaaagcaaaac

SEQ ID NO: 514034 - RNA, 21 nt, Human
uacgacuagacuacaaugcac

SEQ ID NO: 514035 - RNA, 24 nt, Human
uagaauuucuuguccagucuacag

SEQ ID NO: 514036 - RNA, 21 nt, Human
uagacuacaaugcacaaagca

SEQ ID NO: 514037 - RNA, 22 nt, Human
uagcucacgccuguagucccag

SEQ ID NO: 514038 - RNA, 22 nt, Human
uagcucacgccuguagucccag

SEQ ID NO: 514039 - RNA, 25 nt, Human
uagcucacgccuguagucccaggua

SEQ ID NO: 514040 - RNA, 23 nt, Human
uagggcaaaacuccuaaggaagc

SEQ ID NO: 514041 - RNA, 19 nt, Human
ucagucaagcuaagaguug

SEQ ID NO: 514042 - RNA, 19 nt, Human
ucaugcaaagcacaaaaaa

SEQ ID NO: 514043 - RNA, 22 nt, Human
ucaugccuguaaucccagcacu

SEQ ID NO: 514044 - RNA, 19 nt, Human
uccauauaccccgcaauga

SEQ ID NO: 514045 - RNA, 20 nt, Human
uccauggccgggcgcagugg

SEQ ID NO: 514046 - RNA, 18 nt, Human
uccauuuucugaagacaa

SEQ ID NO: 514047 - RNA, 22 nt, Human
ucccgcguccagcagacgcggu

SEQ ID NO: 514048 - RNA, 19 nt, Human
uccgaggcagggugggagc

SEQ ID NO: 514049 - RNA, 18 nt, Human
uccucgggcagagcuggg

SEQ ID NO: 514050 - RNA, 18 nt, Human
ucgggaaaaaaaaaaaaa

SEQ ID NO: 514051 - RNA, 24 nt, Human
ucucgucucaguggaaccuuacga

SEQ ID NO: 514052 - RNA, 21 nt, Human
ucucuacuaaaaauacaaaaa

SEQ ID NO: 514053 - RNA, 24 nt, Human
ucucucgcugucaugaggccacag

SEQ ID NO: 514054 - RNA, 24 nt, Human
ucugcaaaaaaaugcuauuuacaa

SEQ ID NO: 514055 - RNA, 18 nt, Human
ugaaaaaauaggucaucg

SEQ ID NO: 514056 - RNA, 22 nt, Human
ugaaaaaauaggucaucgggug

SEQ ID NO: 514057 - RNA, 19 nt, Human
ugaaaccccaucucuacua

SEQ ID NO: 514058 - RNA, 19 nt, Human
ugaaccaggacacguaaac

SEQ ID NO: 514059 - RNA, 24 nt, Human
ugacaggcugaccgaauucuuccu

SEQ ID NO: 514060 - RNA, 22 nt, Human
ugagguaaggaguucgagacca

SEQ ID NO: 514061 - RNA, 22 nt, Human
ugagugagccuacagacaauau

SEQ ID NO: 514062 - RNA, 23 nt, Human
ugauaaagacagccagguccaug

SEQ ID NO: 514063 - RNA, 21 nt, Human
ugcaaagaaaaguccugggug

SEQ ID NO: 514064 - RNA, 25 nt, Human
ugcaaagcacaaaaaacauuuacaa

SEQ ID NO: 514065 - RNA, 21 nt, Human
ugccagggcggagccgggguc

SEQ ID NO: 514066 - RNA, 23 nt, Human
ugccuguaaucccagcacuucgg

SEQ ID NO: 514067 - RNA, 25 nt, Human
ugcugaacucuacauaaaccagcac

SEQ ID NO: 514068 - RNA, 24 nt, Human
ugcuucagugaggggaugagaugu

SEQ ID NO: 514069 - RNA, 24 nt, Human
uggaucaccugagguaaggaguuc

SEQ ID NO: 514070 - RNA, 19 nt, Human
uggcagggagguugaaauc

SEQ ID NO: 514071 - RNA, 24 nt, Human
uggccgggcgcaguggcucaugcc

SEQ ID NO: 514072 - RNA, 24 nt, Human
uggcucaugccuguaaucccagca

SEQ ID NO: 514073 - RNA, 18 nt, Human
uggggucaacucacacug

SEQ ID NO: 514074 - RNA, 24 nt, Human
uggggucaacucacacuggaaguu

SEQ ID NO: 514075 - RNA, 24 nt, Human
uggguggaucaccugagguaagga

SEQ ID NO: 514076 - RNA, 24 nt, Human
ugguagcucacgccuguaguccca

SEQ ID NO: 514077 - RNA, 23 nt, Human
ugugggcaggagagccaggaacg

SEQ ID NO: 514078 - RNA, 24 nt, Human
uucauaaccacaaacugagcugcu

SEQ ID NO: 514079 - RNA, 18 nt, Human
uugaagggggccuguggc

SEQ ID NO: 514080 - RNA, 18 nt, Human
uugcuugaacccgggagg

SEQ ID NO: 514081 - RNA, 24 nt, Human
uugcuugaacccgggaggcggcag

SEQ ID NO: 514082 - RNA, 23 nt, Human
uugggaggcugaugcaugagaau

SEQ ID NO: 514083 - RNA, 21 nt, Human
uugugagcuucaaaugguuug

SEQ ID NO: 514084 - RNA, 20 nt, Human
uuguggggaugauaaagaca

SEQ ID NO: 514085 - RNA, 19 nt, Human
uuguuuccauuuucugaag

SEQ ID NO: 514086 - RNA, 18 nt, Human
uuuaaauaacuaccuucu

SEQ ID NO: 514087 - RNA, 22 nt, Human
uuucaaaauguuuguggggaug

SEQ ID NO: 514088 - RNA, 23 nt, Human
uuuccugacucuccauauacccc

SEQ ID NO: 514089 - RNA, 25 nt, Human
aacaaggcacuuccagcugggggcc

SEQ ID NO: 514090 - RNA, 21 nt, Human
aaggggcagggguuucagggg

SEQ ID NO: 514091 - RNA, 20 nt, Human
aaggggcuucugagggagac

SEQ ID NO: 514092 - RNA, 22 nt, Human
aauuugccuuuggccuugaccu

SEQ ID NO: 514093 - RNA, 21 nt, Human
acaucuacagaccugacucac

SEQ ID NO: 514094 - RNA, 18 nt, Human
acaugaacgccccucccc

SEQ ID NO: 514095 - RNA, 19 nt, Human
accccgugcacaucuacag

SEQ ID NO: 514096 - RNA, 18 nt, Human
accccgugcucagcacug

SEQ ID NO: 514097 - RNA, 22 nt, Human
accugaaagugauuacagaaac

SEQ ID NO: 514098 - RNA, 23 nt, Human
acucuggggacaccaacacuggg

SEQ ID NO: 514099 - RNA, 18 nt, Human
agagacagcaauggggga

SEQ ID NO: 514100 - RNA, 23 nt, Human
agcugcccucugccugugcccuc

SEQ ID NO: 514101 - RNA, 18 nt, Human
agcugggggccucggagg

SEQ ID NO: 514102 - RNA, 19 nt, Human
aggacaagggcagugggga

SEQ ID NO: 514103 - RNA, 19 nt, Human
aggccucagcccuggguuu

SEQ ID NO: 514104 - RNA, 23 nt, Human
agggggcucagccucuucauggg

SEQ ID NO: 514105 - RNA, 20 nt, Human
aucgcagugcucugaagauu

SEQ ID NO: 514106 - RNA, 19 nt, Human
augccacagcccccauugu

SEQ ID NO: 514107 - RNA, 22 nt, Human
auguccccaaggccucugacag

SEQ ID NO: 514108 - RNA, 22 nt, Human
cacaucuacagaccugacucac

SEQ ID NO: 514109 - RNA, 20 nt, Human
cacccgaggcccuugugccc

SEQ ID NO: 514110 - RNA, 22 nt, Human
cacgaucccauaucaaggcagg

SEQ ID NO: 514111 - RNA, 23 nt, Human
cacgcacacagagcuucauccac

SEQ ID NO: 514112 - RNA, 21 nt, Human
cacuggguuuuucuccuguuu

SEQ ID NO: 514113 - RNA, 21 nt, Human
cacuugcccuuggcucccacu

SEQ ID NO: 514114 - RNA, 19 nt, Human
cagcccugaccccgugcuc

SEQ ID NO: 514115 - RNA, 22 nt, Human
cagcuucuuaaguccacacacc

SEQ ID NO: 514116 - RNA, 19 nt, Human
caggccccugcgccucugg

SEQ ID NO: 514117 - RNA, 18 nt, Human
caggggcuucccuagcuu

SEQ ID NO: 514118 - RNA, 21 nt, Human
ccagacccacucccagaaucc

SEQ ID NO: 514119 - RNA, 21 nt, Human
ccagccugggagcugcccucu

SEQ ID NO: 514120 - RNA, 20 nt, Human
ccauuguccuaaggccuguc

SEQ ID NO: 514121 - RNA, 18 nt, Human
ccccaaggccucugacag

SEQ ID NO: 514122 - RNA, 21 nt, Human
ccccauuguccuaaggccugg

SEQ ID NO: 514123 - RNA, 22 nt, Human
cccccauuguccuaaggccugu

SEQ ID NO: 514124 - RNA, 20 nt, Human
ccccgugcucagcacugucc

SEQ ID NO: 514125 - RNA, 23 nt, Human
ccccugaacaucgcagugcucug

SEQ ID NO: 514126 - RNA, 20 nt, Human
cccuacugcccugggaugug

SEQ ID NO: 514127 - RNA, 18 nt, Human
cccucaaaccccugcagc

SEQ ID NO: 514128 - RNA, 24 nt, Human
cccuccagcccugaccccgugcuc

SEQ ID NO: 514129 - RNA, 19 nt, Human
ccugaggcccagcacgaac

SEQ ID NO: 514130 - RNA, 22 nt, Human
ccugcagccugaccuauaccau

SEQ ID NO: 514131 - RNA, 23 nt, Human
ccugugcccuccagcccugaccg

SEQ ID NO: 514132 - RNA, 22 nt, Human
cggaggcacaggagagcaggag

SEQ ID NO: 514133 - RNA, 25 nt, Human
cuccagcccugaccccgugcucagc

SEQ ID NO: 514134 - RNA, 19 nt, Human
cucccacugucccaggacc

SEQ ID NO: 514135 - RNA, 24 nt, Human
cucucugccccugggaccucuaac

SEQ ID NO: 514136 - RNA, 24 nt, Human
cugaagauucugauauacaacuga

SEQ ID NO: 514137 - RNA, 19 nt, Human
cugcccucugccugugccc

SEQ ID NO: 514138 - RNA, 19 nt, Human
cugcccucugccugugccc

SEQ ID NO: 514139 - RNA, 21 nt, Human
cuugcccuuggcucccacugu

SEQ ID NO: 514140 - RNA, 19 nt, Human
gaaaggaggggagaagagg

SEQ ID NO: 514141 - RNA, 20 nt, Human
gaaaggaggggagaagaggg

SEQ ID NO: 514142 - RNA, 22 nt, Human
gacacacacaagagacagcaau

SEQ ID NO: 514143 - RNA, 21 nt, Human
gacaccaacacuggguuuuuc

SEQ ID NO: 514144 - RNA, 21 nt, Human
gcacaaggcccugacacaccu

SEQ ID NO: 514145 - RNA, 23 nt, Human
gccugugcccuccagcccugacc

SEQ ID NO: 514146 - RNA, 19 nt, Human
gcugcccucugccugugcc

SEQ ID NO: 514147 - RNA, 18 nt, Human
gggcagaggcaacaaggc

SEQ ID NO: 514148 - RNA, 23 nt, Human
ggggcuucugagggagaccagcu

SEQ ID NO: 514149 - RNA, 19 nt, Human
gucccaggaccugucacuc

SEQ ID NO: 514150 - RNA, 19 nt, Human
gugccagccagccugggag

SEQ ID NO: 514151 - RNA, 25 nt, Human
guugcuaagguacuccucgcacgca

SEQ ID NO: 514152 - RNA, 22 nt, Human
uaaauguccccaaggccucuga

SEQ ID NO: 514153 - RNA, 23 nt, Human
uaaauucacugcaacucuagcac

SEQ ID NO: 514154 - RNA, 20 nt, Human
uacaacugaggcccucaaac

SEQ ID NO: 514155 - RNA, 23 nt, Human
uacaacugaggcccucaaacccc

SEQ ID NO: 514156 - RNA, 24 nt, Human
uaccauaaaagcuuaagcaugggg

SEQ ID NO: 514157 - RNA, 23 nt, Human
uacuucacuuguuucuuuuuauu

SEQ ID NO: 514158 - RNA, 19 nt, Human
uagcccacagaaacacuaa

SEQ ID NO: 514159 - RNA, 19 nt, Human
uauacaugaacgccccucc

SEQ ID NO: 514160 - RNA, 18 nt, Human
uaucaaggcagguaaccu

SEQ ID NO: 514161 - RNA, 19 nt, Human
ucacucgaggcucugcccu

SEQ ID NO: 514162 - RNA, 22 nt, Human
ucacugcaacucuagcacuugc

SEQ ID NO: 514163 - RNA, 19 nt, Human
ucauaucccccaggccccu

SEQ ID NO: 514164 - RNA, 19 nt, Human
uccacaaacucuggggaca

SEQ ID NO: 514165 - RNA, 24 nt, Human
uccacacaccagaaauccagaccc

SEQ ID NO: 514166 - RNA, 22 nt, Human
uccaggacaagggcagugggga

SEQ ID NO: 514167 - RNA, 21 nt, Human
uccccaaggccucugacagca

SEQ ID NO: 514168 - RNA, 26 nt, Human
uccccaaggccucugacagcaccuau

SEQ ID NO: 514169 - RNA, 25 nt, Human
uccucgcacgcacacagagcuucau

SEQ ID NO: 514170 - RNA, 23 nt, Human
ucuagcacuugcccuuggcuccc

SEQ ID NO: 514171 - RNA, 22 nt, Human
ucucuggccacacccgaggccc

SEQ ID NO: 514172 - RNA, 18 nt, Human
ucuguggaggaaggggcu

SEQ ID NO: 514173 - RNA, 18 nt, Human
ucuuaaguccacacacca

SEQ ID NO: 514174 - RNA, 20 nt, Human
ugaaaggaggggagaagagg

SEQ ID NO: 514175 - RNA, 20 nt, Human
ugaaagugauuacagaaacu

SEQ ID NO: 514176 - RNA, 22 nt, Human
ugaaagugauuacagaaacuga

SEQ ID NO: 514177 - RNA, 22 nt, Human
ugaacgccccucccccaagucu

SEQ ID NO: 514178 - RNA, 21 nt, Human
ugaggcccagcacgaaccuag

SEQ ID NO: 514179 - RNA, 19 nt, Human
ugccagccagccugggagc

SEQ ID NO: 514180 - RNA, 23 nt, Human
ugccccugggaccucuaacacac

SEQ ID NO: 514181 - RNA, 21 nt, Human
ugcccuaaauguccccaaggc

SEQ ID NO: 514182 - RNA, 20 nt, Human
ugcccucugccugugcccuc

SEQ ID NO: 514183 - RNA, 20 nt, Human
ugccuaaaaugcaccuggga

SEQ ID NO: 514184 - RNA, 19 nt, Human
uggcuucaggaugcugggu

SEQ ID NO: 514185 - RNA, 26 nt, Human
ugggaccucuaacacaccugaggcuc

SEQ ID NO: 514186 - RNA, 18 nt, Human
ugggagcugcccucugcc

SEQ ID NO: 514187 - RNA, 21 nt, Human
ugggagggaaaugaagaccuu

SEQ ID NO: 514188 - RNA, 22 nt, Human
uggggugccagccagccuggga

SEQ ID NO: 514189 - RNA, 24 nt, Human
uguccccaaggccucugacagcac

SEQ ID NO: 514190 - RNA, 22 nt, Human
ugugugcacuguuacugcacaa

SEQ ID NO: 514191 - RNA, 19 nt, Human
uuacugcacaaggcccuga

SEQ ID NO: 514192 - RNA, 21 nt, Human
uucggugggagggaaaugaag

SEQ ID NO: 514193 - RNA, 20 nt, Human
uugccuuuggccuugaccuu

SEQ ID NO: 514194 - RNA, 20 nt, Human
uugccuuuggccuugaccuu

SEQ ID NO: 514195 - RNA, 22 nt, Human
uuggccuugaccuuccgacagg

SEQ ID NO: 514196 - RNA, 20 nt, Human
uuucagggggcucagccucu

SEQ ID NO: 514197 - RNA, 21 nt, Human
uuucuugggcugcuugucucc

SEQ ID NO: 514198 - RNA, 24 nt, Human
uuuggccuugaccuuccgacaggu

SEQ ID NO: 514199 - RNA, 26 nt, Human
uuuuuuuuuuuuuuacuucacuuggu

SEQ ID NO: 514200 - RNA, 26 nt, Human
accacaccaucccagugccuagccca

SEQ ID NO: 514201 - RNA, 19 nt, Human
agagcaauccuggacagga

SEQ ID NO: 514202 - RNA, 24 nt, Human
aguguguaccaguuguacaagaaa

SEQ ID NO: 514203 - RNA, 18 nt, Human
caggagaaaaaaacacgu

SEQ ID NO: 514204 - RNA, 22 nt, Human
ccagccucuguuugacacucaa

SEQ ID NO: 514205 - RNA, 19 nt, Human
ccucuguuugacacucaau

SEQ ID NO: 514206 - RNA, 21 nt, Human
ccucuguuugacacucaauuu

SEQ ID NO: 514207 - RNA, 21 nt, Human
ccuuuaaaauugccaaaauug

SEQ ID NO: 514208 - RNA, 23 nt, Human
cucaggagaaaaaaacacguuaa

SEQ ID NO: 514209 - RNA, 25 nt, Human
cucaggagaaaaaaacacguuaaga

SEQ ID NO: 514210 - RNA, 21 nt, Human
gcccagugccuggaacuuagu

SEQ ID NO: 514211 - RNA, 24 nt, Human
gucauucugaaguacaaucaucuc

SEQ ID NO: 514212 - RNA, 23 nt, Human
uccacggcaggacuggucaguuu

SEQ ID NO: 514213 - RNA, 22 nt, Human
ucucccccagcaaacuccacgg

SEQ ID NO: 514214 - RNA, 22 nt, Human
ugagauaaauugcuauccuuag

SEQ ID NO: 514215 - RNA, 20 nt, Human
uggauuuugggugguauaug

SEQ ID NO: 514216 - RNA, 21 nt, Human
ugggcacauguagauggcagg

SEQ ID NO: 514217 - RNA, 20 nt, Human
ugguauauggguuucagucc

SEQ ID NO: 514218 - RNA, 22 nt, Human
uuaguguucaauagguacuagu

SEQ ID NO: 514219 - RNA, 19 nt, Human
uugguuggccuauucucag

SEQ ID NO: 514220 - RNA, 24 nt, Human
aaagugcugggauuacaggcguga

SEQ ID NO: 514221 - RNA, 22 nt, Human
aagcuugcaaacucuaccccag

SEQ ID NO: 514222 - RNA, 19 nt, Human
aaguagcugggacuacagg

SEQ ID NO: 514223 - RNA, 20 nt, Human
aaguagcugggacuacaggc

SEQ ID NO: 514224 - RNA, 26 nt, Human
aaguagcugggacuacaggcgccugc

SEQ ID NO: 514225 - RNA, 19 nt, Human
aagugcugggauuacaggc

SEQ ID NO: 514226 - RNA, 19 nt, Human
aagugcugggauuacaggc

SEQ ID NO: 514227 - RNA, 18 nt, Human
acgggguuucacuguguu

SEQ ID NO: 514228 - RNA, 19 nt, Human
acgggguuucacuguguua

SEQ ID NO: 514229 - RNA, 20 nt, Human
acgggguuucacuguguuag

SEQ ID NO: 514230 - RNA, 24 nt, Human
acgggguuucacuguguuagccag

SEQ ID NO: 514231 - RNA, 20 nt, Human
acugcaagcuccgccuccca

SEQ ID NO: 514232 - RNA, 22 nt, Human
agacaaaauuuuuaagaaaaca

SEQ ID NO: 514233 - RNA, 20 nt, Human
aggcgccugccaccaugcuu

SEQ ID NO: 514234 - RNA, 18 nt, Human
agugcugggauuacaggc

SEQ ID NO: 514235 - RNA, 24 nt, Human
caaagugcugggauuacaggcgug

SEQ ID NO: 514236 - RNA, 22 nt, Human
cacaccauucuccugccucagc

SEQ ID NO: 514237 - RNA, 24 nt, Human
caccucagccucccaaagugcugg

SEQ ID NO: 514238 - RNA, 23 nt, Human
cacgcccagcugucagacaaaau

SEQ ID NO: 514239 - RNA, 18 nt, Human
cacuguguuagccaggau

SEQ ID NO: 514240 - RNA, 19 nt, Human
cacuguguuagccaggaug

SEQ ID NO: 514241 - RNA, 24 nt, Human
cacuguguuagccaggauggucuu

SEQ ID NO: 514242 - RNA, 20 nt, Human
caggaccgccaucuuccccc

SEQ ID NO: 514243 - RNA, 26 nt, Human
caucuucccccgccgccuucuugcug

SEQ ID NO: 514244 - RNA, 20 nt, Human
ccaaagugcugggauuacag

SEQ ID NO: 514245 - RNA, 22 nt, Human
ccaaagugcugggauuacaggc

SEQ ID NO: 514246 - RNA, 22 nt, Human
ccaaagugcugggauuacaggc

SEQ ID NO: 514247 - RNA, 24 nt, Human
ccaaagugcugggauuacaggcgu

SEQ ID NO: 514248 - RNA, 23 nt, Human
cccaaguagcugggacuacaggc

SEQ ID NO: 514249 - RNA, 23 nt, Human
cccaaguagcugggacuacaggc

SEQ ID NO: 514250 - RNA, 20 nt, Human
cccagguucacaccauucuc

SEQ ID NO: 514251 - RNA, 22 nt, Human
ccccaggaccgccaucuucccc

SEQ ID NO: 514252 - RNA, 26 nt, Human
ccgcccaccucagccucccaaagugc

SEQ ID NO: 514253 - RNA, 23 nt, Human
ccugccucagccucccaaguagc

SEQ ID NO: 514254 - RNA, 22 nt, Human
ccuucuugcugguuuuucuucc

SEQ ID NO: 514255 - RNA, 21 nt, Human
cgcccagcugucagacaaaau

SEQ ID NO: 514256 - RNA, 19 nt, Human
cgccucccagguucacacc

SEQ ID NO: 514257 - RNA, 22 nt, Human
cgcucugucgcccaggcuggag

SEQ ID NO: 514258 - RNA, 24 nt, Human
cgggguuucacuguguuagccagg

SEQ ID NO: 514259 - RNA, 24 nt, Human
cucagccucccaaguagcugggac

SEQ ID NO: 514260 - RNA, 25 nt, Human
cuccugccucagccucccaaguagc

SEQ ID NO: 514261 - RNA, 24 nt, Human
cucgcucugucgcccaggcuggag

SEQ ID NO: 514262 - RNA, 24 nt, Human
cugcaagcuccgccucccagguuc

SEQ ID NO: 514263 - RNA, 23 nt, Human
cugccucagccucccaaguagcu

SEQ ID NO: 514264 - RNA, 25 nt, Human
cuugcaaacucuaccccaggaccgc

SEQ ID NO: 514265 - RNA, 22 nt, Human
cuugcugguuuuucuuccgcgc

SEQ ID NO: 514266 - RNA, 24 nt, Human
gacuacaggcgccugccaccaugc

SEQ ID NO: 514267 - RNA, 22 nt, Human
gcaagcuccgccucccagguuc

SEQ ID NO: 514268 - RNA, 25 nt, Human
gccucccagguucacaccauucucc

SEQ ID NO: 514269 - RNA, 25 nt, Human
gcucugucgcccaggcuggagcaca

SEQ ID NO: 514270 - RNA, 23 nt, Human
gggguuucacuguguuagccagg

SEQ ID NO: 514271 - RNA, 24 nt, Human
gugagccgcccaccucagccuccc

SEQ ID NO: 514272 - RNA, 23 nt, Human
guggagacgggguuucacugugu

SEQ ID NO: 514273 - RNA, 27 nt, Human
uaauuuuuuuguauuuuuuaguggaga

SEQ ID NO: 514274 - RNA, 20 nt, Human
uaguggagacgggguuucac

SEQ ID NO: 514275 - RNA, 22 nt, Human
uaguggagacgggguuucacug

SEQ ID NO: 514276 - RNA, 24 nt, Human
uaguggagacgggguuucacugug

SEQ ID NO: 514277 - RNA, 21 nt, Human
ucacaccauucuccugccuca

SEQ ID NO: 514278 - RNA, 18 nt, Human
ucacugcaagcuccgccu

SEQ ID NO: 514279 - RNA, 19 nt, Human
ucacugcaagcuccgccuc

SEQ ID NO: 514280 - RNA, 19 nt, Human
ucacugcaagcuccgccuc

SEQ ID NO: 514281 - RNA, 24 nt, Human
ucacugcaagcuccgccucccagg

SEQ ID NO: 514282 - RNA, 24 nt, Human
ucacuguguuagccaggauggucu

SEQ ID NO: 514283 - RNA, 18 nt, Human
ucagccucccaaagugcu

SEQ ID NO: 514284 - RNA, 20 nt, Human
ucagccucccaaguagcugg

SEQ ID NO: 514285 - RNA, 24 nt, Human
ucccaaagugcugggauuacaggc

SEQ ID NO: 514286 - RNA, 24 nt, Human
ucccaaguagcugggacuacaggc

SEQ ID NO: 514287 - RNA, 21 nt, Human
ucccagguucacaccauucuc

SEQ ID NO: 514288 - RNA, 24 nt, Human
ucccagguucacaccauucuccug

SEQ ID NO: 514289 - RNA, 21 nt, Human
ucgcccaggcuggagcacagu

SEQ ID NO: 514290 - RNA, 19 nt, Human
ucucgcucugucgcccagg

SEQ ID NO: 514291 - RNA, 23 nt, Human
ucucgcucugucgcccaggcugg

SEQ ID NO: 514292 - RNA, 24 nt, Human
ucucgcucugucgcccaggcugga

SEQ ID NO: 514293 - RNA, 25 nt, Human
ucucgcucugucgcccaggcuggag

SEQ ID NO: 514294 - RNA, 18 nt, Human
ucugucgcccaggcugga

SEQ ID NO: 514295 - RNA, 22 nt, Human
ugaacuacacuguaacuuuaau

SEQ ID NO: 514296 - RNA, 21 nt, Human
ugaauaaaugaacuacacugu

SEQ ID NO: 514297 - RNA, 22 nt, Human
ugagacggagucucgcucuguc

SEQ ID NO: 514298 - RNA, 21 nt, Human
ugcaaacucuaccccaggacc

SEQ ID NO: 514299 - RNA, 24 nt, Human
ugccucagccucccaaguagcugg

SEQ ID NO: 514300 - RNA, 23 nt, Human
ugcugggauuacaggcgugagca

SEQ ID NO: 514301 - RNA, 21 nt, Human
ugggacuacaggcgccugcca

SEQ ID NO: 514302 - RNA, 22 nt, Human
ugggacuacaggcgccugccac

SEQ ID NO: 514303 - RNA, 24 nt, Human
ugggacuacaggcgccugccacca

SEQ ID NO: 514304 - RNA, 25 nt, Human
ugggacuacaggcgccugccaccau

SEQ ID NO: 514305 - RNA, 18 nt, Human
ugggauuacaggcgugag

SEQ ID NO: 514306 - RNA, 19 nt, Human
ugggauuacaggcgugagc

SEQ ID NO: 514307 - RNA, 24 nt, Human
ugggauuacaggcgugagcaacca

SEQ ID NO: 514308 - RNA, 18 nt, Human
uuaguggagacgggguuu

SEQ ID NO: 514309 - RNA, 21 nt, Human
uuaguggagacgggguuucac

SEQ ID NO: 514310 - RNA, 21 nt, Human
uuaguggagacgggguuucac

SEQ ID NO: 514311 - RNA, 24 nt, Human
uuaguggagacgggguuucacugu

SEQ ID NO: 514312 - RNA, 21 nt, Human
uucacuguguuagccaggaug

SEQ ID NO: 514313 - RNA, 19 nt, Human
uuucacuguguuagccagg

SEQ ID NO: 514314 - RNA, 24 nt, Human
uuuuuaguggagacgggguuucac

SEQ ID NO: 514315 - RNA, 22 nt, Human
uuuuuguauuuuuuaguggaga

SEQ ID NO: 514316 - RNA, 23 nt, Human
uuuuuuaguggagacgggguuuc

SEQ ID NO: 514317 - RNA, 22 nt, Human
uuuuuuguauuuuuuaguggag

SEQ ID NO: 514318 - RNA, 25 nt, Human
uuuuuuguauuuuuuaguggagacg

SEQ ID NO: 514319 - RNA, 22 nt, Human
aaaaaacccaaaagucugagaa

SEQ ID NO: 514320 - RNA, 21 nt, Human
aaaaauauagugaguugacaa

SEQ ID NO: 514321 - RNA, 22 nt, Human
aaaagucugagaaugccaagug

SEQ ID NO: 514322 - RNA, 26 nt, Human
aaacaaaaagacaaugcagaaaagaa

SEQ ID NO: 514323 - RNA, 21 nt, Human
aaacaucuuaaaacaaaaaga

SEQ ID NO: 514324 - RNA, 23 nt, Human
aaaccaaaaacauaacugaguaa

SEQ ID NO: 514325 - RNA, 27 nt, Human
aaaccaaaaacauaacugaguaauaau

SEQ ID NO: 514326 - RNA, 19 nt, Human
aaagacaaugcagaaaaga

SEQ ID NO: 514327 - RNA, 25 nt, Human
aacaaaaagacaaugcagaaaagaa

SEQ ID NO: 514328 - RNA, 18 nt, Human
aaccaaaaacauaacuga

SEQ ID NO: 514329 - RNA, 18 nt, Human
aaccccauacuaccucca

SEQ ID NO: 514330 - RNA, 19 nt, Human
aagacaaugcagaaaagaa

SEQ ID NO: 514331 - RNA, 22 nt, Human
acaagcaaagggcaaacaucuu

SEQ ID NO: 514332 - RNA, 20 nt, Human
acacacacaaaguucuccca

SEQ ID NO: 514333 - RNA, 23 nt, Human
accuacacaccucuacacacaca

SEQ ID NO: 514334 - RNA, 18 nt, Human
acucagggcugugugcgg

SEQ ID NO: 514335 - RNA, 18 nt, Human
acugaccagggugaccac

SEQ ID NO: 514336 - RNA, 20 nt, Human
agccagagcaacuccaggcu

SEQ ID NO: 514337 - RNA, 21 nt, Human
aggcagaaagggacgcuuuga

SEQ ID NO: 514338 - RNA, 18 nt, Human
aggcaggugaaauauccc

SEQ ID NO: 514339 - RNA, 19 nt, Human
aggucuuugguuccuggau

SEQ ID NO: 514340 - RNA, 26 nt, Human
auaacacacacacacauacacaccgc

SEQ ID NO: 514341 - RNA, 23 nt, Human
auaggccaaaaaaaacccaaaag

SEQ ID NO: 514342 - RNA, 24 nt, Human
aucacacuuauuagagucaaagau

SEQ ID NO: 514343 - RNA, 27 nt, Human
augccacccacaccuacacaccucuac

SEQ ID NO: 514344 - RNA, 22 nt, Human
caauaaagauugggucaauuca

SEQ ID NO: 514345 - RNA, 23 nt, Human
cacacacacacauacacaccgcu

SEQ ID NO: 514346 - RNA, 19 nt, Human
cacacaugccacccacacc

SEQ ID NO: 514347 - RNA, 21 nt, Human
cacacuuauuagagucaaaga

SEQ ID NO: 514348 - RNA, 18 nt, Human
cacccacaccuacacacc

SEQ ID NO: 514349 - RNA, 19 nt, Human
cacccacaccuacacaccu

SEQ ID NO: 514350 - RNA, 23 nt, Human
cagcagagaaaagauugaucaca

SEQ ID NO: 514351 - RNA, 23 nt, Human
cagcuaaagaaaauaugacacau

SEQ ID NO: 514352 - RNA, 19 nt, Human
caggcgggcacacaugcca

SEQ ID NO: 514353 - RNA, 20 nt, Human
caucaggauggaugcucauu

SEQ ID NO: 514354 - RNA, 19 nt, Human
caugccacccacaccuaca

SEQ ID NO: 514355 - RNA, 20 nt, Human
caugccacccacaccuacac

SEQ ID NO: 514356 - RNA, 19 nt, Human
ccaaguguuggugaaggug

SEQ ID NO: 514357 - RNA, 19 nt, Human
ccacccacaccuacacacc

SEQ ID NO: 514358 - RNA, 20 nt, Human
ccagcuaaagaaaauaugac

SEQ ID NO: 514359 - RNA, 20 nt, Human
ccauacccuuugccccagaa

SEQ ID NO: 514360 - RNA, 22 nt, Human
cccauacccuuugccccagaaa

SEQ ID NO: 514361 - RNA, 20 nt, Human
ccccagaaaucccguacgga

SEQ ID NO: 514362 - RNA, 23 nt, Human
ccccauacuaccuccaccauccc

SEQ ID NO: 514363 - RNA, 24 nt, Human
ccuacacaccucuacacacacaca

SEQ ID NO: 514364 - RNA, 26 nt, Human
ccuacacaccucuacacacacacaaa

SEQ ID NO: 514365 - RNA, 21 nt, Human
ccucacucugugucuccugga

SEQ ID NO: 514366 - RNA, 19 nt, Human
cucacucugugucuccugg

SEQ ID NO: 514367 - RNA, 20 nt, Human
cuccaaccucauccucccuc

SEQ ID NO: 514368 - RNA, 21 nt, Human
cuccuaaauaggccaaaaaaa

SEQ ID NO: 514369 - RNA, 22 nt, Human
gaaaauuuaaagucuauaaaga

SEQ ID NO: 514370 - RNA, 22 nt, Human
gagaaauguaaauugacaccac

SEQ ID NO: 514371 - RNA, 25 nt, Human
gcaggcgggcacacaugccacccac

SEQ ID NO: 514372 - RNA, 22 nt, Human
gcauaugcacgugcaucacaca

SEQ ID NO: 514373 - RNA, 22 nt, Human
gggcacacaugccacccacacc

SEQ ID NO: 514374 - RNA, 18 nt, Human
gucuuugguuccuggauc

SEQ ID NO: 514375 - RNA, 18 nt, Human
gugacauccuugugcccc

SEQ ID NO: 514376 - RNA, 19 nt, Human
uaaaacaaaaagacaaugc

SEQ ID NO: 514377 - RNA, 25 nt, Human
uaaaacaaaaagacaaugcagaaaa

SEQ ID NO: 514378 - RNA, 19 nt, Human
uaaauaggccaaaaaaaac

SEQ ID NO: 514379 - RNA, 23 nt, Human
uacacacacacaaaguucuccca

SEQ ID NO: 514380 - RNA, 26 nt, Human
uacacaccucuacacacacacaaagu

SEQ ID NO: 514381 - RNA, 19 nt, Human
uacccuuugccccagaaau

SEQ ID NO: 514382 - RNA, 22 nt, Human
uacugaaugcccauacccuuug

SEQ ID NO: 514383 - RNA, 21 nt, Human
ucagccagagcaacuccaggc

SEQ ID NO: 514384 - RNA, 18 nt, Human
uccaacaaauuaacaagc

SEQ ID NO: 514385 - RNA, 19 nt, Human
uccaccaucccaggcaggu

SEQ ID NO: 514386 - RNA, 24 nt, Human
uccaccaucccaggcaggugaaau

SEQ ID NO: 514387 - RNA, 22 nt, Human
ucccaggcaggugaaauauccc

SEQ ID NO: 514388 - RNA, 26 nt, Human
ucccugggaguggacugaccagggug

SEQ ID NO: 514389 - RNA, 24 nt, Human
uccuaaauaggccaaaaaaaaccc

SEQ ID NO: 514390 - RNA, 18 nt, Human
ucugagaaugccaagugu

SEQ ID NO: 514391 - RNA, 21 nt, Human
ucugagaaugccaaguguugg

SEQ ID NO: 514392 - RNA, 29 nt, Human
ucuguaauugaugaaaaauuggagcuacu

SEQ ID NO: 514393 - RNA, 18 nt, Human
ugaaauaucccgugacau

SEQ ID NO: 514394 - RNA, 21 nt, Human
ugaaauaucccgugacauccu

SEQ ID NO: 514395 - RNA, 22 nt, Human
ugaaauaucccgugacauccuu

SEQ ID NO: 514396 - RNA, 22 nt, Human
ugaauaacacacacacacauac

SEQ ID NO: 514397 - RNA, 25 nt, Human
ugaauaacacacacacacauacaca

SEQ ID NO: 514398 - RNA, 24 nt, Human
ugaccacacuuucauuuuuuaauu

SEQ ID NO: 514399 - RNA, 20 nt, Human
ugacucagggcugugugcgg

SEQ ID NO: 514400 - RNA, 20 nt, Human
ugaguugacaaagcaugacc

SEQ ID NO: 514401 - RNA, 22 nt, Human
ugcaugcaggcgggcacacaug

SEQ ID NO: 514402 - RNA, 18 nt, Human
uggcuucuggcuuuuccc

SEQ ID NO: 514403 - RNA, 18 nt, Human
uggcuucuggcuuuuccc

SEQ ID NO: 514404 - RNA, 21 nt, Human
ugggagaaauguaaauugaca

SEQ ID NO: 514405 - RNA, 21 nt, Human
ugguuccuggaucuccaaccu

SEQ ID NO: 514406 - RNA, 22 nt, Human
ugguuccuggaucuccaaccuc

SEQ ID NO: 514407 - RNA, 24 nt, Human
uguccucaagaugagugagcccaa

SEQ ID NO: 514408 - RNA, 19 nt, Human
uguuggugaagguguagaa

SEQ ID NO: 514409 - RNA, 23 nt, Human
uucauuuuuuaauuugcauguag

SEQ ID NO: 514410 - RNA, 23 nt, Human
uugccccagaaaucccguacgga

SEQ ID NO: 514411 - RNA, 22 nt, Human
uuuuuacugagcauguauuacu

SEQ ID NO: 514412 - RNA, 18 nt, Human
aaaggcuuuuaucuugag

SEQ ID NO: 514413 - RNA, 22 nt, Human
aaauccucagcaguauuaauuu

SEQ ID NO: 514414 - RNA, 21 nt, Human
aacaaagacagacccugucuc

SEQ ID NO: 514415 - RNA, 19 nt, Human
aaucaguuugguuccagaa

SEQ ID NO: 514416 - RNA, 18 nt, Human
acaccacuguacuccagc

SEQ ID NO: 514417 - RNA, 22 nt, Human
acaccacuguacuccagccugg

SEQ ID NO: 514418 - RNA, 22 nt, Human
acagccccagaaaagcccccag

SEQ ID NO: 514419 - RNA, 19 nt, Human
accacuguacuccagccug

SEQ ID NO: 514420 - RNA, 23 nt, Human
accacuguacuccagccugggua

SEQ ID NO: 514421 - RNA, 24 nt, Human
accacuguacuccagccuggguaa

SEQ ID NO: 514422 - RNA, 18 nt, Human
acuguacuccagccuggg

SEQ ID NO: 514423 - RNA, 23 nt, Human
acuguacuccagccuggguaaca

SEQ ID NO: 514424 - RNA, 19 nt, Human
agaggaggcugaggcaaga

SEQ ID NO: 514425 - RNA, 21 nt, Human
agccccagaaaagcccccagg

SEQ ID NO: 514426 - RNA, 25 nt, Human
aggaguuggaggcugcacugagcuu

SEQ ID NO: 514427 - RNA, 23 nt, Human
aggcaagaguauugagcccagga

SEQ ID NO: 514428 - RNA, 20 nt, Human
aggcugaggcaagaguauug

SEQ ID NO: 514429 - RNA, 18 nt, Human
agggugucaaauugagaa

SEQ ID NO: 514430 - RNA, 19 nt, Human
aguuggaggcugcacugag

SEQ ID NO: 514431 - RNA, 24 nt, Human
augacaccacuguacuccagccug
